United States Patent 10,706,955 (BIOINFORMATIC PROCESSES FOR DETERMINATION OF PEPTIDE BINDING) - sequence listing, part 30

SEQ ID NO: 1163130 - protein, 4 aa, Mycobacterium
GTGK

SEQ ID NO: 1163131 - protein, 11 aa, Mycobacterium
GTGLSGGATAL

SEQ ID NO: 1163132 - protein, 12 aa, Mycobacterium
GTGLSRARRRER

SEQ ID NO: 1163133 - protein, 11 aa, Mycobacterium
GTGNANDTVTS

SEQ ID NO: 1163134 - protein, 11 aa, Mycobacterium
GTGNASIPAAK

SEQ ID NO: 1163135 - protein, 5 aa, Mycobacterium
GTGNG

SEQ ID NO: 1163136 - protein, 7 aa, Mycobacterium
GTGPAEI

SEQ ID NO: 1163137 - protein, 10 aa, Mycobacterium
GTGPAVGPGY

SEQ ID NO: 1163138 - protein, 9 aa, Mycobacterium
GTGPKRSLP

SEQ ID NO: 1163139 - protein, 4 aa, Mycobacterium
GTGQ

SEQ ID NO: 1163140 - protein, 6 aa, Mycobacterium
GTGQVE

SEQ ID NO: 1163141 - protein, 9 aa, Mycobacterium
GTGRGEAAT

SEQ ID NO: 1163142 - protein, 11 aa, Mycobacterium
GTGRPAGPAHL

SEQ ID NO: 1163143 - protein, 6 aa, Mycobacterium
GTGRRG

SEQ ID NO: 1163144 - protein, 12 aa, Mycobacterium
GTGRRLTDTDGR

SEQ ID NO: 1163145 - protein, 6 aa, Mycobacterium
GTGRSH

SEQ ID NO: 1163146 - protein, 17 aa, Mycobacterium
GTGSSDAVPIKDRPAMQ

SEQ ID NO: 1163147 - protein, 11 aa, Mycobacterium
GTGSVTDDALG

SEQ ID NO: 1163148 - protein, 15 aa, Mycobacterium
GTGVTPRDVTPEATR

SEQ ID NO: 1163149 - protein, 6 aa, Mycobacterium
GTGVYG

SEQ ID NO: 1163150 - protein, 18 aa, Mycobacterium
GTHDPYGAAEQLFAVRIE

SEQ ID NO: 1163151 - protein, 5 aa, Mycobacterium
GTHPG

SEQ ID NO: 1163152 - protein, 8 aa, Mycobacterium
GTHPRPGA

SEQ ID NO: 1163153 - protein, 10 aa, Mycobacterium
GTIAGGTSEI

SEQ ID NO: 1163154 - protein, 4 aa, Mycobacterium
GTID

SEQ ID NO: 1163155 - protein, 5 aa, Mycobacterium
GTIEV

SEQ ID NO: 1163156 - protein, 8 aa, Mycobacterium
GTIQRNEH

SEQ ID NO: 1163157 - protein, 6 aa, Mycobacterium
GTKATV

SEQ ID NO: 1163158 - protein, 9 aa, Mycobacterium
GTKNMRGAD

SEQ ID NO: 1163159 - protein, 6 aa, Mycobacterium
GTLDDA

SEQ ID NO: 1163160 - protein, 11 aa, Mycobacterium
GTLDHEGGSIP

SEQ ID NO: 1163161 - protein, 6 aa, Mycobacterium
GTLPEP

SEQ ID NO: 1163162 - protein, 15 aa, Mycobacterium
GTLPGLDAGARSRAD

SEQ ID NO: 1163163 - protein, 8 aa, Mycobacterium
GTLRDTDA

SEQ ID NO: 1163164 - protein, 5 aa, Mycobacterium
GTLTP

SEQ ID NO: 1163165 - protein, 4 aa, Mycobacterium
GTMD

SEQ ID NO: 1163166 - protein, 7 aa, Mycobacterium
GTMPTPR

SEQ ID NO: 1163167 - protein, 7 aa, Mycobacterium
GTMRGRD

SEQ ID NO: 1163168 - protein, 15 aa, Mycobacterium
GTNAKIRDTRKTLPG

SEQ ID NO: 1163169 - protein, 8 aa, Mycobacterium
GTNCENLP

SEQ ID NO: 1163170 - protein, 8 aa, Mycobacterium
GTNGKTSV

SEQ ID NO: 1163171 - protein, 10 aa, Mycobacterium
GTNGKTTTTS

SEQ ID NO: 1163172 - protein, 5 aa, Mycobacterium
GTNNR

SEQ ID NO: 1163173 - protein, 6 aa, Mycobacterium
GTNPAL

SEQ ID NO: 1163174 - protein, 11 aa, Mycobacterium
GTNWSSNPNAM

SEQ ID NO: 1163175 - protein, 17 aa, Mycobacterium
GTNYPGQGDIRGRQDRL

SEQ ID NO: 1163176 - protein, 5 aa, Mycobacterium
GTPAE

SEQ ID NO: 1163177 - protein, 15 aa, Mycobacterium
GTPAGSSVVAPGDTV

SEQ ID NO: 1163178 - protein, 10 aa, Mycobacterium
GTPAPGPAPA

SEQ ID NO: 1163179 - protein, 8 aa, Mycobacterium
GTPAQVAR

SEQ ID NO: 1163180 - protein, 8 aa, Mycobacterium
GTPARRLG

SEQ ID NO: 1163181 - protein, 15 aa, Mycobacterium
GTPDADDAAASGSLH

SEQ ID NO: 1163182 - protein, 5 aa, Mycobacterium
GTPDD

SEQ ID NO: 1163183 - protein, 5 aa, Mycobacterium
GTPDH

SEQ ID NO: 1163184 - protein, 6 aa, Mycobacterium
GTPDTA

SEQ ID NO: 1163185 - protein, 4 aa, Mycobacterium
GTPE

SEQ ID NO: 1163186 - protein, 6 aa, Mycobacterium
GTPEDH

SEQ ID NO: 1163187 - protein, 15 aa, Mycobacterium
GTPEGVSPIEDGDTV

SEQ ID NO: 1163188 - protein, 5 aa, Mycobacterium
GTPEL

SEQ ID NO: 1163189 - protein, 6 aa, Mycobacterium
GTPELS

SEQ ID NO: 1163190 - protein, 9 aa, Mycobacterium
GTPEPPGSS

SEQ ID NO: 1163191 - protein, 6 aa, Mycobacterium
GTPEQK

SEQ ID NO: 1163192 - protein, 6 aa, Mycobacterium
GTPEQL

SEQ ID NO: 1163193 - protein, 9 aa, Mycobacterium
GTPGAAPGF

SEQ ID NO: 1163194 - protein, 7 aa, Mycobacterium
GTPGDTK

SEQ ID NO: 1163195 - protein, 20 aa, Mycobacterium
GTPGETDDDLRRSADAAIGA

SEQ ID NO: 1163196 - protein, 10 aa, Mycobacterium
GTPGSSVYYS

SEQ ID NO: 1163197 - protein, 10 aa, Mycobacterium
GTPGTARTVQ

SEQ ID NO: 1163198 - protein, 6 aa, Mycobacterium
GTPGVA

SEQ ID NO: 1163199 - protein, 6 aa, Mycobacterium
GTPHEV

SEQ ID NO: 1163200 - protein, 5 aa, Mycobacterium
GTPIQ

SEQ ID NO: 1163201 - protein, 13 aa, Mycobacterium
GTPKSDRTGTGTR

SEQ ID NO: 1163202 - protein, 8 aa, Mycobacterium
GTPPPADL

SEQ ID NO: 1163203 - protein, 21 aa, Mycobacterium
GTPPSATLRTTRQRRDRERYG

SEQ ID NO: 1163204 - protein, 6 aa, Mycobacterium
GTPPTF

SEQ ID NO: 1163205 - protein, 8 aa, Mycobacterium
GTPRPVSE

SEQ ID NO: 1163206 - protein, 14 aa, Mycobacterium
GTPTRARGYPPYEG

SEQ ID NO: 1163207 - protein, 13 aa, Mycobacterium
GTPTTAHPTVTSR

SEQ ID NO: 1163208 - protein, 9 aa, Mycobacterium
GTQPSGYTE

SEQ ID NO: 1163209 - protein, 4 aa, Mycobacterium
GTRD

SEQ ID NO: 1163210 - protein, 8 aa, Mycobacterium
GTRDAGRY

SEQ ID NO: 1163211 - protein, 15 aa, Mycobacterium
GTREGSSVRGGSLGG

SEQ ID NO: 1163212 - protein, 9 aa, Mycobacterium
GTRGEHTAQ

SEQ ID NO: 1163213 - protein, 12 aa, Mycobacterium
GTRGGGGAPRFE

SEQ ID NO: 1163214 - protein, 9 aa, Mycobacterium
GTRGSRPAL

SEQ ID NO: 1163215 - protein, 8 aa, Mycobacterium
GTRGTTGL

SEQ ID NO: 1163216 - protein, 10 aa, Mycobacterium
GTRHPEPDTD

SEQ ID NO: 1163217 - protein, 9 aa, Mycobacterium
GTRISDRYT

SEQ ID NO: 1163218 - protein, 9 aa, Mycobacterium
GTRKPSPEV

SEQ ID NO: 1163219 - protein, 8 aa, Mycobacterium
GTRKSSGV

SEQ ID NO: 1163220 - protein, 6 aa, Mycobacterium
GTRLTP

SEQ ID NO: 1163221 - protein, 8 aa, Mycobacterium
GTRQRRSA

SEQ ID NO: 1163222 - protein, 6 aa, Mycobacterium
GTRQYQ

SEQ ID NO: 1163223 - protein, 5 aa, Mycobacterium
GTRRD

SEQ ID NO: 1163224 - protein, 7 aa, Mycobacterium
GTRRPAT

SEQ ID NO: 1163225 - protein, 10 aa, Mycobacterium
GTRSASVSGN

SEQ ID NO: 1163226 - protein, 28 aa, Mycobacterium
GTRSPHGAVRDARRPGHISGGSSSGSAV

SEQ ID NO: 1163227 - protein, 6 aa, Mycobacterium
GTSDIS

SEQ ID NO: 1163228 - protein, 15 aa, Mycobacterium
GTSGGPEAAARTARY

SEQ ID NO: 1163229 - protein, 10 aa, Mycobacterium
GTSGHRGSSL

SEQ ID NO: 1163230 - protein, 4 aa, Mycobacterium
GTSH

SEQ ID NO: 1163231 - protein, 5 aa, Mycobacterium
GTSLD

SEQ ID NO: 1163232 - protein, 6 aa, Mycobacterium
GTSNDE

SEQ ID NO: 1163233 - protein, 10 aa, Mycobacterium
GTSNNDHPAV

SEQ ID NO: 1163234 - protein, 5 aa, Mycobacterium
GTSPE

SEQ ID NO: 1163235 - protein, 7 aa, Mycobacterium
GTSTRKV

SEQ ID NO: 1163236 - protein, 12 aa, Mycobacterium
GTTAGLRTATAA

SEQ ID NO: 1163237 - protein, 6 aa, Mycobacterium
GTTAIP

SEQ ID NO: 1163238 - protein, 6 aa, Mycobacterium
GTTASA

SEQ ID NO: 1163239 - protein, 6 aa, Mycobacterium
GTTATW

SEQ ID NO: 1163240 - protein, 8 aa, Mycobacterium
GTTDGSVE

SEQ ID NO: 1163241 - protein, 13 aa, Mycobacterium
GTTDRPSTGDPVL

SEQ ID NO: 1163242 - protein, 20 aa, Mycobacterium
GTTERAAERARELQSEGIAA

SEQ ID NO: 1163243 - protein, 6 aa, Mycobacterium
GTTGDG

SEQ ID NO: 1163244 - protein, 9 aa, Mycobacterium
GTTGLPKGV

SEQ ID NO: 1163245 - protein, 7 aa, Mycobacterium
GTTGMPK

SEQ ID NO: 1163246 - protein, 21 aa, Mycobacterium
GTTGTPKGAKRSAGSGGAGDL

SEQ ID NO: 1163247 - protein, 7 aa, Mycobacterium
GTTPESV

SEQ ID NO: 1163248 - protein, 16 aa, Mycobacterium
GTTPVEPAKTPEQGYT

SEQ ID NO: 1163249 - protein, 6 aa, Mycobacterium
GTTRRR

SEQ ID NO: 1163250 - protein, 8 aa, Mycobacterium
GTTTAQRT

SEQ ID NO: 1163251 - protein, 4 aa, Mycobacterium
GTTV

SEQ ID NO: 1163252 - protein, 7 aa, Mycobacterium
GTTVPAG

SEQ ID NO: 1163253 - protein, 9 aa, Mycobacterium
GTVDNADPR

SEQ ID NO: 1163254 - protein, 5 aa, Mycobacterium
GTVEA

SEQ ID NO: 1163255 - protein, 5 aa, Mycobacterium
GTVEG

SEQ ID NO: 1163256 - protein, 20 aa, Mycobacterium
GTVESGSQVINSTKGKKERL

SEQ ID NO: 1163257 - protein, 5 aa, Mycobacterium
GTVGD

SEQ ID NO: 1163258 - protein, 10 aa, Mycobacterium
GTVGRAPAPE

SEQ ID NO: 1163259 - protein, 13 aa, Mycobacterium
GTVKSRCSRGRAK

SEQ ID NO: 1163260 - protein, 5 aa, Mycobacterium
GTVNG

SEQ ID NO: 1163261 - protein, 5 aa, Mycobacterium
GTVPA

SEQ ID NO: 1163262 - protein, 4 aa, Mycobacterium
GTVR

SEQ ID NO: 1163263 - protein, 9 aa, Mycobacterium
GTVRAKGPV

SEQ ID NO: 1163264 - protein, 14 aa, Mycobacterium
GTVTANSDAHGVSY

SEQ ID NO: 1163265 - protein, 14 aa, Mycobacterium
GTVTHTGTREYGRT

SEQ ID NO: 1163266 - protein, 20 aa, Mycobacterium
GTVTPERDEYTTCQPPTKSQ

SEQ ID NO: 1163267 - protein, 4 aa, Mycobacterium
GTWE

SEQ ID NO: 1163268 - protein, 5 aa, Mycobacterium
GTYGD

SEQ ID NO: 1163269 - protein, 7 aa, Mycobacterium
GTYPPAV

SEQ ID NO: 1163270 - protein, 22 aa, Mycobacterium
GTYPRGATERLDSDAFSPNTAV

SEQ ID NO: 1163271 - protein, 15 aa, Mycobacterium
GVADADLGRDPRQSL

SEQ ID NO: 1163272 - protein, 6 aa, Mycobacterium
GVADGD

SEQ ID NO: 1163273 - protein, 8 aa, Mycobacterium
GVAGAGPI

SEQ ID NO: 1163274 - protein, 13 aa, Mycobacterium
GVAGAGVSAYPAE

SEQ ID NO: 1163275 - protein, 6 aa, Mycobacterium
GVAGDE

SEQ ID NO: 1163276 - protein, 7 aa, Mycobacterium
GVAGGGP

SEQ ID NO: 1163277 - protein, 6 aa, Mycobacterium
GVAGGT

SEQ ID NO: 1163278 - protein, 12 aa, Mycobacterium
GVAGRREVEAAA

SEQ ID NO: 1163279 - protein, 4 aa, Mycobacterium
GVAK

SEQ ID NO: 1163280 - protein, 6 aa, Mycobacterium
GVAPDE

SEQ ID NO: 1163281 - protein, 7 aa, Mycobacterium
GVAPQDV

SEQ ID NO: 1163282 - protein, 6 aa, Mycobacterium
GVAPSD

SEQ ID NO: 1163283 - protein, 7 aa, Mycobacterium
GVAPSTV

SEQ ID NO: 1163284 - protein, 17 aa, Mycobacterium
GVARDEVTRRVGEAAER

SEQ ID NO: 1163285 - protein, 8 aa, Mycobacterium
GVASDDDL

SEQ ID NO: 1163286 - protein, 5 aa, Mycobacterium
GVDAG

SEQ ID NO: 1163287 - protein, 18 aa, Mycobacterium
GVDATTAVKRPRGGRIGA

SEQ ID NO: 1163288 - protein, 12 aa, Mycobacterium
GVDDAQVRTHAA

SEQ ID NO: 1163289 - protein, 5 aa, Mycobacterium
GVDGA

SEQ ID NO: 1163290 - protein, 7 aa, Mycobacterium
GVDGPGT

SEQ ID NO: 1163291 - protein, 6 aa, Mycobacterium
GVDGSE

SEQ ID NO: 1163292 - protein, 6 aa, Mycobacterium
GVDHAT

SEQ ID NO: 1163293 - protein, 6 aa, Mycobacterium
GVDPAE

SEQ ID NO: 1163294 - protein, 5 aa, Mycobacterium
GVDPE

SEQ ID NO: 1163295 - protein, 7 aa, Mycobacterium
GVDPKAL

SEQ ID NO: 1163296 - protein, 6 aa, Mycobacterium
GVDPSE

SEQ ID NO: 1163297 - protein, 12 aa, Mycobacterium
GVDPSVGSVGDA

SEQ ID NO: 1163298 - protein, 7 aa, Mycobacterium
GVDRQTA

SEQ ID NO: 1163299 - protein, 14 aa, Mycobacterium
GVDRSVPAEEGQRA

SEQ ID NO: 1163300 - protein, 7 aa, Mycobacterium
GVDSGAR

SEQ ID NO: 1163301 - protein, 14 aa, Mycobacterium
GVDSPIPDSDAGHF

SEQ ID NO: 1163302 - protein, 5 aa, Mycobacterium
GVDSR

SEQ ID NO: 1163303 - protein, 8 aa, Mycobacterium
GVDTPDPV

SEQ ID NO: 1163304 - protein, 8 aa, Mycobacterium
GVDVPTTD

SEQ ID NO: 1163305 - protein, 7 aa, Mycobacterium
GVEAGAE

SEQ ID NO: 1163306 - protein, 17 aa, Mycobacterium
GVEKKDYNSYGSRRGNH

SEQ ID NO: 1163307 - protein, 4 aa, Mycobacterium
GVEP

SEQ ID NO: 1163308 - protein, 7 aa, Mycobacterium
GVEPTRT

SEQ ID NO: 1163309 - protein, 5 aa, Mycobacterium
GVERG

SEQ ID NO: 1163310 - protein, 6 aa, Mycobacterium
GVETRP

SEQ ID NO: 1163311 - protein, 11 aa, Mycobacterium
GVGATENAEGF

SEQ ID NO: 1163312 - protein, 7 aa, Mycobacterium
GVGDPEA

SEQ ID NO: 1163313 - protein, 5 aa, Mycobacterium
GVGED

SEQ ID NO: 1163314 - protein, 11 aa, Mycobacterium
GVGEDITGGLP

SEQ ID NO: 1163315 - protein, 12 aa, Mycobacterium
GVGIPDNLTESG

SEQ ID NO: 1163316 - protein, 4 aa, Mycobacterium
GVGP

SEQ ID NO: 1163317 - protein, 6 aa, Mycobacterium
GVGPDQ

SEQ ID NO: 1163318 - protein, 8 aa, Mycobacterium
GVGPGDRV

SEQ ID NO: 1163319 - protein, 6 aa, Mycobacterium
GVGPGS

SEQ ID NO: 1163320 - protein, 7 aa, Mycobacterium
GVGPPPE

SEQ ID NO: 1163321 - protein, 6 aa, Mycobacterium
GVGPTI

SEQ ID NO: 1163322 - protein, 9 aa, Mycobacterium
GVGRPAELG

SEQ ID NO: 1163323 - protein, 5 aa, Mycobacterium
GVGSR

SEQ ID NO: 1163324 - protein, 15 aa, Mycobacterium
GVGTAVPATRETPDE

SEQ ID NO: 1163325 - protein, 10 aa, Mycobacterium
GVGTDEDTAY

SEQ ID NO: 1163326 - protein, 6 aa, Mycobacterium
GVGTGY

SEQ ID NO: 1163327 - protein, 7 aa, Mycobacterium
GVHSDPA

SEQ ID NO: 1163328 - protein, 6 aa, Mycobacterium
GVHTPD

SEQ ID NO: 1163329 - protein, 26 aa, Mycobacterium
GVHTPDLGGAATTTGFTEHVLSVLAS

SEQ ID NO: 1163330 - protein, 5 aa, Mycobacterium
GVKPG

SEQ ID NO: 1163331 - protein, 4 aa, Mycobacterium
GVLA

SEQ ID NO: 1163332 - protein, 5 aa, Mycobacterium
GVNAA

SEQ ID NO: 1163333 - protein, 10 aa, Mycobacterium
GVNNSDARGL

SEQ ID NO: 1163334 - protein, 6 aa, Mycobacterium
GVNPPF

SEQ ID NO: 1163335 - protein, 4 aa, Mycobacterium
GVNT

SEQ ID NO: 1163336 - protein, 9 aa, Mycobacterium
GVPAPGELG

SEQ ID NO: 1163337 - protein, 6 aa, Mycobacterium
GVPATS

SEQ ID NO: 1163338 - protein, 4 aa, Mycobacterium
GVPD

SEQ ID NO: 1163339 - protein, 11 aa, Mycobacterium
GVPDAAAALDG

SEQ ID NO: 1163340 - protein, 8 aa, Mycobacterium
GVPDGDSI

SEQ ID NO: 1163341 - protein, 4 aa, Mycobacterium
GVPG

SEQ ID NO: 1163342 - protein, 8 aa, Mycobacterium
GVPGDPGV

SEQ ID NO: 1163343 - protein, 5 aa, Mycobacterium
GVPGE

SEQ ID NO: 1163344 - protein, 4 aa, Mycobacterium
GVPR

SEQ ID NO: 1163345 - protein, 9 aa, Mycobacterium
GVPRPSRRN

SEQ ID NO: 1163346 - protein, 7 aa, Mycobacterium
GVPSEET

SEQ ID NO: 1163347 - protein, 5 aa, Mycobacterium
GVPSS

SEQ ID NO: 1163348 - protein, 4 aa, Mycobacterium
GVPT

SEQ ID NO: 1163349 - protein, 19 aa, Mycobacterium
GVPTAARPGKLVRGRQPAP

SEQ ID NO: 1163350 - protein, 9 aa, Mycobacterium
GVPTERYPR

SEQ ID NO: 1163351 - protein, 5 aa, Mycobacterium
GVPTG

SEQ ID NO: 1163352 - protein, 7 aa, Mycobacterium
GVPTPDG

SEQ ID NO: 1163353 - protein, 9 aa, Mycobacterium
GVPTPGLPF

SEQ ID NO: 1163354 - protein, 4 aa, Mycobacterium
GVPW

SEQ ID NO: 1163355 - protein, 7 aa, Mycobacterium
GVQDEDS

SEQ ID NO: 1163356 - protein, 34 aa, Mycobacterium
GVQELGRSGVGVGQSGASYAAGDAMNASAYMIAR

SEQ ID NO: 1163357 - protein, 4 aa, Mycobacterium
GVQI

SEQ ID NO: 1163358 - protein, 4 aa, Mycobacterium
GVQP

SEQ ID NO: 1163359 - protein, 7 aa, Mycobacterium
GVQPELA

SEQ ID NO: 1163360 - protein, 8 aa, Mycobacterium
GVQPGREV

SEQ ID NO: 1163361 - protein, 8 aa, Mycobacterium
GVRAKGQR

SEQ ID NO: 1163362 - protein, 5 aa, Mycobacterium
GVRAQ

SEQ ID NO: 1163363 - protein, 5 aa, Mycobacterium
GVRDG

SEQ ID NO: 1163364 - protein, 10 aa, Mycobacterium
GVREAGGQQV

SEQ ID NO: 1163365 - protein, 4 aa, Mycobacterium
GVRG

SEQ ID NO: 1163366 - protein, 9 aa, Mycobacterium
GVRPADPGV

SEQ ID NO: 1163367 - protein, 6 aa, Mycobacterium
GVRPGD

SEQ ID NO: 1163368 - protein, 12 aa, Mycobacterium
GVRPPTRTVRGL

SEQ ID NO: 1163369 - protein, 8 aa, Mycobacterium
GVRPSGYR

SEQ ID NO: 1163370 - protein, 10 aa, Mycobacterium
GVRPTGNPLT

SEQ ID NO: 1163371 - protein, 6 aa, Mycobacterium
GVRTAA

SEQ ID NO: 1163372 - protein, 9 aa, Mycobacterium
GVRTDENGV

SEQ ID NO: 1163373 - protein, 6 aa, Mycobacterium
GVRTRS

SEQ ID NO: 1163374 - protein, 8 aa, Mycobacterium
GVSDPAER

SEQ ID NO: 1163375 - protein, 9 aa, Mycobacterium
GVSESGGAK

SEQ ID NO: 1163376 - protein, 8 aa, Mycobacterium
GVSGGYSR

SEQ ID NO: 1163377 - protein, 9 aa, Mycobacterium
GVSGSGKST

SEQ ID NO: 1163378 - protein, 4 aa, Mycobacterium
GVSP

SEQ ID NO: 1163379 - protein, 9 aa, Mycobacterium
GVSPDSYPT

SEQ ID NO: 1163380 - protein, 10 aa, Mycobacterium
GVSPGNDGRG

SEQ ID NO: 1163381 - protein, 19 aa, Mycobacterium
GVSSGDGLAPRRPVLAPVI

SEQ ID NO: 1163382 - protein, 5 aa, Mycobacterium
GVSTG

SEQ ID NO: 1163383 - protein, 7 aa, Mycobacterium
GVSTQST

SEQ ID NO: 1163384 - protein, 5 aa, Mycobacterium
GVSTR

SEQ ID NO: 1163385 - protein, 16 aa, Mycobacterium
GVTAAKPGSAMTPLPG

SEQ ID NO: 1163386 - protein, 7 aa, Mycobacterium
GVTADAH

SEQ ID NO: 1163387 - protein, 7 aa, Mycobacterium
GVTASRA

SEQ ID NO: 1163388 - protein, 6 aa, Mycobacterium
GVTDHR

SEQ ID NO: 1163389 - protein, 18 aa, Mycobacterium
GVTDSGAPLSIPSDPARR

SEQ ID NO: 1163390 - protein, 5 aa, Mycobacterium
GVTDT

SEQ ID NO: 1163391 - protein, 15 aa, Mycobacterium
GVTGARDAVSSAAPE

SEQ ID NO: 1163392 - protein, 13 aa, Mycobacterium
GVTGITDATPDLD

SEQ ID NO: 1163393 - protein, 10 aa, Mycobacterium
GVTNPEGKRK

SEQ ID NO: 1163394 - protein, 6 aa, Mycobacterium
GVTPAT

SEQ ID NO: 1163395 - protein, 9 aa, Mycobacterium
GVTPQTESR

SEQ ID NO: 1163396 - protein, 4 aa, Mycobacterium
GVTR

SEQ ID NO: 1163397 - protein, 13 aa, Mycobacterium
GVTRPTAANAEAF

SEQ ID NO: 1163398 - protein, 5 aa, Mycobacterium
GVTSG

SEQ ID NO: 1163399 - protein, 9 aa, Mycobacterium
GVTTPERRE

SEQ ID NO: 1163400 - protein, 22 aa, Mycobacterium
GVVPNESGRVVDPASGRSVPGS

SEQ ID NO: 1163401 - protein, 9 aa, Mycobacterium
GVVTPDTPA

SEQ ID NO: 1163402 - protein, 6 aa, Mycobacterium
GWAPGD

SEQ ID NO: 1163403 - protein, 11 aa, Mycobacterium
GWDADGGYAEF

SEQ ID NO: 1163404 - protein, 10 aa, Mycobacterium
GWDNDDGGEF

SEQ ID NO: 1163405 - protein, 13 aa, Mycobacterium
GWPEPTGVTATDD

SEQ ID NO: 1163406 - protein, 6 aa, Mycobacterium
GWPGAG

SEQ ID NO: 1163407 - protein, 7 aa, Mycobacterium
GWPGDEV

SEQ ID NO: 1163408 - protein, 5 aa, Mycobacterium
GWPTQ

SEQ ID NO: 1163409 - protein, 5 aa, Mycobacterium
GWPVP

SEQ ID NO: 1163410 - protein, 9 aa, Mycobacterium
GWQQSGPKS

SEQ ID NO: 1163411 - protein, 26 aa, Mycobacterium
GWRTRKNGKNQTEWLPPPDLDTGQHR

SEQ ID NO: 1163412 - protein, 7 aa, Mycobacterium
GWSPTKS

SEQ ID NO: 1163413 - protein, 6 aa, Mycobacterium
GWSPTR

SEQ ID NO: 1163414 - protein, 4 aa, Mycobacterium
GYAD

SEQ ID NO: 1163415 - protein, 13 aa, Mycobacterium
GYAEADPTADVEG

SEQ ID NO: 1163416 - protein, 15 aa, Mycobacterium
GYAEATADGIPPDLE

SEQ ID NO: 1163417 - protein, 6 aa, Mycobacterium
GYANTT

SEQ ID NO: 1163418 - protein, 13 aa, Mycobacterium
GYAPDPRTGAVNT

SEQ ID NO: 1163419 - protein, 19 aa, Mycobacterium
GYARTGRAPLSETVTFIAD

SEQ ID NO: 1163420 - protein, 8 aa, Mycobacterium
GYATEGQA

SEQ ID NO: 1163421 - protein, 8 aa, Mycobacterium
GYATPIGA

SEQ ID NO: 1163422 - protein, 5 aa, Mycobacterium
GYDKE

SEQ ID NO: 1163423 - protein, 16 aa, Mycobacterium
GYDPAREHTVSPTDPA

SEQ ID NO: 1163424 - protein, 9 aa, Mycobacterium
GYDPQSEKL

SEQ ID NO: 1163425 - protein, 10 aa, Mycobacterium
GYEAFSSGDI

SEQ ID NO: 1163426 - protein, 4 aa, Mycobacterium
GYEN

SEQ ID NO: 1163427 - protein, 8 aa, Mycobacterium
GYENAPRP

SEQ ID NO: 1163428 - protein, 5 aa, Mycobacterium
GYEPD

SEQ ID NO: 1163429 - protein, 6 aa, Mycobacterium
GYEPED

SEQ ID NO: 1163430 - protein, 12 aa, Mycobacterium
GYERPHTEQPPY

SEQ ID NO: 1163431 - protein, 8 aa, Mycobacterium
GYETPSAI

SEQ ID NO: 1163432 - protein, 4 aa, Mycobacterium
GYGM

SEQ ID NO: 1163433 - protein, 23 aa, Mycobacterium
GYGQTGPDAHRAGYASVAEAASG

SEQ ID NO: 1163434 - protein, 13 aa, Mycobacterium
GYGRGDAGPEELR

SEQ ID NO: 1163435 - protein, 5 aa, Mycobacterium
GYGSP

SEQ ID NO: 1163436 - protein, 9 aa, Mycobacterium
GYGYPEAGQ

SEQ ID NO: 1163437 - protein, 6 aa, Mycobacterium
GYHRRE

SEQ ID NO: 1163438 - protein, 5 aa, Mycobacterium
GYKTP

SEQ ID NO: 1163439 - protein, 9 aa, Mycobacterium
GYLPDTATA

SEQ ID NO: 1163440 - protein, 4 aa, Mycobacterium
GYPA

SEQ ID NO: 1163441 - protein, 12 aa, Mycobacterium
GYPDNLSTGADG

SEQ ID NO: 1163442 - protein, 10 aa, Mycobacterium
GYPDTSSEEF

SEQ ID NO: 1163443 - protein, 4 aa, Mycobacterium
GYPK

SEQ ID NO: 1163444 - protein, 21 aa, Mycobacterium
GYPPPSSRARRQAMAEDARQA

SEQ ID NO: 1163445 - protein, 14 aa, Mycobacterium
GYPSGHEAAQVDDD

SEQ ID NO: 1163446 - protein, 6 aa, Mycobacterium
GYPTGF

SEQ ID NO: 1163447 - protein, 4 aa, Mycobacterium
GYPW

SEQ ID NO: 1163448 - protein, 17 aa, Mycobacterium
GYRADGTQSMAQDTGDN

SEQ ID NO: 1163449 - protein, 9 aa, Mycobacterium
GYRASEDHQ

SEQ ID NO: 1163450 - protein, 14 aa, Mycobacterium
GYREEEGVADDSQV

SEQ ID NO: 1163451 - protein, 7 aa, Mycobacterium
GYRPEDY

SEQ ID NO: 1163452 - protein, 8 aa, Mycobacterium
GYRPTDEQ

SEQ ID NO: 1163453 - protein, 15 aa, Mycobacterium
GYRRGALAGTDDDTD

SEQ ID NO: 1163454 - protein, 10 aa, Mycobacterium
GYRRRTDTKD

SEQ ID NO: 1163455 - protein, 4 aa, Mycobacterium
GYRT

SEQ ID NO: 1163456 - protein, 19 aa, Mycobacterium
GYSASGPADDVVAALRAAL

SEQ ID NO: 1163457 - protein, 9 aa, Mycobacterium
GYSASSGQR

SEQ ID NO: 1163458 - protein, 10 aa, Mycobacterium
GYSATSMGSI

SEQ ID NO: 1163459 - protein, 6 aa, Mycobacterium
GYSDGE

SEQ ID NO: 1163460 - protein, 6 aa, Mycobacterium
GYSEET

SEQ ID NO: 1163461 - protein, 4 aa, Mycobacterium
GYSP

SEQ ID NO: 1163462 - protein, 7 aa, Mycobacterium
GYSPAER

SEQ ID NO: 1163463 - protein, 6 aa, Mycobacterium
GYSTRE

SEQ ID NO: 1163464 - protein, 6 aa, Mycobacterium
GYSYGG

SEQ ID NO: 1163465 - protein, 6 aa, Mycobacterium
GYTDRD

SEQ ID NO: 1163466 - protein, 5 aa, Mycobacterium
GYTGA

SEQ ID NO: 1163467 - protein, 7 aa, Mycobacterium
GYTGEQG

SEQ ID NO: 1163468 - protein, 20 aa, Mycobacterium
GYTGGQNDHPTYRNHPGHAE

SEQ ID NO: 1163469 - protein, 10 aa, Mycobacterium
GYTGSPSIEA

SEQ ID NO: 1163470 - protein, 17 aa, Mycobacterium
GYTQRGDAFAAAVRADL

SEQ ID NO: 1163471 - protein, 7 aa, Mycobacterium
GYTSDDK

SEQ ID NO: 1163472 - protein, 14 aa, Mycobacterium
GYTSPGRSKETAED

SEQ ID NO: 1163473 - protein, 7 aa, Mycobacterium
GYTSSLA

SEQ ID NO: 1163474 - protein, 7 aa, Mycobacterium
GYTVDHS

SEQ ID NO: 1163475 - protein, 13 aa, Mycobacterium
GYTVRDDDDDDPV

SEQ ID NO: 1163476 - protein, 5 aa, Mycobacterium
GYTVT

SEQ ID NO: 1163477 - protein, 15 aa, Mycobacterium
GYYNNEGRGGAERNG

SEQ ID NO: 1163478 - protein, 16 aa, Mycobacterium
HAADAQASGTAASGLP

SEQ ID NO: 1163479 - protein, 6 aa, Mycobacterium
HAADPE

SEQ ID NO: 1163480 - protein, 6 aa, Mycobacterium
HAADRG

SEQ ID NO: 1163481 - protein, 25 aa, Mycobacterium
HAAEPKGGRPGPTDQGGEGGMASRE

SEQ ID NO: 1163482 - protein, 11 aa, Mycobacterium
HAAETDGRPGI

SEQ ID NO: 1163483 - protein, 10 aa, Mycobacterium
HAAGPANDAA

SEQ ID NO: 1163484 - protein, 6 aa, Mycobacterium
HAATRE

SEQ ID NO: 1163485 - protein, 13 aa, Mycobacterium
HADAGKARKAGRR

SEQ ID NO: 1163486 - protein, 9 aa, Mycobacterium
HADDKDMEA

SEQ ID NO: 1163487 - protein, 7 aa, Mycobacterium
HADEERE

SEQ ID NO: 1163488 - protein, 5 aa, Mycobacterium
HADPN

SEQ ID NO: 1163489 - protein, 7 aa, Mycobacterium
HADPRDR

SEQ ID NO: 1163490 - protein, 11 aa, Mycobacterium
HADTKGPKSLS

SEQ ID NO: 1163491 - protein, 4 aa, Mycobacterium
HAEA

SEQ ID NO: 1163492 - protein, 6 aa, Mycobacterium
HAERTK

SEQ ID NO: 1163493 - protein, 15 aa, Mycobacterium
HAESELDSRSEVGLP

SEQ ID NO: 1163494 - protein, 9 aa, Mycobacterium
HAESGLPRA

SEQ ID NO: 1163495 - protein, 11 aa, Mycobacterium
HAETGDTNGAA

SEQ ID NO: 1163496 - protein, 10 aa, Mycobacterium
HAGAATDSEW

SEQ ID NO: 1163497 - protein, 7 aa, Mycobacterium
HAGAGRP

SEQ ID NO: 1163498 - protein, 10 aa, Mycobacterium
HAGGTRYRDD

SEQ ID NO: 1163499 - protein, 7 aa, Mycobacterium
HAGKAGF

SEQ ID NO: 1163500 - protein, 16 aa, Mycobacterium
HAGPGEAAPLQCSPGG

SEQ ID NO: 1163501 - protein, 16 aa, Mycobacterium
HAGPVANSRTNKAKAL

SEQ ID NO: 1163502 - protein, 13 aa, Mycobacterium
HAGQTPDAATNAR

SEQ ID NO: 1163503 - protein, 8 aa, Mycobacterium
HAGSATLD

SEQ ID NO: 1163504 - protein, 5 aa, Mycobacterium
HAGSV

SEQ ID NO: 1163505 - protein, 6 aa, Mycobacterium
HAHGTE

SEQ ID NO: 1163506 - protein, 18 aa, Mycobacterium
HAKAGADDTMADRQSDLA

SEQ ID NO: 1163507 - protein, 5 aa, Mycobacterium
HALGA

SEQ ID NO: 1163508 - protein, 6 aa, Mycobacterium
HANEGG

SEQ ID NO: 1163509 - protein, 6 aa, Mycobacterium
HANGAR

SEQ ID NO: 1163510 - protein, 13 aa, Mycobacterium
HAPAAAPNSADDE

SEQ ID NO: 1163511 - protein, 6 aa, Mycobacterium
HAPDRQ

SEQ ID NO: 1163512 - protein, 19 aa, Mycobacterium
HAPEADREPVPSSVGPARA

SEQ ID NO: 1163513 - protein, 6 aa, Mycobacterium
HAPHAE

SEQ ID NO: 1163514 - protein, 6 aa, Mycobacterium
HAPMPA

SEQ ID NO: 1163515 - protein, 7 aa, Mycobacterium
HAPTTAT

SEQ ID NO: 1163516 - protein, 4 aa, Mycobacterium
HAPV

SEQ ID NO: 1163517 - protein, 7 aa, Mycobacterium
HAQNDDI

SEQ ID NO: 1163518 - protein, 10 aa, Mycobacterium
HAQSQGYGAE

SEQ ID NO: 1163519 - protein, 29 aa, Mycobacterium
HARGRDVESGPSATDFAPQSQTDDTLGPV

SEQ ID NO: 1163520 - protein, 4 aa, Mycobacterium
HARS

SEQ ID NO: 1163521 - protein, 18 aa, Mycobacterium
HARSETGTGAGSTADLSR

SEQ ID NO: 1163522 - protein, 6 aa, Mycobacterium
HARSTA

SEQ ID NO: 1163523 - protein, 5 aa, Mycobacterium
HARYG

SEQ ID NO: 1163524 - protein, 14 aa, Mycobacterium
HASAALRQSENDRI

SEQ ID NO: 1163525 - protein, 5 aa, Mycobacterium
HASGA

SEQ ID NO: 1163526 - protein, 7 aa, Mycobacterium
HASPAAV

SEQ ID NO: 1163527 - protein, 36 aa, Mycobacterium
HATGTSVGDVAEGKAINNAMGGHKPAVYAPKGALGH

SEQ ID NO: 1163528 - protein, 16 aa, Mycobacterium
HATPDRAGGPTSALNG

SEQ ID NO: 1163529 - protein, 11 aa, Mycobacterium
HATPQGIPTRR

SEQ ID NO: 1163530 - protein, 8 aa, Mycobacterium
HATTGKPF

SEQ ID NO: 1163531 - protein, 6 aa, Mycobacterium
HAVGPG

SEQ ID NO: 1163532 - protein, 6 aa, Mycobacterium
HAVGSG

SEQ ID NO: 1163533 - protein, 8 aa, Mycobacterium
HAYGGGSQ

SEQ ID NO: 1163534 - protein, 5 aa, Mycobacterium
HAYPD

SEQ ID NO: 1163535 - protein, 8 aa, Mycobacterium
HCEPDDPD

SEQ ID NO: 1163536 - protein, 7 aa, Mycobacterium
HDAADAI

SEQ ID NO: 1163537 - protein, 10 aa, Mycobacterium
HDAAGPQKIP

SEQ ID NO: 1163538 - protein, 6 aa, Mycobacterium
HDAEHS

SEQ ID NO: 1163539 - protein, 4 aa, Mycobacterium
HDAG

SEQ ID NO: 1163540 - protein, 6 aa, Mycobacterium
HDATTR

SEQ ID NO: 1163541 - protein, 4 aa, Mycobacterium
HDDN

SEQ ID NO: 1163542 - protein, 7 aa, Mycobacterium
HDDPEES

SEQ ID NO: 1163543 - protein, 6 aa, Mycobacterium
HDDPRA

SEQ ID NO: 1163544 - protein, 8 aa, Mycobacterium
HDDSASIT

SEQ ID NO: 1163545 - protein, 8 aa, Mycobacterium
HDDTTSEL

SEQ ID NO: 1163546 - protein, 5 aa, Mycobacterium
HDEAT

SEQ ID NO: 1163547 - protein, 6 aa, Mycobacterium
HDEVGG

SEQ ID NO: 1163548 - protein, 6 aa, Mycobacterium
HDGEPV

SEQ ID NO: 1163549 - protein, 6 aa, Mycobacterium
HDGESD

SEQ ID NO: 1163550 - protein, 11 aa, Mycobacterium
HDGGTGAAPLT

SEQ ID NO: 1163551 - protein, 8 aa, Mycobacterium
HDGPATGR

SEQ ID NO: 1163552 - protein, 9 aa, Mycobacterium
HDGTPGRID

SEQ ID NO: 1163553 - protein, 4 aa, Mycobacterium
HDGV

SEQ ID NO: 1163554 - protein, 4 aa, Mycobacterium
HDHM

SEQ ID NO: 1163555 - protein, 9 aa, Mycobacterium
HDLEPAGSF

SEQ ID NO: 1163556 - protein, 6 aa, Mycobacterium
HDLNDP

SEQ ID NO: 1163557 - protein, 8 aa, Mycobacterium
HDLPPTAG

SEQ ID NO: 1163558 - protein, 9 aa, Mycobacterium
HDNAGYPAP

SEQ ID NO: 1163559 - protein, 6 aa, Mycobacterium
HDPDAK

SEQ ID NO: 1163560 - protein, 6 aa, Mycobacterium
HDPDKL

SEQ ID NO: 1163561 - protein, 12 aa, Mycobacterium
HDPDRAEDDDYV

SEQ ID NO: 1163562 - protein, 10 aa, Mycobacterium
HDPEALPPLT

SEQ ID NO: 1163563 - protein, 7 aa, Mycobacterium
HDPESTT

SEQ ID NO: 1163564 - protein, 7 aa, Mycobacterium
HDPLRDD

SEQ ID NO: 1163565 - protein, 13 aa, Mycobacterium
HDPRDSTSVPAEV

SEQ ID NO: 1163566 - protein, 4 aa, Mycobacterium
HDQR

SEQ ID NO: 1163567 - protein, 4 aa, Mycobacterium
HDRA

SEQ ID NO: 1163568 - protein, 4 aa, Mycobacterium
HDRG

SEQ ID NO: 1163569 - protein, 4 aa, Mycobacterium
HDRS

SEQ ID NO: 1163570 - protein, 8 aa, Mycobacterium
HDRSESKV

SEQ ID NO: 1163571 - protein, 8 aa, Mycobacterium
HDRTGGRT

SEQ ID NO: 1163572 - protein, 5 aa, Mycobacterium
HDSPP

SEQ ID NO: 1163573 - protein, 9 aa, Mycobacterium
HDSRVGGGR

SEQ ID NO: 1163574 - protein, 12 aa, Mycobacterium
HDSTGKPPQYPI

SEQ ID NO: 1163575 - protein, 8 aa, Mycobacterium
HDTDGAGA

SEQ ID NO: 1163576 - protein, 8 aa, Mycobacterium
HDTDGDLD

SEQ ID NO: 1163577 - protein, 7 aa, Mycobacterium
HDTGLDD

SEQ ID NO: 1163578 - protein, 10 aa, Mycobacterium
HDTGRVPSTG

SEQ ID NO: 1163579 - protein, 14 aa, Mycobacterium
HDTPGAMAYPGGVE

SEQ ID NO: 1163580 - protein, 6 aa, Mycobacterium
HDTQAD

SEQ ID NO: 1163581 - protein, 7 aa, Mycobacterium
HDTTATG

SEQ ID NO: 1163582 - protein, 4 aa, Mycobacterium
HEAF

SEQ ID NO: 1163583 - protein, 6 aa, Mycobacterium
HEAGAQ

SEQ ID NO: 1163584 - protein, 5 aa, Mycobacterium
HEDDT

SEQ ID NO: 1163585 - protein, 15 aa, Mycobacterium
HEDEPLRDLELAGQS

SEQ ID NO: 1163586 - protein, 7 aa, Mycobacterium
HEDPGEL

SEQ ID NO: 1163587 - protein, 4 aa, Mycobacterium
HEEA

SEQ ID NO: 1163588 - protein, 7 aa, Mycobacterium
HEELPPE

SEQ ID NO: 1163589 - protein, 11 aa, Mycobacterium
HEENKKEFAGP

SEQ ID NO: 1163590 - protein, 10 aa, Mycobacterium
HEFRPDRKNV

SEQ ID NO: 1163591 - protein, 14 aa, Mycobacterium
HEGDTAAAVAVIEE

SEQ ID NO: 1163592 - protein, 8 aa, Mycobacterium
HEGEDTKN

SEQ ID NO: 1163593 - protein, 10 aa, Mycobacterium
HEKNRRQRKN

SEQ ID NO: 1163594 - protein, 11 aa, Mycobacterium
HEKTAALSSAY

SEQ ID NO: 1163595 - protein, 9 aa, Mycobacterium
HEKTETYPE

SEQ ID NO: 1163596 - protein, 4 aa, Mycobacterium
HENA

SEQ ID NO: 1163597 - protein, 10 aa, Mycobacterium
HENADEALRA

SEQ ID NO: 1163598 - protein, 4 aa, Mycobacterium
HEND

SEQ ID NO: 1163599 - protein, 7 aa, Mycobacterium
HENPSTA

SEQ ID NO: 1163600 - protein, 11 aa, Mycobacterium
HEPHRTADGRA

SEQ ID NO: 1163601 - protein, 7 aa, Mycobacterium
HEPPLSA

SEQ ID NO: 1163602 - protein, 8 aa, Mycobacterium
HEPPTPLE

SEQ ID NO: 1163603 - protein, 17 aa, Mycobacterium
HEQRADRRAQRSTRARL

SEQ ID NO: 1163604 - protein, 7 aa, Mycobacterium
HERAGSR

SEQ ID NO: 1163605 - protein, 6 aa, Mycobacterium
HERRGY

SEQ ID NO: 1163606 - protein, 14 aa, Mycobacterium
HERSAGQTAGRPRV

SEQ ID NO: 1163607 - protein, 5 aa, Mycobacterium
HESAG

SEQ ID NO: 1163608 - protein, 9 aa, Mycobacterium
HESGSDRLE

SEQ ID NO: 1163609 - protein, 7 aa, Mycobacterium
HETDPAQ

SEQ ID NO: 1163610 - protein, 7 aa, Mycobacterium
HETTAST

SEQ ID NO: 1163611 - protein, 6 aa, Mycobacterium
HETTSN

SEQ ID NO: 1163612 - protein, 4 aa, Mycobacterium
HEVP

SEQ ID NO: 1163613 - protein, 13 aa, Mycobacterium
HFDRTKAEAQDSD

SEQ ID NO: 1163614 - protein, 11 aa, Mycobacterium
HFGGSTALSGG

SEQ ID NO: 1163615 - protein, 12 aa, Mycobacterium
HFPSTDDRSRER

SEQ ID NO: 1163616 - protein, 9 aa, Mycobacterium
HFRPPRDGV

SEQ ID NO: 1163617 - protein, 11 aa, Mycobacterium
HGADGAVGTDI

SEQ ID NO: 1163618 - protein, 9 aa, Mycobacterium
HGADPEQVT

SEQ ID NO: 1163619 - protein, 7 aa, Mycobacterium
HGAGPRL

SEQ ID NO: 1163620 - protein, 7 aa, Mycobacterium
HGAHPRY

SEQ ID NO: 1163621 - protein, 13 aa, Mycobacterium
HGANRRSTSETRE

SEQ ID NO: 1163622 - protein, 4 aa, Mycobacterium
HGAR

SEQ ID NO: 1163623 - protein, 4 aa, Mycobacterium
HGAS

SEQ ID NO: 1163624 - protein, 6 aa, Mycobacterium
HGASDN

SEQ ID NO: 1163625 - protein, 7 aa, Mycobacterium
HGATAAT

SEQ ID NO: 1163626 - protein, 4 aa, Mycobacterium
HGDF

SEQ ID NO: 1163627 - protein, 11 aa, Mycobacterium
HGDGPEVVGPG

SEQ ID NO: 1163628 - protein, 5 aa, Mycobacterium
HGDNV

SEQ ID NO: 1163629 - protein, 6 aa, Mycobacterium
HGDPVT

SEQ ID NO: 1163630 - protein, 4 aa, Mycobacterium
HGDR

SEQ ID NO: 1163631 - protein, 22 aa, Mycobacterium
HGDTTTIADNRGSATARAGSHL

SEQ ID NO: 1163632 - protein, 6 aa, Mycobacterium
HGEDPT

SEQ ID NO: 1163633 - protein, 4 aa, Mycobacterium
HGEI

SEQ ID NO: 1163634 - protein, 5 aa, Mycobacterium
HGEMT

SEQ ID NO: 1163635 - protein, 5 aa, Mycobacterium
HGEQA

SEQ ID NO: 1163636 - protein, 7 aa, Mycobacterium
HGESRAA

SEQ ID NO: 1163637 - protein, 8 aa, Mycobacterium
HGEYEEDH

SEQ ID NO: 1163638 - protein, 5 aa, Mycobacterium
HGFGG

SEQ ID NO: 1163639 - protein, 38 aa, Mycobacterium
HGGAEPSGGDQSNAPGVSGTPGGSRVQESTAAEANTPL

SEQ ID NO: 1163640 - protein, 5 aa, Mycobacterium
HGGGA

SEQ ID NO: 1163641 - protein, 10 aa, Mycobacterium
HGGNTEALAG

SEQ ID NO: 1163642 - protein, 8 aa, Mycobacterium
HGGPDAGG

SEQ ID NO: 1163643 - protein, 6 aa, Mycobacterium
HGGPEA

SEQ ID NO: 1163644 - protein, 11 aa, Mycobacterium
HGGQLSHGRTH

SEQ ID NO: 1163645 - protein, 12 aa, Mycobacterium
HGGRDGRDVRSA

SEQ ID NO: 1163646 - protein, 11 aa, Mycobacterium
HGGRQANGGLP

SEQ ID NO: 1163647 - protein, 13 aa, Mycobacterium
HGGRSLGEGPAKA

SEQ ID NO: 1163648 - protein, 6 aa, Mycobacterium
HGGSKH

SEQ ID NO: 1163649 - protein, 12 aa, Mycobacterium
HGGVGASGFGKD

SEQ ID NO: 1163650 - protein, 5 aa, Mycobacterium
HGHAH

SEQ ID NO: 1163651 - protein, 5 aa, Mycobacterium
HGHGP

SEQ ID NO: 1163652 - protein, 6 aa, Mycobacterium
HGIDDD

SEQ ID NO: 1163653 - protein, 4 aa, Mycobacterium
HGIT

SEQ ID NO: 1163654 - protein, 23 aa, Mycobacterium
HGKGGRNAHGRITTRHKGGGHKR

SEQ ID NO: 1163655 - protein, 16 aa, Mycobacterium
HGKPDPYESGTWGPES

SEQ ID NO: 1163656 - protein, 5 aa, Mycobacterium
HGKPS

SEQ ID NO: 1163657 - protein, 6 aa, Mycobacterium
HGKRAA

SEQ ID NO: 1163658 - protein, 12 aa, Mycobacterium
HGKSDKPRADYS

SEQ ID NO: 1163659 - protein, 5 aa, Mycobacterium
HGKST

SEQ ID NO: 1163660 - protein, 6 aa, Mycobacterium
HGLPAT

SEQ ID NO: 1163661 - protein, 11 aa, Mycobacterium
HGMGDKSYPDL

SEQ ID NO: 1163662 - protein, 15 aa, Mycobacterium
HGMPAGAAHGDRDAS

SEQ ID NO: 1163663 - protein, 6 aa, Mycobacterium
HGNPLR

SEQ ID NO: 1163664 - protein, 15 aa, Mycobacterium
HGNTAGSQASIDPDA

SEQ ID NO: 1163665 - protein, 9 aa, Mycobacterium
HGPDGDTTV

SEQ ID NO: 1163666 - protein, 16 aa, Mycobacterium
HGPEAAETLRQTSYAQ

SEQ ID NO: 1163667 - protein, 5 aa, Mycobacterium
HGPIE

SEQ ID NO: 1163668 - protein, 10 aa, Mycobacterium
HGPPGTGKTF

SEQ ID NO: 1163669 - protein, 14 aa, Mycobacterium
HGPQVDKGARWDPA

SEQ ID NO: 1163670 - protein, 4 aa, Mycobacterium
HGPR

SEQ ID NO: 1163671 - protein, 6 aa, Mycobacterium
HGPRPL

SEQ ID NO: 1163672 - protein, 15 aa, Mycobacterium
HGPVTEDNAHPHNDC

SEQ ID NO: 1163673 - protein, 7 aa, Mycobacterium
HGQTEVS

SEQ ID NO: 1163674 - protein, 8 aa, Mycobacterium
HGRAARDA

SEQ ID NO: 1163675 - protein, 18 aa, Mycobacterium
HGRADSAVSADADTGDTV

SEQ ID NO: 1163676 - protein, 8 aa, Mycobacterium
HGRAQAES

SEQ ID NO: 1163677 - protein, 4 aa, Mycobacterium
HGRL

SEQ ID NO: 1163678 - protein, 8 aa, Mycobacterium
HGRRTDTP

SEQ ID NO: 1163679 - protein, 11 aa, Mycobacterium
HGRSAKPRTDY

SEQ ID NO: 1163680 - protein, 18 aa, Mycobacterium
HGRSSYQKDKTKDPDDFA

SEQ ID NO: 1163681 - protein, 6 aa, Mycobacterium
HGRTPP

SEQ ID NO: 1163682 - protein, 6 aa, Mycobacterium
HGSAAA

SEQ ID NO: 1163683 - protein, 19 aa, Mycobacterium
HGSDSPESAAREIDLWFPG

SEQ ID NO: 1163684 - protein, 9 aa, Mycobacterium
HGSEEHQPG

SEQ ID NO: 1163685 - protein, 8 aa, Mycobacterium
HGSEEQRK

SEQ ID NO: 1163686 - protein, 6 aa, Mycobacterium
HGSKEL

SEQ ID NO: 1163687 - protein, 7 aa, Mycobacterium
HGSPEQI

SEQ ID NO: 1163688 - protein, 9 aa, Mycobacterium
HGSQYTSTD

SEQ ID NO: 1163689 - protein, 9 aa, Mycobacterium
HGSSSSRVS

SEQ ID NO: 1163690 - protein, 6 aa, Mycobacterium
HGSTAE

SEQ ID NO: 1163691 - protein, 10 aa, Mycobacterium
HGSVSKEQRA

SEQ ID NO: 1163692 - protein, 8 aa, Mycobacterium
HGSYRGAP

SEQ ID NO: 1163693 - protein, 8 aa, Mycobacterium
HGTARSTT

SEQ ID NO: 1163694 - protein, 8 aa, Mycobacterium
HGTEAQKQ

SEQ ID NO: 1163695 - protein, 12 aa, Mycobacterium
HGTGTPTGDPVE

SEQ ID NO: 1163696 - protein, 10 aa, Mycobacterium
HGTGTPVGDP

SEQ ID NO: 1163697 - protein, 13 aa, Mycobacterium
HGTGTRLGDKTEL

SEQ ID NO: 1163698 - protein, 18 aa, Mycobacterium
HGTGTSLGDPIEAQAAGE

SEQ ID NO: 1163699 - protein, 11 aa, Mycobacterium
HGTVERDAEGL

SEQ ID NO: 1163700 - protein, 12 aa, Mycobacterium
HGVGDSIARAGG

SEQ ID NO: 1163701 - protein, 15 aa, Mycobacterium
HGVGTGISASDRATT

SEQ ID NO: 1163702 - protein, 4 aa, Mycobacterium
HGVP

SEQ ID NO: 1163703 - protein, 12 aa, Mycobacterium
HGVPTDDSDDNA

SEQ ID NO: 1163704 - protein, 8 aa, Mycobacterium
HGVSEAPR

SEQ ID NO: 1163705 - protein, 4 aa, Mycobacterium
HGVT

SEQ ID NO: 1163706 - protein, 5 aa, Mycobacterium
HGWYD

SEQ ID NO: 1163707 - protein, 6 aa, Mycobacterium
HHAPGT

SEQ ID NO: 1163708 - protein, 8 aa, Mycobacterium
HHATSRGQ

SEQ ID NO: 1163709 - protein, 8 aa, Mycobacterium
HHDGGVEE

SEQ ID NO: 1163710 - protein, 4 aa, Mycobacterium
HHDP

SEQ ID NO: 1163711 - protein, 16 aa, Mycobacterium
HHDQGKDSEFSDRLTR

SEQ ID NO: 1163712 - protein, 15 aa, Mycobacterium
HHGAPEKARERARRK

SEQ ID NO: 1163713 - protein, 4 aa, Mycobacterium
HHGG

SEQ ID NO: 1163714 - protein, 9 aa, Mycobacterium
HHGPAGERR

SEQ ID NO: 1163715 - protein, 6 aa, Mycobacterium
HHGSPS

SEQ ID NO: 1163716 - protein, 6 aa, Mycobacterium
HHNAGA

SEQ ID NO: 1163717 - protein, 7 aa, Mycobacterium
HHPADGD

SEQ ID NO: 1163718 - protein, 15 aa, Mycobacterium
HHPDDELLAAACERM

SEQ ID NO: 1163719 - protein, 8 aa, Mycobacterium
HHQKGNAV

SEQ ID NO: 1163720 - protein, 8 aa, Mycobacterium
HHTAGGMS

SEQ ID NO: 1163721 - protein, 6 aa, Mycobacterium
HIEPGE

SEQ ID NO: 1163722 - protein, 5 aa, Mycobacterium
HISEE

SEQ ID NO: 1163723 - protein, 6 aa, Mycobacterium
HKASPG

SEQ ID NO: 1163724 - protein, 7 aa, Mycobacterium
HKATAEQ

SEQ ID NO: 1163725 - protein, 10 aa, Mycobacterium
HKATGERSEE

SEQ ID NO: 1163726 - protein, 5 aa, Mycobacterium
HKGEQ

SEQ ID NO: 1163727 - protein, 7 aa, Mycobacterium
HKNRSRV

SEQ ID NO: 1163728 - protein, 12 aa, Mycobacterium
HKPARREGTREG

SEQ ID NO: 1163729 - protein, 6 aa, Mycobacterium
HKRTAD

SEQ ID NO: 1163730 - protein, 7 aa, Mycobacterium
HKRTPTD

SEQ ID NO: 1163731 - protein, 13 aa, Mycobacterium
HLAGPPDDPRIPE

SEQ ID NO: 1163732 - protein, 13 aa, Mycobacterium
HLDSTRAVSPLRA

SEQ ID NO: 1163733 - protein, 19 aa, Mycobacterium
HLEGKATAEYSGDHTSSIR

SEQ ID NO: 1163734 - protein, 7 aa, Mycobacterium
HLEPGGT

SEQ ID NO: 1163735 - protein, 14 aa, Mycobacterium
HLPDPAKRQVRRAQ

SEQ ID NO: 1163736 - protein, 6 aa, Mycobacterium
HLPEDH

SEQ ID NO: 1163737 - protein, 4 aa, Mycobacterium
HLPP

SEQ ID NO: 1163738 - protein, 5 aa, Mycobacterium
HLPSA

SEQ ID NO: 1163739 - protein, 5 aa, Mycobacterium
HLPST

SEQ ID NO: 1163740 - protein, 7 aa, Mycobacterium
HLRSGEE

SEQ ID NO: 1163741 - protein, 6 aa, Mycobacterium
HMSPPT

SEQ ID NO: 1163742 - protein, 7 aa, Mycobacterium
HMSPPTP

SEQ ID NO: 1163743 - protein, 9 aa, Mycobacterium
HNDDSADDI

SEQ ID NO: 1163744 - protein, 6 aa, Mycobacterium
HNDTGG

SEQ ID NO: 1163745 - protein, 10 aa, Mycobacterium
HNGASHQDPG

SEQ ID NO: 1163746 - protein, 10 aa, Mycobacterium
HNGGSTFDEP

SEQ ID NO: 1163747 - protein, 6 aa, Mycobacterium
HNGKNT

SEQ ID NO: 1163748 - protein, 6 aa, Mycobacterium
HNITDD

SEQ ID NO: 1163749 - protein, 14 aa, Mycobacterium
HNKKSDAHEPTFDG

SEQ ID NO: 1163750 - protein, 14 aa, Mycobacterium
HNKPEATAEAVTPD

SEQ ID NO: 1163751 - protein, 9 aa, Mycobacterium
HNLRRGPDM

SEQ ID NO: 1163752 - protein, 8 aa, Mycobacterium
HNPAASPV

SEQ ID NO: 1163753 - protein, 8 aa, Mycobacterium
HNPAGAAA

SEQ ID NO: 1163754 - protein, 9 aa, Mycobacterium
HNPDAEDRM

SEQ ID NO: 1163755 - protein, 4 aa, Mycobacterium
HNPH

SEQ ID NO: 1163756 - protein, 11 aa, Mycobacterium
HNPTGTVESAA

SEQ ID NO: 1163757 - protein, 12 aa, Mycobacterium
HNQDRLAHGSEE

SEQ ID NO: 1163758 - protein, 5 aa, Mycobacterium
HNRAA

SEQ ID NO: 1163759 - protein, 10 aa, Mycobacterium
HNSDPRYTRS

SEQ ID NO: 1163760 - protein, 12 aa, Mycobacterium
HNTGPVPDPPLS

SEQ ID NO: 1163761 - protein, 5 aa, Mycobacterium
HPADP

SEQ ID NO: 1163762 - protein, 20 aa, Mycobacterium
HPAEPQGPRDPVLPEGLLVR

SEQ ID NO: 1163763 - protein, 5 aa, Mycobacterium
HPAES

SEQ ID NO: 1163764 - protein, 8 aa, Mycobacterium
HPAGEKHD

SEQ ID NO: 1163765 - protein, 8 aa, Mycobacterium
HPAGGPPH

SEQ ID NO: 1163766 - protein, 22 aa, Mycobacterium
HPAGGVGARGHRPGDESAPVVR

SEQ ID NO: 1163767 - protein, 11 aa, Mycobacterium
HPAHPQAGEGP

SEQ ID NO: 1163768 - protein, 14 aa, Mycobacterium
HPAPCGASTTGATT

SEQ ID NO: 1163769 - protein, 8 aa, Mycobacterium
HPAPPGAP

SEQ ID NO: 1163770 - protein, 7 aa, Mycobacterium
HPATPMT

SEQ ID NO: 1163771 - protein, 16 aa, Mycobacterium
HPDAGARIGASSQRMA

SEQ ID NO: 1163772 - protein, 4 aa, Mycobacterium
HPDD

SEQ ID NO: 1163773 - protein, 10 aa, Mycobacterium
HPDDARAAGL

SEQ ID NO: 1163774 - protein, 6 aa, Mycobacterium
HPDDDR

SEQ ID NO: 1163775 - protein, 19 aa, Mycobacterium
HPDDPGLPAHRDVLVVTFA

SEQ ID NO: 1163776 - protein, 5 aa, Mycobacterium
HPDDR

SEQ ID NO: 1163777 - protein, 12 aa, Mycobacterium
HPDERTRLSRER

SEQ ID NO: 1163778 - protein, 4 aa, Mycobacterium
HPDG

SEQ ID NO: 1163779 - protein, 5 aa, Mycobacterium
HPDGV

SEQ ID NO: 1163780 - protein, 22 aa, Mycobacterium
HPDHREHAKEPRPLDDDELERR

SEQ ID NO: 1163781 - protein, 5 aa, Mycobacterium
HPDKE

SEQ ID NO: 1163782 - protein, 5 aa, Mycobacterium
HPDLG

SEQ ID NO: 1163783 - protein, 6 aa, Mycobacterium
HPDPDT

SEQ ID NO: 1163784 - protein, 11 aa, Mycobacterium
HPDQRERLSRE

SEQ ID NO: 1163785 - protein, 6 aa, Mycobacterium
HPDQRR

SEQ ID NO: 1163786 - protein, 11 aa, Mycobacterium
HPDRPAGTPYI

SEQ ID NO: 1163787 - protein, 5 aa, Mycobacterium
HPDTE

SEQ ID NO: 1163788 - protein, 4 aa, Mycobacterium
HPDV

SEQ ID NO: 1163789 - protein, 11 aa, Mycobacterium
HPEATQEYRKP

SEQ ID NO: 1163790 - protein, 5 aa, Mycobacterium
HPEGA

SEQ ID NO: 1163791 - protein, 5 aa, Mycobacterium
HPELS

SEQ ID NO: 1163792 - protein, 5 aa, Mycobacterium
HPEPA

SEQ ID NO: 1163793 - protein, 8 aa, Mycobacterium
HPERREGA

SEQ ID NO: 1163794 - protein, 11 aa, Mycobacterium
HPESTAGLAPA

SEQ ID NO: 1163795 - protein, 5 aa, Mycobacterium
HPEVE

SEQ ID NO: 1163796 - protein, 6 aa, Mycobacterium
HPEYAD

SEQ ID NO: 1163797 - protein, 6 aa, Mycobacterium
HPGADI

SEQ ID NO: 1163798 - protein, 7 aa, Mycobacterium
HPGDGPQ

SEQ ID NO: 1163799 - protein, 13 aa, Mycobacterium
HPGEHDDNSIDNP

SEQ ID NO: 1163800 - protein, 5 aa, Mycobacterium
HPGNG

SEQ ID NO: 1163801 - protein, 5 aa, Mycobacterium
HPGPR

SEQ ID NO: 1163802 - protein, 9 aa, Mycobacterium
HPGPTKTSM

SEQ ID NO: 1163803 - protein, 7 aa, Mycobacterium
HPGPTPP

SEQ ID NO: 1163804 - protein, 5 aa, Mycobacterium
HPGPV

SEQ ID NO: 1163805 - protein, 9 aa, Mycobacterium
HPGTSSTEL

SEQ ID NO: 1163806 - protein, 5 aa, Mycobacterium
HPGTV

SEQ ID NO: 1163807 - protein, 7 aa, Mycobacterium
HPGVSNT

SEQ ID NO: 1163808 - protein, 6 aa, Mycobacterium
HPGYSH

SEQ ID NO: 1163809 - protein, 36 aa, Mycobacterium; identical to SEQ ID NO: 503762

SEQ ID NO: 1163810 - protein, 9 aa, Mycobacterium
HPKKLARPK

SEQ ID NO: 1163811 - protein, 12 aa, Mycobacterium
HPKPQQQPGPPL

SEQ ID NO: 1163812 - protein, 14 aa, Mycobacterium
HPKYTVTSGSITLD

SEQ ID NO: 1163813 - protein, 15 aa, Mycobacterium
HPLAGGSGAGGGGGM

SEQ ID NO: 1163814 - protein, 10 aa, Mycobacterium
HPLPSQPWTQ

SEQ ID NO: 1163815 - protein, 4 aa, Mycobacterium
HPNA

SEQ ID NO: 1163816 - protein, 4 aa, Mycobacterium
HPNP

SEQ ID NO: 1163817 - protein, 7 aa, Mycobacterium
HPNPAVA

SEQ ID NO: 1163818 - protein, 15 aa, Mycobacterium
HPNVNASYNEDTKEI

SEQ ID NO: 1163819 - protein, 10 aa, Mycobacterium
HPNWRGDAAS

SEQ ID NO: 1163820 - protein, 21 aa, Mycobacterium
HPPDTSEAPAYAAAARRSELS

SEQ ID NO: 1163821 - protein, 8 aa, Mycobacterium
HPPEFGGR

SEQ ID NO: 1163822 - protein, 6 aa, Mycobacterium
HPPELG

SEQ ID NO: 1163823 - protein, 13 aa, Mycobacterium
HPPGSTDKFGADL

SEQ ID NO: 1163824 - protein, 7 aa, Mycobacterium
HPPTPAT

SEQ ID NO: 1163825 - protein, 6 aa, Mycobacterium
HPPTRP

SEQ ID NO: 1163826 - protein, 8 aa, Mycobacterium
HPQLDGRD

SEQ ID NO: 1163827 - protein, 13 aa, Mycobacterium
HPQPVIGSPTRHA

SEQ ID NO: 1163828 - protein, 5 aa, Mycobacterium
HPQVG

SEQ ID NO: 1163829 - protein, 7 aa, Mycobacterium
HPRGNYP

SEQ ID NO: 1163830 - protein, 5 aa, Mycobacterium
HPRPD

SEQ ID NO: 1163831 - protein, 9 aa, Mycobacterium
HPRRTAPER

SEQ ID NO: 1163832 - protein, 11 aa, Mycobacterium
HPRSAADEDAP

SEQ ID NO: 1163833 - protein, 10 aa, Mycobacterium
HPRVPDPAGV

SEQ ID NO: 1163834 - protein, 5 aa, Mycobacterium
HPSAS

SEQ ID NO: 1163835 - protein, 4 aa, Mycobacterium
HPSR

SEQ ID NO: 1163836 - protein, 8 aa, Mycobacterium
HPSTTGRY

SEQ ID NO: 1163837 - protein, 6 aa, Mycobacterium
HPTDRR

SEQ ID NO: 1163838 - protein, 6 aa, Mycobacterium
HPTDTT

SEQ ID NO: 1163839 - protein, 8 aa, Mycobacterium
HPTGPHNA

SEQ ID NO: 1163840 - protein, 6 aa, Mycobacterium
HPTGVG

SEQ ID NO: 1163841 - protein, 9 aa, Mycobacterium
HPTQLGPAR

SEQ ID NO: 1163842 - protein, 5 aa, Mycobacterium
HPTSG

SEQ ID NO: 1163843 - protein, 6 aa, Mycobacterium
HPTSGT

SEQ ID NO: 1163844 - protein, 6 aa, Mycobacterium
HPTTVG

SEQ ID NO: 1163845 - protein, 15 aa, Mycobacterium
HPVADSVGRADNEGM

SEQ ID NO: 1163846 - protein, 5 aa, Mycobacterium
HPWPA

SEQ ID NO: 1163847 - protein, 6 aa, Mycobacterium
HPWRRA

SEQ ID NO: 1163848 - protein, 5 aa, Mycobacterium
HQGAA

SEQ ID NO: 1163849 - protein, 6 aa, Mycobacterium
HQGERF

SEQ ID NO: 1163850 - protein, 5 aa, Mycobacterium
HQGKR

SEQ ID NO: 1163851 - protein, 10 aa, Mycobacterium
HQGPVPELPA

SEQ ID NO: 1163852 - protein, 9 aa, Mycobacterium
HQLSGGQRQ

SEQ ID NO: 1163853 - protein, 11 aa, Mycobacterium
HQNTARKRTWS

SEQ ID NO: 1163854 - protein, 7 aa, Mycobacterium
HQPDVRG

SEQ ID NO: 1163855 - protein, 9 aa, Mycobacterium
HQQAPGPTL

SEQ ID NO: 1163856 - protein, 9 aa, Mycobacterium
HQQGGEDGA

SEQ ID NO: 1163857 - protein, 9 aa, Mycobacterium
HQQPDGSVR

SEQ ID NO: 1163858 - protein, 7 aa, Mycobacterium
HQQQRTA

SEQ ID NO: 1163859 - protein, 8 aa, Mycobacterium
HQSADGEA

SEQ ID NO: 1163860 - protein, 8 aa, Mycobacterium
HQTGTARV

SEQ ID NO: 1163861 - protein, 10 aa, Mycobacterium
HRADRAEAEM

SEQ ID NO: 1163862 - protein, 9 aa, Mycobacterium
HRAGAGAGV

SEQ ID NO: 1163863 - protein, 5 aa, Mycobacterium
HRAGD

SEQ ID NO: 1163864 - protein, 5 aa, Mycobacterium
HRAQP

SEQ ID NO: 1163865 - protein, 11 aa, Mycobacterium
HRARGRNQDEL

SEQ ID NO: 1163866 - protein, 18 aa, Mycobacterium
HRASRRLAEDRGSFPAFP

SEQ ID NO: 1163867 - protein, 10 aa, Mycobacterium
HRASSDRDGR

SEQ ID NO: 1163868 - protein, 6 aa, Mycobacterium
HRDDEQ

SEQ ID NO: 1163869 - protein, 15 aa, Mycobacterium
HRDDTAQRRTARART

SEQ ID NO: 1163870 - protein, 9 aa, Mycobacterium
HRDEANPAL

SEQ ID NO: 1163871 - protein, 7 aa, Mycobacterium
HRDEPTE

SEQ ID NO: 1163872 - protein, 18 aa, Mycobacterium
HRDGAPDLYPEKHRDEID

SEQ ID NO: 1163873 - protein, 7 aa, Mycobacterium
HRDPDAF

SEQ ID NO: 1163874 - protein, 7 aa, Mycobacterium
HREDGSS

SEQ ID NO: 1163875 - protein, 5 aa, Mycobacterium
HREER

SEQ ID NO: 1163876 - protein, 13 aa, Mycobacterium
HREPGQEEMSPEG

SEQ ID NO: 1163877 - protein, 5 aa, Mycobacterium
HRGAE

SEQ ID NO: 1163878 - protein, 13 aa, Mycobacterium
HRGDEPGDQLAAG

SEQ ID NO: 1163879 - protein, 5 aa, Mycobacterium
HRGEM

SEQ ID NO: 1163880 - protein, 5 aa, Mycobacterium
HRGGG

SEQ ID NO: 1163881 - protein, 11 aa, Mycobacterium
HRGGPLADGLA

SEQ ID NO: 1163882 - protein, 13 aa, Mycobacterium
HRGGRGETTEESL

SEQ ID NO: 1163883 - protein, 9 aa, Mycobacterium
HRGSGAPEG

SEQ ID NO: 1163884 - protein, 10 aa, Mycobacterium
HRHGGYNPAG

SEQ ID NO: 1163885 - protein, 19 aa, Mycobacterium
HRKGPNNSVTAGPNDVGSP

SEQ ID NO: 1163886 - protein, 4 aa, Mycobacterium
HRKR

SEQ ID NO: 1163887 - protein, 9 aa, Mycobacterium
HRNGPTKTI

SEQ ID NO: 1163888 - protein, 7 aa, Mycobacterium
HRNTGAR

SEQ ID NO: 1163889 - protein, 8 aa, Mycobacterium
HRPDATAG

SEQ ID NO: 1163890 - protein, 6 aa, Mycobacterium
HRPDGA

SEQ ID NO: 1163891 - protein, 5 aa, Mycobacterium
HRPGR

SEQ ID NO: 1163892 - protein, 8 aa, Mycobacterium
HRPGTASS

SEQ ID NO: 1163893 - protein, 9 aa, Mycobacterium
HRPGTDPRA

SEQ ID NO: 1163894 - protein, 6 aa, Mycobacterium
HRPLSG

SEQ ID NO: 1163895 - protein, 7 aa, Mycobacterium
HRPPGLR

SEQ ID NO: 1163896 - protein, 10 aa, Mycobacterium
HRQRPATAQG

SEQ ID NO: 1163897 - protein, 7 aa, Mycobacterium
HRQTELP

SEQ ID NO: 1163898 - protein, 5 aa, Mycobacterium
HRREP

SEQ ID NO: 1163899 - protein, 5 aa, Mycobacterium
HRRRG

SEQ ID NO: 1163900 - protein, 6 aa, Mycobacterium
HRRTGV

SEQ ID NO: 1163901 - protein, 9 aa, Mycobacterium
HRSESLDDL

SEQ ID NO: 1163902 - protein, 5 aa, Mycobacterium
HRSPE

SEQ ID NO: 1163903 - protein, 9 aa, Mycobacterium
HRSPEPGHT

SEQ ID NO: 1163904 - protein, 5 aa, Mycobacterium
HRSTN

SEQ ID NO: 1163905 - protein, 8 aa, Mycobacterium
HRTATRER

SEQ ID NO: 1163906 - protein, 10 aa, Mycobacterium
HRTGTDGDVT

SEQ ID NO: 1163907 - protein, 5 aa, Mycobacterium
HRTPG

SEQ ID NO: 1163908 - protein, 8 aa, Mycobacterium
HRTSTSAP

SEQ ID NO: 1163909 - protein, 9 aa, Mycobacterium
HRVSGPKGD

SEQ ID NO: 1163910 - protein, 11 aa, Mycobacterium
HRVTGQGAAGD

SEQ ID NO: 1163911 - protein, 4 aa, Mycobacterium
HSAG

SEQ ID NO: 1163912 - protein, 5 aa, Mycobacterium
HSAGA

SEQ ID NO: 1163913 - protein, 6 aa, Mycobacterium
HSATAA

SEQ ID NO: 1163914 - protein, 8 aa, Mycobacterium
HSATSSLL

SEQ ID NO: 1163915 - protein, 9 aa, Mycobacterium
HSDAGSQYT

SEQ ID NO: 1163916 - protein, 6 aa, Mycobacterium
HSDDQH

SEQ ID NO: 1163917 - protein, 10 aa, Mycobacterium
HSDRPSDTMT

SEQ ID NO: 1163918 - protein, 12 aa, Mycobacterium
HSDTGRDFTPVQ

SEQ ID NO: 1163919 - protein, 9 aa, Mycobacterium
HSEDGSPPY

SEQ ID NO: 1163920 - protein, 4 aa, Mycobacterium
HSEN

SEQ ID NO: 1163921 - protein, 11 aa, Mycobacterium
HSEPEDEAARR

SEQ ID NO: 1163922 - protein, 7 aa, Mycobacterium
HSEPGDR

SEQ ID NO: 1163923 - protein, 17 aa, Mycobacterium
HSESEGVEPSRRVVVLA

SEQ ID NO: 1163924 - protein, 12 aa, Mycobacterium
HSETGIDAAGAS

SEQ ID NO: 1163925 - protein, 9 aa, Mycobacterium
HSGAADAVA

SEQ ID NO: 1163926 - protein, 7 aa, Mycobacterium
HSGAATA

SEQ ID NO: 1163927 - protein, 14 aa, Mycobacterium
HSGDHSAEADDFTD

SEQ ID NO: 1163928 - protein, 10 aa, Mycobacterium
HSGDPAYTGL

SEQ ID NO: 1163929 - protein, 7 aa, Mycobacterium
HSGDPSI

SEQ ID NO: 1163930 - protein, 8 aa, Mycobacterium
HSGDTTDL

SEQ ID NO: 1163931 - protein, 5 aa, Mycobacterium
HSGFA

SEQ ID NO: 1163932 - protein, 8 aa, Mycobacterium
HSGGGDPV

SEQ ID NO: 1163933 - protein, 7 aa, Mycobacterium
HSGGGFD

SEQ ID NO: 1163934 - protein, 9 aa, Mycobacterium
HSGKAEVKG

SEQ ID NO: 1163935 - protein, 8 aa, Mycobacterium
HSGPQSSV

SEQ ID NO: 1163936 - protein, 7 aa, Mycobacterium
HSGPVTG

SEQ ID NO: 1163937 - protein, 9 aa, Mycobacterium
HSGRDDLNS

SEQ ID NO: 1163938 - protein, 15 aa, Mycobacterium
HSGTAPTDLANSNTG

SEQ ID NO: 1163939 - protein, 8 aa, Mycobacterium
HSGYPGGL

SEQ ID NO: 1163940 - protein, 10 aa, Mycobacterium
HSHRRTSRRW

SEQ ID NO: 1163941 - protein, 7 aa, Mycobacterium
HSKARDA

SEQ ID NO: 1163942 - protein, 5 aa, Mycobacterium
HSNVP

SEQ ID NO: 1163943 - protein, 8 aa, Mycobacterium
HSPARSGR

SEQ ID NO: 1163944 - protein, 8 aa, Mycobacterium
HSPEHPPG

SEQ ID NO: 1163945 - protein, 6 aa, Mycobacterium
HSPEPR

SEQ ID NO: 1163946 - protein, 7 aa, Mycobacterium
HSPGRAV

SEQ ID NO: 1163947 - protein, 13 aa, Mycobacterium
HSPRAASDSVTAR

SEQ ID NO: 1163948 - protein, 5 aa, Mycobacterium
HSPTA

SEQ ID NO: 1163949 - protein, 15 aa, Mycobacterium
HSRGQERSDPGDKRG

SEQ ID NO: 1163950 - protein, 6 aa, Mycobacterium
HSRHAP

SEQ ID NO: 1163951 - protein, 4 aa, Mycobacterium
HSRT

SEQ ID NO: 1163952 - protein, 8 aa, Mycobacterium
HSRTAESQ

SEQ ID NO: 1163953 - protein, 6 aa, Mycobacterium
HSSAGA

SEQ ID NO: 1163954 - protein, 14 aa, Mycobacterium
HSTAPGAQQYSDDE

SEQ ID NO: 1163955 - protein, 8 aa, Mycobacterium
HSTGGGEV

SEQ ID NO: 1163956 - protein, 5 aa, Mycobacterium
HSTPE

SEQ ID NO: 1163957 - protein, 8 aa, Mycobacterium
HSTPEDLA

SEQ ID NO: 1163958 - protein, 10 aa, Mycobacterium
HSVDDPEPKY

SEQ ID NO: 1163959 - protein, 10 aa, Mycobacterium
HSYRGPGPRN

SEQ ID NO: 1163960 - protein, 10 aa, Mycobacterium
HTADGGSDTV

SEQ ID NO: 1163961 - protein, 8 aa, Mycobacterium
HTAPGGRT

SEQ ID NO: 1163962 - protein, 11 aa, Mycobacterium
HTARTAARSAG

SEQ ID NO: 1163963 - protein, 6 aa, Mycobacterium
HTATEG

SEQ ID NO: 1163964 - protein, 8 aa, Mycobacterium
HTDDADIA

SEQ ID NO: 1163965 - protein, 13 aa, Mycobacterium
HTDDYSRGGRTDI

SEQ ID NO: 1163966 - protein, 8 aa, Mycobacterium
HTDLTGRP

SEQ ID NO: 1163967 - protein, 7 aa, Mycobacterium
HTDPDAR

SEQ ID NO: 1163968 - protein, 5 aa, Mycobacterium
HTDPW

SEQ ID NO: 1163969 - protein, 13 aa, Mycobacterium
HTDRSDASGTGYF

SEQ ID NO: 1163970 - protein, 4 aa, Mycobacterium
HTDT

SEQ ID NO: 1163971 - protein, 5 aa, Mycobacterium
HTEDG

SEQ ID NO: 1163972 - protein, 8 aa, Mycobacterium
HTEGNPRD

SEQ ID NO: 1163973 - protein, 7 aa, Mycobacterium
HTEYDTG

SEQ ID NO: 1163974 - protein, 13 aa, Mycobacterium
HTGEVTSYGPPAS

SEQ ID NO: 1163975 - protein, 15 aa, Mycobacterium
HTGGEKRVSASGGTL

SEQ ID NO: 1163976 - protein, 17 aa, Mycobacterium
HTGKDPETIRKDTDRDK

SEQ ID NO: 1163977 - protein, 7 aa, Mycobacterium
HTGNDDT

SEQ ID NO: 1163978 - protein, 13 aa, Mycobacterium
HTGQSTAVVPPEN

SEQ ID NO: 1163979 - protein, 8 aa, Mycobacterium
HTGRAVDA

SEQ ID NO: 1163980 - protein, 10 aa, Mycobacterium
HTGRGRPAKR

SEQ ID NO: 1163981 - protein, 9 aa, Mycobacterium
HTGSTNPID

SEQ ID NO: 1163982 - protein, 24 aa, Mycobacterium
HTGTRRTGPGGSGTRLRPGNRPVN

SEQ ID NO: 1163983 - protein, 9 aa, Mycobacterium
HTKKKESEI

SEQ ID NO: 1163984 - protein, 12 aa, Mycobacterium
HTMPRATASTDA

SEQ ID NO: 1163985 - protein, 13 aa, Mycobacterium
HTPERTAERTGIP

SEQ ID NO: 1163986 - protein, 8 aa, Mycobacterium
HTPPAGPA

SEQ ID NO: 1163987 - protein, 8 aa, Mycobacterium
HTQNAQSR

SEQ ID NO: 1163988 - protein, 10 aa, Mycobacterium
HTRDDGGNTV

SEQ ID NO: 1163989 - protein, 6 aa, Mycobacterium
HTRTAE

SEQ ID NO: 1163990 - protein, 9 aa, Mycobacterium
HTSRDDTGC

SEQ ID NO: 1163991 - protein, 4 aa, Mycobacterium
HTST

SEQ ID NO: 1163992 - protein, 10 aa, Mycobacterium
HTTEPPPSQL

SEQ ID NO: 1163993 - protein, 6 aa, Mycobacterium
HTTGDG

SEQ ID NO: 1163994 - protein, 5 aa, Mycobacterium
HTTRV

SEQ ID NO: 1163995 - protein, 4 aa, Mycobacterium
HTTV

SEQ ID NO: 1163996 - protein, 11 aa, Mycobacterium
HVDADTEETAS

SEQ ID NO: 1163997 - protein, 16 aa, Mycobacterium
HVGDARATEVSSDGQL

SEQ ID NO: 1163998 - protein, 5 aa, Mycobacterium
HVGDD

SEQ ID NO: 1163999 - protein, 11 aa, Mycobacterium
HVGPGQSVTTA

SEQ ID NO: 1164000 - protein, 5 aa, Mycobacterium
HVGSS

SEQ ID NO: 1164001 - protein, 10 aa, Mycobacterium
HVPPSESPGM

SEQ ID NO: 1164002 - protein, 8 aa, Mycobacterium
HVQDERGH

SEQ ID NO: 1164003 - protein, 11 aa, Mycobacterium
HVSETAKRLPG

SEQ ID NO: 1164004 - protein, 8 aa, Mycobacterium
HVSGGTRR

SEQ ID NO: 1164005 - protein, 5 aa, Mycobacterium
HYAPP

SEQ ID NO: 1164006 - protein, 5 aa, Mycobacterium
HYPGA

SEQ ID NO: 1164007 - protein, 8 aa, Mycobacterium
HYQGDDSD

SEQ ID NO: 1164008 - protein, 11 aa, Mycobacterium
HYSEGAPAGWE

SEQ ID NO: 1164009 - protein, 9 aa, Mycobacterium
HYSPDSLPA

SEQ ID NO: 1164010 - protein, 5 aa, Mycobacterium
HYTGE

SEQ ID NO: 1164011 - protein, 8 aa, Mycobacterium
HYTPDSRR

SEQ ID NO: 1164012 - protein, 7 aa, Mycobacterium
HYTSGGW

SEQ ID NO: 1164013 - protein, 8 aa, Mycobacterium
IAAEEGAA

SEQ ID NO: 1164014 - protein, 6 aa, Mycobacterium
IAAGGA

SEQ ID NO: 1164015 - protein, 18 aa, Mycobacterium
IAAKSDLERQENKTKTGA

SEQ ID NO: 1164016 - protein, 5 aa, Mycobacterium
IAANG

SEQ ID NO: 1164017 - protein, 8 aa, Mycobacterium
IAASPDAL

SEQ ID NO: 1164018 - protein, 10 aa, Mycobacterium
IAATDEENYN

SEQ ID NO: 1164019 - protein, 8 aa, Mycobacterium
IADDPTQL

SEQ ID NO: 1164020 - protein, 7 aa, Mycobacterium
IADGSLR

SEQ ID NO: 1164021 - protein, 6 aa, Mycobacterium
IADGTL

SEQ ID NO: 1164022 - protein, 8 aa, Mycobacterium
IADPATAD

SEQ ID NO: 1164023 - protein, 10 aa, Mycobacterium
IADPKGNAES

SEQ ID NO: 1164024 - protein, 5 aa, Mycobacterium
IADTG

SEQ ID NO: 1164025 - protein, 10 aa, Mycobacterium
IAERGYRDTT

SEQ ID NO: 1164026 - protein, 5 aa, Mycobacterium
IAERR

SEQ ID NO: 1164027 - protein, 16 aa, Mycobacterium
IAETKKSDLNANDIDQ

SEQ ID NO: 1164028 - protein, 7 aa, Mycobacterium
IAEYDPE

SEQ ID NO: 1164029 - protein, 6 aa, Mycobacterium
IAGGAQ

SEQ ID NO: 1164030 - protein, 8 aa, Mycobacterium
IAGGTSEI

SEQ ID NO: 1164031 - protein, 14 aa, Mycobacterium
IAGNRGQTNYATTK

SEQ ID NO: 1164032 - protein, 11 aa, Mycobacterium
IAGPDGELSPV

SEQ ID NO: 1164033 - protein, 12 aa, Mycobacterium
IAGPGGGTELKP

SEQ ID NO: 1164034 - protein, 5 aa, Mycobacterium
IAGQN

SEQ ID NO: 1164035 - protein, 4 aa, Mycobacterium
IAKE

SEQ ID NO: 1164036 - protein, 4 aa, Mycobacterium
IAPG

SEQ ID NO: 1164037 - protein, 9 aa, Mycobacterium
IAPGQEADW

SEQ ID NO: 1164038 - protein, 5 aa, Mycobacterium
IAPRG

SEQ ID NO: 1164039 - protein, 4 aa, Mycobacterium
IAPY

SEQ ID NO: 1164040 - protein, 6 aa, Mycobacterium
IAQAAQ

SEQ ID NO: 1164041 - protein, 16 aa, Mycobacterium
IAQAPRAPHAPQGAYP

SEQ ID NO: 1164042 - protein, 11 aa, Mycobacterium
IAQKGTPEELY

SEQ ID NO: 1164043 - protein, 13 aa, Mycobacterium
IAQNAADAEAMGA

SEQ ID NO: 1164044 - protein, 6 aa, Mycobacterium
IAQPRE

SEQ ID NO: 1164045 - protein, 5 aa, Mycobacterium
IARPE

SEQ ID NO: 1164046 - protein, 6 aa, Mycobacterium
IARTEA

SEQ ID NO: 1164047 - protein, 15 aa, Mycobacterium
IASAGPIDLPTGTVS

SEQ ID NO: 1164048 - protein, 16 aa, Mycobacterium
IASAPKGEEAKRRGIA

SEQ ID NO: 1164049 - protein, 8 aa, Mycobacterium
IASDTAPL

SEQ ID NO: 1164050 - protein, 7 aa, Mycobacterium
IASEQAA

SEQ ID NO: 1164051 - protein, 9 aa, Mycobacterium
IASGTERRT

SEQ ID NO: 1164052 - protein, 4 aa, Mycobacterium
IASY

SEQ ID NO: 1164053 - protein, 6 aa, Mycobacterium
IATPTR

SEQ ID NO: 1164054 - protein, 9 aa, Mycobacterium
IATSGAPGV

SEQ ID NO: 1164055 - protein, 8 aa, Mycobacterium
IATTASRR

SEQ ID NO: 1164056 - protein, 8 aa, Mycobacterium
IATTGERI

SEQ ID NO: 1164057 - protein, 6 aa, Mycobacterium
IAVTEA

SEQ ID NO: 1164058 - protein, 5 aa, Mycobacterium
IDAAQ

SEQ ID NO: 1164059 - protein, 6 aa, Mycobacterium
IDAATA

SEQ ID NO: 1164060 - protein, 10 aa, Mycobacterium
IDAEDDVSAE

SEQ ID NO: 1164061 - protein, 11 aa, Mycobacterium
IDAEPADGAGE

SEQ ID NO: 1164062 - protein, 11 aa, Mycobacterium
IDAGAERDRAE

SEQ ID NO: 1164063 - protein, 8 aa, Mycobacterium
IDAGPTNN

SEQ ID NO: 1164064 - protein, 7 aa, Mycobacterium
IDAPDRA

SEQ ID NO: 1164065 - protein, 7 aa, Mycobacterium
IDAPPGS

SEQ ID NO: 1164066 - protein, 7 aa, Mycobacterium
IDARNEE

SEQ ID NO: 1164067 - protein, 9 aa, Mycobacterium
IDASASSQF

SEQ ID NO: 1164068 - protein, 9 aa, Mycobacterium
IDATNGRDL

SEQ ID NO: 1164069 - protein, 8 aa, Mycobacterium
IDDASGGH

SEQ ID NO: 1164070 - protein, 9 aa, Mycobacterium
IDDATLATY

SEQ ID NO: 1164071 - protein, 11 aa, Mycobacterium
IDDDGRVPPRT

SEQ ID NO: 1164072 - protein, 5 aa, Mycobacterium
IDDDP

SEQ ID NO: 1164073 - protein, 6 aa, Mycobacterium
IDDDRV

SEQ ID NO: 1164074 - protein, 5 aa, Mycobacterium
IDDPA

SEQ ID NO: 1164075 - protein, 5 aa, Mycobacterium
IDDPE

SEQ ID NO: 1164076 - protein, 13 aa, Mycobacterium
IDDSGKLTRKGAD

SEQ ID NO: 1164077 - protein, 6 aa, Mycobacterium
IDDSPV

SEQ ID NO: 1164078 - protein, 17 aa, Mycobacterium
IDEGAKPGKSTGESAEL

SEQ ID NO: 1164079 - protein, 6 aa, Mycobacterium
IDEGAT

SEQ ID NO: 1164080 - protein, 7 aa, Mycobacterium
IDEQPEA

SEQ ID NO: 1164081 - protein, 17 aa, Mycobacterium
IDESDKPQKEEQGPPPV

SEQ ID NO: 1164082 - protein, 6 aa, Mycobacterium
IDESGS

SEQ ID NO: 1164083 - protein, 38 aa, Mycobacterium
IDETAEGTQEPSTPELSDSESGNPEGSDSESDPDTFPR

SEQ ID NO: 1164084 - protein, 10 aa, Mycobacterium
IDETERRRAK

SEQ ID NO: 1164085 - protein, 17 aa, Mycobacterium
IDETGTHTAEFTTPTGA

SEQ ID NO: 1164086 - protein, 15 aa, Mycobacterium
IDGDGGGDTSQRAAT

SEQ ID NO: 1164087 - protein, 9 aa, Mycobacterium
IDGEKLSDD

SEQ ID NO: 1164088 - protein, 8 aa, Mycobacterium
IDGEKLTD

SEQ ID NO: 1164089 - protein, 6 aa, Mycobacterium
IDGEYS

SEQ ID NO: 1164090 - protein, 7 aa, Mycobacterium
IDGGEDL

SEQ ID NO: 1164091 - protein, 6 aa, Mycobacterium
IDGGPL

SEQ ID NO: 1164092 - protein, 9 aa, Mycobacterium
IDGPASRDV

SEQ ID NO: 1164093 - protein, 9 aa, Mycobacterium
IDGPKDSQV

SEQ ID NO: 1164094 - protein, 8 aa, Mycobacterium
IDGPTIGS

SEQ ID NO: 1164095 - protein, 8 aa, Mycobacterium
IDGSDDRM

SEQ ID NO: 1164096 - protein, 4 aa, Mycobacterium
IDGT

SEQ ID NO: 1164097 - protein, 6 aa, Mycobacterium
IDGYPE

SEQ ID NO: 1164098 - protein, 12 aa, Mycobacterium
IDKASQARPGQT

SEQ ID NO: 1164099 - protein, 14 aa, Mycobacterium
IDKEGADPQKIRGQ

SEQ ID NO: 1164100 - protein, 4 aa, Mycobacterium
IDKG

SEQ ID NO: 1164101 - protein, 9 aa, Mycobacterium
IDKTPQGTQ

SEQ ID NO: 1164102 - protein, 5 aa, Mycobacterium
IDKTS

SEQ ID NO: 1164103 - protein, 8 aa, Mycobacterium
IDLPGEVA

SEQ ID NO: 1164104 - protein, 10 aa, Mycobacterium
IDPAHTRSKL

SEQ ID NO: 1164105 - protein, 5 aa, Mycobacterium
IDPAQ

SEQ ID NO: 1164106 - protein, 6 aa, Mycobacterium
IDPDGP

SEQ ID NO: 1164107 - protein, 10 aa, Mycobacterium
IDPDLTNAGK

SEQ ID NO: 1164108 - protein, 6 aa, Mycobacterium
IDPDTA

SEQ ID NO: 1164109 - protein, 4 aa, Mycobacterium
IDPE

SEQ ID NO: 1164110 - protein, 14 aa, Mycobacterium
IDPGRTRHDETGIS

SEQ ID NO: 1164111 - protein, 4 aa, Mycobacterium
IDPL

SEQ ID NO: 1164112 - protein, 5 aa, Mycobacterium
IDPPN

SEQ ID NO: 1164113 - protein, 9 aa, Mycobacterium
IDPQEQIDS

SEQ ID NO: 1164114 - protein, 7 aa, Mycobacterium
IDPQPTV

SEQ ID NO: 1164115 - protein, 6 aa, Mycobacterium
IDPRDA

SEQ ID NO: 1164116 - protein, 9 aa, Mycobacterium
IDPSDGDAV

SEQ ID NO: 1164117 - protein, 9 aa, Mycobacterium
IDPSRRGET

SEQ ID NO: 1164118 - protein, 7 aa, Mycobacterium
IDQATEE

SEQ ID NO: 1164119 - protein, 9 aa, Mycobacterium
IDQPAESRV

SEQ ID NO: 1164120 - protein, 11 aa, Mycobacterium
IDRAPAPHDAA

SEQ ID NO: 1164121 - protein, 5 aa, Mycobacterium
IDRDG

SEQ ID NO: 1164122 - protein, 4 aa, Mycobacterium
IDSG

SEQ ID NO: 1164123 - protein, 17 aa, Mycobacterium
IDSGGNSGNEDAPAIAD

SEQ ID NO: 1164124 - protein, 7 aa, Mycobacterium
IDSQARS

SEQ ID NO: 1164125 - protein, 4 aa, Mycobacterium
IDST

SEQ ID NO: 1164126 - protein, 4 aa, Mycobacterium
IDTA

SEQ ID NO: 1164127 - protein, 9 aa, Mycobacterium
IDTEDGSLR

SEQ ID NO: 1164128 - protein, 11 aa, Mycobacterium
IDTERQREQDH

SEQ ID NO: 1164129 - protein, 6 aa, Mycobacterium
IDTGER

SEQ ID NO: 1164130 - protein, 9 aa, Mycobacterium
IDTQAGAKD

SEQ ID NO: 1164131 - protein, 6 aa, Mycobacterium
IDTQTA

SEQ ID NO: 1164132 - protein, 11 aa, Mycobacterium
IDTRSGGRQSP

SEQ ID NO: 1164133 - protein, 10 aa, Mycobacterium
IDTSAYPPMD

SEQ ID NO: 1164134 - protein, 7 aa, Mycobacterium
IDTSRSR

SEQ ID NO: 1164135 - protein, 7 aa, Mycobacterium
IDTTRSI

SEQ ID NO: 1164136 - protein, 6 aa, Mycobacterium
IDTVPT

SEQ ID NO: 1164137 - protein, 7 aa, Mycobacterium
IDYGPSG

SEQ ID NO: 1164138 - protein, 9 aa, Mycobacterium
IEAEPGGAH

SEQ ID NO: 1164139 - protein, 6 aa, Mycobacterium
IEAGDG

SEQ ID NO: 1164140 - protein, 8 aa, Mycobacterium
IEAGEASD

SEQ ID NO: 1164141 - protein, 7 aa, Mycobacterium
IEAGETA

SEQ ID NO: 1164142 - protein, 9 aa, Mycobacterium
IEATRDAQD

SEQ ID NO: 1164143 - protein, 16 aa, Mycobacterium
IECSTGSACTAGVAQP

SEQ ID NO: 1164144 - protein, 4 aa, Mycobacterium
IEDG

SEQ ID NO: 1164145 - protein, 7 aa, Mycobacterium
IEDGKTD

SEQ ID NO: 1164146 - protein, 4 aa, Mycobacterium
IEDP

SEQ ID NO: 1164147 - protein, 9 aa, Mycobacterium
IEDPSASPL

SEQ ID NO: 1164148 - protein, 7 aa, Mycobacterium
IEENGRL

SEQ ID NO: 1164149 - protein, 11 aa, Mycobacterium
IEGANGGYPRA

SEQ ID NO: 1164150 - protein, 7 aa, Mycobacterium
IEGNGDV

SEQ ID NO: 1164151 - protein, 4 aa, Mycobacterium
IEGR

SEQ ID NO: 1164152 - protein, 8 aa, Mycobacterium
IEKGAYPE

SEQ ID NO: 1164153 - protein, 17 aa, Mycobacterium
IEKRTTRPRPDATQEAT

SEQ ID NO: 1164154 - protein, 5 aa, Mycobacterium
IENDA

SEQ ID NO: 1164155 - protein, 6 aa, Mycobacterium
IENETG

SEQ ID NO: 1164156 - protein, 15 aa, Mycobacterium
IEPAPKRKPATRKRS

SEQ ID NO: 1164157 - protein, 9 aa, Mycobacterium
IEPDPRNGA

SEQ ID NO: 1164158 - protein, 4 aa, Mycobacterium
IEPE

SEQ ID NO: 1164159 - protein, 4 aa, Mycobacterium
IEPG

SEQ ID NO: 1164160 - protein, 6 aa, Mycobacterium
IEPGQV

SEQ ID NO: 1164161 - protein, 5 aa, Mycobacterium
IEPPR

SEQ ID NO: 1164162 - protein, 7 aa, Mycobacterium
IEPRSVS

SEQ ID NO: 1164163 - protein, 4 aa, Mycobacterium
IEQR

SEQ ID NO: 1164164 - protein, 10 aa, Mycobacterium
IEQTPRPRAE

SEQ ID NO: 1164165 - protein, 15 aa, Mycobacterium
IEQVGSPTEVYDTPA

SEQ ID NO: 1164166 - protein, 9 aa, Mycobacterium
IERAGGKGV

SEQ ID NO: 1164167 - protein, 9 aa, Mycobacterium
IEREDGRME

SEQ ID NO: 1164168 - protein, 8 aa, Mycobacterium
IESEREDL

SEQ ID NO: 1164169 - protein, 5 aa, Mycobacterium
IESGR

SEQ ID NO: 1164170 - protein, 12 aa, Mycobacterium
IESNNSPLPIPD

SEQ ID NO: 1164171 - protein, 7 aa, Mycobacterium
IESRDAR

SEQ ID NO: 1164172 - protein, 7 aa, Mycobacterium
IESTPDV

SEQ ID NO: 1164173 - protein, 6 aa, Mycobacterium
IESTPV

SEQ ID NO: 1164174 - protein, 5 aa, Mycobacterium
IETRY

SEQ ID NO: 1164175 - protein, 21 aa, Mycobacterium
IEVTDTADGPQWSLLDGDSKD

SEQ ID NO: 1164176 - protein, 24 aa, Mycobacterium
IFSTSGDRAVADAAERAKVTASRN

SEQ ID NO: 1164177 - protein, 8 aa, Mycobacterium
IGADEGLG

SEQ ID NO: 1164178 - protein, 5 aa, Mycobacterium
IGAED

SEQ ID NO: 1164179 - protein, 8 aa, Mycobacterium
IGAEDTVA

SEQ ID NO: 1164180 - protein, 10 aa, Mycobacterium
IGAEEAERSG

SEQ ID NO: 1164181 - protein, 7 aa, Mycobacterium
IGAEESE

SEQ ID NO: 1164182 - protein, 6 aa, Mycobacterium
IGAGAA

SEQ ID NO: 1164183 - protein, 8 aa, Mycobacterium
IGAGGFDD

SEQ ID NO: 1164184 - protein, 8 aa, Mycobacterium
IGAGGGSI

SEQ ID NO: 1164185 - protein, 6 aa, Mycobacterium
IGAPGA

SEQ ID NO: 1164186 - protein, 7 aa, Mycobacterium
IGAPGEA

SEQ ID NO: 1164187 - protein, 6 aa, Mycobacterium
IGASYG

SEQ ID NO: 1164188 - protein, 4 aa, Mycobacterium
IGDD

SEQ ID NO: 1164189 - protein, 6 aa, Mycobacterium
IGDGVA

SEQ ID NO: 1164190 - protein, 7 aa, Mycobacterium
IGDSAEH

SEQ ID NO: 1164191 - protein, 7 aa, Mycobacterium
IGEDADG

SEQ ID NO: 1164192 - protein, 6 aa, Mycobacterium
IGEDLD

SEQ ID NO: 1164193 - protein, 9 aa, Mycobacterium
IGEDSSSAS

SEQ ID NO: 1164194 - protein, 7 aa, Mycobacterium
IGEEAGD

SEQ ID NO: 1164195 - protein, 4 aa, Mycobacterium
IGEG

SEQ ID NO: 1164196 - protein, 5 aa, Mycobacterium
IGEIR

SEQ ID NO: 1164197 - protein, 6 aa, Mycobacterium
IGEPGG

SEQ ID NO: 1164198 - protein, 4 aa, Mycobacterium
IGES

SEQ ID NO: 1164199 - protein, 6 aa, Mycobacterium
IGGDDA

SEQ ID NO: 1164200 - protein, 10 aa, Mycobacterium
IGGDDADQLR

SEQ ID NO: 1164201 - protein, 10 aa, Mycobacterium
IGGEPLPGEV

SEQ ID NO: 1164202 - protein, 5 aa, Mycobacterium
IGGGF

SEQ ID NO: 1164203 - protein, 12 aa, Mycobacterium
IGGGSGAPTGFS

SEQ ID NO: 1164204 - protein, 8 aa, Mycobacterium
IGGGTDQI

SEQ ID NO: 1164205 - protein, 8 aa, Mycobacterium
IGGNGPQK

SEQ ID NO: 1164206 - protein, 7 aa, Mycobacterium
IGGPAQV

SEQ ID NO: 1164207 - protein, 5 aa, Mycobacterium
IGGPL

SEQ ID NO: 1164208 - protein, 8 aa, Mycobacterium
IGGPPEQV

SEQ ID NO: 1164209 - protein, 6 aa, Mycobacterium
IGGQES

SEQ ID NO: 1164210 - protein, 10 aa, Mycobacterium
IGGSGEQYSG

SEQ ID NO: 1164211 - protein, 6 aa, Mycobacterium
IGGSSS

SEQ ID NO: 1164212 - protein, 10 aa, Mycobacterium
IGGSTDESGV

SEQ ID NO: 1164213 - protein, 5 aa, Mycobacterium
IGGTG

SEQ ID NO: 1164214 - protein, 8 aa, Mycobacterium
IGGTPEGI

SEQ ID NO: 1164215 - protein, 6 aa, Mycobacterium
IGKDKP

SEQ ID NO: 1164216 - protein, 4 aa, Mycobacterium
IGKG

SEQ ID NO: 1164217 - protein, 6 aa, Mycobacterium
IGKNGD

SEQ ID NO: 1164218 - protein, 9 aa, Mycobacterium
IGLGGDPRR

SEQ ID NO: 1164219 - protein, 6 aa, Mycobacterium
IGLPDE

SEQ ID NO: 1164220 - protein, 12 aa, Mycobacterium
IGNDLSTPRPEY

SEQ ID NO: 1164221 - protein, 21 aa, Mycobacterium
IGNRNSKADTSSGRRNKYRTP

SEQ ID NO: 1164222 - protein, 7 aa, Mycobacterium
IGNTTAA

SEQ ID NO: 1164223 - protein, 5 aa, Mycobacterium
IGPAS

SEQ ID NO: 1164224 - protein, 95 aa, Mycobacterium
IGPDGVATTTVSQPPPPPPTTTQQTTTTTQPTTTTTTTTQQTTTTTQPTTTTTRPTTTQPPTTTQPPPTTTAAPPPTTVDPPDPPVTTVPVPDDG

SEQ ID NO: 1164225 - protein, 6 aa, Mycobacterium
IGPDSD

SEQ ID NO: 1164226 - protein, 9 aa, Mycobacterium
IGPDSPVRS

SEQ ID NO: 1164227 - protein, 9 aa, Mycobacterium
IGPDTEPGF

SEQ ID NO: 1164228 - protein, 23 aa, Mycobacterium
IGPDTPPANGRSAYAKTKGYADR

SEQ ID NO: 1164229 - protein, 4 aa, Mycobacterium
IGPE

SEQ ID NO: 1164230 - protein, 5 aa, Mycobacterium
IGPED

SEQ ID NO: 1164231 - protein, 5 aa, Mycobacterium
IGPEG

SEQ ID NO: 1164232 - protein, 16 aa, Mycobacterium
IGPEQAAAEASEAADD

SEQ ID NO: 1164233 - protein, 5 aa, Mycobacterium
IGPGD

SEQ ID NO: 1164234 - protein, 5 aa, Mycobacterium
IGPGE

SEQ ID NO: 1164235 - protein, 10 aa, Mycobacterium
IGPGGSDLEV

SEQ ID NO: 1164236 - protein, 7 aa, Mycobacterium
IGPGKGI

SEQ ID NO: 1164237 - protein, 7 aa, Mycobacterium
IGPGSSI

SEQ ID NO: 1164238 - protein, 8 aa, Mycobacterium
IGPHDADE

SEQ ID NO: 1164239 - protein, 13 aa, Mycobacterium
IGPMTSARTGIPT

SEQ ID NO: 1164240 - protein, 5 aa, Mycobacterium
IGPNT

SEQ ID NO: 1164241 - protein, 16 aa, Mycobacterium
IGPPDVPGTVAPSEVK

SEQ ID NO: 1164242 - protein, 5 aa, Mycobacterium
IGPRE

SEQ ID NO: 1164243 - protein, 4 aa, Mycobacterium
IGPS

SEQ ID NO: 1164244 - protein, 7 aa, Mycobacterium
IGPSDRS

SEQ ID NO: 1164245 - protein, 11 aa, Mycobacterium
IGPSGSGKSTL

SEQ ID NO: 1164246 - protein, 8 aa, Mycobacterium
IGPSTRAA

SEQ ID NO: 1164247 - protein, 4 aa, Mycobacterium
IGPT

SEQ ID NO: 1164248 - protein, 9 aa, Mycobacterium
IGPTDREAA

SEQ ID NO: 1164249 - protein, 5 aa, Mycobacterium
IGPTP

SEQ ID NO: 1164250 - protein, 7 aa, Mycobacterium
IGPTPAA

SEQ ID NO: 1164251 - protein, 23 aa, Mycobacterium
IGPTTRTASISPDVNDPGARNVS

SEQ ID NO: 1164252 - protein, 13 aa, Mycobacterium
IGPVTTGAGVTAV

SEQ ID NO: 1164253 - protein, 10 aa, Mycobacterium
IGQGGTGTSA

SEQ ID NO: 1164254 - protein, 8 aa, Mycobacterium
IGQNKAGQ

SEQ ID NO: 1164255 - protein, 11 aa, Mycobacterium
IGQPKAGATTA

SEQ ID NO: 1164256 - protein, 9 aa, Mycobacterium
IGQRGQDTS

SEQ ID NO: 1164257 - protein, 7 aa, Mycobacterium
IGRDPKE

SEQ ID NO: 1164258 - protein, 17 aa, Mycobacterium
IGRGSPQGLAASKALTT

SEQ ID NO: 1164259 - protein, 6 aa, Mycobacterium
IGRNER

SEQ ID NO: 1164260 - protein, 16 aa, Mycobacterium
IGRPARQRTTTYAPLA

SEQ ID NO: 1164261 - protein, 7 aa, Mycobacterium
IGRPGGG

SEQ ID NO: 1164262 - protein, 7 aa, Mycobacterium
IGRPPGH

SEQ ID NO: 1164263 - protein, 18 aa, Mycobacterium
IGRPPKDLANPTDEEQQT

SEQ ID NO: 1164264 - protein, 9 aa, Mycobacterium
IGRSGEREG

SEQ ID NO: 1164265 - protein, 7 aa, Mycobacterium
IGRSGRH

SEQ ID NO: 1164266 - protein, 5 aa, Mycobacterium
IGRSR

SEQ ID NO: 1164267 - protein, 7 aa, Mycobacterium
IGRTTAP

SEQ ID NO: 1164268 - protein, 16 aa, Mycobacterium
IGSARSYGAQQRRAEE

SEQ ID NO: 1164269 - protein, 4 aa, Mycobacterium
IGSG

SEQ ID NO: 1164270 - protein, 6 aa, Mycobacterium
IGSHQG

SEQ ID NO: 1164271 - protein, 8 aa, Mycobacterium
IGSPGEVS

SEQ ID NO: 1164272 - protein, 4 aa, Mycobacterium
IGTD

SEQ ID NO: 1164273 - protein, 10 aa, Mycobacterium
IGTDLSESQV

SEQ ID NO: 1164274 - protein, 10 aa, Mycobacterium
IGTGKHGGYA

SEQ ID NO: 1164275 - protein, 10 aa, Mycobacterium
IGTGQTGATY

SEQ ID NO: 1164276 - protein, 28 aa, Mycobacterium
IGTSGAEIGGAFGGEKQTGGGRESGSDA

SEQ ID NO: 1164277 - protein, 6 aa, Mycobacterium
IGTSPF

SEQ ID NO: 1164278 - protein, 7 aa, Mycobacterium
IHGTPGP

SEQ ID NO: 1164279 - protein, 9 aa, Mycobacterium
IHKTPSRTE

SEQ ID NO: 1164280 - protein, 14 aa, Mycobacterium
IHPPTGAQGMNTGI

SEQ ID NO: 1164281 - protein, 5 aa, Mycobacterium
IHPTG

SEQ ID NO: 1164282 - protein, 4 aa, Mycobacterium
IHRG

SEQ ID NO: 1164283 - protein, 24 aa, Mycobacterium
IHTSGTQYGSTDEDQAGTLASSMN

SEQ ID NO: 1164284 - protein, 7 aa, Mycobacterium
IKAGERA

SEQ ID NO: 1164285 - protein, 8 aa, Mycobacterium
IKAKDPQA

SEQ ID NO: 1164286 - protein, 5 aa, Mycobacterium
IKASD

SEQ ID NO: 1164287 - protein, 6 aa, Mycobacterium
IKASGA

SEQ ID NO: 1164288 - protein, 4 aa, Mycobacterium
IKDA

SEQ ID NO: 1164289 - protein, 12 aa, Mycobacterium
IKDEGDRQPPSY

SEQ ID NO: 1164290 - protein, 4 aa, Mycobacterium
IKEG

SEQ ID NO: 1164291 - protein, 5 aa, Mycobacterium
IKEGE

SEQ ID NO: 1164292 - protein, 7 aa, Mycobacterium
IKEPREN

SEQ ID NO: 1164293 - protein, 6 aa, Mycobacterium
IKGQVP

SEQ ID NO: 1164294 - protein, 18 aa, Mycobacterium
IKGSGEEPTPGSGAPLAP

SEQ ID NO: 1164295 - protein, 6 aa, Mycobacterium
IKKGEQ

SEQ ID NO: 1164296 - protein, 6 aa, Mycobacterium
IKPGDT

SEQ ID NO: 1164297 - protein, 12 aa, Mycobacterium
IKPQARTLANDR

SEQ ID NO: 1164298 - protein, 13 aa, Mycobacterium
IKPSIADPSGSGV

SEQ ID NO: 1164299 - protein, 7 aa, Mycobacterium
IKQPADD

SEQ ID NO: 1164300 - protein, 5 aa, Mycobacterium
IKRRT

SEQ ID NO: 1164301 - protein, 11 aa, Mycobacterium
IKRSADPGAVG

SEQ ID NO: 1164302 - protein, 7 aa, Mycobacterium
IKSRNQK

SEQ ID NO: 1164303 - protein, 7 aa, Mycobacterium
ILPTDGR

SEQ ID NO: 1164304 - protein, 4 aa, Mycobacterium
INAG

SEQ ID NO: 1164305 - protein, 4 aa, Mycobacterium
INDG

SEQ ID NO: 1164306 - protein, 7 aa, Mycobacterium
INGAGGV

SEQ ID NO: 1164307 - protein, 8 aa, Mycobacterium
INGERPTA

SEQ ID NO: 1164308 - protein, 14 aa, Mycobacterium
INGGGSRPDGIAKQ

SEQ ID NO: 1164309 - protein, 4 aa, Mycobacterium
INPA

SEQ ID NO: 1164310 - protein, 7 aa, Mycobacterium
INPGGGL

SEQ ID NO: 1164311 - protein, 10 aa, Mycobacterium
INPGQSPEEL

SEQ ID NO: 1164312 - protein, 6 aa, Mycobacterium
INSPID

SEQ ID NO: 1164313 - protein, 9 aa, Mycobacterium
INTHGGQLG

SEQ ID NO: 1164314 - protein, 4 aa, Mycobacterium
IPAA

SEQ ID NO: 1164315 - protein, 7 aa, Mycobacterium
IPADPDG

SEQ ID NO: 1164316 - protein, 10 aa, Mycobacterium
IPAGGAEPSF

SEQ ID NO: 1164317 - protein, 7 aa, Mycobacterium
IPAGRTD

SEQ ID NO: 1164318 - protein, 10 aa, Mycobacterium
IPANRPGRAI

SEQ ID NO: 1164319 - protein, 6 aa, Mycobacterium
IPAPGD

SEQ ID NO: 1164320 - protein, 8 aa, Mycobacterium
IPAPGDPY

SEQ ID NO: 1164321 - protein, 6 aa, Mycobacterium
IPAPPT

SEQ ID NO: 1164322 - protein, 11 aa, Mycobacterium
IPAQNLRGTQT

SEQ ID NO: 1164323 - protein, 5 aa, Mycobacterium
IPAST

SEQ ID NO: 1164324 - protein, 14 aa, Mycobacterium
IPATQKALKKSGLS

SEQ ID NO: 1164325 - protein, 4 aa, Mycobacterium
IPDA

SEQ ID NO: 1164326 - protein, 10 aa, Mycobacterium
IPDDTVAPQE

SEQ ID NO: 1164327 - protein, 16 aa, Mycobacterium
IPDPPERAGVTDPDTM

SEQ ID NO: 1164328 - protein, 7 aa, Mycobacterium
IPDPQTT

SEQ ID NO: 1164329 - protein, 19 aa, Mycobacterium
IPDPRERPADREDAARQKH

SEQ ID NO: 1164330 - protein, 12 aa, Mycobacterium
IPDQDDPASFGP

SEQ ID NO: 1164331 - protein, 6 aa, Mycobacterium
IPDTES

SEQ ID NO: 1164332 - protein, 8 aa, Mycobacterium
IPEDATPA

SEQ ID NO: 1164333 - protein, 4 aa, Mycobacterium
IPEG

SEQ ID NO: 1164334 - protein, 9 aa, Mycobacterium
IPEKHGPVA

SEQ ID NO: 1164335 - protein, 6 aa, Mycobacterium
IPEPAR

SEQ ID NO: 1164336 - protein, 6 aa, Mycobacterium
IPEPGN

SEQ ID NO: 1164337 - protein, 11 aa, Mycobacterium
IPERPGNKRVD

SEQ ID NO: 1164338 - protein, 7 aa, Mycobacterium
IPESAEN

SEQ ID NO: 1164339 - protein, 5 aa, Mycobacterium
IPESR

SEQ ID NO: 1164340 - protein, 5 aa, Mycobacterium
IPGAD

SEQ ID NO: 1164341 - protein, 10 aa, Mycobacterium
IPGAENVPST

SEQ ID NO: 1164342 - protein, 10 aa, Mycobacterium
IPGGPPGTKG

SEQ ID NO: 1164343 - protein, 5 aa, Mycobacterium
IPGKA

SEQ ID NO: 1164344 - protein, 4 aa, Mycobacterium
IPGQ

SEQ ID NO: 1164345 - protein, 4 aa, Mycobacterium
IPGR

SEQ ID NO: 1164346 - protein, 4 aa, Mycobacterium
IPGT

SEQ ID NO: 1164347 - protein, 6 aa, Mycobacterium
IPKPTV

SEQ ID NO: 1164348 - protein, 4 aa, Mycobacterium
IPNQ

SEQ ID NO: 1164349 - protein, 6 aa, Mycobacterium
IPPAAR

SEQ ID NO: 1164350 - protein, 6 aa, Mycobacterium
IPPDKD

SEQ ID NO: 1164351 - protein, 7 aa, Mycobacterium
IPPDSAA

SEQ ID NO: 1164352 - protein, 6 aa, Mycobacterium
IPPGDG

SEQ ID NO: 1164353 - protein, 6 aa, Mycobacterium
IPPGEL

SEQ ID NO: 1164354 - protein, 4 aa, Mycobacterium
IPPH

SEQ ID NO: 1164355 - protein, 6 aa, Mycobacterium
IPPTAG

SEQ ID NO: 1164356 - protein, 5 aa, Mycobacterium
IPPTE

SEQ ID NO: 1164357 - protein, 5 aa, Mycobacterium
IPPTR

SEQ ID NO: 1164358 - protein, 6 aa, Mycobacterium
IPQPET

SEQ ID NO: 1164359 - protein, 21 aa, Mycobacterium
IPQQGPSTQPAVPAGAGVAGG

SEQ ID NO: 1164360 - protein, 6 aa, Mycobacterium
IPQRDD

SEQ ID NO: 1164361 - protein, 6 aa, Mycobacterium
IPQTDS

SEQ ID NO: 1164362 - protein, 9 aa, Mycobacterium
IPRARTPDV

SEQ ID NO: 1164363 - protein, 14 aa, Mycobacterium
IPRATDSVGAPRIR

SEQ ID NO: 1164364 - protein, 9 aa, Mycobacterium
IPRGEEAGK

SEQ ID NO: 1164365 - protein, 11 aa, Mycobacterium
IPRTTSGKLAR

SEQ ID NO: 1164366 - protein, 4 aa, Mycobacterium
IPSA

SEQ ID NO: 1164367 - protein, 5 aa, Mycobacterium
IPSGA

SEQ ID NO: 1164368 - protein, 5 aa, Mycobacterium
IPSPH

SEQ ID NO: 1164369 - protein, 8 aa, Mycobacterium
IPSPSGRH

SEQ ID NO: 1164370 - protein, 7 aa, Mycobacterium
IPTEGTA

SEQ ID NO: 1164371 - protein, 4 aa, Mycobacterium
IPTG

SEQ ID NO: 1164372 - protein, 13 aa, Mycobacterium
IPTPDGVDDASAA

SEQ ID NO: 1164373 - protein, 14 aa, Mycobacterium
IPTPVYGLQEVHHL

SEQ ID NO: 1164374 - protein, 5 aa, Mycobacterium
IPTRH

SEQ ID NO: 1164375 - protein, 7 aa, Mycobacterium
IPTSRQG

SEQ ID NO: 1164376 - protein, 4 aa, Mycobacterium
IPVD

SEQ ID NO: 1164377 - protein, 6 aa, Mycobacterium
IPVPPE

SEQ ID NO: 1164378 - protein, 9 aa, Mycobacterium
IPVTETPGA

SEQ ID NO: 1164379 - protein, 6 aa, Mycobacterium
IQATPE

SEQ ID NO: 1164380 - protein, 7 aa, Mycobacterium
IQGGTYD

SEQ ID NO: 1164381 - protein, 10 aa, Mycobacterium
IQGSTKNAER

SEQ ID NO: 1164382 - protein, 10 aa, Mycobacterium
IQPGRRPRGP

SEQ ID NO: 1164383 - protein, 9 aa, Mycobacterium
IQRPEEVAA

SEQ ID NO: 1164384 - protein, 6 aa, Mycobacterium
IRAAGA

SEQ ID NO: 1164385 - protein, 11 aa, Mycobacterium
IRADGGKADSC

SEQ ID NO: 1164386 - protein, 38 aa, Mycobacterium
IRAEGTAESTERTPGDSTPEAPPAATSPAIDNALPEDR

SEQ ID NO: 1164387 - protein, 12 aa, Mycobacterium
IRAERAQHPDLG

SEQ ID NO: 1164388 - protein, 6 aa, Mycobacterium
IRAGAD

SEQ ID NO: 1164389 - protein, 17 aa, Mycobacterium
IRAGASVEQVANASGMP

SEQ ID NO: 1164390 - protein, 22 aa, Mycobacterium
IRDAGGRASTLGADISDEAEAA

SEQ ID NO: 1164391 - protein, 10 aa, Mycobacterium
IRDRTGVETR

SEQ ID NO: 1164392 - protein, 15 aa, Mycobacterium
IRDTQRSGRRRTEVP

SEQ ID NO: 1164393 - protein, 8 aa, Mycobacterium
IREDTAGY

SEQ ID NO: 1164394 - protein, 13 aa, Mycobacterium
IRESDEPASPASV

SEQ ID NO: 1164395 - protein, 6 aa, Mycobacterium
IRGEMA

SEQ ID NO: 1164396 - protein, 10 aa, Mycobacterium
IRGESENLAP

SEQ ID NO: 1164397 - protein, 9 aa, Mycobacterium
IRGKDKDLG

SEQ ID NO: 1164398 - protein, 5 aa, Mycobacterium
IRGSG

SEQ ID NO: 1164399 - protein, 10 aa, Mycobacterium
IRGTGGAALR

SEQ ID NO: 1164400 - protein, 5 aa, Mycobacterium
IRKGQ

SEQ ID NO: 1164401 - protein, 12 aa, Mycobacterium
IRNRQEDGSDLD

SEQ ID NO: 1164402 - protein, 16 aa, Mycobacterium
IRPGDDGTTVHLEAGI

SEQ ID NO: 1164403 - protein, 7 aa, Mycobacterium
IRPPQRL

SEQ ID NO: 1164404 - protein, 4 aa, Mycobacterium
IRRG

SEQ ID NO: 1164405 - protein, 6 aa, Mycobacterium
IRSDSD

SEQ ID NO: 1164406 - protein, 9 aa, Mycobacterium
IRSGDRSAL

SEQ ID NO: 1164407 - protein, 5 aa, Mycobacterium
IRSGE

SEQ ID NO: 1164408 - protein, 6 aa, Mycobacterium
IRSGSD

SEQ ID NO: 1164409 - protein, 4 aa, Mycobacterium
IRTD

SEQ ID NO: 1164410 - protein, 6 aa, Mycobacterium
IRTGAD

SEQ ID NO: 1164411 - protein, 5 aa, Mycobacterium
IRTGT

SEQ ID NO: 1164412 - protein, 8 aa, Mycobacterium
ISAETSPT

SEQ ID NO: 1164413 - protein, 9 aa, Mycobacterium
ISAKQNPDA

SEQ ID NO: 1164414 - protein, 5 aa, Mycobacterium
ISANG

SEQ ID NO: 1164415 - protein, 14 aa, Mycobacterium
ISATAEDDAADVKG

SEQ ID NO: 1164416 - protein, 10 aa, Mycobacterium
ISDGQLKRGD

SEQ ID NO: 1164417 - protein, 17 aa, Mycobacterium
ISDNKQRAKVATGFGKP

SEQ ID NO: 1164418 - protein, 10 aa, Mycobacterium
ISEPKTTRVG

SEQ ID NO: 1164419 - protein, 5 aa, Mycobacterium
ISEQK

SEQ ID NO: 1164420 - protein, 24 aa, Mycobacterium
ISERERAQSRSSRLQRRAAANDAL

SEQ ID NO: 1164421 - protein, 39 aa, Mycobacterium
ISETAQAAGVPDDDIAGAEAERPISAESAAAIEALIGVL

SEQ ID NO: 1164422 - protein, 11 aa, Mycobacterium
ISGDDPDTVTT

SEQ ID NO: 1164423 - protein, 8 aa, Mycobacterium
ISGGAPLG

SEQ ID NO: 1164424 - protein, 25 aa, Mycobacterium
ISGGEEGALNGPSIMPGGPAESYES

SEQ ID NO: 1164425 - protein, 8 aa, Mycobacterium
ISGGGGIK

SEQ ID NO: 1164426 - protein, 6 aa, Mycobacterium
ISGGRS

SEQ ID NO: 1164427 - protein, 9 aa, Mycobacterium
ISGSGKSSL

SEQ ID NO: 1164428 - protein, 8 aa, Mycobacterium
ISKASGIR

SEQ ID NO: 1164429 - protein, 6 aa, Mycobacterium
ISLGDG

SEQ ID NO: 1164430 - protein, 7 aa, Mycobacterium
ISNSTDI

SEQ ID NO: 1164431 - protein, 10 aa, Mycobacterium
ISPAPPEGFQ

SEQ ID NO: 1164432 - protein, 12 aa, Mycobacterium
ISPASGTRQTVY

SEQ ID NO: 1164433 - protein, 5 aa, Mycobacterium
ISPDA

SEQ ID NO: 1164434 - protein, 10 aa, Mycobacterium
ISPDKPAKLA

SEQ ID NO: 1164435 - protein, 6 aa, Mycobacterium
ISPDTA

SEQ ID NO: 1164436 - protein, 18 aa, Mycobacterium
ISPEAYPGAVAQAGRDIP

SEQ ID NO: 1164437 - protein, 6 aa, Mycobacterium
ISPEPT

SEQ ID NO: 1164438 - protein, 15 aa, Mycobacterium
ISPGNGAGDVREDEP

SEQ ID NO: 1164439 - protein, 17 aa, Mycobacterium
ISPMPDNAEVAFPESAK

SEQ ID NO: 1164440 - protein, 6 aa, Mycobacterium
ISPPNG

SEQ ID NO: 1164441 - protein, 9 aa, Mycobacterium
ISPPSPPLM

SEQ ID NO: 1164442 - protein, 7 aa, Mycobacterium
ISPPTVT

SEQ ID NO: 1164443 - protein, 8 aa, Mycobacterium
ISPQQQVN

SEQ ID NO: 1164444 - protein, 13 aa, Mycobacterium
ISPRKVNKPVTGQ

SEQ ID NO: 1164445 - protein, 4 aa, Mycobacterium
ISPS

SEQ ID NO: 1164446 - protein, 7 aa, Mycobacterium
ISQYTRG

SEQ ID NO: 1164447 - protein, 8 aa, Mycobacterium
ISREPAPA

SEQ ID NO: 1164448 - protein, 5 aa, Mycobacterium
ISRGS

SEQ ID NO: 1164449 - protein, 16 aa, Mycobacterium
ISRGTGPVAELPGRAA

SEQ ID NO: 1164450 - protein, 11 aa, Mycobacterium
ISSAADHTPFR

SEQ ID NO: 1164451 - protein, 7 aa, Mycobacterium
ISSANGR

SEQ ID NO: 1164452 - protein, 8 aa, Mycobacterium
ISTAGARA

SEQ ID NO: 1164453 - protein, 5 aa, Mycobacterium
ISTDG

SEQ ID NO: 1164454 - protein, 14 aa, Mycobacterium
ISTEDYDESAADDP

SEQ ID NO: 1164455 - protein, 7 aa, Mycobacterium
ISTEEAK

SEQ ID NO: 1164456 - protein, 6 aa, Mycobacterium
ISTEQF

SEQ ID NO: 1164457 - protein, 11 aa, Mycobacterium
ISTGPAPSAPQ

SEQ ID NO: 1164458 - protein, 7 aa, Mycobacterium
ISTPGLV

SEQ ID NO: 1164459 - protein, 7 aa, Mycobacterium
ISTPLQA

SEQ ID NO: 1164460 - protein, 14 aa, Mycobacterium
ISYSGGPDSDGIKV

SEQ ID NO: 1164461 - protein, 10 aa, Mycobacterium
ITAAGRDRST

SEQ ID NO: 1164462 - protein, 9 aa, Mycobacterium
ITADTPDPV

SEQ ID NO: 1164463 - protein, 11 aa, Mycobacterium
ITAEGTPLPEA

SEQ ID NO: 1164464 - protein, 6 aa, Mycobacterium
ITAESA

SEQ ID NO: 1164465 - protein, 4 aa, Mycobacterium
ITAG

SEQ ID NO: 1164466 - protein, 8 aa, Mycobacterium
ITANGNEA

SEQ ID NO: 1164467 - protein, 4 aa, Mycobacterium
ITAP

SEQ ID NO: 1164468 - protein, 5 aa, Mycobacterium
ITAPQ

SEQ ID NO: 1164469 - protein, 10 aa, Mycobacterium
ITASEEPSRL

SEQ ID NO: 1164470 - protein, 9 aa, Mycobacterium
ITDAEGNEV

SEQ ID NO: 1164471 - protein, 11 aa, Mycobacterium
ITDEGGRQPVS

SEQ ID NO: 1164472 - protein, 10 aa, Mycobacterium
ITDEREAAAR

SEQ ID NO: 1164473 - protein, 15 aa, Mycobacterium
ITEEYPEKPGPVAPR

SEQ ID NO: 1164474 - protein, 8 aa, Mycobacterium
ITEPADAV

SEQ ID NO: 1164475 - protein, 11 aa, Mycobacterium
ITETRSVAGGG

SEQ ID NO: 1164476 - protein, 4 aa, Mycobacterium
ITEV

SEQ ID NO: 1164477 - protein, 10 aa, Mycobacterium
ITGDSAAGIA

SEQ ID NO: 1164478 - protein, 8 aa, Mycobacterium
ITGEGSPA

SEQ ID NO: 1164479 - protein, 21 aa, Mycobacterium
ITGGQDRDASPEDSPLPPRAQ

SEQ ID NO: 1164480 - protein, 10 aa, Mycobacterium
ITGPTAPSWR

SEQ ID NO: 1164481 - protein, 9 aa, Mycobacterium
ITGPVTGYP

SEQ ID NO: 1164482 - protein, 9 aa, Mycobacterium
ITGSTADAT

SEQ ID NO: 1164483 - protein, 5 aa, Mycobacterium
ITKNP

SEQ ID NO: 1164484 - protein, 8 aa, Mycobacterium
ITNGGKSS

SEQ ID NO: 1164485 - protein, 5 aa, Mycobacterium
ITNGQ

SEQ ID NO: 1164486 - protein, 13 aa, Mycobacterium
ITNNTAEDRTTFS

SEQ ID NO: 1164487 - protein, 4 aa, Mycobacterium
ITPD

SEQ ID NO: 1164488 - protein, 5 aa, Mycobacterium
ITPDG

SEQ ID NO: 1164489 - protein, 10 aa, Mycobacterium
ITPDHRPGIP

SEQ ID NO: 1164490 - protein, 11 aa, Mycobacterium
ITPDRIRGSQT

SEQ ID NO: 1164491 - protein, 12 aa, Mycobacterium
ITPEDAAATRIT

SEQ ID NO: 1164492 - protein, 13 aa, Mycobacterium
ITPGNVASPGADA

SEQ ID NO: 1164493 - protein, 10 aa, Mycobacterium
ITPPSNRGFD

SEQ ID NO: 1164494 - protein, 4 aa, Mycobacterium
ITPQ

SEQ ID NO: 1164495 - protein, 10 aa, Mycobacterium
ITPSAKAGGG

SEQ ID NO: 1164496 - protein, 12 aa, Mycobacterium
ITPSPTGGTRPP

SEQ ID NO: 1164497 - protein, 24 aa, Mycobacterium
ITQGGGRAVASYDSVDSPEGGQSI

SEQ ID NO: 1164498 - protein, 10 aa, Mycobacterium
ITQPEGPSFT

SEQ ID NO: 1164499 - protein, 8 aa, Mycobacterium
ITRGDAEA

SEQ ID NO: 1164500 - protein, 6 aa, Mycobacterium
ITRGPD

SEQ ID NO: 1164501 - protein, 5 aa, Mycobacterium
ITRQP

SEQ ID NO: 1164502 - protein, 6 aa, Mycobacterium
ITRSTL

SEQ ID NO: 1164503 - protein, 21 aa, Mycobacterium
ITSETEAAGRKVKASKDEPQY

SEQ ID NO: 1164504 - protein, 5 aa, Mycobacterium
ITSGE

SEQ ID NO: 1164505 - protein, 8 aa, Mycobacterium
ITSPADPA

SEQ ID NO: 1164506 - protein, 10 aa, Mycobacterium
ITSPRKHGMD

SEQ ID NO: 1164507 - protein, 20 aa, Mycobacterium
ITSSGTGGSASEADVRAAMA

SEQ ID NO: 1164508 - protein, 10 aa, Mycobacterium
ITSTRGRSIT

SEQ ID NO: 1164509 - protein, 4 aa, Mycobacterium
ITSV

SEQ ID NO: 1164510 - protein, 7 aa, Mycobacterium
ITTEAKT

SEQ ID NO: 1164511 - protein, 8 aa, Mycobacterium
ITTEGGQA

SEQ ID NO: 1164512 - protein, 16 aa, Mycobacterium
ITTGKQPEALRAVDPL

SEQ ID NO: 1164513 - protein, 8 aa, Mycobacterium
ITTPGPGQ

SEQ ID NO: 1164514 - protein, 13 aa, Mycobacterium
ITTRAEPRDDGTY

SEQ ID NO: 1164515 - protein, 13 aa, Mycobacterium
IVPPTGSGTRGAL

SEQ ID NO: 1164516 - protein, 5 aa, Mycobacterium
IVRSE

SEQ ID NO: 1164517 - protein, 28 aa, Mycobacterium
IYPGPDGVVRSTNRAGGLEGGMTNGQPL

SEQ ID NO: 1164518 - protein, 9 aa, Mycobacterium
IYSQPSEDL

SEQ ID NO: 1164519 - protein, 4 aa, Mycobacterium
KAAA

SEQ ID NO: 1164520 - protein, 5 aa, Mycobacterium
KAAAA

SEQ ID NO: 1164521 - protein, 7 aa, Mycobacterium
KAAAAAR

SEQ ID NO: 1164522 - protein, 9 aa, Mycobacterium
KAAAAGGDA

SEQ ID NO: 1164523 - protein, 8 aa, Mycobacterium
KAAAESAG

SEQ ID NO: 1164524 - protein, 7 aa, Mycobacterium
KAAAGEC

SEQ ID NO: 1164525 - protein, 12 aa, Mycobacterium
KAAAGKAALTAA

SEQ ID NO: 1164526 - protein, 8 aa, Mycobacterium
KAAAHQAY

SEQ ID NO: 1164527 - protein, 8 aa, Mycobacterium
KAAAPRVK

SEQ ID NO: 1164528 - protein, 8 aa, Mycobacterium
KAAATAPY

SEQ ID NO: 1164529 - protein, 4 aa, Mycobacterium
KAAC

SEQ ID NO: 1164530 - protein, 8 aa, Mycobacterium
KAADAGRP

SEQ ID NO: 1164531 - protein, 6 aa, Mycobacterium
KAADRA

SEQ ID NO: 1164532 - protein, 8 aa, Mycobacterium
KAADRTGA

SEQ ID NO: 1164533 - protein, 8 aa, Mycobacterium
KAADVPAA

SEQ ID NO: 1164534 - protein, 14 aa, Mycobacterium
KAAEAAQADADRTF

SEQ ID NO: 1164535 - protein, 18 aa, Mycobacterium
KAAEDGIAVSPTGSAART

SEQ ID NO: 1164536 - protein, 6 aa, Mycobacterium
KAAGAA

SEQ ID NO: 1164537 - protein, 8 aa, Mycobacterium
KAAGYSKG

SEQ ID NO: 1164538 - protein, 5 aa, Mycobacterium
KAAIT

SEQ ID NO: 1164539 - protein, 8 aa, Mycobacterium
KAAKGLAK

SEQ ID NO: 1164540 - protein, 15 aa, Mycobacterium
KAANEDGTFKSDEDL

SEQ ID NO: 1164541 - protein, 12 aa, Mycobacterium
KAARDNGQFRTR

SEQ ID NO: 1164542 - protein, 12 aa, Mycobacterium
KAARRSGLHADG

SEQ ID NO: 1164543 - protein, 5 aa, Mycobacterium
KAASV

SEQ ID NO: 1164544 - protein, 15 aa, Mycobacterium
KAATEAGAEAASQVG

SEQ ID NO: 1164545 - protein, 6 aa, Mycobacterium
KAATED

SEQ ID NO: 1164546 - protein, 8 aa, Mycobacterium
KAATRGGY

SEQ ID NO: 1164547 - protein, 12 aa, Mycobacterium
KAAWNNDQTAIP

SEQ ID NO: 1164548 - protein, 5 aa, Mycobacterium
KADAD

SEQ ID NO: 1164549 - protein, 13 aa, Mycobacterium
KADAPSGTAARTA

SEQ ID NO: 1164550 - protein, 7 aa, Mycobacterium
KADDVGG

SEQ ID NO: 1164551 - protein, 4 aa, Mycobacterium
KADG

SEQ ID NO: 1164552 - protein, 19 aa, Mycobacterium
KADGAKTPAVQAVRTTPPA

SEQ ID NO: 1164553 - protein, 9 aa, Mycobacterium
KADGRSTPI

SEQ ID NO: 1164554 - protein, 7 aa, Mycobacterium
KADPEEQ

SEQ ID NO: 1164555 - protein, 13 aa, Mycobacterium
KADPEKVNPNGGA

SEQ ID NO: 1164556 - protein, 7 aa, Mycobacterium
KADPRGT

SEQ ID NO: 1164557 - protein, 25 aa, Mycobacterium
KADSAETPGYGDPQRRSTEAGRKNL

SEQ ID NO: 1164558 - protein, 12 aa, Mycobacterium
KADTEPLDPNQG

SEQ ID NO: 1164559 - protein, 5 aa, Mycobacterium
KADTV

SEQ ID NO: 1164560 - protein, 22 aa, Mycobacterium
KAEADSLNAQISGNSASIGPLQ

SEQ ID NO: 1164561 - protein, 12 aa, Mycobacterium
KAEAEEEADDVR

SEQ ID NO: 1164562 - protein, 5 aa, Mycobacterium
KAEAY

SEQ ID NO: 1164563 - protein, 6 aa, Mycobacterium
KAEDAW

SEQ ID NO: 1164564 - protein, 5 aa, Mycobacterium
KAEEL

SEQ ID NO: 1164565 - protein, 13 aa, Mycobacterium
KAEGKTPTREDAE

SEQ ID NO: 1164566 - protein, 10 aa, Mycobacterium
KAENAQAPHA

SEQ ID NO: 1164567 - protein, 17 aa, Mycobacterium
KAEPGQMKPIPGKRPRK

SEQ ID NO: 1164568 - protein, 20 aa, Mycobacterium
KAERRLTETALKDLKKRAEA

SEQ ID NO: 1164569 - protein, 8 aa, Mycobacterium
KAETDGNL

SEQ ID NO: 1164570 - protein, 7 aa, Mycobacterium
KAETSSL

SEQ ID NO: 1164571 - protein, 16 aa, Mycobacterium
KAFDEGPWPRMSPDER

SEQ ID NO: 1164572 - protein, 6 aa, Mycobacterium
KAFGTP

SEQ ID NO: 1164573 - protein, 5 aa, Mycobacterium
KAFPD

SEQ ID NO: 1164574 - protein, 9 aa, Mycobacterium
KAFTSAEGS

SEQ ID NO: 1164575 - protein, 6 aa, Mycobacterium
KAGAAG

SEQ ID NO: 1164576 - protein, 12 aa, Mycobacterium
KAGAGIDPANAC

SEQ ID NO: 1164577 - protein, 7 aa, Mycobacterium
KAGAQIA

SEQ ID NO: 1164578 - protein, 12 aa, Mycobacterium
KAGASGATGDGS

SEQ ID NO: 1164579 - protein, 7 aa, Mycobacterium
KAGEGVV

SEQ ID NO: 1164580 - protein, 5 aa, Mycobacterium
KAGFS

SEQ ID NO: 1164581 - protein, 12 aa, Mycobacterium
KAGHGIGSAGLP

SEQ ID NO: 1164582 - protein, 6 aa, Mycobacterium
KAGLNA

SEQ ID NO: 1164583 - protein, 7 aa, Mycobacterium
KAGMPEE

SEQ ID NO: 1164584 - protein, 7 aa, Mycobacterium
KAGNPDI

SEQ ID NO: 1164585 - protein, 5 aa, Mycobacterium
KAGNR

SEQ ID NO: 1164586 - protein, 9 aa, Mycobacterium
KAGPTRESR

SEQ ID NO: 1164587 - protein, 7 aa, Mycobacterium
KAGRRRY

SEQ ID NO: 1164588 - protein, 6 aa, Mycobacterium
KAGSRN

SEQ ID NO: 1164589 - protein, 9 aa, Mycobacterium
KAGTAVSER

SEQ ID NO: 1164590 - protein, 10 aa, Mycobacterium
KAGTTHRKRA

SEQ ID NO: 1164591 - protein, 6 aa, Mycobacterium
KAGTTV

SEQ ID NO: 1164592 - protein, 6 aa, Mycobacterium
KAGVTP

SEQ ID NO: 1164593 - protein, 4 aa, Mycobacterium
KAHE

SEQ ID NO: 1164594 - protein, 9 aa, Mycobacterium
KAHHGRAGT

SEQ ID NO: 1164595 - protein, 9 aa, Mycobacterium
KAHISGESL

SEQ ID NO: 1164596 - protein, 5 aa, Mycobacterium
KAHRS

SEQ ID NO: 1164597 - protein, 6 aa, Mycobacterium
KAKDLG

SEQ ID NO: 1164598 - protein, 8 aa, Mycobacterium
KAKEVPAA

SEQ ID NO: 1164599 - protein, 5 aa, Mycobacterium
KAKSL

SEQ ID NO: 1164600 - protein, 5 aa, Mycobacterium
KAKSM

SEQ ID NO: 1164601 - protein, 16 aa, Mycobacterium
KALAGPDVAELLWEKV

SEQ ID NO: 1164602 - protein, 8 aa, Mycobacterium
KALESGLA

SEQ ID NO: 1164603 - protein, 11 aa, Mycobacterium
KALGASRDAAL

SEQ ID NO: 1164604 - protein, 5 aa, Mycobacterium
KALGH

SEQ ID NO: 1164605 - protein, 4 aa, Mycobacterium
KALP

SEQ ID NO: 1164606 - protein, 5 aa, Mycobacterium
KANDI

SEQ ID NO: 1164607 - protein, 11 aa, Mycobacterium
KANKLADDAGM

SEQ ID NO: 1164608 - protein, 4 aa, Mycobacterium
KAPA

SEQ ID NO: 1164609 - protein, 7 aa, Mycobacterium
KAPAGER

SEQ ID NO: 1164610 - protein, 5 aa, Mycobacterium
KAPAL

SEQ ID NO: 1164611 - protein, 29 aa, Mycobacterium
KAPATTTASAKFPAATSAADSTVGRSGRA

SEQ ID NO: 1164612 - protein, 10 aa, Mycobacterium
KAPGQRIPRT

SEQ ID NO: 1164613 - protein, 10 aa, Mycobacterium
KAPGVTAGPT

SEQ ID NO: 1164614 - protein, 5 aa, Mycobacterium
KAPQT

SEQ ID NO: 1164615 - protein, 6 aa, Mycobacterium
KAPRLA

SEQ ID NO: 1164616 - protein, 12 aa, Mycobacterium
KAPTVGGTTAVS

SEQ ID NO: 1164617 - protein, 7 aa, Mycobacterium
KAQAEDA

SEQ ID NO: 1164618 - protein, 14 aa, Mycobacterium
KAQARVEAARPYDR

SEQ ID NO: 1164619 - protein, 5 aa, Mycobacterium
KAQGA

SEQ ID NO: 1164620 - protein, 10 aa, Mycobacterium
KAQGAGPSRD

SEQ ID NO: 1164621 - protein, 9 aa, Mycobacterium
KAQKQARRW

SEQ ID NO: 1164622 - protein, 9 aa, Mycobacterium
KAQSAMPPS

SEQ ID NO: 1164623 - protein, 7 aa, Mycobacterium
KARDAFR

SEQ ID NO: 1164624 - protein, 7 aa, Mycobacterium
KARDRAR

SEQ ID NO: 1164625 - protein, 8 aa, Mycobacterium
KAREKAAD

SEQ ID NO: 1164626 - protein, 5 aa, Mycobacterium
KARGN

SEQ ID NO: 1164627 - protein, 4 aa, Mycobacterium
KARK

SEQ ID NO: 1164628 - protein, 5 aa, Mycobacterium
KARKI

SEQ ID NO: 1164629 - protein, 9 aa, Mycobacterium
KARQSGAPI

SEQ ID NO: 1164630 - protein, 6 aa, Mycobacterium
KARRDA

SEQ ID NO: 1164631 - protein, 12 aa, Mycobacterium
KARTGPASPGAA

SEQ ID NO: 1164632 - protein, 9 aa, Mycobacterium
KASAGGSRD

SEQ ID NO: 1164633 - protein, 9 aa, Mycobacterium
KASAPQAIE

SEQ ID NO: 1164634 - protein, 9 aa, Mycobacterium
KASATAKME

SEQ ID NO: 1164635 - protein, 5 aa, Mycobacterium
KASDA

SEQ ID NO: 1164636 - protein, 5 aa, Mycobacterium
KASDE

SEQ ID NO: 1164637 - protein, 22 aa, Mycobacterium
KASDTDAASAESCVDTSGPNIK

SEQ ID NO: 1164638 - protein, 7 aa, Mycobacterium
KASEMST

SEQ ID NO: 1164639 - protein, 9 aa, Mycobacterium
KASGGIRTA

SEQ ID NO: 1164640 - protein, 8 aa, Mycobacterium
KASHQTWP

SEQ ID NO: 1164641 - protein, 7 aa, Mycobacterium
KASIAGA

SEQ ID NO: 1164642 - protein, 8 aa, Mycobacterium
KASSGIDL

SEQ ID NO: 1164643 - protein, 8 aa, Mycobacterium
KATADGRR

SEQ ID NO: 1164644 - protein, 16 aa, Mycobacterium
KATAYPAQLSGGQQQR

SEQ ID NO: 1164645 - protein, 9 aa, Mycobacterium
KATGVDPDA

SEQ ID NO: 1164646 - protein, 8 aa, Mycobacterium
KATHPDTA

SEQ ID NO: 1164647 - protein, 13 aa, Mycobacterium
KATLDGVGDDDAT

SEQ ID NO: 1164648 - protein, 6 aa, Mycobacterium
KATPMR

SEQ ID NO: 1164649 - protein, 14 aa, Mycobacterium
KATRGNIDVKLSAK

SEQ ID NO: 1164650 - protein, 9 aa, Mycobacterium
KATTGAPGP

SEQ ID NO: 1164651 - protein, 10 aa, Mycobacterium
KATYAERTGV

SEQ ID NO: 1164652 - protein, 11 aa, Mycobacterium
KAVASADPAVG

SEQ ID NO: 1164653 - protein, 15 aa, Mycobacterium
KAVGGQDPGAESSAR

SEQ ID NO: 1164654 - protein, 5 aa, Mycobacterium
KAVPR

SEQ ID NO: 1164655 - protein, 7 aa, Mycobacterium
KAVTDRP

SEQ ID NO: 1164656 - protein, 5 aa, Mycobacterium
KAYDA

SEQ ID NO: 1164657 - protein, 5 aa, Mycobacterium
KAYEE

SEQ ID NO: 1164658 - protein, 7 aa, Mycobacterium
KCNDEQF

SEQ ID NO: 1164659 - protein, 5 aa, Mycobacterium
KCTYG

SEQ ID NO: 1164660 - protein, 13 aa, Mycobacterium
KDAAIGDTVDGQS

SEQ ID NO: 1164661 - protein, 6 aa, Mycobacterium
KDAESV

SEQ ID NO: 1164662 - protein, 9 aa, Mycobacterium
KDAGINPRD

SEQ ID NO: 1164663 - protein, 6 aa, Mycobacterium
KDAGLS

SEQ ID NO: 1164664 - protein, 9 aa, Mycobacterium
KDAKDKVVE

SEQ ID NO: 1164665 - protein, 8 aa, Mycobacterium
KDAPPLPA

SEQ ID NO: 1164666 - protein, 5 aa, Mycobacterium
KDAPV

SEQ ID NO: 1164667 - protein, 7 aa, Mycobacterium
KDASTHS

SEQ ID NO: 1164668 - protein, 8 aa, Mycobacterium
KDDEIGPA

SEQ ID NO: 1164669 - protein, 8 aa, Mycobacterium
KDDGADTA

SEQ ID NO: 1164670 - protein, 14 aa, Mycobacterium
KDDGARTGATELAG

SEQ ID NO: 1164671 - protein, 6 aa, Mycobacterium
KDDGTE

SEQ ID NO: 1164672 - protein, 5 aa, Mycobacterium
KDDGV

SEQ ID NO: 1164673 - protein, 19 aa, Mycobacterium
KDDHPAHHDEAAAKESGYD

SEQ ID NO: 1164674 - protein, 6 aa, Mycobacterium
KDDPEF

SEQ ID NO: 1164675 - protein, 7 aa, Mycobacterium
KDDPGLM

SEQ ID NO: 1164676 - protein, 15 aa, Mycobacterium
KDEDGEDIVTFAFQP

SEQ ID NO: 1164677 - protein, 6 aa, Mycobacterium
KDEDGY

SEQ ID NO: 1164678 - protein, 20 aa, Mycobacterium
KDEGARVVTGGERAELGGDL

SEQ ID NO: 1164679 - protein, 8 aa, Mycobacterium
KDEIADAP

SEQ ID NO: 1164680 - protein, 9 aa, Mycobacterium
KDEYPATAA

SEQ ID NO: 1164681 - protein, 15 aa, Mycobacterium
KDFARKGKGAVETPL

SEQ ID NO: 1164682 - protein, 4 aa, Mycobacterium
KDFD

SEQ ID NO: 1164683 - protein, 6 aa, Mycobacterium
KDFDGI

SEQ ID NO: 1164684 - protein, 15 aa, Mycobacterium
KDGAEVARGKDLDTL

SEQ ID NO: 1164685 - protein, 5 aa, Mycobacterium
KDGGG

SEQ ID NO: 1164686 - protein, 7 aa, Mycobacterium
KDGGSVD

SEQ ID NO: 1164687 - protein, 6 aa, Mycobacterium
KDGLRK

SEQ ID NO: 1164688 - protein, 8 aa, Mycobacterium
KDGPDHEK

SEQ ID NO: 1164689 - protein, 6 aa, Mycobacterium
KDGTLR

SEQ ID NO: 1164690 - protein, 8 aa, Mycobacterium
KDGTTTTI

SEQ ID NO: 1164691 - protein, 11 aa, Mycobacterium
KDHNATSGAQR

SEQ ID NO: 1164692 - protein, 7 aa, Mycobacterium
KDKDGTI

SEQ ID NO: 1164693 - protein, 13 aa, Mycobacterium
KDKNGIAGIVDEA

SEQ ID NO: 1164694 - protein, 8 aa, Mycobacterium
KDKQTARV

SEQ ID NO: 1164695 - protein, 13 aa, Mycobacterium
KDKSQKQGADATT

SEQ ID NO: 1164696 - protein, 6 aa, Mycobacterium
KDKVGN

SEQ ID NO: 1164697 - protein, 6 aa, Mycobacterium
KDLGEA

SEQ ID NO: 1164698 - protein, 6 aa, Mycobacterium
KDLGED

SEQ ID NO: 1164699 - protein, 10 aa, Mycobacterium
KDLPDRSGDG

SEQ ID NO: 1164700 - protein, 5 aa, Mycobacterium
KDMNA

SEQ ID NO: 1164701 - protein, 23 aa, Mycobacterium
KDMPPNPDATSTGLEGARGADVD

SEQ ID NO: 1164702 - protein, 5 aa, Mycobacterium
KDNKV

SEQ ID NO: 1164703 - protein, 5 aa, Mycobacterium
KDNPR

SEQ ID NO: 1164704 - protein, 8 aa, Mycobacterium
KDNPSDDI

SEQ ID NO: 1164705 - protein, 8 aa, Mycobacterium
KDNPSDDL

SEQ ID NO: 1164706 - protein, 4 aa, Mycobacterium
KDNR

SEQ ID NO: 1164707 - protein, 6 aa, Mycobacterium
KDPAHY

SEQ ID NO: 1164708 - protein, 8 aa, Mycobacterium
KDPATPKI

SEQ ID NO: 1164709 - protein, 6 aa, Mycobacterium
KDPDEI

SEQ ID NO: 1164710 - protein, 11 aa, Mycobacterium
KDPEGAGYPAT

SEQ ID NO: 1164711 - protein, 7 aa, Mycobacterium
KDPSKLP

SEQ ID NO: 1164712 - protein, 9 aa, Mycobacterium
KDQNGQPVT

SEQ ID NO: 1164713 - protein, 9 aa, Mycobacterium
KDRDPAYAE

SEQ ID NO: 1164714 - protein, 6 aa, Mycobacterium
KDREDG

SEQ ID NO: 1164715 - protein, 7 aa, Mycobacterium
KDRERFS

SEQ ID NO: 1164716 - protein, 5 aa, Mycobacterium
KDRKW

SEQ ID NO: 1164717 - protein, 7 aa, Mycobacterium
KDRLSRG

SEQ ID NO: 1164718 - protein, 20 aa, Mycobacterium
KDRPGHLRSHGRPSKLAGKT

SEQ ID NO: 1164719 - protein, 7 aa, Mycobacterium
KDRQQSA

SEQ ID NO: 1164720 - protein, 19 aa, Mycobacterium
KDRSTKKEVKQVKPTHADV

SEQ ID NO: 1164721 - protein, 4 aa, Mycobacterium
KDSI

SEQ ID NO: 1164722 - protein, 13 aa, Mycobacterium
KDSIAPRYAADPH

SEQ ID NO: 1164723 - protein, 41 aa, Mycobacterium
KDSPATFDPSEVAGYDAATGTWNSDAGYDLEDNQDYAETEQ

SEQ ID NO: 1164724 - protein, 12 aa, Mycobacterium
KDTDRTSGVAEA

SEQ ID NO: 1164725 - protein, 8 aa, Mycobacterium
KDTITQDE

SEQ ID NO: 1164726 - protein, 8 aa, Mycobacterium
KDTPGVSF

SEQ ID NO: 1164727 - protein, 14 aa, Mycobacterium
KDTTTGDTLSDANQ

SEQ ID NO: 1164728 - protein, 6 aa, Mycobacterium
KDVAAG

SEQ ID NO: 1164729 - protein, 14 aa, Mycobacterium
KEAAEQAGRDPDSV

SEQ ID NO: 1164730 - protein, 10 aa, Mycobacterium
KEAAKDGQDV

SEQ ID NO: 1164731 - protein, 9 aa, Mycobacterium
KEAANGVEG

SEQ ID NO: 1164732 - protein, 6 aa, Mycobacterium
KEAPDR

SEQ ID NO: 1164733 - protein, 12 aa, Mycobacterium
KEARTHKDRKPV

SEQ ID NO: 1164734 - protein, 5 aa, Mycobacterium
KEATA

SEQ ID NO: 1164735 - protein, 8 aa, Mycobacterium
KEDEETLD

SEQ ID NO: 1164736 - protein, 4 aa, Mycobacterium
KEDG

SEQ ID NO: 1164737 - protein, 6 aa, Mycobacterium
KEDLQR

SEQ ID NO: 1164738 - protein, 6 aa, Mycobacterium
KEDLTD

SEQ ID NO: 1164739 - protein, 8 aa, Mycobacterium
KEDPDQAQ

SEQ ID NO: 1164740 - protein, 17 aa, Mycobacterium
KEDRRSKGRPGHEGRPE

SEQ ID NO: 1164741 - protein, 23 aa, Mycobacterium
KEEAQRARSQRAANPGDPKASAR

SEQ ID NO: 1164742 - protein, 5 aa, Mycobacterium
KEEQI

SEQ ID NO: 1164743 - protein, 4 aa, Mycobacterium
KEER

SEQ ID NO: 1164744 - protein, 5 aa, Mycobacterium
KEGAD

SEQ ID NO: 1164745 - protein, 8 aa, Mycobacterium
KEGREEAV

SEQ ID NO: 1164746 - protein, 7 aa, Mycobacterium
KEGVTAR

SEQ ID NO: 1164747 - protein, 10 aa, Mycobacterium
KEKRGSEGTD

SEQ ID NO: 1164748 - protein, 11 aa, Mycobacterium
KELEGDAATRI

SEQ ID NO: 1164749 - protein, 14 aa, Mycobacterium
KEMGGSGDGTNPEQ

SEQ ID NO: 1164750 - protein, 6 aa, Mycobacterium
KENPES

SEQ ID NO: 1164751 - protein, 7 aa, Mycobacterium
KENPQEL

SEQ ID NO: 1164752 - protein, 10 aa, Mycobacterium
KENPVERASA

SEQ ID NO: 1164753 - protein, 15 aa, Mycobacterium
KEPASPEKHVTIKST

SEQ ID NO: 1164754 - protein, 5 aa, Mycobacterium
KEPDR

SEQ ID NO: 1164755 - protein, 8 aa, Mycobacterium
KEPNPEEV

SEQ ID NO: 1164756 - protein, 10 aa, Mycobacterium
KEPPSPGPGQ

SEQ ID NO: 1164757 - protein, 5 aa, Mycobacterium
KEPTD

SEQ ID NO: 1164758 - protein, 19 aa, Mycobacterium
KEQTESRPADETHANHVGA

SEQ ID NO: 1164759 - protein, 11 aa, Mycobacterium
KERAQRAKPPL

SEQ ID NO: 1164760 - protein, 9 aa, Mycobacterium
KERDEWPAD

SEQ ID NO: 1164761 - protein, 15 aa, Mycobacterium
KEREQLRESRRRSYD

SEQ ID NO: 1164762 - protein, 6 aa, Mycobacterium
KERLGD

SEQ ID NO: 1164763 - protein, 8 aa, Mycobacterium
KERRGEYL

SEQ ID NO: 1164764 - protein, 9 aa, Mycobacterium
KERRRADGS

SEQ ID NO: 1164765 - protein, 8 aa, Mycobacterium
KESDGGRA

SEQ ID NO: 1164766 - protein, 6 aa, Mycobacterium
KESTRQ

SEQ ID NO: 1164767 - protein, 17 aa, Mycobacterium
KEYGSGSSRDWAAKGTS

SEQ ID NO: 1164768 - protein, 9 aa, Mycobacterium
KFETDDNGC

SEQ ID NO: 1164769 - protein, 5 aa, Mycobacterium
KFGEV

SEQ ID NO: 1164770 - protein, 14 aa, Mycobacterium
KFGGDSLTETRTNV

SEQ ID NO: 1164771 - protein, 4 aa, Mycobacterium
KFPT

SEQ ID NO: 1164772 - protein, 6 aa, Mycobacterium
KFRDGT

SEQ ID NO: 1164773 - protein, 5 aa, Mycobacterium
KFSPE

SEQ ID NO: 1164774 - protein, 7 aa, Mycobacterium
KFTERRD

SEQ ID NO: 1164775 - protein, 13 aa, Mycobacterium
KGAADDAVRSRRA

SEQ ID NO: 1164776 - protein, 4 aa, Mycobacterium
KGAP

SEQ ID NO: 1164777 - protein, 8 aa, Mycobacterium
KGAPGPVE

SEQ ID NO: 1164778 - protein, 7 aa, Mycobacterium
KGAPPMQ

SEQ ID NO: 1164779 - protein, 10 aa, Mycobacterium
KGDAAKTART

SEQ ID NO: 1164780 - protein, 7 aa, Mycobacterium
KGDATSA

SEQ ID NO: 1164781 - protein, 16 aa, Mycobacterium
KGDKQRTVPFGEPAEQ

SEQ ID NO: 1164782 - protein, 8 aa, Mycobacterium
KGDPAASV

SEQ ID NO: 1164783 - protein, 6 aa, Mycobacterium
KGDSVT

SEQ ID NO: 1164784 - protein, 10 aa, Mycobacterium
KGEDGRYRPA

SEQ ID NO: 1164785 - protein, 9 aa, Mycobacterium
KGEEPETEW

SEQ ID NO: 1164786 - protein, 14 aa, Mycobacterium
KGEESSGGADKSSI

SEQ ID NO: 1164787 - protein, 5 aa, Mycobacterium
KGENL

SEQ ID NO: 1164788 - protein, 5 aa, Mycobacterium
KGEPL

SEQ ID NO: 1164789 - protein, 13 aa, Mycobacterium
KGEYAPDEDPWTA

SEQ ID NO: 1164790 - protein, 5 aa, Mycobacterium
KGFGG

SEQ ID NO: 1164791 - protein, 8 aa, Mycobacterium
KGFQGKSS

SEQ ID NO: 1164792 - protein, 8 aa, Mycobacterium
KGGKERHV

SEQ ID NO: 1164793 - protein, 12 aa, Mycobacterium
KGGVGKTTSTIN

SEQ ID NO: 1164794 - protein, 6 aa, Mycobacterium
KGIAND

SEQ ID NO: 1164795 - protein, 12 aa, Mycobacterium
KGIDNDDTPPLT

SEQ ID NO: 1164796 - protein, 14 aa, Mycobacterium
KGIGESATVGSPPA

SEQ ID NO: 1164797 - protein, 15 aa, Mycobacterium
KGITEPDAWGPARNP

SEQ ID NO: 1164798 - protein, 13 aa, Mycobacterium
KGITTRPEPESRE

SEQ ID NO: 1164799 - protein, 7 aa, Mycobacterium
KGKADVV

SEQ ID NO: 1164800 - protein, 5 aa, Mycobacterium
KGKDR

SEQ ID NO: 1164801 - protein, 7 aa, Mycobacterium
KGKPHVS

SEQ ID NO: 1164802 - protein, 6 aa, Mycobacterium
KGKRSV

SEQ ID NO: 1164803 - protein, 6 aa, Mycobacterium
KGLEPQ

SEQ ID NO: 1164804 - protein, 7 aa, Mycobacterium
KGLGKKG

SEQ ID NO: 1164805 - protein, 6 aa, Mycobacterium
KGLPAD

SEQ ID NO: 1164806 - protein, 7 aa, Mycobacterium
KGLPRSC

SEQ ID NO: 1164807 - protein, 6 aa, Mycobacterium
KGLRRT

SEQ ID NO: 1164808 - protein, 7 aa, Mycobacterium
KGLSGGV

SEQ ID NO: 1164809 - protein, 9 aa, Mycobacterium
KGLTSGYSP

SEQ ID NO: 1164810 - protein, 6 aa, Mycobacterium
KGNALD

SEQ ID NO: 1164811 - protein, 15 aa, Mycobacterium
KGNPFGDGRAAERSA

SEQ ID NO: 1164812 - protein, 4 aa, Mycobacterium
KGNR

SEQ ID NO: 1164813 - protein, 39 aa, Mycobacterium
KGPDNAKDDVISDPAEGADDRVDWSSEGGATPSGPADTG

SEQ ID NO: 1164814 - protein, 8 aa, Mycobacterium
KGPPPTWG

SEQ ID NO: 1164815 - protein, 4 aa, Mycobacterium
KGPQ

SEQ ID NO: 1164816 - protein, 6 aa, Mycobacterium
KGPRSL

SEQ ID NO: 1164817 - protein, 10 aa, Mycobacterium
KGQAVSPSAV

SEQ ID NO: 1164818 - protein, 5 aa, Mycobacterium
KGQVR

SEQ ID NO: 1164819 - protein, 21 aa, Mycobacterium
KGQYSPTSEVGKVTKSTPMGS

SEQ ID NO: 1164820 - protein, 17 aa, Mycobacterium
KGRAVRAANEEEKRAAS

SEQ ID NO: 1164821 - protein, 5 aa, Mycobacterium
KGRRD

SEQ ID NO: 1164822 - protein, 6 aa, Mycobacterium
KGSDGV

SEQ ID NO: 1164823 - protein, 8 aa, Mycobacterium
KGSGEVTS

SEQ ID NO: 1164824 - protein, 12 aa, Mycobacterium
KGSGQRQAGSAV

SEQ ID NO: 1164825 - protein, 9 aa, Mycobacterium
KGSHAQAGR

SEQ ID NO: 1164826 - protein, 9 aa, Mycobacterium
KGSPLGQSL

SEQ ID NO: 1164827 - protein, 10 aa, Mycobacterium
KGSSISDPDN

SEQ ID NO: 1164828 - protein, 5 aa, Mycobacterium
KGSTH

SEQ ID NO: 1164829 - protein, 21 aa, Mycobacterium
KGTDFKKAKRLPAEQLAHWDA

SEQ ID NO: 1164830 - protein, 7 aa, Mycobacterium
KGTGSNT

SEQ ID NO: 1164831 - protein, 8 aa, Mycobacterium
KGTGSQDI

SEQ ID NO: 1164832 - protein, 9 aa, Mycobacterium
KGTGVGGRI

SEQ ID NO: 1164833 - protein, 19 aa, Mycobacterium
KGTHGGALGSADKALTKTP

SEQ ID NO: 1164834 - protein, 22 aa, Mycobacterium
KGTHGTSTPATCDTCGGRGEIQ

SEQ ID NO: 1164835 - protein, 7 aa, Mycobacterium
KGTPGFE

SEQ ID NO: 1164836 - protein, 25 aa, Mycobacterium
KGTPSDAAGQERSDSGMSKGAAVAS

SEQ ID NO: 1164837 - protein, 15 aa, Mycobacterium
KGTRLARPIDAVREI

SEQ ID NO: 1164838 - protein, 7 aa, Mycobacterium
KGTTLEP

SEQ ID NO: 1164839 - protein, 9 aa, Mycobacterium
KGVGDRRQI

SEQ ID NO: 1164840 - protein, 7 aa, Mycobacterium
KGVGPGY

SEQ ID NO: 1164841 - protein, 18 aa, Mycobacterium
KGVPAASVYSASKAALES

SEQ ID NO: 1164842 - protein, 6 aa, Mycobacterium
KGVPAG

SEQ ID NO: 1164843 - protein, 6 aa, Mycobacterium
KGVPSD

SEQ ID NO: 1164844 - protein, 5 aa, Mycobacterium
KGWTL

SEQ ID NO: 1164845 - protein, 6 aa, Mycobacterium
KGYANP

SEQ ID NO: 1164846 - protein, 9 aa, Mycobacterium
KGYASHGES

SEQ ID NO: 1164847 - protein, 15 aa, Mycobacterium
KGYDTVEPRDPGDDV

SEQ ID NO: 1164848 - protein, 12 aa, Mycobacterium
KGYSPEFPGADD

SEQ ID NO: 1164849 - protein, 9 aa, Mycobacterium
KGYSTPAHT

SEQ ID NO: 1164850 - protein, 9 aa, Mycobacterium
KGYTAGDTD

SEQ ID NO: 1164851 - protein, 4 aa, Mycobacterium
KHEG

SEQ ID NO: 1164852 - protein, 11 aa, Mycobacterium
KHGLGSSRQAI

SEQ ID NO: 1164853 - protein, 7 aa, Mycobacterium
KHGPGVA

SEQ ID NO: 1164854 - protein, 7 aa, Mycobacterium
KHGSEPG

SEQ ID NO: 1164855 - protein, 12 aa, Mycobacterium
KHHGKGKLDARA

SEQ ID NO: 1164856 - protein, 14 aa, Mycobacterium
KHKPPDYRPAPGAV

SEQ ID NO: 1164857 - protein, 21 aa, Mycobacterium
KHLSEAHPGREYDRDAILFMA

SEQ ID NO: 1164858 - protein, 12 aa, Mycobacterium
KHPAPQNYEEAA

SEQ ID NO: 1164859 - protein, 8 aa, Mycobacterium
KHPPADTP

SEQ ID NO: 1164860 - protein, 9 aa, Mycobacterium
KHPRGAFTE

SEQ ID NO: 1164861 - protein, 5 aa, Mycobacterium
KHSEI

SEQ ID NO: 1164862 - protein, 9 aa, Mycobacterium
KHSVNNPYA

SEQ ID NO: 1164863 - protein, 4 aa, Mycobacterium
KHYG

SEQ ID NO: 1164864 - protein, 6 aa, Mycobacterium
KIAEGA

SEQ ID NO: 1164865 - protein, 12 aa, Mycobacterium
KIAKDRGVGGPV

SEQ ID NO: 1164866 - protein, 11 aa, Mycobacterium
KIDEDSDVDSD

SEQ ID NO: 1164867 - protein, 7 aa, Mycobacterium
KIDPPVA

SEQ ID NO: 1164868 - protein, 9 aa, Mycobacterium
KIEGRYGSA

SEQ ID NO: 1164869 - protein, 9 aa, Mycobacterium
KIEPQAPVD

SEQ ID NO: 1164870 - protein, 77 aa, Mycobacterium
KIGDADQAEAEEPEPEPEPEPEPEPEPEPEPEPKQESKPEPKPEPKQESKQEAKPEPKKEPEPQQDAEPSDGSGPYV

SEQ ID NO: 1164871 - protein, 26 aa, Mycobacterium
KIGEPATQPTPEPVVEPAGEEDLEGP

SEQ ID NO: 1164872 - protein, 13 aa, Mycobacterium
KIGGDAGDGEGGQ

SEQ ID NO: 1164873 - protein, 6 aa, Mycobacterium
KITPRE

SEQ ID NO: 1164874 - protein, 5 aa, Mycobacterium
KKADS

SEQ ID NO: 1164875 - protein, 7 aa, Mycobacterium
KKAEAIA

SEQ ID NO: 1164876 - protein, 7 aa, Mycobacterium
KKAQSID

SEQ ID NO: 1164877 - protein, 8 aa, Mycobacterium
KKARGEAV

SEQ ID NO: 1164878 - protein, 8 aa, Mycobacterium
KKCCRSKP

SEQ ID NO: 1164879 - protein, 6 aa, Mycobacterium
KKDAEP

SEQ ID NO: 1164880 - protein, 25 aa, Mycobacterium
KKDGEAGEDEVSRAEKDLDKTTHTY

SEQ ID NO: 1164881 - protein, 31 aa, Mycobacterium
KKDPVANSRQGSQRERRSDEQAAKAVEASDR

SEQ ID NO: 1164882 - protein, 4 aa, Mycobacterium
KKDV

SEQ ID NO: 1164883 - protein, 11 aa, Mycobacterium
KKEDPQGREIG

SEQ ID NO: 1164884 - protein, 14 aa, Mycobacterium
KKEHDDKRLTSCGR

SEQ ID NO: 1164885 - protein, 6 aa, Mycobacterium
KKEVTT

SEQ ID NO: 1164886 - protein, 6 aa, Mycobacterium
KKEYGE

SEQ ID NO: 1164887 - protein, 9 aa, Mycobacterium
KKFTDQEKL

SEQ ID NO: 1164888 - protein, 5 aa, Mycobacterium
KKGDS

SEQ ID NO: 1164889 - protein, 18 aa, Mycobacterium
KKGQKTRRREKKNVPHGA

SEQ ID NO: 1164890 - protein, 9 aa, Mycobacterium
KKGTEEGAR

SEQ ID NO: 1164891 - protein, 7 aa, Mycobacterium
KKMAEGQ

SEQ ID NO: 1164892 - protein, 20 aa, Mycobacterium
KKMQPGAGASEATGDAYEPA

SEQ ID NO: 1164893 - protein, 9 aa, Mycobacterium
KKNAEHPIE

SEQ ID NO: 1164894 - protein, 11 aa, Mycobacterium
KKPDPQHHERP

SEQ ID NO: 1164895 - protein, 26 aa, Mycobacterium
KKPKPRKRGAHGGAATSGDSVTAPMQ

SEQ ID NO: 1164896 - protein, 6 aa, Mycobacterium
KKPVTT

SEQ ID NO: 1164897 - protein, 10 aa, Mycobacterium
KKQDAEARAK

SEQ ID NO: 1164898 - protein, 9 aa, Mycobacterium
KKQTGGSGQ

SEQ ID NO: 1164899 - protein, 10 aa, Mycobacterium
KKSANAAPYH

SEQ ID NO: 1164900 - protein, 33 aa, Mycobacterium
KKSGKSLKEKRAVKHAKSSAKLSSADALFNDKK

SEQ ID NO: 1164901 - protein, 9 aa, Mycobacterium
KKSIGPDKV

SEQ ID NO: 1164902 - protein, 4 aa, Mycobacterium
KKTG

SEQ ID NO: 1164903 - protein, 11 aa, Mycobacterium
KKTSDSNEPLL

SEQ ID NO: 1164904 - protein, 9 aa, Mycobacterium
KKYDGSRPE

SEQ ID NO: 1164905 - protein, 6 aa, Mycobacterium
KLAAPR

SEQ ID NO: 1164906 - protein, 6 aa, Mycobacterium
KLAEGK

SEQ ID NO: 1164907 - protein, 12 aa, Mycobacterium
KLAGTASRRDTR

SEQ ID NO: 1164908 - protein, 8 aa, Mycobacterium
KLDGPGLS

SEQ ID NO: 1164909 - protein, 6 aa, Mycobacterium
KLDPVQ

SEQ ID NO: 1164910 - protein, 7 aa, Mycobacterium
KLDQPLP

SEQ ID NO: 1164911 - protein, 5 aa, Mycobacterium
KLDRK

SEQ ID NO: 1164912 - protein, 6 aa, Mycobacterium
KLEGTA

SEQ ID NO: 1164913 - protein, 17 aa, Mycobacterium
KLENGTKAIYNPHYEIQ

SEQ ID NO: 1164914 - protein, 9 aa, Mycobacterium
KLGTESQAL

SEQ ID NO: 1164915 - protein, 10 aa, Mycobacterium
KLPAAQRRGV

SEQ ID NO: 1164916 - protein, 6 aa, Mycobacterium
KLPPEF

SEQ ID NO: 1164917 - protein, 9 aa, Mycobacterium
KLPPGPAFY

SEQ ID NO: 1164918 - protein, 6 aa, Mycobacterium
KLPPIG

SEQ ID NO: 1164919 - protein, 5 aa, Mycobacterium
KLRRN

SEQ ID NO: 1164920 - protein, 7 aa, Mycobacterium
KLSDPRP

SEQ ID NO: 1164921 - protein, 7 aa, Mycobacterium
KLSEETP

SEQ ID NO: 1164922 - protein, 11 aa, Mycobacterium
KLSPEQVTATE

SEQ ID NO: 1164923 - protein, 8 aa, Mycobacterium
KLSSPQLA

SEQ ID NO: 1164924 - protein, 34 aa, Mycobacterium
KLTKRPSKKAPAADNEKASAPEKDTSTDKAPAAS

SEQ ID NO: 1164925 - protein, 6 aa, Mycobacterium
KLTQGR

SEQ ID NO: 1164926 - protein, 12 aa, Mycobacterium
KMAPPGGGRTTS

SEQ ID NO: 1164927 - protein, 7 aa, Mycobacterium
KMGRPDT

SEQ ID NO: 1164928 - protein, 12 aa, Mycobacterium
KMPGGTPSSPGL

SEQ ID NO: 1164929 - protein, 5 aa, Mycobacterium
KMPPA

SEQ ID NO: 1164930 - protein, 4 aa, Mycobacterium
KMPS

SEQ ID NO: 1164931 - protein, 6 aa, Mycobacterium
KMPSQR

SEQ ID NO: 1164932 - protein, 13 aa, Mycobacterium
KMSSGSAQGMLSP

SEQ ID NO: 1164933 - protein, 8 aa, Mycobacterium
KNADESKM

SEQ ID NO: 1164934 - protein, 19 aa, Mycobacterium
KNAEATIPDPFGGPPRKPT

SEQ ID NO: 1164935 - protein, 8 aa, Mycobacterium
KNDAEEAR

SEQ ID NO: 1164936 - protein, 12 aa, Mycobacterium
KNDDHPREGLTP

SEQ ID NO: 1164937 - protein, 8 aa, Mycobacterium
KNEAGTPN

SEQ ID NO: 1164938 - protein, 5 aa, Mycobacterium
KNEDP

SEQ ID NO: 1164939 - protein, 12 aa, Mycobacterium
KNFRNGALNPNA

SEQ ID NO: 1164940 - protein, 5 aa, Mycobacterium
KNGPY

SEQ ID NO: 1164941 - protein, 11 aa, Mycobacterium
KNGTGSAGANG

SEQ ID NO: 1164942 - protein, 8 aa, Mycobacterium
KNKESRDD

SEQ ID NO: 1164943 - protein, 11 aa, Mycobacterium
KNLTDAERDGL

SEQ ID NO: 1164944 - protein, 7 aa, Mycobacterium
KNMDHSD

SEQ ID NO: 1164945 - protein, 5 aa, Mycobacterium
KNPDG

SEQ ID NO: 1164946 - protein, 7 aa, Mycobacterium
KNPDQLT

SEQ ID NO: 1164947 - protein, 5 aa, Mycobacterium
KNPNL

SEQ ID NO: 1164948 - protein, 6 aa, Mycobacterium
KNPRVE

SEQ ID NO: 1164949 - protein, 5 aa, Mycobacterium
KNQQA

SEQ ID NO: 1164950 - protein, 7 aa, Mycobacterium
KNQRSLG

SEQ ID NO: 1164951 - protein, 4 aa, Mycobacterium
KNRG

SEQ ID NO: 1164952 - protein, 8 aa, Mycobacterium
KNRRNDPD

SEQ ID NO: 1164953 - protein, 12 aa, Mycobacterium
KNVEAARNFGRD

SEQ ID NO: 1164954 - protein, 10 aa, Mycobacterium
KNVPTSRSEN

SEQ ID NO: 1164955 - protein, 9 aa, Mycobacterium
KNYDGSWTE

SEQ ID NO: 1164956 - protein, 15 aa, Mycobacterium
KPADPPGTPDNPDEA

SEQ ID NO: 1164957 - protein, 13 aa, Mycobacterium
KPAEGVPGTERTP

SEQ ID NO: 1164958 - protein, 5 aa, Mycobacterium
KPAGR

SEQ ID NO: 1164959 - protein, 6 aa, Mycobacterium
KPAKKA

SEQ ID NO: 1164960 - protein, 12 aa, Mycobacterium
KPAKLSGGQRQR

SEQ ID NO: 1164961 - protein, 5 aa, Mycobacterium
KPARI

SEQ ID NO: 1164962 - protein, 6 aa, Mycobacterium
KPATRQ

SEQ ID NO: 1164963 - protein, 9 aa, Mycobacterium
KPDETANAV

SEQ ID NO: 1164964 - protein, 12 aa, Mycobacterium
KPDGTLDTDAAA

SEQ ID NO: 1164965 - protein, 7 aa, Mycobacterium
KPDPEAY

SEQ ID NO: 1164966 - protein, 4 aa, Mycobacterium
KPDT

SEQ ID NO: 1164967 - protein, 8 aa, Mycobacterium
KPESVDTV

SEQ ID NO: 1164968 - protein, 8 aa, Mycobacterium
KPEYSNLP

SEQ ID NO: 1164969 - protein, 5 aa, Mycobacterium
KPFGL

SEQ ID NO: 1164970 - protein, 4 aa, Mycobacterium
KPGF

SEQ ID NO: 1164971 - protein, 5 aa, Mycobacterium
KPGNV

SEQ ID NO: 1164972 - protein, 6 aa, Mycobacterium
KPGRLD

SEQ ID NO: 1164973 - protein, 10 aa, Mycobacterium
KPGTTEPDAA

SEQ ID NO: 1164974 - protein, 11 aa, Mycobacterium
KPGTTTPHTEF

SEQ ID NO: 1164975 - protein, 6 aa, Mycobacterium
KPHTVS

SEQ ID NO: 1164976 - protein, 7 aa, Mycobacterium
KPIDDET

SEQ ID NO: 1164977 - protein, 8 aa, Mycobacterium
KPIRSADQ

SEQ ID NO: 1164978 - protein, 9 aa, Mycobacterium
KPKGMDEKM

SEQ ID NO: 1164979 - protein, 13 aa, Mycobacterium
KPKRRTKAQIARE

SEQ ID NO: 1164980 - protein, 6 aa, Mycobacterium
KPLAAR

SEQ ID NO: 1164981 - protein, 6 aa, Mycobacterium
KPLART

SEQ ID NO: 1164982 - protein, 13 aa, Mycobacterium
KPLGRVSDPEEQS

SEQ ID NO: 1164983 - protein, 23 aa, Mycobacterium
KPLLPTPAQPPGREPLRRRLTKP

SEQ ID NO: 1164984 - protein, 9 aa, Mycobacterium
KPLSEGGRL

SEQ ID NO: 1164985 - protein, 8 aa, Mycobacterium
KPLSSAER

SEQ ID NO: 1164986 - protein, 6 aa, Mycobacterium
KPMPNW

SEQ ID NO: 1164987 - protein, 7 aa, Mycobacterium
KPNPRWS

SEQ ID NO: 1164988 - protein, 6 aa, Mycobacterium
KPPAFD

SEQ ID NO: 1164989 - protein, 7 aa, Mycobacterium
KPPEPKQ

SEQ ID NO: 1164990 - protein, 8 aa, Mycobacterium
KPPLGPGA

SEQ ID NO: 1164991 - protein, 13 aa, Mycobacterium
KPPLGRRGYHDGE

SEQ ID NO: 1164992 - protein, 6 aa, Mycobacterium
KPRLPA

SEQ ID NO: 1164993 - protein, 6 aa, Mycobacterium
KPRPSD

SEQ ID NO: 1164994 - protein, 12 aa, Mycobacterium
KPRQLSGGQQQR

SEQ ID NO: 1164995 - protein, 7 aa, Mycobacterium
KPRSGLS

SEQ ID NO: 1164996 - protein, 11 aa, Mycobacterium
KPSAGTASGPW

SEQ ID NO: 1164997 - protein, 6 aa, Mycobacterium
KPSSCP

SEQ ID NO: 1164998 - protein, 7 aa, Mycobacterium
KPSSYTG

SEQ ID NO: 1164999 - protein, 6 aa, Mycobacterium
KPSVTA

SEQ ID NO: 1165000 - protein, 5 aa, Mycobacterium
KPTEL

SEQ ID NO: 1165001 - protein, 4 aa, Mycobacterium
KPTI

SEQ ID NO: 1165002 - protein, 28 aa, Mycobacterium
KPTKRTRRLAGRTQVSANDAPRINKMLN

SEQ ID NO: 1165003 - protein, 5 aa, Mycobacterium
KPTPE

SEQ ID NO: 1165004 - protein, 5 aa, Mycobacterium
KPTQQ

SEQ ID NO: 1165005 - protein, 5 aa, Mycobacterium
KPTVR

SEQ ID NO: 1165006 - protein, 8 aa, Mycobacterium
KPTYARGD

SEQ ID NO: 1165007 - protein, 9 aa, Mycobacterium
KPVGEGTGL

SEQ ID NO: 1165008 - protein, 5 aa, Mycobacterium
KPVSA

SEQ ID NO: 1165009 - protein, 4 aa, Mycobacterium
KPWP

SEQ ID NO: 1165010 - protein, 4 aa, Mycobacterium
KPYD

SEQ ID NO: 1165011 - protein, 6 aa, Mycobacterium
KPYTAI

SEQ ID NO: 1165012 - protein, 8 aa, Mycobacterium
KPYTSGGA

SEQ ID NO: 1165013 - protein, 8 aa, Mycobacterium
KQAAENAP

SEQ ID NO: 1165014 - protein, 7 aa, Mycobacterium
KQAAQKR

SEQ ID NO: 1165015 - protein, 7 aa, Mycobacterium
KQAEEAC

SEQ ID NO: 1165016 - protein, 9 aa, Mycobacterium
KQAETAGHS

SEQ ID NO: 1165017 - protein, 6 aa, Mycobacterium
KQAGGK

SEQ ID NO: 1165018 - protein, 5 aa, Mycobacterium
KQAGV

SEQ ID NO: 1165019 - protein, 7 aa, Mycobacterium
KQDGVAR

SEQ ID NO: 1165020 - protein, 20 aa, Mycobacterium
KQDPEATVTAGNASGQNDAA

SEQ ID NO: 1165021 - protein, 6 aa, Mycobacterium
KQEGAG

SEQ ID NO: 1165022 - protein, 4 aa, Mycobacterium
KQES

SEQ ID NO: 1165023 - protein, 6 aa, Mycobacterium
KQEWTG

SEQ ID NO: 1165024 - protein, 10 aa, Mycobacterium
KQGDTGVRPA

SEQ ID NO: 1165025 - protein, 4 aa, Mycobacterium
KQGI

SEQ ID NO: 1165026 - protein, 23 aa, Mycobacterium
KQGLSTGLGDEGGFAPDVAGTKA

SEQ ID NO: 1165027 - protein, 10 aa, Mycobacterium
KQGPAPAPVT

SEQ ID NO: 1165028 - protein, 6 aa, Mycobacterium
KQGQTV

SEQ ID NO: 1165029 - protein, 8 aa, Mycobacterium
KQGTRTVR

SEQ ID NO: 1165030 - protein, 16 aa, Mycobacterium
KQKDVSARFGSREPDK

SEQ ID NO: 1165031 - protein, 4 aa, Mycobacterium
KQLT

SEQ ID NO: 1165032 - protein, 4 aa, Mycobacterium
KQPA

SEQ ID NO: 1165033 - protein, 8 aa, Mycobacterium
KQQNDSIE

SEQ ID NO: 1165034 - protein, 7 aa, Mycobacterium
KQRAGAS

SEQ ID NO: 1165035 - protein, 7 aa, Mycobacterium
KQRGAKG

SEQ ID NO: 1165036 - protein, 20 aa, Mycobacterium
KQRNGKDSGASVGDLATDPD

SEQ ID NO: 1165037 - protein, 7 aa, Mycobacterium
KQRSTEN

SEQ ID NO: 1165038 - protein, 4 aa, Mycobacterium
KQRT

SEQ ID NO: 1165039 - protein, 19 aa, Mycobacterium
KQSGLGRELGPDALDEYTE

SEQ ID NO: 1165040 - protein, 6 aa, Mycobacterium
KQSGRI

SEQ ID NO: 1165041 - protein, 11 aa, Mycobacterium
KQSNGKLETAG

SEQ ID NO: 1165042 - protein, 5 aa, Mycobacterium
KQVTA

SEQ ID NO: 1165043 - protein, 5 aa, Mycobacterium
KQWPG

SEQ ID NO: 1165044 - protein, 9 aa, Mycobacterium
KQYGDRPPW

SEQ ID NO: 1165045 - protein, 14 aa, Mycobacterium
KQYSQMDRGAYQSA

SEQ ID NO: 1165046 - protein, 8 aa, Mycobacterium
KRAAAAQR

SEQ ID NO: 1165047 - protein, 7 aa, Mycobacterium
KRAAQLR

SEQ ID NO: 1165048 - protein, 7 aa, Mycobacterium
KRADDPL

SEQ ID NO: 1165049 - protein, 7 aa, Mycobacterium
KRAENSA

SEQ ID NO: 1165050 - protein, 8 aa, Mycobacterium
KRAEPGDD

SEQ ID NO: 1165051 - protein, 6 aa, Mycobacterium
KRAERA

SEQ ID NO: 1165052 - protein, 5 aa, Mycobacterium
KRAET

SEQ ID NO: 1165053 - protein, 32 aa, Mycobacterium
KRAGLNRDVPDPKGARFGRDADGELDGTAEET

SEQ ID NO: 1165054 - protein, 7 aa, Mycobacterium
KRARSGL

SEQ ID NO: 1165055 - protein, 10 aa, Mycobacterium
KRASPSRGAL

SEQ ID NO: 1165056 - protein, 8 aa, Mycobacterium
KRATGATV

SEQ ID NO: 1165057 - protein, 7 aa, Mycobacterium
KRDGAPQ

SEQ ID NO: 1165058 - protein, 6 aa, Mycobacterium
KRDGRE

SEQ ID NO: 1165059 - protein, 12 aa, Mycobacterium
KRDKAQGHLDAG

SEQ ID NO: 1165060 - protein, 5 aa, Mycobacterium
KRDNG

SEQ ID NO: 1165061 - protein, 10 aa, Mycobacterium
KRDTPDPIPG

SEQ ID NO: 1165062 - protein, 25 aa, Mycobacterium
KREHRADLTDTSPTDTIGPYPQWGE

SEQ ID NO: 1165063 - protein, 5 aa, Mycobacterium
KREIG

SEQ ID NO: 1165064 - protein, 6 aa, Mycobacterium
KREPGQ

SEQ ID NO: 1165065 - protein, 18 aa, Mycobacterium
KREYDASTGRAKSEADRL

SEQ ID NO: 1165066 - protein, 13 aa, Mycobacterium
KRFEPVDPKTSTE

SEQ ID NO: 1165067 - protein, 7 aa, Mycobacterium
KRFGGPG

SEQ ID NO: 1165068 - protein, 14 aa, Mycobacterium
KRFGPADAADAAKV

SEQ ID NO: 1165069 - protein, 11 aa, Mycobacterium
KRFRRTGTGKI

SEQ ID NO: 1165070 - protein, 8 aa, Mycobacterium
KRGAGNEI

SEQ ID NO: 1165071 - protein, 4 aa, Mycobacterium
KRGG

SEQ ID NO: 1165072 - protein, 10 aa, Mycobacterium
KRGGRPGPGI

SEQ ID NO: 1165073 - protein, 9 aa, Mycobacterium
KRGHSAEQI

SEQ ID NO: 1165074 - protein, 6 aa, Mycobacterium
KRGPGL

SEQ ID NO: 1165075 - protein, 11 aa, Mycobacterium
KRGSDDEHRER

SEQ ID NO: 1165076 - protein, 7 aa, Mycobacterium
KRGTPFP

SEQ ID NO: 1165077 - protein, 10 aa, Mycobacterium
KRIAGGTPAV

SEQ ID NO: 1165078 - protein, 14 aa, Mycobacterium
KRKPGQLSGGQQQR

SEQ ID NO: 1165079 - protein, 10 aa, Mycobacterium
KRLGESRKRD

SEQ ID NO: 1165080 - protein, 5 aa, Mycobacterium
KRLGR

SEQ ID NO: 1165081 - protein, 8 aa, Mycobacterium
KRLGTDKG

SEQ ID NO: 1165082 - protein, 6 aa, Mycobacterium
KRLKEN

SEQ ID NO: 1165083 - protein, 5 aa, Mycobacterium
KRNAD

SEQ ID NO: 1165084 - protein, 6 aa, Mycobacterium
KRNDGT

SEQ ID NO: 1165085 - protein, 7 aa, Mycobacterium
KRNPAAA

SEQ ID NO: 1165086 - protein, 7 aa, Mycobacterium
KRPALPE

SEQ ID NO: 1165087 - protein, 4 aa, Mycobacterium
KRPG

SEQ ID NO: 1165088 - protein, 7 aa, Mycobacterium
KRPGPDL

SEQ ID NO: 1165089 - protein, 31 aa, Mycobacterium
KRPGSAAARAAERASGEAAEQALGHHDDSQG

SEQ ID NO: 1165090 - protein, 14 aa, Mycobacterium
KRPGTPAADMPGQL

SEQ ID NO: 1165091 - protein, 5 aa, Mycobacterium
KRPHV

SEQ ID NO: 1165092 - protein, 16 aa, Mycobacterium
KRPRGRPRKTERDPAA

SEQ ID NO: 1165093 - protein, 6 aa, Mycobacterium
KRQQMS

SEQ ID NO: 1165094 - protein, 11 aa, Mycobacterium
KRQVGGDTADQ

SEQ ID NO: 1165095 - protein, 21 aa, Mycobacterium
KRRAAEAAAGVPANKRGRGLA

SEQ ID NO: 1165096 - protein, 4 aa, Mycobacterium
KRRN

SEQ ID NO: 1165097 - protein, 7 aa, Mycobacterium
KRRPEAS

SEQ ID NO: 1165098 - protein, 5 aa, Mycobacterium
KRSEL

SEQ ID NO: 1165099 - protein, 8 aa, Mycobacterium
KRTAQKVA

SEQ ID NO: 1165100 - protein, 7 aa, Mycobacterium
KRTDTRV

SEQ ID NO: 1165101 - protein, 5 aa, Mycobacterium
KRTGL

SEQ ID NO: 1165102 - protein, 9 aa, Mycobacterium
KRVEAEAKT

SEQ ID NO: 1165103 - protein, 14 aa, Mycobacterium
KRVSPGDGALRNPA

SEQ ID NO: 1165104 - protein, 10 aa, Mycobacterium
KRWPEERTTW

SEQ ID NO: 1165105 - protein, 6 aa, Mycobacterium
KRWPNG

SEQ ID NO: 1165106 - protein, 10 aa, Mycobacterium
KSAAETTGGL

SEQ ID NO: 1165107 - protein, 8 aa, Mycobacterium
KSAAGDVV

SEQ ID NO: 1165108 - protein, 20 aa, Mycobacterium
KSAAPPAGAPLPPPPPAAPG

SEQ ID NO: 1165109 - protein, 8 aa, Mycobacterium
KSAHPSAL

SEQ ID NO: 1165110 - protein, 9 aa, Mycobacterium
KSAKPGSPV

SEQ ID NO: 1165111 - protein, 10 aa, Mycobacterium
KSANGATYDA

SEQ ID NO: 1165112 - protein, 45 aa, Mycobacterium
KSAPRAEAATPAPPTPNRPRRRRRPPWRRDAAKDQQESDGPPTPA

SEQ ID NO: 1165113 - protein, 8 aa, Mycobacterium
KSAQSEAF

SEQ ID NO: 1165114 - protein, 14 aa, Mycobacterium
KSASQTRGSDKGEV

SEQ ID NO: 1165115 - protein, 6 aa, Mycobacterium
KSCAAQ

SEQ ID NO: 1165116 - protein, 7 aa, Mycobacterium
KSCPSSA

SEQ ID NO: 1165117 - protein, 15 aa, Mycobacterium
KSDIRESLDRFKTVF

SEQ ID NO: 1165118 - protein, 15 aa, Mycobacterium
KSDYPDGVDDHERPL

SEQ ID NO: 1165119 - protein, 4 aa, Mycobacterium
KSEA

SEQ ID NO: 1165120 - protein, 9 aa, Mycobacterium
KSEADGGFS

SEQ ID NO: 1165121 - protein, 19 aa, Mycobacterium
KSELPSTLKKSDAKAQRTF

SEQ ID NO: 1165122 - protein, 8 aa, Mycobacterium
KSESGNHL

SEQ ID NO: 1165123 - protein, 12 aa, Mycobacterium
KSFDQPVRDARA

SEQ ID NO: 1165124 - protein, 6 aa, Mycobacterium
KSGADY

SEQ ID NO: 1165125 - protein, 8 aa, Mycobacterium
KSGAPSFV

SEQ ID NO: 1165126 - protein, 21 aa, Mycobacterium
KSGAPSQAIGRATPVHGKPGR

SEQ ID NO: 1165127 - protein, 10 aa, Mycobacterium
KSGASSAEMA

SEQ ID NO: 1165128 - protein, 7 aa, Mycobacterium
KSGDDAI

SEQ ID NO: 1165129 - protein, 7 aa, Mycobacterium
KSGDNAL

SEQ ID NO: 1165130 - protein, 12 aa, Mycobacterium
KSGEPGESGEGQ

SEQ ID NO: 1165131 - protein, 6 aa, Mycobacterium
KSGEVE

SEQ ID NO: 1165132 - protein, 5 aa, Mycobacterium
KSGPV

SEQ ID NO: 1165133 - protein, 7 aa, Mycobacterium
KSGRVRD

SEQ ID NO: 1165134 - protein, 6 aa, Mycobacterium
KSGVTS

SEQ ID NO: 1165135 - protein, 11 aa, Mycobacterium
KSHPADDGGKA

SEQ ID NO: 1165136 - protein, 8 aa, Mycobacterium
KSHSGGGD

SEQ ID NO: 1165137 - protein, 6 aa, Mycobacterium
KSHSVT

SEQ ID NO: 1165138 - protein, 4 aa, Mycobacterium
KSIR

SEQ ID NO: 1165139 - protein, 7 aa, Mycobacterium
KSISRNG

SEQ ID NO: 1165140 - protein, 16 aa, Mycobacterium
KSITVGSQGSGTGEVS

SEQ ID NO: 1165141 - protein, 17 aa, Mycobacterium
KSLADDPFRAPDADTLG

SEQ ID NO: 1165142 - protein, 11 aa, Mycobacterium
KSLKNSVSPDE

SEQ ID NO: 1165143 - protein, 7 aa, Mycobacterium
KSLKSVG

SEQ ID NO: 1165144 - protein, 6 aa, Mycobacterium
KSLNTD

SEQ ID NO: 1165145 - protein, 7 aa, Mycobacterium
KSNGGTL

SEQ ID NO: 1165146 - protein, 7 aa, Mycobacterium
KSPEMTA

SEQ ID NO: 1165147 - protein, 9 aa, Mycobacterium
KSPGEARDQ

SEQ ID NO: 1165148 - protein, 8 aa, Mycobacterium
KSPLHDPD

SEQ ID NO: 1165149 - protein, 14 aa, Mycobacterium
KSPNAPYEAGRRGA

SEQ ID NO: 1165150 - protein, 8 aa, Mycobacterium
KSPPAAYA

SEQ ID NO: 1165151 - protein, 5 aa, Mycobacterium
KSPQM

SEQ ID NO: 1165152 - protein, 6 aa, Mycobacterium
KSPVPI

SEQ ID NO: 1165153 - protein, 6 aa, Mycobacterium
KSQGKK

SEQ ID NO: 1165154 - protein, 5 aa, Mycobacterium
KSQIR

SEQ ID NO: 1165155 - protein, 5 aa, Mycobacterium
KSQLP

SEQ ID NO: 1165156 - protein, 6 aa, Mycobacterium
KSQVGA

SEQ ID NO: 1165157 - protein, 6 aa, Mycobacterium
KSRNEI

SEQ ID NO: 1165158 - protein, 6 aa, Mycobacterium
KSRSVP

SEQ ID NO: 1165159 - protein, 8 aa, Mycobacterium
KSRVQGAD

SEQ ID NO: 1165160 - protein, 4 aa, Mycobacterium
KSSD

SEQ ID NO: 1165161 - protein, 5 aa, Mycobacterium
KSSDW

SEQ ID NO: 1165162 - protein, 8 aa, Mycobacterium
KSSERSTY

SEQ ID NO: 1165163 - protein, 14 aa, Mycobacterium
KSSGYGRELGREGI

SEQ ID NO: 1165164 - protein, 7 aa, Mycobacterium
KSSWQQT

SEQ ID NO: 1165165 - protein, 9 aa, Mycobacterium
KSTDASPVR

SEQ ID NO: 1165166 - protein, 8 aa, Mycobacterium
KSTGNGYP

SEQ ID NO: 1165167 - protein, 6 aa, Mycobacterium
KSVHSS

SEQ ID NO: 1165168 - protein, 5 aa, Mycobacterium
KSVKN

SEQ ID NO: 1165169 - protein, 4 aa, Mycobacterium
KSVN

SEQ ID NO: 1165170 - protein, 8 aa, Mycobacterium
KSVRQAQG

SEQ ID NO: 1165171 - protein, 6 aa, Mycobacterium
KSYGGA

SEQ ID NO: 1165172 - protein, 7 aa, Mycobacterium
KSYVGEH

SEQ ID NO: 1165173 - protein, 14 aa, Mycobacterium
KTAEEVAQLQAEGV

SEQ ID NO: 1165174 - protein, 6 aa, Mycobacterium
KTAGAA

SEQ ID NO: 1165175 - protein, 6 aa, Mycobacterium
KTANTY

SEQ ID NO: 1165176 - protein, 5 aa, Mycobacterium
KTAQA

SEQ ID NO: 1165177 - protein, 7 aa, Mycobacterium
KTARNHV

SEQ ID NO: 1165178 - protein, 7 aa, Mycobacterium
KTASYTV

SEQ ID NO: 1165179 - protein, 5 aa, Mycobacterium
KTDNR

SEQ ID NO: 1165180 - protein, 6 aa, Mycobacterium
KTDPTM

SEQ ID NO: 1165181 - protein, 6 aa, Mycobacterium
KTDVPV

SEQ ID NO: 1165182 - protein, 9 aa, Mycobacterium
KTEASGEPR

SEQ ID NO: 1165183 - protein, 8 aa, Mycobacterium
KTEFPSSE

SEQ ID NO: 1165184 - protein, 4 aa, Mycobacterium
KTEG

SEQ ID NO: 1165185 - protein, 16 aa, Mycobacterium
KTERSEKKESRGRSEF

SEQ ID NO: 1165186 - protein, 7 aa, Mycobacterium
KTGEPAP

SEQ ID NO: 1165187 - protein, 6 aa, Mycobacterium
KTGEQL

SEQ ID NO: 1165188 - protein, 7 aa, Mycobacterium
KTGKEFT

SEQ ID NO: 1165189 - protein, 5 aa, Mycobacterium
KTGQH

SEQ ID NO: 1165190 - protein, 5 aa, Mycobacterium
KTGQP

SEQ ID NO: 1165191 - protein, 4 aa, Mycobacterium
KTGR

SEQ ID NO: 1165192 - protein, 7 aa, Mycobacterium
KTGRPGA

SEQ ID NO: 1165193 - protein, 8 aa, Mycobacterium
KTGRSAEL

SEQ ID NO: 1165194 - protein, 7 aa, Mycobacterium
KTGRSYG

SEQ ID NO: 1165195 - protein, 6 aa, Mycobacterium
KTGSLA

SEQ ID NO: 1165196 - protein, 10 aa, Mycobacterium
KTKAGKGCGS

SEQ ID NO: 1165197 - protein, 22 aa, Mycobacterium
KTKATPADRAVEDYAQSARQLG

SEQ ID NO: 1165198 - protein, 5 aa, Mycobacterium
KTKTN

SEQ ID NO: 1165199 - protein, 9 aa, Mycobacterium
KTKTPAPDL

SEQ ID NO: 1165200 - protein, 4 aa, Mycobacterium
KTLA

SEQ ID NO: 1165201 - protein, 6 aa, Mycobacterium
KTLADA

SEQ ID NO: 1165202 - protein, 8 aa, Mycobacterium
KTLSDPTR

SEQ ID NO: 1165203 - protein, 10 aa, Mycobacterium
KTLSSPATLS

SEQ ID NO: 1165204 - protein, 5 aa, Mycobacterium
KTNEY

SEQ ID NO: 1165205 - protein, 6 aa, Mycobacterium
KTNGRI

SEQ ID NO: 1165206 - protein, 22 aa, Mycobacterium
KTNPQQPPAQQPPVNPQNPPLH

SEQ ID NO: 1165207 - protein, 8 aa, Mycobacterium
KTNTPRNF

SEQ ID NO: 1165208 - protein, 6 aa, Mycobacterium
KTPAAV

SEQ ID NO: 1165209 - protein, 6 aa, Mycobacterium
KTPEGA

SEQ ID NO: 1165210 - protein, 7 aa, Mycobacterium
KTPETAG

SEQ ID NO: 1165211 - protein, 8 aa, Mycobacterium
KTPPSRAE

SEQ ID NO: 1165212 - protein, 5 aa, Mycobacterium
KTPRS

SEQ ID NO: 1165213 - protein, 4 aa, Mycobacterium
KTRA

SEQ ID NO: 1165214 - protein, 12 aa, Mycobacterium
KTRLSSGDEYEQ

SEQ ID NO: 1165215 - protein, 16 aa, Mycobacterium
KTRNELEHEGQRHGVP

SEQ ID NO: 1165216 - protein, 6 aa, Mycobacterium
KTRRGL

SEQ ID NO: 1165217 - protein, 13 aa, Mycobacterium
KTSGGKYVAPPAI

SEQ ID NO: 1165218 - protein, 14 aa, Mycobacterium
KTSGIGARFGGPEG

SEQ ID NO: 1165219 - protein, 12 aa, Mycobacterium
KTSSGSPIPTYD

SEQ ID NO: 1165220 - protein, 8 aa, Mycobacterium
KTTPTHRA

SEQ ID NO: 1165221 - protein, 6 aa, Mycobacterium
KTTTDL

SEQ ID NO: 1165222 - protein, 10 aa, Mycobacterium
KTTTVPYRSG

SEQ ID NO: 1165223 - protein, 6 aa, Mycobacterium
KTVEAN

SEQ ID NO: 1165224 - protein, 8 aa, Mycobacterium
KTVRPEGD

SEQ ID NO: 1165225 - protein, 22 aa, Mycobacterium
KTVTQRWPSGIKDGAEFVIPTM

SEQ ID NO: 1165226 - protein, 76 aa, Mycobacterium
KTVTSEANRARRVGASKQTAPVAAAAAPQAAVEPEATEGPDADDSSALPEAEDTTASEASRSTETDDPTQDSDADK

SEQ ID NO: 1165227 - protein, 6 aa, Mycobacterium
KTWQEG

SEQ ID NO: 1165228 - protein, 6 aa, Mycobacterium
KTWSTS

SEQ ID NO: 1165229 - protein, 8 aa, Mycobacterium
KTYGRTSD

SEQ ID NO: 1165230 - protein, 5 aa, Mycobacterium
KVAAK

SEQ ID NO: 1165231 - protein, 5 aa, Mycobacterium
KVASW

SEQ ID NO: 1165232 - protein, 7 aa, Mycobacterium
KVDDPAI

SEQ ID NO: 1165233 - protein, 12 aa, Mycobacterium
KVDNDNASALRR

SEQ ID NO: 1165234 - protein, 10 aa, Mycobacterium
KVDPAADPAV

SEQ ID NO: 1165235 - protein, 8 aa, Mycobacterium
KVDPDAAA

SEQ ID NO: 1165236 - protein, 7 aa, Mycobacterium
KVDPKSD

SEQ ID NO: 1165237 - protein, 6 aa, Mycobacterium
KVDSGN

SEQ ID NO: 1165238 - protein, 8 aa, Mycobacterium
KVDSNHGT

SEQ ID NO: 1165239 - protein, 11 aa, Mycobacterium
KVDVTDSTVGA

SEQ ID NO: 1165240 - protein, 8 aa, Mycobacterium
KVEDDVAD

SEQ ID NO: 1165241 - protein, 14 aa, Mycobacterium
KVGDPAARDTEMGP

SEQ ID NO: 1165242 - protein, 20 aa, Mycobacterium
KVGDPGDKTAIGPVASKAQF

SEQ ID NO: 1165243 - protein, 4 aa, Mycobacterium
KVGE

SEQ ID NO: 1165244 - protein, 15 aa, Mycobacterium
KVGEAPKQSGVALPG

SEQ ID NO: 1165245 - protein, 21 aa, Mycobacterium
KVGGRGKAGGVKYAATADDAF

SEQ ID NO: 1165246 - protein, 23 aa, Mycobacterium
KVGNGDATVAPSGAGIHEVDVKV

SEQ ID NO: 1165247 - protein, 10 aa, Mycobacterium
KVGNGHPGTA

SEQ ID NO: 1165248 - protein, 10 aa, Mycobacterium
KVGPGDTAAA

SEQ ID NO: 1165249 - protein, 4 aa, Mycobacterium
KVGQ

SEQ ID NO: 1165250 - protein, 8 aa, Mycobacterium
KVMPGGTG

SEQ ID NO: 1165251 - protein, 5 aa, Mycobacterium
KVNDE

SEQ ID NO: 1165252 - protein, 4 aa, Mycobacterium
KVPG

SEQ ID NO: 1165253 - protein, 6 aa, Mycobacterium
KVPGRS

SEQ ID NO: 1165254 - protein, 6 aa, Mycobacterium
KVPPAS

SEQ ID NO: 1165255 - protein, 10 aa, Mycobacterium
KVPPKDFAPQ

SEQ ID NO: 1165256 - protein, 6 aa, Mycobacterium
KVPRER

SEQ ID NO: 1165257 - protein, 5 aa, Mycobacterium
KVQET

SEQ ID NO: 1165258 - protein, 22 aa, Mycobacterium
KVRAENRAKASVKGSGDGVTPA

SEQ ID NO: 1165259 - protein, 20 aa, Mycobacterium
KVRDAASSNWTDPEAQARAD

SEQ ID NO: 1165260 - protein, 6 aa, Mycobacterium
KVRPGE

SEQ ID NO: 1165261 - protein, 7 aa, Mycobacterium
KVRTRAG

SEQ ID NO: 1165262 - protein, 9 aa, Mycobacterium
KVSAEETAD

SEQ ID NO: 1165263 - protein, 9 aa, Mycobacterium
KVSGTAQRP

SEQ ID NO: 1165264 - protein, 6 aa, Mycobacterium
KVSSGS

SEQ ID NO: 1165265 - protein, 5 aa, Mycobacterium
KVSTR

SEQ ID NO: 1165266 - protein, 4 aa, Mycobacterium
KVTE

SEQ ID NO: 1165267 - protein, 7 aa, Mycobacterium
KVTENAE

SEQ ID NO: 1165268 - protein, 5 aa, Mycobacterium
KVTGR

SEQ ID NO: 1165269 - protein, 10 aa, Mycobacterium
KVTPKAPSRF

SEQ ID NO: 1165270 - protein, 6 aa, Mycobacterium
KWGRRG

SEQ ID NO: 1165271 - protein, 5 aa, Mycobacterium
KWQER

SEQ ID NO: 1165272 - protein, 10 aa, Mycobacterium
KWSPDSGETI

SEQ ID NO: 1165273 - protein, 4 aa, Mycobacterium
KYAN

SEQ ID NO: 1165274 - protein, 16 aa, Mycobacterium
KYAQERAKRLRPEGAD

SEQ ID NO: 1165275 - protein, 7 aa, Mycobacterium
KYDDAVE

SEQ ID NO: 1165276 - protein, 7 aa, Mycobacterium
KYGAPTY

SEQ ID NO: 1165277 - protein, 4 aa, Mycobacterium
KYGN

SEQ ID NO: 1165278 - protein, 6 aa, Mycobacterium
KYKEEA

SEQ ID NO: 1165279 - protein, 5 aa, Mycobacterium
KYPNV

SEQ ID NO: 1165280 - protein, 20 aa, Mycobacterium
KYSDGMSVRGEGESLDLEEG

SEQ ID NO: 1165281 - protein, 4 aa, Mycobacterium
KYTG

SEQ ID NO: 1165282 - protein, 4 aa, Mycobacterium
LAAD

SEQ ID NO: 1165283 - protein, 5 aa, Mycobacterium
LAADE

SEQ ID NO: 1165284 - protein, 7 aa, Mycobacterium
LAADPRA

SEQ ID NO: 1165285 - protein, 18 aa, Mycobacterium
LAADSPRTRHTSGITQPP

SEQ ID NO: 1165286 - protein, 4 aa, Mycobacterium
LAAE

SEQ ID NO: 1165287 - protein, 5 aa, Mycobacterium
LAAEG

SEQ ID NO: 1165288 - protein, 8 aa, Mycobacterium
LAAEPAVR

SEQ ID NO: 1165289 - protein, 21 aa, Mycobacterium
LAAERGVQSELTTASESPNHR

SEQ ID NO: 1165290 - protein, 10 aa, Mycobacterium
LAAESDAPVR

SEQ ID NO: 1165291 - protein, 11 aa, Mycobacterium
LAAGGPDTLPV

SEQ ID NO: 1165292 - protein, 7 aa, Mycobacterium
LAAGPDG

SEQ ID NO: 1165293 - protein, 7 aa, Mycobacterium
LAAGSGL

SEQ ID NO: 1165294 - protein, 4 aa, Mycobacterium
LAAP

SEQ ID NO: 1165295 - protein, 7 aa, Mycobacterium
LAAPPVA

SEQ ID NO: 1165296 - protein, 18 aa, Mycobacterium
LAAQAKSALDGTDDATLR

SEQ ID NO: 1165297 - protein, 6 aa, Mycobacterium
LAAQTG

SEQ ID NO: 1165298 - protein, 5 aa, Mycobacterium
LAARG

SEQ ID NO: 1165299 - protein, 8 aa, Mycobacterium
LAARSDEL

SEQ ID NO: 1165300 - protein, 6 aa, Mycobacterium
LAASGH

SEQ ID NO: 1165301 - protein, 12 aa, Mycobacterium
LAATELGEEDLT

SEQ ID NO: 1165302 - protein, 7 aa, Mycobacterium
LADAGQR

SEQ ID NO: 1165303 - protein, 7 aa, Mycobacterium
LADAPPE

SEQ ID NO: 1165304 - protein, 18 aa, Mycobacterium
LADDLGPGSVADLADSAR

SEQ ID NO: 1165305 - protein, 8 aa, Mycobacterium
LADGGAGV

SEQ ID NO: 1165306 - protein, 18 aa, Mycobacterium
LADGPLPTHYEPHESPVR

SEQ ID NO: 1165307 - protein, 8 aa, Mycobacterium
LADGSGSV

SEQ ID NO: 1165308 - protein, 9 aa, Mycobacterium
LADNGQGRA

SEQ ID NO: 1165309 - protein, 5 aa, Mycobacterium
LADPA

SEQ ID NO: 1165310 - protein, 5 aa, Mycobacterium
LADPD

SEQ ID NO: 1165311 - protein, 8 aa, Mycobacterium
LADPDDPT

SEQ ID NO: 1165312 - protein, 9 aa, Mycobacterium
LADPTRTET

SEQ ID NO: 1165313 - protein, 4 aa, Mycobacterium
LADQ

SEQ ID NO: 1165314 - protein, 8 aa, Mycobacterium
LADQPAGR

SEQ ID NO: 1165315 - protein, 8 aa, Mycobacterium
LADSDPYG

SEQ ID NO: 1165316 - protein, 8 aa, Mycobacterium
LADSGGDG

SEQ ID NO: 1165317 - protein, 11 aa, Mycobacterium
LADSPDIEGIP

SEQ ID NO: 1165318 - protein, 5 aa, Mycobacterium
LADTD

SEQ ID NO: 1165319 - protein, 10 aa, Mycobacterium
LADTGEADPV

SEQ ID NO: 1165320 - protein, 13 aa, Mycobacterium
LAEAAKAGTDGTD

SEQ ID NO: 1165321 - protein, 14 aa, Mycobacterium
LAEDRRAHPGDDLT

SEQ ID NO: 1165322 - protein, 9 aa, Mycobacterium
LAEEEPETA

SEQ ID NO: 1165323 - protein, 6 aa, Mycobacterium
LAEGGD

SEQ ID NO: 1165324 - protein, 7 aa, Mycobacterium
LAEGGRR

SEQ ID NO: 1165325 - protein, 7 aa, Mycobacterium
LAEGGTH

SEQ ID NO: 1165326 - protein, 8 aa, Mycobacterium
LAEGQRPT

SEQ ID NO: 1165327 - protein, 16 aa, Mycobacterium
LAEGRDEPLPSTIEDP

SEQ ID NO: 1165328 - protein, 9 aa, Mycobacterium
LAEKDPESL

SEQ ID NO: 1165329 - protein, 12 aa, Mycobacterium
LAEKKKQTGQPV

SEQ ID NO: 1165330 - protein, 6 aa, Mycobacterium
LAENYG

SEQ ID NO: 1165331 - protein, 23 aa, Mycobacterium
LAEQGSSREEFDANTRTEAEKAV

SEQ ID NO: 1165332 - protein, 6 aa, Mycobacterium
LAEQNR

SEQ ID NO: 1165333 - protein, 10 aa, Mycobacterium
LAERTGVPPE

SEQ ID NO: 1165334 - protein, 18 aa, Mycobacterium
LAERTNPAGRTGGVAEAL

SEQ ID NO: 1165335 - protein, 5 aa, Mycobacterium
LAESV

SEQ ID NO: 1165336 - protein, 18 aa, Mycobacterium
LAETEKEKRQQERAAKNG

SEQ ID NO: 1165337 - protein, 9 aa, Mycobacterium
LAGAGGTAY

SEQ ID NO: 1165338 - protein, 9 aa, Mycobacterium
LAGDSAPRS

SEQ ID NO: 1165339 - protein, 7 aa, Mycobacterium
LAGEPIT

SEQ ID NO: 1165340 - protein, 10 aa, Mycobacterium
LAGERGDDSV

SEQ ID NO: 1165341 - protein, 4 aa, Mycobacterium
LAGG

SEQ ID NO: 1165342 - protein, 42 aa, Mycobacterium
LAGGESDDAESRLPNLTQGQRVDAKELTPAGHQTSPPARYTE

SEQ ID NO: 1165343 - protein, 8 aa, Mycobacterium
LAGGKSTE

SEQ ID NO: 1165344 - protein, 6 aa, Mycobacterium
LAGGPA

SEQ ID NO: 1165345 - protein, 10 aa, Mycobacterium
LAGGPRRTEP

SEQ ID NO: 1165346 - protein, 26 aa, Mycobacterium
LAGGSDDLDPSDGVADDPWAPEDDWR

SEQ ID NO: 1165347 - protein, 5 aa, Mycobacterium
LAGGT

SEQ ID NO: 1165348 - protein, 6 aa, Mycobacterium
LAGGTD

SEQ ID NO: 1165349 - protein, 5 aa, Mycobacterium
LAGHP

SEQ ID NO: 1165350 - protein, 5 aa, Mycobacterium
LAGNT

SEQ ID NO: 1165351 - protein, 14 aa, Mycobacterium
LAGPAADAQRAQAT

SEQ ID NO: 1165352 - protein, 5 aa, Mycobacterium
LAGPD

SEQ ID NO: 1165353 - protein, 6 aa, Mycobacterium
LAGPDR

SEQ ID NO: 1165354 - protein, 5 aa, Mycobacterium
LAGQL

SEQ ID NO: 1165355 - protein, 4 aa, Mycobacterium
LAGR

SEQ ID NO: 1165356 - protein, 5 aa, Mycobacterium
LAGRA

SEQ ID NO: 1165357 - protein, 6 aa, Mycobacterium
LAGRGI

SEQ ID NO: 1165358 - protein, 13 aa, Mycobacterium
LAGRSGILDDLAE

SEQ ID NO: 1165359 - protein, 6 aa, Mycobacterium
LAGTSV

SEQ ID NO: 1165360 - protein, 6 aa, Mycobacterium
LAGTTR

SEQ ID NO: 1165361 - protein, 10 aa, Mycobacterium
LAKPGTAEEI

SEQ ID NO: 1165362 - protein, 8 aa, Mycobacterium
LAKSPNTA

SEQ ID NO: 1165363 - protein, 6 aa, Mycobacterium
LAKTKK

SEQ ID NO: 1165364 - protein, 10 aa, Mycobacterium
LANQSEQAQR

SEQ ID NO: 1165365 - protein, 7 aa, Mycobacterium
LAPAQWG

SEQ ID NO: 1165366 - protein, 8 aa, Mycobacterium
LAPDDSVS

SEQ ID NO: 1165367 - protein, 7 aa, Mycobacterium
LAPDGPV

SEQ ID NO: 1165368 - protein, 8 aa, Mycobacterium
LAPDGTAA

SEQ ID NO: 1165369 - protein, 9 aa, Mycobacterium
LAPDSRPAA

SEQ ID NO: 1165370 - protein, 9 aa, Mycobacterium
LAPDSSSEY

SEQ ID NO: 1165371 - protein, 9 aa, Mycobacterium
LAPEEPAQK

SEQ ID NO: 1165372 - protein, 4 aa, Mycobacterium
LAPG

SEQ ID NO: 1165373 - protein, 5 aa, Mycobacterium
LAPGA

SEQ ID NO: 1165374 - protein, 6 aa, Mycobacterium
LAPGAS

SEQ ID NO: 1165375 - protein, 12 aa, Mycobacterium
LAPGPDATTDDE

SEQ ID NO: 1165376 - protein, 6 aa, Mycobacterium
LAPGQR

SEQ ID NO: 1165377 - protein, 9 aa, Mycobacterium
LAPGTPLRD

SEQ ID NO: 1165378 - protein, 17 aa, Mycobacterium
LAPKDDEERQKAIDAGH

SEQ ID NO: 1165379 - protein, 10 aa, Mycobacterium
LAPNPDAQAE

SEQ ID NO: 1165380 - protein, 9 aa, Mycobacterium
LAPPAGPAS

SEQ ID NO: 1165381 - protein, 7 aa, Mycobacterium
LAPPPVD

SEQ ID NO: 1165382 - protein, 9 aa, Mycobacterium
LAPSGECKR

SEQ ID NO: 1165383 - protein, 7 aa, Mycobacterium
LAPSYGL

SEQ ID NO: 1165384 - protein, 13 aa, Mycobacterium
LAPVGGAGGGMGP

SEQ ID NO: 1165385 - protein, 5 aa, Mycobacterium
LAQAG

SEQ ID NO: 1165386 - protein, 8 aa, Mycobacterium
LAQDGDTS

SEQ ID NO: 1165387 - protein, 9 aa, Mycobacterium
LAQEKTGEH

SEQ ID NO: 1165388 - protein, 8 aa, Mycobacterium
LAQETGGH

SEQ ID NO: 1165389 - protein, 16 aa, Mycobacterium
LAQGDTDRPVAPSSPD

SEQ ID NO: 1165390 - protein, 12 aa, Mycobacterium
LAQHGDRRRATT

SEQ ID NO: 1165391 - protein, 5 aa, Mycobacterium
LAQNP

SEQ ID NO: 1165392 - protein, 7 aa, Mycobacterium
LAQNSVQ

SEQ ID NO: 1165393 - protein, 5 aa, Mycobacterium
LAQPG

SEQ ID NO: 1165394 - protein, 6 aa, Mycobacterium
LAQRGQ

SEQ ID NO: 1165395 - protein, 9 aa, Mycobacterium
LAQSAPEAV

SEQ ID NO: 1165396 - protein, 5 aa, Mycobacterium
LAQTA

SEQ ID NO: 1165397 - protein, 10 aa, Mycobacterium
LAQTAENNGF

SEQ ID NO: 1165398 - protein, 14 aa, Mycobacterium
LARDSNGTMICADC

SEQ ID NO: 1165399 - protein, 5 aa, Mycobacterium
LARPG

SEQ ID NO: 1165400 - protein, 7 aa, Mycobacterium
LARPGGT

SEQ ID NO: 1165401 - protein, 7 aa, Mycobacterium
LARRDDE

SEQ ID NO: 1165402 - protein, 13 aa, Mycobacterium
LARREGEKAEQPT

SEQ ID NO: 1165403 - protein, 11 aa, Mycobacterium
LARSQSADIGS

SEQ ID NO: 1165404 - protein, 8 aa, Mycobacterium
LASAAEAL

SEQ ID NO: 1165405 - protein, 7 aa, Mycobacterium
LASAGNA

SEQ ID NO: 1165406 - protein, 11 aa, Mycobacterium
LASASGTRVGA

SEQ ID NO: 1165407 - protein, 4 aa, Mycobacterium
LASD

SEQ ID NO: 1165408 - protein, 15 aa, Mycobacterium
LASEKNGVMICSDCA

SEQ ID NO: 1165409 - protein, 5 aa, Mycobacterium
LASGG

SEQ ID NO: 1165410 - protein, 9 aa, Mycobacterium
LASKQQAKA

SEQ ID NO: 1165411 - protein, 10 aa, Mycobacterium
LASNGTPQQI

SEQ ID NO: 1165412 - protein, 6 aa, Mycobacterium
LASPAG

SEQ ID NO: 1165413 - protein, 9 aa, Mycobacterium
LASPGPSDL

SEQ ID NO: 1165414 - protein, 10 aa, Mycobacterium
LASPPKEVRS

SEQ ID NO: 1165415 - protein, 7 aa, Mycobacterium
LASSSTI

SEQ ID NO: 1165416 - protein, 9 aa, Mycobacterium
LASVGTATL

SEQ ID NO: 1165417 - protein, 7 aa, Mycobacterium
LATESSG

SEQ ID NO: 1165418 - protein, 5 aa, Mycobacterium
LATGA

SEQ ID NO: 1165419 - protein, 9 aa, Mycobacterium
LATGATQRI

SEQ ID NO: 1165420 - protein, 5 aa, Mycobacterium
LATGG

SEQ ID NO: 1165421 - protein, 13 aa, Mycobacterium
LATGGEHYRRATP

SEQ ID NO: 1165422 - protein, 10 aa, Mycobacterium
LATNVDSADL

SEQ ID NO: 1165423 - protein, 15 aa, Mycobacterium
LATPDAAGRRPLDDT

SEQ ID NO: 1165424 - protein, 7 aa, Mycobacterium
LATPDDL

SEQ ID NO: 1165425 - protein, 8 aa, Mycobacterium
LATPPPRI

SEQ ID NO: 1165426 - protein, 5 aa, Mycobacterium
LATPR

SEQ ID NO: 1165427 - protein, 6 aa, Mycobacterium
LATQES

SEQ ID NO: 1165428 - protein, 9 aa, Mycobacterium
LATRGAPRD

SEQ ID NO: 1165429 - protein, 4 aa, Mycobacterium
LATS

SEQ ID NO: 1165430 - protein, 23 aa, Mycobacterium
LATYDGRNRVNPPLREAGDAEAL

SEQ ID NO: 1165431 - protein, 9 aa, Mycobacterium
LDAADQDRL

SEQ ID NO: 1165432 - protein, 10 aa, Mycobacterium
LDAAERRARV

SEQ ID NO: 1165433 - protein, 8 aa, Mycobacterium
LDAAGTPF

SEQ ID NO: 1165434 - protein, 11 aa, Mycobacterium
LDADGSPITVE

SEQ ID NO: 1165435 - protein, 9 aa, Mycobacterium
LDAETTSEF

SEQ ID NO: 1165436 - protein, 8 aa, Mycobacterium
LDAGDEPF

SEQ ID NO: 1165437 - protein, 9 aa, Mycobacterium
LDAGGSESL

SEQ ID NO: 1165438 - protein, 5 aa, Mycobacterium
LDAKY

SEQ ID NO: 1165439 - protein, 8 aa, Mycobacterium
LDAPADDL

SEQ ID NO: 1165440 - protein, 6 aa, Mycobacterium
LDAPQR

SEQ ID NO: 1165441 - protein, 23 aa, Mycobacterium
LDAQPDGALPPSAQPYSTPYPAP

SEQ ID NO: 1165442 - protein, 8 aa, Mycobacterium
LDARQGER

SEQ ID NO: 1165443 - protein, 6 aa, Mycobacterium
LDASPL

SEQ ID NO: 1165444 - protein, 7 aa, Mycobacterium
LDDDEVA

SEQ ID NO: 1165445 - protein, 5 aa, Mycobacterium
LDDDG

SEQ ID NO: 1165446 - protein, 7 aa, Mycobacterium
LDDDSAA

SEQ ID NO: 1165447 - protein, 7 aa, Mycobacterium
LDDEASL

SEQ ID NO: 1165448 - protein, 10 aa, Mycobacterium
LDDEGNGAMR

SEQ ID NO: 1165449 - protein, 6 aa, Mycobacterium
LDDGGA

SEQ ID NO: 1165450 - protein, 8 aa, Mycobacterium
LDDGPARV

SEQ ID NO: 1165451 - protein, 13 aa, Mycobacterium
LDDGSVPTASTPK

SEQ ID NO: 1165452 - protein, 5 aa, Mycobacterium
LDDHG

SEQ ID NO: 1165453 - protein, 6 aa, Mycobacterium
LDDKRT

SEQ ID NO: 1165454 - protein, 10 aa, Mycobacterium
LDDPERPEQD

SEQ ID NO: 1165455 - protein, 4 aa, Mycobacterium
LDDQ

SEQ ID NO: 1165456 - protein, 10 aa, Mycobacterium
LDDQTADRHR

SEQ ID NO: 1165457 - protein, 13 aa, Mycobacterium
LDDSKKLGEKERE

SEQ ID NO: 1165458 - protein, 10 aa, Mycobacterium
LDEAPASTLT

SEQ ID NO: 1165459 - protein, 5 aa, Mycobacterium
LDEDG

SEQ ID NO: 1165460 - protein, 7 aa, Mycobacterium
LDEDGDA

SEQ ID NO: 1165461 - protein, 17 aa, Mycobacterium
LDEEPDYAGAAAALEKA

SEQ ID NO: 1165462 - protein, 10 aa, Mycobacterium
LDEGKPDLAP

SEQ ID NO: 1165463 - protein, 8 aa, Mycobacterium
LDENHPDK

SEQ ID NO: 1165464 - protein, 6 aa, Mycobacterium
LDEPHE

SEQ ID NO: 1165465 - protein, 15 aa, Mycobacterium
LDEPIDSNAEYRDRQ

SEQ ID NO: 1165466 - protein, 5 aa, Mycobacterium
LDEPT

SEQ ID NO: 1165467 - protein, 7 aa, Mycobacterium
LDEQAAE

SEQ ID NO: 1165468 - protein, 10 aa, Mycobacterium
LDEQGRDATR

SEQ ID NO: 1165469 - protein, 71 aa, Mycobacterium
LDETATEVHQQAEANLESTREQAKREQMQAEQDREREIKESRETASERKQNAVQTAQKKAADAKQQADQIA

SEQ ID NO: 1165470 - protein, 15 aa, Mycobacterium
LDETETASPPPAGRG

SEQ ID NO: 1165471 - protein, 13 aa, Mycobacterium
LDGAMDQQKGAEI

SEQ ID NO: 1165472 - protein, 5 aa, Mycobacterium
LDGAP

SEQ ID NO: 1165473 - protein, 7 aa, Mycobacterium
LDGAQGA

SEQ ID NO: 1165474 - protein, 5 aa, Mycobacterium
LDGAR

SEQ ID NO: 1165475 - protein, 5 aa, Mycobacterium
LDGDD

SEQ ID NO: 1165476 - protein, 7 aa, Mycobacterium
LDGERPD

SEQ ID NO: 1165477 - protein, 7 aa, Mycobacterium
LDGESVG

SEQ ID NO: 1165478 - protein, 6 aa, Mycobacterium
LDGGAA

SEQ ID NO: 1165479 - protein, 16 aa, Mycobacterium
LDGGGSDVTAPKTVAT

SEQ ID NO: 1165480 - protein, 10 aa, Mycobacterium
LDGGPEHPSS

SEQ ID NO: 1165481 - protein, 12 aa, Mycobacterium
LDGGSTSQSAKV

SEQ ID NO: 1165482 - protein, 10 aa, Mycobacterium
LDGGTASGVA

SEQ ID NO: 1165483 - protein, 17 aa, Mycobacterium
LDGGTTYRSGARFGPSA

SEQ ID NO: 1165484 - protein, 4 aa, Mycobacterium
LDGH

SEQ ID NO: 1165485 - protein, 8 aa, Mycobacterium
LDGHDRGA

SEQ ID NO: 1165486 - protein, 5 aa, Mycobacterium
LDGLS

SEQ ID NO: 1165487 - protein, 6 aa, Mycobacterium
LDGNVT

SEQ ID NO: 1165488 - protein, 8 aa, Mycobacterium
LDGPDRDE

SEQ ID NO: 1165489 - protein, 9 aa, Mycobacterium
LDGPSSERH

SEQ ID NO: 1165490 - protein, 6 aa, Mycobacterium
LDGPYL

SEQ ID NO: 1165491 - protein, 9 aa, Mycobacterium
LDGQRTADV

SEQ ID NO: 1165492 - protein, 8 aa, Mycobacterium
LDGRADPG

SEQ ID NO: 1165493 - protein, 19 aa, Mycobacterium
LDGRARSAHSTVDKTEAER

SEQ ID NO: 1165494 - protein, 10 aa, Mycobacterium
LDGRPTDLPG

SEQ ID NO: 1165495 - protein, 9 aa, Mycobacterium
LDGRTYAGA

SEQ ID NO: 1165496 - protein, 7 aa, Mycobacterium
LDGSEWD

SEQ ID NO: 1165497 - protein, 15 aa, Mycobacterium
LDGSPAGGGSAAQSV

SEQ ID NO: 1165498 - protein, 9 aa, Mycobacterium
LDGTPLTAE

SEQ ID NO: 1165499 - protein, 10 aa, Mycobacterium
LDGTSTSLRE

SEQ ID NO: 1165500 - protein, 4 aa, Mycobacterium
LDIP

SEQ ID NO: 1165501 - protein, 9 aa, Mycobacterium
LDKEGAERA

SEQ ID NO: 1165502 - protein, 10 aa, Mycobacterium
LDKGDTEDGY

SEQ ID NO: 1165503 - protein, 8 aa, Mycobacterium
LDKPPGIA

SEQ ID NO: 1165504 - protein, 9 aa, Mycobacterium
LDKQSDGSW

SEQ ID NO: 1165505 - protein, 10 aa, Mycobacterium
LDLPPSPPKA

SEQ ID NO: 1165506 - protein, 4 aa, Mycobacterium
LDNA

SEQ ID NO: 1165507 - protein, 10 aa, Mycobacterium
LDNETREGAR

SEQ ID NO: 1165508 - protein, 14 aa, Mycobacterium
LDNRRTKYSIGSAA

SEQ ID NO: 1165509 - protein, 5 aa, Mycobacterium
LDPAA

SEQ ID NO: 1165510 - protein, 7 aa, Mycobacterium
LDPADGP

SEQ ID NO: 1165511 - protein, 9 aa, Mycobacterium
LDPATDAAA

SEQ ID NO: 1165512 - protein, 7 aa, Mycobacterium
LDPDATN

SEQ ID NO: 1165513 - protein, 7 aa, Mycobacterium
LDPDDAW

SEQ ID NO: 1165514 - protein, 13 aa, Mycobacterium
LDPDDDASARETM

SEQ ID NO: 1165515 - protein, 8 aa, Mycobacterium
LDPDEAAE

SEQ ID NO: 1165516 - protein, 17 aa, Mycobacterium
LDPDGTNSHLVDRFGEE

SEQ ID NO: 1165517 - protein, 6 aa, Mycobacterium
LDPDPG

SEQ ID NO: 1165518 - protein, 6 aa, Mycobacterium
LDPDSL

SEQ ID NO: 1165519 - protein, 5 aa, Mycobacterium
LDPDY

SEQ ID NO: 1165520 - protein, 4 aa, Mycobacterium
LDPE

SEQ ID NO: 1165521 - protein, 7 aa, Mycobacterium
LDPEDVE

SEQ ID NO: 1165522 - protein, 6 aa, Mycobacterium
LDPETL

SEQ ID NO: 1165523 - protein, 10 aa, Mycobacterium
LDPGGGDPAV

SEQ ID NO: 1165524 - protein, 6 aa, Mycobacterium
LDPHGL

SEQ ID NO: 1165525 - protein, 7 aa, Mycobacterium
LDPKLSH

SEQ ID NO: 1165526 - protein, 7 aa, Mycobacterium
LDPMDKN

SEQ ID NO: 1165527 - protein, 7 aa, Mycobacterium
LDPPGPD

SEQ ID NO: 1165528 - protein, 8 aa, Mycobacterium
LDPPGPGE

SEQ ID NO: 1165529 - protein, 6 aa, Mycobacterium
LDPQGQ

SEQ ID NO: 1165530 - protein, 4 aa, Mycobacterium
LDPR

SEQ ID NO: 1165531 - protein, 8 aa, Mycobacterium
LDPRKSGF

SEQ ID NO: 1165532 - protein, 14 aa, Mycobacterium
LDPSERAAATVYTS

SEQ ID NO: 1165533 - protein, 12 aa, Mycobacterium
LDPSGDRDRAAR

SEQ ID NO: 1165534 - protein, 13 aa, Mycobacterium
LDPSGNIVELFEN

SEQ ID NO: 1165535 - protein, 7 aa, Mycobacterium
LDPSGRV

SEQ ID NO: 1165536 - protein, 9 aa, Mycobacterium
LDPSNSVRH

SEQ ID NO: 1165537 - protein, 6 aa, Mycobacterium
LDPSPV

SEQ ID NO: 1165538 - protein, 12 aa, Mycobacterium
LDPSQPDDAPAR

SEQ ID NO: 1165539 - protein, 10 aa, Mycobacterium
LDPSSGGNTY

SEQ ID NO: 1165540 - protein, 9 aa, Mycobacterium
LDPTKGGVE

SEQ ID NO: 1165541 - protein, 5 aa, Mycobacterium
LDPVS

SEQ ID NO: 1165542 - protein, 9 aa, Mycobacterium
LDQAAGDPA

SEQ ID NO: 1165543 - protein, 10 aa, Mycobacterium
LDQPDTGTIT

SEQ ID NO: 1165544 - protein, 8 aa, Mycobacterium
LDQPTSDR

SEQ ID NO: 1165545 - protein, 4 aa, Mycobacterium
LDRE

SEQ ID NO: 1165546 - protein, 6 aa, Mycobacterium
LDRGGT

SEQ ID NO: 1165547 - protein, 8 aa, Mycobacterium
LDRKTDDA

SEQ ID NO: 1165548 - protein, 7 aa, Mycobacterium
LDRPDTT

SEQ ID NO: 1165549 - protein, 8 aa, Mycobacterium
LDRPGGSL

SEQ ID NO: 1165550 - protein, 8 aa, Mycobacterium
LDRRTATI

SEQ ID NO: 1165551 - protein, 8 aa, Mycobacterium
LDSDNLSE

SEQ ID NO: 1165552 - protein, 15 aa, Mycobacterium
LDSDTDPASLKSIVN

SEQ ID NO: 1165553 - protein, 9 aa, Mycobacterium
LDSEPGASV

SEQ ID NO: 1165554 - protein, 8 aa, Mycobacterium
LDSEPGRP

SEQ ID NO: 1165555 - protein, 7 aa, Mycobacterium
LDSPGDL

SEQ ID NO: 1165556 - protein, 7 aa, Mycobacterium
LDSSEAV

SEQ ID NO: 1165557 - protein, 15 aa, Mycobacterium
LDSSNRNVREAAERA

SEQ ID NO: 1165558 - protein, 5 aa, Mycobacterium
LDTAQ

SEQ ID NO: 1165559 - protein, 11 aa, Mycobacterium
LDTDRPASPLA

SEQ ID NO: 1165560 - protein, 8 aa, Mycobacterium
LDTEPFGG

SEQ ID NO: 1165561 - protein, 9 aa, Mycobacterium
LDTGKTASE

SEQ ID NO: 1165562 - protein, 10 aa, Mycobacterium
LDTKKYSPRL

SEQ ID NO: 1165563 - protein, 19 aa, Mycobacterium
LDTKPPRPLEDTSIPTGGI

SEQ ID NO: 1165564 - protein, 6 aa, Mycobacterium
LDTPIG

SEQ ID NO: 1165565 - protein, 19 aa, Mycobacterium
LDTPISDGDSVTILPAVAG

SEQ ID NO: 1165566 - protein, 5 aa, Mycobacterium
LDTPK

SEQ ID NO: 1165567 - protein, 7 aa, Mycobacterium
LDTPVPV

SEQ ID NO: 1165568 - protein, 14 aa, Mycobacterium
LDTPVTAQTARDFA

SEQ ID NO: 1165569 - protein, 8 aa, Mycobacterium
LDTSGGDV

SEQ ID NO: 1165570 - protein, 4 aa, Mycobacterium
LDTT

SEQ ID NO: 1165571 - protein, 6 aa, Mycobacterium
LDWPED

SEQ ID NO: 1165572 - protein, 5 aa, Mycobacterium
LEAEG

SEQ ID NO: 1165573 - protein, 22 aa, Mycobacterium
LEAEGAKSDVRRKVRDGGEREM

SEQ ID NO: 1165574 - protein, 7 aa, Mycobacterium
LEAGGAP

SEQ ID NO: 1165575 - protein, 18 aa, Mycobacterium
LEAGTRPEPDVTDAYDEA

SEQ ID NO: 1165576 - protein, 6 aa, Mycobacterium
LEANAP

SEQ ID NO: 1165577 - protein, 4 aa, Mycobacterium
LEAP

SEQ ID NO: 1165578 - protein, 7 aa, Mycobacterium
LEARGRG

SEQ ID NO: 1165579 - protein, 15 aa, Mycobacterium
LEASASRAQSRGGIA

SEQ ID NO: 1165580 - protein, 10 aa, Mycobacterium
LEASNDPQDL

SEQ ID NO: 1165581 - protein, 12 aa, Mycobacterium
LEASRPVGVSRL

SEQ ID NO: 1165582 - protein, 5 aa, Mycobacterium
LEDAE

SEQ ID NO: 1165583 - protein, 9 aa, Mycobacterium
LEDDPSRPR

SEQ ID NO: 1165584 - protein, 5 aa, Mycobacterium
LEDGP

SEQ ID NO: 1165585 - protein, 6 aa, Mycobacterium
LEDKGV

SEQ ID NO: 1165586 - protein, 10 aa, Mycobacterium
LEDKPADGYD

SEQ ID NO: 1165587 - protein, 8 aa, Mycobacterium
LEDPPPVK

SEQ ID NO: 1165588 - protein, 7 aa, Mycobacterium
LEDQGYD

SEQ ID NO: 1165589 - protein, 6 aa, Mycobacterium
LEDQQQ

SEQ ID NO: 1165590 - protein, 4 aa, Mycobacterium
LEEN

SEQ ID NO: 1165591 - protein, 5 aa, Mycobacterium
LEENP

SEQ ID NO: 1165592 - protein, 5 aa, Mycobacterium
LEENQ

SEQ ID NO: 1165593 - protein, 18 aa, Mycobacterium
LEEQPSAVRDRSAAITSD

SEQ ID NO: 1165594 - protein, 7 aa, Mycobacterium
LEESEEF

SEQ ID NO: 1165595 - protein, 12 aa, Mycobacterium
LEESSTAPSPGD

SEQ ID NO: 1165596 - protein, 5 aa, Mycobacterium
LEGAS

SEQ ID NO: 1165597 - protein, 6 aa, Mycobacterium
LEGDEK

SEQ ID NO: 1165598 - protein, 6 aa, Mycobacterium
LEGGRA

SEQ ID NO: 1165599 - protein, 16 aa, Mycobacterium
LEGKQGLTKPAGGPGT

SEQ ID NO: 1165600 - protein, 9 aa, Mycobacterium
LEGKQRASL

SEQ ID NO: 1165601 - protein, 13 aa, Mycobacterium
LEGLGDKRIEAEA

SEQ ID NO: 1165602 - protein, 4 aa, Mycobacterium
LEGP

SEQ ID NO: 1165603 - protein, 6 aa, Mycobacterium
LEGRDG

SEQ ID NO: 1165604 - protein, 69 aa, Mycobacterium
LEGSATAISNQDSEISQGDSDAGDTTGGTADAGTDSGTGGTSSADSGGSSDSGGSGSTGSSGDGGGSTA

SEQ ID NO: 1165605 - protein, 11 aa, Mycobacterium
LEGTDPAAAPR

SEQ ID NO: 1165606 - protein, 22 aa, Mycobacterium
LEHGTAGQERNDSGGGESGVEP

SEQ ID NO: 1165607 - protein, 9 aa, Mycobacterium
LEHPDGAES

SEQ ID NO: 1165608 - protein, 11 aa, Mycobacterium
LEHSDDLERAA

SEQ ID NO: 1165609 - protein, 14 aa, Mycobacterium
LENAQKGKAYSEKI

SEQ ID NO: 1165610 - protein, 7 aa, Mycobacterium
LENPGVD

SEQ ID NO: 1165611 - protein, 7 aa, Mycobacterium
LENQPTA

SEQ ID NO: 1165612 - protein, 11 aa, Mycobacterium
LENRSDDEAIT

SEQ ID NO: 1165613 - protein, 4 aa, Mycobacterium
LEPA

SEQ ID NO: 1165614 - protein, 4 aa, Mycobacterium
LEPD

SEQ ID NO: 1165615 - protein, 14 aa, Mycobacterium
LEPDARRGRGHSPH

SEQ ID NO: 1165616 - protein, 9 aa, Mycobacterium
LEPDPAAMA

SEQ ID NO: 1165617 - protein, 9 aa, Mycobacterium
LEPDSDGGF

SEQ ID NO: 1165618 - protein, 6 aa, Mycobacterium
LEPDTD

SEQ ID NO: 1165619 - protein, 6 aa, Mycobacterium
LEPEQR

SEQ ID NO: 1165620 - protein, 8 aa, Mycobacterium
LEPGAYSR

SEQ ID NO: 1165621 - protein, 15 aa, Mycobacterium
LEPGGRPDAPEPGPA

SEQ ID NO: 1165622 - protein, 5 aa, Mycobacterium
LEPGS

SEQ ID NO: 1165623 - protein, 5 aa, Mycobacterium
LEPMP

SEQ ID NO: 1165624 - protein, 6 aa, Mycobacterium
LEPMPD

SEQ ID NO: 1165625 - protein, 9 aa, Mycobacterium
LEPNGPTEK

SEQ ID NO: 1165626 - protein, 15 aa, Mycobacterium
LEPPAPTVTPAEPAV

SEQ ID NO: 1165627 - protein, 7 aa, Mycobacterium
LEPPTSG

SEQ ID NO: 1165628 - protein, 14 aa, Mycobacterium
LEPRADLPDPPRMP

SEQ ID NO: 1165629 - protein, 4 aa, Mycobacterium
LEPT

SEQ ID NO: 1165630 - protein, 10 aa, Mycobacterium
LEPTSGNTGI

SEQ ID NO: 1165631 - protein, 4 aa, Mycobacterium
LEQA

SEQ ID NO: 1165632 - protein, 11 aa, Mycobacterium
LEQEASDPNLW

SEQ ID NO: 1165633 - protein, 6 aa, Mycobacterium
LEQGTN

SEQ ID NO: 1165634 - protein, 14 aa, Mycobacterium
LEQPRAAVETAGGQ

SEQ ID NO: 1165635 - protein, 5 aa, Mycobacterium
LEQTP

SEQ ID NO: 1165636 - protein, 4 aa, Mycobacterium
LEQY

SEQ ID NO: 1165637 - protein, 5 aa, Mycobacterium
LERAQ

SEQ ID NO: 1165638 - protein, 12 aa, Mycobacterium
LERAQETAGPIA

SEQ ID NO: 1165639 - protein, 7 aa, Mycobacterium
LERDSAG

SEQ ID NO: 1165640 - protein, 19 aa, Mycobacterium
LERGVSAGKVTDREKSAAL

SEQ ID NO: 1165641 - protein, 8 aa, Mycobacterium
LERKPGQL

SEQ ID NO: 1165642 - protein, 5 aa, Mycobacterium
LERPD

SEQ ID NO: 1165643 - protein, 18 aa, Mycobacterium
LERTESRGGHTRDDYPSM

SEQ ID NO: 1165644 - protein, 6 aa, Mycobacterium
LERTSE

SEQ ID NO: 1165645 - protein, 5 aa, Mycobacterium
LESDG

SEQ ID NO: 1165646 - protein, 13 aa, Mycobacterium
LESEKPSPNGSAP

SEQ ID NO: 1165647 - protein, 17 aa, Mycobacterium
LESGGNGAERRTLGPST

SEQ ID NO: 1165648 - protein, 14 aa, Mycobacterium
LESGNLSVNSHSSV

SEQ ID NO: 1165649 - protein, 8 aa, Mycobacterium
LESGSPVR

SEQ ID NO: 1165650 - protein, 18 aa, Mycobacterium
LESGTDGWPPDGRAPQGC

SEQ ID NO: 1165651 - protein, 5 aa, Mycobacterium
LESPE

SEQ ID NO: 1165652 - protein, 5 aa, Mycobacterium
LESRD

SEQ ID NO: 1165653 - protein, 6 aa, Mycobacterium
LESSGV

SEQ ID NO: 1165654 - protein, 5 aa, Mycobacterium
LETEH

SEQ ID NO: 1165655 - protein, 14 aa, Mycobacterium
LETTPEDSRKDIHH

SEQ ID NO: 1165656 - protein, 9 aa, Mycobacterium
LEVPDSGPL

SEQ ID NO: 1165657 - protein, 13 aa, Mycobacterium
LEYPDGPRSVEPV

SEQ ID NO: 1165658 - protein, 7 aa, Mycobacterium
LFDTDDD

SEQ ID NO: 1165659 - protein, 7 aa, Mycobacterium
LFPPPDG

SEQ ID NO: 1165660 - protein, 16 aa, Mycobacterium
LGAAGATVDPDKRAQS

SEQ ID NO: 1165661 - protein, 4 aa, Mycobacterium
LGAD

SEQ ID NO: 1165662 - protein, 9 aa, Mycobacterium
LGADPGRIA

SEQ ID NO: 1165663 - protein, 6 aa, Mycobacterium
LGADRQ

SEQ ID NO: 1165664 - protein, 20 aa, Mycobacterium
LGAGGTGKGTAGTMRGATGA

SEQ ID NO: 1165665 - protein, 6 aa, Mycobacterium
LGAGQS

SEQ ID NO: 1165666 - protein, 9 aa, Mycobacterium
LGAGRSAAD

SEQ ID NO: 1165667 - protein, 9 aa, Mycobacterium
LGAPADSGA

SEQ ID NO: 1165668 - protein, 10 aa, Mycobacterium
LGAPGDVGNY

SEQ ID NO: 1165669 - protein, 10 aa, Mycobacterium
LGAPPSGNRL

SEQ ID NO: 1165670 - protein, 7 aa, Mycobacterium
LGAQRST

SEQ ID NO: 1165671 - protein, 11 aa, Mycobacterium
LGAQTDGERAA

SEQ ID NO: 1165672 - protein, 4 aa, Mycobacterium
LGAS

SEQ ID NO: 1165673 - protein, 9 aa, Mycobacterium
LGASPAAEL

SEQ ID NO: 1165674 - protein, 7 aa, Mycobacterium
LGATAEA

SEQ ID NO: 1165675 - protein, 8 aa, Mycobacterium
LGATTDTL

SEQ ID NO: 1165676 - protein, 6 aa, Mycobacterium
LGDAGR

SEQ ID NO: 1165677 - protein, 8 aa, Mycobacterium
LGDDAANP

SEQ ID NO: 1165678 - protein, 12 aa, Mycobacterium
LGDDADRAAQLD

SEQ ID NO: 1165679 - protein, 9 aa, Mycobacterium
LGDDATARQ

SEQ ID NO: 1165680 - protein, 12 aa, Mycobacterium
LGDDGEPTSDAE

SEQ ID NO: 1165681 - protein, 10 aa, Mycobacterium
LGDDPALARP

SEQ ID NO: 1165682 - protein, 10 aa, Mycobacterium
LGDDPSTLGA

SEQ ID NO: 1165683 - protein, 6 aa, Mycobacterium
LGDDYT

SEQ ID NO: 1165684 - protein, 9 aa, Mycobacterium
LGDEAGPAY

SEQ ID NO: 1165685 - protein, 5 aa, Mycobacterium
LGDEL

SEQ ID NO: 1165686 - protein, 5 aa, Mycobacterium
LGDET

SEQ ID NO: 1165687 - protein, 7 aa, Mycobacterium
LGDGALP

SEQ ID NO: 1165688 - protein, 9 aa, Mycobacterium
LGDGGQDRR

SEQ ID NO: 1165689 - protein, 5 aa, Mycobacterium
LGDGP

SEQ ID NO: 1165690 - protein, 21 aa, Mycobacterium
LGDGSPDTARDVSAAKVAASD

SEQ ID NO: 1165691 - protein, 12 aa, Mycobacterium
LGDGTSHWEGSA

SEQ ID NO: 1165692 - protein, 6 aa, Mycobacterium
LGDPQA

SEQ ID NO: 1165693 - protein, 9 aa, Mycobacterium
LGDQAAVDA

SEQ ID NO: 1165694 - protein, 7 aa, Mycobacterium
LGDQPEL

SEQ ID NO: 1165695 - protein, 10 aa, Mycobacterium
LGDQTQLPDI

SEQ ID NO: 1165696 - protein, 4 aa, Mycobacterium
LGDR

SEQ ID NO: 1165697 - protein, 15 aa, Mycobacterium
LGDRQRKALLEKFDQ

SEQ ID NO: 1165698 - protein, 7 aa, Mycobacterium
LGDRTTS

SEQ ID NO: 1165699 - protein, 10 aa, Mycobacterium
LGDTGADKKD

SEQ ID NO: 1165700 - protein, 12 aa, Mycobacterium
LGDTRARTRTGA

SEQ ID NO: 1165701 - protein, 5 aa, Mycobacterium
LGEAG

SEQ ID NO: 1165702 - protein, 9 aa, Mycobacterium
LGEATEDGL

SEQ ID NO: 1165703 - protein, 8 aa, Mycobacterium
LGEDGKPV

SEQ ID NO: 1165704 - protein, 11 aa, Mycobacterium
LGEDRVDPAPV

SEQ ID NO: 1165705 - protein, 5 aa, Mycobacterium
LGEER

SEQ ID NO: 1165706 - protein, 9 aa, Mycobacterium
LGENDTPAT

SEQ ID NO: 1165707 - protein, 15 aa, Mycobacterium
LGEPGDTVEVKDGYG

SEQ ID NO: 1165708 - protein, 12 aa, Mycobacterium
LGEPLNAEQTAR

SEQ ID NO: 1165709 - protein, 7 aa, Mycobacterium
LGEPQRL

SEQ ID NO: 1165710 - protein, 6 aa, Mycobacterium
LGERAG

SEQ ID NO: 1165711 - protein, 9 aa, Mycobacterium
LGERGTPPW

SEQ ID NO: 1165712 - protein, 7 aa, Mycobacterium
LGERPGQ

SEQ ID NO: 1165713 - protein, 7 aa, Mycobacterium
LGERPTM

SEQ ID NO: 1165714 - protein, 17 aa, Mycobacterium
LGESAGGGTLLRWCAPL

SEQ ID NO: 1165715 - protein, 11 aa, Mycobacterium
LGESRASARQL

SEQ ID NO: 1165716 - protein, 9 aa, Mycobacterium
LGETDAARR

SEQ ID NO: 1165717 - protein, 6 aa, Mycobacterium
LGEYQA

SEQ ID NO: 1165718 - protein, 7 aa, Mycobacterium
LGGAPKH

SEQ ID NO: 1165719 - protein, 8 aa, Mycobacterium
LGGAPPRT

SEQ ID NO: 1165720 - protein, 10 aa, Mycobacterium
LGGAQLPATV

SEQ ID NO: 1165721 - protein, 6 aa, Mycobacterium
LGGDEH

SEQ ID NO: 1165722 - protein, 9 aa, Mycobacterium
LGGDRAAGL

SEQ ID NO: 1165723 - protein, 7 aa, Mycobacterium
LGGDSAD

SEQ ID NO: 1165724 - protein, 6 aa, Mycobacterium
LGGEAL

SEQ ID NO: 1165725 - protein, 6 aa, Mycobacterium
LGGEGQ

SEQ ID NO: 1165726 - protein, 14 aa, Mycobacterium
LGGGDPGGADFDPD

SEQ ID NO: 1165727 - protein, 10 aa, Mycobacterium
LGGGDPSAAY

SEQ ID NO: 1165728 - protein, 6 aa, Mycobacterium
LGGGSR

SEQ ID NO: 1165729 - protein, 11 aa, Mycobacterium
LGGGSVSGNGV

SEQ ID NO: 1165730 - protein, 7 aa, Mycobacterium
LGGGTLR

SEQ ID NO: 1165731 - protein, 6 aa, Mycobacterium
LGGHGN

SEQ ID NO: 1165732 - protein, 5 aa, Mycobacterium
LGGKS

SEQ ID NO: 1165733 - protein, 7 aa, Mycobacterium
LGGPGYG

SEQ ID NO: 1165734 - protein, 6 aa, Mycobacterium
LGGPHT

SEQ ID NO: 1165735 - protein, 6 aa, Mycobacterium
LGGPNF

SEQ ID NO: 1165736 - protein, 10 aa, Mycobacterium
LGGPPVPEAV

SEQ ID NO: 1165737 - protein, 11 aa, Mycobacterium
LGGPTPADSPL

SEQ ID NO: 1165738 - protein, 17 aa, Mycobacterium
LGGPTQALATADEPAHS

SEQ ID NO: 1165739 - protein, 7 aa, Mycobacterium
LGGRGWQ

SEQ ID NO: 1165740 - protein, 11 aa, Mycobacterium
LGGRPVTTGTG

SEQ ID NO: 1165741 - protein, 12 aa, Mycobacterium
LGGRSPTVSPVA

SEQ ID NO: 1165742 - protein, 17 aa, Mycobacterium
LGGRTAAQAIEDGVEPR

SEQ ID NO: 1165743 - protein, 11 aa, Mycobacterium
LGGSEDGDEAG

SEQ ID NO: 1165744 - protein, 11 aa, Mycobacterium
LGGSPKGTPGA

SEQ ID NO: 1165745 - protein, 10 aa, Mycobacterium
LGGTDAPNSL

SEQ ID NO: 1165746 - protein, 13 aa, Mycobacterium
LGHKRKTKHHGEV

SEQ ID NO: 1165747 - protein, 27 aa, Mycobacterium
LGHPTRDPHGDPIPAADGRVPTPPARQ

SEQ ID NO: 1165748 - protein, 5 aa, Mycobacterium
LGHTG

SEQ ID NO: 1165749 - protein, 9 aa, Mycobacterium
LGKDAAREA

SEQ ID NO: 1165750 - protein, 9 aa, Mycobacterium
LGKPDKKAV

SEQ ID NO: 1165751 - protein, 8 aa, Mycobacterium
LGKSAPEI

SEQ ID NO: 1165752 - protein, 17 aa, Mycobacterium
LGLNTDKPITSSTLTEE

SEQ ID NO: 1165753 - protein, 7 aa, Mycobacterium
LGLPDDP

SEQ ID NO: 1165754 - protein, 5 aa, Mycobacterium
LGMPD

SEQ ID NO: 1165755 - protein, 8 aa, Mycobacterium
LGNPAAAR

SEQ ID NO: 1165756 - protein, 8 aa, Mycobacterium
LGNTPQRV

SEQ ID NO: 1165757 - protein, 8 aa, Mycobacterium
LGPAATLA

SEQ ID NO: 1165758 - protein, 23 aa, Mycobacterium
LGPAEKAPRGAKRQGAGATGRRQ

SEQ ID NO: 1165759 - protein, 7 aa, Mycobacterium
LGPAGAS

SEQ ID NO: 1165760 - protein, 7 aa, Mycobacterium
LGPAPDM

SEQ ID NO: 1165761 - protein, 9 aa, Mycobacterium
LGPATAGQI

SEQ ID NO: 1165762 - protein, 11 aa, Mycobacterium
LGPDGLGNSPA

SEQ ID NO: 1165763 - protein, 6 aa, Mycobacterium
LGPDQP

SEQ ID NO: 1165764 - protein, 4 aa, Mycobacterium
LGPE

SEQ ID NO: 1165765 - protein, 6 aa, Mycobacterium
LGPEDC

SEQ ID NO: 1165766 - protein, 6 aa, Mycobacterium
LGPEGK

SEQ ID NO: 1165767 - protein, 6 aa, Mycobacterium
LGPEHR

SEQ ID NO: 1165768 - protein, 5 aa, Mycobacterium
LGPEM

SEQ ID NO: 1165769 - protein, 7 aa, Mycobacterium
LGPEPDA

SEQ ID NO: 1165770 - protein, 9 aa, Mycobacterium
LGPERADRQ

SEQ ID NO: 1165771 - protein, 9 aa, Mycobacterium
LGPGPQPAV

SEQ ID NO: 1165772 - protein, 8 aa, Mycobacterium
LGPGRTRE

SEQ ID NO: 1165773 - protein, 6 aa, Mycobacterium
LGPGTL

SEQ ID NO: 1165774 - protein, 9 aa, Mycobacterium
LGPGTTEKA

SEQ ID NO: 1165775 - protein, 11 aa, Mycobacterium
LGPIRPPTTPA

SEQ ID NO: 1165776 - protein, 5 aa, Mycobacterium
LGPMG

SEQ ID NO: 1165777 - protein, 5 aa, Mycobacterium
LGPPI

SEQ ID NO: 1165778 - protein, 15 aa, Mycobacterium
LGPPREQLRRLETQV

SEQ ID NO: 1165779 - protein, 8 aa, Mycobacterium
LGPPSSLD

SEQ ID NO: 1165780 - protein, 8 aa, Mycobacterium
LGPQTGGA

SEQ ID NO: 1165781 - protein, 4 aa, Mycobacterium
LGPR

SEQ ID NO: 1165782 - protein, 5 aa, Mycobacterium
LGPRE

SEQ ID NO: 1165783 - protein, 6 aa, Mycobacterium
LGPRGR

SEQ ID NO: 1165784 - protein, 9 aa, Mycobacterium
LGPRPASPW

SEQ ID NO: 1165785 - protein, 9 aa, Mycobacterium
LGPSAPAES

SEQ ID NO: 1165786 - protein, 7 aa, Mycobacterium
LGPSARI

SEQ ID NO: 1165787 - protein, 10 aa, Mycobacterium
LGPSGKRPAY

SEQ ID NO: 1165788 - protein, 14 aa, Mycobacterium
LGPSLSDPGRRSVA

SEQ ID NO: 1165789 - protein, 19 aa, Mycobacterium
LGPTDAAYCGPEKRTRQTA

SEQ ID NO: 1165790 - protein, 11 aa, Mycobacterium
LGQDARAAAEE

SEQ ID NO: 1165791 - protein, 8 aa, Mycobacterium
LGQGGTSF

SEQ ID NO: 1165792 - protein, 11 aa, Mycobacterium
LGQGRSDDDPL

SEQ ID NO: 1165793 - protein, 10 aa, Mycobacterium
LGQQRSAVGP

SEQ ID NO: 1165794 - protein, 6 aa, Mycobacterium
LGRADS

SEQ ID NO: 1165795 - protein, 6 aa, Mycobacterium
LGRAGM

SEQ ID NO: 1165796 - protein, 10 aa, Mycobacterium
LGRAPTASEL

SEQ ID NO: 1165797 - protein, 7 aa, Mycobacterium
LGREPRG

SEQ ID NO: 1165798 - protein, 8 aa, Mycobacterium
LGRESEGQ

SEQ ID NO: 1165799 - protein, 6 aa, Mycobacterium
LGRGHT

SEQ ID NO: 1165800 - protein, 9 aa, Mycobacterium
LGRGKGAQA

SEQ ID NO: 1165801 - protein, 11 aa, Mycobacterium
LGRPGARDSAA

SEQ ID NO: 1165802 - protein, 10 aa, Mycobacterium
LGRPGTPEEI

SEQ ID NO: 1165803 - protein, 11 aa, Mycobacterium
LGRPPADDEFE

SEQ ID NO: 1165804 - protein, 10 aa, Mycobacterium
LGRPPTPTDL

SEQ ID NO: 1165805 - protein, 7 aa, Mycobacterium
LGRPTPC

SEQ ID NO: 1165806 - protein, 6 aa, Mycobacterium
LGRPVG

SEQ ID NO: 1165807 - protein, 7 aa, Mycobacterium
LGRQPEA

SEQ ID NO: 1165808 - protein, 6 aa, Mycobacterium
LGRRPA

SEQ ID NO: 1165809 - protein, 9 aa, Mycobacterium
LGRSENAVS

SEQ ID NO: 1165810 - protein, 9 aa, Mycobacterium
LGRSGQTKL

SEQ ID NO: 1165811 - protein, 9 aa, Mycobacterium
LGRSPTAQH

SEQ ID NO: 1165812 - protein, 10 aa, Mycobacterium
LGRSQAGAAA

SEQ ID NO: 1165813 - protein, 6 aa, Mycobacterium
LGSARD

SEQ ID NO: 1165814 - protein, 9 aa, Mycobacterium
LGSDPSVVR

SEQ ID NO: 1165815 - protein, 20 aa, Mycobacterium
LGSDTGRIAGATNSLADYNR

SEQ ID NO: 1165816 - protein, 11 aa, Mycobacterium
LGSEAQRERRK

SEQ ID NO: 1165817 - protein, 6 aa, Mycobacterium
LGSEHG

SEQ ID NO: 1165818 - protein, 33 aa, Mycobacterium
LGSGHNRRVQDDDPSVHAETDAFRNAGRQRDYR

SEQ ID NO: 1165819 - protein, 6 aa, Mycobacterium
LGSGQV

SEQ ID NO: 1165820 - protein, 8 aa, Mycobacterium
LGSGRSET

SEQ ID NO: 1165821 - protein, 6 aa, Mycobacterium
LGSLGD

SEQ ID NO: 1165822 - protein, 10 aa, Mycobacterium
LGSPQAAQTW

SEQ ID NO: 1165823 - protein, 6 aa, Mycobacterium
LGSQAD

SEQ ID NO: 1165824 - protein, 9 aa, Mycobacterium
LGSRTPGVM

SEQ ID NO: 1165825 - protein, 6 aa, Mycobacterium
LGSTGT

SEQ ID NO: 1165826 - protein, 7 aa, Mycobacterium
LGSVDED

SEQ ID NO: 1165827 - protein, 11 aa, Mycobacterium
LGTAPAQTLRA

SEQ ID NO: 1165828 - protein, 16 aa, Mycobacterium
LGTGEPPISGSTTVPA

SEQ ID NO: 1165829 - protein, 7 aa, Mycobacterium
LGTKPAG

SEQ ID NO: 1165830 - protein, 8 aa, Mycobacterium
LGTLDGQR

SEQ ID NO: 1165831 - protein, 6 aa, Mycobacterium
LGTLPG

SEQ ID NO: 1165832 - protein, 6 aa, Mycobacterium
LGTLTD

SEQ ID NO: 1165833 - protein, 18 aa, Mycobacterium
LGTNPRKSTKTGAGERDV

SEQ ID NO: 1165834 - protein, 13 aa, Mycobacterium
LGTNTDPYQRAEG

SEQ ID NO: 1165835 - protein, 7 aa, Mycobacterium
LGTPDAP

SEQ ID NO: 1165836 - protein, 7 aa, Mycobacterium
LGTPPAD

SEQ ID NO: 1165837 - protein, 7 aa, Mycobacterium
LGTPSGR

SEQ ID NO: 1165838 - protein, 8 aa, Mycobacterium
LGTSTADA

SEQ ID NO: 1165839 - protein, 9 aa, Mycobacterium
LGTTSTGLP

SEQ ID NO: 1165840 - protein, 12 aa, Mycobacterium
LGVDDPQYRHES

SEQ ID NO: 1165841 - protein, 5 aa, Mycobacterium
LGVDT

SEQ ID NO: 1165842 - protein, 6 aa, Mycobacterium
LGVGGR

SEQ ID NO: 1165843 - protein, 28 aa, Mycobacterium
LGVGSDSVRTNANADAWSANSPFTDEQQ

SEQ ID NO: 1165844 - protein, 4 aa, Mycobacterium
LGVP

SEQ ID NO: 1165845 - protein, 7 aa, Mycobacterium
LGVPGAA

SEQ ID NO: 1165846 - protein, 10 aa, Mycobacterium
LGYPGPDPVA

SEQ ID NO: 1165847 - protein, 15 aa, Mycobacterium
LGYPQPSNGDLSPWA

SEQ ID NO: 1165848 - protein, 16 aa, Mycobacterium
LHDAGDPGSGEASNMA

SEQ ID NO: 1165849 - protein, 5 aa, Mycobacterium
LHGPD

SEQ ID NO: 1165850 - protein, 14 aa, Mycobacterium
LHPDTNPDPSAAER

SEQ ID NO: 1165851 - protein, 13 aa, Mycobacterium
LHPPGKPDRARTE

SEQ ID NO: 1165852 - protein, 8 aa, Mycobacterium
LHPQDHGP

SEQ ID NO: 1165853 - protein, 8 aa, Mycobacterium
LHQGSDDE

SEQ ID NO: 1165854 - protein, 8 aa, Mycobacterium
LHSQERAH

SEQ ID NO: 1165855 - protein, 4 aa, Mycobacterium
LHTR

SEQ ID NO: 1165856 - protein, 11 aa, Mycobacterium
LIPAPRPGDPV

SEQ ID NO: 1165857 - protein, 8 aa, Mycobacterium
LKAKLDED

SEQ ID NO: 1165858 - protein, 14 aa, Mycobacterium
LKARPGDTAIEAGG

SEQ ID NO: 1165859 - protein, 7 aa, Mycobacterium
LKATGDP

SEQ ID NO: 1165860 - protein, 6 aa, Mycobacterium
LKDEPA

SEQ ID NO: 1165861 - protein, 4 aa, Mycobacterium
LKDG

SEQ ID NO: 1165862 - protein, 9 aa, Mycobacterium
LKDNPDELR

SEQ ID NO: 1165863 - protein, 7 aa, Mycobacterium
LKERTTD

SEQ ID NO: 1165864 - protein, 12 aa, Mycobacterium
LKGDGGSSWGNQ

SEQ ID NO: 1165865 - protein, 5 aa, Mycobacterium
LKGND

SEQ ID NO: 1165866 - protein, 10 aa, Mycobacterium
LKKSARGEYE

SEQ ID NO: 1165867 - protein, 10 aa, Mycobacterium
LKNQTYNTPA

SEQ ID NO: 1165868 - protein, 8 aa, Mycobacterium
LKPGDGEF

SEQ ID NO: 1165869 - protein, 14 aa, Mycobacterium
LKPGGHFDEVQPFA

SEQ ID NO: 1165870 - protein, 4 aa, Mycobacterium
LKQK

SEQ ID NO: 1165871 - protein, 5 aa, Mycobacterium
LKRDP

SEQ ID NO: 1165872 - protein, 9 aa, Mycobacterium
LKRSQSGQW

SEQ ID NO: 1165873 - protein, 5 aa, Mycobacterium
LKSGR

SEQ ID NO: 1165874 - protein, 9 aa, Mycobacterium
LKSTAYQYD

SEQ ID NO: 1165875 - protein, 12 aa, Mycobacterium
LKTAGPEDRRRA

SEQ ID NO: 1165876 - protein, 5 aa, Mycobacterium
LKTDR

SEQ ID NO: 1165877 - protein, 12 aa, Mycobacterium
LKTTTNRIAGRA

SEQ ID NO: 1165878 - protein, 13 aa, Mycobacterium
LLPGNKPQKSSKV

SEQ ID NO: 1165879 - protein, 9 aa, Mycobacterium
LMRPTGGKA

SEQ ID NO: 1165880 - protein, 13 aa, Mycobacterium
LNAAEGKADSDGA

SEQ ID NO: 1165881 - protein, 6 aa, Mycobacterium
LNAATK

SEQ ID NO: 1165882 - protein, 15 aa, Mycobacterium
LNANEQSKKDDNPLN

SEQ ID NO: 1165883 - protein, 4 aa, Mycobacterium
LNAP

SEQ ID NO: 1165884 - protein, 9 aa, Mycobacterium
LNASYNGYG

SEQ ID NO: 1165885 - protein, 4 aa, Mycobacterium
LNDA

SEQ ID NO: 1165886 - protein, 9 aa, Mycobacterium
LNDGPGESW

SEQ ID NO: 1165887 - protein, 7 aa, Mycobacterium
LNDPATG

SEQ ID NO: 1165888 - protein, 10 aa, Mycobacterium
LNEEKKPNSY

SEQ ID NO: 1165889 - protein, 9 aa, Mycobacterium
LNEPGAQAH

SEQ ID NO: 1165890 - protein, 14 aa, Mycobacterium
LNEQGQLAAPPAKE

SEQ ID NO: 1165891 - protein, 11 aa, Mycobacterium
LNESRGLDPAL

SEQ ID NO: 1165892 - protein, 11 aa, Mycobacterium
LNGARQVPGRH

SEQ ID NO: 1165893 - protein, 6 aa, Mycobacterium
LNGDGE

SEQ ID NO: 1165894 - protein, 5 aa, Mycobacterium
LNGDS

SEQ ID NO: 1165895 - protein, 5 aa, Mycobacterium
LNGPQ

SEQ ID NO: 1165896 - protein, 8 aa, Mycobacterium
LNGSGEMT

SEQ ID NO: 1165897 - protein, 8 aa, Mycobacterium
LNGSTPGG

SEQ ID NO: 1165898 - protein, 6 aa, Mycobacterium
LNGTGA

SEQ ID NO: 1165899 - protein, 8 aa, Mycobacterium
LNPAPTRE

SEQ ID NO: 1165900 - protein, 7 aa, Mycobacterium
LNPATGQ

SEQ ID NO: 1165901 - protein, 11 aa, Mycobacterium
LNPEQAQQAEW

SEQ ID NO: 1165902 - protein, 6 aa, Mycobacterium
LNPPAT

SEQ ID NO: 1165903 - protein, 6 aa, Mycobacterium
LNPQTG

SEQ ID NO: 1165904 - protein, 5 aa, Mycobacterium
LNQDQ

SEQ ID NO: 1165905 - protein, 21 aa, Mycobacterium
LNQPSGGTELATGAMRIDVGS

SEQ ID NO: 1165906 - protein, 14 aa, Mycobacterium
LNRAQRRASNGRSR

SEQ ID NO: 1165907 - protein, 4 aa, Mycobacterium
LNRE

SEQ ID NO: 1165908 - protein, 8 aa, Mycobacterium
LNRTPTGV

SEQ ID NO: 1165909 - protein, 11 aa, Mycobacterium
LNSRQSQHSEI

SEQ ID NO: 1165910 - protein, 11 aa, Mycobacterium
LNTGPGGRAQL

SEQ ID NO: 1165911 - protein, 15 aa, Mycobacterium
LNTPDPAETYSSSPH

SEQ ID NO: 1165912 - protein, 17 aa, Mycobacterium
LNTQPDPARDLPTVSAR

SEQ ID NO: 1165913 - protein, 7 aa, Mycobacterium
LPAAARE

SEQ ID NO: 1165914 - protein, 13 aa, Mycobacterium
LPAASRSEEERDG

SEQ ID NO: 1165915 - protein, 8 aa, Mycobacterium
LPADEAAA

SEQ ID NO: 1165916 - protein, 5 aa, Mycobacterium
LPADG

SEQ ID NO: 1165917 - protein, 7 aa, Mycobacterium
LPADGEW

SEQ ID NO: 1165918 - protein, 5 aa, Mycobacterium
LPADP

SEQ ID NO: 1165919 - protein, 10 aa, Mycobacterium
LPADPGRRGE

SEQ ID NO: 1165920 - protein, 9 aa, Mycobacterium
LPADQREHL

SEQ ID NO: 1165921 - protein, 9 aa, Mycobacterium
LPADTANLR

SEQ ID NO: 1165922 - protein, 13 aa, Mycobacterium
LPADYTETTTDTA

SEQ ID NO: 1165923 - protein, 9 aa, Mycobacterium
LPAEDPGPL

SEQ ID NO: 1165924 - protein, 7 aa, Mycobacterium
LPAGEAA

SEQ ID NO: 1165925 - protein, 8 aa, Mycobacterium
LPAGGGRF

SEQ ID NO: 1165926 - protein, 8 aa, Mycobacterium
LPAGQRDT

SEQ ID NO: 1165927 - protein, 19 aa, Mycobacterium
LPAGYERARRQRPVFANAA

SEQ ID NO: 1165928 - protein, 12 aa, Mycobacterium
LPANPPATQAEA

SEQ ID NO: 1165929 - protein, 10 aa, Mycobacterium
LPAPAAAPTL

SEQ ID NO: 1165930 - protein, 9 aa, Mycobacterium
LPAPPAPVA

SEQ ID NO: 1165931 - protein, 9 aa, Mycobacterium
LPAPPEDDV

SEQ ID NO: 1165932 - protein, 8 aa, Mycobacterium
LPAPPQPI

SEQ ID NO: 1165933 - protein, 10 aa, Mycobacterium
LPAREEDPYN

SEQ ID NO: 1165934 - protein, 8 aa, Mycobacterium
LPASQREE

SEQ ID NO: 1165935 - protein, 5 aa, Mycobacterium
LPASR

SEQ ID NO: 1165936 - protein, 4 aa, Mycobacterium
LPDA

SEQ ID NO: 1165937 - protein, 5 aa, Mycobacterium
LPDAE

SEQ ID NO: 1165938 - protein, 7 aa, Mycobacterium
LPDATQD

SEQ ID NO: 1165939 - protein, 8 aa, Mycobacterium
LPDDGVRE

SEQ ID NO: 1165940 - protein, 7 aa, Mycobacterium
LPDDPDY

SEQ ID NO: 1165941 - protein, 9 aa, Mycobacterium
LPDDPNAAI

SEQ ID NO: 1165942 - protein, 6 aa, Mycobacterium
LPDEGR

SEQ ID NO: 1165943 - protein, 6 aa, Mycobacterium
LPDETV

SEQ ID NO: 1165944 - protein, 9 aa, Mycobacterium
LPDGATLDG

SEQ ID NO: 1165945 - protein, 6 aa, Mycobacterium
LPDGGA

SEQ ID NO: 1165946 - protein, 6 aa, Mycobacterium
LPDGPH

SEQ ID NO: 1165947 - protein, 6 aa, Mycobacterium
LPDGSD

SEQ ID NO: 1165948 - protein, 11 aa, Mycobacterium
LPDGSEAPDNA

SEQ ID NO: 1165949 - protein, 10 aa, Mycobacterium
LPDGSLAERQ

SEQ ID NO: 1165950 - protein, 6 aa, Mycobacterium
LPDGSV

SEQ ID NO: 1165951 - protein, 28 aa, Mycobacterium
LPDGTPVSSGEGGRGVKVGGGGAHQPQF

SEQ ID NO: 1165952 - protein, 12 aa, Mycobacterium
LPDHDTAEREYA

SEQ ID NO: 1165953 - protein, 11 aa, Mycobacterium
LPDKTAETLTD

SEQ ID NO: 1165954 - protein, 4 aa, Mycobacterium
LPDP

SEQ ID NO: 1165955 - protein, 16 aa, Mycobacterium
LPDPAAGYPSSIPTIA

SEQ ID NO: 1165956 - protein, 5 aa, Mycobacterium
LPDPD

SEQ ID NO: 1165957 - protein, 7 aa, Mycobacterium
LPDPNHR

SEQ ID NO: 1165958 - protein, 8 aa, Mycobacterium
LPDPPQYA

SEQ ID NO: 1165959 - protein, 5 aa, Mycobacterium
LPDPV

SEQ ID NO: 1165960 - protein, 16 aa, Mycobacterium
LPDPVGTNVPTNPETV

SEQ ID NO: 1165961 - protein, 21 aa, Mycobacterium
LPDPVKGNAYTSGAERLPTTL

SEQ ID NO: 1165962 - protein, 6 aa, Mycobacterium
LPDSLA

SEQ ID NO: 1165963 - protein, 8 aa, Mycobacterium
LPDTKAGD

SEQ ID NO: 1165964 - protein, 5 aa, Mycobacterium
LPDTP

SEQ ID NO: 1165965 - protein, 6 aa, Mycobacterium
LPEAGS

SEQ ID NO: 1165966 - protein, 11 aa, Mycobacterium
LPEDAADTVTE

SEQ ID NO: 1165967 - protein, 12 aa, Mycobacterium
LPEDAGGIGGGA

SEQ ID NO: 1165968 - protein, 8 aa, Mycobacterium
LPEDQQRH

SEQ ID NO: 1165969 - protein, 26 aa, Mycobacterium
LPEEAQKSLGQQVPHPARLGDPDEYG

SEQ ID NO: 1165970 - protein, 7 aa, Mycobacterium
LPEEARA

SEQ ID NO: 1165971 - protein, 6 aa, Mycobacterium
LPEEPE

SEQ ID NO: 1165972 - protein, 9 aa, Mycobacterium
LPEETGLRP

SEQ ID NO: 1165973 - protein, 4 aa, Mycobacterium
LPEG

SEQ ID NO: 1165974 - protein, 5 aa, Mycobacterium
LPEGN

SEQ ID NO: 1165975 - protein, 14 aa, Mycobacterium
LPEGPRGWDAPTPA

SEQ ID NO: 1165976 - protein, 6 aa, Mycobacterium
LPEGRG

SEQ ID NO: 1165977 - protein, 9 aa, Mycobacterium
LPEGTPADK

SEQ ID NO: 1165978 - protein, 9 aa, Mycobacterium
LPEPDHAGD

SEQ ID NO: 1165979 - protein, 5 aa, Mycobacterium
LPEPF

SEQ ID NO: 1165980 - protein, 8 aa, Mycobacterium
LPEPGSYA

SEQ ID NO: 1165981 - protein, 8 aa, Mycobacterium
LPEPPLPG

SEQ ID NO: 1165982 - protein, 11 aa, Mycobacterium
LPEPQSTAQLR

SEQ ID NO: 1165983 - protein, 7 aa, Mycobacterium
LPEQDEL

SEQ ID NO: 1165984 - protein, 7 aa, Mycobacterium
LPESRAT

SEQ ID NO: 1165985 - protein, 4 aa, Mycobacterium
LPET

SEQ ID NO: 1165986 - protein, 11 aa, Mycobacterium
LPETLDKGARI

SEQ ID NO: 1165987 - protein, 11 aa, Mycobacterium
LPETSKAGARL

SEQ ID NO: 1165988 - protein, 5 aa, Mycobacterium
LPEYR

SEQ ID NO: 1165989 - protein, 6 aa, Mycobacterium
LPFTPG

SEQ ID NO: 1165990 - protein, 4 aa, Mycobacterium
LPGA

SEQ ID NO: 1165991 - protein, 14 aa, Mycobacterium
LPGAARAAAEASRP

SEQ ID NO: 1165992 - protein, 10 aa, Mycobacterium
LPGADLSGEE

SEQ ID NO: 1165993 - protein, 11 aa, Mycobacterium
LPGAEAVRAGR

SEQ ID NO: 1165994 - protein, 8 aa, Mycobacterium
LPGANADE

SEQ ID NO: 1165995 - protein, 5 aa, Mycobacterium
LPGAQ

SEQ ID NO: 1165996 - protein, 5 aa, Mycobacterium
LPGAR

SEQ ID NO: 1165997 - protein, 11 aa, Mycobacterium
LPGDPGYDSAA

SEQ ID NO: 1165998 - protein, 14 aa, Mycobacterium
LPGDRSDVRERSTT

SEQ ID NO: 1165999 - protein, 10 aa, Mycobacterium
LPGDVSDPDE

SEQ ID NO: 1166000 - protein, 8 aa, Mycobacterium
LPGESALG

SEQ ID NO: 1166001 - protein, 9 aa, Mycobacterium
LPGGAESGL

SEQ ID NO: 1166002 - protein, 5 aa, Mycobacterium
LPGGG

SEQ ID NO: 1166003 - protein, 6 aa, Mycobacterium
LPGGGF

SEQ ID NO: 1166004 - protein, 5 aa, Mycobacterium
LPGGK

SEQ ID NO: 1166005 - protein, 11 aa, Mycobacterium
LPGGSPRPYGG

SEQ ID NO: 1166006 - protein, 6 aa, Mycobacterium
LPGKPH

SEQ ID NO: 1166007 - protein, 19 aa, Mycobacterium
LPGLDSSRSTPPTSSTGPG

SEQ ID NO: 1166008 - protein, 27 aa, Mycobacterium
LPGLNSTSTLAAAAAPAVGGSDDPLTR

SEQ ID NO: 1166009 - protein, 6 aa, Mycobacterium
LPGPCG

SEQ ID NO: 1166010 - protein, 6 aa, Mycobacterium
LPGPEL

SEQ ID NO: 1166011 - protein, 5 aa, Mycobacterium
LPGPF

SEQ ID NO: 1166012 - protein, 6 aa, Mycobacterium
LPGPGA

SEQ ID NO: 1166013 - protein, 9 aa, Mycobacterium
LPGPGEPIE

SEQ ID NO: 1166014 - protein, 6 aa, Mycobacterium
LPGPRM

SEQ ID NO: 1166015 - protein, 5 aa, Mycobacterium
LPGRA

SEQ ID NO: 1166016 - protein, 7 aa, Mycobacterium
LPGRGPQ

SEQ ID NO: 1166017 - protein, 11 aa, Mycobacterium
LPGRGSTYSAS

SEQ ID NO: 1166018 - protein, 20 aa, Mycobacterium
LPGRPDAREGHRLLRPGIER

SEQ ID NO: 1166019 - protein, 8 aa, Mycobacterium
LPGRRGRA

SEQ ID NO: 1166020 - protein, 10 aa, Mycobacterium
LPGSASPVAI

SEQ ID NO: 1166021 - protein, 6 aa, Mycobacterium
LPGSEH

SEQ ID NO: 1166022 - protein, 11 aa, Mycobacterium
LPGSESDKMGP

SEQ ID NO: 1166023 - protein, 6 aa, Mycobacterium
LPGSGA

SEQ ID NO: 1166024 - protein, 9 aa, Mycobacterium
LPGSNPFGD

SEQ ID NO: 1166025 - protein, 15 aa, Mycobacterium
LPGSRNQLTDGVGEV

SEQ ID NO: 1166026 - protein, 9 aa, Mycobacterium
LPGSSAAET

SEQ ID NO: 1166027 - protein, 5 aa, Mycobacterium
LPGVD

SEQ ID NO: 1166028 - protein, 11 aa, Mycobacterium
LPHGPDEKNRV

SEQ ID NO: 1166029 - protein, 4 aa, Mycobacterium
LPHP

SEQ ID NO: 1166030 - protein, 7 aa, Mycobacterium
LPHPGDD

SEQ ID NO: 1166031 - protein, 6 aa, Mycobacterium
LPHTPD

SEQ ID NO: 1166032 - protein, 8 aa, Mycobacterium
LPIEGQPE

SEQ ID NO: 1166033 - protein, 9 aa, Mycobacterium
LPKGSTTEQ

SEQ ID NO: 1166034 - protein, 9 aa, Mycobacterium
LPKPGSGNV

SEQ ID NO: 1166035 - protein, 29 aa, Mycobacterium
LPKSAKANKVDKNADAQSAEQLQQQQQQQ

SEQ ID NO: 1166036 - protein, 10 aa, Mycobacterium
LPKSWDPGAV

SEQ ID NO: 1166037 - protein, 5 aa, Mycobacterium
LPLGA

SEQ ID NO: 1166038 - protein, 5 aa, Mycobacterium
LPLPE

SEQ ID NO: 1166039 - protein, 4 aa, Mycobacterium
LPLR

SEQ ID NO: 1166040 - protein, 6 aa, Mycobacterium
LPNAGH

SEQ ID NO: 1166041 - protein, 8 aa, Mycobacterium
LPNAPADV

SEQ ID NO: 1166042 - protein, 6 aa, Mycobacterium
LPNATE

SEQ ID NO: 1166043 - protein, 4 aa, Mycobacterium
LPNG

SEQ ID NO: 1166044 - protein, 4 aa, Mycobacterium
LPNI

SEQ ID NO: 1166045 - protein, 10 aa, Mycobacterium
LPNPEEPGAV

SEQ ID NO: 1166046 - protein, 16 aa, Mycobacterium
LPNQPGGSESTLPGPS

SEQ ID NO: 1166047 - protein, 4 aa, Mycobacterium
LPNR

SEQ ID NO: 1166048 - protein, 9 aa, Mycobacterium
LPNTTAVPT

SEQ ID NO: 1166049 - protein, 6 aa, Mycobacterium
LPPAAP

SEQ ID NO: 1166050 - protein, 11 aa, Mycobacterium
LPPAPSSTQGQ

SEQ ID NO: 1166051 - protein, 8 aa, Mycobacterium
LPPASDTS

SEQ ID NO: 1166052 - protein, 6 aa, Mycobacterium
LPPDRR

SEQ ID NO: 1166053 - protein, 6 aa, Mycobacterium
LPPDSW

SEQ ID NO: 1166054 - protein, 6 aa, Mycobacterium
LPPDTD

SEQ ID NO: 1166055 - protein, 6 aa, Mycobacterium
LPPDTP

SEQ ID NO: 1166056 - protein, 5 aa, Mycobacterium
LPPEA

SEQ ID NO: 1166057 - protein, 6 aa, Mycobacterium
LPPEGA

SEQ ID NO: 1166058 - protein, 5 aa, Mycobacterium
LPPEK

SEQ ID NO: 1166059 - protein, 7 aa, Mycobacterium
LPPEPQD

SEQ ID NO: 1166060 - protein, 5 aa, Mycobacterium
LPPGD

SEQ ID NO: 1166061 - protein, 7 aa, Mycobacterium
LPPGPPV

SEQ ID NO: 1166062 - protein, 14 aa, Mycobacterium
LPPGRRGERRDPEA

SEQ ID NO: 1166063 - protein, 9 aa, Mycobacterium
LPPGSEPHG

SEQ ID NO: 1166064 - protein, 6 aa, Mycobacterium
LPPGTL

SEQ ID NO: 1166065 - protein, 4 aa, Mycobacterium
LPPH

SEQ ID NO: 1166066 - protein, 5 aa, Mycobacterium
LPPHP

SEQ ID NO: 1166067 - protein, 9 aa, Mycobacterium
LPPIEEPDE

SEQ ID NO: 1166068 - protein, 6 aa, Mycobacterium
LPPKGQ

SEQ ID NO: 1166069 - protein, 5 aa, Mycobacterium
LPPLP

SEQ ID NO: 1166070 - protein, 6 aa, Mycobacterium
LPPLSP

SEQ ID NO: 1166071 - protein, 6 aa, Mycobacterium
LPPNQV

SEQ ID NO: 1166072 - protein, 29 aa, Mycobacterium
LPPNTNGRFARPPQHTSKAAAPKIPADQV

SEQ ID NO: 1166073 - protein, 6 aa, Mycobacterium
LPPPGY

SEQ ID NO: 1166074 - protein, 7 aa, Mycobacterium
LPPPQRD

SEQ ID NO: 1166075 - protein, 39 aa, Mycobacterium
LPPPSGPEPAEPADAADEQAGSTIPGGPDIRPALGDPAE

SEQ ID NO: 1166076 - protein, 11 aa, Mycobacterium
LPPQPDAPEED

SEQ ID NO: 1166077 - protein, 6 aa, Mycobacterium
LPPRDQ

SEQ ID NO: 1166078 - protein, 5 aa, Mycobacterium
LPPSD

SEQ ID NO: 1166079 - protein, 5 aa, Mycobacterium
LPPSE

SEQ ID NO: 1166080 - protein, 8 aa, Mycobacterium
LPPSGPVT

SEQ ID NO: 1166081 - protein, 6 aa, Mycobacterium
LPPSRT

SEQ ID NO: 1166082 - protein, 15 aa, Mycobacterium
LPPSYRSTSRDDGIS

SEQ ID NO: 1166083 - protein, 9 aa, Mycobacterium
LPPTAGNYS

SEQ ID NO: 1166084 - protein, 5 aa, Mycobacterium
LPPVS

SEQ ID NO: 1166085 - protein, 8 aa, Mycobacterium
LPQPIKDR

SEQ ID NO: 1166086 - protein, 5 aa, Mycobacterium
LPQRA

SEQ ID NO: 1166087 - protein, 17 aa, Mycobacterium
LPQRAPLSAPLGAPAAA

SEQ ID NO: 1166088 - protein, 11 aa, Mycobacterium
LPRADRVGSEI

SEQ ID NO: 1166089 - protein, 7 aa, Mycobacterium
LPRDGAE

SEQ ID NO: 1166090 - protein, 6 aa, Mycobacterium
LPREER

SEQ ID NO: 1166091 - protein, 8 aa, Mycobacterium
LPREERDE

SEQ ID NO: 1166092 - protein, 6 aa, Mycobacterium
LPRGLE

SEQ ID NO: 1166093 - protein, 10 aa, Mycobacterium
LPRGRQPITS

SEQ ID NO: 1166094 - protein, 7 aa, Mycobacterium
LPRKSDY

SEQ ID NO: 1166095 - protein, 4 aa, Mycobacterium
LPRL

SEQ ID NO: 1166096 - protein, 10 aa, Mycobacterium
LPRPGGDADL

SEQ ID NO: 1166097 - protein, 7 aa, Mycobacterium
LPRPGQT

SEQ ID NO: 1166098 - protein, 12 aa, Mycobacterium
LPRTPGDADPGG

SEQ ID NO: 1166099 - protein, 6 aa, Mycobacterium
LPRTPS

SEQ ID NO: 1166100 - protein, 7 aa, Mycobacterium
LPSAAAS

SEQ ID NO: 1166101 - protein, 12 aa, Mycobacterium
LPSAGGGGGGVV

SEQ ID NO: 1166102 - protein, 5 aa, Mycobacterium
LPSAV

SEQ ID NO: 1166103 - protein, 20 aa, Mycobacterium
LPSDTNGAVATKPGFSRPAS

SEQ ID NO: 1166104 - protein, 5 aa, Mycobacterium
LPSER

SEQ ID NO: 1166105 - protein, 7 aa, Mycobacterium
LPSGVDE

SEQ ID NO: 1166106 - protein, 8 aa, Mycobacterium
LPSHPGHD

SEQ ID NO: 1166107 - protein, 9 aa, Mycobacterium
LPSPGGRQE

SEQ ID NO: 1166108 - protein, 16 aa, Mycobacterium
LPSPPRGYTPAPPPEW

SEQ ID NO: 1166109 - protein, 6 aa, Mycobacterium
LPSPTE

SEQ ID NO: 1166110 - protein, 7 aa, Mycobacterium
LPSQEQV

SEQ ID NO: 1166111 - protein, 7 aa, Mycobacterium
LPSTATN

SEQ ID NO: 1166112 - protein, 5 aa, Mycobacterium
LPSTE

SEQ ID NO: 1166113 - protein, 7 aa, Mycobacterium
LPSTPKG

SEQ ID NO: 1166114 - protein, 7 aa, Mycobacterium
LPSTPSH

SEQ ID NO: 1166115 - protein, 10 aa, Mycobacterium
LPSTSPAQTM

SEQ ID NO: 1166116 - protein, 5 aa, Mycobacterium
LPTAE

SEQ ID NO: 1166117 - protein, 10 aa, Mycobacterium
LPTASTPQEA

SEQ ID NO: 1166118 - protein, 8 aa, Mycobacterium
LPTDGTGR

SEQ ID NO: 1166119 - protein, 8 aa, Mycobacterium
LPTDPAAQ

SEQ ID NO: 1166120 - protein, 6 aa, Mycobacterium
LPTDPG

SEQ ID NO: 1166121 - protein, 8 aa, Mycobacterium
LPTEKGRL

SEQ ID NO: 1166122 - protein, 19 aa, Mycobacterium
LPTGATEEWAGGTAPLGDR

SEQ ID NO: 1166123 - protein, 10 aa, Mycobacterium
LPTGDPEAAA

SEQ ID NO: 1166124 - protein, 6 aa, Mycobacterium
LPTGIR

SEQ ID NO: 1166125 - protein, 12 aa, Mycobacterium
LPTGPGASEDEW

SEQ ID NO: 1166126 - protein, 6 aa, Mycobacterium
LPTLAG

SEQ ID NO: 1166127 - protein, 8 aa, Mycobacterium
LPTNATGK

SEQ ID NO: 1166128 - protein, 10 aa, Mycobacterium
LPTPAGAVGG

SEQ ID NO: 1166129 - protein, 10 aa, Mycobacterium
LPTPEEARAH

SEQ ID NO: 1166130 - protein, 7 aa, Mycobacterium
LPTPETL

SEQ ID NO: 1166131 - protein, 5 aa, Mycobacterium
LPTPG

SEQ ID NO: 1166132 - protein, 5 aa, Mycobacterium
LPTPS

SEQ ID NO: 1166133 - protein, 9 aa, Mycobacterium
LPTPSGDTF

SEQ ID NO: 1166134 - protein, 8 aa, Mycobacterium
LPTQAEEW

SEQ ID NO: 1166135 - protein, 6 aa, Mycobacterium
LPTRED

SEQ ID NO: 1166136 - protein, 6 aa, Mycobacterium
LPTRPT

SEQ ID NO: 1166137 - protein, 9 aa, Mycobacterium
LPTSGGAAA

SEQ ID NO: 1166138 - protein, 20 aa, Mycobacterium
LPTTERPTGLRDALTLVGLE

SEQ ID NO: 1166139 - protein, 8 aa, Mycobacterium
LPTTPAGV

SEQ ID NO: 1166140 - protein, 11 aa, Mycobacterium
LPTYENDDTAT

SEQ ID NO: 1166141 - protein, 4 aa, Mycobacterium
LPVA

SEQ ID NO: 1166142 - protein, 7 aa, Mycobacterium
LPVDTTR

SEQ ID NO: 1166143 - protein, 8 aa, Mycobacterium
LPVPPRLG

SEQ ID NO: 1166144 - protein, 8 aa, Mycobacterium
LPVQPDPA

SEQ ID NO: 1166145 - protein, 12 aa, Mycobacterium
LPYTPAPEAPGY

SEQ ID NO: 1166146 - protein, 4 aa, Mycobacterium
LQAA

SEQ ID NO: 1166147 - protein, 11 aa, Mycobacterium
LQAAKDSQIRA

SEQ ID NO: 1166148 - protein, 4 aa, Mycobacterium
LQAG

SEQ ID NO: 1166149 - protein, 6 aa, Mycobacterium
LQDKKE

SEQ ID NO: 1166150 - protein, 17 aa, Mycobacterium
LQDPGGDIELGRQTDED

SEQ ID NO: 1166151 - protein, 4 aa, Mycobacterium
LQDQ

SEQ ID NO: 1166152 - protein, 4 aa, Mycobacterium
LQDR

SEQ ID NO: 1166153 - protein, 6 aa, Mycobacterium
LQDRGS

SEQ ID NO: 1166154 - protein, 5 aa, Mycobacterium
LQEAG

SEQ ID NO: 1166155 - protein, 5 aa, Mycobacterium
LQGAG

SEQ ID NO: 1166156 - protein, 7 aa, Mycobacterium
LQGASSV

SEQ ID NO: 1166157 - protein, 13 aa, Mycobacterium
LQGDPNSDKPDAH

SEQ ID NO: 1166158 - protein, 15 aa, Mycobacterium
LQGEPRPLLQLVAEP

SEQ ID NO: 1166159 - protein, 4 aa, Mycobacterium
LQGG

SEQ ID NO: 1166160 - protein, 5 aa, Mycobacterium
LQGNN

SEQ ID NO: 1166161 - protein, 8 aa, Mycobacterium
LQKRSTGR

SEQ ID NO: 1166162 - protein, 15 aa, Mycobacterium
LQNAREEVDDASHEP

SEQ ID NO: 1166163 - protein, 5 aa, Mycobacterium
LQNPA

SEQ ID NO: 1166164 - protein, 14 aa, Mycobacterium
LQPDSAAVAETARA

SEQ ID NO: 1166165 - protein, 5 aa, Mycobacterium
LQPDT

SEQ ID NO: 1166166 - protein, 5 aa, Mycobacterium
LQPGD

SEQ ID NO: 1166167 - protein, 9 aa, Mycobacterium
LQPPGEFPD

SEQ ID NO: 1166168 - protein, 8 aa, Mycobacterium
LQPSDTRD

SEQ ID NO: 1166169 - protein, 11 aa, Mycobacterium
LQQAGPPAVNT

SEQ ID NO: 1166170 - protein, 9 aa, Mycobacterium
LQQKAGPAR

SEQ ID NO: 1166171 - protein, 13 aa, Mycobacterium
LQRDRANQQPDAE

SEQ ID NO: 1166172 - protein, 20 aa, Mycobacterium
LQRGQAALTGPVARGDAPAI

SEQ ID NO: 1166173 - protein, 6 aa, Mycobacterium
LQRGSS

SEQ ID NO: 1166174 - protein, 14 aa, Mycobacterium
LQSATRAHDDGRSV

SEQ ID NO: 1166175 - protein, 11 aa, Mycobacterium
LQSDRTAARDA

SEQ ID NO: 1166176 - protein, 8 aa, Mycobacterium
LQSDSDGI

SEQ ID NO: 1166177 - protein, 8 aa, Mycobacterium
LQSERSYN

SEQ ID NO: 1166178 - protein, 8 aa, Mycobacterium
LQSGERTD

SEQ ID NO: 1166179 - protein, 11 aa, Mycobacterium
LQSGGSHMSST

SEQ ID NO: 1166180 - protein, 6 aa, Mycobacterium
LQSPDQ

SEQ ID NO: 1166181 - protein, 14 aa, Mycobacterium
LQTEQEQLQAYITR

SEQ ID NO: 1166182 - protein, 5 aa, Mycobacterium
LQTHG

SEQ ID NO: 1166183 - protein, 7 aa, Mycobacterium
LQTPDDV

SEQ ID NO: 1166184 - protein, 8 aa, Mycobacterium
LQTTEACG

SEQ ID NO: 1166185 - protein, 7 aa, Mycobacterium
LQTYTRD

SEQ ID NO: 1166186 - protein, 8 aa, Mycobacterium
LRAAGADE

SEQ ID NO: 1166187 - protein, 6 aa, Mycobacterium
LRAEGD

SEQ ID NO: 1166188 - protein, 4 aa, Mycobacterium
LRAG

SEQ ID NO: 1166189 - protein, 11 aa, Mycobacterium
LRAQRESDRAA

SEQ ID NO: 1166190 - protein, 13 aa, Mycobacterium
LRASSDTTPACTP

SEQ ID NO: 1166191 - protein, 8 aa, Mycobacterium
LRASTRKA

SEQ ID NO: 1166192 - protein, 4 aa, Mycobacterium
LRDA

SEQ ID NO: 1166193 - protein, 8 aa, Mycobacterium
LRDAERDL

SEQ ID NO: 1166194 - protein, 10 aa, Mycobacterium
LRDAGHDEVA

SEQ ID NO: 1166195 - protein, 10 aa, Mycobacterium
LRDDDPNSAI

SEQ ID NO: 1166196 - protein, 12 aa, Mycobacterium
LRDDRKDTFERR

SEQ ID NO: 1166197 - protein, 8 aa, Mycobacterium
LRDGPDGR

SEQ ID NO: 1166198 - protein, 10 aa, Mycobacterium
LRDGSDDVSV

SEQ ID NO: 1166199 - protein, 9 aa, Mycobacterium
LRDGTEERI

SEQ ID NO: 1166200 - protein, 15 aa, Mycobacterium
LRDPSDTPQYDESDG

SEQ ID NO: 1166201 - protein, 5 aa, Mycobacterium
LRDSP

SEQ ID NO: 1166202 - protein, 7 aa, Mycobacterium
LREAGGG

SEQ ID NO: 1166203 - protein, 7 aa, Mycobacterium
LREDPGL

SEQ ID NO: 1166204 - protein, 12 aa, Mycobacterium
LREETGLRAGTV

SEQ ID NO: 1166205 - protein, 19 aa, Mycobacterium
LREGDEVREGDPSRWNSAA

SEQ ID NO: 1166206 - protein, 12 aa, Mycobacterium
LRENGTAATGGR

SEQ ID NO: 1166207 - protein, 12 aa, Mycobacterium
LREPDPDRQRRI

SEQ ID NO: 1166208 - protein, 8 aa, Mycobacterium
LREPGDPF

SEQ ID NO: 1166209 - protein, 9 aa, Mycobacterium
LREPSDADA

SEQ ID NO: 1166210 - protein, 6 aa, Mycobacterium
LRERTR

SEQ ID NO: 1166211 - protein, 14 aa, Mycobacterium
LRESSSVDQRSGVS

SEQ ID NO: 1166212 - protein, 9 aa, Mycobacterium
LRGDADGAF

SEQ ID NO: 1166213 - protein, 8 aa, Mycobacterium
LRGDRDPL

SEQ ID NO: 1166214 - protein, 4 aa, Mycobacterium
LRGE

SEQ ID NO: 1166215 - protein, 13 aa, Mycobacterium
LRGPGKTRALAQS

SEQ ID NO: 1166216 - protein, 22 aa, Mycobacterium
LRGSADRATAPKGTAPGTNDEI

SEQ ID NO: 1166217 - protein, 4 aa, Mycobacterium
LRHR

SEQ ID NO: 1166218 - protein, 8 aa, Mycobacterium
LRNGNGPA

SEQ ID NO: 1166219 - protein, 11 aa, Mycobacterium
LRNKPGEPLPV

SEQ ID NO: 1166220 - protein, 5 aa, Mycobacterium
LRPDA

SEQ ID NO: 1166221 - protein, 12 aa, Mycobacterium
LRPDKTPDDVVW

SEQ ID NO: 1166222 - protein, 6 aa, Mycobacterium
LRPEDF

SEQ ID NO: 1166223 - protein, 8 aa, Mycobacterium
LRPEGKHG

SEQ ID NO: 1166224 - protein, 6 aa, Mycobacterium
LRPGDP

SEQ ID NO: 1166225 - protein, 6 aa, Mycobacterium
LRPGDT

SEQ ID NO: 1166226 - protein, 7 aa, Mycobacterium
LRPGGRA

SEQ ID NO: 1166227 - protein, 12 aa, Mycobacterium
LRPPADGELADE

SEQ ID NO: 1166228 - protein, 10 aa, Mycobacterium
LRPPDADSRV

SEQ ID NO: 1166229 - protein, 6 aa, Mycobacterium
LRPPPP

SEQ ID NO: 1166230 - protein, 8 aa, Mycobacterium
LRPQQRTA

SEQ ID NO: 1166231 - protein, 6 aa, Mycobacterium
LRPSDV

SEQ ID NO: 1166232 - protein, 10 aa, Mycobacterium
LRPSTTGADA

SEQ ID NO: 1166233 - protein, 6 aa, Mycobacterium
LRPTDP

SEQ ID NO: 1166234 - protein, 6 aa, Mycobacterium
LRQEDP

SEQ ID NO: 1166235 - protein, 10 aa, Mycobacterium
LRQESDPSIR

SEQ ID NO: 1166236 - protein, 8 aa, Mycobacterium
LRRDADSP

SEQ ID NO: 1166237 - protein, 5 aa, Mycobacterium
LRRDP

SEQ ID NO: 1166238 - protein, 11 aa, Mycobacterium
LRREGKSVPPH

SEQ ID NO: 1166239 - protein, 6 aa, Mycobacterium
LRRENG

SEQ ID NO: 1166240 - protein, 4 aa, Mycobacterium
LRRG

SEQ ID NO: 1166241 - protein, 6 aa, Mycobacterium
LRRGAT

SEQ ID NO: 1166242 - protein, 9 aa, Mycobacterium
LRRRESQAR

SEQ ID NO: 1166243 - protein, 4 aa, Mycobacterium
LRSA

SEQ ID NO: 1166244 - protein, 6 aa, Mycobacterium
LRSDPG

SEQ ID NO: 1166245 - protein, 8 aa, Mycobacterium
LRSGDSNL

SEQ ID NO: 1166246 - protein, 18 aa, Mycobacterium
LRSGPTPRPAHESTALQL

SEQ ID NO: 1166247 - protein, 8 aa, Mycobacterium
LRSRQTRE

SEQ ID NO: 1166248 - protein, 8 aa, Mycobacterium
LRSSAYSP

SEQ ID NO: 1166249 - protein, 5 aa, Mycobacterium
LRSTG

SEQ ID NO: 1166250 - protein, 6 aa, Mycobacterium
LRSTSA

SEQ ID NO: 1166251 - protein, 11 aa, Mycobacterium
LRTASNALPRR

SEQ ID NO: 1166252 - protein, 5 aa, Mycobacterium
LRTDA

SEQ ID NO: 1166253 - protein, 7 aa, Mycobacterium
LRTDDGA

SEQ ID NO: 1166254 - protein, 11 aa, Mycobacterium
LRTEDGDEFTA

SEQ ID NO: 1166255 - protein, 8 aa, Mycobacterium
LRTEPEAS

SEQ ID NO: 1166256 - protein, 6 aa, Mycobacterium
LRTGDA

SEQ ID NO: 1166257 - protein, 12 aa, Mycobacterium
LRTGSRTTPSFD

SEQ ID NO: 1166258 - protein, 14 aa, Mycobacterium
LRTPDKKVHAAPPE

SEQ ID NO: 1166259 - protein, 13 aa, Mycobacterium
LRTRASDAIADGA

SEQ ID NO: 1166260 - protein, 18 aa, Mycobacterium
LRTSPRSDEVAKTPAAQK

SEQ ID NO: 1166261 - protein, 4 aa, Mycobacterium
LRTT

SEQ ID NO: 1166262 - protein, 11 aa, Mycobacterium
LRTTTDNRQRL

SEQ ID NO: 1166263 - protein, 12 aa, Mycobacterium
LRVTSGPALERA

SEQ ID NO: 1166264 - protein, 19 aa, Mycobacterium
LSAAANAVAGVSGEQQDPE

SEQ ID NO: 1166265 - protein, 7 aa, Mycobacterium
LSAAGSR

SEQ ID NO: 1166266 - protein, 12 aa, Mycobacterium
LSAASAAVPGVG

SEQ ID NO: 1166267 - protein, 8 aa, Mycobacterium
LSAEEADA

SEQ ID NO: 1166268 - protein, 7 aa, Mycobacterium
LSAEQYR

SEQ ID NO: 1166269 - protein, 8 aa, Mycobacterium
LSAERGAA

SEQ ID NO: 1166270 - protein, 10 aa, Mycobacterium
LSAGEEAQAA

SEQ ID NO: 1166271 - protein, 10 aa, Mycobacterium
LSAGQTPGDV

SEQ ID NO: 1166272 - protein, 24 aa, Mycobacterium
LSAGTGEVASPEVTSTRIAPESRT

SEQ ID NO: 1166273 - protein, 9 aa, Mycobacterium
LSAKGAPTI

SEQ ID NO: 1166274 - protein, 8 aa, Mycobacterium
LSANAPVR

SEQ ID NO: 1166275 - protein, 9 aa, Mycobacterium
LSAPAAKER

SEQ ID NO: 1166276 - protein, 11 aa, Mycobacterium
LSAPEGADAVD

SEQ ID NO: 1166277 - protein, 8 aa, Mycobacterium
LSAPEVEH

SEQ ID NO: 1166278 - protein, 24 aa, Mycobacterium
LSAPGSRVAAETAGVQAEDRRQQM

SEQ ID NO: 1166279 - protein, 14 aa, Mycobacterium
LSAPKPAKPAGGEV

SEQ ID NO: 1166280 - protein, 9 aa, Mycobacterium
LSAPTTEAG

SEQ ID NO: 1166281 - protein, 5 aa, Mycobacterium
LSAQG

SEQ ID NO: 1166282 - protein, 7 aa, Mycobacterium
LSARPGL

SEQ ID NO: 1166283 - protein, 6 aa, Mycobacterium
LSASGG

SEQ ID NO: 1166284 - protein, 14 aa, Mycobacterium
LSATAGAALPIVAV

SEQ ID NO: 1166285 - protein, 8 aa, Mycobacterium
LSATQSAV

SEQ ID NO: 1166286 - protein, 7 aa, Mycobacterium
LSDASTE

SEQ ID NO: 1166287 - protein, 10 aa, Mycobacterium
LSDATSDEAV

SEQ ID NO: 1166288 - protein, 12 aa, Mycobacterium
LSDEAAQTGAQK

SEQ ID NO: 1166289 - protein, 7 aa, Mycobacterium
LSDEDVE

SEQ ID NO: 1166290 - protein, 4 aa, Mycobacterium
LSDK

SEQ ID NO: 1166291 - protein, 6 aa, Mycobacterium
LSDPAL

SEQ ID NO: 1166292 - protein, 5 aa, Mycobacterium
LSDPD

SEQ ID NO: 1166293 - protein, 19 aa, Mycobacterium
LSDPNADYGLEAPPRGESV

SEQ ID NO: 1166294 - protein, 6 aa, Mycobacterium
LSDSAV

SEQ ID NO: 1166295 - protein, 15 aa, Mycobacterium
LSDSTKINPSGGTLA

SEQ ID NO: 1166296 - protein, 6 aa, Mycobacterium
LSDTDH

SEQ ID NO: 1166297 - protein, 8 aa, Mycobacterium
LSDTPAGS

SEQ ID NO: 1166298 - protein, 6 aa, Mycobacterium
LSEAAE

SEQ ID NO: 1166299 - protein, 6 aa, Mycobacterium
LSEAGL

SEQ ID NO: 1166300 - protein, 6 aa, Mycobacterium
LSEANA

SEQ ID NO: 1166301 - protein, 4 aa, Mycobacterium
LSED

SEQ ID NO: 1166302 - protein, 6 aa, Mycobacterium
LSEDGT

SEQ ID NO: 1166303 - protein, 6 aa, Mycobacterium
LSEDPD

SEQ ID NO: 1166304 - protein, 8 aa, Mycobacterium
LSEDPELA

SEQ ID NO: 1166305 - protein, 6 aa, Mycobacterium
LSEDPR

SEQ ID NO: 1166306 - protein, 7 aa, Mycobacterium
LSEGERK

SEQ ID NO: 1166307 - protein, 12 aa, Mycobacterium
LSEGGPAAAEKA

SEQ ID NO: 1166308 - protein, 7 aa, Mycobacterium
LSELGRE

SEQ ID NO: 1166309 - protein, 9 aa, Mycobacterium
LSEPTGAGV

SEQ ID NO: 1166310 - protein, 5 aa, Mycobacterium
LSEPV

SEQ ID NO: 1166311 - protein, 7 aa, Mycobacterium
LSEQAQR

SEQ ID NO: 1166312 - protein, 11 aa, Mycobacterium
LSESAISGSVD

SEQ ID NO: 1166313 - protein, 10 aa, Mycobacterium
LSESDGEGVA

SEQ ID NO: 1166314 - protein, 6 aa, Mycobacterium
LSETFG

SEQ ID NO: 1166315 - protein, 12 aa, Mycobacterium
LSETRWDGEGLR

SEQ ID NO: 1166316 - protein, 17 aa, Mycobacterium
LSGAGADAAAPRAAGGA

SEQ ID NO: 1166317 - protein, 7 aa, Mycobacterium
LSGAPVD

SEQ ID NO: 1166318 - protein, 11 aa, Mycobacterium
LSGDDSPAGVE

SEQ ID NO: 1166319 - protein, 8 aa, Mycobacterium
LSGDEKDA

SEQ ID NO: 1166320 - protein, 6 aa, Mycobacterium
LSGETN

SEQ ID NO: 1166321 - protein, 8 aa, Mycobacterium
LSGGGEAL

SEQ ID NO: 1166322 - protein, 8 aa, Mycobacterium
LSGGGKEV

SEQ ID NO: 1166323 - protein, 5 aa, Mycobacterium
LSGGM

SEQ ID NO: 1166324 - protein, 8 aa, Mycobacterium
LSGGQAAR

SEQ ID NO: 1166325 - protein, 13 aa, Mycobacterium
LSGHGDSGTRQSY

SEQ ID NO: 1166326 - protein, 7 aa, Mycobacterium
LSGPDGL

SEQ ID NO: 1166327 - protein, 7 aa, Mycobacterium
LSGPGKR

SEQ ID NO: 1166328 - protein, 36 aa, Mycobacterium
LSGQAKEALGRGASEVGTSTTTGDGGMTPEERGQSK

SEQ ID NO: 1166329 - protein, 8 aa, Mycobacterium
LSGQTPSV

SEQ ID NO: 1166330 - protein, 7 aa, Mycobacterium
LSGRRGR

SEQ ID NO: 1166331 - protein, 6 aa, Mycobacterium
LSGRSE

SEQ ID NO: 1166332 - protein, 17 aa, Mycobacterium
LSGSASSTLVRSGRADW

SEQ ID NO: 1166333 - protein, 8 aa, Mycobacterium
LSGSGDIR

SEQ ID NO: 1166334 - protein, 8 aa, Mycobacterium
LSGSPGMS

SEQ ID NO: 1166335 - protein, 11 aa, Mycobacterium
LSGSVVPQQQG

SEQ ID NO: 1166336 - protein, 10 aa, Mycobacterium
LSGTTRSAAV

SEQ ID NO: 1166337 - protein, 9 aa, Mycobacterium
LSKATARTT

SEQ ID NO: 1166338 - protein, 6 aa, Mycobacterium
LSKSQV

SEQ ID NO: 1166339 - protein, 4 aa, Mycobacterium
LSNG

SEQ ID NO: 1166340 - protein, 8 aa, Mycobacterium
LSNGDEVQ

SEQ ID NO: 1166341 - protein, 8 aa, Mycobacterium
LSNSPQPT

SEQ ID NO: 1166342 - protein, 6 aa, Mycobacterium
LSPAGM

SEQ ID NO: 1166343 - protein, 10 aa, Mycobacterium
LSPASGKPLA

SEQ ID NO: 1166344 - protein, 9 aa, Mycobacterium
LSPASTWRD

SEQ ID NO: 1166345 - protein, 9 aa, Mycobacterium
LSPCPAPRD

SEQ ID NO: 1166346 - protein, 4 aa, Mycobacterium
LSPD

SEQ ID NO: 1166347 - protein, 7 aa, Mycobacterium
LSPDPRQ

SEQ ID NO: 1166348 - protein, 6 aa, Mycobacterium
LSPDRL

SEQ ID NO: 1166349 - protein, 4 aa, Mycobacterium
LSPE

SEQ ID NO: 1166350 - protein, 9 aa, Mycobacterium
LSPEDRQTL

SEQ ID NO: 1166351 - protein, 15 aa, Mycobacterium
LSPEEQADKFRMAWS

SEQ ID NO: 1166352 - protein, 6 aa, Mycobacterium
LSPEPV

SEQ ID NO: 1166353 - protein, 7 aa, Mycobacterium
LSPEQPA

SEQ ID NO: 1166354 - protein, 6 aa, Mycobacterium
LSPETA

SEQ ID NO: 1166355 - protein, 8 aa, Mycobacterium
LSPGADVE

SEQ ID NO: 1166356 - protein, 11 aa, Mycobacterium
LSPGASGGSRL

SEQ ID NO: 1166357 - protein, 8 aa, Mycobacterium
LSPGGTIR

SEQ ID NO: 1166358 - protein, 6 aa, Mycobacterium
LSPKRY

SEQ ID NO: 1166359 - protein, 5 aa, Mycobacterium
LSPLS

SEQ ID NO: 1166360 - protein, 6 aa, Mycobacterium
LSPNRD

SEQ ID NO: 1166361 - protein, 9 aa, Mycobacterium
LSPQETVTA

SEQ ID NO: 1166362 - protein, 12 aa, Mycobacterium
LSPREGAAIGTA

SEQ ID NO: 1166363 - protein, 11 aa, Mycobacterium
LSPSAGTVSVT

SEQ ID NO: 1166364 - protein, 11 aa, Mycobacterium
LSPSPAKAVQE

SEQ ID NO: 1166365 - protein, 8 aa, Mycobacterium
LSPSQRTE

SEQ ID NO: 1166366 - protein, 12 aa, Mycobacterium
LSPSRAAAEDVR

SEQ ID NO: 1166367 - protein, 12 aa, Mycobacterium
LSPTAPTSSAAI

SEQ ID NO: 1166368 - protein, 6 aa, Mycobacterium
LSPTEG

SEQ ID NO: 1166369 - protein, 19 aa, Mycobacterium
LSQESKSRARDAAQRATDI

SEQ ID NO: 1166370 - protein, 6 aa, Mycobacterium
LSQGTD

SEQ ID NO: 1166371 - protein, 9 aa, Mycobacterium
LSQGTIKGD

SEQ ID NO: 1166372 - protein, 9 aa, Mycobacterium
LSQNARERN

SEQ ID NO: 1166373 - protein, 7 aa, Mycobacterium
LSQQPRF

SEQ ID NO: 1166374 - protein, 10 aa, Mycobacterium
LSQSYAGATM

SEQ ID NO: 1166375 - protein, 6 aa, Mycobacterium
LSQTRR

SEQ ID NO: 1166376 - protein, 9 aa, Mycobacterium
LSRDTDDTV

SEQ ID NO: 1166377 - protein, 7 aa, Mycobacterium
LSRPEER

SEQ ID NO: 1166378 - protein, 13 aa, Mycobacterium
LSRPRRPDDPAEA

SEQ ID NO: 1166379 - protein, 5 aa, Mycobacterium
LSRQD

SEQ ID NO: 1166380 - protein, 5 aa, Mycobacterium
LSRRA

SEQ ID NO: 1166381 - protein, 8 aa, Mycobacterium
LSRTGRPD

SEQ ID NO: 1166382 - protein, 9 aa, Mycobacterium
LSSDTDTDP

SEQ ID NO: 1166383 - protein, 8 aa, Mycobacterium
LSSNPIGA

SEQ ID NO: 1166384 - protein, 8 aa, Mycobacterium
LSSPSGLG

SEQ ID NO: 1166385 - protein, 4 aa, Mycobacterium
LSSR

SEQ ID NO: 1166386 - protein, 21 aa, Mycobacterium
LSSRGDQELGTAAVGDRIVGL

SEQ ID NO: 1166387 - protein, 5 aa, Mycobacterium
LSSSA

SEQ ID NO: 1166388 - protein, 9 aa, Mycobacterium
LSSSKYAID

SEQ ID NO: 1166389 - protein, 8 aa, Mycobacterium
LSSSRETA

SEQ ID NO: 1166390 - protein, 6 aa, Mycobacterium
LSTDDL

SEQ ID NO: 1166391 - protein, 15 aa, Mycobacterium
LSTDQSSERITGNEI

SEQ ID NO: 1166392 - protein, 6 aa, Mycobacterium
LSTEAI

SEQ ID NO: 1166393 - protein, 5 aa, Mycobacterium
LSTED

SEQ ID NO: 1166394 - protein, 12 aa, Mycobacterium
LSTETKNRALRA

SEQ ID NO: 1166395 - protein, 7 aa, Mycobacterium
LSTGGTA

SEQ ID NO: 1166396 - protein, 5 aa, Mycobacterium
LSTGS

SEQ ID NO: 1166397 - protein, 9 aa, Mycobacterium
LSTGSLANL

SEQ ID NO: 1166398 - protein, 6 aa, Mycobacterium
LSTGTV

SEQ ID NO: 1166399 - protein, 4 aa, Mycobacterium
LSTL

SEQ ID NO: 1166400 - protein, 6 aa, Mycobacterium
LSTNPM

SEQ ID NO: 1166401 - protein, 4 aa, Mycobacterium
LSTP

SEQ ID NO: 1166402 - protein, 10 aa, Mycobacterium
LSTPDGRARA

SEQ ID NO: 1166403 - protein, 10 aa, Mycobacterium
LSTPEDLAET

SEQ ID NO: 1166404 - protein, 7 aa, Mycobacterium
LSTPGVP

SEQ ID NO: 1166405 - protein, 6 aa, Mycobacterium
LSTPTG

SEQ ID NO: 1166406 - protein, 7 aa, Mycobacterium
LSTRSEA

SEQ ID NO: 1166407 - protein, 5 aa, Mycobacterium
LSTSS

SEQ ID NO: 1166408 - protein, 14 aa, Mycobacterium
LSVNRPSGDTVQAA

SEQ ID NO: 1166409 - protein, 4 aa, Mycobacterium
LSYP

SEQ ID NO: 1166410 - protein, 7 aa, Mycobacterium
LSYPGGE

SEQ ID NO: 1166411 - protein, 10 aa, Mycobacterium
LTAAQEASDV

SEQ ID NO: 1166412 - protein, 10 aa, Mycobacterium
LTAEEAERTG

SEQ ID NO: 1166413 - protein, 7 aa, Mycobacterium
LTAGGGD

SEQ ID NO: 1166414 - protein, 11 aa, Mycobacterium
LTAGRDANTRA

SEQ ID NO: 1166415 - protein, 4 aa, Mycobacterium
LTAK

SEQ ID NO: 1166416 - protein, 6 aa, Mycobacterium
LTANTP

SEQ ID NO: 1166417 - protein, 5 aa, Mycobacterium
LTAPE

SEQ ID NO: 1166418 - protein, 7 aa, Mycobacterium
LTAPPPV

SEQ ID NO: 1166419 - protein, 8 aa, Mycobacterium
LTAPRASH

SEQ ID NO: 1166420 - protein, 10 aa, Mycobacterium
LTAPSERAQS

SEQ ID NO: 1166421 - protein, 16 aa, Mycobacterium
LTATNSSVTEELQRDN

SEQ ID NO: 1166422 - protein, 4 aa, Mycobacterium
LTDA

SEQ ID NO: 1166423 - protein, 17 aa, Mycobacterium
LTDAAGRVERGSALQGN

SEQ ID NO: 1166424 - protein, 6 aa, Mycobacterium
LTDDPY

SEQ ID NO: 1166425 - protein, 4 aa, Mycobacterium
LTDE

SEQ ID NO: 1166426 - protein, 11 aa, Mycobacterium
LTDESERIGRP

SEQ ID NO: 1166427 - protein, 6 aa, Mycobacterium
LTDGDT

SEQ ID NO: 1166428 - protein, 9 aa, Mycobacterium
LTDGEPDKS

SEQ ID NO: 1166429 - protein, 7 aa, Mycobacterium
LTDGHPD

SEQ ID NO: 1166430 - protein, 8 aa, Mycobacterium
LTDGSERE

SEQ ID NO: 1166431 - protein, 7 aa, Mycobacterium
LTDPDGN

SEQ ID NO: 1166432 - protein, 11 aa, Mycobacterium
LTDPGHELAPG

SEQ ID NO: 1166433 - protein, 7 aa, Mycobacterium
LTDPRQG

SEQ ID NO: 1166434 - protein, 7 aa, Mycobacterium
LTDPSSD

SEQ ID NO: 1166435 - protein, 11 aa, Mycobacterium
LTDSPDAETAL

SEQ ID NO: 1166436 - protein, 4 aa, Mycobacterium
LTDT

SEQ ID NO: 1166437 - protein, 10 aa, Mycobacterium
LTDTSAKDLK

SEQ ID NO: 1166438 - protein, 6 aa, Mycobacterium
LTEAGQ

SEQ ID NO: 1166439 - protein, 9 aa, Mycobacterium
LTEDATADR

SEQ ID NO: 1166440 - protein, 8 aa, Mycobacterium
LTEDPEQL

SEQ ID NO: 1166441 - protein, 5 aa, Mycobacterium
LTEEE

SEQ ID NO: 1166442 - protein, 10 aa, Mycobacterium
LTEGDASPRV

SEQ ID NO: 1166443 - protein, 4 aa, Mycobacterium
LTEN

SEQ ID NO: 1166444 - protein, 7 aa, Mycobacterium
LTEPDEL

SEQ ID NO: 1166445 - protein, 5 aa, Mycobacterium
LTEPG

SEQ ID NO: 1166446 - protein, 9 aa, Mycobacterium
LTEPGRSSA

SEQ ID NO: 1166447 - protein, 13 aa, Mycobacterium
LTERAEGTITADD

SEQ ID NO: 1166448 - protein, 26 aa, Mycobacterium
LTERGATRADDRISEAGMEDRKREGY

SEQ ID NO: 1166449 - protein, 19 aa, Mycobacterium
LTESASGARFDNHSPATGR

SEQ ID NO: 1166450 - protein, 6 aa, Mycobacterium
LTETRR

SEQ ID NO: 1166451 - protein, 6 aa, Mycobacterium
LTETSA

SEQ ID NO: 1166452 - protein, 4 aa, Mycobacterium
LTGA

SEQ ID NO: 1166453 - protein, 7 aa, Mycobacterium
LTGAREE

SEQ ID NO: 1166454 - protein, 11 aa, Mycobacterium
LTGDGPPPPIE

SEQ ID NO: 1166455 - protein, 10 aa, Mycobacterium
LTGDQLDART

SEQ ID NO: 1166456 - protein, 11 aa, Mycobacterium
LTGEDSPARTR

SEQ ID NO: 1166457 - protein, 7 aa, Mycobacterium
LTGEPAD

SEQ ID NO: 1166458 - protein, 8 aa, Mycobacterium
LTGEPPAA

SEQ ID NO: 1166459 - protein, 4 aa, Mycobacterium
LTGG

SEQ ID NO: 1166460 - protein, 5 aa, Mycobacterium
LTGGD

SEQ ID NO: 1166461 - protein, 7 aa, Mycobacterium
LTGGGSH

SEQ ID NO: 1166462 - protein, 7 aa, Mycobacterium
LTGGNGV

SEQ ID NO: 1166463 - protein, 12 aa, Mycobacterium
LTGKPGTPAAAR

SEQ ID NO: 1166464 - protein, 10 aa, Mycobacterium
LTGKSRDEVN

SEQ ID NO: 1166465 - protein, 12 aa, Mycobacterium
LTGPDGTYHQNE

SEQ ID NO: 1166466 - protein, 6 aa, Mycobacterium
LTGPDT

SEQ ID NO: 1166467 - protein, 14 aa, Mycobacterium
LTGQPSKQAPFEPL

SEQ ID NO: 1166468 - protein, 15 aa, Mycobacterium
LTGRKNPVIAGDSAD

SEQ ID NO: 1166469 - protein, 16 aa, Mycobacterium
LTGRQTAAGLAESERR

SEQ ID NO: 1166470 - protein, 18 aa, Mycobacterium
LTGRRRRRAKHGQRPPDE

SEQ ID NO: 1166471 - protein, 7 aa, Mycobacterium
LTGRSLP

SEQ ID NO: 1166472 - protein, 20 aa, Mycobacterium
LTGSATGDIDELRDGAEVGS

SEQ ID NO: 1166473 - protein, 7 aa, Mycobacterium
LTGSPAE

SEQ ID NO: 1166474 - protein, 6 aa, Mycobacterium
LTGTAK

SEQ ID NO: 1166475 - protein, 10 aa, Mycobacterium
LTGTASNGQH

SEQ ID NO: 1166476 - protein, 12 aa, Mycobacterium
LTGTDTGAGGDY

SEQ ID NO: 1166477 - protein, 9 aa, Mycobacterium
LTGTTAPYN

SEQ ID NO: 1166478 - protein, 10 aa, Mycobacterium
LTGTTPGSGI

SEQ ID NO: 1166479 - protein, 8 aa, Mycobacterium
LTHPDGRS

SEQ ID NO: 1166480 - protein, 10 aa, Mycobacterium
LTKGTGGAAV

SEQ ID NO: 1166481 - protein, 11 aa, Mycobacterium
LTKPDSGKATI

SEQ ID NO: 1166482 - protein, 5 aa, Mycobacterium
LTKTY

SEQ ID NO: 1166483 - protein, 11 aa, Mycobacterium
LTLPGSENPDL

SEQ ID NO: 1166484 - protein, 13 aa, Mycobacterium
LTNANTPADLPVT

SEQ ID NO: 1166485 - protein, 8 aa, Mycobacterium
LTNARSAH

SEQ ID NO: 1166486 - protein, 9 aa, Mycobacterium
LTNPDKPYF

SEQ ID NO: 1166487 - protein, 12 aa, Mycobacterium
LTNPTAHGGRAE

SEQ ID NO: 1166488 - protein, 18 aa, Mycobacterium
LTPATASGAAPSEQTRPQ

SEQ ID NO: 1166489 - protein, 6 aa, Mycobacterium
LTPATR

SEQ ID NO: 1166490 - protein, 7 aa, Mycobacterium
LTPDDDQ

SEQ ID NO: 1166491 - protein, 8 aa, Mycobacterium
LTPDERRA

SEQ ID NO: 1166492 - protein, 5 aa, Mycobacterium
LTPDG

SEQ ID NO: 1166493 - protein, 8 aa, Mycobacterium
LTPDLGPG

SEQ ID NO: 1166494 - protein, 9 aa, Mycobacterium
LTPEGDRTR

SEQ ID NO: 1166495 - protein, 7 aa, Mycobacterium
LTPEGTA

SEQ ID NO: 1166496 - protein, 5 aa, Mycobacterium
LTPEK

SEQ ID NO: 1166497 - protein, 13 aa, Mycobacterium
LTPEQRTYLQRYL

SEQ ID NO: 1166498 - protein, 4 aa, Mycobacterium
LTPG

SEQ ID NO: 1166499 - protein, 6 aa, Mycobacterium
LTPGRE

SEQ ID NO: 1166500 - protein, 6 aa, Mycobacterium
LTPGRT

SEQ ID NO: 1166501 - protein, 10 aa, Mycobacterium
LTPGSGEKRS

SEQ ID NO: 1166502 - protein, 5 aa, Mycobacterium
LTPIS

SEQ ID NO: 1166503 - protein, 20 aa, Mycobacterium
LTPPGEQRKAAARALATDAD

SEQ ID NO: 1166504 - protein, 7 aa, Mycobacterium
LTPQTPD

SEQ ID NO: 1166505 - protein, 4 aa, Mycobacterium
LTPR

SEQ ID NO: 1166506 - protein, 6 aa, Mycobacterium
LTPRNN

SEQ ID NO: 1166507 - protein, 6 aa, Mycobacterium
LTPRNQ

SEQ ID NO: 1166508 - protein, 6 aa, Mycobacterium
LTPSGL

SEQ ID NO: 1166509 - protein, 8 aa, Mycobacterium
LTPTHPDK

SEQ ID NO: 1166510 - protein, 6 aa, Mycobacterium
LTPTTK

SEQ ID NO: 1166511 - protein, 9 aa, Mycobacterium
LTPWSGSEY

SEQ ID NO: 1166512 - protein, 10 aa, Mycobacterium
LTQGANLGAG

SEQ ID NO: 1166513 - protein, 4 aa, Mycobacterium
LTQP

SEQ ID NO: 1166514 - protein, 16 aa, Mycobacterium
LTQRASVGSPTPRDTV

SEQ ID NO: 1166515 - protein, 4 aa, Mycobacterium
LTRE

SEQ ID NO: 1166516 - protein, 12 aa, Mycobacterium
LTRPEPTPVTAR

SEQ ID NO: 1166517 - protein, 4 aa, Mycobacterium
LTRQ

SEQ ID NO: 1166518 - protein, 15 aa, Mycobacterium
LTRQKAQSCVPGDGA

SEQ ID NO: 1166519 - protein, 5 aa, Mycobacterium
LTRRG

SEQ ID NO: 1166520 - protein, 7 aa, Mycobacterium
LTRRQGR

SEQ ID NO: 1166521 - protein, 4 aa, Mycobacterium
LTRT

SEQ ID NO: 1166522 - protein, 18 aa, Mycobacterium
LTRTGKVGADVDPDDAKD

SEQ ID NO: 1166523 - protein, 8 aa, Mycobacterium
LTRTTARD

SEQ ID NO: 1166524 - protein, 11 aa, Mycobacterium
LTSASGSPRAR

SEQ ID NO: 1166525 - protein, 7 aa, Mycobacterium
LTSETRA

SEQ ID NO: 1166526 - protein, 6 aa, Mycobacterium
LTSGAA

SEQ ID NO: 1166527 - protein, 7 aa, Mycobacterium
LTSGQQD

SEQ ID NO: 1166528 - protein, 7 aa, Mycobacterium
LTSGRTA

SEQ ID NO: 1166529 - protein, 4 aa, Mycobacterium
LTSL

SEQ ID NO: 1166530 - protein, 10 aa, Mycobacterium
LTSPDRPLDA

SEQ ID NO: 1166531 - protein, 5 aa, Mycobacterium
LTSPE

SEQ ID NO: 1166532 - protein, 10 aa, Mycobacterium
LTSPRGKRQF

SEQ ID NO: 1166533 - protein, 6 aa, Mycobacterium
LTSRGD

SEQ ID NO: 1166534 - protein, 4 aa, Mycobacterium
LTSS

SEQ ID NO: 1166535 - protein, 12 aa, Mycobacterium
LTSSPRSGGRTI

SEQ ID NO: 1166536 - protein, 11 aa, Mycobacterium
LTTATTPARLT

SEQ ID NO: 1166537 - protein, 5 aa, Mycobacterium
LTTGE

SEQ ID NO: 1166538 - protein, 5 aa, Mycobacterium
LTTND

SEQ ID NO: 1166539 - protein, 20 aa, Mycobacterium
LTTNGKIDKNRVRRLARSAL

SEQ ID NO: 1166540 - protein, 7 aa, Mycobacterium
LTTPSGT

SEQ ID NO: 1166541 - protein, 22 aa, Mycobacterium
LTTSPSTAASAQAATGGDAGSI

SEQ ID NO: 1166542 - protein, 7 aa, Mycobacterium
LTTTDAA

SEQ ID NO: 1166543 - protein, 8 aa, Mycobacterium
LTTTPAED

SEQ ID NO: 1166544 - protein, 4 aa, Mycobacterium
LTVD

SEQ ID NO: 1166545 - protein, 5 aa, Mycobacterium
LTVDG

SEQ ID NO: 1166546 - protein, 4 aa, Mycobacterium
LVDG

SEQ ID NO: 1166547 - protein, 6 aa, Mycobacterium
LVEPTA

SEQ ID NO: 1166548 - protein, 10 aa, Mycobacterium
LVGDDDEPGW

SEQ ID NO: 1166549 - protein, 13 aa, Mycobacterium
LVGSGRRDTPITE

SEQ ID NO: 1166550 - protein, 6 aa, Mycobacterium
LVPAAA

SEQ ID NO: 1166551 - protein, 5 aa, Mycobacterium
LVPED

SEQ ID NO: 1166552 - protein, 8 aa, Mycobacterium
LVPERGET

SEQ ID NO: 1166553 - protein, 8 aa, Mycobacterium
LVQDEGSQ

SEQ ID NO: 1166554 - protein, 9 aa, Mycobacterium
LVRGGSDRL

SEQ ID NO: 1166555 - protein, 15 aa, Mycobacterium
LYDGGDDAGAAEAAN

SEQ ID NO: 1166556 - protein, 11 aa, Mycobacterium
LYDPEHEKDSC

SEQ ID NO: 1166557 - protein, 6 aa, Mycobacterium
LYGPDR

SEQ ID NO: 1166558 - protein, 7 aa, Mycobacterium
MAAKQGR

SEQ ID NO: 1166559 - protein, 6 aa, Mycobacterium
MADDNR

SEQ ID NO: 1166560 - protein, 4 aa, Mycobacterium
MADP

SEQ ID NO: 1166561 - protein, 8 aa, Mycobacterium
MAEGTSED

SEQ ID NO: 1166562 - protein, 4 aa, Mycobacterium
MAEP

SEQ ID NO: 1166563 - protein, 14 aa, Mycobacterium
MAGADGNQEGDPVK

SEQ ID NO: 1166564 - protein, 5 aa, Mycobacterium
MAGDD

SEQ ID NO: 1166565 - protein, 10 aa, Mycobacterium
MAGGGDPRRM

SEQ ID NO: 1166566 - protein, 6 aa, Mycobacterium
MAGPEH

SEQ ID NO: 1166567 - protein, 6 aa, Mycobacterium
MAGQGT

SEQ ID NO: 1166568 - protein, 5 aa, Mycobacterium
MAPAT

SEQ ID NO: 1166569 - protein, 4 aa, Mycobacterium
MAPG

SEQ ID NO: 1166570 - protein, 11 aa, Mycobacterium
MAPKDPESVQW

SEQ ID NO: 1166571 - protein, 10 aa, Mycobacterium
MAPRSDGGAP

SEQ ID NO: 1166572 - protein, 6 aa, Mycobacterium
MAPTDR

SEQ ID NO: 1166573 - protein, 14 aa, Mycobacterium
MAQPSGSADDADNA

SEQ ID NO: 1166574 - protein, 7 aa, Mycobacterium
MARNPPE

SEQ ID NO: 1166575 - protein, 11 aa, Mycobacterium
MASGGSTGRPK

SEQ ID NO: 1166576 - protein, 9 aa, Mycobacterium
MASPGPRRA

SEQ ID NO: 1166577 - protein, 9 aa, Mycobacterium
MATAADGRP

SEQ ID NO: 1166578 - protein, 31 aa, Mycobacterium
MCNPDDPEPCTSGTPSQAQIDHDQRSLAQRQ

SEQ ID NO: 1166579 - protein, 13 aa, Mycobacterium
MDEGADKAAELAN

SEQ ID NO: 1166580 - protein, 9 aa, Mycobacterium
MDGSDGSVA

SEQ ID NO: 1166581 - protein, 6 aa, Mycobacterium
MDLPEP

SEQ ID NO: 1166582 - protein, 8 aa, Mycobacterium
MDNGGESS

SEQ ID NO: 1166583 - protein, 9 aa, Mycobacterium
MDPAGPRDY

SEQ ID NO: 1166584 - protein, 10 aa, Mycobacterium
MDPDGDDPHI

SEQ ID NO: 1166585 - protein, 20 aa, Mycobacterium
MDPHSDDSVDLENKVVALLK

SEQ ID NO: 1166586 - protein, 9 aa, Mycobacterium
MDQPDGSAE

SEQ ID NO: 1166587 - protein, 6 aa, Mycobacterium
MDSAHR

SEQ ID NO: 1166588 - protein, 5 aa, Mycobacterium
MDTGP

SEQ ID NO: 1166589 - protein, 5 aa, Mycobacterium
MEAGR

SEQ ID NO: 1166590 - protein, 4 aa, Mycobacterium
MEAQ

SEQ ID NO: 1166591 - protein, 6 aa, Mycobacterium
MEDAGA

SEQ ID NO: 1166592 - protein, 10 aa, Mycobacterium
MEDGKRGGIA

SEQ ID NO: 1166593 - protein, 9 aa, Mycobacterium
MEGNSVQGR

SEQ ID NO: 1166594 - protein, 9 aa, Mycobacterium
MEGSSPRRA

SEQ ID NO: 1166595 - protein, 12 aa, Mycobacterium
MEHTGTADDGRE

SEQ ID NO: 1166596 - protein, 5 aa, Mycobacterium
MEKPV

SEQ ID NO: 1166597 - protein, 9 aa, Mycobacterium
MEPGRDPIS

SEQ ID NO: 1166598 - protein, 13 aa, Mycobacterium
MEPSPQAPPPPVT

SEQ ID NO: 1166599 - protein, 55 aa, Mycobacterium
MEQAGESAETPDGDPDPEPPPDPPGGGVSGESPEPSRPQGNSSSAQTRSSGDPAA

SEQ ID NO: 1166600 - protein, 12 aa, Mycobacterium
MEQTGGFEGRTK

SEQ ID NO: 1166601 - protein, 8 aa, Mycobacterium
MERPREGL

SEQ ID NO: 1166602 - protein, 12 aa, Mycobacterium
MERRSGGVGADL

SEQ ID NO: 1166603 - protein, 7 aa, Mycobacterium
MESDLPD

SEQ ID NO: 1166604 - protein, 4 aa, Mycobacterium
META

SEQ ID NO: 1166605 - protein, 9 aa, Mycobacterium
MGAGEGNDF

SEQ ID NO: 1166606 - protein, 11 aa, Mycobacterium
MGDDRPADYPA

SEQ ID NO: 1166607 - protein, 5 aa, Mycobacterium
MGDGE

SEQ ID NO: 1166608 - protein, 15 aa, Mycobacterium
MGDPPDEEAAARGGR

SEQ ID NO: 1166609 - protein, 4 aa, Mycobacterium
MGEA

SEQ ID NO: 1166610 - protein, 7 aa, Mycobacterium
MGEGGVT

SEQ ID NO: 1166611 - protein, 5 aa, Mycobacterium
MGESA

SEQ ID NO: 1166612 - protein, 10 aa, Mycobacterium
MGGDPADRDE

SEQ ID NO: 1166613 - protein, 6 aa, Mycobacterium
MGGPAR

SEQ ID NO: 1166614 - protein, 9 aa, Mycobacterium
MGPGADDRR

SEQ ID NO: 1166615 - protein, 9 aa, Mycobacterium
MGPPADRRG

SEQ ID NO: 1166616 - protein, 6 aa, Mycobacterium
MGPSDH

SEQ ID NO: 1166617 - protein, 6 aa, Mycobacterium
MGPSYP

SEQ ID NO: 1166618 - protein, 5 aa, Mycobacterium
MGPWG

SEQ ID NO: 1166619 - protein, 9 aa, Mycobacterium
MGQGPGGIA

SEQ ID NO: 1166620 - protein, 5 aa, Mycobacterium
MGQPE

SEQ ID NO: 1166621 - protein, 5 aa, Mycobacterium
MGSFD

SEQ ID NO: 1166622 - protein, 4 aa, Mycobacterium
MGSP

SEQ ID NO: 1166623 - protein, 6 aa, Mycobacterium
MGSSAD

SEQ ID NO: 1166624 - protein, 13 aa, Mycobacterium
MGYAPAENDEAEQ

SEQ ID NO: 1166625 - protein, 5 aa, Mycobacterium
MHGPA

SEQ ID NO: 1166626 - protein, 12 aa, Mycobacterium
MHGPAGERKYEY

SEQ ID NO: 1166627 - protein, 7 aa, Mycobacterium
MHTSGRV

SEQ ID NO: 1166628 - protein, 15 aa, Mycobacterium
MIKTGGENVASREVE

SEQ ID NO: 1166629 - protein, 4 aa, Mycobacterium
MKAG

SEQ ID NO: 1166630 - protein, 20 aa, Mycobacterium
MKATSKRKVEVQRNKGLGEM

SEQ ID NO: 1166631 - protein, 5 aa, Mycobacterium
MKDDP

SEQ ID NO: 1166632 - protein, 8 aa, Mycobacterium
MKPGEEPL

SEQ ID NO: 1166633 - protein, 8 aa, Mycobacterium
MKPGRGPR

SEQ ID NO: 1166634 - protein, 8 aa, Mycobacterium
MKTGEGKT

SEQ ID NO: 1166635 - protein, 9 aa, Mycobacterium
MLSKPNPAV

SEQ ID NO: 1166636 - protein, 9 aa, Mycobacterium
MNDDDTAAM

SEQ ID NO: 1166637 - protein, 15 aa, Mycobacterium
MNDGTAGGFENNTAP

SEQ ID NO: 1166638 - protein, 8 aa, Mycobacterium
MNPSTGAV

SEQ ID NO: 1166639 - protein, 22 aa, Mycobacterium
MPAAPPPDDLPGFRSGKAFDDA

SEQ ID NO: 1166640 - protein, 9 aa, Mycobacterium
MPAPDGPNT

SEQ ID NO: 1166641 - protein, 6 aa, Mycobacterium
MPDSPF

SEQ ID NO: 1166642 - protein, 7 aa, Mycobacterium
MPEGAED

SEQ ID NO: 1166643 - protein, 8 aa, Mycobacterium
MPEHRDDT

SEQ ID NO: 1166644 - protein, 12 aa, Mycobacterium
MPEPDPGDGTST

SEQ ID NO: 1166645 - protein, 22 aa, Mycobacterium
MPESDDDDEDQDDDGGKSGDSK

SEQ ID NO: 1166646 - protein, 14 aa, Mycobacterium
MPESVGGGGGDGAD

SEQ ID NO: 1166647 - protein, 10 aa, Mycobacterium
MPGEDKGTQK

SEQ ID NO: 1166648 - protein, 9 aa, Mycobacterium
MPGGETGDE

SEQ ID NO: 1166649 - protein, 4 aa, Mycobacterium
MPGR

SEQ ID NO: 1166650 - protein, 8 aa, Mycobacterium
MPKQVTAT

SEQ ID NO: 1166651 - protein, 11 aa, Mycobacterium
MPNPKTGTVTA

SEQ ID NO: 1166652 - protein, 5 aa, Mycobacterium
MPPDA

SEQ ID NO: 1166653 - protein, 10 aa, Mycobacterium
MPPEADHDVA

SEQ ID NO: 1166654 - protein, 5 aa, Mycobacterium
MPPGI

SEQ ID NO: 1166655 - protein, 7 aa, Mycobacterium
MPPPGQG

SEQ ID NO: 1166656 - protein, 14 aa, Mycobacterium
MPPPPPGASPPPLW

SEQ ID NO: 1166657 - protein, 7 aa, Mycobacterium
MPPQQRA

SEQ ID NO: 1166658 - protein, 9 aa, Mycobacterium
MPPRPGERE

SEQ ID NO: 1166659 - protein, 9 aa, Mycobacterium
MPPSTGTGM

SEQ ID NO: 1166660 - protein, 20 aa, Mycobacterium
MPPTDPRYVDGGPGSEVPSV

SEQ ID NO: 1166661 - protein, 8 aa, Mycobacterium
MPQPQREE

SEQ ID NO: 1166662 - protein, 11 aa, Mycobacterium
MPRAPGRLEGR

SEQ ID NO: 1166663 - protein, 8 aa, Mycobacterium
MPRGGPRA

SEQ ID NO: 1166664 - protein, 10 aa, Mycobacterium
MPSSRYSEIA

SEQ ID NO: 1166665 - protein, 7 aa, Mycobacterium
MPTDHTG

SEQ ID NO: 1166666 - protein, 11 aa, Mycobacterium
MPTITSGNTNA

SEQ ID NO: 1166667 - protein, 7 aa, Mycobacterium
MPTSTKR

SEQ ID NO: 1166668 - protein, 6 aa, Mycobacterium
MPTTGA

SEQ ID NO: 1166669 - protein, 12 aa, Mycobacterium
MQGAARPGKQTT

SEQ ID NO: 1166670 - protein, 14 aa, Mycobacterium
MQGRGATGNLRGSF

SEQ ID NO: 1166671 - protein, 12 aa, Mycobacterium
MQRDGDTDFTGS

SEQ ID NO: 1166672 - protein, 12 aa, Mycobacterium
MRAASEAATGEH

SEQ ID NO: 1166673 - protein, 6 aa, Mycobacterium
MRAEGT

SEQ ID NO: 1166674 - protein, 8 aa, Mycobacterium
MREEPDET

SEQ ID NO: 1166675 - protein, 6 aa, Mycobacterium
MREGGY

SEQ ID NO: 1166676 - protein, 8 aa, Mycobacterium
MRERGSGS

SEQ ID NO: 1166677 - protein, 10 aa, Mycobacterium
MRETRGAVEG

SEQ ID NO: 1166678 - protein, 6 aa, Mycobacterium
MRNGTT

SEQ ID NO: 1166679 - protein, 7 aa, Mycobacterium
MRNPTGG

SEQ ID NO: 1166680 - protein, 6 aa, Mycobacterium
MRPNGG

SEQ ID NO: 1166681 - protein, 13 aa, Mycobacterium
MRRDPPSVAKREV

SEQ ID NO: 1166682 - protein, 14 aa, Mycobacterium
MRRRAADRAGARTE

SEQ ID NO: 1166683 - protein, 6 aa, Mycobacterium
MRSNQQ

SEQ ID NO: 1166684 - protein, 14 aa, Mycobacterium
MRTMTGGTDRPSNF

SEQ ID NO: 1166685 - protein, 4 aa, Mycobacterium
MRTT

SEQ ID NO: 1166686 - protein, 4 aa, Mycobacterium
MSAD

SEQ ID NO: 1166687 - protein, 5 aa, Mycobacterium
MSADE

SEQ ID NO: 1166688 - protein, 9 aa, Mycobacterium
MSAPEKVTG

SEQ ID NO: 1166689 - protein, 9 aa, Mycobacterium
MSAQQAVDA

SEQ ID NO: 1166690 - protein, 15 aa, Mycobacterium
MSDEAAATDPSAEEP

SEQ ID NO: 1166691 - protein, 37 aa, Mycobacterium
MSDGAGSGATVPSTAAKPRPHNSFGASTRGRRMPPRT

SEQ ID NO: 1166692 - protein, 11 aa, Mycobacterium
MSEPGAGSDLA

SEQ ID NO: 1166693 - protein, 6 aa, Mycobacterium
MSESRN

SEQ ID NO: 1166694 - protein, 6 aa, Mycobacterium
MSGDAD

SEQ ID NO: 1166695 - protein, 12 aa, Mycobacterium
MSGKPSVPTLPG

SEQ ID NO: 1166696 - protein, 38 aa, Mycobacterium
MSGRGTDTRLEQTDRVSAAERKIARRERRQSTDEPGGE

SEQ ID NO: 1166697 - protein, 12 aa, Mycobacterium
MSGRMGSDRVTT

SEQ ID NO: 1166698 - protein, 6 aa, Mycobacterium
MSKKKH

SEQ ID NO: 1166699 - protein, 11 aa, Mycobacterium
MSKNEPEDDER

SEQ ID NO: 1166700 - protein, 6 aa, Mycobacterium
MSPADQ

SEQ ID NO: 1166701 - protein, 4 aa, Mycobacterium
MSPG

SEQ ID NO: 1166702 - protein, 8 aa, Mycobacterium
MSPPTPAR

SEQ ID NO: 1166703 - protein, 8 aa, Mycobacterium
MSREERSA

SEQ ID NO: 1166704 - protein, 6 aa, Mycobacterium
MSRGEH

SEQ ID NO: 1166705 - protein, 8 aa, Mycobacterium
MSRPDGER

SEQ ID NO: 1166706 - protein, 11 aa, Mycobacterium
MSRSGNPAAAL

SEQ ID NO: 1166707 - protein, 7 aa, Mycobacterium
MSRSKRE

SEQ ID NO: 1166708 - protein, 6 aa, Mycobacterium
MSSEEI

SEQ ID NO: 1166709 - protein, 7 aa, Mycobacterium
MSTPPGL

SEQ ID NO: 1166710 - protein, 14 aa, Mycobacterium
MSTTVGPHPSARRS

SEQ ID NO: 1166711 - protein, 14 aa, Mycobacterium
MTAAGSSLRERTRA

SEQ ID NO: 1166712 - protein, 10 aa, Mycobacterium
MTADEQQAMA

SEQ ID NO: 1166713 - protein, 7 aa, Mycobacterium
MTAGSGA

SEQ ID NO: 1166714 - protein, 5 aa, Mycobacterium
MTEDE

SEQ ID NO: 1166715 - protein, 7 aa, Mycobacterium
MTETGGN

SEQ ID NO: 1166716 - protein, 24 aa, Mycobacterium
MTGEPDGPPTLPGYSSADNSTGLT

SEQ ID NO: 1166717 - protein, 15 aa, Mycobacterium
MTGGKEPNKGVNPDE

SEQ ID NO: 1166718 - protein, 9 aa, Mycobacterium
MTGGRGPDA

SEQ ID NO: 1166719 - protein, 4 aa, Mycobacterium
MTGR

SEQ ID NO: 1166720 - protein, 5 aa, Mycobacterium
MTIDR

SEQ ID NO: 1166721 - protein, 7 aa, Mycobacterium
MTPADAE

SEQ ID NO: 1166722 - protein, 10 aa, Mycobacterium
MTPSSAHGVT

SEQ ID NO: 1166723 - protein, 12 aa, Mycobacterium
MTPSSWSPAARE

SEQ ID NO: 1166724 - protein, 8 aa, Mycobacterium
MTRKREER

SEQ ID NO: 1166725 - protein, 8 aa, Mycobacterium
MTSERGYD

SEQ ID NO: 1166726 - protein, 15 aa, Mycobacterium
MTSGEDVDTAKPQPD

SEQ ID NO: 1166727 - protein, 6 aa, Mycobacterium
MTSSGR

SEQ ID NO: 1166728 - protein, 12 aa, Mycobacterium
MTTDPHTVTDDQ

SEQ ID NO: 1166729 - protein, 6 aa, Mycobacterium
MTTGDE

SEQ ID NO: 1166730 - protein, 14 aa, Mycobacterium
MTTSPGGKGGNQAI

SEQ ID NO: 1166731 - protein, 4 aa, Mycobacterium
MVTT

SEQ ID NO: 1166732 - protein, 6 aa, Mycobacterium
MYDGPG

SEQ ID NO: 1166733 - protein, 12 aa, Mycobacterium
MYETGAGGSAPK

SEQ ID NO: 1166734 - protein, 6 aa, Mycobacterium
MYPPSD

SEQ ID NO: 1166735 - protein, 10 aa, Mycobacterium
NAAAGGSPSR

SEQ ID NO: 1166736 - protein, 5 aa, Mycobacterium
NAAAL

SEQ ID NO: 1166737 - protein, 7 aa, Mycobacterium
NAAARGV

SEQ ID NO: 1166738 - protein, 8 aa, Mycobacterium
NAADYDRA

SEQ ID NO: 1166739 - protein, 5 aa, Mycobacterium
NAAPR

SEQ ID NO: 1166740 - protein, 10 aa, Mycobacterium
NAAPTPALRT

SEQ ID NO: 1166741 - protein, 8 aa, Mycobacterium
NAARHAKG

SEQ ID NO: 1166742 - protein, 7 aa, Mycobacterium
NAARSIT

SEQ ID NO: 1166743 - protein, 19 aa, Mycobacterium
NAATAERDAEFKANAAAKE

SEQ ID NO: 1166744 - protein, 9 aa, Mycobacterium
NACGANDGA

SEQ ID NO: 1166745 - protein, 5 aa, Mycobacterium
NADEL

SEQ ID NO: 1166746 - protein, 9 aa, Mycobacterium
NADGPVGTA

SEQ ID NO: 1166747 - protein, 13 aa, Mycobacterium
NADGQPVASAADA

SEQ ID NO: 1166748 - protein, 8 aa, Mycobacterium
NADPDEAE

SEQ ID NO: 1166749 - protein, 9 aa, Mycobacterium
NADPDGAAA

SEQ ID NO: 1166750 - protein, 6 aa, Mycobacterium
NADPER

SEQ ID NO: 1166751 - protein, 6 aa, Mycobacterium
NADRLA

SEQ ID NO: 1166752 - protein, 7 aa, Mycobacterium
NADVTAD

SEQ ID NO: 1166753 - protein, 7 aa, Mycobacterium
NAEAAQR

SEQ ID NO: 1166754 - protein, 17 aa, Mycobacterium
NAEAGDSTDEVNTDPDA

SEQ ID NO: 1166755 - protein, 10 aa, Mycobacterium
NAEDTDKAQL

SEQ ID NO: 1166756 - protein, 12 aa, Mycobacterium
NAEHSSTGLRSA

SEQ ID NO: 1166757 - protein, 9 aa, Mycobacterium
NAEPATDEV

SEQ ID NO: 1166758 - protein, 5 aa, Mycobacterium
NAEPE

SEQ ID NO: 1166759 - protein, 5 aa, Mycobacterium
NAEPG

SEQ ID NO: 1166760 - protein, 5 aa, Mycobacterium
NAEQI

SEQ ID NO: 1166761 - protein, 5 aa, Mycobacterium
NAETG

SEQ ID NO: 1166762 - protein, 13 aa, Mycobacterium
NAEVGDMARSSYA

SEQ ID NO: 1166763 - protein, 5 aa, Mycobacterium
NAGGA

SEQ ID NO: 1166764 - protein, 11 aa, Mycobacterium
NAGGARGLDPI

SEQ ID NO: 1166765 - protein, 5 aa, Mycobacterium
NAGGM

SEQ ID NO: 1166766 - protein, 10 aa, Mycobacterium
NAGKAPQRPP

SEQ ID NO: 1166767 - protein, 11 aa, Mycobacterium
NAGKTTRRPDG

SEQ ID NO: 1166768 - protein, 8 aa, Mycobacterium
NAGLPENS

SEQ ID NO: 1166769 - protein, 7 aa, Mycobacterium
NAGRTGR

SEQ ID NO: 1166770 - protein, 5 aa, Mycobacterium
NAHDR

SEQ ID NO: 1166771 - protein, 4 aa, Mycobacterium
NAHG

SEQ ID NO: 1166772 - protein, 30 aa, Mycobacterium
NAHPEAVSAADEVTSRNTDDGVARVLERWW

SEQ ID NO: 1166773 - protein, 12 aa, Mycobacterium
NAIEGPYGFTGN

SEQ ID NO: 1166774 - protein, 4 aa, Mycobacterium
NAIN

SEQ ID NO: 1166775 - protein, 7 aa, Mycobacterium
NAKASFA

SEQ ID NO: 1166776 - protein, 16 aa, Mycobacterium
NAKRGGASAWAGVSTP

SEQ ID NO: 1166777 - protein, 5 aa, Mycobacterium
NALAQ

SEQ ID NO: 1166778 - protein, 6 aa, Mycobacterium
NALPDA

SEQ ID NO: 1166779 - protein, 9 aa, Mycobacterium
NANDGGGRS

SEQ ID NO: 1166780 - protein, 6 aa, Mycobacterium
NANDRA

SEQ ID NO: 1166781 - protein, 4 aa, Mycobacterium
NANG

SEQ ID NO: 1166782 - protein, 8 aa, Mycobacterium
NANVPSPV

SEQ ID NO: 1166783 - protein, 5 aa, Mycobacterium
NAPAK

SEQ ID NO: 1166784 - protein, 5 aa, Mycobacterium
NAPGA

SEQ ID NO: 1166785 - protein, 8 aa, Mycobacterium
NAPKYTPE

SEQ ID NO: 1166786 - protein, 13 aa, Mycobacterium
NAPLTRPRPGHAD

SEQ ID NO: 1166787 - protein, 8 aa, Mycobacterium
NAPRGEGM

SEQ ID NO: 1166788 - protein, 15 aa, Mycobacterium
NAPSALREAKAGAER

SEQ ID NO: 1166789 - protein, 5 aa, Mycobacterium
NAQIQ

SEQ ID NO: 1166790 - protein, 6 aa, Mycobacterium
NAQPTA

SEQ ID NO: 1166791 - protein, 11 aa, Mycobacterium
NAQSERGPHPI

SEQ ID NO: 1166792 - protein, 7 aa, Mycobacterium
NAQTSCS

SEQ ID NO: 1166793 - protein, 7 aa, Mycobacterium
NAQTVRD

SEQ ID NO: 1166794 - protein, 4 aa, Mycobacterium
NARA

SEQ ID NO: 1166795 - protein, 10 aa, Mycobacterium
NARKAGTTVS

SEQ ID NO: 1166796 - protein, 4 aa, Mycobacterium
NARN

SEQ ID NO: 1166797 - protein, 7 aa, Mycobacterium
NARQPAV

SEQ ID NO: 1166798 - protein, 7 aa, Mycobacterium
NARSASE

SEQ ID NO: 1166799 - protein, 9 aa, Mycobacterium
NARTPGKGV

SEQ ID NO: 1166800 - protein, 19 aa, Mycobacterium
NASAGVDGLEGTPDKRTTT

SEQ ID NO: 1166801 - protein, 10 aa, Mycobacterium
NASASGGKKI

SEQ ID NO: 1166802 - protein, 16 aa, Mycobacterium
NASETLRKQSDDKPDA

SEQ ID NO: 1166803 - protein, 10 aa, Mycobacterium
NASHDDARAA

SEQ ID NO: 1166804 - protein, 9 aa, Mycobacterium
NASRSPGDV

SEQ ID NO: 1166805 - protein, 10 aa, Mycobacterium
NASTDDGEAA

SEQ ID NO: 1166806 - protein, 5 aa, Mycobacterium
NATAD

SEQ ID NO: 1166807 - protein, 6 aa, Mycobacterium
NATADI

SEQ ID NO: 1166808 - protein, 9 aa, Mycobacterium
NATIGAGTK

SEQ ID NO: 1166809 - protein, 4 aa, Mycobacterium
NATL

SEQ ID NO: 1166810 - protein, 6 aa, Mycobacterium
NATPTW

SEQ ID NO: 1166811 - protein, 20 aa, Mycobacterium
NATRARTSSVRGWAKLPVRT

SEQ ID NO: 1166812 - protein, 15 aa, Mycobacterium
NATRGNIDVTVTVTD

SEQ ID NO: 1166813 - protein, 8 aa, Mycobacterium
NATTPTEI

SEQ ID NO: 1166814 - protein, 7 aa, Mycobacterium
NATTTEA

SEQ ID NO: 1166815 - protein, 7 aa, Mycobacterium
NATVSGT

SEQ ID NO: 1166816 - protein, 5 aa, Mycobacterium
NATVT

SEQ ID NO: 1166817 - protein, 9 aa, Mycobacterium
NAVRPDGRR

SEQ ID NO: 1166818 - protein, 21 aa, Mycobacterium
NAWKSRTRAHPDVAELHHGIT

SEQ ID NO: 1166819 - protein, 7 aa, Mycobacterium
NCDGSQQ

SEQ ID NO: 1166820 - protein, 5 aa, Mycobacterium
NCGKS

SEQ ID NO: 1166821 - protein, 6 aa, Mycobacterium
NCGNRQ

SEQ ID NO: 1166822 - protein, 7 aa, Mycobacterium
NCSTGSS

SEQ ID NO: 1166823 - protein, 7 aa, Mycobacterium
NDAAALG

SEQ ID NO: 1166824 - protein, 9 aa, Mycobacterium
NDAARVARD

SEQ ID NO: 1166825 - protein, 8 aa, Mycobacterium
NDADRAAY

SEQ ID NO: 1166826 - protein, 11 aa, Mycobacterium
NDAGKPGTPLS

SEQ ID NO: 1166827 - protein, 6 aa, Mycobacterium
NDAGSQ

SEQ ID NO: 1166828 - protein, 5 aa, Mycobacterium
NDAPG

SEQ ID NO: 1166829 - protein, 6 aa, Mycobacterium
NDAPTA

SEQ ID NO: 1166830 - protein, 7 aa, Mycobacterium
NDARNDR

SEQ ID NO: 1166831 - protein, 5 aa, Mycobacterium
NDDDA

SEQ ID NO: 1166832 - protein, 5 aa, Mycobacterium
NDDEI

SEQ ID NO: 1166833 - protein, 10 aa, Mycobacterium
NDDGAYEDPW

SEQ ID NO: 1166834 - protein, 11 aa, Mycobacterium
NDEATRETIDD

SEQ ID NO: 1166835 - protein, 5 aa, Mycobacterium
NDEEL

SEQ ID NO: 1166836 - protein, 6 aa, Mycobacterium
NDEGRP

SEQ ID NO: 1166837 - protein, 6 aa, Mycobacterium
NDEQRK

SEQ ID NO: 1166838 - protein, 6 aa, Mycobacterium
NDEVGG

SEQ ID NO: 1166839 - protein, 6 aa, Mycobacterium
NDEYDN

SEQ ID NO: 1166840 - protein, 7 aa, Mycobacterium
NDGAARL

SEQ ID NO: 1166841 - protein, 14 aa, Mycobacterium
NDGDFARSYSTAGT

SEQ ID NO: 1166842 - protein, 7 aa, Mycobacterium
NDGGSSV

SEQ ID NO: 1166843 - protein, 14 aa, Mycobacterium
NDGQKMSKSLRNYP

SEQ ID NO: 1166844 - protein, 5 aa, Mycobacterium
NDGTL

SEQ ID NO: 1166845 - protein, 9 aa, Mycobacterium
NDGVQGPSV

SEQ ID NO: 1166846 - protein, 13 aa, Mycobacterium
NDHAPDGPAKGGE

SEQ ID NO: 1166847 - protein, 10 aa, Mycobacterium
NDHEDGNGQF

SEQ ID NO: 1166848 - protein, 8 aa, Mycobacterium
NDKKRGRI

SEQ ID NO: 1166849 - protein, 5 aa, Mycobacterium
NDLGR

SEQ ID NO: 1166850 - protein, 4 aa, Mycobacterium
NDLS

SEQ ID NO: 1166851 - protein, 27 aa, Mycobacterium
NDLSNETAKKNRNASQVVGGKGELNSV

SEQ ID NO: 1166852 - protein, 5 aa, Mycobacterium
NDMRD

SEQ ID NO: 1166853 - protein, 10 aa, Mycobacterium
NDNGDKGFGT

SEQ ID NO: 1166854 - protein, 4 aa, Mycobacterium
NDPD

SEQ ID NO: 1166855 - protein, 6 aa, Mycobacterium
NDPDTW

SEQ ID NO: 1166856 - protein, 14 aa, Mycobacterium
NDPEVDPETGNPWS

SEQ ID NO: 1166857 - protein, 6 aa, Mycobacterium
NDPFTD

SEQ ID NO: 1166858 - protein, 9 aa, Mycobacterium
NDPNATGDR

SEQ ID NO: 1166859 - protein, 12 aa, Mycobacterium
NDPRTTEQRRAD

SEQ ID NO: 1166860 - protein, 5 aa, Mycobacterium
NDPTG

SEQ ID NO: 1166861 - protein, 4 aa, Mycobacterium
NDPW

SEQ ID NO: 1166862 - protein, 6 aa, Mycobacterium
NDRAAL

SEQ ID NO: 1166863 - protein, 15 aa, Mycobacterium
NDRPLKREGTPDDVA

SEQ ID NO: 1166864 - protein, 7 aa, Mycobacterium
NDSDYGL

SEQ ID NO: 1166865 - protein, 7 aa, Mycobacterium
NDSESRV

SEQ ID NO: 1166866 - protein, 6 aa, Mycobacterium
NDSEYA

SEQ ID NO: 1166867 - protein, 11 aa, Mycobacterium
NDSVPDGERVN

SEQ ID NO: 1166868 - protein, 6 aa, Mycobacterium
NDTEYG

SEQ ID NO: 1166869 - protein, 17 aa, Mycobacterium
NDTGADYDSALADASAL

SEQ ID NO: 1166870 - protein, 4 aa, Mycobacterium
NDTK

SEQ ID NO: 1166871 - protein, 7 aa, Mycobacterium
NDTPPFD

SEQ ID NO: 1166872 - protein, 7 aa, Mycobacterium
NDTPYGL

SEQ ID NO: 1166873 - protein, 6 aa, Mycobacterium
NDTQYG

SEQ ID NO: 1166874 - protein, 9 aa, Mycobacterium
NDTTGAPAL

SEQ ID NO: 1166875 - protein, 10 aa, Mycobacterium
NDTTRNSMSG

SEQ ID NO: 1166876 - protein, 8 aa, Mycobacterium
NDVSTNTD

SEQ ID NO: 1166877 - protein, 14 aa, Mycobacterium
NDYADRKNGRQPIK

SEQ ID NO: 1166878 - protein, 6 aa, Mycobacterium
NEAAAR

SEQ ID NO: 1166879 - protein, 6 aa, Mycobacterium
NEAGSV

SEQ ID NO: 1166880 - protein, 12 aa, Mycobacterium
NEAPDDGQENTV

SEQ ID NO: 1166881 - protein, 11 aa, Mycobacterium
NEATDGAGGAV

SEQ ID NO: 1166882 - protein, 8 aa, Mycobacterium
NEATNKAK

SEQ ID NO: 1166883 - protein, 7 aa, Mycobacterium
NEDEKRS

SEQ ID NO: 1166884 - protein, 8 aa, Mycobacterium
NEDGKAEL

SEQ ID NO: 1166885 - protein, 5 aa, Mycobacterium
NEDGR

SEQ ID NO: 1166886 - protein, 10 aa, Mycobacterium
NEDPKSDLGG

SEQ ID NO: 1166887 - protein, 8 aa, Mycobacterium
NEDPPPHK

SEQ ID NO: 1166888 - protein, 7 aa, Mycobacterium
NEDQKRE

SEQ ID NO: 1166889 - protein, 14 aa, Mycobacterium
NEDQPETSGDPRVA

SEQ ID NO: 1166890 - protein, 7 aa, Mycobacterium
NEDTKDL

SEQ ID NO: 1166891 - protein, 9 aa, Mycobacterium
NEEETAKAF

SEQ ID NO: 1166892 - protein, 6 aa, Mycobacterium
NEEGSL

SEQ ID NO: 1166893 - protein, 6 aa, Mycobacterium
NEEQGI

SEQ ID NO: 1166894 - protein, 4 aa, Mycobacterium
NEET

SEQ ID NO: 1166895 - protein, 10 aa, Mycobacterium
NEETHEPTPY

SEQ ID NO: 1166896 - protein, 15 aa, Mycobacterium
NEFGPSATRGTGGPL

SEQ ID NO: 1166897 - protein, 8 aa, Mycobacterium
NEGAPRDL

SEQ ID NO: 1166898 - protein, 8 aa, Mycobacterium
NEGGTETL

SEQ ID NO: 1166899 - protein, 10 aa, Mycobacterium
NEGIDSTHSP

SEQ ID NO: 1166900 - protein, 9 aa, Mycobacterium
NEGKTPKTV

SEQ ID NO: 1166901 - protein, 18 aa, Mycobacterium
NEGRVKAAEAEKRAREQA

SEQ ID NO: 1166902 - protein, 9 aa, Mycobacterium
NEGSTDPVP

SEQ ID NO: 1166903 - protein, 18 aa, Mycobacterium
NEGYQDMRSGKNIRGLVR

SEQ ID NO: 1166904 - protein, 21 aa, Mycobacterium
NEKHNEDNGEDNNDGESHNRS

SEQ ID NO: 1166905 - protein, 8 aa, Mycobacterium
NEKSQLQN

SEQ ID NO: 1166906 - protein, 6 aa, Mycobacterium
NELGNP

SEQ ID NO: 1166907 - protein, 7 aa, Mycobacterium
NELGPRS

SEQ ID NO: 1166908 - protein, 11 aa, Mycobacterium
NELTSNRSADL

SEQ ID NO: 1166909 - protein, 7 aa, Mycobacterium
NEPDHPG

SEQ ID NO: 1166910 - protein, 6 aa, Mycobacterium
NEPDLA

SEQ ID NO: 1166911 - protein, 6 aa, Mycobacterium
NEPTLA

SEQ ID NO: 1166912 - protein, 6 aa, Mycobacterium
NEPTTA

SEQ ID NO: 1166913 - protein, 5 aa, Mycobacterium
NEQAN

SEQ ID NO: 1166914 - protein, 8 aa, Mycobacterium
NEQRPGDA

SEQ ID NO: 1166915 - protein, 4 aa, Mycobacterium
NERE

SEQ ID NO: 1166916 - protein, 10 aa, Mycobacterium
NESAGGAGRS

SEQ ID NO: 1166917 - protein, 10 aa, Mycobacterium
NESPSHTARR

SEQ ID NO: 1166918 - protein, 7 aa, Mycobacterium
NETFSSR

SEQ ID NO: 1166919 - protein, 6 aa, Mycobacterium
NETHAE

SEQ ID NO: 1166920 - protein, 5 aa, Mycobacterium
NETIT

SEQ ID NO: 1166921 - protein, 4 aa, Mycobacterium
NETP

SEQ ID NO: 1166922 - protein, 4 aa, Mycobacterium
NEVP

SEQ ID NO: 1166923 - protein, 8 aa, Mycobacterium
NFDAPSHQ

SEQ ID NO: 1166924 - protein, 12 aa, Mycobacterium
NFGHGQSASGAI

SEQ ID NO: 1166925 - protein, 10 aa, Mycobacterium
NFKTQGGLTT

SEQ ID NO: 1166926 - protein, 7 aa, Mycobacterium
NFNPPAA

SEQ ID NO: 1166927 - protein, 6 aa, Mycobacterium
NFPSPQ

SEQ ID NO: 1166928 - protein, 7 aa, Mycobacterium
NFTPREG

SEQ ID NO: 1166929 - protein, 11 aa, Mycobacterium
NFTSEPEGFQH

SEQ ID NO: 1166930 - protein, 14 aa, Mycobacterium
NGAARTASAPGPHL

SEQ ID NO: 1166931 - protein, 8 aa, Mycobacterium
NGAEDEDQ

SEQ ID NO: 1166932 - protein, 12 aa, Mycobacterium
NGAKEIADQHGK

SEQ ID NO: 1166933 - protein, 15 aa, Mycobacterium
NGARGLAGGTAATAA

SEQ ID NO: 1166934 - protein, 15 aa, Mycobacterium
NGASGEGGPDGSVNE

SEQ ID NO: 1166935 - protein, 5 aa, Mycobacterium
NGATR

SEQ ID NO: 1166936 - protein, 8 aa, Mycobacterium
NGAYADAD

SEQ ID NO: 1166937 - protein, 8 aa, Mycobacterium
NGDGKGGV

SEQ ID NO: 1166938 - protein, 5 aa, Mycobacterium
NGDGW

SEQ ID NO: 1166939 - protein, 23 aa, Mycobacterium
NGDPAATGPRNGDGALPTLTPQQ

SEQ ID NO: 1166940 - protein, 8 aa, Mycobacterium
NGDPKLAT

SEQ ID NO: 1166941 - protein, 6 aa, Mycobacterium
NGDPRG

SEQ ID NO: 1166942 - protein, 9 aa, Mycobacterium
NGDTASGDA

SEQ ID NO: 1166943 - protein, 9 aa, Mycobacterium
NGDVGAKAR

SEQ ID NO: 1166944 - protein, 5 aa, Mycobacterium
NGEAD

SEQ ID NO: 1166945 - protein, 7 aa, Mycobacterium
NGEPHSR

SEQ ID NO: 1166946 - protein, 13 aa, Mycobacterium
NGFHRPDDARRAF

SEQ ID NO: 1166947 - protein, 10 aa, Mycobacterium
NGFPGTSSTF

SEQ ID NO: 1166948 - protein, 10 aa, Mycobacterium
NGGAPLSPTV

SEQ ID NO: 1166949 - protein, 15 aa, Mycobacterium
NGGARPRLTGVCVSA

SEQ ID NO: 1166950 - protein, 8 aa, Mycobacterium
NGGAYNPV

SEQ ID NO: 1166951 - protein, 5 aa, Mycobacterium
NGGDI

SEQ ID NO: 1166952 - protein, 5 aa, Mycobacterium
NGGDT

SEQ ID NO: 1166953 - protein, 6 aa, Mycobacterium
NGGESA

SEQ ID NO: 1166954 - protein, 10 aa, Mycobacterium
NGGGAAPAGV

SEQ ID NO: 1166955 - protein, 12 aa, Mycobacterium
NGGGYTSAKHAQ

SEQ ID NO: 1166956 - protein, 4 aa, Mycobacterium
NGGQ

SEQ ID NO: 1166957 - protein, 10 aa, Mycobacterium
NGGSATSKAL

SEQ ID NO: 1166958 - protein, 10 aa, Mycobacterium
NGGSTGNSLE

SEQ ID NO: 1166959 - protein, 4 aa, Mycobacterium
NGGV

SEQ ID NO: 1166960 - protein, 5 aa, Mycobacterium
NGHGG

SEQ ID NO: 1166961 - protein, 4 aa, Mycobacterium
NGHN

SEQ ID NO: 1166962 - protein, 11 aa, Mycobacterium
NGHNVSTRGRI

SEQ ID NO: 1166963 - protein, 5 aa, Mycobacterium
NGIDA

SEQ ID NO: 1166964 - protein, 5 aa, Mycobacterium
NGIEP

SEQ ID NO: 1166965 - protein, 11 aa, Mycobacterium
NGKAHGMGAPG

SEQ ID NO: 1166966 - protein, 9 aa, Mycobacterium
NGKGAFTHT

SEQ ID NO: 1166967 - protein, 14 aa, Mycobacterium
NGKPGELGGGGLPQ

SEQ ID NO: 1166968 - protein, 7 aa, Mycobacterium
NGKSPQA

SEQ ID NO: 1166969 - protein, 10 aa, Mycobacterium
NGLDESATLG

SEQ ID NO: 1166970 - protein, 5 aa, Mycobacterium
NGLEE

SEQ ID NO: 1166971 - protein, 12 aa, Mycobacterium
NGLNGSAERFGA

SEQ ID NO: 1166972 - protein, 7 aa, Mycobacterium
NGLPDDY

SEQ ID NO: 1166973 - protein, 6 aa, Mycobacterium
NGLSED

SEQ ID NO: 1166974 - protein, 7 aa, Mycobacterium
NGPAYGG

SEQ ID NO: 1166975 - protein, 7 aa, Mycobacterium
NGPDYDL

SEQ ID NO: 1166976 - protein, 7 aa, Mycobacterium
NGPKMAG

SEQ ID NO: 1166977 - protein, 8 aa, Mycobacterium
NGPRDRRP

SEQ ID NO: 1166978 - protein, 9 aa, Mycobacterium
NGPVVGPDG

SEQ ID NO: 1166979 - protein, 12 aa, Mycobacterium
NGQGMDAEGVQR

SEQ ID NO: 1166980 - protein, 6 aa, Mycobacterium
NGQGVA

SEQ ID NO: 1166981 - protein, 5 aa, Mycobacterium
NGQPW

SEQ ID NO: 1166982 - protein, 4 aa, Mycobacterium
NGQR

SEQ ID NO: 1166983 - protein, 11 aa, Mycobacterium
NGRGGGEIDPT

SEQ ID NO: 1166984 - protein, 8 aa, Mycobacterium
NGRGTEQL

SEQ ID NO: 1166985 - protein, 8 aa, Mycobacterium
NGRPPRER

SEQ ID NO: 1166986 - protein, 6 aa, Mycobacterium
NGRRGG

SEQ ID NO: 1166987 - protein, 5 aa, Mycobacterium
NGRRP

SEQ ID NO: 1166988 - protein, 6 aa, Mycobacterium
NGRRPA

SEQ ID NO: 1166989 - protein, 10 aa, Mycobacterium
NGRSQAGVPE

SEQ ID NO: 1166990 - protein, 13 aa, Mycobacterium
NGRTPGAATTDSD

SEQ ID NO: 1166991 - protein, 6 aa, Mycobacterium
NGRVTG

SEQ ID NO: 1166992 - protein, 16 aa, Mycobacterium
NGSATSQISYTASKGG

SEQ ID NO: 1166993 - protein, 8 aa, Mycobacterium
NGSEPISA

SEQ ID NO: 1166994 - protein, 6 aa, Mycobacterium
NGSGPT

SEQ ID NO: 1166995 - protein, 8 aa, Mycobacterium
NGSGVSVS

SEQ ID NO: 1166996 - protein, 6 aa, Mycobacterium
NGSLGH

SEQ ID NO: 1166997 - protein, 12 aa, Mycobacterium
NGSLTGYGGGIE

SEQ ID NO: 1166998 - protein, 7 aa, Mycobacterium
NGSPRAL

SEQ ID NO: 1166999 - protein, 22 aa, Mycobacterium
NGSPRTASRLPPPEPDPPAAGD

SEQ ID NO: 1167000 - protein, 4 aa, Mycobacterium
NGSQ

SEQ ID NO: 1167001 - protein, 9 aa, Mycobacterium
NGSRVARAR

SEQ ID NO: 1167002 - protein, 10 aa, Mycobacterium
NGSSLYDSTI

SEQ ID NO: 1167003 - protein, 17 aa, Mycobacterium
NGSTGIGDAPDDRPQEE

SEQ ID NO: 1167004 - protein, 8 aa, Mycobacterium
NGSTRAAG

SEQ ID NO: 1167005 - protein, 10 aa, Mycobacterium
NGTASRETDA

SEQ ID NO: 1167006 - protein, 10 aa, Mycobacterium
NGTPGFERGR

SEQ ID NO: 1167007 - protein, 121 aa, Mycobacterium
NGTPSAPTTLTTPGLGATGLTSPGLTTPGLTSPGLTAPGLTTPGLTTPGLTTPGLTTPGLTTPSASVPPLTASAPGLGDAGLTNPALTNPALTSPTGDLPGLTAPGLSTPGLTTPTTGLDP

SEQ ID NO: 1167008 - protein, 6 aa, Mycobacterium
NGTPYG

SEQ ID NO: 1167009 - protein, 5 aa, Mycobacterium
NGTRR

SEQ ID NO: 1167010 - protein, 4 aa, Mycobacterium
NGVG

SEQ ID NO: 1167011 - protein, 14 aa, Mycobacterium
NGVGGEAYRSSPLD

SEQ ID NO: 1167012 - protein, 7 aa, Mycobacterium
NGVPPHP

SEQ ID NO: 1167013 - protein, 9 aa, Mycobacterium
NGYQPGGIT

SEQ ID NO: 1167014 - protein, 7 aa, Mycobacterium
NGYTRDY

SEQ ID NO: 1167015 - protein, 7 aa, Mycobacterium
NHAPRRN

SEQ ID NO: 1167016 - protein, 5 aa, Mycobacterium
NHARQ

SEQ ID NO: 1167017 - protein, 7 aa, Mycobacterium
NHASAER

SEQ ID NO: 1167018 - protein, 6 aa, Mycobacterium
NHDRTA

SEQ ID NO: 1167019 - protein, 10 aa, Mycobacterium
NHEDAESRDD

SEQ ID NO: 1167020 - protein, 6 aa, Mycobacterium
NHEGTP

SEQ ID NO: 1167021 - protein, 6 aa, Mycobacterium
NHGGTE

SEQ ID NO: 1167022 - protein, 6 aa, Mycobacterium
NHGRRE

SEQ ID NO: 1167023 - protein, 15 aa, Mycobacterium
NHHERLDGTGYPRGL

SEQ ID NO: 1167024 - protein, 8 aa, Mycobacterium
NHKERNDS

SEQ ID NO: 1167025 - protein, 7 aa, Mycobacterium
NHPEPEH

SEQ ID NO: 1167026 - protein, 7 aa, Mycobacterium
NHPGTSQ

SEQ ID NO: 1167027 - protein, 10 aa, Mycobacterium
NHPHPSGRPV

SEQ ID NO: 1167028 - protein, 7 aa, Mycobacterium
NHPRRTK

SEQ ID NO: 1167029 - protein, 5 aa, Mycobacterium
NHRPD

SEQ ID NO: 1167030 - protein, 7 aa, Mycobacterium
NHRPGVR

SEQ ID NO: 1167031 - protein, 5 aa, Mycobacterium
NHSGG

SEQ ID NO: 1167032 - protein, 5 aa, Mycobacterium
NHSPS

SEQ ID NO: 1167033 - protein, 10 aa, Mycobacterium
NHTKKDIAAA

SEQ ID NO: 1167034 - protein, 6 aa, Mycobacterium
NHTSSA

SEQ ID NO: 1167035 - protein, 5 aa, Mycobacterium
NIAPA

SEQ ID NO: 1167036 - protein, 5 aa, Mycobacterium
NIEGS

SEQ ID NO: 1167037 - protein, 12 aa, Mycobacterium
NIGHTQSAAGAL

SEQ ID NO: 1167038 - protein, 4 aa, Mycobacterium
NIGR

SEQ ID NO: 1167039 - protein, 10 aa, Mycobacterium
NIGRSSREDT

SEQ ID NO: 1167040 - protein, 9 aa, Mycobacterium
NIGSVDSDA

SEQ ID NO: 1167041 - protein, 9 aa, Mycobacterium
NIKTGTTDS

SEQ ID NO: 1167042 - protein, 6 aa, Mycobacterium
NIPGDL

SEQ ID NO: 1167043 - protein, 7 aa, Mycobacterium
NIRPGKR

SEQ ID NO: 1167044 - protein, 5 aa, Mycobacterium
NKAAL

SEQ ID NO: 1167045 - protein, 12 aa, Mycobacterium
NKAETKEKYGEE

SEQ ID NO: 1167046 - protein, 15 aa, Mycobacterium
NKALRATEARLSTER

SEQ ID NO: 1167047 - protein, 7 aa, Mycobacterium
NKAPGGV

SEQ ID NO: 1167048 - protein, 13 aa, Mycobacterium
NKDEINRKVEETA

SEQ ID NO: 1167049 - protein, 4 aa, Mycobacterium
NKDV

SEQ ID NO: 1167050 - protein, 7 aa, Mycobacterium
NKGDETL

SEQ ID NO: 1167051 - protein, 13 aa, Mycobacterium
NKIANGAPIADVL

SEQ ID NO: 1167052 - protein, 8 aa, Mycobacterium
NKLTPEQV

SEQ ID NO: 1167053 - protein, 7 aa, Mycobacterium
NKQYEQW

SEQ ID NO: 1167054 - protein, 10 aa, Mycobacterium
NKRERAETFD

SEQ ID NO: 1167055 - protein, 5 aa, Mycobacterium
NKRPE

SEQ ID NO: 1167056 - protein, 7 aa, Mycobacterium
NKRPRSV

SEQ ID NO: 1167057 - protein, 10 aa, Mycobacterium
NKSDGTQDEI

SEQ ID NO: 1167058 - protein, 13 aa, Mycobacterium
NKSEKADDPAAAE

SEQ ID NO: 1167059 - protein, 19 aa, Mycobacterium
NKSGTARERDPQEPVDDTE

SEQ ID NO: 1167060 - protein, 5 aa, Mycobacterium
NKVPG

SEQ ID NO: 1167061 - protein, 5 aa, Mycobacterium
NKVPN

SEQ ID NO: 1167062 - protein, 10 aa, Mycobacterium
NLAESDADVR

SEQ ID NO: 1167063 - protein, 4 aa, Mycobacterium
NLAG

SEQ ID NO: 1167064 - protein, 5 aa, Mycobacterium
NLAGR

SEQ ID NO: 1167065 - protein, 6 aa, Mycobacterium
NLAGSG

SEQ ID NO: 1167066 - protein, 12 aa, Mycobacterium
NLDEGEPHGMPG

SEQ ID NO: 1167067 - protein, 6 aa, Mycobacterium
NLDGTL

SEQ ID NO: 1167068 - protein, 8 aa, Mycobacterium
NLDTGGRA

SEQ ID NO: 1167069 - protein, 7 aa, Mycobacterium
NLEADEA

SEQ ID NO: 1167070 - protein, 16 aa, Mycobacterium
NLEASPDLVNSDPYGE

SEQ ID NO: 1167071 - protein, 6 aa, Mycobacterium
NLEPGE

SEQ ID NO: 1167072 - protein, 7 aa, Mycobacterium
NLERERT

SEQ ID NO: 1167073 - protein, 8 aa, Mycobacterium
NLGTERHH

SEQ ID NO: 1167074 - protein, 4 aa, Mycobacterium
NLKP

SEQ ID NO: 1167075 - protein, 9 aa, Mycobacterium
NLPDRPSEN

SEQ ID NO: 1167076 - protein, 7 aa, Mycobacterium
NLPKTGG

SEQ ID NO: 1167077 - protein, 14 aa, Mycobacterium
NLPPESATLERPRS

SEQ ID NO: 1167078 - protein, 5 aa, Mycobacterium
NLPSP

SEQ ID NO: 1167079 - protein, 12 aa, Mycobacterium
NLPSPNAMEVGP

SEQ ID NO: 1167080 - protein, 8 aa, Mycobacterium
NLPSSETR

SEQ ID NO: 1167081 - protein, 11 aa, Mycobacterium
NLPSTATPADV

SEQ ID NO: 1167082 - protein, 6 aa, Mycobacterium
NLQAEA

SEQ ID NO: 1167083 - protein, 11 aa, Mycobacterium
NLQGQSGRKLG

SEQ ID NO: 1167084 - protein, 8 aa, Mycobacterium
NLQRDADE

SEQ ID NO: 1167085 - protein, 11 aa, Mycobacterium
NLRADSSAEKL

SEQ ID NO: 1167086 - protein, 10 aa, Mycobacterium
NLSADPDRRL

SEQ ID NO: 1167087 - protein, 8 aa, Mycobacterium
NLSSAKGD

SEQ ID NO: 1167088 - protein, 5 aa, Mycobacterium
NLTAA

SEQ ID NO: 1167089 - protein, 7 aa, Mycobacterium
NLTETAA

SEQ ID NO: 1167090 - protein, 12 aa, Mycobacterium
NLTREQIERAGG

SEQ ID NO: 1167091 - protein, 5 aa, Mycobacterium
NMGTG

SEQ ID NO: 1167092 - protein, 10 aa, Mycobacterium
NMQSSNVSTA

SEQ ID NO: 1167093 - protein, 11 aa, Mycobacterium
NNAPDNDPDIP

SEQ ID NO: 1167094 - protein, 16 aa, Mycobacterium
NNARAKASTSIGTSSS

SEQ ID NO: 1167095 - protein, 5 aa, Mycobacterium
NNARV

SEQ ID NO: 1167096 - protein, 8 aa, Mycobacterium
NNAVGKVD

SEQ ID NO: 1167097 - protein, 27 aa, Mycobacterium
NNDERGASGEAPVDAANPRNDNKSGQV

SEQ ID NO: 1167098 - protein, 8 aa, Mycobacterium
NNDGDELR

SEQ ID NO: 1167099 - protein, 7 aa, Mycobacterium
NNDYGGD

SEQ ID NO: 1167100 - protein, 7 aa, Mycobacterium
NNELTPS

SEQ ID NO: 1167101 - protein, 12 aa, Mycobacterium
NNEVPGATERDH

SEQ ID NO: 1167102 - protein, 5 aa, Mycobacterium
NNGDN

SEQ ID NO: 1167103 - protein, 10 aa, Mycobacterium
NNGQSATAIS

SEQ ID NO: 1167104 - protein, 8 aa, Mycobacterium
NNLNNRSW

SEQ ID NO: 1167105 - protein, 10 aa, Mycobacterium
NNNPQSLRDE

SEQ ID NO: 1167106 - protein, 10 aa, Mycobacterium
NNPAAATARA

SEQ ID NO: 1167107 - protein, 12 aa, Mycobacterium
NNPATGQPMTTS

SEQ ID NO: 1167108 - protein, 6 aa, Mycobacterium
NNRPDA

SEQ ID NO: 1167109 - protein, 8 aa, Mycobacterium
NNRSDARS

SEQ ID NO: 1167110 - protein, 5 aa, Mycobacterium
NNSAA

SEQ ID NO: 1167111 - protein, 13 aa, Mycobacterium
NNSTDGTAEVARR

SEQ ID NO: 1167112 - protein, 6 aa, Mycobacterium
NNTRAY

SEQ ID NO: 1167113 - protein, 8 aa, Mycobacterium
NNTSMDAD

SEQ ID NO: 1167114 - protein, 8 aa, Mycobacterium
NPAARTTI

SEQ ID NO: 1167115 - protein, 9 aa, Mycobacterium
NPAATAATL

SEQ ID NO: 1167116 - protein, 7 aa, Mycobacterium
NPADETV

SEQ ID NO: 1167117 - protein, 6 aa, Mycobacterium
NPAFSS

SEQ ID NO: 1167118 - protein, 6 aa, Mycobacterium
NPAGEA

SEQ ID NO: 1167119 - protein, 7 aa, Mycobacterium
NPANGDA

SEQ ID NO: 1167120 - protein, 10 aa, Mycobacterium
NPARASKVTG

SEQ ID NO: 1167121 - protein, 11 aa, Mycobacterium
NPARDPDTGRR

SEQ ID NO: 1167122 - protein, 6 aa, Mycobacterium
NPARNE

SEQ ID NO: 1167123 - protein, 13 aa, Mycobacterium
NPASHADDSHSAG

SEQ ID NO: 1167124 - protein, 10 aa, Mycobacterium
NPASNAVTGN

SEQ ID NO: 1167125 - protein, 4 aa, Mycobacterium
NPAT

SEQ ID NO: 1167126 - protein, 8 aa, Mycobacterium
NPAVGSAH

SEQ ID NO: 1167127 - protein, 8 aa, Mycobacterium
NPDAPTRE

SEQ ID NO: 1167128 - protein, 12 aa, Mycobacterium
NPDNPNQPPYTP

SEQ ID NO: 1167129 - protein, 7 aa, Mycobacterium
NPDPEIH

SEQ ID NO: 1167130 - protein, 5 aa, Mycobacterium
NPDPM

SEQ ID NO: 1167131 - protein, 9 aa, Mycobacterium
NPDPSGDTV

SEQ ID NO: 1167132 - protein, 6 aa, Mycobacterium
NPDRAG

SEQ ID NO: 1167133 - protein, 4 aa, Mycobacterium
NPDT

SEQ ID NO: 1167134 - protein, 5 aa, Mycobacterium
NPDTA

SEQ ID NO: 1167135 - protein, 10 aa, Mycobacterium
NPEAPDDAGF

SEQ ID NO: 1167136 - protein, 6 aa, Mycobacterium
NPEDRP

SEQ ID NO: 1167137 - protein, 7 aa, Mycobacterium
NPELGRQ

SEQ ID NO: 1167138 - protein, 4 aa, Mycobacterium
NPEP

SEQ ID NO: 1167139 - protein, 6 aa, Mycobacterium
NPESLT

SEQ ID NO: 1167140 - protein, 8 aa, Mycobacterium
NPFSKDAQ

SEQ ID NO: 1167141 - protein, 6 aa, Mycobacterium
NPGDGG

SEQ ID NO: 1167142 - protein, 4 aa, Mycobacterium
NPGF

SEQ ID NO: 1167143 - protein, 11 aa, Mycobacterium
NPGKDDEGNIY

SEQ ID NO: 1167144 - protein, 4 aa, Mycobacterium
NPGL

SEQ ID NO: 1167145 - protein, 10 aa, Mycobacterium
NPGPNYAKTR

SEQ ID NO: 1167146 - protein, 8 aa, Mycobacterium
NPGRGGTL

SEQ ID NO: 1167147 - protein, 5 aa, Mycobacterium
NPGSA

SEQ ID NO: 1167148 - protein, 8 aa, Mycobacterium
NPGSAEGI

SEQ ID NO: 1167149 - protein, 11 aa, Mycobacterium
NPGSDGAPDTW

SEQ ID NO: 1167150 - protein, 7 aa, Mycobacterium
NPGSERY

SEQ ID NO: 1167151 - protein, 12 aa, Mycobacterium
NPGSPTDRRRQP

SEQ ID NO: 1167152 - protein, 7 aa, Mycobacterium
NPGTTFE

SEQ ID NO: 1167153 - protein, 6 aa, Mycobacterium
NPGTVG

SEQ ID NO: 1167154 - protein, 5 aa, Mycobacterium
NPGVR

SEQ ID NO: 1167155 - protein, 5 aa, Mycobacterium
NPGYQ

SEQ ID NO: 1167156 - protein, 4 aa, Mycobacterium
NPHA

SEQ ID NO: 1167157 - protein, 4 aa, Mycobacterium
NPHG

SEQ ID NO: 1167158 - protein, 5 aa, Mycobacterium
NPIGQ

SEQ ID NO: 1167159 - protein, 6 aa, Mycobacterium
NPIPKL

SEQ ID NO: 1167160 - protein, 8 aa, Mycobacterium
NPIPNPPP

SEQ ID NO: 1167161 - protein, 15 aa, Mycobacterium
NPIRERKKKTGAAAR

SEQ ID NO: 1167162 - protein, 9 aa, Mycobacterium
NPKATAEAF

SEQ ID NO: 1167163 - protein, 9 aa, Mycobacterium
NPKSRADLK

SEQ ID NO: 1167164 - protein, 8 aa, Mycobacterium
NPLPAEGF

SEQ ID NO: 1167165 - protein, 6 aa, Mycobacterium
NPLRGK

SEQ ID NO: 1167166 - protein, 8 aa, Mycobacterium
NPNGRGQF

SEQ ID NO: 1167167 - protein, 14 aa, Mycobacterium
NPPGSTAKGPGALA

SEQ ID NO: 1167168 - protein, 9 aa, Mycobacterium
NPPRTEDQL

SEQ ID NO: 1167169 - protein, 5 aa, Mycobacterium
NPQGF

SEQ ID NO: 1167170 - protein, 8 aa, Mycobacterium
NPQIDEAA

SEQ ID NO: 1167171 - protein, 11 aa, Mycobacterium
NPQKDQSQWVT

SEQ ID NO: 1167172 - protein, 5 aa, Mycobacterium
NPQLA

SEQ ID NO: 1167173 - protein, 7 aa, Mycobacterium
NPQRGYP

SEQ ID NO: 1167174 - protein, 16 aa, Mycobacterium
NPQTDRAKDFLGKILH

SEQ ID NO: 1167175 - protein, 17 aa, Mycobacterium
NPQTREPLAPYGASSAA

SEQ ID NO: 1167176 - protein, 4 aa, Mycobacterium
NPRA

SEQ ID NO: 1167177 - protein, 11 aa, Mycobacterium
NPRPTNPAGKL

SEQ ID NO: 1167178 - protein, 4 aa, Mycobacterium
NPRT

SEQ ID NO: 1167179 - protein, 9 aa, Mycobacterium
NPRTAETEQ

SEQ ID NO: 1167180 - protein, 8 aa, Mycobacterium
NPRTAPRL

SEQ ID NO: 1167181 - protein, 10 aa, Mycobacterium
NPRTPSWGEP

SEQ ID NO: 1167182 - protein, 8 aa, Mycobacterium
NPSGEPSL

SEQ ID NO: 1167183 - protein, 10 aa, Mycobacterium
NPSKRNELGS

SEQ ID NO: 1167184 - protein, 6 aa, Mycobacterium
NPTAES

SEQ ID NO: 1167185 - protein, 6 aa, Mycobacterium
NPTCGD

SEQ ID NO: 1167186 - protein, 8 aa, Mycobacterium
NPTNPTGV

SEQ ID NO: 1167187 - protein, 18 aa, Mycobacterium
NPTPGSEWDASPKPAERE

SEQ ID NO: 1167188 - protein, 12 aa, Mycobacterium
NPTQVVPKGPDL

SEQ ID NO: 1167189 - protein, 8 aa, Mycobacterium
NPTTTPDH

SEQ ID NO: 1167190 - protein, 13 aa, Mycobacterium
NPVSQGPAQEKTM

SEQ ID NO: 1167191 - protein, 12 aa, Mycobacterium
NPVTAHKDGTIT

SEQ ID NO: 1167192 - protein, 10 aa, Mycobacterium
NPVTGGSTMP

SEQ ID NO: 1167193 - protein, 18 aa, Mycobacterium
NPWDTDHTAGASSSGSGA

SEQ ID NO: 1167194 - protein, 13 aa, Mycobacterium
NPYGPPDWNPRQG

SEQ ID NO: 1167195 - protein, 12 aa, Mycobacterium
NPYPETAPPERP

SEQ ID NO: 1167196 - protein, 16 aa, Mycobacterium
NQAANKKSALSVALNK

SEQ ID NO: 1167197 - protein, 6 aa, Mycobacterium
NQAARE

SEQ ID NO: 1167198 - protein, 7 aa, Mycobacterium
NQAQNLA

SEQ ID NO: 1167199 - protein, 10 aa, Mycobacterium
NQDPEEGRRR

SEQ ID NO: 1167200 - protein, 4 aa, Mycobacterium
NQEK

SEQ ID NO: 1167201 - protein, 7 aa, Mycobacterium
NQGMTEP

SEQ ID NO: 1167202 - protein, 8 aa, Mycobacterium
NQGPAGAA

SEQ ID NO: 1167203 - protein, 4 aa, Mycobacterium
NQHA

SEQ ID NO: 1167204 - protein, 5 aa, Mycobacterium
NQHGP

SEQ ID NO: 1167205 - protein, 7 aa, Mycobacterium
NQLADSR

SEQ ID NO: 1167206 - protein, 19 aa, Mycobacterium
NQPDEADTAQRPRSSADLP

SEQ ID NO: 1167207 - protein, 7 aa, Mycobacterium
NQPEATR

SEQ ID NO: 1167208 - protein, 6 aa, Mycobacterium
NQPEHE

SEQ ID NO: 1167209 - protein, 15 aa, Mycobacterium
NQPHGPRPSTVYPQD

SEQ ID NO: 1167210 - protein, 5 aa, Mycobacterium
NQPLY

SEQ ID NO: 1167211 - protein, 7 aa, Mycobacterium
NQPPEKL

SEQ ID NO: 1167212 - protein, 7 aa, Mycobacterium
NQPRPVR

SEQ ID NO: 1167213 - protein, 4 aa, Mycobacterium
NQRE

SEQ ID NO: 1167214 - protein, 16 aa, Mycobacterium
NQRGYSPGARPRRRRD

SEQ ID NO: 1167215 - protein, 27 aa, Mycobacterium
NQRNATRDERGRVRNTEEVHDELRRLN

SEQ ID NO: 1167216 - protein, 8 aa, Mycobacterium
NQTGSTAI

SEQ ID NO: 1167217 - protein, 7 aa, Mycobacterium
NQVEPGT

SEQ ID NO: 1167218 - protein, 9 aa, Mycobacterium
NQYGEPYGG

SEQ ID NO: 1167219 - protein, 6 aa, Mycobacterium
NQYPPG

SEQ ID NO: 1167220 - protein, 5 aa, Mycobacterium
NRAAQ

SEQ ID NO: 1167221 - protein, 5 aa, Mycobacterium
NRADP

SEQ ID NO: 1167222 - protein, 9 aa, Mycobacterium
NRAGIDPKK

SEQ ID NO: 1167223 - protein, 8 aa, Mycobacterium
NRAPGGDV

SEQ ID NO: 1167224 - protein, 6 aa, Mycobacterium
NRATGI

SEQ ID NO: 1167225 - protein, 4 aa, Mycobacterium
NRDA

SEQ ID NO: 1167226 - protein, 11 aa, Mycobacterium
NRDAEKAGDWK

SEQ ID NO: 1167227 - protein, 6 aa, Mycobacterium
NRDEEV

SEQ ID NO: 1167228 - protein, 6 aa, Mycobacterium
NRDGDR

SEQ ID NO: 1167229 - protein, 6 aa, Mycobacterium
NRDPLK

SEQ ID NO: 1167230 - protein, 12 aa, Mycobacterium
NRDPRRYPDPDA

SEQ ID NO: 1167231 - protein, 4 aa, Mycobacterium
NRDR

SEQ ID NO: 1167232 - protein, 12 aa, Mycobacterium
NRDRRRFGETAE

SEQ ID NO: 1167233 - protein, 7 aa, Mycobacterium
NRDTGEI

SEQ ID NO: 1167234 - protein, 7 aa, Mycobacterium
NRDTVSA

SEQ ID NO: 1167235 - protein, 7 aa, Mycobacterium
NREGLSA

SEQ ID NO: 1167236 - protein, 12 aa, Mycobacterium
NRESARRRTVAN

SEQ ID NO: 1167237 - protein, 11 aa, Mycobacterium
NRFATDGYERT

SEQ ID NO: 1167238 - protein, 9 aa, Mycobacterium
NRGDNAGSA

SEQ ID NO: 1167239 - protein, 7 aa, Mycobacterium
NRGDRYG

SEQ ID NO: 1167240 - protein, 8 aa, Mycobacterium
NRGHATTA

SEQ ID NO: 1167241 - protein, 10 aa, Mycobacterium
NRGTGTEDRI

SEQ ID NO: 1167242 - protein, 7 aa, Mycobacterium
NRGTLGG

SEQ ID NO: 1167243 - protein, 5 aa, Mycobacterium
NRIPR

SEQ ID NO: 1167244 - protein, 30 aa, Mycobacterium
NRLGADPKNTNYAGGNTSAKGTETDPVTGA

SEQ ID NO: 1167245 - protein, 4 aa, Mycobacterium
NRLH

SEQ ID NO: 1167246 - protein, 7 aa, Mycobacterium
NRLPDKR

SEQ ID NO: 1167247 - protein, 12 aa, Mycobacterium
NRLRRSKDRRKI

SEQ ID NO: 1167248 - protein, 8 aa, Mycobacterium
NRNRAAGE

SEQ ID NO: 1167249 - protein, 10 aa, Mycobacterium
NRPADGQPGI

SEQ ID NO: 1167250 - protein, 5 aa, Mycobacterium
NRPAF

SEQ ID NO: 1167251 - protein, 7 aa, Mycobacterium
NRPAGTL

SEQ ID NO: 1167252 - protein, 5 aa, Mycobacterium
NRPAL

SEQ ID NO: 1167253 - protein, 4 aa, Mycobacterium
NRPD

SEQ ID NO: 1167254 - protein, 8 aa, Mycobacterium
NRPDATAD

SEQ ID NO: 1167255 - protein, 8 aa, Mycobacterium
NRPDSLNS

SEQ ID NO: 1167256 - protein, 4 aa, Mycobacterium
NRPE

SEQ ID NO: 1167257 - protein, 5 aa, Mycobacterium
NRPEA

SEQ ID NO: 1167258 - protein, 7 aa, Mycobacterium
NRPEAVG

SEQ ID NO: 1167259 - protein, 8 aa, Mycobacterium
NRPEKGNA

SEQ ID NO: 1167260 - protein, 5 aa, Mycobacterium
NRPFD

SEQ ID NO: 1167261 - protein, 9 aa, Mycobacterium
NRPHTPAIE

SEQ ID NO: 1167262 - protein, 12 aa, Mycobacterium
NRPMGAPPAPPA

SEQ ID NO: 1167263 - protein, 7 aa, Mycobacterium
NRPPHGI

SEQ ID NO: 1167264 - protein, 5 aa, Mycobacterium
NRPRR

SEQ ID NO: 1167265 - protein, 30 aa, Mycobacterium
NRQAAQSSRASGPSPQVPAARPASATLYRS

SEQ ID NO: 1167266 - protein, 5 aa, Mycobacterium
NRQPV

SEQ ID NO: 1167267 - protein, 13 aa, Mycobacterium
NRQRRSLGQRQTG

SEQ ID NO: 1167268 - protein, 8 aa, Mycobacterium
NRRGNAVE

SEQ ID NO: 1167269 - protein, 6 aa, Mycobacterium
NRRGRT

SEQ ID NO: 1167270 - protein, 9 aa, Mycobacterium
NRRPPRAPE

SEQ ID NO: 1167271 - protein, 4 aa, Mycobacterium
NRRT

SEQ ID NO: 1167272 - protein, 8 aa, Mycobacterium
NRSEYLDR

SEQ ID NO: 1167273 - protein, 19 aa, Mycobacterium
NRSRADTFGPDAHAPRGTD

SEQ ID NO: 1167274 - protein, 23 aa, Mycobacterium
NRTDPEWTTAADGPHKRERASAL

SEQ ID NO: 1167275 - protein, 7 aa, Mycobacterium
NRVEEGR

SEQ ID NO: 1167276 - protein, 12 aa, Mycobacterium
NRVSGGDHTRHP

SEQ ID NO: 1167277 - protein, 12 aa, Mycobacterium
NRYGPPERAPQA

SEQ ID NO: 1167278 - protein, 8 aa, Mycobacterium
NRYGRTRS

SEQ ID NO: 1167279 - protein, 5 aa, Mycobacterium
NSAAI

SEQ ID NO: 1167280 - protein, 4 aa, Mycobacterium
NSAD

SEQ ID NO: 1167281 - protein, 4 aa, Mycobacterium
NSAG

SEQ ID NO: 1167282 - protein, 6 aa, Mycobacterium
NSAPGV

SEQ ID NO: 1167283 - protein, 7 aa, Mycobacterium
NSARSQM

SEQ ID NO: 1167284 - protein, 13 aa, Mycobacterium
NSDAAVRTARDRI

SEQ ID NO: 1167285 - protein, 4 aa, Mycobacterium
NSDE

SEQ ID NO: 1167286 - protein, 5 aa, Mycobacterium
NSERD

SEQ ID NO: 1167287 - protein, 9 aa, Mycobacterium
NSESAEKAA

SEQ ID NO: 1167288 - protein, 6 aa, Mycobacterium
NSFTGT

SEQ ID NO: 1167289 - protein, 8 aa, Mycobacterium
NSGARQTI

SEQ ID NO: 1167290 - protein, 9 aa, Mycobacterium
NSGHPIGSA

SEQ ID NO: 1167291 - protein, 10 aa, Mycobacterium
NSGINPDDLA

SEQ ID NO: 1167292 - protein, 9 aa, Mycobacterium
NSGPLPEEI

SEQ ID NO: 1167293 - protein, 10 aa, Mycobacterium
NSGQDCTAAT

SEQ ID NO: 1167294 - protein, 9 aa, Mycobacterium
NSGSEAVEN

SEQ ID NO: 1167295 - protein, 4 aa, Mycobacterium
NSGT

SEQ ID NO: 1167296 - protein, 8 aa, Mycobacterium
NSGTREEL

SEQ ID NO: 1167297 - protein, 4 aa, Mycobacterium
NSGY

SEQ ID NO: 1167298 - protein, 12 aa, Mycobacterium
NSHADDDGRSDL

SEQ ID NO: 1167299 - protein, 4 aa, Mycobacterium
NSLS

SEQ ID NO: 1167300 - protein, 4 aa, Mycobacterium
NSMT

SEQ ID NO: 1167301 - protein, 14 aa, Mycobacterium
NSMTTNGESVSRST

SEQ ID NO: 1167302 - protein, 16 aa, Mycobacterium
NSNPARFDQKKADALN

SEQ ID NO: 1167303 - protein, 9 aa, Mycobacterium
NSNTFQDDD

SEQ ID NO: 1167304 - protein, 21 aa, Mycobacterium
NSPDLGADGEMPMRPDEQGTP

SEQ ID NO: 1167305 - protein, 12 aa, Mycobacterium
NSPEAVAPHGQA

SEQ ID NO: 1167306 - protein, 12 aa, Mycobacterium
NSPGTIDAGYRG

SEQ ID NO: 1167307 - protein, 4 aa, Mycobacterium
NSPH

SEQ ID NO: 1167308 - protein, 5 aa, Mycobacterium
NSPLY

SEQ ID NO: 1167309 - protein, 8 aa, Mycobacterium
NSPSFEEA

SEQ ID NO: 1167310 - protein, 5 aa, Mycobacterium
NSPYT

SEQ ID NO: 1167311 - protein, 11 aa, Mycobacterium
NSRADGYGGDL

SEQ ID NO: 1167312 - protein, 15 aa, Mycobacterium
NSRRRTADGSWEPGN

SEQ ID NO: 1167313 - protein, 9 aa, Mycobacterium
NSSADGTTL

SEQ ID NO: 1167314 - protein, 11 aa, Mycobacterium
NSSHSTLARRA

SEQ ID NO: 1167315 - protein, 4 aa, Mycobacterium
NSSM

SEQ ID NO: 1167316 - protein, 7 aa, Mycobacterium
NSSSEAV

SEQ ID NO: 1167317 - protein, 8 aa, Mycobacterium
NSSTLGLE

SEQ ID NO: 1167318 - protein, 8 aa, Mycobacterium
NSTAGGAY

SEQ ID NO: 1167319 - protein, 9 aa, Mycobacterium
NSTAGGAYV

SEQ ID NO: 1167320 - protein, 5 aa, Mycobacterium
NSTAY

SEQ ID NO: 1167321 - protein, 9 aa, Mycobacterium
NSTSQDARS

SEQ ID NO: 1167322 - protein, 7 aa, Mycobacterium
NSTTLSN

SEQ ID NO: 1167323 - protein, 5 aa, Mycobacterium
NSTWG

SEQ ID NO: 1167324 - protein, 5 aa, Mycobacterium
NSVGI

SEQ ID NO: 1167325 - protein, 11 aa, Mycobacterium
NSVKPGRPRTG

SEQ ID NO: 1167326 - protein, 9 aa, Mycobacterium
NSVTPPGQM

SEQ ID NO: 1167327 - protein, 7 aa, Mycobacterium
NTAADQL

SEQ ID NO: 1167328 - protein, 7 aa, Mycobacterium
NTAAGAG

SEQ ID NO: 1167329 - protein, 7 aa, Mycobacterium
NTAANAF

SEQ ID NO: 1167330 - protein, 14 aa, Mycobacterium
NTAEQNARNDGKGR

SEQ ID NO: 1167331 - protein, 14 aa, Mycobacterium
NTAKGDEAAATMTG

SEQ ID NO: 1167332 - protein, 6 aa, Mycobacterium
NTATRR

SEQ ID NO: 1167333 - protein, 5 aa, Mycobacterium
NTDDS

SEQ ID NO: 1167334 - protein, 12 aa, Mycobacterium
NTDKGGAAAERI

SEQ ID NO: 1167335 - protein, 4 aa, Mycobacterium
NTDL

SEQ ID NO: 1167336 - protein, 10 aa, Mycobacterium
NTDPAGVEEA

SEQ ID NO: 1167337 - protein, 6 aa, Mycobacterium
NTEARL

SEQ ID NO: 1167338 - protein, 6 aa, Mycobacterium
NTEGFY

SEQ ID NO: 1167339 - protein, 4 aa, Mycobacterium
NTEL

SEQ ID NO: 1167340 - protein, 11 aa, Mycobacterium
NTELASAAGLS

SEQ ID NO: 1167341 - protein, 34 aa, Mycobacterium
NTETSTASEGPAVTTTTAESAPTADVASGDRAAS

SEQ ID NO: 1167342 - protein, 10 aa, Mycobacterium
NTGAVGRDDT

SEQ ID NO: 1167343 - protein, 6 aa, Mycobacterium
NTGLGH

SEQ ID NO: 1167344 - protein, 15 aa, Mycobacterium
NTGTGPTAPHRTNWP

SEQ ID NO: 1167345 - protein, 6 aa, Mycobacterium
NTGVGG

SEQ ID NO: 1167346 - protein, 12 aa, Mycobacterium
NTHEGGTHEEGF

SEQ ID NO: 1167347 - protein, 7 aa, Mycobacterium
NTHPSAR

SEQ ID NO: 1167348 - protein, 9 aa, Mycobacterium
NTIEGGTSD

SEQ ID NO: 1167349 - protein, 6 aa, Mycobacterium
NTIRAH

SEQ ID NO: 1167350 - protein, 8 aa, Mycobacterium
NTLSEPIP

SEQ ID NO: 1167351 - protein, 7 aa, Mycobacterium
NTNDDGL

SEQ ID NO: 1167352 - protein, 5 aa, Mycobacterium
NTNSR

SEQ ID NO: 1167353 - protein, 5 aa, Mycobacterium
NTPGS

SEQ ID NO: 1167354 - protein, 8 aa, Mycobacterium
NTPKPSIA

SEQ ID NO: 1167355 - protein, 7 aa, Mycobacterium
NTPNFRG

SEQ ID NO: 1167356 - protein, 13 aa, Mycobacterium
NTQPNSTGPTGFS

SEQ ID NO: 1167357 - protein, 5 aa, Mycobacterium
NTRFE

SEQ ID NO: 1167358 - protein, 8 aa, Mycobacterium
NTRSRRAQ

SEQ ID NO: 1167359 - protein, 6 aa, Mycobacterium
NTRSYG

SEQ ID NO: 1167360 - protein, 11 aa, Mycobacterium
NTSAWTTRYEN

SEQ ID NO: 1167361 - protein, 6 aa, Mycobacterium
NTSEDR

SEQ ID NO: 1167362 - protein, 6 aa, Mycobacterium
NTSGVR

SEQ ID NO: 1167363 - protein, 5 aa, Mycobacterium
NTSRA

SEQ ID NO: 1167364 - protein, 23 aa, Mycobacterium
NTSSGAGLQGSVGQANYSAAKAG

SEQ ID NO: 1167365 - protein, 5 aa, Mycobacterium
NTSSM

SEQ ID NO: 1167366 - protein, 21 aa, Mycobacterium
NTSSTSGLQGNPGQVNYSTAK

SEQ ID NO: 1167367 - protein, 6 aa, Mycobacterium
NTTIDG

SEQ ID NO: 1167368 - protein, 4 aa, Mycobacterium
NTTM

SEQ ID NO: 1167369 - protein, 6 aa, Mycobacterium
NTYPGA

SEQ ID NO: 1167370 - protein, 16 aa, Mycobacterium
NVARRSKTDVLIVHTT

SEQ ID NO: 1167371 - protein, 7 aa, Mycobacterium
NVATNAG

SEQ ID NO: 1167372 - protein, 13 aa, Mycobacterium
NVATQTRAVGERA

SEQ ID NO: 1167373 - protein, 7 aa, Mycobacterium
NVATTEV

SEQ ID NO: 1167374 - protein, 12 aa, Mycobacterium
NVDEKTAQEIAD

SEQ ID NO: 1167375 - protein, 9 aa, Mycobacterium
NVDRPPESL

SEQ ID NO: 1167376 - protein, 6 aa, Mycobacterium
NVEDEK

SEQ ID NO: 1167377 - protein, 5 aa, Mycobacterium
NVEGE

SEQ ID NO: 1167378 - protein, 6 aa, Mycobacterium
NVEPGS

SEQ ID NO: 1167379 - protein, 13 aa, Mycobacterium
NVGATPGRGFDGD

SEQ ID NO: 1167380 - protein, 11 aa, Mycobacterium
NVGDRSEHTRR

SEQ ID NO: 1167381 - protein, 8 aa, Mycobacterium
NVGKPQVA

SEQ ID NO: 1167382 - protein, 15 aa, Mycobacterium
NVGPEPEGAPIEEQG

SEQ ID NO: 1167383 - protein, 7 aa, Mycobacterium
NVKVGST

SEQ ID NO: 1167384 - protein, 15 aa, Mycobacterium
NVLPSSTNPTRPHTV

SEQ ID NO: 1167385 - protein, 6 aa, Mycobacterium
NVMPPR

SEQ ID NO: 1167386 - protein, 6 aa, Mycobacterium
NVPDGG

SEQ ID NO: 1167387 - protein, 8 aa, Mycobacterium
NVPGPQEE

SEQ ID NO: 1167388 - protein, 6 aa, Mycobacterium
NVPGPR

SEQ ID NO: 1167389 - protein, 7 aa, Mycobacterium
NVPGPRE

SEQ ID NO: 1167390 - protein, 12 aa, Mycobacterium
NVPGPRERGRVG

SEQ ID NO: 1167391 - protein, 8 aa, Mycobacterium
NVPGPRNY

SEQ ID NO: 1167392 - protein, 9 aa, Mycobacterium
NVPPRPEDL

SEQ ID NO: 1167393 - protein, 9 aa, Mycobacterium
NVPPSGIET

SEQ ID NO: 1167394 - protein, 6 aa, Mycobacterium
NVPTQN

SEQ ID NO: 1167395 - protein, 11 aa, Mycobacterium
NVREGEAGGIT

SEQ ID NO: 1167396 - protein, 5 aa, Mycobacterium
NVRRA

SEQ ID NO: 1167397 - protein, 5 aa, Mycobacterium
NVTAR

SEQ ID NO: 1167398 - protein, 8 aa, Mycobacterium
NVTGIEEG

SEQ ID NO: 1167399 - protein, 5 aa, Mycobacterium
NWADP

SEQ ID NO: 1167400 - protein, 9 aa, Mycobacterium
NWGDARTNL

SEQ ID NO: 1167401 - protein, 6 aa, Mycobacterium
NWRDDA

SEQ ID NO: 1167402 - protein, 4 aa, Mycobacterium
NYAG

SEQ ID NO: 1167403 - protein, 6 aa, Mycobacterium
NYAPGD

SEQ ID NO: 1167404 - protein, 4 aa, Mycobacterium
NYDH

SEQ ID NO: 1167405 - protein, 23 aa, Mycobacterium
NYFSPDSPFGGYKQSGIGREMGT

SEQ ID NO: 1167406 - protein, 11 aa, Mycobacterium
NYGAKKAQQTM

SEQ ID NO: 1167407 - protein, 9 aa, Mycobacterium
NYGATTGQP

SEQ ID NO: 1167408 - protein, 10 aa, Mycobacterium
NYGPGDPNLA

SEQ ID NO: 1167409 - protein, 13 aa, Mycobacterium
NYGPPYGSAEENF

SEQ ID NO: 1167410 - protein, 7 aa, Mycobacterium
NYPPEVS

SEQ ID NO: 1167411 - protein, 13 aa, Mycobacterium
PAAADEDGITAGY

SEQ ID NO: 1167412 - protein, 6 aa, Mycobacterium
PAAADT

SEQ ID NO: 1167413 - protein, 12 aa, Mycobacterium
PAAAEPLTTPDH

SEQ ID NO: 1167414 - protein, 13 aa, Mycobacterium
PAAAETAGAAATV

SEQ ID NO: 1167415 - protein, 22 aa, Mycobacterium
PAAAPADPAITAAPVSAAPAVP

SEQ ID NO: 1167416 - protein, 29 aa, Mycobacterium
PAAARQLASRARRAVADAEAPARDPSHDE

SEQ ID NO: 1167417 - protein, 7 aa, Mycobacterium
PAAARQS

SEQ ID NO: 1167418 - protein, 13 aa, Mycobacterium
PAAASDDLADTVD

SEQ ID NO: 1167419 - protein, 9 aa, Mycobacterium
PAADAAMGD

SEQ ID NO: 1167420 - protein, 11 aa, Mycobacterium
PAADNVPSRRV

SEQ ID NO: 1167421 - protein, 8 aa, Mycobacterium
PAADPADL

SEQ ID NO: 1167422 - protein, 5 aa, Mycobacterium
PAAED

SEQ ID NO: 1167423 - protein, 13 aa, Mycobacterium
PAAEELADDRAAQ

SEQ ID NO: 1167424 - protein, 7 aa, Mycobacterium
PAAENGI

SEQ ID NO: 1167425 - protein, 9 aa, Mycobacterium
PAAEPDSTV

SEQ ID NO: 1167426 - protein, 11 aa, Mycobacterium
PAAESGPPLST

SEQ ID NO: 1167427 - protein, 21 aa, Mycobacterium
PAAGAPRWTAPAAGSARPATD

SEQ ID NO: 1167428 - protein, 8 aa, Mycobacterium
PAAGEHGG

SEQ ID NO: 1167429 - protein, 18 aa, Mycobacterium
PAAGEYSGEEEDQLPAED

SEQ ID NO: 1167430 - protein, 5 aa, Mycobacterium
PAAGL

SEQ ID NO: 1167431 - protein, 10 aa, Mycobacterium
PAAGPEGSGV

SEQ ID NO: 1167432 - protein, 9 aa, Mycobacterium
PAAITSGTY

SEQ ID NO: 1167433 - protein, 5 aa, Mycobacterium
PAALT

SEQ ID NO: 1167434 - protein, 7 aa, Mycobacterium
PAAPERD

SEQ ID NO: 1167435 - protein, 15 aa, Mycobacterium
PAAPTALDTPAGDIA

SEQ ID NO: 1167436 - protein, 4 aa, Mycobacterium
PAAQ

SEQ ID NO: 1167437 - protein, 6 aa, Mycobacterium
PAAQDL

SEQ ID NO: 1167438 - protein, 9 aa, Mycobacterium
PAAQGRGLG

SEQ ID NO: 1167439 - protein, 13 aa, Mycobacterium
PAASGGDGTGSIR

SEQ ID NO: 1167440 - protein, 6 aa, Mycobacterium
PAASYL

SEQ ID NO: 1167441 - protein, 7 aa, Mycobacterium
PAATDTD

SEQ ID NO: 1167442 - protein, 9 aa, Mycobacterium
PAATGSARQ

SEQ ID NO: 1167443 - protein, 5 aa, Mycobacterium
PAATL

SEQ ID NO: 1167444 - protein, 8 aa, Mycobacterium
PAATPNTA

SEQ ID NO: 1167445 - protein, 6 aa, Mycobacterium
PAAVEA

SEQ ID NO: 1167446 - protein, 15 aa, Mycobacterium
PACRSARAVSTGPYD

SEQ ID NO: 1167447 - protein, 11 aa, Mycobacterium
PADAAQRVTGS

SEQ ID NO: 1167448 - protein, 8 aa, Mycobacterium
PADAGQNV

SEQ ID NO: 1167449 - protein, 8 aa, Mycobacterium
PADAPAGL

SEQ ID NO: 1167450 - protein, 8 aa, Mycobacterium
PADARDYG

SEQ ID NO: 1167451 - protein, 5 aa, Mycobacterium
PADAV

SEQ ID NO: 1167452 - protein, 10 aa, Mycobacterium
PADEHRRASP

SEQ ID NO: 1167453 - protein, 7 aa, Mycobacterium
PADENWK

SEQ ID NO: 1167454 - protein, 5 aa, Mycobacterium
PADEP

SEQ ID NO: 1167455 - protein, 6 aa, Mycobacterium
PADERE

SEQ ID NO: 1167456 - protein, 5 aa, Mycobacterium
PADFA

SEQ ID NO: 1167457 - protein, 5 aa, Mycobacterium
PADGA

SEQ ID NO: 1167458 - protein, 6 aa, Mycobacterium
PADGRR

SEQ ID NO: 1167459 - protein, 7 aa, Mycobacterium
PADGVPD

SEQ ID NO: 1167460 - protein, 7 aa, Mycobacterium
PADISQA

SEQ ID NO: 1167461 - protein, 12 aa, Mycobacterium
PADLGTAEGVQT

SEQ ID NO: 1167462 - protein, 7 aa, Mycobacterium
PADLTSD

SEQ ID NO: 1167463 - protein, 10 aa, Mycobacterium
PADPAARRAA

SEQ ID NO: 1167464 - protein, 7 aa, Mycobacterium
PADPADY

SEQ ID NO: 1167465 - protein, 8 aa, Mycobacterium
PADPDADA

SEQ ID NO: 1167466 - protein, 7 aa, Mycobacterium
PADPPHI

SEQ ID NO: 1167467 - protein, 11 aa, Mycobacterium
PADPPPTPDEH

SEQ ID NO: 1167468 - protein, 9 aa, Mycobacterium
PADPQVQPR

SEQ ID NO: 1167469 - protein, 6 aa, Mycobacterium
PADPVD

SEQ ID NO: 1167470 - protein, 9 aa, Mycobacterium
PADRAADGA

SEQ ID NO: 1167471 - protein, 10 aa, Mycobacterium
PADRGSGLGK

SEQ ID NO: 1167472 - protein, 5 aa, Mycobacterium
PADRT

SEQ ID NO: 1167473 - protein, 8 aa, Mycobacterium
PADSADGA

SEQ ID NO: 1167474 - protein, 10 aa, Mycobacterium
PADSEDGRSV

SEQ ID NO: 1167475 - protein, 5 aa, Mycobacterium
PADTG

SEQ ID NO: 1167476 - protein, 6 aa, Mycobacterium
PADTNT

SEQ ID NO: 1167477 - protein, 4 aa, Mycobacterium
PADV

SEQ ID NO: 1167478 - protein, 6 aa, Mycobacterium
PADVAD

SEQ ID NO: 1167479 - protein, 6 aa, Mycobacterium
PADVPD

SEQ ID NO: 1167480 - protein, 8 aa, Mycobacterium
PADVRTRT

SEQ ID NO: 1167481 - protein, 10 aa, Mycobacterium
PAEAAESVEE

SEQ ID NO: 1167482 - protein, 16 aa, Mycobacterium
PAEADEYRAAARAAAA

SEQ ID NO: 1167483 - protein, 7 aa, Mycobacterium
PAEAPER

SEQ ID NO: 1167484 - protein, 10 aa, Mycobacterium
PAEESADGAR

SEQ ID NO: 1167485 - protein, 6 aa, Mycobacterium
PAEEVA

SEQ ID NO: 1167486 - protein, 25 aa, Mycobacterium
PAEHPDAGPEHASTGVAVQPPPRGN

SEQ ID NO: 1167487 - protein, 33 aa, Mycobacterium
PAEHPYGSAKVGSKYQGQRGPTPSRSYQNFIKL

SEQ ID NO: 1167488 - protein, 5 aa, Mycobacterium
PAELG

SEQ ID NO: 1167489 - protein, 7 aa, Mycobacterium
PAELPES

SEQ ID NO: 1167490 - protein, 9 aa, Mycobacterium
PAENAPADY

SEQ ID NO: 1167491 - protein, 10 aa, Mycobacterium
PAEPADPDIL

SEQ ID NO: 1167492 - protein, 8 aa, Mycobacterium
PAEPEPVA

SEQ ID NO: 1167493 - protein, 10 aa, Mycobacterium
PAEPQPVSDI

SEQ ID NO: 1167494 - protein, 5 aa, Mycobacterium
PAEPW

SEQ ID NO: 1167495 - protein, 6 aa, Mycobacterium
PAEQRT

SEQ ID NO: 1167496 - protein, 6 aa, Mycobacterium
PAERET

SEQ ID NO: 1167497 - protein, 5 aa, Mycobacterium
PAERS

SEQ ID NO: 1167498 - protein, 11 aa, Mycobacterium
PAESDGIDPSA

SEQ ID NO: 1167499 - protein, 11 aa, Mycobacterium
PAEVASGDLAD

SEQ ID NO: 1167500 - protein, 5 aa, Mycobacterium
PAEVR

SEQ ID NO: 1167501 - protein, 10 aa, Mycobacterium
PAEYTGERTH

SEQ ID NO: 1167502 - protein, 4 aa, Mycobacterium
PAFA

SEQ ID NO: 1167503 - protein, 15 aa, Mycobacterium
PAFDPPRRDLTTRAD

SEQ ID NO: 1167504 - protein, 7 aa, Mycobacterium
PAFGADD

SEQ ID NO: 1167505 - protein, 4 aa, Mycobacterium
PAFR

SEQ ID NO: 1167506 - protein, 8 aa, Mycobacterium
PAGAAYGQ

SEQ ID NO: 1167507 - protein, 6 aa, Mycobacterium
PAGADA

SEQ ID NO: 1167508 - protein, 7 aa, Mycobacterium
PAGCPDE

SEQ ID NO: 1167509 - protein, 12 aa, Mycobacterium
PAGDPAEAGETV

SEQ ID NO: 1167510 - protein, 5 aa, Mycobacterium
PAGFS

SEQ ID NO: 1167511 - protein, 5 aa, Mycobacterium
PAGGG

SEQ ID NO: 1167512 - protein, 7 aa, Mycobacterium
PAGGGPV

SEQ ID NO: 1167513 - protein, 13 aa, Mycobacterium
PAGGKRLDQTADG

SEQ ID NO: 1167514 - protein, 6 aa, Mycobacterium
PAGGNR

SEQ ID NO: 1167515 - protein, 5 aa, Mycobacterium
PAGGY

SEQ ID NO: 1167516 - protein, 13 aa, Mycobacterium
PAGIDAASQTEVD

SEQ ID NO: 1167517 - protein, 7 aa, Mycobacterium
PAGIGKT

SEQ ID NO: 1167518 - protein, 24 aa, Mycobacterium
PAGPDARTEVRAPLDGAENEVPDE

SEQ ID NO: 1167519 - protein, 9 aa, Mycobacterium
PAGQRCTTV

SEQ ID NO: 1167520 - protein, 5 aa, Mycobacterium
PAGRL

SEQ ID NO: 1167521 - protein, 25 aa, Mycobacterium
PAGRRPARRLTRGAKGERAPAFTPG

SEQ ID NO: 1167522 - protein, 12 aa, Mycobacterium
PAGSGVDAASAS

SEQ ID NO: 1167523 - protein, 7 aa, Mycobacterium
PAGSTPV

SEQ ID NO: 1167524 - protein, 15 aa, Mycobacterium
PAGSTVGTSSPRRAA

SEQ ID NO: 1167525 - protein, 5 aa, Mycobacterium
PAGTA

SEQ ID NO: 1167526 - protein, 8 aa, Mycobacterium
PAGTGSDV

SEQ ID NO: 1167527 - protein, 7 aa, Mycobacterium
PAGTRST

SEQ ID NO: 1167528 - protein, 15 aa, Mycobacterium
PAGVGDGSAKGFPGD

SEQ ID NO: 1167529 - protein, 7 aa, Mycobacterium
PAGVGKT

SEQ ID NO: 1167530 - protein, 7 aa, Mycobacterium
PAGVGSV

SEQ ID NO: 1167531 - protein, 5 aa, Mycobacterium
PAGVN

SEQ ID NO: 1167532 - protein, 4 aa, Mycobacterium
PAHA

SEQ ID NO: 1167533 - protein, 9 aa, Mycobacterium
PAHATSSGK

SEQ ID NO: 1167534 - protein, 6 aa, Mycobacterium
PAHERA

SEQ ID NO: 1167535 - protein, 4 aa, Mycobacterium
PAHP

SEQ ID NO: 1167536 - protein, 5 aa, Mycobacterium
PAHPY

SEQ ID NO: 1167537 - protein, 6 aa, Mycobacterium
PAHPYT

SEQ ID NO: 1167538 - protein, 10 aa, Mycobacterium
PAHRAGSAGD

SEQ ID NO: 1167539 - protein, 4 aa, Mycobacterium
PAIT

SEQ ID NO: 1167540 - protein, 5 aa, Mycobacterium
PAKAV

SEQ ID NO: 1167541 - protein, 6 aa, Mycobacterium
PAKDPL

SEQ ID NO: 1167542 - protein, 7 aa, Mycobacterium
PAKSGVQ

SEQ ID NO: 1167543 - protein, 6 aa, Mycobacterium
PALATG

SEQ ID NO: 1167544 - protein, 8 aa, Mycobacterium
PALGTGKQ

SEQ ID NO: 1167545 - protein, 5 aa, Mycobacterium
PALKD

SEQ ID NO: 1167546 - protein, 6 aa, Mycobacterium
PALPES

SEQ ID NO: 1167547 - protein, 7 aa, Mycobacterium
PALPKPV

SEQ ID NO: 1167548 - protein, 5 aa, Mycobacterium
PALPP

SEQ ID NO: 1167549 - protein, 7 aa, Mycobacterium
PALPSEL

SEQ ID NO: 1167550 - protein, 10 aa, Mycobacterium
PALQERESSK

SEQ ID NO: 1167551 - protein, 7 aa, Mycobacterium
PALSDGN

SEQ ID NO: 1167552 - protein, 9 aa, Mycobacterium
PALSPPAGL

SEQ ID NO: 1167553 - protein, 5 aa, Mycobacterium
PALTG

SEQ ID NO: 1167554 - protein, 12 aa, Mycobacterium
PALTPTAGETAP

SEQ ID NO: 1167555 - protein, 9 aa, Mycobacterium
PAMPPGRRE

SEQ ID NO: 1167556 - protein, 7 aa, Mycobacterium
PANEALQ

SEQ ID NO: 1167557 - protein, 6 aa, Mycobacterium
PANEEV

SEQ ID NO: 1167558 - protein, 6 aa, Mycobacterium
PANHPP

SEQ ID NO: 1167559 - protein, 8 aa, Mycobacterium
PANKGHTR

SEQ ID NO: 1167560 - protein, 9 aa, Mycobacterium
PANRADPYP

SEQ ID NO: 1167561 - protein, 13 aa, Mycobacterium
PANWTKTYPGSSY

SEQ ID NO: 1167562 - protein, 5 aa, Mycobacterium
PAPAE

SEQ ID NO: 1167563 - protein, 7 aa, Mycobacterium
PAPAERA

SEQ ID NO: 1167564 - protein, 9 aa, Mycobacterium
PAPAISPAL

SEQ ID NO: 1167565 - protein, 8 aa, Mycobacterium
PAPAREGL

SEQ ID NO: 1167566 - protein, 7 aa, Mycobacterium
PAPDAGA

SEQ ID NO: 1167567 - protein, 8 aa, Mycobacterium
PAPDPARW

SEQ ID NO: 1167568 - protein, 11 aa, Mycobacterium
PAPDQEEDVRR

SEQ ID NO: 1167569 - protein, 6 aa, Mycobacterium
PAPDTP

SEQ ID NO: 1167570 - protein, 7 aa, Mycobacterium
PAPESPL

SEQ ID NO: 1167571 - protein, 9 aa, Mycobacterium
PAPGDGRTI

SEQ ID NO: 1167572 - protein, 8 aa, Mycobacterium
PAPGGRRE

SEQ ID NO: 1167573 - protein, 8 aa, Mycobacterium
PAPGLPGL

SEQ ID NO: 1167574 - protein, 18 aa, Mycobacterium
PAPGPVTTFEPPTGPGVR

SEQ ID NO: 1167575 - protein, 7 aa, Mycobacterium
PAPGQAK

SEQ ID NO: 1167576 - protein, 43 aa, Mycobacterium
PAPGSKTAKTRVGRGEGSKGKTAGRGTKGTKARKNVPSTFEGG

SEQ ID NO: 1167577 - protein, 12 aa, Mycobacterium
PAPGTVNAEPGD

SEQ ID NO: 1167578 - protein, 7 aa, Mycobacterium
PAPNAAL

SEQ ID NO: 1167579 - protein, 21 aa, Mycobacterium
PAPNKMNTGGVHGSALGDDEV

SEQ ID NO: 1167580 - protein, 7 aa, Mycobacterium
PAPNLDP

SEQ ID NO: 1167581 - protein, 8 aa, Mycobacterium
PAPNTPFN

SEQ ID NO: 1167582 - protein, 6 aa, Mycobacterium
PAPPDE

SEQ ID NO: 1167583 - protein, 5 aa, Mycobacterium
PAPPE

SEQ ID NO: 1167584 - protein, 28 aa, Mycobacterium
PAPPEEPEDGAPAKKGKKPTGPKPRTGS

SEQ ID NO: 1167585 - protein, 6 aa, Mycobacterium
PAPPMP

SEQ ID NO: 1167586 - protein, 9 aa, Mycobacterium
PAPPPGAVS

SEQ ID NO: 1167587 - protein, 8 aa, Mycobacterium
PAPQEHRA

SEQ ID NO: 1167588 - protein, 12 aa, Mycobacterium
PAPQYPPADPRT

SEQ ID NO: 1167589 - protein, 8 aa, Mycobacterium
PAPRDGDF

SEQ ID NO: 1167590 - protein, 10 aa, Mycobacterium
PAPRRVGPAP

SEQ ID NO: 1167591 - protein, 6 aa, Mycobacterium
PAPRVS

SEQ ID NO: 1167592 - protein, 9 aa, Mycobacterium
PAPSVEGLR

SEQ ID NO: 1167593 - protein, 9 aa, Mycobacterium
PAPTPTGQT

SEQ ID NO: 1167594 - protein, 6 aa, Mycobacterium
PAPVEP

SEQ ID NO: 1167595 - protein, 5 aa, Mycobacterium
PAPVP

SEQ ID NO: 1167596 - protein, 16 aa, Mycobacterium
PAPYKPREDDIDEEVR

SEQ ID NO: 1167597 - protein, 26 aa, Mycobacterium
PAQAETATKITKREPAVAGDRPELTE

SEQ ID NO: 1167598 - protein, 7 aa, Mycobacterium
PAQAPMY

SEQ ID NO: 1167599 - protein, 8 aa, Mycobacterium
PAQARATR

SEQ ID NO: 1167600 - protein, 10 aa, Mycobacterium
PAQEPDDLRR

SEQ ID NO: 1167601 - protein, 7 aa, Mycobacterium
PAQGGVR

SEQ ID NO: 1167602 - protein, 7 aa, Mycobacterium
PAQRDRA

SEQ ID NO: 1167603 - protein, 19 aa, Mycobacterium
PAQSELLGGSGQLESTVSD

SEQ ID NO: 1167604 - protein, 14 aa, Mycobacterium
PAQWPSNSVQLVHR

SEQ ID NO: 1167605 - protein, 7 aa, Mycobacterium
PARDEDP

SEQ ID NO: 1167606 - protein, 4 aa, Mycobacterium
PARE

SEQ ID NO: 1167607 - protein, 4 aa, Mycobacterium
PARG

SEQ ID NO: 1167608 - protein, 9 aa, Mycobacterium
PARGGSSIG

SEQ ID NO: 1167609 - protein, 4 aa, Mycobacterium
PARR

SEQ ID NO: 1167610 - protein, 9 aa, Mycobacterium
PARSRETSL

SEQ ID NO: 1167611 - protein, 10 aa, Mycobacterium
PARTQTFTPP

SEQ ID NO: 1167612 - protein, 7 aa, Mycobacterium
PARTVTA

SEQ ID NO: 1167613 - protein, 5 aa, Mycobacterium
PARTW

SEQ ID NO: 1167614 - protein, 8 aa, Mycobacterium
PARVPGAR

SEQ ID NO: 1167615 - protein, 25 aa, Mycobacterium
PARVTGRNVPSSAKAPYEPDRADAA

SEQ ID NO: 1167616 - protein, 19 aa, Mycobacterium
PASAETSVSTSTSTSTVTT

SEQ ID NO: 1167617 - protein, 10 aa, Mycobacterium
PASAPTTTCG

SEQ ID NO: 1167618 - protein, 15 aa, Mycobacterium
PASASDRLKSTVAQR

SEQ ID NO: 1167619 - protein, 11 aa, Mycobacterium
PASASGRGRRR

SEQ ID NO: 1167620 - protein, 9 aa, Mycobacterium
PASDTAPPM

SEQ ID NO: 1167621 - protein, 11 aa, Mycobacterium
PASESDPLASG

SEQ ID NO: 1167622 - protein, 4 aa, Mycobacterium
PASG

SEQ ID NO: 1167623 - protein, 7 aa, Mycobacterium
PASGGAT

SEQ ID NO: 1167624 - protein, 10 aa, Mycobacterium
PASGGGNGAR

SEQ ID NO: 1167625 - protein, 8 aa, Mycobacterium
PASGKSTV

SEQ ID NO: 1167626 - protein, 13 aa, Mycobacterium
PASKAEGTWTTTG

SEQ ID NO: 1167627 - protein, 4 aa, Mycobacterium
PASL

SEQ ID NO: 1167628 - protein, 11 aa, Mycobacterium
PASNPHATAEQ

SEQ ID NO: 1167629 - protein, 9 aa, Mycobacterium
PASRPSRAG

SEQ ID NO: 1167630 - protein, 7 aa, Mycobacterium
PASSFSP

SEQ ID NO: 1167631 - protein, 8 aa, Mycobacterium
PASSLRGE

SEQ ID NO: 1167632 - protein, 4 aa, Mycobacterium
PATA

SEQ ID NO: 1167633 - protein, 9 aa, Mycobacterium
PATAESSPP

SEQ ID NO: 1167634 - protein, 6 aa, Mycobacterium
PATDPE

SEQ ID NO: 1167635 - protein, 5 aa, Mycobacterium
PATFP

SEQ ID NO: 1167636 - protein, 4 aa, Mycobacterium
PATG

SEQ ID NO: 1167637 - protein, 10 aa, Mycobacterium
PATGFAGTED

SEQ ID NO: 1167638 - protein, 5 aa, Mycobacterium
PATGG

SEQ ID NO: 1167639 - protein, 7 aa, Mycobacterium
PATGKTA

SEQ ID NO: 1167640 - protein, 5 aa, Mycobacterium
PATGL

SEQ ID NO: 1167641 - protein, 8 aa, Mycobacterium
PATGQKVG

SEQ ID NO: 1167642 - protein, 6 aa, Mycobacterium
PATGRH

SEQ ID NO: 1167643 - protein, 8 aa, Mycobacterium
PATGTTKA

SEQ ID NO: 1167644 - protein, 5 aa, Mycobacterium
PATPA

SEQ ID NO: 1167645 - protein, 7 aa, Mycobacterium
PATPEPV

SEQ ID NO: 1167646 - protein, 15 aa, Mycobacterium
PATPPAFGERETPKS

SEQ ID NO: 1167647 - protein, 7 aa, Mycobacterium
PATPSTA

SEQ ID NO: 1167648 - protein, 10 aa, Mycobacterium
PATPYPDARY

SEQ ID NO: 1167649 - protein, 12 aa, Mycobacterium
PATRQVTNTDLP

SEQ ID NO: 1167650 - protein, 6 aa, Mycobacterium
PATTAE

SEQ ID NO: 1167651 - protein, 7 aa, Mycobacterium
PATTSGV

SEQ ID NO: 1167652 - protein, 5 aa, Mycobacterium
PATTY

SEQ ID NO: 1167653 - protein, 5 aa, Mycobacterium
PATVT

SEQ ID NO: 1167654 - protein, 4 aa, Mycobacterium
PAVG

SEQ ID NO: 1167655 - protein, 11 aa, Mycobacterium
PAVPGGQTDAG

SEQ ID NO: 1167656 - protein, 12 aa, Mycobacterium
PAVPSSADEANG

SEQ ID NO: 1167657 - protein, 7 aa, Mycobacterium
PAVQGDQ

SEQ ID NO: 1167658 - protein, 4 aa, Mycobacterium
PAVS

SEQ ID NO: 1167659 - protein, 10 aa, Mycobacterium
PAVTPESTAM

SEQ ID NO: 1167660 - protein, 8 aa, Mycobacterium
PAYGGRRR

SEQ ID NO: 1167661 - protein, 12 aa, Mycobacterium
PAYRAPLPGDRD

SEQ ID NO: 1167662 - protein, 11 aa, Mycobacterium
PAYTPGKTVPG

SEQ ID NO: 1167663 - protein, 4 aa, Mycobacterium
PCEG

SEQ ID NO: 1167664 - protein, 8 aa, Mycobacterium
PCGDPDGL

SEQ ID NO: 1167665 - protein, 6 aa, Mycobacterium
PCPGGG

SEQ ID NO: 1167666 - protein, 5 aa, Mycobacterium
PCPPA

SEQ ID NO: 1167667 - protein, 7 aa, Mycobacterium
PCQAQAP

SEQ ID NO: 1167668 - protein, 7 aa, Mycobacterium
PCRATAS

SEQ ID NO: 1167669 - protein, 4 aa, Mycobacterium
PDAA

SEQ ID NO: 1167670 - protein, 10 aa, Mycobacterium
PDAAPGTSPF

SEQ ID NO: 1167671 - protein, 11 aa, Mycobacterium
PDAAQTPDEAT

SEQ ID NO: 1167672 - protein, 8 aa, Mycobacterium
PDAARGIR

SEQ ID NO: 1167673 - protein, 8 aa, Mycobacterium
PDAASTRG

SEQ ID NO: 1167674 - protein, 7 aa, Mycobacterium
PDAATRK

SEQ ID NO: 1167675 - protein, 4 aa, Mycobacterium
PDAD

SEQ ID NO: 1167676 - protein, 16 aa, Mycobacterium
PDADDDTRKRLKDGHS

SEQ ID NO: 1167677 - protein, 7 aa, Mycobacterium
PDADGAD

SEQ ID NO: 1167678 - protein, 7 aa, Mycobacterium
PDADGSI

SEQ ID NO: 1167679 - protein, 11 aa, Mycobacterium
PDADSSEESVA

SEQ ID NO: 1167680 - protein, 7 aa, Mycobacterium
PDADTGT

SEQ ID NO: 1167681 - protein, 9 aa, Mycobacterium
PDAEAGKDL

SEQ ID NO: 1167682 - protein, 7 aa, Mycobacterium
PDAEGAP

SEQ ID NO: 1167683 - protein, 4 aa, Mycobacterium
PDAG

SEQ ID NO: 1167684 - protein, 9 aa, Mycobacterium
PDAGATKRD

SEQ ID NO: 1167685 - protein, 7 aa, Mycobacterium
PDAGEPW

SEQ ID NO: 1167686 - protein, 4 aa, Mycobacterium
PDAI

SEQ ID NO: 1167687 - protein, 5 aa, Mycobacterium
PDAIE

SEQ ID NO: 1167688 - protein, 5 aa, Mycobacterium
PDALP

SEQ ID NO: 1167689 - protein, 9 aa, Mycobacterium
PDANGTDAV

SEQ ID NO: 1167690 - protein, 10 aa, Mycobacterium
PDAQTAGAEL

SEQ ID NO: 1167691 - protein, 4 aa, Mycobacterium
PDAR

SEQ ID NO: 1167692 - protein, 13 aa, Mycobacterium
PDARNAVNRPTAE

SEQ ID NO: 1167693 - protein, 5 aa, Mycobacterium
PDART

SEQ ID NO: 1167694 - protein, 7 aa, Mycobacterium
PDARTAD

SEQ ID NO: 1167695 - protein, 11 aa, Mycobacterium
PDASAPATRPR

SEQ ID NO: 1167696 - protein, 9 aa, Mycobacterium
PDASDKELN

SEQ ID NO: 1167697 - protein, 4 aa, Mycobacterium
PDAT

SEQ ID NO: 1167698 - protein, 5 aa, Mycobacterium
PDATG

SEQ ID NO: 1167699 - protein, 5 aa, Mycobacterium
PDAVR

SEQ ID NO: 1167700 - protein, 10 aa, Mycobacterium
PDAVTSPAAD

SEQ ID NO: 1167701 - protein, 14 aa, Mycobacterium
PDDADSEPNPPLNK

SEQ ID NO: 1167702 - protein, 15 aa, Mycobacterium
PDDAGDPSSIVGSRE

SEQ ID NO: 1167703 - protein, 13 aa, Mycobacterium
PDDCPQGSIGKGF

SEQ ID NO: 1167704 - protein, 16 aa, Mycobacterium
PDDCTVPAGADVMHSG

SEQ ID NO: 1167705 - protein, 8 aa, Mycobacterium
PDDDELRA

SEQ ID NO: 1167706 - protein, 6 aa, Mycobacterium
PDDDLG

SEQ ID NO: 1167707 - protein, 4 aa, Mycobacterium
PDDE

SEQ ID NO: 1167708 - protein, 16 aa, Mycobacterium
PDDEDVQRAVSPRPAI

SEQ ID NO: 1167709 - protein, 5 aa, Mycobacterium
PDDEI

SEQ ID NO: 1167710 - protein, 4 aa, Mycobacterium
PDDG

SEQ ID NO: 1167711 - protein, 6 aa, Mycobacterium
PDDGHR

SEQ ID NO: 1167712 - protein, 5 aa, Mycobacterium
PDDGI

SEQ ID NO: 1167713 - protein, 15 aa, Mycobacterium
PDDHRAALASDDAAV

SEQ ID NO: 1167714 - protein, 5 aa, Mycobacterium
PDDIT

SEQ ID NO: 1167715 - protein, 7 aa, Mycobacterium
PDDKYGE

SEQ ID NO: 1167716 - protein, 9 aa, Mycobacterium
PDDPGRDAA

SEQ ID NO: 1167717 - protein, 8 aa, Mycobacterium
PDDPHFGD

SEQ ID NO: 1167718 - protein, 6 aa, Mycobacterium
PDDPRV

SEQ ID NO: 1167719 - protein, 7 aa, Mycobacterium
PDDSENK

SEQ ID NO: 1167720 - protein, 5 aa, Mycobacterium
PDDSP

SEQ ID NO: 1167721 - protein, 7 aa, Mycobacterium
PDDSRTQ

SEQ ID NO: 1167722 - protein, 13 aa, Mycobacterium
PDDTGAIDPTDVR

SEQ ID NO: 1167723 - protein, 4 aa, Mycobacterium
PDDY

SEQ ID NO: 1167724 - protein, 15 aa, Mycobacterium
PDEAAALGDELKNVT

SEQ ID NO: 1167725 - protein, 7 aa, Mycobacterium
PDEADGV

SEQ ID NO: 1167726 - protein, 7 aa, Mycobacterium
PDEDRPE

SEQ ID NO: 1167727 - protein, 4 aa, Mycobacterium
PDEG

SEQ ID NO: 1167728 - protein, 9 aa, Mycobacterium
PDEHGNRPD

SEQ ID NO: 1167729 - protein, 7 aa, Mycobacterium
PDEIRDG

SEQ ID NO: 1167730 - protein, 10 aa, Mycobacterium
PDEKTARDAL

SEQ ID NO: 1167731 - protein, 4 aa, Mycobacterium
PDEM

SEQ ID NO: 1167732 - protein, 21 aa, Mycobacterium
PDENGPVADSLQPEALARNGS

SEQ ID NO: 1167733 - protein, 11 aa, Mycobacterium
PDEPDATTALR

SEQ ID NO: 1167734 - protein, 7 aa, Mycobacterium
PDEPEAH

SEQ ID NO: 1167735 - protein, 7 aa, Mycobacterium
PDEQKTL

SEQ ID NO: 1167736 - protein, 8 aa, Mycobacterium
PDERRSRA

SEQ ID NO: 1167737 - protein, 9 aa, Mycobacterium
PDETASNRL

SEQ ID NO: 1167738 - protein, 7 aa, Mycobacterium
PDETGGL

SEQ ID NO: 1167739 - protein, 19 aa, Mycobacterium
PDFGSNPAGMRTTARRDGS

SEQ ID NO: 1167740 - protein, 5 aa, Mycobacterium
PDFPD

SEQ ID NO: 1167741 - protein, 4 aa, Mycobacterium
PDGA

SEQ ID NO: 1167742 - protein, 6 aa, Mycobacterium
PDGAEP

SEQ ID NO: 1167743 - protein, 7 aa, Mycobacterium
PDGAERE

SEQ ID NO: 1167744 - protein, 10 aa, Mycobacterium
PDGAPQDLDR

SEQ ID NO: 1167745 - protein, 9 aa, Mycobacterium
PDGASASID

SEQ ID NO: 1167746 - protein, 10 aa, Mycobacterium
PDGDAPAEGW

SEQ ID NO: 1167747 - protein, 7 aa, Mycobacterium
PDGDRTK

SEQ ID NO: 1167748 - protein, 12 aa, Mycobacterium
PDGELTDEPEET

SEQ ID NO: 1167749 - protein, 8 aa, Mycobacterium
PDGFDADG

SEQ ID NO: 1167750 - protein, 6 aa, Mycobacterium
PDGGAS

SEQ ID NO: 1167751 - protein, 7 aa, Mycobacterium
PDGGNRA

SEQ ID NO: 1167752 - protein, 18 aa, Mycobacterium
PDGGPPSWIGGGTPPEPA

SEQ ID NO: 1167753 - protein, 7 aa, Mycobacterium
PDGGSDD

SEQ ID NO: 1167754 - protein, 4 aa, Mycobacterium
PDGH

SEQ ID NO: 1167755 - protein, 8 aa, Mycobacterium
PDGHPAVK

SEQ ID NO: 1167756 - protein, 17 aa, Mycobacterium
PDGIGGSAAEVHAALQK

SEQ ID NO: 1167757 - protein, 8 aa, Mycobacterium
PDGKTQVT

SEQ ID NO: 1167758 - protein, 9 aa, Mycobacterium
PDGLSDPPG

SEQ ID NO: 1167759 - protein, 6 aa, Mycobacterium
PDGLTG

SEQ ID NO: 1167760 - protein, 4 aa, Mycobacterium
PDGN

SEQ ID NO: 1167761 - protein, 8 aa, Mycobacterium
PDGPAPTE

SEQ ID NO: 1167762 - protein, 7 aa, Mycobacterium
PDGPSLG

SEQ ID NO: 1167763 - protein, 4 aa, Mycobacterium
PDGQ

SEQ ID NO: 1167764 - protein, 13 aa, Mycobacterium
PDGRPLGMRLRRA

SEQ ID NO: 1167765 - protein, 5 aa, Mycobacterium
PDGRR

SEQ ID NO: 1167766 - protein, 10 aa, Mycobacterium
PDGRVDASTI

SEQ ID NO: 1167767 - protein, 19 aa, Mycobacterium
PDGSALTNPSIKDVKAKLG

SEQ ID NO: 1167768 - protein, 19 aa, Mycobacterium
PDGSRPGDVDVSPENEERI

SEQ ID NO: 1167769 - protein, 8 aa, Mycobacterium
PDGSWSKT

SEQ ID NO: 1167770 - protein, 22 aa, Mycobacterium
PDGTELARAANAREALGDPTAH

SEQ ID NO: 1167771 - protein, 5 aa, Mycobacterium
PDGTP

SEQ ID NO: 1167772 - protein, 8 aa, Mycobacterium
PDGTTRAR

SEQ ID NO: 1167773 - protein, 5 aa, Mycobacterium
PDGVD

SEQ ID NO: 1167774 - protein, 21 aa, Mycobacterium
PDGVDSDGGGVTTRRRTTTVA

SEQ ID NO: 1167775 - protein, 5 aa, Mycobacterium
PDGVG

SEQ ID NO: 1167776 - protein, 7 aa, Mycobacterium
PDGVPPE

SEQ ID NO: 1167777 - protein, 8 aa, Mycobacterium
PDHEGPRG

SEQ ID NO: 1167778 - protein, 4 aa, Mycobacterium
PDIG

SEQ ID NO: 1167779 - protein, 8 aa, Mycobacterium
PDIPGRDT

SEQ ID NO: 1167780 - protein, 5 aa, Mycobacterium
PDISG

SEQ ID NO: 1167781 - protein, 8 aa, Mycobacterium
PDISQNPY

SEQ ID NO: 1167782 - protein, 15 aa, Mycobacterium
PDKADELRAAKDRPL

SEQ ID NO: 1167783 - protein, 15 aa, Mycobacterium
PDKLTGIGVARTIRR

SEQ ID NO: 1167784 - protein, 12 aa, Mycobacterium
PDKPIRKYTKKE

SEQ ID NO: 1167785 - protein, 8 aa, Mycobacterium
PDLARAGG

SEQ ID NO: 1167786 - protein, 16 aa, Mycobacterium
PDLGEMPAGLNPAKCD

SEQ ID NO: 1167787 - protein, 9 aa, Mycobacterium
PDLGGQGYG

SEQ ID NO: 1167788 - protein, 8 aa, Mycobacterium
PDLPADAN

SEQ ID NO: 1167789 - protein, 6 aa, Mycobacterium
PDLPPL

SEQ ID NO: 1167790 - protein, 4 aa, Mycobacterium
PDLR

SEQ ID NO: 1167791 - protein, 6 aa, Mycobacterium
PDLSGP

SEQ ID NO: 1167792 - protein, 10 aa, Mycobacterium
PDLSRSSGIE

SEQ ID NO: 1167793 - protein, 6 aa, Mycobacterium
PDLSTG

SEQ ID NO: 1167794 - protein, 5 aa, Mycobacterium
PDLTT

SEQ ID NO: 1167795 - protein, 7 aa, Mycobacterium
PDMPGRQ

SEQ ID NO: 1167796 - protein, 4 aa, Mycobacterium
PDNG

SEQ ID NO: 1167797 - protein, 10 aa, Mycobacterium
PDNGEEPESD

SEQ ID NO: 1167798 - protein, 9 aa, Mycobacterium
PDNNGPFEG

SEQ ID NO: 1167799 - protein, 6 aa, Mycobacterium
PDNPDQ

SEQ ID NO: 1167800 - protein, 5 aa, Mycobacterium
PDNTG

SEQ ID NO: 1167801 - protein, 8 aa, Mycobacterium
PDPAADTL

SEQ ID NO: 1167802 - protein, 8 aa, Mycobacterium
PDPAQDSL

SEQ ID NO: 1167803 - protein, 6 aa, Mycobacterium
PDPDPI

SEQ ID NO: 1167804 - protein, 9 aa, Mycobacterium
PDPDPRQEE

SEQ ID NO: 1167805 - protein, 5 aa, Mycobacterium
PDPDR

SEQ ID NO: 1167806 - protein, 16 aa, Mycobacterium
PDPDTDPEGYRQTSQA

SEQ ID NO: 1167807 - protein, 7 aa, Mycobacterium
PDPEMGE

SEQ ID NO: 1167808 - protein, 15 aa, Mycobacterium
PDPKYSSSLTPGGQV

SEQ ID NO: 1167809 - protein, 19 aa, Mycobacterium
PDPLSGEPLTPGAAAGPRV

SEQ ID NO: 1167810 - protein, 9 aa, Mycobacterium
PDPNAPEVQ

SEQ ID NO: 1167811 - protein, 5 aa, Mycobacterium
PDPNE

SEQ ID NO: 1167812 - protein, 9 aa, Mycobacterium
PDPNGEQAG

SEQ ID NO: 1167813 - protein, 20 aa, Mycobacterium
PDPNPVAAGGAARLGESGVT

SEQ ID NO: 1167814 - protein, 6 aa, Mycobacterium
PDPPEI

SEQ ID NO: 1167815 - protein, 10 aa, Mycobacterium
PDPPQSERGA

SEQ ID NO: 1167816 - protein, 29 aa, Mycobacterium
PDPPTGAVPPAGIAPPAKLPAPSGPTRLA

SEQ ID NO: 1167817 - protein, 6 aa, Mycobacterium
PDPPTQ

SEQ ID NO: 1167818 - protein, 10 aa, Mycobacterium
PDPRSDDPDK

SEQ ID NO: 1167819 - protein, 6 aa, Mycobacterium
PDPTEG

SEQ ID NO: 1167820 - protein, 9 aa, Mycobacterium
PDPYSRTFG

SEQ ID NO: 1167821 - protein, 16 aa, Mycobacterium
PDQDDPELGADPMRNN

SEQ ID NO: 1167822 - protein, 9 aa, Mycobacterium
PDQERPEAR

SEQ ID NO: 1167823 - protein, 12 aa, Mycobacterium
PDQGFGEDTEAD

SEQ ID NO: 1167824 - protein, 12 aa, Mycobacterium
PDQGRPIEVGEP

SEQ ID NO: 1167825 - protein, 8 aa, Mycobacterium
PDQLDDET

SEQ ID NO: 1167826 - protein, 29 aa, Mycobacterium
PDQLSPGQRCASTSNRNFEGRQGKGGRTH

SEQ ID NO: 1167827 - protein, 7 aa, Mycobacterium
PDQRAAV

SEQ ID NO: 1167828 - protein, 12 aa, Mycobacterium
PDQYSNPDNVEA

SEQ ID NO: 1167829 - protein, 10 aa, Mycobacterium
PDRAKGRTAR

SEQ ID NO: 1167830 - protein, 11 aa, Mycobacterium
PDRARVQPNHE

SEQ ID NO: 1167831 - protein, 7 aa, Mycobacterium
PDRATGL

SEQ ID NO: 1167832 - protein, 13 aa, Mycobacterium
PDREALGRLIRKE

SEQ ID NO: 1167833 - protein, 11 aa, Mycobacterium
PDRGTAEDLTS

SEQ ID NO: 1167834 - protein, 19 aa, Mycobacterium
PDRGYGRTAPVGSYPPNGY

SEQ ID NO: 1167835 - protein, 4 aa, Mycobacterium
PDRL

SEQ ID NO: 1167836 - protein, 6 aa, Mycobacterium
PDRLTG

SEQ ID NO: 1167837 - protein, 14 aa, Mycobacterium
PDRNAGFSKATPGR

SEQ ID NO: 1167838 - protein, 5 aa, Mycobacterium
PDRPD

SEQ ID NO: 1167839 - protein, 10 aa, Mycobacterium
PDRPNKYNPI

SEQ ID NO: 1167840 - protein, 12 aa, Mycobacterium
PDRRDQIETKSL

SEQ ID NO: 1167841 - protein, 8 aa, Mycobacterium
PDRSEGDL

SEQ ID NO: 1167842 - protein, 6 aa, Mycobacterium
PDRTPE

SEQ ID NO: 1167843 - protein, 17 aa, Mycobacterium
PDRTYTTPDGSGELTLP

SEQ ID NO: 1167844 - protein, 7 aa, Mycobacterium
PDSAGES

SEQ ID NO: 1167845 - protein, 10 aa, Mycobacterium
PDSASPSVNP

SEQ ID NO: 1167846 - protein, 10 aa, Mycobacterium
PDSGAPIARN

SEQ ID NO: 1167847 - protein, 8 aa, Mycobacterium
PDSGASLA

SEQ ID NO: 1167848 - protein, 10 aa, Mycobacterium
PDSGEEMPDG

SEQ ID NO: 1167849 - protein, 5 aa, Mycobacterium
PDSGT

SEQ ID NO: 1167850 - protein, 17 aa, Mycobacterium
PDSKADKVRAALEQEAR

SEQ ID NO: 1167851 - protein, 5 aa, Mycobacterium
PDSTA

SEQ ID NO: 1167852 - protein, 8 aa, Mycobacterium
PDSTLAGR

SEQ ID NO: 1167853 - protein, 6 aa, Mycobacterium
PDSTPV

SEQ ID NO: 1167854 - protein, 6 aa, Mycobacterium
PDTDAL

SEQ ID NO: 1167855 - protein, 15 aa, Mycobacterium
PDTDIDAEAGTDTGA

SEQ ID NO: 1167856 - protein, 13 aa, Mycobacterium
PDTDRVRTDSERA

SEQ ID NO: 1167857 - protein, 10 aa, Mycobacterium
PDTEPWSPEK

SEQ ID NO: 1167858 - protein, 7 aa, Mycobacterium
PDTNGYK

SEQ ID NO: 1167859 - protein, 4 aa, Mycobacterium
PDTP

SEQ ID NO: 1167860 - protein, 13 aa, Mycobacterium
PDTPRTGGFDEAR

SEQ ID NO: 1167861 - protein, 8 aa, Mycobacterium
PDTPTASG

SEQ ID NO: 1167862 - protein, 5 aa, Mycobacterium
PDTTA

SEQ ID NO: 1167863 - protein, 9 aa, Mycobacterium
PDTTTGPTL

SEQ ID NO: 1167864 - protein, 14 aa, Mycobacterium
PDVDAAALADGLTA

SEQ ID NO: 1167865 - protein, 12 aa, Mycobacterium
PDVEQGKGYQAQ

SEQ ID NO: 1167866 - protein, 12 aa, Mycobacterium
PDVNPDEEAQAR

SEQ ID NO: 1167867 - protein, 9 aa, Mycobacterium
PDVPAQDPL

SEQ ID NO: 1167868 - protein, 13 aa, Mycobacterium
PDVRPGAKPPGPP

SEQ ID NO: 1167869 - protein, 6 aa, Mycobacterium
PDVSAY

SEQ ID NO: 1167870 - protein, 8 aa, Mycobacterium
PDVTPGKN

SEQ ID NO: 1167871 - protein, 9 aa, Mycobacterium
PDVTRAQED

SEQ ID NO: 1167872 - protein, 10 aa, Mycobacterium
PDWPASGSTI

SEQ ID NO: 1167873 - protein, 4 aa, Mycobacterium
PDYN

SEQ ID NO: 1167874 - protein, 6 aa, Mycobacterium
PDYPRR

SEQ ID NO: 1167875 - protein, 17 aa, Mycobacterium
PDYRPPPQLPEAATGQS

SEQ ID NO: 1167876 - protein, 4 aa, Mycobacterium
PEAA

SEQ ID NO: 1167877 - protein, 10 aa, Mycobacterium
PEAANGMNDT

SEQ ID NO: 1167878 - protein, 4 aa, Mycobacterium
PEAD

SEQ ID NO: 1167879 - protein, 5 aa, Mycobacterium
PEADR

SEQ ID NO: 1167880 - protein, 7 aa, Mycobacterium
PEAEAAM

SEQ ID NO: 1167881 - protein, 5 aa, Mycobacterium
PEAER

SEQ ID NO: 1167882 - protein, 8 aa, Mycobacterium
PEAGEGDV

SEQ ID NO: 1167883 - protein, 11 aa, Mycobacterium
PEAKTAATGLE

SEQ ID NO: 1167884 - protein, 4 aa, Mycobacterium
PEAM

SEQ ID NO: 1167885 - protein, 5 aa, Mycobacterium
PEAPI

SEQ ID NO: 1167886 - protein, 14 aa, Mycobacterium
PEAPKPPEPLVAAD

SEQ ID NO: 1167887 - protein, 12 aa, Mycobacterium
PEAPPAQPTAEF

SEQ ID NO: 1167888 - protein, 5 aa, Mycobacterium
PEAQW

SEQ ID NO: 1167889 - protein, 14 aa, Mycobacterium
PEARERVAAKRSEV

SEQ ID NO: 1167890 - protein, 11 aa, Mycobacterium
PEARPTAGGIG

SEQ ID NO: 1167891 - protein, 5 aa, Mycobacterium
PEASY

SEQ ID NO: 1167892 - protein, 4 aa, Mycobacterium
PEAT

SEQ ID NO: 1167893 - protein, 7 aa, Mycobacterium
PEATLTD

SEQ ID NO: 1167894 - protein, 10 aa, Mycobacterium
PEATTQPAAR

SEQ ID NO: 1167895 - protein, 5 aa, Mycobacterium
PEAVD

SEQ ID NO: 1167896 - protein, 8 aa, Mycobacterium
PEDAGGRK

SEQ ID NO: 1167897 - protein, 5 aa, Mycobacterium
PEDAR

SEQ ID NO: 1167898 - protein, 5 aa, Mycobacterium
PEDDQ

SEQ ID NO: 1167899 - protein, 7 aa, Mycobacterium
PEDDRPE

SEQ ID NO: 1167900 - protein, 22 aa, Mycobacterium
PEDFPDPDAFKPDRYDKPEQAD

SEQ ID NO: 1167901 - protein, 5 aa, Mycobacterium
PEDGP

SEQ ID NO: 1167902 - protein, 7 aa, Mycobacterium
PEDGPDE

SEQ ID NO: 1167903 - protein, 11 aa, Mycobacterium
PEDQGGAGGTV

SEQ ID NO: 1167904 - protein, 6 aa, Mycobacterium
PEDQSW

SEQ ID NO: 1167905 - protein, 9 aa, Mycobacterium
PEEAQSGYA

SEQ ID NO: 1167906 - protein, 6 aa, Mycobacterium
PEEDEE

SEQ ID NO: 1167907 - protein, 7 aa, Mycobacterium
PEEDHAE

SEQ ID NO: 1167908 - protein, 7 aa, Mycobacterium
PEEDHEE

SEQ ID NO: 1167909 - protein, 8 aa, Mycobacterium
PEEERTRR

SEQ ID NO: 1167910 - protein, 10 aa, Mycobacterium
PEEGQQQIRD

SEQ ID NO: 1167911 - protein, 10 aa, Mycobacterium
PEEQRPPQEP

SEQ ID NO: 1167912 - protein, 7 aa, Mycobacterium
PEERELR

SEQ ID NO: 1167913 - protein, 7 aa, Mycobacterium
PEERITR

SEQ ID NO: 1167914 - protein, 9 aa, Mycobacterium
PEETDEEQL

SEQ ID NO: 1167915 - protein, 7 aa, Mycobacterium
PEETVEP

SEQ ID NO: 1167916 - protein, 4 aa, Mycobacterium
PEEW

SEQ ID NO: 1167917 - protein, 12 aa, Mycobacterium
PEGAQIARSDES

SEQ ID NO: 1167918 - protein, 7 aa, Mycobacterium
PEGDHTQ

SEQ ID NO: 1167919 - protein, 16 aa, Mycobacterium
PEGESAASLKLDGTET

SEQ ID NO: 1167920 - protein, 5 aa, Mycobacterium
PEGFE

SEQ ID NO: 1167921 - protein, 10 aa, Mycobacterium
PEGGAGGGTV

SEQ ID NO: 1167922 - protein, 8 aa, Mycobacterium
PEGGIADE

SEQ ID NO: 1167923 - protein, 12 aa, Mycobacterium
PEGNEFCVLAAQ

SEQ ID NO: 1167924 - protein, 8 aa, Mycobacterium
PEGPEAPR

SEQ ID NO: 1167925 - protein, 8 aa, Mycobacterium
PEGSDTSV

SEQ ID NO: 1167926 - protein, 10 aa, Mycobacterium
PEGTDGWTED

SEQ ID NO: 1167927 - protein, 9 aa, Mycobacterium
PEGTTPPAV

SEQ ID NO: 1167928 - protein, 8 aa, Mycobacterium
PEHDSATT

SEQ ID NO: 1167929 - protein, 12 aa, Mycobacterium
PEHKAPAAADDA

SEQ ID NO: 1167930 - protein, 9 aa, Mycobacterium
PEHPPDEPK

SEQ ID NO: 1167931 - protein, 5 aa, Mycobacterium
PEHRD

SEQ ID NO: 1167932 - protein, 15 aa, Mycobacterium
PEHSPEREKINEQHR

SEQ ID NO: 1167933 - protein, 5 aa, Mycobacterium
PEHTI

SEQ ID NO: 1167934 - protein, 4 aa, Mycobacterium
PEIG

SEQ ID NO: 1167935 - protein, 8 aa, Mycobacterium
PEINGEAN

SEQ ID NO: 1167936 - protein, 4 aa, Mycobacterium
PEIS

SEQ ID NO: 1167937 - protein, 11 aa, Mycobacterium
PEKAAQGPFGG

SEQ ID NO: 1167938 - protein, 8 aa, Mycobacterium
PEKFDPAR

SEQ ID NO: 1167939 - protein, 4 aa, Mycobacterium
PEKI

SEQ ID NO: 1167940 - protein, 9 aa, Mycobacterium
PEKPADGPL

SEQ ID NO: 1167941 - protein, 8 aa, Mycobacterium
PEKRSIRD

SEQ ID NO: 1167942 - protein, 7 aa, Mycobacterium
PELGGTR

SEQ ID NO: 1167943 - protein, 12 aa, Mycobacterium
PELPGGSELGST

SEQ ID NO: 1167944 - protein, 12 aa, Mycobacterium
PELRSTAAARDA

SEQ ID NO: 1167945 - protein, 8 aa, Mycobacterium
PEMAERNS

SEQ ID NO: 1167946 - protein, 4 aa, Mycobacterium
PENA

SEQ ID NO: 1167947 - protein, 7 aa, Mycobacterium
PENPRNV

SEQ ID NO: 1167948 - protein, 17 aa, Mycobacterium
PEPAEQESEARASGRAA

SEQ ID NO: 1167949 - protein, 20 aa, Mycobacterium
PEPDNDDYQRRIEEGRGVPS

SEQ ID NO: 1167950 - protein, 5 aa, Mycobacterium
PEPDV

SEQ ID NO: 1167951 - protein, 4 aa, Mycobacterium
PEPF

SEQ ID NO: 1167952 - protein, 7 aa, Mycobacterium
PEPLPPN

SEQ ID NO: 1167953 - protein, 9 aa, Mycobacterium
PEPLSETAD

SEQ ID NO: 1167954 - protein, 6 aa, Mycobacterium
PEPMTG

SEQ ID NO: 1167955 - protein, 12 aa, Mycobacterium
PEPPPGLEPIGP

SEQ ID NO: 1167956 - protein, 4 aa, Mycobacterium
PEPR

SEQ ID NO: 1167957 - protein, 32 aa, Mycobacterium
PEPSDQIGHRKRRGTHGGRPPAFDAEDYKGRN

SEQ ID NO: 1167958 - protein, 5 aa, Mycobacterium
PEPSG

SEQ ID NO: 1167959 - protein, 6 aa, Mycobacterium
PEPTAA

SEQ ID NO: 1167960 - protein, 9 aa, Mycobacterium
PEPTGLDAE

SEQ ID NO: 1167961 - protein, 5 aa, Mycobacterium
PEPVG

SEQ ID NO: 1167962 - protein, 21 aa, Mycobacterium
PEPVGTPRDPVEGPGDATPLG

SEQ ID NO: 1167963 - protein, 5 aa, Mycobacterium
PEPYA

SEQ ID NO: 1167964 - protein, 5 aa, Mycobacterium
PEQEY

SEQ ID NO: 1167965 - protein, 4 aa, Mycobacterium
PEQF

SEQ ID NO: 1167966 - protein, 17 aa, Mycobacterium
PEQGQQQIRDNTDSAIG

SEQ ID NO: 1167967 - protein, 12 aa, Mycobacterium
PEQNRAALTAAS

SEQ ID NO: 1167968 - protein, 9 aa, Mycobacterium
PEQPLTETA

SEQ ID NO: 1167969 - protein, 6 aa, Mycobacterium
PEQPYT

SEQ ID NO: 1167970 - protein, 5 aa, Mycobacterium
PEQRP

SEQ ID NO: 1167971 - protein, 5 aa, Mycobacterium
PEQRR

SEQ ID NO: 1167972 - protein, 17 aa, Mycobacterium
PEQRSNGVELLQEPASR

SEQ ID NO: 1167973 - protein, 10 aa, Mycobacterium
PEQTRTTRDI

SEQ ID NO: 1167974 - protein, 20 aa, Mycobacterium
PEQVAGARRTGTTEGTVRTR

SEQ ID NO: 1167975 - protein, 13 aa, Mycobacterium
PEQVKSAPQRSLR

SEQ ID NO: 1167976 - protein, 4 aa, Mycobacterium
PEQW

SEQ ID NO: 1167977 - protein, 8 aa, Mycobacterium
PERAANPA

SEQ ID NO: 1167978 - protein, 17 aa, Mycobacterium
PERAEALASNDGEMGRG

SEQ ID NO: 1167979 - protein, 4 aa, Mycobacterium
PERC

SEQ ID NO: 1167980 - protein, 18 aa, Mycobacterium
PERFDPSRFDEPRREDQH

SEQ ID NO: 1167981 - protein, 11 aa, Mycobacterium
PERFGDTTVTP

SEQ ID NO: 1167982 - protein, 7 aa, Mycobacterium
PERGKRR

SEQ ID NO: 1167983 - protein, 5 aa, Mycobacterium
PERIA

SEQ ID NO: 1167984 - protein, 10 aa, Mycobacterium
PERKPPPDDV

SEQ ID NO: 1167985 - protein, 4 aa, Mycobacterium
PERL

SEQ ID NO: 1167986 - protein, 8 aa, Mycobacterium
PERQRTSR

SEQ ID NO: 1167987 - protein, 32 aa, Mycobacterium
PERRTKSKALALPSSDAYKALKKGSGKQEVAT

SEQ ID NO: 1167988 - protein, 8 aa, Mycobacterium
PERSEGDA

SEQ ID NO: 1167989 - protein, 14 aa, Mycobacterium
PERTPLSDSATVSL

SEQ ID NO: 1167990 - protein, 4 aa, Mycobacterium
PERV

SEQ ID NO: 1167991 - protein, 7 aa, Mycobacterium
PERVPGY

SEQ ID NO: 1167992 - protein, 10 aa, Mycobacterium
PESAGGDGAT

SEQ ID NO: 1167993 - protein, 10 aa, Mycobacterium
PESEHPHGLS

SEQ ID NO: 1167994 - protein, 4 aa, Mycobacterium
PESG

SEQ ID NO: 1167995 - protein, 12 aa, Mycobacterium
PESGTENPAGQV

SEQ ID NO: 1167996 - protein, 20 aa, Mycobacterium
PESGTPAAVGYAQGSGIPYG

SEQ ID NO: 1167997 - protein, 4 aa, Mycobacterium
PESL

SEQ ID NO: 1167998 - protein, 7 aa, Mycobacterium
PESMSDD

SEQ ID NO: 1167999 - protein, 4 aa, Mycobacterium
PESR

SEQ ID NO: 1168000 - protein, 16 aa, Mycobacterium
PESVGDGSDRDATAAR

SEQ ID NO: 1168001 - protein, 8 aa, Mycobacterium
PESYTGTE

SEQ ID NO: 1168002 - protein, 12 aa, Mycobacterium
PETAAEKASETV

SEQ ID NO: 1168003 - protein, 4 aa, Mycobacterium
PETG

SEQ ID NO: 1168004 - protein, 5 aa, Mycobacterium
PETGN

SEQ ID NO: 1168005 - protein, 6 aa, Mycobacterium
PETGRF

SEQ ID NO: 1168006 - protein, 4 aa, Mycobacterium
PETI

SEQ ID NO: 1168007 - protein, 8 aa, Mycobacterium
PETPAHPK

SEQ ID NO: 1168008 - protein, 11 aa, Mycobacterium
PETPTAPPVHA

SEQ ID NO: 1168009 - protein, 6 aa, Mycobacterium
PETRDA

SEQ ID NO: 1168010 - protein, 5 aa, Mycobacterium
PETTS

SEQ ID NO: 1168011 - protein, 5 aa, Mycobacterium
PETVN

SEQ ID NO: 1168012 - protein, 13 aa, Mycobacterium
PEVADGDGLRTDV

SEQ ID NO: 1168013 - protein, 11 aa, Mycobacterium
PEVAPQPGKGE

SEQ ID NO: 1168014 - protein, 8 aa, Mycobacterium
PEVEDERV

SEQ ID NO: 1168015 - protein, 8 aa, Mycobacterium
PEVPGEPP

SEQ ID NO: 1168016 - protein, 18 aa, Mycobacterium
PEVSAYRRSPRAPAPGGS

SEQ ID NO: 1168017 - protein, 4 aa, Mycobacterium
PEWA

SEQ ID NO: 1168018 - protein, 15 aa, Mycobacterium
PEYKAGRSSTPDEFR

SEQ ID NO: 1168019 - protein, 18 aa, Mycobacterium
PEYNDGKPSTPTALGGSP

SEQ ID NO: 1168020 - protein, 23 aa, Mycobacterium
PEYQREDNKINTDATQRPSDHEY

SEQ ID NO: 1168021 - protein, 8 aa, Mycobacterium
PEYSDAVD

SEQ ID NO: 1168022 - protein, 4 aa, Mycobacterium
PFAE

SEQ ID NO: 1168023 - protein, 16 aa, Mycobacterium
PFDPAGRGWTKTTYRR

SEQ ID NO: 1168024 - protein, 12 aa, Mycobacterium
PFESPQSNPELA

SEQ ID NO: 1168025 - protein, 7 aa, Mycobacterium
PFGAPSA

SEQ ID NO: 1168026 - protein, 5 aa, Mycobacterium
PFGMG

SEQ ID NO: 1168027 - protein, 11 aa, Mycobacterium
PFGPESDAPGL

SEQ ID NO: 1168028 - protein, 11 aa, Mycobacterium
PFGRRRDDAVR

SEQ ID NO: 1168029 - protein, 7 aa, Mycobacterium
PFNGTGE

SEQ ID NO: 1168030 - protein, 16 aa, Mycobacterium
PFPATSDSRTTSVGSR

SEQ ID NO: 1168031 - protein, 8 aa, Mycobacterium
PFPEEGNR

SEQ ID NO: 1168032 - protein, 4 aa, Mycobacterium
PFPP

SEQ ID NO: 1168033 - protein, 6 aa, Mycobacterium
PFPTGE

SEQ ID NO: 1168034 - protein, 4 aa, Mycobacterium
PFRA

SEQ ID NO: 1168035 - protein, 6 aa, Mycobacterium
PFTPED

SEQ ID NO: 1168036 - protein, 7 aa, Mycobacterium
PFTPGGR

SEQ ID NO: 1168037 - protein, 14 aa, Mycobacterium
PGAANRDPKRFDNP

SEQ ID NO: 1168038 - protein, 12 aa, Mycobacterium
PGAAPYRPNSLD

SEQ ID NO: 1168039 - protein, 7 aa, Mycobacterium
PGAAQRA

SEQ ID NO: 1168040 - protein, 10 aa, Mycobacterium
PGAASATSAR

SEQ ID NO: 1168041 - protein, 9 aa, Mycobacterium
PGADGDVTP

SEQ ID NO: 1168042 - protein, 8 aa, Mycobacterium
PGADPSRG

SEQ ID NO: 1168043 - protein, 7 aa, Mycobacterium
PGADPTV

SEQ ID NO: 1168044 - protein, 8 aa, Mycobacterium
PGAESPRE

SEQ ID NO: 1168045 - protein, 8 aa, Mycobacterium
PGAGRSDI

SEQ ID NO: 1168046 - protein, 7 aa, Mycobacterium
PGANLDE

SEQ ID NO: 1168047 - protein, 7 aa, Mycobacterium
PGAPEEL

SEQ ID NO: 1168048 - protein, 7 aa, Mycobacterium
PGAPERD

SEQ ID NO: 1168049 - protein, 22 aa, Mycobacterium
PGAPFGGYKNSGIGRENGPEGI

SEQ ID NO: 1168050 - protein, 7 aa, Mycobacterium
PGAPGFS

SEQ ID NO: 1168051 - protein, 5 aa, Mycobacterium
PGAPP

SEQ ID NO: 1168052 - protein, 19 aa, Mycobacterium
PGAPPKPAERLQNPPPGKP

SEQ ID NO: 1168053 - protein, 20 aa, Mycobacterium
PGAQAGTLSAAAAAATGLPE

SEQ ID NO: 1168054 - protein, 5 aa, Mycobacterium
PGARG

SEQ ID NO: 1168055 - protein, 10 aa, Mycobacterium
PGARRQIPAE

SEQ ID NO: 1168056 - protein, 6 aa, Mycobacterium
PGARTA

SEQ ID NO: 1168057 - protein, 9 aa, Mycobacterium
PGASEGRGL

SEQ ID NO: 1168058 - protein, 5 aa, Mycobacterium
PGASG

SEQ ID NO: 1168059 - protein, 5 aa, Mycobacterium
PGASL

SEQ ID NO: 1168060 - protein, 8 aa, Mycobacterium
PGASYVTG

SEQ ID NO: 1168061 - protein, 8 aa, Mycobacterium
PGATPEDD

SEQ ID NO: 1168062 - protein, 8 aa, Mycobacterium
PGDEPGPQ

SEQ ID NO: 1168063 - protein, 7 aa, Mycobacterium
PGDGSVG

SEQ ID NO: 1168064 - protein, 9 aa, Mycobacterium
PGDHRRGLA

SEQ ID NO: 1168065 - protein, 13 aa, Mycobacterium
PGDLGTKGGVRTD

SEQ ID NO: 1168066 - protein, 6 aa, Mycobacterium
PGDLPG

SEQ ID NO: 1168067 - protein, 6 aa, Mycobacterium
PGDLRP

SEQ ID NO: 1168068 - protein, 8 aa, Mycobacterium
PGDMNTPD

SEQ ID NO: 1168069 - protein, 10 aa, Mycobacterium
PGDPAPDSGI

SEQ ID NO: 1168070 - protein, 17 aa, Mycobacterium
PGDPEAEAELEASENPA

SEQ ID NO: 1168071 - protein, 6 aa, Mycobacterium
PGDPLS

SEQ ID NO: 1168072 - protein, 10 aa, Mycobacterium
PGDPPATRQA

SEQ ID NO: 1168073 - protein, 10 aa, Mycobacterium
PGDPSSDIAT

SEQ ID NO: 1168074 - protein, 5 aa, Mycobacterium
PGDRK

SEQ ID NO: 1168075 - protein, 6 aa, Mycobacterium
PGDTDR

SEQ ID NO: 1168076 - protein, 10 aa, Mycobacterium
PGDTEAPPDQ

SEQ ID NO: 1168077 - protein, 5 aa, Mycobacterium
PGEAK

SEQ ID NO: 1168078 - protein, 7 aa, Mycobacterium
PGEEVKG

SEQ ID NO: 1168079 - protein, 11 aa, Mycobacterium
PGEGDPGRGRR

SEQ ID NO: 1168080 - protein, 4 aa, Mycobacterium
PGEI

SEQ ID NO: 1168081 - protein, 6 aa, Mycobacterium
PGEIEA

SEQ ID NO: 1168082 - protein, 11 aa, Mycobacterium
PGELGYDEQAR

SEQ ID NO: 1168083 - protein, 4 aa, Mycobacterium
PGEP

SEQ ID NO: 1168084 - protein, 4 aa, Mycobacterium
PGER

SEQ ID NO: 1168085 - protein, 16 aa, Mycobacterium
PGETPAPTAPAVPRTM

SEQ ID NO: 1168086 - protein, 5 aa, Mycobacterium
PGEVA

SEQ ID NO: 1168087 - protein, 12 aa, Mycobacterium
PGEVDDARAHAG

SEQ ID NO: 1168088 - protein, 6 aa, Mycobacterium
PGFGKS

SEQ ID NO: 1168089 - protein, 4 aa, Mycobacterium
PGFP

SEQ ID NO: 1168090 - protein, 11 aa, Mycobacterium
PGFPPSEPAAP

SEQ ID NO: 1168091 - protein, 19 aa, Mycobacterium
PGFRGAKGRLPSDTGVSAA

SEQ ID NO: 1168092 - protein, 4 aa, Mycobacterium
PGGA

SEQ ID NO: 1168093 - protein, 16 aa, Mycobacterium
PGGAETGRALTANPEI

SEQ ID NO: 1168094 - protein, 5 aa, Mycobacterium
PGGAM

SEQ ID NO: 1168095 - protein, 9 aa, Mycobacterium
PGGDEANRA

SEQ ID NO: 1168096 - protein, 5 aa, Mycobacterium
PGGFG

SEQ ID NO: 1168097 - protein, 48 aa, Mycobacterium
PGGGEGTADGGSNPEGHDGGADGTADAGEGTADGGSNPEGHDGGADGT

SEQ ID NO: 1168098 - protein, 7 aa, Mycobacterium
PGGGGVA

SEQ ID NO: 1168099 - protein, 7 aa, Mycobacterium
PGGGGVT

SEQ ID NO: 1168100 - protein, 11 aa, Mycobacterium
PGGGRRRAVTG

SEQ ID NO: 1168101 - protein, 8 aa, Mycobacterium
PGGIGTTA

SEQ ID NO: 1168102 - protein, 4 aa, Mycobacterium
PGGK

SEQ ID NO: 1168103 - protein, 10 aa, Mycobacterium
PGGPLTAEEV

SEQ ID NO: 1168104 - protein, 7 aa, Mycobacterium
PGGPTAV

SEQ ID NO: 1168105 - protein, 11 aa, Mycobacterium
PGGQGTQTAVA

SEQ ID NO: 1168106 - protein, 6 aa, Mycobacterium
PGGQTQ

SEQ ID NO: 1168107 - protein, 12 aa, Mycobacterium
PGGRFSKDIPGL

SEQ ID NO: 1168108 - protein, 12 aa, Mycobacterium
PGGRSYDTPPVN

SEQ ID NO: 1168109 - protein, 6 aa, Mycobacterium
PGGSQH

SEQ ID NO: 1168110 - protein, 8 aa, Mycobacterium
PGGSSEIQ

SEQ ID NO: 1168111 - protein, 7 aa, Mycobacterium
PGGSVPC

SEQ ID NO: 1168112 - protein, 10 aa, Mycobacterium
PGGTGGFGDK

SEQ ID NO: 1168113 - protein, 10 aa, Mycobacterium
PGGTPLPQQS

SEQ ID NO: 1168114 - protein, 8 aa, Mycobacterium
PGHAETGE

SEQ ID NO: 1168115 - protein, 6 aa, Mycobacterium
PGHAPE

SEQ ID NO: 1168116 - protein, 16 aa, Mycobacterium
PGHAPGTGTPEPGGFS

SEQ ID NO: 1168117 - protein, 13 aa, Mycobacterium
PGHAPSGLGFRPD

SEQ ID NO: 1168118 - protein, 6 aa, Mycobacterium
PGHDVP

SEQ ID NO: 1168119 - protein, 4 aa, Mycobacterium
PGHG

SEQ ID NO: 1168120 - protein, 18 aa, Mycobacterium
PGHGARIGEESTLANRRD

SEQ ID NO: 1168121 - protein, 23 aa, Mycobacterium
PGHGDDTTLGAERPHLGEWRDRG

SEQ ID NO: 1168122 - protein, 9 aa, Mycobacterium
PGHGPDLPD

SEQ ID NO: 1168123 - protein, 19 aa, Mycobacterium
PGHGRSAWREDGDYGPKLN

SEQ ID NO: 1168124 - protein, 4 aa, Mycobacterium
PGHL

SEQ ID NO: 1168125 - protein, 5 aa, Mycobacterium
PGHPD

SEQ ID NO: 1168126 - protein, 6 aa, Mycobacterium
PGHRDD

SEQ ID NO: 1168127 - protein, 15 aa, Mycobacterium
PGHVRGPAPELGADT

SEQ ID NO: 1168128 - protein, 8 aa, Mycobacterium
PGIEGDAE

SEQ ID NO: 1168129 - protein, 9 aa, Mycobacterium
PGIGKRGAE

SEQ ID NO: 1168130 - protein, 12 aa, Mycobacterium
PGKAVNAGGVAT

SEQ ID NO: 1168131 - protein, 5 aa, Mycobacterium
PGKDA

SEQ ID NO: 1168132 - protein, 5 aa, Mycobacterium
PGKQT

SEQ ID NO: 1168133 - protein, 30 aa, Mycobacterium
PGKVRRELSEAEVDGNRTNATLYQHLVDMH

SEQ ID NO: 1168134 - protein, 5 aa, Mycobacterium
PGLAD

SEQ ID NO: 1168135 - protein, 7 aa, Mycobacterium
PGLAGRT

SEQ ID NO: 1168136 - protein, 9 aa, Mycobacterium
PGLDTGPSV

SEQ ID NO: 1168137 - protein, 6 aa, Mycobacterium
PGLGGQ

SEQ ID NO: 1168138 - protein, 10 aa, Mycobacterium
PGLGVRPANE

SEQ ID NO: 1168139 - protein, 10 aa, Mycobacterium
PGLPEDPAHE

SEQ ID NO: 1168140 - protein, 6 aa, Mycobacterium
PGLPGP

SEQ ID NO: 1168141 - protein, 7 aa, Mycobacterium
PGLPGQR

SEQ ID NO: 1168142 - protein, 7 aa, Mycobacterium
PGLQEKP

SEQ ID NO: 1168143 - protein, 11 aa, Mycobacterium
PGLSADQRAEV

SEQ ID NO: 1168144 - protein, 8 aa, Mycobacterium
PGLSPQEA

SEQ ID NO: 1168145 - protein, 18 aa, Mycobacterium
PGLSQDQALDAAPKAVDG

SEQ ID NO: 1168146 - protein, 6 aa, Mycobacterium
PGLTDE

SEQ ID NO: 1168147 - protein, 5 aa, Mycobacterium
PGLTP

SEQ ID NO: 1168148 - protein, 15 aa, Mycobacterium
PGMLPGSRSERSGVL

SEQ ID NO: 1168149 - protein, 7 aa, Mycobacterium
PGMPPVG

SEQ ID NO: 1168150 - protein, 13 aa, Mycobacterium
PGMPQGAGRVGET

SEQ ID NO: 1168151 - protein, 4 aa, Mycobacterium
PGMQ

SEQ ID NO: 1168152 - protein, 6 aa, Mycobacterium
PGMSSQ

SEQ ID NO: 1168153 - protein, 5 aa, Mycobacterium
PGMTT

SEQ ID NO: 1168154 - protein, 7 aa, Mycobacterium
PGNAAVA

SEQ ID NO: 1168155 - protein, 5 aa, Mycobacterium
PGNEL

SEQ ID NO: 1168156 - protein, 8 aa, Mycobacterium
PGNKAPLS

SEQ ID NO: 1168157 - protein, 5 aa, Mycobacterium
PGNPV

SEQ ID NO: 1168158 - protein, 6 aa, Mycobacterium
PGNRNA

SEQ ID NO: 1168159 - protein, 8 aa, Mycobacterium
PGNRPTTS

SEQ ID NO: 1168160 - protein, 11 aa, Mycobacterium
PGNSARITYAD

SEQ ID NO: 1168161 - protein, 5 aa, Mycobacterium
PGNWA

SEQ ID NO: 1168162 - protein, 10 aa, Mycobacterium
PGPAGATESE

SEQ ID NO: 1168163 - protein, 5 aa, Mycobacterium
PGPDG

SEQ ID NO: 1168164 - protein, 7 aa, Mycobacterium
PGPEAPE

SEQ ID NO: 1168165 - protein, 6 aa, Mycobacterium
PGPGEG

SEQ ID NO: 1168166 - protein, 21 aa, Mycobacterium
PGPGVGGYKGAGEGGAIGSTP

SEQ ID NO: 1168167 - protein, 8 aa, Mycobacterium
PGPIEPDP

SEQ ID NO: 1168168 - protein, 4 aa, Mycobacterium
PGPK

SEQ ID NO: 1168169 - protein, 8 aa, Mycobacterium
PGPLQRRN

SEQ ID NO: 1168170 - protein, 17 aa, Mycobacterium
PGPNDGTPPVPADNGGY

SEQ ID NO: 1168171 - protein, 16 aa, Mycobacterium
PGPPVGKGLGADGTVT

SEQ ID NO: 1168172 - protein, 21 aa, Mycobacterium
PGPRREESVREREAAAGGLTD

SEQ ID NO: 1168173 - protein, 15 aa, Mycobacterium
PGPTGEQHVAYLKRP

SEQ ID NO: 1168174 - protein, 11 aa, Mycobacterium
PGPVDTPVYGT

SEQ ID NO: 1168175 - protein, 8 aa, Mycobacterium
PGPVPSAT

SEQ ID NO: 1168176 - protein, 5 aa, Mycobacterium
PGPVR

SEQ ID NO: 1168177 - protein, 10 aa, Mycobacterium
PGPVRGAAAD

SEQ ID NO: 1168178 - protein, 9 aa, Mycobacterium
PGPVTSGAS

SEQ ID NO: 1168179 - protein, 9 aa, Mycobacterium
PGQELEGKN

SEQ ID NO: 1168180 - protein, 4 aa, Mycobacterium
PGQG

SEQ ID NO: 1168181 - protein, 8 aa, Mycobacterium
PGQGPGAI

SEQ ID NO: 1168182 - protein, 7 aa, Mycobacterium
PGQKTSV

SEQ ID NO: 1168183 - protein, 7 aa, Mycobacterium
PGQPAVT

SEQ ID NO: 1168184 - protein, 7 aa, Mycobacterium
PGQPLPE

SEQ ID NO: 1168185 - protein, 5 aa, Mycobacterium
PGQRY

SEQ ID NO: 1168186 - protein, 9 aa, Mycobacterium
PGQTATLSG

SEQ ID NO: 1168187 - protein, 8 aa, Mycobacterium
PGRADERI

SEQ ID NO: 1168188 - protein, 8 aa, Mycobacterium
PGRADGGI

SEQ ID NO: 1168189 - protein, 7 aa, Mycobacterium
PGRGGGF

SEQ ID NO: 1168190 - protein, 16 aa, Mycobacterium
PGRGLTPSGPAVGESM

SEQ ID NO: 1168191 - protein, 9 aa, Mycobacterium
PGRGTQPTA

SEQ ID NO: 1168192 - protein, 21 aa, Mycobacterium
PGRGWAPHDPGVTASATGSGF

SEQ ID NO: 1168193 - protein, 12 aa, Mycobacterium
PGRIGSTAATLA

SEQ ID NO: 1168194 - protein, 4 aa, Mycobacterium
PGRP

SEQ ID NO: 1168195 - protein, 8 aa, Mycobacterium
PGRPLDPS

SEQ ID NO: 1168196 - protein, 10 aa, Mycobacterium
PGRPPRTGEA

SEQ ID NO: 1168197 - protein, 5 aa, Mycobacterium
PGRQI

SEQ ID NO: 1168198 - protein, 4 aa, Mycobacterium
PGRR

SEQ ID NO: 1168199 - protein, 5 aa, Mycobacterium
PGRTF

SEQ ID NO: 1168200 - protein, 12 aa, Mycobacterium
PGRWDDEGEKRI

SEQ ID NO: 1168201 - protein, 5 aa, Mycobacterium
PGSAA

SEQ ID NO: 1168202 - protein, 5 aa, Mycobacterium
PGSAG

SEQ ID NO: 1168203 - protein, 4 aa, Mycobacterium
PGSD

SEQ ID NO: 1168204 - protein, 9 aa, Mycobacterium
PGSDPVAAQ

SEQ ID NO: 1168205 - protein, 8 aa, Mycobacterium
PGSDRTSQ

SEQ ID NO: 1168206 - protein, 5 aa, Mycobacterium
PGSES

SEQ ID NO: 1168207 - protein, 7 aa, Mycobacterium
PGSFTAA

SEQ ID NO: 1168208 - protein, 28 aa, Mycobacterium
PGSISSGMTDGTGQARQSVGPGLPDDAD

SEQ ID NO: 1168209 - protein, 10 aa, Mycobacterium
PGSPDVSEFP

SEQ ID NO: 1168210 - protein, 9 aa, Mycobacterium
PGSPGGVRD

SEQ ID NO: 1168211 - protein, 11 aa, Mycobacterium
PGSRTNPDMSR

SEQ ID NO: 1168212 - protein, 5 aa, Mycobacterium
PGSTP

SEQ ID NO: 1168213 - protein, 8 aa, Mycobacterium
PGSVGRPL

SEQ ID NO: 1168214 - protein, 7 aa, Mycobacterium
PGSVGRS

SEQ ID NO: 1168215 - protein, 4 aa, Mycobacterium
PGTA

SEQ ID NO: 1168216 - protein, 11 aa, Mycobacterium
PGTAAPGTPAA

SEQ ID NO: 1168217 - protein, 13 aa, Mycobacterium
PGTADGAGPDVHD

SEQ ID NO: 1168218 - protein, 11 aa, Mycobacterium
PGTADLTDEPR

SEQ ID NO: 1168219 - protein, 5 aa, Mycobacterium
PGTAG

SEQ ID NO: 1168220 - protein, 8 aa, Mycobacterium
PGTALGGP

SEQ ID NO: 1168221 - protein, 8 aa, Mycobacterium
PGTDEATV

SEQ ID NO: 1168222 - protein, 7 aa, Mycobacterium
PGTDFAP

SEQ ID NO: 1168223 - protein, 6 aa, Mycobacterium
PGTDGA

SEQ ID NO: 1168224 - protein, 7 aa, Mycobacterium
PGTEQEY

SEQ ID NO: 1168225 - protein, 10 aa, Mycobacterium
PGTGSDDDYA

SEQ ID NO: 1168226 - protein, 16 aa, Mycobacterium
PGTINTPAYGKAADQL

SEQ ID NO: 1168227 - protein, 6 aa, Mycobacterium
PGTKTL

SEQ ID NO: 1168228 - protein, 5 aa, Mycobacterium
PGTMN

SEQ ID NO: 1168229 - protein, 18 aa, Mycobacterium
PGTPAAQTQARLDEANAD

SEQ ID NO: 1168230 - protein, 8 aa, Mycobacterium
PGTPLHDP

SEQ ID NO: 1168231 - protein, 8 aa, Mycobacterium
PGTPPYNY

SEQ ID NO: 1168232 - protein, 10 aa, Mycobacterium
PGTTGVHSSG

SEQ ID NO: 1168233 - protein, 17 aa, Mycobacterium
PGTTQTAQGVGAHKDSG

SEQ ID NO: 1168234 - protein, 6 aa, Mycobacterium
PGTWGP

SEQ ID NO: 1168235 - protein, 8 aa, Mycobacterium
PGVDPEKD

SEQ ID NO: 1168236 - protein, 9 aa, Mycobacterium
PGVDPGPTH

SEQ ID NO: 1168237 - protein, 9 aa, Mycobacterium
PGVEAQDGD

SEQ ID NO: 1168238 - protein, 7 aa, Mycobacterium
PGVEGAG

SEQ ID NO: 1168239 - protein, 4 aa, Mycobacterium
PGVP

SEQ ID NO: 1168240 - protein, 8 aa, Mycobacterium
PGVPPADL

SEQ ID NO: 1168241 - protein, 13 aa, Mycobacterium
PGVPVDGPAPELA

SEQ ID NO: 1168242 - protein, 16 aa, Mycobacterium
PGVQVSSDAAAARSAA

SEQ ID NO: 1168243 - protein, 7 aa, Mycobacterium
PGVRNGG

SEQ ID NO: 1168244 - protein, 10 aa, Mycobacterium
PGVTDTPQLQ

SEQ ID NO: 1168245 - protein, 14 aa, Mycobacterium
PGWPDGSGGAPAAA

SEQ ID NO: 1168246 - protein, 7 aa, Mycobacterium
PGYAAAA

SEQ ID NO: 1168247 - protein, 8 aa, Mycobacterium
PGYDPAKH

SEQ ID NO: 1168248 - protein, 4 aa, Mycobacterium
PGYQ

SEQ ID NO: 1168249 - protein, 10 aa, Mycobacterium
PGYRSSDEVA

SEQ ID NO: 1168250 - protein, 9 aa, Mycobacterium
PHAAPGPDL

SEQ ID NO: 1168251 - protein, 5 aa, Mycobacterium
PHADT

SEQ ID NO: 1168252 - protein, 9 aa, Mycobacterium
PHAERSSRI

SEQ ID NO: 1168253 - protein, 9 aa, Mycobacterium
PHAGPGASQ

SEQ ID NO: 1168254 - protein, 10 aa, Mycobacterium
PHAPDTHSPL

SEQ ID NO: 1168255 - protein, 9 aa, Mycobacterium
PHARNDSLG

SEQ ID NO: 1168256 - protein, 14 aa, Mycobacterium
PHDGNATESPEEAD

SEQ ID NO: 1168257 - protein, 8 aa, Mycobacterium
PHDGPCGS

SEQ ID NO: 1168258 - protein, 7 aa, Mycobacterium
PHDPQPS

SEQ ID NO: 1168259 - protein, 5 aa, Mycobacterium
PHEGA

SEQ ID NO: 1168260 - protein, 8 aa, Mycobacterium
PHEGPCGS

SEQ ID NO: 1168261 - protein, 9 aa, Mycobacterium
PHEVDEDEL

SEQ ID NO: 1168262 - protein, 5 aa, Mycobacterium
PHGEG

SEQ ID NO: 1168263 - protein, 7 aa, Mycobacterium
PHGERSI

SEQ ID NO: 1168264 - protein, 7 aa, Mycobacterium
PHGNGET

SEQ ID NO: 1168265 - protein, 4 aa, Mycobacterium
PHGQ

SEQ ID NO: 1168266 - protein, 16 aa, Mycobacterium
PHGRQPGEINHHDGGR

SEQ ID NO: 1168267 - protein, 12 aa, Mycobacterium
PHGTPEEPKGTP

SEQ ID NO: 1168268 - protein, 4 aa, Mycobacterium
PHHP

SEQ ID NO: 1168269 - protein, 12 aa, Mycobacterium
PHIGPNGGTAAG

SEQ ID NO: 1168270 - protein, 4 aa, Mycobacterium
PHIP

SEQ ID NO: 1168271 - protein, 19 aa, Mycobacterium
PHLDETKTVRENVEEGVPI

SEQ ID NO: 1168272 - protein, 5 aa, Mycobacterium
PHNSG

SEQ ID NO: 1168273 - protein, 4 aa, Mycobacterium
PHPA

SEQ ID NO: 1168274 - protein, 13 aa, Mycobacterium
PHPADPGATPATR

SEQ ID NO: 1168275 - protein, 8 aa, Mycobacterium
PHPDGDPN

SEQ ID NO: 1168276 - protein, 5 aa, Mycobacterium
PHPEL

SEQ ID NO: 1168277 - protein, 8 aa, Mycobacterium
PHPGPGRG

SEQ ID NO: 1168278 - protein, 19 aa, Mycobacterium
PHPGTAPGAPEVKGTADPV

SEQ ID NO: 1168279 - protein, 12 aa, Mycobacterium
PHPMAPGATDDD

SEQ ID NO: 1168280 - protein, 7 aa, Mycobacterium
PHPPRDA

SEQ ID NO: 1168281 - protein, 4 aa, Mycobacterium
PHPR

SEQ ID NO: 1168282 - protein, 10 aa, Mycobacterium
PHPSAPAGYP

SEQ ID NO: 1168283 - protein, 13 aa, Mycobacterium
PHPTRSGDLAHPD

SEQ ID NO: 1168284 - protein, 10 aa, Mycobacterium
PHQAHDTPTI

SEQ ID NO: 1168285 - protein, 6 aa, Mycobacterium
PHQTGI

SEQ ID NO: 1168286 - protein, 4 aa, Mycobacterium
PHRD

SEQ ID NO: 1168287 - protein, 7 aa, Mycobacterium
PHREDGS

SEQ ID NO: 1168288 - protein, 16 aa, Mycobacterium
PHRTKSSLPKPLQTVG

SEQ ID NO: 1168289 - protein, 11 aa, Mycobacterium
PHSDSTWPLSP

SEQ ID NO: 1168290 - protein, 7 aa, Mycobacterium
PHSPMAG

SEQ ID NO: 1168291 - protein, 7 aa, Mycobacterium
PHTAGGT

SEQ ID NO: 1168292 - protein, 7 aa, Mycobacterium
PHTETTV

SEQ ID NO: 1168293 - protein, 8 aa, Mycobacterium
PHTGQHPD

SEQ ID NO: 1168294 - protein, 6 aa, Mycobacterium
PHTRSG

SEQ ID NO: 1168295 - protein, 10 aa, Mycobacterium
PHTRTGKKLE

SEQ ID NO: 1168296 - protein, 11 aa, Mycobacterium
PHVPNRGRPGR

SEQ ID NO: 1168297 - protein, 10 aa, Mycobacterium
PIAGREKVDQ

SEQ ID NO: 1168298 - protein, 4 aa, Mycobacterium
PIDA

SEQ ID NO: 1168299 - protein, 35 aa, Mycobacterium
PIDNASGNGRKSEPGTGRRSKRGKKGGKPEEAPAA

SEQ ID NO: 1168300 - protein, 6 aa, Mycobacterium
PIDPAP

SEQ ID NO: 1168301 - protein, 5 aa, Mycobacterium
PIEPE

SEQ ID NO: 1168302 - protein, 6 aa, Mycobacterium
PIEPGR

SEQ ID NO: 1168303 - protein, 10 aa, Mycobacterium
PIEPTLPAPE

SEQ ID NO: 1168304 - protein, 9 aa, Mycobacterium
PIGDARAGE

SEQ ID NO: 1168305 - protein, 5 aa, Mycobacterium
PIGED

SEQ ID NO: 1168306 - protein, 70 aa, Mycobacterium
PIGGSSSNGAVKRSASTADDAPADASTQSRPKSSGTTDRPSGAGNSNGKGGSSSSSTGNSNGKGSSSSTG

SEQ ID NO: 1168307 - protein, 4 aa, Mycobacterium
PIGT

SEQ ID NO: 1168308 - protein, 7 aa, Mycobacterium
PIPDTQY

SEQ ID NO: 1168309 - protein, 4 aa, Mycobacterium
PIPE

SEQ ID NO: 1168310 - protein, 20 aa, Mycobacterium
PIPGAATDRHQCEQRAEETL

SEQ ID NO: 1168311 - protein, 15 aa, Mycobacterium
PIPQEDSGPLAGQGW

SEQ ID NO: 1168312 - protein, 4 aa, Mycobacterium
PIPS

SEQ ID NO: 1168313 - protein, 5 aa, Mycobacterium
PIPTE

SEQ ID NO: 1168314 - protein, 5 aa, Mycobacterium
PIQPM

SEQ ID NO: 1168315 - protein, 19 aa, Mycobacterium
PIRRDGNGDRVSYWCPHCQ

SEQ ID NO: 1168316 - protein, 8 aa, Mycobacterium
PISDPHGG

SEQ ID NO: 1168317 - protein, 15 aa, Mycobacterium
PISHPDTAVLAMLLA

SEQ ID NO: 1168318 - protein, 7 aa, Mycobacterium
PISPDTM

SEQ ID NO: 1168319 - protein, 5 aa, Mycobacterium
PITAD

SEQ ID NO: 1168320 - protein, 4 aa, Mycobacterium
PITN

SEQ ID NO: 1168321 - protein, 7 aa, Mycobacterium
PITPYPP

SEQ ID NO: 1168322 - protein, 11 aa, Mycobacterium
PITTSGKIRRS

SEQ ID NO: 1168323 - protein, 7 aa, Mycobacterium
PKAALGH

SEQ ID NO: 1168324 - protein, 8 aa, Mycobacterium
PKAKEASV

SEQ ID NO: 1168325 - protein, 6 aa, Mycobacterium
PKAPFE

SEQ ID NO: 1168326 - protein, 8 aa, Mycobacterium
PKAPSVQQ

SEQ ID NO: 1168327 - protein, 8 aa, Mycobacterium
PKATPEQV

SEQ ID NO: 1168328 - protein, 12 aa, Mycobacterium
PKDAPSGGDPLQ

SEQ ID NO: 1168329 - protein, 7 aa, Mycobacterium
PKDRTDL

SEQ ID NO: 1168330 - protein, 11 aa, Mycobacterium
PKDVPGTSRVG

SEQ ID NO: 1168331 - protein, 17 aa, Mycobacterium
PKEPEVDRDIAFRDARR

SEQ ID NO: 1168332 - protein, 8 aa, Mycobacterium
PKEQATVG

SEQ ID NO: 1168333 - protein, 9 aa, Mycobacterium
PKERHRDTF

SEQ ID NO: 1168334 - protein, 14 aa, Mycobacterium
PKFSNSSAQTSSEY

SEQ ID NO: 1168335 - protein, 6 aa, Mycobacterium
PKGEAE

SEQ ID NO: 1168336 - protein, 12 aa, Mycobacterium
PKGENADARARR

SEQ ID NO: 1168337 - protein, 8 aa, Mycobacterium
PKGEYGGG

SEQ ID NO: 1168338 - protein, 14 aa, Mycobacterium
PKGKVDPGETEPVT

SEQ ID NO: 1168339 - protein, 23 aa, Mycobacterium
PKGLTGLEENRAGSHGDAARRQS

SEQ ID NO: 1168340 - protein, 11 aa, Mycobacterium
PKGQARRQAEE

SEQ ID NO: 1168341 - protein, 9 aa, Mycobacterium
PKGRDPGAR

SEQ ID NO: 1168342 - protein, 14 aa, Mycobacterium
PKGTDGADSLDPEV

SEQ ID NO: 1168343 - protein, 7 aa, Mycobacterium
PKHDGGG

SEQ ID NO: 1168344 - protein, 12 aa, Mycobacterium
PKKAIKAQAYWQ

SEQ ID NO: 1168345 - protein, 10 aa, Mycobacterium
PKKGTWRTDS

SEQ ID NO: 1168346 - protein, 4 aa, Mycobacterium
PKKI

SEQ ID NO: 1168347 - protein, 40 aa, Mycobacterium
PKKTEETAEPVKAAAKKAPAKKAPAKKAPAKKAPAKKVTQ

SEQ ID NO: 1168348 - protein, 19 aa, Mycobacterium
PKLGDRYPAQLSGGQQQRV

SEQ ID NO: 1168349 - protein, 4 aa, Mycobacterium
PKLV

SEQ ID NO: 1168350 - protein, 12 aa, Mycobacterium
PKPEPASAQGFG

SEQ ID NO: 1168351 - protein, 20 aa, Mycobacterium
PKPGQRVERGASPAIEPWWQ

SEQ ID NO: 1168352 - protein, 10 aa, Mycobacterium
PKPGQTIPGV

SEQ ID NO: 1168353 - protein, 6 aa, Mycobacterium
PKPGVT

SEQ ID NO: 1168354 - protein, 7 aa, Mycobacterium
PKPLQDN

SEQ ID NO: 1168355 - protein, 13 aa, Mycobacterium
PKPVNTPERPNPE

SEQ ID NO: 1168356 - protein, 9 aa, Mycobacterium
PKQFDGTGN

SEQ ID NO: 1168357 - protein, 14 aa, Mycobacterium
PKQSSQPAAASLPD

SEQ ID NO: 1168358 - protein, 5 aa, Mycobacterium
PKQVP

SEQ ID NO: 1168359 - protein, 7 aa, Mycobacterium
PKRAEYD

SEQ ID NO: 1168360 - protein, 7 aa, Mycobacterium
PKRARDL

SEQ ID NO: 1168361 - protein, 10 aa, Mycobacterium
PKRGARSADE

SEQ ID NO: 1168362 - protein, 4 aa, Mycobacterium
PKRQ

SEQ ID NO: 1168363 - protein, 19 aa, Mycobacterium
PKRVTTRSAAERPAAVPTT

SEQ ID NO: 1168364 - protein, 14 aa, Mycobacterium
PKSASGKILRKDLR

SEQ ID NO: 1168365 - protein, 7 aa, Mycobacterium
PKSDRAE

SEQ ID NO: 1168366 - protein, 35 aa, Mycobacterium
PKSGGGADPLTGAPAPITPQQRRESGIDAKPKKDG

SEQ ID NO: 1168367 - protein, 8 aa, Mycobacterium
PKSGKTTI

SEQ ID NO: 1168368 - protein, 15 aa, Mycobacterium
PKSRDGQGRDAYGSV

SEQ ID NO: 1168369 - protein, 9 aa, Mycobacterium
PKTINDDRA

SEQ ID NO: 1168370 - protein, 10 aa, Mycobacterium
PKTKAEALAT

SEQ ID NO: 1168371 - protein, 17 aa, Mycobacterium
PKTPSGKLRRAHALSLI

SEQ ID NO: 1168372 - protein, 20 aa, Mycobacterium
PKTTRPTGPRISIQFRPHDV

SEQ ID NO: 1168373 - protein, 8 aa, Mycobacterium
PKVGPGGW

SEQ ID NO: 1168374 - protein, 4 aa, Mycobacterium
PKVP

SEQ ID NO: 1168375 - protein, 18 aa, Mycobacterium
PKVPDSGATTLDCDAEPF

SEQ ID NO: 1168376 - protein, 7 aa, Mycobacterium
PKVQEEI

SEQ ID NO: 1168377 - protein, 9 aa, Mycobacterium
PKVRPLPGR

SEQ ID NO: 1168378 - protein, 5 aa, Mycobacterium
PLADD

SEQ ID NO: 1168379 - protein, 11 aa, Mycobacterium
PLADSTARQAR

SEQ ID NO: 1168380 - protein, 13 aa, Mycobacterium
PLAGGMGGLGIPG

SEQ ID NO: 1168381 - protein, 5 aa, Mycobacterium
PLAPE

SEQ ID NO: 1168382 - protein, 7 aa, Mycobacterium
PLAPGGF

SEQ ID NO: 1168383 - protein, 16 aa, Mycobacterium
PLAPTGRGRPDGDGVR

SEQ ID NO: 1168384 - protein, 9 aa, Mycobacterium
PLDDERNAA

SEQ ID NO: 1168385 - protein, 6 aa, Mycobacterium
PLDDRG

SEQ ID NO: 1168386 - protein, 6 aa, Mycobacterium
PLDPTL

SEQ ID NO: 1168387 - protein, 19 aa, Mycobacterium
PLDQTTSRGQYTGGWQGGE

SEQ ID NO: 1168388 - protein, 5 aa, Mycobacterium
PLDTA

SEQ ID NO: 1168389 - protein, 12 aa, Mycobacterium
PLDYPEDKTELT

SEQ ID NO: 1168390 - protein, 8 aa, Mycobacterium
PLEPDENG

SEQ ID NO: 1168391 - protein, 16 aa, Mycobacterium
PLEPPATANPNIRPAG

SEQ ID NO: 1168392 - protein, 10 aa, Mycobacterium
PLGDADKDAA

SEQ ID NO: 1168393 - protein, 9 aa, Mycobacterium
PLGGASAGA

SEQ ID NO: 1168394 - protein, 6 aa, Mycobacterium
PLGPKG

SEQ ID NO: 1168395 - protein, 10 aa, Mycobacterium
PLGSETSFED

SEQ ID NO: 1168396 - protein, 10 aa, Mycobacterium
PLHRAGERVT

SEQ ID NO: 1168397 - protein, 6 aa, Mycobacterium
PLNTTG

SEQ ID NO: 1168398 - protein, 7 aa, Mycobacterium
PLPDDSP

SEQ ID NO: 1168399 - protein, 6 aa, Mycobacterium
PLPEGA

SEQ ID NO: 1168400 - protein, 10 aa, Mycobacterium
PLPGVPEPLA

SEQ ID NO: 1168401 - protein, 9 aa, Mycobacterium
PLPHPDPID

SEQ ID NO: 1168402 - protein, 6 aa, Mycobacterium
PLPQGR

SEQ ID NO: 1168403 - protein, 6 aa, Mycobacterium
PLPRGA

SEQ ID NO: 1168404 - protein, 4 aa, Mycobacterium
PLPS

SEQ ID NO: 1168405 - protein, 13 aa, Mycobacterium
PLPSRRGRPPRFT

SEQ ID NO: 1168406 - protein, 9 aa, Mycobacterium
PLPSSPDDR

SEQ ID NO: 1168407 - protein, 8 aa, Mycobacterium
PLPVPPTP

SEQ ID NO: 1168408 - protein, 9 aa, Mycobacterium
PLQPSGSPY

SEQ ID NO: 1168409 - protein, 7 aa, Mycobacterium
PLQTDTG

SEQ ID NO: 1168410 - protein, 5 aa, Mycobacterium
PLRDA

SEQ ID NO: 1168411 - protein, 8 aa, Mycobacterium
PLRDDGGQ

SEQ ID NO: 1168412 - protein, 10 aa, Mycobacterium
PLRDEGNRYA

SEQ ID NO: 1168413 - protein, 7 aa, Mycobacterium
PLRDGGY

SEQ ID NO: 1168414 - protein, 10 aa, Mycobacterium
PLRGDSPAAR

SEQ ID NO: 1168415 - protein, 10 aa, Mycobacterium
PLRPEERRTT

SEQ ID NO: 1168416 - protein, 14 aa, Mycobacterium
PLRRPRRVNPGGRY

SEQ ID NO: 1168417 - protein, 8 aa, Mycobacterium
PLRTDTDR

SEQ ID NO: 1168418 - protein, 10 aa, Mycobacterium
PLSDAQARLG

SEQ ID NO: 1168419 - protein, 6 aa, Mycobacterium
PLSEDD

SEQ ID NO: 1168420 - protein, 9 aa, Mycobacterium
PLSGVGPDQ

SEQ ID NO: 1168421 - protein, 10 aa, Mycobacterium
PLSLPSSEHP

SEQ ID NO: 1168422 - protein, 5 aa, Mycobacterium
PLTDA

SEQ ID NO: 1168423 - protein, 11 aa, Mycobacterium
PLTDNEISERA

SEQ ID NO: 1168424 - protein, 11 aa, Mycobacterium
PLTPDAAAQMA

SEQ ID NO: 1168425 - protein, 7 aa, Mycobacterium
PLTSGSK

SEQ ID NO: 1168426 - protein, 7 aa, Mycobacterium
PLTTGSG

SEQ ID NO: 1168427 - protein, 10 aa, Mycobacterium
PLTTSTADLE

SEQ ID NO: 1168428 - protein, 6 aa, Mycobacterium
PLVPRP

SEQ ID NO: 1168429 - protein, 5 aa, Mycobacterium
PMAGS

SEQ ID NO: 1168430 - protein, 13 aa, Mycobacterium
PMDAGRKGQKGIE

SEQ ID NO: 1168431 - protein, 5 aa, Mycobacterium
PMGGW

SEQ ID NO: 1168432 - protein, 17 aa, Mycobacterium
PMGSDGGAWAADPETNY

SEQ ID NO: 1168433 - protein, 11 aa, Mycobacterium
PMPAPAPEPGL

SEQ ID NO: 1168434 - protein, 16 aa, Mycobacterium
PMPGPVTSPGERTDGL

SEQ ID NO: 1168435 - protein, 5 aa, Mycobacterium
PMPPV

SEQ ID NO: 1168436 - protein, 5 aa, Mycobacterium
PMSAN

SEQ ID NO: 1168437 - protein, 8 aa, Mycobacterium
PMSPATDL

SEQ ID NO: 1168438 - protein, 9 aa, Mycobacterium
PMSTEQRMA

SEQ ID NO: 1168439 - protein, 8 aa, Mycobacterium
PMTAQRAK

SEQ ID NO: 1168440 - protein, 5 aa, Mycobacterium
PMTNE

SEQ ID NO: 1168441 - protein, 5 aa, Mycobacterium
PNAEE

SEQ ID NO: 1168442 - protein, 8 aa, Mycobacterium
PNAGGPRD

SEQ ID NO: 1168443 - protein, 7 aa, Mycobacterium
PNAPELG

SEQ ID NO: 1168444 - protein, 13 aa, Mycobacterium
PNAQIGAAWVSMP

SEQ ID NO: 1168445 - protein, 12 aa, Mycobacterium
PNEASDGPLPQA

SEQ ID NO: 1168446 - protein, 12 aa, Mycobacterium
PNEDAEVSKEIE

SEQ ID NO: 1168447 - protein, 7 aa, Mycobacterium
PNEVGQT

SEQ ID NO: 1168448 - protein, 5 aa, Mycobacterium
PNEVP

SEQ ID NO: 1168449 - protein, 5 aa, Mycobacterium
PNFPE

SEQ ID NO: 1168450 - protein, 7 aa, Mycobacterium
PNGAAAR

SEQ ID NO: 1168451 - protein, 8 aa, Mycobacterium
PNGAGKST

SEQ ID NO: 1168452 - protein, 9 aa, Mycobacterium
PNGAGKSTT

SEQ ID NO: 1168453 - protein, 7 aa, Mycobacterium
PNGEPGV

SEQ ID NO: 1168454 - protein, 4 aa, Mycobacterium
PNGH

SEQ ID NO: 1168455 - protein, 5 aa, Mycobacterium
PNGLG

SEQ ID NO: 1168456 - protein, 13 aa, Mycobacterium
PNGQGAAVSGGYR

SEQ ID NO: 1168457 - protein, 6 aa, Mycobacterium
PNGRSG

SEQ ID NO: 1168458 - protein, 7 aa, Mycobacterium
PNGTVPA

SEQ ID NO: 1168459 - protein, 5 aa, Mycobacterium
PNGYD

SEQ ID NO: 1168460 - protein, 4 aa, Mycobacterium
PNIG

SEQ ID NO: 1168461 - protein, 15 aa, Mycobacterium
PNKRPMQADENGRVL

SEQ ID NO: 1168462 - protein, 13 aa, Mycobacterium
PNLEPPERPLPGP

SEQ ID NO: 1168463 - protein, 7 aa, Mycobacterium
PNLSPAN

SEQ ID NO: 1168464 - protein, 27 aa, Mycobacterium
PNNYADPPRYPSPQPAGPIEETLTDED

SEQ ID NO: 1168465 - protein, 14 aa, Mycobacterium
PNPAEGGKKKAAKT

SEQ ID NO: 1168466 - protein, 6 aa, Mycobacterium
PNPAEP

SEQ ID NO: 1168467 - protein, 5 aa, Mycobacterium
PNPAP

SEQ ID NO: 1168468 - protein, 10 aa, Mycobacterium
PNPDEGGQAP

SEQ ID NO: 1168469 - protein, 10 aa, Mycobacterium
PNPHVGFGGT

SEQ ID NO: 1168470 - protein, 9 aa, Mycobacterium
PNPIDAGSE

SEQ ID NO: 1168471 - protein, 10 aa, Mycobacterium
PNPPSRSRDD

SEQ ID NO: 1168472 - protein, 11 aa, Mycobacterium
PNPRAEADENE

SEQ ID NO: 1168473 - protein, 13 aa, Mycobacterium
PNQARRGEPGPPF

SEQ ID NO: 1168474 - protein, 8 aa, Mycobacterium
PNREGEPR

SEQ ID NO: 1168475 - protein, 6 aa, Mycobacterium
PNRESA

SEQ ID NO: 1168476 - protein, 14 aa, Mycobacterium
PNRPGGDPWNPHGT

SEQ ID NO: 1168477 - protein, 15 aa, Mycobacterium
PNRTEGVEMSGTDTA

SEQ ID NO: 1168478 - protein, 8 aa, Mycobacterium
PNRTPKQI

SEQ ID NO: 1168479 - protein, 4 aa, Mycobacterium
PNSS

SEQ ID NO: 1168480 - protein, 5 aa, Mycobacterium
PNTGE

SEQ ID NO: 1168481 - protein, 10 aa, Mycobacterium
PNVDRGREHA

SEQ ID NO: 1168482 - protein, 15 aa, Mycobacterium
PNYSMPAQNRPLAAD

SEQ ID NO: 1168483 - protein, 5 aa, Mycobacterium
PPAAD

SEQ ID NO: 1168484 - protein, 8 aa, Mycobacterium
PPAARSGK

SEQ ID NO: 1168485 - protein, 9 aa, Mycobacterium
PPAASPTGT

SEQ ID NO: 1168486 - protein, 8 aa, Mycobacterium
PPAATPTW

SEQ ID NO: 1168487 - protein, 5 aa, Mycobacterium
PPAAY

SEQ ID NO: 1168488 - protein, 5 aa, Mycobacterium
PPAET

SEQ ID NO: 1168489 - protein, 7 aa, Mycobacterium
PPAEYDP

SEQ ID NO: 1168490 - protein, 8 aa, Mycobacterium
PPAGGEES

SEQ ID NO: 1168491 - protein, 7 aa, Mycobacterium
PPAGLTA

SEQ ID NO: 1168492 - protein, 4 aa, Mycobacterium
PPAL

SEQ ID NO: 1168493 - protein, 5 aa, Mycobacterium
PPANV

SEQ ID NO: 1168494 - protein, 13 aa, Mycobacterium
PPAPADTTPPADN

SEQ ID NO: 1168495 - protein, 6 aa, Mycobacterium
PPAPDP

SEQ ID NO: 1168496 - protein, 14 aa, Mycobacterium
PPAPPLPAGPAGEQ

SEQ ID NO: 1168497 - protein, 6 aa, Mycobacterium
PPATAV

SEQ ID NO: 1168498 - protein, 8 aa, Mycobacterium
PPDAEARR

SEQ ID NO: 1168499 - protein, 9 aa, Mycobacterium
PPDGAPPQV

SEQ ID NO: 1168500 - protein, 7 aa, Mycobacterium
PPDGISG

SEQ ID NO: 1168501 - protein, 9 aa, Mycobacterium
PPDGPTPTM

SEQ ID NO: 1168502 - protein, 4 aa, Mycobacterium
PPDI

SEQ ID NO: 1168503 - protein, 12 aa, Mycobacterium
PPDPIDDDDAFG

SEQ ID NO: 1168504 - protein, 7 aa, Mycobacterium
PPDPSSY

SEQ ID NO: 1168505 - protein, 7 aa, Mycobacterium
PPDQTEE

SEQ ID NO: 1168506 - protein, 17 aa, Mycobacterium
PPDSPKAVAQASAGKVG

SEQ ID NO: 1168507 - protein, 6 aa, Mycobacterium
PPEAQD

SEQ ID NO: 1168508 - protein, 5 aa, Mycobacterium
PPEDE

SEQ ID NO: 1168509 - protein, 7 aa, Mycobacterium
PPEEPKH

SEQ ID NO: 1168510 - protein, 4 aa, Mycobacterium
PPEG

SEQ ID NO: 1168511 - protein, 5 aa, Mycobacterium
PPEIT

SEQ ID NO: 1168512 - protein, 5 aa, Mycobacterium
PPEKI

SEQ ID NO: 1168513 - protein, 6 aa, Mycobacterium
PPEQES

SEQ ID NO: 1168514 - protein, 5 aa, Mycobacterium
PPEQM

SEQ ID NO: 1168515 - protein, 6 aa, Mycobacterium
PPETAD

SEQ ID NO: 1168516 - protein, 6 aa, Mycobacterium
PPEVNT

SEQ ID NO: 1168517 - protein, 6 aa, Mycobacterium
PPFGTM

SEQ ID NO: 1168518 - protein, 11 aa, Mycobacterium
PPFSGPQGPFA

SEQ ID NO: 1168519 - protein, 7 aa, Mycobacterium
PPFTGMP

SEQ ID NO: 1168520 - protein, 10 aa, Mycobacterium
PPGAGNAVGG

SEQ ID NO: 1168521 - protein, 5 aa, Mycobacterium
PPGEF

SEQ ID NO: 1168522 - protein, 11 aa, Mycobacterium
PPGGGPAEPFA

SEQ ID NO: 1168523 - protein, 8 aa, Mycobacterium
PPGGSPAK

SEQ ID NO: 1168524 - protein, 12 aa, Mycobacterium
PPGHDPRNGLGG

SEQ ID NO: 1168525 - protein, 6 aa, Mycobacterium
PPGLAT

SEQ ID NO: 1168526 - protein, 7 aa, Mycobacterium
PPGLTEA

SEQ ID NO: 1168527 - protein, 5 aa, Mycobacterium
PPGNG

SEQ ID NO: 1168528 - protein, 8 aa, Mycobacterium
PPGQDAMS

SEQ ID NO: 1168529 - protein, 11 aa, Mycobacterium
PPGRGDAEALR

SEQ ID NO: 1168530 - protein, 14 aa, Mycobacterium
PPGSLGLSTGGYTR

SEQ ID NO: 1168531 - protein, 11 aa, Mycobacterium
PPGTASKAEGL

SEQ ID NO: 1168532 - protein, 17 aa, Mycobacterium
PPGTEPAGIAPARRADL

SEQ ID NO: 1168533 - protein, 7 aa, Mycobacterium
PPGTGDV

SEQ ID NO: 1168534 - protein, 13 aa, Mycobacterium
PPGTIRTDAGPGA

SEQ ID NO: 1168535 - protein, 12 aa, Mycobacterium
PPGTRGLSQGQK

SEQ ID NO: 1168536 - protein, 11 aa, Mycobacterium
PPGVASNTVQE

SEQ ID NO: 1168537 - protein, 13 aa, Mycobacterium
PPGVDTDRFAPDT

SEQ ID NO: 1168538 - protein, 8 aa, Mycobacterium
PPGVEDGQ

SEQ ID NO: 1168539 - protein, 7 aa, Mycobacterium
PPGWPEL

SEQ ID NO: 1168540 - protein, 21 aa, Mycobacterium
PPGYTGPPPPLSEASQALQGP

SEQ ID NO: 1168541 - protein, 6 aa, Mycobacterium
PPHDPC

SEQ ID NO: 1168542 - protein, 7 aa, Mycobacterium
PPHPAGE

SEQ ID NO: 1168543 - protein, 6 aa, Mycobacterium
PPHTGV

SEQ ID NO: 1168544 - protein, 11 aa, Mycobacterium
PPKESDHAGAV

SEQ ID NO: 1168545 - protein, 9 aa, Mycobacterium
PPKQTTEDG

SEQ ID NO: 1168546 - protein, 13 aa, Mycobacterium
PPKRRTREPESKS

SEQ ID NO: 1168547 - protein, 9 aa, Mycobacterium
PPKSKGPVR

SEQ ID NO: 1168548 - protein, 9 aa, Mycobacterium
PPKTREATF

SEQ ID NO: 1168549 - protein, 4 aa, Mycobacterium
PPLA

SEQ ID NO: 1168550 - protein, 10 aa, Mycobacterium
PPLGPGAPPL

SEQ ID NO: 1168551 - protein, 12 aa, Mycobacterium
PPLPEDEARNEG

SEQ ID NO: 1168552 - protein, 13 aa, Mycobacterium
PPLPPDPTEIGTR

SEQ ID NO: 1168553 - protein, 6 aa, Mycobacterium
PPLSEL

SEQ ID NO: 1168554 - protein, 5 aa, Mycobacterium
PPLSQ

SEQ ID NO: 1168555 - protein, 7 aa, Mycobacterium
PPNAKAR

SEQ ID NO: 1168556 - protein, 11 aa, Mycobacterium
PPNLEGEAAEA

SEQ ID NO: 1168557 - protein, 16 aa, Mycobacterium
PPPDFDVKAEKKRLAN

SEQ ID NO: 1168558 - protein, 7 aa, Mycobacterium
PPPGAID

SEQ ID NO: 1168559 - protein, 12 aa, Mycobacterium
PPPGAPPDRDKG

SEQ ID NO: 1168560 - protein, 18 aa, Mycobacterium
PPPGEPVAPLSDADAALG

SEQ ID NO: 1168561 - protein, 14 aa, Mycobacterium
PPPGPNDPAKAHDR

SEQ ID NO: 1168562 - protein, 10 aa, Mycobacterium
PPPGVHGSPI

SEQ ID NO: 1168563 - protein, 8 aa, Mycobacterium
PPPITPGG

SEQ ID NO: 1168564 - protein, 17 aa, Mycobacterium
PPPLRRRGAARERAAEL

SEQ ID NO: 1168565 - protein, 4 aa, Mycobacterium
PPPM

SEQ ID NO: 1168566 - protein, 6 aa, Mycobacterium
PPPPLT

SEQ ID NO: 1168567 - protein, 7 aa, Mycobacterium
PPPPPID

SEQ ID NO: 1168568 - protein, 12 aa, Mycobacterium
PPPTGDADAPAR

SEQ ID NO: 1168569 - protein, 13 aa, Mycobacterium
PPPVDADESLASE

SEQ ID NO: 1168570 - protein, 5 aa, Mycobacterium
PPQAM

SEQ ID NO: 1168571 - protein, 6 aa, Mycobacterium
PPQHDL

SEQ ID NO: 1168572 - protein, 5 aa, Mycobacterium
PPQKQ

SEQ ID NO: 1168573 - protein, 8 aa, Mycobacterium
PPQPEPNK

SEQ ID NO: 1168574 - protein, 7 aa, Mycobacterium
PPQPSPC

SEQ ID NO: 1168575 - protein, 6 aa, Mycobacterium
PPQSRE

SEQ ID NO: 1168576 - protein, 14 aa, Mycobacterium
PPREADPATGRPTT

SEQ ID NO: 1168577 - protein, 9 aa, Mycobacterium
PPREQYPQR

SEQ ID NO: 1168578 - protein, 5 aa, Mycobacterium
PPRFT

SEQ ID NO: 1168579 - protein, 4 aa, Mycobacterium
PPRI

SEQ ID NO: 1168580 - protein, 9 aa, Mycobacterium
PPRRTPPAH

SEQ ID NO: 1168581 - protein, 6 aa, Mycobacterium
PPSARP

SEQ ID NO: 1168582 - protein, 7 aa, Mycobacterium
PPSGPMD

SEQ ID NO: 1168583 - protein, 6 aa, Mycobacterium
PPSGRH

SEQ ID NO: 1168584 - protein, 7 aa, Mycobacterium
PPSHTRG

SEQ ID NO: 1168585 - protein, 10 aa, Mycobacterium
PPSRISNRNA

SEQ ID NO: 1168586 - protein, 4 aa, Mycobacterium
PPST

SEQ ID NO: 1168587 - protein, 6 aa, Mycobacterium
PPSTGR

SEQ ID NO: 1168588 - protein, 7 aa, Mycobacterium
PPSTYRQ

SEQ ID NO: 1168589 - protein, 5 aa, Mycobacterium
PPTAR

SEQ ID NO: 1168590 - protein, 5 aa, Mycobacterium
PPTDA

SEQ ID NO: 1168591 - protein, 7 aa, Mycobacterium
PPTDELR

SEQ ID NO: 1168592 - protein, 6 aa, Mycobacterium
PPTHTE

SEQ ID NO: 1168593 - protein, 9 aa, Mycobacterium
PPTPNGLTR

SEQ ID NO: 1168594 - protein, 14 aa, Mycobacterium
PPVEAGPATPLDGL

SEQ ID NO: 1168595 - protein, 5 aa, Mycobacterium
PPVEE

SEQ ID NO: 1168596 - protein, 5 aa, Mycobacterium
PPVEQ

SEQ ID NO: 1168597 - protein, 6 aa, Mycobacterium
PPVERD

SEQ ID NO: 1168598 - protein, 4 aa, Mycobacterium
PPVL

SEQ ID NO: 1168599 - protein, 12 aa, Mycobacterium
PPVPRASDPPTQ

SEQ ID NO: 1168600 - protein, 19 aa, Mycobacterium
PPVPTGDAAADRDAQRAEG

SEQ ID NO: 1168601 - protein, 4 aa, Mycobacterium
PPVR

SEQ ID NO: 1168602 - protein, 6 aa, Mycobacterium
PPVRRD

SEQ ID NO: 1168603 - protein, 6 aa, Mycobacterium
PPVSAT

SEQ ID NO: 1168604 - protein, 8 aa, Mycobacterium
PPVSNEKR

SEQ ID NO: 1168605 - protein, 7 aa, Mycobacterium
PPVTVPS

SEQ ID NO: 1168606 - protein, 4 aa, Mycobacterium
PPYD

SEQ ID NO: 1168607 - protein, 10 aa, Mycobacterium
PPYDVPDSEV

SEQ ID NO: 1168608 - protein, 8 aa, Mycobacterium
PPYTGGSA

SEQ ID NO: 1168609 - protein, 5 aa, Mycobacterium
PQAED

SEQ ID NO: 1168610 - protein, 7 aa, Mycobacterium
PQAGTIT

SEQ ID NO: 1168611 - protein, 11 aa, Mycobacterium
PQAQRAREGEV

SEQ ID NO: 1168612 - protein, 10 aa, Mycobacterium
PQAVPALRPS

SEQ ID NO: 1168613 - protein, 17 aa, Mycobacterium
PQDDEESPTQQAAAKLT

SEQ ID NO: 1168614 - protein, 13 aa, Mycobacterium
PQDDPDQTDWESP

SEQ ID NO: 1168615 - protein, 10 aa, Mycobacterium
PQDDPPPVAD

SEQ ID NO: 1168616 - protein, 6 aa, Mycobacterium
PQDDRD

SEQ ID NO: 1168617 - protein, 10 aa, Mycobacterium
PQDEAGLPDI

SEQ ID NO: 1168618 - protein, 5 aa, Mycobacterium
PQDGA

SEQ ID NO: 1168619 - protein, 9 aa, Mycobacterium
PQDGSRPSL

SEQ ID NO: 1168620 - protein, 9 aa, Mycobacterium
PQDNTGAFD

SEQ ID NO: 1168621 - protein, 8 aa, Mycobacterium
PQDPREGD

SEQ ID NO: 1168622 - protein, 6 aa, Mycobacterium
PQDTEA

SEQ ID NO: 1168623 - protein, 97 aa, Mycobacterium
PQEQRGAPGSRDTGSDQPSGGPTDRPSGTYHGDETVPAHEGGGSGQTGREKTEAPPSDAEPAVPPYEGRQTTAKPDSGVDDGGDARTGGAVKPGSAA

SEQ ID NO: 1168624 - protein, 7 aa, Mycobacterium
PQERPDY

SEQ ID NO: 1168625 - protein, 4 aa, Mycobacterium
PQEV

SEQ ID NO: 1168626 - protein, 14 aa, Mycobacterium
PQFAPRDDRPRPAL

SEQ ID NO: 1168627 - protein, 14 aa, Mycobacterium
PQFDDPSINSGGQA

SEQ ID NO: 1168628 - protein, 14 aa, Mycobacterium
PQFGSGRSGDIDPQ

SEQ ID NO: 1168629 - protein, 10 aa, Mycobacterium
PQGAAGEDIV

SEQ ID NO: 1168630 - protein, 10 aa, Mycobacterium
PQGAASEDFS

SEQ ID NO: 1168631 - protein, 16 aa, Mycobacterium
PQGAPRPNPGCDPAGP

SEQ ID NO: 1168632 - protein, 10 aa, Mycobacterium
PQGDEAPGSL

SEQ ID NO: 1168633 - protein, 5 aa, Mycobacterium
PQGFE

SEQ ID NO: 1168634 - protein, 7 aa, Mycobacterium
PQGPISE

SEQ ID NO: 1168635 - protein, 12 aa, Mycobacterium
PQHANDARSEAA

SEQ ID NO: 1168636 - protein, 13 aa, Mycobacterium
PQHERTKAFLSKV

SEQ ID NO: 1168637 - protein, 7 aa, Mycobacterium
PQHPSTH

SEQ ID NO: 1168638 - protein, 6 aa, Mycobacterium
PQHSPE

SEQ ID NO: 1168639 - protein, 9 aa, Mycobacterium
PQISETQRQ

SEQ ID NO: 1168640 - protein, 25 aa, Mycobacterium
PQKEPARQKSDPLTAYNVTEIGGRR

SEQ ID NO: 1168641 - protein, 12 aa, Mycobacterium
PQLARSSQHPGN

SEQ ID NO: 1168642 - protein, 20 aa, Mycobacterium
PQLPRTDTGKLYKQELIKKY

SEQ ID NO: 1168643 - protein, 10 aa, Mycobacterium
PQPAQPGGSY

SEQ ID NO: 1168644 - protein, 9 aa, Mycobacterium
PQPASIRTG

SEQ ID NO: 1168645 - protein, 14 aa, Mycobacterium
PQPDAADPVTGERY

SEQ ID NO: 1168646 - protein, 13 aa, Mycobacterium
PQPEEWGGGGQPY

SEQ ID NO: 1168647 - protein, 5 aa, Mycobacterium
PQPER

SEQ ID NO: 1168648 - protein, 14 aa, Mycobacterium
PQPGGADAKTAVTT

SEQ ID NO: 1168649 - protein, 7 aa, Mycobacterium
PQPHPSK

SEQ ID NO: 1168650 - protein, 4 aa, Mycobacterium
PQPI

SEQ ID NO: 1168651 - protein, 10 aa, Mycobacterium
PQPLQQTGGL

SEQ ID NO: 1168652 - protein, 10 aa, Mycobacterium
PQPPFDSGHV

SEQ ID NO: 1168653 - protein, 9 aa, Mycobacterium
PQPTADGCN

SEQ ID NO: 1168654 - protein, 10 aa, Mycobacterium
PQPVDSGAAA

SEQ ID NO: 1168655 - protein, 4 aa, Mycobacterium
PQQA

SEQ ID NO: 1168656 - protein, 7 aa, Mycobacterium
PQQPVNL

SEQ ID NO: 1168657 - protein, 8 aa, Mycobacterium
PQQYPPDE

SEQ ID NO: 1168658 - protein, 16 aa, Mycobacterium
PQRAKSANIRRAGRAS

SEQ ID NO: 1168659 - protein, 5 aa, Mycobacterium
PQRDD

SEQ ID NO: 1168660 - protein, 6 aa, Mycobacterium
PQRDGS

SEQ ID NO: 1168661 - protein, 13 aa, Mycobacterium
PQRDLADARKAYG

SEQ ID NO: 1168662 - protein, 5 aa, Mycobacterium
PQRDV

SEQ ID NO: 1168663 - protein, 4 aa, Mycobacterium
PQRE

SEQ ID NO: 1168664 - protein, 7 aa, Mycobacterium
PQRGPGE

SEQ ID NO: 1168665 - protein, 4 aa, Mycobacterium
PQRI

SEQ ID NO: 1168666 - protein, 10 aa, Mycobacterium
PQRKGDPIEF

SEQ ID NO: 1168667 - protein, 12 aa, Mycobacterium
PQRLPESLSTND

SEQ ID NO: 1168668 - protein, 12 aa, Mycobacterium
PQRSWEGNEPAE

SEQ ID NO: 1168669 - protein, 10 aa, Mycobacterium
PQSEDQRAAD

SEQ ID NO: 1168670 - protein, 8 aa, Mycobacterium
PQSNVSYT

SEQ ID NO: 1168671 - protein, 17 aa, Mycobacterium
PQSQPPAQPAPTSAAAM

SEQ ID NO: 1168672 - protein, 8 aa, Mycobacterium
PQSRRELA

SEQ ID NO: 1168673 - protein, 7 aa, Mycobacterium
PQSVNGL

SEQ ID NO: 1168674 - protein, 14 aa, Mycobacterium
PQSWKKPKPREDAE

SEQ ID NO: 1168675 - protein, 9 aa, Mycobacterium
PQTAQQLGG

SEQ ID NO: 1168676 - protein, 6 aa, Mycobacterium
PQTGRR

SEQ ID NO: 1168677 - protein, 10 aa, Mycobacterium
PQTNLPGGAR

SEQ ID NO: 1168678 - protein, 7 aa, Mycobacterium
PQTSSNI

SEQ ID NO: 1168679 - protein, 4 aa, Mycobacterium
PQVE

SEQ ID NO: 1168680 - protein, 5 aa, Mycobacterium
PQYPS

SEQ ID NO: 1168681 - protein, 4 aa, Mycobacterium
PRAA

SEQ ID NO: 1168682 - protein, 9 aa, Mycobacterium
PRAAPADEQ

SEQ ID NO: 1168683 - protein, 10 aa, Mycobacterium
PRADGRPGRW

SEQ ID NO: 1168684 - protein, 14 aa, Mycobacterium
PRAGYEPAAAAGDE

SEQ ID NO: 1168685 - protein, 5 aa, Mycobacterium
PRAKA

SEQ ID NO: 1168686 - protein, 10 aa, Mycobacterium
PRAKTDEDKL

SEQ ID NO: 1168687 - protein, 13 aa, Mycobacterium
PRASEAPGNPSGI

SEQ ID NO: 1168688 - protein, 8 aa, Mycobacterium
PRAVPSPG

SEQ ID NO: 1168689 - protein, 16 aa, Mycobacterium
PRDDTGYGHSPDDVGK

SEQ ID NO: 1168690 - protein, 17 aa, Mycobacterium
PRDGRFGSGPSKVRPEQ

SEQ ID NO: 1168691 - protein, 11 aa, Mycobacterium
PRDKPCGDGLT

SEQ ID NO: 1168692 - protein, 7 aa, Mycobacterium
PRDPDDP

SEQ ID NO: 1168693 - protein, 5 aa, Mycobacterium
PRDRS

SEQ ID NO: 1168694 - protein, 6 aa, Mycobacterium
PRDVTD

SEQ ID NO: 1168695 - protein, 4 aa, Mycobacterium
PREA

SEQ ID NO: 1168696 - protein, 5 aa, Mycobacterium
PREAE

SEQ ID NO: 1168697 - protein, 8 aa, Mycobacterium
PREATSAA

SEQ ID NO: 1168698 - protein, 4 aa, Mycobacterium
PREE

SEQ ID NO: 1168699 - protein, 6 aa, Mycobacterium
PREGEP

SEQ ID NO: 1168700 - protein, 6 aa, Mycobacterium
PRELST

SEQ ID NO: 1168701 - protein, 11 aa, Mycobacterium
PRENGTPPPHV

SEQ ID NO: 1168702 - protein, 19 aa, Mycobacterium
PREPAADRGVPFKDVKRNK

SEQ ID NO: 1168703 - protein, 16 aa, Mycobacterium
PRFGPDSAERHRRSGA

SEQ ID NO: 1168704 - protein, 5 aa, Mycobacterium
PRGAN

SEQ ID NO: 1168705 - protein, 7 aa, Mycobacterium
PRGAVDA

SEQ ID NO: 1168706 - protein, 8 aa, Mycobacterium
PRGDSPQN

SEQ ID NO: 1168707 - protein, 17 aa, Mycobacterium
PRGGTGKVLRNELRAHL

SEQ ID NO: 1168708 - protein, 5 aa, Mycobacterium
PRGPV

SEQ ID NO: 1168709 - protein, 11 aa, Mycobacterium
PRGPVDPTASV

SEQ ID NO: 1168710 - protein, 7 aa, Mycobacterium
PRGRPEL

SEQ ID NO: 1168711 - protein, 13 aa, Mycobacterium
PRGRRRDPRTQQD

SEQ ID NO: 1168712 - protein, 15 aa, Mycobacterium
PRHAGAEKKPAAELP

SEQ ID NO: 1168713 - protein, 7 aa, Mycobacterium
PRHGSAV

SEQ ID NO: 1168714 - protein, 14 aa, Mycobacterium
PRHTRAERGLTREE

SEQ ID NO: 1168715 - protein, 22 aa, Mycobacterium
PRIEHDPDAHRRQAWEGFTLSA

SEQ ID NO: 1168716 - protein, 4 aa, Mycobacterium
PRIG

SEQ ID NO: 1168717 - protein, 4 aa, Mycobacterium
PRKA

SEQ ID NO: 1168718 - protein, 14 aa, Mycobacterium
PRKAEPGATVNGAQ

SEQ ID NO: 1168719 - protein, 9 aa, Mycobacterium
PRKASSRRI

SEQ ID NO: 1168720 - protein, 5 aa, Mycobacterium
PRKEV

SEQ ID NO: 1168721 - protein, 13 aa, Mycobacterium
PRKPSRPERRDKS

SEQ ID NO: 1168722 - protein, 6 aa, Mycobacterium
PRLDNQ

SEQ ID NO: 1168723 - protein, 5 aa, Mycobacterium
PRLGD

SEQ ID NO: 1168724 - protein, 10 aa, Mycobacterium
PRLGDDGDFD

SEQ ID NO: 1168725 - protein, 6 aa, Mycobacterium
PRLGEH

SEQ ID NO: 1168726 - protein, 4 aa, Mycobacterium
PRLS

SEQ ID NO: 1168727 - protein, 11 aa, Mycobacterium
PRLTRATAEHA

SEQ ID NO: 1168728 - protein, 11 aa, Mycobacterium
PRLTSDADTGI

SEQ ID NO: 1168729 - protein, 13 aa, Mycobacterium
PRLTSREDEDVSA

SEQ ID NO: 1168730 - protein, 7 aa, Mycobacterium
PRMNTQQ

SEQ ID NO: 1168731 - protein, 4 aa, Mycobacterium
PRNA

SEQ ID NO: 1168732 - protein, 6 aa, Mycobacterium
PRNATG

SEQ ID NO: 1168733 - protein, 10 aa, Mycobacterium
PRNKAPIADV

SEQ ID NO: 1168734 - protein, 8 aa, Mycobacterium
PRNKPSDT

SEQ ID NO: 1168735 - protein, 6 aa, Mycobacterium
PRNNET

SEQ ID NO: 1168736 - protein, 16 aa, Mycobacterium
PRNPGGKVVKPLLRKR

SEQ ID NO: 1168737 - protein, 6 aa, Mycobacterium
PRNQSS

SEQ ID NO: 1168738 - protein, 10 aa, Mycobacterium
PRNSRPRDAL

SEQ ID NO: 1168739 - protein, 6 aa, Mycobacterium
PRNTDL

SEQ ID NO: 1168740 - protein, 6 aa, Mycobacterium
PRPDAR

SEQ ID NO: 1168741 - protein, 7 aa, Mycobacterium
PRPDDGL

SEQ ID NO: 1168742 - protein, 5 aa, Mycobacterium
PRPET

SEQ ID NO: 1168743 - protein, 7 aa, Mycobacterium
PRPEVTD

SEQ ID NO: 1168744 - protein, 9 aa, Mycobacterium
PRPGWAEAD

SEQ ID NO: 1168745 - protein, 4 aa, Mycobacterium
PRPI

SEQ ID NO: 1168746 - protein, 7 aa, Mycobacterium
PRPLPGR

SEQ ID NO: 1168747 - protein, 8 aa, Mycobacterium
PRPLPTPA

SEQ ID NO: 1168748 - protein, 4 aa, Mycobacterium
PRPQ

SEQ ID NO: 1168749 - protein, 8 aa, Mycobacterium
PRPSGDRA

SEQ ID NO: 1168750 - protein, 17 aa, Mycobacterium
PRPSMRSRRRRLSTPAP

SEQ ID NO: 1168751 - protein, 10 aa, Mycobacterium
PRPVTPDGRP

SEQ ID NO: 1168752 - protein, 8 aa, Mycobacterium
PRQSAPDW

SEQ ID NO: 1168753 - protein, 7 aa, Mycobacterium
PRRAGGE

SEQ ID NO: 1168754 - protein, 9 aa, Mycobacterium
PRRAKPPRH

SEQ ID NO: 1168755 - protein, 7 aa, Mycobacterium
PRRAPKK

SEQ ID NO: 1168756 - protein, 10 aa, Mycobacterium
PRRARTSFAP

SEQ ID NO: 1168757 - protein, 7 aa, Mycobacterium
PRRDDVA

SEQ ID NO: 1168758 - protein, 7 aa, Mycobacterium
PRRDESF

SEQ ID NO: 1168759 - protein, 8 aa, Mycobacterium
PRRDGGER

SEQ ID NO: 1168760 - protein, 8 aa, Mycobacterium
PRREDPRD

SEQ ID NO: 1168761 - protein, 7 aa, Mycobacterium
PRRESAR

SEQ ID NO: 1168762 - protein, 10 aa, Mycobacterium
PRRGGKALRP

SEQ ID NO: 1168763 - protein, 5 aa, Mycobacterium
PRRGI

SEQ ID NO: 1168764 - protein, 4 aa, Mycobacterium
PRRH

SEQ ID NO: 1168765 - protein, 18 aa, Mycobacterium
PRRRADRRPYRAQPLPEG

SEQ ID NO: 1168766 - protein, 7 aa, Mycobacterium
PRRRPAH

SEQ ID NO: 1168767 - protein, 8 aa, Mycobacterium
PRRRSDQM

SEQ ID NO: 1168768 - protein, 18 aa, Mycobacterium
PRRRTDRRRYSSREVSPA

SEQ ID NO: 1168769 - protein, 6 aa, Mycobacterium
PRRSQR

SEQ ID NO: 1168770 - protein, 4 aa, Mycobacterium
PRRT

SEQ ID NO: 1168771 - protein, 9 aa, Mycobacterium
PRRTETARE

SEQ ID NO: 1168772 - protein, 4 aa, Mycobacterium
PRRY

SEQ ID NO: 1168773 - protein, 4 aa, Mycobacterium
PRSA

SEQ ID NO: 1168774 - protein, 7 aa, Mycobacterium
PRSECGG

SEQ ID NO: 1168775 - protein, 13 aa, Mycobacterium
PRSGNWNPDASAR

SEQ ID NO: 1168776 - protein, 7 aa, Mycobacterium
PRSLPRG

SEQ ID NO: 1168777 - protein, 11 aa, Mycobacterium
PRSNRSSAINR

SEQ ID NO: 1168778 - protein, 5 aa, Mycobacterium
PRSRE

SEQ ID NO: 1168779 - protein, 9 aa, Mycobacterium
PRSRGGDHS

SEQ ID NO: 1168780 - protein, 21 aa, Mycobacterium
PRSTAAAFPGLARTAALVRLV

SEQ ID NO: 1168781 - protein, 8 aa, Mycobacterium
PRSVEQAE

SEQ ID NO: 1168782 - protein, 7 aa, Mycobacterium
PRTAAAA

SEQ ID NO: 1168783 - protein, 4 aa, Mycobacterium
PRTD

SEQ ID NO: 1168784 - protein, 11 aa, Mycobacterium
PRTGKTAARVR

SEQ ID NO: 1168785 - protein, 19 aa, Mycobacterium
PRTNVGAGGNYYNNSPKAL

SEQ ID NO: 1168786 - protein, 13 aa, Mycobacterium
PRTPTGKLVKGLL

SEQ ID NO: 1168787 - protein, 8 aa, Mycobacterium
PRTSVGKY

SEQ ID NO: 1168788 - protein, 13 aa, Mycobacterium
PRTVENTSGGHRV

SEQ ID NO: 1168789 - protein, 4 aa, Mycobacterium
PRVA

SEQ ID NO: 1168790 - protein, 13 aa, Mycobacterium
PRVPPTAVKPSSV

SEQ ID NO: 1168791 - protein, 9 aa, Mycobacterium
PRYQPPGEL

SEQ ID NO: 1168792 - protein, 16 aa, Mycobacterium
PRYSGAEALSSLAKAF

SEQ ID NO: 1168793 - protein, 5 aa, Mycobacterium
PSAAP

SEQ ID NO: 1168794 - protein, 11 aa, Mycobacterium
PSADELPKDPA

SEQ ID NO: 1168795 - protein, 4 aa, Mycobacterium
PSAE

SEQ ID NO: 1168796 - protein, 7 aa, Mycobacterium
PSAEEYQ

SEQ ID NO: 1168797 - protein, 4 aa, Mycobacterium
PSAF

SEQ ID NO: 1168798 - protein, 9 aa, Mycobacterium
PSAGGGGKG

SEQ ID NO: 1168799 - protein, 9 aa, Mycobacterium
PSAGGVDGE

SEQ ID NO: 1168800 - protein, 11 aa, Mycobacterium
PSAGLHPADAE

SEQ ID NO: 1168801 - protein, 13 aa, Mycobacterium
PSAIEPNPRQPRQ

SEQ ID NO: 1168802 - protein, 4 aa, Mycobacterium
PSAL

SEQ ID NO: 1168803 - protein, 7 aa, Mycobacterium
PSANPYL

SEQ ID NO: 1168804 - protein, 13 aa, Mycobacterium
PSAQAGRAQGRRV

SEQ ID NO: 1168805 - protein, 6 aa, Mycobacterium
PSARRR

SEQ ID NO: 1168806 - protein, 14 aa, Mycobacterium
PSASLEGAHPRENA

SEQ ID NO: 1168807 - protein, 7 aa, Mycobacterium
PSASQTD

SEQ ID NO: 1168808 - protein, 16 aa, Mycobacterium
PSASTVASTAHDRDAK

SEQ ID NO: 1168809 - protein, 11 aa, Mycobacterium
PSATAATDRGL

SEQ ID NO: 1168810 - protein, 13 aa, Mycobacterium
PSATQNEINGADA

SEQ ID NO: 1168811 - protein, 10 aa, Mycobacterium
PSAVASSVGD

SEQ ID NO: 1168812 - protein, 6 aa, Mycobacterium
PSAVPG

SEQ ID NO: 1168813 - protein, 9 aa, Mycobacterium
PSAYTAEQR

SEQ ID NO: 1168814 - protein, 8 aa, Mycobacterium
PSDEEFAE

SEQ ID NO: 1168815 - protein, 4 aa, Mycobacterium
PSDI

SEQ ID NO: 1168816 - protein, 6 aa, Mycobacterium
PSDPDE

SEQ ID NO: 1168817 - protein, 6 aa, Mycobacterium
PSDRAA

SEQ ID NO: 1168818 - protein, 4 aa, Mycobacterium
PSDT

SEQ ID NO: 1168819 - protein, 12 aa, Mycobacterium
PSDTAAYDEASE

SEQ ID NO: 1168820 - protein, 8 aa, Mycobacterium
PSDWPEGK

SEQ ID NO: 1168821 - protein, 6 aa, Mycobacterium
PSEGSA

SEQ ID NO: 1168822 - protein, 8 aa, Mycobacterium
PSEHGYAR

SEQ ID NO: 1168823 - protein, 11 aa, Mycobacterium
PSELTASDANL

SEQ ID NO: 1168824 - protein, 9 aa, Mycobacterium
PSESRHEQR

SEQ ID NO: 1168825 - protein, 15 aa, Mycobacterium
PSETTPSLPECNGAA

SEQ ID NO: 1168826 - protein, 11 aa, Mycobacterium
PSFDPPKHTAH

SEQ ID NO: 1168827 - protein, 20 aa, Mycobacterium
PSFSERSVNEGFSGGEKKRH

SEQ ID NO: 1168828 - protein, 10 aa, Mycobacterium
PSGAADGAQF

SEQ ID NO: 1168829 - protein, 10 aa, Mycobacterium
PSGAGKTTTL

SEQ ID NO: 1168830 - protein, 10 aa, Mycobacterium
PSGAYSPDAA

SEQ ID NO: 1168831 - protein, 18 aa, Mycobacterium
PSGKQGAGSNRDGAAGAD

SEQ ID NO: 1168832 - protein, 4 aa, Mycobacterium
PSGL

SEQ ID NO: 1168833 - protein, 10 aa, Mycobacterium
PSGLSPDDNL

SEQ ID NO: 1168834 - protein, 16 aa, Mycobacterium
PSGRQQGSKCPGRGSP

SEQ ID NO: 1168835 - protein, 11 aa, Mycobacterium
PSGSAAGDGKP

SEQ ID NO: 1168836 - protein, 10 aa, Mycobacterium
PSGSDADLTE

SEQ ID NO: 1168837 - protein, 12 aa, Mycobacterium
PSGSDSTGRPGN

SEQ ID NO: 1168838 - protein, 9 aa, Mycobacterium
PSGSGKSTA

SEQ ID NO: 1168839 - protein, 8 aa, Mycobacterium
PSGTEPKV

SEQ ID NO: 1168840 - protein, 6 aa, Mycobacterium
PSGTGD

SEQ ID NO: 1168841 - protein, 5 aa, Mycobacterium
PSGTS

SEQ ID NO: 1168842 - protein, 15 aa, Mycobacterium
PSGTTLAAPSPSDLQ

SEQ ID NO: 1168843 - protein, 4 aa, Mycobacterium
PSGW

SEQ ID NO: 1168844 - protein, 8 aa, Mycobacterium
PSHDPEAT

SEQ ID NO: 1168845 - protein, 5 aa, Mycobacterium
PSHEQ

SEQ ID NO: 1168846 - protein, 9 aa, Mycobacterium
PSHSGGPSD

SEQ ID NO: 1168847 - protein, 10 aa, Mycobacterium
PSKDEFQSAA

SEQ ID NO: 1168848 - protein, 8 aa, Mycobacterium
PSKLGSPI

SEQ ID NO: 1168849 - protein, 13 aa, Mycobacterium
PSKTLNETLESAS

SEQ ID NO: 1168850 - protein, 17 aa, Mycobacterium
PSLHPEPADEATGPERS

SEQ ID NO: 1168851 - protein, 4 aa, Mycobacterium
PSLN

SEQ ID NO: 1168852 - protein, 14 aa, Mycobacterium
PSLPANGRIPPKAA

SEQ ID NO: 1168853 - protein, 8 aa, Mycobacterium
PSLPPHRR

SEQ ID NO: 1168854 - protein, 10 aa, Mycobacterium
PSLSPQDSLG

SEQ ID NO: 1168855 - protein, 8 aa, Mycobacterium
PSLTPAEA

SEQ ID NO: 1168856 - protein, 5 aa, Mycobacterium
PSNRY

SEQ ID NO: 1168857 - protein, 5 aa, Mycobacterium
PSNSR

SEQ ID NO: 1168858 - protein, 8 aa, Mycobacterium
PSPAPDRG

SEQ ID NO: 1168859 - protein, 6 aa, Mycobacterium
PSPDAL

SEQ ID NO: 1168860 - protein, 9 aa, Mycobacterium
PSPESLDPE

SEQ ID NO: 1168861 - protein, 7 aa, Mycobacterium
PSPPTTF

SEQ ID NO: 1168862 - protein, 6 aa, Mycobacterium
PSPTAA

SEQ ID NO: 1168863 - protein, 6 aa, Mycobacterium
PSPTQT

SEQ ID NO: 1168864 - protein, 4 aa, Mycobacterium
PSPV

SEQ ID NO: 1168865 - protein, 14 aa, Mycobacterium
PSPVAKPATVAPDA

SEQ ID NO: 1168866 - protein, 5 aa, Mycobacterium
PSPVG

SEQ ID NO: 1168867 - protein, 8 aa, Mycobacterium
PSQDDAVR

SEQ ID NO: 1168868 - protein, 5 aa, Mycobacterium
PSRAE

SEQ ID NO: 1168869 - protein, 7 aa, Mycobacterium
PSREPKF

SEQ ID NO: 1168870 - protein, 13 aa, Mycobacterium
PSRLDASTREMAA

SEQ ID NO: 1168871 - protein, 10 aa, Mycobacterium
PSRLRPGALE

SEQ ID NO: 1168872 - protein, 5 aa, Mycobacterium
PSRPQ

SEQ ID NO: 1168873 - protein, 17 aa, Mycobacterium
PSRPTPRPALNGTGPRE

SEQ ID NO: 1168874 - protein, 11 aa, Mycobacterium
PSRPYRGVPPS

SEQ ID NO: 1168875 - protein, 4 aa, Mycobacterium
PSSD

SEQ ID NO: 1168876 - protein, 9 aa, Mycobacterium
PSSEDLDEP

SEQ ID NO: 1168877 - protein, 6 aa, Mycobacterium
PSSPHV

SEQ ID NO: 1168878 - protein, 9 aa, Mycobacterium
PSSPPTPPR

SEQ ID NO: 1168879 - protein, 7 aa, Mycobacterium
PSSRDLT

SEQ ID NO: 1168880 - protein, 11 aa, Mycobacterium
PSSSTVSTAQE

SEQ ID NO: 1168881 - protein, 8 aa, Mycobacterium
PSSSVTAT

SEQ ID NO: 1168882 - protein, 4 aa, Mycobacterium
PSST

SEQ ID NO: 1168883 - protein, 6 aa, Mycobacterium
PSTANH

SEQ ID NO: 1168884 - protein, 5 aa, Mycobacterium
PSTAQ

SEQ ID NO: 1168885 - protein, 11 aa, Mycobacterium
PSTASTGERGV

SEQ ID NO: 1168886 - protein, 12 aa, Mycobacterium
PSTAVRTPGASQ

SEQ ID NO: 1168887 - protein, 5 aa, Mycobacterium
PSTDR

SEQ ID NO: 1168888 - protein, 5 aa, Mycobacterium
PSTGE

SEQ ID NO: 1168889 - protein, 5 aa, Mycobacterium
PSTGR

SEQ ID NO: 1168890 - protein, 13 aa, Mycobacterium
PSTQGAKFDPDGT

SEQ ID NO: 1168891 - protein, 4 aa, Mycobacterium
PSTT

SEQ ID NO: 1168892 - protein, 5 aa, Mycobacterium
PSTVD

SEQ ID NO: 1168893 - protein, 5 aa, Mycobacterium
PSVAG

SEQ ID NO: 1168894 - protein, 7 aa, Mycobacterium
PSVATED

SEQ ID NO: 1168895 - protein, 14 aa, Mycobacterium
PSVPRRGRDQRPYA

SEQ ID NO: 1168896 - protein, 10 aa, Mycobacterium
PSVSDNKKTV

SEQ ID NO: 1168897 - protein, 5 aa, Mycobacterium
PSVTA

SEQ ID NO: 1168898 - protein, 6 aa, Mycobacterium
PSVTTT

SEQ ID NO: 1168899 - protein, 5 aa, Mycobacterium
PSWDD

SEQ ID NO: 1168900 - protein, 11 aa, Mycobacterium
PSWSGDKAKRR

SEQ ID NO: 1168901 - protein, 7 aa, Mycobacterium
PSYAGNP

SEQ ID NO: 1168902 - protein, 9 aa, Mycobacterium
PSYDPLDGD

SEQ ID NO: 1168903 - protein, 7 aa, Mycobacterium
PSYETTF

SEQ ID NO: 1168904 - protein, 28 aa, Mycobacterium
PSYRAAARSAAATAGQVTDPVQVCHRAL

SEQ ID NO: 1168905 - protein, 7 aa, Mycobacterium
PSYSPGE

SEQ ID NO: 1168906 - protein, 19 aa, Mycobacterium
PTAAERGPVIGTTANRSHR

SEQ ID NO: 1168907 - protein, 5 aa, Mycobacterium
PTADD

SEQ ID NO: 1168908 - protein, 6 aa, Mycobacterium
PTADPT

SEQ ID NO: 1168909 - protein, 21 aa, Mycobacterium
PTAEAPIQPTKNTKDTTTDRG

SEQ ID NO: 1168910 - protein, 6 aa, Mycobacterium
PTAEVD

SEQ ID NO: 1168911 - protein, 16 aa, Mycobacterium
PTAGAAALTRFWESLD

SEQ ID NO: 1168912 - protein, 9 aa, Mycobacterium
PTAGGRANL

SEQ ID NO: 1168913 - protein, 12 aa, Mycobacterium
PTAGIDRTPAVQ

SEQ ID NO: 1168914 - protein, 7 aa, Mycobacterium
PTAGPVD

SEQ ID NO: 1168915 - protein, 10 aa, Mycobacterium
PTAKDRHGNP

SEQ ID NO: 1168916 - protein, 14 aa, Mycobacterium
PTALEPRAISEEKN

SEQ ID NO: 1168917 - protein, 8 aa, Mycobacterium
PTANLDPA

SEQ ID NO: 1168918 - protein, 9 aa, Mycobacterium
PTAPASTGL

SEQ ID NO: 1168919 - protein, 6 aa, Mycobacterium
PTAPGL

SEQ ID NO: 1168920 - protein, 7 aa, Mycobacterium
PTAPTLS

SEQ ID NO: 1168921 - protein, 5 aa, Mycobacterium
PTAPV

SEQ ID NO: 1168922 - protein, 5 aa, Mycobacterium
PTARD

SEQ ID NO: 1168923 - protein, 7 aa, Mycobacterium
PTARGRS

SEQ ID NO: 1168924 - protein, 6 aa, Mycobacterium
PTARRK

SEQ ID NO: 1168925 - protein, 10 aa, Mycobacterium
PTASFAEQRT

SEQ ID NO: 1168926 - protein, 7 aa, Mycobacterium
PTDAPAW

SEQ ID NO: 1168927 - protein, 5 aa, Mycobacterium
PTDEQ

SEQ ID NO: 1168928 - protein, 4 aa, Mycobacterium
PTDG

SEQ ID NO: 1168929 - protein, 8 aa, Mycobacterium
PTDHRPVA

SEQ ID NO: 1168930 - protein, 14 aa, Mycobacterium
PTDLSDPGGASKLG

SEQ ID NO: 1168931 - protein, 6 aa, Mycobacterium
PTDPGV

SEQ ID NO: 1168932 - protein, 9 aa, Mycobacterium
PTDPTPTVG

SEQ ID NO: 1168933 - protein, 5 aa, Mycobacterium
PTDRE

SEQ ID NO: 1168934 - protein, 4 aa, Mycobacterium
PTDV

SEQ ID NO: 1168935 - protein, 8 aa, Mycobacterium
PTEAEARE

SEQ ID NO: 1168936 - protein, 8 aa, Mycobacterium
PTEPTPRN

SEQ ID NO: 1168937 - protein, 16 aa, Mycobacterium
PTESAKERDAQSAAAA

SEQ ID NO: 1168938 - protein, 9 aa, Mycobacterium
PTESESLSE

SEQ ID NO: 1168939 - protein, 4 aa, Mycobacterium
PTEV

SEQ ID NO: 1168940 - protein, 9 aa, Mycobacterium
PTFGQDRNT

SEQ ID NO: 1168941 - protein, 6 aa, Mycobacterium
PTFTDA

SEQ ID NO: 1168942 - protein, 4 aa, Mycobacterium
PTGA

SEQ ID NO: 1168943 - protein, 6 aa, Mycobacterium
PTGDHS

SEQ ID NO: 1168944 - protein, 5 aa, Mycobacterium
PTGEH

SEQ ID NO: 1168945 - protein, 4 aa, Mycobacterium
PTGF

SEQ ID NO: 1168946 - protein, 4 aa, Mycobacterium
PTGG

SEQ ID NO: 1168947 - protein, 4 aa, Mycobacterium
PTGI

SEQ ID NO: 1168948 - protein, 5 aa, Mycobacterium
PTGIY

SEQ ID NO: 1168949 - protein, 7 aa, Mycobacterium
PTGPAEL

SEQ ID NO: 1168950 - protein, 11 aa, Mycobacterium
PTGPGADGNLP

SEQ ID NO: 1168951 - protein, 21 aa, Mycobacterium
PTGPTEDGSQAALGGPRMGNA

SEQ ID NO: 1168952 - protein, 5 aa, Mycobacterium
PTGRN

SEQ ID NO: 1168953 - protein, 9 aa, Mycobacterium
PTGSGKSAI

SEQ ID NO: 1168954 - protein, 6 aa, Mycobacterium
PTGSHC

SEQ ID NO: 1168955 - protein, 4 aa, Mycobacterium
PTGV

SEQ ID NO: 1168956 - protein, 12 aa, Mycobacterium
PTGVETGMRPDS

SEQ ID NO: 1168957 - protein, 7 aa, Mycobacterium
PTKNLNG

SEQ ID NO: 1168958 - protein, 14 aa, Mycobacterium
PTKVHTPDVPGNFD

SEQ ID NO: 1168959 - protein, 14 aa, Mycobacterium
PTLADLTPDTLRRV

SEQ ID NO: 1168960 - protein, 4 aa, Mycobacterium
PTLD

SEQ ID NO: 1168961 - protein, 5 aa, Mycobacterium
PTLEP

SEQ ID NO: 1168962 - protein, 7 aa, Mycobacterium
PTLPNPV

SEQ ID NO: 1168963 - protein, 7 aa, Mycobacterium
PTLPTAA

SEQ ID NO: 1168964 - protein, 8 aa, Mycobacterium
PTLSDDED

SEQ ID NO: 1168965 - protein, 6 aa, Mycobacterium
PTMQGT

SEQ ID NO: 1168966 - protein, 12 aa, Mycobacterium
PTMTRSTPEGAR

SEQ ID NO: 1168967 - protein, 9 aa, Mycobacterium
PTNDSDINE

SEQ ID NO: 1168968 - protein, 11 aa, Mycobacterium
PTNNLDADARN

SEQ ID NO: 1168969 - protein, 4 aa, Mycobacterium
PTNP

SEQ ID NO: 1168970 - protein, 11 aa, Mycobacterium
PTPAVGGVPTD

SEQ ID NO: 1168971 - protein, 6 aa, Mycobacterium
PTPHLS

SEQ ID NO: 1168972 - protein, 4 aa, Mycobacterium
PTPL

SEQ ID NO: 1168973 - protein, 6 aa, Mycobacterium
PTPNSY

SEQ ID NO: 1168974 - protein, 13 aa, Mycobacterium
PTPPPPPKPAEQA

SEQ ID NO: 1168975 - protein, 6 aa, Mycobacterium
PTPPRL

SEQ ID NO: 1168976 - protein, 11 aa, Mycobacterium
PTPQPATPDAV

SEQ ID NO: 1168977 - protein, 10 aa, Mycobacterium
PTPQRRRANA

SEQ ID NO: 1168978 - protein, 8 aa, Mycobacterium
PTPRPAKG

SEQ ID NO: 1168979 - protein, 15 aa, Mycobacterium
PTPRSTRLGQDREGL

SEQ ID NO: 1168980 - protein, 6 aa, Mycobacterium
PTPRTD

SEQ ID NO: 1168981 - protein, 10 aa, Mycobacterium
PTPSATAAAG

SEQ ID NO: 1168982 - protein, 7 aa, Mycobacterium
PTPSNDV

SEQ ID NO: 1168983 - protein, 12 aa, Mycobacterium
PTPTKPGREAPG

SEQ ID NO: 1168984 - protein, 7 aa, Mycobacterium
PTQDTCS

SEQ ID NO: 1168985 - protein, 7 aa, Mycobacterium
PTQEQSV

SEQ ID NO: 1168986 - protein, 4 aa, Mycobacterium
PTQF

SEQ ID NO: 1168987 - protein, 7 aa, Mycobacterium
PTQNGGG

SEQ ID NO: 1168988 - protein, 11 aa, Mycobacterium
PTRADALTDEA

SEQ ID NO: 1168989 - protein, 5 aa, Mycobacterium
PTRDA

SEQ ID NO: 1168990 - protein, 7 aa, Mycobacterium
PTRDEAL

SEQ ID NO: 1168991 - protein, 11 aa, Mycobacterium
PTRGGSPDADA

SEQ ID NO: 1168992 - protein, 7 aa, Mycobacterium
PTRGVDV

SEQ ID NO: 1168993 - protein, 9 aa, Mycobacterium
PTRPTRDEW

SEQ ID NO: 1168994 - protein, 7 aa, Mycobacterium
PTRTEEV

SEQ ID NO: 1168995 - protein, 5 aa, Mycobacterium
PTRTY

SEQ ID NO: 1168996 - protein, 5 aa, Mycobacterium
PTRVD

SEQ ID NO: 1168997 - protein, 10 aa, Mycobacterium
PTSAISEREV

SEQ ID NO: 1168998 - protein, 11 aa, Mycobacterium
PTSDARIPQAV

SEQ ID NO: 1168999 - protein, 18 aa, Mycobacterium
PTSENLTDRTATDTSEEG

SEQ ID NO: 1169000 - protein, 11 aa, Mycobacterium
PTSGAYSAAKA

SEQ ID NO: 1169001 - protein, 11 aa, Mycobacterium
PTSGLDPVNAR

SEQ ID NO: 1169002 - protein, 15 aa, Mycobacterium
PTSGTLTVDGNDVTK

SEQ ID NO: 1169003 - protein, 5 aa, Mycobacterium
PTSLA

SEQ ID NO: 1169004 - protein, 10 aa, Mycobacterium
PTSRKGDHNH

SEQ ID NO: 1169005 - protein, 8 aa, Mycobacterium
PTSSLPGV

SEQ ID NO: 1169006 - protein, 10 aa, Mycobacterium
PTSSPGPVTE

SEQ ID NO: 1169007 - protein, 6 aa, Mycobacterium
PTSTDA

SEQ ID NO: 1169008 - protein, 11 aa, Mycobacterium
PTTAPGEKVHS

SEQ ID NO: 1169009 - protein, 15 aa, Mycobacterium
PTTDEATAADVEPRE

SEQ ID NO: 1169010 - protein, 8 aa, Mycobacterium
PTTEIERD

SEQ ID NO: 1169011 - protein, 5 aa, Mycobacterium
PTTGE

SEQ ID NO: 1169012 - protein, 10 aa, Mycobacterium
PTTGLDATTG

SEQ ID NO: 1169013 - protein, 11 aa, Mycobacterium
PTTGLDPRSRQ

SEQ ID NO: 1169014 - protein, 6 aa, Mycobacterium
PTTGLH

SEQ ID NO: 1169015 - protein, 12 aa, Mycobacterium
PTTLHDPSEGVN

SEQ ID NO: 1169016 - protein, 7 aa, Mycobacterium
PTTNPVS

SEQ ID NO: 1169017 - protein, 35 aa, Mycobacterium
PTTPAAAAPTTGTVTGDRNAKMPQRRRTRAQNRAA

SEQ ID NO: 1169018 - protein, 7 aa, Mycobacterium
PTTPGSR

SEQ ID NO: 1169019 - protein, 5 aa, Mycobacterium
PTTRP

SEQ ID NO: 1169020 - protein, 7 aa, Mycobacterium
PTTTAAR

SEQ ID NO: 1169021 - protein, 6 aa, Mycobacterium
PTTYGA

SEQ ID NO: 1169022 - protein, 5 aa, Mycobacterium
PTVEN

SEQ ID NO: 1169023 - protein, 7 aa, Mycobacterium
PTVGTPV

SEQ ID NO: 1169024 - protein, 4 aa, Mycobacterium
PTVP

SEQ ID NO: 1169025 - protein, 5 aa, Mycobacterium
PTVPV

SEQ ID NO: 1169026 - protein, 12 aa, Mycobacterium
PTVRGGASNPYT

SEQ ID NO: 1169027 - protein, 6 aa, Mycobacterium
PTYPED

SEQ ID NO: 1169028 - protein, 8 aa, Mycobacterium
PVAAPTAR

SEQ ID NO: 1169029 - protein, 17 aa, Mycobacterium
PVAGTDTEHREPATTVT

SEQ ID NO: 1169030 - protein, 5 aa, Mycobacterium
PVANE

SEQ ID NO: 1169031 - protein, 8 aa, Mycobacterium
PVANGETV

SEQ ID NO: 1169032 - protein, 4 aa, Mycobacterium
PVAP

SEQ ID NO: 1169033 - protein, 11 aa, Mycobacterium
PVAPPDTTGHH

SEQ ID NO: 1169034 - protein, 12 aa, Mycobacterium
PVAPPGTPEDGY

SEQ ID NO: 1169035 - protein, 18 aa, Mycobacterium
PVATGATDPAAPPPPPQI

SEQ ID NO: 1169036 - protein, 5 aa, Mycobacterium
PVDAA

SEQ ID NO: 1169037 - protein, 8 aa, Mycobacterium
PVDDATQA

SEQ ID NO: 1169038 - protein, 5 aa, Mycobacterium
PVDEP

SEQ ID NO: 1169039 - protein, 8 aa, Mycobacterium
PVDERTSD

SEQ ID NO: 1169040 - protein, 7 aa, Mycobacterium
PVDEWAD

SEQ ID NO: 1169041 - protein, 7 aa, Mycobacterium
PVDGDGA

SEQ ID NO: 1169042 - protein, 9 aa, Mycobacterium
PVDNDDDLA

SEQ ID NO: 1169043 - protein, 12 aa, Mycobacterium
PVDPGGGTPDLA

SEQ ID NO: 1169044 - protein, 4 aa, Mycobacterium
PVDR

SEQ ID NO: 1169045 - protein, 5 aa, Mycobacterium
PVDTT

SEQ ID NO: 1169046 - protein, 6 aa, Mycobacterium
PVEAGR

SEQ ID NO: 1169047 - protein, 5 aa, Mycobacterium
PVEQG

SEQ ID NO: 1169048 - protein, 5 aa, Mycobacterium
PVEQT

SEQ ID NO: 1169049 - protein, 5 aa, Mycobacterium
PVETT

SEQ ID NO: 1169050 - protein, 14 aa, Mycobacterium
PVGASISQTRRRDR

SEQ ID NO: 1169051 - protein, 9 aa, Mycobacterium
PVGDPGWFG

SEQ ID NO: 1169052 - protein, 10 aa, Mycobacterium
PVGDQGGDIA

SEQ ID NO: 1169053 - protein, 4 aa, Mycobacterium
PVGG

SEQ ID NO: 1169054 - protein, 8 aa, Mycobacterium
PVGGRPKI

SEQ ID NO: 1169055 - protein, 9 aa, Mycobacterium
PVGKPERLR

SEQ ID NO: 1169056 - protein, 6 aa, Mycobacterium
PVGNPP

SEQ ID NO: 1169057 - protein, 6 aa, Mycobacterium
PVGNVD

SEQ ID NO: 1169058 - protein, 4 aa, Mycobacterium
PVGP

SEQ ID NO: 1169059 - protein, 8 aa, Mycobacterium
PVGPGVDE

SEQ ID NO: 1169060 - protein, 13 aa, Mycobacterium
PVGRSTSDGKALS

SEQ ID NO: 1169061 - protein, 7 aa, Mycobacterium
PVGTDPR

SEQ ID NO: 1169062 - protein, 7 aa, Mycobacterium
PVHTPDA

SEQ ID NO: 1169063 - protein, 7 aa, Mycobacterium
PVKGGGF

SEQ ID NO: 1169064 - protein, 12 aa, Mycobacterium
PVKPGSATVPMP

SEQ ID NO: 1169065 - protein, 6 aa, Mycobacterium
PVNDLS

SEQ ID NO: 1169066 - protein, 4 aa, Mycobacterium
PVNG

SEQ ID NO: 1169067 - protein, 7 aa, Mycobacterium
PVNPSGG

SEQ ID NO: 1169068 - protein, 11 aa, Mycobacterium
PVPADHGGAPR

SEQ ID NO: 1169069 - protein, 9 aa, Mycobacterium
PVPAPDGHT

SEQ ID NO: 1169070 - protein, 17 aa, Mycobacterium
PVPAPGEDDPQGRRERC

SEQ ID NO: 1169071 - protein, 26 aa, Mycobacterium
PVPATDGRQDGSDELPPEDAVVGGST

SEQ ID NO: 1169072 - protein, 7 aa, Mycobacterium
PVPATEA

SEQ ID NO: 1169073 - protein, 9 aa, Mycobacterium
PVPDDAPAI

SEQ ID NO: 1169074 - protein, 7 aa, Mycobacterium
PVPDSSD

SEQ ID NO: 1169075 - protein, 7 aa, Mycobacterium
PVPGGAV

SEQ ID NO: 1169076 - protein, 4 aa, Mycobacterium
PVPI

SEQ ID NO: 1169077 - protein, 7 aa, Mycobacterium
PVPLSEG

SEQ ID NO: 1169078 - protein, 10 aa, Mycobacterium
PVPNTSDNEY

SEQ ID NO: 1169079 - protein, 7 aa, Mycobacterium
PVPPPVA

SEQ ID NO: 1169080 - protein, 14 aa, Mycobacterium
PVPRSARSRRRPTI

SEQ ID NO: 1169081 - protein, 7 aa, Mycobacterium
PVQDGQP

SEQ ID NO: 1169082 - protein, 13 aa, Mycobacterium
PVQTGVSTDHQSV

SEQ ID NO: 1169083 - protein, 4 aa, Mycobacterium
PVRA

SEQ ID NO: 1169084 - protein, 11 aa, Mycobacterium
PVRAKSGDYRQ

SEQ ID NO: 1169085 - protein, 8 aa, Mycobacterium
PVRGDTQR

SEQ ID NO: 1169086 - protein, 14 aa, Mycobacterium
PVRNQEAPPAAPHL

SEQ ID NO: 1169087 - protein, 11 aa, Mycobacterium
PVRQRGAPGLP

SEQ ID NO: 1169088 - protein, 22 aa, Mycobacterium
PVRRPEPTGRRRGHLRVLPDPA

SEQ ID NO: 1169089 - protein, 15 aa, Mycobacterium
PVRRTQAQRTAETRS

SEQ ID NO: 1169090 - protein, 16 aa, Mycobacterium
PVRSSGMTPYVTRLIE

SEQ ID NO: 1169091 - protein, 4 aa, Mycobacterium
PVSA

SEQ ID NO: 1169092 - protein, 8 aa, Mycobacterium
PVSDRRDE

SEQ ID NO: 1169093 - protein, 9 aa, Mycobacterium
PVSDTAPDR

SEQ ID NO: 1169094 - protein, 10 aa, Mycobacterium
PVSGEAARKL

SEQ ID NO: 1169095 - protein, 13 aa, Mycobacterium
PVSGGAGAAEKGE

SEQ ID NO: 1169096 - protein, 11 aa, Mycobacterium
PVSGGAPAVEQ

SEQ ID NO: 1169097 - protein, 10 aa, Mycobacterium
PVSGGEAGAI

SEQ ID NO: 1169098 - protein, 7 aa, Mycobacterium
PVSKDEL

SEQ ID NO: 1169099 - protein, 26 aa, Mycobacterium
PVSRDSGKRTGRLPNPQALQSPTAPS

SEQ ID NO: 1169100 - protein, 10 aa, Mycobacterium
PVSSESVAAY

SEQ ID NO: 1169101 - protein, 9 aa, Mycobacterium
PVSSGAPLD

SEQ ID NO: 1169102 - protein, 4 aa, Mycobacterium
PVTA

SEQ ID NO: 1169103 - protein, 13 aa, Mycobacterium
PVTDRSEASGTGY

SEQ ID NO: 1169104 - protein, 14 aa, Mycobacterium
PVTEERDEDGRVRT

SEQ ID NO: 1169105 - protein, 4 aa, Mycobacterium
PVTG

SEQ ID NO: 1169106 - protein, 6 aa, Mycobacterium
PVTGAR

SEQ ID NO: 1169107 - protein, 19 aa, Mycobacterium
PVTGQEVHDESGAYPAPVA

SEQ ID NO: 1169108 - protein, 11 aa, Mycobacterium
PVTGRLPDPTF

SEQ ID NO: 1169109 - protein, 7 aa, Mycobacterium
PVTPGRR

SEQ ID NO: 1169110 - protein, 5 aa, Mycobacterium
PVTRE

SEQ ID NO: 1169111 - protein, 12 aa, Mycobacterium
PWAADGRLSPKS

SEQ ID NO: 1169112 - protein, 21 aa, Mycobacterium
PWGPDKITEDGREQLRALGFT

SEQ ID NO: 1169113 - protein, 9 aa, Mycobacterium
PWGRGAGPV

SEQ ID NO: 1169114 - protein, 10 aa, Mycobacterium
PWPPRGDPVE

SEQ ID NO: 1169115 - protein, 12 aa, Mycobacterium
PWPRGEQPRRAA

SEQ ID NO: 1169116 - protein, 6 aa, Mycobacterium
PWRAEE

SEQ ID NO: 1169117 - protein, 5 aa, Mycobacterium
PWSER

SEQ ID NO: 1169118 - protein, 19 aa, Mycobacterium
PWSPDVTPGGSSGGSAAAV

SEQ ID NO: 1169119 - protein, 12 aa, Mycobacterium
PYADAPGECGNT

SEQ ID NO: 1169120 - protein, 10 aa, Mycobacterium
PYADSRDDYT

SEQ ID NO: 1169121 - protein, 11 aa, Mycobacterium
PYAGGGPTQAA

SEQ ID NO: 1169122 - protein, 13 aa, Mycobacterium
PYAPQGVAKPVDG

SEQ ID NO: 1169123 - protein, 9 aa, Mycobacterium
PYAPTGGLR

SEQ ID NO: 1169124 - protein, 4 aa, Mycobacterium
PYAR

SEQ ID NO: 1169125 - protein, 5 aa, Mycobacterium
PYASE

SEQ ID NO: 1169126 - protein, 4 aa, Mycobacterium
PYDD

SEQ ID NO: 1169127 - protein, 6 aa, Mycobacterium
PYDGPV

SEQ ID NO: 1169128 - protein, 7 aa, Mycobacterium
PYDPSGR

SEQ ID NO: 1169129 - protein, 8 aa, Mycobacterium
PYDTDDEA

SEQ ID NO: 1169130 - protein, 12 aa, Mycobacterium
PYEGDGPGAAAH

SEQ ID NO: 1169131 - protein, 7 aa, Mycobacterium
PYEISSA

SEQ ID NO: 1169132 - protein, 7 aa, Mycobacterium
PYGQARQ

SEQ ID NO: 1169133 - protein, 6 aa, Mycobacterium
PYGQLG

SEQ ID NO: 1169134 - protein, 29 aa, Mycobacterium
PYGRQETWEDSPAGWPQRPPYEWIRLHDA

SEQ ID NO: 1169135 - protein, 10 aa, Mycobacterium
PYHGGPGNNY

SEQ ID NO: 1169136 - protein, 6 aa, Mycobacterium
PYIPEG

SEQ ID NO: 1169137 - protein, 5 aa, Mycobacterium
PYPAG

SEQ ID NO: 1169138 - protein, 5 aa, Mycobacterium
PYPEN

SEQ ID NO: 1169139 - protein, 16 aa, Mycobacterium
PYPPGYSDIDDGDGGR

SEQ ID NO: 1169140 - protein, 4 aa, Mycobacterium
PYPV

SEQ ID NO: 1169141 - protein, 10 aa, Mycobacterium
PYQGAATGVG

SEQ ID NO: 1169142 - protein, 10 aa, Mycobacterium
PYQPDRPNRA

SEQ ID NO: 1169143 - protein, 8 aa, Mycobacterium
PYRQRVGD

SEQ ID NO: 1169144 - protein, 11 aa, Mycobacterium
PYTADTLGKET

SEQ ID NO: 1169145 - protein, 5 aa, Mycobacterium
PYTAK

SEQ ID NO: 1169146 - protein, 5 aa, Mycobacterium
PYTEY

SEQ ID NO: 1169147 - protein, 8 aa, Mycobacterium
PYTTGPLS

SEQ ID NO: 1169148 - protein, 17 aa, Mycobacterium
QAAAGTARTTLARRTSA

SEQ ID NO: 1169149 - protein, 25 aa, Mycobacterium
QAAAPASVVTGNQKPGYGDDEKTTW

SEQ ID NO: 1169150 - protein, 18 aa, Mycobacterium
QAAASRKQPADGRTVRDR

SEQ ID NO: 1169151 - protein, 11 aa, Mycobacterium
QAAATARERGV

SEQ ID NO: 1169152 - protein, 9 aa, Mycobacterium
QAADPAVDT

SEQ ID NO: 1169153 - protein, 5 aa, Mycobacterium
QAADS

SEQ ID NO: 1169154 - protein, 6 aa, Mycobacterium
QAAELG

SEQ ID NO: 1169155 - protein, 20 aa, Mycobacterium
QAAGAAPLVTGEPVKNPETI

SEQ ID NO: 1169156 - protein, 6 aa, Mycobacterium
QAAGGR

SEQ ID NO: 1169157 - protein, 9 aa, Mycobacterium
QAAGTGEFG

SEQ ID NO: 1169158 - protein, 16 aa, Mycobacterium
QAAKAATNGKVKDEAH

SEQ ID NO: 1169159 - protein, 24 aa, Mycobacterium
QAAKQQQTGRGQRQGPGPSQTPLG

SEQ ID NO: 1169160 - protein, 8 aa, Mycobacterium
QAALQDSN

SEQ ID NO: 1169161 - protein, 9 aa, Mycobacterium
QAANQANSY

SEQ ID NO: 1169162 - protein, 8 aa, Mycobacterium
QAAQEDPE

SEQ ID NO: 1169163 - protein, 4 aa, Mycobacterium
QAAR

SEQ ID NO: 1169164 - protein, 7 aa, Mycobacterium
QAARLGS

SEQ ID NO: 1169165 - protein, 8 aa, Mycobacterium
QAARPGSA

SEQ ID NO: 1169166 - protein, 5 aa, Mycobacterium
QAASV

SEQ ID NO: 1169167 - protein, 11 aa, Mycobacterium
QAATLDAPAAT

SEQ ID NO: 1169168 - protein, 9 aa, Mycobacterium
QADADTAKS

SEQ ID NO: 1169169 - protein, 11 aa, Mycobacterium
QADASPSQRAI

SEQ ID NO: 1169170 - protein, 4 aa, Mycobacterium
QADE

SEQ ID NO: 1169171 - protein, 8 aa, Mycobacterium
QADPAEDL

SEQ ID NO: 1169172 - protein, 4 aa, Mycobacterium
QADV

SEQ ID NO: 1169173 - protein, 8 aa, Mycobacterium
QAEASNPW

SEQ ID NO: 1169174 - protein, 12 aa, Mycobacterium
QAEDYVDPERFS

SEQ ID NO: 1169175 - protein, 5 aa, Mycobacterium
QAEGA

SEQ ID NO: 1169176 - protein, 24 aa, Mycobacterium
QAELGSAGDNAGDSGQDEATNPVP

SEQ ID NO: 1169177 - protein, 5 aa, Mycobacterium
QAEMP

SEQ ID NO: 1169178 - protein, 9 aa, Mycobacterium
QAENGADGY

SEQ ID NO: 1169179 - protein, 6 aa, Mycobacterium
QAEPDV

SEQ ID NO: 1169180 - protein, 7 aa, Mycobacterium
QAEPTST

SEQ ID NO: 1169181 - protein, 10 aa, Mycobacterium
QAEQAAQSSQ

SEQ ID NO: 1169182 - protein, 8 aa, Mycobacterium
QAETPADE

SEQ ID NO: 1169183 - protein, 16 aa, Mycobacterium
QAETRAALERTQEADY

SEQ ID NO: 1169184 - protein, 6 aa, Mycobacterium
QAGAAV

SEQ ID NO: 1169185 - protein, 6 aa, Mycobacterium
QAGATT

SEQ ID NO: 1169186 - protein, 7 aa, Mycobacterium
QAGDGLD

SEQ ID NO: 1169187 - protein, 9 aa, Mycobacterium
QAGEASKDA

SEQ ID NO: 1169188 - protein, 21 aa, Mycobacterium
QAGEKDKEDRYRDGFSDGEDR

SEQ ID NO: 1169189 - protein, 15 aa, Mycobacterium
QAGEKSRDSRTEPVE

SEQ ID NO: 1169190 - protein, 5 aa, Mycobacterium
QAGGT

SEQ ID NO: 1169191 - protein, 11 aa, Mycobacterium
QAGIDPARQPI

SEQ ID NO: 1169192 - protein, 5 aa, Mycobacterium
QAGQG

SEQ ID NO: 1169193 - protein, 4 aa, Mycobacterium
QAGR

SEQ ID NO: 1169194 - protein, 11 aa, Mycobacterium
QAGRDYHADTA

SEQ ID NO: 1169195 - protein, 7 aa, Mycobacterium
QAGSAEY

SEQ ID NO: 1169196 - protein, 17 aa, Mycobacterium
QAGSGTDDQTNEPSEIT

SEQ ID NO: 1169197 - protein, 8 aa, Mycobacterium
QAGSSVRE

SEQ ID NO: 1169198 - protein, 4 aa, Mycobacterium
QAGW

SEQ ID NO: 1169199 - protein, 6 aa, Mycobacterium
QAHARG

SEQ ID NO: 1169200 - protein, 6 aa, Mycobacterium
QAIPEP

SEQ ID NO: 1169201 - protein, 23 aa, Mycobacterium
QAISPRGPQVDDGDPGPHPGHTS

SEQ ID NO: 1169202 - protein, 10 aa, Mycobacterium
QAKDPSGGYA

SEQ ID NO: 1169203 - protein, 9 aa, Mycobacterium
QAKKTMSDA

SEQ ID NO: 1169204 - protein, 17 aa, Mycobacterium
QAKPAETAAVIREHLER

SEQ ID NO: 1169205 - protein, 6 aa, Mycobacterium
QALKPG

SEQ ID NO: 1169206 - protein, 5 aa, Mycobacterium
QALQS

SEQ ID NO: 1169207 - protein, 7 aa, Mycobacterium
QAMTGGG

SEQ ID NO: 1169208 - protein, 9 aa, Mycobacterium
QANHGKPQA

SEQ ID NO: 1169209 - protein, 5 aa, Mycobacterium
QAPAH

SEQ ID NO: 1169210 - protein, 10 aa, Mycobacterium
QAPDETPAMD

SEQ ID NO: 1169211 - protein, 16 aa, Mycobacterium
QAPDQAAPPLAKAEET

SEQ ID NO: 1169212 - protein, 5 aa, Mycobacterium
QAPDR

SEQ ID NO: 1169213 - protein, 9 aa, Mycobacterium
QAPDSGNSE

SEQ ID NO: 1169214 - protein, 4 aa, Mycobacterium
QAPE

SEQ ID NO: 1169215 - protein, 13 aa, Mycobacterium
QAPEAPAPVVEPT

SEQ ID NO: 1169216 - protein, 6 aa, Mycobacterium
QAPEEA

SEQ ID NO: 1169217 - protein, 6 aa, Mycobacterium
QAPGEV

SEQ ID NO: 1169218 - protein, 5 aa, Mycobacterium
QAPGL

SEQ ID NO: 1169219 - protein, 5 aa, Mycobacterium
QAPPR

SEQ ID NO: 1169220 - protein, 5 aa, Mycobacterium
QAPPV

SEQ ID NO: 1169221 - protein, 4 aa, Mycobacterium
QAPT

SEQ ID NO: 1169222 - protein, 9 aa, Mycobacterium
QAPTGSNAQ

SEQ ID NO: 1169223 - protein, 6 aa, Mycobacterium
QAPTPA

SEQ ID NO: 1169224 - protein, 8 aa, Mycobacterium
QAPTSAFQ

SEQ ID NO: 1169225 - protein, 6 aa, Mycobacterium
QAQIDS

SEQ ID NO: 1169226 - protein, 14 aa, Mycobacterium
QAQPSPGPSPIGGS

SEQ ID NO: 1169227 - protein, 6 aa, Mycobacterium
QAQSGA

SEQ ID NO: 1169228 - protein, 9 aa, Mycobacterium
QARAGTLTT

SEQ ID NO: 1169229 - protein, 11 aa, Mycobacterium
QARDKTGTDPV

SEQ ID NO: 1169230 - protein, 8 aa, Mycobacterium
QARDRRKR

SEQ ID NO: 1169231 - protein, 8 aa, Mycobacterium
QARGAPDG

SEQ ID NO: 1169232 - protein, 6 aa, Mycobacterium
QARGDR

SEQ ID NO: 1169233 - protein, 5 aa, Mycobacterium
QARGG

SEQ ID NO: 1169234 - protein, 6 aa, Mycobacterium
QARRAA

SEQ ID NO: 1169235 - protein, 10 aa, Mycobacterium
QARRDGAEIV

SEQ ID NO: 1169236 - protein, 7 aa, Mycobacterium
QARRGDG

SEQ ID NO: 1169237 - protein, 10 aa, Mycobacterium
QARSAVTESG

SEQ ID NO: 1169238 - protein, 9 aa, Mycobacterium
QARTSDPDI

SEQ ID NO: 1169239 - protein, 7 aa, Mycobacterium
QARVSRP

SEQ ID NO: 1169240 - protein, 7 aa, Mycobacterium
QASAPTY

SEQ ID NO: 1169241 - protein, 5 aa, Mycobacterium
QASDG

SEQ ID NO: 1169242 - protein, 6 aa, Mycobacterium
QASGGN

SEQ ID NO: 1169243 - protein, 6 aa, Mycobacterium
QASRAH

SEQ ID NO: 1169244 - protein, 6 aa, Mycobacterium
QASRRK

SEQ ID NO: 1169245 - protein, 6 aa, Mycobacterium
QATAST

SEQ ID NO: 1169246 - protein, 15 aa, Mycobacterium
QATATQPLPAGDDER

SEQ ID NO: 1169247 - protein, 7 aa, Mycobacterium
QATDPRI

SEQ ID NO: 1169248 - protein, 9 aa, Mycobacterium
QATGTEDRT

SEQ ID NO: 1169249 - protein, 12 aa, Mycobacterium
QATLDDPSSHSA

SEQ ID NO: 1169250 - protein, 8 aa, Mycobacterium
QATRPQTL

SEQ ID NO: 1169251 - protein, 8 aa, Mycobacterium
QATSRAAY

SEQ ID NO: 1169252 - protein, 15 aa, Mycobacterium
QAVAPNPLDETTRSA

SEQ ID NO: 1169253 - protein, 7 aa, Mycobacterium
QAVDNGV

SEQ ID NO: 1169254 - protein, 9 aa, Mycobacterium
QAVDPDGEV

SEQ ID NO: 1169255 - protein, 7 aa, Mycobacterium
QAVDTDM

SEQ ID NO: 1169256 - protein, 9 aa, Mycobacterium
QAVSGSGLA

SEQ ID NO: 1169257 - protein, 8 aa, Mycobacterium
QAVTPAEA

SEQ ID NO: 1169258 - protein, 7 aa, Mycobacterium
QAVYGDG

SEQ ID NO: 1169259 - protein, 13 aa, Mycobacterium
QAYGGLAKSGLPD

SEQ ID NO: 1169260 - protein, 18 aa, Mycobacterium
QAYPGDEVAASGPTGIGG

SEQ ID NO: 1169261 - protein, 7 aa, Mycobacterium
QCGSSQQ

SEQ ID NO: 1169262 - protein, 9 aa, Mycobacterium
QCGSSQQAI

SEQ ID NO: 1169263 - protein, 14 aa, Mycobacterium
QCGYDSDDPEFGEE

SEQ ID NO: 1169264 - protein, 18 aa, Mycobacterium
QCRQTAESIAAEQESSGA

SEQ ID NO: 1169265 - protein, 6 aa, Mycobacterium
QCTGES

SEQ ID NO: 1169266 - protein, 11 aa, Mycobacterium
QDAAATVEGDI

SEQ ID NO: 1169267 - protein, 19 aa, Mycobacterium
QDADGVTVTARSQDSSRDI

SEQ ID NO: 1169268 - protein, 7 aa, Mycobacterium
QDAGGQL

SEQ ID NO: 1169269 - protein, 7 aa, Mycobacterium
QDATQSA

SEQ ID NO: 1169270 - protein, 6 aa, Mycobacterium
QDDAEA

SEQ ID NO: 1169271 - protein, 28 aa, Mycobacterium
QDDEPAGEPVPYAGADYDPSATGARPPV

SEQ ID NO: 1169272 - protein, 5 aa, Mycobacterium
QDDFN

SEQ ID NO: 1169273 - protein, 11 aa, Mycobacterium
QDDGARPISDD

SEQ ID NO: 1169274 - protein, 5 aa, Mycobacterium
QDDTR

SEQ ID NO: 1169275 - protein, 8 aa, Mycobacterium
QDEDNSVA

SEQ ID NO: 1169276 - protein, 5 aa, Mycobacterium
QDEPD

SEQ ID NO: 1169277 - protein, 16 aa, Mycobacterium
QDGAAARAARETPAEG

SEQ ID NO: 1169278 - protein, 6 aa, Mycobacterium
QDGAYG

SEQ ID NO: 1169279 - protein, 14 aa, Mycobacterium
QDGEPHLAGTAPPA

SEQ ID NO: 1169280 - protein, 16 aa, Mycobacterium
QDGRDPAGITTQDPEL

SEQ ID NO: 1169281 - protein, 9 aa, Mycobacterium
QDHRGDDPN

SEQ ID NO: 1169282 - protein, 6 aa, Mycobacterium
QDIPNR

SEQ ID NO: 1169283 - protein, 10 aa, Mycobacterium
QDISTPQSAT

SEQ ID NO: 1169284 - protein, 7 aa, Mycobacterium
QDLGRKP

SEQ ID NO: 1169285 - protein, 7 aa, Mycobacterium
QDLSPND

SEQ ID NO: 1169286 - protein, 6 aa, Mycobacterium
QDMTTR

SEQ ID NO: 1169287 - protein, 21 aa, Mycobacterium
QDNAGGVTFDAPEGKVTIDGE

SEQ ID NO: 1169288 - protein, 6 aa, Mycobacterium
QDNEVT

SEQ ID NO: 1169289 - protein, 14 aa, Mycobacterium
QDPASKAYQPGPSL

SEQ ID NO: 1169290 - protein, 9 aa, Mycobacterium
QDPATQAEL

SEQ ID NO: 1169291 - protein, 5 aa, Mycobacterium
QDPGP

SEQ ID NO: 1169292 - protein, 4 aa, Mycobacterium
QDPR

SEQ ID NO: 1169293 - protein, 5 aa, Mycobacterium
QDPRA

SEQ ID NO: 1169294 - protein, 12 aa, Mycobacterium
QDPRLAKTHRPD

SEQ ID NO: 1169295 - protein, 6 aa, Mycobacterium
QDPRSR

SEQ ID NO: 1169296 - protein, 5 aa, Mycobacterium
QDPRW

SEQ ID NO: 1169297 - protein, 16 aa, Mycobacterium
QDPTAKMSKSAGTDAG

SEQ ID NO: 1169298 - protein, 10 aa, Mycobacterium
QDPTPAQQKQ

SEQ ID NO: 1169299 - protein, 21 aa, Mycobacterium
QDQARDALDAANSGAQQGDPL

SEQ ID NO: 1169300 - protein, 17 aa, Mycobacterium
QDQTARDDDYAGQNPSV

SEQ ID NO: 1169301 - protein, 6 aa, Mycobacterium
QDRGGL

SEQ ID NO: 1169302 - protein, 7 aa, Mycobacterium
QDRTKWD

SEQ ID NO: 1169303 - protein, 9 aa, Mycobacterium
QDSARQGGA

SEQ ID NO: 1169304 - protein, 8 aa, Mycobacterium
QDSIASGN

SEQ ID NO: 1169305 - protein, 8 aa, Mycobacterium
QDSTGNSG

SEQ ID NO: 1169306 - protein, 12 aa, Mycobacterium
QDSTHVTPPERQ

SEQ ID NO: 1169307 - protein, 4 aa, Mycobacterium
QDSV

SEQ ID NO: 1169308 - protein, 5 aa, Mycobacterium
QDTAA

SEQ ID NO: 1169309 - protein, 5 aa, Mycobacterium
QDTAE

SEQ ID NO: 1169310 - protein, 16 aa, Mycobacterium
QDTAENERDQTELGGE

SEQ ID NO: 1169311 - protein, 4 aa, Mycobacterium
QDVA

SEQ ID NO: 1169312 - protein, 5 aa, Mycobacterium
QDVTG

SEQ ID NO: 1169313 - protein, 14 aa, Mycobacterium
QDWDPEQSKLSEVA

SEQ ID NO: 1169314 - protein, 12 aa, Mycobacterium
QDWEPEQSQLSE

SEQ ID NO: 1169315 - protein, 4 aa, Mycobacterium
QDWR

SEQ ID NO: 1169316 - protein, 6 aa, Mycobacterium
QDYGDR

SEQ ID NO: 1169317 - protein, 9 aa, Mycobacterium
QDYSPADEL

SEQ ID NO: 1169318 - protein, 7 aa, Mycobacterium
QDYTAKA

SEQ ID NO: 1169319 - protein, 9 aa, Mycobacterium
QEADSAVRP

SEQ ID NO: 1169320 - protein, 31 aa, Mycobacterium
QEAGEQIPEDLTKAQASETIDRLQQQTGRGT

SEQ ID NO: 1169321 - protein, 6 aa, Mycobacterium
QEAGLT

SEQ ID NO: 1169322 - protein, 13 aa, Mycobacterium
QEAGLTGTAQTST

SEQ ID NO: 1169323 - protein, 8 aa, Mycobacterium
QEAQAAQE

SEQ ID NO: 1169324 - protein, 6 aa, Mycobacterium
QEATNV

SEQ ID NO: 1169325 - protein, 9 aa, Mycobacterium
QEDDTVEVG

SEQ ID NO: 1169326 - protein, 8 aa, Mycobacterium
QEDGAPSI

SEQ ID NO: 1169327 - protein, 9 aa, Mycobacterium
QEDLESDSL

SEQ ID NO: 1169328 - protein, 6 aa, Mycobacterium
QEDPPQ

SEQ ID NO: 1169329 - protein, 7 aa, Mycobacterium
QEDSGRV

SEQ ID NO: 1169330 - protein, 5 aa, Mycobacterium
QEEAM

SEQ ID NO: 1169331 - protein, 8 aa, Mycobacterium
QEERNEEK

SEQ ID NO: 1169332 - protein, 7 aa, Mycobacterium
QEFPEDP

SEQ ID NO: 1169333 - protein, 8 aa, Mycobacterium
QEGGEGQY

SEQ ID NO: 1169334 - protein, 5 aa, Mycobacterium
QEGVG

SEQ ID NO: 1169335 - protein, 5 aa, Mycobacterium
QEHVS

SEQ ID NO: 1169336 - protein, 8 aa, Mycobacterium
QEKANISD

SEQ ID NO: 1169337 - protein, 5 aa, Mycobacterium
QEKFD

SEQ ID NO: 1169338 - protein, 14 aa, Mycobacterium
QELAGRAAKPTADY

SEQ ID NO: 1169339 - protein, 6 aa, Mycobacterium
QELRDQ

SEQ ID NO: 1169340 - protein, 6 aa, Mycobacterium
QELSPL

SEQ ID NO: 1169341 - protein, 55 aa, Mycobacterium
QELSSARSGGGVSQPQAAPVYEPEPEPTPPPQPVYEAPPAAPAPTAQQSEDSALR

SEQ ID NO: 1169342 - protein, 6 aa, Mycobacterium
QENPAE

SEQ ID NO: 1169343 - protein, 4 aa, Mycobacterium
QENR

SEQ ID NO: 1169344 - protein, 7 aa, Mycobacterium
QENRRAQ

SEQ ID NO: 1169345 - protein, 5 aa, Mycobacterium
QEPDF

SEQ ID NO: 1169346 - protein, 4 aa, Mycobacterium
QEPE

SEQ ID NO: 1169347 - protein, 5 aa, Mycobacterium
QEPGT

SEQ ID NO: 1169348 - protein, 8 aa, Mycobacterium
QEPTVQPY

SEQ ID NO: 1169349 - protein, 6 aa, Mycobacterium
QEPVTV

SEQ ID NO: 1169350 - protein, 10 aa, Mycobacterium
QEQATEAEAE

SEQ ID NO: 1169351 - protein, 17 aa, Mycobacterium
QEQDVGAAVDAGSLRPG

SEQ ID NO: 1169352 - protein, 8 aa, Mycobacterium
QEQERGIT

SEQ ID NO: 1169353 - protein, 16 aa, Mycobacterium
QEQPAAELPMAQRYFL

SEQ ID NO: 1169354 - protein, 7 aa, Mycobacterium
QERESFG

SEQ ID NO: 1169355 - protein, 6 aa, Mycobacterium
QERGTG

SEQ ID NO: 1169356 - protein, 7 aa, Mycobacterium
QERGVPN

SEQ ID NO: 1169357 - protein, 21 aa, Mycobacterium
QESEHKGERQREANEQRAAAG

SEQ ID NO: 1169358 - protein, 12 aa, Mycobacterium
QESGTTRPIDPW

SEQ ID NO: 1169359 - protein, 11 aa, Mycobacterium
QESRTGSLEST

SEQ ID NO: 1169360 - protein, 17 aa, Mycobacterium
QETADRLTSTAKAESDK

SEQ ID NO: 1169361 - protein, 4 aa, Mycobacterium
QETG

SEQ ID NO: 1169362 - protein, 6 aa, Mycobacterium
QETQHE

SEQ ID NO: 1169363 - protein, 8 aa, Mycobacterium
QETTSFDG

SEQ ID NO: 1169364 - protein, 5 aa, Mycobacterium
QEVPF

SEQ ID NO: 1169365 - protein, 7 aa, Mycobacterium
QEVTDDG

SEQ ID NO: 1169366 - protein, 14 aa, Mycobacterium
QEWPSVSRARRAGV

SEQ ID NO: 1169367 - protein, 5 aa, Mycobacterium
QFEEA

SEQ ID NO: 1169368 - protein, 9 aa, Mycobacterium
QFGGRGGSN

SEQ ID NO: 1169369 - protein, 9 aa, Mycobacterium
QFGPDPDVA

SEQ ID NO: 1169370 - protein, 4 aa, Mycobacterium
QFPY

SEQ ID NO: 1169371 - protein, 22 aa, Mycobacterium
QFTRAQQDEFAATSHQKAAAAW

SEQ ID NO: 1169372 - protein, 9 aa, Mycobacterium
QGAAVPPDQ

SEQ ID NO: 1169373 - protein, 5 aa, Mycobacterium
QGADD

SEQ ID NO: 1169374 - protein, 10 aa, Mycobacterium
QGADGQPVSA

SEQ ID NO: 1169375 - protein, 9 aa, Mycobacterium
QGAGEREIA

SEQ ID NO: 1169376 - protein, 15 aa, Mycobacterium
QGAGHAASGYAHATG

SEQ ID NO: 1169377 - protein, 13 aa, Mycobacterium
QGAKGPQATSVTA

SEQ ID NO: 1169378 - protein, 9 aa, Mycobacterium
QGAKPGGGG

SEQ ID NO: 1169379 - protein, 9 aa, Mycobacterium
QGAKRTPAL

SEQ ID NO: 1169380 - protein, 14 aa, Mycobacterium
QGAMTDGAYPLTTA

SEQ ID NO: 1169381 - protein, 8 aa, Mycobacterium
QGASGYDA

SEQ ID NO: 1169382 - protein, 6 aa, Mycobacterium
QGATYG

SEQ ID NO: 1169383 - protein, 5 aa, Mycobacterium
QGDAP

SEQ ID NO: 1169384 - protein, 10 aa, Mycobacterium
QGDTAGAPDP

SEQ ID NO: 1169385 - protein, 5 aa, Mycobacterium
QGEAA

SEQ ID NO: 1169386 - protein, 6 aa, Mycobacterium
QGEGVP

SEQ ID NO: 1169387 - protein, 4 aa, Mycobacterium
QGEL

SEQ ID NO: 1169388 - protein, 4 aa, Mycobacterium
QGER

SEQ ID NO: 1169389 - protein, 7 aa, Mycobacterium
QGERGRT

SEQ ID NO: 1169390 - protein, 5 aa, Mycobacterium
QGESL

SEQ ID NO: 1169391 - protein, 4 aa, Mycobacterium
QGET

SEQ ID NO: 1169392 - protein, 15 aa, Mycobacterium
QGETLVDPSDAELGA

SEQ ID NO: 1169393 - protein, 14 aa, Mycobacterium
QGEVPPSAKAEVVK

SEQ ID NO: 1169394 - protein, 5 aa, Mycobacterium
QGEWG

SEQ ID NO: 1169395 - protein, 4 aa, Mycobacterium
QGEY

SEQ ID NO: 1169396 - protein, 4 aa, Mycobacterium
QGFP

SEQ ID NO: 1169397 - protein, 11 aa, Mycobacterium
QGFPDEDGPAS

SEQ ID NO: 1169398 - protein, 6 aa, Mycobacterium
QGGAGF

SEQ ID NO: 1169399 - protein, 12 aa, Mycobacterium
QGGDASSDSYCY

SEQ ID NO: 1169400 - protein, 9 aa, Mycobacterium
QGGDPARVV

SEQ ID NO: 1169401 - protein, 4 aa, Mycobacterium
QGGG

SEQ ID NO: 1169402 - protein, 5 aa, Mycobacterium
QGGGF

SEQ ID NO: 1169403 - protein, 6 aa, Mycobacterium
QGGGIR

SEQ ID NO: 1169404 - protein, 6 aa, Mycobacterium
QGGGMP

SEQ ID NO: 1169405 - protein, 12 aa, Mycobacterium
QGGGNGHHGADR

SEQ ID NO: 1169406 - protein, 5 aa, Mycobacterium
QGGGT

SEQ ID NO: 1169407 - protein, 7 aa, Mycobacterium
QGGQPVD

SEQ ID NO: 1169408 - protein, 5 aa, Mycobacterium
QGGQV

SEQ ID NO: 1169409 - protein, 6 aa, Mycobacterium
QGGRTS

SEQ ID NO: 1169410 - protein, 11 aa, Mycobacterium
QGGSSGSTRLR

SEQ ID NO: 1169411 - protein, 10 aa, Mycobacterium
QGGVAVPSAS

SEQ ID NO: 1169412 - protein, 10 aa, Mycobacterium
QGHEDAAADA

SEQ ID NO: 1169413 - protein, 13 aa, Mycobacterium
QGHGRTPDTSRRM

SEQ ID NO: 1169414 - protein, 8 aa, Mycobacterium
QGHPGAQQ

SEQ ID NO: 1169415 - protein, 6 aa, Mycobacterium
QGIEAQ

SEQ ID NO: 1169416 - protein, 14 aa, Mycobacterium
QGIEDTYKTGRGSV

SEQ ID NO: 1169417 - protein, 4 aa, Mycobacterium
QGIP

SEQ ID NO: 1169418 - protein, 9 aa, Mycobacterium
QGIPSGAAT

SEQ ID NO: 1169419 - protein, 13 aa, Mycobacterium
QGITETPPDGVAT

SEQ ID NO: 1169420 - protein, 8 aa, Mycobacterium
QGKDGNRQ

SEQ ID NO: 1169421 - protein, 7 aa, Mycobacterium
QGLARPA

SEQ ID NO: 1169422 - protein, 8 aa, Mycobacterium
QGLTQRES

SEQ ID NO: 1169423 - protein, 14 aa, Mycobacterium
QGNFGSPGNDPPAA

SEQ ID NO: 1169424 - protein, 8 aa, Mycobacterium
QGNVRGPY

SEQ ID NO: 1169425 - protein, 7 aa, Mycobacterium
QGPDAPK

SEQ ID NO: 1169426 - protein, 10 aa, Mycobacterium
QGPGSPSAAT

SEQ ID NO: 1169427 - protein, 9 aa, Mycobacterium
QGPRGSGPG

SEQ ID NO: 1169428 - protein, 7 aa, Mycobacterium
QGPTRAL

SEQ ID NO: 1169429 - protein, 5 aa, Mycobacterium
QGQAG

SEQ ID NO: 1169430 - protein, 218 aa, Mycobacterium
QGQGRPGDEYYDDGYGRPQEEPRGQEPRAPYPPEQGGYPPRGGYPEQGGYPDRGGYPDQGGYPDQGGYGGGYEQRGPGGYGPPGGGYDQGYRQGPGGYAPPPPPGGQPGYGAPGADYDYGRPPGGPGRHEDGGYGRPGYPDQGGYPDQGGYGGGYGAPAGGRQDYGQDYGRGYAEPAGGYGDPGYGEPAGRDYDYGQGAGGYGGGYGQADYPAAGVGT

SEQ ID NO: 1169431 - protein, 9 aa, Mycobacterium
QGQKCSAAS

SEQ ID NO: 1169432 - protein, 4 aa, Mycobacterium
QGQP

SEQ ID NO: 1169433 - protein, 15 aa, Mycobacterium
QGQRGGPAHPGTGQY

SEQ ID NO: 1169434 - protein, 13 aa, Mycobacterium
QGQSTPIRMPTPA

SEQ ID NO: 1169435 - protein, 9 aa, Mycobacterium
QGRAAGDDR

SEQ ID NO: 1169436 - protein, 14 aa, Mycobacterium
QGREGGSSGAGSRR

SEQ ID NO: 1169437 - protein, 11 aa, Mycobacterium
QGRERSPSAPV

SEQ ID NO: 1169438 - protein, 27 aa, Mycobacterium
QGRGIGKGLGSGPDTNTASVKLQSQLA

SEQ ID NO: 1169439 - protein, 5 aa, Mycobacterium
QGRGV

SEQ ID NO: 1169440 - protein, 15 aa, Mycobacterium
QGRGYGDLKKDTADA

SEQ ID NO: 1169441 - protein, 7 aa, Mycobacterium
QGRPPIS

SEQ ID NO: 1169442 - protein, 6 aa, Mycobacterium
QGRRAE

SEQ ID NO: 1169443 - protein, 9 aa, Mycobacterium
QGRRTAQEI

SEQ ID NO: 1169444 - protein, 9 aa, Mycobacterium
QGRRTGTLH

SEQ ID NO: 1169445 - protein, 4 aa, Mycobacterium
QGRT

SEQ ID NO: 1169446 - protein, 5 aa, Mycobacterium
QGRVS

SEQ ID NO: 1169447 - protein, 4 aa, Mycobacterium
QGRW

SEQ ID NO: 1169448 - protein, 15 aa, Mycobacterium
QGSAADAERQADAVR

SEQ ID NO: 1169449 - protein, 5 aa, Mycobacterium
QGSAP

SEQ ID NO: 1169450 - protein, 7 aa, Mycobacterium
QGSQYPR

SEQ ID NO: 1169451 - protein, 7 aa, Mycobacterium
QGTADQQ

SEQ ID NO: 1169452 - protein, 10 aa, Mycobacterium
QGTAPGRADM

SEQ ID NO: 1169453 - protein, 13 aa, Mycobacterium
QGTGEGATFPRST

SEQ ID NO: 1169454 - protein, 20 aa, Mycobacterium
QGTKDYKGENASGSTSGPFY

SEQ ID NO: 1169455 - protein, 13 aa, Mycobacterium
QGTPASLGATPAE

SEQ ID NO: 1169456 - protein, 7 aa, Mycobacterium
QGTPGGA

SEQ ID NO: 1169457 - protein, 9 aa, Mycobacterium
QGTQWPSMG

SEQ ID NO: 1169458 - protein, 8 aa, Mycobacterium
QGTTGLSV

SEQ ID NO: 1169459 - protein, 9 aa, Mycobacterium
QGTTVEGKP

SEQ ID NO: 1169460 - protein, 5 aa, Mycobacterium
QGTWR

SEQ ID NO: 1169461 - protein, 9 aa, Mycobacterium
QGVDSATGA

SEQ ID NO: 1169462 - protein, 9 aa, Mycobacterium
QGVEPARPL

SEQ ID NO: 1169463 - protein, 5 aa, Mycobacterium
QGVGK

SEQ ID NO: 1169464 - protein, 6 aa, Mycobacterium
QGVPTP

SEQ ID NO: 1169465 - protein, 4 aa, Mycobacterium
QGVS

SEQ ID NO: 1169466 - protein, 7 aa, Mycobacterium
QGVSVGT

SEQ ID NO: 1169467 - protein, 7 aa, Mycobacterium
QGVTSGP

SEQ ID NO: 1169468 - protein, 6 aa, Mycobacterium
QHADDA

SEQ ID NO: 1169469 - protein, 6 aa, Mycobacterium
QHADGG

SEQ ID NO: 1169470 - protein, 10 aa, Mycobacterium
QHAGPASSIA

SEQ ID NO: 1169471 - protein, 7 aa, Mycobacterium
QHAGPGS

SEQ ID NO: 1169472 - protein, 7 aa, Mycobacterium
QHDFGGP

SEQ ID NO: 1169473 - protein, 4 aa, Mycobacterium
QHDY

SEQ ID NO: 1169474 - protein, 11 aa, Mycobacterium
QHFTNPDDYAA

SEQ ID NO: 1169475 - protein, 17 aa, Mycobacterium
QHHPRQRGIASGGTTVS

SEQ ID NO: 1169476 - protein, 16 aa, Mycobacterium
QHPGNAAPEPHYRPSA

SEQ ID NO: 1169477 - protein, 16 aa, Mycobacterium
QHPGNAPPEPHYRPSA

SEQ ID NO: 1169478 - protein, 6 aa, Mycobacterium
QHRSAE

SEQ ID NO: 1169479 - protein, 7 aa, Mycobacterium
QHSPAAY

SEQ ID NO: 1169480 - protein, 6 aa, Mycobacterium
QHTRAQ

SEQ ID NO: 1169481 - protein, 4 aa, Mycobacterium
QIGA

SEQ ID NO: 1169482 - protein, 9 aa, Mycobacterium
QIGDPADLA

SEQ ID NO: 1169483 - protein, 10 aa, Mycobacterium
QINGVPRDEA

SEQ ID NO: 1169484 - protein, 4 aa, Mycobacterium
QIPA

SEQ ID NO: 1169485 - protein, 12 aa, Mycobacterium
QIPAADSTLRER

SEQ ID NO: 1169486 - protein, 10 aa, Mycobacterium
QIPDDDRAAA

SEQ ID NO: 1169487 - protein, 13 aa, Mycobacterium
QIPGHDPAQEALP

SEQ ID NO: 1169488 - protein, 9 aa, Mycobacterium
QIPPTPDEL

SEQ ID NO: 1169489 - protein, 6 aa, Mycobacterium
QIQKGQ

SEQ ID NO: 1169490 - protein, 8 aa, Mycobacterium
QIQSRTAE

SEQ ID NO: 1169491 - protein, 7 aa, Mycobacterium
QIRPTAA

SEQ ID NO: 1169492 - protein, 6 aa, Mycobacterium
QISAPT

SEQ ID NO: 1169493 - protein, 4 aa, Mycobacterium
QKAN

SEQ ID NO: 1169494 - protein, 8 aa, Mycobacterium
QKATGGDY

SEQ ID NO: 1169495 - protein, 6 aa, Mycobacterium
QKDRDA

SEQ ID NO: 1169496 - protein, 7 aa, Mycobacterium
QKEDPTI

SEQ ID NO: 1169497 - protein, 11 aa, Mycobacterium
QKGGVGKTTTA

SEQ ID NO: 1169498 - protein, 14 aa, Mycobacterium
QKIAETAAAEGAGD

SEQ ID NO: 1169499 - protein, 13 aa, Mycobacterium
QKKQDGMVKVVLT

SEQ ID NO: 1169500 - protein, 8 aa, Mycobacterium
QKRTDDLA

SEQ ID NO: 1169501 - protein, 4 aa, Mycobacterium
QKRV

SEQ ID NO: 1169502 - protein, 8 aa, Mycobacterium
QKSDGDVR

SEQ ID NO: 1169503 - protein, 4 aa, Mycobacterium
QKSG

SEQ ID NO: 1169504 - protein, 6 aa, Mycobacterium
QKTESE

SEQ ID NO: 1169505 - protein, 11 aa, Mycobacterium
QKTNAESNTVA

SEQ ID NO: 1169506 - protein, 29 aa, Mycobacterium
QKTVSENLASPLKSGRTGRYSEAERTERI

SEQ ID NO: 1169507 - protein, 12 aa, Mycobacterium
QLAESAEQRAAL

SEQ ID NO: 1169508 - protein, 16 aa, Mycobacterium
QLAESQKGKTAEEIAA

SEQ ID NO: 1169509 - protein, 12 aa, Mycobacterium
QLAGGSAPSHGA

SEQ ID NO: 1169510 - protein, 13 aa, Mycobacterium
QLAKSDDATREAL

SEQ ID NO: 1169511 - protein, 18 aa, Mycobacterium
QLAPTSTVRGWERLRIVL

SEQ ID NO: 1169512 - protein, 4 aa, Mycobacterium
QLAR

SEQ ID NO: 1169513 - protein, 8 aa, Mycobacterium
QLDGTPDR

SEQ ID NO: 1169514 - protein, 9 aa, Mycobacterium
QLGGAESAT

SEQ ID NO: 1169515 - protein, 6 aa, Mycobacterium
QLGGGY

SEQ ID NO: 1169516 - protein, 12 aa, Mycobacterium
QLGKKSGQGFYS

SEQ ID NO: 1169517 - protein, 5 aa, Mycobacterium
QLGRN

SEQ ID NO: 1169518 - protein, 8 aa, Mycobacterium
QLGRTPAQ

SEQ ID NO: 1169519 - protein, 7 aa, Mycobacterium
QLHPGDT

SEQ ID NO: 1169520 - protein, 19 aa, Mycobacterium
QLKAQDASYTLTPDGEKTK

SEQ ID NO: 1169521 - protein, 13 aa, Mycobacterium
QLKPGDATDADGA

SEQ ID NO: 1169522 - protein, 10 aa, Mycobacterium
QLPASSTVTS

SEQ ID NO: 1169523 - protein, 6 aa, Mycobacterium
QLPDAQ

SEQ ID NO: 1169524 - protein, 6 aa, Mycobacterium
QLPGDP

SEQ ID NO: 1169525 - protein, 7 aa, Mycobacterium
QLPGDPT

SEQ ID NO: 1169526 - protein, 7 aa, Mycobacterium
QLPGGSA

SEQ ID NO: 1169527 - protein, 6 aa, Mycobacterium
QLPPTE

SEQ ID NO: 1169528 - protein, 5 aa, Mycobacterium
QLPQQ

SEQ ID NO: 1169529 - protein, 6 aa, Mycobacterium
QLPRGD

SEQ ID NO: 1169530 - protein, 9 aa, Mycobacterium
QLPRKGSYF

SEQ ID NO: 1169531 - protein, 5 aa, Mycobacterium
QLPSE

SEQ ID NO: 1169532 - protein, 15 aa, Mycobacterium
QLPSSQATKFTSGDA

SEQ ID NO: 1169533 - protein, 9 aa, Mycobacterium
QLPTPHSDA

SEQ ID NO: 1169534 - protein, 15 aa, Mycobacterium
QLPTYKSRNRGSGRA

SEQ ID NO: 1169535 - protein, 6 aa, Mycobacterium
QLRGEG

SEQ ID NO: 1169536 - protein, 4 aa, Mycobacterium
QLRR

SEQ ID NO: 1169537 - protein, 14 aa, Mycobacterium
QLSAAPPDPTAPPS

SEQ ID NO: 1169538 - protein, 5 aa, Mycobacterium
QLSDD

SEQ ID NO: 1169539 - protein, 9 aa, Mycobacterium
QLSGGQRQR

SEQ ID NO: 1169540 - protein, 7 aa, Mycobacterium
QLTDGGA

SEQ ID NO: 1169541 - protein, 9 aa, Mycobacterium
QLTESGVPS

SEQ ID NO: 1169542 - protein, 6 aa, Mycobacterium
QLTGEA

SEQ ID NO: 1169543 - protein, 17 aa, Mycobacterium
QLTGTAGHDDPNSSLPY

SEQ ID NO: 1169544 - protein, 6 aa, Mycobacterium
QLTSAG

SEQ ID NO: 1169545 - protein, 5 aa, Mycobacterium
QLTSS

SEQ ID NO: 1169546 - protein, 13 aa, Mycobacterium
QMEEAAKAGNASF

SEQ ID NO: 1169547 - protein, 22 aa, Mycobacterium
QMGGQAASSAGQAGGGGQGGGM

SEQ ID NO: 1169548 - protein, 13 aa, Mycobacterium
QMGPNRPGPKGYV

SEQ ID NO: 1169549 - protein, 11 aa, Mycobacterium
QMGQQGSGAVQ

SEQ ID NO: 1169550 - protein, 10 aa, Mycobacterium
QMQPAYNASK

SEQ ID NO: 1169551 - protein, 12 aa, Mycobacterium
QMQPGQTLPSER

SEQ ID NO: 1169552 - protein, 4 aa, Mycobacterium
QMRD

SEQ ID NO: 1169553 - protein, 6 aa, Mycobacterium
QMRGGG

SEQ ID NO: 1169554 - protein, 11 aa, Mycobacterium
QMSDKSAPRVT

SEQ ID NO: 1169555 - protein, 11 aa, Mycobacterium
QMSGPATGSTA

SEQ ID NO: 1169556 - protein, 8 aa, Mycobacterium
QNAKPAPE

SEQ ID NO: 1169557 - protein, 18 aa, Mycobacterium
QNATEAASAAIEADRERI

SEQ ID NO: 1169558 - protein, 9 aa, Mycobacterium
QNATGDPAI

SEQ ID NO: 1169559 - protein, 10 aa, Mycobacterium
QNDKGNPLGE

SEQ ID NO: 1169560 - protein, 13 aa, Mycobacterium
QNFPPGRQYEYSN

SEQ ID NO: 1169561 - protein, 7 aa, Mycobacterium
QNHTEAR

SEQ ID NO: 1169562 - protein, 19 aa, Mycobacterium
QNMSNNSAVTVDGGEIGRA

SEQ ID NO: 1169563 - protein, 11 aa, Mycobacterium
QNNGNKTTIAP

SEQ ID NO: 1169564 - protein, 21 aa, Mycobacterium
QNNRGRLTSPMRRRPDGSYEE

SEQ ID NO: 1169565 - protein, 5 aa, Mycobacterium
QNPDQ

SEQ ID NO: 1169566 - protein, 6 aa, Mycobacterium
QNPIEY

SEQ ID NO: 1169567 - protein, 9 aa, Mycobacterium
QNPSAGAAL

SEQ ID NO: 1169568 - protein, 17 aa, Mycobacterium
QNPVDQEGTYPLSEAQT

SEQ ID NO: 1169569 - protein, 23 aa, Mycobacterium
QNREIQSEAVKTAEAAVAGTGSL

SEQ ID NO: 1169570 - protein, 7 aa, Mycobacterium
QNRGGAG

SEQ ID NO: 1169571 - protein, 8 aa, Mycobacterium
QNRPDFPP

SEQ ID NO: 1169572 - protein, 7 aa, Mycobacterium
QNRVDGR

SEQ ID NO: 1169573 - protein, 9 aa, Mycobacterium
QNSESLGPV

SEQ ID NO: 1169574 - protein, 13 aa, Mycobacterium
QNTAREARHSEIT

SEQ ID NO: 1169575 - protein, 6 aa, Mycobacterium
QNTPVE

SEQ ID NO: 1169576 - protein, 5 aa, Mycobacterium
QNTRD

SEQ ID NO: 1169577 - protein, 11 aa, Mycobacterium
QNWETGDPNQQ

SEQ ID NO: 1169578 - protein, 6 aa, Mycobacterium
QNYAEQ

SEQ ID NO: 1169579 - protein, 12 aa, Mycobacterium
QNYGSNAGEAIR

SEQ ID NO: 1169580 - protein, 10 aa, Mycobacterium
QPAAEDVGTD

SEQ ID NO: 1169581 - protein, 7 aa, Mycobacterium
QPADQRT

SEQ ID NO: 1169582 - protein, 6 aa, Mycobacterium
QPAEGE

SEQ ID NO: 1169583 - protein, 6 aa, Mycobacterium
QPAELR

SEQ ID NO: 1169584 - protein, 8 aa, Mycobacterium
QPAGESGF

SEQ ID NO: 1169585 - protein, 5 aa, Mycobacterium
QPALE

SEQ ID NO: 1169586 - protein, 8 aa, Mycobacterium
QPALQPGA

SEQ ID NO: 1169587 - protein, 5 aa, Mycobacterium
QPALT

SEQ ID NO: 1169588 - protein, 19 aa, Mycobacterium
QPAPRGTNGFHPEHISVEW

SEQ ID NO: 1169589 - protein, 13 aa, Mycobacterium
QPATELSGGEAQR

SEQ ID NO: 1169590 - protein, 5 aa, Mycobacterium
QPATR

SEQ ID NO: 1169591 - protein, 7 aa, Mycobacterium
QPATRAT

SEQ ID NO: 1169592 - protein, 6 aa, Mycobacterium
QPDEVR

SEQ ID NO: 1169593 - protein, 11 aa, Mycobacterium
QPDGNRVTTDY

SEQ ID NO: 1169594 - protein, 12 aa, Mycobacterium
QPDGRDDYAAGH

SEQ ID NO: 1169595 - protein, 13 aa, Mycobacterium
QPDLQKGRYPDRK

SEQ ID NO: 1169596 - protein, 8 aa, Mycobacterium
QPDPEDVA

SEQ ID NO: 1169597 - protein, 5 aa, Mycobacterium
QPDQT

SEQ ID NO: 1169598 - protein, 8 aa, Mycobacterium
QPDTSTEL

SEQ ID NO: 1169599 - protein, 24 aa, Mycobacterium
QPDTTPPLRRTARTGSVPTDQGAS

SEQ ID NO: 1169600 - protein, 6 aa, Mycobacterium
QPDYHA

SEQ ID NO: 1169601 - protein, 4 aa, Mycobacterium
QPED

SEQ ID NO: 1169602 - protein, 5 aa, Mycobacterium
QPEDI

SEQ ID NO: 1169603 - protein, 6 aa, Mycobacterium
QPEFPG

SEQ ID NO: 1169604 - protein, 9 aa, Mycobacterium
QPELATDDR

SEQ ID NO: 1169605 - protein, 6 aa, Mycobacterium
QPERRA

SEQ ID NO: 1169606 - protein, 7 aa, Mycobacterium
QPEVDPD

SEQ ID NO: 1169607 - protein, 9 aa, Mycobacterium
QPFDDRARS

SEQ ID NO: 1169608 - protein, 6 aa, Mycobacterium
QPGALG

SEQ ID NO: 1169609 - protein, 10 aa, Mycobacterium
QPGATNTKPH

SEQ ID NO: 1169610 - protein, 4 aa, Mycobacterium
QPGD

SEQ ID NO: 1169611 - protein, 4 aa, Mycobacterium
QPGE

SEQ ID NO: 1169612 - protein, 8 aa, Mycobacterium
QPGEGPGW

SEQ ID NO: 1169613 - protein, 4 aa, Mycobacterium
QPGG

SEQ ID NO: 1169614 - protein, 9 aa, Mycobacterium
QPGGAPDYR

SEQ ID NO: 1169615 - protein, 5 aa, Mycobacterium
QPGGY

SEQ ID NO: 1169616 - protein, 5 aa, Mycobacterium
QPGQQ

SEQ ID NO: 1169617 - protein, 13 aa, Mycobacterium
QPGRSAVSGTFHG

SEQ ID NO: 1169618 - protein, 17 aa, Mycobacterium
QPGSLSGGASDRESPMG

SEQ ID NO: 1169619 - protein, 5 aa, Mycobacterium
QPGTN

SEQ ID NO: 1169620 - protein, 5 aa, Mycobacterium
QPGVV

SEQ ID NO: 1169621 - protein, 9 aa, Mycobacterium
QPGWQEERK

SEQ ID NO: 1169622 - protein, 18 aa, Mycobacterium
QPGYGPSTQFAANGSDRM

SEQ ID NO: 1169623 - protein, 7 aa, Mycobacterium
QPHHPDD

SEQ ID NO: 1169624 - protein, 5 aa, Mycobacterium
QPHRS

SEQ ID NO: 1169625 - protein, 4 aa, Mycobacterium
QPHS

SEQ ID NO: 1169626 - protein, 6 aa, Mycobacterium
QPHSGI

SEQ ID NO: 1169627 - protein, 7 aa, Mycobacterium
QPIPSTY

SEQ ID NO: 1169628 - protein, 11 aa, Mycobacterium
QPIPVGSEGGT

SEQ ID NO: 1169629 - protein, 10 aa, Mycobacterium
QPKKDTDRKH

SEQ ID NO: 1169630 - protein, 11 aa, Mycobacterium
QPLDQTGRDAY

SEQ ID NO: 1169631 - protein, 11 aa, Mycobacterium
QPLGGGGREGY

SEQ ID NO: 1169632 - protein, 18 aa, Mycobacterium
QPLPAYPTPEQLDRGPRR

SEQ ID NO: 1169633 - protein, 5 aa, Mycobacterium
QPLPG

SEQ ID NO: 1169634 - protein, 8 aa, Mycobacterium
QPLTEQDQ

SEQ ID NO: 1169635 - protein, 11 aa, Mycobacterium
QPNDGRPASTT

SEQ ID NO: 1169636 - protein, 10 aa, Mycobacterium
QPNHAEAKGA

SEQ ID NO: 1169637 - protein, 6 aa, Mycobacterium
QPNNGH

SEQ ID NO: 1169638 - protein, 4 aa, Mycobacterium
QPNV

SEQ ID NO: 1169639 - protein, 7 aa, Mycobacterium
QPPAASS

SEQ ID NO: 1169640 - protein, 7 aa, Mycobacterium
QPPAPQR

SEQ ID NO: 1169641 - protein, 13 aa, Mycobacterium
QPPDAALTETTQM

SEQ ID NO: 1169642 - protein, 7 aa, Mycobacterium
QPPDLSA

SEQ ID NO: 1169643 - protein, 9 aa, Mycobacterium
QPPETYRND

SEQ ID NO: 1169644 - protein, 8 aa, Mycobacterium
QPPGAVNG

SEQ ID NO: 1169645 - protein, 10 aa, Mycobacterium
QPPGHDDTRV

SEQ ID NO: 1169646 - protein, 6 aa, Mycobacterium
QPPRNG

SEQ ID NO: 1169647 - protein, 15 aa, Mycobacterium
QPPRPGYPADPLARR

SEQ ID NO: 1169648 - protein, 12 aa, Mycobacterium
QPPTTGTELRPI

SEQ ID NO: 1169649 - protein, 11 aa, Mycobacterium
QPQKQWDQAKA

SEQ ID NO: 1169650 - protein, 9 aa, Mycobacterium
QPQNSPMPV

SEQ ID NO: 1169651 - protein, 9 aa, Mycobacterium
QPQQMTPAA

SEQ ID NO: 1169652 - protein, 4 aa, Mycobacterium
QPRD

SEQ ID NO: 1169653 - protein, 8 aa, Mycobacterium
QPRDDEEV

SEQ ID NO: 1169654 - protein, 7 aa, Mycobacterium
QPRGTTR

SEQ ID NO: 1169655 - protein, 5 aa, Mycobacterium
QPRRA

SEQ ID NO: 1169656 - protein, 9 aa, Mycobacterium
QPRSGTTDL

SEQ ID NO: 1169657 - protein, 8 aa, Mycobacterium
QPRTARER

SEQ ID NO: 1169658 - protein, 13 aa, Mycobacterium
QPSGSVARYETRV

SEQ ID NO: 1169659 - protein, 8 aa, Mycobacterium
QPSLSQQI

SEQ ID NO: 1169660 - protein, 6 aa, Mycobacterium
QPSPEN

SEQ ID NO: 1169661 - protein, 8 aa, Mycobacterium
QPSPGAAL

SEQ ID NO: 1169662 - protein, 5 aa, Mycobacterium
QPSSV

SEQ ID NO: 1169663 - protein, 4 aa, Mycobacterium
QPTD

SEQ ID NO: 1169664 - protein, 15 aa, Mycobacterium
QPTDDLPTADGTGSM

SEQ ID NO: 1169665 - protein, 6 aa, Mycobacterium
QPTLPR

SEQ ID NO: 1169666 - protein, 7 aa, Mycobacterium
QPTLTAG

SEQ ID NO: 1169667 - protein, 14 aa, Mycobacterium
QPTVEIDPSQHPVT

SEQ ID NO: 1169668 - protein, 11 aa, Mycobacterium
QPVDGDRRRRL

SEQ ID NO: 1169669 - protein, 4 aa, Mycobacterium
QPVG

SEQ ID NO: 1169670 - protein, 22 aa, Mycobacterium
QPVHPEPTLTEEAYAEDKKPAR

SEQ ID NO: 1169671 - protein, 4 aa, Mycobacterium
QPVL

SEQ ID NO: 1169672 - protein, 5 aa, Mycobacterium
QPVSA

SEQ ID NO: 1169673 - protein, 6 aa, Mycobacterium
QPVSSP

SEQ ID NO: 1169674 - protein, 7 aa, Mycobacterium
QPVTTAN

SEQ ID NO: 1169675 - protein, 5 aa, Mycobacterium
QPYGD

SEQ ID NO: 1169676 - protein, 8 aa, Mycobacterium
QQAASRGA

SEQ ID NO: 1169677 - protein, 11 aa, Mycobacterium
QQAEGKLPPAE

SEQ ID NO: 1169678 - protein, 19 aa, Mycobacterium
QQAELDPDNAYVTDQSDGE

SEQ ID NO: 1169679 - protein, 7 aa, Mycobacterium
QQAEQIR

SEQ ID NO: 1169680 - protein, 8 aa, Mycobacterium
QQAGQDVS

SEQ ID NO: 1169681 - protein, 6 aa, Mycobacterium
QQAGVT

SEQ ID NO: 1169682 - protein, 13 aa, Mycobacterium
QQAPDRHTRLDAS

SEQ ID NO: 1169683 - protein, 7 aa, Mycobacterium
QQASEPV

SEQ ID NO: 1169684 - protein, 5 aa, Mycobacterium
QQATA

SEQ ID NO: 1169685 - protein, 4 aa, Mycobacterium
QQDN

SEQ ID NO: 1169686 - protein, 23 aa, Mycobacterium
QQDPTIVTGASSRIEGIGRPRVE

SEQ ID NO: 1169687 - protein, 4 aa, Mycobacterium
QQDS

SEQ ID NO: 1169688 - protein, 18 aa, Mycobacterium
QQDTTAKPAAARRKNASS

SEQ ID NO: 1169689 - protein, 6 aa, Mycobacterium
QQEAGK

SEQ ID NO: 1169690 - protein, 11 aa, Mycobacterium
QQEDKEELGDY

SEQ ID NO: 1169691 - protein, 6 aa, Mycobacterium
QQEERG

SEQ ID NO: 1169692 - protein, 7 aa, Mycobacterium
QQEYGED

SEQ ID NO: 1169693 - protein, 5 aa, Mycobacterium
QQGEH

SEQ ID NO: 1169694 - protein, 13 aa, Mycobacterium
QQGEHRDGIPNRS

SEQ ID NO: 1169695 - protein, 11 aa, Mycobacterium
QQGPGERPVGA

SEQ ID NO: 1169696 - protein, 6 aa, Mycobacterium
QQGTGA

SEQ ID NO: 1169697 - protein, 10 aa, Mycobacterium
QQIGSPEELY

SEQ ID NO: 1169698 - protein, 18 aa, Mycobacterium
QQLEQEADRVRGQRWGPR

SEQ ID NO: 1169699 - protein, 8 aa, Mycobacterium
QQLGTGHA

SEQ ID NO: 1169700 - protein, 8 aa, Mycobacterium
QQLTDAPR

SEQ ID NO: 1169701 - protein, 6 aa, Mycobacterium
QQNQMK

SEQ ID NO: 1169702 - protein, 9 aa, Mycobacterium
QQPDSAVSG

SEQ ID NO: 1169703 - protein, 20 aa, Mycobacterium
QQPFGGSRASGTNDKAGSPM

SEQ ID NO: 1169704 - protein, 6 aa, Mycobacterium
QQPGRA

SEQ ID NO: 1169705 - protein, 17 aa, Mycobacterium
QQPIPDVPGPESLPSVQ

SEQ ID NO: 1169706 - protein, 5 aa, Mycobacterium
QQPRR

SEQ ID NO: 1169707 - protein, 5 aa, Mycobacterium
QQPSA

SEQ ID NO: 1169708 - protein, 11 aa, Mycobacterium
QQRAKKRLPKS

SEQ ID NO: 1169709 - protein, 9 aa, Mycobacterium
QQRDDPVMT

SEQ ID NO: 1169710 - protein, 8 aa, Mycobacterium
QQREEGLT

SEQ ID NO: 1169711 - protein, 6 aa, Mycobacterium
QQRETA

SEQ ID NO: 1169712 - protein, 11 aa, Mycobacterium
QQRGMERTRSD

SEQ ID NO: 1169713 - protein, 5 aa, Mycobacterium
QQRTP

SEQ ID NO: 1169714 - protein, 14 aa, Mycobacterium
QQSENRPRTVQQGI

SEQ ID NO: 1169715 - protein, 8 aa, Mycobacterium
QQSGPPAD

SEQ ID NO: 1169716 - protein, 7 aa, Mycobacterium
QQSPNST

SEQ ID NO: 1169717 - protein, 23 aa, Mycobacterium
QQTDYPTVGPDRPEYEPRGCPRG

SEQ ID NO: 1169718 - protein, 10 aa, Mycobacterium
QQWEGDPSAR

SEQ ID NO: 1169719 - protein, 12 aa, Mycobacterium
QQYLGAGQTRTC

SEQ ID NO: 1169720 - protein, 9 aa, Mycobacterium
QRAAANPGT

SEQ ID NO: 1169721 - protein, 7 aa, Mycobacterium
QRAAERG

SEQ ID NO: 1169722 - protein, 6 aa, Mycobacterium
QRAEED

SEQ ID NO: 1169723 - protein, 5 aa, Mycobacterium
QRAGG

SEQ ID NO: 1169724 - protein, 12 aa, Mycobacterium
QRAGQRAQTVGT

SEQ ID NO: 1169725 - protein, 8 aa, Mycobacterium
QRAKEAGA

SEQ ID NO: 1169726 - protein, 7 aa, Mycobacterium
QRAKPRD

SEQ ID NO: 1169727 - protein, 9 aa, Mycobacterium
QRAQEAEDL

SEQ ID NO: 1169728 - protein, 15 aa, Mycobacterium
QRARGGAGAGQLQGR

SEQ ID NO: 1169729 - protein, 5 aa, Mycobacterium
QRARR

SEQ ID NO: 1169730 - protein, 8 aa, Mycobacterium
QRATGVGK

SEQ ID NO: 1169731 - protein, 4 aa, Mycobacterium
QRAV

SEQ ID NO: 1169732 - protein, 13 aa, Mycobacterium
QRAVGGETILAEL

SEQ ID NO: 1169733 - protein, 6 aa, Mycobacterium
QRDAAA

SEQ ID NO: 1169734 - protein, 17 aa, Mycobacterium
QRDAEASADAGAADKPA

SEQ ID NO: 1169735 - protein, 9 aa, Mycobacterium
QRDDALARS

SEQ ID NO: 1169736 - protein, 9 aa, Mycobacterium
QRDGESVAG

SEQ ID NO: 1169737 - protein, 14 aa, Mycobacterium
QRDGQSPDGEGRTP

SEQ ID NO: 1169738 - protein, 8 aa, Mycobacterium
QRDPSHPA

SEQ ID NO: 1169739 - protein, 9 aa, Mycobacterium
QRDTPVAGT

SEQ ID NO: 1169740 - protein, 6 aa, Mycobacterium
QREAAQ

SEQ ID NO: 1169741 - protein, 10 aa, Mycobacterium
QREAATEARW

SEQ ID NO: 1169742 - protein, 19 aa, Mycobacterium
QREERSGATERNRRLDNDA

SEQ ID NO: 1169743 - protein, 6 aa, Mycobacterium
QREHPV

SEQ ID NO: 1169744 - protein, 5 aa, Mycobacterium
QREPG

SEQ ID NO: 1169745 - protein, 18 aa, Mycobacterium
QREPSARAAASDADAARS

SEQ ID NO: 1169746 - protein, 8 aa, Mycobacterium
QRERAGKQ

SEQ ID NO: 1169747 - protein, 7 aa, Mycobacterium
QRESMGN

SEQ ID NO: 1169748 - protein, 7 aa, Mycobacterium
QRESTQS

SEQ ID NO: 1169749 - protein, 7 aa, Mycobacterium
QRETGGR

SEQ ID NO: 1169750 - protein, 13 aa, Mycobacterium
QRGADREPATGED

SEQ ID NO: 1169751 - protein, 6 aa, Mycobacterium
QRGDTA

SEQ ID NO: 1169752 - protein, 5 aa, Mycobacterium
QRGEH

SEQ ID NO: 1169753 - protein, 14 aa, Mycobacterium
QRGQGDPPSGFNPL

SEQ ID NO: 1169754 - protein, 5 aa, Mycobacterium
QRGRA

SEQ ID NO: 1169755 - protein, 10 aa, Mycobacterium
QRGREAHEKW

SEQ ID NO: 1169756 - protein, 12 aa, Mycobacterium
QRGRPVESTGEM

SEQ ID NO: 1169757 - protein, 6 aa, Mycobacterium
QRGRSL

SEQ ID NO: 1169758 - protein, 8 aa, Mycobacterium
QRGSAAER

SEQ ID NO: 1169759 - protein, 6 aa, Mycobacterium
QRISDT

SEQ ID NO: 1169760 - protein, 20 aa, Mycobacterium
QRLGAEAARPHRVTHRRLTR

SEQ ID NO: 1169761 - protein, 10 aa, Mycobacterium
QRLPGKASQQ

SEQ ID NO: 1169762 - protein, 13 aa, Mycobacterium
QRMNESDNPDTVS

SEQ ID NO: 1169763 - protein, 6 aa, Mycobacterium
QRNAID

SEQ ID NO: 1169764 - protein, 10 aa, Mycobacterium
QRNGDAPPRL

SEQ ID NO: 1169765 - protein, 5 aa, Mycobacterium
QRNTS

SEQ ID NO: 1169766 - protein, 8 aa, Mycobacterium
QRPADSGD

SEQ ID NO: 1169767 - protein, 8 aa, Mycobacterium
QRPAQGGD

SEQ ID NO: 1169768 - protein, 7 aa, Mycobacterium
QRPDGSW

SEQ ID NO: 1169769 - protein, 8 aa, Mycobacterium
QRPDGTAQ

SEQ ID NO: 1169770 - protein, 6 aa, Mycobacterium
QRPGIA

SEQ ID NO: 1169771 - protein, 9 aa, Mycobacterium
QRPTPGPAD

SEQ ID NO: 1169772 - protein, 12 aa, Mycobacterium
QRQATGTVPTDT

SEQ ID NO: 1169773 - protein, 7 aa, Mycobacterium
QRQRERT

SEQ ID NO: 1169774 - protein, 5 aa, Mycobacterium
QRRAA

SEQ ID NO: 1169775 - protein, 7 aa, Mycobacterium
QRRDGRY

SEQ ID NO: 1169776 - protein, 11 aa, Mycobacterium
QRRERKQPPVQ

SEQ ID NO: 1169777 - protein, 15 aa, Mycobacterium
QRRGTATSRSTVGTV

SEQ ID NO: 1169778 - protein, 5 aa, Mycobacterium
QRRLT

SEQ ID NO: 1169779 - protein, 6 aa, Mycobacterium
QRRPTA

SEQ ID NO: 1169780 - protein, 10 aa, Mycobacterium
QRRQRAAHPA

SEQ ID NO: 1169781 - protein, 10 aa, Mycobacterium
QRRSAAGARS

SEQ ID NO: 1169782 - protein, 8 aa, Mycobacterium
QRSGAPEF

SEQ ID NO: 1169783 - protein, 8 aa, Mycobacterium
QRSGGRPV

SEQ ID NO: 1169784 - protein, 9 aa, Mycobacterium
QRSGRARGA

SEQ ID NO: 1169785 - protein, 13 aa, Mycobacterium
QRSGRRVGPDQLS

SEQ ID NO: 1169786 - protein, 19 aa, Mycobacterium
QRSPAGKADYRWAREQAIG

SEQ ID NO: 1169787 - protein, 7 aa, Mycobacterium
QRSPHSE

SEQ ID NO: 1169788 - protein, 9 aa, Mycobacterium
QRSVSGNAV

SEQ ID NO: 1169789 - protein, 4 aa, Mycobacterium
QRTA

SEQ ID NO: 1169790 - protein, 10 aa, Mycobacterium
QRTADRAARM

SEQ ID NO: 1169791 - protein, 8 aa, Mycobacterium
QRTAEEDA

SEQ ID NO: 1169792 - protein, 7 aa, Mycobacterium
QRTGKPH

SEQ ID NO: 1169793 - protein, 11 aa, Mycobacterium
QRTPAGKPDYR

SEQ ID NO: 1169794 - protein, 5 aa, Mycobacterium
QRTPV

SEQ ID NO: 1169795 - protein, 9 aa, Mycobacterium
QRVDGPPAN

SEQ ID NO: 1169796 - protein, 6 aa, Mycobacterium
QRVQGA

SEQ ID NO: 1169797 - protein, 4 aa, Mycobacterium
QRVR

SEQ ID NO: 1169798 - protein, 14 aa, Mycobacterium
QRVTATDTVAPDQS

SEQ ID NO: 1169799 - protein, 4 aa, Mycobacterium
QRYA

SEQ ID NO: 1169800 - protein, 11 aa, Mycobacterium
QRYAGTDRQVR

SEQ ID NO: 1169801 - protein, 9 aa, Mycobacterium
QRYASESSD

SEQ ID NO: 1169802 - protein, 5 aa, Mycobacterium
QRYPN

SEQ ID NO: 1169803 - protein, 6 aa, Mycobacterium
QSAADV

SEQ ID NO: 1169804 - protein, 8 aa, Mycobacterium
QSAAEQAV

SEQ ID NO: 1169805 - protein, 9 aa, Mycobacterium
QSADPDGRE

SEQ ID NO: 1169806 - protein, 19 aa, Mycobacterium
QSAEDSSANFADVRYVTAV

SEQ ID NO: 1169807 - protein, 9 aa, Mycobacterium
QSAGQDARL

SEQ ID NO: 1169808 - protein, 5 aa, Mycobacterium
QSDET

SEQ ID NO: 1169809 - protein, 14 aa, Mycobacterium
QSDIGRPKAQSARD

SEQ ID NO: 1169810 - protein, 4 aa, Mycobacterium
QSDL

SEQ ID NO: 1169811 - protein, 6 aa, Mycobacterium
QSDPAR

SEQ ID NO: 1169812 - protein, 15 aa, Mycobacterium
QSDPERRRRYQRARG

SEQ ID NO: 1169813 - protein, 13 aa, Mycobacterium
QSDQQRAAGELRL

SEQ ID NO: 1169814 - protein, 9 aa, Mycobacterium
QSEDGPIPE

SEQ ID NO: 1169815 - protein, 20 aa, Mycobacterium
QSEIEDYERRRPSWKPRTLP

SEQ ID NO: 1169816 - protein, 7 aa, Mycobacterium
QSEPDGL

SEQ ID NO: 1169817 - protein, 12 aa, Mycobacterium
QSGAAPGAGETR

SEQ ID NO: 1169818 - protein, 5 aa, Mycobacterium
QSGAV

SEQ ID NO: 1169819 - protein, 6 aa, Mycobacterium
QSGDTV

SEQ ID NO: 1169820 - protein, 10 aa, Mycobacterium
QSGEDISSYG

SEQ ID NO: 1169821 - protein, 7 aa, Mycobacterium
QSGETAD

SEQ ID NO: 1169822 - protein, 10 aa, Mycobacterium
QSGGSGTTVN

SEQ ID NO: 1169823 - protein, 5 aa, Mycobacterium
QSGIR

SEQ ID NO: 1169824 - protein, 7 aa, Mycobacterium
QSGLGPA

SEQ ID NO: 1169825 - protein, 8 aa, Mycobacterium
QSGNGYDA

SEQ ID NO: 1169826 - protein, 21 aa, Mycobacterium
QSGPQRDRDSYATDPPPGRGE

SEQ ID NO: 1169827 - protein, 5 aa, Mycobacterium
QSGRE

SEQ ID NO: 1169828 - protein, 6 aa, Mycobacterium
QSGRTA

SEQ ID NO: 1169829 - protein, 18 aa, Mycobacterium
QSGTPTGRRHPKPPATVR

SEQ ID NO: 1169830 - protein, 6 aa, Mycobacterium
QSHANV

SEQ ID NO: 1169831 - protein, 6 aa, Mycobacterium
QSIEER

SEQ ID NO: 1169832 - protein, 9 aa, Mycobacterium
QSKAGKTVD

SEQ ID NO: 1169833 - protein, 7 aa, Mycobacterium
QSKPVSE

SEQ ID NO: 1169834 - protein, 9 aa, Mycobacterium
QSKSAYQAE

SEQ ID NO: 1169835 - protein, 5 aa, Mycobacterium
QSLGT

SEQ ID NO: 1169836 - protein, 14 aa, Mycobacterium
QSLPERAEEVSQQA

SEQ ID NO: 1169837 - protein, 6 aa, Mycobacterium
QSLPFE

SEQ ID NO: 1169838 - protein, 5 aa, Mycobacterium
QSLPG

SEQ ID NO: 1169839 - protein, 12 aa, Mycobacterium
QSMGGNGLTKEY

SEQ ID NO: 1169840 - protein, 15 aa, Mycobacterium
QSMGGVGSSADNALA

SEQ ID NO: 1169841 - protein, 6 aa, Mycobacterium
QSMPEE

SEQ ID NO: 1169842 - protein, 4 aa, Mycobacterium
QSPA

SEQ ID NO: 1169843 - protein, 6 aa, Mycobacterium
QSPDGL

SEQ ID NO: 1169844 - protein, 13 aa, Mycobacterium
QSPDWSRTYAPGH

SEQ ID NO: 1169845 - protein, 10 aa, Mycobacterium
QSPPGTPNPG

SEQ ID NO: 1169846 - protein, 6 aa, Mycobacterium
QSPTMG

SEQ ID NO: 1169847 - protein, 9 aa, Mycobacterium
QSPVADTTI

SEQ ID NO: 1169848 - protein, 5 aa, Mycobacterium
QSQAA

SEQ ID NO: 1169849 - protein, 4 aa, Mycobacterium
QSQH

SEQ ID NO: 1169850 - protein, 5 aa, Mycobacterium
QSRGE

SEQ ID NO: 1169851 - protein, 5 aa, Mycobacterium
QSRPI

SEQ ID NO: 1169852 - protein, 6 aa, Mycobacterium
QSRSDL

SEQ ID NO: 1169853 - protein, 5 aa, Mycobacterium
QSRTR

SEQ ID NO: 1169854 - protein, 7 aa, Mycobacterium
QSRTYDR

SEQ ID NO: 1169855 - protein, 5 aa, Mycobacterium
QSRYQ

SEQ ID NO: 1169856 - protein, 10 aa, Mycobacterium
QSSIDDPQLE

SEQ ID NO: 1169857 - protein, 11 aa, Mycobacterium
QSSKDAATACE

SEQ ID NO: 1169858 - protein, 8 aa, Mycobacterium
QSSLSHPQ

SEQ ID NO: 1169859 - protein, 13 aa, Mycobacterium
QSSPSACGGRALT

SEQ ID NO: 1169860 - protein, 7 aa, Mycobacterium
QSSRLSR

SEQ ID NO: 1169861 - protein, 12 aa, Mycobacterium
QSSYAASEEQQA

SEQ ID NO: 1169862 - protein, 6 aa, Mycobacterium
QSTDTG

SEQ ID NO: 1169863 - protein, 10 aa, Mycobacterium
QSTHGTANTN

SEQ ID NO: 1169864 - protein, 6 aa, Mycobacterium
QSTLPA

SEQ ID NO: 1169865 - protein, 5 aa, Mycobacterium
QSTTA

SEQ ID NO: 1169866 - protein, 9 aa, Mycobacterium
QSVAGGAYT

SEQ ID NO: 1169867 - protein, 8 aa, Mycobacterium
QSYGGDVR

SEQ ID NO: 1169868 - protein, 5 aa, Mycobacterium
QSYPG

SEQ ID NO: 1169869 - protein, 4 aa, Mycobacterium
QTAA

SEQ ID NO: 1169870 - protein, 6 aa, Mycobacterium
QTAARQ

SEQ ID NO: 1169871 - protein, 13 aa, Mycobacterium
QTADGRFALAGEG

SEQ ID NO: 1169872 - protein, 11 aa, Mycobacterium
QTAERAAERQV

SEQ ID NO: 1169873 - protein, 11 aa, Mycobacterium
QTAIDDGSVPA

SEQ ID NO: 1169874 - protein, 23 aa, Mycobacterium
QTAPAPPEVAPDGYQIGEEHPEL

SEQ ID NO: 1169875 - protein, 7 aa, Mycobacterium
QTAQDIN

SEQ ID NO: 1169876 - protein, 8 aa, Mycobacterium
QTASPQAA

SEQ ID NO: 1169877 - protein, 6 aa, Mycobacterium
QTAYGA

SEQ ID NO: 1169878 - protein, 17 aa, Mycobacterium
QTDADRRAAVENTPARK

SEQ ID NO: 1169879 - protein, 6 aa, Mycobacterium
QTDGVT

SEQ ID NO: 1169880 - protein, 7 aa, Mycobacterium
QTDPLAE

SEQ ID NO: 1169881 - protein, 7 aa, Mycobacterium
QTEADRA

SEQ ID NO: 1169882 - protein, 4 aa, Mycobacterium
QTEE

SEQ ID NO: 1169883 - protein, 9 aa, Mycobacterium
QTEETRRDP

SEQ ID NO: 1169884 - protein, 5 aa, Mycobacterium
QTEFE

SEQ ID NO: 1169885 - protein, 4 aa, Mycobacterium
QTEK

SEQ ID NO: 1169886 - protein, 5 aa, Mycobacterium
QTERT

SEQ ID NO: 1169887 - protein, 6 aa, Mycobacterium
QTFGGS

SEQ ID NO: 1169888 - protein, 16 aa, Mycobacterium
QTGEPAIKGSAVVQVT

SEQ ID NO: 1169889 - protein, 4 aa, Mycobacterium
QTGG

SEQ ID NO: 1169890 - protein, 7 aa, Mycobacterium
QTGPVGA

SEQ ID NO: 1169891 - protein, 6 aa, Mycobacterium
QTGSRD

SEQ ID NO: 1169892 - protein, 9 aa, Mycobacterium
QTGTAEDFA

SEQ ID NO: 1169893 - protein, 12 aa, Mycobacterium
QTGTHPRTRTEA

SEQ ID NO: 1169894 - protein, 11 aa, Mycobacterium
QTHGGNGMATE

SEQ ID NO: 1169895 - protein, 4 aa, Mycobacterium
QTKR

SEQ ID NO: 1169896 - protein, 4 aa, Mycobacterium
QTLD

SEQ ID NO: 1169897 - protein, 6 aa, Mycobacterium
QTLDDN

SEQ ID NO: 1169898 - protein, 11 aa, Mycobacterium
QTLEPATEETA

SEQ ID NO: 1169899 - protein, 11 aa, Mycobacterium
QTLRPAGLPDV

SEQ ID NO: 1169900 - protein, 9 aa, Mycobacterium
QTNADGDKL

SEQ ID NO: 1169901 - protein, 15 aa, Mycobacterium
QTNTGDHEDSLRNAQ

SEQ ID NO: 1169902 - protein, 6 aa, Mycobacterium
QTPDTR

SEQ ID NO: 1169903 - protein, 6 aa, Mycobacterium
QTPPLD

SEQ ID NO: 1169904 - protein, 4 aa, Mycobacterium
QTPQ

SEQ ID NO: 1169905 - protein, 6 aa, Mycobacterium
QTPQDC

SEQ ID NO: 1169906 - protein, 6 aa, Mycobacterium
QTPQYP

SEQ ID NO: 1169907 - protein, 5 aa, Mycobacterium
QTPSD

SEQ ID NO: 1169908 - protein, 6 aa, Mycobacterium
QTPVSS

SEQ ID NO: 1169909 - protein, 10 aa, Mycobacterium
QTQGQGHETT

SEQ ID NO: 1169910 - protein, 6 aa, Mycobacterium
QTQTGD

SEQ ID NO: 1169911 - protein, 7 aa, Mycobacterium
QTRARAG

SEQ ID NO: 1169912 - protein, 15 aa, Mycobacterium
QTRDHADHRSYAGTV

SEQ ID NO: 1169913 - protein, 5 aa, Mycobacterium
QTREE

SEQ ID NO: 1169914 - protein, 9 aa, Mycobacterium
QTREPNSQI

SEQ ID NO: 1169915 - protein, 6 aa, Mycobacterium
QTRESR

SEQ ID NO: 1169916 - protein, 5 aa, Mycobacterium
QTRKS

SEQ ID NO: 1169917 - protein, 7 aa, Mycobacterium
QTRREGR

SEQ ID NO: 1169918 - protein, 6 aa, Mycobacterium
QTRRPD

SEQ ID NO: 1169919 - protein, 16 aa, Mycobacterium
QTSAVKEYAEQTAVTS

SEQ ID NO: 1169920 - protein, 14 aa, Mycobacterium
QTSDSDDGSDLAEA

SEQ ID NO: 1169921 - protein, 6 aa, Mycobacterium
QTSGWP

SEQ ID NO: 1169922 - protein, 7 aa, Mycobacterium
QTSQVRF

SEQ ID NO: 1169923 - protein, 43 aa, Mycobacterium
QTTDPEEGGAEAKEQSSGDRSGSGGPPVEGGAGDIPRDPTLQD

SEQ ID NO: 1169924 - protein, 37 aa, Mycobacterium
QTTSAPANSWGTSAGAMSPIAGAPVDATVEREPAGPL

SEQ ID NO: 1169925 - protein, 6 aa, Mycobacterium
QTVPEG

SEQ ID NO: 1169926 - protein, 9 aa, Mycobacterium
QTVPRTDRG

SEQ ID NO: 1169927 - protein, 8 aa, Mycobacterium
QTVTKEYD

SEQ ID NO: 1169928 - protein, 10 aa, Mycobacterium
QTYGDAERDV

SEQ ID NO: 1169929 - protein, 8 aa, Mycobacterium
QVAAGGER

SEQ ID NO: 1169930 - protein, 4 aa, Mycobacterium
QVDA

SEQ ID NO: 1169931 - protein, 14 aa, Mycobacterium
QVDAQRGGIPGGQD

SEQ ID NO: 1169932 - protein, 17 aa, Mycobacterium
QVDDERDAVRAATARLG

SEQ ID NO: 1169933 - protein, 8 aa, Mycobacterium
QVDEPASI

SEQ ID NO: 1169934 - protein, 7 aa, Mycobacterium
QVDGGLA

SEQ ID NO: 1169935 - protein, 6 aa, Mycobacterium
QVDPGE

SEQ ID NO: 1169936 - protein, 17 aa, Mycobacterium
QVDQNARPPHQRRPRFD

SEQ ID NO: 1169937 - protein, 4 aa, Mycobacterium
QVEA

SEQ ID NO: 1169938 - protein, 4 aa, Mycobacterium
QVEQ

SEQ ID NO: 1169939 - protein, 6 aa, Mycobacterium
QVEQVS

SEQ ID NO: 1169940 - protein, 9 aa, Mycobacterium
QVESLGPQS

SEQ ID NO: 1169941 - protein, 6 aa, Mycobacterium
QVGDDA

SEQ ID NO: 1169942 - protein, 10 aa, Mycobacterium
QVGEEGAEQT

SEQ ID NO: 1169943 - protein, 19 aa, Mycobacterium
QVGNRAVGDRPSQNLDTGQ

SEQ ID NO: 1169944 - protein, 5 aa, Mycobacterium
QVGPR

SEQ ID NO: 1169945 - protein, 7 aa, Mycobacterium
QVGRTMS

SEQ ID NO: 1169946 - protein, 5 aa, Mycobacterium
QVGTP

SEQ ID NO: 1169947 - protein, 10 aa, Mycobacterium
QVKGKVGDAL

SEQ ID NO: 1169948 - protein, 5 aa, Mycobacterium
QVKPA

SEQ ID NO: 1169949 - protein, 5 aa, Mycobacterium
QVPAD

SEQ ID NO: 1169950 - protein, 12 aa, Mycobacterium
QVPAGTGTDLDA

SEQ ID NO: 1169951 - protein, 4 aa, Mycobacterium
QVPG

SEQ ID NO: 1169952 - protein, 5 aa, Mycobacterium
QVPPA

SEQ ID NO: 1169953 - protein, 5 aa, Mycobacterium
QVPPN

SEQ ID NO: 1169954 - protein, 17 aa, Mycobacterium
QVPPPTPRRALEEVLQF

SEQ ID NO: 1169955 - protein, 4 aa, Mycobacterium
QVPT

SEQ ID NO: 1169956 - protein, 7 aa, Mycobacterium
QVRAGNV

SEQ ID NO: 1169957 - protein, 6 aa, Mycobacterium
QVRKPD

SEQ ID NO: 1169958 - protein, 7 aa, Mycobacterium
QVSGRYT

SEQ ID NO: 1169959 - protein, 10 aa, Mycobacterium
QVSRRTDRAS

SEQ ID NO: 1169960 - protein, 8 aa, Mycobacterium
QVSSDDGR

SEQ ID NO: 1169961 - protein, 5 aa, Mycobacterium
QVSSG

SEQ ID NO: 1169962 - protein, 10 aa, Mycobacterium
QVSSGEDVRP

SEQ ID NO: 1169963 - protein, 9 aa, Mycobacterium
QVSSPEAAE

SEQ ID NO: 1169964 - protein, 5 aa, Mycobacterium
QVSVT

SEQ ID NO: 1169965 - protein, 7 aa, Mycobacterium
QVTGRDG

SEQ ID NO: 1169966 - protein, 16 aa, Mycobacterium
QVTPPPPPAGPPAGTQ

SEQ ID NO: 1169967 - protein, 5 aa, Mycobacterium
QVTRP

SEQ ID NO: 1169968 - protein, 7 aa, Mycobacterium
QVTSGPA

SEQ ID NO: 1169969 - protein, 15 aa, Mycobacterium
QVVGPREGDTPRTRL

SEQ ID NO: 1169970 - protein, 5 aa, Mycobacterium
QWQEE

SEQ ID NO: 1169971 - protein, 11 aa, Mycobacterium
QYAESEDEADQ

SEQ ID NO: 1169972 - protein, 11 aa, Mycobacterium
QYAKPRSSDID

SEQ ID NO: 1169973 - protein, 9 aa, Mycobacterium
QYDEGNPIG

SEQ ID NO: 1169974 - protein, 10 aa, Mycobacterium
QYERDGAPGD

SEQ ID NO: 1169975 - protein, 27 aa, Mycobacterium
QYERQAEKAEAAGRTKDAEQARANAEQ

SEQ ID NO: 1169976 - protein, 9 aa, Mycobacterium
QYGEQSNNI

SEQ ID NO: 1169977 - protein, 9 aa, Mycobacterium
QYNNPDNVE

SEQ ID NO: 1169978 - protein, 20 aa, Mycobacterium
QYPAATPRAVTTASAGGPFT

SEQ ID NO: 1169979 - protein, 21 aa, Mycobacterium
QYPDNVAGGMGGAPPDEETFS

SEQ ID NO: 1169980 - protein, 4 aa, Mycobacterium
QYRD

SEQ ID NO: 1169981 - protein, 5 aa, Mycobacterium
QYSPR

SEQ ID NO: 1169982 - protein, 6 aa, Mycobacterium
QYTETN

SEQ ID NO: 1169983 - protein, 16 aa, Mycobacterium
QYTPRELEGQNGHHDA

SEQ ID NO: 1169984 - protein, 10 aa, Mycobacterium
RAAAASAGYP

SEQ ID NO: 1169985 - protein, 17 aa, Mycobacterium
RAAADGKTVATPQETKD

SEQ ID NO: 1169986 - protein, 15 aa, Mycobacterium
RAAADVPAKYKSEPW

SEQ ID NO: 1169987 - protein, 5 aa, Mycobacterium
RAAAG

SEQ ID NO: 1169988 - protein, 6 aa, Mycobacterium
RAAATI

SEQ ID NO: 1169989 - protein, 12 aa, Mycobacterium
RAAATPDQPQPF

SEQ ID NO: 1169990 - protein, 7 aa, Mycobacterium
RAAAVNP

SEQ ID NO: 1169991 - protein, 10 aa, Mycobacterium
RAADAPDEVV

SEQ ID NO: 1169992 - protein, 7 aa, Mycobacterium
RAADEDL

SEQ ID NO: 1169993 - protein, 7 aa, Mycobacterium
RAADPEV

SEQ ID NO: 1169994 - protein, 20 aa, Mycobacterium
RAADRYTRKHGHRPKNDYGS

SEQ ID NO: 1169995 - protein, 8 aa, Mycobacterium
RAAEAADA

SEQ ID NO: 1169996 - protein, 8 aa, Mycobacterium
RAAEAADE

SEQ ID NO: 1169997 - protein, 18 aa, Mycobacterium
RAAEAADQQLTAQRNALT

SEQ ID NO: 1169998 - protein, 6 aa, Mycobacterium
RAAEAD

SEQ ID NO: 1169999 - protein, 11 aa, Mycobacterium
RAAEDAAAAGV

SEQ ID NO: 1170000 - protein, 6 aa, Mycobacterium
RAAEDP

SEQ ID NO: 1170001 - protein, 6 aa, Mycobacterium
RAAEEA

SEQ ID NO: 1170002 - protein, 6 aa, Mycobacterium
RAAELA

SEQ ID NO: 1170003 - protein, 5 aa, Mycobacterium
RAAEP

SEQ ID NO: 1170004 - protein, 6 aa, Mycobacterium
RAAEPL

SEQ ID NO: 1170005 - protein, 6 aa, Mycobacterium
RAAERQ

SEQ ID NO: 1170006 - protein, 8 aa, Mycobacterium
RAAESTGR

SEQ ID NO: 1170007 - protein, 9 aa, Mycobacterium
RAAETERDE

SEQ ID NO: 1170008 - protein, 7 aa, Mycobacterium
RAAETPE

SEQ ID NO: 1170009 - protein, 7 aa, Mycobacterium
RAAGADE

SEQ ID NO: 1170010 - protein, 18 aa, Mycobacterium
RAAGAKAGLAVKPGTPID

SEQ ID NO: 1170011 - protein, 15 aa, Mycobacterium
RAAGAQGSAGEDGLG

SEQ ID NO: 1170012 - protein, 9 aa, Mycobacterium
RAAGEAPAW

SEQ ID NO: 1170013 - protein, 7 aa, Mycobacterium
RAAGEGL

SEQ ID NO: 1170014 - protein, 6 aa, Mycobacterium
RAAGEM

SEQ ID NO: 1170015 - protein, 7 aa, Mycobacterium
RAAGHPD

SEQ ID NO: 1170016 - protein, 8 aa, Mycobacterium
RAAGLDPS

SEQ ID NO: 1170017 - protein, 21 aa, Mycobacterium
RAAGLTDADVEAARTGAPADA

SEQ ID NO: 1170018 - protein, 8 aa, Mycobacterium
RAAGPDNL

SEQ ID NO: 1170019 - protein, 9 aa, Mycobacterium
RAAGSTAQR

SEQ ID NO: 1170020 - protein, 44 aa, Mycobacterium
RAAGTTERTGSATALTGPSTAAGTAAETSGSRATGAATTAGATA

SEQ ID NO: 1170021 - protein, 9 aa, Mycobacterium
RAAHAGRDW

SEQ ID NO: 1170022 - protein, 13 aa, Mycobacterium
RAAHRKEAEGPIK

SEQ ID NO: 1170023 - protein, 11 aa, Mycobacterium
RAAHSTGAASE

SEQ ID NO: 1170024 - protein, 7 aa, Mycobacterium
RAAKRAV

SEQ ID NO: 1170025 - protein, 7 aa, Mycobacterium
RAALEAD

SEQ ID NO: 1170026 - protein, 9 aa, Mycobacterium
RAAPAPEPL

SEQ ID NO: 1170027 - protein, 12 aa, Mycobacterium
RAAPDGRRAPRG

SEQ ID NO: 1170028 - protein, 7 aa, Mycobacterium
RAAPDGS

SEQ ID NO: 1170029 - protein, 9 aa, Mycobacterium
RAAPGYAAY

SEQ ID NO: 1170030 - protein, 7 aa, Mycobacterium
RAAPQAD

SEQ ID NO: 1170031 - protein, 7 aa, Mycobacterium
RAAPYSM

SEQ ID NO: 1170032 - protein, 6 aa, Mycobacterium
RAAQRE

SEQ ID NO: 1170033 - protein, 5 aa, Mycobacterium
RAAQV

SEQ ID NO: 1170034 - protein, 4 aa, Mycobacterium
RAAR

SEQ ID NO: 1170035 - protein, 9 aa, Mycobacterium
RAARADAET

SEQ ID NO: 1170036 - protein, 7 aa, Mycobacterium
RAARAGV

SEQ ID NO: 1170037 - protein, 12 aa, Mycobacterium
RAARASSVLDGG

SEQ ID NO: 1170038 - protein, 10 aa, Mycobacterium
RAARGEMDTA

SEQ ID NO: 1170039 - protein, 9 aa, Mycobacterium
RAASQYADE

SEQ ID NO: 1170040 - protein, 8 aa, Mycobacterium
RAATAGSF

SEQ ID NO: 1170041 - protein, 7 aa, Mycobacterium
RAATAYG

SEQ ID NO: 1170042 - protein, 7 aa, Mycobacterium
RAATDQA

SEQ ID NO: 1170043 - protein, 5 aa, Mycobacterium
RAATG

SEQ ID NO: 1170044 - protein, 6 aa, Mycobacterium
RAATQD

SEQ ID NO: 1170045 - protein, 7 aa, Mycobacterium
RAAVSGP

SEQ ID NO: 1170046 - protein, 9 aa, Mycobacterium
RADAARNRD

SEQ ID NO: 1170047 - protein, 11 aa, Mycobacterium
RADAEVDANKG

SEQ ID NO: 1170048 - protein, 8 aa, Mycobacterium
RADARHPP

SEQ ID NO: 1170049 - protein, 11 aa, Mycobacterium
RADDAGVSAKQ

SEQ ID NO: 1170050 - protein, 5 aa, Mycobacterium
RADDE

SEQ ID NO: 1170051 - protein, 13 aa, Mycobacterium
RADDQGLVDPSDA

SEQ ID NO: 1170052 - protein, 13 aa, Mycobacterium
RADDTGPGTDQRA

SEQ ID NO: 1170053 - protein, 4 aa, Mycobacterium
RADE

SEQ ID NO: 1170054 - protein, 5 aa, Mycobacterium
RADEG

SEQ ID NO: 1170055 - protein, 6 aa, Mycobacterium
RADEQY

SEQ ID NO: 1170056 - protein, 5 aa, Mycobacterium
RADER

SEQ ID NO: 1170057 - protein, 18 aa, Mycobacterium
RADERRHRLNPGREPDEG

SEQ ID NO: 1170058 - protein, 5 aa, Mycobacterium
RADEV

SEQ ID NO: 1170059 - protein, 8 aa, Mycobacterium
RADFTGPE

SEQ ID NO: 1170060 - protein, 8 aa, Mycobacterium
RADGGGDI

SEQ ID NO: 1170061 - protein, 6 aa, Mycobacterium
RADGNP

SEQ ID NO: 1170062 - protein, 11 aa, Mycobacterium
RADGSQPPREF

SEQ ID NO: 1170063 - protein, 6 aa, Mycobacterium
RADGTD

SEQ ID NO: 1170064 - protein, 6 aa, Mycobacterium
RADGTF

SEQ ID NO: 1170065 - protein, 7 aa, Mycobacterium
RADHGTE

SEQ ID NO: 1170066 - protein, 8 aa, Mycobacterium
RADHPDEA

SEQ ID NO: 1170067 - protein, 9 aa, Mycobacterium
RADLATREE

SEQ ID NO: 1170068 - protein, 9 aa, Mycobacterium
RADNPAQQQ

SEQ ID NO: 1170069 - protein, 6 aa, Mycobacterium
RADPAA

SEQ ID NO: 1170070 - protein, 16 aa, Mycobacterium
RADPNGIGLTESDEIT

SEQ ID NO: 1170071 - protein, 4 aa, Mycobacterium
RADQ

SEQ ID NO: 1170072 - protein, 12 aa, Mycobacterium
RADRDEDATRAA

SEQ ID NO: 1170073 - protein, 7 aa, Mycobacterium
RADRRGD

SEQ ID NO: 1170074 - protein, 15 aa, Mycobacterium
RADSAVQKKGNDFAT

SEQ ID NO: 1170075 - protein, 6 aa, Mycobacterium
RADSDA

SEQ ID NO: 1170076 - protein, 5 aa, Mycobacterium
RADTG

SEQ ID NO: 1170077 - protein, 5 aa, Mycobacterium
RADVP

SEQ ID NO: 1170078 - protein, 10 aa, Mycobacterium
RAEAAGGAAV

SEQ ID NO: 1170079 - protein, 9 aa, Mycobacterium
RAEADRREG

SEQ ID NO: 1170080 - protein, 9 aa, Mycobacterium
RAEALDPSI

SEQ ID NO: 1170081 - protein, 7 aa, Mycobacterium
RAEDEEL

SEQ ID NO: 1170082 - protein, 13 aa, Mycobacterium
RAEEFGRRNGVPG

SEQ ID NO: 1170083 - protein, 5 aa, Mycobacterium
RAEEP

SEQ ID NO: 1170084 - protein, 6 aa, Mycobacterium
RAEEVG

SEQ ID NO: 1170085 - protein, 6 aa, Mycobacterium
RAEGAD

SEQ ID NO: 1170086 - protein, 10 aa, Mycobacterium
RAEGFTSGLP

SEQ ID NO: 1170087 - protein, 7 aa, Mycobacterium
RAEGGEA

SEQ ID NO: 1170088 - protein, 12 aa, Mycobacterium
RAEGKLPSDAPL

SEQ ID NO: 1170089 - protein, 10 aa, Mycobacterium
RAEGNPAAKT

SEQ ID NO: 1170090 - protein, 16 aa, Mycobacterium
RAEGVSASGTKSSGWR

SEQ ID NO: 1170091 - protein, 9 aa, Mycobacterium
RAEKARRRR

SEQ ID NO: 1170092 - protein, 11 aa, Mycobacterium
RAEKYSPYSGY

SEQ ID NO: 1170093 - protein, 25 aa, Mycobacterium
RAEPPVVDGNPADLVDNRSVGAAEL

SEQ ID NO: 1170094 - protein, 9 aa, Mycobacterium
RAEPSLRQR

SEQ ID NO: 1170095 - protein, 12 aa, Mycobacterium
RAEQAAKRERGE

SEQ ID NO: 1170096 - protein, 9 aa, Mycobacterium
RAEQAGQPC

SEQ ID NO: 1170097 - protein, 5 aa, Mycobacterium
RAERA

SEQ ID NO: 1170098 - protein, 8 aa, Mycobacterium
RAERDGDG

SEQ ID NO: 1170099 - protein, 9 aa, Mycobacterium
RAERRGDDM

SEQ ID NO: 1170100 - protein, 11 aa, Mycobacterium
RAERVARDRTE

SEQ ID NO: 1170101 - protein, 7 aa, Mycobacterium
RAESDEL

SEQ ID NO: 1170102 - protein, 7 aa, Mycobacterium
RAESDPA

SEQ ID NO: 1170103 - protein, 9 aa, Mycobacterium
RAESGGVLG

SEQ ID NO: 1170104 - protein, 15 aa, Mycobacterium
RAESPQSSATHDTTA

SEQ ID NO: 1170105 - protein, 8 aa, Mycobacterium
RAESPYSA

SEQ ID NO: 1170106 - protein, 7 aa, Mycobacterium
RAESRGC

SEQ ID NO: 1170107 - protein, 22 aa, Mycobacterium
RAESRRQAEAAAAAASAEVHRV

SEQ ID NO: 1170108 - protein, 10 aa, Mycobacterium
RAETERGLTS

SEQ ID NO: 1170109 - protein, 7 aa, Mycobacterium
RAETGAG

SEQ ID NO: 1170110 - protein, 14 aa, Mycobacterium
RAETGDTLSGKDDP

SEQ ID NO: 1170111 - protein, 8 aa, Mycobacterium
RAETPASE

SEQ ID NO: 1170112 - protein, 7 aa, Mycobacterium
RAFSAGG

SEQ ID NO: 1170113 - protein, 8 aa, Mycobacterium
RAFSGGYD

SEQ ID NO: 1170114 - protein, 26 aa, Mycobacterium
RAGADLPDRATRDAAAREPATLIDRR

SEQ ID NO: 1170115 - protein, 10 aa, Mycobacterium
RAGAGSDDHY

SEQ ID NO: 1170116 - protein, 6 aa, Mycobacterium
RAGAKS

SEQ ID NO: 1170117 - protein, 6 aa, Mycobacterium
RAGAPL

SEQ ID NO: 1170118 - protein, 11 aa, Mycobacterium
RAGDDVQPGDV

SEQ ID NO: 1170119 - protein, 8 aa, Mycobacterium
RAGDFTAR

SEQ ID NO: 1170120 - protein, 7 aa, Mycobacterium
RAGDGTV

SEQ ID NO: 1170121 - protein, 8 aa, Mycobacterium
RAGDPAEI

SEQ ID NO: 1170122 - protein, 11 aa, Mycobacterium
RAGDRTASPAE

SEQ ID NO: 1170123 - protein, 4 aa, Mycobacterium
RAGE

SEQ ID NO: 1170124 - protein, 5 aa, Mycobacterium
RAGEA

SEQ ID NO: 1170125 - protein, 6 aa, Mycobacterium
RAGEAT

SEQ ID NO: 1170126 - protein, 7 aa, Mycobacterium
RAGELPR

SEQ ID NO: 1170127 - protein, 8 aa, Mycobacterium
RAGEPAEV

SEQ ID NO: 1170128 - protein, 10 aa, Mycobacterium
RAGERGAVEA

SEQ ID NO: 1170129 - protein, 13 aa, Mycobacterium
RAGESASGAPGLA

SEQ ID NO: 1170130 - protein, 7 aa, Mycobacterium
RAGETGA

SEQ ID NO: 1170131 - protein, 9 aa, Mycobacterium
RAGEVSATE

SEQ ID NO: 1170132 - protein, 5 aa, Mycobacterium
RAGFR

SEQ ID NO: 1170133 - protein, 4 aa, Mycobacterium
RAGG

SEQ ID NO: 1170134 - protein, 11 aa, Mycobacterium
RAGGGGPARPR

SEQ ID NO: 1170135 - protein, 7 aa, Mycobacterium
RAGGSGL

SEQ ID NO: 1170136 - protein, 6 aa, Mycobacterium
RAGGSL

SEQ ID NO: 1170137 - protein, 7 aa, Mycobacterium
RAGGTEV

SEQ ID NO: 1170138 - protein, 21 aa, Mycobacterium
RAGIASTTEPANGENPDGENL

SEQ ID NO: 1170139 - protein, 9 aa, Mycobacterium
RAGNSRGEI

SEQ ID NO: 1170140 - protein, 6 aa, Mycobacterium
RAGPPE

SEQ ID NO: 1170141 - protein, 9 aa, Mycobacterium
RAGQESSIE

SEQ ID NO: 1170142 - protein, 5 aa, Mycobacterium
RAGQH

SEQ ID NO: 1170143 - protein, 6 aa, Mycobacterium
RAGQPL

SEQ ID NO: 1170144 - protein, 11 aa, Mycobacterium
RAGRAGYDTAG

SEQ ID NO: 1170145 - protein, 9 aa, Mycobacterium
RAGRDVGTE

SEQ ID NO: 1170146 - protein, 21 aa, Mycobacterium
RAGREYDDRPAPREYDEPPIY

SEQ ID NO: 1170147 - protein, 6 aa, Mycobacterium
RAGRLT

SEQ ID NO: 1170148 - protein, 14 aa, Mycobacterium
RAGRVRPAELSGST

SEQ ID NO: 1170149 - protein, 7 aa, Mycobacterium
RAGSAGT

SEQ ID NO: 1170150 - protein, 6 aa, Mycobacterium
RAGSAQ

SEQ ID NO: 1170151 - protein, 5 aa, Mycobacterium
RAGSP

SEQ ID NO: 1170152 - protein, 6 aa, Mycobacterium
RAGTDA

SEQ ID NO: 1170153 - protein, 8 aa, Mycobacterium
RAGTEKPA

SEQ ID NO: 1170154 - protein, 8 aa, Mycobacterium
RAGTEQDA

SEQ ID NO: 1170155 - protein, 5 aa, Mycobacterium
RAGVG

SEQ ID NO: 1170156 - protein, 7 aa, Mycobacterium
RAHGGRT

SEQ ID NO: 1170157 - protein, 6 aa, Mycobacterium
RAHPGE

SEQ ID NO: 1170158 - protein, 9 aa, Mycobacterium
RAIDERGAD

SEQ ID NO: 1170159 - protein, 19 aa, Mycobacterium
RAIGGGSNDAHYAAAKGAA

SEQ ID NO: 1170160 - protein, 12 aa, Mycobacterium
RAKEGQRTASQA

SEQ ID NO: 1170161 - protein, 9 aa, Mycobacterium
RAKGEDPDE

SEQ ID NO: 1170162 - protein, 5 aa, Mycobacterium
RAKNP

SEQ ID NO: 1170163 - protein, 10 aa, Mycobacterium
RAKNPDRGYA

SEQ ID NO: 1170164 - protein, 6 aa, Mycobacterium
RAKPGT

SEQ ID NO: 1170165 - protein, 9 aa, Mycobacterium
RAKRPDERQ

SEQ ID NO: 1170166 - protein, 8 aa, Mycobacterium
RAKRTVSG

SEQ ID NO: 1170167 - protein, 14 aa, Mycobacterium
RAKSAAAAAQARAT

SEQ ID NO: 1170168 - protein, 9 aa, Mycobacterium
RAKSRPSGN

SEQ ID NO: 1170169 - protein, 4 aa, Mycobacterium
RALG

SEQ ID NO: 1170170 - protein, 8 aa, Mycobacterium
RALGGQSL

SEQ ID NO: 1170171 - protein, 25 aa, Mycobacterium
RALPGDPDFGDPLSADGVGGPRAAA

SEQ ID NO: 1170172 - protein, 16 aa, Mycobacterium
RALRTGDGTKDSDMGP

SEQ ID NO: 1170173 - protein, 7 aa, Mycobacterium
RALTERE

SEQ ID NO: 1170174 - protein, 7 aa, Mycobacterium
RALTQTN

SEQ ID NO: 1170175 - protein, 8 aa, Mycobacterium
RANDTAGE

SEQ ID NO: 1170176 - protein, 4 aa, Mycobacterium
RANE

SEQ ID NO: 1170177 - protein, 28 aa, Mycobacterium
RANELAETTRKQAKQAQKQARKDAKRRL

SEQ ID NO: 1170178 - protein, 11 aa, Mycobacterium
RANKNNTDPTR

SEQ ID NO: 1170179 - protein, 7 aa, Mycobacterium
RANPQAI

SEQ ID NO: 1170180 - protein, 6 aa, Mycobacterium
RANQRR

SEQ ID NO: 1170181 - protein, 11 aa, Mycobacterium
RANRNADSHPT

SEQ ID NO: 1170182 - protein, 6 aa, Mycobacterium
RANVSK

SEQ ID NO: 1170183 - protein, 9 aa, Mycobacterium
RAPAEGGRV

SEQ ID NO: 1170184 - protein, 12 aa, Mycobacterium
RAPAGGSPAMGG

SEQ ID NO: 1170185 - protein, 9 aa, Mycobacterium
RAPAKRPDY

SEQ ID NO: 1170186 - protein, 7 aa, Mycobacterium
RAPAPHD

SEQ ID NO: 1170187 - protein, 15 aa, Mycobacterium
RAPAVPASTTEFASV

SEQ ID NO: 1170188 - protein, 8 aa, Mycobacterium
RAPDADSA

SEQ ID NO: 1170189 - protein, 9 aa, Mycobacterium
RAPDPADRR

SEQ ID NO: 1170190 - protein, 7 aa, Mycobacterium
RAPDYAP

SEQ ID NO: 1170191 - protein, 7 aa, Mycobacterium
RAPERVD

SEQ ID NO: 1170192 - protein, 14 aa, Mycobacterium
RAPGARRDKYSIPA

SEQ ID NO: 1170193 - protein, 6 aa, Mycobacterium
RAPGDD

SEQ ID NO: 1170194 - protein, 13 aa, Mycobacterium
RAPGGRQGRRPSR

SEQ ID NO: 1170195 - protein, 13 aa, Mycobacterium
RAPGRPATVPDRR

SEQ ID NO: 1170196 - protein, 9 aa, Mycobacterium
RAPGSALDE

SEQ ID NO: 1170197 - protein, 5 aa, Mycobacterium
RAPIR

SEQ ID NO: 1170198 - protein, 6 aa, Mycobacterium
RAPLSR

SEQ ID NO: 1170199 - protein, 9 aa, Mycobacterium
RAPRGEGGF

SEQ ID NO: 1170200 - protein, 9 aa, Mycobacterium
RAPSPLPPH

SEQ ID NO: 1170201 - protein, 16 aa, Mycobacterium
RAPSQPALLAALRTGV

SEQ ID NO: 1170202 - protein, 38 aa, Mycobacterium
RAPSTPAGAPGDVDLTGSAAGVSEAPAELSELSPEDAQ

SEQ ID NO: 1170203 - protein, 6 aa, Mycobacterium
RAPTRR

SEQ ID NO: 1170204 - protein, 11 aa, Mycobacterium
RAQPGWEPRTL

SEQ ID NO: 1170205 - protein, 4 aa, Mycobacterium
RAQQ

SEQ ID NO: 1170206 - protein, 11 aa, Mycobacterium
RAQQRAAAVGA

SEQ ID NO: 1170207 - protein, 6 aa, Mycobacterium
RAQQRR

SEQ ID NO: 1170208 - protein, 24 aa, Mycobacterium
RAQSRSAQPRTPKSHNAKRRPPPR

SEQ ID NO: 1170209 - protein, 5 aa, Mycobacterium
RAQTI

SEQ ID NO: 1170210 - protein, 12 aa, Mycobacterium
RAQYGTKEAFRR

SEQ ID NO: 1170211 - protein, 11 aa, Mycobacterium
RARAGGPGSYG

SEQ ID NO: 1170212 - protein, 6 aa, Mycobacterium
RARAPR

SEQ ID NO: 1170213 - protein, 6 aa, Mycobacterium
RARAQG

SEQ ID NO: 1170214 - protein, 6 aa, Mycobacterium
RARASG

SEQ ID NO: 1170215 - protein, 8 aa, Mycobacterium
RARDEGAA

SEQ ID NO: 1170216 - protein, 10 aa, Mycobacterium
RARDEGDVRD

SEQ ID NO: 1170217 - protein, 8 aa, Mycobacterium
RARDPRSR

SEQ ID NO: 1170218 - protein, 7 aa, Mycobacterium
RAREGRA

SEQ ID NO: 1170219 - protein, 14 aa, Mycobacterium
RARGDLRDDADTET

SEQ ID NO: 1170220 - protein, 7 aa, Mycobacterium
RARGLPK

SEQ ID NO: 1170221 - protein, 19 aa, Mycobacterium
RARGYDVDKPRNLAKSVTV

SEQ ID NO: 1170222 - protein, 11 aa, Mycobacterium
RARMTGSERRQ

SEQ ID NO: 1170223 - protein, 13 aa, Mycobacterium
RARPLRSRADVED

SEQ ID NO: 1170224 - protein, 7 aa, Mycobacterium
RARPPAR

SEQ ID NO: 1170225 - protein, 10 aa, Mycobacterium
RARPRDDEPS

SEQ ID NO: 1170226 - protein, 13 aa, Mycobacterium
RARQAALAASGVT

SEQ ID NO: 1170227 - protein, 5 aa, Mycobacterium
RARRD

SEQ ID NO: 1170228 - protein, 8 aa, Mycobacterium
RARRGRGA

SEQ ID NO: 1170229 - protein, 6 aa, Mycobacterium
RARRKG

SEQ ID NO: 1170230 - protein, 7 aa, Mycobacterium
RARSAGA

SEQ ID NO: 1170231 - protein, 14 aa, Mycobacterium
RARSHGDLDTGPLK

SEQ ID NO: 1170232 - protein, 9 aa, Mycobacterium
RARTGTVAE

SEQ ID NO: 1170233 - protein, 9 aa, Mycobacterium
RARTPRPAR

SEQ ID NO: 1170234 - protein, 6 aa, Mycobacterium
RARVGK

SEQ ID NO: 1170235 - protein, 9 aa, Mycobacterium
RASAADREL

SEQ ID NO: 1170236 - protein, 17 aa, Mycobacterium
RASAGTAPDPGAPTLQG

SEQ ID NO: 1170237 - protein, 9 aa, Mycobacterium
RASDECTVT

SEQ ID NO: 1170238 - protein, 6 aa, Mycobacterium
RASDRT

SEQ ID NO: 1170239 - protein, 6 aa, Mycobacterium
RASEPA

SEQ ID NO: 1170240 - protein, 4 aa, Mycobacterium
RASG

SEQ ID NO: 1170241 - protein, 13 aa, Mycobacterium
RASGERISSGPVA

SEQ ID NO: 1170242 - protein, 5 aa, Mycobacterium
RASGL

SEQ ID NO: 1170243 - protein, 9 aa, Mycobacterium
RASGPPPVV

SEQ ID NO: 1170244 - protein, 11 aa, Mycobacterium
RASGTATIGST

SEQ ID NO: 1170245 - protein, 14 aa, Mycobacterium
RASGTRRADPAPAV

SEQ ID NO: 1170246 - protein, 7 aa, Mycobacterium
RASITDP

SEQ ID NO: 1170247 - protein, 8 aa, Mycobacterium
RASNTSEL

SEQ ID NO: 1170248 - protein, 7 aa, Mycobacterium
RASPAGI

SEQ ID NO: 1170249 - protein, 10 aa, Mycobacterium
RASREDRERV

SEQ ID NO: 1170250 - protein, 15 aa, Mycobacterium
RASRRRAERWLADRH

SEQ ID NO: 1170251 - protein, 6 aa, Mycobacterium
RASSGH

SEQ ID NO: 1170252 - protein, 4 aa, Mycobacterium
RASY

SEQ ID NO: 1170253 - protein, 8 aa, Mycobacterium
RASYERRA

SEQ ID NO: 1170254 - protein, 4 aa, Mycobacterium
RATA

SEQ ID NO: 1170255 - protein, 7 aa, Mycobacterium
RATADGR

SEQ ID NO: 1170256 - protein, 14 aa, Mycobacterium
RATADQIGTQSTQV

SEQ ID NO: 1170257 - protein, 5 aa, Mycobacterium
RATAL

SEQ ID NO: 1170258 - protein, 5 aa, Mycobacterium
RATAP

SEQ ID NO: 1170259 - protein, 20 aa, Mycobacterium
RATAPGGGPSIPGRKAKPTI

SEQ ID NO: 1170260 - protein, 8 aa, Mycobacterium
RATAQNGR

SEQ ID NO: 1170261 - protein, 8 aa, Mycobacterium
RATATAAR

SEQ ID NO: 1170262 - protein, 7 aa, Mycobacterium
RATDGPT

SEQ ID NO: 1170263 - protein, 8 aa, Mycobacterium
RATDPTPF

SEQ ID NO: 1170264 - protein, 15 aa, Mycobacterium
RATEHSDPLSGLSDQ

SEQ ID NO: 1170265 - protein, 7 aa, Mycobacterium
RATGGKI

SEQ ID NO: 1170266 - protein, 9 aa, Mycobacterium
RATKSPSQL

SEQ ID NO: 1170267 - protein, 8 aa, Mycobacterium
RATLAGEG

SEQ ID NO: 1170268 - protein, 6 aa, Mycobacterium
RATNPA

SEQ ID NO: 1170269 - protein, 4 aa, Mycobacterium
RATP

SEQ ID NO: 1170270 - protein, 13 aa, Mycobacterium
RATREAGERLHTS

SEQ ID NO: 1170271 - protein, 16 aa, Mycobacterium
RATRGTERPTRSEQAR

SEQ ID NO: 1170272 - protein, 6 aa, Mycobacterium
RATSAL

SEQ ID NO: 1170273 - protein, 6 aa, Mycobacterium
RATSAR

SEQ ID NO: 1170274 - protein, 8 aa, Mycobacterium
RATSPTGK

SEQ ID NO: 1170275 - protein, 12 aa, Mycobacterium
RATTAGKSGTFN

SEQ ID NO: 1170276 - protein, 13 aa, Mycobacterium
RATTDFAEAASSA

SEQ ID NO: 1170277 - protein, 22 aa, Mycobacterium
RATTGSAINDPGMRARGRGDER

SEQ ID NO: 1170278 - protein, 5 aa, Mycobacterium
RATTI

SEQ ID NO: 1170279 - protein, 5 aa, Mycobacterium
RATTV

SEQ ID NO: 1170280 - protein, 6 aa, Mycobacterium
RATVED

SEQ ID NO: 1170281 - protein, 5 aa, Mycobacterium
RAVQD

SEQ ID NO: 1170282 - protein, 5 aa, Mycobacterium
RAVTA

SEQ ID NO: 1170283 - protein, 8 aa, Mycobacterium
RAVTPHGT

SEQ ID NO: 1170284 - protein, 20 aa, Mycobacterium
RAYGAADARRALTEARRRGT

SEQ ID NO: 1170285 - protein, 8 aa, Mycobacterium
RAYPYEGN

SEQ ID NO: 1170286 - protein, 8 aa, Mycobacterium
RAYQDGGA

SEQ ID NO: 1170287 - protein, 8 aa, Mycobacterium
RAYQPDGQ

SEQ ID NO: 1170288 - protein, 5 aa, Mycobacterium
RAYSD

SEQ ID NO: 1170289 - protein, 8 aa, Mycobacterium
RAYTDEPA

SEQ ID NO: 1170290 - protein, 6 aa, Mycobacterium
RCATTA

SEQ ID NO: 1170291 - protein, 7 aa, Mycobacterium
RCDPDQL

SEQ ID NO: 1170292 - protein, 7 aa, Mycobacterium
RCEGPRI

SEQ ID NO: 1170293 - protein, 5 aa, Mycobacterium
RCPTC

SEQ ID NO: 1170294 - protein, 20 aa, Mycobacterium
RCRDGEGATDADAGGQPAIP

SEQ ID NO: 1170295 - protein, 6 aa, Mycobacterium
RCTGCD

SEQ ID NO: 1170296 - protein, 4 aa, Mycobacterium
RDAA

SEQ ID NO: 1170297 - protein, 5 aa, Mycobacterium
RDAAP

SEQ ID NO: 1170298 - protein, 5 aa, Mycobacterium
RDAAQ

SEQ ID NO: 1170299 - protein, 8 aa, Mycobacterium
RDADGVDV

SEQ ID NO: 1170300 - protein, 7 aa, Mycobacterium
RDAEAAD

SEQ ID NO: 1170301 - protein, 8 aa, Mycobacterium
RDAEHPER

SEQ ID NO: 1170302 - protein, 18 aa, Mycobacterium
RDAEPAEVDSARADVREA

SEQ ID NO: 1170303 - protein, 5 aa, Mycobacterium
RDAFG

SEQ ID NO: 1170304 - protein, 8 aa, Mycobacterium
RDAGDLAG

SEQ ID NO: 1170305 - protein, 9 aa, Mycobacterium
RDAGHDDVS

SEQ ID NO: 1170306 - protein, 6 aa, Mycobacterium
RDAGPA

SEQ ID NO: 1170307 - protein, 9 aa, Mycobacterium
RDAGPEPGG

SEQ ID NO: 1170308 - protein, 9 aa, Mycobacterium
RDAGQSQVA

SEQ ID NO: 1170309 - protein, 6 aa, Mycobacterium
RDAGSG

SEQ ID NO: 1170310 - protein, 10 aa, Mycobacterium
RDAGTRPKGI

SEQ ID NO: 1170311 - protein, 17 aa, Mycobacterium
RDAIKEASEFPLSDYQI

SEQ ID NO: 1170312 - protein, 10 aa, Mycobacterium
RDAPADIEEK

SEQ ID NO: 1170313 - protein, 6 aa, Mycobacterium
RDAPRA

SEQ ID NO: 1170314 - protein, 5 aa, Mycobacterium
RDAQP

SEQ ID NO: 1170315 - protein, 8 aa, Mycobacterium
RDARGHGH

SEQ ID NO: 1170316 - protein, 12 aa, Mycobacterium
RDARKAGETEQR

SEQ ID NO: 1170317 - protein, 4 aa, Mycobacterium
RDAS

SEQ ID NO: 1170318 - protein, 12 aa, Mycobacterium
RDASALTGRVDP

SEQ ID NO: 1170319 - protein, 9 aa, Mycobacterium
RDASGDGAR

SEQ ID NO: 1170320 - protein, 5 aa, Mycobacterium
RDDAA

SEQ ID NO: 1170321 - protein, 5 aa, Mycobacterium
RDDAI

SEQ ID NO: 1170322 - protein, 4 aa, Mycobacterium
RDDD

SEQ ID NO: 1170323 - protein, 13 aa, Mycobacterium
RDDDGKDVPWDGQ

SEQ ID NO: 1170324 - protein, 6 aa, Mycobacterium
RDDDGV

SEQ ID NO: 1170325 - protein, 9 aa, Mycobacterium
RDDDSAWAS

SEQ ID NO: 1170326 - protein, 12 aa, Mycobacterium
RDDEGRPKRSRQ

SEQ ID NO: 1170327 - protein, 8 aa, Mycobacterium
RDDEQVRT

SEQ ID NO: 1170328 - protein, 9 aa, Mycobacterium
RDDGTNRRA

SEQ ID NO: 1170329 - protein, 5 aa, Mycobacterium
RDDGV

SEQ ID NO: 1170330 - protein, 5 aa, Mycobacterium
RDDGY

SEQ ID NO: 1170331 - protein, 6 aa, Mycobacterium
RDDNLV

SEQ ID NO: 1170332 - protein, 11 aa, Mycobacterium
RDDPAYRQRPE

SEQ ID NO: 1170333 - protein, 21 aa, Mycobacterium
RDDPDAQSPQRRSAAPARPLT

SEQ ID NO: 1170334 - protein, 10 aa, Mycobacterium
RDDPKAAVEG

SEQ ID NO: 1170335 - protein, 14 aa, Mycobacterium
RDDPNHTVTADDNS

SEQ ID NO: 1170336 - protein, 11 aa, Mycobacterium
RDDRKASFKRS

SEQ ID NO: 1170337 - protein, 8 aa, Mycobacterium
RDDRTATG

SEQ ID NO: 1170338 - protein, 8 aa, Mycobacterium
RDDSLPYD

SEQ ID NO: 1170339 - protein, 6 aa, Mycobacterium
RDDSPR

SEQ ID NO: 1170340 - protein, 7 aa, Mycobacterium
RDDWNTS

SEQ ID NO: 1170341 - protein, 14 aa, Mycobacterium
RDEAGKATNISSAT

SEQ ID NO: 1170342 - protein, 7 aa, Mycobacterium
RDEARAQ

SEQ ID NO: 1170343 - protein, 13 aa, Mycobacterium
RDEDKDPRGSIGM

SEQ ID NO: 1170344 - protein, 8 aa, Mycobacterium
RDEDPDYG

SEQ ID NO: 1170345 - protein, 7 aa, Mycobacterium
RDEEDPA

SEQ ID NO: 1170346 - protein, 5 aa, Mycobacterium
RDEGL

SEQ ID NO: 1170347 - protein, 16 aa, Mycobacterium
RDEGRTATHASTGARL

SEQ ID NO: 1170348 - protein, 5 aa, Mycobacterium
RDEGY

SEQ ID NO: 1170349 - protein, 7 aa, Mycobacterium
RDELGPL

SEQ ID NO: 1170350 - protein, 4 aa, Mycobacterium
RDER

SEQ ID NO: 1170351 - protein, 8 aa, Mycobacterium
RDERGGRA

SEQ ID NO: 1170352 - protein, 17 aa, Mycobacterium
RDERRPVSRDEAASAVG

SEQ ID NO: 1170353 - protein, 4 aa, Mycobacterium
RDES

SEQ ID NO: 1170354 - protein, 6 aa, Mycobacterium
RDESDT

SEQ ID NO: 1170355 - protein, 9 aa, Mycobacterium
RDESSCDAE

SEQ ID NO: 1170356 - protein, 4 aa, Mycobacterium
RDEV

SEQ ID NO: 1170357 - protein, 9 aa, Mycobacterium
RDEVAKAQA

SEQ ID NO: 1170358 - protein, 7 aa, Mycobacterium
RDEVDPT

SEQ ID NO: 1170359 - protein, 12 aa, Mycobacterium
RDFPDRSRSTVD

SEQ ID NO: 1170360 - protein, 7 aa, Mycobacterium
RDFRGGT

SEQ ID NO: 1170361 - protein, 8 aa, Mycobacterium
RDGAAPIA

SEQ ID NO: 1170362 - protein, 9 aa, Mycobacterium
RDGADPHDL

SEQ ID NO: 1170363 - protein, 5 aa, Mycobacterium
RDGAL

SEQ ID NO: 1170364 - protein, 13 aa, Mycobacterium
RDGATEPIPNARP

SEQ ID NO: 1170365 - protein, 9 aa, Mycobacterium
RDGDSVTAA

SEQ ID NO: 1170366 - protein, 8 aa, Mycobacterium
RDGDTARD

SEQ ID NO: 1170367 - protein, 7 aa, Mycobacterium
RDGENVR

SEQ ID NO: 1170368 - protein, 8 aa, Mycobacterium
RDGESGLS

SEQ ID NO: 1170369 - protein, 5 aa, Mycobacterium
RDGEY

SEQ ID NO: 1170370 - protein, 7 aa, Mycobacterium
RDGGAAV

SEQ ID NO: 1170371 - protein, 15 aa, Mycobacterium
RDGGEIRNGSDLPRI

SEQ ID NO: 1170372 - protein, 10 aa, Mycobacterium
RDGGLDPAAA

SEQ ID NO: 1170373 - protein, 5 aa, Mycobacterium
RDGGR

SEQ ID NO: 1170374 - protein, 15 aa, Mycobacterium
RDGGSRYGGKGVDKA

SEQ ID NO: 1170375 - protein, 5 aa, Mycobacterium
RDGGV

SEQ ID NO: 1170376 - protein, 9 aa, Mycobacterium
RDGHDGEEL

SEQ ID NO: 1170377 - protein, 8 aa, Mycobacterium
RDGITESE

SEQ ID NO: 1170378 - protein, 5 aa, Mycobacterium
RDGLD

SEQ ID NO: 1170379 - protein, 11 aa, Mycobacterium
RDGNEVDFEGS

SEQ ID NO: 1170380 - protein, 8 aa, Mycobacterium
RDGNRSVS

SEQ ID NO: 1170381 - protein, 8 aa, Mycobacterium
RDGPAGRG

SEQ ID NO: 1170382 - protein, 10 aa, Mycobacterium
RDGQPAPYAA

SEQ ID NO: 1170383 - protein, 7 aa, Mycobacterium
RDGQPRW

SEQ ID NO: 1170384 - protein, 18 aa, Mycobacterium
RDGQQRHPSDNTDEPARA

SEQ ID NO: 1170385 - protein, 6 aa, Mycobacterium
RDGQTL

SEQ ID NO: 1170386 - protein, 9 aa, Mycobacterium
RDGRPKPTA

SEQ ID NO: 1170387 - protein, 8 aa, Mycobacterium
RDGRPQLS

SEQ ID NO: 1170388 - protein, 5 aa, Mycobacterium
RDGRQ

SEQ ID NO: 1170389 - protein, 5 aa, Mycobacterium
RDGRS

SEQ ID NO: 1170390 - protein, 5 aa, Mycobacterium
RDGTE

SEQ ID NO: 1170391 - protein, 6 aa, Mycobacterium
RDGTER

SEQ ID NO: 1170392 - protein, 14 aa, Mycobacterium
RDGTGVTLNEALHA

SEQ ID NO: 1170393 - protein, 6 aa, Mycobacterium
RDGVQV

SEQ ID NO: 1170394 - protein, 9 aa, Mycobacterium
RDGYETRVR

SEQ ID NO: 1170395 - protein, 10 aa, Mycobacterium
RDHGRTRGGA

SEQ ID NO: 1170396 - protein, 11 aa, Mycobacterium
RDHHTSAHQPI

SEQ ID NO: 1170397 - protein, 6 aa, Mycobacterium
RDHSDR

SEQ ID NO: 1170398 - protein, 8 aa, Mycobacterium
RDITATAR

SEQ ID NO: 1170399 - protein, 7 aa, Mycobacterium
RDKNGGL

SEQ ID NO: 1170400 - protein, 9 aa, Mycobacterium
RDKRDELPN

SEQ ID NO: 1170401 - protein, 8 aa, Mycobacterium
RDLDELSG

SEQ ID NO: 1170402 - protein, 8 aa, Mycobacterium
RDLEAAGA

SEQ ID NO: 1170403 - protein, 5 aa, Mycobacterium
RDLGG

SEQ ID NO: 1170404 - protein, 13 aa, Mycobacterium
RDLRARPGTVGRP

SEQ ID NO: 1170405 - protein, 9 aa, Mycobacterium
RDLSTSNFP

SEQ ID NO: 1170406 - protein, 8 aa, Mycobacterium
RDLTPGPF

SEQ ID NO: 1170407 - protein, 4 aa, Mycobacterium
RDMA

SEQ ID NO: 1170408 - protein, 7 aa, Mycobacterium
RDNAGKH

SEQ ID NO: 1170409 - protein, 19 aa, Mycobacterium
RDNDNGARAKSVSSRTVPV

SEQ ID NO: 1170410 - protein, 9 aa, Mycobacterium
RDNGNISSA

SEQ ID NO: 1170411 - protein, 8 aa, Mycobacterium
RDNPGSYG

SEQ ID NO: 1170412 - protein, 14 aa, Mycobacterium
RDNPRRSVRLSFLG

SEQ ID NO: 1170413 - protein, 13 aa, Mycobacterium
RDNQPYKESYGMA

SEQ ID NO: 1170414 - protein, 9 aa, Mycobacterium
RDPADRERL

SEQ ID NO: 1170415 - protein, 5 aa, Mycobacterium
RDPAG

SEQ ID NO: 1170416 - protein, 10 aa, Mycobacterium
RDPAGAADAA

SEQ ID NO: 1170417 - protein, 13 aa, Mycobacterium
RDPAGTMIRIQEL

SEQ ID NO: 1170418 - protein, 5 aa, Mycobacterium
RDPAL

SEQ ID NO: 1170419 - protein, 10 aa, Mycobacterium
RDPDDGRPLD

SEQ ID NO: 1170420 - protein, 9 aa, Mycobacterium
RDPDGTVTT

SEQ ID NO: 1170421 - protein, 10 aa, Mycobacterium
RDPDREESGR

SEQ ID NO: 1170422 - protein, 6 aa, Mycobacterium
RDPGGL

SEQ ID NO: 1170423 - protein, 7 aa, Mycobacterium
RDPGHPN

SEQ ID NO: 1170424 - protein, 6 aa, Mycobacterium
RDPGTP

SEQ ID NO: 1170425 - protein, 5 aa, Mycobacterium
RDPNN

SEQ ID NO: 1170426 - protein, 8 aa, Mycobacterium
RDPNPQIG

SEQ ID NO: 1170427 - protein, 6 aa, Mycobacterium
RDPNRH

SEQ ID NO: 1170428 - protein, 5 aa, Mycobacterium
RDPQA

SEQ ID NO: 1170429 - protein, 5 aa, Mycobacterium
RDPQE

SEQ ID NO: 1170430 - protein, 6 aa, Mycobacterium
RDPQTA

SEQ ID NO: 1170431 - protein, 8 aa, Mycobacterium
RDPRASGE

SEQ ID NO: 1170432 - protein, 9 aa, Mycobacterium
RDPRGGGVS

SEQ ID NO: 1170433 - protein, 6 aa, Mycobacterium
RDPRNA

SEQ ID NO: 1170434 - protein, 17 aa, Mycobacterium
RDPSPRASNWRATGTLD

SEQ ID NO: 1170435 - protein, 6 aa, Mycobacterium
RDPSVF

SEQ ID NO: 1170436 - protein, 6 aa, Mycobacterium
RDPTTP

SEQ ID NO: 1170437 - protein, 10 aa, Mycobacterium
RDPTVTAEQA

SEQ ID NO: 1170438 - protein, 6 aa, Mycobacterium
RDPVKS

SEQ ID NO: 1170439 - protein, 9 aa, Mycobacterium
RDPYGRTAR

SEQ ID NO: 1170440 - protein, 7 aa, Mycobacterium
RDQAASR

SEQ ID NO: 1170441 - protein, 7 aa, Mycobacterium
RDQATKF

SEQ ID NO: 1170442 - protein, 8 aa, Mycobacterium
RDQNGRGR

SEQ ID NO: 1170443 - protein, 7 aa, Mycobacterium
RDQPKPV

SEQ ID NO: 1170444 - protein, 13 aa, Mycobacterium
RDQQLTADRAKAG

SEQ ID NO: 1170445 - protein, 10 aa, Mycobacterium
RDQSTDNAAF

SEQ ID NO: 1170446 - protein, 11 aa, Mycobacterium
RDRAGDGDTID

SEQ ID NO: 1170447 - protein, 7 aa, Mycobacterium
RDRAGRA

SEQ ID NO: 1170448 - protein, 13 aa, Mycobacterium
RDRAPAAGSDERL

SEQ ID NO: 1170449 - protein, 23 aa, Mycobacterium
RDRAPEENRLRNRRRDSPGYRTE

SEQ ID NO: 1170450 - protein, 17 aa, Mycobacterium
RDRAPELADAAKGRSAE

SEQ ID NO: 1170451 - protein, 8 aa, Mycobacterium
RDRAQAQN

SEQ ID NO: 1170452 - protein, 17 aa, Mycobacterium
RDRDGEGIAPAARGGRL

SEQ ID NO: 1170453 - protein, 6 aa, Mycobacterium
RDRERR

SEQ ID NO: 1170454 - protein, 10 aa, Mycobacterium
RDRETGENFD

SEQ ID NO: 1170455 - protein, 10 aa, Mycobacterium
RDRGEQEAPD

SEQ ID NO: 1170456 - protein, 26 aa, Mycobacterium
RDRHPHADETLSRRTARRFSRRRGVR

SEQ ID NO: 1170457 - protein, 12 aa, Mycobacterium
RDRLQGHESGQD

SEQ ID NO: 1170458 - protein, 4 aa, Mycobacterium
RDRR

SEQ ID NO: 1170459 - protein, 6 aa, Mycobacterium
RDRSDA

SEQ ID NO: 1170460 - protein, 11 aa, Mycobacterium
RDRSSAIASRI

SEQ ID NO: 1170461 - protein, 8 aa, Mycobacterium
RDRVRGAD

SEQ ID NO: 1170462 - protein, 9 aa, Mycobacterium
RDSADGTSI

SEQ ID NO: 1170463 - protein, 10 aa, Mycobacterium
RDSDHTRAPI

SEQ ID NO: 1170464 - protein, 10 aa, Mycobacterium
RDSEDGSVTD

SEQ ID NO: 1170465 - protein, 20 aa, Mycobacterium
RDSEPDWGPYAAPTAPEGAP

SEQ ID NO: 1170466 - protein, 10 aa, Mycobacterium
RDSRAGDPDL

SEQ ID NO: 1170467 - protein, 14 aa, Mycobacterium
RDSRRHQQAADDHW

SEQ ID NO: 1170468 - protein, 10 aa, Mycobacterium
RDTADISDRQ

SEQ ID NO: 1170469 - protein, 7 aa, Mycobacterium
RDTANPT

SEQ ID NO: 1170470 - protein, 7 aa, Mycobacterium
RDTATNR

SEQ ID NO: 1170471 - protein, 4 aa, Mycobacterium
RDTD

SEQ ID NO: 1170472 - protein, 11 aa, Mycobacterium
RDTDADPEVAP

SEQ ID NO: 1170473 - protein, 13 aa, Mycobacterium
RDTDDDTHADRTG

SEQ ID NO: 1170474 - protein, 5 aa, Mycobacterium
RDTED

SEQ ID NO: 1170475 - protein, 6 aa, Mycobacterium
RDTERA

SEQ ID NO: 1170476 - protein, 4 aa, Mycobacterium
RDTG

SEQ ID NO: 1170477 - protein, 18 aa, Mycobacterium
RDTGDPAAAADPAATDTT

SEQ ID NO: 1170478 - protein, 6 aa, Mycobacterium
RDTMTQ

SEQ ID NO: 1170479 - protein, 9 aa, Mycobacterium
RDTNGDPTG

SEQ ID NO: 1170480 - protein, 13 aa, Mycobacterium
RDTPDNAPETRSE

SEQ ID NO: 1170481 - protein, 8 aa, Mycobacterium
RDTPPDRL

SEQ ID NO: 1170482 - protein, 8 aa, Mycobacterium
RDTYRPPE

SEQ ID NO: 1170483 - protein, 4 aa, Mycobacterium
RDVG

SEQ ID NO: 1170484 - protein, 11 aa, Mycobacterium
RDWGSPKIPEQ

SEQ ID NO: 1170485 - protein, 6 aa, Mycobacterium
RDYPNA

SEQ ID NO: 1170486 - protein, 5 aa, Mycobacterium
RDYQR

SEQ ID NO: 1170487 - protein, 6 aa, Mycobacterium
RDYSPA

SEQ ID NO: 1170488 - protein, 12 aa, Mycobacterium
REAAGRDPGDVA

SEQ ID NO: 1170489 - protein, 8 aa, Mycobacterium
REAAGRDV

SEQ ID NO: 1170490 - protein, 9 aa, Mycobacterium
REAAPEDYR

SEQ ID NO: 1170491 - protein, 5 aa, Mycobacterium
REAAV

SEQ ID NO: 1170492 - protein, 4 aa, Mycobacterium
READ

SEQ ID NO: 1170493 - protein, 8 aa, Mycobacterium
READGRTR

SEQ ID NO: 1170494 - protein, 15 aa, Mycobacterium
READTTFDDRSRGQV

SEQ ID NO: 1170495 - protein, 5 aa, Mycobacterium
REAEE

SEQ ID NO: 1170496 - protein, 7 aa, Mycobacterium
REAEVDR

SEQ ID NO: 1170497 - protein, 6 aa, Mycobacterium
REAGAD

SEQ ID NO: 1170498 - protein, 6 aa, Mycobacterium
REAGGE

SEQ ID NO: 1170499 - protein, 13 aa, Mycobacterium
REAGGQPARTKAC

SEQ ID NO: 1170500 - protein, 5 aa, Mycobacterium
REAGV

SEQ ID NO: 1170501 - protein, 8 aa, Mycobacterium
REAGVSRP

SEQ ID NO: 1170502 - protein, 9 aa, Mycobacterium
REAHEEAGL

SEQ ID NO: 1170503 - protein, 4 aa, Mycobacterium
REAL

SEQ ID NO: 1170504 - protein, 10 aa, Mycobacterium
REAMPSSDVD

SEQ ID NO: 1170505 - protein, 4 aa, Mycobacterium
REAR

SEQ ID NO: 1170506 - protein, 7 aa, Mycobacterium
REAREAL

SEQ ID NO: 1170507 - protein, 9 aa, Mycobacterium
REARPGDPV

SEQ ID NO: 1170508 - protein, 12 aa, Mycobacterium
REARRRSNGLPL

SEQ ID NO: 1170509 - protein, 8 aa, Mycobacterium
REATAIDP

SEQ ID NO: 1170510 - protein, 9 aa, Mycobacterium
REAVGDDER

SEQ ID NO: 1170511 - protein, 9 aa, Mycobacterium
REAVRRSDE

SEQ ID NO: 1170512 - protein, 10 aa, Mycobacterium
REDDRHSYHR

SEQ ID NO: 1170513 - protein, 10 aa, Mycobacterium
REDFQRRSAR

SEQ ID NO: 1170514 - protein, 9 aa, Mycobacterium
REDGSPIPG

SEQ ID NO: 1170515 - protein, 13 aa, Mycobacterium
REDGVAPDSETET

SEQ ID NO: 1170516 - protein, 4 aa, Mycobacterium
REDI

SEQ ID NO: 1170517 - protein, 9 aa, Mycobacterium
REDLEETAQ

SEQ ID NO: 1170518 - protein, 13 aa, Mycobacterium
REDPNNPAAADPF

SEQ ID NO: 1170519 - protein, 10 aa, Mycobacterium
REDPSSVDPS

SEQ ID NO: 1170520 - protein, 9 aa, Mycobacterium
REDRQDRYH

SEQ ID NO: 1170521 - protein, 4 aa, Mycobacterium
REDV

SEQ ID NO: 1170522 - protein, 6 aa, Mycobacterium
REDYPQ

SEQ ID NO: 1170523 - protein, 7 aa, Mycobacterium
REDYPSE

SEQ ID NO: 1170524 - protein, 43 aa, Mycobacterium
REEAAKRGMPDRGRRRNGADAAPAQPRRAPDVAARPDPADPTL

SEQ ID NO: 1170525 - protein, 9 aa, Mycobacterium
REEAAPYAA

SEQ ID NO: 1170526 - protein, 13 aa, Mycobacterium
REEAGPRRDPEEA

SEQ ID NO: 1170527 - protein, 9 aa, Mycobacterium
REEAGSARS

SEQ ID NO: 1170528 - protein, 5 aa, Mycobacterium
REEAR

SEQ ID NO: 1170529 - protein, 6 aa, Mycobacterium
REEDRI

SEQ ID NO: 1170530 - protein, 7 aa, Mycobacterium
REEEGYP

SEQ ID NO: 1170531 - protein, 11 aa, Mycobacterium
REEERAAGEEG

SEQ ID NO: 1170532 - protein, 4 aa, Mycobacterium
REEF

SEQ ID NO: 1170533 - protein, 18 aa, Mycobacterium
REENKRYRHRAQRADTYA

SEQ ID NO: 1170534 - protein, 5 aa, Mycobacterium
REEPV

SEQ ID NO: 1170535 - protein, 9 aa, Mycobacterium
REEQGQSGP

SEQ ID NO: 1170536 - protein, 8 aa, Mycobacterium
REEQNKAI

SEQ ID NO: 1170537 - protein, 12 aa, Mycobacterium
REFGADPRGRLR

SEQ ID NO: 1170538 - protein, 9 aa, Mycobacterium
REFGGQDLP

SEQ ID NO: 1170539 - protein, 5 aa, Mycobacterium
REFPA

SEQ ID NO: 1170540 - protein, 5 aa, Mycobacterium
REFTP

SEQ ID NO: 1170541 - protein, 10 aa, Mycobacterium
REGAEVSGSQ

SEQ ID NO: 1170542 - protein, 5 aa, Mycobacterium
REGAG

SEQ ID NO: 1170543 - protein, 22 aa, Mycobacterium
REGDGQARTRGANPAQYQGARN

SEQ ID NO: 1170544 - protein, 10 aa, Mycobacterium
REGEVPPVKA

SEQ ID NO: 1170545 - protein, 5 aa, Mycobacterium
REGGH

SEQ ID NO: 1170546 - protein, 7 aa, Mycobacterium
REGGHSR

SEQ ID NO: 1170547 - protein, 7 aa, Mycobacterium
REGGIND

SEQ ID NO: 1170548 - protein, 9 aa, Mycobacterium
REGGNSAHE

SEQ ID NO: 1170549 - protein, 6 aa, Mycobacterium
REGGPN

SEQ ID NO: 1170550 - protein, 6 aa, Mycobacterium
REGGYT

SEQ ID NO: 1170551 - protein, 11 aa, Mycobacterium
REGNGGRSSGI

SEQ ID NO: 1170552 - protein, 18 aa, Mycobacterium
REGPAPVDLTPPAPVDPA

SEQ ID NO: 1170553 - protein, 7 aa, Mycobacterium
REGPGKA

SEQ ID NO: 1170554 - protein, 4 aa, Mycobacterium
REGQ

SEQ ID NO: 1170555 - protein, 10 aa, Mycobacterium
REGQVQPSYD

SEQ ID NO: 1170556 - protein, 8 aa, Mycobacterium
REGSDTIA

SEQ ID NO: 1170557 - protein, 6 aa, Mycobacterium
REGTGM

SEQ ID NO: 1170558 - protein, 4 aa, Mycobacterium
REGW

SEQ ID NO: 1170559 - protein, 4 aa, Mycobacterium
REHG

SEQ ID NO: 1170560 - protein, 5 aa, Mycobacterium
REHGE

SEQ ID NO: 1170561 - protein, 4 aa, Mycobacterium
REIA

SEQ ID NO: 1170562 - protein, 8 aa, Mycobacterium
REIEGKPS

SEQ ID NO: 1170563 - protein, 6 aa, Mycobacterium
REIPDA

SEQ ID NO: 1170564 - protein, 5 aa, Mycobacterium
REIQQ

SEQ ID NO: 1170565 - protein, 6 aa, Mycobacterium
REIRDT

SEQ ID NO: 1170566 - protein, 14 aa, Mycobacterium
REISSDSRVLNDDS

SEQ ID NO: 1170567 - protein, 5 aa, Mycobacterium
REKPA

SEQ ID NO: 1170568 - protein, 6 aa, Mycobacterium
REKPNE

SEQ ID NO: 1170569 - protein, 14 aa, Mycobacterium
REKQARQSTDLGAP

SEQ ID NO: 1170570 - protein, 13 aa, Mycobacterium
RELAEDSSPEATA

SEQ ID NO: 1170571 - protein, 14 aa, Mycobacterium
RELAERGAPHDGAS

SEQ ID NO: 1170572 - protein, 10 aa, Mycobacterium
RELSNGQRQR

SEQ ID NO: 1170573 - protein, 4 aa, Mycobacterium
RELT

SEQ ID NO: 1170574 - protein, 14 aa, Mycobacterium
REMEGNPRFAPSQD

SEQ ID NO: 1170575 - protein, 4 aa, Mycobacterium
RENA

SEQ ID NO: 1170576 - protein, 15 aa, Mycobacterium
RENAAKMQERIRARR

SEQ ID NO: 1170577 - protein, 6 aa, Mycobacterium
RENDER

SEQ ID NO: 1170578 - protein, 5 aa, Mycobacterium
RENNL

SEQ ID NO: 1170579 - protein, 6 aa, Mycobacterium
RENPPD

SEQ ID NO: 1170580 - protein, 4 aa, Mycobacterium
REPA

SEQ ID NO: 1170581 - protein, 14 aa, Mycobacterium
REPAAAGERQDDTA

SEQ ID NO: 1170582 - protein, 7 aa, Mycobacterium
REPAPED

SEQ ID NO: 1170583 - protein, 6 aa, Mycobacterium
REPEHD

SEQ ID NO: 1170584 - protein, 4 aa, Mycobacterium
REPG

SEQ ID NO: 1170585 - protein, 6 aa, Mycobacterium
REPGGE

SEQ ID NO: 1170586 - protein, 8 aa, Mycobacterium
REPGGGRY

SEQ ID NO: 1170587 - protein, 6 aa, Mycobacterium
REPKKE

SEQ ID NO: 1170588 - protein, 6 aa, Mycobacterium
REPQTV

SEQ ID NO: 1170589 - protein, 9 aa, Mycobacterium
REPSAHDQR

SEQ ID NO: 1170590 - protein, 5 aa, Mycobacterium
REPTH

SEQ ID NO: 1170591 - protein, 5 aa, Mycobacterium
REPTR

SEQ ID NO: 1170592 - protein, 4 aa, Mycobacterium
REPW

SEQ ID NO: 1170593 - protein, 11 aa, Mycobacterium
REQAESSPSIV

SEQ ID NO: 1170594 - protein, 16 aa, Mycobacterium
REQASGFGATHTAASM

SEQ ID NO: 1170595 - protein, 8 aa, Mycobacterium
REQESPDG

SEQ ID NO: 1170596 - protein, 7 aa, Mycobacterium
REQGEAE

SEQ ID NO: 1170597 - protein, 14 aa, Mycobacterium
REQKQRVTAEWADT

SEQ ID NO: 1170598 - protein, 8 aa, Mycobacterium
REQPGKRS

SEQ ID NO: 1170599 - protein, 5 aa, Mycobacterium
REQTD

SEQ ID NO: 1170600 - protein, 8 aa, Mycobacterium
REQTRPER

SEQ ID NO: 1170601 - protein, 13 aa, Mycobacterium
REQYERQGNPYYS

SEQ ID NO: 1170602 - protein, 11 aa, Mycobacterium
REQYGKSIGSY

SEQ ID NO: 1170603 - protein, 12 aa, Mycobacterium
RERAAQKPPLTL

SEQ ID NO: 1170604 - protein, 12 aa, Mycobacterium
RERAEQERTRAT

SEQ ID NO: 1170605 - protein, 8 aa, Mycobacterium
RERAGDPV

SEQ ID NO: 1170606 - protein, 5 aa, Mycobacterium
RERAL

SEQ ID NO: 1170607 - protein, 5 aa, Mycobacterium
RERAP

SEQ ID NO: 1170608 - protein, 7 aa, Mycobacterium
RERGSEW

SEQ ID NO: 1170609 - protein, 5 aa, Mycobacterium
RERGV

SEQ ID NO: 1170610 - protein, 7 aa, Mycobacterium
RERGVQA

SEQ ID NO: 1170611 - protein, 9 aa, Mycobacterium
RERQSQITQ

SEQ ID NO: 1170612 - protein, 6 aa, Mycobacterium
RERREG

SEQ ID NO: 1170613 - protein, 9 aa, Mycobacterium
RERSGKGQV

SEQ ID NO: 1170614 - protein, 15 aa, Mycobacterium
RERSRRGGEVSKDDI

SEQ ID NO: 1170615 - protein, 13 aa, Mycobacterium
RERTADLTVDSKD

SEQ ID NO: 1170616 - protein, 10 aa, Mycobacterium
RESAAAAGMP

SEQ ID NO: 1170617 - protein, 15 aa, Mycobacterium
RESAERAKARKRTAL

SEQ ID NO: 1170618 - protein, 12 aa, Mycobacterium
RESATRRGGGDA

SEQ ID NO: 1170619 - protein, 8 aa, Mycobacterium
RESDEQMA

SEQ ID NO: 1170620 - protein, 8 aa, Mycobacterium
RESGGTIG

SEQ ID NO: 1170621 - protein, 11 aa, Mycobacterium
RESNVATRGYP

SEQ ID NO: 1170622 - protein, 4 aa, Mycobacterium
RESP

SEQ ID NO: 1170623 - protein, 6 aa, Mycobacterium
RESTGF

SEQ ID NO: 1170624 - protein, 7 aa, Mycobacterium
RESWGEP

SEQ ID NO: 1170625 - protein, 6 aa, Mycobacterium
RETAER

SEQ ID NO: 1170626 - protein, 6 aa, Mycobacterium
RETAKY

SEQ ID NO: 1170627 - protein, 15 aa, Mycobacterium
RETAYRQGRPPPELT

SEQ ID NO: 1170628 - protein, 8 aa, Mycobacterium
RETDADGN

SEQ ID NO: 1170629 - protein, 16 aa, Mycobacterium
RETETTKWRDPSGNVG

SEQ ID NO: 1170630 - protein, 7 aa, Mycobacterium
RETETVP

SEQ ID NO: 1170631 - protein, 8 aa, Mycobacterium
RETGEAHT

SEQ ID NO: 1170632 - protein, 5 aa, Mycobacterium
RETGL

SEQ ID NO: 1170633 - protein, 6 aa, Mycobacterium
RETPLR

SEQ ID NO: 1170634 - protein, 8 aa, Mycobacterium
RETRADRA

SEQ ID NO: 1170635 - protein, 6 aa, Mycobacterium
RETSDA

SEQ ID NO: 1170636 - protein, 10 aa, Mycobacterium
RETSGATRVR

SEQ ID NO: 1170637 - protein, 5 aa, Mycobacterium
RETSS

SEQ ID NO: 1170638 - protein, 11 aa, Mycobacterium
RETYGDTSRLS

SEQ ID NO: 1170639 - protein, 12 aa, Mycobacterium
REVGGGDRRSTV

SEQ ID NO: 1170640 - protein, 5 aa, Mycobacterium
REVTP

SEQ ID NO: 1170641 - protein, 11 aa, Mycobacterium
REVTPGAQTRN

SEQ ID NO: 1170642 - protein, 9 aa, Mycobacterium
REVTRGSRQ

SEQ ID NO: 1170643 - protein, 5 aa, Mycobacterium
REWQP

SEQ ID NO: 1170644 - protein, 10 aa, Mycobacterium
REWTTEEQNA

SEQ ID NO: 1170645 - protein, 8 aa, Mycobacterium
RFANPTPK

SEQ ID NO: 1170646 - protein, 7 aa, Mycobacterium
RFAPDGT

SEQ ID NO: 1170647 - protein, 10 aa, Mycobacterium
RFATGASTGD

SEQ ID NO: 1170648 - protein, 5 aa, Mycobacterium
RFDPG

SEQ ID NO: 1170649 - protein, 10 aa, Mycobacterium
RFDPQQAGAA

SEQ ID NO: 1170650 - protein, 11 aa, Mycobacterium
RFDTGGKTPLA

SEQ ID NO: 1170651 - protein, 5 aa, Mycobacterium
RFGAA

SEQ ID NO: 1170652 - protein, 9 aa, Mycobacterium
RFGAGRDNT

SEQ ID NO: 1170653 - protein, 13 aa, Mycobacterium
RFGGKTHDKTADV

SEQ ID NO: 1170654 - protein, 10 aa, Mycobacterium
RFPDPGERDH

SEQ ID NO: 1170655 - protein, 14 aa, Mycobacterium
RFPDSDLGDVAPEE

SEQ ID NO: 1170656 - protein, 12 aa, Mycobacterium
RFPGGSVNHAQG

SEQ ID NO: 1170657 - protein, 6 aa, Mycobacterium
RFSEHN

SEQ ID NO: 1170658 - protein, 18 aa, Mycobacterium
RFTDPAESRAALEGMKDG

SEQ ID NO: 1170659 - protein, 6 aa, Mycobacterium
RGAAGA

SEQ ID NO: 1170660 - protein, 14 aa, Mycobacterium
RGAAGAETNSGDGA

SEQ ID NO: 1170661 - protein, 11 aa, Mycobacterium
RGAAKEDDARA

SEQ ID NO: 1170662 - protein, 8 aa, Mycobacterium
RGAAPDRG

SEQ ID NO: 1170663 - protein, 5 aa, Mycobacterium
RGAAR

SEQ ID NO: 1170664 - protein, 9 aa, Mycobacterium
RGADGELAD

SEQ ID NO: 1170665 - protein, 12 aa, Mycobacterium
RGADVTAADRTE

SEQ ID NO: 1170666 - protein, 13 aa, Mycobacterium
RGAEDAAKPPALS

SEQ ID NO: 1170667 - protein, 11 aa, Mycobacterium
RGAEVGAGARL

SEQ ID NO: 1170668 - protein, 11 aa, Mycobacterium
RGAEYGVGTGD

SEQ ID NO: 1170669 - protein, 11 aa, Mycobacterium
RGAGAVSTDDI

SEQ ID NO: 1170670 - protein, 8 aa, Mycobacterium
RGAGDPTL

SEQ ID NO: 1170671 - protein, 5 aa, Mycobacterium
RGAGL

SEQ ID NO: 1170672 - protein, 20 aa, Mycobacterium
RGAGNPISAADPTLERVTVV

SEQ ID NO: 1170673 - protein, 6 aa, Mycobacterium
RGAGRD

SEQ ID NO: 1170674 - protein, 6 aa, Mycobacterium
RGALAE

SEQ ID NO: 1170675 - protein, 17 aa, Mycobacterium
RGALEGDGRADNNRARR

SEQ ID NO: 1170676 - protein, 8 aa, Mycobacterium
RGAPDRAP

SEQ ID NO: 1170677 - protein, 5 aa, Mycobacterium
RGAPG

SEQ ID NO: 1170678 - protein, 13 aa, Mycobacterium
RGAQRQADDIRRA

SEQ ID NO: 1170679 - protein, 9 aa, Mycobacterium
RGARGVRSA

SEQ ID NO: 1170680 - protein, 24 aa, Mycobacterium
RGARSTTALPATPNADTPPAVSRG

SEQ ID NO: 1170681 - protein, 10 aa, Mycobacterium
RGARVPAPGR

SEQ ID NO: 1170682 - protein, 6 aa, Mycobacterium
RGASAT

SEQ ID NO: 1170683 - protein, 10 aa, Mycobacterium
RGASPDDGRG

SEQ ID NO: 1170684 - protein, 20 aa, Mycobacterium
RGASPRPSRPRRGNDLETET

SEQ ID NO: 1170685 - protein, 8 aa, Mycobacterium
RGATTNNL

SEQ ID NO: 1170686 - protein, 6 aa, Mycobacterium
RGATVE

SEQ ID NO: 1170687 - protein, 7 aa, Mycobacterium
RGAVGPV

SEQ ID NO: 1170688 - protein, 15 aa, Mycobacterium
RGAVRRREDNTHREV

SEQ ID NO: 1170689 - protein, 6 aa, Mycobacterium
RGAYDD

SEQ ID NO: 1170690 - protein, 7 aa, Mycobacterium
RGDARNV

SEQ ID NO: 1170691 - protein, 9 aa, Mycobacterium
RGDEPPDYD

SEQ ID NO: 1170692 - protein, 5 aa, Mycobacterium
RGDHI

SEQ ID NO: 1170693 - protein, 17 aa, Mycobacterium
RGDIGGVSTAVGPEDGL

SEQ ID NO: 1170694 - protein, 6 aa, Mycobacterium
RGDLDG

SEQ ID NO: 1170695 - protein, 13 aa, Mycobacterium
RGDLTATGHGNSV

SEQ ID NO: 1170696 - protein, 6 aa, Mycobacterium
RGDPDG

SEQ ID NO: 1170697 - protein, 11 aa, Mycobacterium
RGDPDTGAQAL

SEQ ID NO: 1170698 - protein, 14 aa, Mycobacterium
RGDPPREDWSPPPV

SEQ ID NO: 1170699 - protein, 5 aa, Mycobacterium
RGDPT

SEQ ID NO: 1170700 - protein, 6 aa, Mycobacterium
RGDPTF

SEQ ID NO: 1170701 - protein, 6 aa, Mycobacterium
RGDQLQ

SEQ ID NO: 1170702 - protein, 9 aa, Mycobacterium
RGDQTNASL

SEQ ID NO: 1170703 - protein, 5 aa, Mycobacterium
RGDRA

SEQ ID NO: 1170704 - protein, 6 aa, Mycobacterium
RGDSAA

SEQ ID NO: 1170705 - protein, 5 aa, Mycobacterium
RGDYD

SEQ ID NO: 1170706 - protein, 8 aa, Mycobacterium
RGEAARGT

SEQ ID NO: 1170707 - protein, 15 aa, Mycobacterium
RGEAGDRQVPGEPKV

SEQ ID NO: 1170708 - protein, 14 aa, Mycobacterium
RGEAGDRQVPGEPR

SEQ ID NO: 1170709 - protein, 6 aa, Mycobacterium
RGECDR

SEQ ID NO: 1170710 - protein, 5 aa, Mycobacterium
RGEDA

SEQ ID NO: 1170711 - protein, 6 aa, Mycobacterium
RGEDGV

SEQ ID NO: 1170712 - protein, 6 aa, Mycobacterium
RGEDVG

SEQ ID NO: 1170713 - protein, 4 aa, Mycobacterium
RGEE

SEQ ID NO: 1170714 - protein, 14 aa, Mycobacterium
RGEEKAKNLPYGDQ

SEQ ID NO: 1170715 - protein, 12 aa, Mycobacterium
RGEGEDTTADAA

SEQ ID NO: 1170716 - protein, 7 aa, Mycobacterium
RGELPTS

SEQ ID NO: 1170717 - protein, 5 aa, Mycobacterium
RGEPA

SEQ ID NO: 1170718 - protein, 17 aa, Mycobacterium
RGEPARGPSGREPPAEL

SEQ ID NO: 1170719 - protein, 12 aa, Mycobacterium
RGERPRPAERSS

SEQ ID NO: 1170720 - protein, 6 aa, Mycobacterium
RGESHA

SEQ ID NO: 1170721 - protein, 10 aa, Mycobacterium
RGEVTAPDDD

SEQ ID NO: 1170722 - protein, 10 aa, Mycobacterium
RGFDGAGRLD

SEQ ID NO: 1170723 - protein, 10 aa, Mycobacterium
RGFPSPKEHP

SEQ ID NO: 1170724 - protein, 5 aa, Mycobacterium
RGFRG

SEQ ID NO: 1170725 - protein, 4 aa, Mycobacterium
RGFS

SEQ ID NO: 1170726 - protein, 13 aa, Mycobacterium
RGFSEDPKALEPV

SEQ ID NO: 1170727 - protein, 8 aa, Mycobacterium
RGGAAKRR

SEQ ID NO: 1170728 - protein, 9 aa, Mycobacterium
RGGAAPSID

SEQ ID NO: 1170729 - protein, 11 aa, Mycobacterium
RGGDAQHDKQL

SEQ ID NO: 1170730 - protein, 10 aa, Mycobacterium
RGGDGSANPY

SEQ ID NO: 1170731 - protein, 14 aa, Mycobacterium
RGGDPDRAGKADEL

SEQ ID NO: 1170732 - protein, 4 aa, Mycobacterium
RGGE

SEQ ID NO: 1170733 - protein, 8 aa, Mycobacterium
RGGGELGR

SEQ ID NO: 1170734 - protein, 10 aa, Mycobacterium
RGGGSSAPAL

SEQ ID NO: 1170735 - protein, 11 aa, Mycobacterium
RGGLPTGEPNE

SEQ ID NO: 1170736 - protein, 10 aa, Mycobacterium
RGGLRQGPQG

SEQ ID NO: 1170737 - protein, 16 aa, Mycobacterium
RGGNVSSEHGVGTRKR

SEQ ID NO: 1170738 - protein, 22 aa, Mycobacterium
RGGPVEPGWPGSRADTESGGQG

SEQ ID NO: 1170739 - protein, 8 aa, Mycobacterium
RGGQDPDW

SEQ ID NO: 1170740 - protein, 7 aa, Mycobacterium
RGGQGLK

SEQ ID NO: 1170741 - protein, 8 aa, Mycobacterium
RGGQQREQ

SEQ ID NO: 1170742 - protein, 16 aa, Mycobacterium
RGGQYAEASAESGRGF

SEQ ID NO: 1170743 - protein, 5 aa, Mycobacterium
RGGRN

SEQ ID NO: 1170744 - protein, 8 aa, Mycobacterium
RGGSADEV

SEQ ID NO: 1170745 - protein, 8 aa, Mycobacterium
RGGSLKSS

SEQ ID NO: 1170746 - protein, 9 aa, Mycobacterium
RGGSVEEAA

SEQ ID NO: 1170747 - protein, 4 aa, Mycobacterium
RGGT

SEQ ID NO: 1170748 - protein, 10 aa, Mycobacterium
RGGTEPTVTD

SEQ ID NO: 1170749 - protein, 9 aa, Mycobacterium
RGGTPTPYD

SEQ ID NO: 1170750 - protein, 5 aa, Mycobacterium
RGGVV

SEQ ID NO: 1170751 - protein, 5 aa, Mycobacterium
RGGYA

SEQ ID NO: 1170752 - protein, 7 aa, Mycobacterium
RGHDRHD

SEQ ID NO: 1170753 - protein, 5 aa, Mycobacterium
RGHGA

SEQ ID NO: 1170754 - protein, 9 aa, Mycobacterium
RGHGARAGK

SEQ ID NO: 1170755 - protein, 10 aa, Mycobacterium
RGHGRSDGKR

SEQ ID NO: 1170756 - protein, 5 aa, Mycobacterium
RGHGS

SEQ ID NO: 1170757 - protein, 5 aa, Mycobacterium
RGHGY

SEQ ID NO: 1170758 - protein, 16 aa, Mycobacterium
RGHRPVRTSVSAATRE

SEQ ID NO: 1170759 - protein, 5 aa, Mycobacterium
RGIDA

SEQ ID NO: 1170760 - protein, 16 aa, Mycobacterium
RGIGAGPASEAATPRN

SEQ ID NO: 1170761 - protein, 6 aa, Mycobacterium
RGITRE

SEQ ID NO: 1170762 - protein, 11 aa, Mycobacterium
RGKDLDNTRTE

SEQ ID NO: 1170763 - protein, 39 aa, Mycobacterium
RGKNTRKNAKGKGKKGKKAGRGPTPPKNRNPLGAGMPGM

SEQ ID NO: 1170764 - protein, 10 aa, Mycobacterium
RGKPPEQPVT

SEQ ID NO: 1170765 - protein, 10 aa, Mycobacterium
RGKPSPAQLD

SEQ ID NO: 1170766 - protein, 8 aa, Mycobacterium
RGKSGELP

SEQ ID NO: 1170767 - protein, 10 aa, Mycobacterium
RGKTIRPKTL

SEQ ID NO: 1170768 - protein, 8 aa, Mycobacterium
RGLDGRDA

SEQ ID NO: 1170769 - protein, 6 aa, Mycobacterium
RGLERT

SEQ ID NO: 1170770 - protein, 6 aa, Mycobacterium
RGLGGA

SEQ ID NO: 1170771 - protein, 8 aa, Mycobacterium
RGLKSTAE

SEQ ID NO: 1170772 - protein, 8 aa, Mycobacterium
RGLRAAAE

SEQ ID NO: 1170773 - protein, 9 aa, Mycobacterium
RGLRDSPVE

SEQ ID NO: 1170774 - protein, 4 aa, Mycobacterium
RGLS

SEQ ID NO: 1170775 - protein, 6 aa, Mycobacterium
RGLSPE

SEQ ID NO: 1170776 - protein, 8 aa, Mycobacterium
RGNALGAG

SEQ ID NO: 1170777 - protein, 6 aa, Mycobacterium
RGNGEP

SEQ ID NO: 1170778 - protein, 7 aa, Mycobacterium
RGNGGTV

SEQ ID NO: 1170779 - protein, 4 aa, Mycobacterium
RGNL

SEQ ID NO: 1170780 - protein, 21 aa, Mycobacterium
RGNPATAPKDPLGTPSSARNR

SEQ ID NO: 1170781 - protein, 10 aa, Mycobacterium
RGNPGPAGYG

SEQ ID NO: 1170782 - protein, 6 aa, Mycobacterium
RGNRGD

SEQ ID NO: 1170783 - protein, 7 aa, Mycobacterium
RGNTAPL

SEQ ID NO: 1170784 - protein, 7 aa, Mycobacterium
RGNVDGA

SEQ ID NO: 1170785 - protein, 10 aa, Mycobacterium
RGPAENRQQA

SEQ ID NO: 1170786 - protein, 6 aa, Mycobacterium
RGPAGE

SEQ ID NO: 1170787 - protein, 5 aa, Mycobacterium
RGPAT

SEQ ID NO: 1170788 - protein, 8 aa, Mycobacterium
RGPDGRQR

SEQ ID NO: 1170789 - protein, 5 aa, Mycobacterium
RGPDW

SEQ ID NO: 1170790 - protein, 12 aa, Mycobacterium
RGPEPPDDAWTS

SEQ ID NO: 1170791 - protein, 17 aa, Mycobacterium
RGPERAALTGPNGAGKS

SEQ ID NO: 1170792 - protein, 7 aa, Mycobacterium
RGPGAAA

SEQ ID NO: 1170793 - protein, 13 aa, Mycobacterium
RGPHSCPGAPLAR

SEQ ID NO: 1170794 - protein, 4 aa, Mycobacterium
RGPL

SEQ ID NO: 1170795 - protein, 10 aa, Mycobacterium
RGPLRAGPNG

SEQ ID NO: 1170796 - protein, 9 aa, Mycobacterium
RGPLSHDEA

SEQ ID NO: 1170797 - protein, 9 aa, Mycobacterium
RGPNDGGWT

SEQ ID NO: 1170798 - protein, 9 aa, Mycobacterium
RGPNRVDDE

SEQ ID NO: 1170799 - protein, 6 aa, Mycobacterium
RGPQTG

SEQ ID NO: 1170800 - protein, 7 aa, Mycobacterium
RGPRIEH

SEQ ID NO: 1170801 - protein, 7 aa, Mycobacterium
RGPRKKG

SEQ ID NO: 1170802 - protein, 8 aa, Mycobacterium
RGPSGERA

SEQ ID NO: 1170803 - protein, 9 aa, Mycobacterium
RGPSGQREI

SEQ ID NO: 1170804 - protein, 19 aa, Mycobacterium
RGPSGVIGSNKKDSQATVD

SEQ ID NO: 1170805 - protein, 9 aa, Mycobacterium
RGPTRGDDL

SEQ ID NO: 1170806 - protein, 5 aa, Mycobacterium
RGPVS

SEQ ID NO: 1170807 - protein, 13 aa, Mycobacterium
RGPVSPPNNTGDG

SEQ ID NO: 1170808 - protein, 4 aa, Mycobacterium
RGQE

SEQ ID NO: 1170809 - protein, 8 aa, Mycobacterium
RGQEAAQI

SEQ ID NO: 1170810 - protein, 6 aa, Mycobacterium
RGQEIG

SEQ ID NO: 1170811 - protein, 20 aa, Mycobacterium
RGQHGSLTDAEQRVPLLLAH

SEQ ID NO: 1170812 - protein, 9 aa, Mycobacterium
RGQIRDPAL

SEQ ID NO: 1170813 - protein, 10 aa, Mycobacterium
RGQRSGEFRP

SEQ ID NO: 1170814 - protein, 10 aa, Mycobacterium
RGQTAIDPGM

SEQ ID NO: 1170815 - protein, 5 aa, Mycobacterium
RGQTG

SEQ ID NO: 1170816 - protein, 8 aa, Mycobacterium
RGQVADEQ

SEQ ID NO: 1170817 - protein, 9 aa, Mycobacterium
RGRAARNAK

SEQ ID NO: 1170818 - protein, 10 aa, Mycobacterium
RGRAGARQAK

SEQ ID NO: 1170819 - protein, 10 aa, Mycobacterium
RGRAPRGGAE

SEQ ID NO: 1170820 - protein, 11 aa, Mycobacterium
RGRDEAGARSE

SEQ ID NO: 1170821 - protein, 6 aa, Mycobacterium
RGRDGL

SEQ ID NO: 1170822 - protein, 6 aa, Mycobacterium
RGRDHG

SEQ ID NO: 1170823 - protein, 11 aa, Mycobacterium
RGRESGGAPTA

SEQ ID NO: 1170824 - protein, 5 aa, Mycobacterium
RGRFP

SEQ ID NO: 1170825 - protein, 4 aa, Mycobacterium
RGRG

SEQ ID NO: 1170826 - protein, 5 aa, Mycobacterium
RGRGA

SEQ ID NO: 1170827 - protein, 11 aa, Mycobacterium
RGRGEAHDDPA

SEQ ID NO: 1170828 - protein, 9 aa, Mycobacterium
RGRGGRTLR

SEQ ID NO: 1170829 - protein, 7 aa, Mycobacterium
RGRGSLS

SEQ ID NO: 1170830 - protein, 7 aa, Mycobacterium
RGRHDRA

SEQ ID NO: 1170831 - protein, 6 aa, Mycobacterium
RGRHRK

SEQ ID NO: 1170832 - protein, 8 aa, Mycobacterium
RGRPATSP

SEQ ID NO: 1170833 - protein, 8 aa, Mycobacterium
RGRPEQRI

SEQ ID NO: 1170834 - protein, 9 aa, Mycobacterium
RGRPLPERS

SEQ ID NO: 1170835 - protein, 4 aa, Mycobacterium
RGRQ

SEQ ID NO: 1170836 - protein, 10 aa, Mycobacterium
RGRQQVAREE

SEQ ID NO: 1170837 - protein, 15 aa, Mycobacterium
RGRRREKRAQAALRA

SEQ ID NO: 1170838 - protein, 9 aa, Mycobacterium
RGRSDHTRR

SEQ ID NO: 1170839 - protein, 8 aa, Mycobacterium
RGRTDPPP

SEQ ID NO: 1170840 - protein, 5 aa, Mycobacterium
RGRTV

SEQ ID NO: 1170841 - protein, 4 aa, Mycobacterium
RGRV

SEQ ID NO: 1170842 - protein, 12 aa, Mycobacterium
RGRVDNDATNQQ

SEQ ID NO: 1170843 - protein, 10 aa, Mycobacterium
RGSADGTAAV

SEQ ID NO: 1170844 - protein, 5 aa, Mycobacterium
RGSDA

SEQ ID NO: 1170845 - protein, 6 aa, Mycobacterium
RGSDEL

SEQ ID NO: 1170846 - protein, 11 aa, Mycobacterium
RGSDGGERGGV

SEQ ID NO: 1170847 - protein, 7 aa, Mycobacterium
RGSDGRV

SEQ ID NO: 1170848 - protein, 7 aa, Mycobacterium
RGSGASF

SEQ ID NO: 1170849 - protein, 8 aa, Mycobacterium
RGSGPQPY

SEQ ID NO: 1170850 - protein, 8 aa, Mycobacterium
RGSGPRSI

SEQ ID NO: 1170851 - protein, 6 aa, Mycobacterium
RGSGTL

SEQ ID NO: 1170852 - protein, 10 aa, Mycobacterium
RGSHGPVRRR

SEQ ID NO: 1170853 - protein, 11 aa, Mycobacterium
RGSIGPDGVGV

SEQ ID NO: 1170854 - protein, 10 aa, Mycobacterium
RGSLDRGADR

SEQ ID NO: 1170855 - protein, 15 aa, Mycobacterium
RGSPRMPPRPRDSHD

SEQ ID NO: 1170856 - protein, 18 aa, Mycobacterium
RGSQSINSGGEKIYPEEV

SEQ ID NO: 1170857 - protein, 8 aa, Mycobacterium
RGSRTPDR

SEQ ID NO: 1170858 - protein, 4 aa, Mycobacterium
RGSS

SEQ ID NO: 1170859 - protein, 8 aa, Mycobacterium
RGSSPAVR

SEQ ID NO: 1170860 - protein, 5 aa, Mycobacterium
RGSVP

SEQ ID NO: 1170861 - protein, 5 aa, Mycobacterium
RGSVT

SEQ ID NO: 1170862 - protein, 8 aa, Mycobacterium
RGTAETAG

SEQ ID NO: 1170863 - protein, 8 aa, Mycobacterium
RGTDDDAH

SEQ ID NO: 1170864 - protein, 10 aa, Mycobacterium
RGTDEPAART

SEQ ID NO: 1170865 - protein, 19 aa, Mycobacterium
RGTDLAAADARAAAVRPDD

SEQ ID NO: 1170866 - protein, 6 aa, Mycobacterium
RGTGAL

SEQ ID NO: 1170867 - protein, 15 aa, Mycobacterium
RGTGLGDSTEPGCPP

SEQ ID NO: 1170868 - protein, 10 aa, Mycobacterium
RGTIEGDEDV

SEQ ID NO: 1170869 - protein, 6 aa, Mycobacterium
RGTPAG

SEQ ID NO: 1170870 - protein, 9 aa, Mycobacterium
RGTPEDAPY

SEQ ID NO: 1170871 - protein, 8 aa, Mycobacterium
RGTPLTEA

SEQ ID NO: 1170872 - protein, 8 aa, Mycobacterium
RGTRVGEV

SEQ ID NO: 1170873 - protein, 6 aa, Mycobacterium
RGTSAR

SEQ ID NO: 1170874 - protein, 8 aa, Mycobacterium
RGTSVNQV

SEQ ID NO: 1170875 - protein, 10 aa, Mycobacterium
RGTTGHNRLR

SEQ ID NO: 1170876 - protein, 17 aa, Mycobacterium
RGTTTSPDMGPGGAGYG

SEQ ID NO: 1170877 - protein, 12 aa, Mycobacterium
RGTVGSADRPTV

SEQ ID NO: 1170878 - protein, 11 aa, Mycobacterium
RGVDGGFSSGY

SEQ ID NO: 1170879 - protein, 6 aa, Mycobacterium
RGVEQA

SEQ ID NO: 1170880 - protein, 10 aa, Mycobacterium
RGVETDPDNP

SEQ ID NO: 1170881 - protein, 6 aa, Mycobacterium
RGVGRG

SEQ ID NO: 1170882 - protein, 14 aa, Mycobacterium
RGVGRTKKEAELKA

SEQ ID NO: 1170883 - protein, 4 aa, Mycobacterium
RGVP

SEQ ID NO: 1170884 - protein, 5 aa, Mycobacterium
RGVPD

SEQ ID NO: 1170885 - protein, 6 aa, Mycobacterium
RGVPET

SEQ ID NO: 1170886 - protein, 11 aa, Mycobacterium
RGVPKRGGGHG

SEQ ID NO: 1170887 - protein, 19 aa, Mycobacterium
RGVPTHPVKSPADLDGLTS

SEQ ID NO: 1170888 - protein, 10 aa, Mycobacterium
RGVPTTTKTN

SEQ ID NO: 1170889 - protein, 7 aa, Mycobacterium
RGVTDEQ

SEQ ID NO: 1170890 - protein, 5 aa, Mycobacterium
RGVTS

SEQ ID NO: 1170891 - protein, 6 aa, Mycobacterium
RGWEPE

SEQ ID NO: 1170892 - protein, 8 aa, Mycobacterium
RGWETDGG

SEQ ID NO: 1170893 - protein, 17 aa, Mycobacterium
RGWRGQRAAAGAGRTVS

SEQ ID NO: 1170894 - protein, 5 aa, Mycobacterium
RGYAP

SEQ ID NO: 1170895 - protein, 12 aa, Mycobacterium
RGYDSDHPRVQG

SEQ ID NO: 1170896 - protein, 8 aa, Mycobacterium
RGYEGTSI

SEQ ID NO: 1170897 - protein, 10 aa, Mycobacterium
RGYGESDPDF

SEQ ID NO: 1170898 - protein, 7 aa, Mycobacterium
RGYPTTD

SEQ ID NO: 1170899 - protein, 11 aa, Mycobacterium
RGYQEDSVRRT

SEQ ID NO: 1170900 - protein, 9 aa, Mycobacterium
RGYQNTTVE

SEQ ID NO: 1170901 - protein, 9 aa, Mycobacterium
RHAAREAGY

SEQ ID NO: 1170902 - protein, 5 aa, Mycobacterium
RHAPA

SEQ ID NO: 1170903 - protein, 5 aa, Mycobacterium
RHAPD

SEQ ID NO: 1170904 - protein, 11 aa, Mycobacterium
RHAPYQRPPLS

SEQ ID NO: 1170905 - protein, 30 aa, Mycobacterium; identical to SEQ ID NO: 403978

SEQ ID NO: 1170906 - protein, 7 aa, Mycobacterium
RHDADGS

SEQ ID NO: 1170907 - protein, 6 aa, Mycobacterium
RHDGAA

SEQ ID NO: 1170908 - protein, 8 aa, Mycobacterium
RHDLGSKA

SEQ ID NO: 1170909 - protein, 7 aa, Mycobacterium
RHDNPDV

SEQ ID NO: 1170910 - protein, 10 aa, Mycobacterium
RHDPDTQRRL

SEQ ID NO: 1170911 - protein, 16 aa, Mycobacterium
RHDTEPARVQIDPLHI

SEQ ID NO: 1170912 - protein, 11 aa, Mycobacterium
RHEAACASGSV

SEQ ID NO: 1170913 - protein, 12 aa, Mycobacterium
RHEAGGRTAREN

SEQ ID NO: 1170914 - protein, 5 aa, Mycobacterium
RHEHT

SEQ ID NO: 1170915 - protein, 5 aa, Mycobacterium
RHEPN

SEQ ID NO: 1170916 - protein, 11 aa, Mycobacterium
RHGGASESFED

SEQ ID NO: 1170917 - protein, 4 aa, Mycobacterium
RHGL

SEQ ID NO: 1170918 - protein, 5 aa, Mycobacterium
RHGPD

SEQ ID NO: 1170919 - protein, 14 aa, Mycobacterium
RHGPGRRAGTQSHA

SEQ ID NO: 1170920 - protein, 9 aa, Mycobacterium
RHGPGRVPA

SEQ ID NO: 1170921 - protein, 7 aa, Mycobacterium
RHGRAED

SEQ ID NO: 1170922 - protein, 6 aa, Mycobacterium
RHGRDF

SEQ ID NO: 1170923 - protein, 5 aa, Mycobacterium
RHGRS

SEQ ID NO: 1170924 - protein, 10 aa, Mycobacterium
RHGVGEGDNV

SEQ ID NO: 1170925 - protein, 7 aa, Mycobacterium
RHHRGGD

SEQ ID NO: 1170926 - protein, 4 aa, Mycobacterium
RHLT

SEQ ID NO: 1170927 - protein, 12 aa, Mycobacterium
RHPAAAERLQPP

SEQ ID NO: 1170928 - protein, 9 aa, Mycobacterium
RHPAADSIG

SEQ ID NO: 1170929 - protein, 5 aa, Mycobacterium
RHPAE

SEQ ID NO: 1170930 - protein, 8 aa, Mycobacterium
RHPDGADA

SEQ ID NO: 1170931 - protein, 10 aa, Mycobacterium
RHPDGRPRRV

SEQ ID NO: 1170932 - protein, 4 aa, Mycobacterium
RHPG

SEQ ID NO: 1170933 - protein, 8 aa, Mycobacterium
RHPGAGPA

SEQ ID NO: 1170934 - protein, 7 aa, Mycobacterium
RHPGGAS

SEQ ID NO: 1170935 - protein, 4 aa, Mycobacterium
RHPL

SEQ ID NO: 1170936 - protein, 7 aa, Mycobacterium
RHQDSTA

SEQ ID NO: 1170937 - protein, 21 aa, Mycobacterium
RHQSEPEHRPGHFPRPADDRQ

SEQ ID NO: 1170938 - protein, 6 aa, Mycobacterium
RHRDDT

SEQ ID NO: 1170939 - protein, 7 aa, Mycobacterium
RHREGSC

SEQ ID NO: 1170940 - protein, 6 aa, Mycobacterium
RHRGRK

SEQ ID NO: 1170941 - protein, 6 aa, Mycobacterium
RHRPDH

SEQ ID NO: 1170942 - protein, 7 aa, Mycobacterium
RHRTTPL

SEQ ID NO: 1170943 - protein, 6 aa, Mycobacterium
RHSTAG

SEQ ID NO: 1170944 - protein, 7 aa, Mycobacterium
RHTDGTP

SEQ ID NO: 1170945 - protein, 9 aa, Mycobacterium
RHTSDAPVG

SEQ ID NO: 1170946 - protein, 6 aa, Mycobacterium
RHVDSG

SEQ ID NO: 1170947 - protein, 10 aa, Mycobacterium
RIADEEVDSG

SEQ ID NO: 1170948 - protein, 16 aa, Mycobacterium
RIAGRPAASIEQHDGQ

SEQ ID NO: 1170949 - protein, 12 aa, Mycobacterium
RIDAPTDATVSA

SEQ ID NO: 1170950 - protein, 7 aa, Mycobacterium
RIDGQGR

SEQ ID NO: 1170951 - protein, 17 aa, Mycobacterium
RIDPDNPPDADRGEEGP

SEQ ID NO: 1170952 - protein, 15 aa, Mycobacterium
RIDPGKDADGLHPTN

SEQ ID NO: 1170953 - protein, 17 aa, Mycobacterium
RIDPRGVTEDLAPARAA

SEQ ID NO: 1170954 - protein, 9 aa, Mycobacterium
RIDQDDAKN

SEQ ID NO: 1170955 - protein, 8 aa, Mycobacterium
RIDTDRDK

SEQ ID NO: 1170956 - protein, 21 aa, Mycobacterium
RIDTGHDHGAGDTLAAATASA

SEQ ID NO: 1170957 - protein, 12 aa, Mycobacterium
RIEAEAKKITTR

SEQ ID NO: 1170958 - protein, 5 aa, Mycobacterium
RIEDA

SEQ ID NO: 1170959 - protein, 4 aa, Mycobacterium
RIEE

SEQ ID NO: 1170960 - protein, 6 aa, Mycobacterium
RIERTE

SEQ ID NO: 1170961 - protein, 9 aa, Mycobacterium
RIGDADASA

SEQ ID NO: 1170962 - protein, 6 aa, Mycobacterium
RIGEDM

SEQ ID NO: 1170963 - protein, 7 aa, Mycobacterium
RIGGGVA

SEQ ID NO: 1170964 - protein, 8 aa, Mycobacterium
RIGPGKAQ

SEQ ID NO: 1170965 - protein, 5 aa, Mycobacterium
RIGRG

SEQ ID NO: 1170966 - protein, 11 aa, Mycobacterium
RIGSPRSRCQA

SEQ ID NO: 1170967 - protein, 7 aa, Mycobacterium
RIPAQRA

SEQ ID NO: 1170968 - protein, 6 aa, Mycobacterium
RIPSEG

SEQ ID NO: 1170969 - protein, 6 aa, Mycobacterium
RIPSSS

SEQ ID NO: 1170970 - protein, 6 aa, Mycobacterium
RIPTEP

SEQ ID NO: 1170971 - protein, 5 aa, Mycobacterium
RIRKT

SEQ ID NO: 1170972 - protein, 5 aa, Mycobacterium
RISAG

SEQ ID NO: 1170973 - protein, 9 aa, Mycobacterium
RISDDGEVQ

SEQ ID NO: 1170974 - protein, 7 aa, Mycobacterium
RISNSAL

SEQ ID NO: 1170975 - protein, 21 aa, Mycobacterium
RITGSDASAAGGLSVNDGQTY

SEQ ID NO: 1170976 - protein, 5 aa, Mycobacterium
RITRG

SEQ ID NO: 1170977 - protein, 8 aa, Mycobacterium
RITRGGAT

SEQ ID NO: 1170978 - protein, 17 aa, Mycobacterium
RKAARKAAAAADTEADE

SEQ ID NO: 1170979 - protein, 61 aa, Mycobacterium
RKAGTKKGPTVGSGGVRRRGLEGRGATPPAHQRPNHPAAKRAAKAAKQQQRRPARKTDETE

SEQ ID NO: 1170980 - protein, 8 aa, Mycobacterium
RKANGPFE

SEQ ID NO: 1170981 - protein, 27 aa, Mycobacterium
RKAPDNDKIRRRAATESSEKQAQKVRQ

SEQ ID NO: 1170982 - protein, 6 aa, Mycobacterium
RKAQDA

SEQ ID NO: 1170983 - protein, 17 aa, Mycobacterium
RKATTKLATSDEPITID

SEQ ID NO: 1170984 - protein, 12 aa, Mycobacterium
RKDEYGGSIDNR

SEQ ID NO: 1170985 - protein, 5 aa, Mycobacterium
RKDGD

SEQ ID NO: 1170986 - protein, 17 aa, Mycobacterium
RKDTNADVNDRYPVPAG

SEQ ID NO: 1170987 - protein, 7 aa, Mycobacterium
RKEAFER

SEQ ID NO: 1170988 - protein, 4 aa, Mycobacterium
RKEG

SEQ ID NO: 1170989 - protein, 9 aa, Mycobacterium
RKEGETGGV

SEQ ID NO: 1170990 - protein, 9 aa, Mycobacterium
RKEGHGSHI

SEQ ID NO: 1170991 - protein, 5 aa, Mycobacterium
RKEGK

SEQ ID NO: 1170992 - protein, 8 aa, Mycobacterium
RKEGRALG

SEQ ID NO: 1170993 - protein, 5 aa, Mycobacterium
RKEPT

SEQ ID NO: 1170994 - protein, 9 aa, Mycobacterium
RKEYEEERP

SEQ ID NO: 1170995 - protein, 17 aa, Mycobacterium
RKGDADAYSLSTDEVAD

SEQ ID NO: 1170996 - protein, 6 aa, Mycobacterium
RKGDGF

SEQ ID NO: 1170997 - protein, 7 aa, Mycobacterium
RKGDGPG

SEQ ID NO: 1170998 - protein, 10 aa, Mycobacterium
RKGGASATTV

SEQ ID NO: 1170999 - protein, 28 aa, Mycobacterium
RKGHDDDFNRGDSAYDNYYGDPTLPNPN

SEQ ID NO: 1171000 - protein, 7 aa, Mycobacterium
RKGKGGV

SEQ ID NO: 1171001 - protein, 4 aa, Mycobacterium
RKGR

SEQ ID NO: 1171002 - protein, 12 aa, Mycobacterium
RKGRERDTNPDL

SEQ ID NO: 1171003 - protein, 7 aa, Mycobacterium
RKGTGQG

SEQ ID NO: 1171004 - protein, 8 aa, Mycobacterium
RKGVDDEV

SEQ ID NO: 1171005 - protein, 13 aa, Mycobacterium
RKGYTDVNQFTLV

SEQ ID NO: 1171006 - protein, 7 aa, Mycobacterium
RKHGASK

SEQ ID NO: 1171007 - protein, 38 aa, Mycobacterium
RKKAHSTDSAGQRKGGPQQAKAHGHGPVENRREFRRKS

SEQ ID NO: 1171008 - protein, 9 aa, Mycobacterium
RKKGFDGTE

SEQ ID NO: 1171009 - protein, 14 aa, Mycobacterium
RKKQRQPSEYPTEE

SEQ ID NO: 1171010 - protein, 9 aa, Mycobacterium
RKKQRTRTT

SEQ ID NO: 1171011 - protein, 10 aa, Mycobacterium
RKLAGTDDVP

SEQ ID NO: 1171012 - protein, 11 aa, Mycobacterium
RKLDKAASKGV

SEQ ID NO: 1171013 - protein, 7 aa, Mycobacterium
RKNIDTG

SEQ ID NO: 1171014 - protein, 6 aa, Mycobacterium
RKNNGA

SEQ ID NO: 1171015 - protein, 13 aa, Mycobacterium
RKPDGTPLTDTEA

SEQ ID NO: 1171016 - protein, 6 aa, Mycobacterium
RKPDVA

SEQ ID NO: 1171017 - protein, 32 aa, Mycobacterium
RKPGATTTTSAVRGQFKTDKASRAEALDLILR

SEQ ID NO: 1171018 - protein, 17 aa, Mycobacterium
RKPGFDGTWTGDENTDM

SEQ ID NO: 1171019 - protein, 13 aa, Mycobacterium
RKPGQLSGGQRQR

SEQ ID NO: 1171020 - protein, 8 aa, Mycobacterium
RKPHPAGD

SEQ ID NO: 1171021 - protein, 6 aa, Mycobacterium
RKPKGV

SEQ ID NO: 1171022 - protein, 7 aa, Mycobacterium
RKPNPHL

SEQ ID NO: 1171023 - protein, 7 aa, Mycobacterium
RKPSEYV

SEQ ID NO: 1171024 - protein, 9 aa, Mycobacterium
RKQDEVDSM

SEQ ID NO: 1171025 - protein, 7 aa, Mycobacterium
RKQRDTV

SEQ ID NO: 1171026 - protein, 16 aa, Mycobacterium
RKQRLTSGDELTAQEA

SEQ ID NO: 1171027 - protein, 7 aa, Mycobacterium
RKQSPYP

SEQ ID NO: 1171028 - protein, 7 aa, Mycobacterium
RKRPPGQ

SEQ ID NO: 1171029 - protein, 15 aa, Mycobacterium
RKRRAQESAGRADDV

SEQ ID NO: 1171030 - protein, 13 aa, Mycobacterium
RKRTEEAQHPVGE

SEQ ID NO: 1171031 - protein, 16 aa, Mycobacterium
RKSAEPLLRGLGLTVS

SEQ ID NO: 1171032 - protein, 11 aa, Mycobacterium
RKSEGTGSEPV

SEQ ID NO: 1171033 - protein, 7 aa, Mycobacterium
RKSPQIS

SEQ ID NO: 1171034 - protein, 8 aa, Mycobacterium
RKSSGLDV

SEQ ID NO: 1171035 - protein, 8 aa, Mycobacterium
RKSSPGVK

SEQ ID NO: 1171036 - protein, 6 aa, Mycobacterium
RKTADD

SEQ ID NO: 1171037 - protein, 16 aa, Mycobacterium
RKTLRRNRTELTESPE

SEQ ID NO: 1171038 - protein, 8 aa, Mycobacterium
RKVKGAEQ

SEQ ID NO: 1171039 - protein, 6 aa, Mycobacterium
RKYQGA

SEQ ID NO: 1171040 - protein, 15 aa, Mycobacterium
RLAARSTLSFAVLDP

SEQ ID NO: 1171041 - protein, 7 aa, Mycobacterium
RLADGER

SEQ ID NO: 1171042 - protein, 5 aa, Mycobacterium
RLAEN

SEQ ID NO: 1171043 - protein, 5 aa, Mycobacterium
RLAER

SEQ ID NO: 1171044 - protein, 8 aa, Mycobacterium
RLAETTGD

SEQ ID NO: 1171045 - protein, 10 aa, Mycobacterium
RLAGEERAPM

SEQ ID NO: 1171046 - protein, 7 aa, Mycobacterium
RLAPGSY

SEQ ID NO: 1171047 - protein, 7 aa, Mycobacterium
RLAPRDP

SEQ ID NO: 1171048 - protein, 13 aa, Mycobacterium
RLDGGKGQHGHLA

SEQ ID NO: 1171049 - protein, 5 aa, Mycobacterium
RLDGS

SEQ ID NO: 1171050 - protein, 10 aa, Mycobacterium
RLDGYPRPGR

SEQ ID NO: 1171051 - protein, 5 aa, Mycobacterium
RLDPP

SEQ ID NO: 1171052 - protein, 15 aa, Mycobacterium
RLDQPGGGLSGGQQQ

SEQ ID NO: 1171053 - protein, 16 aa, Mycobacterium
RLEPGARRTDDEHTAG

SEQ ID NO: 1171054 - protein, 8 aa, Mycobacterium
RLEPGDNV

SEQ ID NO: 1171055 - protein, 7 aa, Mycobacterium
RLEPTMS

SEQ ID NO: 1171056 - protein, 16 aa, Mycobacterium
RLESKKISKTQAVTSN

SEQ ID NO: 1171057 - protein, 5 aa, Mycobacterium
RLGDD

SEQ ID NO: 1171058 - protein, 13 aa, Mycobacterium
RLGDTGRPDAATV

SEQ ID NO: 1171059 - protein, 5 aa, Mycobacterium
RLGES

SEQ ID NO: 1171060 - protein, 9 aa, Mycobacterium
RLGGEPLSD

SEQ ID NO: 1171061 - protein, 15 aa, Mycobacterium
RLGGPLPEHPTDPAE

SEQ ID NO: 1171062 - protein, 13 aa, Mycobacterium
RLGGSDEGDHDEV

SEQ ID NO: 1171063 - protein, 11 aa, Mycobacterium
RLGPSAAGSIG

SEQ ID NO: 1171064 - protein, 11 aa, Mycobacterium
RLGRATQALPN

SEQ ID NO: 1171065 - protein, 5 aa, Mycobacterium
RLGRR

SEQ ID NO: 1171066 - protein, 9 aa, Mycobacterium
RLNETRDQL

SEQ ID NO: 1171067 - protein, 8 aa, Mycobacterium
RLNPEGAG

SEQ ID NO: 1171068 - protein, 12 aa, Mycobacterium
RLPAADDGTGPH

SEQ ID NO: 1171069 - protein, 9 aa, Mycobacterium
RLPADQARE

SEQ ID NO: 1171070 - protein, 6 aa, Mycobacterium
RLPDAG

SEQ ID NO: 1171071 - protein, 11 aa, Mycobacterium
RLPEDQRVPDN

SEQ ID NO: 1171072 - protein, 6 aa, Mycobacterium
RLPEGY

SEQ ID NO: 1171073 - protein, 5 aa, Mycobacterium
RLPET

SEQ ID NO: 1171074 - protein, 7 aa, Mycobacterium
RLPGERA

SEQ ID NO: 1171075 - protein, 12 aa, Mycobacterium
RLPKSGGKAPWR

SEQ ID NO: 1171076 - protein, 9 aa, Mycobacterium
RLPPPDLTT

SEQ ID NO: 1171077 - protein, 14 aa, Mycobacterium
RLPPSVTLGPGDDA

SEQ ID NO: 1171078 - protein, 5 aa, Mycobacterium
RLPRP

SEQ ID NO: 1171079 - protein, 4 aa, Mycobacterium
RLPS

SEQ ID NO: 1171080 - protein, 8 aa, Mycobacterium
RLPSPVTE

SEQ ID NO: 1171081 - protein, 9 aa, Mycobacterium
RLPTPDDVG

SEQ ID NO: 1171082 - protein, 4 aa, Mycobacterium
RLPV

SEQ ID NO: 1171083 - protein, 7 aa, Mycobacterium
RLQGGDE

SEQ ID NO: 1171084 - protein, 10 aa, Mycobacterium
RLQGKSKEMS

SEQ ID NO: 1171085 - protein, 5 aa, Mycobacterium
RLQRT

SEQ ID NO: 1171086 - protein, 5 aa, Mycobacterium
RLSAP

SEQ ID NO: 1171087 - protein, 8 aa, Mycobacterium
RLSASGSV

SEQ ID NO: 1171088 - protein, 8 aa, Mycobacterium
RLSDDVPE

SEQ ID NO: 1171089 - protein, 11 aa, Mycobacterium
RLSDRDEADRL

SEQ ID NO: 1171090 - protein, 10 aa, Mycobacterium
RLSEGSAADA

SEQ ID NO: 1171091 - protein, 6 aa, Mycobacterium
RLSGAR

SEQ ID NO: 1171092 - protein, 13 aa, Mycobacterium
RLSPPAGGDPSAW

SEQ ID NO: 1171093 - protein, 5 aa, Mycobacterium
RLSSH

SEQ ID NO: 1171094 - protein, 13 aa, Mycobacterium
RLSTATRDAAERI

SEQ ID NO: 1171095 - protein, 7 aa, Mycobacterium
RLTADGQ

SEQ ID NO: 1171096 - protein, 12 aa, Mycobacterium
RLTAEGVTLAPF

SEQ ID NO: 1171097 - protein, 12 aa, Mycobacterium
RLTAKQADTVDR

SEQ ID NO: 1171098 - protein, 12 aa, Mycobacterium
RLTDFDSNRSGG

SEQ ID NO: 1171099 - protein, 6 aa, Mycobacterium
RLTESH

SEQ ID NO: 1171100 - protein, 8 aa, Mycobacterium
RLTGSSDL

SEQ ID NO: 1171101 - protein, 19 aa, Mycobacterium
RLTPAAAPEWEYPPDGRSG

SEQ ID NO: 1171102 - protein, 20 aa, Mycobacterium
RLTPGTALPKPVGVFPRYQV

SEQ ID NO: 1171103 - protein, 10 aa, Mycobacterium
RLTPRSDARQ

SEQ ID NO: 1171104 - protein, 17 aa, Mycobacterium
RLTPTKEEPRQEGSAND

SEQ ID NO: 1171105 - protein, 13 aa, Mycobacterium
RLTYGDAERRSAE

SEQ ID NO: 1171106 - protein, 16 aa, Mycobacterium
RMGANPRSTVGTATDA

SEQ ID NO: 1171107 - protein, 6 aa, Mycobacterium
RMGPEY

SEQ ID NO: 1171108 - protein, 4 aa, Mycobacterium
RMGQ

SEQ ID NO: 1171109 - protein, 8 aa, Mycobacterium
RMPGPDGK

SEQ ID NO: 1171110 - protein, 9 aa, Mycobacterium
RMPKPKPLA

SEQ ID NO: 1171111 - protein, 5 aa, Mycobacterium
RMPRS

SEQ ID NO: 1171112 - protein, 5 aa, Mycobacterium
RMRAE

SEQ ID NO: 1171113 - protein, 11 aa, Mycobacterium
RMRPEDRETLS

SEQ ID NO: 1171114 - protein, 6 aa, Mycobacterium
RMSADQ

SEQ ID NO: 1171115 - protein, 5 aa, Mycobacterium
RMSAQ

SEQ ID NO: 1171116 - protein, 4 aa, Mycobacterium
RMSP

SEQ ID NO: 1171117 - protein, 22 aa, Mycobacterium
RMTGHSRAGRLPRSAVTGVRRA

SEQ ID NO: 1171118 - protein, 8 aa, Mycobacterium
RNAAAPLP

SEQ ID NO: 1171119 - protein, 8 aa, Mycobacterium
RNADSGYA

SEQ ID NO: 1171120 - protein, 8 aa, Mycobacterium
RNAGRREK

SEQ ID NO: 1171121 - protein, 8 aa, Mycobacterium
RNAKEALA

SEQ ID NO: 1171122 - protein, 5 aa, Mycobacterium
RNANG

SEQ ID NO: 1171123 - protein, 14 aa, Mycobacterium
RNAPTGRLASLVWM

SEQ ID NO: 1171124 - protein, 6 aa, Mycobacterium
RNAQQY

SEQ ID NO: 1171125 - protein, 7 aa, Mycobacterium
RNARDSY

SEQ ID NO: 1171126 - protein, 18 aa, Mycobacterium
RNATGGESSVFDTAGNPV

SEQ ID NO: 1171127 - protein, 8 aa, Mycobacterium
RNATPDKL

SEQ ID NO: 1171128 - protein, 5 aa, Mycobacterium
RNAVN

SEQ ID NO: 1171129 - protein, 6 aa, Mycobacterium
RNAVSS

SEQ ID NO: 1171130 - protein, 7 aa, Mycobacterium
RNCQSPR

SEQ ID NO: 1171131 - protein, 6 aa, Mycobacterium
RNDPRG

SEQ ID NO: 1171132 - protein, 5 aa, Mycobacterium
RNDQS

SEQ ID NO: 1171133 - protein, 6 aa, Mycobacterium
RNDSTV

SEQ ID NO: 1171134 - protein, 8 aa, Mycobacterium
RNEEQLRE

SEQ ID NO: 1171135 - protein, 11 aa, Mycobacterium
RNEGADALTGL

SEQ ID NO: 1171136 - protein, 9 aa, Mycobacterium
RNGDGGVRI

SEQ ID NO: 1171137 - protein, 8 aa, Mycobacterium
RNGEEPVT

SEQ ID NO: 1171138 - protein, 6 aa, Mycobacterium
RNGEPL

SEQ ID NO: 1171139 - protein, 5 aa, Mycobacterium
RNGGG

SEQ ID NO: 1171140 - protein, 9 aa, Mycobacterium
RNGTKEGHD

SEQ ID NO: 1171141 - protein, 5 aa, Mycobacterium
RNGVT

SEQ ID NO: 1171142 - protein, 17 aa, Mycobacterium
RNGYPTGTALPAGGDLA

SEQ ID NO: 1171143 - protein, 16 aa, Mycobacterium
RNKGRLTDADIDATAR

SEQ ID NO: 1171144 - protein, 7 aa, Mycobacterium
RNKPNDI

SEQ ID NO: 1171145 - protein, 6 aa, Mycobacterium
RNLPPV

SEQ ID NO: 1171146 - protein, 16 aa, Mycobacterium
RNLSQEVGTLSGGNQQ

SEQ ID NO: 1171147 - protein, 18 aa, Mycobacterium
RNMGQTDQPAHDARYDHA

SEQ ID NO: 1171148 - protein, 20 aa, Mycobacterium
RNNPSQPQTTTWQTQGGREV

SEQ ID NO: 1171149 - protein, 13 aa, Mycobacterium
RNPDRTVATVQVG

SEQ ID NO: 1171150 - protein, 6 aa, Mycobacterium
RNPERV

SEQ ID NO: 1171151 - protein, 12 aa, Mycobacterium
RNPGEVAAGTIP

SEQ ID NO: 1171152 - protein, 8 aa, Mycobacterium
RNPGSAET

SEQ ID NO: 1171153 - protein, 6 aa, Mycobacterium
RNPGTR

SEQ ID NO: 1171154 - protein, 17 aa, Mycobacterium
RNPHAPKRVRSTEHPVE

SEQ ID NO: 1171155 - protein, 6 aa, Mycobacterium
RNPHDE

SEQ ID NO: 1171156 - protein, 8 aa, Mycobacterium
RNPHPTEH

SEQ ID NO: 1171157 - protein, 10 aa, Mycobacterium
RNPSAQAAVG

SEQ ID NO: 1171158 - protein, 19 aa, Mycobacterium
RNPSATTAPARGVETPDQE

SEQ ID NO: 1171159 - protein, 4 aa, Mycobacterium
RNPT

SEQ ID NO: 1171160 - protein, 7 aa, Mycobacterium
RNQDNLD

SEQ ID NO: 1171161 - protein, 5 aa, Mycobacterium
RNQHG

SEQ ID NO: 1171162 - protein, 5 aa, Mycobacterium
RNQQA

SEQ ID NO: 1171163 - protein, 8 aa, Mycobacterium
RNRPDGTV

SEQ ID NO: 1171164 - protein, 9 aa, Mycobacterium
RNRRGGQFD

SEQ ID NO: 1171165 - protein, 7 aa, Mycobacterium
RNRTARQ

SEQ ID NO: 1171166 - protein, 4 aa, Mycobacterium
RNSD

SEQ ID NO: 1171167 - protein, 8 aa, Mycobacterium
RNSDEARA

SEQ ID NO: 1171168 - protein, 18 aa, Mycobacterium
RNSFGDTARSAQKSFDSG

SEQ ID NO: 1171169 - protein, 13 aa, Mycobacterium
RNSLGGRFPGDDA

SEQ ID NO: 1171170 - protein, 9 aa, Mycobacterium
RNSRPPAQY

SEQ ID NO: 1171171 - protein, 9 aa, Mycobacterium
RNTADHRQI

SEQ ID NO: 1171172 - protein, 15 aa, Mycobacterium
RNTAPTADLVKAGAG

SEQ ID NO: 1171173 - protein, 7 aa, Mycobacterium
RNTGPAF

SEQ ID NO: 1171174 - protein, 5 aa, Mycobacterium
RNTGR

SEQ ID NO: 1171175 - protein, 21 aa, Mycobacterium
RNTPVGGPLPKDDPADVARQG

SEQ ID NO: 1171176 - protein, 7 aa, Mycobacterium
RNYPSGE

SEQ ID NO: 1171177 - protein, 11 aa, Mycobacterium
RPAAGDAELGR

SEQ ID NO: 1171178 - protein, 9 aa, Mycobacterium
RPADNNPMP

SEQ ID NO: 1171179 - protein, 8 aa, Mycobacterium
RPAEGTWP

SEQ ID NO: 1171180 - protein, 6 aa, Mycobacterium
RPAGLE

SEQ ID NO: 1171181 - protein, 6 aa, Mycobacterium
RPAGRG

SEQ ID NO: 1171182 - protein, 14 aa, Mycobacterium
RPAGTLSGGEAQRT

SEQ ID NO: 1171183 - protein, 6 aa, Mycobacterium
RPAGVG

SEQ ID NO: 1171184 - protein, 8 aa, Mycobacterium
RPALTRPS

SEQ ID NO: 1171185 - protein, 20 aa, Mycobacterium
RPANRSPSDAERAATANTVG

SEQ ID NO: 1171186 - protein, 8 aa, Mycobacterium
RPANTRRH

SEQ ID NO: 1171187 - protein, 6 aa, Mycobacterium
RPAPDE

SEQ ID NO: 1171188 - protein, 8 aa, Mycobacterium
RPAPGTVR

SEQ ID NO: 1171189 - protein, 15 aa, Mycobacterium
RPAPPPARTGADRTS

SEQ ID NO: 1171190 - protein, 13 aa, Mycobacterium
RPAPSSVLNGPVG

SEQ ID NO: 1171191 - protein, 19 aa, Mycobacterium
RPAPTHTDHVPARNGEGMS

SEQ ID NO: 1171192 - protein, 4 aa, Mycobacterium
RPAQ

SEQ ID NO: 1171193 - protein, 8 aa, Mycobacterium
RPARETTG

SEQ ID NO: 1171194 - protein, 37 aa, Mycobacterium
RPARGRPPAPEAELSDDEDDYETPDSVPPSLADPLRA

SEQ ID NO: 1171195 - protein, 7 aa, Mycobacterium
RPARIRA

SEQ ID NO: 1171196 - protein, 17 aa, Mycobacterium
RPDAAAGRRGRPTPSPV

SEQ ID NO: 1171197 - protein, 12 aa, Mycobacterium
RPDATPRAEQTR

SEQ ID NO: 1171198 - protein, 5 aa, Mycobacterium
RPDDG

SEQ ID NO: 1171199 - protein, 8 aa, Mycobacterium
RPDERAHR

SEQ ID NO: 1171200 - protein, 10 aa, Mycobacterium
RPDETDGRRR

SEQ ID NO: 1171201 - protein, 5 aa, Mycobacterium
RPDEV

SEQ ID NO: 1171202 - protein, 16 aa, Mycobacterium
RPDGDPITTTTGSACG

SEQ ID NO: 1171203 - protein, 7 aa, Mycobacterium
RPDGTPY

SEQ ID NO: 1171204 - protein, 13 aa, Mycobacterium
RPDGTSVVLDDTP

SEQ ID NO: 1171205 - protein, 9 aa, Mycobacterium
RPDIQQQLR

SEQ ID NO: 1171206 - protein, 12 aa, Mycobacterium
RPDLANTRGALQ

SEQ ID NO: 1171207 - protein, 6 aa, Mycobacterium
RPDLDG

SEQ ID NO: 1171208 - protein, 12 aa, Mycobacterium
RPDLTGYDTVSA

SEQ ID NO: 1171209 - protein, 12 aa, Mycobacterium
RPDNHSAPTAGG

SEQ ID NO: 1171210 - protein, 15 aa, Mycobacterium
RPDPDHPLSQGRACP

SEQ ID NO: 1171211 - protein, 8 aa, Mycobacterium
RPDPTDAR

SEQ ID NO: 1171212 - protein, 25 aa, Mycobacterium
RPDPYKGKGVRYEGEQIRRKVGKTG

SEQ ID NO: 1171213 - protein, 6 aa, Mycobacterium
RPDRAP

SEQ ID NO: 1171214 - protein, 9 aa, Mycobacterium
RPDRDPASC

SEQ ID NO: 1171215 - protein, 18 aa, Mycobacterium
RPDRTAGVDYPPGTTERR

SEQ ID NO: 1171216 - protein, 5 aa, Mycobacterium
RPDVT

SEQ ID NO: 1171217 - protein, 6 aa, Mycobacterium
RPDYDG

SEQ ID NO: 1171218 - protein, 15 aa, Mycobacterium
RPEAPTAPIARTRWS

SEQ ID NO: 1171219 - protein, 11 aa, Mycobacterium
RPEAQNSTTMG

SEQ ID NO: 1171220 - protein, 8 aa, Mycobacterium
RPEARNAI

SEQ ID NO: 1171221 - protein, 13 aa, Mycobacterium
RPEATDEPREAYR

SEQ ID NO: 1171222 - protein, 18 aa, Mycobacterium
RPEDDHGAPSYRTGRPRT

SEQ ID NO: 1171223 - protein, 15 aa, Mycobacterium
RPEDSADWHPARPPA

SEQ ID NO: 1171224 - protein, 13 aa, Mycobacterium
RPEDTAGSIPCGP

SEQ ID NO: 1171225 - protein, 4 aa, Mycobacterium
RPEE

SEQ ID NO: 1171226 - protein, 15 aa, Mycobacterium
RPEGAHPLPQPAPNL

SEQ ID NO: 1171227 - protein, 7 aa, Mycobacterium
RPEGGWT

SEQ ID NO: 1171228 - protein, 14 aa, Mycobacterium
RPEGNENPEIPTGG

SEQ ID NO: 1171229 - protein, 5 aa, Mycobacterium
RPEKL

SEQ ID NO: 1171230 - protein, 6 aa, Mycobacterium
RPEPDG

SEQ ID NO: 1171231 - protein, 5 aa, Mycobacterium
RPEQH

SEQ ID NO: 1171232 - protein, 6 aa, Mycobacterium
RPERHT

SEQ ID NO: 1171233 - protein, 8 aa, Mycobacterium
RPERRNAL

SEQ ID NO: 1171234 - protein, 13 aa, Mycobacterium
RPESNAARLRSSA

SEQ ID NO: 1171235 - protein, 5 aa, Mycobacterium
RPESP

SEQ ID NO: 1171236 - protein, 9 aa, Mycobacterium
RPESRNALS

SEQ ID NO: 1171237 - protein, 6 aa, Mycobacterium
RPETAE

SEQ ID NO: 1171238 - protein, 10 aa, Mycobacterium
RPETRSWGSG

SEQ ID NO: 1171239 - protein, 12 aa, Mycobacterium
RPETVASQQSVT

SEQ ID NO: 1171240 - protein, 7 aa, Mycobacterium
RPEVRGD

SEQ ID NO: 1171241 - protein, 5 aa, Mycobacterium
RPFGT

SEQ ID NO: 1171242 - protein, 12 aa, Mycobacterium
RPFPPDAPLAAP

SEQ ID NO: 1171243 - protein, 8 aa, Mycobacterium
RPFTPPPS

SEQ ID NO: 1171244 - protein, 19 aa, Mycobacterium
RPGAGPMSLTGQPNAMGGR

SEQ ID NO: 1171245 - protein, 15 aa, Mycobacterium
RPGDDPPFQRGGMGD

SEQ ID NO: 1171246 - protein, 9 aa, Mycobacterium
RPGDLGPGD

SEQ ID NO: 1171247 - protein, 6 aa, Mycobacterium
RPGDSV

SEQ ID NO: 1171248 - protein, 6 aa, Mycobacterium
RPGEPL

SEQ ID NO: 1171249 - protein, 10 aa, Mycobacterium
RPGEPVSAGE

SEQ ID NO: 1171250 - protein, 11 aa, Mycobacterium
RPGGENTKDAL

SEQ ID NO: 1171251 - protein, 13 aa, Mycobacterium
RPGGGAKLARSAG

SEQ ID NO: 1171252 - protein, 11 aa, Mycobacterium
RPGGWVPSGST

SEQ ID NO: 1171253 - protein, 5 aa, Mycobacterium
RPGHE

SEQ ID NO: 1171254 - protein, 12 aa, Mycobacterium
RPGIGSSTPHQY

SEQ ID NO: 1171255 - protein, 10 aa, Mycobacterium
RPGIRADEQS

SEQ ID NO: 1171256 - protein, 17 aa, Mycobacterium
RPGLEPPPPPSATRPYE

SEQ ID NO: 1171257 - protein, 5 aa, Mycobacterium
RPGMG

SEQ ID NO: 1171258 - protein, 22 aa, Mycobacterium
RPGRIPARERDSERRPPPRELR

SEQ ID NO: 1171259 - protein, 8 aa, Mycobacterium
RPGRPDPA

SEQ ID NO: 1171260 - protein, 5 aa, Mycobacterium
RPGRT

SEQ ID NO: 1171261 - protein, 5 aa, Mycobacterium
RPGSS

SEQ ID NO: 1171262 - protein, 8 aa, Mycobacterium
RPGSTDEV

SEQ ID NO: 1171263 - protein, 5 aa, Mycobacterium
RPGTP

SEQ ID NO: 1171264 - protein, 13 aa, Mycobacterium
RPGTPASHRGKGW

SEQ ID NO: 1171265 - protein, 10 aa, Mycobacterium
RPGTTKTTVT

SEQ ID NO: 1171266 - protein, 4 aa, Mycobacterium
RPGV

SEQ ID NO: 1171267 - protein, 11 aa, Mycobacterium
RPGVTAEQIDA

SEQ ID NO: 1171268 - protein, 5 aa, Mycobacterium
RPGWP

SEQ ID NO: 1171269 - protein, 13 aa, Mycobacterium
RPGYGSSAPYPDA

SEQ ID NO: 1171270 - protein, 7 aa, Mycobacterium
RPHEAEL

SEQ ID NO: 1171271 - protein, 4 aa, Mycobacterium
RPHG

SEQ ID NO: 1171272 - protein, 8 aa, Mycobacterium
RPHGDGQR

SEQ ID NO: 1171273 - protein, 12 aa, Mycobacterium
RPIGRTPRSTLA

SEQ ID NO: 1171274 - protein, 11 aa, Mycobacterium
RPISKDDAVDG

SEQ ID NO: 1171275 - protein, 12 aa, Mycobacterium
RPKDYSEARTIG

SEQ ID NO: 1171276 - protein, 9 aa, Mycobacterium
RPKEAPSHG

SEQ ID NO: 1171277 - protein, 8 aa, Mycobacterium
RPKETERV

SEQ ID NO: 1171278 - protein, 10 aa, Mycobacterium
RPKLKARYGD

SEQ ID NO: 1171279 - protein, 5 aa, Mycobacterium
RPKPE

SEQ ID NO: 1171280 - protein, 5 aa, Mycobacterium
RPKPL

SEQ ID NO: 1171281 - protein, 11 aa, Mycobacterium
RPKTSADQQAI

SEQ ID NO: 1171282 - protein, 7 aa, Mycobacterium
RPLDAGP

SEQ ID NO: 1171283 - protein, 9 aa, Mycobacterium
RPLGYDDST

SEQ ID NO: 1171284 - protein, 5 aa, Mycobacterium
RPLPE

SEQ ID NO: 1171285 - protein, 8 aa, Mycobacterium
RPLPHPRT

SEQ ID NO: 1171286 - protein, 5 aa, Mycobacterium
RPLPN

SEQ ID NO: 1171287 - protein, 6 aa, Mycobacterium
RPLPQH

SEQ ID NO: 1171288 - protein, 4 aa, Mycobacterium
RPLT

SEQ ID NO: 1171289 - protein, 8 aa, Mycobacterium
RPMPDAGL

SEQ ID NO: 1171290 - protein, 6 aa, Mycobacterium
RPNGDV

SEQ ID NO: 1171291 - protein, 6 aa, Mycobacterium
RPNGEI

SEQ ID NO: 1171292 - protein, 9 aa, Mycobacterium
RPNGEPPPW

SEQ ID NO: 1171293 - protein, 6 aa, Mycobacterium
RPNGSA

SEQ ID NO: 1171294 - protein, 9 aa, Mycobacterium
RPNSGLGGA

SEQ ID NO: 1171295 - protein, 4 aa, Mycobacterium
RPNT

SEQ ID NO: 1171296 - protein, 11 aa, Mycobacterium
RPNTSSAYTKV

SEQ ID NO: 1171297 - protein, 12 aa, Mycobacterium
RPNYSYSSSKAA

SEQ ID NO: 1171298 - protein, 5 aa, Mycobacterium
RPPAA

SEQ ID NO: 1171299 - protein, 6 aa, Mycobacterium
RPPAYG

SEQ ID NO: 1171300 - protein, 27 aa, Mycobacterium
RPPDDPEPQGHHNTAASADSDDGDEIG

SEQ ID NO: 1171301 - protein, 11 aa, Mycobacterium
RPPDDPSVPGD

SEQ ID NO: 1171302 - protein, 21 aa, Mycobacterium
RPPEPAPAWDGERQATRSGPR

SEQ ID NO: 1171303 - protein, 6 aa, Mycobacterium
RPPERF

SEQ ID NO: 1171304 - protein, 14 aa, Mycobacterium
RPPETPAAEDPNAV

SEQ ID NO: 1171305 - protein, 7 aa, Mycobacterium
RPPGADR

SEQ ID NO: 1171306 - protein, 7 aa, Mycobacterium
RPPGALN

SEQ ID NO: 1171307 - protein, 8 aa, Mycobacterium
RPPGDRAD

SEQ ID NO: 1171308 - protein, 9 aa, Mycobacterium
RPPKPNSEE

SEQ ID NO: 1171309 - protein, 4 aa, Mycobacterium
RPPM

SEQ ID NO: 1171310 - protein, 7 aa, Mycobacterium
RPPPSPH

SEQ ID NO: 1171311 - protein, 6 aa, Mycobacterium
RPPQIE

SEQ ID NO: 1171312 - protein, 6 aa, Mycobacterium
RPPRGT

SEQ ID NO: 1171313 - protein, 19 aa, Mycobacterium
RPPRTRSGAPLPTGPDVSA

SEQ ID NO: 1171314 - protein, 8 aa, Mycobacterium
RPPSGAGP

SEQ ID NO: 1171315 - protein, 15 aa, Mycobacterium
RPPSWTDELTYEPVA

SEQ ID NO: 1171316 - protein, 9 aa, Mycobacterium
RPPTATPTG

SEQ ID NO: 1171317 - protein, 6 aa, Mycobacterium
RPPTDA

SEQ ID NO: 1171318 - protein, 8 aa, Mycobacterium
RPPTGGAR

SEQ ID NO: 1171319 - protein, 16 aa, Mycobacterium
RPPVAATDEPLDTGGH

SEQ ID NO: 1171320 - protein, 5 aa, Mycobacterium
RPPYA

SEQ ID NO: 1171321 - protein, 5 aa, Mycobacterium
RPPYT

SEQ ID NO: 1171322 - protein, 10 aa, Mycobacterium
RPQAAGLPTR

SEQ ID NO: 1171323 - protein, 8 aa, Mycobacterium
RPQARNAL

SEQ ID NO: 1171324 - protein, 14 aa, Mycobacterium
RPQAWSATTAAGQY

SEQ ID NO: 1171325 - protein, 4 aa, Mycobacterium
RPQD

SEQ ID NO: 1171326 - protein, 7 aa, Mycobacterium
RPQDGAA

SEQ ID NO: 1171327 - protein, 7 aa, Mycobacterium
RPQEGIT

SEQ ID NO: 1171328 - protein, 7 aa, Mycobacterium
RPQERKA

SEQ ID NO: 1171329 - protein, 4 aa, Mycobacterium
RPQF

SEQ ID NO: 1171330 - protein, 5 aa, Mycobacterium
RPQGE

SEQ ID NO: 1171331 - protein, 9 aa, Mycobacterium
RPQHQGSHT

SEQ ID NO: 1171332 - protein, 8 aa, Mycobacterium
RPQPDGHA

SEQ ID NO: 1171333 - protein, 7 aa, Mycobacterium
RPQRRNS

SEQ ID NO: 1171334 - protein, 14 aa, Mycobacterium
RPQTELDESSRAAA

SEQ ID NO: 1171335 - protein, 8 aa, Mycobacterium
RPRDELAR

SEQ ID NO: 1171336 - protein, 8 aa, Mycobacterium
RPREEAEA

SEQ ID NO: 1171337 - protein, 5 aa, Mycobacterium
RPRGA

SEQ ID NO: 1171338 - protein, 12 aa, Mycobacterium
RPRPFTESAPLS

SEQ ID NO: 1171339 - protein, 10 aa, Mycobacterium
RPRPGAEPGT

SEQ ID NO: 1171340 - protein, 16 aa, Mycobacterium
RPRRRAAARPAGPPSS

SEQ ID NO: 1171341 - protein, 4 aa, Mycobacterium
RPRS

SEQ ID NO: 1171342 - protein, 8 aa, Mycobacterium
RPRSGKVD

SEQ ID NO: 1171343 - protein, 20 aa, Mycobacterium
RPRTEPDAPEVISAIEAVLP

SEQ ID NO: 1171344 - protein, 10 aa, Mycobacterium
RPRYSPAARR

SEQ ID NO: 1171345 - protein, 8 aa, Mycobacterium
RPSAGTAT

SEQ ID NO: 1171346 - protein, 13 aa, Mycobacterium
RPSALPDADRDAL

SEQ ID NO: 1171347 - protein, 6 aa, Mycobacterium
RPSDLA

SEQ ID NO: 1171348 - protein, 7 aa, Mycobacterium
RPSDLAE

SEQ ID NO: 1171349 - protein, 5 aa, Mycobacterium
RPSDV

SEQ ID NO: 1171350 - protein, 7 aa, Mycobacterium
RPSERWG

SEQ ID NO: 1171351 - protein, 4 aa, Mycobacterium
RPSF

SEQ ID NO: 1171352 - protein, 8 aa, Mycobacterium
RPSGPESI

SEQ ID NO: 1171353 - protein, 5 aa, Mycobacterium
RPSGV

SEQ ID NO: 1171354 - protein, 5 aa, Mycobacterium
RPSHA

SEQ ID NO: 1171355 - protein, 24 aa, Mycobacterium
RPSKGLPPIGSGLAPGRGVRGRAR

SEQ ID NO: 1171356 - protein, 17 aa, Mycobacterium
RPSNRFAAEESHAVGVA

SEQ ID NO: 1171357 - protein, 8 aa, Mycobacterium
RPSQRRKQ

SEQ ID NO: 1171358 - protein, 5 aa, Mycobacterium
RPSRG

SEQ ID NO: 1171359 - protein, 7 aa, Mycobacterium
RPSSRGH

SEQ ID NO: 1171360 - protein, 9 aa, Mycobacterium
RPSVGSVGD

SEQ ID NO: 1171361 - protein, 5 aa, Mycobacterium
RPSWL

SEQ ID NO: 1171362 - protein, 6 aa, Mycobacterium
RPSWTG

SEQ ID NO: 1171363 - protein, 14 aa, Mycobacterium
RPTAEQRRRYTGRL

SEQ ID NO: 1171364 - protein, 15 aa, Mycobacterium
RPTDDGGADPPPLTA

SEQ ID NO: 1171365 - protein, 5 aa, Mycobacterium
RPTDR

SEQ ID NO: 1171366 - protein, 5 aa, Mycobacterium
RPTFS

SEQ ID NO: 1171367 - protein, 16 aa, Mycobacterium
RPTGDSAEDGDSPPAA

SEQ ID NO: 1171368 - protein, 16 aa, Mycobacterium
RPTGEPDAEYDTYKHH

SEQ ID NO: 1171369 - protein, 14 aa, Mycobacterium
RPTGRGAEREIGGR

SEQ ID NO: 1171370 - protein, 7 aa, Mycobacterium
RPTLGYS

SEQ ID NO: 1171371 - protein, 18 aa, Mycobacterium
RPTLQGDSTLGDLAERPR

SEQ ID NO: 1171372 - protein, 4 aa, Mycobacterium
RPTP

SEQ ID NO: 1171373 - protein, 12 aa, Mycobacterium
RPTPGRVKIAIT

SEQ ID NO: 1171374 - protein, 5 aa, Mycobacterium
RPTQE

SEQ ID NO: 1171375 - protein, 8 aa, Mycobacterium
RPTQRRGA

SEQ ID NO: 1171376 - protein, 6 aa, Mycobacterium
RPTRAD

SEQ ID NO: 1171377 - protein, 10 aa, Mycobacterium
RPTSDTTMTS

SEQ ID NO: 1171378 - protein, 9 aa, Mycobacterium
RPTSGSVRV

SEQ ID NO: 1171379 - protein, 7 aa, Mycobacterium
RPTSSEH

SEQ ID NO: 1171380 - protein, 6 aa, Mycobacterium
RPTSSG

SEQ ID NO: 1171381 - protein, 10 aa, Mycobacterium
RPTVAPSSTS

SEQ ID NO: 1171382 - protein, 24 aa, Mycobacterium
RPTYDDAAREQVSSAREAKPHDTA

SEQ ID NO: 1171383 - protein, 8 aa, Mycobacterium
RPVDGSPY

SEQ ID NO: 1171384 - protein, 7 aa, Mycobacterium
RPVGEAR

SEQ ID NO: 1171385 - protein, 5 aa, Mycobacterium
RPVPG

SEQ ID NO: 1171386 - protein, 9 aa, Mycobacterium
RPVPSPGPH

SEQ ID NO: 1171387 - protein, 4 aa, Mycobacterium
RPVQ

SEQ ID NO: 1171388 - protein, 10 aa, Mycobacterium
RPVSRGYTTT

SEQ ID NO: 1171389 - protein, 12 aa, Mycobacterium
RPVSTVSSAAQI

SEQ ID NO: 1171390 - protein, 4 aa, Mycobacterium
RPVT

SEQ ID NO: 1171391 - protein, 5 aa, Mycobacterium
RPVTE

SEQ ID NO: 1171392 - protein, 15 aa, Mycobacterium
RPYEDAGRIAADPAY

SEQ ID NO: 1171393 - protein, 4 aa, Mycobacterium
RPYP

SEQ ID NO: 1171394 - protein, 8 aa, Mycobacterium
RPYPGGLT

SEQ ID NO: 1171395 - protein, 15 aa, Mycobacterium
RPYPRDRYEPADATT

SEQ ID NO: 1171396 - protein, 12 aa, Mycobacterium
RPYQEPGQRRRD

SEQ ID NO: 1171397 - protein, 8 aa, Mycobacterium
RQAADAGV

SEQ ID NO: 1171398 - protein, 17 aa, Mycobacterium
RQAAPGHAFSPDTPWQN

SEQ ID NO: 1171399 - protein, 9 aa, Mycobacterium
RQADDGNSA

SEQ ID NO: 1171400 - protein, 9 aa, Mycobacterium
RQADQRSDE

SEQ ID NO: 1171401 - protein, 10 aa, Mycobacterium
RQADTNSTPI

SEQ ID NO: 1171402 - protein, 10 aa, Mycobacterium
RQAGGRGPAR

SEQ ID NO: 1171403 - protein, 6 aa, Mycobacterium
RQAGNA

SEQ ID NO: 1171404 - protein, 15 aa, Mycobacterium
RQAHNEQWDPLGASD

SEQ ID NO: 1171405 - protein, 9 aa, Mycobacterium
RQALTGASL

SEQ ID NO: 1171406 - protein, 6 aa, Mycobacterium
RQAMTG

SEQ ID NO: 1171407 - protein, 5 aa, Mycobacterium
RQAPE

SEQ ID NO: 1171408 - protein, 17 aa, Mycobacterium
RQARTSAELTADQAEHR

SEQ ID NO: 1171409 - protein, 8 aa, Mycobacterium
RQASDGTF

SEQ ID NO: 1171410 - protein, 14 aa, Mycobacterium
RQATANAAESGADI

SEQ ID NO: 1171411 - protein, 5 aa, Mycobacterium
RQATG

SEQ ID NO: 1171412 - protein, 13 aa, Mycobacterium
RQATPEITHLTGV

SEQ ID NO: 1171413 - protein, 12 aa, Mycobacterium
RQDGADELPDEW

SEQ ID NO: 1171414 - protein, 10 aa, Mycobacterium
RQDPGAPEGR

SEQ ID NO: 1171415 - protein, 13 aa, Mycobacterium
RQDRAADPSAGTA

SEQ ID NO: 1171416 - protein, 12 aa, Mycobacterium
RQDRAKPSERPV

SEQ ID NO: 1171417 - protein, 7 aa, Mycobacterium
RQEDTRG

SEQ ID NO: 1171418 - protein, 21 aa, Mycobacterium
RQEEQLTRRTASGEPPPVTPY

SEQ ID NO: 1171419 - protein, 17 aa, Mycobacterium
RQETWEDSPAGYPQDPP

SEQ ID NO: 1171420 - protein, 10 aa, Mycobacterium
RQEVSGGDEV

SEQ ID NO: 1171421 - protein, 7 aa, Mycobacterium
RQFPPDG

SEQ ID NO: 1171422 - protein, 4 aa, Mycobacterium
RQGA

SEQ ID NO: 1171423 - protein, 5 aa, Mycobacterium
RQGIP

SEQ ID NO: 1171424 - protein, 5 aa, Mycobacterium
RQGKL

SEQ ID NO: 1171425 - protein, 4 aa, Mycobacterium
RQGL

SEQ ID NO: 1171426 - protein, 9 aa, Mycobacterium
RQGRSAPEL

SEQ ID NO: 1171427 - protein, 5 aa, Mycobacterium
RQGSA

SEQ ID NO: 1171428 - protein, 8 aa, Mycobacterium
RQGSPSGL

SEQ ID NO: 1171429 - protein, 4 aa, Mycobacterium
RQGT

SEQ ID NO: 1171430 - protein, 15 aa, Mycobacterium
RQGTLQTTARSGDKI

SEQ ID NO: 1171431 - protein, 9 aa, Mycobacterium
RQGVGDSAN

SEQ ID NO: 1171432 - protein, 6 aa, Mycobacterium
RQHRDA

SEQ ID NO: 1171433 - protein, 11 aa, Mycobacterium
RQLPDVGPQEQ

SEQ ID NO: 1171434 - protein, 10 aa, Mycobacterium
RQLSGGQAQR

SEQ ID NO: 1171435 - protein, 6 aa, Mycobacterium
RQLSTA

SEQ ID NO: 1171436 - protein, 7 aa, Mycobacterium
RQNSDVH

SEQ ID NO: 1171437 - protein, 19 aa, Mycobacterium
RQPASPRAAAATVAEGGKP

SEQ ID NO: 1171438 - protein, 7 aa, Mycobacterium
RQPDQYL

SEQ ID NO: 1171439 - protein, 8 aa, Mycobacterium
RQPNTDDL

SEQ ID NO: 1171440 - protein, 6 aa, Mycobacterium
RQPPDI

SEQ ID NO: 1171441 - protein, 7 aa, Mycobacterium
RQQPTPA

SEQ ID NO: 1171442 - protein, 6 aa, Mycobacterium
RQQQRV

SEQ ID NO: 1171443 - protein, 4 aa, Mycobacterium
RQQR

SEQ ID NO: 1171444 - protein, 9 aa, Mycobacterium
RQQRPAPSV

SEQ ID NO: 1171445 - protein, 9 aa, Mycobacterium
RQRAEARAG

SEQ ID NO: 1171446 - protein, 6 aa, Mycobacterium
RQRAQT

SEQ ID NO: 1171447 - protein, 16 aa, Mycobacterium
RQRDEPFGDHGRRASG

SEQ ID NO: 1171448 - protein, 6 aa, Mycobacterium
RQRDRI

SEQ ID NO: 1171449 - protein, 8 aa, Mycobacterium
RQREDRDR

SEQ ID NO: 1171450 - protein, 8 aa, Mycobacterium
RQRHGDRF

SEQ ID NO: 1171451 - protein, 6 aa, Mycobacterium
RQRPRT

SEQ ID NO: 1171452 - protein, 4 aa, Mycobacterium
RQRR

SEQ ID NO: 1171453 - protein, 18 aa, Mycobacterium
RQRSTDDTGVSVPGAPGV

SEQ ID NO: 1171454 - protein, 10 aa, Mycobacterium
RQRTAERDEL

SEQ ID NO: 1171455 - protein, 50 aa, Mycobacterium
RQSGPAGAGEAPEAPETGGEVADGADAEAGHTGPGTGPGDPDAAEALPLS

SEQ ID NO: 1171456 - protein, 5 aa, Mycobacterium
RQSPG

SEQ ID NO: 1171457 - protein, 7 aa, Mycobacterium
RQTAGAV

SEQ ID NO: 1171458 - protein, 8 aa, Mycobacterium
RQTAGGRR

SEQ ID NO: 1171459 - protein, 10 aa, Mycobacterium
RQTARDMPEV

SEQ ID NO: 1171460 - protein, 6 aa, Mycobacterium
RQTARS

SEQ ID NO: 1171461 - protein, 17 aa, Mycobacterium
RQTERDRRLLDKSRYFD

SEQ ID NO: 1171462 - protein, 14 aa, Mycobacterium
RQTESALRSVLSDF

SEQ ID NO: 1171463 - protein, 53 aa, Mycobacterium
RQTFGQGTPQPGADFDKSPQLTDLGSGVTAAAPGSKWSGAAATNYDKANTDHQ

SEQ ID NO: 1171464 - protein, 6 aa, Mycobacterium
RQTGQK

SEQ ID NO: 1171465 - protein, 16 aa, Mycobacterium
RQTSDGMAANADRPSR

SEQ ID NO: 1171466 - protein, 4 aa, Mycobacterium
RQVG

SEQ ID NO: 1171467 - protein, 7 aa, Mycobacterium
RQVGDGD

SEQ ID NO: 1171468 - protein, 10 aa, Mycobacterium
RQVRDGELTP

SEQ ID NO: 1171469 - protein, 11 aa, Mycobacterium
RQVSADGGENG

SEQ ID NO: 1171470 - protein, 13 aa, Mycobacterium
RRAAAKKWDNETQ

SEQ ID NO: 1171471 - protein, 15 aa, Mycobacterium
RRAAEGYAEAAQSTY

SEQ ID NO: 1171472 - protein, 9 aa, Mycobacterium
RRADPAVER

SEQ ID NO: 1171473 - protein, 5 aa, Mycobacterium
RRADY

SEQ ID NO: 1171474 - protein, 9 aa, Mycobacterium
RRAEDSQEV

SEQ ID NO: 1171475 - protein, 8 aa, Mycobacterium
RRAEPKDD

SEQ ID NO: 1171476 - protein, 14 aa, Mycobacterium
RRAEPRTKVPAGSV

SEQ ID NO: 1171477 - protein, 7 aa, Mycobacterium
RRAEPTD

SEQ ID NO: 1171478 - protein, 7 aa, Mycobacterium
RRAERSA

SEQ ID NO: 1171479 - protein, 9 aa, Mycobacterium
RRAGAQGVG

SEQ ID NO: 1171480 - protein, 11 aa, Mycobacterium
RRAGKRRDADA

SEQ ID NO: 1171481 - protein, 8 aa, Mycobacterium
RRAGMSPP

SEQ ID NO: 1171482 - protein, 7 aa, Mycobacterium
RRAGSPV

SEQ ID NO: 1171483 - protein, 13 aa, Mycobacterium
RRALGDDGESQRY

SEQ ID NO: 1171484 - protein, 5 aa, Mycobacterium
RRAPG

SEQ ID NO: 1171485 - protein, 12 aa, Mycobacterium
RRAPGDAAQQRI

SEQ ID NO: 1171486 - protein, 8 aa, Mycobacterium
RRAPGPEL

SEQ ID NO: 1171487 - protein, 6 aa, Mycobacterium
RRAQDT

SEQ ID NO: 1171488 - protein, 6 aa, Mycobacterium
RRARAG

SEQ ID NO: 1171489 - protein, 8 aa, Mycobacterium
RRARDTAA

SEQ ID NO: 1171490 - protein, 35 aa, Mycobacterium
RRARGPVKKKAAAKKAPAKKTAAKKTAAKKASAKK

SEQ ID NO: 1171491 - protein, 6 aa, Mycobacterium
RRARHQ

SEQ ID NO: 1171492 - protein, 8 aa, Mycobacterium
RRARQNGC

SEQ ID NO: 1171493 - protein, 6 aa, Mycobacterium
RRASGD

SEQ ID NO: 1171494 - protein, 4 aa, Mycobacterium
RRAT

SEQ ID NO: 1171495 - protein, 7 aa, Mycobacterium
RRATGLP

SEQ ID NO: 1171496 - protein, 13 aa, Mycobacterium
RRATKESDGDEPV

SEQ ID NO: 1171497 - protein, 17 aa, Mycobacterium
RRATPSNGRGRPGRSSR

SEQ ID NO: 1171498 - protein, 22 aa, Mycobacterium
RRATSAPAPTEEPDGDRGETEL

SEQ ID NO: 1171499 - protein, 13 aa, Mycobacterium
RRAVKDASRPVER

SEQ ID NO: 1171500 - protein, 22 aa, Mycobacterium
RRCGPSPHRPDLALTGRECQLH

SEQ ID NO: 1171501 - protein, 7 aa, Mycobacterium
RRDAGQQ

SEQ ID NO: 1171502 - protein, 5 aa, Mycobacterium
RRDAP

SEQ ID NO: 1171503 - protein, 6 aa, Mycobacterium
RRDATG

SEQ ID NO: 1171504 - protein, 14 aa, Mycobacterium
RRDDASHRGDPQAV

SEQ ID NO: 1171505 - protein, 6 aa, Mycobacterium
RRDDLT

SEQ ID NO: 1171506 - protein, 17 aa, Mycobacterium
RRDDPDLPERVSTPQGY

SEQ ID NO: 1171507 - protein, 8 aa, Mycobacterium
RRDDTPVD

SEQ ID NO: 1171508 - protein, 6 aa, Mycobacterium
RRDGAH

SEQ ID NO: 1171509 - protein, 11 aa, Mycobacterium
RRDGGCPPDVG

SEQ ID NO: 1171510 - protein, 9 aa, Mycobacterium
RRDGQPVSA

SEQ ID NO: 1171511 - protein, 14 aa, Mycobacterium
RRDHGDPPAIGATT

SEQ ID NO: 1171512 - protein, 17 aa, Mycobacterium
RRDHPDRPLRPIPPGRD

SEQ ID NO: 1171513 - protein, 18 aa, Mycobacterium
RRDKPDASTYIGSGKAAE

SEQ ID NO: 1171514 - protein, 5 aa, Mycobacterium
RRDND

SEQ ID NO: 1171515 - protein, 16 aa, Mycobacterium
RRDNKADGVLNGPTTE

SEQ ID NO: 1171516 - protein, 13 aa, Mycobacterium
RRDPLGKDAGPKL

SEQ ID NO: 1171517 - protein, 9 aa, Mycobacterium
RRDPNRPRA

SEQ ID NO: 1171518 - protein, 6 aa, Mycobacterium
RRDPRA

SEQ ID NO: 1171519 - protein, 8 aa, Mycobacterium
RRDPTDAG

SEQ ID NO: 1171520 - protein, 12 aa, Mycobacterium
RRDRSEPYTTRT

SEQ ID NO: 1171521 - protein, 10 aa, Mycobacterium
RRDSDPADRR

SEQ ID NO: 1171522 - protein, 19 aa, Mycobacterium
RRDSRSPATKLESSGGLSL

SEQ ID NO: 1171523 - protein, 6 aa, Mycobacterium
RRDTGA

SEQ ID NO: 1171524 - protein, 7 aa, Mycobacterium
RRDTHGA

SEQ ID NO: 1171525 - protein, 4 aa, Mycobacterium
RREA

SEQ ID NO: 1171526 - protein, 9 aa, Mycobacterium
RREAAAAFG

SEQ ID NO: 1171527 - protein, 16 aa, Mycobacterium
RREADALAASSSREGS

SEQ ID NO: 1171528 - protein, 6 aa, Mycobacterium
RREAGR

SEQ ID NO: 1171529 - protein, 5 aa, Mycobacterium
RREDL

SEQ ID NO: 1171530 - protein, 17 aa, Mycobacterium
RREEALEAGKDAIGREV

SEQ ID NO: 1171531 - protein, 11 aa, Mycobacterium
RREEASSLPGR

SEQ ID NO: 1171532 - protein, 16 aa, Mycobacterium
RREGQPGVTYRRSGDD

SEQ ID NO: 1171533 - protein, 6 aa, Mycobacterium
RREGTD

SEQ ID NO: 1171534 - protein, 6 aa, Mycobacterium
RREGTT

SEQ ID NO: 1171535 - protein, 7 aa, Mycobacterium
RREPRED

SEQ ID NO: 1171536 - protein, 13 aa, Mycobacterium
RREPTGRRRSSVQ

SEQ ID NO: 1171537 - protein, 15 aa, Mycobacterium
RREREAAQYGTSRAG

SEQ ID NO: 1171538 - protein, 11 aa, Mycobacterium
RREREQESPGQ

SEQ ID NO: 1171539 - protein, 11 aa, Mycobacterium
RRERGSINPED

SEQ ID NO: 1171540 - protein, 11 aa, Mycobacterium
RRGAAPGQELE

SEQ ID NO: 1171541 - protein, 6 aa, Mycobacterium
RRGAEL

SEQ ID NO: 1171542 - protein, 10 aa, Mycobacterium
RRGDARRQLN

SEQ ID NO: 1171543 - protein, 9 aa, Mycobacterium
RRGDLTADD

SEQ ID NO: 1171544 - protein, 7 aa, Mycobacterium
RRGDQSQ

SEQ ID NO: 1171545 - protein, 7 aa, Mycobacterium
RRGEDEW

SEQ ID NO: 1171546 - protein, 6 aa, Mycobacterium
RRGEGI

SEQ ID NO: 1171547 - protein, 14 aa, Mycobacterium
RRGELDDDTDVEGV

SEQ ID NO: 1171548 - protein, 6 aa, Mycobacterium
RRGELG

SEQ ID NO: 1171549 - protein, 6 aa, Mycobacterium
RRGENG

SEQ ID NO: 1171550 - protein, 12 aa, Mycobacterium
RRGGGEKGLLGD

SEQ ID NO: 1171551 - protein, 6 aa, Mycobacterium
RRGGGI

SEQ ID NO: 1171552 - protein, 15 aa, Mycobacterium
RRGGHPTPMSSTKAS

SEQ ID NO: 1171553 - protein, 6 aa, Mycobacterium
RRGGRP

SEQ ID NO: 1171554 - protein, 6 aa, Mycobacterium
RRGGRT

SEQ ID NO: 1171555 - protein, 5 aa, Mycobacterium
RRGGV

SEQ ID NO: 1171556 - protein, 6 aa, Mycobacterium
RRGHDN

SEQ ID NO: 1171557 - protein, 13 aa, Mycobacterium
RRGHGLGTAGTAA

SEQ ID NO: 1171558 - protein, 15 aa, Mycobacterium
RRGHGRSTQTADGHD

SEQ ID NO: 1171559 - protein, 6 aa, Mycobacterium
RRGKPK

SEQ ID NO: 1171560 - protein, 6 aa, Mycobacterium
RRGLGA

SEQ ID NO: 1171561 - protein, 4 aa, Mycobacterium
RRGN

SEQ ID NO: 1171562 - protein, 8 aa, Mycobacterium
RRGPAQSA

SEQ ID NO: 1171563 - protein, 9 aa, Mycobacterium
RRGQPTPPP

SEQ ID NO: 1171564 - protein, 8 aa, Mycobacterium
RRGRARSL

SEQ ID NO: 1171565 - protein, 6 aa, Mycobacterium
RRGRGD

SEQ ID NO: 1171566 - protein, 7 aa, Mycobacterium
RRGRQMG

SEQ ID NO: 1171567 - protein, 5 aa, Mycobacterium
RRGSD

SEQ ID NO: 1171568 - protein, 22 aa, Mycobacterium
RRGSGNIANEDALSDEETEAAL

SEQ ID NO: 1171569 - protein, 6 aa, Mycobacterium
RRGSGR

SEQ ID NO: 1171570 - protein, 6 aa, Mycobacterium
RRGSGY

SEQ ID NO: 1171571 - protein, 7 aa, Mycobacterium
RRGSNVS

SEQ ID NO: 1171572 - protein, 7 aa, Mycobacterium
RRGSSAG

SEQ ID NO: 1171573 - protein, 11 aa, Mycobacterium
RRGSSATFSSE

SEQ ID NO: 1171574 - protein, 7 aa, Mycobacterium
RRGTESR

SEQ ID NO: 1171575 - protein, 5 aa, Mycobacterium
RRGTG

SEQ ID NO: 1171576 - protein, 8 aa, Mycobacterium
RRGTGAAM

SEQ ID NO: 1171577 - protein, 8 aa, Mycobacterium
RRGTPVEQ

SEQ ID NO: 1171578 - protein, 8 aa, Mycobacterium
RRGWGEGG

SEQ ID NO: 1171579 - protein, 9 aa, Mycobacterium
RRHGRPLDT

SEQ ID NO: 1171580 - protein, 18 aa, Mycobacterium
RRIAEETARNEGKPEQAL

SEQ ID NO: 1171581 - protein, 8 aa, Mycobacterium
RRIEPSPL

SEQ ID NO: 1171582 - protein, 9 aa, Mycobacterium
RRKPEAAAR

SEQ ID NO: 1171583 - protein, 8 aa, Mycobacterium
RRKPLDPA

SEQ ID NO: 1171584 - protein, 9 aa, Mycobacterium
RRKQRGDKP

SEQ ID NO: 1171585 - protein, 9 aa, Mycobacterium
RRKSGNYTV

SEQ ID NO: 1171586 - protein, 7 aa, Mycobacterium
RRKTSGV

SEQ ID NO: 1171587 - protein, 8 aa, Mycobacterium
RRKTSRNA

SEQ ID NO: 1171588 - protein, 5 aa, Mycobacterium
RRLGK

SEQ ID NO: 1171589 - protein, 7 aa, Mycobacterium
RRLPRPR

SEQ ID NO: 1171590 - protein, 7 aa, Mycobacterium
RRLPTEA

SEQ ID NO: 1171591 - protein, 10 aa, Mycobacterium
RRLSTYSGGM

SEQ ID NO: 1171592 - protein, 9 aa, Mycobacterium
RRLTAAADG

SEQ ID NO: 1171593 - protein, 8 aa, Mycobacterium
RRMGSKSP

SEQ ID NO: 1171594 - protein, 6 aa, Mycobacterium
RRMQGQ

SEQ ID NO: 1171595 - protein, 8 aa, Mycobacterium
RRNDPTAF

SEQ ID NO: 1171596 - protein, 8 aa, Mycobacterium
RRNGAPAL

SEQ ID NO: 1171597 - protein, 7 aa, Mycobacterium
RRNHGRS

SEQ ID NO: 1171598 - protein, 8 aa, Mycobacterium
RRNPGETE

SEQ ID NO: 1171599 - protein, 11 aa, Mycobacterium
RRNPQDRPTAP

SEQ ID NO: 1171600 - protein, 4 aa, Mycobacterium
RRNW

SEQ ID NO: 1171601 - protein, 17 aa, Mycobacterium
RRPADVTSYGDDATGRI

SEQ ID NO: 1171602 - protein, 8 aa, Mycobacterium
RRPAGNGL

SEQ ID NO: 1171603 - protein, 5 aa, Mycobacterium
RRPAL

SEQ ID NO: 1171604 - protein, 15 aa, Mycobacterium
RRPDASTPAGAGHGV

SEQ ID NO: 1171605 - protein, 5 aa, Mycobacterium
RRPDG

SEQ ID NO: 1171606 - protein, 7 aa, Mycobacterium
RRPDPQH

SEQ ID NO: 1171607 - protein, 7 aa, Mycobacterium
RRPERRR

SEQ ID NO: 1171608 - protein, 5 aa, Mycobacterium
RRPES

SEQ ID NO: 1171609 - protein, 7 aa, Mycobacterium
RRPESLA

SEQ ID NO: 1171610 - protein, 5 aa, Mycobacterium
RRPEW

SEQ ID NO: 1171611 - protein, 23 aa, Mycobacterium
RRPGAAKISDKKNWGASSKGVAP

SEQ ID NO: 1171612 - protein, 8 aa, Mycobacterium
RRPGDPAR

SEQ ID NO: 1171613 - protein, 7 aa, Mycobacterium
RRPGEVA

SEQ ID NO: 1171614 - protein, 5 aa, Mycobacterium
RRPGL

SEQ ID NO: 1171615 - protein, 7 aa, Mycobacterium
RRPHGQH

SEQ ID NO: 1171616 - protein, 13 aa, Mycobacterium
RRPHQLSGGQQQR

SEQ ID NO: 1171617 - protein, 6 aa, Mycobacterium
RRPLSA

SEQ ID NO: 1171618 - protein, 10 aa, Mycobacterium
RRPLSDPGTF

SEQ ID NO: 1171619 - protein, 14 aa, Mycobacterium
RRPLTSQKAELSEL

SEQ ID NO: 1171620 - protein, 8 aa, Mycobacterium
RRPPPGVR

SEQ ID NO: 1171621 - protein, 6 aa, Mycobacterium
RRPRHG

SEQ ID NO: 1171622 - protein, 6 aa, Mycobacterium
RRPRTE

SEQ ID NO: 1171623 - protein, 5 aa, Mycobacterium
RRPVG

SEQ ID NO: 1171624 - protein, 5 aa, Mycobacterium
RRPVS

SEQ ID NO: 1171625 - protein, 10 aa, Mycobacterium
RRQAKPGDFD

SEQ ID NO: 1171626 - protein, 7 aa, Mycobacterium
RRQASLE

SEQ ID NO: 1171627 - protein, 15 aa, Mycobacterium
RRQDATGQRDGVSFS

SEQ ID NO: 1171628 - protein, 15 aa, Mycobacterium
RRQDGEALTSLTSDT

SEQ ID NO: 1171629 - protein, 9 aa, Mycobacterium
RRQPGDVPG

SEQ ID NO: 1171630 - protein, 5 aa, Mycobacterium
RRQPV

SEQ ID NO: 1171631 - protein, 6 aa, Mycobacterium
RRQQPA

SEQ ID NO: 1171632 - protein, 13 aa, Mycobacterium
RRQRRKEAAAATL

SEQ ID NO: 1171633 - protein, 5 aa, Mycobacterium
RRRAI

SEQ ID NO: 1171634 - protein, 6 aa, Mycobacterium
RRRAPN

SEQ ID NO: 1171635 - protein, 12 aa, Mycobacterium
RRRATGGPAEQT

SEQ ID NO: 1171636 - protein, 4 aa, Mycobacterium
RRRD

SEQ ID NO: 1171637 - protein, 13 aa, Mycobacterium
RRRDGGARSEGRS

SEQ ID NO: 1171638 - protein, 16 aa, Mycobacterium
RRRDPFDDPGLDPQRL

SEQ ID NO: 1171639 - protein, 9 aa, Mycobacterium
RRREPGDDT

SEQ ID NO: 1171640 - protein, 8 aa, Mycobacterium
RRREPRDD

SEQ ID NO: 1171641 - protein, 8 aa, Mycobacterium
RRRGEAVR

SEQ ID NO: 1171642 - protein, 9 aa, Mycobacterium
RRRGSGAVA

SEQ ID NO: 1171643 - protein, 7 aa, Mycobacterium
RRRGTAA

SEQ ID NO: 1171644 - protein, 15 aa, Mycobacterium
RRRIERKRAARRELE

SEQ ID NO: 1171645 - protein, 17 aa, Mycobacterium
RRRKDAAAGTTWDPSQP

SEQ ID NO: 1171646 - protein, 22 aa, Mycobacterium
RRRPATPAAVPAATTEQRESVR

SEQ ID NO: 1171647 - protein, 20 aa, Mycobacterium
RRRPKGPPSGSATADRAGVA

SEQ ID NO: 1171648 - protein, 12 aa, Mycobacterium
RRRPPGTAVADP

SEQ ID NO: 1171649 - protein, 28 aa, Mycobacterium
RRRRPSGWRTTETTDVPGALRDDPATAT

SEQ ID NO: 1171650 - protein, 8 aa, Mycobacterium
RRRRQGAL

SEQ ID NO: 1171651 - protein, 7 aa, Mycobacterium
RRRTGQG

SEQ ID NO: 1171652 - protein, 9 aa, Mycobacterium
RRSAGAHPY

SEQ ID NO: 1171653 - protein, 15 aa, Mycobacterium
RRSAQTLADVRRSLG

SEQ ID NO: 1171654 - protein, 7 aa, Mycobacterium
RRSDPQL

SEQ ID NO: 1171655 - protein, 12 aa, Mycobacterium
RRSEFDSTHQTE

SEQ ID NO: 1171656 - protein, 7 aa, Mycobacterium
RRSGDKL

SEQ ID NO: 1171657 - protein, 11 aa, Mycobacterium
RRSGRIGATSS

SEQ ID NO: 1171658 - protein, 6 aa, Mycobacterium
RRSGSD

SEQ ID NO: 1171659 - protein, 9 aa, Mycobacterium
RRSGTLTGR

SEQ ID NO: 1171660 - protein, 6 aa, Mycobacterium
RRSISG

SEQ ID NO: 1171661 - protein, 5 aa, Mycobacterium
RRSPD

SEQ ID NO: 1171662 - protein, 8 aa, Mycobacterium
RRSPRTHR

SEQ ID NO: 1171663 - protein, 12 aa, Mycobacterium
RRSRASAADGDW

SEQ ID NO: 1171664 - protein, 13 aa, Mycobacterium
RRSRTEVQARARR

SEQ ID NO: 1171665 - protein, 6 aa, Mycobacterium
RRSSED

SEQ ID NO: 1171666 - protein, 5 aa, Mycobacterium
RRSSW

SEQ ID NO: 1171667 - protein, 12 aa, Mycobacterium
RRSTAAAENALD

SEQ ID NO: 1171668 - protein, 8 aa, Mycobacterium
RRSTTQDH

SEQ ID NO: 1171669 - protein, 13 aa, Mycobacterium
RRSTYAQTADRTR

SEQ ID NO: 1171670 - protein, 11 aa, Mycobacterium
RRSVDDGLDPR

SEQ ID NO: 1171671 - protein, 6 aa, Mycobacterium
RRSYDA

SEQ ID NO: 1171672 - protein, 4 aa, Mycobacterium
RRTA

SEQ ID NO: 1171673 - protein, 8 aa, Mycobacterium
RRTADEIT

SEQ ID NO: 1171674 - protein, 11 aa, Mycobacterium
RRTARSEESAQ

SEQ ID NO: 1171675 - protein, 9 aa, Mycobacterium
RRTATADRA

SEQ ID NO: 1171676 - protein, 17 aa, Mycobacterium
RRTATDAAPQGDSSAGV

SEQ ID NO: 1171677 - protein, 22 aa, Mycobacterium
RRTDQPTSGHRSSTPPAASTVN

SEQ ID NO: 1171678 - protein, 9 aa, Mycobacterium
RRTEDDAGR

SEQ ID NO: 1171679 - protein, 17 aa, Mycobacterium
RRTEGTDQERAARAGVQ

SEQ ID NO: 1171680 - protein, 4 aa, Mycobacterium
RRTG

SEQ ID NO: 1171681 - protein, 9 aa, Mycobacterium
RRTGAKRKL

SEQ ID NO: 1171682 - protein, 13 aa, Mycobacterium
RRTGQSEAAAERD

SEQ ID NO: 1171683 - protein, 11 aa, Mycobacterium
RRTGRTTSPHL

SEQ ID NO: 1171684 - protein, 7 aa, Mycobacterium
RRTGSDT

SEQ ID NO: 1171685 - protein, 8 aa, Mycobacterium
RRTHPGEP

SEQ ID NO: 1171686 - protein, 6 aa, Mycobacterium
RRTLGN

SEQ ID NO: 1171687 - protein, 11 aa, Mycobacterium
RRTNNAEGREA

SEQ ID NO: 1171688 - protein, 7 aa, Mycobacterium
RRTPDSA

SEQ ID NO: 1171689 - protein, 6 aa, Mycobacterium
RRTPGA

SEQ ID NO: 1171690 - protein, 6 aa, Mycobacterium
RRTPLQ

SEQ ID NO: 1171691 - protein, 7 aa, Mycobacterium
RRTPTTR

SEQ ID NO: 1171692 - protein, 7 aa, Mycobacterium
RRTPTTV

SEQ ID NO: 1171693 - protein, 7 aa, Mycobacterium
RRTRAGE

SEQ ID NO: 1171694 - protein, 9 aa, Mycobacterium
RRTTSPDNA

SEQ ID NO: 1171695 - protein, 11 aa, Mycobacterium
RRVAEKAGLKP

SEQ ID NO: 1171696 - protein, 23 aa, Mycobacterium
RRVDEPAKSAVLPGTGTEHRTDF

SEQ ID NO: 1171697 - protein, 28 aa, Mycobacterium
RRVGGRRRGRATGPTRGRGAIDREQSAA

SEQ ID NO: 1171698 - protein, 14 aa, Mycobacterium
RRVNDGADRPTAEA

SEQ ID NO: 1171699 - protein, 4 aa, Mycobacterium
RRVR

SEQ ID NO: 1171700 - protein, 8 aa, Mycobacterium
RRVTAPED

SEQ ID NO: 1171701 - protein, 6 aa, Mycobacterium
RRWPSK

SEQ ID NO: 1171702 - protein, 4 aa, Mycobacterium
RRYA

SEQ ID NO: 1171703 - protein, 12 aa, Mycobacterium
RRYAEHGNTPRT

SEQ ID NO: 1171704 - protein, 12 aa, Mycobacterium
RRYAGTSEGARL

SEQ ID NO: 1171705 - protein, 16 aa, Mycobacterium
RRYGRGRTGNGNGGGL

SEQ ID NO: 1171706 - protein, 4 aa, Mycobacterium
RSAD

SEQ ID NO: 1171707 - protein, 13 aa, Mycobacterium
RSADDALQTRAAS

SEQ ID NO: 1171708 - protein, 7 aa, Mycobacterium
RSADRWS

SEQ ID NO: 1171709 - protein, 12 aa, Mycobacterium
RSADTPVMREPS

SEQ ID NO: 1171710 - protein, 5 aa, Mycobacterium
RSAEE

SEQ ID NO: 1171711 - protein, 6 aa, Mycobacterium
RSAEPA

SEQ ID NO: 1171712 - protein, 12 aa, Mycobacterium
RSAEQVRELAAL

SEQ ID NO: 1171713 - protein, 14 aa, Mycobacterium
RSAFDDTDWSTNTE

SEQ ID NO: 1171714 - protein, 9 aa, Mycobacterium
RSAGDGGLD

SEQ ID NO: 1171715 - protein, 20 aa, Mycobacterium
RSAGEGSEELPDQAGTQTGR

SEQ ID NO: 1171716 - protein, 6 aa, Mycobacterium
RSAGLS

SEQ ID NO: 1171717 - protein, 7 aa, Mycobacterium
RSAGPRR

SEQ ID NO: 1171718 - protein, 6 aa, Mycobacterium
RSAGRE

SEQ ID NO: 1171719 - protein, 7 aa, Mycobacterium
RSAGRPV

SEQ ID NO: 1171720 - protein, 15 aa, Mycobacterium
RSAGRTFRDRRDAGR

SEQ ID NO: 1171721 - protein, 5 aa, Mycobacterium
RSAGS

SEQ ID NO: 1171722 - protein, 9 aa, Mycobacterium
RSAKAAGDR

SEQ ID NO: 1171723 - protein, 5 aa, Mycobacterium
RSANV

SEQ ID NO: 1171724 - protein, 6 aa, Mycobacterium
RSAPGQ

SEQ ID NO: 1171725 - protein, 10 aa, Mycobacterium
RSAPNPAATA

SEQ ID NO: 1171726 - protein, 10 aa, Mycobacterium
RSASALRAHG

SEQ ID NO: 1171727 - protein, 10 aa, Mycobacterium
RSASLSNSGQ

SEQ ID NO: 1171728 - protein, 13 aa, Mycobacterium
RSASVEHPRGLHN

SEQ ID NO: 1171729 - protein, 4 aa, Mycobacterium
RSAT

SEQ ID NO: 1171730 - protein, 10 aa, Mycobacterium
RSATDPDGFS

SEQ ID NO: 1171731 - protein, 8 aa, Mycobacterium
RSATDTAS

SEQ ID NO: 1171732 - protein, 12 aa, Mycobacterium
RSATELSEVTAE

SEQ ID NO: 1171733 - protein, 8 aa, Mycobacterium
RSATPLAD

SEQ ID NO: 1171734 - protein, 17 aa, Mycobacterium
RSATRSARLEPEVTRRS

SEQ ID NO: 1171735 - protein, 7 aa, Mycobacterium
RSAVPRG

SEQ ID NO: 1171736 - protein, 5 aa, Mycobacterium
RSCPE

SEQ ID NO: 1171737 - protein, 16 aa, Mycobacterium
RSDAGVPHPPPTQGTF

SEQ ID NO: 1171738 - protein, 8 aa, Mycobacterium
RSDDAGVH

SEQ ID NO: 1171739 - protein, 9 aa, Mycobacterium
RSDDPQIAE

SEQ ID NO: 1171740 - protein, 6 aa, Mycobacterium
RSDDQV

SEQ ID NO: 1171741 - protein, 7 aa, Mycobacterium
RSDDTII

SEQ ID NO: 1171742 - protein, 6 aa, Mycobacterium
RSDEAV

SEQ ID NO: 1171743 - protein, 8 aa, Mycobacterium
RSDGASGV

SEQ ID NO: 1171744 - protein, 10 aa, Mycobacterium
RSDKPTRVED

SEQ ID NO: 1171745 - protein, 7 aa, Mycobacterium
RSDNSPH

SEQ ID NO: 1171746 - protein, 5 aa, Mycobacterium
RSDNT

SEQ ID NO: 1171747 - protein, 4 aa, Mycobacterium
RSDP

SEQ ID NO: 1171748 - protein, 10 aa, Mycobacterium
RSDPDTDLEE

SEQ ID NO: 1171749 - protein, 10 aa, Mycobacterium
RSDPNAAARK

SEQ ID NO: 1171750 - protein, 8 aa, Mycobacterium
RSDRDAAW

SEQ ID NO: 1171751 - protein, 7 aa, Mycobacterium
RSDRTVP

SEQ ID NO: 1171752 - protein, 4 aa, Mycobacterium
RSED

SEQ ID NO: 1171753 - protein, 5 aa, Mycobacterium
RSEDH

SEQ ID NO: 1171754 - protein, 10 aa, Mycobacterium
RSEEAGGPRL

SEQ ID NO: 1171755 - protein, 5 aa, Mycobacterium
RSEFG

SEQ ID NO: 1171756 - protein, 10 aa, Mycobacterium
RSEIDGRTTY

SEQ ID NO: 1171757 - protein, 9 aa, Mycobacterium
RSENLTSTG

SEQ ID NO: 1171758 - protein, 25 aa, Mycobacterium
RSEPGQGSDPDLSEDGIEQAKRLPD

SEQ ID NO: 1171759 - protein, 16 aa, Mycobacterium
RSEPHPSPILPPQLME

SEQ ID NO: 1171760 - protein, 5 aa, Mycobacterium
RSEPR

SEQ ID NO: 1171761 - protein, 7 aa, Mycobacterium
RSERSPI

SEQ ID NO: 1171762 - protein, 9 aa, Mycobacterium
RSESDHTYG

SEQ ID NO: 1171763 - protein, 9 aa, Mycobacterium
RSESGASPF

SEQ ID NO: 1171764 - protein, 8 aa, Mycobacterium
RSETDDVT

SEQ ID NO: 1171765 - protein, 9 aa, Mycobacterium
RSETDHPGQ

SEQ ID NO: 1171766 - protein, 4 aa, Mycobacterium
RSFA

SEQ ID NO: 1171767 - protein, 4 aa, Mycobacterium
RSFG

SEQ ID NO: 1171768 - protein, 5 aa, Mycobacterium
RSFPR

SEQ ID NO: 1171769 - protein, 9 aa, Mycobacterium
RSFSSGGDL

SEQ ID NO: 1171770 - protein, 9 aa, Mycobacterium
RSGAADRRA

SEQ ID NO: 1171771 - protein, 6 aa, Mycobacterium
RSGAGE

SEQ ID NO: 1171772 - protein, 10 aa, Mycobacterium
RSGDADELRA

SEQ ID NO: 1171773 - protein, 10 aa, Mycobacterium
RSGDGPLDDG

SEQ ID NO: 1171774 - protein, 10 aa, Mycobacterium
RSGDTTPAQR

SEQ ID NO: 1171775 - protein, 5 aa, Mycobacterium
RSGEA

SEQ ID NO: 1171776 - protein, 8 aa, Mycobacterium
RSGEDDEL

SEQ ID NO: 1171777 - protein, 6 aa, Mycobacterium
RSGEIA

SEQ ID NO: 1171778 - protein, 6 aa, Mycobacterium
RSGEQR

SEQ ID NO: 1171779 - protein, 12 aa, Mycobacterium
RSGEVTEPTGQD

SEQ ID NO: 1171780 - protein, 4 aa, Mycobacterium
RSGG

SEQ ID NO: 1171781 - protein, 6 aa, Mycobacterium
RSGGDG

SEQ ID NO: 1171782 - protein, 9 aa, Mycobacterium
RSGGGSPHV

SEQ ID NO: 1171783 - protein, 7 aa, Mycobacterium
RSGGNAL

SEQ ID NO: 1171784 - protein, 11 aa, Mycobacterium
RSGLHQQAQSG

SEQ ID NO: 1171785 - protein, 12 aa, Mycobacterium
RSGNRTNPSQAT

SEQ ID NO: 1171786 - protein, 6 aa, Mycobacterium
RSGNYR

SEQ ID NO: 1171787 - protein, 7 aa, Mycobacterium
RSGPARA

SEQ ID NO: 1171788 - protein, 8 aa, Mycobacterium
RSGPRLSG

SEQ ID NO: 1171789 - protein, 16 aa, Mycobacterium
RSGPRPQDHPGLSDLG

SEQ ID NO: 1171790 - protein, 10 aa, Mycobacterium
RSGPRRNAQV

SEQ ID NO: 1171791 - protein, 8 aa, Mycobacterium
RSGRAPAD

SEQ ID NO: 1171792 - protein, 5 aa, Mycobacterium
RSGRL

SEQ ID NO: 1171793 - protein, 13 aa, Mycobacterium
RSGRTARAGSAGD

SEQ ID NO: 1171794 - protein, 8 aa, Mycobacterium
RSGVDPNA

SEQ ID NO: 1171795 - protein, 13 aa, Mycobacterium
RSGVPAAARTDEV

SEQ ID NO: 1171796 - protein, 8 aa, Mycobacterium
RSGVRGLG

SEQ ID NO: 1171797 - protein, 9 aa, Mycobacterium
RSGVSGEEA

SEQ ID NO: 1171798 - protein, 7 aa, Mycobacterium
RSGYAGA

SEQ ID NO: 1171799 - protein, 7 aa, Mycobacterium
RSGYKYG

SEQ ID NO: 1171800 - protein, 7 aa, Mycobacterium
RSHPGDD

SEQ ID NO: 1171801 - protein, 7 aa, Mycobacterium
RSHPTDD

SEQ ID NO: 1171802 - protein, 22 aa, Mycobacterium
RSHTPSPSVRAGAAAALPGTIG

SEQ ID NO: 1171803 - protein, 4 aa, Mycobacterium
RSIP

SEQ ID NO: 1171804 - protein, 12 aa, Mycobacterium
RSIQDETGIKPE

SEQ ID NO: 1171805 - protein, 12 aa, Mycobacterium
RSISPASPSASN

SEQ ID NO: 1171806 - protein, 9 aa, Mycobacterium
RSKAPTSDL

SEQ ID NO: 1171807 - protein, 4 aa, Mycobacterium
RSKE

SEQ ID NO: 1171808 - protein, 9 aa, Mycobacterium
RSKGSDTFA

SEQ ID NO: 1171809 - protein, 7 aa, Mycobacterium
RSKIPAA

SEQ ID NO: 1171810 - protein, 6 aa, Mycobacterium
RSKLTR

SEQ ID NO: 1171811 - protein, 7 aa, Mycobacterium
RSKYASG

SEQ ID NO: 1171812 - protein, 5 aa, Mycobacterium
RSLGA

SEQ ID NO: 1171813 - protein, 7 aa, Mycobacterium
RSLGDPV

SEQ ID NO: 1171814 - protein, 11 aa, Mycobacterium
RSLPPDLPTTV

SEQ ID NO: 1171815 - protein, 13 aa, Mycobacterium
RSLTGSQQGGGQL

SEQ ID NO: 1171816 - protein, 13 aa, Mycobacterium
RSMTDNPDGAITD

SEQ ID NO: 1171817 - protein, 16 aa, Mycobacterium
RSNRGVAGIDGTVSTA

SEQ ID NO: 1171818 - protein, 7 aa, Mycobacterium
RSNRTLA

SEQ ID NO: 1171819 - protein, 11 aa, Mycobacterium
RSPAGKQVKVQ

SEQ ID NO: 1171820 - protein, 18 aa, Mycobacterium
RSPEAEDPRVRSDSHTRH

SEQ ID NO: 1171821 - protein, 10 aa, Mycobacterium
RSPEAREKYD

SEQ ID NO: 1171822 - protein, 6 aa, Mycobacterium
RSPHNT

SEQ ID NO: 1171823 - protein, 7 aa, Mycobacterium
RSPNPHL

SEQ ID NO: 1171824 - protein, 9 aa, Mycobacterium
RSPQKTAAV

SEQ ID NO: 1171825 - protein, 8 aa, Mycobacterium
RSPRDRRS

SEQ ID NO: 1171826 - protein, 8 aa, Mycobacterium
RSPRGELA

SEQ ID NO: 1171827 - protein, 14 aa, Mycobacterium
RSPTAIPVTFEPVA

SEQ ID NO: 1171828 - protein, 8 aa, Mycobacterium
RSPTPVGV

SEQ ID NO: 1171829 - protein, 12 aa, Mycobacterium
RSPTSLPVLFDP

SEQ ID NO: 1171830 - protein, 5 aa, Mycobacterium
RSPVE

SEQ ID NO: 1171831 - protein, 11 aa, Mycobacterium
RSQASTPSDAL

SEQ ID NO: 1171832 - protein, 6 aa, Mycobacterium
RSQRAH

SEQ ID NO: 1171833 - protein, 24 aa, Mycobacterium
RSQRDELASSMSSARAQPVTGEAR

SEQ ID NO: 1171834 - protein, 11 aa, Mycobacterium
RSQTRKGSDIP

SEQ ID NO: 1171835 - protein, 12 aa, Mycobacterium
RSRAQADGTPSY

SEQ ID NO: 1171836 - protein, 8 aa, Mycobacterium
RSRDPSDL

SEQ ID NO: 1171837 - protein, 5 aa, Mycobacterium
RSREA

SEQ ID NO: 1171838 - protein, 10 aa, Mycobacterium
RSREQAAEIG

SEQ ID NO: 1171839 - protein, 7 aa, Mycobacterium
RSRGEHL

SEQ ID NO: 1171840 - protein, 12 aa, Mycobacterium
RSRGHGPALAVG

SEQ ID NO: 1171841 - protein, 8 aa, Mycobacterium
RSRGVGAD

SEQ ID NO: 1171842 - protein, 9 aa, Mycobacterium
RSRKPDERR

SEQ ID NO: 1171843 - protein, 9 aa, Mycobacterium
RSRPADQPA

SEQ ID NO: 1171844 - protein, 16 aa, Mycobacterium
RSRPALRDQAAAALTG

SEQ ID NO: 1171845 - protein, 8 aa, Mycobacterium
RSRPDGPL

SEQ ID NO: 1171846 - protein, 20 aa, Mycobacterium
RSRPGAGTAVTATIPLPSVA

SEQ ID NO: 1171847 - protein, 8 aa, Mycobacterium
RSRPGDAV

SEQ ID NO: 1171848 - protein, 14 aa, Mycobacterium
RSRPVSGPGSKSDI

SEQ ID NO: 1171849 - protein, 6 aa, Mycobacterium
RSRQQR

SEQ ID NO: 1171850 - protein, 10 aa, Mycobacterium
RSRQRRDNPD

SEQ ID NO: 1171851 - protein, 6 aa, Mycobacterium
RSRRPV

SEQ ID NO: 1171852 - protein, 9 aa, Mycobacterium
RSRSDERQV

SEQ ID NO: 1171853 - protein, 4 aa, Mycobacterium
RSRY

SEQ ID NO: 1171854 - protein, 5 aa, Mycobacterium
RSRYP

SEQ ID NO: 1171855 - protein, 12 aa, Mycobacterium
RSSAERAGRDPM

SEQ ID NO: 1171856 - protein, 9 aa, Mycobacterium
RSSDTAELS

SEQ ID NO: 1171857 - protein, 4 aa, Mycobacterium
RSSF

SEQ ID NO: 1171858 - protein, 12 aa, Mycobacterium
RSSRPHTSPMRT

SEQ ID NO: 1171859 - protein, 9 aa, Mycobacterium
RSSSPALSE

SEQ ID NO: 1171860 - protein, 6 aa, Mycobacterium
RSSTDF

SEQ ID NO: 1171861 - protein, 10 aa, Mycobacterium
RSSTTPEAPL

SEQ ID NO: 1171862 - protein, 4 aa, Mycobacterium
RSTA

SEQ ID NO: 1171863 - protein, 12 aa, Mycobacterium
RSTDSDVVTEDE

SEQ ID NO: 1171864 - protein, 8 aa, Mycobacterium
RSTEADID

SEQ ID NO: 1171865 - protein, 14 aa, Mycobacterium
RSTGASVQFGTDAG

SEQ ID NO: 1171866 - protein, 15 aa, Mycobacterium
RSTGPGPAKTFPDTV

SEQ ID NO: 1171867 - protein, 6 aa, Mycobacterium
RSTGRR

SEQ ID NO: 1171868 - protein, 7 aa, Mycobacterium
RSTPEFA

SEQ ID NO: 1171869 - protein, 26 aa, Mycobacterium
RSTRESSWESTDPSVRTPLCAGRLVR

SEQ ID NO: 1171870 - protein, 9 aa, Mycobacterium
RSTSDLPAD

SEQ ID NO: 1171871 - protein, 7 aa, Mycobacterium
RSTTGVA

SEQ ID NO: 1171872 - protein, 4 aa, Mycobacterium
RSVA

SEQ ID NO: 1171873 - protein, 13 aa, Mycobacterium
RSVGANLKTDEGR

SEQ ID NO: 1171874 - protein, 6 aa, Mycobacterium
RSVGEA

SEQ ID NO: 1171875 - protein, 19 aa, Mycobacterium
RSVPGTLKQGEKTKKTGTT

SEQ ID NO: 1171876 - protein, 11 aa, Mycobacterium
RSWPRERTRAK

SEQ ID NO: 1171877 - protein, 4 aa, Mycobacterium
RSWS

SEQ ID NO: 1171878 - protein, 8 aa, Mycobacterium
RSYSSAEL

SEQ ID NO: 1171879 - protein, 8 aa, Mycobacterium
RTAAADPA

SEQ ID NO: 1171880 - protein, 7 aa, Mycobacterium
RTAAPGH

SEQ ID NO: 1171881 - protein, 10 aa, Mycobacterium
RTAATARERF

SEQ ID NO: 1171882 - protein, 10 aa, Mycobacterium
RTADDPASRR

SEQ ID NO: 1171883 - protein, 5 aa, Mycobacterium
RTADG

SEQ ID NO: 1171884 - protein, 7 aa, Mycobacterium
RTADPET

SEQ ID NO: 1171885 - protein, 8 aa, Mycobacterium
RTADSSQR

SEQ ID NO: 1171886 - protein, 41 aa, Mycobacterium
RTAEERANAVRGRADSLRRAAAAEREARVRAQRAKQAREHA

SEQ ID NO: 1171887 - protein, 5 aa, Mycobacterium
RTAEL

SEQ ID NO: 1171888 - protein, 14 aa, Mycobacterium
RTAEPTAEFADPDS

SEQ ID NO: 1171889 - protein, 4 aa, Mycobacterium
RTAF

SEQ ID NO: 1171890 - protein, 7 aa, Mycobacterium
RTAGASQ

SEQ ID NO: 1171891 - protein, 10 aa, Mycobacterium
RTAGDDRTRV

SEQ ID NO: 1171892 - protein, 16 aa, Mycobacterium
RTAGLRAPSSCETGSC

SEQ ID NO: 1171893 - protein, 7 aa, Mycobacterium
RTAGVPA

SEQ ID NO: 1171894 - protein, 18 aa, Mycobacterium
RTAPGGSKLGSAKGVNVP

SEQ ID NO: 1171895 - protein, 7 aa, Mycobacterium
RTASKAH

SEQ ID NO: 1171896 - protein, 11 aa, Mycobacterium
RTASSSGPVYQ

SEQ ID NO: 1171897 - protein, 4 aa, Mycobacterium
RTAT

SEQ ID NO: 1171898 - protein, 16 aa, Mycobacterium
RTATRKAELRRAEDPV

SEQ ID NO: 1171899 - protein, 12 aa, Mycobacterium
RTAVPPSSRRAY

SEQ ID NO: 1171900 - protein, 10 aa, Mycobacterium
RTDDDAGTFT

SEQ ID NO: 1171901 - protein, 8 aa, Mycobacterium
RTDDPDAR

SEQ ID NO: 1171902 - protein, 7 aa, Mycobacterium
RTDDPSL

SEQ ID NO: 1171903 - protein, 10 aa, Mycobacterium
RTDPDARKHR

SEQ ID NO: 1171904 - protein, 8 aa, Mycobacterium
RTDPGAEF

SEQ ID NO: 1171905 - protein, 10 aa, Mycobacterium
RTDPNAPKHN

SEQ ID NO: 1171906 - protein, 8 aa, Mycobacterium
RTDPTEQH

SEQ ID NO: 1171907 - protein, 7 aa, Mycobacterium
RTDPTRA

SEQ ID NO: 1171908 - protein, 18 aa, Mycobacterium
RTDSSDKVEALDAGADDY

SEQ ID NO: 1171909 - protein, 7 aa, Mycobacterium
RTDTDHA

SEQ ID NO: 1171910 - protein, 4 aa, Mycobacterium
RTEA

SEQ ID NO: 1171911 - protein, 6 aa, Mycobacterium
RTEADV

SEQ ID NO: 1171912 - protein, 9 aa, Mycobacterium
RTEAVDPAL

SEQ ID NO: 1171913 - protein, 8 aa, Mycobacterium
RTEDARVG

SEQ ID NO: 1171914 - protein, 17 aa, Mycobacterium
RTEGLQDALGKDGVSSN

SEQ ID NO: 1171915 - protein, 5 aa, Mycobacterium
RTEHQ

SEQ ID NO: 1171916 - protein, 10 aa, Mycobacterium
RTEIKDPELR

SEQ ID NO: 1171917 - protein, 5 aa, Mycobacterium
RTELD

SEQ ID NO: 1171918 - protein, 6 aa, Mycobacterium
RTERAS

SEQ ID NO: 1171919 - protein, 7 aa, Mycobacterium
RTERGFS

SEQ ID NO: 1171920 - protein, 7 aa, Mycobacterium
RTESQLD

SEQ ID NO: 1171921 - protein, 5 aa, Mycobacterium
RTGAA

SEQ ID NO: 1171922 - protein, 7 aa, Mycobacterium
RTGADVS

SEQ ID NO: 1171923 - protein, 15 aa, Mycobacterium
RTGAEPIGSMGTDTP

SEQ ID NO: 1171924 - protein, 9 aa, Mycobacterium
RTGARAGGH

SEQ ID NO: 1171925 - protein, 7 aa, Mycobacterium
RTGARGL

SEQ ID NO: 1171926 - protein, 6 aa, Mycobacterium
RTGDPW

SEQ ID NO: 1171927 - protein, 11 aa, Mycobacterium
RTGDRRVSEVP

SEQ ID NO: 1171928 - protein, 13 aa, Mycobacterium
RTGDVTTAAASIT

SEQ ID NO: 1171929 - protein, 7 aa, Mycobacterium
RTGEATV

SEQ ID NO: 1171930 - protein, 7 aa, Mycobacterium
RTGEQYD

SEQ ID NO: 1171931 - protein, 6 aa, Mycobacterium
RTGGAT

SEQ ID NO: 1171932 - protein, 7 aa, Mycobacterium
RTGGHAY

SEQ ID NO: 1171933 - protein, 5 aa, Mycobacterium
RTGGI

SEQ ID NO: 1171934 - protein, 7 aa, Mycobacterium
RTGGNPL

SEQ ID NO: 1171935 - protein, 10 aa, Mycobacterium
RTGGPGGGLT

SEQ ID NO: 1171936 - protein, 27 aa, Mycobacterium
RTGGPTPDERGLEEQAAALTTAVDELG

SEQ ID NO: 1171937 - protein, 17 aa, Mycobacterium
RTGGTSVHGSGLNPGNL

SEQ ID NO: 1171938 - protein, 7 aa, Mycobacterium
RTGLDEA

SEQ ID NO: 1171939 - protein, 12 aa, Mycobacterium
RTGLGGSASIAQ

SEQ ID NO: 1171940 - protein, 6 aa, Mycobacterium
RTGLSR

SEQ ID NO: 1171941 - protein, 11 aa, Mycobacterium
RTGNPTRQSLE

SEQ ID NO: 1171942 - protein, 5 aa, Mycobacterium
RTGNS

SEQ ID NO: 1171943 - protein, 7 aa, Mycobacterium
RTGQGLD

SEQ ID NO: 1171944 - protein, 6 aa, Mycobacterium
RTGQPH

SEQ ID NO: 1171945 - protein, 11 aa, Mycobacterium
RTGQPSGAPLR

SEQ ID NO: 1171946 - protein, 10 aa, Mycobacterium
RTGRAGKTGV

SEQ ID NO: 1171947 - protein, 7 aa, Mycobacterium
RTGRDDW

SEQ ID NO: 1171948 - protein, 9 aa, Mycobacterium
RTGRDGDFA

SEQ ID NO: 1171949 - protein, 8 aa, Mycobacterium
RTGRRRSD

SEQ ID NO: 1171950 - protein, 5 aa, Mycobacterium
RTGRS

SEQ ID NO: 1171951 - protein, 12 aa, Mycobacterium
RTGRTSLETEYG

SEQ ID NO: 1171952 - protein, 6 aa, Mycobacterium
RTGSTS

SEQ ID NO: 1171953 - protein, 15 aa, Mycobacterium
RTGTPGDAWAPYSAD

SEQ ID NO: 1171954 - protein, 10 aa, Mycobacterium
RTGTPTPGAI

SEQ ID NO: 1171955 - protein, 5 aa, Mycobacterium
RTGTT

SEQ ID NO: 1171956 - protein, 12 aa, Mycobacterium
RTGTVEGSHTPL

SEQ ID NO: 1171957 - protein, 10 aa, Mycobacterium
RTGVTTPAEL

SEQ ID NO: 1171958 - protein, 4 aa, Mycobacterium
RTGY

SEQ ID NO: 1171959 - protein, 11 aa, Mycobacterium
RTHDQRGGTDE

SEQ ID NO: 1171960 - protein, 12 aa, Mycobacterium
RTHEAPPVPGAP

SEQ ID NO: 1171961 - protein, 16 aa, Mycobacterium
RTHEESQRGPRAPKHT

SEQ ID NO: 1171962 - protein, 8 aa, Mycobacterium
RTHGSESL

SEQ ID NO: 1171963 - protein, 10 aa, Mycobacterium
RTHRSGTTDS

SEQ ID NO: 1171964 - protein, 7 aa, Mycobacterium
RTHSEPH

SEQ ID NO: 1171965 - protein, 4 aa, Mycobacterium
RTIR

SEQ ID NO: 1171966 - protein, 10 aa, Mycobacterium
RTKEPGSVGE

SEQ ID NO: 1171967 - protein, 8 aa, Mycobacterium
RTLGGDEV

SEQ ID NO: 1171968 - protein, 8 aa, Mycobacterium
RTLPDSST

SEQ ID NO: 1171969 - protein, 5 aa, Mycobacterium
RTLRP

SEQ ID NO: 1171970 - protein, 8 aa, Mycobacterium
RTLSSGSR

SEQ ID NO: 1171971 - protein, 15 aa, Mycobacterium
RTLTEDEASTAREAA

SEQ ID NO: 1171972 - protein, 9 aa, Mycobacterium
RTNARRRED

SEQ ID NO: 1171973 - protein, 18 aa, Mycobacterium
RTNERRRLRNQSVKSSLR

SEQ ID NO: 1171974 - protein, 7 aa, Mycobacterium
RTNRGLP

SEQ ID NO: 1171975 - protein, 16 aa, Mycobacterium
RTNVDPDELRRSPEYT

SEQ ID NO: 1171976 - protein, 23 aa, Mycobacterium
RTPADAPPTGDLQSSPVGESISS

SEQ ID NO: 1171977 - protein, 8 aa, Mycobacterium
RTPADRGT

SEQ ID NO: 1171978 - protein, 6 aa, Mycobacterium
RTPAME

SEQ ID NO: 1171979 - protein, 5 aa, Mycobacterium
RTPDE

SEQ ID NO: 1171980 - protein, 11 aa, Mycobacterium
RTPDEGRASLG

SEQ ID NO: 1171981 - protein, 7 aa, Mycobacterium
RTPDGEP

SEQ ID NO: 1171982 - protein, 6 aa, Mycobacterium
RTPDRD

SEQ ID NO: 1171983 - protein, 7 aa, Mycobacterium
RTPEGVQ

SEQ ID NO: 1171984 - protein, 5 aa, Mycobacterium
RTPGE

SEQ ID NO: 1171985 - protein, 10 aa, Mycobacterium
RTPGKLDDAP

SEQ ID NO: 1171986 - protein, 10 aa, Mycobacterium
RTPGPDQDAA

SEQ ID NO: 1171987 - protein, 18 aa, Mycobacterium
RTPGRDDQRAADKARGFG

SEQ ID NO: 1171988 - protein, 9 aa, Mycobacterium
RTPGTEHPG

SEQ ID NO: 1171989 - protein, 4 aa, Mycobacterium
RTPL

SEQ ID NO: 1171990 - protein, 5 aa, Mycobacterium
RTPMR

SEQ ID NO: 1171991 - protein, 16 aa, Mycobacterium
RTPNGWRADNTDVDGV

SEQ ID NO: 1171992 - protein, 10 aa, Mycobacterium
RTPPAPKTTE

SEQ ID NO: 1171993 - protein, 24 aa, Mycobacterium
RTPPFYPEPDADPVRDALESVDPM

SEQ ID NO: 1171994 - protein, 7 aa, Mycobacterium
RTPPGVV

SEQ ID NO: 1171995 - protein, 9 aa, Mycobacterium
RTPPYQRAT

SEQ ID NO: 1171996 - protein, 4 aa, Mycobacterium
RTPQ

SEQ ID NO: 1171997 - protein, 5 aa, Mycobacterium
RTPRD

SEQ ID NO: 1171998 - protein, 7 aa, Mycobacterium
RTPRDGG

SEQ ID NO: 1171999 - protein, 7 aa, Mycobacterium
RTPRVNP

SEQ ID NO: 1172000 - protein, 4 aa, Mycobacterium
RTPS

SEQ ID NO: 1172001 - protein, 5 aa, Mycobacterium
RTPSE

SEQ ID NO: 1172002 - protein, 6 aa, Mycobacterium
RTPSGV

SEQ ID NO: 1172003 - protein, 6 aa, Mycobacterium
RTPTGD

SEQ ID NO: 1172004 - protein, 8 aa, Mycobacterium
RTPTPSGR

SEQ ID NO: 1172005 - protein, 5 aa, Mycobacterium
RTPTV

SEQ ID NO: 1172006 - protein, 9 aa, Mycobacterium
RTPTVSPGE

SEQ ID NO: 1172007 - protein, 5 aa, Mycobacterium
RTPVT

SEQ ID NO: 1172008 - protein, 10 aa, Mycobacterium
RTPWPAAPGR

SEQ ID NO: 1172009 - protein, 11 aa, Mycobacterium
RTQADAGTVAA

SEQ ID NO: 1172010 - protein, 6 aa, Mycobacterium
RTQAGD

SEQ ID NO: 1172011 - protein, 5 aa, Mycobacterium
RTQDV

SEQ ID NO: 1172012 - protein, 9 aa, Mycobacterium
RTQKPPDFG

SEQ ID NO: 1172013 - protein, 11 aa, Mycobacterium
RTRAAQAEGGH

SEQ ID NO: 1172014 - protein, 17 aa, Mycobacterium
RTRAGDAHAAGLRPRTG

SEQ ID NO: 1172015 - protein, 5 aa, Mycobacterium
RTRCE

SEQ ID NO: 1172016 - protein, 4 aa, Mycobacterium
RTRE

SEQ ID NO: 1172017 - protein, 6 aa, Mycobacterium
RTREAL

SEQ ID NO: 1172018 - protein, 10 aa, Mycobacterium
RTRGRSTRQV

SEQ ID NO: 1172019 - protein, 10 aa, Mycobacterium
RTRPAGGTAV

SEQ ID NO: 1172020 - protein, 6 aa, Mycobacterium
RTRPAT

SEQ ID NO: 1172021 - protein, 11 aa, Mycobacterium
RTRPNDADAKA

SEQ ID NO: 1172022 - protein, 13 aa, Mycobacterium
RTRPSRSVGPGTP

SEQ ID NO: 1172023 - protein, 13 aa, Mycobacterium
RTRPYRPQTNGKV

SEQ ID NO: 1172024 - protein, 5 aa, Mycobacterium
RTRSD

SEQ ID NO: 1172025 - protein, 13 aa, Mycobacterium
RTRSHGRSPRSTV

SEQ ID NO: 1172026 - protein, 5 aa, Mycobacterium
RTRSW

SEQ ID NO: 1172027 - protein, 5 aa, Mycobacterium
RTRTQ

SEQ ID NO: 1172028 - protein, 6 aa, Mycobacterium
RTSAPG

SEQ ID NO: 1172029 - protein, 6 aa, Mycobacterium
RTSDDA

SEQ ID NO: 1172030 - protein, 5 aa, Mycobacterium
RTSDG

SEQ ID NO: 1172031 - protein, 11 aa, Mycobacterium
RTSGGRDDEEG

SEQ ID NO: 1172032 - protein, 5 aa, Mycobacterium
RTSGL

SEQ ID NO: 1172033 - protein, 5 aa, Mycobacterium
RTSGV

SEQ ID NO: 1172034 - protein, 12 aa, Mycobacterium
RTSPDEGPDSPA

SEQ ID NO: 1172035 - protein, 6 aa, Mycobacterium
RTSTDY

SEQ ID NO: 1172036 - protein, 7 aa, Mycobacterium
RTTAPGN

SEQ ID NO: 1172037 - protein, 9 aa, Mycobacterium
RTTARRDGD

SEQ ID NO: 1172038 - protein, 7 aa, Mycobacterium
RTTDEDM

SEQ ID NO: 1172039 - protein, 5 aa, Mycobacterium
RTTDV

SEQ ID NO: 1172040 - protein, 15 aa, Mycobacterium
RTTISNAYNRPDQLS

SEQ ID NO: 1172041 - protein, 7 aa, Mycobacterium
RTTNTSV

SEQ ID NO: 1172042 - protein, 8 aa, Mycobacterium
RTTPAQRQ

SEQ ID NO: 1172043 - protein, 5 aa, Mycobacterium
RTTRE

SEQ ID NO: 1172044 - protein, 12 aa, Mycobacterium
RTTSEGVLPGLF

SEQ ID NO: 1172045 - protein, 6 aa, Mycobacterium
RTTSVG

SEQ ID NO: 1172046 - protein, 6 aa, Mycobacterium
RTTTDI

SEQ ID NO: 1172047 - protein, 4 aa, Mycobacterium
RTTV

SEQ ID NO: 1172048 - protein, 8 aa, Mycobacterium
RTTYPGKA

SEQ ID NO: 1172049 - protein, 9 aa, Mycobacterium
RTVAPGPLH

SEQ ID NO: 1172050 - protein, 12 aa, Mycobacterium
RTVAPGSEPATI

SEQ ID NO: 1172051 - protein, 29 aa, Mycobacterium
RTVEGAESTLPGTIDDTAERVTAAGGKGI

SEQ ID NO: 1172052 - protein, 9 aa, Mycobacterium
RTVNPPGPL

SEQ ID NO: 1172053 - protein, 14 aa, Mycobacterium
RTVPQGEQPTPSGW

SEQ ID NO: 1172054 - protein, 6 aa, Mycobacterium
RTVSTG

SEQ ID NO: 1172055 - protein, 13 aa, Mycobacterium
RTWQPDSPPITAA

SEQ ID NO: 1172056 - protein, 7 aa, Mycobacterium
RTYPAPA

SEQ ID NO: 1172057 - protein, 6 aa, Mycobacterium
RTYPKT

SEQ ID NO: 1172058 - protein, 5 aa, Mycobacterium
RVAAG

SEQ ID NO: 1172059 - protein, 8 aa, Mycobacterium
RVAAGGNP

SEQ ID NO: 1172060 - protein, 9 aa, Mycobacterium
RVADTAARQ

SEQ ID NO: 1172061 - protein, 10 aa, Mycobacterium
RVAEEGPAAS

SEQ ID NO: 1172062 - protein, 10 aa, Mycobacterium
RVAGAADAQE

SEQ ID NO: 1172063 - protein, 9 aa, Mycobacterium
RVANDGEPL

SEQ ID NO: 1172064 - protein, 8 aa, Mycobacterium
RVANPGDD

SEQ ID NO: 1172065 - protein, 6 aa, Mycobacterium
RVAPAT

SEQ ID NO: 1172066 - protein, 9 aa, Mycobacterium
RVASSDEIS

SEQ ID NO: 1172067 - protein, 7 aa, Mycobacterium
RVDGERG

SEQ ID NO: 1172068 - protein, 7 aa, Mycobacterium
RVDGTDA

SEQ ID NO: 1172069 - protein, 15 aa, Mycobacterium
RVDPDYPDPQRAVSE

SEQ ID NO: 1172070 - protein, 9 aa, Mycobacterium
RVDSPPNDL

SEQ ID NO: 1172071 - protein, 8 aa, Mycobacterium
RVEAGGES

SEQ ID NO: 1172072 - protein, 4 aa, Mycobacterium
RVED

SEQ ID NO: 1172073 - protein, 5 aa, Mycobacterium
RVEGE

SEQ ID NO: 1172074 - protein, 5 aa, Mycobacterium
RVEPE

SEQ ID NO: 1172075 - protein, 6 aa, Mycobacterium
RVEPRD

SEQ ID NO: 1172076 - protein, 4 aa, Mycobacterium
RVEQ

SEQ ID NO: 1172077 - protein, 10 aa, Mycobacterium
RVERKTKESD

SEQ ID NO: 1172078 - protein, 6 aa, Mycobacterium
RVESGR

SEQ ID NO: 1172079 - protein, 6 aa, Mycobacterium
RVETYT

SEQ ID NO: 1172080 - protein, 8 aa, Mycobacterium
RVGADPAR

SEQ ID NO: 1172081 - protein, 7 aa, Mycobacterium
RVGEEGR

SEQ ID NO: 1172082 - protein, 6 aa, Mycobacterium
RVGGAA

SEQ ID NO: 1172083 - protein, 9 aa, Mycobacterium
RVGGQGGDL

SEQ ID NO: 1172084 - protein, 17 aa, Mycobacterium
RVGHTRSPKPPAPPEAT

SEQ ID NO: 1172085 - protein, 4 aa, Mycobacterium
RVNA

SEQ ID NO: 1172086 - protein, 6 aa, Mycobacterium
RVNGRP

SEQ ID NO: 1172087 - protein, 8 aa, Mycobacterium
RVNKNGLP

SEQ ID NO: 1172088 - protein, 5 aa, Mycobacterium
RVPDA

SEQ ID NO: 1172089 - protein, 11 aa, Mycobacterium
RVPDGEPGDRA

SEQ ID NO: 1172090 - protein, 7 aa, Mycobacterium
RVPNGDR

SEQ ID NO: 1172091 - protein, 4 aa, Mycobacterium
RVPP

SEQ ID NO: 1172092 - protein, 8 aa, Mycobacterium
RVPPNDGG

SEQ ID NO: 1172093 - protein, 9 aa, Mycobacterium
RVPQKRPDY

SEQ ID NO: 1172094 - protein, 14 aa, Mycobacterium
RVPSDRERDQLSRT

SEQ ID NO: 1172095 - protein, 4 aa, Mycobacterium
RVQA

SEQ ID NO: 1172096 - protein, 5 aa, Mycobacterium
RVRPG

SEQ ID NO: 1172097 - protein, 4 aa, Mycobacterium
RVRT

SEQ ID NO: 1172098 - protein, 10 aa, Mycobacterium
RVSGPGLEGE

SEQ ID NO: 1172099 - protein, 8 aa, Mycobacterium
RVSKNDPR

SEQ ID NO: 1172100 - protein, 4 aa, Mycobacterium
RVSP

SEQ ID NO: 1172101 - protein, 11 aa, Mycobacterium
RVSSKKRDDLQ

SEQ ID NO: 1172102 - protein, 10 aa, Mycobacterium
RVSSPQGRFA

SEQ ID NO: 1172103 - protein, 27 aa, Mycobacterium
RVSTTIPVGKGPNGISYSPRPPAAGAS

SEQ ID NO: 1172104 - protein, 4 aa, Mycobacterium
RVTA

SEQ ID NO: 1172105 - protein, 5 aa, Mycobacterium
RVTAE

SEQ ID NO: 1172106 - protein, 6 aa, Mycobacterium
RVTGTG

SEQ ID NO: 1172107 - protein, 4 aa, Mycobacterium
RVTP

SEQ ID NO: 1172108 - protein, 5 aa, Mycobacterium
RVTRD

SEQ ID NO: 1172109 - protein, 12 aa, Mycobacterium
RVTSGSSDPVVS

SEQ ID NO: 1172110 - protein, 10 aa, Mycobacterium
RWDDDENGPH

SEQ ID NO: 1172111 - protein, 6 aa, Mycobacterium
RWGDEN

SEQ ID NO: 1172112 - protein, 7 aa, Mycobacterium
RWGDPVP

SEQ ID NO: 1172113 - protein, 7 aa, Mycobacterium
RWNRSGE

SEQ ID NO: 1172114 - protein, 4 aa, Mycobacterium
RWNT

SEQ ID NO: 1172115 - protein, 13 aa, Mycobacterium
RWPEGGNGTARPS

SEQ ID NO: 1172116 - protein, 5 aa, Mycobacterium
RYAGQ

SEQ ID NO: 1172117 - protein, 8 aa, Mycobacterium
RYDKANSW

SEQ ID NO: 1172118 - protein, 10 aa, Mycobacterium
RYDPGGGGIN

SEQ ID NO: 1172119 - protein, 4 aa, Mycobacterium
RYDS

SEQ ID NO: 1172120 - protein, 6 aa, Mycobacterium
RYEASG

SEQ ID NO: 1172121 - protein, 6 aa, Mycobacterium
RYEGRA

SEQ ID NO: 1172122 - protein, 6 aa, Mycobacterium
RYEKGQ

SEQ ID NO: 1172123 - protein, 9 aa, Mycobacterium
RYEPPSPVQ

SEQ ID NO: 1172124 - protein, 8 aa, Mycobacterium
RYEPTGPH

SEQ ID NO: 1172125 - protein, 7 aa, Mycobacterium
RYESARG

SEQ ID NO: 1172126 - protein, 10 aa, Mycobacterium
RYGDTAGDFP

SEQ ID NO: 1172127 - protein, 9 aa, Mycobacterium
RYGGNPKRA

SEQ ID NO: 1172128 - protein, 6 aa, Mycobacterium
RYGGRD

SEQ ID NO: 1172129 - protein, 17 aa, Mycobacterium
RYGKRGANKAANTDSAD

SEQ ID NO: 1172130 - protein, 6 aa, Mycobacterium
RYGPVY

SEQ ID NO: 1172131 - protein, 11 aa, Mycobacterium
RYGRGGQEVTA

SEQ ID NO: 1172132 - protein, 7 aa, Mycobacterium
RYGSEEP

SEQ ID NO: 1172133 - protein, 9 aa, Mycobacterium
RYGSTSDKA

SEQ ID NO: 1172134 - protein, 7 aa, Mycobacterium
RYKGQRV

SEQ ID NO: 1172135 - protein, 11 aa, Mycobacterium
RYPAGGVSTQA

SEQ ID NO: 1172136 - protein, 5 aa, Mycobacterium
RYPDQ

SEQ ID NO: 1172137 - protein, 11 aa, Mycobacterium
RYPGAQPTVTD

SEQ ID NO: 1172138 - protein, 4 aa, Mycobacterium
RYPI

SEQ ID NO: 1172139 - protein, 13 aa, Mycobacterium
RYPNQLSGGQRQR

SEQ ID NO: 1172140 - protein, 7 aa, Mycobacterium
RYPQSNG

SEQ ID NO: 1172141 - protein, 7 aa, Mycobacterium
RYRRGAR

SEQ ID NO: 1172142 - protein, 9 aa, Mycobacterium
RYRTGAGWS

SEQ ID NO: 1172143 - protein, 7 aa, Mycobacterium
RYSARDG

SEQ ID NO: 1172144 - protein, 12 aa, Mycobacterium
RYSGRGNPALTE

SEQ ID NO: 1172145 - protein, 4 aa, Mycobacterium
RYTE

SEQ ID NO: 1172146 - protein, 5 aa, Mycobacterium
RYTEL

SEQ ID NO: 1172147 - protein, 10 aa, Mycobacterium
RYTQPTGSVE

SEQ ID NO: 1172148 - protein, 23 aa, Mycobacterium
RYTVGDPLDPATRIGPSASASQF

SEQ ID NO: 1172149 - protein, 4 aa, Mycobacterium
SAAA

SEQ ID NO: 1172150 - protein, 6 aa, Mycobacterium
SAAADA

SEQ ID NO: 1172151 - protein, 7 aa, Mycobacterium
SAAAGAV

SEQ ID NO: 1172152 - protein, 5 aa, Mycobacterium
SAAAP

SEQ ID NO: 1172153 - protein, 5 aa, Mycobacterium
SAAAR

SEQ ID NO: 1172154 - protein, 6 aa, Mycobacterium
SAAARG

SEQ ID NO: 1172155 - protein, 6 aa, Mycobacterium
SAAASR

SEQ ID NO: 1172156 - protein, 4 aa, Mycobacterium
SAAD

SEQ ID NO: 1172157 - protein, 8 aa, Mycobacterium
SAADKPHE

SEQ ID NO: 1172158 - protein, 15 aa, Mycobacterium
SAADNSIDATAARDF

SEQ ID NO: 1172159 - protein, 8 aa, Mycobacterium
SAAEQAAA

SEQ ID NO: 1172160 - protein, 16 aa, Mycobacterium
SAAERDRRLADWAREN

SEQ ID NO: 1172161 - protein, 9 aa, Mycobacterium
SAAETGGRT

SEQ ID NO: 1172162 - protein, 7 aa, Mycobacterium
SAAFSAE

SEQ ID NO: 1172163 - protein, 8 aa, Mycobacterium
SAAFTGAR

SEQ ID NO: 1172164 - protein, 5 aa, Mycobacterium
SAAGA

SEQ ID NO: 1172165 - protein, 15 aa, Mycobacterium
SAAGADYGDADDAEL

SEQ ID NO: 1172166 - protein, 7 aa, Mycobacterium
SAAGGLR

SEQ ID NO: 1172167 - protein, 8 aa, Mycobacterium
SAAGHDTY

SEQ ID NO: 1172168 - protein, 20 aa, Mycobacterium
SAAGQQGAPRQGHYSATKGG

SEQ ID NO: 1172169 - protein, 7 aa, Mycobacterium
SAAGRMG

SEQ ID NO: 1172170 - protein, 12 aa, Mycobacterium
SAAGRTPGRDGG

SEQ ID NO: 1172171 - protein, 7 aa, Mycobacterium
SAAGTGA

SEQ ID NO: 1172172 - protein, 7 aa, Mycobacterium
SAAGTPL

SEQ ID NO: 1172173 - protein, 12 aa, Mycobacterium
SAAHAESRHAET

SEQ ID NO: 1172174 - protein, 21 aa, Mycobacterium
SAAKAGQHVRTAGEDVTAGTT

SEQ ID NO: 1172175 - protein, 14 aa, Mycobacterium
SAAKAHAERRYPHK

SEQ ID NO: 1172176 - protein, 9 aa, Mycobacterium
SAAKATIGR

SEQ ID NO: 1172177 - protein, 5 aa, Mycobacterium
SAALG

SEQ ID NO: 1172178 - protein, 6 aa, Mycobacterium
SAANPH

SEQ ID NO: 1172179 - protein, 7 aa, Mycobacterium
SAAPDDE

SEQ ID NO: 1172180 - protein, 10 aa, Mycobacterium
SAAPGAGGEP

SEQ ID NO: 1172181 - protein, 7 aa, Mycobacterium
SAAPRPV

SEQ ID NO: 1172182 - protein, 8 aa, Mycobacterium
SAAPYGSA

SEQ ID NO: 1172183 - protein, 9 aa, Mycobacterium
SAAQPDSPF

SEQ ID NO: 1172184 - protein, 4 aa, Mycobacterium
SAAR

SEQ ID NO: 1172185 - protein, 15 aa, Mycobacterium
SAARGGGAQLRSPAQ

SEQ ID NO: 1172186 - protein, 9 aa, Mycobacterium
SAARGTGLA

SEQ ID NO: 1172187 - protein, 8 aa, Mycobacterium
SAARRRET

SEQ ID NO: 1172188 - protein, 6 aa, Mycobacterium
SAASSA

SEQ ID NO: 1172189 - protein, 6 aa, Mycobacterium
SAATRG

SEQ ID NO: 1172190 - protein, 5 aa, Mycobacterium
SAAVP

SEQ ID NO: 1172191 - protein, 7 aa, Mycobacterium
SACGSTG

SEQ ID NO: 1172192 - protein, 9 aa, Mycobacterium
SADADPGAL

SEQ ID NO: 1172193 - protein, 10 aa, Mycobacterium
SADAEPETVA

SEQ ID NO: 1172194 - protein, 5 aa, Mycobacterium
SADAP

SEQ ID NO: 1172195 - protein, 8 aa, Mycobacterium
SADDLPRG

SEQ ID NO: 1172196 - protein, 8 aa, Mycobacterium
SADDLQSV

SEQ ID NO: 1172197 - protein, 10 aa, Mycobacterium
SADDPRAAGL

SEQ ID NO: 1172198 - protein, 8 aa, Mycobacterium
SADEPAEQ

SEQ ID NO: 1172199 - protein, 9 aa, Mycobacterium
SADEPVPQR

SEQ ID NO: 1172200 - protein, 8 aa, Mycobacterium
SADESRAL

SEQ ID NO: 1172201 - protein, 8 aa, Mycobacterium
SADESSVQ

SEQ ID NO: 1172202 - protein, 4 aa, Mycobacterium
SADF

SEQ ID NO: 1172203 - protein, 7 aa, Mycobacterium
SADGDGK

SEQ ID NO: 1172204 - protein, 8 aa, Mycobacterium
SADGKEIA

SEQ ID NO: 1172205 - protein, 8 aa, Mycobacterium
SADGQRRL

SEQ ID NO: 1172206 - protein, 8 aa, Mycobacterium
SADGSDLA

SEQ ID NO: 1172207 - protein, 20 aa, Mycobacterium
SADGVQVTETPTSNGGDEAA

SEQ ID NO: 1172208 - protein, 18 aa, Mycobacterium
SADGYPEGQPAAGIQPGD

SEQ ID NO: 1172209 - protein, 8 aa, Mycobacterium
SADIPDYP

SEQ ID NO: 1172210 - protein, 7 aa, Mycobacterium
SADNGRA

SEQ ID NO: 1172211 - protein, 19 aa, Mycobacterium
SADNVREAEDELMRLCGVP

SEQ ID NO: 1172212 - protein, 7 aa, Mycobacterium
SADPDWA

SEQ ID NO: 1172213 - protein, 7 aa, Mycobacterium
SADPEDA

SEQ ID NO: 1172214 - protein, 8 aa, Mycobacterium
SADPERTA

SEQ ID NO: 1172215 - protein, 8 aa, Mycobacterium
SADPGGPT

SEQ ID NO: 1172216 - protein, 7 aa, Mycobacterium
SADPNPA

SEQ ID NO: 1172217 - protein, 7 aa, Mycobacterium
SADQQAT

SEQ ID NO: 1172218 - protein, 8 aa, Mycobacterium
SADRGADY

SEQ ID NO: 1172219 - protein, 7 aa, Mycobacterium
SADRPDV

SEQ ID NO: 1172220 - protein, 8 aa, Mycobacterium
SADRPGTM

SEQ ID NO: 1172221 - protein, 9 aa, Mycobacterium
SADRPGWRG

SEQ ID NO: 1172222 - protein, 6 aa, Mycobacterium
SADSAA

SEQ ID NO: 1172223 - protein, 7 aa, Mycobacterium
SADTARR

SEQ ID NO: 1172224 - protein, 4 aa, Mycobacterium
SAEA

SEQ ID NO: 1172225 - protein, 8 aa, Mycobacterium
SAEAEAKA

SEQ ID NO: 1172226 - protein, 8 aa, Mycobacterium
SAEARQRS

SEQ ID NO: 1172227 - protein, 8 aa, Mycobacterium
SAEDTRKV

SEQ ID NO: 1172228 - protein, 9 aa, Mycobacterium
SAEESERVD

SEQ ID NO: 1172229 - protein, 10 aa, Mycobacterium
SAEGDRNGAV

SEQ ID NO: 1172230 - protein, 6 aa, Mycobacterium
SAEGRE

SEQ ID NO: 1172231 - protein, 6 aa, Mycobacterium
SAEGTT

SEQ ID NO: 1172232 - protein, 8 aa, Mycobacterium
SAEHATYS

SEQ ID NO: 1172233 - protein, 20 aa, Mycobacterium
SAEHPDAEEQRELEARAAGL

SEQ ID NO: 1172234 - protein, 7 aa, Mycobacterium
SAEHPRL

SEQ ID NO: 1172235 - protein, 7 aa, Mycobacterium
SAEHTDH

SEQ ID NO: 1172236 - protein, 7 aa, Mycobacterium
SAEIRED

SEQ ID NO: 1172237 - protein, 7 aa, Mycobacterium
SAENQPI

SEQ ID NO: 1172238 - protein, 4 aa, Mycobacterium
SAEP

SEQ ID NO: 1172239 - protein, 6 aa, Mycobacterium
SAEQDL

SEQ ID NO: 1172240 - protein, 7 aa, Mycobacterium
SAEREDT

SEQ ID NO: 1172241 - protein, 8 aa, Mycobacterium
SAERGRPI

SEQ ID NO: 1172242 - protein, 6 aa, Mycobacterium
SAESAA

SEQ ID NO: 1172243 - protein, 6 aa, Mycobacterium
SAESEH

SEQ ID NO: 1172244 - protein, 10 aa, Mycobacterium
SAETATLTGE

SEQ ID NO: 1172245 - protein, 8 aa, Mycobacterium
SAETDNRA

SEQ ID NO: 1172246 - protein, 5 aa, Mycobacterium
SAETY

SEQ ID NO: 1172247 - protein, 8 aa, Mycobacterium
SAFEGEPS

SEQ ID NO: 1172248 - protein, 8 aa, Mycobacterium
SAFGGGGH

SEQ ID NO: 1172249 - protein, 12 aa, Mycobacterium
SAGAALGLPPPA

SEQ ID NO: 1172250 - protein, 9 aa, Mycobacterium
SAGATTTAG

SEQ ID NO: 1172251 - protein, 5 aa, Mycobacterium
SAGCP

SEQ ID NO: 1172252 - protein, 4 aa, Mycobacterium
SAGD

SEQ ID NO: 1172253 - protein, 9 aa, Mycobacterium
SAGDGAVRR

SEQ ID NO: 1172254 - protein, 9 aa, Mycobacterium
SAGEATRDA

SEQ ID NO: 1172255 - protein, 7 aa, Mycobacterium
SAGERAD

SEQ ID NO: 1172256 - protein, 8 aa, Mycobacterium
SAGETQGP

SEQ ID NO: 1172257 - protein, 14 aa, Mycobacterium
SAGFRRAGKAPLSR

SEQ ID NO: 1172258 - protein, 6 aa, Mycobacterium
SAGGAA

SEQ ID NO: 1172259 - protein, 6 aa, Mycobacterium
SAGGAR

SEQ ID NO: 1172260 - protein, 18 aa, Mycobacterium
SAGGEAKAYSASIDDTAA

SEQ ID NO: 1172261 - protein, 11 aa, Mycobacterium
SAGGNVKEMAD

SEQ ID NO: 1172262 - protein, 8 aa, Mycobacterium
SAGGRRTD

SEQ ID NO: 1172263 - protein, 10 aa, Mycobacterium
SAGGSETIGP

SEQ ID NO: 1172264 - protein, 11 aa, Mycobacterium
SAGHGGISGRY

SEQ ID NO: 1172265 - protein, 7 aa, Mycobacterium
SAGITDE

SEQ ID NO: 1172266 - protein, 4 aa, Mycobacterium
SAGM

SEQ ID NO: 1172267 - protein, 10 aa, Mycobacterium
SAGNSNGDDE

SEQ ID NO: 1172268 - protein, 7 aa, Mycobacterium
SAGPAFP

SEQ ID NO: 1172269 - protein, 5 aa, Mycobacterium
SAGPL

SEQ ID NO: 1172270 - protein, 9 aa, Mycobacterium
SAGPPPHFD

SEQ ID NO: 1172271 - protein, 7 aa, Mycobacterium
SAGPQSW

SEQ ID NO: 1172272 - protein, 7 aa, Mycobacterium
SAGPSLS

SEQ ID NO: 1172273 - protein, 21 aa, Mycobacterium
SAGPVSEPLPGGRAPDATGLS

SEQ ID NO: 1172274 - protein, 14 aa, Mycobacterium
SAGQPSAGAPTAVR

SEQ ID NO: 1172275 - protein, 8 aa, Mycobacterium
SAGSGPET

SEQ ID NO: 1172276 - protein, 15 aa, Mycobacterium
SAGSHEKAAAATKAG

SEQ ID NO: 1172277 - protein, 7 aa, Mycobacterium
SAGSPAP

SEQ ID NO: 1172278 - protein, 18 aa, Mycobacterium
SAGSPHPAREQVAKNMST

SEQ ID NO: 1172279 - protein, 8 aa, Mycobacterium
SAGSQRNI

SEQ ID NO: 1172280 - protein, 9 aa, Mycobacterium
SAGTADDPA

SEQ ID NO: 1172281 - protein, 5 aa, Mycobacterium
SAGTD

SEQ ID NO: 1172282 - protein, 6 aa, Mycobacterium
SAGTDE

SEQ ID NO: 1172283 - protein, 7 aa, Mycobacterium
SAGTSGV

SEQ ID NO: 1172284 - protein, 4 aa, Mycobacterium
SAGV

SEQ ID NO: 1172285 - protein, 7 aa, Mycobacterium
SAGVSLP

SEQ ID NO: 1172286 - protein, 5 aa, Mycobacterium
SAHAD

SEQ ID NO: 1172287 - protein, 12 aa, Mycobacterium
SAHGTNAASAAL

SEQ ID NO: 1172288 - protein, 7 aa, Mycobacterium
SAHPSAA

SEQ ID NO: 1172289 - protein, 9 aa, Mycobacterium
SAIPGSDLD

SEQ ID NO: 1172290 - protein, 5 aa, Mycobacterium
SAIPW

SEQ ID NO: 1172291 - protein, 14 aa, Mycobacterium
SAISGTYHGKGELG

SEQ ID NO: 1172292 - protein, 8 aa, Mycobacterium
SAKDPGFS

SEQ ID NO: 1172293 - protein, 4 aa, Mycobacterium
SAKG

SEQ ID NO: 1172294 - protein, 8 aa, Mycobacterium
SAKKNEPE

SEQ ID NO: 1172295 - protein, 9 aa, Mycobacterium
SAKLGEKAT

SEQ ID NO: 1172296 - protein, 11 aa, Mycobacterium
SAKLPASAPLS

SEQ ID NO: 1172297 - protein, 13 aa, Mycobacterium
SALASRSDNTPFE

SEQ ID NO: 1172298 - protein, 5 aa, Mycobacterium
SALDP

SEQ ID NO: 1172299 - protein, 7 aa, Mycobacterium
SALDPDA

SEQ ID NO: 1172300 - protein, 15 aa, Mycobacterium
SALGASGSRRGAGTI

SEQ ID NO: 1172301 - protein, 17 aa, Mycobacterium
SALPEASVAGGSSGINS

SEQ ID NO: 1172302 - protein, 8 aa, Mycobacterium
SALPGRRR

SEQ ID NO: 1172303 - protein, 27 aa, Mycobacterium
SALPNGPKVSAGGSLSPRGDWRAPSDM

SEQ ID NO: 1172304 - protein, 15 aa, Mycobacterium
SALPPDYTGPRSAGT

SEQ ID NO: 1172305 - protein, 9 aa, Mycobacterium
SALRGASSA

SEQ ID NO: 1172306 - protein, 8 aa, Mycobacterium
SALRSGAV

SEQ ID NO: 1172307 - protein, 13 aa, Mycobacterium
SANAGQAAASVHP

SEQ ID NO: 1172308 - protein, 10 aa, Mycobacterium
SANGADPSDL

SEQ ID NO: 1172309 - protein, 7 aa, Mycobacterium
SANIGAD

SEQ ID NO: 1172310 - protein, 8 aa, Mycobacterium
SANPDRIT

SEQ ID NO: 1172311 - protein, 6 aa, Mycobacterium
SANRDE

SEQ ID NO: 1172312 - protein, 13 aa, Mycobacterium
SANRDERQYPDGE

SEQ ID NO: 1172313 - protein, 11 aa, Mycobacterium
SANRDPDAWTD

SEQ ID NO: 1172314 - protein, 8 aa, Mycobacterium
SANRDPSF

SEQ ID NO: 1172315 - protein, 17 aa, Mycobacterium
SANTDGGGAGRHHGGVS

SEQ ID NO: 1172316 - protein, 5 aa, Mycobacterium
SANTN

SEQ ID NO: 1172317 - protein, 7 aa, Mycobacterium
SAPAAPQ

SEQ ID NO: 1172318 - protein, 14 aa, Mycobacterium
SAPAGSGVSPGDRV

SEQ ID NO: 1172319 - protein, 15 aa, Mycobacterium
SAPAPDLADNPLPPL

SEQ ID NO: 1172320 - protein, 6 aa, Mycobacterium
SAPDGV

SEQ ID NO: 1172321 - protein, 7 aa, Mycobacterium
SAPDIAN

SEQ ID NO: 1172322 - protein, 12 aa, Mycobacterium
SAPDLQQARRAR

SEQ ID NO: 1172323 - protein, 6 aa, Mycobacterium
SAPDNQ

SEQ ID NO: 1172324 - protein, 10 aa, Mycobacterium
SAPDPQPGER

SEQ ID NO: 1172325 - protein, 8 aa, Mycobacterium
SAPDSRAI

SEQ ID NO: 1172326 - protein, 6 aa, Mycobacterium
SAPDTP

SEQ ID NO: 1172327 - protein, 6 aa, Mycobacterium
SAPEFD

SEQ ID NO: 1172328 - protein, 8 aa, Mycobacterium
SAPGFSDE

SEQ ID NO: 1172329 - protein, 8 aa, Mycobacterium
SAPGGRRE

SEQ ID NO: 1172330 - protein, 6 aa, Mycobacterium
SAPGMS

SEQ ID NO: 1172331 - protein, 27 aa, Mycobacterium
SAPGQSPAALGDTTEISAPTPMQPGRN

SEQ ID NO: 1172332 - protein, 7 aa, Mycobacterium
SAPGTGQ

SEQ ID NO: 1172333 - protein, 9 aa, Mycobacterium
SAPHPPAFP

SEQ ID NO: 1172334 - protein, 4 aa, Mycobacterium
SAPI

SEQ ID NO: 1172335 - protein, 17 aa, Mycobacterium
SAPKLGGSSLSGDTGRE

SEQ ID NO: 1172336 - protein, 7 aa, Mycobacterium
SAPLGRV

SEQ ID NO: 1172337 - protein, 5 aa, Mycobacterium
SAPLP

SEQ ID NO: 1172338 - protein, 5 aa, Mycobacterium
SAPLT

SEQ ID NO: 1172339 - protein, 4 aa, Mycobacterium
SAPR

SEQ ID NO: 1172340 - protein, 9 aa, Mycobacterium
SAPRPDEGQ

SEQ ID NO: 1172341 - protein, 8 aa, Mycobacterium
SAPRQPGA

SEQ ID NO: 1172342 - protein, 5 aa, Mycobacterium
SAPRS

SEQ ID NO: 1172343 - protein, 12 aa, Mycobacterium
SAPSARGQQSSV

SEQ ID NO: 1172344 - protein, 6 aa, Mycobacterium
SAPTEA

SEQ ID NO: 1172345 - protein, 6 aa, Mycobacterium
SAPTVA

SEQ ID NO: 1172346 - protein, 6 aa, Mycobacterium
SAPVEE

SEQ ID NO: 1172347 - protein, 12 aa, Mycobacterium
SAPVGADSPHAD

SEQ ID NO: 1172348 - protein, 10 aa, Mycobacterium
SAPVRDGRGG

SEQ ID NO: 1172349 - protein, 6 aa, Mycobacterium
SAPYDR

SEQ ID NO: 1172350 - protein, 17 aa, Mycobacterium
SAQGVGDYGTHAGPLDV

SEQ ID NO: 1172351 - protein, 6 aa, Mycobacterium
SAQPDV

SEQ ID NO: 1172352 - protein, 7 aa, Mycobacterium
SAQQHGQ

SEQ ID NO: 1172353 - protein, 9 aa, Mycobacterium
SAQRSLREA

SEQ ID NO: 1172354 - protein, 9 aa, Mycobacterium
SAQTQVEQQ

SEQ ID NO: 1172355 - protein, 5 aa, Mycobacterium
SAQVG

SEQ ID NO: 1172356 - protein, 8 aa, Mycobacterium
SARAAGVR

SEQ ID NO: 1172357 - protein, 12 aa, Mycobacterium
SARAATDPNPEL

SEQ ID NO: 1172358 - protein, 10 aa, Mycobacterium
SARADEAERI

SEQ ID NO: 1172359 - protein, 19 aa, Mycobacterium
SARAERRAIPGKGLTGAGY

SEQ ID NO: 1172360 - protein, 27 aa, Mycobacterium
SARARRSAEGAKARSRAASKAKGLGTN

SEQ ID NO: 1172361 - protein, 8 aa, Mycobacterium
SARARTQL

SEQ ID NO: 1172362 - protein, 7 aa, Mycobacterium
SAREAPY

SEQ ID NO: 1172363 - protein, 4 aa, Mycobacterium
SARF

SEQ ID NO: 1172364 - protein, 5 aa, Mycobacterium
SARGI

SEQ ID NO: 1172365 - protein, 5 aa, Mycobacterium
SARHT

SEQ ID NO: 1172366 - protein, 8 aa, Mycobacterium
SARKPTPR

SEQ ID NO: 1172367 - protein, 7 aa, Mycobacterium
SARKRGL

SEQ ID NO: 1172368 - protein, 9 aa, Mycobacterium
SARPAEQAR

SEQ ID NO: 1172369 - protein, 8 aa, Mycobacterium
SARPDGVD

SEQ ID NO: 1172370 - protein, 14 aa, Mycobacterium
SARPKRAGKESAVG

SEQ ID NO: 1172371 - protein, 8 aa, Mycobacterium
SARRDEQF

SEQ ID NO: 1172372 - protein, 25 aa, Mycobacterium
SARRGTDPATAPARDTTLELLAKEL

SEQ ID NO: 1172373 - protein, 11 aa, Mycobacterium
SARRPTPGTVA

SEQ ID NO: 1172374 - protein, 6 aa, Mycobacterium
SARSGV

SEQ ID NO: 1172375 - protein, 7 aa, Mycobacterium
SARTARE

SEQ ID NO: 1172376 - protein, 17 aa, Mycobacterium
SARTTSADDPSDPRLNG

SEQ ID NO: 1172377 - protein, 4 aa, Mycobacterium
SARY

SEQ ID NO: 1172378 - protein, 10 aa, Mycobacterium
SASADPTALA

SEQ ID NO: 1172379 - protein, 13 aa, Mycobacterium
SASAVSQRAGRDG

SEQ ID NO: 1172380 - protein, 8 aa, Mycobacterium
SASDTESA

SEQ ID NO: 1172381 - protein, 15 aa, Mycobacterium
SASGSSVAKGESLRD

SEQ ID NO: 1172382 - protein, 8 aa, Mycobacterium
SASPESTV

SEQ ID NO: 1172383 - protein, 8 aa, Mycobacterium
SASQNGKR

SEQ ID NO: 1172384 - protein, 6 aa, Mycobacterium
SASRIE

SEQ ID NO: 1172385 - protein, 9 aa, Mycobacterium
SASRPPEIS

SEQ ID NO: 1172386 - protein, 8 aa, Mycobacterium
SASSTIGT

SEQ ID NO: 1172387 - protein, 14 aa, Mycobacterium
SASTAAADFSGSDA

SEQ ID NO: 1172388 - protein, 6 aa, Mycobacterium
SASVTQ

SEQ ID NO: 1172389 - protein, 20 aa, Mycobacterium
SATATRALPGLGSDDTVPAA

SEQ ID NO: 1172390 - protein, 6 aa, Mycobacterium
SATDAK

SEQ ID NO: 1172391 - protein, 5 aa, Mycobacterium
SATDR

SEQ ID NO: 1172392 - protein, 8 aa, Mycobacterium
SATEAGAD

SEQ ID NO: 1172393 - protein, 9 aa, Mycobacterium
SATEKTPED

SEQ ID NO: 1172394 - protein, 12 aa, Mycobacterium
SATEPSGTVAGT

SEQ ID NO: 1172395 - protein, 5 aa, Mycobacterium
SATGA

SEQ ID NO: 1172396 - protein, 13 aa, Mycobacterium
SATGRYNITGSRY

SEQ ID NO: 1172397 - protein, 5 aa, Mycobacterium
SATGT

SEQ ID NO: 1172398 - protein, 10 aa, Mycobacterium
SATIDPESTP

SEQ ID NO: 1172399 - protein, 19 aa, Mycobacterium
SATIGSDRHYPEEAPARDV

SEQ ID NO: 1172400 - protein, 5 aa, Mycobacterium
SATKF

SEQ ID NO: 1172401 - protein, 26 aa, Mycobacterium
SATLDTTIGKTMGKKRYKSSTTTRNL

SEQ ID NO: 1172402 - protein, 5 aa, Mycobacterium
SATNW

SEQ ID NO: 1172403 - protein, 7 aa, Mycobacterium
SATPMGL

SEQ ID NO: 1172404 - protein, 9 aa, Mycobacterium
SATPPGTGV

SEQ ID NO: 1172405 - protein, 4 aa, Mycobacterium
SATR

SEQ ID NO: 1172406 - protein, 11 aa, Mycobacterium
SATRKIGTKSL

SEQ ID NO: 1172407 - protein, 6 aa, Mycobacterium
SATRPP

SEQ ID NO: 1172408 - protein, 4 aa, Mycobacterium
SATS

SEQ ID NO: 1172409 - protein, 8 aa, Mycobacterium
SATSMRSG

SEQ ID NO: 1172410 - protein, 12 aa, Mycobacterium
SATSPHPAGTEV

SEQ ID NO: 1172411 - protein, 9 aa, Mycobacterium
SATTDDEGR

SEQ ID NO: 1172412 - protein, 7 aa, Mycobacterium
SATTGEQ

SEQ ID NO: 1172413 - protein, 8 aa, Mycobacterium
SATTGRGL

SEQ ID NO: 1172414 - protein, 10 aa, Mycobacterium
SATVTTTGPA

SEQ ID NO: 1172415 - protein, 8 aa, Mycobacterium
SAVAPDRD

SEQ ID NO: 1172416 - protein, 5 aa, Mycobacterium
SAVAQ

SEQ ID NO: 1172417 - protein, 9 aa, Mycobacterium
SAVAQSADT

SEQ ID NO: 1172418 - protein, 6 aa, Mycobacterium
SAVDGE

SEQ ID NO: 1172419 - protein, 21 aa, Mycobacterium
SAVNQDGASSGQTVPNGPAQQ

SEQ ID NO: 1172420 - protein, 27 aa, Mycobacterium
SAVPPPVAAPTSSAGSVVGAPAPVPVS

SEQ ID NO: 1172421 - protein, 16 aa, Mycobacterium
SAVPPRKGTGRVPGRP

SEQ ID NO: 1172422 - protein, 5 aa, Mycobacterium
SAVRH

SEQ ID NO: 1172423 - protein, 5 aa, Mycobacterium
SAVSQ

SEQ ID NO: 1172424 - protein, 5 aa, Mycobacterium
SAVTG

SEQ ID NO: 1172425 - protein, 11 aa, Mycobacterium
SAWERGSRAIG

SEQ ID NO: 1172426 - protein, 12 aa, Mycobacterium
SAWPDPATAPRA

SEQ ID NO: 1172427 - protein, 13 aa, Mycobacterium
SAYADAAEARGAW

SEQ ID NO: 1172428 - protein, 5 aa, Mycobacterium
SAYVD

SEQ ID NO: 1172429 - protein, 14 aa, Mycobacterium
SCARGRFASGSSQA

SEQ ID NO: 1172430 - protein, 6 aa, Mycobacterium
SCDGDS

SEQ ID NO: 1172431 - protein, 7 aa, Mycobacterium
SCEEAGQ

SEQ ID NO: 1172432 - protein, 5 aa, Mycobacterium
SCPAP

SEQ ID NO: 1172433 - protein, 7 aa, Mycobacterium
SCPPGTT

SEQ ID NO: 1172434 - protein, 13 aa, Mycobacterium
SCRRDDGVGPAVA

SEQ ID NO: 1172435 - protein, 21 aa, Mycobacterium
SCSGADYAAAEPDPVAPHASG

SEQ ID NO: 1172436 - protein, 22 aa, Mycobacterium
SDAAPPDQHRPDSDAPQSAVRD

SEQ ID NO: 1172437 - protein, 11 aa, Mycobacterium
SDAASGGTDLR

SEQ ID NO: 1172438 - protein, 10 aa, Mycobacterium
SDADAGARHV

SEQ ID NO: 1172439 - protein, 7 aa, Mycobacterium
SDADARE

SEQ ID NO: 1172440 - protein, 8 aa, Mycobacterium
SDADPALS

SEQ ID NO: 1172441 - protein, 8 aa, Mycobacterium
SDAEAPHE

SEQ ID NO: 1172442 - protein, 5 aa, Mycobacterium
SDAED

SEQ ID NO: 1172443 - protein, 10 aa, Mycobacterium
SDAEPDWPQR

SEQ ID NO: 1172444 - protein, 8 aa, Mycobacterium
SDAFGGNT

SEQ ID NO: 1172445 - protein, 7 aa, Mycobacterium
SDAGEQR

SEQ ID NO: 1172446 - protein, 8 aa, Mycobacterium
SDAGSQYT

SEQ ID NO: 1172447 - protein, 7 aa, Mycobacterium
SDAPLTA

SEQ ID NO: 1172448 - protein, 5 aa, Mycobacterium
SDAQT

SEQ ID NO: 1172449 - protein, 9 aa, Mycobacterium
SDARRDGDE

SEQ ID NO: 1172450 - protein, 5 aa, Mycobacterium
SDATR

SEQ ID NO: 1172451 - protein, 7 aa, Mycobacterium
SDAVGGD

SEQ ID NO: 1172452 - protein, 5 aa, Mycobacterium
SDCTD

SEQ ID NO: 1172453 - protein, 9 aa, Mycobacterium
SDDADRPVE

SEQ ID NO: 1172454 - protein, 9 aa, Mycobacterium
SDDAGGAVE

SEQ ID NO: 1172455 - protein, 8 aa, Mycobacterium
SDDAGGHP

SEQ ID NO: 1172456 - protein, 5 aa, Mycobacterium
SDDAR

SEQ ID NO: 1172457 - protein, 9 aa, Mycobacterium
SDDDDRARL

SEQ ID NO: 1172458 - protein, 6 aa, Mycobacterium
SDDDPY

SEQ ID NO: 1172459 - protein, 6 aa, Mycobacterium
SDDEKK

SEQ ID NO: 1172460 - protein, 8 aa, Mycobacterium
SDDEPYAP

SEQ ID NO: 1172461 - protein, 8 aa, Mycobacterium
SDDGDTVA

SEQ ID NO: 1172462 - protein, 6 aa, Mycobacterium
SDDGED

SEQ ID NO: 1172463 - protein, 41 aa, Mycobacterium
SDDIRNDDGDNVVDPPEDWSEANRSDQLPRGEVGGGESLDE

SEQ ID NO: 1172464 - protein, 10 aa, Mycobacterium
SDDNGGFSRA

SEQ ID NO: 1172465 - protein, 7 aa, Mycobacterium
SDDPRFA

SEQ ID NO: 1172466 - protein, 12 aa, Mycobacterium
SDDRGAAGAEDA

SEQ ID NO: 1172467 - protein, 8 aa, Mycobacterium
SDDRNEGF

SEQ ID NO: 1172468 - protein, 7 aa, Mycobacterium
SDDTLSH

SEQ ID NO: 1172469 - protein, 6 aa, Mycobacterium
SDEEAL

SEQ ID NO: 1172470 - protein, 5 aa, Mycobacterium
SDEEV

SEQ ID NO: 1172471 - protein, 5 aa, Mycobacterium
SDEGP

SEQ ID NO: 1172472 - protein, 4 aa, Mycobacterium
SDEH

SEQ ID NO: 1172473 - protein, 5 aa, Mycobacterium
SDEIS

SEQ ID NO: 1172474 - protein, 4 aa, Mycobacterium
SDEK

SEQ ID NO: 1172475 - protein, 7 aa, Mycobacterium
SDEKGRR

SEQ ID NO: 1172476 - protein, 9 aa, Mycobacterium
SDELRSGGA

SEQ ID NO: 1172477 - protein, 8 aa, Mycobacterium
SDENSSYA

SEQ ID NO: 1172478 - protein, 9 aa, Mycobacterium
SDEPATPVV

SEQ ID NO: 1172479 - protein, 9 aa, Mycobacterium
SDEPDADAL

SEQ ID NO: 1172480 - protein, 5 aa, Mycobacterium
SDEPR

SEQ ID NO: 1172481 - protein, 7 aa, Mycobacterium
SDEQQDR

SEQ ID NO: 1172482 - protein, 6 aa, Mycobacterium
SDEQVT

SEQ ID NO: 1172483 - protein, 8 aa, Mycobacterium
SDERGLGL

SEQ ID NO: 1172484 - protein, 6 aa, Mycobacterium
SDERSL

SEQ ID NO: 1172485 - protein, 7 aa, Mycobacterium
SDESPRS

SEQ ID NO: 1172486 - protein, 7 aa, Mycobacterium
SDESRTL

SEQ ID NO: 1172487 - protein, 6 aa, Mycobacterium
SDGAGK

SEQ ID NO: 1172488 - protein, 8 aa, Mycobacterium
SDGAPAYI

SEQ ID NO: 1172489 - protein, 11 aa, Mycobacterium
SDGAPSDEPPR

SEQ ID NO: 1172490 - protein, 12 aa, Mycobacterium
SDGAYANASNQD

SEQ ID NO: 1172491 - protein, 14 aa, Mycobacterium
SDGDGDGRADAATG

SEQ ID NO: 1172492 - protein, 13 aa, Mycobacterium
SDGDLYGGTEPAR

SEQ ID NO: 1172493 - protein, 5 aa, Mycobacterium
SDGEI

SEQ ID NO: 1172494 - protein, 8 aa, Mycobacterium
SDGGALTA

SEQ ID NO: 1172495 - protein, 14 aa, Mycobacterium
SDGHSHQIGVVGTS

SEQ ID NO: 1172496 - protein, 10 aa, Mycobacterium
SDGLGKGEWA

SEQ ID NO: 1172497 - protein, 8 aa, Mycobacterium
SDGNPTRI

SEQ ID NO: 1172498 - protein, 14 aa, Mycobacterium
SDGPAGGGLTVGST

SEQ ID NO: 1172499 - protein, 7 aa, Mycobacterium
SDGPDSL

SEQ ID NO: 1172500 - protein, 7 aa, Mycobacterium
SDGPGWT

SEQ ID NO: 1172501 - protein, 6 aa, Mycobacterium
SDGRKE

SEQ ID NO: 1172502 - protein, 10 aa, Mycobacterium
SDGRPHPLPE

SEQ ID NO: 1172503 - protein, 8 aa, Mycobacterium
SDGSAHRG

SEQ ID NO: 1172504 - protein, 10 aa, Mycobacterium
SDGSEANYTY

SEQ ID NO: 1172505 - protein, 17 aa, Mycobacterium
SDGSGAHGMTAEGESAV

SEQ ID NO: 1172506 - protein, 9 aa, Mycobacterium
SDGSQLTGR

SEQ ID NO: 1172507 - protein, 8 aa, Mycobacterium
SDGSRNLH

SEQ ID NO: 1172508 - protein, 6 aa, Mycobacterium
SDGSTV

SEQ ID NO: 1172509 - protein, 23 aa, Mycobacterium
SDGTAGQYVGGSAAKAALLRLER

SEQ ID NO: 1172510 - protein, 5 aa, Mycobacterium
SDGTE

SEQ ID NO: 1172511 - protein, 5 aa, Mycobacterium
SDGTR

SEQ ID NO: 1172512 - protein, 10 aa, Mycobacterium
SDGTVGANKN

SEQ ID NO: 1172513 - protein, 5 aa, Mycobacterium
SDGVG

SEQ ID NO: 1172514 - protein, 17 aa, Mycobacterium
SDGVGAAAAKRLSRSGE

SEQ ID NO: 1172515 - protein, 8 aa, Mycobacterium
SDHPDQRR

SEQ ID NO: 1172516 - protein, 6 aa, Mycobacterium
SDHTEA

SEQ ID NO: 1172517 - protein, 21 aa, Mycobacterium
SDHTVTGRGRHPLPSGAAVQA

SEQ ID NO: 1172518 - protein, 17 aa, Mycobacterium
SDIPETMPDPDDDEEGC

SEQ ID NO: 1172519 - protein, 17 aa, Mycobacterium
SDKSGNDAVHKPGALDK

SEQ ID NO: 1172520 - protein, 5 aa, Mycobacterium
SDLPE

SEQ ID NO: 1172521 - protein, 6 aa, Mycobacterium
SDLPTA

SEQ ID NO: 1172522 - protein, 24 aa, Mycobacterium
SDLSRYGGGDNPTLDIFVDKALDK

SEQ ID NO: 1172523 - protein, 6 aa, Mycobacterium
SDMNET

SEQ ID NO: 1172524 - protein, 8 aa, Mycobacterium
SDNGGSHA

SEQ ID NO: 1172525 - protein, 19 aa, Mycobacterium
SDNGSVAGSSYDDGTRRTE

SEQ ID NO: 1172526 - protein, 7 aa, Mycobacterium
SDNPRFG

SEQ ID NO: 1172527 - protein, 8 aa, Mycobacterium
SDNPVPIT

SEQ ID NO: 1172528 - protein, 6 aa, Mycobacterium
SDNSAV

SEQ ID NO: 1172529 - protein, 4 aa, Mycobacterium
SDPA

SEQ ID NO: 1172530 - protein, 7 aa, Mycobacterium
SDPAHDP

SEQ ID NO: 1172531 - protein, 7 aa, Mycobacterium
SDPAPTV

SEQ ID NO: 1172532 - protein, 8 aa, Mycobacterium
SDPASVAA

SEQ ID NO: 1172533 - protein, 7 aa, Mycobacterium
SDPATRL

SEQ ID NO: 1172534 - protein, 8 aa, Mycobacterium
SDPDDAVR

SEQ ID NO: 1172535 - protein, 9 aa, Mycobacterium
SDPDDPQTT

SEQ ID NO: 1172536 - protein, 8 aa, Mycobacterium
SDPDEAVE

SEQ ID NO: 1172537 - protein, 8 aa, Mycobacterium
SDPDHPAV

SEQ ID NO: 1172538 - protein, 6 aa, Mycobacterium
SDPEKR

SEQ ID NO: 1172539 - protein, 14 aa, Mycobacterium
SDPELSRDEIEHSF

SEQ ID NO: 1172540 - protein, 13 aa, Mycobacterium
SDPFDGATPSGAS

SEQ ID NO: 1172541 - protein, 6 aa, Mycobacterium
SDPGVH

SEQ ID NO: 1172542 - protein, 6 aa, Mycobacterium
SDPITG

SEQ ID NO: 1172543 - protein, 5 aa, Mycobacterium
SDPIV

SEQ ID NO: 1172544 - protein, 10 aa, Mycobacterium
SDPPTAEEVS

SEQ ID NO: 1172545 - protein, 14 aa, Mycobacterium
SDPPVVTDGPYTEA

SEQ ID NO: 1172546 - protein, 14 aa, Mycobacterium
SDPRISAEEGQAYR

SEQ ID NO: 1172547 - protein, 5 aa, Mycobacterium
SDPSV

SEQ ID NO: 1172548 - protein, 9 aa, Mycobacterium
SDPTVRGAG

SEQ ID NO: 1172549 - protein, 5 aa, Mycobacterium
SDQDD

SEQ ID NO: 1172550 - protein, 12 aa, Mycobacterium
SDQGLADRQRVP

SEQ ID NO: 1172551 - protein, 6 aa, Mycobacterium
SDQLTA

SEQ ID NO: 1172552 - protein, 8 aa, Mycobacterium
SDRALGER

SEQ ID NO: 1172553 - protein, 19 aa, Mycobacterium
SDREEADAPKLPSIRPPGE

SEQ ID NO: 1172554 - protein, 8 aa, Mycobacterium
SDRERDGL

SEQ ID NO: 1172555 - protein, 13 aa, Mycobacterium
SDREVQKLGGPVD

SEQ ID NO: 1172556 - protein, 7 aa, Mycobacterium
SDRGTQY

SEQ ID NO: 1172557 - protein, 12 aa, Mycobacterium
SDRHDDAAERLQ

SEQ ID NO: 1172558 - protein, 4 aa, Mycobacterium
SDRR

SEQ ID NO: 1172559 - protein, 5 aa, Mycobacterium
SDRSL

SEQ ID NO: 1172560 - protein, 8 aa, Mycobacterium
SDRTPWYD

SEQ ID NO: 1172561 - protein, 12 aa, Mycobacterium
SDRTTENPEKGR

SEQ ID NO: 1172562 - protein, 6 aa, Mycobacterium
SDSERC

SEQ ID NO: 1172563 - protein, 11 aa, Mycobacterium
SDSGEGDTYAT

SEQ ID NO: 1172564 - protein, 8 aa, Mycobacterium
SDSGRLDG

SEQ ID NO: 1172565 - protein, 6 aa, Mycobacterium
SDSGYA

SEQ ID NO: 1172566 - protein, 10 aa, Mycobacterium
SDSNRIDDPL

SEQ ID NO: 1172567 - protein, 8 aa, Mycobacterium
SDSPVTDM

SEQ ID NO: 1172568 - protein, 15 aa, Mycobacterium
SDSRTDAHGNPLSEE

SEQ ID NO: 1172569 - protein, 8 aa, Mycobacterium
SDSSTNVA

SEQ ID NO: 1172570 - protein, 7 aa, Mycobacterium
SDSTSKL

SEQ ID NO: 1172571 - protein, 6 aa, Mycobacterium
SDTDAQ

SEQ ID NO: 1172572 - protein, 8 aa, Mycobacterium
SDTDHYRA

SEQ ID NO: 1172573 - protein, 5 aa, Mycobacterium
SDTKG

SEQ ID NO: 1172574 - protein, 4 aa, Mycobacterium
SDTL

SEQ ID NO: 1172575 - protein, 29 aa, Mycobacterium
SDTPASADALRAAEASLTARAEARQQQFG

SEQ ID NO: 1172576 - protein, 10 aa, Mycobacterium
SDTPDTARDT

SEQ ID NO: 1172577 - protein, 8 aa, Mycobacterium
SDTRPAAR

SEQ ID NO: 1172578 - protein, 8 aa, Mycobacterium
SDTSIGMG

SEQ ID NO: 1172579 - protein, 21 aa, Mycobacterium
SDTTTESDGGTPILESGEQAG

SEQ ID NO: 1172580 - protein, 11 aa, Mycobacterium
SDTVDGGGYPV

SEQ ID NO: 1172581 - protein, 12 aa, Mycobacterium
SDVAHDDSGRWG

SEQ ID NO: 1172582 - protein, 6 aa, Mycobacterium
SDVNDR

SEQ ID NO: 1172583 - protein, 6 aa, Mycobacterium
SDVNIG

SEQ ID NO: 1172584 - protein, 7 aa, Mycobacterium
SDVPGDP

SEQ ID NO: 1172585 - protein, 7 aa, Mycobacterium
SDVPGRP

SEQ ID NO: 1172586 - protein, 8 aa, Mycobacterium
SDVQASNV

SEQ ID NO: 1172587 - protein, 7 aa, Mycobacterium
SDVRQGK

SEQ ID NO: 1172588 - protein, 8 aa, Mycobacterium
SDVSDTAN

SEQ ID NO: 1172589 - protein, 6 aa, Mycobacterium
SDVTSR

SEQ ID NO: 1172590 - protein, 7 aa, Mycobacterium
SDWQTDA

SEQ ID NO: 1172591 - protein, 7 aa, Mycobacterium
SDWSTNR

SEQ ID NO: 1172592 - protein, 4 aa, Mycobacterium
SDYD

SEQ ID NO: 1172593 - protein, 14 aa, Mycobacterium
SDYGGAKKATDEHV

SEQ ID NO: 1172594 - protein, 8 aa, Mycobacterium
SEAAGGTD

SEQ ID NO: 1172595 - protein, 11 aa, Mycobacterium
SEADGGAGGDL

SEQ ID NO: 1172596 - protein, 8 aa, Mycobacterium
SEADRRRT

SEQ ID NO: 1172597 - protein, 8 aa, Mycobacterium
SEAETTGT

SEQ ID NO: 1172598 - protein, 10 aa, Mycobacterium
SEAGGDVGSR

SEQ ID NO: 1172599 - protein, 7 aa, Mycobacterium
SEAGGVA

SEQ ID NO: 1172600 - protein, 8 aa, Mycobacterium
SEAGPARR

SEQ ID NO: 1172601 - protein, 10 aa, Mycobacterium
SEAGRRYERT

SEQ ID NO: 1172602 - protein, 7 aa, Mycobacterium
SEALPDD

SEQ ID NO: 1172603 - protein, 14 aa, Mycobacterium
SEANSVAKQHNSAI

SEQ ID NO: 1172604 - protein, 6 aa, Mycobacterium
SEAQRS

SEQ ID NO: 1172605 - protein, 5 aa, Mycobacterium
SEAQV

SEQ ID NO: 1172606 - protein, 4 aa, Mycobacterium
SEAS

SEQ ID NO: 1172607 - protein, 9 aa, Mycobacterium
SEATPTLRP

SEQ ID NO: 1172608 - protein, 5 aa, Mycobacterium
SEAVG

SEQ ID NO: 1172609 - protein, 4 aa, Mycobacterium
SEAW

SEQ ID NO: 1172610 - protein, 13 aa, Mycobacterium
SECEDGDAGTVAR

SEQ ID NO: 1172611 - protein, 11 aa, Mycobacterium
SECTEDDCTTP

SEQ ID NO: 1172612 - protein, 20 aa, Mycobacterium
SEDERRALKRRNARTKARSG

SEQ ID NO: 1172613 - protein, 9 aa, Mycobacterium
SEDERRSNA

SEQ ID NO: 1172614 - protein, 5 aa, Mycobacterium
SEDGG

SEQ ID NO: 1172615 - protein, 9 aa, Mycobacterium
SEDGPCVPS

SEQ ID NO: 1172616 - protein, 6 aa, Mycobacterium
SEDPRI

SEQ ID NO: 1172617 - protein, 11 aa, Mycobacterium
SEDQNTDVPPN

SEQ ID NO: 1172618 - protein, 9 aa, Mycobacterium
SEDTDGPLS

SEQ ID NO: 1172619 - protein, 9 aa, Mycobacterium
SEEDTNEPH

SEQ ID NO: 1172620 - protein, 6 aa, Mycobacterium
SEEEAR

SEQ ID NO: 1172621 - protein, 8 aa, Mycobacterium
SEEEQGRV

SEQ ID NO: 1172622 - protein, 12 aa, Mycobacterium
SEEGRASSLESI

SEQ ID NO: 1172623 - protein, 5 aa, Mycobacterium
SEELK

SEQ ID NO: 1172624 - protein, 4 aa, Mycobacterium
SEEP

SEQ ID NO: 1172625 - protein, 7 aa, Mycobacterium
SEEPGHH

SEQ ID NO: 1172626 - protein, 7 aa, Mycobacterium
SEEQRAE

SEQ ID NO: 1172627 - protein, 8 aa, Mycobacterium
SEESGDPH

SEQ ID NO: 1172628 - protein, 15 aa, Mycobacterium
SEEVAGQATDGTVDD

SEQ ID NO: 1172629 - protein, 21 aa, Mycobacterium
SEEYSQARREFNDDDWKGATD

SEQ ID NO: 1172630 - protein, 9 aa, Mycobacterium
SEGDTAHGR

SEQ ID NO: 1172631 - protein, 11 aa, Mycobacterium
SEGESKEFTTT

SEQ ID NO: 1172632 - protein, 10 aa, Mycobacterium
SEGGGVYSRE

SEQ ID NO: 1172633 - protein, 7 aa, Mycobacterium
SEGGVSY

SEQ ID NO: 1172634 - protein, 9 aa, Mycobacterium
SEGKRSTTR

SEQ ID NO: 1172635 - protein, 6 aa, Mycobacterium
SEGNTA

SEQ ID NO: 1172636 - protein, 17 aa, Mycobacterium
SEGRIDATEHTTDGTRV

SEQ ID NO: 1172637 - protein, 9 aa, Mycobacterium
SEGRSTATA

SEQ ID NO: 1172638 - protein, 4 aa, Mycobacterium
SEGS

SEQ ID NO: 1172639 - protein, 8 aa, Mycobacterium
SEGSGERL

SEQ ID NO: 1172640 - protein, 9 aa, Mycobacterium
SEGSRQGRV

SEQ ID NO: 1172641 - protein, 5 aa, Mycobacterium
SEGVE

SEQ ID NO: 1172642 - protein, 12 aa, Mycobacterium
SEHADGDPRPDP

SEQ ID NO: 1172643 - protein, 9 aa, Mycobacterium
SEHGAGSDL

SEQ ID NO: 1172644 - protein, 7 aa, Mycobacterium
SEHGGGS

SEQ ID NO: 1172645 - protein, 9 aa, Mycobacterium
SEIDGTPVY

SEQ ID NO: 1172646 - protein, 6 aa, Mycobacterium
SEIPQA

SEQ ID NO: 1172647 - protein, 12 aa, Mycobacterium
SEIPRRRNEAGR

SEQ ID NO: 1172648 - protein, 7 aa, Mycobacterium
SEISDED

SEQ ID NO: 1172649 - protein, 8 aa, Mycobacterium
SEKAFAAG

SEQ ID NO: 1172650 - protein, 6 aa, Mycobacterium
SELDGH

SEQ ID NO: 1172651 - protein, 8 aa, Mycobacterium
SELGAKAN

SEQ ID NO: 1172652 - protein, 14 aa, Mycobacterium
SELGEHPYTPITPE

SEQ ID NO: 1172653 - protein, 4 aa, Mycobacterium
SELP

SEQ ID NO: 1172654 - protein, 14 aa, Mycobacterium
SELPAGSRVEVWDL

SEQ ID NO: 1172655 - protein, 10 aa, Mycobacterium
SELPPPSEKL

SEQ ID NO: 1172656 - protein, 7 aa, Mycobacterium
SELPREE

SEQ ID NO: 1172657 - protein, 6 aa, Mycobacterium
SELSPQ

SEQ ID NO: 1172658 - protein, 6 aa, Mycobacterium
SELTGA

SEQ ID NO: 1172659 - protein, 6 aa, Mycobacterium
SENAPE

SEQ ID NO: 1172660 - protein, 6 aa, Mycobacterium
SENEKV

SEQ ID NO: 1172661 - protein, 9 aa, Mycobacterium
SEPEAGTDL

SEQ ID NO: 1172662 - protein, 6 aa, Mycobacterium
SEPEEV

SEQ ID NO: 1172663 - protein, 12 aa, Mycobacterium
SEPEPRWPAAPD

SEQ ID NO: 1172664 - protein, 21 aa, Mycobacterium
SEPGAGSDLASLTTTATRDGD

SEQ ID NO: 1172665 - protein, 9 aa, Mycobacterium
SEPGAGTDL

SEQ ID NO: 1172666 - protein, 10 aa, Mycobacterium
SEPGKIGRPR

SEQ ID NO: 1172667 - protein, 9 aa, Mycobacterium
SEPGRTESQ

SEQ ID NO: 1172668 - protein, 9 aa, Mycobacterium
SEPMGTGGA

SEQ ID NO: 1172669 - protein, 6 aa, Mycobacterium
SEPSGA

SEQ ID NO: 1172670 - protein, 9 aa, Mycobacterium
SEPSPQRTP

SEQ ID NO: 1172671 - protein, 4 aa, Mycobacterium
SEPT

SEQ ID NO: 1172672 - protein, 7 aa, Mycobacterium
SEPTSGR

SEQ ID NO: 1172673 - protein, 8 aa, Mycobacterium
SEPVRGAE

SEQ ID NO: 1172674 - protein, 6 aa, Mycobacterium
SEQAIR

SEQ ID NO: 1172675 - protein, 7 aa, Mycobacterium
SEQDRPL

SEQ ID NO: 1172676 - protein, 10 aa, Mycobacterium
SEQEARDQIE

SEQ ID NO: 1172677 - protein, 7 aa, Mycobacterium
SEQGYDA

SEQ ID NO: 1172678 - protein, 10 aa, Mycobacterium
SEQNPDHAAT

SEQ ID NO: 1172679 - protein, 8 aa, Mycobacterium
SERASEPF

SEQ ID NO: 1172680 - protein, 22 aa, Mycobacterium
SEREAGSDAASMRTRAKADGDD

SEQ ID NO: 1172681 - protein, 6 aa, Mycobacterium
SERERS

SEQ ID NO: 1172682 - protein, 7 aa, Mycobacterium
SERFEEV

SEQ ID NO: 1172683 - protein, 9 aa, Mycobacterium
SERGLPADP

SEQ ID NO: 1172684 - protein, 10 aa, Mycobacterium
SERGRMSAGD

SEQ ID NO: 1172685 - protein, 9 aa, Mycobacterium
SERHPSPKS

SEQ ID NO: 1172686 - protein, 4 aa, Mycobacterium
SERM

SEQ ID NO: 1172687 - protein, 4 aa, Mycobacterium
SERQ

SEQ ID NO: 1172688 - protein, 4 aa, Mycobacterium
SERR

SEQ ID NO: 1172689 - protein, 6 aa, Mycobacterium
SERSER

SEQ ID NO: 1172690 - protein, 7 aa, Mycobacterium
SERSLPH

SEQ ID NO: 1172691 - protein, 6 aa, Mycobacterium
SERSRP

SEQ ID NO: 1172692 - protein, 13 aa, Mycobacterium
SERTDREKPAKSI

SEQ ID NO: 1172693 - protein, 4 aa, Mycobacterium
SERV

SEQ ID NO: 1172694 - protein, 8 aa, Mycobacterium
SERYTPRG

SEQ ID NO: 1172695 - protein, 6 aa, Mycobacterium
SESADI

SEQ ID NO: 1172696 - protein, 9 aa, Mycobacterium
SESAGGTYS

SEQ ID NO: 1172697 - protein, 7 aa, Mycobacterium
SESEHVG

SEQ ID NO: 1172698 - protein, 9 aa, Mycobacterium
SESGNGRLK

SEQ ID NO: 1172699 - protein, 6 aa, Mycobacterium
SESHMR

SEQ ID NO: 1172700 - protein, 4 aa, Mycobacterium
SESP

SEQ ID NO: 1172701 - protein, 4 aa, Mycobacterium
SESQ

SEQ ID NO: 1172702 - protein, 10 aa, Mycobacterium
SESTDRDEVQ

SEQ ID NO: 1172703 - protein, 14 aa, Mycobacterium
SESVTDGQPLANDQ

SEQ ID NO: 1172704 - protein, 18 aa, Mycobacterium
SETDPAVSEAFSSDDYTR

SEQ ID NO: 1172705 - protein, 11 aa, Mycobacterium
SETEEFPQDNP

SEQ ID NO: 1172706 - protein, 7 aa, Mycobacterium
SETGELG

SEQ ID NO: 1172707 - protein, 8 aa, Mycobacterium
SETHTNAD

SEQ ID NO: 1172708 - protein, 10 aa, Mycobacterium
SETKGNEGVI

SEQ ID NO: 1172709 - protein, 11 aa, Mycobacterium
SETQAGSSLAD

SEQ ID NO: 1172710 - protein, 7 aa, Mycobacterium
SETQGVQ

SEQ ID NO: 1172711 - protein, 4 aa, Mycobacterium
SETV

SEQ ID NO: 1172712 - protein, 5 aa, Mycobacterium
SETVS

SEQ ID NO: 1172713 - protein, 6 aa, Mycobacterium
SEVGED

SEQ ID NO: 1172714 - protein, 10 aa, Mycobacterium
SEVPKKKPRP

SEQ ID NO: 1172715 - protein, 11 aa, Mycobacterium
SEVRRGQPSVR

SEQ ID NO: 1172716 - protein, 8 aa, Mycobacterium
SEVTDPAL

SEQ ID NO: 1172717 - protein, 6 aa, Mycobacterium
SEVTPL

SEQ ID NO: 1172718 - protein, 5 aa, Mycobacterium
SEVTR

SEQ ID NO: 1172719 - protein, 5 aa, Mycobacterium
SEWTS

SEQ ID NO: 1172720 - protein, 6 aa, Mycobacterium
SEYGAP

SEQ ID NO: 1172721 - protein, 6 aa, Mycobacterium
SEYGRD

SEQ ID NO: 1172722 - protein, 6 aa, Mycobacterium
SFAGPD

SEQ ID NO: 1172723 - protein, 5 aa, Mycobacterium
SFAPD

SEQ ID NO: 1172724 - protein, 6 aa, Mycobacterium
SFDEKK

SEQ ID NO: 1172725 - protein, 12 aa, Mycobacterium
SFDPTGDDAVAT

SEQ ID NO: 1172726 - protein, 4 aa, Mycobacterium
SFEG

SEQ ID NO: 1172727 - protein, 8 aa, Mycobacterium
SFGDGRTG

SEQ ID NO: 1172728 - protein, 9 aa, Mycobacterium
SFGKPTAEE

SEQ ID NO: 1172729 - protein, 6 aa, Mycobacterium
SFGRGP

SEQ ID NO: 1172730 - protein, 7 aa, Mycobacterium
SFPGAPP

SEQ ID NO: 1172731 - protein, 7 aa, Mycobacterium
SFPPDGE

SEQ ID NO: 1172732 - protein, 6 aa, Mycobacterium
SFPRSG

SEQ ID NO: 1172733 - protein, 7 aa, Mycobacterium
SFPSAGG

SEQ ID NO: 1172734 - protein, 9 aa, Mycobacterium
SFPSEDDLR

SEQ ID NO: 1172735 - protein, 4 aa, Mycobacterium
SFQS

SEQ ID NO: 1172736 - protein, 15 aa, Mycobacterium
SFSQDANGYARSEGA

SEQ ID NO: 1172737 - protein, 5 aa, Mycobacterium
SFTEP

SEQ ID NO: 1172738 - protein, 8 aa, Mycobacterium
SFTGDGEH

SEQ ID NO: 1172739 - protein, 4 aa, Mycobacterium
SGAA

SEQ ID NO: 1172740 - protein, 8 aa, Mycobacterium
SGADETQI

SEQ ID NO: 1172741 - protein, 8 aa, Mycobacterium
SGAEESTA

SEQ ID NO: 1172742 - protein, 5 aa, Mycobacterium
SGAEI

SEQ ID NO: 1172743 - protein, 5 aa, Mycobacterium
SGAER

SEQ ID NO: 1172744 - protein, 9 aa, Mycobacterium
SGAEVSDGL

SEQ ID NO: 1172745 - protein, 8 aa, Mycobacterium
SGAGDHTE

SEQ ID NO: 1172746 - protein, 9 aa, Mycobacterium
SGAGEERDA

SEQ ID NO: 1172747 - protein, 18 aa, Mycobacterium
SGAGEGSAISDADFKAAG

SEQ ID NO: 1172748 - protein, 14 aa, Mycobacterium
SGAGHVQANHPDMA

SEQ ID NO: 1172749 - protein, 5 aa, Mycobacterium
SGAGN

SEQ ID NO: 1172750 - protein, 5 aa, Mycobacterium
SGAGQ

SEQ ID NO: 1172751 - protein, 12 aa, Mycobacterium
SGAKAIVGSGKL

SEQ ID NO: 1172752 - protein, 6 aa, Mycobacterium
SGALPR

SEQ ID NO: 1172753 - protein, 7 aa, Mycobacterium
SGAMGDG

SEQ ID NO: 1172754 - protein, 9 aa, Mycobacterium
SGANNGERH

SEQ ID NO: 1172755 - protein, 6 aa, Mycobacterium
SGAPAT

SEQ ID NO: 1172756 - protein, 8 aa, Mycobacterium
SGAPIARP

SEQ ID NO: 1172757 - protein, 8 aa, Mycobacterium
SGAPMAQQ

SEQ ID NO: 1172758 - protein, 5 aa, Mycobacterium
SGAPQ

SEQ ID NO: 1172759 - protein, 14 aa, Mycobacterium
SGAPSASDAPQWPQ

SEQ ID NO: 1172760 - protein, 10 aa, Mycobacterium
SGAPTATDDA

SEQ ID NO: 1172761 - protein, 5 aa, Mycobacterium
SGASL

SEQ ID NO: 1172762 - protein, 8 aa, Mycobacterium
SGATPPGM

SEQ ID NO: 1172763 - protein, 8 aa, Mycobacterium
SGATSQRP

SEQ ID NO: 1172764 - protein, 4 aa, Mycobacterium
SGAV

SEQ ID NO: 1172765 - protein, 8 aa, Mycobacterium
SGAVRDGR

SEQ ID NO: 1172766 - protein, 8 aa, Mycobacterium
SGAVREAD

SEQ ID NO: 1172767 - protein, 4 aa, Mycobacterium
SGAW

SEQ ID NO: 1172768 - protein, 8 aa, Mycobacterium
SGCGKSTT

SEQ ID NO: 1172769 - protein, 7 aa, Mycobacterium
SGDALQS

SEQ ID NO: 1172770 - protein, 7 aa, Mycobacterium
SGDAQAA

SEQ ID NO: 1172771 - protein, 6 aa, Mycobacterium
SGDARQ

SEQ ID NO: 1172772 - protein, 6 aa, Mycobacterium
SGDELT

SEQ ID NO: 1172773 - protein, 5 aa, Mycobacterium
SGDEM

SEQ ID NO: 1172774 - protein, 9 aa, Mycobacterium
SGDESAAPM

SEQ ID NO: 1172775 - protein, 8 aa, Mycobacterium
SGDEVRVG

SEQ ID NO: 1172776 - protein, 6 aa, Mycobacterium
SGDFGP

SEQ ID NO: 1172777 - protein, 9 aa, Mycobacterium
SGDGAAAEA

SEQ ID NO: 1172778 - protein, 8 aa, Mycobacterium
SGDGESVG

SEQ ID NO: 1172779 - protein, 13 aa, Mycobacterium
SGDGSGADAGDSA

SEQ ID NO: 1172780 - protein, 7 aa, Mycobacterium
SGDHGTY

SEQ ID NO: 1172781 - protein, 13 aa, Mycobacterium
SGDHPGRAAGEAA

SEQ ID NO: 1172782 - protein, 7 aa, Mycobacterium
SGDIATA

SEQ ID NO: 1172783 - protein, 9 aa, Mycobacterium
SGDLGGTDR

SEQ ID NO: 1172784 - protein, 8 aa, Mycobacterium
SGDQTVPE

SEQ ID NO: 1172785 - protein, 5 aa, Mycobacterium
SGDRG

SEQ ID NO: 1172786 - protein, 6 aa, Mycobacterium
SGDRYA

SEQ ID NO: 1172787 - protein, 22 aa, Mycobacterium
SGDSGPMRTYGEQAKKFAGTLR

SEQ ID NO: 1172788 - protein, 10 aa, Mycobacterium
SGDSTSGQRA

SEQ ID NO: 1172789 - protein, 7 aa, Mycobacterium
SGDTATS

SEQ ID NO: 1172790 - protein, 9 aa, Mycobacterium
SGDVRDPYT

SEQ ID NO: 1172791 - protein, 12 aa, Mycobacterium
SGDVTPKPNVTR

SEQ ID NO: 1172792 - protein, 4 aa, Mycobacterium
SGDY

SEQ ID NO: 1172793 - protein, 15 aa, Mycobacterium
SGEAALSRRARAASR

SEQ ID NO: 1172794 - protein, 17 aa, Mycobacterium
SGEAELGAGVTGPDAER

SEQ ID NO: 1172795 - protein, 6 aa, Mycobacterium
SGEAEN

SEQ ID NO: 1172796 - protein, 6 aa, Mycobacterium
SGEEVQ

SEQ ID NO: 1172797 - protein, 7 aa, Mycobacterium
SGEGPPL

SEQ ID NO: 1172798 - protein, 5 aa, Mycobacterium
SGEKL

SEQ ID NO: 1172799 - protein, 6 aa, Mycobacterium
SGELTS

SEQ ID NO: 1172800 - protein, 6 aa, Mycobacterium
SGEMSG

SEQ ID NO: 1172801 - protein, 6 aa, Mycobacterium
SGEPEW

SEQ ID NO: 1172802 - protein, 5 aa, Mycobacterium
SGEQL

SEQ ID NO: 1172803 - protein, 8 aa, Mycobacterium
SGESPRRL

SEQ ID NO: 1172804 - protein, 7 aa, Mycobacterium
SGEVTDA

SEQ ID NO: 1172805 - protein, 12 aa, Mycobacterium
SGFDTMPADGPW

SEQ ID NO: 1172806 - protein, 15 aa, Mycobacterium
SGFEQERDPAAHTAR

SEQ ID NO: 1172807 - protein, 6 aa, Mycobacterium
SGFGEQ

SEQ ID NO: 1172808 - protein, 4 aa, Mycobacterium
SGFR

SEQ ID NO: 1172809 - protein, 22 aa, Mycobacterium
SGFRPAVSGGAQPYGAPATAAD

SEQ ID NO: 1172810 - protein, 6 aa, Mycobacterium
SGFSSR

SEQ ID NO: 1172811 - protein, 4 aa, Mycobacterium
SGGA

SEQ ID NO: 1172812 - protein, 20 aa, Mycobacterium
SGGADLGDGAPQHLSDWIVH

SEQ ID NO: 1172813 - protein, 7 aa, Mycobacterium
SGGAGLA

SEQ ID NO: 1172814 - protein, 5 aa, Mycobacterium
SGGAL

SEQ ID NO: 1172815 - protein, 10 aa, Mycobacterium
SGGANACTGP

SEQ ID NO: 1172816 - protein, 5 aa, Mycobacterium
SGGAR

SEQ ID NO: 1172817 - protein, 8 aa, Mycobacterium
SGGDGAVA

SEQ ID NO: 1172818 - protein, 10 aa, Mycobacterium
SGGDLGTLTE

SEQ ID NO: 1172819 - protein, 4 aa, Mycobacterium
SGGE

SEQ ID NO: 1172820 - protein, 8 aa, Mycobacterium
SGGENSYP

SEQ ID NO: 1172821 - protein, 8 aa, Mycobacterium
SGGERPPY

SEQ ID NO: 1172822 - protein, 6 aa, Mycobacterium
SGGERR

SEQ ID NO: 1172823 - protein, 10 aa, Mycobacterium
SGGETRTTLA

SEQ ID NO: 1172824 - protein, 7 aa, Mycobacterium
SGGGNRL

SEQ ID NO: 1172825 - protein, 10 aa, Mycobacterium
SGGGSGHEPM

SEQ ID NO: 1172826 - protein, 14 aa, Mycobacterium
SGGGTAPATPLDDD

SEQ ID NO: 1172827 - protein, 15 aa, Mycobacterium
SGGGVAGAYTAAREG

SEQ ID NO: 1172828 - protein, 6 aa, Mycobacterium
SGGHPP

SEQ ID NO: 1172829 - protein, 6 aa, Mycobacterium
SGGHVG

SEQ ID NO: 1172830 - protein, 5 aa, Mycobacterium
SGGIG

SEQ ID NO: 1172831 - protein, 5 aa, Mycobacterium
SGGLR

SEQ ID NO: 1172832 - protein, 15 aa, Mycobacterium
SGGLTPSGVLLLRSD

SEQ ID NO: 1172833 - protein, 4 aa, Mycobacterium
SGGP

SEQ ID NO: 1172834 - protein, 8 aa, Mycobacterium
SGGPTSDE

SEQ ID NO: 1172835 - protein, 6 aa, Mycobacterium
SGGQDV

SEQ ID NO: 1172836 - protein, 5 aa, Mycobacterium
SGGQI

SEQ ID NO: 1172837 - protein, 9 aa, Mycobacterium
SGGRGPAER

SEQ ID NO: 1172838 - protein, 6 aa, Mycobacterium
SGGRTR

SEQ ID NO: 1172839 - protein, 4 aa, Mycobacterium
SGGS

SEQ ID NO: 1172840 - protein, 11 aa, Mycobacterium
SGGSDRKPSTL

SEQ ID NO: 1172841 - protein, 8 aa, Mycobacterium
SGGTEPVG

SEQ ID NO: 1172842 - protein, 17 aa, Mycobacterium
SGGTGISPTDATPQATA

SEQ ID NO: 1172843 - protein, 7 aa, Mycobacterium
SGGTSGA

SEQ ID NO: 1172844 - protein, 7 aa, Mycobacterium
SGGVSSL

SEQ ID NO: 1172845 - protein, 22 aa, Mycobacterium
SGGYAKRTSIEEYTAQGRGGKG

SEQ ID NO: 1172846 - protein, 14 aa, Mycobacterium
SGHGNRCPEVRTDE

SEQ ID NO: 1172847 - protein, 9 aa, Mycobacterium
SGHGPDEAA

SEQ ID NO: 1172848 - protein, 11 aa, Mycobacterium
SGHSVQGDQPK

SEQ ID NO: 1172849 - protein, 4 aa, Mycobacterium
SGIE

SEQ ID NO: 1172850 - protein, 6 aa, Mycobacterium
SGIERH

SEQ ID NO: 1172851 - protein, 8 aa, Mycobacterium
SGIPERSA

SEQ ID NO: 1172852 - protein, 4 aa, Mycobacterium
SGKD

SEQ ID NO: 1172853 - protein, 16 aa, Mycobacterium
SGKGGTHRGGIPTAQA

SEQ ID NO: 1172854 - protein, 11 aa, Mycobacterium
SGKGGVGKSSV

SEQ ID NO: 1172855 - protein, 4 aa, Mycobacterium
SGKH

SEQ ID NO: 1172856 - protein, 5 aa, Mycobacterium
SGKLF

SEQ ID NO: 1172857 - protein, 5 aa, Mycobacterium
SGKSV

SEQ ID NO: 1172858 - protein, 4 aa, Mycobacterium
SGKT

SEQ ID NO: 1172859 - protein, 8 aa, Mycobacterium
SGKTGAGV

SEQ ID NO: 1172860 - protein, 13 aa, Mycobacterium
SGKTGTTESHRSS

SEQ ID NO: 1172861 - protein, 6 aa, Mycobacterium
SGKTQA

SEQ ID NO: 1172862 - protein, 6 aa, Mycobacterium
SGLAET

SEQ ID NO: 1172863 - protein, 16 aa, Mycobacterium
SGLDGTPAHDPTDADR

SEQ ID NO: 1172864 - protein, 5 aa, Mycobacterium
SGLEP

SEQ ID NO: 1172865 - protein, 6 aa, Mycobacterium
SGLGDR

SEQ ID NO: 1172866 - protein, 8 aa, Mycobacterium
SGLHSNGY

SEQ ID NO: 1172867 - protein, 6 aa, Mycobacterium
SGLPAR

SEQ ID NO: 1172868 - protein, 6 aa, Mycobacterium
SGLPPG

SEQ ID NO: 1172869 - protein, 14 aa, Mycobacterium
SGLRGRGGAGFPTG

SEQ ID NO: 1172870 - protein, 6 aa, Mycobacterium
SGLRPE

SEQ ID NO: 1172871 - protein, 7 aa, Mycobacterium
SGLRPEQ

SEQ ID NO: 1172872 - protein, 5 aa, Mycobacterium
SGLSP

SEQ ID NO: 1172873 - protein, 8 aa, Mycobacterium
SGLSPTDI

SEQ ID NO: 1172874 - protein, 9 aa, Mycobacterium
SGLTNGRPH

SEQ ID NO: 1172875 - protein, 5 aa, Mycobacterium
SGMTT

SEQ ID NO: 1172876 - protein, 8 aa, Mycobacterium
SGNAAPTL

SEQ ID NO: 1172877 - protein, 29 aa, Mycobacterium
SGNDTGFETNTGIDTDVASNNDTNTGLDV

SEQ ID NO: 1172878 - protein, 6 aa, Mycobacterium
SGNGRV

SEQ ID NO: 1172879 - protein, 5 aa, Mycobacterium
SGNIS

SEQ ID NO: 1172880 - protein, 18 aa, Mycobacterium
SGNPYGAFSPDQAERVSR

SEQ ID NO: 1172881 - protein, 7 aa, Mycobacterium
SGNRDDD

SEQ ID NO: 1172882 - protein, 7 aa, Mycobacterium
SGNSATD

SEQ ID NO: 1172883 - protein, 5 aa, Mycobacterium
SGNVG

SEQ ID NO: 1172884 - protein, 6 aa, Mycobacterium
SGPAAM

SEQ ID NO: 1172885 - protein, 7 aa, Mycobacterium
SGPAGYT

SEQ ID NO: 1172886 - protein, 5 aa, Mycobacterium
SGPAK

SEQ ID NO: 1172887 - protein, 6 aa, Mycobacterium
SGPDAK

SEQ ID NO: 1172888 - protein, 5 aa, Mycobacterium
SGPDE

SEQ ID NO: 1172889 - protein, 15 aa, Mycobacterium
SGPDPDSEPNREEQA

SEQ ID NO: 1172890 - protein, 7 aa, Mycobacterium
SGPDRAD

SEQ ID NO: 1172891 - protein, 5 aa, Mycobacterium
SGPES

SEQ ID NO: 1172892 - protein, 15 aa, Mycobacterium
SGPEVETGEITPQTC

SEQ ID NO: 1172893 - protein, 7 aa, Mycobacterium
SGPGAGV

SEQ ID NO: 1172894 - protein, 7 aa, Mycobacterium
SGPGFTN

SEQ ID NO: 1172895 - protein, 9 aa, Mycobacterium
SGPGGQAES

SEQ ID NO: 1172896 - protein, 9 aa, Mycobacterium
SGPIAKGTA

SEQ ID NO: 1172897 - protein, 6 aa, Mycobacterium
SGPIPP

SEQ ID NO: 1172898 - protein, 12 aa, Mycobacterium
SGPLDPATRDEF

SEQ ID NO: 1172899 - protein, 5 aa, Mycobacterium
SGPMT

SEQ ID NO: 1172900 - protein, 10 aa, Mycobacterium
SGPNASVKAA

SEQ ID NO: 1172901 - protein, 14 aa, Mycobacterium
SGPPARLDGGGYRG

SEQ ID NO: 1172902 - protein, 5 aa, Mycobacterium
SGPPT

SEQ ID NO: 1172903 - protein, 14 aa, Mycobacterium
SGPRAGRGTPTTVV

SEQ ID NO: 1172904 - protein, 8 aa, Mycobacterium
SGPRAVPV

SEQ ID NO: 1172905 - protein, 6 aa, Mycobacterium
SGPRVT

SEQ ID NO: 1172906 - protein, 5 aa, Mycobacterium
SGPSE

SEQ ID NO: 1172907 - protein, 7 aa, Mycobacterium
SGPSPSE

SEQ ID NO: 1172908 - protein, 4 aa, Mycobacterium
SGPV

SEQ ID NO: 1172909 - protein, 6 aa, Mycobacterium
SGPVHP

SEQ ID NO: 1172910 - protein, 16 aa, Mycobacterium
SGPVQGARVVPAPSPS

SEQ ID NO: 1172911 - protein, 7 aa, Mycobacterium
SGPVSPA

SEQ ID NO: 1172912 - protein, 11 aa, Mycobacterium
SGQDTRRGTFT

SEQ ID NO: 1172913 - protein, 4 aa, Mycobacterium
SGQG

SEQ ID NO: 1172914 - protein, 5 aa, Mycobacterium
SGQGV

SEQ ID NO: 1172915 - protein, 5 aa, Mycobacterium
SGQLP

SEQ ID NO: 1172916 - protein, 5 aa, Mycobacterium
SGQRL

SEQ ID NO: 1172917 - protein, 6 aa, Mycobacterium
SGRAPA

SEQ ID NO: 1172918 - protein, 6 aa, Mycobacterium
SGRAPV

SEQ ID NO: 1172919 - protein, 10 aa, Mycobacterium
SGRDVEPVDG

SEQ ID NO: 1172920 - protein, 8 aa, Mycobacterium
SGREQGAR

SEQ ID NO: 1172921 - protein, 21 aa, Mycobacterium
SGRGGPGLSPLGNSSAGGDTI

SEQ ID NO: 1172922 - protein, 17 aa, Mycobacterium
SGRGHRLPDHAPNRAER

SEQ ID NO: 1172923 - protein, 7 aa, Mycobacterium
SGRGRPQ

SEQ ID NO: 1172924 - protein, 8 aa, Mycobacterium
SGRLATPA

SEQ ID NO: 1172925 - protein, 5 aa, Mycobacterium
SGRNF

SEQ ID NO: 1172926 - protein, 8 aa, Mycobacterium
SGRPGRAA

SEQ ID NO: 1172927 - protein, 7 aa, Mycobacterium
SGRPLEE

SEQ ID NO: 1172928 - protein, 12 aa, Mycobacterium
SGRSEGLGGETY

SEQ ID NO: 1172929 - protein, 13 aa, Mycobacterium
SGRSSNEITEQQI

SEQ ID NO: 1172930 - protein, 13 aa, Mycobacterium
SGRSSPSPFGSGA

SEQ ID NO: 1172931 - protein, 9 aa, Mycobacterium
SGRSTMSKD

SEQ ID NO: 1172932 - protein, 7 aa, Mycobacterium
SGRTGVS

SEQ ID NO: 1172933 - protein, 5 aa, Mycobacterium
SGRTV

SEQ ID NO: 1172934 - protein, 13 aa, Mycobacterium
SGSADGQPNPASS

SEQ ID NO: 1172935 - protein, 14 aa, Mycobacterium
SGSAGSELLETPQA

SEQ ID NO: 1172936 - protein, 6 aa, Mycobacterium
SGSARF

SEQ ID NO: 1172937 - protein, 6 aa, Mycobacterium
SGSASI

SEQ ID NO: 1172938 - protein, 11 aa, Mycobacterium
SGSAVDADTDG

SEQ ID NO: 1172939 - protein, 6 aa, Mycobacterium
SGSAVV

SEQ ID NO: 1172940 - protein, 8 aa, Mycobacterium
SGSDDTSE

SEQ ID NO: 1172941 - protein, 8 aa, Mycobacterium
SGSDLGPE

SEQ ID NO: 1172942 - protein, 9 aa, Mycobacterium
SGSEDDYQA

SEQ ID NO: 1172943 - protein, 11 aa, Mycobacterium
SGSEEDETAWR

SEQ ID NO: 1172944 - protein, 16 aa, Mycobacterium
SGSEQNPDITAKDRRG

SEQ ID NO: 1172945 - protein, 9 aa, Mycobacterium
SGSGALRPA

SEQ ID NO: 1172946 - protein, 7 aa, Mycobacterium
SGSGDHA

SEQ ID NO: 1172947 - protein, 9 aa, Mycobacterium
SGSGKSSVA

SEQ ID NO: 1172948 - protein, 6 aa, Mycobacterium
SGSGPT

SEQ ID NO: 1172949 - protein, 9 aa, Mycobacterium
SGSGRGIGR

SEQ ID NO: 1172950 - protein, 12 aa, Mycobacterium
SGSHDPGEVGSR

SEQ ID NO: 1172951 - protein, 5 aa, Mycobacterium
SGSKL

SEQ ID NO: 1172952 - protein, 8 aa, Mycobacterium
SGSLPRRP

SEQ ID NO: 1172953 - protein, 10 aa, Mycobacterium
SGSPITIGRS

SEQ ID NO: 1172954 - protein, 7 aa, Mycobacterium
SGSRAGE

SEQ ID NO: 1172955 - protein, 23 aa, Mycobacterium
SGSRRGGGVSGIGGHNAAMAVLD

SEQ ID NO: 1172956 - protein, 9 aa, Mycobacterium
SGSTADPKG

SEQ ID NO: 1172957 - protein, 6 aa, Mycobacterium
SGSTAL

SEQ ID NO: 1172958 - protein, 8 aa, Mycobacterium
SGSTDDTA

SEQ ID NO: 1172959 - protein, 11 aa, Mycobacterium
SGSTGAPKGVE

SEQ ID NO: 1172960 - protein, 8 aa, Mycobacterium
SGSWGPQE

SEQ ID NO: 1172961 - protein, 10 aa, Mycobacterium
SGTARVTGSV

SEQ ID NO: 1172962 - protein, 6 aa, Mycobacterium
SGTGAA

SEQ ID NO: 1172963 - protein, 7 aa, Mycobacterium
SGTGTST

SEQ ID NO: 1172964 - protein, 7 aa, Mycobacterium
SGTGTVE

SEQ ID NO: 1172965 - protein, 4 aa, Mycobacterium
SGTK

SEQ ID NO: 1172966 - protein, 16 aa, Mycobacterium
SGTKESGAIKPVEPED

SEQ ID NO: 1172967 - protein, 11 aa, Mycobacterium
SGTKGSPPPDT

SEQ ID NO: 1172968 - protein, 6 aa, Mycobacterium
SGTLDD

SEQ ID NO: 1172969 - protein, 8 aa, Mycobacterium
SGTREPNG

SEQ ID NO: 1172970 - protein, 4 aa, Mycobacterium
SGTS

SEQ ID NO: 1172971 - protein, 14 aa, Mycobacterium
SGTSGAGRAAKPDL

SEQ ID NO: 1172972 - protein, 4 aa, Mycobacterium
SGTT

SEQ ID NO: 1172973 - protein, 9 aa, Mycobacterium
SGTTGDPKG

SEQ ID NO: 1172974 - protein, 25 aa, Mycobacterium
SGTTGFPKGIQPDLPGRDVDAPGDP

SEQ ID NO: 1172975 - protein, 9 aa, Mycobacterium
SGTTGIPKG

SEQ ID NO: 1172976 - protein, 10 aa, Mycobacterium
SGTTGKPKGV

SEQ ID NO: 1172977 - protein, 7 aa, Mycobacterium
SGTTGLP

SEQ ID NO: 1172978 - protein, 12 aa, Mycobacterium
SGTTGPPKRQAI

SEQ ID NO: 1172979 - protein, 11 aa, Mycobacterium
SGTTGRPKAVK

SEQ ID NO: 1172980 - protein, 10 aa, Mycobacterium
SGTTGRPKGC

SEQ ID NO: 1172981 - protein, 12 aa, Mycobacterium
SGTTGRPKGVEL

SEQ ID NO: 1172982 - protein, 8 aa, Mycobacterium
SGTTGRSK

SEQ ID NO: 1172983 - protein, 5 aa, Mycobacterium
SGTTL

SEQ ID NO: 1172984 - protein, 7 aa, Mycobacterium
SGTTNGR

SEQ ID NO: 1172985 - protein, 8 aa, Mycobacterium
SGTVESVD

SEQ ID NO: 1172986 - protein, 6 aa, Mycobacterium
SGTVTA

SEQ ID NO: 1172987 - protein, 7 aa, Mycobacterium
SGTYRGK

SEQ ID NO: 1172988 - protein, 8 aa, Mycobacterium
SGVADNEL

SEQ ID NO: 1172989 - protein, 15 aa, Mycobacterium
SGVAHSEVSTAATAT

SEQ ID NO: 1172990 - protein, 11 aa, Mycobacterium
SGVANDDAGDL

SEQ ID NO: 1172991 - protein, 10 aa, Mycobacterium
SGVATDEQLE

SEQ ID NO: 1172992 - protein, 6 aa, Mycobacterium
SGVDEE

SEQ ID NO: 1172993 - protein, 7 aa, Mycobacterium
SGVGAGD

SEQ ID NO: 1172994 - protein, 6 aa, Mycobacterium
SGVGES

SEQ ID NO: 1172995 - protein, 10 aa, Mycobacterium
SGVPTDAYTA

SEQ ID NO: 1172996 - protein, 7 aa, Mycobacterium
SGVRGPA

SEQ ID NO: 1172997 - protein, 4 aa, Mycobacterium
SGVS

SEQ ID NO: 1172998 - protein, 11 aa, Mycobacterium
SGVSANADPYL

SEQ ID NO: 1172999 - protein, 11 aa, Mycobacterium
SGVSERRPAVP

SEQ ID NO: 1173000 - protein, 8 aa, Mycobacterium
SGVSRSSI

SEQ ID NO: 1173001 - protein, 6 aa, Mycobacterium
SGWGGQ

SEQ ID NO: 1173002 - protein, 5 aa, Mycobacterium
SGWSE

SEQ ID NO: 1173003 - protein, 9 aa, Mycobacterium
SGYAGLSDT

SEQ ID NO: 1173004 - protein, 6 aa, Mycobacterium
SGYGPA

SEQ ID NO: 1173005 - protein, 16 aa, Mycobacterium
SGYPDAPYDGIDNNAY

SEQ ID NO: 1173006 - protein, 12 aa, Mycobacterium
SGYQETLTDPSY

SEQ ID NO: 1173007 - protein, 17 aa, Mycobacterium
SGYQTKRYRDAAGDEHE

SEQ ID NO: 1173008 - protein, 12 aa, Mycobacterium
SGYTEDSGEGRW

SEQ ID NO: 1173009 - protein, 6 aa, Mycobacterium
SHASAA

SEQ ID NO: 1173010 - protein, 12 aa, Mycobacterium
SHATGRPLPPPI

SEQ ID NO: 1173011 - protein, 8 aa, Mycobacterium
SHATGTSV

SEQ ID NO: 1173012 - protein, 7 aa, Mycobacterium
SHDTASA

SEQ ID NO: 1173013 - protein, 12 aa, Mycobacterium
SHDVGRGRGGVR

SEQ ID NO: 1173014 - protein, 6 aa, Mycobacterium
SHDWPD

SEQ ID NO: 1173015 - protein, 5 aa, Mycobacterium
SHEPV

SEQ ID NO: 1173016 - protein, 13 aa, Mycobacterium
SHGAPETQAQSAP

SEQ ID NO: 1173017 - protein, 9 aa, Mycobacterium
SHGTGASSA

SEQ ID NO: 1173018 - protein, 17 aa, Mycobacterium
SHHEGMDPVGDDVGTPT

SEQ ID NO: 1173019 - protein, 9 aa, Mycobacterium
SHHQTPGSA

SEQ ID NO: 1173020 - protein, 6 aa, Mycobacterium
SHLPDA

SEQ ID NO: 1173021 - protein, 9 aa, Mycobacterium
SHNPPTDNG

SEQ ID NO: 1173022 - protein, 12 aa, Mycobacterium
SHNSGRSARTVY

SEQ ID NO: 1173023 - protein, 4 aa, Mycobacterium
SHPA

SEQ ID NO: 1173024 - protein, 12 aa, Mycobacterium
SHPAYGGGKAME

SEQ ID NO: 1173025 - protein, 5 aa, Mycobacterium
SHPCA

SEQ ID NO: 1173026 - protein, 10 aa, Mycobacterium
SHPDDPVNAS

SEQ ID NO: 1173027 - protein, 7 aa, Mycobacterium
SHPERDI

SEQ ID NO: 1173028 - protein, 9 aa, Mycobacterium
SHPGGNKKR

SEQ ID NO: 1173029 - protein, 8 aa, Mycobacterium
SHPPSESD

SEQ ID NO: 1173030 - protein, 6 aa, Mycobacterium
SHPPTY

SEQ ID NO: 1173031 - protein, 4 aa, Mycobacterium
SHRE

SEQ ID NO: 1173032 - protein, 13 aa, Mycobacterium
SHRNTGKACNDPI

SEQ ID NO: 1173033 - protein, 13 aa, Mycobacterium
SHRNTGKACQDPV

SEQ ID NO: 1173034 - protein, 20 aa, Mycobacterium
SHRRRRRGDADAAESSGQRS

SEQ ID NO: 1173035 - protein, 7 aa, Mycobacterium
SHSPQVD

SEQ ID NO: 1173036 - protein, 6 aa, Mycobacterium
SHSTRA

SEQ ID NO: 1173037 - protein, 4 aa, Mycobacterium
SHTD

SEQ ID NO: 1173038 - protein, 7 aa, Mycobacterium
SHTGAEG

SEQ ID NO: 1173039 - protein, 5 aa, Mycobacterium
SHTGV

SEQ ID NO: 1173040 - protein, 4 aa, Mycobacterium
SHTH

SEQ ID NO: 1173041 - protein, 9 aa, Mycobacterium
SHTRTSTGS

SEQ ID NO: 1173042 - protein, 8 aa, Mycobacterium
SHWPDSAT

SEQ ID NO: 1173043 - protein, 11 aa, Mycobacterium
SIAEDGYQKTT

SEQ ID NO: 1173044 - protein, 11 aa, Mycobacterium
SIAGPKRPQDR

SEQ ID NO: 1173045 - protein, 7 aa, Mycobacterium
SIDADEA

SEQ ID NO: 1173046 - protein, 8 aa, Mycobacterium
SIDPDTVE

SEQ ID NO: 1173047 - protein, 9 aa, Mycobacterium
SIDRTVPES

SEQ ID NO: 1173048 - protein, 7 aa, Mycobacterium
SIDTDDE

SEQ ID NO: 1173049 - protein, 8 aa, Mycobacterium
SIEATAAD

SEQ ID NO: 1173050 - protein, 7 aa, Mycobacterium
SIEPSAE

SEQ ID NO: 1173051 - protein, 9 aa, Mycobacterium
SIESDGGRV

SEQ ID NO: 1173052 - protein, 21 aa, Mycobacterium
SIGPAPGNVTAADDGDTARRI

SEQ ID NO: 1173053 - protein, 9 aa, Mycobacterium
SIGSSEPPF

SEQ ID NO: 1173054 - protein, 9 aa, Mycobacterium
SIHPTSDTH

SEQ ID NO: 1173055 - protein, 4 aa, Mycobacterium
SIPE

SEQ ID NO: 1173056 - protein, 9 aa, Mycobacterium
SIPGPAGAI

SEQ ID NO: 1173057 - protein, 9 aa, Mycobacterium
SIPGPAQPI

SEQ ID NO: 1173058 - protein, 6 aa, Mycobacterium
SIPVSP

SEQ ID NO: 1173059 - protein, 5 aa, Mycobacterium
SIQAT

SEQ ID NO: 1173060 - protein, 8 aa, Mycobacterium
SIQGSTDV

SEQ ID NO: 1173061 - protein, 12 aa, Mycobacterium
SIRSKGDSADGV

SEQ ID NO: 1173062 - protein, 11 aa, Mycobacterium
SISGGGSHNGS

SEQ ID NO: 1173063 - protein, 16 aa, Mycobacterium
SISGSSGVVDGGDGLA

SEQ ID NO: 1173064 - protein, 5 aa, Mycobacterium
SISPD

SEQ ID NO: 1173065 - protein, 5 aa, Mycobacterium
SISQA

SEQ ID NO: 1173066 - protein, 11 aa, Mycobacterium
SITAATTHNGP

SEQ ID NO: 1173067 - protein, 4 aa, Mycobacterium
SITT

SEQ ID NO: 1173068 - protein, 11 aa, Mycobacterium
SITTAADERRI

SEQ ID NO: 1173069 - protein, 13 aa, Mycobacterium
SITVDGPATSGIL

SEQ ID NO: 1173070 - protein, 6 aa, Mycobacterium
SIYPGN

SEQ ID NO: 1173071 - protein, 8 aa, Mycobacterium
SKAEIDTQ

SEQ ID NO: 1173072 - protein, 16 aa, Mycobacterium
SKASAVTKAAATAALG

SEQ ID NO: 1173073 - protein, 13 aa, Mycobacterium
SKATQGLRGNEKL

SEQ ID NO: 1173074 - protein, 7 aa, Mycobacterium
SKDAEAD

SEQ ID NO: 1173075 - protein, 7 aa, Mycobacterium
SKDGLGA

SEQ ID NO: 1173076 - protein, 4 aa, Mycobacterium
SKDP

SEQ ID NO: 1173077 - protein, 8 aa, Mycobacterium
SKEEAKQW

SEQ ID NO: 1173078 - protein, 7 aa, Mycobacterium
SKFGASP

SEQ ID NO: 1173079 - protein, 10 aa, Mycobacterium
SKGASDQEIK

SEQ ID NO: 1173080 - protein, 5 aa, Mycobacterium
SKGDF

SEQ ID NO: 1173081 - protein, 5 aa, Mycobacterium
SKGDV

SEQ ID NO: 1173082 - protein, 15 aa, Mycobacterium
SKGEAGTGDVSNATT

SEQ ID NO: 1173083 - protein, 7 aa, Mycobacterium
SKGERAR

SEQ ID NO: 1173084 - protein, 11 aa, Mycobacterium
SKGGLEVRGEP

SEQ ID NO: 1173085 - protein, 6 aa, Mycobacterium
SKHAPA

SEQ ID NO: 1173086 - protein, 12 aa, Mycobacterium
SKINATVEGRPK

SEQ ID NO: 1173087 - protein, 16 aa, Mycobacterium
SKINGTSYEVDSESGW

SEQ ID NO: 1173088 - protein, 5 aa, Mycobacterium
SKISD

SEQ ID NO: 1173089 - protein, 7 aa, Mycobacterium
SKITDRT

SEQ ID NO: 1173090 - protein, 4 aa, Mycobacterium
SKKG

SEQ ID NO: 1173091 - protein, 10 aa, Mycobacterium
SKKLSDELEK

SEQ ID NO: 1173092 - protein, 9 aa, Mycobacterium
SKKSGSQTV

SEQ ID NO: 1173093 - protein, 4 aa, Mycobacterium
SKLG

SEQ ID NO: 1173094 - protein, 4 aa, Mycobacterium
SKLQ

SEQ ID NO: 1173095 - protein, 7 aa, Mycobacterium
SKNGPHD

SEQ ID NO: 1173096 - protein, 14 aa, Mycobacterium
SKNPDKAGSAIEKA

SEQ ID NO: 1173097 - protein, 8 aa, Mycobacterium
SKNPSDDL

SEQ ID NO: 1173098 - protein, 6 aa, Mycobacterium
SKPGHN

SEQ ID NO: 1173099 - protein, 4 aa, Mycobacterium
SKPI

SEQ ID NO: 1173100 - protein, 11 aa, Mycobacterium
SKPNPRTATNA

SEQ ID NO: 1173101 - protein, 4 aa, Mycobacterium
SKPV

SEQ ID NO: 1173102 - protein, 6 aa, Mycobacterium
SKPVGL

SEQ ID NO: 1173103 - protein, 9 aa, Mycobacterium
SKQQRAQDG

SEQ ID NO: 1173104 - protein, 9 aa, Mycobacterium
SKRARAERL

SEQ ID NO: 1173105 - protein, 7 aa, Mycobacterium
SKRGAEF

SEQ ID NO: 1173106 - protein, 17 aa, Mycobacterium
SKRRQGREQLASGDVEA

SEQ ID NO: 1173107 - protein, 18 aa, Mycobacterium
SKRSGGADIQTGRTSQRG

SEQ ID NO: 1173108 - protein, 10 aa, Mycobacterium
SKRSKRMTAS

SEQ ID NO: 1173109 - protein, 6 aa, Mycobacterium
SKRTGA

SEQ ID NO: 1173110 - protein, 9 aa, Mycobacterium
SKSASGGEL

SEQ ID NO: 1173111 - protein, 7 aa, Mycobacterium
SKSDRKM

SEQ ID NO: 1173112 - protein, 4 aa, Mycobacterium
SKSE

SEQ ID NO: 1173113 - protein, 9 aa, Mycobacterium
SKSGSTAKL

SEQ ID NO: 1173114 - protein, 8 aa, Mycobacterium
SKSRRYST

SEQ ID NO: 1173115 - protein, 22 aa, Mycobacterium
SKTAGVPTTDQPQKGKDFTSDQ

SEQ ID NO: 1173116 - protein, 13 aa, Mycobacterium
SKTPESLRPTDGY

SEQ ID NO: 1173117 - protein, 8 aa, Mycobacterium
SKTPVPQG

SEQ ID NO: 1173118 - protein, 6 aa, Mycobacterium
SKTQEI

SEQ ID NO: 1173119 - protein, 5 aa, Mycobacterium
SKTYP

SEQ ID NO: 1173120 - protein, 15 aa, Mycobacterium
SKVGRRNSYTINPKG

SEQ ID NO: 1173121 - protein, 15 aa, Mycobacterium
SLAASADASGRKVVD

SEQ ID NO: 1173122 - protein, 6 aa, Mycobacterium
SLAEGG

SEQ ID NO: 1173123 - protein, 8 aa, Mycobacterium
SLAGGSSM

SEQ ID NO: 1173124 - protein, 5 aa, Mycobacterium
SLAKR

SEQ ID NO: 1173125 - protein, 16 aa, Mycobacterium
SLAPGQFGQQALQGTT

SEQ ID NO: 1173126 - protein, 13 aa, Mycobacterium
SLARPPTTPPPTV

SEQ ID NO: 1173127 - protein, 24 aa, Mycobacterium
SLARPPTTPPPTVPPYRGPSGERA

SEQ ID NO: 1173128 - protein, 6 aa, Mycobacterium
SLDAPA

SEQ ID NO: 1173129 - protein, 5 aa, Mycobacterium
SLDDV

SEQ ID NO: 1173130 - protein, 4 aa, Mycobacterium
SLDE

SEQ ID NO: 1173131 - protein, 6 aa, Mycobacterium
SLDGPV

SEQ ID NO: 1173132 - protein, 7 aa, Mycobacterium
SLDSERS

SEQ ID NO: 1173133 - protein, 5 aa, Mycobacterium
SLEDG

SEQ ID NO: 1173134 - protein, 11 aa, Mycobacterium
SLGAETNTGDA

SEQ ID NO: 1173135 - protein, 8 aa, Mycobacterium
SLGAPESI

SEQ ID NO: 1173136 - protein, 7 aa, Mycobacterium
SLGAPTR

SEQ ID NO: 1173137 - protein, 12 aa, Mycobacterium
SLGATGGEGQTH

SEQ ID NO: 1173138 - protein, 9 aa, Mycobacterium
SLGESATYT

SEQ ID NO: 1173139 - protein, 4 aa, Mycobacterium
SLGG

SEQ ID NO: 1173140 - protein, 9 aa, Mycobacterium
SLGGRVGES

SEQ ID NO: 1173141 - protein, 7 aa, Mycobacterium
SLGHGTK

SEQ ID NO: 1173142 - protein, 11 aa, Mycobacterium
SLGPPGTSGAT

SEQ ID NO: 1173143 - protein, 11 aa, Mycobacterium
SLGQRPPGTLR

SEQ ID NO: 1173144 - protein, 5 aa, Mycobacterium
SLGRA

SEQ ID NO: 1173145 - protein, 10 aa, Mycobacterium
SLGRSEPHVE

SEQ ID NO: 1173146 - protein, 30 aa, Mycobacterium
SLGSLPKTERADAGKRVNVARSDAQRSYDE

SEQ ID NO: 1173147 - protein, 8 aa, Mycobacterium
SLGSQQDK

SEQ ID NO: 1173148 - protein, 12 aa, Mycobacterium
SLGTKAAGLRQE

SEQ ID NO: 1173149 - protein, 5 aa, Mycobacterium
SLGTR

SEQ ID NO: 1173150 - protein, 6 aa, Mycobacterium
SLGTTT

SEQ ID NO: 1173151 - protein, 13 aa, Mycobacterium
SLGVDPQGALRAM

SEQ ID NO: 1173152 - protein, 7 aa, Mycobacterium
SLHGDTA

SEQ ID NO: 1173153 - protein, 5 aa, Mycobacterium
SLHNS

SEQ ID NO: 1173154 - protein, 11 aa, Mycobacterium
SLHPPSDQVRS

SEQ ID NO: 1173155 - protein, 7 aa, Mycobacterium
SLKSADD

SEQ ID NO: 1173156 - protein, 8 aa, Mycobacterium
SLKTPDGF

SEQ ID NO: 1173157 - protein, 5 aa, Mycobacterium
SLNPG

SEQ ID NO: 1173158 - protein, 8 aa, Mycobacterium
SLPAESTA

SEQ ID NO: 1173159 - protein, 10 aa, Mycobacterium
SLPARAVPGD

SEQ ID NO: 1173160 - protein, 7 aa, Mycobacterium
SLPDTEI

SEQ ID NO: 1173161 - protein, 7 aa, Mycobacterium
SLPDVSR

SEQ ID NO: 1173162 - protein, 8 aa, Mycobacterium
SLPETPAL

SEQ ID NO: 1173163 - protein, 4 aa, Mycobacterium
SLPG

SEQ ID NO: 1173164 - protein, 10 aa, Mycobacterium
SLPGIGPKTA

SEQ ID NO: 1173165 - protein, 13 aa, Mycobacterium
SLPGSGGVSAQTP

SEQ ID NO: 1173166 - protein, 9 aa, Mycobacterium
SLPKTLDAA

SEQ ID NO: 1173167 - protein, 7 aa, Mycobacterium
SLPPAAG

SEQ ID NO: 1173168 - protein, 5 aa, Mycobacterium
SLPPE

SEQ ID NO: 1173169 - protein, 18 aa, Mycobacterium
SLPPGARVAPGSADGQRS

SEQ ID NO: 1173170 - protein, 7 aa, Mycobacterium
SLPPGLP

SEQ ID NO: 1173171 - protein, 6 aa, Mycobacterium
SLPPHN

SEQ ID NO: 1173172 - protein, 4 aa, Mycobacterium
SLPS

SEQ ID NO: 1173173 - protein, 6 aa, Mycobacterium
SLPSGH

SEQ ID NO: 1173174 - protein, 6 aa, Mycobacterium
SLPTDE

SEQ ID NO: 1173175 - protein, 8 aa, Mycobacterium
SLPTKQRQ

SEQ ID NO: 1173176 - protein, 9 aa, Mycobacterium
SLQPETRAA

SEQ ID NO: 1173177 - protein, 5 aa, Mycobacterium
SLQRR

SEQ ID NO: 1173178 - protein, 9 aa, Mycobacterium
SLRDGQASL

SEQ ID NO: 1173179 - protein, 8 aa, Mycobacterium
SLRRSQTG

SEQ ID NO: 1173180 - protein, 15 aa, Mycobacterium
SLRSGKVANAFPDET

SEQ ID NO: 1173181 - protein, 5 aa, Mycobacterium
SLSDN

SEQ ID NO: 1173182 - protein, 6 aa, Mycobacterium
SLSDNE

SEQ ID NO: 1173183 - protein, 6 aa, Mycobacterium
SLSGAR

SEQ ID NO: 1173184 - protein, 7 aa, Mycobacterium
SLSGNGI

SEQ ID NO: 1173185 - protein, 9 aa, Mycobacterium
SLSPDQRAE

SEQ ID NO: 1173186 - protein, 24 aa, Mycobacterium
SLSRSASEQLDRVDESGPGVTADA

SEQ ID NO: 1173187 - protein, 5 aa, Mycobacterium
SLTDS

SEQ ID NO: 1173188 - protein, 6 aa, Mycobacterium
SLTDSR

SEQ ID NO: 1173189 - protein, 7 aa, Mycobacterium
SLTGGPQ

SEQ ID NO: 1173190 - protein, 7 aa, Mycobacterium
SLTGPGG

SEQ ID NO: 1173191 - protein, 6 aa, Mycobacterium
SLTPAS

SEQ ID NO: 1173192 - protein, 4 aa, Mycobacterium
SLTR

SEQ ID NO: 1173193 - protein, 6 aa, Mycobacterium
SLTSAE

SEQ ID NO: 1173194 - protein, 12 aa, Mycobacterium
SLVTGGEKVDPG

SEQ ID NO: 1173195 - protein, 9 aa, Mycobacterium
SLYAPQAQN

SEQ ID NO: 1173196 - protein, 10 aa, Mycobacterium
SLYGGDTVTS

SEQ ID NO: 1173197 - protein, 12 aa, Mycobacterium
SLYTAGKKAREL

SEQ ID NO: 1173198 - protein, 4 aa, Mycobacterium
SMDD

SEQ ID NO: 1173199 - protein, 9 aa, Mycobacterium
SMEKGRRAG

SEQ ID NO: 1173200 - protein, 8 aa, Mycobacterium
SMNEPGLP

SEQ ID NO: 1173201 - protein, 11 aa, Mycobacterium
SMNSDGRWDPG

SEQ ID NO: 1173202 - protein, 18 aa, Mycobacterium
SMRATASPGTVDTEQHRT

SEQ ID NO: 1173203 - protein, 4 aa, Mycobacterium
SMRH

SEQ ID NO: 1173204 - protein, 11 aa, Mycobacterium
SMSGTPGPSYI

SEQ ID NO: 1173205 - protein, 4 aa, Mycobacterium
SMSP

SEQ ID NO: 1173206 - protein, 9 aa, Mycobacterium
SNAATGVRY

SEQ ID NO: 1173207 - protein, 6 aa, Mycobacterium
SNAGGR

SEQ ID NO: 1173208 - protein, 7 aa, Mycobacterium
SNAPHEQ

SEQ ID NO: 1173209 - protein, 6 aa, Mycobacterium
SNARGK

SEQ ID NO: 1173210 - protein, 8 aa, Mycobacterium
SNDAKEGA

SEQ ID NO: 1173211 - protein, 4 aa, Mycobacterium
SNDE

SEQ ID NO: 1173212 - protein, 10 aa, Mycobacterium
SNEPGLSGAE

SEQ ID NO: 1173213 - protein, 10 aa, Mycobacterium
SNGCAYADSP

SEQ ID NO: 1173214 - protein, 6 aa, Mycobacterium
SNGDVA

SEQ ID NO: 1173215 - protein, 6 aa, Mycobacterium
SNGHGG

SEQ ID NO: 1173216 - protein, 14 aa, Mycobacterium
SNGHPVTKVDSGRE

SEQ ID NO: 1173217 - protein, 6 aa, Mycobacterium
SNHEFP

SEQ ID NO: 1173218 - protein, 7 aa, Mycobacterium
SNHYPDD

SEQ ID NO: 1173219 - protein, 19 aa, Mycobacterium
SNIAQDGKGYASGTQLGEG

SEQ ID NO: 1173220 - protein, 13 aa, Mycobacterium
SNLSDTASGLAQS

SEQ ID NO: 1173221 - protein, 5 aa, Mycobacterium
SNNDY

SEQ ID NO: 1173222 - protein, 6 aa, Mycobacterium
SNPAAQ

SEQ ID NO: 1173223 - protein, 7 aa, Mycobacterium
SNPADDA

SEQ ID NO: 1173224 - protein, 11 aa, Mycobacterium
SNPAKVGRDAG

SEQ ID NO: 1173225 - protein, 6 aa, Mycobacterium
SNPDAR

SEQ ID NO: 1173226 - protein, 4 aa, Mycobacterium
SNPG

SEQ ID NO: 1173227 - protein, 16 aa, Mycobacterium
SNPQLTSTAHPGDGDD

SEQ ID NO: 1173228 - protein, 6 aa, Mycobacterium
SNPVRD

SEQ ID NO: 1173229 - protein, 8 aa, Mycobacterium
SNPYGNGT

SEQ ID NO: 1173230 - protein, 5 aa, Mycobacterium
SNRGI

SEQ ID NO: 1173231 - protein, 4 aa, Mycobacterium
SNRH

SEQ ID NO: 1173232 - protein, 5 aa, Mycobacterium
SNRID

SEQ ID NO: 1173233 - protein, 10 aa, Mycobacterium
SNRKDEAAKV

SEQ ID NO: 1173234 - protein, 7 aa, Mycobacterium
SNRRARH

SEQ ID NO: 1173235 - protein, 6 aa, Mycobacterium
SNRRTG

SEQ ID NO: 1173236 - protein, 7 aa, Mycobacterium
SNRSRDL

SEQ ID NO: 1173237 - protein, 5 aa, Mycobacterium
SNSRS

SEQ ID NO: 1173238 - protein, 5 aa, Mycobacterium
SNTPD

SEQ ID NO: 1173239 - protein, 12 aa, Mycobacterium
SNVTSREGKRGG

SEQ ID NO: 1173240 - protein, 6 aa, Mycobacterium
SPAADG

SEQ ID NO: 1173241 - protein, 6 aa, Mycobacterium
SPAAHR

SEQ ID NO: 1173242 - protein, 7 aa, Mycobacterium
SPAATAA

SEQ ID NO: 1173243 - protein, 13 aa, Mycobacterium
SPACAAAAPEKSN

SEQ ID NO: 1173244 - protein, 11 aa, Mycobacterium
SPADHGKATRD

SEQ ID NO: 1173245 - protein, 13 aa, Mycobacterium
SPAELEADEDYQK

SEQ ID NO: 1173246 - protein, 4 aa, Mycobacterium
SPAF

SEQ ID NO: 1173247 - protein, 6 aa, Mycobacterium
SPAGAD

SEQ ID NO: 1173248 - protein, 8 aa, Mycobacterium
SPAGAPPH

SEQ ID NO: 1173249 - protein, 5 aa, Mycobacterium
SPAGI

SEQ ID NO: 1173250 - protein, 11 aa, Mycobacterium
SPAHAEGGQRR

SEQ ID NO: 1173251 - protein, 8 aa, Mycobacterium
SPANPTGT

SEQ ID NO: 1173252 - protein, 6 aa, Mycobacterium
SPAPDR

SEQ ID NO: 1173253 - protein, 8 aa, Mycobacterium
SPAPSEPV

SEQ ID NO: 1173254 - protein, 8 aa, Mycobacterium
SPAPSSNH

SEQ ID NO: 1173255 - protein, 8 aa, Mycobacterium
SPARPDDA

SEQ ID NO: 1173256 - protein, 7 aa, Mycobacterium
SPASADA

SEQ ID NO: 1173257 - protein, 7 aa, Mycobacterium
SPASASL

SEQ ID NO: 1173258 - protein, 15 aa, Mycobacterium
SPASAVRGWDSMPAR

SEQ ID NO: 1173259 - protein, 7 aa, Mycobacterium
SPASPLG

SEQ ID NO: 1173260 - protein, 5 aa, Mycobacterium
SPAYT

SEQ ID NO: 1173261 - protein, 6 aa, Mycobacterium
SPCEEC

SEQ ID NO: 1173262 - protein, 13 aa, Mycobacterium
SPDCAAGGLSASP

SEQ ID NO: 1173263 - protein, 11 aa, Mycobacterium
SPDDENLEPSG

SEQ ID NO: 1173264 - protein, 19 aa, Mycobacterium
SPDEAQPLDTYGRSSNPTW

SEQ ID NO: 1173265 - protein, 5 aa, Mycobacterium
SPDEM

SEQ ID NO: 1173266 - protein, 10 aa, Mycobacterium
SPDGDGYRLD

SEQ ID NO: 1173267 - protein, 7 aa, Mycobacterium
SPDGKEV

SEQ ID NO: 1173268 - protein, 5 aa, Mycobacterium
SPDLP

SEQ ID NO: 1173269 - protein, 8 aa, Mycobacterium
SPDPIEAT

SEQ ID NO: 1173270 - protein, 11 aa, Mycobacterium
SPDPKPSAGLG

SEQ ID NO: 1173271 - protein, 8 aa, Mycobacterium
SPDPQPGA

SEQ ID NO: 1173272 - protein, 7 aa, Mycobacterium
SPDQEWK

SEQ ID NO: 1173273 - protein, 12 aa, Mycobacterium
SPDRAGGQRAAE

SEQ ID NO: 1173274 - protein, 12 aa, Mycobacterium
SPDSELVTESHG

SEQ ID NO: 1173275 - protein, 6 aa, Mycobacterium
SPDSVS

SEQ ID NO: 1173276 - protein, 7 aa, Mycobacterium
SPDTRHD

SEQ ID NO: 1173277 - protein, 5 aa, Mycobacterium
SPDWD

SEQ ID NO: 1173278 - protein, 9 aa, Mycobacterium
SPDYADNTK

SEQ ID NO: 1173279 - protein, 10 aa, Mycobacterium
SPEDVDRAEA

SEQ ID NO: 1173280 - protein, 18 aa, Mycobacterium
SPEELEDRYSTRRCRAPA

SEQ ID NO: 1173281 - protein, 5 aa, Mycobacterium
SPEEV

SEQ ID NO: 1173282 - protein, 8 aa, Mycobacterium
SPEHRASA

SEQ ID NO: 1173283 - protein, 5 aa, Mycobacterium
SPEIS

SEQ ID NO: 1173284 - protein, 8 aa, Mycobacterium
SPELGPDD

SEQ ID NO: 1173285 - protein, 9 aa, Mycobacterium
SPENPDGTE

SEQ ID NO: 1173286 - protein, 6 aa, Mycobacterium
SPEPPS

SEQ ID NO: 1173287 - protein, 7 aa, Mycobacterium
SPETGPS

SEQ ID NO: 1173288 - protein, 6 aa, Mycobacterium
SPETTA

SEQ ID NO: 1173289 - protein, 7 aa, Mycobacterium
SPETVDD

SEQ ID NO: 1173290 - protein, 6 aa, Mycobacterium
SPEVSA

SEQ ID NO: 1173291 - protein, 24 aa, Mycobacterium
SPFSPQTSFAPTTEFASRNDTDLL

SEQ ID NO: 1173292 - protein, 7 aa, Mycobacterium
SPFTDDP

SEQ ID NO: 1173293 - protein, 6 aa, Mycobacterium
SPFTRR

SEQ ID NO: 1173294 - protein, 8 aa, Mycobacterium
SPGAAPTY

SEQ ID NO: 1173295 - protein, 7 aa, Mycobacterium
SPGDLER

SEQ ID NO: 1173296 - protein, 8 aa, Mycobacterium
SPGEAQRR

SEQ ID NO: 1173297 - protein, 8 aa, Mycobacterium
SPGELDGL

SEQ ID NO: 1173298 - protein, 9 aa, Mycobacterium
SPGGLPAGI

SEQ ID NO: 1173299 - protein, 5 aa, Mycobacterium
SPGGS

SEQ ID NO: 1173300 - protein, 8 aa, Mycobacterium
SPGMEQAK

SEQ ID NO: 1173301 - protein, 5 aa, Mycobacterium
SPGPV

SEQ ID NO: 1173302 - protein, 8 aa, Mycobacterium
SPGSIDTE

SEQ ID NO: 1173303 - protein, 12 aa, Mycobacterium
SPGVDRPLTTEK

SEQ ID NO: 1173304 - protein, 5 aa, Mycobacterium
SPGVV

SEQ ID NO: 1173305 - protein, 8 aa, Mycobacterium
SPHDSHAS

SEQ ID NO: 1173306 - protein, 5 aa, Mycobacterium
SPHGE

SEQ ID NO: 1173307 - protein, 8 aa, Mycobacterium
SPHNPTGM

SEQ ID NO: 1173308 - protein, 19 aa, Mycobacterium
SPHPAALRTSATRRRDQGR

SEQ ID NO: 1173309 - protein, 10 aa, Mycobacterium
SPHPSPLSAS

SEQ ID NO: 1173310 - protein, 17 aa, Mycobacterium
SPIEPNKPNIREDESDR

SEQ ID NO: 1173311 - protein, 10 aa, Mycobacterium
SPIGRANKGS

SEQ ID NO: 1173312 - protein, 13 aa, Mycobacterium
SPKCGNGNDPLDK

SEQ ID NO: 1173313 - protein, 6 aa, Mycobacterium
SPKGAS

SEQ ID NO: 1173314 - protein, 15 aa, Mycobacterium
SPKPAADAAKPTIEG

SEQ ID NO: 1173315 - protein, 6 aa, Mycobacterium
SPLDDT

SEQ ID NO: 1173316 - protein, 5 aa, Mycobacterium
SPLDT

SEQ ID NO: 1173317 - protein, 16 aa, Mycobacterium
SPLGGPEDADGYDVST

SEQ ID NO: 1173318 - protein, 5 aa, Mycobacterium
SPLGQ

SEQ ID NO: 1173319 - protein, 7 aa, Mycobacterium
SPLPPAV

SEQ ID NO: 1173320 - protein, 9 aa, Mycobacterium
SPLQPRPDR

SEQ ID NO: 1173321 - protein, 11 aa, Mycobacterium
SPLSTGDAAGY

SEQ ID NO: 1173322 - protein, 14 aa, Mycobacterium
SPLTPDHVNPERPW

SEQ ID NO: 1173323 - protein, 5 aa, Mycobacterium
SPLVP

SEQ ID NO: 1173324 - protein, 14 aa, Mycobacterium
SPMGGQGMNTGIQD

SEQ ID NO: 1173325 - protein, 17 aa, Mycobacterium
SPMKKGSNSSQSSQPFT

SEQ ID NO: 1173326 - protein, 8 aa, Mycobacterium
SPNGAAQE

SEQ ID NO: 1173327 - protein, 10 aa, Mycobacterium
SPNGGAAARG

SEQ ID NO: 1173328 - protein, 12 aa, Mycobacterium
SPNGGDKPTGEL

SEQ ID NO: 1173329 - protein, 12 aa, Mycobacterium
SPNGVRTADGVE

SEQ ID NO: 1173330 - protein, 11 aa, Mycobacterium
SPNNPSGQSVP

SEQ ID NO: 1173331 - protein, 13 aa, Mycobacterium
SPPGFGAPLPGGF

SEQ ID NO: 1173332 - protein, 5 aa, Mycobacterium
SPPNE

SEQ ID NO: 1173333 - protein, 7 aa, Mycobacterium
SPPPKLG

SEQ ID NO: 1173334 - protein, 12 aa, Mycobacterium
SPPQADHGGLPH

SEQ ID NO: 1173335 - protein, 20 aa, Mycobacterium
SPPQQLPDDVARTQLETFIE

SEQ ID NO: 1173336 - protein, 4 aa, Mycobacterium
SPPY

SEQ ID NO: 1173337 - protein, 5 aa, Mycobacterium
SPQAF

SEQ ID NO: 1173338 - protein, 5 aa, Mycobacterium
SPQAI

SEQ ID NO: 1173339 - protein, 9 aa, Mycobacterium
SPQAPTSQE

SEQ ID NO: 1173340 - protein, 9 aa, Mycobacterium
SPQGGYRAD

SEQ ID NO: 1173341 - protein, 23 aa, Mycobacterium
SPQNLPPGTTVDPAQVPGQSPNV

SEQ ID NO: 1173342 - protein, 15 aa, Mycobacterium
SPQRTSGGGRRYSER

SEQ ID NO: 1173343 - protein, 6 aa, Mycobacterium
SPQSGM

SEQ ID NO: 1173344 - protein, 14 aa, Mycobacterium
SPQSTVVGGAKESI

SEQ ID NO: 1173345 - protein, 16 aa, Mycobacterium
SPRDESAVARGLGSGA

SEQ ID NO: 1173346 - protein, 14 aa, Mycobacterium
SPREGDADVSGREV

SEQ ID NO: 1173347 - protein, 24 aa, Mycobacterium
SPRGNTQWARNARAAGEVEAGPRW

SEQ ID NO: 1173348 - protein, 8 aa, Mycobacterium
SPRHTGRD

SEQ ID NO: 1173349 - protein, 9 aa, Mycobacterium
SPRKQWPSG

SEQ ID NO: 1173350 - protein, 8 aa, Mycobacterium
SPRQQDYD

SEQ ID NO: 1173351 - protein, 11 aa, Mycobacterium
SPRRLRSGPMG

SEQ ID NO: 1173352 - protein, 5 aa, Mycobacterium
SPSAD

SEQ ID NO: 1173353 - protein, 6 aa, Mycobacterium
SPSDYP

SEQ ID NO: 1173354 - protein, 6 aa, Mycobacterium
SPSGHT

SEQ ID NO: 1173355 - protein, 7 aa, Mycobacterium
SPSLAPR

SEQ ID NO: 1173356 - protein, 7 aa, Mycobacterium
SPSLPPT

SEQ ID NO: 1173357 - protein, 4 aa, Mycobacterium
SPSP

SEQ ID NO: 1173358 - protein, 6 aa, Mycobacterium
SPSPGR

SEQ ID NO: 1173359 - protein, 7 aa, Mycobacterium
SPSRNAA

SEQ ID NO: 1173360 - protein, 16 aa, Mycobacterium
SPSSLDPYTHPDATLE

SEQ ID NO: 1173361 - protein, 10 aa, Mycobacterium
SPSTEEAASV

SEQ ID NO: 1173362 - protein, 5 aa, Mycobacterium
SPSTL

SEQ ID NO: 1173363 - protein, 17 aa, Mycobacterium
SPTASGCRVTESTWDRR

SEQ ID NO: 1173364 - protein, 5 aa, Mycobacterium
SPTDL

SEQ ID NO: 1173365 - protein, 5 aa, Mycobacterium
SPTES

SEQ ID NO: 1173366 - protein, 7 aa, Mycobacterium
SPTGDRL

SEQ ID NO: 1173367 - protein, 7 aa, Mycobacterium
SPTGTPH

SEQ ID NO: 1173368 - protein, 6 aa, Mycobacterium
SPTRST

SEQ ID NO: 1173369 - protein, 7 aa, Mycobacterium
SPTRTRV

SEQ ID NO: 1173370 - protein, 6 aa, Mycobacterium
SPTSDA

SEQ ID NO: 1173371 - protein, 5 aa, Mycobacterium
SPTWD

SEQ ID NO: 1173372 - protein, 6 aa, Mycobacterium
SPVDDP

SEQ ID NO: 1173373 - protein, 13 aa, Mycobacterium
SPVDGAPTKPVKA

SEQ ID NO: 1173374 - protein, 12 aa, Mycobacterium
SPVDGDTRNPFE

SEQ ID NO: 1173375 - protein, 5 aa, Mycobacterium
SPVGG

SEQ ID NO: 1173376 - protein, 12 aa, Mycobacterium
SPVGKRNGGLSG

SEQ ID NO: 1173377 - protein, 7 aa, Mycobacterium
SPVGTFP

SEQ ID NO: 1173378 - protein, 30 aa, Mycobacterium
SPVKPSPLDPPHVPAAPTADEDLSTKPAAQ

SEQ ID NO: 1173379 - protein, 5 aa, Mycobacterium
SPVND

SEQ ID NO: 1173380 - protein, 4 aa, Mycobacterium
SPVS

SEQ ID NO: 1173381 - protein, 12 aa, Mycobacterium
SPVSDADEASLA

SEQ ID NO: 1173382 - protein, 4 aa, Mycobacterium
SPWK

SEQ ID NO: 1173383 - protein, 4 aa, Mycobacterium
SPYE

SEQ ID NO: 1173384 - protein, 6 aa, Mycobacterium
SPYESD

SEQ ID NO: 1173385 - protein, 6 aa, Mycobacterium
SPYQNI

SEQ ID NO: 1173386 - protein, 8 aa, Mycobacterium
SQADVDAG

SEQ ID NO: 1173387 - protein, 8 aa, Mycobacterium
SQAEGGPG

SEQ ID NO: 1173388 - protein, 6 aa, Mycobacterium
SQAEKD

SEQ ID NO: 1173389 - protein, 10 aa, Mycobacterium
SQAKAKQAWA

SEQ ID NO: 1173390 - protein, 14 aa, Mycobacterium
SQASRRRAQRRLPD

SEQ ID NO: 1173391 - protein, 6 aa, Mycobacterium
SQAVGP

SEQ ID NO: 1173392 - protein, 15 aa, Mycobacterium
SQCETTQNRDQGTGA

SEQ ID NO: 1173393 - protein, 26 aa, Mycobacterium
SQDAAVAAPEARDSAPPLPPTETPGD

SEQ ID NO: 1173394 - protein, 6 aa, Mycobacterium
SQDDAV

SEQ ID NO: 1173395 - protein, 8 aa, Mycobacterium
SQDGTDID

SEQ ID NO: 1173396 - protein, 14 aa, Mycobacterium
SQDIDGDQSMQGWA

SEQ ID NO: 1173397 - protein, 9 aa, Mycobacterium
SQDPDAPIG

SEQ ID NO: 1173398 - protein, 11 aa, Mycobacterium
SQDPDTPGLAE

SEQ ID NO: 1173399 - protein, 19 aa, Mycobacterium
SQDSNKKLTEIAQQVIDTR

SEQ ID NO: 1173400 - protein, 8 aa, Mycobacterium
SQETNTKL

SEQ ID NO: 1173401 - protein, 6 aa, Mycobacterium
SQGDGE

SEQ ID NO: 1173402 - protein, 10 aa, Mycobacterium
SQGGRKEHPQ

SEQ ID NO: 1173403 - protein, 5 aa, Mycobacterium
SQGHR

SEQ ID NO: 1173404 - protein, 4 aa, Mycobacterium
SQGT

SEQ ID NO: 1173405 - protein, 8 aa, Mycobacterium
SQISDGAS

SEQ ID NO: 1173406 - protein, 9 aa, Mycobacterium
SQLPAAKRG

SEQ ID NO: 1173407 - protein, 9 aa, Mycobacterium
SQMRASSPR

SEQ ID NO: 1173408 - protein, 9 aa, Mycobacterium
SQNPQASAL

SEQ ID NO: 1173409 - protein, 4 aa, Mycobacterium
SQNR

SEQ ID NO: 1173410 - protein, 5 aa, Mycobacterium
SQPCT

SEQ ID NO: 1173411 - protein, 7 aa, Mycobacterium
SQPEQKA

SEQ ID NO: 1173412 - protein, 9 aa, Mycobacterium
SQPGFTDAA

SEQ ID NO: 1173413 - protein, 5 aa, Mycobacterium
SQPGM

SEQ ID NO: 1173414 - protein, 9 aa, Mycobacterium
SQPGYDGRP

SEQ ID NO: 1173415 - protein, 9 aa, Mycobacterium
SQPPNPKAT

SEQ ID NO: 1173416 - protein, 7 aa, Mycobacterium
SQPPWRP

SEQ ID NO: 1173417 - protein, 9 aa, Mycobacterium
SQPRTPDIP

SEQ ID NO: 1173418 - protein, 6 aa, Mycobacterium
SQPVPS

SEQ ID NO: 1173419 - protein, 8 aa, Mycobacterium
SQQDINDT

SEQ ID NO: 1173420 - protein, 8 aa, Mycobacterium
SQQNTFTG

SEQ ID NO: 1173421 - protein, 6 aa, Mycobacterium
SQQVGE

SEQ ID NO: 1173422 - protein, 10 aa, Mycobacterium
SQRGRDGGYE

SEQ ID NO: 1173423 - protein, 13 aa, Mycobacterium
SQRHPDLRSDEHD

SEQ ID NO: 1173424 - protein, 21 aa, Mycobacterium
SQRISPRTRDAVRKAAETLGY

SEQ ID NO: 1173425 - protein, 16 aa, Mycobacterium
SQRRHRPDDPAMKPQP

SEQ ID NO: 1173426 - protein, 5 aa, Mycobacterium
SQRRM

SEQ ID NO: 1173427 - protein, 19 aa, Mycobacterium
SQRSRNRHVGEQLGSGKPI

SEQ ID NO: 1173428 - protein, 6 aa, Mycobacterium
SQRTKD

SEQ ID NO: 1173429 - protein, 4 aa, Mycobacterium
SQSE

SEQ ID NO: 1173430 - protein, 8 aa, Mycobacterium
SQSPASGM

SEQ ID NO: 1173431 - protein, 6 aa, Mycobacterium
SQSRPA

SEQ ID NO: 1173432 - protein, 7 aa, Mycobacterium
SQSRPGA

SEQ ID NO: 1173433 - protein, 4 aa, Mycobacterium
SQTG

SEQ ID NO: 1173434 - protein, 8 aa, Mycobacterium
SQTGTPIS

SEQ ID NO: 1173435 - protein, 21 aa, Mycobacterium
SQTQWYSDDAGDRVFTPRYYP

SEQ ID NO: 1173436 - protein, 5 aa, Mycobacterium
SQTRR

SEQ ID NO: 1173437 - protein, 19 aa, Mycobacterium
SQVEAQAPYRKVGAGPLDT

SEQ ID NO: 1173438 - protein, 8 aa, Mycobacterium
SQVPDEAA

SEQ ID NO: 1173439 - protein, 8 aa, Mycobacterium
SQYGDSPA

SEQ ID NO: 1173440 - protein, 5 aa, Mycobacterium
SQYNG

SEQ ID NO: 1173441 - protein, 12 aa, Mycobacterium
SRAAARRAGRLG

SEQ ID NO: 1173442 - protein, 9 aa, Mycobacterium
SRAAEGDDN

SEQ ID NO: 1173443 - protein, 24 aa, Mycobacterium
SRAATPDDLRRPSDAGTDPGTRRR

SEQ ID NO: 1173444 - protein, 9 aa, Mycobacterium
SRADDSERL

SEQ ID NO: 1173445 - protein, 6 aa, Mycobacterium
SRAEAQ

SEQ ID NO: 1173446 - protein, 7 aa, Mycobacterium
SRAGEFT

SEQ ID NO: 1173447 - protein, 7 aa, Mycobacterium
SRAGEGA

SEQ ID NO: 1173448 - protein, 5 aa, Mycobacterium
SRAGG

SEQ ID NO: 1173449 - protein, 8 aa, Mycobacterium
SRAGGARG

SEQ ID NO: 1173450 - protein, 6 aa, Mycobacterium
SRAGGE

SEQ ID NO: 1173451 - protein, 14 aa, Mycobacterium
SRAGGHADGVPDDG

SEQ ID NO: 1173452 - protein, 6 aa, Mycobacterium
SRAGRG

SEQ ID NO: 1173453 - protein, 9 aa, Mycobacterium
SRAQQKNNT

SEQ ID NO: 1173454 - protein, 10 aa, Mycobacterium
SRAQRTGEPY

SEQ ID NO: 1173455 - protein, 6 aa, Mycobacterium
SRATEK

SEQ ID NO: 1173456 - protein, 11 aa, Mycobacterium
SRATHAGEDYT

SEQ ID NO: 1173457 - protein, 8 aa, Mycobacterium
SRATVPPA

SEQ ID NO: 1173458 - protein, 8 aa, Mycobacterium
SRDDNGKL

SEQ ID NO: 1173459 - protein, 10 aa, Mycobacterium
SRDDTGELTR

SEQ ID NO: 1173460 - protein, 6 aa, Mycobacterium
SRDEAT

SEQ ID NO: 1173461 - protein, 9 aa, Mycobacterium
SRDEGPTVA

SEQ ID NO: 1173462 - protein, 11 aa, Mycobacterium
SRDFSAELSGA

SEQ ID NO: 1173463 - protein, 5 aa, Mycobacterium
SRDGK

SEQ ID NO: 1173464 - protein, 4 aa, Mycobacterium
SRDH

SEQ ID NO: 1173465 - protein, 8 aa, Mycobacterium
SRDRGAEH

SEQ ID NO: 1173466 - protein, 9 aa, Mycobacterium
SRDRGAEHA

SEQ ID NO: 1173467 - protein, 11 aa, Mycobacterium
SRDTADEAWQQ

SEQ ID NO: 1173468 - protein, 8 aa, Mycobacterium
SRDTDPAS

SEQ ID NO: 1173469 - protein, 6 aa, Mycobacterium
SREDAA

SEQ ID NO: 1173470 - protein, 8 aa, Mycobacterium
SREDDPDA

SEQ ID NO: 1173471 - protein, 7 aa, Mycobacterium
SREDQDH

SEQ ID NO: 1173472 - protein, 4 aa, Mycobacterium
SREE

SEQ ID NO: 1173473 - protein, 20 aa, Mycobacterium
SREEVNRRDPTTAEASEARG

SEQ ID NO: 1173474 - protein, 7 aa, Mycobacterium
SRELSTA

SEQ ID NO: 1173475 - protein, 7 aa, Mycobacterium
SREPGAD

SEQ ID NO: 1173476 - protein, 5 aa, Mycobacterium
SRESA

SEQ ID NO: 1173477 - protein, 13 aa, Mycobacterium
SRESGHDVDDSTA

SEQ ID NO: 1173478 - protein, 8 aa, Mycobacterium
SRESPQWE

SEQ ID NO: 1173479 - protein, 7 aa, Mycobacterium
SRESTVP

SEQ ID NO: 1173480 - protein, 5 aa, Mycobacterium
SRETA

SEQ ID NO: 1173481 - protein, 5 aa, Mycobacterium
SRGAS

SEQ ID NO: 1173482 - protein, 8 aa, Mycobacterium
SRGASADV

SEQ ID NO: 1173483 - protein, 7 aa, Mycobacterium
SRGEGLT

SEQ ID NO: 1173484 - protein, 8 aa, Mycobacterium
SRGEPAIP

SEQ ID NO: 1173485 - protein, 9 aa, Mycobacterium
SRGESFEGT

SEQ ID NO: 1173486 - protein, 5 aa, Mycobacterium
SRGFG

SEQ ID NO: 1173487 - protein, 7 aa, Mycobacterium
SRGGADA

SEQ ID NO: 1173488 - protein, 5 aa, Mycobacterium
SRGGD

SEQ ID NO: 1173489 - protein, 6 aa, Mycobacterium
SRGGGR

SEQ ID NO: 1173490 - protein, 7 aa, Mycobacterium
SRGGGRY

SEQ ID NO: 1173491 - protein, 8 aa, Mycobacterium
SRGGSDKH

SEQ ID NO: 1173492 - protein, 15 aa, Mycobacterium
SRGHGDSDRSPEANY

SEQ ID NO: 1173493 - protein, 4 aa, Mycobacterium
SRGI

SEQ ID NO: 1173494 - protein, 4 aa, Mycobacterium
SRGL

SEQ ID NO: 1173495 - protein, 5 aa, Mycobacterium
SRGLG

SEQ ID NO: 1173496 - protein, 7 aa, Mycobacterium
SRGPATM

SEQ ID NO: 1173497 - protein, 5 aa, Mycobacterium
SRGPD

SEQ ID NO: 1173498 - protein, 5 aa, Mycobacterium
SRGPL

SEQ ID NO: 1173499 - protein, 7 aa, Mycobacterium
SRGRGAL

SEQ ID NO: 1173500 - protein, 6 aa, Mycobacterium
SRGRNA

SEQ ID NO: 1173501 - protein, 16 aa, Mycobacterium
SRGRTTAGGKNHPVPG

SEQ ID NO: 1173502 - protein, 6 aa, Mycobacterium
SRGSQV

SEQ ID NO: 1173503 - protein, 7 aa, Mycobacterium
SRHVSPA

SEQ ID NO: 1173504 - protein, 16 aa, Mycobacterium
SRIGAGDSEAAGQSMA

SEQ ID NO: 1173505 - protein, 19 aa, Mycobacterium
SRIPAASAGTHPADSIHPG

SEQ ID NO: 1173506 - protein, 7 aa, Mycobacterium
SRKEAEL

SEQ ID NO: 1173507 - protein, 9 aa, Mycobacterium
SRKKSAAAE

SEQ ID NO: 1173508 - protein, 9 aa, Mycobacterium
SRKLNPDDI

SEQ ID NO: 1173509 - protein, 18 aa, Mycobacterium
SRKPGSDDDHAAAAADGW

SEQ ID NO: 1173510 - protein, 15 aa, Mycobacterium
SRLDDEGRAALSGYG

SEQ ID NO: 1173511 - protein, 7 aa, Mycobacterium
SRMTGKP

SEQ ID NO: 1173512 - protein, 11 aa, Mycobacterium
SRNAARTPTAR

SEQ ID NO: 1173513 - protein, 7 aa, Mycobacterium
SRNAATG

SEQ ID NO: 1173514 - protein, 9 aa, Mycobacterium
SRNASRMAK

SEQ ID NO: 1173515 - protein, 5 aa, Mycobacterium
SRNED

SEQ ID NO: 1173516 - protein, 5 aa, Mycobacterium
SRNGI

SEQ ID NO: 1173517 - protein, 7 aa, Mycobacterium
SRNPDGE

SEQ ID NO: 1173518 - protein, 8 aa, Mycobacterium
SRNPGDRL

SEQ ID NO: 1173519 - protein, 12 aa, Mycobacterium
SRPAAGMPTTGP

SEQ ID NO: 1173520 - protein, 14 aa, Mycobacterium
SRPADSDLLPPEQN

SEQ ID NO: 1173521 - protein, 5 aa, Mycobacterium
SRPAP

SEQ ID NO: 1173522 - protein, 9 aa, Mycobacterium
SRPDGSHRA

SEQ ID NO: 1173523 - protein, 9 aa, Mycobacterium
SRPDPAAQR

SEQ ID NO: 1173524 - protein, 7 aa, Mycobacterium
SRPGALN

SEQ ID NO: 1173525 - protein, 7 aa, Mycobacterium
SRPGNDE

SEQ ID NO: 1173526 - protein, 5 aa, Mycobacterium
SRPGR

SEQ ID NO: 1173527 - protein, 10 aa, Mycobacterium
SRPGRSTLSA

SEQ ID NO: 1173528 - protein, 12 aa, Mycobacterium
SRPPAEQPAASL

SEQ ID NO: 1173529 - protein, 7 aa, Mycobacterium
SRPPEDQ

SEQ ID NO: 1173530 - protein, 7 aa, Mycobacterium
SRPQTAA

SEQ ID NO: 1173531 - protein, 6 aa, Mycobacterium
SRPSDV

SEQ ID NO: 1173532 - protein, 12 aa, Mycobacterium
SRPSEATAVDSA

SEQ ID NO: 1173533 - protein, 6 aa, Mycobacterium
SRPTHE

SEQ ID NO: 1173534 - protein, 12 aa, Mycobacterium
SRPVADADEAAG

SEQ ID NO: 1173535 - protein, 10 aa, Mycobacterium
SRPVAGGERV

SEQ ID NO: 1173536 - protein, 10 aa, Mycobacterium
SRQEDSPTMK

SEQ ID NO: 1173537 - protein, 10 aa, Mycobacterium
SRQESEEGVA

SEQ ID NO: 1173538 - protein, 6 aa, Mycobacterium
SRQGAG

SEQ ID NO: 1173539 - protein, 7 aa, Mycobacterium
SRQPELD

SEQ ID NO: 1173540 - protein, 11 aa, Mycobacterium
SRQRASQTDDN

SEQ ID NO: 1173541 - protein, 5 aa, Mycobacterium
SRQRG

SEQ ID NO: 1173542 - protein, 4 aa, Mycobacterium
SRQV

SEQ ID NO: 1173543 - protein, 15 aa, Mycobacterium
SRRAAEREADARERE

SEQ ID NO: 1173544 - protein, 5 aa, Mycobacterium
SRRAG

SEQ ID NO: 1173545 - protein, 7 aa, Mycobacterium
SRRATEL

SEQ ID NO: 1173546 - protein, 10 aa, Mycobacterium
SRRDPDGPYG

SEQ ID NO: 1173547 - protein, 9 aa, Mycobacterium
SRREHPTDD

SEQ ID NO: 1173548 - protein, 11 aa, Mycobacterium
SRREPDADTQQ

SEQ ID NO: 1173549 - protein, 6 aa, Mycobacterium
SRREPG

SEQ ID NO: 1173550 - protein, 13 aa, Mycobacterium
SRRGATDDRRGAT

SEQ ID NO: 1173551 - protein, 7 aa, Mycobacterium
SRRRPQA

SEQ ID NO: 1173552 - protein, 11 aa, Mycobacterium
SRRRRGAEATA

SEQ ID NO: 1173553 - protein, 7 aa, Mycobacterium
SRRTAGD

SEQ ID NO: 1173554 - protein, 14 aa, Mycobacterium
SRRTAGNQRRYARE

SEQ ID NO: 1173555 - protein, 8 aa, Mycobacterium
SRRTHDDR

SEQ ID NO: 1173556 - protein, 15 aa, Mycobacterium
SRRTVDGTPEGGWTP

SEQ ID NO: 1173557 - protein, 7 aa, Mycobacterium
SRRYGDT

SEQ ID NO: 1173558 - protein, 10 aa, Mycobacterium
SRSADDAASA

SEQ ID NO: 1173559 - protein, 18 aa, Mycobacterium
SRSADQIRAATASHTDPI

SEQ ID NO: 1173560 - protein, 4 aa, Mycobacterium
SRSD

SEQ ID NO: 1173561 - protein, 5 aa, Mycobacterium
SRSDR

SEQ ID NO: 1173562 - protein, 7 aa, Mycobacterium
SRSGDDV

SEQ ID NO: 1173563 - protein, 8 aa, Mycobacterium
SRSGPPRI

SEQ ID NO: 1173564 - protein, 10 aa, Mycobacterium
SRSGSSPLSQ

SEQ ID NO: 1173565 - protein, 5 aa, Mycobacterium
SRSLR

SEQ ID NO: 1173566 - protein, 15 aa, Mycobacterium
SRSPNVTKTTHRRVP

SEQ ID NO: 1173567 - protein, 4 aa, Mycobacterium
SRSR

SEQ ID NO: 1173568 - protein, 8 aa, Mycobacterium
SRSSPRVG

SEQ ID NO: 1173569 - protein, 6 aa, Mycobacterium
SRSTAF

SEQ ID NO: 1173570 - protein, 6 aa, Mycobacterium
SRSTDF

SEQ ID NO: 1173571 - protein, 19 aa, Mycobacterium
SRSVGQQAATLKGEKRSGL

SEQ ID NO: 1173572 - protein, 4 aa, Mycobacterium
SRTA

SEQ ID NO: 1173573 - protein, 9 aa, Mycobacterium
SRTADGSFN

SEQ ID NO: 1173574 - protein, 9 aa, Mycobacterium
SRTDPPYAT

SEQ ID NO: 1173575 - protein, 5 aa, Mycobacterium
SRTDV

SEQ ID NO: 1173576 - protein, 4 aa, Mycobacterium
SRTE

SEQ ID NO: 1173577 - protein, 14 aa, Mycobacterium
SRTNPSHAEGAPDD

SEQ ID NO: 1173578 - protein, 4 aa, Mycobacterium
SRTP

SEQ ID NO: 1173579 - protein, 7 aa, Mycobacterium
SRTPAAG

SEQ ID NO: 1173580 - protein, 15 aa, Mycobacterium
SRTPGGSSGGSAAAV

SEQ ID NO: 1173581 - protein, 5 aa, Mycobacterium
SRTRI

SEQ ID NO: 1173582 - protein, 10 aa, Mycobacterium
SRTTESRDSA

SEQ ID NO: 1173583 - protein, 6 aa, Mycobacterium
SRTTHS

SEQ ID NO: 1173584 - protein, 6 aa, Mycobacterium
SRTTSI

SEQ ID NO: 1173585 - protein, 10 aa, Mycobacterium
SRTTTLTDDE

SEQ ID NO: 1173586 - protein, 5 aa, Mycobacterium
SRTYG

SEQ ID NO: 1173587 - protein, 11 aa, Mycobacterium
SRVADDGKSVG

SEQ ID NO: 1173588 - protein, 12 aa, Mycobacterium
SRVAGTRGRVTA

SEQ ID NO: 1173589 - protein, 5 aa, Mycobacterium
SRVDN

SEQ ID NO: 1173590 - protein, 10 aa, Mycobacterium
SRVDPNAQGS

SEQ ID NO: 1173591 - protein, 10 aa, Mycobacterium
SRVGGRQPAH

SEQ ID NO: 1173592 - protein, 7 aa, Mycobacterium
SRVGNNA

SEQ ID NO: 1173593 - protein, 7 aa, Mycobacterium
SRVQGPA

SEQ ID NO: 1173594 - protein, 6 aa, Mycobacterium
SRVREV

SEQ ID NO: 1173595 - protein, 6 aa, Mycobacterium
SRVSAD

SEQ ID NO: 1173596 - protein, 6 aa, Mycobacterium
SRVSSY

SEQ ID NO: 1173597 - protein, 5 aa, Mycobacterium
SRYAE

SEQ ID NO: 1173598 - protein, 19 aa, Mycobacterium
SRYLGGGAATTVGATAVGP

SEQ ID NO: 1173599 - protein, 8 aa, Mycobacterium
SRYPLDRG

SEQ ID NO: 1173600 - protein, 7 aa, Mycobacterium
SRYTQGG

SEQ ID NO: 1173601 - protein, 10 aa, Mycobacterium
SSAAAGPVAA

SEQ ID NO: 1173602 - protein, 7 aa, Mycobacterium
SSAALDA

SEQ ID NO: 1173603 - protein, 9 aa, Mycobacterium
SSAATDPDL

SEQ ID NO: 1173604 - protein, 22 aa, Mycobacterium
SSAAVAEPTSHDPDARGHFGPY

SEQ ID NO: 1173605 - protein, 7 aa, Mycobacterium
SSAAYQT

SEQ ID NO: 1173606 - protein, 19 aa, Mycobacterium
SSADDARFSASEGIPMPKG

SEQ ID NO: 1173607 - protein, 13 aa, Mycobacterium
SSADYTGATPRVG

SEQ ID NO: 1173608 - protein, 4 aa, Mycobacterium
SSAE

SEQ ID NO: 1173609 - protein, 8 aa, Mycobacterium
SSAGITGT

SEQ ID NO: 1173610 - protein, 5 aa, Mycobacterium
SSAGL

SEQ ID NO: 1173611 - protein, 9 aa, Mycobacterium
SSAGLSATT

SEQ ID NO: 1173612 - protein, 7 aa, Mycobacterium
SSANTGE

SEQ ID NO: 1173613 - protein, 7 aa, Mycobacterium
SSAPMAS

SEQ ID NO: 1173614 - protein, 9 aa, Mycobacterium
SSAPSSSVD

SEQ ID NO: 1173615 - protein, 5 aa, Mycobacterium
SSAQI

SEQ ID NO: 1173616 - protein, 9 aa, Mycobacterium
SSAQRGSPK

SEQ ID NO: 1173617 - protein, 7 aa, Mycobacterium
SSARGRA

SEQ ID NO: 1173618 - protein, 8 aa, Mycobacterium
SSATGADG

SEQ ID NO: 1173619 - protein, 11 aa, Mycobacterium
SSATGEDRERL

SEQ ID NO: 1173620 - protein, 4 aa, Mycobacterium
SSAV

SEQ ID NO: 1173621 - protein, 9 aa, Mycobacterium
SSAWRKDPD

SEQ ID NO: 1173622 - protein, 12 aa, Mycobacterium
SSDAVASYTRSL

SEQ ID NO: 1173623 - protein, 5 aa, Mycobacterium
SSDDR

SEQ ID NO: 1173624 - protein, 4 aa, Mycobacterium
SSDE

SEQ ID NO: 1173625 - protein, 9 aa, Mycobacterium
SSDEARAKA

SEQ ID NO: 1173626 - protein, 9 aa, Mycobacterium
SSDGAITEG

SEQ ID NO: 1173627 - protein, 15 aa, Mycobacterium
SSDGFGAGENQSLER

SEQ ID NO: 1173628 - protein, 5 aa, Mycobacterium
SSDHA

SEQ ID NO: 1173629 - protein, 6 aa, Mycobacterium
SSDPAI

SEQ ID NO: 1173630 - protein, 10 aa, Mycobacterium
SSDPGDPVRV

SEQ ID NO: 1173631 - protein, 4 aa, Mycobacterium
SSDR

SEQ ID NO: 1173632 - protein, 6 aa, Mycobacterium
SSDRTR

SEQ ID NO: 1173633 - protein, 6 aa, Mycobacterium
SSEGVE

SEQ ID NO: 1173634 - protein, 13 aa, Mycobacterium
SSEPGAGSDVGAV

SEQ ID NO: 1173635 - protein, 6 aa, Mycobacterium
SSEPLE

SEQ ID NO: 1173636 - protein, 12 aa, Mycobacterium
SSERLKKTGTDT

SEQ ID NO: 1173637 - protein, 6 aa, Mycobacterium
SSEWTS

SEQ ID NO: 1173638 - protein, 8 aa, Mycobacterium
SSFNGTEI

SEQ ID NO: 1173639 - protein, 15 aa, Mycobacterium
SSFTTGAILRADGGI

SEQ ID NO: 1173640 - protein, 8 aa, Mycobacterium
SSGADRAA

SEQ ID NO: 1173641 - protein, 7 aa, Mycobacterium
SSGDGAP

SEQ ID NO: 1173642 - protein, 5 aa, Mycobacterium
SSGDV

SEQ ID NO: 1173643 - protein, 12 aa, Mycobacterium
SSGGADDGSVHP

SEQ ID NO: 1173644 - protein, 9 aa, Mycobacterium
SSGHEGNAA

SEQ ID NO: 1173645 - protein, 8 aa, Mycobacterium
SSGIGDPP

SEQ ID NO: 1173646 - protein, 17 aa, Mycobacterium
SSGITGQTLDVNCGEYK

SEQ ID NO: 1173647 - protein, 18 aa, Mycobacterium
SSGITPGHAAAPETLSAD

SEQ ID NO: 1173648 - protein, 14 aa, Mycobacterium
SSGKPGRHREANRY

SEQ ID NO: 1173649 - protein, 11 aa, Mycobacterium
SSGRIQPGDAA

SEQ ID NO: 1173650 - protein, 9 aa, Mycobacterium
SSGRPGSGF

SEQ ID NO: 1173651 - protein, 5 aa, Mycobacterium
SSGRR

SEQ ID NO: 1173652 - protein, 9 aa, Mycobacterium
SSGSTRLPT

SEQ ID NO: 1173653 - protein, 5 aa, Mycobacterium
SSGTC

SEQ ID NO: 1173654 - protein, 10 aa, Mycobacterium
SSGTTGNPKG

SEQ ID NO: 1173655 - protein, 5 aa, Mycobacterium
SSGVG

SEQ ID NO: 1173656 - protein, 21 aa, Mycobacterium
SSGVNTDSEGVLSASDPAGLT

SEQ ID NO: 1173657 - protein, 4 aa, Mycobacterium
SSHA

SEQ ID NO: 1173658 - protein, 10 aa, Mycobacterium
SSHHTAARRR

SEQ ID NO: 1173659 - protein, 9 aa, Mycobacterium
SSIGENLRP

SEQ ID NO: 1173660 - protein, 7 aa, Mycobacterium
SSIKRSQ

SEQ ID NO: 1173661 - protein, 6 aa, Mycobacterium
SSILGK

SEQ ID NO: 1173662 - protein, 11 aa, Mycobacterium
SSINSDGRTVG

SEQ ID NO: 1173663 - protein, 11 aa, Mycobacterium
SSIRTGRANPG

SEQ ID NO: 1173664 - protein, 5 aa, Mycobacterium
SSKEE

SEQ ID NO: 1173665 - protein, 6 aa, Mycobacterium
SSKEFT

SEQ ID NO: 1173666 - protein, 6 aa, Mycobacterium
SSKGGV

SEQ ID NO: 1173667 - protein, 11 aa, Mycobacterium
SSKNAKKLRED

SEQ ID NO: 1173668 - protein, 10 aa, Mycobacterium
SSKRGGGSDR

SEQ ID NO: 1173669 - protein, 7 aa, Mycobacterium
SSKTSEH

SEQ ID NO: 1173670 - protein, 6 aa, Mycobacterium
SSLAGG

SEQ ID NO: 1173671 - protein, 10 aa, Mycobacterium
SSLDLRGDPV

SEQ ID NO: 1173672 - protein, 11 aa, Mycobacterium
SSLSDPPTRAA

SEQ ID NO: 1173673 - protein, 9 aa, Mycobacterium
SSLTNNRSR

SEQ ID NO: 1173674 - protein, 7 aa, Mycobacterium
SSNASTA

SEQ ID NO: 1173675 - protein, 9 aa, Mycobacterium
SSNDTVGAG

SEQ ID NO: 1173676 - protein, 9 aa, Mycobacterium
SSNPAHSLA

SEQ ID NO: 1173677 - protein, 6 aa, Mycobacterium
SSNPLG

SEQ ID NO: 1173678 - protein, 5 aa, Mycobacterium
SSNTV

SEQ ID NO: 1173679 - protein, 6 aa, Mycobacterium
SSPAVT

SEQ ID NO: 1173680 - protein, 4 aa, Mycobacterium
SSPD

SEQ ID NO: 1173681 - protein, 9 aa, Mycobacterium
SSPGAFGEG

SEQ ID NO: 1173682 - protein, 9 aa, Mycobacterium
SSPHGDHNR

SEQ ID NO: 1173683 - protein, 12 aa, Mycobacterium
SSPHTDAAPKVT

SEQ ID NO: 1173684 - protein, 5 aa, Mycobacterium
SSPLG

SEQ ID NO: 1173685 - protein, 35 aa, Mycobacterium
SSPLPASVAATTTASVTTTTTRGDAMGDAMGDQTM

SEQ ID NO: 1173686 - protein, 6 aa, Mycobacterium
SSPLVS

SEQ ID NO: 1173687 - protein, 9 aa, Mycobacterium
SSPNPAAAH

SEQ ID NO: 1173688 - protein, 9 aa, Mycobacterium
SSPPTRVPA

SEQ ID NO: 1173689 - protein, 15 aa, Mycobacterium
SSPQRRAVQTAQPVA

SEQ ID NO: 1173690 - protein, 6 aa, Mycobacterium
SSPWTY

SEQ ID NO: 1173691 - protein, 15 aa, Mycobacterium
SSPYWDGSDTGYASN

SEQ ID NO: 1173692 - protein, 8 aa, Mycobacterium
SSQIADAN

SEQ ID NO: 1173693 - protein, 6 aa, Mycobacterium
SSQPER

SEQ ID NO: 1173694 - protein, 11 aa, Mycobacterium
SSQTGSDRTPR

SEQ ID NO: 1173695 - protein, 10 aa, Mycobacterium
SSRASGPGDR

SEQ ID NO: 1173696 - protein, 4 aa, Mycobacterium
SSRD

SEQ ID NO: 1173697 - protein, 8 aa, Mycobacterium
SSRDTEGG

SEQ ID NO: 1173698 - protein, 6 aa, Mycobacterium
SSRLED

SEQ ID NO: 1173699 - protein, 4 aa, Mycobacterium
SSRN

SEQ ID NO: 1173700 - protein, 6 aa, Mycobacterium
SSRPDA

SEQ ID NO: 1173701 - protein, 12 aa, Mycobacterium
SSRPDAGPDTTD

SEQ ID NO: 1173702 - protein, 5 aa, Mycobacterium
SSRRS

SEQ ID NO: 1173703 - protein, 7 aa, Mycobacterium
SSRSAEL

SEQ ID NO: 1173704 - protein, 15 aa, Mycobacterium
SSRTAATAYAYQHDL

SEQ ID NO: 1173705 - protein, 8 aa, Mycobacterium
SSRTLEPP

SEQ ID NO: 1173706 - protein, 10 aa, Mycobacterium
SSSDCRKRAV

SEQ ID NO: 1173707 - protein, 10 aa, Mycobacterium
SSSEQVGSRE

SEQ ID NO: 1173708 - protein, 10 aa, Mycobacterium
SSSESSFGAD

SEQ ID NO: 1173709 - protein, 7 aa, Mycobacterium
SSSEVQI

SEQ ID NO: 1173710 - protein, 9 aa, Mycobacterium
SSSGLSDEE

SEQ ID NO: 1173711 - protein, 9 aa, Mycobacterium
SSSGSIRPD

SEQ ID NO: 1173712 - protein, 6 aa, Mycobacterium
SSSLGV

SEQ ID NO: 1173713 - protein, 9 aa, Mycobacterium
SSSSATDIA

SEQ ID NO: 1173714 - protein, 11 aa, Mycobacterium
SSSSTHSGAPY

SEQ ID NO: 1173715 - protein, 8 aa, Mycobacterium
SSSTRGID

SEQ ID NO: 1173716 - protein, 5 aa, Mycobacterium
SSSTY

SEQ ID NO: 1173717 - protein, 17 aa, Mycobacterium
SSSVVETDVDDRPAETV

SEQ ID NO: 1173718 - protein, 4 aa, Mycobacterium
SSTA

SEQ ID NO: 1173719 - protein, 8 aa, Mycobacterium
SSTAGDVG

SEQ ID NO: 1173720 - protein, 7 aa, Mycobacterium
SSTFSSA

SEQ ID NO: 1173721 - protein, 7 aa, Mycobacterium
SSTSASK

SEQ ID NO: 1173722 - protein, 10 aa, Mycobacterium
SSVADSSQSA

SEQ ID NO: 1173723 - protein, 8 aa, Mycobacterium
SSVDPDRV

SEQ ID NO: 1173724 - protein, 12 aa, Mycobacterium
SSVEQKPYTRRP

SEQ ID NO: 1173725 - protein, 9 aa, Mycobacterium
SSVKQADSA

SEQ ID NO: 1173726 - protein, 7 aa, Mycobacterium
SSVSDAD

SEQ ID NO: 1173727 - protein, 6 aa, Mycobacterium
SSVTSW

SEQ ID NO: 1173728 - protein, 7 aa, Mycobacterium
SSWGTGS

SEQ ID NO: 1173729 - protein, 9 aa, Mycobacterium
SSWTPYPDT

SEQ ID NO: 1173730 - protein, 8 aa, Mycobacterium
SSYERGEP

SEQ ID NO: 1173731 - protein, 11 aa, Mycobacterium
SSYSDKPGTIV

SEQ ID NO: 1173732 - protein, 5 aa, Mycobacterium
SSYSL

SEQ ID NO: 1173733 - protein, 5 aa, Mycobacterium
SSYTP

SEQ ID NO: 1173734 - protein, 6 aa, Mycobacterium
SSYTPT

SEQ ID NO: 1173735 - protein, 7 aa, Mycobacterium
STAAKTL

SEQ ID NO: 1173736 - protein, 9 aa, Mycobacterium
STAAPERDR

SEQ ID NO: 1173737 - protein, 6 aa, Mycobacterium
STAAPL

SEQ ID NO: 1173738 - protein, 8 aa, Mycobacterium
STADSESL

SEQ ID NO: 1173739 - protein, 5 aa, Mycobacterium
STADT

SEQ ID NO: 1173740 - protein, 4 aa, Mycobacterium
STAE

SEQ ID NO: 1173741 - protein, 7 aa, Mycobacterium
STAFDRD

SEQ ID NO: 1173742 - protein, 4 aa, Mycobacterium
STAG

SEQ ID NO: 1173743 - protein, 7 aa, Mycobacterium
STAGDSY

SEQ ID NO: 1173744 - protein, 7 aa, Mycobacterium
STAGDVA

SEQ ID NO: 1173745 - protein, 8 aa, Mycobacterium
STAGFQPV

SEQ ID NO: 1173746 - protein, 9 aa, Mycobacterium
STAGHRQTL

SEQ ID NO: 1173747 - protein, 7 aa, Mycobacterium
STAGLRG

SEQ ID NO: 1173748 - protein, 8 aa, Mycobacterium
STAGTGYT

SEQ ID NO: 1173749 - protein, 4 aa, Mycobacterium
STAK

SEQ ID NO: 1173750 - protein, 9 aa, Mycobacterium
STAKGPAGL

SEQ ID NO: 1173751 - protein, 11 aa, Mycobacterium
STAKSRDGWDS

SEQ ID NO: 1173752 - protein, 24 aa, Mycobacterium
STALREDAEGLAGAAGYHPQRPLT

SEQ ID NO: 1173753 - protein, 6 aa, Mycobacterium
STANTA

SEQ ID NO: 1173754 - protein, 7 aa, Mycobacterium
STAPATP

SEQ ID NO: 1173755 - protein, 6 aa, Mycobacterium
STASLD

SEQ ID NO: 1173756 - protein, 7 aa, Mycobacterium
STASRTV

SEQ ID NO: 1173757 - protein, 6 aa, Mycobacterium
STASTV

SEQ ID NO: 1173758 - protein, 8 aa, Mycobacterium
STATAEAT

SEQ ID NO: 1173759 - protein, 10 aa, Mycobacterium
STDAQPEAAR

SEQ ID NO: 1173760 - protein, 9 aa, Mycobacterium
STDASGRYT

SEQ ID NO: 1173761 - protein, 12 aa, Mycobacterium
STDDGAPDNKGP

SEQ ID NO: 1173762 - protein, 9 aa, Mycobacterium
STDESDQAK

SEQ ID NO: 1173763 - protein, 15 aa, Mycobacterium
STDGRPDNPGEAGRV

SEQ ID NO: 1173764 - protein, 7 aa, Mycobacterium
STDPWSP

SEQ ID NO: 1173765 - protein, 13 aa, Mycobacterium
STDRDELVETEDK

SEQ ID NO: 1173766 - protein, 8 aa, Mycobacterium
STDRGDDI

SEQ ID NO: 1173767 - protein, 8 aa, Mycobacterium
STDRSGRE

SEQ ID NO: 1173768 - protein, 5 aa, Mycobacterium
STDVA

SEQ ID NO: 1173769 - protein, 4 aa, Mycobacterium
STEA

SEQ ID NO: 1173770 - protein, 14 aa, Mycobacterium
STEAAPSPADASAA

SEQ ID NO: 1173771 - protein, 5 aa, Mycobacterium
STEAH

SEQ ID NO: 1173772 - protein, 16 aa, Mycobacterium
STEDAQDPEASRSWQK

SEQ ID NO: 1173773 - protein, 5 aa, Mycobacterium
STEED

SEQ ID NO: 1173774 - protein, 8 aa, Mycobacterium
STEEIPAQ

SEQ ID NO: 1173775 - protein, 8 aa, Mycobacterium
STEIPPNE

SEQ ID NO: 1173776 - protein, 4 aa, Mycobacterium
STEP

SEQ ID NO: 1173777 - protein, 9 aa, Mycobacterium
STEPANHDQ

SEQ ID NO: 1173778 - protein, 20 aa, Mycobacterium
STEPDAPDPEPVAGVGGGNQ

SEQ ID NO: 1173779 - protein, 15 aa, Mycobacterium
STEPPETDSSVDEYD

SEQ ID NO: 1173780 - protein, 4 aa, Mycobacterium
STES

SEQ ID NO: 1173781 - protein, 7 aa, Mycobacterium
STESELA

SEQ ID NO: 1173782 - protein, 11 aa, Mycobacterium
STESPVRQGDT

SEQ ID NO: 1173783 - protein, 4 aa, Mycobacterium
STFD

SEQ ID NO: 1173784 - protein, 7 aa, Mycobacterium
STFDGTA

SEQ ID NO: 1173785 - protein, 10 aa, Mycobacterium
STGAALTVPG

SEQ ID NO: 1173786 - protein, 8 aa, Mycobacterium
STGAARVT

SEQ ID NO: 1173787 - protein, 6 aa, Mycobacterium
STGAGA

SEQ ID NO: 1173788 - protein, 5 aa, Mycobacterium
STGAR

SEQ ID NO: 1173789 - protein, 15 aa, Mycobacterium
STGASTKLVPNTSLS

SEQ ID NO: 1173790 - protein, 8 aa, Mycobacterium
STGATGPT

SEQ ID NO: 1173791 - protein, 12 aa, Mycobacterium
STGAVPESVPGA

SEQ ID NO: 1173792 - protein, 6 aa, Mycobacterium
STGDLD

SEQ ID NO: 1173793 - protein, 5 aa, Mycobacterium
STGEA

SEQ ID NO: 1173794 - protein, 4 aa, Mycobacterium
STGG

SEQ ID NO: 1173795 - protein, 7 aa, Mycobacterium
STGGSTA

SEQ ID NO: 1173796 - protein, 12 aa, Mycobacterium
STGGWDSQGHPV

SEQ ID NO: 1173797 - protein, 5 aa, Mycobacterium
STGHS

SEQ ID NO: 1173798 - protein, 6 aa, Mycobacterium
STGIES

SEQ ID NO: 1173799 - protein, 9 aa, Mycobacterium
STGKPEQAD

SEQ ID NO: 1173800 - protein, 4 aa, Mycobacterium
STGL

SEQ ID NO: 1173801 - protein, 17 aa, Mycobacterium
STGNISAEDRDATPPRA

SEQ ID NO: 1173802 - protein, 5 aa, Mycobacterium
STGPC

SEQ ID NO: 1173803 - protein, 10 aa, Mycobacterium
STGPDHDKEF

SEQ ID NO: 1173804 - protein, 6 aa, Mycobacterium
STGRGY

SEQ ID NO: 1173805 - protein, 17 aa, Mycobacterium
STGTSGTGADVEKVREA

SEQ ID NO: 1173806 - protein, 4 aa, Mycobacterium
STGV

SEQ ID NO: 1173807 - protein, 6 aa, Mycobacterium
STHELD

SEQ ID NO: 1173808 - protein, 7 aa, Mycobacterium
STHPSDD

SEQ ID NO: 1173809 - protein, 9 aa, Mycobacterium
STHSAGVDG

SEQ ID NO: 1173810 - protein, 11 aa, Mycobacterium
STITDPGAAAA

SEQ ID NO: 1173811 - protein, 9 aa, Mycobacterium
STKGRIGAT

SEQ ID NO: 1173812 - protein, 15 aa, Mycobacterium
STLAGRERKSKDGTV

SEQ ID NO: 1173813 - protein, 13 aa, Mycobacterium
STLDGVGDREGSL

SEQ ID NO: 1173814 - protein, 15 aa, Mycobacterium
STLEAQDSAMSSRGY

SEQ ID NO: 1173815 - protein, 15 aa, Mycobacterium
STLGREDHLSDPEFE

SEQ ID NO: 1173816 - protein, 14 aa, Mycobacterium
STLNPPGSLTAPMP

SEQ ID NO: 1173817 - protein, 11 aa, Mycobacterium
STLPAARESAY

SEQ ID NO: 1173818 - protein, 6 aa, Mycobacterium
STLSPP

SEQ ID NO: 1173819 - protein, 4 aa, Mycobacterium
STMQ

SEQ ID NO: 1173820 - protein, 5 aa, Mycobacterium
STNAK

SEQ ID NO: 1173821 - protein, 12 aa, Mycobacterium
STPASRSVAKAS

SEQ ID NO: 1173822 - protein, 5 aa, Mycobacterium
STPAY

SEQ ID NO: 1173823 - protein, 13 aa, Mycobacterium
STPDEVAQQAADN

SEQ ID NO: 1173824 - protein, 8 aa, Mycobacterium
STPDTNLE

SEQ ID NO: 1173825 - protein, 14 aa, Mycobacterium
STPEQLRKDTGCTS

SEQ ID NO: 1173826 - protein, 11 aa, Mycobacterium
STPESLAATRA

SEQ ID NO: 1173827 - protein, 5 aa, Mycobacterium
STPLD

SEQ ID NO: 1173828 - protein, 7 aa, Mycobacterium
STPLDRD

SEQ ID NO: 1173829 - protein, 13 aa, Mycobacterium
STPLRGVDGEQAV

SEQ ID NO: 1173830 - protein, 4 aa, Mycobacterium
STPP

SEQ ID NO: 1173831 - protein, 5 aa, Mycobacterium
STPPG

SEQ ID NO: 1173832 - protein, 17 aa, Mycobacterium
STPQEGRTLGVDPETGH

SEQ ID NO: 1173833 - protein, 8 aa, Mycobacterium
STPSRVSR

SEQ ID NO: 1173834 - protein, 9 aa, Mycobacterium
STPTPAPGW

SEQ ID NO: 1173835 - protein, 7 aa, Mycobacterium
STPTRTA

SEQ ID NO: 1173836 - protein, 5 aa, Mycobacterium
STPTV

SEQ ID NO: 1173837 - protein, 5 aa, Mycobacterium
STQRM

SEQ ID NO: 1173838 - protein, 9 aa, Mycobacterium
STRAGGATV

SEQ ID NO: 1173839 - protein, 7 aa, Mycobacterium
STRAQWD

SEQ ID NO: 1173840 - protein, 4 aa, Mycobacterium
STRG

SEQ ID NO: 1173841 - protein, 7 aa, Mycobacterium
STRRPVP

SEQ ID NO: 1173842 - protein, 4 aa, Mycobacterium
STRT

SEQ ID NO: 1173843 - protein, 4 aa, Mycobacterium
STRV

SEQ ID NO: 1173844 - protein, 9 aa, Mycobacterium
STSAERGAA

SEQ ID NO: 1173845 - protein, 7 aa, Mycobacterium
STSEAVG

SEQ ID NO: 1173846 - protein, 6 aa, Mycobacterium
STSGLT

SEQ ID NO: 1173847 - protein, 8 aa, Mycobacterium
STSGPDLD

SEQ ID NO: 1173848 - protein, 11 aa, Mycobacterium
STSPAAARGRG

SEQ ID NO: 1173849 - protein, 8 aa, Mycobacterium
STSSPDVE

SEQ ID NO: 1173850 - protein, 6 aa, Mycobacterium
STSSTS

SEQ ID NO: 1173851 - protein, 6 aa, Mycobacterium
STSTHS

SEQ ID NO: 1173852 - protein, 5 aa, Mycobacterium
STSTT

SEQ ID NO: 1173853 - protein, 6 aa, Mycobacterium
STTAVD

SEQ ID NO: 1173854 - protein, 6 aa, Mycobacterium
STTCQN

SEQ ID NO: 1173855 - protein, 4 aa, Mycobacterium
STTD

SEQ ID NO: 1173856 - protein, 4 aa, Mycobacterium
STTG

SEQ ID NO: 1173857 - protein, 19 aa, Mycobacterium
STTHAQLSPEEQLASGVTP

SEQ ID NO: 1173858 - protein, 6 aa, Mycobacterium
STTIED

SEQ ID NO: 1173859 - protein, 24 aa, Mycobacterium
STTIEETEELPAKSKACTDAGKPA

SEQ ID NO: 1173860 - protein, 4 aa, Mycobacterium
STTK

SEQ ID NO: 1173861 - protein, 12 aa, Mycobacterium
STTTEFERRPRV

SEQ ID NO: 1173862 - protein, 6 aa, Mycobacterium
STTTGD

SEQ ID NO: 1173863 - protein, 20 aa, Mycobacterium
STTTGPGIPVDPQVTRNFAE

SEQ ID NO: 1173864 - protein, 16 aa, Mycobacterium
STTVEEGSSAFEEPEL

SEQ ID NO: 1173865 - protein, 6 aa, Mycobacterium
STTVEQ

SEQ ID NO: 1173866 - protein, 4 aa, Mycobacterium
STVE

SEQ ID NO: 1173867 - protein, 11 aa, Mycobacterium
STVGAGDASLA

SEQ ID NO: 1173868 - protein, 8 aa, Mycobacterium
STVGSASE

SEQ ID NO: 1173869 - protein, 21 aa, Mycobacterium
STVSDAAGGVPGQTAAPPNDT

SEQ ID NO: 1173870 - protein, 8 aa, Mycobacterium
STVSETLD

SEQ ID NO: 1173871 - protein, 12 aa, Mycobacterium
STVSSADADGHE

SEQ ID NO: 1173872 - protein, 12 aa, Mycobacterium
STWAGHGGGEFA

SEQ ID NO: 1173873 - protein, 6 aa, Mycobacterium
STWPPA

SEQ ID NO: 1173874 - protein, 5 aa, Mycobacterium
STYPG

SEQ ID NO: 1173875 - protein, 6 aa, Mycobacterium
STYVRK

SEQ ID NO: 1173876 - protein, 16 aa, Mycobacterium
STYYDRQGKGTLTTTD

SEQ ID NO: 1173877 - protein, 7 aa, Mycobacterium
SVAAGAD

SEQ ID NO: 1173878 - protein, 4 aa, Mycobacterium
SVAE

SEQ ID NO: 1173879 - protein, 8 aa, Mycobacterium
SVAEGRKR

SEQ ID NO: 1173880 - protein, 6 aa, Mycobacterium
SVAGEV

SEQ ID NO: 1173881 - protein, 7 aa, Mycobacterium
SVAGRDE

SEQ ID NO: 1173882 - protein, 5 aa, Mycobacterium
SVAKT

SEQ ID NO: 1173883 - protein, 15 aa, Mycobacterium
SVAPPERRDPASVGN

SEQ ID NO: 1173884 - protein, 7 aa, Mycobacterium
SVAPPGG

SEQ ID NO: 1173885 - protein, 10 aa, Mycobacterium
SVATGELSAT

SEQ ID NO: 1173886 - protein, 11 aa, Mycobacterium
SVAVSGDRRAV

SEQ ID NO: 1173887 - protein, 9 aa, Mycobacterium
SVDATNAAD

SEQ ID NO: 1173888 - protein, 7 aa, Mycobacterium
SVDATPV

SEQ ID NO: 1173889 - protein, 9 aa, Mycobacterium
SVDDRRSGF

SEQ ID NO: 1173890 - protein, 6 aa, Mycobacterium
SVDGQV

SEQ ID NO: 1173891 - protein, 12 aa, Mycobacterium
SVDGRRVATGRD

SEQ ID NO: 1173892 - protein, 7 aa, Mycobacterium
SVDGRTV

SEQ ID NO: 1173893 - protein, 8 aa, Mycobacterium
SVDNGRDV

SEQ ID NO: 1173894 - protein, 11 aa, Mycobacterium
SVDPNDRAPGT

SEQ ID NO: 1173895 - protein, 10 aa, Mycobacterium
SVDPPGGESF

SEQ ID NO: 1173896 - protein, 10 aa, Mycobacterium
SVDRTDPDVS

SEQ ID NO: 1173897 - protein, 5 aa, Mycobacterium
SVEER

SEQ ID NO: 1173898 - protein, 14 aa, Mycobacterium
SVEIGERAARRAEP

SEQ ID NO: 1173899 - protein, 8 aa, Mycobacterium
SVENDADL

SEQ ID NO: 1173900 - protein, 10 aa, Mycobacterium
SVEQEPAPED

SEQ ID NO: 1173901 - protein, 8 aa, Mycobacterium
SVEQTMTG

SEQ ID NO: 1173902 - protein, 6 aa, Mycobacterium
SVERSE

SEQ ID NO: 1173903 - protein, 6 aa, Mycobacterium
SVESGQ

SEQ ID NO: 1173904 - protein, 13 aa, Mycobacterium
SVETNSKNCAGGV

SEQ ID NO: 1173905 - protein, 6 aa, Mycobacterium
SVFAGP

SEQ ID NO: 1173906 - protein, 15 aa, Mycobacterium
SVGDEDSYSLATTAA

SEQ ID NO: 1173907 - protein, 6 aa, Mycobacterium
SVGEIQ

SEQ ID NO: 1173908 - protein, 5 aa, Mycobacterium
SVGGK

SEQ ID NO: 1173909 - protein, 6 aa, Mycobacterium
SVGGYD

SEQ ID NO: 1173910 - protein, 7 aa, Mycobacterium
SVGKTGR

SEQ ID NO: 1173911 - protein, 7 aa, Mycobacterium
SVGPGTS

SEQ ID NO: 1173912 - protein, 6 aa, Mycobacterium
SVGPPI

SEQ ID NO: 1173913 - protein, 8 aa, Mycobacterium
SVGPRGEE

SEQ ID NO: 1173914 - protein, 4 aa, Mycobacterium
SVGS

SEQ ID NO: 1173915 - protein, 6 aa, Mycobacterium
SVGSGT

SEQ ID NO: 1173916 - protein, 10 aa, Mycobacterium
SVGTGCRSGA

SEQ ID NO: 1173917 - protein, 5 aa, Mycobacterium
SVHNS

SEQ ID NO: 1173918 - protein, 7 aa, Mycobacterium
SVHSEPG

SEQ ID NO: 1173919 - protein, 11 aa, Mycobacterium
SVIGGANAKGI

SEQ ID NO: 1173920 - protein, 13 aa, Mycobacterium
SVIPSTSPPAPKQ

SEQ ID NO: 1173921 - protein, 10 aa, Mycobacterium
SVKGGVHSAG

SEQ ID NO: 1173922 - protein, 8 aa, Mycobacterium
SVKPSYGL

SEQ ID NO: 1173923 - protein, 7 aa, Mycobacterium
SVNHSTA

SEQ ID NO: 1173924 - protein, 15 aa, Mycobacterium
SVNPAEPPQNPAQEI

SEQ ID NO: 1173925 - protein, 9 aa, Mycobacterium
SVNSHQGSA

SEQ ID NO: 1173926 - protein, 11 aa, Mycobacterium
SVPDGATPVAQ

SEQ ID NO: 1173927 - protein, 7 aa, Mycobacterium
SVPDGGD

SEQ ID NO: 1173928 - protein, 10 aa, Mycobacterium
SVPDGTTADV

SEQ ID NO: 1173929 - protein, 10 aa, Mycobacterium
SVPEGDGPWP

SEQ ID NO: 1173930 - protein, 9 aa, Mycobacterium
SVPESGAQG

SEQ ID NO: 1173931 - protein, 7 aa, Mycobacterium
SVPGANV

SEQ ID NO: 1173932 - protein, 5 aa, Mycobacterium
SVPGD

SEQ ID NO: 1173933 - protein, 8 aa, Mycobacterium
SVPGPREH

SEQ ID NO: 1173934 - protein, 8 aa, Mycobacterium
SVPTPADV

SEQ ID NO: 1173935 - protein, 11 aa, Mycobacterium
SVPVEPGNLDT

SEQ ID NO: 1173936 - protein, 9 aa, Mycobacterium
SVQEGRDNL

SEQ ID NO: 1173937 - protein, 10 aa, Mycobacterium
SVQGSIGSPL

SEQ ID NO: 1173938 - protein, 12 aa, Mycobacterium
SVRATPDARVST

SEQ ID NO: 1173939 - protein, 8 aa, Mycobacterium
SVRDGYEV

SEQ ID NO: 1173940 - protein, 13 aa, Mycobacterium
SVRDKSDRPGRNQ

SEQ ID NO: 1173941 - protein, 6 aa, Mycobacterium
SVRDPR

SEQ ID NO: 1173942 - protein, 8 aa, Mycobacterium
SVRDQMSN

SEQ ID NO: 1173943 - protein, 6 aa, Mycobacterium
SVRDRA

SEQ ID NO: 1173944 - protein, 8 aa, Mycobacterium
SVREGQEG

SEQ ID NO: 1173945 - protein, 8 aa, Mycobacterium
SVRGTGGL

SEQ ID NO: 1173946 - protein, 6 aa, Mycobacterium
SVRHTD

SEQ ID NO: 1173947 - protein, 5 aa, Mycobacterium
SVRPD

SEQ ID NO: 1173948 - protein, 5 aa, Mycobacterium
SVRRE

SEQ ID NO: 1173949 - protein, 9 aa, Mycobacterium
SVSAASAAI

SEQ ID NO: 1173950 - protein, 7 aa, Mycobacterium
SVSASTV

SEQ ID NO: 1173951 - protein, 8 aa, Mycobacterium
SVSDAERI

SEQ ID NO: 1173952 - protein, 11 aa, Mycobacterium
SVSKDGPSRAY

SEQ ID NO: 1173953 - protein, 9 aa, Mycobacterium
SVSKDTISR

SEQ ID NO: 1173954 - protein, 15 aa, Mycobacterium
SVSPGPTRTPGTADM

SEQ ID NO: 1173955 - protein, 7 aa, Mycobacterium
SVSPTGF

SEQ ID NO: 1173956 - protein, 11 aa, Mycobacterium
SVSSGSLRDGL

SEQ ID NO: 1173957 - protein, 12 aa, Mycobacterium
SVTADGDGATVR

SEQ ID NO: 1173958 - protein, 10 aa, Mycobacterium
SVTANTRADA

SEQ ID NO: 1173959 - protein, 7 aa, Mycobacterium
SVTDEYR

SEQ ID NO: 1173960 - protein, 10 aa, Mycobacterium
SVTENAGAPI

SEQ ID NO: 1173961 - protein, 11 aa, Mycobacterium
SVTGETGTAAS

SEQ ID NO: 1173962 - protein, 7 aa, Mycobacterium
SVTGPIP

SEQ ID NO: 1173963 - protein, 6 aa, Mycobacterium
SVTGTL

SEQ ID NO: 1173964 - protein, 9 aa, Mycobacterium
SVTLDGEQR

SEQ ID NO: 1173965 - protein, 6 aa, Mycobacterium
SVTLGP

SEQ ID NO: 1173966 - protein, 14 aa, Mycobacterium
SVTPTGIDAEQGSF

SEQ ID NO: 1173967 - protein, 12 aa, Mycobacterium
SVTSEPGGKGVN

SEQ ID NO: 1173968 - protein, 12 aa, Mycobacterium
SWDDESGAKTTH

SEQ ID NO: 1173969 - protein, 7 aa, Mycobacterium
SWDNTTY

SEQ ID NO: 1173970 - protein, 6 aa, Mycobacterium
SWETPD

SEQ ID NO: 1173971 - protein, 17 aa, Mycobacterium
SWFDPGNAEVRQRERDM

SEQ ID NO: 1173972 - protein, 5 aa, Mycobacterium
SWGGD

SEQ ID NO: 1173973 - protein, 11 aa, Mycobacterium
SWGPQSEKKTL

SEQ ID NO: 1173974 - protein, 16 aa, Mycobacterium
SWKTPRTEVDTRRGRG

SEQ ID NO: 1173975 - protein, 19 aa, Mycobacterium
SWTGDDELGDRAARNLRFT

SEQ ID NO: 1173976 - protein, 6 aa, Mycobacterium
SYCPYK

SEQ ID NO: 1173977 - protein, 10 aa, Mycobacterium
SYDATHDSPY

SEQ ID NO: 1173978 - protein, 4 aa, Mycobacterium
SYDD

SEQ ID NO: 1173979 - protein, 5 aa, Mycobacterium
SYDDS

SEQ ID NO: 1173980 - protein, 10 aa, Mycobacterium
SYDPGRRRRQ

SEQ ID NO: 1173981 - protein, 12 aa, Mycobacterium
SYDQVSRNPAVR

SEQ ID NO: 1173982 - protein, 10 aa, Mycobacterium
SYEEGPRQAL

SEQ ID NO: 1173983 - protein, 8 aa, Mycobacterium
SYEQPDNP

SEQ ID NO: 1173984 - protein, 7 aa, Mycobacterium
SYGLSGT

SEQ ID NO: 1173985 - protein, 5 aa, Mycobacterium
SYGPE

SEQ ID NO: 1173986 - protein, 4 aa, Mycobacterium
SYGS

SEQ ID NO: 1173987 - protein, 6 aa, Mycobacterium
SYGSQR

SEQ ID NO: 1173988 - protein, 10 aa, Mycobacterium
SYGTDPETGL

SEQ ID NO: 1173989 - protein, 15 aa, Mycobacterium
SYKKQAKAAAKDQAK

SEQ ID NO: 1173990 - protein, 6 aa, Mycobacterium
SYKRPS

SEQ ID NO: 1173991 - protein, 28 aa, Mycobacterium
SYKRTGAVSTASGASWAPRSATFGGNDR

SEQ ID NO: 1173992 - protein, 20 aa, Mycobacterium
SYPGEVSHSAQYRNPRPYTG

SEQ ID NO: 1173993 - protein, 9 aa, Mycobacterium
SYPNGATAV

SEQ ID NO: 1173994 - protein, 19 aa, Mycobacterium
SYPPTRLADDTADPRPTPE

SEQ ID NO: 1173995 - protein, 8 aa, Mycobacterium
SYRTEEPD

SEQ ID NO: 1173996 - protein, 6 aa, Mycobacterium
SYSGGM

SEQ ID NO: 1173997 - protein, 6 aa, Mycobacterium
SYSGTE

SEQ ID NO: 1173998 - protein, 4 aa, Mycobacterium
SYTH

SEQ ID NO: 1173999 - protein, 4 aa, Mycobacterium
SYTM

SEQ ID NO: 1174000 - protein, 4 aa, Mycobacterium
SYVG

SEQ ID NO: 1174001 - protein, 13 aa, Mycobacterium
TAAAASPPSADDP

SEQ ID NO: 1174002 - protein, 8 aa, Mycobacterium
TAAAATPV

SEQ ID NO: 1174003 - protein, 9 aa, Mycobacterium
TAAAGSPAF

SEQ ID NO: 1174004 - protein, 6 aa, Mycobacterium
TAAARA

SEQ ID NO: 1174005 - protein, 30 aa, Mycobacterium
TAAASGASATDRFRADKSPYDAVRDTPRER

SEQ ID NO: 1174006 - protein, 24 aa, Mycobacterium
TAAATASPLQAEYGQTVDRESAYE

SEQ ID NO: 1174007 - protein, 8 aa, Mycobacterium
TAADGEAL

SEQ ID NO: 1174008 - protein, 11 aa, Mycobacterium
TAADPDGRTVA

SEQ ID NO: 1174009 - protein, 10 aa, Mycobacterium
TAADPQVATA

SEQ ID NO: 1174010 - protein, 5 aa, Mycobacterium
TAADR

SEQ ID NO: 1174011 - protein, 5 aa, Mycobacterium
TAADT

SEQ ID NO: 1174012 - protein, 4 aa, Mycobacterium
TAAE

SEQ ID NO: 1174013 - protein, 10 aa, Mycobacterium
TAAEPAAASA

SEQ ID NO: 1174014 - protein, 13 aa, Mycobacterium
TAAEQRAVPGDGA

SEQ ID NO: 1174015 - protein, 5 aa, Mycobacterium
TAAGA

SEQ ID NO: 1174016 - protein, 6 aa, Mycobacterium
TAAGGA

SEQ ID NO: 1174017 - protein, 9 aa, Mycobacterium
TAAGGALEA

SEQ ID NO: 1174018 - protein, 13 aa, Mycobacterium
TAAGGEAVTSGAN

SEQ ID NO: 1174019 - protein, 12 aa, Mycobacterium
TAAGPAPSGPSV

SEQ ID NO: 1174020 - protein, 8 aa, Mycobacterium
TAAGPFTQ

SEQ ID NO: 1174021 - protein, 6 aa, Mycobacterium
TAAGQT

SEQ ID NO: 1174022 - protein, 10 aa, Mycobacterium
TAAGSGCSAA

SEQ ID NO: 1174023 - protein, 7 aa, Mycobacterium
TAAGTGE

SEQ ID NO: 1174024 - protein, 11 aa, Mycobacterium
TAAGYRGYTDA

SEQ ID NO: 1174025 - protein, 6 aa, Mycobacterium
TAAHAD

SEQ ID NO: 1174026 - protein, 9 aa, Mycobacterium
TAAKPGKRI

SEQ ID NO: 1174027 - protein, 11 aa, Mycobacterium
TAAPAPPEGIP

SEQ ID NO: 1174028 - protein, 11 aa, Mycobacterium
TAAPGNNAPLG

SEQ ID NO: 1174029 - protein, 7 aa, Mycobacterium
TAAPHLS

SEQ ID NO: 1174030 - protein, 6 aa, Mycobacterium
TAAPRA

SEQ ID NO: 1174031 - protein, 7 aa, Mycobacterium
TAAPWND

SEQ ID NO: 1174032 - protein, 5 aa, Mycobacterium
TAAQH

SEQ ID NO: 1174033 - protein, 9 aa, Mycobacterium
TAAREAAQA

SEQ ID NO: 1174034 - protein, 6 aa, Mycobacterium
TAAREG

SEQ ID NO: 1174035 - protein, 5 aa, Mycobacterium
TAARL

SEQ ID NO: 1174036 - protein, 6 aa, Mycobacterium
TAARPA

SEQ ID NO: 1174037 - protein, 7 aa, Mycobacterium
TAARRDI

SEQ ID NO: 1174038 - protein, 6 aa, Mycobacterium
TAASIH

SEQ ID NO: 1174039 - protein, 12 aa, Mycobacterium
TAASRDGRAQSA

SEQ ID NO: 1174040 - protein, 4 aa, Mycobacterium
TAAT

SEQ ID NO: 1174041 - protein, 5 aa, Mycobacterium
TAATD

SEQ ID NO: 1174042 - protein, 8 aa, Mycobacterium
TAATDGSL

SEQ ID NO: 1174043 - protein, 9 aa, Mycobacterium
TAAVGGAAP

SEQ ID NO: 1174044 - protein, 7 aa, Mycobacterium
TADAAPI

SEQ ID NO: 1174045 - protein, 9 aa, Mycobacterium
TADAGERIT

SEQ ID NO: 1174046 - protein, 8 aa, Mycobacterium
TADAGTGH

SEQ ID NO: 1174047 - protein, 8 aa, Mycobacterium
TADAPDAI

SEQ ID NO: 1174048 - protein, 10 aa, Mycobacterium
TADAPGGPGE

SEQ ID NO: 1174049 - protein, 14 aa, Mycobacterium
TADDDDARESVTAG

SEQ ID NO: 1174050 - protein, 9 aa, Mycobacterium
TADDGQAYG

SEQ ID NO: 1174051 - protein, 8 aa, Mycobacterium
TADDGYDL

SEQ ID NO: 1174052 - protein, 9 aa, Mycobacterium
TADDTDPTE

SEQ ID NO: 1174053 - protein, 9 aa, Mycobacterium
TADEIPPER

SEQ ID NO: 1174054 - protein, 6 aa, Mycobacterium
TADGES

SEQ ID NO: 1174055 - protein, 15 aa, Mycobacterium
TADGLGDAVDSTLDA

SEQ ID NO: 1174056 - protein, 8 aa, Mycobacterium
TADGPDEV

SEQ ID NO: 1174057 - protein, 6 aa, Mycobacterium
TADHPD

SEQ ID NO: 1174058 - protein, 10 aa, Mycobacterium
TADKTPDATP

SEQ ID NO: 1174059 - protein, 4 aa, Mycobacterium
TADL

SEQ ID NO: 1174060 - protein, 6 aa, Mycobacterium
TADPQD

SEQ ID NO: 1174061 - protein, 18 aa, Mycobacterium
TADPTKLASSTASQQQQQ

SEQ ID NO: 1174062 - protein, 14 aa, Mycobacterium
TADPTRSPEGTESA

SEQ ID NO: 1174063 - protein, 5 aa, Mycobacterium
TADPV

SEQ ID NO: 1174064 - protein, 7 aa, Mycobacterium
TADRRES

SEQ ID NO: 1174065 - protein, 7 aa, Mycobacterium
TADSSRA

SEQ ID NO: 1174066 - protein, 8 aa, Mycobacterium
TADTAGDR

SEQ ID NO: 1174067 - protein, 16 aa, Mycobacterium
TADTPMTLTGPAAGTD

SEQ ID NO: 1174068 - protein, 13 aa, Mycobacterium
TADTSWVFDATGM

SEQ ID NO: 1174069 - protein, 10 aa, Mycobacterium
TAEAEASERF

SEQ ID NO: 1174070 - protein, 10 aa, Mycobacterium
TAEDTHGPEG

SEQ ID NO: 1174071 - protein, 8 aa, Mycobacterium
TAEEAKDY

SEQ ID NO: 1174072 - protein, 6 aa, Mycobacterium
TAEEAT

SEQ ID NO: 1174073 - protein, 5 aa, Mycobacterium
TAEEG

SEQ ID NO: 1174074 - protein, 14 aa, Mycobacterium
TAEEIAAEDTPADV

SEQ ID NO: 1174075 - protein, 14 aa, Mycobacterium
TAEERERRYEEGWQ

SEQ ID NO: 1174076 - protein, 6 aa, Mycobacterium
TAEFTG

SEQ ID NO: 1174077 - protein, 8 aa, Mycobacterium
TAEGNHMG

SEQ ID NO: 1174078 - protein, 12 aa, Mycobacterium
TAEGRNTGKPNH

SEQ ID NO: 1174079 - protein, 9 aa, Mycobacterium
TAEHGADDI

SEQ ID NO: 1174080 - protein, 5 aa, Mycobacterium
TAEMP

SEQ ID NO: 1174081 - protein, 7 aa, Mycobacterium
TAEPAAA

SEQ ID NO: 1174082 - protein, 7 aa, Mycobacterium
TAEPGHH

SEQ ID NO: 1174083 - protein, 10 aa, Mycobacterium
TAEPHPKLPG

SEQ ID NO: 1174084 - protein, 8 aa, Mycobacterium
TAEPNQPA

SEQ ID NO: 1174085 - protein, 5 aa, Mycobacterium
TAEQL

SEQ ID NO: 1174086 - protein, 13 aa, Mycobacterium
TAEQVRKSGRKAL

SEQ ID NO: 1174087 - protein, 8 aa, Mycobacterium
TAERGGDR

SEQ ID NO: 1174088 - protein, 8 aa, Mycobacterium
TAERRGQL

SEQ ID NO: 1174089 - protein, 5 aa, Mycobacterium
TAERT

SEQ ID NO: 1174090 - protein, 15 aa, Mycobacterium
TAESAVAAGADLTPA

SEQ ID NO: 1174091 - protein, 6 aa, Mycobacterium
TAESGK

SEQ ID NO: 1174092 - protein, 5 aa, Mycobacterium
TAETP

SEQ ID NO: 1174093 - protein, 8 aa, Mycobacterium
TAETTSHT

SEQ ID NO: 1174094 - protein, 15 aa, Mycobacterium
TAFEREDYSGSKNDP

SEQ ID NO: 1174095 - protein, 6 aa, Mycobacterium
TAGAAI

SEQ ID NO: 1174096 - protein, 5 aa, Mycobacterium
TAGAN

SEQ ID NO: 1174097 - protein, 10 aa, Mycobacterium
TAGASTDSQA

SEQ ID NO: 1174098 - protein, 7 aa, Mycobacterium
TAGCEKR

SEQ ID NO: 1174099 - protein, 6 aa, Mycobacterium
TAGDDA

SEQ ID NO: 1174100 - protein, 8 aa, Mycobacterium
TAGDDDLS

SEQ ID NO: 1174101 - protein, 8 aa, Mycobacterium
TAGDGATA

SEQ ID NO: 1174102 - protein, 6 aa, Mycobacterium
TAGERQ

SEQ ID NO: 1174103 - protein, 5 aa, Mycobacterium
TAGEV

SEQ ID NO: 1174104 - protein, 8 aa, Mycobacterium
TAGFDGPA

SEQ ID NO: 1174105 - protein, 13 aa, Mycobacterium
TAGGATAAPEEHI

SEQ ID NO: 1174106 - protein, 8 aa, Mycobacterium
TAGGATDV

SEQ ID NO: 1174107 - protein, 6 aa, Mycobacterium
TAGGEH

SEQ ID NO: 1174108 - protein, 5 aa, Mycobacterium
TAGGG

SEQ ID NO: 1174109 - protein, 9 aa, Mycobacterium
TAGGGSAMR

SEQ ID NO: 1174110 - protein, 6 aa, Mycobacterium
TAGGPL

SEQ ID NO: 1174111 - protein, 9 aa, Mycobacterium
TAGGTREPI

SEQ ID NO: 1174112 - protein, 5 aa, Mycobacterium
TAGGV

SEQ ID NO: 1174113 - protein, 9 aa, Mycobacterium
TAGIDPKDV

SEQ ID NO: 1174114 - protein, 26 aa, Mycobacterium
TAGKRTEPHERPADGTPVVDTDRGGK

SEQ ID NO: 1174115 - protein, 13 aa, Mycobacterium
TAGNSSGTNDAAA

SEQ ID NO: 1174116 - protein, 8 aa, Mycobacterium
TAGPDRLD

SEQ ID NO: 1174117 - protein, 5 aa, Mycobacterium
TAGPV

SEQ ID NO: 1174118 - protein, 6 aa, Mycobacterium
TAGRRT

SEQ ID NO: 1174119 - protein, 8 aa, Mycobacterium
TAGRRTAA

SEQ ID NO: 1174120 - protein, 8 aa, Mycobacterium
TAGRTDSR

SEQ ID NO: 1174121 - protein, 7 aa, Mycobacterium
TAGSANK

SEQ ID NO: 1174122 - protein, 8 aa, Mycobacterium
TAGSPERR

SEQ ID NO: 1174123 - protein, 7 aa, Mycobacterium
TAGSRLD

SEQ ID NO: 1174124 - protein, 10 aa, Mycobacterium
TAGTAGHGRR

SEQ ID NO: 1174125 - protein, 8 aa, Mycobacterium
TAGVGRPD

SEQ ID NO: 1174126 - protein, 14 aa, Mycobacterium
TAHAGDRIRRRQAS

SEQ ID NO: 1174127 - protein, 9 aa, Mycobacterium
TAHGARPAA

SEQ ID NO: 1174128 - protein, 5 aa, Mycobacterium
TAHPD

SEQ ID NO: 1174129 - protein, 11 aa, Mycobacterium
TAHPQPGNPEP

SEQ ID NO: 1174130 - protein, 13 aa, Mycobacterium
TAHSDLDDAAAGE

SEQ ID NO: 1174131 - protein, 10 aa, Mycobacterium
TAHTPGGKKP

SEQ ID NO: 1174132 - protein, 7 aa, Mycobacterium
TAIGPEA

SEQ ID NO: 1174133 - protein, 7 aa, Mycobacterium
TAKEAKR

SEQ ID NO: 1174134 - protein, 5 aa, Mycobacterium
TAKGA

SEQ ID NO: 1174135 - protein, 4 aa, Mycobacterium
TALE

SEQ ID NO: 1174136 - protein, 8 aa, Mycobacterium
TALEPKER

SEQ ID NO: 1174137 - protein, 7 aa, Mycobacterium
TALPGAD

SEQ ID NO: 1174138 - protein, 9 aa, Mycobacterium
TALPRPTAD

SEQ ID NO: 1174139 - protein, 8 aa, Mycobacterium
TALSGTAR

SEQ ID NO: 1174140 - protein, 7 aa, Mycobacterium
TALTGEQ

SEQ ID NO: 1174141 - protein, 8 aa, Mycobacterium
TALTTPTG

SEQ ID NO: 1174142 - protein, 15 aa, Mycobacterium
TAMAPRQDGTAEDDG

SEQ ID NO: 1174143 - protein, 11 aa, Mycobacterium
TAMASTPDAGI

SEQ ID NO: 1174144 - protein, 11 aa, Mycobacterium
TAMATGPNVGL

SEQ ID NO: 1174145 - protein, 6 aa, Mycobacterium
TAMDGE

SEQ ID NO: 1174146 - protein, 9 aa, Mycobacterium
TAMPPGEDL

SEQ ID NO: 1174147 - protein, 8 aa, Mycobacterium
TAPAGAEG

SEQ ID NO: 1174148 - protein, 10 aa, Mycobacterium
TAPAKVKPGY

SEQ ID NO: 1174149 - protein, 6 aa, Mycobacterium
TAPALG

SEQ ID NO: 1174150 - protein, 9 aa, Mycobacterium
TAPAPNEKY

SEQ ID NO: 1174151 - protein, 26 aa, Mycobacterium
TAPAPSDTERPVRSITTGPRGYEGEG

SEQ ID NO: 1174152 - protein, 8 aa, Mycobacterium
TAPARIPD

SEQ ID NO: 1174153 - protein, 7 aa, Mycobacterium
TAPATRQ

SEQ ID NO: 1174154 - protein, 6 aa, Mycobacterium
TAPDAV

SEQ ID NO: 1174155 - protein, 16 aa, Mycobacterium
TAPDFSLPDADGNTVN

SEQ ID NO: 1174156 - protein, 10 aa, Mycobacterium
TAPDGGTWDA

SEQ ID NO: 1174157 - protein, 6 aa, Mycobacterium
TAPDGS

SEQ ID NO: 1174158 - protein, 9 aa, Mycobacterium
TAPDGSPWT

SEQ ID NO: 1174159 - protein, 6 aa, Mycobacterium
TAPEGT

SEQ ID NO: 1174160 - protein, 15 aa, Mycobacterium
TAPEPLAPDTDAPDR

SEQ ID NO: 1174161 - protein, 7 aa, Mycobacterium
TAPESDT

SEQ ID NO: 1174162 - protein, 9 aa, Mycobacterium
TAPETEPWG

SEQ ID NO: 1174163 - protein, 10 aa, Mycobacterium
TAPETGRRTQ

SEQ ID NO: 1174164 - protein, 4 aa, Mycobacterium
TAPG

SEQ ID NO: 1174165 - protein, 10 aa, Mycobacterium
TAPGDGRGEQ

SEQ ID NO: 1174166 - protein, 10 aa, Mycobacterium
TAPGHTPGSS

SEQ ID NO: 1174167 - protein, 26 aa, Mycobacterium
TAPGSVEFGSRRGRKTVNIVPVARPE

SEQ ID NO: 1174168 - protein, 6 aa, Mycobacterium
TAPGYL

SEQ ID NO: 1174169 - protein, 9 aa, Mycobacterium
TAPKAGTVE

SEQ ID NO: 1174170 - protein, 12 aa, Mycobacterium
TAPKKGCDHGQC

SEQ ID NO: 1174171 - protein, 9 aa, Mycobacterium
TAPKPAGYL

SEQ ID NO: 1174172 - protein, 8 aa, Mycobacterium
TAPKRRRW

SEQ ID NO: 1174173 - protein, 5 aa, Mycobacterium
TAPLS

SEQ ID NO: 1174174 - protein, 8 aa, Mycobacterium
TAPNATLG

SEQ ID NO: 1174175 - protein, 10 aa, Mycobacterium
TAPPADVEPL

SEQ ID NO: 1174176 - protein, 6 aa, Mycobacterium
TAPPPF

SEQ ID NO: 1174177 - protein, 4 aa, Mycobacterium
TAPQ

SEQ ID NO: 1174178 - protein, 20 aa, Mycobacterium
TAPRVNDKRIDADTGERQRF

SEQ ID NO: 1174179 - protein, 6 aa, Mycobacterium
TAPSRD

SEQ ID NO: 1174180 - protein, 18 aa, Mycobacterium
TAPSRDNAVALSGVELKP

SEQ ID NO: 1174181 - protein, 7 aa, Mycobacterium
TAPTGRS

SEQ ID NO: 1174182 - protein, 5 aa, Mycobacterium
TAQAA

SEQ ID NO: 1174183 - protein, 9 aa, Mycobacterium
TAQDELRDR

SEQ ID NO: 1174184 - protein, 14 aa, Mycobacterium
TAQFRSTTADPGGV

SEQ ID NO: 1174185 - protein, 5 aa, Mycobacterium
TAQMS

SEQ ID NO: 1174186 - protein, 14 aa, Mycobacterium
TAQPDRTPLPRPDL

SEQ ID NO: 1174187 - protein, 7 aa, Mycobacterium
TAQPQDR

SEQ ID NO: 1174188 - protein, 7 aa, Mycobacterium
TAQRLPK

SEQ ID NO: 1174189 - protein, 8 aa, Mycobacterium
TAQRSTVN

SEQ ID NO: 1174190 - protein, 13 aa, Mycobacterium
TAQVEGGDLLVVV

SEQ ID NO: 1174191 - protein, 14 aa, Mycobacterium
TARADGGEVTGGER

SEQ ID NO: 1174192 - protein, 7 aa, Mycobacterium
TARAGKL

SEQ ID NO: 1174193 - protein, 7 aa, Mycobacterium
TARASET

SEQ ID NO: 1174194 - protein, 7 aa, Mycobacterium
TARDEAD

SEQ ID NO: 1174195 - protein, 7 aa, Mycobacterium
TARDRPL

SEQ ID NO: 1174196 - protein, 4 aa, Mycobacterium
TARE

SEQ ID NO: 1174197 - protein, 14 aa, Mycobacterium
TARGDGREVATDPH

SEQ ID NO: 1174198 - protein, 10 aa, Mycobacterium
TARGVGAETP

SEQ ID NO: 1174199 - protein, 6 aa, Mycobacterium
TARIGG

SEQ ID NO: 1174200 - protein, 8 aa, Mycobacterium
TARKDDGY

SEQ ID NO: 1174201 - protein, 6 aa, Mycobacterium
TARPDT

SEQ ID NO: 1174202 - protein, 5 aa, Mycobacterium
TARPE

SEQ ID NO: 1174203 - protein, 7 aa, Mycobacterium
TARPEGF

SEQ ID NO: 1174204 - protein, 8 aa, Mycobacterium
TARPIGGE

SEQ ID NO: 1174205 - protein, 7 aa, Mycobacterium
TARSAPR

SEQ ID NO: 1174206 - protein, 24 aa, Mycobacterium
TARSARLAAEQTGADARTRESVPS

SEQ ID NO: 1174207 - protein, 9 aa, Mycobacterium
TARSSGARY

SEQ ID NO: 1174208 - protein, 7 aa, Mycobacterium
TARTAAL

SEQ ID NO: 1174209 - protein, 9 aa, Mycobacterium
TARTGGVAG

SEQ ID NO: 1174210 - protein, 20 aa, Mycobacterium
TARTMGDGWETSRRRDAGND

SEQ ID NO: 1174211 - protein, 7 aa, Mycobacterium
TARTPGG

SEQ ID NO: 1174212 - protein, 13 aa, Mycobacterium
TARWSDDEVTATE

SEQ ID NO: 1174213 - protein, 16 aa, Mycobacterium
TASAGVPTAQQQRNWD

SEQ ID NO: 1174214 - protein, 8 aa, Mycobacterium
TASAKGKD

SEQ ID NO: 1174215 - protein, 8 aa, Mycobacterium
TASAPEST

SEQ ID NO: 1174216 - protein, 8 aa, Mycobacterium
TASASAGT

SEQ ID NO: 1174217 - protein, 18 aa, Mycobacterium
TASDGASALDKARDVRPD

SEQ ID NO: 1174218 - protein, 6 aa, Mycobacterium
TASEEF

SEQ ID NO: 1174219 - protein, 10 aa, Mycobacterium
TASGGQRVTA

SEQ ID NO: 1174220 - protein, 6 aa, Mycobacterium
TASPEF

SEQ ID NO: 1174221 - protein, 13 aa, Mycobacterium
TASPQAKSSSGWK

SEQ ID NO: 1174222 - protein, 5 aa, Mycobacterium
TASRK

SEQ ID NO: 1174223 - protein, 9 aa, Mycobacterium
TASSGVTDE

SEQ ID NO: 1174224 - protein, 8 aa, Mycobacterium
TASSLRKA

SEQ ID NO: 1174225 - protein, 7 aa, Mycobacterium
TASTAKA

SEQ ID NO: 1174226 - protein, 16 aa, Mycobacterium
TASWPNRTDPGGSRGL

SEQ ID NO: 1174227 - protein, 6 aa, Mycobacterium
TATAEE

SEQ ID NO: 1174228 - protein, 7 aa, Mycobacterium
TATANDR

SEQ ID NO: 1174229 - protein, 9 aa, Mycobacterium
TATAPDGAA

SEQ ID NO: 1174230 - protein, 14 aa, Mycobacterium
TATAPESASGTPEQ

SEQ ID NO: 1174231 - protein, 7 aa, Mycobacterium
TATAPPT

SEQ ID NO: 1174232 - protein, 4 aa, Mycobacterium
TATD

SEQ ID NO: 1174233 - protein, 11 aa, Mycobacterium
TATDGKAVPPA

SEQ ID NO: 1174234 - protein, 6 aa, Mycobacterium
TATDSV

SEQ ID NO: 1174235 - protein, 9 aa, Mycobacterium
TATEGTDIP

SEQ ID NO: 1174236 - protein, 9 aa, Mycobacterium
TATELPDGQ

SEQ ID NO: 1174237 - protein, 5 aa, Mycobacterium
TATER

SEQ ID NO: 1174238 - protein, 11 aa, Mycobacterium
TATESSVEADS

SEQ ID NO: 1174239 - protein, 8 aa, Mycobacterium
TATGDDPV

SEQ ID NO: 1174240 - protein, 7 aa, Mycobacterium
TATGDTD

SEQ ID NO: 1174241 - protein, 12 aa, Mycobacterium
TATGKTVGEREA

SEQ ID NO: 1174242 - protein, 6 aa, Mycobacterium
TATGLP

SEQ ID NO: 1174243 - protein, 6 aa, Mycobacterium
TATGSV

SEQ ID NO: 1174244 - protein, 6 aa, Mycobacterium
TATKGL

SEQ ID NO: 1174245 - protein, 8 aa, Mycobacterium
TATLTAAP

SEQ ID NO: 1174246 - protein, 8 aa, Mycobacterium
TATPAERS

SEQ ID NO: 1174247 - protein, 11 aa, Mycobacterium
TATPAPTVDED

SEQ ID NO: 1174248 - protein, 15 aa, Mycobacterium
TATPERLPRVAAGVP

SEQ ID NO: 1174249 - protein, 6 aa, Mycobacterium
TATPEW

SEQ ID NO: 1174250 - protein, 12 aa, Mycobacterium
TATPGPVSDYTG

SEQ ID NO: 1174251 - protein, 9 aa, Mycobacterium
TATRTRQTL

SEQ ID NO: 1174252 - protein, 9 aa, Mycobacterium
TATSEGCVD

SEQ ID NO: 1174253 - protein, 5 aa, Mycobacterium
TATSH

SEQ ID NO: 1174254 - protein, 12 aa, Mycobacterium
TATSQKADDKPT

SEQ ID NO: 1174255 - protein, 8 aa, Mycobacterium
TATTRDVN

SEQ ID NO: 1174256 - protein, 13 aa, Mycobacterium
TATTSGDKKAQVC

SEQ ID NO: 1174257 - protein, 11 aa, Mycobacterium
TATYPDGSTPE

SEQ ID NO: 1174258 - protein, 5 aa, Mycobacterium
TAVDD

SEQ ID NO: 1174259 - protein, 12 aa, Mycobacterium
TAVDEGAGSDEL

SEQ ID NO: 1174260 - protein, 18 aa, Mycobacterium
TAVDGAEALRSATETRPD

SEQ ID NO: 1174261 - protein, 5 aa, Mycobacterium
TAVEA

SEQ ID NO: 1174262 - protein, 6 aa, Mycobacterium
TAVGPD

SEQ ID NO: 1174263 - protein, 5 aa, Mycobacterium
TAVPP

SEQ ID NO: 1174264 - protein, 8 aa, Mycobacterium
TAVPPQRR

SEQ ID NO: 1174265 - protein, 5 aa, Mycobacterium
TAVPQ

SEQ ID NO: 1174266 - protein, 8 aa, Mycobacterium
TAVRGEAP

SEQ ID NO: 1174267 - protein, 18 aa, Mycobacterium
TAVRGTLSSPADLSAVPA

SEQ ID NO: 1174268 - protein, 7 aa, Mycobacterium
TAVSRAR

SEQ ID NO: 1174269 - protein, 16 aa, Mycobacterium
TAVSSNERGASSGGIV

SEQ ID NO: 1174270 - protein, 5 aa, Mycobacterium
TAYDR

SEQ ID NO: 1174271 - protein, 10 aa, Mycobacterium
TAYGSSGKVY

SEQ ID NO: 1174272 - protein, 8 aa, Mycobacterium
TAYPPAAE

SEQ ID NO: 1174273 - protein, 5 aa, Mycobacterium
TCAST

SEQ ID NO: 1174274 - protein, 23 aa, Mycobacterium
TCPGGPVAEYEPPADGYVSGEPW

SEQ ID NO: 1174275 - protein, 7 aa, Mycobacterium
TCPSSDG

SEQ ID NO: 1174276 - protein, 6 aa, Mycobacterium
TCSDVG

SEQ ID NO: 1174277 - protein, 11 aa, Mycobacterium
TCTPGPLAQDT

SEQ ID NO: 1174278 - protein, 12 aa, Mycobacterium
TDAAAELARNLG

SEQ ID NO: 1174279 - protein, 10 aa, Mycobacterium
TDAANSSGVP

SEQ ID NO: 1174280 - protein, 9 aa, Mycobacterium
TDADGYPKT

SEQ ID NO: 1174281 - protein, 6 aa, Mycobacterium
TDADHA

SEQ ID NO: 1174282 - protein, 15 aa, Mycobacterium
TDAEAVDSAVAAGAD

SEQ ID NO: 1174283 - protein, 4 aa, Mycobacterium
TDAG

SEQ ID NO: 1174284 - protein, 6 aa, Mycobacterium
TDAGKF

SEQ ID NO: 1174285 - protein, 8 aa, Mycobacterium
TDAGRAAL

SEQ ID NO: 1174286 - protein, 8 aa, Mycobacterium
TDAGRDAS

SEQ ID NO: 1174287 - protein, 4 aa, Mycobacterium
TDAH

SEQ ID NO: 1174288 - protein, 6 aa, Mycobacterium
TDAKGR

SEQ ID NO: 1174289 - protein, 13 aa, Mycobacterium
TDAPALRRAAEGA

SEQ ID NO: 1174290 - protein, 12 aa, Mycobacterium
TDAPAVPHGQNA

SEQ ID NO: 1174291 - protein, 12 aa, Mycobacterium
TDAPVLEPADQR

SEQ ID NO: 1174292 - protein, 7 aa, Mycobacterium
TDARADL

SEQ ID NO: 1174293 - protein, 7 aa, Mycobacterium
TDARPEQ

SEQ ID NO: 1174294 - protein, 8 aa, Mycobacterium
TDARSGTL

SEQ ID NO: 1174295 - protein, 13 aa, Mycobacterium
TDARSQSDPEGAA

SEQ ID NO: 1174296 - protein, 6 aa, Mycobacterium
TDASGN

SEQ ID NO: 1174297 - protein, 8 aa, Mycobacterium
TDATPDEF

SEQ ID NO: 1174298 - protein, 7 aa, Mycobacterium
TDATPGQ

SEQ ID NO: 1174299 - protein, 6 aa, Mycobacterium
TDAVQT

SEQ ID NO: 1174300 - protein, 9 aa, Mycobacterium
TDDADRDAL

SEQ ID NO: 1174301 - protein, 5 aa, Mycobacterium
TDDAG

SEQ ID NO: 1174302 - protein, 10 aa, Mycobacterium
TDDAGPGHAD

SEQ ID NO: 1174303 - protein, 10 aa, Mycobacterium
TDDDDPARRL

SEQ ID NO: 1174304 - protein, 9 aa, Mycobacterium
TDDDGPARV

SEQ ID NO: 1174305 - protein, 8 aa, Mycobacterium
TDDDGQIT

SEQ ID NO: 1174306 - protein, 6 aa, Mycobacterium
TDDDRR

SEQ ID NO: 1174307 - protein, 8 aa, Mycobacterium
TDDETSPH

SEQ ID NO: 1174308 - protein, 8 aa, Mycobacterium
TDDGAAAQ

SEQ ID NO: 1174309 - protein, 7 aa, Mycobacterium
TDDGRAL

SEQ ID NO: 1174310 - protein, 24 aa, Mycobacterium
TDDGVPSPSQYDPARNRHRDPRGW

SEQ ID NO: 1174311 - protein, 9 aa, Mycobacterium
TDDLPAPAA

SEQ ID NO: 1174312 - protein, 14 aa, Mycobacterium
TDDLSQANLAAGGG

SEQ ID NO: 1174313 - protein, 14 aa, Mycobacterium
TDDPDFDSDPTVAN

SEQ ID NO: 1174314 - protein, 7 aa, Mycobacterium
TDDPDVN

SEQ ID NO: 1174315 - protein, 6 aa, Mycobacterium
TDDPEV

SEQ ID NO: 1174316 - protein, 8 aa, Mycobacterium
TDDSVSRR

SEQ ID NO: 1174317 - protein, 7 aa, Mycobacterium
TDDTRTE

SEQ ID NO: 1174318 - protein, 8 aa, Mycobacterium
TDDVESTV

SEQ ID NO: 1174319 - protein, 13 aa, Mycobacterium
TDEAAARRQPWTA

SEQ ID NO: 1174320 - protein, 10 aa, Mycobacterium
TDEAGAPERM

SEQ ID NO: 1174321 - protein, 9 aa, Mycobacterium
TDEATARGA

SEQ ID NO: 1174322 - protein, 4 aa, Mycobacterium
TDEE

SEQ ID NO: 1174323 - protein, 6 aa, Mycobacterium
TDEEGV

SEQ ID NO: 1174324 - protein, 13 aa, Mycobacterium
TDEELANHPARRG

SEQ ID NO: 1174325 - protein, 9 aa, Mycobacterium
TDEGARKLE

SEQ ID NO: 1174326 - protein, 6 aa, Mycobacterium
TDEGRS

SEQ ID NO: 1174327 - protein, 8 aa, Mycobacterium
TDEGRSQV

SEQ ID NO: 1174328 - protein, 9 aa, Mycobacterium
TDEPGLTPG

SEQ ID NO: 1174329 - protein, 9 aa, Mycobacterium
TDEPISGGR

SEQ ID NO: 1174330 - protein, 9 aa, Mycobacterium
TDEPPPDID

SEQ ID NO: 1174331 - protein, 12 aa, Mycobacterium
TDEQARSTPSVS

SEQ ID NO: 1174332 - protein, 6 aa, Mycobacterium
TDEQKQ

SEQ ID NO: 1174333 - protein, 8 aa, Mycobacterium
TDEQRRAR

SEQ ID NO: 1174334 - protein, 8 aa, Mycobacterium
TDEQYRAS

SEQ ID NO: 1174335 - protein, 4 aa, Mycobacterium
TDER

SEQ ID NO: 1174336 - protein, 6 aa, Mycobacterium
TDESEA

SEQ ID NO: 1174337 - protein, 5 aa, Mycobacterium
TDFPA

SEQ ID NO: 1174338 - protein, 5 aa, Mycobacterium
TDGAD

SEQ ID NO: 1174339 - protein, 13 aa, Mycobacterium
TDGADDDDRNPVV

SEQ ID NO: 1174340 - protein, 5 aa, Mycobacterium
TDGDD

SEQ ID NO: 1174341 - protein, 8 aa, Mycobacterium
TDGDDRLD

SEQ ID NO: 1174342 - protein, 12 aa, Mycobacterium
TDGDPLVLTRRA

SEQ ID NO: 1174343 - protein, 8 aa, Mycobacterium
TDGEGTLR

SEQ ID NO: 1174344 - protein, 7 aa, Mycobacterium
TDGEQEF

SEQ ID NO: 1174345 - protein, 14 aa, Mycobacterium
TDGETNASLRKGDD

SEQ ID NO: 1174346 - protein, 12 aa, Mycobacterium
TDGGDDTTAPPL

SEQ ID NO: 1174347 - protein, 10 aa, Mycobacterium
TDGGGAQATA

SEQ ID NO: 1174348 - protein, 9 aa, Mycobacterium
TDGGGSARV

SEQ ID NO: 1174349 - protein, 6 aa, Mycobacterium
TDGHGA

SEQ ID NO: 1174350 - protein, 4 aa, Mycobacterium
TDGL

SEQ ID NO: 1174351 - protein, 8 aa, Mycobacterium
TDGNEHRR

SEQ ID NO: 1174352 - protein, 11 aa, Mycobacterium
TDGRGGLTARE

SEQ ID NO: 1174353 - protein, 5 aa, Mycobacterium
TDGRL

SEQ ID NO: 1174354 - protein, 8 aa, Mycobacterium
TDGRPIPG

SEQ ID NO: 1174355 - protein, 11 aa, Mycobacterium
TDGRPVTQAPR

SEQ ID NO: 1174356 - protein, 6 aa, Mycobacterium
TDGSDP

SEQ ID NO: 1174357 - protein, 7 aa, Mycobacterium
TDGSGEA

SEQ ID NO: 1174358 - protein, 14 aa, Mycobacterium
TDGSSVQLSALRGP

SEQ ID NO: 1174359 - protein, 6 aa, Mycobacterium
TDGSTA

SEQ ID NO: 1174360 - protein, 14 aa, Mycobacterium
TDGSTLAQASPPDM

SEQ ID NO: 1174361 - protein, 8 aa, Mycobacterium
TDGTAREV

SEQ ID NO: 1174362 - protein, 7 aa, Mycobacterium
TDGTATV

SEQ ID NO: 1174363 - protein, 6 aa, Mycobacterium
TDGVEI

SEQ ID NO: 1174364 - protein, 5 aa, Mycobacterium
TDGYG

SEQ ID NO: 1174365 - protein, 14 aa, Mycobacterium
TDHPAGSGTAESLN

SEQ ID NO: 1174366 - protein, 11 aa, Mycobacterium
TDIAGANAASL

SEQ ID NO: 1174367 - protein, 6 aa, Mycobacterium
TDIESL

SEQ ID NO: 1174368 - protein, 14 aa, Mycobacterium
TDIPPATPDDLAQT

SEQ ID NO: 1174369 - protein, 8 aa, Mycobacterium
TDKDDNAV

SEQ ID NO: 1174370 - protein, 6 aa, Mycobacterium
TDKGQA

SEQ ID NO: 1174371 - protein, 12 aa, Mycobacterium
TDKGRAEATRAG

SEQ ID NO: 1174372 - protein, 8 aa, Mycobacterium
TDKPQVGH

SEQ ID NO: 1174373 - protein, 7 aa, Mycobacterium
TDKSGTL

SEQ ID NO: 1174374 - protein, 7 aa, Mycobacterium
TDKSYEA

SEQ ID NO: 1174375 - protein, 5 aa, Mycobacterium
TDLPE

SEQ ID NO: 1174376 - protein, 5 aa, Mycobacterium
TDLSA

SEQ ID NO: 1174377 - protein, 7 aa, Mycobacterium
TDLSGEH

SEQ ID NO: 1174378 - protein, 11 aa, Mycobacterium
TDNDPGATARV

SEQ ID NO: 1174379 - protein, 6 aa, Mycobacterium
TDNEPA

SEQ ID NO: 1174380 - protein, 11 aa, Mycobacterium
TDNPDSIEDKN

SEQ ID NO: 1174381 - protein, 8 aa, Mycobacterium
TDNPHAYR

SEQ ID NO: 1174382 - protein, 8 aa, Mycobacterium
TDNPQGIE

SEQ ID NO: 1174383 - protein, 9 aa, Mycobacterium
TDPAAPKHK

SEQ ID NO: 1174384 - protein, 7 aa, Mycobacterium
TDPAGDW

SEQ ID NO: 1174385 - protein, 9 aa, Mycobacterium
TDPAGRAVR

SEQ ID NO: 1174386 - protein, 16 aa, Mycobacterium
TDPARVRAALERLRAG

SEQ ID NO: 1174387 - protein, 7 aa, Mycobacterium
TDPASIA

SEQ ID NO: 1174388 - protein, 9 aa, Mycobacterium
TDPDAAKHR

SEQ ID NO: 1174389 - protein, 6 aa, Mycobacterium
TDPDAL

SEQ ID NO: 1174390 - protein, 10 aa, Mycobacterium
TDPDAPKHRG

SEQ ID NO: 1174391 - protein, 10 aa, Mycobacterium
TDPDAPKRKG

SEQ ID NO: 1174392 - protein, 5 aa, Mycobacterium
TDPDD

SEQ ID NO: 1174393 - protein, 11 aa, Mycobacterium
TDPDFKAGEYG

SEQ ID NO: 1174394 - protein, 10 aa, Mycobacterium
TDPDNSPIAS

SEQ ID NO: 1174395 - protein, 8 aa, Mycobacterium
TDPDRLAA

SEQ ID NO: 1174396 - protein, 8 aa, Mycobacterium
TDPDRVPP

SEQ ID NO: 1174397 - protein, 8 aa, Mycobacterium
TDPDSRRN

SEQ ID NO: 1174398 - protein, 17 aa, Mycobacterium
TDPDSVKAAVEQTTSEL

SEQ ID NO: 1174399 - protein, 4 aa, Mycobacterium
TDPE

SEQ ID NO: 1174400 - protein, 6 aa, Mycobacterium
TDPELS

SEQ ID NO: 1174401 - protein, 13 aa, Mycobacterium
TDPEPPDDLREDV

SEQ ID NO: 1174402 - protein, 11 aa, Mycobacterium
TDPERKADERR

SEQ ID NO: 1174403 - protein, 6 aa, Mycobacterium
TDPETL

SEQ ID NO: 1174404 - protein, 4 aa, Mycobacterium
TDPG

SEQ ID NO: 1174405 - protein, 6 aa, Mycobacterium
TDPGGI

SEQ ID NO: 1174406 - protein, 6 aa, Mycobacterium
TDPGLR

SEQ ID NO: 1174407 - protein, 20 aa, Mycobacterium
TDPGLSNDLSDVSKQRVAGS

SEQ ID NO: 1174408 - protein, 8 aa, Mycobacterium
TDPHSPPE

SEQ ID NO: 1174409 - protein, 23 aa, Mycobacterium
TDPNDYAGPGSGYTPTEKRRAEI

SEQ ID NO: 1174410 - protein, 11 aa, Mycobacterium
TDPQAPKRQAG

SEQ ID NO: 1174411 - protein, 6 aa, Mycobacterium
TDPQQV

SEQ ID NO: 1174412 - protein, 13 aa, Mycobacterium
TDPSALADTAGYA

SEQ ID NO: 1174413 - protein, 9 aa, Mycobacterium
TDPSQGAAG

SEQ ID NO: 1174414 - protein, 7 aa, Mycobacterium
TDPTDEQ

SEQ ID NO: 1174415 - protein, 7 aa, Mycobacterium
TDPTPVD

SEQ ID NO: 1174416 - protein, 8 aa, Mycobacterium
TDQAGDGR

SEQ ID NO: 1174417 - protein, 32 aa, Mycobacterium
TDQVSSRGQVTQAPMAGTPAQAPAGGDGFAGI

SEQ ID NO: 1174418 - protein, 7 aa, Mycobacterium
TDQYKPG

SEQ ID NO: 1174419 - protein, 9 aa, Mycobacterium
TDRAAPQQQ

SEQ ID NO: 1174420 - protein, 6 aa, Mycobacterium
TDRADD

SEQ ID NO: 1174421 - protein, 9 aa, Mycobacterium
TDRAGADAA

SEQ ID NO: 1174422 - protein, 8 aa, Mycobacterium
TDRGETRP

SEQ ID NO: 1174423 - protein, 10 aa, Mycobacterium
TDRGLRGDDL

SEQ ID NO: 1174424 - protein, 10 aa, Mycobacterium
TDRGRSSERQ

SEQ ID NO: 1174425 - protein, 7 aa, Mycobacterium
TDRGVEG

SEQ ID NO: 1174426 - protein, 5 aa, Mycobacterium
TDRNI

SEQ ID NO: 1174427 - protein, 7 aa, Mycobacterium
TDRPDLV

SEQ ID NO: 1174428 - protein, 9 aa, Mycobacterium
TDRPPNHEY

SEQ ID NO: 1174429 - protein, 18 aa, Mycobacterium
TDRQAARSGVGGEVLAYV

SEQ ID NO: 1174430 - protein, 7 aa, Mycobacterium
TDRRAER

SEQ ID NO: 1174431 - protein, 4 aa, Mycobacterium
TDRT

SEQ ID NO: 1174432 - protein, 5 aa, Mycobacterium
TDSAR

SEQ ID NO: 1174433 - protein, 8 aa, Mycobacterium
TDSDEMSQ

SEQ ID NO: 1174434 - protein, 10 aa, Mycobacterium
TDSDGNPTGG

SEQ ID NO: 1174435 - protein, 7 aa, Mycobacterium
TDSGERY

SEQ ID NO: 1174436 - protein, 6 aa, Mycobacterium
TDSPGV

SEQ ID NO: 1174437 - protein, 8 aa, Mycobacterium
TDSPTRSV

SEQ ID NO: 1174438 - protein, 7 aa, Mycobacterium
TDSPYRA

SEQ ID NO: 1174439 - protein, 9 aa, Mycobacterium
TDSRGSYVP

SEQ ID NO: 1174440 - protein, 7 aa, Mycobacterium
TDSVPRA

SEQ ID NO: 1174441 - protein, 9 aa, Mycobacterium
TDTAAKELP

SEQ ID NO: 1174442 - protein, 6 aa, Mycobacterium
TDTADD

SEQ ID NO: 1174443 - protein, 11 aa, Mycobacterium
TDTAGSGRVPA

SEQ ID NO: 1174444 - protein, 6 aa, Mycobacterium
TDTARA

SEQ ID NO: 1174445 - protein, 8 aa, Mycobacterium
TDTASGYA

SEQ ID NO: 1174446 - protein, 5 aa, Mycobacterium
TDTER

SEQ ID NO: 1174447 - protein, 5 aa, Mycobacterium
TDTGA

SEQ ID NO: 1174448 - protein, 7 aa, Mycobacterium
TDTGESV

SEQ ID NO: 1174449 - protein, 8 aa, Mycobacterium
TDTGGSAC

SEQ ID NO: 1174450 - protein, 6 aa, Mycobacterium
TDTHRQ

SEQ ID NO: 1174451 - protein, 4 aa, Mycobacterium
TDTP

SEQ ID NO: 1174452 - protein, 8 aa, Mycobacterium
TDTPADTV

SEQ ID NO: 1174453 - protein, 6 aa, Mycobacterium
TDTPAL

SEQ ID NO: 1174454 - protein, 10 aa, Mycobacterium
TDTPFGDGDP

SEQ ID NO: 1174455 - protein, 6 aa, Mycobacterium
TDTPGF

SEQ ID NO: 1174456 - protein, 6 aa, Mycobacterium
TDTPGV

SEQ ID NO: 1174457 - protein, 8 aa, Mycobacterium
TDTSEELP

SEQ ID NO: 1174458 - protein, 8 aa, Mycobacterium
TDTTRNQL

SEQ ID NO: 1174459 - protein, 8 aa, Mycobacterium
TDVADGTA

SEQ ID NO: 1174460 - protein, 10 aa, Mycobacterium
TDVDTANATV

SEQ ID NO: 1174461 - protein, 9 aa, Mycobacterium
TDVNGADRH

SEQ ID NO: 1174462 - protein, 9 aa, Mycobacterium
TDVNSRQTG

SEQ ID NO: 1174463 - protein, 5 aa, Mycobacterium
TDVPN

SEQ ID NO: 1174464 - protein, 9 aa, Mycobacterium
TDYDRETTA

SEQ ID NO: 1174465 - protein, 5 aa, Mycobacterium
TEAAK

SEQ ID NO: 1174466 - protein, 10 aa, Mycobacterium
TEAALSDAGR

SEQ ID NO: 1174467 - protein, 16 aa, Mycobacterium
TEAARRQLEETDDTVT

SEQ ID NO: 1174468 - protein, 4 aa, Mycobacterium
TEAC

SEQ ID NO: 1174469 - protein, 8 aa, Mycobacterium
TEADERVT

SEQ ID NO: 1174470 - protein, 11 aa, Mycobacterium
TEAEADRALQA

SEQ ID NO: 1174471 - protein, 11 aa, Mycobacterium
TEAEADSGGNM

SEQ ID NO: 1174472 - protein, 8 aa, Mycobacterium
TEAEFQPA

SEQ ID NO: 1174473 - protein, 9 aa, Mycobacterium
TEAGPPGST

SEQ ID NO: 1174474 - protein, 6 aa, Mycobacterium
TEAGVS

SEQ ID NO: 1174475 - protein, 4 aa, Mycobacterium
TEAH

SEQ ID NO: 1174476 - protein, 8 aa, Mycobacterium
TEANRRGT

SEQ ID NO: 1174477 - protein, 9 aa, Mycobacterium
TEAPSDDPR

SEQ ID NO: 1174478 - protein, 13 aa, Mycobacterium
TEARIGSGAERFD

SEQ ID NO: 1174479 - protein, 6 aa, Mycobacterium
TEATGY

SEQ ID NO: 1174480 - protein, 9 aa, Mycobacterium
TECKGSGSI

SEQ ID NO: 1174481 - protein, 4 aa, Mycobacterium
TEDA

SEQ ID NO: 1174482 - protein, 5 aa, Mycobacterium
TEDAL

SEQ ID NO: 1174483 - protein, 19 aa, Mycobacterium
TEDATQAEVASQLGTSRAT

SEQ ID NO: 1174484 - protein, 4 aa, Mycobacterium
TEDE

SEQ ID NO: 1174485 - protein, 6 aa, Mycobacterium
TEDFPE

SEQ ID NO: 1174486 - protein, 7 aa, Mycobacterium
TEDGKEL

SEQ ID NO: 1174487 - protein, 8 aa, Mycobacterium
TEDGTRYP

SEQ ID NO: 1174488 - protein, 9 aa, Mycobacterium
TEDIRDDAG

SEQ ID NO: 1174489 - protein, 17 aa, Mycobacterium
TEDPDSYLRKDGASFAS

SEQ ID NO: 1174490 - protein, 6 aa, Mycobacterium
TEDPER

SEQ ID NO: 1174491 - protein, 9 aa, Mycobacterium
TEDPSPGVD

SEQ ID NO: 1174492 - protein, 12 aa, Mycobacterium
TEDQLKGPDGSS

SEQ ID NO: 1174493 - protein, 6 aa, Mycobacterium
TEDQRD

SEQ ID NO: 1174494 - protein, 9 aa, Mycobacterium
TEDSLEGPK

SEQ ID NO: 1174495 - protein, 9 aa, Mycobacterium
TEDSTDLTA

SEQ ID NO: 1174496 - protein, 7 aa, Mycobacterium
TEEGKAA

SEQ ID NO: 1174497 - protein, 16 aa, Mycobacterium
TEEMGAPPSLSAGPQV

SEQ ID NO: 1174498 - protein, 11 aa, Mycobacterium
TEEQAREEGYD

SEQ ID NO: 1174499 - protein, 15 aa, Mycobacterium
TEEVSGKEARELTDD

SEQ ID NO: 1174500 - protein, 7 aa, Mycobacterium
TEGDPLA

SEQ ID NO: 1174501 - protein, 11 aa, Mycobacterium
TEGDRNQGPIA

SEQ ID NO: 1174502 - protein, 6 aa, Mycobacterium
TEGGQG

SEQ ID NO: 1174503 - protein, 8 aa, Mycobacterium
TEGHQADA

SEQ ID NO: 1174504 - protein, 5 aa, Mycobacterium
TEGRR

SEQ ID NO: 1174505 - protein, 6 aa, Mycobacterium
TEGRSG

SEQ ID NO: 1174506 - protein, 6 aa, Mycobacterium
TEGTAT

SEQ ID NO: 1174507 - protein, 8 aa, Mycobacterium
TEGTDKPL

SEQ ID NO: 1174508 - protein, 9 aa, Mycobacterium
TEGTVKEAG

SEQ ID NO: 1174509 - protein, 9 aa, Mycobacterium
TEGTVSTTM

SEQ ID NO: 1174510 - protein, 6 aa, Mycobacterium
TEHGNR

SEQ ID NO: 1174511 - protein, 8 aa, Mycobacterium
TEHTPDGE

SEQ ID NO: 1174512 - protein, 13 aa, Mycobacterium
TEIDGKKYTAQEI

SEQ ID NO: 1174513 - protein, 10 aa, Mycobacterium
TEIEGDPKVT

SEQ ID NO: 1174514 - protein, 4 aa, Mycobacterium
TEIG

SEQ ID NO: 1174515 - protein, 10 aa, Mycobacterium
TEIPDDGATL

SEQ ID NO: 1174516 - protein, 10 aa, Mycobacterium
TEKPDDHDNP

SEQ ID NO: 1174517 - protein, 9 aa, Mycobacterium
TEKPTKGLR

SEQ ID NO: 1174518 - protein, 26 aa, Mycobacterium
TEKQGGSDVRAGTTQAVPNGDGTYSL

SEQ ID NO: 1174519 - protein, 13 aa, Mycobacterium
TEKVQNRAAEGDW

SEQ ID NO: 1174520 - protein, 5 aa, Mycobacterium
TELAP

SEQ ID NO: 1174521 - protein, 8 aa, Mycobacterium
TELAPSNT

SEQ ID NO: 1174522 - protein, 6 aa, Mycobacterium
TELATG

SEQ ID NO: 1174523 - protein, 4 aa, Mycobacterium
TELD

SEQ ID NO: 1174524 - protein, 6 aa, Mycobacterium
TELKPA

SEQ ID NO: 1174525 - protein, 8 aa, Mycobacterium
TELPPPDD

SEQ ID NO: 1174526 - protein, 8 aa, Mycobacterium
TELTSNSG

SEQ ID NO: 1174527 - protein, 8 aa, Mycobacterium
TENAGRKV

SEQ ID NO: 1174528 - protein, 5 aa, Mycobacterium
TENLE

SEQ ID NO: 1174529 - protein, 9 aa, Mycobacterium
TEPASAAAL

SEQ ID NO: 1174530 - protein, 12 aa, Mycobacterium
TEPDAQSPHVAE

SEQ ID NO: 1174531 - protein, 10 aa, Mycobacterium
TEPEGGSDIA

SEQ ID NO: 1174532 - protein, 15 aa, Mycobacterium
TEPELTRESAAAASL

SEQ ID NO: 1174533 - protein, 7 aa, Mycobacterium
TEPERAG

SEQ ID NO: 1174534 - protein, 9 aa, Mycobacterium
TEPGAGSDL

SEQ ID NO: 1174535 - protein, 14 aa, Mycobacterium
TEPGAGSNPAGLRT

SEQ ID NO: 1174536 - protein, 12 aa, Mycobacterium
TEPGGGSDLQNM

SEQ ID NO: 1174537 - protein, 23 aa, Mycobacterium
TEPGLQGDRSSAGTKPATMETGA

SEQ ID NO: 1174538 - protein, 5 aa, Mycobacterium
TEPGT

SEQ ID NO: 1174539 - protein, 12 aa, Mycobacterium
TEPGTGSDLAGV

SEQ ID NO: 1174540 - protein, 12 aa, Mycobacterium
TEPGTGSDLQSV

SEQ ID NO: 1174541 - protein, 11 aa, Mycobacterium
TEPHSLDNERP

SEQ ID NO: 1174542 - protein, 4 aa, Mycobacterium
TEPI

SEQ ID NO: 1174543 - protein, 5 aa, Mycobacterium
TEPLS

SEQ ID NO: 1174544 - protein, 13 aa, Mycobacterium
TEPPKLKKQEKHD

SEQ ID NO: 1174545 - protein, 6 aa, Mycobacterium
TEPPSV

SEQ ID NO: 1174546 - protein, 16 aa, Mycobacterium
TEPRAKTRNLRRDPRA

SEQ ID NO: 1174547 - protein, 12 aa, Mycobacterium
TEPSLAAPGREE

SEQ ID NO: 1174548 - protein, 4 aa, Mycobacterium
TEPT

SEQ ID NO: 1174549 - protein, 6 aa, Mycobacterium
TEPTEV

SEQ ID NO: 1174550 - protein, 9 aa, Mycobacterium
TEPTSGTAR

SEQ ID NO: 1174551 - protein, 22 aa, Mycobacterium
TEPVRDPQTAETTAAPVDTADA

SEQ ID NO: 1174552 - protein, 5 aa, Mycobacterium
TEQGD

SEQ ID NO: 1174553 - protein, 9 aa, Mycobacterium
TEQGRTPGL

SEQ ID NO: 1174554 - protein, 6 aa, Mycobacterium
TEQGSD

SEQ ID NO: 1174555 - protein, 5 aa, Mycobacterium
TEQHG

SEQ ID NO: 1174556 - protein, 7 aa, Mycobacterium
TEQRNDV

SEQ ID NO: 1174557 - protein, 5 aa, Mycobacterium
TEQVP

SEQ ID NO: 1174558 - protein, 8 aa, Mycobacterium
TERDGVER

SEQ ID NO: 1174559 - protein, 6 aa, Mycobacterium
TERDRK

SEQ ID NO: 1174560 - protein, 6 aa, Mycobacterium
TERDVA

SEQ ID NO: 1174561 - protein, 6 aa, Mycobacterium
TERETT

SEQ ID NO: 1174562 - protein, 5 aa, Mycobacterium
TERGD

SEQ ID NO: 1174563 - protein, 6 aa, Mycobacterium
TERGDE

SEQ ID NO: 1174564 - protein, 14 aa, Mycobacterium
TERHPGGTQTTTDV

SEQ ID NO: 1174565 - protein, 4 aa, Mycobacterium
TERP

SEQ ID NO: 1174566 - protein, 15 aa, Mycobacterium
TERPAGRLGPQARNY

SEQ ID NO: 1174567 - protein, 4 aa, Mycobacterium
TERQ

SEQ ID NO: 1174568 - protein, 6 aa, Mycobacterium
TERQGY

SEQ ID NO: 1174569 - protein, 6 aa, Mycobacterium
TERQQA

SEQ ID NO: 1174570 - protein, 10 aa, Mycobacterium
TERQRQHTTE

SEQ ID NO: 1174571 - protein, 13 aa, Mycobacterium
TERSELGGHETGQ

SEQ ID NO: 1174572 - protein, 8 aa, Mycobacterium
TERSPVPG

SEQ ID NO: 1174573 - protein, 19 aa, Mycobacterium
TERSREVAADAADVDGLCD

SEQ ID NO: 1174574 - protein, 17 aa, Mycobacterium
TERSSATSLPEPRTSHN

SEQ ID NO: 1174575 - protein, 6 aa, Mycobacterium
TERTRV

SEQ ID NO: 1174576 - protein, 7 aa, Mycobacterium
TESAEQV

SEQ ID NO: 1174577 - protein, 15 aa, Mycobacterium
TESDEFSELRQTVVT

SEQ ID NO: 1174578 - protein, 25 aa, Mycobacterium
TESDGTTTKLNERGAALDAAARDAL

SEQ ID NO: 1174579 - protein, 9 aa, Mycobacterium
TESEATADE

SEQ ID NO: 1174580 - protein, 8 aa, Mycobacterium
TESEGSKK

SEQ ID NO: 1174581 - protein, 8 aa, Mycobacterium
TESGEEVP

SEQ ID NO: 1174582 - protein, 8 aa, Mycobacterium
TESGEYDR

SEQ ID NO: 1174583 - protein, 5 aa, Mycobacterium
TESGF

SEQ ID NO: 1174584 - protein, 6 aa, Mycobacterium
TESGPV

SEQ ID NO: 1174585 - protein, 10 aa, Mycobacterium
TESIPERNQP

SEQ ID NO: 1174586 - protein, 11 aa, Mycobacterium
TESPAPSPHID

SEQ ID NO: 1174587 - protein, 5 aa, Mycobacterium
TESPV

SEQ ID NO: 1174588 - protein, 7 aa, Mycobacterium
TESRDIT

SEQ ID NO: 1174589 - protein, 6 aa, Mycobacterium
TESSWD

SEQ ID NO: 1174590 - protein, 7 aa, Mycobacterium
TESTPLA

SEQ ID NO: 1174591 - protein, 5 aa, Mycobacterium
TETAA

SEQ ID NO: 1174592 - protein, 7 aa, Mycobacterium
TETADEW

SEQ ID NO: 1174593 - protein, 9 aa, Mycobacterium
TETAPAYAE

SEQ ID NO: 1174594 - protein, 20 aa, Mycobacterium
TETDPARFRTREAPTVDGDV

SEQ ID NO: 1174595 - protein, 5 aa, Mycobacterium
TETER

SEQ ID NO: 1174596 - protein, 18 aa, Mycobacterium
TETGHARRDSSFTPPDHG

SEQ ID NO: 1174597 - protein, 9 aa, Mycobacterium
TETGIQDGP

SEQ ID NO: 1174598 - protein, 9 aa, Mycobacterium
TETPGGPVA

SEQ ID NO: 1174599 - protein, 6 aa, Mycobacterium
TETPIG

SEQ ID NO: 1174600 - protein, 10 aa, Mycobacterium
TETTGRRGGI

SEQ ID NO: 1174601 - protein, 9 aa, Mycobacterium
TETVDPAKI

SEQ ID NO: 1174602 - protein, 4 aa, Mycobacterium
TEVE

SEQ ID NO: 1174603 - protein, 6 aa, Mycobacterium
TEVGGP

SEQ ID NO: 1174604 - protein, 12 aa, Mycobacterium
TEVKEGRGTPHG

SEQ ID NO: 1174605 - protein, 9 aa, Mycobacterium
TEVPPPAEG

SEQ ID NO: 1174606 - protein, 12 aa, Mycobacterium
TEVPRYAGKSTF

SEQ ID NO: 1174607 - protein, 4 aa, Mycobacterium
TEVR

SEQ ID NO: 1174608 - protein, 14 aa, Mycobacterium
TEVTPGLESPTIAP

SEQ ID NO: 1174609 - protein, 6 aa, Mycobacterium
TEYGGH

SEQ ID NO: 1174610 - protein, 5 aa, Mycobacterium
TFAPG

SEQ ID NO: 1174611 - protein, 7 aa, Mycobacterium
TFDDPPI

SEQ ID NO: 1174612 - protein, 5 aa, Mycobacterium
TFEGF

SEQ ID NO: 1174613 - protein, 9 aa, Mycobacterium
TFESSDRIG

SEQ ID NO: 1174614 - protein, 4 aa, Mycobacterium
TFGG

SEQ ID NO: 1174615 - protein, 21 aa, Mycobacterium
TFGGSAKGHGRHVKQSGGHGQ

SEQ ID NO: 1174616 - protein, 5 aa, Mycobacterium
TFGIS

SEQ ID NO: 1174617 - protein, 6 aa, Mycobacterium
TFGPTT

SEQ ID NO: 1174618 - protein, 4 aa, Mycobacterium
TFPD

SEQ ID NO: 1174619 - protein, 7 aa, Mycobacterium
TFSDSGA

SEQ ID NO: 1174620 - protein, 9 aa, Mycobacterium
TFSGGGMPD

SEQ ID NO: 1174621 - protein, 7 aa, Mycobacterium
TFSPPDL

SEQ ID NO: 1174622 - protein, 6 aa, Mycobacterium
TFSSAR

SEQ ID NO: 1174623 - protein, 5 aa, Mycobacterium
TFTAP

SEQ ID NO: 1174624 - protein, 5 aa, Mycobacterium
TFTDG

SEQ ID NO: 1174625 - protein, 11 aa, Mycobacterium
TFTGGSPGAFQ

SEQ ID NO: 1174626 - protein, 19 aa, Mycobacterium
TFTPANGGDAESYASRYGG

SEQ ID NO: 1174627 - protein, 7 aa, Mycobacterium
TFTPEGT

SEQ ID NO: 1174628 - protein, 10 aa, Mycobacterium
TFTPQSDTAV

SEQ ID NO: 1174629 - protein, 8 aa, Mycobacterium
TGAAAGRV

SEQ ID NO: 1174630 - protein, 6 aa, Mycobacterium
TGAAEA

SEQ ID NO: 1174631 - protein, 9 aa, Mycobacterium
TGAAEGETF

SEQ ID NO: 1174632 - protein, 4 aa, Mycobacterium
TGAD

SEQ ID NO: 1174633 - protein, 5 aa, Mycobacterium
TGADG

SEQ ID NO: 1174634 - protein, 8 aa, Mycobacterium
TGADQTRM

SEQ ID NO: 1174635 - protein, 17 aa, Mycobacterium
TGADTDPAVNGKPFGTN

SEQ ID NO: 1174636 - protein, 8 aa, Mycobacterium
TGAEGLER

SEQ ID NO: 1174637 - protein, 10 aa, Mycobacterium
TGAEHEAGSR

SEQ ID NO: 1174638 - protein, 8 aa, Mycobacterium
TGAEPGLV

SEQ ID NO: 1174639 - protein, 11 aa, Mycobacterium
TGAERARDVTA

SEQ ID NO: 1174640 - protein, 4 aa, Mycobacterium
TGAG

SEQ ID NO: 1174641 - protein, 6 aa, Mycobacterium
TGAGDA

SEQ ID NO: 1174642 - protein, 10 aa, Mycobacterium
TGAGERESYG

SEQ ID NO: 1174643 - protein, 15 aa, Mycobacterium
TGAGGPAIEQKCPVA

SEQ ID NO: 1174644 - protein, 7 aa, Mycobacterium
TGAGGRY

SEQ ID NO: 1174645 - protein, 6 aa, Mycobacterium
TGAGQR

SEQ ID NO: 1174646 - protein, 8 aa, Mycobacterium
TGAGSGIG

SEQ ID NO: 1174647 - protein, 9 aa, Mycobacterium
TGAGSGIGR

SEQ ID NO: 1174648 - protein, 11 aa, Mycobacterium
TGAKSGQPRLS

SEQ ID NO: 1174649 - protein, 10 aa, Mycobacterium
TGAKVGETAP

SEQ ID NO: 1174650 - protein, 17 aa, Mycobacterium
TGANDGPVAEGNVGGGT

SEQ ID NO: 1174651 - protein, 11 aa, Mycobacterium
TGANGSGKSSL

SEQ ID NO: 1174652 - protein, 10 aa, Mycobacterium
TGANPLDETD

SEQ ID NO: 1174653 - protein, 8 aa, Mycobacterium
TGAPGEPG

SEQ ID NO: 1174654 - protein, 9 aa, Mycobacterium
TGAPKVDDI

SEQ ID NO: 1174655 - protein, 7 aa, Mycobacterium
TGAPPHP

SEQ ID NO: 1174656 - protein, 7 aa, Mycobacterium
TGAPPRR

SEQ ID NO: 1174657 - protein, 9 aa, Mycobacterium
TGAPSETCR

SEQ ID NO: 1174658 - protein, 9 aa, Mycobacterium
TGAPTEDDA

SEQ ID NO: 1174659 - protein, 12 aa, Mycobacterium
TGAPWSYDEPRY

SEQ ID NO: 1174660 - protein, 8 aa, Mycobacterium
TGAQARAT

SEQ ID NO: 1174661 - protein, 5 aa, Mycobacterium
TGARL

SEQ ID NO: 1174662 - protein, 14 aa, Mycobacterium
TGARRTPPPRTPPL

SEQ ID NO: 1174663 - protein, 8 aa, Mycobacterium
TGASGEPG

SEQ ID NO: 1174664 - protein, 10 aa, Mycobacterium
TGASGGRDAR

SEQ ID NO: 1174665 - protein, 17 aa, Mycobacterium
TGASNTNVQRDRGSRSR

SEQ ID NO: 1174666 - protein, 11 aa, Mycobacterium
TGASPGADDEW

SEQ ID NO: 1174667 - protein, 12 aa, Mycobacterium
TGATAPQQRVVV

SEQ ID NO: 1174668 - protein, 8 aa, Mycobacterium
TGATATES

SEQ ID NO: 1174669 - protein, 5 aa, Mycobacterium
TGATG

SEQ ID NO: 1174670 - protein, 6 aa, Mycobacterium
TGATLP

SEQ ID NO: 1174671 - protein, 7 aa, Mycobacterium
TGATPIG

SEQ ID NO: 1174672 - protein, 10 aa, Mycobacterium
TGDANTPNHE

SEQ ID NO: 1174673 - protein, 6 aa, Mycobacterium
TGDDPA

SEQ ID NO: 1174674 - protein, 8 aa, Mycobacterium
TGDFSTLP

SEQ ID NO: 1174675 - protein, 11 aa, Mycobacterium
TGDGENGTEAA

SEQ ID NO: 1174676 - protein, 9 aa, Mycobacterium
TGDKVTIGD

SEQ ID NO: 1174677 - protein, 5 aa, Mycobacterium
TGDLT

SEQ ID NO: 1174678 - protein, 5 aa, Mycobacterium
TGDPA

SEQ ID NO: 1174679 - protein, 8 aa, Mycobacterium
TGDPALRG

SEQ ID NO: 1174680 - protein, 9 aa, Mycobacterium
TGDPETPVT

SEQ ID NO: 1174681 - protein, 9 aa, Mycobacterium
TGDPRPVSE

SEQ ID NO: 1174682 - protein, 5 aa, Mycobacterium
TGDPS

SEQ ID NO: 1174683 - protein, 8 aa, Mycobacterium
TGDPSDRD

SEQ ID NO: 1174684 - protein, 9 aa, Mycobacterium
TGDPSTTET

SEQ ID NO: 1174685 - protein, 7 aa, Mycobacterium
TGDRAIP

SEQ ID NO: 1174686 - protein, 9 aa, Mycobacterium
TGDRGQLDD

SEQ ID NO: 1174687 - protein, 20 aa, Mycobacterium
TGDRPTNEQLATVDAGEQRE

SEQ ID NO: 1174688 - protein, 5 aa, Mycobacterium
TGDTD

SEQ ID NO: 1174689 - protein, 14 aa, Mycobacterium
TGDTKVVDSGHGDG

SEQ ID NO: 1174690 - protein, 9 aa, Mycobacterium
TGDVAPPKR

SEQ ID NO: 1174691 - protein, 5 aa, Mycobacterium
TGDVV

SEQ ID NO: 1174692 - protein, 4 aa, Mycobacterium
TGEA

SEQ ID NO: 1174693 - protein, 11 aa, Mycobacterium
TGEAETDRQLE

SEQ ID NO: 1174694 - protein, 12 aa, Mycobacterium
TGEAGAQHYSDE

SEQ ID NO: 1174695 - protein, 5 aa, Mycobacterium
TGEAP

SEQ ID NO: 1174696 - protein, 7 aa, Mycobacterium
TGEDGTV

SEQ ID NO: 1174697 - protein, 5 aa, Mycobacterium
TGEEV

SEQ ID NO: 1174698 - protein, 5 aa, Mycobacterium
TGEEY

SEQ ID NO: 1174699 - protein, 9 aa, Mycobacterium
TGEGGRRGR

SEQ ID NO: 1174700 - protein, 15 aa, Mycobacterium
TGEGRDGHGRSSDGR

SEQ ID NO: 1174701 - protein, 20 aa, Mycobacterium
TGEGRKDAATARLSGRARDG

SEQ ID NO: 1174702 - protein, 7 aa, Mycobacterium
TGEGSRG

SEQ ID NO: 1174703 - protein, 14 aa, Mycobacterium
TGEGTTGLGKPLKP

SEQ ID NO: 1174704 - protein, 4 aa, Mycobacterium
TGEH

SEQ ID NO: 1174705 - protein, 12 aa, Mycobacterium
TGEHTRNNATRL

SEQ ID NO: 1174706 - protein, 6 aa, Mycobacterium
TGELRG

SEQ ID NO: 1174707 - protein, 6 aa, Mycobacterium
TGENAP

SEQ ID NO: 1174708 - protein, 5 aa, Mycobacterium
TGENL

SEQ ID NO: 1174709 - protein, 10 aa, Mycobacterium
TGEPADPATL

SEQ ID NO: 1174710 - protein, 25 aa, Mycobacterium
TGEPETTDTGDTGTRQASAASETPA

SEQ ID NO: 1174711 - protein, 7 aa, Mycobacterium
TGEPHEP

SEQ ID NO: 1174712 - protein, 11 aa, Mycobacterium
TGEPNDGAVRR

SEQ ID NO: 1174713 - protein, 16 aa, Mycobacterium
TGEQDTQTVAPTAALT

SEQ ID NO: 1174714 - protein, 6 aa, Mycobacterium
TGEQVS

SEQ ID NO: 1174715 - protein, 9 aa, Mycobacterium
TGERTKEGF

SEQ ID NO: 1174716 - protein, 6 aa, Mycobacterium
TGESFS

SEQ ID NO: 1174717 - protein, 9 aa, Mycobacterium
TGESRPRVG

SEQ ID NO: 1174718 - protein, 5 aa, Mycobacterium
TGETS

SEQ ID NO: 1174719 - protein, 10 aa, Mycobacterium
TGEVDGRKEI

SEQ ID NO: 1174720 - protein, 6 aa, Mycobacterium
TGFGPG

SEQ ID NO: 1174721 - protein, 8 aa, Mycobacterium
TGFGSATN

SEQ ID NO: 1174722 - protein, 5 aa, Mycobacterium
TGFSG

SEQ ID NO: 1174723 - protein, 4 aa, Mycobacterium
TGFT

SEQ ID NO: 1174724 - protein, 15 aa, Mycobacterium
TGGAPLVTTEDAATA

SEQ ID NO: 1174725 - protein, 7 aa, Mycobacterium
TGGAQGL

SEQ ID NO: 1174726 - protein, 9 aa, Mycobacterium
TGGASGIGA

SEQ ID NO: 1174727 - protein, 9 aa, Mycobacterium
TGGASGIGE

SEQ ID NO: 1174728 - protein, 24 aa, Mycobacterium
TGGDDDEMRRYGDGIDKSARYRRT

SEQ ID NO: 1174729 - protein, 6 aa, Mycobacterium
TGGDTI

SEQ ID NO: 1174730 - protein, 6 aa, Mycobacterium
TGGEAA

SEQ ID NO: 1174731 - protein, 6 aa, Mycobacterium
TGGFEA

SEQ ID NO: 1174732 - protein, 21 aa, Mycobacterium
TGGFPPPRDAGESAGEDRTAP

SEQ ID NO: 1174733 - protein, 7 aa, Mycobacterium
TGGGAGI

SEQ ID NO: 1174734 - protein, 6 aa, Mycobacterium
TGGGFG

SEQ ID NO: 1174735 - protein, 9 aa, Mycobacterium
TGGGGPPAL

SEQ ID NO: 1174736 - protein, 6 aa, Mycobacterium
TGGGRG

SEQ ID NO: 1174737 - protein, 8 aa, Mycobacterium
TGGGRGLG

SEQ ID NO: 1174738 - protein, 7 aa, Mycobacterium
TGGGVDT

SEQ ID NO: 1174739 - protein, 14 aa, Mycobacterium
TGGIPRHSDHPGYG

SEQ ID NO: 1174740 - protein, 6 aa, Mycobacterium
TGGKHR

SEQ ID NO: 1174741 - protein, 11 aa, Mycobacterium
TGGKQSPEDLD

SEQ ID NO: 1174742 - protein, 9 aa, Mycobacterium
TGGLPSEQA

SEQ ID NO: 1174743 - protein, 8 aa, Mycobacterium
TGGNQGLG

SEQ ID NO: 1174744 - protein, 8 aa, Mycobacterium
TGGPDTAA

SEQ ID NO: 1174745 - protein, 9 aa, Mycobacterium
TGGQGANTT

SEQ ID NO: 1174746 - protein, 6 aa, Mycobacterium
TGGRIG

SEQ ID NO: 1174747 - protein, 8 aa, Mycobacterium
TGGRPLPD

SEQ ID NO: 1174748 - protein, 16 aa, Mycobacterium
TGGRQNGVRGQSNTKS

SEQ ID NO: 1174749 - protein, 5 aa, Mycobacterium
TGGRS

SEQ ID NO: 1174750 - protein, 19 aa, Mycobacterium
TGGSGRMYKTTSNAHTLTG

SEQ ID NO: 1174751 - protein, 8 aa, Mycobacterium
TGGSRGIG

SEQ ID NO: 1174752 - protein, 7 aa, Mycobacterium
TGGSTQI

SEQ ID NO: 1174753 - protein, 13 aa, Mycobacterium
TGGTSSRWPDGSY

SEQ ID NO: 1174754 - protein, 5 aa, Mycobacterium
TGGTV

SEQ ID NO: 1174755 - protein, 6 aa, Mycobacterium
TGGVGQ

SEQ ID NO: 1174756 - protein, 10 aa, Mycobacterium
TGGWEPDAKG

SEQ ID NO: 1174757 - protein, 11 aa, Mycobacterium
TGHNAPPQDAT

SEQ ID NO: 1174758 - protein, 6 aa, Mycobacterium
TGHPEA

SEQ ID NO: 1174759 - protein, 7 aa, Mycobacterium
TGHPGNG

SEQ ID NO: 1174760 - protein, 6 aa, Mycobacterium
TGHRSG

SEQ ID NO: 1174761 - protein, 5 aa, Mycobacterium
TGIDE

SEQ ID NO: 1174762 - protein, 8 aa, Mycobacterium
TGIDTERA

SEQ ID NO: 1174763 - protein, 13 aa, Mycobacterium
TGIEPDKNSPAHW

SEQ ID NO: 1174764 - protein, 12 aa, Mycobacterium
TGIKPQNAPSVT

SEQ ID NO: 1174765 - protein, 28 aa, Mycobacterium
TGKAPAAYIGDNTRPDAVRTRTLSEETN

SEQ ID NO: 1174766 - protein, 11 aa, Mycobacterium
TGKAPPEARAL

SEQ ID NO: 1174767 - protein, 8 aa, Mycobacterium
TGKAREQL

SEQ ID NO: 1174768 - protein, 16 aa, Mycobacterium
TGKPSELDRDEPRRVA

SEQ ID NO: 1174769 - protein, 5 aa, Mycobacterium
TGKSA

SEQ ID NO: 1174770 - protein, 14 aa, Mycobacterium
TGKSPVTKDDAQRH

SEQ ID NO: 1174771 - protein, 20 aa, Mycobacterium
TGKSSSANRAIDTESNLGQY

SEQ ID NO: 1174772 - protein, 8 aa, Mycobacterium
TGLPTGDF

SEQ ID NO: 1174773 - protein, 6 aa, Mycobacterium
TGLTDD

SEQ ID NO: 1174774 - protein, 6 aa, Mycobacterium
TGMGST

SEQ ID NO: 1174775 - protein, 6 aa, Mycobacterium
TGMTDD

SEQ ID NO: 1174776 - protein, 7 aa, Mycobacterium
TGNAAGL

SEQ ID NO: 1174777 - protein, 6 aa, Mycobacterium
TGNGYH

SEQ ID NO: 1174778 - protein, 5 aa, Mycobacterium
TGNIG

SEQ ID NO: 1174779 - protein, 9 aa, Mycobacterium
TGNPELTAR

SEQ ID NO: 1174780 - protein, 18 aa, Mycobacterium
TGNPLAAGRSAAVDPADG

SEQ ID NO: 1174781 - protein, 7 aa, Mycobacterium
TGNRGGA

SEQ ID NO: 1174782 - protein, 17 aa, Mycobacterium
TGNTPDLGYPMPGERTR

SEQ ID NO: 1174783 - protein, 18 aa, Mycobacterium
TGPASKLTVTDATGRQLH

SEQ ID NO: 1174784 - protein, 8 aa, Mycobacterium
TGPASNLT

SEQ ID NO: 1174785 - protein, 8 aa, Mycobacterium
TGPDCATT

SEQ ID NO: 1174786 - protein, 6 aa, Mycobacterium
TGPDGE

SEQ ID NO: 1174787 - protein, 8 aa, Mycobacterium
TGPDGSTS

SEQ ID NO: 1174788 - protein, 9 aa, Mycobacterium
TGPDSDNGV

SEQ ID NO: 1174789 - protein, 7 aa, Mycobacterium
TGPEALK

SEQ ID NO: 1174790 - protein, 9 aa, Mycobacterium
TGPEKIDAT

SEQ ID NO: 1174791 - protein, 4 aa, Mycobacterium
TGPG

SEQ ID NO: 1174792 - protein, 7 aa, Mycobacterium
TGPGESW

SEQ ID NO: 1174793 - protein, 9 aa, Mycobacterium
TGPGPALAR

SEQ ID NO: 1174794 - protein, 8 aa, Mycobacterium
TGPGPVAG

SEQ ID NO: 1174795 - protein, 9 aa, Mycobacterium
TGPGVTETP

SEQ ID NO: 1174796 - protein, 17 aa, Mycobacterium
TGPHDGPVDDADGLVTT

SEQ ID NO: 1174797 - protein, 8 aa, Mycobacterium
TGPNGVGK

SEQ ID NO: 1174798 - protein, 13 aa, Mycobacterium
TGPNSAIPHHRPT

SEQ ID NO: 1174799 - protein, 7 aa, Mycobacterium
TGPPDEV

SEQ ID NO: 1174800 - protein, 5 aa, Mycobacterium
TGPPF

SEQ ID NO: 1174801 - protein, 12 aa, Mycobacterium
TGPPGAGKSTTV

SEQ ID NO: 1174802 - protein, 11 aa, Mycobacterium
TGPPGTGKSTF

SEQ ID NO: 1174803 - protein, 11 aa, Mycobacterium
TGPQEPAAQVT

SEQ ID NO: 1174804 - protein, 28 aa, Mycobacterium
TGPRWPDVSGNSQATGTRAVTSGTPDPA

SEQ ID NO: 1174805 - protein, 9 aa, Mycobacterium
TGPSDDPFG

SEQ ID NO: 1174806 - protein, 10 aa, Mycobacterium
TGPSEDLTRP

SEQ ID NO: 1174807 - protein, 5 aa, Mycobacterium
TGPTT

SEQ ID NO: 1174808 - protein, 6 aa, Mycobacterium
TGPTVQ

SEQ ID NO: 1174809 - protein, 4 aa, Mycobacterium
TGPV

SEQ ID NO: 1174810 - protein, 6 aa, Mycobacterium
TGPVSA

SEQ ID NO: 1174811 - protein, 7 aa, Mycobacterium
TGPYSDD

SEQ ID NO: 1174812 - protein, 4 aa, Mycobacterium
TGQA

SEQ ID NO: 1174813 - protein, 5 aa, Mycobacterium
TGQGG

SEQ ID NO: 1174814 - protein, 8 aa, Mycobacterium
TGQNYDCD

SEQ ID NO: 1174815 - protein, 5 aa, Mycobacterium
TGQPL

SEQ ID NO: 1174816 - protein, 7 aa, Mycobacterium
TGQTPLD

SEQ ID NO: 1174817 - protein, 9 aa, Mycobacterium
TGRAAADTG

SEQ ID NO: 1174818 - protein, 9 aa, Mycobacterium
TGRAGTWTA

SEQ ID NO: 1174819 - protein, 9 aa, Mycobacterium
TGRAKPANL

SEQ ID NO: 1174820 - protein, 8 aa, Mycobacterium
TGRAQSEL

SEQ ID NO: 1174821 - protein, 8 aa, Mycobacterium
TGRDEERL

SEQ ID NO: 1174822 - protein, 8 aa, Mycobacterium
TGRDGGRP

SEQ ID NO: 1174823 - protein, 5 aa, Mycobacterium
TGRDP

SEQ ID NO: 1174824 - protein, 9 aa, Mycobacterium
TGRDPTLPR

SEQ ID NO: 1174825 - protein, 9 aa, Mycobacterium
TGREEDVAD

SEQ ID NO: 1174826 - protein, 10 aa, Mycobacterium
TGREQPGTAA

SEQ ID NO: 1174827 - protein, 8 aa, Mycobacterium
TGRETDTD

SEQ ID NO: 1174828 - protein, 5 aa, Mycobacterium
TGREV

SEQ ID NO: 1174829 - protein, 5 aa, Mycobacterium
TGRFP

SEQ ID NO: 1174830 - protein, 12 aa, Mycobacterium
TGRGAEEPKTSR

SEQ ID NO: 1174831 - protein, 7 aa, Mycobacterium
TGRGGRQ

SEQ ID NO: 1174832 - protein, 5 aa, Mycobacterium
TGRGV

SEQ ID NO: 1174833 - protein, 9 aa, Mycobacterium
TGRHNTQRL

SEQ ID NO: 1174834 - protein, 11 aa, Mycobacterium
TGRKSGRRFET

SEQ ID NO: 1174835 - protein, 20 aa, Mycobacterium
TGRLDPGRREEELLVIRADK

SEQ ID NO: 1174836 - protein, 5 aa, Mycobacterium
TGRNM

SEQ ID NO: 1174837 - protein, 8 aa, Mycobacterium
TGRPAEEG

SEQ ID NO: 1174838 - protein, 10 aa, Mycobacterium
TGRPAEKPVP

SEQ ID NO: 1174839 - protein, 8 aa, Mycobacterium
TGRPARGL

SEQ ID NO: 1174840 - protein, 7 aa, Mycobacterium
TGRPEGR

SEQ ID NO: 1174841 - protein, 9 aa, Mycobacterium
TGRPEWEGV

SEQ ID NO: 1174842 - protein, 15 aa, Mycobacterium
TGRPGLRAATADGDL

SEQ ID NO: 1174843 - protein, 7 aa, Mycobacterium
TGRPKSK

SEQ ID NO: 1174844 - protein, 8 aa, Mycobacterium
TGRPQRIG

SEQ ID NO: 1174845 - protein, 5 aa, Mycobacterium
TGRPT

SEQ ID NO: 1174846 - protein, 8 aa, Mycobacterium
TGRPTGEW

SEQ ID NO: 1174847 - protein, 13 aa, Mycobacterium
TGRPTPEAYAQAQ

SEQ ID NO: 1174848 - protein, 5 aa, Mycobacterium
TGRQA

SEQ ID NO: 1174849 - protein, 11 aa, Mycobacterium
TGRRDRDDAEL

SEQ ID NO: 1174850 - protein, 6 aa, Mycobacterium
TGRRGG

SEQ ID NO: 1174851 - protein, 12 aa, Mycobacterium
TGRRRKGRRSLT

SEQ ID NO: 1174852 - protein, 8 aa, Mycobacterium
TGRSASAM

SEQ ID NO: 1174853 - protein, 5 aa, Mycobacterium
TGRSR

SEQ ID NO: 1174854 - protein, 5 aa, Mycobacterium
TGRTA

SEQ ID NO: 1174855 - protein, 8 aa, Mycobacterium
TGSAGQSI

SEQ ID NO: 1174856 - protein, 8 aa, Mycobacterium
TGSAPTAA

SEQ ID NO: 1174857 - protein, 7 aa, Mycobacterium
TGSDDSV

SEQ ID NO: 1174858 - protein, 15 aa, Mycobacterium
TGSDPGDPYNAAPPA

SEQ ID NO: 1174859 - protein, 8 aa, Mycobacterium
TGSEDYCS

SEQ ID NO: 1174860 - protein, 7 aa, Mycobacterium
TGSGEVK

SEQ ID NO: 1174861 - protein, 5 aa, Mycobacterium
TGSGR

SEQ ID NO: 1174862 - protein, 5 aa, Mycobacterium
TGSIG

SEQ ID NO: 1174863 - protein, 7 aa, Mycobacterium
TGSLPSG

SEQ ID NO: 1174864 - protein, 6 aa, Mycobacterium
TGSPDL

SEQ ID NO: 1174865 - protein, 13 aa, Mycobacterium
TGSPFPGPATDPE

SEQ ID NO: 1174866 - protein, 6 aa, Mycobacterium
TGSPGE

SEQ ID NO: 1174867 - protein, 13 aa, Mycobacterium
TGSPGLRGAGEES

SEQ ID NO: 1174868 - protein, 19 aa, Mycobacterium
TGSPQAATARIEDGETRSL

SEQ ID NO: 1174869 - protein, 5 aa, Mycobacterium
TGSQI

SEQ ID NO: 1174870 - protein, 5 aa, Mycobacterium
TGSRF

SEQ ID NO: 1174871 - protein, 11 aa, Mycobacterium
TGSRSANAGPV

SEQ ID NO: 1174872 - protein, 11 aa, Mycobacterium
TGSSGKTSTKD

SEQ ID NO: 1174873 - protein, 10 aa, Mycobacterium
TGSSSARSEV

SEQ ID NO: 1174874 - protein, 8 aa, Mycobacterium
TGSSSELG

SEQ ID NO: 1174875 - protein, 5 aa, Mycobacterium
TGSTF

SEQ ID NO: 1174876 - protein, 8 aa, Mycobacterium
TGSTGVGK

SEQ ID NO: 1174877 - protein, 9 aa, Mycobacterium
TGSTPDAVR

SEQ ID NO: 1174878 - protein, 10 aa, Mycobacterium
TGSWGGAASM

SEQ ID NO: 1174879 - protein, 6 aa, Mycobacterium
TGSYGR

SEQ ID NO: 1174880 - protein, 20 aa, Mycobacterium
TGTATDTLQTELPERWLEAA

SEQ ID NO: 1174881 - protein, 6 aa, Mycobacterium
TGTDEV

SEQ ID NO: 1174882 - protein, 7 aa, Mycobacterium
TGTDEVR

SEQ ID NO: 1174883 - protein, 17 aa, Mycobacterium
TGTDPTAAYHGSRTATK

SEQ ID NO: 1174884 - protein, 6 aa, Mycobacterium
TGTDSR

SEQ ID NO: 1174885 - protein, 10 aa, Mycobacterium
TGTEAYPSRT

SEQ ID NO: 1174886 - protein, 15 aa, Mycobacterium
TGTEGDSTPVTETAT

SEQ ID NO: 1174887 - protein, 8 aa, Mycobacterium
TGTERYGG

SEQ ID NO: 1174888 - protein, 6 aa, Mycobacterium
TGTGEV

SEQ ID NO: 1174889 - protein, 12 aa, Mycobacterium
TGTGNKASDQLR

SEQ ID NO: 1174890 - protein, 7 aa, Mycobacterium
TGTHRTR

SEQ ID NO: 1174891 - protein, 4 aa, Mycobacterium
TGTL

SEQ ID NO: 1174892 - protein, 7 aa, Mycobacterium
TGTNGNT

SEQ ID NO: 1174893 - protein, 8 aa, Mycobacterium
TGTPAPIG

SEQ ID NO: 1174894 - protein, 9 aa, Mycobacterium
TGTPEAAPP

SEQ ID NO: 1174895 - protein, 8 aa, Mycobacterium
TGTPTQLG

SEQ ID NO: 1174896 - protein, 9 aa, Mycobacterium
TGTQGEPMS

SEQ ID NO: 1174897 - protein, 11 aa, Mycobacterium
TGTRDDDPWAP

SEQ ID NO: 1174898 - protein, 7 aa, Mycobacterium
TGTSSGI

SEQ ID NO: 1174899 - protein, 8 aa, Mycobacterium
TGTTAAAA

SEQ ID NO: 1174900 - protein, 5 aa, Mycobacterium
TGTTL

SEQ ID NO: 1174901 - protein, 6 aa, Mycobacterium
TGTTSS

SEQ ID NO: 1174902 - protein, 13 aa, Mycobacterium
TGTVEPEPHGLRK

SEQ ID NO: 1174903 - protein, 6 aa, Mycobacterium
TGTVSA

SEQ ID NO: 1174904 - protein, 13 aa, Mycobacterium
TGTVTAASEWGGV

SEQ ID NO: 1174905 - protein, 8 aa, Mycobacterium
TGVDGPAV

SEQ ID NO: 1174906 - protein, 8 aa, Mycobacterium
TGVDPAQV

SEQ ID NO: 1174907 - protein, 8 aa, Mycobacterium
TGVGGELG

SEQ ID NO: 1174908 - protein, 7 aa, Mycobacterium
TGVGIPE

SEQ ID NO: 1174909 - protein, 5 aa, Mycobacterium
TGVGR

SEQ ID NO: 1174910 - protein, 4 aa, Mycobacterium
TGVH

SEQ ID NO: 1174911 - protein, 8 aa, Mycobacterium
TGVPADDV

SEQ ID NO: 1174912 - protein, 10 aa, Mycobacterium
TGVPEAEASP

SEQ ID NO: 1174913 - protein, 8 aa, Mycobacterium
TGVSDNQR

SEQ ID NO: 1174914 - protein, 6 aa, Mycobacterium
TGWGDT

SEQ ID NO: 1174915 - protein, 10 aa, Mycobacterium
TGWGRSSDGD

SEQ ID NO: 1174916 - protein, 14 aa, Mycobacterium
TGWTYDSGDYETTM

SEQ ID NO: 1174917 - protein, 30 aa, Mycobacterium; identical to SEQ ID NO: 57507

SEQ ID NO: 1174918 - protein, 7 aa, Mycobacterium
TGYAPEA

SEQ ID NO: 1174919 - protein, 15 aa, Mycobacterium
TGYGSAVRTGEVRAG

SEQ ID NO: 1174920 - protein, 5 aa, Mycobacterium
TGYTT

SEQ ID NO: 1174921 - protein, 5 aa, Mycobacterium
THDDR

SEQ ID NO: 1174922 - protein, 8 aa, Mycobacterium
THDGKTGV

SEQ ID NO: 1174923 - protein, 6 aa, Mycobacterium
THDINS

SEQ ID NO: 1174924 - protein, 5 aa, Mycobacterium
THDPE

SEQ ID NO: 1174925 - protein, 13 aa, Mycobacterium
THDPEGTGKGPLN

SEQ ID NO: 1174926 - protein, 5 aa, Mycobacterium
THDPI

SEQ ID NO: 1174927 - protein, 20 aa, Mycobacterium
THDRSDRESVKGRVGGRTQE

SEQ ID NO: 1174928 - protein, 4 aa, Mycobacterium
THDS

SEQ ID NO: 1174929 - protein, 11 aa, Mycobacterium
THGGPASGGRL

SEQ ID NO: 1174930 - protein, 8 aa, Mycobacterium
THGPQGSL

SEQ ID NO: 1174931 - protein, 17 aa, Mycobacterium
THGRPTDRNAHPHRDAD

SEQ ID NO: 1174932 - protein, 5 aa, Mycobacterium
THGSP

SEQ ID NO: 1174933 - protein, 9 aa, Mycobacterium
THNDADAED

SEQ ID NO: 1174934 - protein, 11 aa, Mycobacterium
THPDRADAPNM

SEQ ID NO: 1174935 - protein, 7 aa, Mycobacterium
THPEDRA

SEQ ID NO: 1174936 - protein, 11 aa, Mycobacterium
THPNYPERHEP

SEQ ID NO: 1174937 - protein, 7 aa, Mycobacterium
THPTLNR

SEQ ID NO: 1174938 - protein, 7 aa, Mycobacterium
THRQCPD

SEQ ID NO: 1174939 - protein, 14 aa, Mycobacterium
THRTSTTSDATPQI

SEQ ID NO: 1174940 - protein, 12 aa, Mycobacterium
THSGEVASDEAR

SEQ ID NO: 1174941 - protein, 6 aa, Mycobacterium
THSGSY

SEQ ID NO: 1174942 - protein, 8 aa, Mycobacterium
TIASGAYQ

SEQ ID NO: 1174943 - protein, 16 aa, Mycobacterium
TIDPSTALRWGLVDAV

SEQ ID NO: 1174944 - protein, 7 aa, Mycobacterium
TIENADR

SEQ ID NO: 1174945 - protein, 10 aa, Mycobacterium
TIEPDGARDL

SEQ ID NO: 1174946 - protein, 5 aa, Mycobacterium
TIEPG

SEQ ID NO: 1174947 - protein, 4 aa, Mycobacterium
TIEQ

SEQ ID NO: 1174948 - protein, 4 aa, Mycobacterium
TIER

SEQ ID NO: 1174949 - protein, 7 aa, Mycobacterium
TIGGSGS

SEQ ID NO: 1174950 - protein, 4 aa, Mycobacterium
TIGP

SEQ ID NO: 1174951 - protein, 13 aa, Mycobacterium
TIGRPTPPRGADG

SEQ ID NO: 1174952 - protein, 18 aa, Mycobacterium
TIPPAQAYGPAGGGHRLS

SEQ ID NO: 1174953 - protein, 6 aa, Mycobacterium
TIPQAD

SEQ ID NO: 1174954 - protein, 26 aa, Mycobacterium
TIQGDTAITPYGAGTQGSRSAPMTAG

SEQ ID NO: 1174955 - protein, 14 aa, Mycobacterium
TIRPPATPHAPEPH

SEQ ID NO: 1174956 - protein, 20 aa, Mycobacterium
TIRPPATPHAPEPHPQLPTT

SEQ ID NO: 1174957 - protein, 11 aa, Mycobacterium
TIRSGKGQKKL

SEQ ID NO: 1174958 - protein, 20 aa, Mycobacterium
TISEAGSTMAQTEAGVTGMF

SEQ ID NO: 1174959 - protein, 5 aa, Mycobacterium
TISGS

SEQ ID NO: 1174960 - protein, 7 aa, Mycobacterium
TITDDPQ

SEQ ID NO: 1174961 - protein, 11 aa, Mycobacterium
TITDGASSRRN

SEQ ID NO: 1174962 - protein, 17 aa, Mycobacterium
TITSEQAKGGVDDEDIE

SEQ ID NO: 1174963 - protein, 10 aa, Mycobacterium
TIYGGSNEVQ

SEQ ID NO: 1174964 - protein, 13 aa, Mycobacterium
TKAAADAGRPAPR

SEQ ID NO: 1174965 - protein, 28 aa, Mycobacterium
TKAAAEAARTAPPRENGGNQDIKNLTKG

SEQ ID NO: 1174966 - protein, 6 aa, Mycobacterium
TKAATT

SEQ ID NO: 1174967 - protein, 8 aa, Mycobacterium
TKAGTSCG

SEQ ID NO: 1174968 - protein, 7 aa, Mycobacterium
TKALSGH

SEQ ID NO: 1174969 - protein, 5 aa, Mycobacterium
TKATG

SEQ ID NO: 1174970 - protein, 10 aa, Mycobacterium
TKDPDKYVGS

SEQ ID NO: 1174971 - protein, 10 aa, Mycobacterium
TKDRKQFGTS

SEQ ID NO: 1174972 - protein, 8 aa, Mycobacterium
TKDRNNQV

SEQ ID NO: 1174973 - protein, 7 aa, Mycobacterium
TKELGAP

SEQ ID NO: 1174974 - protein, 6 aa, Mycobacterium
TKEQAE

SEQ ID NO: 1174975 - protein, 20 aa, Mycobacterium
TKFGTRRLTSKQGHGEPNPT

SEQ ID NO: 1174976 - protein, 9 aa, Mycobacterium
TKGDPEAYR

SEQ ID NO: 1174977 - protein, 11 aa, Mycobacterium
TKGGAVSANGR

SEQ ID NO: 1174978 - protein, 8 aa, Mycobacterium
TKGPRSVT

SEQ ID NO: 1174979 - protein, 8 aa, Mycobacterium
TKGQWTEP

SEQ ID NO: 1174980 - protein, 9 aa, Mycobacterium
TKGSEPETF

SEQ ID NO: 1174981 - protein, 7 aa, Mycobacterium
TKGSRVD

SEQ ID NO: 1174982 - protein, 8 aa, Mycobacterium
TKHGVKGL

SEQ ID NO: 1174983 - protein, 9 aa, Mycobacterium
TKHPGGGAV

SEQ ID NO: 1174984 - protein, 8 aa, Mycobacterium
TKHPGTGG

SEQ ID NO: 1174985 - protein, 8 aa, Mycobacterium
TKLSDEPK

SEQ ID NO: 1174986 - protein, 18 aa, Mycobacterium
TKPDLTPVTDADRSVEND

SEQ ID NO: 1174987 - protein, 7 aa, Mycobacterium
TKPETFG

SEQ ID NO: 1174988 - protein, 8 aa, Mycobacterium
TKPGDDPF

SEQ ID NO: 1174989 - protein, 8 aa, Mycobacterium
TKPSAAAD

SEQ ID NO: 1174990 - protein, 8 aa, Mycobacterium
TKPTRPDV

SEQ ID NO: 1174991 - protein, 7 aa, Mycobacterium
TKQAINA

SEQ ID NO: 1174992 - protein, 13 aa, Mycobacterium
TKQMRGAYTLLEF

SEQ ID NO: 1174993 - protein, 11 aa, Mycobacterium
TKQPEGNHFPA

SEQ ID NO: 1174994 - protein, 8 aa, Mycobacterium
TKQTGVTV

SEQ ID NO: 1174995 - protein, 6 aa, Mycobacterium
TKRAKE

SEQ ID NO: 1174996 - protein, 10 aa, Mycobacterium
TKRAPPTGLT

SEQ ID NO: 1174997 - protein, 11 aa, Mycobacterium
TKRPGQPADTV

SEQ ID NO: 1174998 - protein, 5 aa, Mycobacterium
TKRPP

SEQ ID NO: 1174999 - protein, 8 aa, Mycobacterium
TKSPAGAW

SEQ ID NO: 1175000 - protein, 13 aa, Mycobacterium
TKSVADDVTRRTG

SEQ ID NO: 1175001 - protein, 7 aa, Mycobacterium
TKTDGNP

SEQ ID NO: 1175002 - protein, 11 aa, Mycobacterium
TKTGESVTISP

SEQ ID NO: 1175003 - protein, 8 aa, Mycobacterium
TKTKDEAL

SEQ ID NO: 1175004 - protein, 6 aa, Mycobacterium
TKTVPK

SEQ ID NO: 1175005 - protein, 10 aa, Mycobacterium
TKTYAGQGAD

SEQ ID NO: 1175006 - protein, 19 aa, Mycobacterium
TKVQTSDGQTVKARDLSGA

SEQ ID NO: 1175007 - protein, 6 aa, Mycobacterium
TKYGHT

SEQ ID NO: 1175008 - protein, 4 aa, Mycobacterium
TLAG

SEQ ID NO: 1175009 - protein, 6 aa, Mycobacterium
TLAGRE

SEQ ID NO: 1175010 - protein, 7 aa, Mycobacterium
TLAPTAA

SEQ ID NO: 1175011 - protein, 6 aa, Mycobacterium
TLARRG

SEQ ID NO: 1175012 - protein, 10 aa, Mycobacterium
TLDDGRPWSE

SEQ ID NO: 1175013 - protein, 8 aa, Mycobacterium
TLDDPPQE

SEQ ID NO: 1175014 - protein, 5 aa, Mycobacterium
TLDEQ

SEQ ID NO: 1175015 - protein, 8 aa, Mycobacterium
TLDPADAL

SEQ ID NO: 1175016 - protein, 14 aa, Mycobacterium
TLDPAGILNPGKLI

SEQ ID NO: 1175017 - protein, 7 aa, Mycobacterium
TLDPRDP

SEQ ID NO: 1175018 - protein, 9 aa, Mycobacterium
TLEDTRANA

SEQ ID NO: 1175019 - protein, 8 aa, Mycobacterium
TLEEGGAM

SEQ ID NO: 1175020 - protein, 12 aa, Mycobacterium
TLEPTDGADPHR

SEQ ID NO: 1175021 - protein, 15 aa, Mycobacterium
TLEQPAGAEPSQDSG

SEQ ID NO: 1175022 - protein, 9 aa, Mycobacterium
TLGDGVRGR

SEQ ID NO: 1175023 - protein, 5 aa, Mycobacterium
TLGPR

SEQ ID NO: 1175024 - protein, 7 aa, Mycobacterium
TLGPVAD

SEQ ID NO: 1175025 - protein, 7 aa, Mycobacterium
TLGSAQD

SEQ ID NO: 1175026 - protein, 7 aa, Mycobacterium
TLGSSEV

SEQ ID NO: 1175027 - protein, 8 aa, Mycobacterium
TLGTPPPV

SEQ ID NO: 1175028 - protein, 9 aa, Mycobacterium
TLKPRGKDA

SEQ ID NO: 1175029 - protein, 17 aa, Mycobacterium
TLKSGTKVTFEVKNVGR

SEQ ID NO: 1175030 - protein, 6 aa, Mycobacterium
TLPAQT

SEQ ID NO: 1175031 - protein, 16 aa, Mycobacterium
TLPGDTADDVAARDTA

SEQ ID NO: 1175032 - protein, 17 aa, Mycobacterium
TLPGTPAAVPTPGHTGG

SEQ ID NO: 1175033 - protein, 11 aa, Mycobacterium
TLPGVRGNEET

SEQ ID NO: 1175034 - protein, 16 aa, Mycobacterium
TLPIGTDGAADDGGAE

SEQ ID NO: 1175035 - protein, 7 aa, Mycobacterium
TLPNRDG

SEQ ID NO: 1175036 - protein, 6 aa, Mycobacterium
TLPPRS

SEQ ID NO: 1175037 - protein, 6 aa, Mycobacterium
TLPPSQ

SEQ ID NO: 1175038 - protein, 8 aa, Mycobacterium
TLQSGPEF

SEQ ID NO: 1175039 - protein, 4 aa, Mycobacterium
TLQT

SEQ ID NO: 1175040 - protein, 6 aa, Mycobacterium
TLRRPE

SEQ ID NO: 1175041 - protein, 9 aa, Mycobacterium
TLRTNSPGA

SEQ ID NO: 1175042 - protein, 5 aa, Mycobacterium
TLSAR

SEQ ID NO: 1175043 - protein, 8 aa, Mycobacterium
TLSKNGAF

SEQ ID NO: 1175044 - protein, 6 aa, Mycobacterium
TLSTRS

SEQ ID NO: 1175045 - protein, 8 aa, Mycobacterium
TLTDGREI

SEQ ID NO: 1175046 - protein, 5 aa, Mycobacterium
TLTEA

SEQ ID NO: 1175047 - protein, 10 aa, Mycobacterium
TLTGGASRTT

SEQ ID NO: 1175048 - protein, 10 aa, Mycobacterium
TLTGHAKGGA

SEQ ID NO: 1175049 - protein, 10 aa, Mycobacterium
TLTGSEDPPI

SEQ ID NO: 1175050 - protein, 6 aa, Mycobacterium
TLTPDI

SEQ ID NO: 1175051 - protein, 8 aa, Mycobacterium
TLTSPRGN

SEQ ID NO: 1175052 - protein, 6 aa, Mycobacterium
TLTSVD

SEQ ID NO: 1175053 - protein, 7 aa, Mycobacterium
TLTSVDD

SEQ ID NO: 1175054 - protein, 5 aa, Mycobacterium
TMAPG

SEQ ID NO: 1175055 - protein, 13 aa, Mycobacterium
TMHGEGSDASVAD

SEQ ID NO: 1175056 - protein, 8 aa, Mycobacterium
TMPNRRTT

SEQ ID NO: 1175057 - protein, 8 aa, Mycobacterium
TMPQRAGA

SEQ ID NO: 1175058 - protein, 5 aa, Mycobacterium
TMREE

SEQ ID NO: 1175059 - protein, 15 aa, Mycobacterium
TMSTSENDGVTGGVT

SEQ ID NO: 1175060 - protein, 6 aa, Mycobacterium
TMTGDD

SEQ ID NO: 1175061 - protein, 7 aa, Mycobacterium
TMTGGEL

SEQ ID NO: 1175062 - protein, 6 aa, Mycobacterium
TNAART

SEQ ID NO: 1175063 - protein, 14 aa, Mycobacterium
TNADDIAKAARVNR

SEQ ID NO: 1175064 - protein, 17 aa, Mycobacterium
TNADRPGVGPSESEIGP

SEQ ID NO: 1175065 - protein, 5 aa, Mycobacterium
TNAPT

SEQ ID NO: 1175066 - protein, 8 aa, Mycobacterium
TNAQKSGD

SEQ ID NO: 1175067 - protein, 14 aa, Mycobacterium
TNAQTGTDSSEPRL

SEQ ID NO: 1175068 - protein, 6 aa, Mycobacterium
TNDATR

SEQ ID NO: 1175069 - protein, 7 aa, Mycobacterium
TNDEQKQ

SEQ ID NO: 1175070 - protein, 4 aa, Mycobacterium
TNDR

SEQ ID NO: 1175071 - protein, 4 aa, Mycobacterium
TNEA

SEQ ID NO: 1175072 - protein, 11 aa, Mycobacterium
TNENPHPPSQA

SEQ ID NO: 1175073 - protein, 7 aa, Mycobacterium
TNETELG

SEQ ID NO: 1175074 - protein, 4 aa, Mycobacterium
TNGA

SEQ ID NO: 1175075 - protein, 19 aa, Mycobacterium
TNGGAVAGIDSESATTSVT

SEQ ID NO: 1175076 - protein, 9 aa, Mycobacterium
TNGGPDDFT

SEQ ID NO: 1175077 - protein, 7 aa, Mycobacterium
TNGGSKS

SEQ ID NO: 1175078 - protein, 8 aa, Mycobacterium
TNGPAELG

SEQ ID NO: 1175079 - protein, 16 aa, Mycobacterium
TNIPSATNTHKGADKL

SEQ ID NO: 1175080 - protein, 6 aa, Mycobacterium
TNKKGL

SEQ ID NO: 1175081 - protein, 5 aa, Mycobacterium
TNLAH

SEQ ID NO: 1175082 - protein, 4 aa, Mycobacterium
TNLN

SEQ ID NO: 1175083 - protein, 7 aa, Mycobacterium
TNLPRNQ

SEQ ID NO: 1175084 - protein, 9 aa, Mycobacterium
TNMRSSTAD

SEQ ID NO: 1175085 - protein, 7 aa, Mycobacterium
TNPADRS

SEQ ID NO: 1175086 - protein, 7 aa, Mycobacterium
TNPAPGK

SEQ ID NO: 1175087 - protein, 10 aa, Mycobacterium
TNPDAASHQQ

SEQ ID NO: 1175088 - protein, 8 aa, Mycobacterium
TNPDVPKH

SEQ ID NO: 1175089 - protein, 8 aa, Mycobacterium
TNPPGTVT

SEQ ID NO: 1175090 - protein, 4 aa, Mycobacterium
TNPR

SEQ ID NO: 1175091 - protein, 5 aa, Mycobacterium
TNPRD

SEQ ID NO: 1175092 - protein, 16 aa, Mycobacterium
TNPRDGFTQPGPPYRL

SEQ ID NO: 1175093 - protein, 10 aa, Mycobacterium
TNPSGNRPCE

SEQ ID NO: 1175094 - protein, 11 aa, Mycobacterium
TNPTAHGGRAE

SEQ ID NO: 1175095 - protein, 19 aa, Mycobacterium
TNQPYAQAAAGQADDVDRA

SEQ ID NO: 1175096 - protein, 8 aa, Mycobacterium
TNQRGGEL

SEQ ID NO: 1175097 - protein, 5 aa, Mycobacterium
TNRET

SEQ ID NO: 1175098 - protein, 14 aa, Mycobacterium
TNRHHGSGTPIGAP

SEQ ID NO: 1175099 - protein, 14 aa, Mycobacterium
TNRNSIPADPNGAW

SEQ ID NO: 1175100 - protein, 8 aa, Mycobacterium
TNRRNPGA

SEQ ID NO: 1175101 - protein, 9 aa, Mycobacterium
TNRTHATST

SEQ ID NO: 1175102 - protein, 7 aa, Mycobacterium
TNSAKVR

SEQ ID NO: 1175103 - protein, 7 aa, Mycobacterium
TNSESIV

SEQ ID NO: 1175104 - protein, 6 aa, Mycobacterium
TNSEWS

SEQ ID NO: 1175105 - protein, 8 aa, Mycobacterium
TNSPGALS

SEQ ID NO: 1175106 - protein, 5 aa, Mycobacterium
TNSSV

SEQ ID NO: 1175107 - protein, 12 aa, Mycobacterium
TNTAGQRPRTGD

SEQ ID NO: 1175108 - protein, 5 aa, Mycobacterium
TNTPD

SEQ ID NO: 1175109 - protein, 6 aa, Mycobacterium
TNTPEW

SEQ ID NO: 1175110 - protein, 10 aa, Mycobacterium
TNTTTKTRRQ

SEQ ID NO: 1175111 - protein, 6 aa, Mycobacterium
TNTVNY

SEQ ID NO: 1175112 - protein, 8 aa, Mycobacterium
TNVAGTGT

SEQ ID NO: 1175113 - protein, 7 aa, Mycobacterium
TNVDTGD

SEQ ID NO: 1175114 - protein, 8 aa, Mycobacterium
TNWRSDGD

SEQ ID NO: 1175115 - protein, 8 aa, Mycobacterium
TPAAGRGG

SEQ ID NO: 1175116 - protein, 16 aa, Mycobacterium
TPAAPPGGRGVHEPDS

SEQ ID NO: 1175117 - protein, 10 aa, Mycobacterium
TPAARPPASS

SEQ ID NO: 1175118 - protein, 8 aa, Mycobacterium
TPAATTEP

SEQ ID NO: 1175119 - protein, 17 aa, Mycobacterium
TPADPERFTAMLDELLD

SEQ ID NO: 1175120 - protein, 9 aa, Mycobacterium
TPAEEAGGG

SEQ ID NO: 1175121 - protein, 6 aa, Mycobacterium
TPAEGY

SEQ ID NO: 1175122 - protein, 10 aa, Mycobacterium
TPAERADPKI

SEQ ID NO: 1175123 - protein, 8 aa, Mycobacterium
TPAESRKE

SEQ ID NO: 1175124 - protein, 6 aa, Mycobacterium
TPAETP

SEQ ID NO: 1175125 - protein, 5 aa, Mycobacterium
TPAGF

SEQ ID NO: 1175126 - protein, 7 aa, Mycobacterium
TPAGVTR

SEQ ID NO: 1175127 - protein, 8 aa, Mycobacterium
TPALGATG

SEQ ID NO: 1175128 - protein, 8 aa, Mycobacterium
TPALTTRG

SEQ ID NO: 1175129 - protein, 12 aa, Mycobacterium
TPANITGSGPVG

SEQ ID NO: 1175130 - protein, 5 aa, Mycobacterium
TPAPE

SEQ ID NO: 1175131 - protein, 23 aa, Mycobacterium
TPAPPPPPAEALDTGYTPGGVPT

SEQ ID NO: 1175132 - protein, 7 aa, Mycobacterium
TPAPSGG

SEQ ID NO: 1175133 - protein, 5 aa, Mycobacterium
TPARV

SEQ ID NO: 1175134 - protein, 8 aa, Mycobacterium
TPATVEPD

SEQ ID NO: 1175135 - protein, 5 aa, Mycobacterium
TPAVT

SEQ ID NO: 1175136 - protein, 14 aa, Mycobacterium
TPCNKRSPGSGCSA

SEQ ID NO: 1175137 - protein, 4 aa, Mycobacterium
TPDA

SEQ ID NO: 1175138 - protein, 7 aa, Mycobacterium
TPDAPAR

SEQ ID NO: 1175139 - protein, 7 aa, Mycobacterium
TPDAPTI

SEQ ID NO: 1175140 - protein, 6 aa, Mycobacterium
TPDATK

SEQ ID NO: 1175141 - protein, 4 aa, Mycobacterium
TPDD

SEQ ID NO: 1175142 - protein, 9 aa, Mycobacterium
TPDDQQAEV

SEQ ID NO: 1175143 - protein, 6 aa, Mycobacterium
TPDGDY

SEQ ID NO: 1175144 - protein, 12 aa, Mycobacterium
TPDGPRAERGAR

SEQ ID NO: 1175145 - protein, 10 aa, Mycobacterium
TPDGQDGDEY

SEQ ID NO: 1175146 - protein, 8 aa, Mycobacterium
TPDGSRAQ

SEQ ID NO: 1175147 - protein, 8 aa, Mycobacterium
TPDKMATD

SEQ ID NO: 1175148 - protein, 12 aa, Mycobacterium
TPDPAAAEAARA

SEQ ID NO: 1175149 - protein, 4 aa, Mycobacterium
TPEA

SEQ ID NO: 1175150 - protein, 21 aa, Mycobacterium
TPEAVTDAQAELTADGATAVG

SEQ ID NO: 1175151 - protein, 5 aa, Mycobacterium
TPEDL

SEQ ID NO: 1175152 - protein, 5 aa, Mycobacterium
TPEEI

SEQ ID NO: 1175153 - protein, 10 aa, Mycobacterium
TPEGPGGSID

SEQ ID NO: 1175154 - protein, 7 aa, Mycobacterium
TPEHAER

SEQ ID NO: 1175155 - protein, 9 aa, Mycobacterium
TPEHTGQAR

SEQ ID NO: 1175156 - protein, 5 aa, Mycobacterium
TPEIP

SEQ ID NO: 1175157 - protein, 5 aa, Mycobacterium
TPEIQ

SEQ ID NO: 1175158 - protein, 4 aa, Mycobacterium
TPEK

SEQ ID NO: 1175159 - protein, 8 aa, Mycobacterium
TPEKAAEL

SEQ ID NO: 1175160 - protein, 4 aa, Mycobacterium
TPEP

SEQ ID NO: 1175161 - protein, 4 aa, Mycobacterium
TPER

SEQ ID NO: 1175162 - protein, 8 aa, Mycobacterium
TPERTVAE

SEQ ID NO: 1175163 - protein, 6 aa, Mycobacterium
TPESGI

SEQ ID NO: 1175164 - protein, 4 aa, Mycobacterium
TPET

SEQ ID NO: 1175165 - protein, 9 aa, Mycobacterium
TPEYPLGRA

SEQ ID NO: 1175166 - protein, 9 aa, Mycobacterium
TPEYTRGAT

SEQ ID NO: 1175167 - protein, 4 aa, Mycobacterium
TPFD

SEQ ID NO: 1175168 - protein, 5 aa, Mycobacterium
TPFGG

SEQ ID NO: 1175169 - protein, 6 aa, Mycobacterium
TPFGPD

SEQ ID NO: 1175170 - protein, 4 aa, Mycobacterium
TPGA

SEQ ID NO: 1175171 - protein, 12 aa, Mycobacterium
TPGAEPEPAAGY

SEQ ID NO: 1175172 - protein, 10 aa, Mycobacterium
TPGASDTARF

SEQ ID NO: 1175173 - protein, 6 aa, Mycobacterium
TPGATE

SEQ ID NO: 1175174 - protein, 5 aa, Mycobacterium
TPGDL

SEQ ID NO: 1175175 - protein, 8 aa, Mycobacterium
TPGDTRAD

SEQ ID NO: 1175176 - protein, 6 aa, Mycobacterium
TPGDTV

SEQ ID NO: 1175177 - protein, 5 aa, Mycobacterium
TPGEV

SEQ ID NO: 1175178 - protein, 11 aa, Mycobacterium
TPGFGRAETPI

SEQ ID NO: 1175179 - protein, 5 aa, Mycobacterium
TPGGL

SEQ ID NO: 1175180 - protein, 7 aa, Mycobacterium
TPGGRRQ

SEQ ID NO: 1175181 - protein, 7 aa, Mycobacterium
TPGHERY

SEQ ID NO: 1175182 - protein, 8 aa, Mycobacterium
TPGHTPES

SEQ ID NO: 1175183 - protein, 5 aa, Mycobacterium
TPGIA

SEQ ID NO: 1175184 - protein, 10 aa, Mycobacterium
TPGNPHGANA

SEQ ID NO: 1175185 - protein, 6 aa, Mycobacterium
TPGQPM

SEQ ID NO: 1175186 - protein, 6 aa, Mycobacterium
TPGQYD

SEQ ID NO: 1175187 - protein, 14 aa, Mycobacterium
TPGRDFDTDTDSRN

SEQ ID NO: 1175188 - protein, 4 aa, Mycobacterium
TPGS

SEQ ID NO: 1175189 - protein, 15 aa, Mycobacterium
TPGSESARAPAARTL

SEQ ID NO: 1175190 - protein, 6 aa, Mycobacterium
TPGTVG

SEQ ID NO: 1175191 - protein, 5 aa, Mycobacterium
TPHAA

SEQ ID NO: 1175192 - protein, 5 aa, Mycobacterium
TPHLN

SEQ ID NO: 1175193 - protein, 5 aa, Mycobacterium
TPHPV

SEQ ID NO: 1175194 - protein, 4 aa, Mycobacterium
TPIA

SEQ ID NO: 1175195 - protein, 4 aa, Mycobacterium
TPIG

SEQ ID NO: 1175196 - protein, 8 aa, Mycobacterium
TPIGAEAE

SEQ ID NO: 1175197 - protein, 12 aa, Mycobacterium
TPIGKGKPGGGL

SEQ ID NO: 1175198 - protein, 5 aa, Mycobacterium
TPIPA

SEQ ID NO: 1175199 - protein, 6 aa, Mycobacterium
TPIPDG

SEQ ID NO: 1175200 - protein, 11 aa, Mycobacterium
TPIPPDTGEVD

SEQ ID NO: 1175201 - protein, 6 aa, Mycobacterium
TPIPPV

SEQ ID NO: 1175202 - protein, 7 aa, Mycobacterium
TPITPTE

SEQ ID NO: 1175203 - protein, 9 aa, Mycobacterium
TPKASSRLR

SEQ ID NO: 1175204 - protein, 5 aa, Mycobacterium
TPKAT

SEQ ID NO: 1175205 - protein, 8 aa, Mycobacterium
TPKDQATV

SEQ ID NO: 1175206 - protein, 9 aa, Mycobacterium
TPKPPWRQR

SEQ ID NO: 1175207 - protein, 8 aa, Mycobacterium
TPLAGGSQ

SEQ ID NO: 1175208 - protein, 7 aa, Mycobacterium
TPLDPSR

SEQ ID NO: 1175209 - protein, 5 aa, Mycobacterium
TPLET

SEQ ID NO: 1175210 - protein, 4 aa, Mycobacterium
TPLG

SEQ ID NO: 1175211 - protein, 13 aa, Mycobacterium
TPLPGDDDPSPLL

SEQ ID NO: 1175212 - protein, 5 aa, Mycobacterium
TPLPV

SEQ ID NO: 1175213 - protein, 6 aa, Mycobacterium
TPLRDG

SEQ ID NO: 1175214 - protein, 15 aa, Mycobacterium
TPLSQASGDGLDPAG

SEQ ID NO: 1175215 - protein, 8 aa, Mycobacterium
TPNGPGPW

SEQ ID NO: 1175216 - protein, 12 aa, Mycobacterium
TPNGPRGSGNGH

SEQ ID NO: 1175217 - protein, 4 aa, Mycobacterium
TPNV

SEQ ID NO: 1175218 - protein, 5 aa, Mycobacterium
TPNVH

SEQ ID NO: 1175219 - protein, 4 aa, Mycobacterium
TPPA

SEQ ID NO: 1175220 - protein, 12 aa, Mycobacterium
TPPAASPDDDTV

SEQ ID NO: 1175221 - protein, 13 aa, Mycobacterium
TPPASAPPLEGPP

SEQ ID NO: 1175222 - protein, 6 aa, Mycobacterium
TPPEDR

SEQ ID NO: 1175223 - protein, 9 aa, Mycobacterium
TPPEDTERA

SEQ ID NO: 1175224 - protein, 4 aa, Mycobacterium
TPPG

SEQ ID NO: 1175225 - protein, 9 aa, Mycobacterium
TPPGPQRDE

SEQ ID NO: 1175226 - protein, 13 aa, Mycobacterium
TPPHLSHTDPDGR

SEQ ID NO: 1175227 - protein, 4 aa, Mycobacterium
TPPI

SEQ ID NO: 1175228 - protein, 13 aa, Mycobacterium
TPPLDPSRRGPTA

SEQ ID NO: 1175229 - protein, 5 aa, Mycobacterium
TPPLG

SEQ ID NO: 1175230 - protein, 6 aa, Mycobacterium
TPPPLS

SEQ ID NO: 1175231 - protein, 6 aa, Mycobacterium
TPPPPY

SEQ ID NO: 1175232 - protein, 8 aa, Mycobacterium
TPPPQPQR

SEQ ID NO: 1175233 - protein, 15 aa, Mycobacterium
TPPSGITGLGQTGLF

SEQ ID NO: 1175234 - protein, 6 aa, Mycobacterium
TPPSRN

SEQ ID NO: 1175235 - protein, 4 aa, Mycobacterium
TPPT

SEQ ID NO: 1175236 - protein, 5 aa, Mycobacterium
TPPVG

SEQ ID NO: 1175237 - protein, 4 aa, Mycobacterium
TPQF

SEQ ID NO: 1175238 - protein, 7 aa, Mycobacterium
TPQFQRQ

SEQ ID NO: 1175239 - protein, 5 aa, Mycobacterium
TPQGE

SEQ ID NO: 1175240 - protein, 6 aa, Mycobacterium
TPQGGA

SEQ ID NO: 1175241 - protein, 6 aa, Mycobacterium
TPQGTL

SEQ ID NO: 1175242 - protein, 8 aa, Mycobacterium
TPQPAMPG

SEQ ID NO: 1175243 - protein, 9 aa, Mycobacterium
TPQRTDRTV

SEQ ID NO: 1175244 - protein, 5 aa, Mycobacterium
TPQVT

SEQ ID NO: 1175245 - protein, 12 aa, Mycobacterium
TPRAIQSQRETI

SEQ ID NO: 1175246 - protein, 5 aa, Mycobacterium
TPRDG

SEQ ID NO: 1175247 - protein, 9 aa, Mycobacterium
TPRDQGGLG

SEQ ID NO: 1175248 - protein, 11 aa, Mycobacterium
TPRDSRNATDN

SEQ ID NO: 1175249 - protein, 4 aa, Mycobacterium
TPRG

SEQ ID NO: 1175250 - protein, 11 aa, Mycobacterium
TPRGKQRNGSL

SEQ ID NO: 1175251 - protein, 5 aa, Mycobacterium
TPRGR

SEQ ID NO: 1175252 - protein, 6 aa, Mycobacterium
TPRGTT

SEQ ID NO: 1175253 - protein, 8 aa, Mycobacterium
TPRGVRTV

SEQ ID NO: 1175254 - protein, 5 aa, Mycobacterium
TPRQL

SEQ ID NO: 1175255 - protein, 26 aa, Mycobacterium
TPRRPHADLDGQKDDELGRGGFTGRT

SEQ ID NO: 1175256 - protein, 8 aa, Mycobacterium
TPRTGRTH

SEQ ID NO: 1175257 - protein, 20 aa, Mycobacterium
TPSAAGPVKIDPGIGAPHSA

SEQ ID NO: 1175258 - protein, 8 aa, Mycobacterium
TPSADGPA

SEQ ID NO: 1175259 - protein, 11 aa, Mycobacterium
TPSAPERHEQM

SEQ ID NO: 1175260 - protein, 9 aa, Mycobacterium
TPSARSAGG

SEQ ID NO: 1175261 - protein, 7 aa, Mycobacterium
TPSDSPH

SEQ ID NO: 1175262 - protein, 4 aa, Mycobacterium
TPSG

SEQ ID NO: 1175263 - protein, 7 aa, Mycobacterium
TPSGDGR

SEQ ID NO: 1175264 - protein, 7 aa, Mycobacterium
TPSLADG

SEQ ID NO: 1175265 - protein, 5 aa, Mycobacterium
TPSNY

SEQ ID NO: 1175266 - protein, 6 aa, Mycobacterium
TPSPAS

SEQ ID NO: 1175267 - protein, 5 aa, Mycobacterium
TPSPH

SEQ ID NO: 1175268 - protein, 9 aa, Mycobacterium
TPSPSGTGR

SEQ ID NO: 1175269 - protein, 4 aa, Mycobacterium
TPSR

SEQ ID NO: 1175270 - protein, 6 aa, Mycobacterium
TPSRPA

SEQ ID NO: 1175271 - protein, 17 aa, Mycobacterium
TPSSVDQRVNTPTDPNW

SEQ ID NO: 1175272 - protein, 5 aa, Mycobacterium
TPSTL

SEQ ID NO: 1175273 - protein, 8 aa, Mycobacterium
TPTAREEL

SEQ ID NO: 1175274 - protein, 8 aa, Mycobacterium
TPTDPVAC

SEQ ID NO: 1175275 - protein, 9 aa, Mycobacterium
TPTDTIGSA

SEQ ID NO: 1175276 - protein, 5 aa, Mycobacterium
TPTDY

SEQ ID NO: 1175277 - protein, 11 aa, Mycobacterium
TPTERTSAKGV

SEQ ID NO: 1175278 - protein, 18 aa, Mycobacterium
TPTGPSAGAEADELPEDA

SEQ ID NO: 1175279 - protein, 15 aa, Mycobacterium
TPTGSGKSLVATGAQ

SEQ ID NO: 1175280 - protein, 5 aa, Mycobacterium
TPTNR

SEQ ID NO: 1175281 - protein, 5 aa, Mycobacterium
TPTPA

SEQ ID NO: 1175282 - protein, 6 aa, Mycobacterium
TPTPGA

SEQ ID NO: 1175283 - protein, 6 aa, Mycobacterium
TPTSAP

SEQ ID NO: 1175284 - protein, 4 aa, Mycobacterium
TPVD

SEQ ID NO: 1175285 - protein, 12 aa, Mycobacterium
TPVGKRNGGLSG

SEQ ID NO: 1175286 - protein, 5 aa, Mycobacterium
TPVGN

SEQ ID NO: 1175287 - protein, 8 aa, Mycobacterium
TPVNESPK

SEQ ID NO: 1175288 - protein, 5 aa, Mycobacterium
TPVPA

SEQ ID NO: 1175289 - protein, 7 aa, Mycobacterium
TPVPDAA

SEQ ID NO: 1175290 - protein, 5 aa, Mycobacterium
TPVPV

SEQ ID NO: 1175291 - protein, 7 aa, Mycobacterium
TPVRRSG

SEQ ID NO: 1175292 - protein, 6 aa, Mycobacterium
TPVTGG

SEQ ID NO: 1175293 - protein, 12 aa, Mycobacterium
TPVTPPARASAY

SEQ ID NO: 1175294 - protein, 12 aa, Mycobacterium
TPVTPSESATDA

SEQ ID NO: 1175295 - protein, 10 aa, Mycobacterium
TPVVTSSGEA

SEQ ID NO: 1175296 - protein, 11 aa, Mycobacterium
TPWAPKMPSDY

SEQ ID NO: 1175297 - protein, 11 aa, Mycobacterium
TPWPARNGERV

SEQ ID NO: 1175298 - protein, 6 aa, Mycobacterium
TPWPRE

SEQ ID NO: 1175299 - protein, 12 aa, Mycobacterium
TPYDEVTKKTDG

SEQ ID NO: 1175300 - protein, 7 aa, Mycobacterium
TPYGVRG

SEQ ID NO: 1175301 - protein, 5 aa, Mycobacterium
TPYNG

SEQ ID NO: 1175302 - protein, 12 aa, Mycobacterium
TPYPYTRDGERR

SEQ ID NO: 1175303 - protein, 17 aa, Mycobacterium
TPYRPGPDGRFAPFDQP

SEQ ID NO: 1175304 - protein, 7 aa, Mycobacterium
TQAEGEG

SEQ ID NO: 1175305 - protein, 12 aa, Mycobacterium
TQAKNSGQRQAG

SEQ ID NO: 1175306 - protein, 6 aa, Mycobacterium
TQAPHA

SEQ ID NO: 1175307 - protein, 5 aa, Mycobacterium
TQDAD

SEQ ID NO: 1175308 - protein, 6 aa, Mycobacterium
TQDDGG

SEQ ID NO: 1175309 - protein, 7 aa, Mycobacterium
TQDGTSL

SEQ ID NO: 1175310 - protein, 17 aa, Mycobacterium
TQDKTPVDRLPADAEQG

SEQ ID NO: 1175311 - protein, 14 aa, Mycobacterium
TQDMSNPLDPYPRD

SEQ ID NO: 1175312 - protein, 10 aa, Mycobacterium
TQDRPEADHV

SEQ ID NO: 1175313 - protein, 8 aa, Mycobacterium
TQEPTTVK

SEQ ID NO: 1175314 - protein, 7 aa, Mycobacterium
TQETGRV

SEQ ID NO: 1175315 - protein, 14 aa, Mycobacterium
TQGAGEVLTWHGRL

SEQ ID NO: 1175316 - protein, 4 aa, Mycobacterium
TQGD

SEQ ID NO: 1175317 - protein, 8 aa, Mycobacterium
TQGERDVE

SEQ ID NO: 1175318 - protein, 10 aa, Mycobacterium
TQGFTAEPAY

SEQ ID NO: 1175319 - protein, 7 aa, Mycobacterium
TQGHRDG

SEQ ID NO: 1175320 - protein, 6 aa, Mycobacterium
TQGNDF

SEQ ID NO: 1175321 - protein, 5 aa, Mycobacterium
TQGPG

SEQ ID NO: 1175322 - protein, 8 aa, Mycobacterium
TQGRGADS

SEQ ID NO: 1175323 - protein, 4 aa, Mycobacterium
TQGS

SEQ ID NO: 1175324 - protein, 5 aa, Mycobacterium
TQGYT

SEQ ID NO: 1175325 - protein, 18 aa, Mycobacterium
TQHPTELSAEGKSRKFAY

SEQ ID NO: 1175326 - protein, 4 aa, Mycobacterium
TQID

SEQ ID NO: 1175327 - protein, 7 aa, Mycobacterium
TQLGPQR

SEQ ID NO: 1175328 - protein, 8 aa, Mycobacterium
TQNRRDER

SEQ ID NO: 1175329 - protein, 13 aa, Mycobacterium
TQPFPPVPANLRA

SEQ ID NO: 1175330 - protein, 31 aa, Mycobacterium; identical to SEQ ID NO: 599942

SEQ ID NO: 1175331 - protein, 10 aa, Mycobacterium
TQPPERKNEI

SEQ ID NO: 1175332 - protein, 5 aa, Mycobacterium
TQPRG

SEQ ID NO: 1175333 - protein, 8 aa, Mycobacterium
TQPTPADL

SEQ ID NO: 1175334 - protein, 15 aa, Mycobacterium
TQQTYRELTSTSNCT

SEQ ID NO: 1175335 - protein, 4 aa, Mycobacterium
TQRA

SEQ ID NO: 1175336 - protein, 7 aa, Mycobacterium
TQRALTE

SEQ ID NO: 1175337 - protein, 13 aa, Mycobacterium
TQRETAQRVVNRS

SEQ ID NO: 1175338 - protein, 12 aa, Mycobacterium
TQRLERSARLLL

SEQ ID NO: 1175339 - protein, 5 aa, Mycobacterium
TQRPR

SEQ ID NO: 1175340 - protein, 17 aa, Mycobacterium
TQSRRRAAATGGESQIP

SEQ ID NO: 1175341 - protein, 7 aa, Mycobacterium
TQSTAGD

SEQ ID NO: 1175342 - protein, 7 aa, Mycobacterium
TQSVNDE

SEQ ID NO: 1175343 - protein, 13 aa, Mycobacterium
TQTDGIGKTYGDS

SEQ ID NO: 1175344 - protein, 13 aa, Mycobacterium
TQTPDAGGEAGDV

SEQ ID NO: 1175345 - protein, 13 aa, Mycobacterium
TQTQSMRKRPGIA

SEQ ID NO: 1175346 - protein, 6 aa, Mycobacterium
TQTTEL

SEQ ID NO: 1175347 - protein, 8 aa, Mycobacterium
TQYPDDAT

SEQ ID NO: 1175348 - protein, 4 aa, Mycobacterium
TRAA

SEQ ID NO: 1175349 - protein, 9 aa, Mycobacterium
TRAADADFN

SEQ ID NO: 1175350 - protein, 9 aa, Mycobacterium
TRAADPPAM

SEQ ID NO: 1175351 - protein, 9 aa, Mycobacterium
TRADDDQLA

SEQ ID NO: 1175352 - protein, 7 aa, Mycobacterium
TRADDQL

SEQ ID NO: 1175353 - protein, 10 aa, Mycobacterium
TRADGERRPG

SEQ ID NO: 1175354 - protein, 9 aa, Mycobacterium
TRADHREQA

SEQ ID NO: 1175355 - protein, 11 aa, Mycobacterium
TRAEKGKYSDF

SEQ ID NO: 1175356 - protein, 8 aa, Mycobacterium
TRAEQDEL

SEQ ID NO: 1175357 - protein, 10 aa, Mycobacterium
TRAERDGDSY

SEQ ID NO: 1175358 - protein, 8 aa, Mycobacterium
TRAGVGRS

SEQ ID NO: 1175359 - protein, 4 aa, Mycobacterium
TRAI

SEQ ID NO: 1175360 - protein, 7 aa, Mycobacterium
TRAPAGD

SEQ ID NO: 1175361 - protein, 9 aa, Mycobacterium
TRAPKKQQG

SEQ ID NO: 1175362 - protein, 9 aa, Mycobacterium
TRAPQASEH

SEQ ID NO: 1175363 - protein, 5 aa, Mycobacterium
TRARI

SEQ ID NO: 1175364 - protein, 12 aa, Mycobacterium
TRARRDDSGGYV

SEQ ID NO: 1175365 - protein, 8 aa, Mycobacterium
TRATEVDG

SEQ ID NO: 1175366 - protein, 17 aa, Mycobacterium
TRAVDTGYANGYGNSKW

SEQ ID NO: 1175367 - protein, 9 aa, Mycobacterium
TRDAAREDV

SEQ ID NO: 1175368 - protein, 9 aa, Mycobacterium
TRDDAESTH

SEQ ID NO: 1175369 - protein, 16 aa, Mycobacterium
TRDDDAPSRLRAGEAT

SEQ ID NO: 1175370 - protein, 18 aa, Mycobacterium
TRDELAERERVAAEAERA

SEQ ID NO: 1175371 - protein, 8 aa, Mycobacterium
TRDGEQGR

SEQ ID NO: 1175372 - protein, 9 aa, Mycobacterium
TRDLSNEAA

SEQ ID NO: 1175373 - protein, 8 aa, Mycobacterium
TRDNPFSG

SEQ ID NO: 1175374 - protein, 6 aa, Mycobacterium
TRDPAR

SEQ ID NO: 1175375 - protein, 18 aa, Mycobacterium
TRDPKSAKAAALSDAGAE

SEQ ID NO: 1175376 - protein, 12 aa, Mycobacterium
TRDSDGEAAGVD

SEQ ID NO: 1175377 - protein, 6 aa, Mycobacterium
TRDSYT

SEQ ID NO: 1175378 - protein, 7 aa, Mycobacterium
TRDTELG

SEQ ID NO: 1175379 - protein, 12 aa, Mycobacterium
TRDTGKTLPESR

SEQ ID NO: 1175380 - protein, 12 aa, Mycobacterium
TRDTTGSDLTGR

SEQ ID NO: 1175381 - protein, 4 aa, Mycobacterium
TRDY

SEQ ID NO: 1175382 - protein, 10 aa, Mycobacterium
TREDGPLGGE

SEQ ID NO: 1175383 - protein, 7 aa, Mycobacterium
TREDQVP

SEQ ID NO: 1175384 - protein, 8 aa, Mycobacterium
TREDVPED

SEQ ID NO: 1175385 - protein, 8 aa, Mycobacterium
TREGGTPV

SEQ ID NO: 1175386 - protein, 11 aa, Mycobacterium
TREPGPAKRHQ

SEQ ID NO: 1175387 - protein, 6 aa, Mycobacterium
TREQAI

SEQ ID NO: 1175388 - protein, 6 aa, Mycobacterium
TREREA

SEQ ID NO: 1175389 - protein, 8 aa, Mycobacterium
TRESDGAL

SEQ ID NO: 1175390 - protein, 9 aa, Mycobacterium
TRETGGVGE

SEQ ID NO: 1175391 - protein, 4 aa, Mycobacterium
TRFE

SEQ ID NO: 1175392 - protein, 6 aa, Mycobacterium
TRFQPT

SEQ ID NO: 1175393 - protein, 17 aa, Mycobacterium
TRGAAPESKAGQVHYPG

SEQ ID NO: 1175394 - protein, 4 aa, Mycobacterium
TRGE

SEQ ID NO: 1175395 - protein, 5 aa, Mycobacterium
TRGEA

SEQ ID NO: 1175396 - protein, 5 aa, Mycobacterium
TRGGQ

SEQ ID NO: 1175397 - protein, 8 aa, Mycobacterium
TRGPVSTE

SEQ ID NO: 1175398 - protein, 10 aa, Mycobacterium
TRGRQSSAQV

SEQ ID NO: 1175399 - protein, 10 aa, Mycobacterium
TRGSDAQKAA

SEQ ID NO: 1175400 - protein, 10 aa, Mycobacterium
TRHDGVAPVG

SEQ ID NO: 1175401 - protein, 12 aa, Mycobacterium
TRHEEPVPAPVD

SEQ ID NO: 1175402 - protein, 5 aa, Mycobacterium
TRHGD

SEQ ID NO: 1175403 - protein, 4 aa, Mycobacterium
TRHP

SEQ ID NO: 1175404 - protein, 13 aa, Mycobacterium
TRHPDEPIDGDAD

SEQ ID NO: 1175405 - protein, 4 aa, Mycobacterium
TRIA

SEQ ID NO: 1175406 - protein, 5 aa, Mycobacterium
TRIDT

SEQ ID NO: 1175407 - protein, 15 aa, Mycobacterium
TRKNIEETEEPDPVT

SEQ ID NO: 1175408 - protein, 9 aa, Mycobacterium
TRKPSVDEP

SEQ ID NO: 1175409 - protein, 9 aa, Mycobacterium
TRKRSGLGR

SEQ ID NO: 1175410 - protein, 4 aa, Mycobacterium
TRLA

SEQ ID NO: 1175411 - protein, 9 aa, Mycobacterium
TRLDGGPRF

SEQ ID NO: 1175412 - protein, 5 aa, Mycobacterium
TRLPE

SEQ ID NO: 1175413 - protein, 7 aa, Mycobacterium
TRLPSDE

SEQ ID NO: 1175414 - protein, 8 aa, Mycobacterium
TRMPAGPA

SEQ ID NO: 1175415 - protein, 9 aa, Mycobacterium
TRNAENGVT

SEQ ID NO: 1175416 - protein, 17 aa, Mycobacterium
TRNDDPAGASRPFDKNR

SEQ ID NO: 1175417 - protein, 4 aa, Mycobacterium
TRNP

SEQ ID NO: 1175418 - protein, 19 aa, Mycobacterium
TRPADDDHSRAARNNRATY

SEQ ID NO: 1175419 - protein, 9 aa, Mycobacterium
TRPADDRGA

SEQ ID NO: 1175420 - protein, 9 aa, Mycobacterium
TRPATTDDG

SEQ ID NO: 1175421 - protein, 10 aa, Mycobacterium
TRPDEERPDG

SEQ ID NO: 1175422 - protein, 9 aa, Mycobacterium
TRPDPRNPT

SEQ ID NO: 1175423 - protein, 5 aa, Mycobacterium
TRPEA

SEQ ID NO: 1175424 - protein, 5 aa, Mycobacterium
TRPER

SEQ ID NO: 1175425 - protein, 5 aa, Mycobacterium
TRPGA

SEQ ID NO: 1175426 - protein, 8 aa, Mycobacterium
TRPGRVDN

SEQ ID NO: 1175427 - protein, 5 aa, Mycobacterium
TRPLQ

SEQ ID NO: 1175428 - protein, 14 aa, Mycobacterium
TRPNPDDPTGKSTM

SEQ ID NO: 1175429 - protein, 5 aa, Mycobacterium
TRPPP

SEQ ID NO: 1175430 - protein, 8 aa, Mycobacterium
TRPPVEES

SEQ ID NO: 1175431 - protein, 6 aa, Mycobacterium
TRPSYG

SEQ ID NO: 1175432 - protein, 6 aa, Mycobacterium
TRPTLA

SEQ ID NO: 1175433 - protein, 5 aa, Mycobacterium
TRQPF

SEQ ID NO: 1175434 - protein, 6 aa, Mycobacterium
TRQPRS

SEQ ID NO: 1175435 - protein, 5 aa, Mycobacterium
TRQRC

SEQ ID NO: 1175436 - protein, 6 aa, Mycobacterium
TRQRRA

SEQ ID NO: 1175437 - protein, 4 aa, Mycobacterium
TRQY

SEQ ID NO: 1175438 - protein, 9 aa, Mycobacterium
TRRAGKKKL

SEQ ID NO: 1175439 - protein, 8 aa, Mycobacterium
TRRAQADL

SEQ ID NO: 1175440 - protein, 11 aa, Mycobacterium
TRRASQQRSGL

SEQ ID NO: 1175441 - protein, 8 aa, Mycobacterium
TRRATRKV

SEQ ID NO: 1175442 - protein, 9 aa, Mycobacterium
TRRELPDSP

SEQ ID NO: 1175443 - protein, 22 aa, Mycobacterium
TRRGEDVVDTDEHPRADTSMET

SEQ ID NO: 1175444 - protein, 9 aa, Mycobacterium
TRRNPDGRG

SEQ ID NO: 1175445 - protein, 8 aa, Mycobacterium
TRRQARER

SEQ ID NO: 1175446 - protein, 5 aa, Mycobacterium
TRRSL

SEQ ID NO: 1175447 - protein, 4 aa, Mycobacterium
TRRT

SEQ ID NO: 1175448 - protein, 12 aa, Mycobacterium
TRRTADGIVEIE

SEQ ID NO: 1175449 - protein, 5 aa, Mycobacterium
TRRTF

SEQ ID NO: 1175450 - protein, 8 aa, Mycobacterium
TRRTGRPT

SEQ ID NO: 1175451 - protein, 9 aa, Mycobacterium
TRRVSPENS

SEQ ID NO: 1175452 - protein, 8 aa, Mycobacterium
TRSAGAAA

SEQ ID NO: 1175453 - protein, 11 aa, Mycobacterium
TRSAGEPAGAT

SEQ ID NO: 1175454 - protein, 8 aa, Mycobacterium
TRSAQDQC

SEQ ID NO: 1175455 - protein, 9 aa, Mycobacterium
TRSARQTAD

SEQ ID NO: 1175456 - protein, 7 aa, Mycobacterium
TRSGPAR

SEQ ID NO: 1175457 - protein, 4 aa, Mycobacterium
TRSL

SEQ ID NO: 1175458 - protein, 8 aa, Mycobacterium
TRSLESSE

SEQ ID NO: 1175459 - protein, 6 aa, Mycobacterium
TRSNSL

SEQ ID NO: 1175460 - protein, 5 aa, Mycobacterium
TRSPE

SEQ ID NO: 1175461 - protein, 8 aa, Mycobacterium
TRSTPEKS

SEQ ID NO: 1175462 - protein, 8 aa, Mycobacterium
TRSTVDER

SEQ ID NO: 1175463 - protein, 8 aa, Mycobacterium
TRTAGASV

SEQ ID NO: 1175464 - protein, 9 aa, Mycobacterium
TRTAPSGRV

SEQ ID NO: 1175465 - protein, 7 aa, Mycobacterium
TRTGRED

SEQ ID NO: 1175466 - protein, 18 aa, Mycobacterium
TRTGSTARSGRAGGRPPA

SEQ ID NO: 1175467 - protein, 7 aa, Mycobacterium
TRTPFPP

SEQ ID NO: 1175468 - protein, 10 aa, Mycobacterium
TRTRDAQRRP

SEQ ID NO: 1175469 - protein, 6 aa, Mycobacterium
TRTTDH

SEQ ID NO: 1175470 - protein, 5 aa, Mycobacterium
TRTVD

SEQ ID NO: 1175471 - protein, 5 aa, Mycobacterium
TRTVP

SEQ ID NO: 1175472 - protein, 4 aa, Mycobacterium
TRTY

SEQ ID NO: 1175473 - protein, 13 aa, Mycobacterium
TRVSTGDADVDEA

SEQ ID NO: 1175474 - protein, 8 aa, Mycobacterium
TRYEGPTG

SEQ ID NO: 1175475 - protein, 6 aa, Mycobacterium
TRYGGG

SEQ ID NO: 1175476 - protein, 8 aa, Mycobacterium
TRYPPAGV

SEQ ID NO: 1175477 - protein, 4 aa, Mycobacterium
TRYQ

SEQ ID NO: 1175478 - protein, 13 aa, Mycobacterium
TRYRDENGKPQIA

SEQ ID NO: 1175479 - protein, 9 aa, Mycobacterium
TSAADSTNC

SEQ ID NO: 1175480 - protein, 8 aa, Mycobacterium
TSAAGGEA

SEQ ID NO: 1175481 - protein, 9 aa, Mycobacterium
TSAAGKSPA

SEQ ID NO: 1175482 - protein, 55 aa, Mycobacterium
TSAAKSTPAQRAKRRAAKDEARADELARAKAARNRFRTPASDRRTGGPNAVKARR

SEQ ID NO: 1175483 - protein, 5 aa, Mycobacterium
TSADF

SEQ ID NO: 1175484 - protein, 9 aa, Mycobacterium
TSAEELRRT

SEQ ID NO: 1175485 - protein, 4 aa, Mycobacterium
TSAG

SEQ ID NO: 1175486 - protein, 8 aa, Mycobacterium
TSAGAAAR

SEQ ID NO: 1175487 - protein, 13 aa, Mycobacterium
TSAGLGGNPNWDA

SEQ ID NO: 1175488 - protein, 9 aa, Mycobacterium
TSAGSTVAA

SEQ ID NO: 1175489 - protein, 7 aa, Mycobacterium
TSAGTDT

SEQ ID NO: 1175490 - protein, 9 aa, Mycobacterium
TSAKQDGRN

SEQ ID NO: 1175491 - protein, 4 aa, Mycobacterium
TSAN

SEQ ID NO: 1175492 - protein, 5 aa, Mycobacterium
TSAPE

SEQ ID NO: 1175493 - protein, 8 aa, Mycobacterium
TSAPEDEL

SEQ ID NO: 1175494 - protein, 8 aa, Mycobacterium
TSAPGRDA

SEQ ID NO: 1175495 - protein, 14 aa, Mycobacterium
TSAPLDEDASPTVY

SEQ ID NO: 1175496 - protein, 7 aa, Mycobacterium
TSAPLGD

SEQ ID NO: 1175497 - protein, 6 aa, Mycobacterium
TSARAI

SEQ ID NO: 1175498 - protein, 10 aa, Mycobacterium
TSASKSPKDH

SEQ ID NO: 1175499 - protein, 8 aa, Mycobacterium
TSATKSNG

SEQ ID NO: 1175500 - protein, 7 aa, Mycobacterium
TSDAGKS

SEQ ID NO: 1175501 - protein, 16 aa, Mycobacterium
TSDDGRKDDIAFLREN

SEQ ID NO: 1175502 - protein, 9 aa, Mycobacterium
TSDEAAPAR

SEQ ID NO: 1175503 - protein, 19 aa, Mycobacterium
TSDEPEPRKATRVRSRRAD

SEQ ID NO: 1175504 - protein, 6 aa, Mycobacterium
TSDFGP

SEQ ID NO: 1175505 - protein, 9 aa, Mycobacterium
TSDGDQMPW

SEQ ID NO: 1175506 - protein, 8 aa, Mycobacterium
TSDRGHAP

SEQ ID NO: 1175507 - protein, 6 aa, Mycobacterium
TSDRYA

SEQ ID NO: 1175508 - protein, 12 aa, Mycobacterium
TSEDGATHTTRD

SEQ ID NO: 1175509 - protein, 5 aa, Mycobacterium
TSEGV

SEQ ID NO: 1175510 - protein, 10 aa, Mycobacterium
TSEPKTEAAG

SEQ ID NO: 1175511 - protein, 8 aa, Mycobacterium
TSESAADT

SEQ ID NO: 1175512 - protein, 21 aa, Mycobacterium
TSESTEPTHGNAFARDRHPKA

SEQ ID NO: 1175513 - protein, 7 aa, Mycobacterium
TSEVSGA

SEQ ID NO: 1175514 - protein, 12 aa, Mycobacterium
TSEVYGSSPRDP

SEQ ID NO: 1175515 - protein, 14 aa, Mycobacterium
TSEYDDREGVRRSS

SEQ ID NO: 1175516 - protein, 6 aa, Mycobacterium
TSFNPV

SEQ ID NO: 1175517 - protein, 9 aa, Mycobacterium
TSGAATADY

SEQ ID NO: 1175518 - protein, 6 aa, Mycobacterium
TSGAGR

SEQ ID NO: 1175519 - protein, 6 aa, Mycobacterium
TSGAHD

SEQ ID NO: 1175520 - protein, 6 aa, Mycobacterium
TSGANG

SEQ ID NO: 1175521 - protein, 7 aa, Mycobacterium
TSGAPVL

SEQ ID NO: 1175522 - protein, 11 aa, Mycobacterium
TSGARTANERE

SEQ ID NO: 1175523 - protein, 7 aa, Mycobacterium
TSGASEA

SEQ ID NO: 1175524 - protein, 11 aa, Mycobacterium
TSGATRPPAGV

SEQ ID NO: 1175525 - protein, 9 aa, Mycobacterium
TSGDPDGAE

SEQ ID NO: 1175526 - protein, 10 aa, Mycobacterium
TSGDPGQARG

SEQ ID NO: 1175527 - protein, 18 aa, Mycobacterium
TSGEDIDDSLDLVAIAVR

SEQ ID NO: 1175528 - protein, 8 aa, Mycobacterium
TSGERAGW

SEQ ID NO: 1175529 - protein, 8 aa, Mycobacterium
TSGFRPGQ

SEQ ID NO: 1175530 - protein, 9 aa, Mycobacterium
TSGGQVHQE

SEQ ID NO: 1175531 - protein, 18 aa, Mycobacterium
TSGGQVTRYRPAAGESEV

SEQ ID NO: 1175532 - protein, 6 aa, Mycobacterium
TSGGTP

SEQ ID NO: 1175533 - protein, 8 aa, Mycobacterium
TSGIDPAT

SEQ ID NO: 1175534 - protein, 8 aa, Mycobacterium
TSGPAGGV

SEQ ID NO: 1175535 - protein, 7 aa, Mycobacterium
TSGPALQ

SEQ ID NO: 1175536 - protein, 12 aa, Mycobacterium
TSGPEDPQRGLR

SEQ ID NO: 1175537 - protein, 9 aa, Mycobacterium
TSGPFRPRS

SEQ ID NO: 1175538 - protein, 7 aa, Mycobacterium
TSGPSDE

SEQ ID NO: 1175539 - protein, 12 aa, Mycobacterium
TSGPWESEQTHA

SEQ ID NO: 1175540 - protein, 4 aa, Mycobacterium
TSGQ

SEQ ID NO: 1175541 - protein, 7 aa, Mycobacterium
TSGRAVS

SEQ ID NO: 1175542 - protein, 6 aa, Mycobacterium
TSGREH

SEQ ID NO: 1175543 - protein, 10 aa, Mycobacterium
TSGSKKEIEI

SEQ ID NO: 1175544 - protein, 5 aa, Mycobacterium
TSGTA

SEQ ID NO: 1175545 - protein, 6 aa, Mycobacterium
TSGTDA

SEQ ID NO: 1175546 - protein, 8 aa, Mycobacterium
TSGTGGRP

SEQ ID NO: 1175547 - protein, 8 aa, Mycobacterium
TSGVIGRD

SEQ ID NO: 1175548 - protein, 8 aa, Mycobacterium
TSHRETPR

SEQ ID NO: 1175549 - protein, 9 aa, Mycobacterium
TSHRQGAAS

SEQ ID NO: 1175550 - protein, 6 aa, Mycobacterium
TSKGGT

SEQ ID NO: 1175551 - protein, 6 aa, Mycobacterium
TSKLER

SEQ ID NO: 1175552 - protein, 5 aa, Mycobacterium
TSKRT

SEQ ID NO: 1175553 - protein, 7 aa, Mycobacterium
TSKTRDT

SEQ ID NO: 1175554 - protein, 10 aa, Mycobacterium
TSLDPDDEAA

SEQ ID NO: 1175555 - protein, 4 aa, Mycobacterium
TSLG

SEQ ID NO: 1175556 - protein, 11 aa, Mycobacterium
TSLKQARGQRL

SEQ ID NO: 1175557 - protein, 15 aa, Mycobacterium
TSLNGTQAQADPDGK

SEQ ID NO: 1175558 - protein, 11 aa, Mycobacterium
TSLPTGPDATD

SEQ ID NO: 1175559 - protein, 10 aa, Mycobacterium
TSLREEGGAI

SEQ ID NO: 1175560 - protein, 28 aa, Mycobacterium
TSLTALDGRARRPLPTGLGAPSSDPVDD

SEQ ID NO: 1175561 - protein, 15 aa, Mycobacterium
TSMEQANGGPSDNDR

SEQ ID NO: 1175562 - protein, 19 aa, Mycobacterium
TSNPEGASVQRARVDGRTV

SEQ ID NO: 1175563 - protein, 39 aa, Mycobacterium
TSNPTGRVRRPGATRCRPGGVRTARSSCSGSGGPSAVTR

SEQ ID NO: 1175564 - protein, 26 aa, Mycobacterium
TSNTAHTLAGRSEGVDLDERGAEQAR

SEQ ID NO: 1175565 - protein, 6 aa, Mycobacterium
TSNTEP

SEQ ID NO: 1175566 - protein, 16 aa, Mycobacterium
TSNTGDPATTKGEGDC

SEQ ID NO: 1175567 - protein, 10 aa, Mycobacterium
TSPALKDRDS

SEQ ID NO: 1175568 - protein, 5 aa, Mycobacterium
TSPDA

SEQ ID NO: 1175569 - protein, 6 aa, Mycobacterium
TSPDLA

SEQ ID NO: 1175570 - protein, 9 aa, Mycobacterium
TSPDRLSGN

SEQ ID NO: 1175571 - protein, 11 aa, Mycobacterium
TSPEPRGIGTT

SEQ ID NO: 1175572 - protein, 5 aa, Mycobacterium
TSPGD

SEQ ID NO: 1175573 - protein, 6 aa, Mycobacterium
TSPQGA

SEQ ID NO: 1175574 - protein, 15 aa, Mycobacterium
TSPRGRVVRTYRRES

SEQ ID NO: 1175575 - protein, 10 aa, Mycobacterium
TSPSAPDLGT

SEQ ID NO: 1175576 - protein, 5 aa, Mycobacterium
TSPTG

SEQ ID NO: 1175577 - protein, 4 aa, Mycobacterium
TSPY

SEQ ID NO: 1175578 - protein, 10 aa, Mycobacterium
TSQDPDERAA

SEQ ID NO: 1175579 - protein, 4 aa, Mycobacterium
TSQV

SEQ ID NO: 1175580 - protein, 12 aa, Mycobacterium
TSRAAGRSARAA

SEQ ID NO: 1175581 - protein, 9 aa, Mycobacterium
TSRADSRRY

SEQ ID NO: 1175582 - protein, 9 aa, Mycobacterium
TSRDPRSAV

SEQ ID NO: 1175583 - protein, 5 aa, Mycobacterium
TSRGP

SEQ ID NO: 1175584 - protein, 6 aa, Mycobacterium
TSRGRG

SEQ ID NO: 1175585 - protein, 12 aa, Mycobacterium
TSRGRGRTLASP

SEQ ID NO: 1175586 - protein, 7 aa, Mycobacterium
TSRGRSP

SEQ ID NO: 1175587 - protein, 7 aa, Mycobacterium
TSRHRQG

SEQ ID NO: 1175588 - protein, 5 aa, Mycobacterium
TSRIE

SEQ ID NO: 1175589 - protein, 5 aa, Mycobacterium
TSRLD

SEQ ID NO: 1175590 - protein, 11 aa, Mycobacterium
TSRLSGGQQQR

SEQ ID NO: 1175591 - protein, 6 aa, Mycobacterium
TSRPGV

SEQ ID NO: 1175592 - protein, 7 aa, Mycobacterium
TSRPRAG

SEQ ID NO: 1175593 - protein, 5 aa, Mycobacterium
TSRRK

SEQ ID NO: 1175594 - protein, 8 aa, Mycobacterium
TSRSPKDL

SEQ ID NO: 1175595 - protein, 10 aa, Mycobacterium
TSRTDTIGDA

SEQ ID NO: 1175596 - protein, 6 aa, Mycobacterium
TSSAEQ

SEQ ID NO: 1175597 - protein, 7 aa, Mycobacterium
TSSETVN

SEQ ID NO: 1175598 - protein, 5 aa, Mycobacterium
TSSFR

SEQ ID NO: 1175599 - protein, 8 aa, Mycobacterium
TSSGERVD

SEQ ID NO: 1175600 - protein, 8 aa, Mycobacterium
TSSGMAGA

SEQ ID NO: 1175601 - protein, 6 aa, Mycobacterium
TSSIHP

SEQ ID NO: 1175602 - protein, 20 aa, Mycobacterium
TSSNPTAGGASVGSGIGPTR

SEQ ID NO: 1175603 - protein, 12 aa, Mycobacterium
TSSNREDAADAL

SEQ ID NO: 1175604 - protein, 10 aa, Mycobacterium
TSSPGAGKTT

SEQ ID NO: 1175605 - protein, 6 aa, Mycobacterium
TSSPGS

SEQ ID NO: 1175606 - protein, 6 aa, Mycobacterium
TSSPIG

SEQ ID NO: 1175607 - protein, 13 aa, Mycobacterium
TSSPVAAESRGLG

SEQ ID NO: 1175608 - protein, 9 aa, Mycobacterium
TSSQEADDA

SEQ ID NO: 1175609 - protein, 9 aa, Mycobacterium
TSSSSATYG

SEQ ID NO: 1175610 - protein, 4 aa, Mycobacterium
TSST

SEQ ID NO: 1175611 - protein, 7 aa, Mycobacterium
TSSTDRP

SEQ ID NO: 1175612 - protein, 6 aa, Mycobacterium
TSTAAA

SEQ ID NO: 1175613 - protein, 6 aa, Mycobacterium
TSTAPV

SEQ ID NO: 1175614 - protein, 8 aa, Mycobacterium
TSTDAPIA

SEQ ID NO: 1175615 - protein, 10 aa, Mycobacterium
TSTDPENRRR

SEQ ID NO: 1175616 - protein, 7 aa, Mycobacterium
TSTERGD

SEQ ID NO: 1175617 - protein, 4 aa, Mycobacterium
TSTF

SEQ ID NO: 1175618 - protein, 8 aa, Mycobacterium
TSTGDLTA

SEQ ID NO: 1175619 - protein, 8 aa, Mycobacterium
TSTGQRGA

SEQ ID NO: 1175620 - protein, 6 aa, Mycobacterium
TSTGYV

SEQ ID NO: 1175621 - protein, 13 aa, Mycobacterium
TSTLANDPNETEL

SEQ ID NO: 1175622 - protein, 7 aa, Mycobacterium
TSTLPAS

SEQ ID NO: 1175623 - protein, 9 aa, Mycobacterium
TSTNDSGRG

SEQ ID NO: 1175624 - protein, 5 aa, Mycobacterium
TSTPM

SEQ ID NO: 1175625 - protein, 7 aa, Mycobacterium
TSTVPGG

SEQ ID NO: 1175626 - protein, 8 aa, Mycobacterium
TSVARPET

SEQ ID NO: 1175627 - protein, 4 aa, Mycobacterium
TSVG

SEQ ID NO: 1175628 - protein, 8 aa, Mycobacterium
TSVRPGQQ

SEQ ID NO: 1175629 - protein, 6 aa, Mycobacterium
TSVTEP

SEQ ID NO: 1175630 - protein, 7 aa, Mycobacterium
TSWNTAD

SEQ ID NO: 1175631 - protein, 7 aa, Mycobacterium
TSYATHN

SEQ ID NO: 1175632 - protein, 4 aa, Mycobacterium
TSYC

SEQ ID NO: 1175633 - protein, 5 aa, Mycobacterium
TSYGD

SEQ ID NO: 1175634 - protein, 6 aa, Mycobacterium
TSYPEL

SEQ ID NO: 1175635 - protein, 6 aa, Mycobacterium
TSYPSI

SEQ ID NO: 1175636 - protein, 5 aa, Mycobacterium
TTAAG

SEQ ID NO: 1175637 - protein, 6 aa, Mycobacterium
TTAAGE

SEQ ID NO: 1175638 - protein, 7 aa, Mycobacterium
TTAAGGH

SEQ ID NO: 1175639 - protein, 6 aa, Mycobacterium
TTAANE

SEQ ID NO: 1175640 - protein, 10 aa, Mycobacterium
TTAAPSATAA

SEQ ID NO: 1175641 - protein, 5 aa, Mycobacterium
TTAAT

SEQ ID NO: 1175642 - protein, 18 aa, Mycobacterium
TTAATGAEALRSAADHKP

SEQ ID NO: 1175643 - protein, 18 aa, Mycobacterium
TTADASSVDSLLEASGRV

SEQ ID NO: 1175644 - protein, 15 aa, Mycobacterium
TTADDGTRQALTSGA

SEQ ID NO: 1175645 - protein, 8 aa, Mycobacterium
TTADREEA

SEQ ID NO: 1175646 - protein, 9 aa, Mycobacterium
TTADSVATT

SEQ ID NO: 1175647 - protein, 5 aa, Mycobacterium
TTAEG

SEQ ID NO: 1175648 - protein, 10 aa, Mycobacterium
TTAEGREQAR

SEQ ID NO: 1175649 - protein, 56 aa, Mycobacterium
TTAELPPLAQPPPDPGRTAKMPKRRRTRAADNAARVKAEREHNAAQRNSRAERPPP

SEQ ID NO: 1175650 - protein, 7 aa, Mycobacterium
TTAEQRD

SEQ ID NO: 1175651 - protein, 6 aa, Mycobacterium
TTAFSA

SEQ ID NO: 1175652 - protein, 11 aa, Mycobacterium
TTAGATPGELG

SEQ ID NO: 1175653 - protein, 5 aa, Mycobacterium
TTAGE

SEQ ID NO: 1175654 - protein, 14 aa, Mycobacterium
TTAGTGSEVSGGAV

SEQ ID NO: 1175655 - protein, 8 aa, Mycobacterium
TTAHRTGD

SEQ ID NO: 1175656 - protein, 7 aa, Mycobacterium
TTAKTLP

SEQ ID NO: 1175657 - protein, 8 aa, Mycobacterium
TTANGQTA

SEQ ID NO: 1175658 - protein, 9 aa, Mycobacterium
TTAPAGPYG

SEQ ID NO: 1175659 - protein, 9 aa, Mycobacterium
TTAPHDPDG

SEQ ID NO: 1175660 - protein, 11 aa, Mycobacterium
TTATPLGQQPL

SEQ ID NO: 1175661 - protein, 8 aa, Mycobacterium
TTDADGAP

SEQ ID NO: 1175662 - protein, 5 aa, Mycobacterium
TTDAT

SEQ ID NO: 1175663 - protein, 10 aa, Mycobacterium
TTDDGQQRVS

SEQ ID NO: 1175664 - protein, 5 aa, Mycobacterium
TTDEA

SEQ ID NO: 1175665 - protein, 9 aa, Mycobacterium
TTDGDLPGA

SEQ ID NO: 1175666 - protein, 7 aa, Mycobacterium
TTDHPTI

SEQ ID NO: 1175667 - protein, 9 aa, Mycobacterium
TTDLTPQQR

SEQ ID NO: 1175668 - protein, 13 aa, Mycobacterium
TTDPAPDTGSLAG

SEQ ID NO: 1175669 - protein, 12 aa, Mycobacterium
TTDPEKARAVGR

SEQ ID NO: 1175670 - protein, 6 aa, Mycobacterium
TTDQAE

SEQ ID NO: 1175671 - protein, 8 aa, Mycobacterium
TTDSRWRN

SEQ ID NO: 1175672 - protein, 7 aa, Mycobacterium
TTDSYRA

SEQ ID NO: 1175673 - protein, 11 aa, Mycobacterium
TTDTEKELSGI

SEQ ID NO: 1175674 - protein, 6 aa, Mycobacterium
TTEAAE

SEQ ID NO: 1175675 - protein, 12 aa, Mycobacterium
TTEAKVRGYQPG

SEQ ID NO: 1175676 - protein, 6 aa, Mycobacterium
TTEAPV

SEQ ID NO: 1175677 - protein, 6 aa, Mycobacterium
TTEDGT

SEQ ID NO: 1175678 - protein, 5 aa, Mycobacterium
TTEDI

SEQ ID NO: 1175679 - protein, 27 aa, Mycobacterium
TTEDPANGFRPDTGRITGYRSPGGAGI

SEQ ID NO: 1175680 - protein, 8 aa, Mycobacterium
TTEDPGLG

SEQ ID NO: 1175681 - protein, 5 aa, Mycobacterium
TTELS

SEQ ID NO: 1175682 - protein, 5 aa, Mycobacterium
TTEPS

SEQ ID NO: 1175683 - protein, 10 aa, Mycobacterium
TTEVPEPGHG

SEQ ID NO: 1175684 - protein, 6 aa, Mycobacterium
TTFTSS

SEQ ID NO: 1175685 - protein, 6 aa, Mycobacterium
TTGAGL

SEQ ID NO: 1175686 - protein, 8 aa, Mycobacterium
TTGDGRTG

SEQ ID NO: 1175687 - protein, 15 aa, Mycobacterium
TTGDPGWAPNELRRW

SEQ ID NO: 1175688 - protein, 19 aa, Mycobacterium
TTGDVDGAHTADFETPTGA

SEQ ID NO: 1175689 - protein, 5 aa, Mycobacterium
TTGEA

SEQ ID NO: 1175690 - protein, 7 aa, Mycobacterium
TTGETPV

SEQ ID NO: 1175691 - protein, 8 aa, Mycobacterium
TTGGASFD

SEQ ID NO: 1175692 - protein, 14 aa, Mycobacterium
TTGGGYPTGSETYF

SEQ ID NO: 1175693 - protein, 5 aa, Mycobacterium
TTGGL

SEQ ID NO: 1175694 - protein, 14 aa, Mycobacterium
TTGGRATGERPDAI

SEQ ID NO: 1175695 - protein, 8 aa, Mycobacterium
TTGGTGHR

SEQ ID NO: 1175696 - protein, 5 aa, Mycobacterium
TTGHA

SEQ ID NO: 1175697 - protein, 14 aa, Mycobacterium
TTGLSRTTHGAASA

SEQ ID NO: 1175698 - protein, 15 aa, Mycobacterium
TTGQIVSDGADDSFP

SEQ ID NO: 1175699 - protein, 19 aa, Mycobacterium
TTGRANKARLNRSPVRSPR

SEQ ID NO: 1175700 - protein, 8 aa, Mycobacterium
TTGRDSVT

SEQ ID NO: 1175701 - protein, 18 aa, Mycobacterium
TTGRKSGQPRRTPLGGKR

SEQ ID NO: 1175702 - protein, 17 aa, Mycobacterium
TTGRTDLVGPDDTEKLT

SEQ ID NO: 1175703 - protein, 10 aa, Mycobacterium
TTGRTPARSF

SEQ ID NO: 1175704 - protein, 17 aa, Mycobacterium
TTGSAGPVSPNPAPEPI

SEQ ID NO: 1175705 - protein, 6 aa, Mycobacterium
TTGSSG

SEQ ID NO: 1175706 - protein, 7 aa, Mycobacterium
TTGTDQW

SEQ ID NO: 1175707 - protein, 5 aa, Mycobacterium
TTGTK

SEQ ID NO: 1175708 - protein, 6 aa, Mycobacterium
TTGVAH

SEQ ID NO: 1175709 - protein, 4 aa, Mycobacterium
TTHP

SEQ ID NO: 1175710 - protein, 25 aa, Mycobacterium
TTHRPGNGRTEWTPPADHDTGQPRI

SEQ ID NO: 1175711 - protein, 18 aa, Mycobacterium
TTHTTHPPVTPHPPEPHP

SEQ ID NO: 1175712 - protein, 15 aa, Mycobacterium
TTIGPPGAVHKPDDI

SEQ ID NO: 1175713 - protein, 12 aa, Mycobacterium
TTKAESGSHLPG

SEQ ID NO: 1175714 - protein, 21 aa, Mycobacterium
TTKTSGKRTGDDIRAGKPTEL

SEQ ID NO: 1175715 - protein, 13 aa, Mycobacterium
TTLNTRDTITRGR

SEQ ID NO: 1175716 - protein, 8 aa, Mycobacterium
TTMDTARE

SEQ ID NO: 1175717 - protein, 16 aa, Mycobacterium
TTNDDPAGACRPFDKD

SEQ ID NO: 1175718 - protein, 8 aa, Mycobacterium
TTNEERQR

SEQ ID NO: 1175719 - protein, 6 aa, Mycobacterium
TTNPLQ

SEQ ID NO: 1175720 - protein, 8 aa, Mycobacterium
TTNPNAEL

SEQ ID NO: 1175721 - protein, 10 aa, Mycobacterium
TTNSDVPADE

SEQ ID NO: 1175722 - protein, 10 aa, Mycobacterium
TTNTEEQALD

SEQ ID NO: 1175723 - protein, 9 aa, Mycobacterium
TTPAAEPSA

SEQ ID NO: 1175724 - protein, 8 aa, Mycobacterium
TTPAKPGL

SEQ ID NO: 1175725 - protein, 15 aa, Mycobacterium
TTPAPAGGMPTPTGD

SEQ ID NO: 1175726 - protein, 6 aa, Mycobacterium
TTPDAE

SEQ ID NO: 1175727 - protein, 8 aa, Mycobacterium
TTPDETAA

SEQ ID NO: 1175728 - protein, 17 aa, Mycobacterium
TTPDGDYQTYKANDGGY

SEQ ID NO: 1175729 - protein, 13 aa, Mycobacterium
TTPEDPASAANRA

SEQ ID NO: 1175730 - protein, 4 aa, Mycobacterium
TTPG

SEQ ID NO: 1175731 - protein, 8 aa, Mycobacterium
TTPGAQSC

SEQ ID NO: 1175732 - protein, 5 aa, Mycobacterium
TTPGQ

SEQ ID NO: 1175733 - protein, 4 aa, Mycobacterium
TTPI

SEQ ID NO: 1175734 - protein, 13 aa, Mycobacterium
TTPIDKSSNTLIP

SEQ ID NO: 1175735 - protein, 11 aa, Mycobacterium
TTPKAPPGVRG

SEQ ID NO: 1175736 - protein, 14 aa, Mycobacterium
TTPLGRETDDGGVA

SEQ ID NO: 1175737 - protein, 13 aa, Mycobacterium
TTPLSTRDADRAV

SEQ ID NO: 1175738 - protein, 5 aa, Mycobacterium
TTPMH

SEQ ID NO: 1175739 - protein, 6 aa, Mycobacterium
TTPPGG

SEQ ID NO: 1175740 - protein, 8 aa, Mycobacterium
TTPPLPEI

SEQ ID NO: 1175741 - protein, 10 aa, Mycobacterium
TTPSDPEDRL

SEQ ID NO: 1175742 - protein, 9 aa, Mycobacterium
TTPVADSPV

SEQ ID NO: 1175743 - protein, 7 aa, Mycobacterium
TTQAGTI

SEQ ID NO: 1175744 - protein, 8 aa, Mycobacterium
TTQRPDAV

SEQ ID NO: 1175745 - protein, 8 aa, Mycobacterium
TTQRRGRE

SEQ ID NO: 1175746 - protein, 6 aa, Mycobacterium
TTQSGI

SEQ ID NO: 1175747 - protein, 11 aa, Mycobacterium
TTRAEPSDAAA

SEQ ID NO: 1175748 - protein, 4 aa, Mycobacterium
TTRE

SEQ ID NO: 1175749 - protein, 9 aa, Mycobacterium
TTREANDRG

SEQ ID NO: 1175750 - protein, 7 aa, Mycobacterium
TTREDGV

SEQ ID NO: 1175751 - protein, 5 aa, Mycobacterium
TTRPE

SEQ ID NO: 1175752 - protein, 7 aa, Mycobacterium
TTRRGEA

SEQ ID NO: 1175753 - protein, 7 aa, Mycobacterium
TTRRPSI

SEQ ID NO: 1175754 - protein, 4 aa, Mycobacterium
TTRS

SEQ ID NO: 1175755 - protein, 11 aa, Mycobacterium
TTRSGALTGPL

SEQ ID NO: 1175756 - protein, 6 aa, Mycobacterium
TTRSVT

SEQ ID NO: 1175757 - protein, 8 aa, Mycobacterium
TTRTGTER

SEQ ID NO: 1175758 - protein, 11 aa, Mycobacterium
TTRVEGPKGNA

SEQ ID NO: 1175759 - protein, 20 aa, Mycobacterium
TTRVGEGHVARDDPHGRPGM

SEQ ID NO: 1175760 - protein, 4 aa, Mycobacterium
TTSA

SEQ ID NO: 1175761 - protein, 10 aa, Mycobacterium
TTSAPPGAYN

SEQ ID NO: 1175762 - protein, 11 aa, Mycobacterium
TTSAPQVRPTS

SEQ ID NO: 1175763 - protein, 7 aa, Mycobacterium
TTSAVSQ

SEQ ID NO: 1175764 - protein, 7 aa, Mycobacterium
TTSDPYV

SEQ ID NO: 1175765 - protein, 9 aa, Mycobacterium
TTSDTAYTH

SEQ ID NO: 1175766 - protein, 5 aa, Mycobacterium
TTSGE

SEQ ID NO: 1175767 - protein, 18 aa, Mycobacterium
TTSGRGASAGRNAGTPLA

SEQ ID NO: 1175768 - protein, 4 aa, Mycobacterium
TTSI

SEQ ID NO: 1175769 - protein, 18 aa, Mycobacterium
TTSKVKAHDENGDAGVGD

SEQ ID NO: 1175770 - protein, 5 aa, Mycobacterium
TTSPD

SEQ ID NO: 1175771 - protein, 15 aa, Mycobacterium
TTSQAPRVDEGRSEA

SEQ ID NO: 1175772 - protein, 13 aa, Mycobacterium
TTSRTRFDTNPGL

SEQ ID NO: 1175773 - protein, 7 aa, Mycobacterium
TTTADDL

SEQ ID NO: 1175774 - protein, 5 aa, Mycobacterium
TTTAE

SEQ ID NO: 1175775 - protein, 19 aa, Mycobacterium
TTTAELPPMAQPPPDPDRL

SEQ ID NO: 1175776 - protein, 6 aa, Mycobacterium
TTTAHY

SEQ ID NO: 1175777 - protein, 10 aa, Mycobacterium
TTTAPGERRR

SEQ ID NO: 1175778 - protein, 4 aa, Mycobacterium
TTTD

SEQ ID NO: 1175779 - protein, 13 aa, Mycobacterium
TTTDVDDGATGEG

SEQ ID NO: 1175780 - protein, 6 aa, Mycobacterium
TTTEEG

SEQ ID NO: 1175781 - protein, 10 aa, Mycobacterium
TTTEHGEARD

SEQ ID NO: 1175782 - protein, 7 aa, Mycobacterium
TTTGEPD

SEQ ID NO: 1175783 - protein, 7 aa, Mycobacterium
TTTGGSE

SEQ ID NO: 1175784 - protein, 8 aa, Mycobacterium
TTTGPDTL

SEQ ID NO: 1175785 - protein, 12 aa, Mycobacterium
TTTHKSLRGPRG

SEQ ID NO: 1175786 - protein, 4 aa, Mycobacterium
TTTL

SEQ ID NO: 1175787 - protein, 13 aa, Mycobacterium
TTTLGDAAVPAGT

SEQ ID NO: 1175788 - protein, 6 aa, Mycobacterium
TTTLRP

SEQ ID NO: 1175789 - protein, 10 aa, Mycobacterium
TTTPPSSETA

SEQ ID NO: 1175790 - protein, 9 aa, Mycobacterium
TTTRRTPEE

SEQ ID NO: 1175791 - protein, 7 aa, Mycobacterium
TTTSPPL

SEQ ID NO: 1175792 - protein, 12 aa, Mycobacterium
TTTTLGDADIPA

SEQ ID NO: 1175793 - protein, 10 aa, Mycobacterium
TTTTPDAARE

SEQ ID NO: 1175794 - protein, 4 aa, Mycobacterium
TTVG

SEQ ID NO: 1175795 - protein, 12 aa, Mycobacterium
TTVTARDGTVDI

SEQ ID NO: 1175796 - protein, 6 aa, Mycobacterium
TTVTGA

SEQ ID NO: 1175797 - protein, 12 aa, Mycobacterium
TTVTGRDGRTAH

SEQ ID NO: 1175798 - protein, 10 aa, Mycobacterium
TTVTPSAAAP

SEQ ID NO: 1175799 - protein, 5 aa, Mycobacterium
TTVTS

SEQ ID NO: 1175800 - protein, 12 aa, Mycobacterium
TTYGGTTGDTGA

SEQ ID NO: 1175801 - protein, 8 aa, Mycobacterium
TTYSDPYN

SEQ ID NO: 1175802 - protein, 4 aa, Mycobacterium
TVAE

SEQ ID NO: 1175803 - protein, 12 aa, Mycobacterium
TVAEAPALSAPY

SEQ ID NO: 1175804 - protein, 9 aa, Mycobacterium
TVAEDREQM

SEQ ID NO: 1175805 - protein, 14 aa, Mycobacterium
TVAEPTAPPAANPL

SEQ ID NO: 1175806 - protein, 5 aa, Mycobacterium
TVAES

SEQ ID NO: 1175807 - protein, 5 aa, Mycobacterium
TVAPS

SEQ ID NO: 1175808 - protein, 4 aa, Mycobacterium
TVAQ

SEQ ID NO: 1175809 - protein, 18 aa, Mycobacterium
TVASPPDRLAGSRYGRRR

SEQ ID NO: 1175810 - protein, 9 aa, Mycobacterium
TVDDDPAPY

SEQ ID NO: 1175811 - protein, 4 aa, Mycobacterium
TVDG

SEQ ID NO: 1175812 - protein, 8 aa, Mycobacterium
TVDGGSPI

SEQ ID NO: 1175813 - protein, 22 aa, Mycobacterium
TVDGKDVPEATTEGLSHEVGSG

SEQ ID NO: 1175814 - protein, 4 aa, Mycobacterium
TVDI

SEQ ID NO: 1175815 - protein, 4 aa, Mycobacterium
TVDN

SEQ ID NO: 1175816 - protein, 8 aa, Mycobacterium
TVDPGDGS

SEQ ID NO: 1175817 - protein, 20 aa, Mycobacterium
TVDPTSSTTALTGSTEEGQF

SEQ ID NO: 1175818 - protein, 10 aa, Mycobacterium
TVDRDGVTGL

SEQ ID NO: 1175819 - protein, 8 aa, Mycobacterium
TVDRHDQR

SEQ ID NO: 1175820 - protein, 5 aa, Mycobacterium
TVEGQ

SEQ ID NO: 1175821 - protein, 5 aa, Mycobacterium
TVEPV

SEQ ID NO: 1175822 - protein, 8 aa, Mycobacterium
TVEPVDGA

SEQ ID NO: 1175823 - protein, 6 aa, Mycobacterium
TVESTG

SEQ ID NO: 1175824 - protein, 8 aa, Mycobacterium
TVGDETHR

SEQ ID NO: 1175825 - protein, 6 aa, Mycobacterium
TVGDGA

SEQ ID NO: 1175826 - protein, 10 aa, Mycobacterium
TVGDTSEATD

SEQ ID NO: 1175827 - protein, 5 aa, Mycobacterium
TVGEG

SEQ ID NO: 1175828 - protein, 9 aa, Mycobacterium
TVGEGDGAR

SEQ ID NO: 1175829 - protein, 6 aa, Mycobacterium
TVGGGA

SEQ ID NO: 1175830 - protein, 11 aa, Mycobacterium
TVGGNDQPEEW

SEQ ID NO: 1175831 - protein, 8 aa, Mycobacterium
TVGKPVPG

SEQ ID NO: 1175832 - protein, 10 aa, Mycobacterium
TVGNPTAKSA

SEQ ID NO: 1175833 - protein, 13 aa, Mycobacterium
TVGPRHELAMSLS

SEQ ID NO: 1175834 - protein, 8 aa, Mycobacterium
TVGQPGNR

SEQ ID NO: 1175835 - protein, 12 aa, Mycobacterium
TVGSGMTGKSSG

SEQ ID NO: 1175836 - protein, 6 aa, Mycobacterium
TVGSGR

SEQ ID NO: 1175837 - protein, 13 aa, Mycobacterium
TVHGDDELEKAAG

SEQ ID NO: 1175838 - protein, 12 aa, Mycobacterium
TVKDTDGNDIDT

SEQ ID NO: 1175839 - protein, 8 aa, Mycobacterium
TVNPDGAP

SEQ ID NO: 1175840 - protein, 28 aa, Mycobacterium
TVPATAPNPIEGPQMRSTSRVDPAAHQR

SEQ ID NO: 1175841 - protein, 5 aa, Mycobacterium
TVPEQ

SEQ ID NO: 1175842 - protein, 5 aa, Mycobacterium
TVPER

SEQ ID NO: 1175843 - protein, 12 aa, Mycobacterium
TVPGPIPPSGTG

SEQ ID NO: 1175844 - protein, 7 aa, Mycobacterium
TVPGPVG

SEQ ID NO: 1175845 - protein, 15 aa, Mycobacterium
TVPGSDQPSFDLGPD

SEQ ID NO: 1175846 - protein, 6 aa, Mycobacterium
TVPKGD

SEQ ID NO: 1175847 - protein, 6 aa, Mycobacterium
TVPQGA

SEQ ID NO: 1175848 - protein, 5 aa, Mycobacterium
TVPRS

SEQ ID NO: 1175849 - protein, 8 aa, Mycobacterium
TVPSDPAL

SEQ ID NO: 1175850 - protein, 10 aa, Mycobacterium
TVPTTGRSAT

SEQ ID NO: 1175851 - protein, 13 aa, Mycobacterium
TVQPPGKKPMNAA

SEQ ID NO: 1175852 - protein, 8 aa, Mycobacterium
TVRANPAA

SEQ ID NO: 1175853 - protein, 15 aa, Mycobacterium
TVRNDGDTTELGGTA

SEQ ID NO: 1175854 - protein, 7 aa, Mycobacterium
TVRSGPL

SEQ ID NO: 1175855 - protein, 29 aa, Mycobacterium
TVRTEDYSGAQLSAAARQDRAARGQSEVP

SEQ ID NO: 1175856 - protein, 11 aa, Mycobacterium
TVSAGEADRRG

SEQ ID NO: 1175857 - protein, 6 aa, Mycobacterium
TVSARG

SEQ ID NO: 1175858 - protein, 7 aa, Mycobacterium
TVSEGAE

SEQ ID NO: 1175859 - protein, 8 aa, Mycobacterium
TVSGRGTL

SEQ ID NO: 1175860 - protein, 4 aa, Mycobacterium
TVSP

SEQ ID NO: 1175861 - protein, 11 aa, Mycobacterium
TVTAPRGGTMG

SEQ ID NO: 1175862 - protein, 7 aa, Mycobacterium
TVTDPDG

SEQ ID NO: 1175863 - protein, 11 aa, Mycobacterium
TVTEHTATRTT

SEQ ID NO: 1175864 - protein, 10 aa, Mycobacterium
TVTGAGRGLG

SEQ ID NO: 1175865 - protein, 9 aa, Mycobacterium
TVTGEESKL

SEQ ID NO: 1175866 - protein, 5 aa, Mycobacterium
TVTGN

SEQ ID NO: 1175867 - protein, 6 aa, Mycobacterium
TVTGTA

SEQ ID NO: 1175868 - protein, 14 aa, Mycobacterium
TVTLPSAATPESQT

SEQ ID NO: 1175869 - protein, 8 aa, Mycobacterium
TVTPPAPA

SEQ ID NO: 1175870 - protein, 8 aa, Mycobacterium
TVTPQPDP

SEQ ID NO: 1175871 - protein, 6 aa, Mycobacterium
TVTSGS

SEQ ID NO: 1175872 - protein, 12 aa, Mycobacterium
TVTTGGAPNATV

SEQ ID NO: 1175873 - protein, 57 aa, Mycobacterium
TVTTPAPDPQAEPSTQQDSAIPAPPTDPSGPNIPPPPTNPAGPDTTAKSSAAKAAAQ

SEQ ID NO: 1175874 - protein, 9 aa, Mycobacterium
TVYKDSENF

SEQ ID NO: 1175875 - protein, 8 aa, Mycobacterium
TVYSGEPA

SEQ ID NO: 1175876 - protein, 4 aa, Mycobacterium
TWGE

SEQ ID NO: 1175877 - protein, 11 aa, Mycobacterium
TWGGSDPGLPE

SEQ ID NO: 1175878 - protein, 10 aa, Mycobacterium
TWSETSPAAH

SEQ ID NO: 1175879 - protein, 12 aa, Mycobacterium
TWSSGRSPASNN

SEQ ID NO: 1175880 - protein, 7 aa, Mycobacterium
TWTSPTA

SEQ ID NO: 1175881 - protein, 4 aa, Mycobacterium
TWTT

SEQ ID NO: 1175882 - protein, 8 aa, Mycobacterium
TYAAGRYG

SEQ ID NO: 1175883 - protein, 7 aa, Mycobacterium
TYADGTA

SEQ ID NO: 1175884 - protein, 5 aa, Mycobacterium
TYAPH

SEQ ID NO: 1175885 - protein, 9 aa, Mycobacterium
TYCESGSST

SEQ ID NO: 1175886 - protein, 8 aa, Mycobacterium
TYDPRTAQ

SEQ ID NO: 1175887 - protein, 12 aa, Mycobacterium
TYDSADGAFDGD

SEQ ID NO: 1175888 - protein, 5 aa, Mycobacterium
TYEPA

SEQ ID NO: 1175889 - protein, 7 aa, Mycobacterium
TYEPETS

SEQ ID NO: 1175890 - protein, 7 aa, Mycobacterium
TYESPGD

SEQ ID NO: 1175891 - protein, 6 aa, Mycobacterium
TYETEK

SEQ ID NO: 1175892 - protein, 8 aa, Mycobacterium
TYGDGGNS

SEQ ID NO: 1175893 - protein, 19 aa, Mycobacterium
TYGDRPPAETTQALRLAWS

SEQ ID NO: 1175894 - protein, 13 aa, Mycobacterium
TYGGSVAAGYQNP

SEQ ID NO: 1175895 - protein, 5 aa, Mycobacterium
TYGHS

SEQ ID NO: 1175896 - protein, 8 aa, Mycobacterium
TYGHTPGH

SEQ ID NO: 1175897 - protein, 12 aa, Mycobacterium
TYGSGDWGRTPH

SEQ ID NO: 1175898 - protein, 6 aa, Mycobacterium
TYGTMP

SEQ ID NO: 1175899 - protein, 5 aa, Mycobacterium
TYGVP

SEQ ID NO: 1175900 - protein, 12 aa, Mycobacterium
TYMNESGRNVGP

SEQ ID NO: 1175901 - protein, 15 aa, Mycobacterium
TYNEPNTNLTSPETT

SEQ ID NO: 1175902 - protein, 5 aa, Mycobacterium
TYNRG

SEQ ID NO: 1175903 - protein, 6 aa, Mycobacterium
TYPAGG

SEQ ID NO: 1175904 - protein, 6 aa, Mycobacterium
TYPDGA

SEQ ID NO: 1175905 - protein, 8 aa, Mycobacterium
TYQRSQDA

SEQ ID NO: 1175906 - protein, 16 aa, Mycobacterium
TYRPGARFGPNAIRQG

SEQ ID NO: 1175907 - protein, 10 aa, Mycobacterium
TYSGPGDDPE

SEQ ID NO: 1175908 - protein, 10 aa, Mycobacterium
TYTTSDGEVA

SEQ ID NO: 1175909 - protein, 6 aa, Mycobacterium
VAADGA

SEQ ID NO: 1175910 - protein, 7 aa, Mycobacterium
VAAEAAA

SEQ ID NO: 1175911 - protein, 8 aa, Mycobacterium
VAAGRAGD

SEQ ID NO: 1175912 - protein, 48 aa, Mycobacterium
VAAPPAPAPLPEPEPEPEPAPEPAAGPEPEAPKPAKPRKGKARPTVPG

SEQ ID NO: 1175913 - protein, 8 aa, Mycobacterium
VAAPPGLS

SEQ ID NO: 1175914 - protein, 5 aa, Mycobacterium
VAAPR

SEQ ID NO: 1175915 - protein, 8 aa, Mycobacterium
VAAPTTGE

SEQ ID NO: 1175916 - protein, 6 aa, Mycobacterium
VAARDD

SEQ ID NO: 1175917 - protein, 10 aa, Mycobacterium
VAARDREAAR

SEQ ID NO: 1175918 - protein, 9 aa, Mycobacterium
VAASTPKGA

SEQ ID NO: 1175919 - protein, 8 aa, Mycobacterium
VADAGDPR

SEQ ID NO: 1175920 - protein, 5 aa, Mycobacterium
VADAP

SEQ ID NO: 1175921 - protein, 9 aa, Mycobacterium
VADATEDRP

SEQ ID NO: 1175922 - protein, 8 aa, Mycobacterium
VADDPQRG

SEQ ID NO: 1175923 - protein, 10 aa, Mycobacterium
VADDPVTEAE

SEQ ID NO: 1175924 - protein, 9 aa, Mycobacterium
VADEAAKAT

SEQ ID NO: 1175925 - protein, 4 aa, Mycobacterium
VADG

SEQ ID NO: 1175926 - protein, 7 aa, Mycobacterium
VADGGGG

SEQ ID NO: 1175927 - protein, 10 aa, Mycobacterium
VADGPPAETV

SEQ ID NO: 1175928 - protein, 12 aa, Mycobacterium
VADHDDGRAPLV

SEQ ID NO: 1175929 - protein, 9 aa, Mycobacterium
VADNAKSLA

SEQ ID NO: 1175930 - protein, 7 aa, Mycobacterium
VADNQRA

SEQ ID NO: 1175931 - protein, 8 aa, Mycobacterium
VADPGAAR

SEQ ID NO: 1175932 - protein, 7 aa, Mycobacterium
VADPGGG

SEQ ID NO: 1175933 - protein, 12 aa, Mycobacterium
VADPPKDKADRD

SEQ ID NO: 1175934 - protein, 7 aa, Mycobacterium
VADPRDI

SEQ ID NO: 1175935 - protein, 8 aa, Mycobacterium
VADPRPRI

SEQ ID NO: 1175936 - protein, 5 aa, Mycobacterium
VADPS

SEQ ID NO: 1175937 - protein, 10 aa, Mycobacterium
VADPSHGGSA

SEQ ID NO: 1175938 - protein, 10 aa, Mycobacterium
VADPSPPPGG

SEQ ID NO: 1175939 - protein, 8 aa, Mycobacterium
VADQGTVG

SEQ ID NO: 1175940 - protein, 6 aa, Mycobacterium
VADQSE

SEQ ID NO: 1175941 - protein, 9 aa, Mycobacterium
VADRSGADR

SEQ ID NO: 1175942 - protein, 21 aa, Mycobacterium
VADSADADDFRSRVSDSENAS

SEQ ID NO: 1175943 - protein, 8 aa, Mycobacterium
VADSGDDL

SEQ ID NO: 1175944 - protein, 6 aa, Mycobacterium
VAEAGR

SEQ ID NO: 1175945 - protein, 12 aa, Mycobacterium
VAEAPENPESEK

SEQ ID NO: 1175946 - protein, 7 aa, Mycobacterium
VAEASDE

SEQ ID NO: 1175947 - protein, 15 aa, Mycobacterium
VAEDGTYTSPIENPN

SEQ ID NO: 1175948 - protein, 7 aa, Mycobacterium
VAEEHDG

SEQ ID NO: 1175949 - protein, 6 aa, Mycobacterium
VAENPR

SEQ ID NO: 1175950 - protein, 16 aa, Mycobacterium
VAEPDSAESTVSPSFD

SEQ ID NO: 1175951 - protein, 11 aa, Mycobacterium
VAEPQAAGTDV

SEQ ID NO: 1175952 - protein, 7 aa, Mycobacterium
VAEPRKE

SEQ ID NO: 1175953 - protein, 7 aa, Mycobacterium
VAEPSPL

SEQ ID NO: 1175954 - protein, 11 aa, Mycobacterium
VAEQVAKSRSM

SEQ ID NO: 1175955 - protein, 7 aa, Mycobacterium
VAESEEL

SEQ ID NO: 1175956 - protein, 7 aa, Mycobacterium
VAESERP

SEQ ID NO: 1175957 - protein, 11 aa, Mycobacterium
VAESHGKTAAQ

SEQ ID NO: 1175958 - protein, 6 aa, Mycobacterium
VAGASQ

SEQ ID NO: 1175959 - protein, 9 aa, Mycobacterium
VAGDTDTGV

SEQ ID NO: 1175960 - protein, 4 aa, Mycobacterium
VAGE

SEQ ID NO: 1175961 - protein, 12 aa, Mycobacterium
VAGEAKDAAKNV

SEQ ID NO: 1175962 - protein, 6 aa, Mycobacterium
VAGEAR

SEQ ID NO: 1175963 - protein, 13 aa, Mycobacterium
VAGGHSGTFTPDR

SEQ ID NO: 1175964 - protein, 12 aa, Mycobacterium
VAGGLDENNPAL

SEQ ID NO: 1175965 - protein, 6 aa, Mycobacterium
VAGGRP

SEQ ID NO: 1175966 - protein, 6 aa, Mycobacterium
VAGGSD

SEQ ID NO: 1175967 - protein, 7 aa, Mycobacterium
VAGHNGL

SEQ ID NO: 1175968 - protein, 11 aa, Mycobacterium
VAGKGSQARRA

SEQ ID NO: 1175969 - protein, 8 aa, Mycobacterium
VAGKPAGA

SEQ ID NO: 1175970 - protein, 7 aa, Mycobacterium
VAGPDGA

SEQ ID NO: 1175971 - protein, 11 aa, Mycobacterium
VAGPEPHGGHP

SEQ ID NO: 1175972 - protein, 8 aa, Mycobacterium
VAGPHGDG

SEQ ID NO: 1175973 - protein, 7 aa, Mycobacterium
VAGPSIA

SEQ ID NO: 1175974 - protein, 7 aa, Mycobacterium
VAGQARE

SEQ ID NO: 1175975 - protein, 7 aa, Mycobacterium
VAGRPGA

SEQ ID NO: 1175976 - protein, 12 aa, Mycobacterium
VAGRPTTARRDA

SEQ ID NO: 1175977 - protein, 9 aa, Mycobacterium
VAGRSADEI

SEQ ID NO: 1175978 - protein, 22 aa, Mycobacterium
VAGRTASGALLGPGAGDNAAAA

SEQ ID NO: 1175979 - protein, 6 aa, Mycobacterium
VAGSPK

SEQ ID NO: 1175980 - protein, 4 aa, Mycobacterium
VAGT

SEQ ID NO: 1175981 - protein, 9 aa, Mycobacterium
VAGTTGYDA

SEQ ID NO: 1175982 - protein, 14 aa, Mycobacterium
VAKEALKEKKTIRQ

SEQ ID NO: 1175983 - protein, 4 aa, Mycobacterium
VAND

SEQ ID NO: 1175984 - protein, 9 aa, Mycobacterium
VAPADEAVA

SEQ ID NO: 1175985 - protein, 6 aa, Mycobacterium
VAPAVA

SEQ ID NO: 1175986 - protein, 4 aa, Mycobacterium
VAPD

SEQ ID NO: 1175987 - protein, 10 aa, Mycobacterium
VAPDDPDSYY

SEQ ID NO: 1175988 - protein, 6 aa, Mycobacterium
VAPDDT

SEQ ID NO: 1175989 - protein, 7 aa, Mycobacterium
VAPDGQV

SEQ ID NO: 1175990 - protein, 6 aa, Mycobacterium
VAPDGS

SEQ ID NO: 1175991 - protein, 12 aa, Mycobacterium
VAPDGTPYDATD

SEQ ID NO: 1175992 - protein, 8 aa, Mycobacterium
VAPDHPKI

SEQ ID NO: 1175993 - protein, 10 aa, Mycobacterium
VAPDHQSTKR

SEQ ID NO: 1175994 - protein, 6 aa, Mycobacterium
VAPDRP

SEQ ID NO: 1175995 - protein, 11 aa, Mycobacterium
VAPEAKAEART

SEQ ID NO: 1175996 - protein, 7 aa, Mycobacterium
VAPGEDA

SEQ ID NO: 1175997 - protein, 6 aa, Mycobacterium
VAPGER

SEQ ID NO: 1175998 - protein, 8 aa, Mycobacterium
VAPGGGRR

SEQ ID NO: 1175999 - protein, 7 aa, Mycobacterium
VAPGGYT

SEQ ID NO: 1176000 - protein, 7 aa, Mycobacterium
VAPGNPD

SEQ ID NO: 1176001 - protein, 19 aa, Mycobacterium
VAPGPIATDMNPAEGEFAD

SEQ ID NO: 1176002 - protein, 11 aa, Mycobacterium
VAPGPTRTEGV

SEQ ID NO: 1176003 - protein, 7 aa, Mycobacterium
VAPGTST

SEQ ID NO: 1176004 - protein, 10 aa, Mycobacterium
VAPNGAGKST

SEQ ID NO: 1176005 - protein, 13 aa, Mycobacterium
VAPNRRPYETKDG

SEQ ID NO: 1176006 - protein, 8 aa, Mycobacterium
VAPNSEDT

SEQ ID NO: 1176007 - protein, 11 aa, Mycobacterium
VAPPGQGLPIE

SEQ ID NO: 1176008 - protein, 6 aa, Mycobacterium
VAPPPA

SEQ ID NO: 1176009 - protein, 6 aa, Mycobacterium
VAPPRS

SEQ ID NO: 1176010 - protein, 8 aa, Mycobacterium
VAPQPDQL

SEQ ID NO: 1176011 - protein, 9 aa, Mycobacterium
VAPRDTGLG

SEQ ID NO: 1176012 - protein, 10 aa, Mycobacterium
VAPRRHPNGA

SEQ ID NO: 1176013 - protein, 4 aa, Mycobacterium
VAPS

SEQ ID NO: 1176014 - protein, 16 aa, Mycobacterium
VAPSDPYHSDEGEAPE

SEQ ID NO: 1176015 - protein, 7 aa, Mycobacterium
VAPSETV

SEQ ID NO: 1176016 - protein, 7 aa, Mycobacterium
VAPSGVH

SEQ ID NO: 1176017 - protein, 5 aa, Mycobacterium
VAPTA

SEQ ID NO: 1176018 - protein, 6 aa, Mycobacterium
VAPTGR

SEQ ID NO: 1176019 - protein, 7 aa, Mycobacterium
VAPTQEG

SEQ ID NO: 1176020 - protein, 8 aa, Mycobacterium
VAPTTRAY

SEQ ID NO: 1176021 - protein, 9 aa, Mycobacterium
VAQARTEAV

SEQ ID NO: 1176022 - protein, 13 aa, Mycobacterium
VAQDGPARADNPA

SEQ ID NO: 1176023 - protein, 5 aa, Mycobacterium
VAQGR

SEQ ID NO: 1176024 - protein, 13 aa, Mycobacterium
VAQPSEPDKVDSA

SEQ ID NO: 1176025 - protein, 10 aa, Mycobacterium
VARAKSAQRT

SEQ ID NO: 1176026 - protein, 5 aa, Mycobacterium
VARDD

SEQ ID NO: 1176027 - protein, 8 aa, Mycobacterium
VARGDIGT

SEQ ID NO: 1176028 - protein, 10 aa, Mycobacterium
VARGGGRASY

SEQ ID NO: 1176029 - protein, 10 aa, Mycobacterium
VARHDPASLK

SEQ ID NO: 1176030 - protein, 9 aa, Mycobacterium
VARRGRQGA

SEQ ID NO: 1176031 - protein, 4 aa, Mycobacterium
VARS

SEQ ID NO: 1176032 - protein, 8 aa, Mycobacterium
VARSRSDA

SEQ ID NO: 1176033 - protein, 6 aa, Mycobacterium
VARTGM

SEQ ID NO: 1176034 - protein, 17 aa, Mycobacterium
VASADAARAVTEGDERQ

SEQ ID NO: 1176035 - protein, 5 aa, Mycobacterium
VASAR

SEQ ID NO: 1176036 - protein, 13 aa, Mycobacterium
VASATSSVPPHRR

SEQ ID NO: 1176037 - protein, 14 aa, Mycobacterium
VASETPGSIHEGGE

SEQ ID NO: 1176038 - protein, 15 aa, Mycobacterium
VASEVTTSDDTEESP

SEQ ID NO: 1176039 - protein, 6 aa, Mycobacterium
VASGAL

SEQ ID NO: 1176040 - protein, 7 aa, Mycobacterium
VASGAQD

SEQ ID NO: 1176041 - protein, 6 aa, Mycobacterium
VASKRG

SEQ ID NO: 1176042 - protein, 9 aa, Mycobacterium
VASKRGAEL

SEQ ID NO: 1176043 - protein, 7 aa, Mycobacterium
VASPAPG

SEQ ID NO: 1176044 - protein, 16 aa, Mycobacterium
VASSTRPDAQAKGLGE

SEQ ID NO: 1176045 - protein, 4 aa, Mycobacterium
VASY

SEQ ID NO: 1176046 - protein, 7 aa, Mycobacterium
VATAAAQ

SEQ ID NO: 1176047 - protein, 15 aa, Mycobacterium
VATDRSPDRVTGNEI

SEQ ID NO: 1176048 - protein, 8 aa, Mycobacterium
VATDSSDG

SEQ ID NO: 1176049 - protein, 25 aa, Mycobacterium
VATGLTGRPYRSIPEPAPRSTHGPA

SEQ ID NO: 1176050 - protein, 6 aa, Mycobacterium
VATGRD

SEQ ID NO: 1176051 - protein, 6 aa, Mycobacterium
VATGTA

SEQ ID NO: 1176052 - protein, 4 aa, Mycobacterium
VATP

SEQ ID NO: 1176053 - protein, 7 aa, Mycobacterium
VATPGAV

SEQ ID NO: 1176054 - protein, 7 aa, Mycobacterium
VATRAAE

SEQ ID NO: 1176055 - protein, 7 aa, Mycobacterium
VATRAGA

SEQ ID NO: 1176056 - protein, 8 aa, Mycobacterium
VATRAPDA

SEQ ID NO: 1176057 - protein, 6 aa, Mycobacterium
VATSGE

SEQ ID NO: 1176058 - protein, 10 aa, Mycobacterium
VATSSRTPVF

SEQ ID NO: 1176059 - protein, 10 aa, Mycobacterium
VAVTDDGRPL

SEQ ID NO: 1176060 - protein, 7 aa, Mycobacterium
VDAADGV

SEQ ID NO: 1176061 - protein, 7 aa, Mycobacterium
VDAASRQ

SEQ ID NO: 1176062 - protein, 17 aa, Mycobacterium
VDAATEHLTEESAAAAS

SEQ ID NO: 1176063 - protein, 5 aa, Mycobacterium
VDADS

SEQ ID NO: 1176064 - protein, 7 aa, Mycobacterium
VDAEDAW

SEQ ID NO: 1176065 - protein, 10 aa, Mycobacterium
VDAEPEDADD

SEQ ID NO: 1176066 - protein, 8 aa, Mycobacterium
VDAESADL

SEQ ID NO: 1176067 - protein, 4 aa, Mycobacterium
VDAG

SEQ ID NO: 1176068 - protein, 7 aa, Mycobacterium
VDAGDPL

SEQ ID NO: 1176069 - protein, 8 aa, Mycobacterium
VDANGMSS

SEQ ID NO: 1176070 - protein, 9 aa, Mycobacterium
VDANSRPRS

SEQ ID NO: 1176071 - protein, 5 aa, Mycobacterium
VDAPA

SEQ ID NO: 1176072 - protein, 7 aa, Mycobacterium
VDAPGSG

SEQ ID NO: 1176073 - protein, 9 aa, Mycobacterium
VDAPPGGGF

SEQ ID NO: 1176074 - protein, 11 aa, Mycobacterium
VDAPTAESAAE

SEQ ID NO: 1176075 - protein, 6 aa, Mycobacterium
VDAPTV

SEQ ID NO: 1176076 - protein, 8 aa, Mycobacterium
VDAQPGQI

SEQ ID NO: 1176077 - protein, 8 aa, Mycobacterium
VDARGTPG

SEQ ID NO: 1176078 - protein, 4 aa, Mycobacterium
VDDA

SEQ ID NO: 1176079 - protein, 7 aa, Mycobacterium
VDDAEQL

SEQ ID NO: 1176080 - protein, 11 aa, Mycobacterium
VDDAPYGGGPG

SEQ ID NO: 1176081 - protein, 8 aa, Mycobacterium
VDDATAAK

SEQ ID NO: 1176082 - protein, 6 aa, Mycobacterium
VDDDIR

SEQ ID NO: 1176083 - protein, 8 aa, Mycobacterium
VDDDTAQG

SEQ ID NO: 1176084 - protein, 12 aa, Mycobacterium
VDDEPGTQPASL

SEQ ID NO: 1176085 - protein, 10 aa, Mycobacterium
VDDGEDADGG

SEQ ID NO: 1176086 - protein, 6 aa, Mycobacterium
VDDGGA

SEQ ID NO: 1176087 - protein, 8 aa, Mycobacterium
VDDGPDED

SEQ ID NO: 1176088 - protein, 6 aa, Mycobacterium
VDDGVT

SEQ ID NO: 1176089 - protein, 6 aa, Mycobacterium
VDDNGA

SEQ ID NO: 1176090 - protein, 5 aa, Mycobacterium
VDDPD

SEQ ID NO: 1176091 - protein, 11 aa, Mycobacterium
VDDPGAPEALQ

SEQ ID NO: 1176092 - protein, 7 aa, Mycobacterium
VDDPRQN

SEQ ID NO: 1176093 - protein, 8 aa, Mycobacterium
VDDPTGDA

SEQ ID NO: 1176094 - protein, 7 aa, Mycobacterium
VDDPTGY

SEQ ID NO: 1176095 - protein, 7 aa, Mycobacterium
VDDSQLD

SEQ ID NO: 1176096 - protein, 5 aa, Mycobacterium
VDDYP

SEQ ID NO: 1176097 - protein, 8 aa, Mycobacterium
VDEAGAAD

SEQ ID NO: 1176098 - protein, 9 aa, Mycobacterium
VDEARGDAG

SEQ ID NO: 1176099 - protein, 4 aa, Mycobacterium
VDED

SEQ ID NO: 1176100 - protein, 24 aa, Mycobacterium
VDEEATARAVDQAAQQAAERARAA

SEQ ID NO: 1176101 - protein, 4 aa, Mycobacterium
VDEG

SEQ ID NO: 1176102 - protein, 10 aa, Mycobacterium
VDEGPRESTL

SEQ ID NO: 1176103 - protein, 7 aa, Mycobacterium
VDEPRDV

SEQ ID NO: 1176104 - protein, 7 aa, Mycobacterium
VDEPTAI

SEQ ID NO: 1176105 - protein, 4 aa, Mycobacterium
VDGA

SEQ ID NO: 1176106 - protein, 12 aa, Mycobacterium
VDGADDAEGLGP

SEQ ID NO: 1176107 - protein, 5 aa, Mycobacterium
VDGAP

SEQ ID NO: 1176108 - protein, 4 aa, Mycobacterium
VDGC

SEQ ID NO: 1176109 - protein, 8 aa, Mycobacterium
VDGDRTNI

SEQ ID NO: 1176110 - protein, 7 aa, Mycobacterium
VDGDSVR

SEQ ID NO: 1176111 - protein, 9 aa, Mycobacterium
VDGEPSPGV

SEQ ID NO: 1176112 - protein, 9 aa, Mycobacterium
VDGERLTSA

SEQ ID NO: 1176113 - protein, 6 aa, Mycobacterium
VDGGNE

SEQ ID NO: 1176114 - protein, 8 aa, Mycobacterium
VDGGTEVT

SEQ ID NO: 1176115 - protein, 7 aa, Mycobacterium
VDGGYGS

SEQ ID NO: 1176116 - protein, 12 aa, Mycobacterium
VDGHPDASGPSY

SEQ ID NO: 1176117 - protein, 10 aa, Mycobacterium
VDGKRLTDEE

SEQ ID NO: 1176118 - protein, 10 aa, Mycobacterium
VDGKTKEDFG

SEQ ID NO: 1176119 - protein, 25 aa, Mycobacterium
VDGPAVNAPADVPPGATVAAGSPDH

SEQ ID NO: 1176120 - protein, 14 aa, Mycobacterium
VDGPVPSYPAPDGV

SEQ ID NO: 1176121 - protein, 10 aa, Mycobacterium
VDGQRLTSGE

SEQ ID NO: 1176122 - protein, 12 aa, Mycobacterium
VDGRERSSDEMQ

SEQ ID NO: 1176123 - protein, 8 aa, Mycobacterium
VDGRPGGQ

SEQ ID NO: 1176124 - protein, 8 aa, Mycobacterium
VDGRPPED

SEQ ID NO: 1176125 - protein, 24 aa, Mycobacterium
VDGRRGASEYHREEGNVKQAAMRS

SEQ ID NO: 1176126 - protein, 6 aa, Mycobacterium
VDGSDY

SEQ ID NO: 1176127 - protein, 9 aa, Mycobacterium
VDGTGADRF

SEQ ID NO: 1176128 - protein, 10 aa, Mycobacterium
VDHSSDGHHP

SEQ ID NO: 1176129 - protein, 8 aa, Mycobacterium
VDKDGKDV

SEQ ID NO: 1176130 - protein, 13 aa, Mycobacterium
VDKPRNLAKSVTV

SEQ ID NO: 1176131 - protein, 9 aa, Mycobacterium
VDLSDPASF

SEQ ID NO: 1176132 - protein, 4 aa, Mycobacterium
VDLT

SEQ ID NO: 1176133 - protein, 6 aa, Mycobacterium
VDNDPE

SEQ ID NO: 1176134 - protein, 10 aa, Mycobacterium
VDNPTTEEVS

SEQ ID NO: 1176135 - protein, 12 aa, Mycobacterium
VDNSERTFRDGA

SEQ ID NO: 1176136 - protein, 8 aa, Mycobacterium
VDPAGRRA

SEQ ID NO: 1176137 - protein, 8 aa, Mycobacterium
VDPAPGCG

SEQ ID NO: 1176138 - protein, 5 aa, Mycobacterium
VDPDA

SEQ ID NO: 1176139 - protein, 8 aa, Mycobacterium
VDPDADWD

SEQ ID NO: 1176140 - protein, 12 aa, Mycobacterium
VDPDGADVGATA

SEQ ID NO: 1176141 - protein, 9 aa, Mycobacterium
VDPDGSAAH

SEQ ID NO: 1176142 - protein, 7 aa, Mycobacterium
VDPDNPA

SEQ ID NO: 1176143 - protein, 6 aa, Mycobacterium
VDPDTD

SEQ ID NO: 1176144 - protein, 13 aa, Mycobacterium
VDPDTGAAKTPGL

SEQ ID NO: 1176145 - protein, 4 aa, Mycobacterium
VDPE

SEQ ID NO: 1176146 - protein, 6 aa, Mycobacterium
VDPEDV

SEQ ID NO: 1176147 - protein, 16 aa, Mycobacterium
VDPEEDARLLEAISRC

SEQ ID NO: 1176148 - protein, 7 aa, Mycobacterium
VDPERGE

SEQ ID NO: 1176149 - protein, 7 aa, Mycobacterium
VDPEYDR

SEQ ID NO: 1176150 - protein, 6 aa, Mycobacterium
VDPFEE

SEQ ID NO: 1176151 - protein, 6 aa, Mycobacterium
VDPGAV

SEQ ID NO: 1176152 - protein, 5 aa, Mycobacterium
VDPGD

SEQ ID NO: 1176153 - protein, 16 aa, Mycobacterium
VDPHRPHPFTDGGNTE

SEQ ID NO: 1176154 - protein, 5 aa, Mycobacterium
VDPMD

SEQ ID NO: 1176155 - protein, 18 aa, Mycobacterium
VDPNTGEEITAQNGRYGP

SEQ ID NO: 1176156 - protein, 19 aa, Mycobacterium
VDPPADPLEEEVLAPPPQG

SEQ ID NO: 1176157 - protein, 14 aa, Mycobacterium
VDPPARRHDDAQDL

SEQ ID NO: 1176158 - protein, 18 aa, Mycobacterium
VDPPPDTVYGGGSARAPW

SEQ ID NO: 1176159 - protein, 4 aa, Mycobacterium
VDPQ

SEQ ID NO: 1176160 - protein, 11 aa, Mycobacterium
VDPRAADRARR

SEQ ID NO: 1176161 - protein, 6 aa, Mycobacterium
VDPRRA

SEQ ID NO: 1176162 - protein, 9 aa, Mycobacterium
VDPRRGSDP

SEQ ID NO: 1176163 - protein, 9 aa, Mycobacterium
VDPSADSTT

SEQ ID NO: 1176164 - protein, 10 aa, Mycobacterium
VDPSPGEDDA

SEQ ID NO: 1176165 - protein, 6 aa, Mycobacterium
VDPSVG

SEQ ID NO: 1176166 - protein, 12 aa, Mycobacterium
VDPTVGTGEHSR

SEQ ID NO: 1176167 - protein, 24 aa, Mycobacterium
VDQNGGVATADVTATAATGGTATQ

SEQ ID NO: 1176168 - protein, 7 aa, Mycobacterium
VDQPGVT

SEQ ID NO: 1176169 - protein, 8 aa, Mycobacterium
VDQPPYEP

SEQ ID NO: 1176170 - protein, 5 aa, Mycobacterium
VDQSC

SEQ ID NO: 1176171 - protein, 9 aa, Mycobacterium
VDQSRIGEG

SEQ ID NO: 1176172 - protein, 5 aa, Mycobacterium
VDRAK

SEQ ID NO: 1176173 - protein, 9 aa, Mycobacterium
VDREDPNVQ

SEQ ID NO: 1176174 - protein, 16 aa, Mycobacterium
VDREETTARRNRERAR

SEQ ID NO: 1176175 - protein, 5 aa, Mycobacterium
VDRGP

SEQ ID NO: 1176176 - protein, 12 aa, Mycobacterium
VDRKGRSRNVTD

SEQ ID NO: 1176177 - protein, 11 aa, Mycobacterium
VDRNETEAEEL

SEQ ID NO: 1176178 - protein, 9 aa, Mycobacterium
VDRPAKDGD

SEQ ID NO: 1176179 - protein, 13 aa, Mycobacterium
VDRSAPPRPVHGA

SEQ ID NO: 1176180 - protein, 10 aa, Mycobacterium
VDRTSSGTGV

SEQ ID NO: 1176181 - protein, 4 aa, Mycobacterium
VDSD

SEQ ID NO: 1176182 - protein, 9 aa, Mycobacterium
VDSDRPLSE

SEQ ID NO: 1176183 - protein, 7 aa, Mycobacterium
VDSPDEV

SEQ ID NO: 1176184 - protein, 9 aa, Mycobacterium
VDSPPTDTR

SEQ ID NO: 1176185 - protein, 7 aa, Mycobacterium
VDSPRPW

SEQ ID NO: 1176186 - protein, 17 aa, Mycobacterium
VDSPYEAGGQRGAITEA

SEQ ID NO: 1176187 - protein, 17 aa, Mycobacterium
VDSQDGPARGPGATHTP

SEQ ID NO: 1176188 - protein, 7 aa, Mycobacterium
VDSQTGE

SEQ ID NO: 1176189 - protein, 4 aa, Mycobacterium
VDSR

SEQ ID NO: 1176190 - protein, 10 aa, Mycobacterium
VDSSGLPDTP

SEQ ID NO: 1176191 - protein, 8 aa, Mycobacterium
VDTAADVE

SEQ ID NO: 1176192 - protein, 18 aa, Mycobacterium
VDTATAPLAPAVSPRAPV

SEQ ID NO: 1176193 - protein, 9 aa, Mycobacterium
VDTEAEQQL

SEQ ID NO: 1176194 - protein, 14 aa, Mycobacterium
VDTEARTAIWQWSR

SEQ ID NO: 1176195 - protein, 10 aa, Mycobacterium
VDTERGEADA

SEQ ID NO: 1176196 - protein, 21 aa, Mycobacterium
VDTGRPLADSVAEAQQICCLA

SEQ ID NO: 1176197 - protein, 7 aa, Mycobacterium
VDTGSST

SEQ ID NO: 1176198 - protein, 19 aa, Mycobacterium
VDTGTDLDTTKRSTEHTEE

SEQ ID NO: 1176199 - protein, 15 aa, Mycobacterium
VDTPDGAKNAVGRAR

SEQ ID NO: 1176200 - protein, 8 aa, Mycobacterium
VDTPDGRR

SEQ ID NO: 1176201 - protein, 11 aa, Mycobacterium
VDTPPQTTRAK

SEQ ID NO: 1176202 - protein, 5 aa, Mycobacterium
VDTPV

SEQ ID NO: 1176203 - protein, 8 aa, Mycobacterium
VDTQAERD

SEQ ID NO: 1176204 - protein, 11 aa, Mycobacterium
VDTQKRPQGHP

SEQ ID NO: 1176205 - protein, 4 aa, Mycobacterium
VDTS

SEQ ID NO: 1176206 - protein, 10 aa, Mycobacterium
VDTTEPGLPI

SEQ ID NO: 1176207 - protein, 15 aa, Mycobacterium
VDTTERRMRAGAGAT

SEQ ID NO: 1176208 - protein, 6 aa, Mycobacterium
VDTTPR

SEQ ID NO: 1176209 - protein, 6 aa, Mycobacterium
VDVSDD

SEQ ID NO: 1176210 - protein, 12 aa, Mycobacterium
VDYTPPSGPVDS

SEQ ID NO: 1176211 - protein, 9 aa, Mycobacterium
VEAADKAGF

SEQ ID NO: 1176212 - protein, 8 aa, Mycobacterium
VEAAGGKA

SEQ ID NO: 1176213 - protein, 8 aa, Mycobacterium
VEAAGPRL

SEQ ID NO: 1176214 - protein, 8 aa, Mycobacterium
VEAAPLTD

SEQ ID NO: 1176215 - protein, 8 aa, Mycobacterium
VEAGQRNA

SEQ ID NO: 1176216 - protein, 7 aa, Mycobacterium
VEALQGT

SEQ ID NO: 1176217 - protein, 12 aa, Mycobacterium
VEARPPESAGGY

SEQ ID NO: 1176218 - protein, 4 aa, Mycobacterium
VEAT

SEQ ID NO: 1176219 - protein, 9 aa, Mycobacterium
VEATGTQEK

SEQ ID NO: 1176220 - protein, 12 aa, Mycobacterium
VEDAGTADPSGL

SEQ ID NO: 1176221 - protein, 6 aa, Mycobacterium
VEDGRE

SEQ ID NO: 1176222 - protein, 9 aa, Mycobacterium
VEDGRGEQA

SEQ ID NO: 1176223 - protein, 11 aa, Mycobacterium
VEDPGTQAHSV

SEQ ID NO: 1176224 - protein, 8 aa, Mycobacterium
VEDPRLST

SEQ ID NO: 1176225 - protein, 10 aa, Mycobacterium
VEDRDPSGFA

SEQ ID NO: 1176226 - protein, 10 aa, Mycobacterium
VEDSGGEGLA

SEQ ID NO: 1176227 - protein, 8 aa, Mycobacterium
VEDTSAPA

SEQ ID NO: 1176228 - protein, 12 aa, Mycobacterium
VEEAAETAERAG

SEQ ID NO: 1176229 - protein, 8 aa, Mycobacterium
VEEAEDAG

SEQ ID NO: 1176230 - protein, 10 aa, Mycobacterium
VEEAREIGRG

SEQ ID NO: 1176231 - protein, 13 aa, Mycobacterium
VEEEAGGSGEVQA

SEQ ID NO: 1176232 - protein, 7 aa, Mycobacterium
VEEGNNA

SEQ ID NO: 1176233 - protein, 18 aa, Mycobacterium
VEEGPSGLPPVHDGTATA

SEQ ID NO: 1176234 - protein, 12 aa, Mycobacterium
VEEGRSPADDFA

SEQ ID NO: 1176235 - protein, 11 aa, Mycobacterium
VEEKPLAEAAE

SEQ ID NO: 1176236 - protein, 8 aa, Mycobacterium
VEELSEGD

SEQ ID NO: 1176237 - protein, 7 aa, Mycobacterium
VEEMTPP

SEQ ID NO: 1176238 - protein, 5 aa, Mycobacterium
VEEPA

SEQ ID NO: 1176239 - protein, 7 aa, Mycobacterium
VEEPGIG

SEQ ID NO: 1176240 - protein, 12 aa, Mycobacterium
VEEPGSQSAEAT

SEQ ID NO: 1176241 - protein, 5 aa, Mycobacterium
VEETS

SEQ ID NO: 1176242 - protein, 8 aa, Mycobacterium
VEGASEPV

SEQ ID NO: 1176243 - protein, 8 aa, Mycobacterium
VEGDPDLQ

SEQ ID NO: 1176244 - protein, 10 aa, Mycobacterium
VEGEYSEIGG

SEQ ID NO: 1176245 - protein, 9 aa, Mycobacterium
VEGKGHDGK

SEQ ID NO: 1176246 - protein, 7 aa, Mycobacterium
VEGPEEL

SEQ ID NO: 1176247 - protein, 9 aa, Mycobacterium
VEGPTDDPD

SEQ ID NO: 1176248 - protein, 11 aa, Mycobacterium
VEGPTDDPQVN

SEQ ID NO: 1176249 - protein, 4 aa, Mycobacterium
VEGQ

SEQ ID NO: 1176250 - protein, 5 aa, Mycobacterium
VEGQQ

SEQ ID NO: 1176251 - protein, 11 aa, Mycobacterium
VEGRDTANMPR

SEQ ID NO: 1176252 - protein, 12 aa, Mycobacterium
VEGRQPAGEFGD

SEQ ID NO: 1176253 - protein, 6 aa, Mycobacterium
VEGSQD

SEQ ID NO: 1176254 - protein, 8 aa, Mycobacterium
VEGSRMTD

SEQ ID NO: 1176255 - protein, 11 aa, Mycobacterium
VEGTHDRVSTT

SEQ ID NO: 1176256 - protein, 17 aa, Mycobacterium
VEGTPYKEATAAELADR

SEQ ID NO: 1176257 - protein, 4 aa, Mycobacterium
VEKA

SEQ ID NO: 1176258 - protein, 8 aa, Mycobacterium
VEKAGRKA

SEQ ID NO: 1176259 - protein, 10 aa, Mycobacterium
VEKAGTFTQT

SEQ ID NO: 1176260 - protein, 13 aa, Mycobacterium
VEKARRSGEPDIS

SEQ ID NO: 1176261 - protein, 4 aa, Mycobacterium
VEKG

SEQ ID NO: 1176262 - protein, 9 aa, Mycobacterium
VEKGLTSKP

SEQ ID NO: 1176263 - protein, 27 aa, Mycobacterium
VEKRSSHKESHGGRKQAARLAKPSGTI

SEQ ID NO: 1176264 - protein, 5 aa, Mycobacterium
VEKTS

SEQ ID NO: 1176265 - protein, 11 aa, Mycobacterium
VEPAAGLPRRT

SEQ ID NO: 1176266 - protein, 11 aa, Mycobacterium
VEPAATAVNAD

SEQ ID NO: 1176267 - protein, 21 aa, Mycobacterium
VEPASIERAGSMAGYPAPPLQ

SEQ ID NO: 1176268 - protein, 4 aa, Mycobacterium
VEPD

SEQ ID NO: 1176269 - protein, 17 aa, Mycobacterium
VEPDAGAVQRADGRTAY

SEQ ID NO: 1176270 - protein, 6 aa, Mycobacterium
VEPEPE

SEQ ID NO: 1176271 - protein, 7 aa, Mycobacterium
VEPEPEP

SEQ ID NO: 1176272 - protein, 4 aa, Mycobacterium
VEPG

SEQ ID NO: 1176273 - protein, 5 aa, Mycobacterium
VEPGA

SEQ ID NO: 1176274 - protein, 6 aa, Mycobacterium
VEPGDT

SEQ ID NO: 1176275 - protein, 11 aa, Mycobacterium
VEPGGRADPVA

SEQ ID NO: 1176276 - protein, 7 aa, Mycobacterium
VEPGSAA

SEQ ID NO: 1176277 - protein, 7 aa, Mycobacterium
VEPHPRD

SEQ ID NO: 1176278 - protein, 12 aa, Mycobacterium
VEPHSTAPGTGF

SEQ ID NO: 1176279 - protein, 5 aa, Mycobacterium
VEPNT

SEQ ID NO: 1176280 - protein, 9 aa, Mycobacterium
VEPPEGDNT

SEQ ID NO: 1176281 - protein, 9 aa, Mycobacterium
VEPPEGDPL

SEQ ID NO: 1176282 - protein, 10 aa, Mycobacterium
VEPPSGDPAR

SEQ ID NO: 1176283 - protein, 4 aa, Mycobacterium
VEPS

SEQ ID NO: 1176284 - protein, 7 aa, Mycobacterium
VEPSPGE

SEQ ID NO: 1176285 - protein, 18 aa, Mycobacterium
VEPSVAKTKMPDSPVAGR

SEQ ID NO: 1176286 - protein, 4 aa, Mycobacterium
VEPT

SEQ ID NO: 1176287 - protein, 7 aa, Mycobacterium
VEQAGGQ

SEQ ID NO: 1176288 - protein, 11 aa, Mycobacterium
VEQGASSEAAR

SEQ ID NO: 1176289 - protein, 11 aa, Mycobacterium
VEQGDDTTGLP

SEQ ID NO: 1176290 - protein, 8 aa, Mycobacterium
VEQGDGDR

SEQ ID NO: 1176291 - protein, 11 aa, Mycobacterium
VEQIGTPTDIY

SEQ ID NO: 1176292 - protein, 7 aa, Mycobacterium
VEQPDGS

SEQ ID NO: 1176293 - protein, 9 aa, Mycobacterium
VEQPGQDNI

SEQ ID NO: 1176294 - protein, 9 aa, Mycobacterium
VEQPTRHEP

SEQ ID NO: 1176295 - protein, 19 aa, Mycobacterium
VEQTDAAAGALPGLTRPAA

SEQ ID NO: 1176296 - protein, 9 aa, Mycobacterium
VERATERPN

SEQ ID NO: 1176297 - protein, 5 aa, Mycobacterium
VERED

SEQ ID NO: 1176298 - protein, 5 aa, Mycobacterium
VERGE

SEQ ID NO: 1176299 - protein, 8 aa, Mycobacterium
VERGTGGN

SEQ ID NO: 1176300 - protein, 22 aa, Mycobacterium
VERPEGAGRPAPAAGPAIATRP

SEQ ID NO: 1176301 - protein, 12 aa, Mycobacterium
VERRDRNEQVVA

SEQ ID NO: 1176302 - protein, 13 aa, Mycobacterium
VERTSKERGNDYT

SEQ ID NO: 1176303 - protein, 8 aa, Mycobacterium
VESGNARA

SEQ ID NO: 1176304 - protein, 7 aa, Mycobacterium
VESGPDE

SEQ ID NO: 1176305 - protein, 10 aa, Mycobacterium
VESGRDPDAV

SEQ ID NO: 1176306 - protein, 5 aa, Mycobacterium
VESGS

SEQ ID NO: 1176307 - protein, 14 aa, Mycobacterium
VESIKDEGGDGSVT

SEQ ID NO: 1176308 - protein, 10 aa, Mycobacterium
VESPGGRRQL

SEQ ID NO: 1176309 - protein, 7 aa, Mycobacterium
VESPRGE

SEQ ID NO: 1176310 - protein, 8 aa, Mycobacterium
VESRAGRV

SEQ ID NO: 1176311 - protein, 10 aa, Mycobacterium
VESTTGNGTA

SEQ ID NO: 1176312 - protein, 11 aa, Mycobacterium
VETDGGARSKR

SEQ ID NO: 1176313 - protein, 8 aa, Mycobacterium
VETGAGPH

SEQ ID NO: 1176314 - protein, 10 aa, Mycobacterium
VETPDAPTRD

SEQ ID NO: 1176315 - protein, 10 aa, Mycobacterium
VETPSPQAQT

SEQ ID NO: 1176316 - protein, 6 aa, Mycobacterium
VETTRG

SEQ ID NO: 1176317 - protein, 6 aa, Mycobacterium
VETTTY

SEQ ID NO: 1176318 - protein, 8 aa, Mycobacterium
VETVDDPE

SEQ ID NO: 1176319 - protein, 5 aa, Mycobacterium
VETVS

SEQ ID NO: 1176320 - protein, 9 aa, Mycobacterium
VEVDGKTER

SEQ ID NO: 1176321 - protein, 16 aa, Mycobacterium
VEVPPDPTTPASMSPE

SEQ ID NO: 1176322 - protein, 4 aa, Mycobacterium
VEVR

SEQ ID NO: 1176323 - protein, 7 aa, Mycobacterium
VEYTGPD

SEQ ID NO: 1176324 - protein, 4 aa, Mycobacterium
VGAA

SEQ ID NO: 1176325 - protein, 8 aa, Mycobacterium
VGAAPGRY

SEQ ID NO: 1176326 - protein, 22 aa, Mycobacterium
VGAAREAFDTGGWPRTSPAGRI

SEQ ID NO: 1176327 - protein, 8 aa, Mycobacterium
VGADARDG

SEQ ID NO: 1176328 - protein, 6 aa, Mycobacterium
VGADGP

SEQ ID NO: 1176329 - protein, 9 aa, Mycobacterium
VGAGSGKQI

SEQ ID NO: 1176330 - protein, 7 aa, Mycobacterium
VGAGTGV

SEQ ID NO: 1176331 - protein, 7 aa, Mycobacterium
VGANPDA

SEQ ID NO: 1176332 - protein, 12 aa, Mycobacterium
VGAPADSKPSVI

SEQ ID NO: 1176333 - protein, 14 aa, Mycobacterium
VGAPAPAPVTTGCA

SEQ ID NO: 1176334 - protein, 15 aa, Mycobacterium
VGARADEQIRQGTPL

SEQ ID NO: 1176335 - protein, 6 aa, Mycobacterium
VGATGG

SEQ ID NO: 1176336 - protein, 9 aa, Mycobacterium
VGATGKRGV

SEQ ID NO: 1176337 - protein, 11 aa, Mycobacterium
VGATSKGLSGQ

SEQ ID NO: 1176338 - protein, 8 aa, Mycobacterium
VGAYGQSK

SEQ ID NO: 1176339 - protein, 15 aa, Mycobacterium
VGDDPAAVAANRERL

SEQ ID NO: 1176340 - protein, 7 aa, Mycobacterium
VGDESQV

SEQ ID NO: 1176341 - protein, 14 aa, Mycobacterium
VGDGDTGPNTGGMG

SEQ ID NO: 1176342 - protein, 9 aa, Mycobacterium
VGDGTLSPG

SEQ ID NO: 1176343 - protein, 7 aa, Mycobacterium
VGDHRDG

SEQ ID NO: 1176344 - protein, 10 aa, Mycobacterium
VGDPAADGTL

SEQ ID NO: 1176345 - protein, 9 aa, Mycobacterium
VGDPARPLT

SEQ ID NO: 1176346 - protein, 10 aa, Mycobacterium
VGDPASPSTF

SEQ ID NO: 1176347 - protein, 6 aa, Mycobacterium
VGDPDN

SEQ ID NO: 1176348 - protein, 6 aa, Mycobacterium
VGDPTA

SEQ ID NO: 1176349 - protein, 7 aa, Mycobacterium
VGDPVDD

SEQ ID NO: 1176350 - protein, 7 aa, Mycobacterium
VGDQEQM

SEQ ID NO: 1176351 - protein, 8 aa, Mycobacterium
VGDQSSNI

SEQ ID NO: 1176352 - protein, 17 aa, Mycobacterium
VGDRAGAVATALREGIY

SEQ ID NO: 1176353 - protein, 9 aa, Mycobacterium
VGDSGSSPA

SEQ ID NO: 1176354 - protein, 6 aa, Mycobacterium
VGDSGV

SEQ ID NO: 1176355 - protein, 12 aa, Mycobacterium
VGEAAAATQGPG

SEQ ID NO: 1176356 - protein, 15 aa, Mycobacterium
VGEDGSIDVTTTQTL

SEQ ID NO: 1176357 - protein, 8 aa, Mycobacterium
VGEENKGW

SEQ ID NO: 1176358 - protein, 7 aa, Mycobacterium
VGEEQTA

SEQ ID NO: 1176359 - protein, 8 aa, Mycobacterium
VGEGPAQV

SEQ ID NO: 1176360 - protein, 7 aa, Mycobacterium
VGEGQAR

SEQ ID NO: 1176361 - protein, 10 aa, Mycobacterium
VGENDAAVRR

SEQ ID NO: 1176362 - protein, 7 aa, Mycobacterium
VGEPENR

SEQ ID NO: 1176363 - protein, 7 aa, Mycobacterium
VGEPGNR

SEQ ID NO: 1176364 - protein, 8 aa, Mycobacterium
VGEPGTGF

SEQ ID NO: 1176365 - protein, 17 aa, Mycobacterium
VGEPPQDVAALSHWPST

SEQ ID NO: 1176366 - protein, 12 aa, Mycobacterium
VGEREATRAEYK

SEQ ID NO: 1176367 - protein, 20 aa, Mycobacterium
VGESTGAAAVAQAGARAPMG

SEQ ID NO: 1176368 - protein, 6 aa, Mycobacterium
VGETQA

SEQ ID NO: 1176369 - protein, 15 aa, Mycobacterium
VGETRTYTVPSGSTV

SEQ ID NO: 1176370 - protein, 5 aa, Mycobacterium
VGEVG

SEQ ID NO: 1176371 - protein, 4 aa, Mycobacterium
VGGA

SEQ ID NO: 1176372 - protein, 10 aa, Mycobacterium
VGGAERPGQV

SEQ ID NO: 1176373 - protein, 6 aa, Mycobacterium
VGGAKN

SEQ ID NO: 1176374 - protein, 8 aa, Mycobacterium
VGGDAGAG

SEQ ID NO: 1176375 - protein, 13 aa, Mycobacterium
VGGDGPPAADPDA

SEQ ID NO: 1176376 - protein, 5 aa, Mycobacterium
VGGDP

SEQ ID NO: 1176377 - protein, 7 aa, Mycobacterium
VGGDRFT

SEQ ID NO: 1176378 - protein, 11 aa, Mycobacterium
VGGEDPPTRDE

SEQ ID NO: 1176379 - protein, 12 aa, Mycobacterium
VGGGGAPEVTLP

SEQ ID NO: 1176380 - protein, 15 aa, Mycobacterium
VGGGPGADDHDGRDV

SEQ ID NO: 1176381 - protein, 13 aa, Mycobacterium
VGGGRDDPKHRDE

SEQ ID NO: 1176382 - protein, 7 aa, Mycobacterium
VGGGSNA

SEQ ID NO: 1176383 - protein, 7 aa, Mycobacterium
VGGKPYG

SEQ ID NO: 1176384 - protein, 4 aa, Mycobacterium
VGGL

SEQ ID NO: 1176385 - protein, 8 aa, Mycobacterium
VGGNPTAF

SEQ ID NO: 1176386 - protein, 7 aa, Mycobacterium
VGGNTPQ

SEQ ID NO: 1176387 - protein, 8 aa, Mycobacterium
VGGPDASA

SEQ ID NO: 1176388 - protein, 8 aa, Mycobacterium
VGGPRSDA

SEQ ID NO: 1176389 - protein, 7 aa, Mycobacterium
VGGPSTW

SEQ ID NO: 1176390 - protein, 7 aa, Mycobacterium
VGGPTGD

SEQ ID NO: 1176391 - protein, 12 aa, Mycobacterium
VGGRGSGPVRVP

SEQ ID NO: 1176392 - protein, 5 aa, Mycobacterium
VGGRR

SEQ ID NO: 1176393 - protein, 9 aa, Mycobacterium
VGGRRDDQA

SEQ ID NO: 1176394 - protein, 10 aa, Mycobacterium
VGGSDDIAVT

SEQ ID NO: 1176395 - protein, 9 aa, Mycobacterium
VGGSGAAAA

SEQ ID NO: 1176396 - protein, 4 aa, Mycobacterium
VGGT

SEQ ID NO: 1176397 - protein, 7 aa, Mycobacterium
VGGTTMP

SEQ ID NO: 1176398 - protein, 7 aa, Mycobacterium
VGGYGNS

SEQ ID NO: 1176399 - protein, 5 aa, Mycobacterium
VGHAR

SEQ ID NO: 1176400 - protein, 19 aa, Mycobacterium
VGITGANSAEFDPATPDPV

SEQ ID NO: 1176401 - protein, 9 aa, Mycobacterium
VGKETADRL

SEQ ID NO: 1176402 - protein, 8 aa, Mycobacterium
VGKSTTAV

SEQ ID NO: 1176403 - protein, 18 aa, Mycobacterium
VGKTPSETAQLAREILQN

SEQ ID NO: 1176404 - protein, 4 aa, Mycobacterium
VGLD

SEQ ID NO: 1176405 - protein, 8 aa, Mycobacterium
VGLPDGKS

SEQ ID NO: 1176406 - protein, 5 aa, Mycobacterium
VGLTG

SEQ ID NO: 1176407 - protein, 6 aa, Mycobacterium
VGNAQK

SEQ ID NO: 1176408 - protein, 6 aa, Mycobacterium
VGNGEL

SEQ ID NO: 1176409 - protein, 6 aa, Mycobacterium
VGNQRH

SEQ ID NO: 1176410 - protein, 13 aa, Mycobacterium
VGNSTGSSGLETN

SEQ ID NO: 1176411 - protein, 6 aa, Mycobacterium
VGPARR

SEQ ID NO: 1176412 - protein, 13 aa, Mycobacterium
VGPATAAALGVAA

SEQ ID NO: 1176413 - protein, 4 aa, Mycobacterium
VGPD

SEQ ID NO: 1176414 - protein, 10 aa, Mycobacterium
VGPDDAPTRI

SEQ ID NO: 1176415 - protein, 21 aa, Mycobacterium
VGPDPANPGQSQTMPFEIKAP

SEQ ID NO: 1176416 - protein, 5 aa, Mycobacterium
VGPEN

SEQ ID NO: 1176417 - protein, 5 aa, Mycobacterium
VGPER

SEQ ID NO: 1176418 - protein, 7 aa, Mycobacterium
VGPFRAD

SEQ ID NO: 1176419 - protein, 6 aa, Mycobacterium
VGPGAG

SEQ ID NO: 1176420 - protein, 12 aa, Mycobacterium
VGPGDPGRRRSV

SEQ ID NO: 1176421 - protein, 17 aa, Mycobacterium
VGPGRDQTIVRRDVLAP

SEQ ID NO: 1176422 - protein, 11 aa, Mycobacterium
VGPGVEDLAPG

SEQ ID NO: 1176423 - protein, 6 aa, Mycobacterium
VGPGVT

SEQ ID NO: 1176424 - protein, 10 aa, Mycobacterium
VGPGVTEHQV

SEQ ID NO: 1176425 - protein, 4 aa, Mycobacterium
VGPH

SEQ ID NO: 1176426 - protein, 9 aa, Mycobacterium
VGPKQTALG

SEQ ID NO: 1176427 - protein, 7 aa, Mycobacterium
VGPPPTH

SEQ ID NO: 1176428 - protein, 11 aa, Mycobacterium
VGPPPVQVGGP

SEQ ID NO: 1176429 - protein, 13 aa, Mycobacterium
VGPPTGPHPRRAV

SEQ ID NO: 1176430 - protein, 7 aa, Mycobacterium
VGPRDEQ

SEQ ID NO: 1176431 - protein, 6 aa, Mycobacterium
VGPRLS

SEQ ID NO: 1176432 - protein, 6 aa, Mycobacterium
VGPRRA

SEQ ID NO: 1176433 - protein, 7 aa, Mycobacterium
VGPSYGT

SEQ ID NO: 1176434 - protein, 13 aa, Mycobacterium
VGPTLKPAEEAAA

SEQ ID NO: 1176435 - protein, 4 aa, Mycobacterium
VGPV

SEQ ID NO: 1176436 - protein, 4 aa, Mycobacterium
VGQA

SEQ ID NO: 1176437 - protein, 12 aa, Mycobacterium
VGQAEELRRNGA

SEQ ID NO: 1176438 - protein, 6 aa, Mycobacterium
VGQSEV

SEQ ID NO: 1176439 - protein, 13 aa, Mycobacterium
VGRDGERTQGGYS

SEQ ID NO: 1176440 - protein, 21 aa, Mycobacterium
VGRDPSAVERSSGVPESGKDA

SEQ ID NO: 1176441 - protein, 6 aa, Mycobacterium
VGRDTP

SEQ ID NO: 1176442 - protein, 4 aa, Mycobacterium
VGRG

SEQ ID NO: 1176443 - protein, 10 aa, Mycobacterium
VGRGADPARA

SEQ ID NO: 1176444 - protein, 8 aa, Mycobacterium
VGRGSPWA

SEQ ID NO: 1176445 - protein, 10 aa, Mycobacterium
VGRKLSDDGL

SEQ ID NO: 1176446 - protein, 10 aa, Mycobacterium
VGRNQGWAKE

SEQ ID NO: 1176447 - protein, 7 aa, Mycobacterium
VGRPDAY

SEQ ID NO: 1176448 - protein, 17 aa, Mycobacterium
VGRPGSSVTTDHDYKPT

SEQ ID NO: 1176449 - protein, 31 aa, Mycobacterium
VGRPPQGPTPPPDRWSGQTGPLESPAARTVR

SEQ ID NO: 1176450 - protein, 6 aa, Mycobacterium
VGRRQA

SEQ ID NO: 1176451 - protein, 9 aa, Mycobacterium
VGRTPVTGA

SEQ ID NO: 1176452 - protein, 4 aa, Mycobacterium
VGSD

SEQ ID NO: 1176453 - protein, 8 aa, Mycobacterium
VGSDEQKQ

SEQ ID NO: 1176454 - protein, 10 aa, Mycobacterium
VGSDGSVTNV

SEQ ID NO: 1176455 - protein, 19 aa, Mycobacterium
VGSDSGSPTSPDYGPHDNA

SEQ ID NO: 1176456 - protein, 11 aa, Mycobacterium
VGSDYRGDPAA

SEQ ID NO: 1176457 - protein, 18 aa, Mycobacterium
VGSEELGDCQAATTAYRP

SEQ ID NO: 1176458 - protein, 6 aa, Mycobacterium
VGSESA

SEQ ID NO: 1176459 - protein, 6 aa, Mycobacterium
VGSGAE

SEQ ID NO: 1176460 - protein, 9 aa, Mycobacterium
VGSGEVPDG

SEQ ID NO: 1176461 - protein, 8 aa, Mycobacterium
VGSGGASW

SEQ ID NO: 1176462 - protein, 10 aa, Mycobacterium
VGSGPDAGAT

SEQ ID NO: 1176463 - protein, 9 aa, Mycobacterium
VGSGPGNVT

SEQ ID NO: 1176464 - protein, 8 aa, Mycobacterium
VGSGTPAL

SEQ ID NO: 1176465 - protein, 7 aa, Mycobacterium
VGSPAEV

SEQ ID NO: 1176466 - protein, 11 aa, Mycobacterium
VGSPGQGAYAA

SEQ ID NO: 1176467 - protein, 13 aa, Mycobacterium
VGSSAHDAATPQF

SEQ ID NO: 1176468 - protein, 7 aa, Mycobacterium
VGSSDEV

SEQ ID NO: 1176469 - protein, 7 aa, Mycobacterium
VGSSQGL

SEQ ID NO: 1176470 - protein, 4 aa, Mycobacterium
VGST

SEQ ID NO: 1176471 - protein, 7 aa, Mycobacterium
VGTAEEV

SEQ ID NO: 1176472 - protein, 5 aa, Mycobacterium
VGTAP

SEQ ID NO: 1176473 - protein, 7 aa, Mycobacterium
VGTDNRR

SEQ ID NO: 1176474 - protein, 7 aa, Mycobacterium
VGTGAQL

SEQ ID NO: 1176475 - protein, 11 aa, Mycobacterium
VGTLGRRQPPV

SEQ ID NO: 1176476 - protein, 13 aa, Mycobacterium
VGTNPTFSGRTRT

SEQ ID NO: 1176477 - protein, 12 aa, Mycobacterium
VGTQTARAVGAE

SEQ ID NO: 1176478 - protein, 9 aa, Mycobacterium
VGTQTGDLK

SEQ ID NO: 1176479 - protein, 9 aa, Mycobacterium
VGTVDERGN

SEQ ID NO: 1176480 - protein, 12 aa, Mycobacterium
VGVEPTAVLVVS

SEQ ID NO: 1176481 - protein, 10 aa, Mycobacterium
VGVGDPPSEV

SEQ ID NO: 1176482 - protein, 6 aa, Mycobacterium
VGVSGP

SEQ ID NO: 1176483 - protein, 6 aa, Mycobacterium
VGVTAN

SEQ ID NO: 1176484 - protein, 14 aa, Mycobacterium
VGYGASGEHESFPG

SEQ ID NO: 1176485 - protein, 6 aa, Mycobacterium
VGYSEE

SEQ ID NO: 1176486 - protein, 9 aa, Mycobacterium
VGYTPYPET

SEQ ID NO: 1176487 - protein, 8 aa, Mycobacterium
VHDPGAPH

SEQ ID NO: 1176488 - protein, 13 aa, Mycobacterium
VHDTALTGGDGPR

SEQ ID NO: 1176489 - protein, 9 aa, Mycobacterium
VHEDPSGPV

SEQ ID NO: 1176490 - protein, 6 aa, Mycobacterium
VHGAAK

SEQ ID NO: 1176491 - protein, 13 aa, Mycobacterium
VHGAPAEERMREP

SEQ ID NO: 1176492 - protein, 11 aa, Mycobacterium
VHGDPTPEGLH

SEQ ID NO: 1176493 - protein, 15 aa, Mycobacterium
VHGEGGRLRSAGEHA

SEQ ID NO: 1176494 - protein, 19 aa, Mycobacterium
VHGGGEPPHYLSTTTADIK

SEQ ID NO: 1176495 - protein, 5 aa, Mycobacterium
VHGPA

SEQ ID NO: 1176496 - protein, 7 aa, Mycobacterium
VHGPARR

SEQ ID NO: 1176497 - protein, 7 aa, Mycobacterium
VHGSAKG

SEQ ID NO: 1176498 - protein, 4 aa, Mycobacterium
VHNP

SEQ ID NO: 1176499 - protein, 8 aa, Mycobacterium
VHPDGQGG

SEQ ID NO: 1176500 - protein, 8 aa, Mycobacterium
VHPNRTAR

SEQ ID NO: 1176501 - protein, 10 aa, Mycobacterium
VHPPAGGQGL

SEQ ID NO: 1176502 - protein, 12 aa, Mycobacterium
VHPRPTSDKTMQ

SEQ ID NO: 1176503 - protein, 11 aa, Mycobacterium
VHSPTSGPGTI

SEQ ID NO: 1176504 - protein, 6 aa, Mycobacterium
VHSPTY

SEQ ID NO: 1176505 - protein, 10 aa, Mycobacterium
VIRPPDDDWG

SEQ ID NO: 1176506 - protein, 9 aa, Mycobacterium
VKAATDKPF

SEQ ID NO: 1176507 - protein, 7 aa, Mycobacterium
VKAATTI

SEQ ID NO: 1176508 - protein, 10 aa, Mycobacterium
VKADRDADAV

SEQ ID NO: 1176509 - protein, 6 aa, Mycobacterium
VKAEAD

SEQ ID NO: 1176510 - protein, 14 aa, Mycobacterium
VKAGPGQTVGADEE

SEQ ID NO: 1176511 - protein, 8 aa, Mycobacterium
VKAPYDAD

SEQ ID NO: 1176512 - protein, 4 aa, Mycobacterium
VKDG

SEQ ID NO: 1176513 - protein, 9 aa, Mycobacterium
VKDPAGMAE

SEQ ID NO: 1176514 - protein, 4 aa, Mycobacterium
VKDQ

SEQ ID NO: 1176515 - protein, 19 aa, Mycobacterium
VKDVSKRNDVFGSSPDGAI

SEQ ID NO: 1176516 - protein, 13 aa, Mycobacterium
VKEANQAVSKAEA

SEQ ID NO: 1176517 - protein, 9 aa, Mycobacterium
VKERKGSVH

SEQ ID NO: 1176518 - protein, 8 aa, Mycobacterium
VKGASPQS

SEQ ID NO: 1176519 - protein, 8 aa, Mycobacterium
VKGKAKEV

SEQ ID NO: 1176520 - protein, 4 aa, Mycobacterium
VKGM

SEQ ID NO: 1176521 - protein, 14 aa, Mycobacterium
VKGPETEHLLALAG

SEQ ID NO: 1176522 - protein, 10 aa, Mycobacterium
VKGPLAGPNP

SEQ ID NO: 1176523 - protein, 12 aa, Mycobacterium
VKGQDVDGQEKV

SEQ ID NO: 1176524 - protein, 17 aa, Mycobacterium
VKGRRPSWNAAAPRPVA

SEQ ID NO: 1176525 - protein, 19 aa, Mycobacterium
VKKGGKDEPRALLVGQHPR

SEQ ID NO: 1176526 - protein, 8 aa, Mycobacterium
VKKPETIN

SEQ ID NO: 1176527 - protein, 7 aa, Mycobacterium
VKPEDVA

SEQ ID NO: 1176528 - protein, 8 aa, Mycobacterium
VKPEQENA

SEQ ID NO: 1176529 - protein, 9 aa, Mycobacterium
VKPGGAGDF

SEQ ID NO: 1176530 - protein, 18 aa, Mycobacterium
VKPKPGGDHSRGTKLTGP

SEQ ID NO: 1176531 - protein, 10 aa, Mycobacterium
VKPPTPGRRL

SEQ ID NO: 1176532 - protein, 10 aa, Mycobacterium
VKPSGDGSTV

SEQ ID NO: 1176533 - protein, 12 aa, Mycobacterium
VKPTSVPAFRPG

SEQ ID NO: 1176534 - protein, 6 aa, Mycobacterium
VKQPTI

SEQ ID NO: 1176535 - protein, 6 aa, Mycobacterium
VKQSAD

SEQ ID NO: 1176536 - protein, 11 aa, Mycobacterium
VKRGREAGAPA

SEQ ID NO: 1176537 - protein, 6 aa, Mycobacterium
VKRPGV

SEQ ID NO: 1176538 - protein, 6 aa, Mycobacterium
VKRPQM

SEQ ID NO: 1176539 - protein, 12 aa, Mycobacterium
VKSAEAARRQEE

SEQ ID NO: 1176540 - protein, 7 aa, Mycobacterium
VKSDPDL

SEQ ID NO: 1176541 - protein, 9 aa, Mycobacterium
VKSGRSRGV

SEQ ID NO: 1176542 - protein, 7 aa, Mycobacterium
VKSPADA

SEQ ID NO: 1176543 - protein, 6 aa, Mycobacterium
VKSTAD

SEQ ID NO: 1176544 - protein, 7 aa, Mycobacterium
VKSTSGD

SEQ ID NO: 1176545 - protein, 14 aa, Mycobacterium
VKTTTPDPAKQKVP

SEQ ID NO: 1176546 - protein, 10 aa, Mycobacterium
VLDPDESVAT

SEQ ID NO: 1176547 - protein, 6 aa, Mycobacterium
VLGNPT

SEQ ID NO: 1176548 - protein, 8 aa, Mycobacterium
VLGPEESD

SEQ ID NO: 1176549 - protein, 8 aa, Mycobacterium
VLPADGKR

SEQ ID NO: 1176550 - protein, 9 aa, Mycobacterium
VLPDPAPLG

SEQ ID NO: 1176551 - protein, 13 aa, Mycobacterium
VLPGGDTTGLSAE

SEQ ID NO: 1176552 - protein, 5 aa, Mycobacterium
VLPPG

SEQ ID NO: 1176553 - protein, 10 aa, Mycobacterium
VLSGPAGDLE

SEQ ID NO: 1176554 - protein, 4 aa, Mycobacterium
VMGG

SEQ ID NO: 1176555 - protein, 6 aa, Mycobacterium
VMPDST

SEQ ID NO: 1176556 - protein, 5 aa, Mycobacterium
VNAAA

SEQ ID NO: 1176557 - protein, 8 aa, Mycobacterium
VNADGTKT

SEQ ID NO: 1176558 - protein, 8 aa, Mycobacterium
VNAPPPAM

SEQ ID NO: 1176559 - protein, 5 aa, Mycobacterium
VNAQR

SEQ ID NO: 1176560 - protein, 9 aa, Mycobacterium
VNDDSSGQQ

SEQ ID NO: 1176561 - protein, 10 aa, Mycobacterium
VNDSAGNAVT

SEQ ID NO: 1176562 - protein, 8 aa, Mycobacterium
VNFSGSGC

SEQ ID NO: 1176563 - protein, 15 aa, Mycobacterium
VNGGPVEDARKRPEF

SEQ ID NO: 1176564 - protein, 4 aa, Mycobacterium
VNGV

SEQ ID NO: 1176565 - protein, 9 aa, Mycobacterium
VNHDGRSNG

SEQ ID NO: 1176566 - protein, 7 aa, Mycobacterium
VNHPDER

SEQ ID NO: 1176567 - protein, 55 aa, Mycobacterium
VNKASRGGGGGGGFGGGGGGGSRAGGGGGQAAAAEDPWGSAPASGSFSGADDEPP

SEQ ID NO: 1176568 - protein, 6 aa, Mycobacterium
VNPDAA

SEQ ID NO: 1176569 - protein, 8 aa, Mycobacterium
VNPDGADA

SEQ ID NO: 1176570 - protein, 9 aa, Mycobacterium
VNPDVEQQY

SEQ ID NO: 1176571 - protein, 14 aa, Mycobacterium
VNPEGRPWQEPDEA

SEQ ID NO: 1176572 - protein, 7 aa, Mycobacterium
VNPQRIE

SEQ ID NO: 1176573 - protein, 15 aa, Mycobacterium
VNPSEFRRTATVGRP

SEQ ID NO: 1176574 - protein, 10 aa, Mycobacterium
VNPTLPPSVP

SEQ ID NO: 1176575 - protein, 4 aa, Mycobacterium
VNQN

SEQ ID NO: 1176576 - protein, 12 aa, Mycobacterium
VNRAAGLEGNPR

SEQ ID NO: 1176577 - protein, 5 aa, Mycobacterium
VNRAG

SEQ ID NO: 1176578 - protein, 6 aa, Mycobacterium
VNRNHA

SEQ ID NO: 1176579 - protein, 6 aa, Mycobacterium
VNRNQG

SEQ ID NO: 1176580 - protein, 5 aa, Mycobacterium
VNRSA

SEQ ID NO: 1176581 - protein, 10 aa, Mycobacterium
VNRSNPIEGK

SEQ ID NO: 1176582 - protein, 8 aa, Mycobacterium
VNRTGSPI

SEQ ID NO: 1176583 - protein, 20 aa, Mycobacterium
VNSASTTPRFTRRASSAKDA

SEQ ID NO: 1176584 - protein, 7 aa, Mycobacterium
VNSDESR

SEQ ID NO: 1176585 - protein, 4 aa, Mycobacterium
VNSR

SEQ ID NO: 1176586 - protein, 5 aa, Mycobacterium
VNSTE

SEQ ID NO: 1176587 - protein, 6 aa, Mycobacterium
VNTPET

SEQ ID NO: 1176588 - protein, 4 aa, Mycobacterium
VPAD

SEQ ID NO: 1176589 - protein, 5 aa, Mycobacterium
VPADA

SEQ ID NO: 1176590 - protein, 12 aa, Mycobacterium
VPADQRLNLLRR

SEQ ID NO: 1176591 - protein, 6 aa, Mycobacterium
VPADVS

SEQ ID NO: 1176592 - protein, 4 aa, Mycobacterium
VPAE

SEQ ID NO: 1176593 - protein, 8 aa, Mycobacterium
VPAEGDRR

SEQ ID NO: 1176594 - protein, 4 aa, Mycobacterium
VPAG

SEQ ID NO: 1176595 - protein, 14 aa, Mycobacterium
VPAGADASEAQATE

SEQ ID NO: 1176596 - protein, 12 aa, Mycobacterium
VPAGDPAKGRLR

SEQ ID NO: 1176597 - protein, 22 aa, Mycobacterium
VPAGDTAENASAAGREAAESDN

SEQ ID NO: 1176598 - protein, 6 aa, Mycobacterium
VPAGGE

SEQ ID NO: 1176599 - protein, 9 aa, Mycobacterium
VPAGPSRGA

SEQ ID NO: 1176600 - protein, 6 aa, Mycobacterium
VPAGTS

SEQ ID NO: 1176601 - protein, 7 aa, Mycobacterium
VPAGTTA

SEQ ID NO: 1176602 - protein, 9 aa, Mycobacterium
VPAKEGADI

SEQ ID NO: 1176603 - protein, 5 aa, Mycobacterium
VPAKS

SEQ ID NO: 1176604 - protein, 11 aa, Mycobacterium
VPAPDLAGPLT

SEQ ID NO: 1176605 - protein, 7 aa, Mycobacterium
VPAPDSL

SEQ ID NO: 1176606 - protein, 9 aa, Mycobacterium
VPAPGDGRD

SEQ ID NO: 1176607 - protein, 32 aa, Mycobacterium
VPAPGGPLPPEAPVREHRGDHPHPGNGERTEH

SEQ ID NO: 1176608 - protein, 10 aa, Mycobacterium
VPAPGSRRDH

SEQ ID NO: 1176609 - protein, 6 aa, Mycobacterium
VPAPGV

SEQ ID NO: 1176610 - protein, 17 aa, Mycobacterium
VPAPTGQPMSYDVDKDD

SEQ ID NO: 1176611 - protein, 13 aa, Mycobacterium
VPARGSAEHYYSE

SEQ ID NO: 1176612 - protein, 8 aa, Mycobacterium
VPARPDSA

SEQ ID NO: 1176613 - protein, 13 aa, Mycobacterium
VPARPRPLTGNER

SEQ ID NO: 1176614 - protein, 4 aa, Mycobacterium
VPAT

SEQ ID NO: 1176615 - protein, 9 aa, Mycobacterium
VPATKAGIT

SEQ ID NO: 1176616 - protein, 11 aa, Mycobacterium
VPATKGNTKRL

SEQ ID NO: 1176617 - protein, 11 aa, Mycobacterium
VPATPTVGPPL

SEQ ID NO: 1176618 - protein, 5 aa, Mycobacterium
VPDAH

SEQ ID NO: 1176619 - protein, 8 aa, Mycobacterium
VPDATNPN

SEQ ID NO: 1176620 - protein, 25 aa, Mycobacterium
VPDDQQNAVREAASSCPEQAISIED

SEQ ID NO: 1176621 - protein, 9 aa, Mycobacterium
VPDERRGAG

SEQ ID NO: 1176622 - protein, 5 aa, Mycobacterium
VPDGD

SEQ ID NO: 1176623 - protein, 8 aa, Mycobacterium
VPDGDGSI

SEQ ID NO: 1176624 - protein, 9 aa, Mycobacterium
VPDPGGAAF

SEQ ID NO: 1176625 - protein, 8 aa, Mycobacterium
VPDPQASA

SEQ ID NO: 1176626 - protein, 5 aa, Mycobacterium
VPDPS

SEQ ID NO: 1176627 - protein, 9 aa, Mycobacterium
VPDQTKSAI

SEQ ID NO: 1176628 - protein, 5 aa, Mycobacterium
VPDRS

SEQ ID NO: 1176629 - protein, 9 aa, Mycobacterium
VPDSDNTAY

SEQ ID NO: 1176630 - protein, 6 aa, Mycobacterium
VPDSLD

SEQ ID NO: 1176631 - protein, 6 aa, Mycobacterium
VPDTAH

SEQ ID NO: 1176632 - protein, 5 aa, Mycobacterium
VPDTS

SEQ ID NO: 1176633 - protein, 9 aa, Mycobacterium
VPDYLPPES

SEQ ID NO: 1176634 - protein, 4 aa, Mycobacterium
VPEA

SEQ ID NO: 1176635 - protein, 15 aa, Mycobacterium
VPEADDERNDKQARE

SEQ ID NO: 1176636 - protein, 10 aa, Mycobacterium
VPEDEATGAA

SEQ ID NO: 1176637 - protein, 13 aa, Mycobacterium
VPEDRADSCEGEF

SEQ ID NO: 1176638 - protein, 5 aa, Mycobacterium
VPEEL

SEQ ID NO: 1176639 - protein, 8 aa, Mycobacterium
VPEGAGTV

SEQ ID NO: 1176640 - protein, 5 aa, Mycobacterium
VPEGG

SEQ ID NO: 1176641 - protein, 16 aa, Mycobacterium
VPEIPGDTEAPKAAVL

SEQ ID NO: 1176642 - protein, 12 aa, Mycobacterium
VPELTDDEIRER

SEQ ID NO: 1176643 - protein, 11 aa, Mycobacterium
VPEPEITDQTR

SEQ ID NO: 1176644 - protein, 10 aa, Mycobacterium
VPEPEPGPGE

SEQ ID NO: 1176645 - protein, 11 aa, Mycobacterium
VPEPGDGLRTD

SEQ ID NO: 1176646 - protein, 7 aa, Mycobacterium
VPEPLPE

SEQ ID NO: 1176647 - protein, 9 aa, Mycobacterium
VPEPVPGPG

SEQ ID NO: 1176648 - protein, 12 aa, Mycobacterium
VPERLTPSDEFP

SEQ ID NO: 1176649 - protein, 5 aa, Mycobacterium
VPESA

SEQ ID NO: 1176650 - protein, 8 aa, Mycobacterium
VPESPTHG

SEQ ID NO: 1176651 - protein, 7 aa, Mycobacterium
VPETEAA

SEQ ID NO: 1176652 - protein, 7 aa, Mycobacterium
VPEVQPG

SEQ ID NO: 1176653 - protein, 22 aa, Mycobacterium
VPFPPAATGPRGRQGSAASVSL

SEQ ID NO: 1176654 - protein, 12 aa, Mycobacterium
VPFPTGQRPNLK

SEQ ID NO: 1176655 - protein, 7 aa, Mycobacterium
VPGAPAS

SEQ ID NO: 1176656 - protein, 5 aa, Mycobacterium
VPGAQ

SEQ ID NO: 1176657 - protein, 6 aa, Mycobacterium
VPGATT

SEQ ID NO: 1176658 - protein, 8 aa, Mycobacterium
VPGDEVAA

SEQ ID NO: 1176659 - protein, 6 aa, Mycobacterium
VPGDGA

SEQ ID NO: 1176660 - protein, 5 aa, Mycobacterium
VPGDR

SEQ ID NO: 1176661 - protein, 6 aa, Mycobacterium
VPGDRA

SEQ ID NO: 1176662 - protein, 4 aa, Mycobacterium
VPGE

SEQ ID NO: 1176663 - protein, 5 aa, Mycobacterium
VPGEA

SEQ ID NO: 1176664 - protein, 5 aa, Mycobacterium
VPGEL

SEQ ID NO: 1176665 - protein, 8 aa, Mycobacterium
VPGEPPEF

SEQ ID NO: 1176666 - protein, 5 aa, Mycobacterium
VPGER

SEQ ID NO: 1176667 - protein, 13 aa, Mycobacterium
VPGESASGATPAT

SEQ ID NO: 1176668 - protein, 10 aa, Mycobacterium
VPGETSSFNE

SEQ ID NO: 1176669 - protein, 8 aa, Mycobacterium
VPGGATTV

SEQ ID NO: 1176670 - protein, 24 aa, Mycobacterium
VPGGDADDTAVTPVPTDSTPAGLE

SEQ ID NO: 1176671 - protein, 12 aa, Mycobacterium
VPGGSGGGSAAA

SEQ ID NO: 1176672 - protein, 5 aa, Mycobacterium
VPGGT

SEQ ID NO: 1176673 - protein, 5 aa, Mycobacterium
VPGIS

SEQ ID NO: 1176674 - protein, 5 aa, Mycobacterium
VPGLN

SEQ ID NO: 1176675 - protein, 7 aa, Mycobacterium
VPGNQEP

SEQ ID NO: 1176676 - protein, 12 aa, Mycobacterium
VPGNTLDPADPA

SEQ ID NO: 1176677 - protein, 5 aa, Mycobacterium
VPGPQ

SEQ ID NO: 1176678 - protein, 9 aa, Mycobacterium
VPGPRQRGR

SEQ ID NO: 1176679 - protein, 7 aa, Mycobacterium
VPGPSGS

SEQ ID NO: 1176680 - protein, 10 aa, Mycobacterium
VPGQGSPGAP

SEQ ID NO: 1176681 - protein, 19 aa, Mycobacterium
VPGRAEDTMGCPGNTGAAH

SEQ ID NO: 1176682 - protein, 5 aa, Mycobacterium
VPGRD

SEQ ID NO: 1176683 - protein, 12 aa, Mycobacterium
VPGRPSNFEDGR

SEQ ID NO: 1176684 - protein, 10 aa, Mycobacterium
VPGSAVGREP

SEQ ID NO: 1176685 - protein, 10 aa, Mycobacterium
VPGSPAAGPP

SEQ ID NO: 1176686 - protein, 13 aa, Mycobacterium
VPGSPSPDSGGPF

SEQ ID NO: 1176687 - protein, 5 aa, Mycobacterium
VPGSS

SEQ ID NO: 1176688 - protein, 12 aa, Mycobacterium
VPGSSDPIDGAA

SEQ ID NO: 1176689 - protein, 8 aa, Mycobacterium
VPGTDKLP

SEQ ID NO: 1176690 - protein, 10 aa, Mycobacterium
VPGVGKSTTI

SEQ ID NO: 1176691 - protein, 5 aa, Mycobacterium
VPGVR

SEQ ID NO: 1176692 - protein, 14 aa, Mycobacterium
VPHRSTPLGTLALV

SEQ ID NO: 1176693 - protein, 18 aa, Mycobacterium
VPIASPDQAAGANAQNGA

SEQ ID NO: 1176694 - protein, 8 aa, Mycobacterium
VPKAPDLE

SEQ ID NO: 1176695 - protein, 15 aa, Mycobacterium
VPKEGEGGGQNQRQK

SEQ ID NO: 1176696 - protein, 10 aa, Mycobacterium
VPKERAGAAY

SEQ ID NO: 1176697 - protein, 4 aa, Mycobacterium
VPKG

SEQ ID NO: 1176698 - protein, 7 aa, Mycobacterium
VPKGSAE

SEQ ID NO: 1176699 - protein, 4 aa, Mycobacterium
VPKM

SEQ ID NO: 1176700 - protein, 6 aa, Mycobacterium
VPKPRV

SEQ ID NO: 1176701 - protein, 6 aa, Mycobacterium
VPLAPG

SEQ ID NO: 1176702 - protein, 6 aa, Mycobacterium
VPLETT

SEQ ID NO: 1176703 - protein, 6 aa, Mycobacterium
VPLGPG

SEQ ID NO: 1176704 - protein, 7 aa, Mycobacterium
VPNTEGL

SEQ ID NO: 1176705 - protein, 12 aa, Mycobacterium
VPPAEANDGGMP

SEQ ID NO: 1176706 - protein, 9 aa, Mycobacterium
VPPANPEQV

SEQ ID NO: 1176707 - protein, 5 aa, Mycobacterium
VPPAV

SEQ ID NO: 1176708 - protein, 7 aa, Mycobacterium
VPPAVDP

SEQ ID NO: 1176709 - protein, 10 aa, Mycobacterium
VPPDADPDTA

SEQ ID NO: 1176710 - protein, 26 aa, Mycobacterium
VPPDAGAAAEARGRQGRLTKPAGALG

SEQ ID NO: 1176711 - protein, 8 aa, Mycobacterium
VPPDRPEM

SEQ ID NO: 1176712 - protein, 5 aa, Mycobacterium
VPPEA

SEQ ID NO: 1176713 - protein, 8 aa, Mycobacterium
VPPETSGF

SEQ ID NO: 1176714 - protein, 5 aa, Mycobacterium
VPPGA

SEQ ID NO: 1176715 - protein, 12 aa, Mycobacterium
VPPGGDGLAGDA

SEQ ID NO: 1176716 - protein, 8 aa, Mycobacterium
VPPGPGEI

SEQ ID NO: 1176717 - protein, 8 aa, Mycobacterium
VPPGPRFG

SEQ ID NO: 1176718 - protein, 6 aa, Mycobacterium
VPPGQA

SEQ ID NO: 1176719 - protein, 8 aa, Mycobacterium
VPPGSPNA

SEQ ID NO: 1176720 - protein, 20 aa, Mycobacterium
VPPGTDAGPLDQDHTPPAIQ

SEQ ID NO: 1176721 - protein, 10 aa, Mycobacterium
VPPGTPDLTG

SEQ ID NO: 1176722 - protein, 11 aa, Mycobacterium
VPPGTTGVPPG

SEQ ID NO: 1176723 - protein, 7 aa, Mycobacterium
VPPIGDD

SEQ ID NO: 1176724 - protein, 12 aa, Mycobacterium
VPPNPEYTGVPQ

SEQ ID NO: 1176725 - protein, 7 aa, Mycobacterium
VPPPAAR

SEQ ID NO: 1176726 - protein, 10 aa, Mycobacterium
VPPPGQTRPD

SEQ ID NO: 1176727 - protein, 4 aa, Mycobacterium
VPPQ

SEQ ID NO: 1176728 - protein, 19 aa, Mycobacterium
VPPRGPQPVRDGAEPEPVD

SEQ ID NO: 1176729 - protein, 5 aa, Mycobacterium
VPPRQ

SEQ ID NO: 1176730 - protein, 6 aa, Mycobacterium
VPPRTV

SEQ ID NO: 1176731 - protein, 5 aa, Mycobacterium
VPPRY

SEQ ID NO: 1176732 - protein, 39 aa, Mycobacterium
VPPSIPTPGVPPTVPGQQAAQGAAKEAGQAGGQGSQQGM

SEQ ID NO: 1176733 - protein, 8 aa, Mycobacterium
VPPSRAAD

SEQ ID NO: 1176734 - protein, 9 aa, Mycobacterium
VPPTAQNQA

SEQ ID NO: 1176735 - protein, 12 aa, Mycobacterium
VPPTDHDYPHME

SEQ ID NO: 1176736 - protein, 7 aa, Mycobacterium
VPPTGGI

SEQ ID NO: 1176737 - protein, 16 aa, Mycobacterium
VPPTPTVQTQASHQRE

SEQ ID NO: 1176738 - protein, 14 aa, Mycobacterium
VPPTTPTKLPTAEP

SEQ ID NO: 1176739 - protein, 5 aa, Mycobacterium
VPQGL

SEQ ID NO: 1176740 - protein, 10 aa, Mycobacterium
VPQPDDTRLS

SEQ ID NO: 1176741 - protein, 8 aa, Mycobacterium
VPQPDGSE

SEQ ID NO: 1176742 - protein, 6 aa, Mycobacterium
VPQPVQ

SEQ ID NO: 1176743 - protein, 8 aa, Mycobacterium
VPQRGDKK

SEQ ID NO: 1176744 - protein, 5 aa, Mycobacterium
VPQRS

SEQ ID NO: 1176745 - protein, 4 aa, Mycobacterium
VPQS

SEQ ID NO: 1176746 - protein, 8 aa, Mycobacterium
VPQSGSGI

SEQ ID NO: 1176747 - protein, 7 aa, Mycobacterium
VPRDPDP

SEQ ID NO: 1176748 - protein, 5 aa, Mycobacterium
VPREG

SEQ ID NO: 1176749 - protein, 11 aa, Mycobacterium
VPRERRAERRE

SEQ ID NO: 1176750 - protein, 17 aa, Mycobacterium
VPRGGQSAPGTDPRAGC

SEQ ID NO: 1176751 - protein, 5 aa, Mycobacterium
VPRGL

SEQ ID NO: 1176752 - protein, 6 aa, Mycobacterium
VPRGTD

SEQ ID NO: 1176753 - protein, 8 aa, Mycobacterium
VPRPSEIR

SEQ ID NO: 1176754 - protein, 4 aa, Mycobacterium
VPRS

SEQ ID NO: 1176755 - protein, 17 aa, Mycobacterium
VPRSSGSPLSSPQGTNL

SEQ ID NO: 1176756 - protein, 6 aa, Mycobacterium
VPSAGP

SEQ ID NO: 1176757 - protein, 5 aa, Mycobacterium
VPSDG

SEQ ID NO: 1176758 - protein, 7 aa, Mycobacterium
VPSDRPT

SEQ ID NO: 1176759 - protein, 7 aa, Mycobacterium
VPSGETE

SEQ ID NO: 1176760 - protein, 7 aa, Mycobacterium
VPSGGTD

SEQ ID NO: 1176761 - protein, 4 aa, Mycobacterium
VPSS

SEQ ID NO: 1176762 - protein, 7 aa, Mycobacterium
VPTAANA

SEQ ID NO: 1176763 - protein, 5 aa, Mycobacterium
VPTAG

SEQ ID NO: 1176764 - protein, 7 aa, Mycobacterium
VPTAQPA

SEQ ID NO: 1176765 - protein, 5 aa, Mycobacterium
VPTAT

SEQ ID NO: 1176766 - protein, 8 aa, Mycobacterium
VPTDEATH

SEQ ID NO: 1176767 - protein, 6 aa, Mycobacterium
VPTEEA

SEQ ID NO: 1176768 - protein, 14 aa, Mycobacterium
VPTEQGDPLDWMRR

SEQ ID NO: 1176769 - protein, 5 aa, Mycobacterium
VPTGA

SEQ ID NO: 1176770 - protein, 6 aa, Mycobacterium
VPTIET

SEQ ID NO: 1176771 - protein, 4 aa, Mycobacterium
VPTK

SEQ ID NO: 1176772 - protein, 6 aa, Mycobacterium
VPTPNN

SEQ ID NO: 1176773 - protein, 10 aa, Mycobacterium
VPTPPRPEGA

SEQ ID NO: 1176774 - protein, 12 aa, Mycobacterium
VPTQPMPVIELD

SEQ ID NO: 1176775 - protein, 12 aa, Mycobacterium
VPTRPDPNASLG

SEQ ID NO: 1176776 - protein, 6 aa, Mycobacterium
VPTSSA

SEQ ID NO: 1176777 - protein, 21 aa, Mycobacterium
VPTTPGRVTDTAEDAKAIAEE

SEQ ID NO: 1176778 - protein, 4 aa, Mycobacterium
VPTY

SEQ ID NO: 1176779 - protein, 6 aa, Mycobacterium
VPVEEE

SEQ ID NO: 1176780 - protein, 26 aa, Mycobacterium
VPVGGDGGIRNPNLPPPSRPQDNDLD

SEQ ID NO: 1176781 - protein, 4 aa, Mycobacterium
VPVP

SEQ ID NO: 1176782 - protein, 7 aa, Mycobacterium
VQAPGPI

SEQ ID NO: 1176783 - protein, 4 aa, Mycobacterium
VQAT

SEQ ID NO: 1176784 - protein, 13 aa, Mycobacterium
VQATDEPWHGRPA

SEQ ID NO: 1176785 - protein, 7 aa, Mycobacterium
VQDRNGP

SEQ ID NO: 1176786 - protein, 7 aa, Mycobacterium
VQDSNQK

SEQ ID NO: 1176787 - protein, 4 aa, Mycobacterium
VQEA

SEQ ID NO: 1176788 - protein, 15 aa, Mycobacterium
VQEAARDGIAGFSSS

SEQ ID NO: 1176789 - protein, 7 aa, Mycobacterium
VQEAGAG

SEQ ID NO: 1176790 - protein, 4 aa, Mycobacterium
VQGG

SEQ ID NO: 1176791 - protein, 10 aa, Mycobacterium
VQGSTRYPGG

SEQ ID NO: 1176792 - protein, 14 aa, Mycobacterium
VQKQSGSVAYSSSK

SEQ ID NO: 1176793 - protein, 9 aa, Mycobacterium
VQNDKNTKQ

SEQ ID NO: 1176794 - protein, 17 aa, Mycobacterium
VQPADHDPGQNPGFDLF

SEQ ID NO: 1176795 - protein, 9 aa, Mycobacterium
VQPAEPENL

SEQ ID NO: 1176796 - protein, 10 aa, Mycobacterium
VQPGANPKFP

SEQ ID NO: 1176797 - protein, 17 aa, Mycobacterium
VQPGHGSRRTAWPPYPN

SEQ ID NO: 1176798 - protein, 10 aa, Mycobacterium
VQPRRGRRGT

SEQ ID NO: 1176799 - protein, 14 aa, Mycobacterium
VQQAGNSTADKKGM

SEQ ID NO: 1176800 - protein, 14 aa, Mycobacterium
VQREPYDAHGSRTA

SEQ ID NO: 1176801 - protein, 17 aa, Mycobacterium
VQRGDERLGQGGVPADR

SEQ ID NO: 1176802 - protein, 10 aa, Mycobacterium
VQTDDGPAPA

SEQ ID NO: 1176803 - protein, 8 aa, Mycobacterium
VQTEEIDA

SEQ ID NO: 1176804 - protein, 10 aa, Mycobacterium
VQTGAADGPH

SEQ ID NO: 1176805 - protein, 7 aa, Mycobacterium
VQTSASA

SEQ ID NO: 1176806 - protein, 7 aa, Mycobacterium
VQVNTGA

SEQ ID NO: 1176807 - protein, 8 aa, Mycobacterium
VRAAEQLG

SEQ ID NO: 1176808 - protein, 16 aa, Mycobacterium
VRAGQGLSSITPKNDR

SEQ ID NO: 1176809 - protein, 6 aa, Mycobacterium
VRAGRG

SEQ ID NO: 1176810 - protein, 12 aa, Mycobacterium
VRAGTDGTLTGS

SEQ ID NO: 1176811 - protein, 15 aa, Mycobacterium
VRAGTVKPSHDPRGR

SEQ ID NO: 1176812 - protein, 7 aa, Mycobacterium
VRAKGGD

SEQ ID NO: 1176813 - protein, 6 aa, Mycobacterium
VRAPDA

SEQ ID NO: 1176814 - protein, 7 aa, Mycobacterium
VRAPRIK

SEQ ID NO: 1176815 - protein, 11 aa, Mycobacterium
VRAPSGGNSQP

SEQ ID NO: 1176816 - protein, 12 aa, Mycobacterium
VRATGSPEVPSH

SEQ ID NO: 1176817 - protein, 17 aa, Mycobacterium
VRDAGLTSAGRRGPAGR

SEQ ID NO: 1176818 - protein, 9 aa, Mycobacterium
VRDATNSDD

SEQ ID NO: 1176819 - protein, 11 aa, Mycobacterium
VRDDPDAVGPA

SEQ ID NO: 1176820 - protein, 20 aa, Mycobacterium
VRDGADDVAATDRSAANAWG

SEQ ID NO: 1176821 - protein, 10 aa, Mycobacterium
VRDGDDEATL

SEQ ID NO: 1176822 - protein, 6 aa, Mycobacterium
VRDGVT

SEQ ID NO: 1176823 - protein, 9 aa, Mycobacterium
VRDRGEPAL

SEQ ID NO: 1176824 - protein, 16 aa, Mycobacterium
VRDSADGLTADQVASQ

SEQ ID NO: 1176825 - protein, 9 aa, Mycobacterium
VRDSERDLQ

SEQ ID NO: 1176826 - protein, 4 aa, Mycobacterium
VRDT

SEQ ID NO: 1176827 - protein, 7 aa, Mycobacterium
VREARAG

SEQ ID NO: 1176828 - protein, 16 aa, Mycobacterium
VREGAKHAGDADPYRV

SEQ ID NO: 1176829 - protein, 14 aa, Mycobacterium
VREGRDSTGPTAGA

SEQ ID NO: 1176830 - protein, 10 aa, Mycobacterium
VREGSEEYLN

SEQ ID NO: 1176831 - protein, 8 aa, Mycobacterium
VREQNGED

SEQ ID NO: 1176832 - protein, 9 aa, Mycobacterium
VRERRQAGI

SEQ ID NO: 1176833 - protein, 4 aa, Mycobacterium
VRES

SEQ ID NO: 1176834 - protein, 6 aa, Mycobacterium
VRESAA

SEQ ID NO: 1176835 - protein, 5 aa, Mycobacterium
VRGAY

SEQ ID NO: 1176836 - protein, 6 aa, Mycobacterium
VRGDDP

SEQ ID NO: 1176837 - protein, 7 aa, Mycobacterium
VRGEGGR

SEQ ID NO: 1176838 - protein, 25 aa, Mycobacterium
VRGEPAEELAQQTADNAIRAYALRT

SEQ ID NO: 1176839 - protein, 10 aa, Mycobacterium
VRGEPPPPTL

SEQ ID NO: 1176840 - protein, 5 aa, Mycobacterium
VRGGD

SEQ ID NO: 1176841 - protein, 17 aa, Mycobacterium
VRGKDPAPRGKNRTRDA

SEQ ID NO: 1176842 - protein, 7 aa, Mycobacterium
VRGNSTR

SEQ ID NO: 1176843 - protein, 8 aa, Mycobacterium
VRGPREVA

SEQ ID NO: 1176844 - protein, 5 aa, Mycobacterium
VRGRG

SEQ ID NO: 1176845 - protein, 7 aa, Mycobacterium
VRGSGGF

SEQ ID NO: 1176846 - protein, 8 aa, Mycobacterium
VRGTGGRG

SEQ ID NO: 1176847 - protein, 8 aa, Mycobacterium
VRNEDEGL

SEQ ID NO: 1176848 - protein, 7 aa, Mycobacterium
VRNNGPE

SEQ ID NO: 1176849 - protein, 17 aa, Mycobacterium
VRNRKTLDEVAEQSLKG

SEQ ID NO: 1176850 - protein, 18 aa, Mycobacterium
VRNSAAGTGLNAATGEYE

SEQ ID NO: 1176851 - protein, 8 aa, Mycobacterium
VRPATDGQ

SEQ ID NO: 1176852 - protein, 7 aa, Mycobacterium
VRPDGLR

SEQ ID NO: 1176853 - protein, 9 aa, Mycobacterium
VRPDGQRDA

SEQ ID NO: 1176854 - protein, 6 aa, Mycobacterium
VRPDGY

SEQ ID NO: 1176855 - protein, 5 aa, Mycobacterium
VRPGD

SEQ ID NO: 1176856 - protein, 6 aa, Mycobacterium
VRPGDT

SEQ ID NO: 1176857 - protein, 14 aa, Mycobacterium
VRPGPPATDYTRRQ

SEQ ID NO: 1176858 - protein, 6 aa, Mycobacterium
VRPGSE

SEQ ID NO: 1176859 - protein, 5 aa, Mycobacterium
VRPNT

SEQ ID NO: 1176860 - protein, 15 aa, Mycobacterium
VRPQGRRSGRRMYGP

SEQ ID NO: 1176861 - protein, 6 aa, Mycobacterium
VRPRPG

SEQ ID NO: 1176862 - protein, 17 aa, Mycobacterium
VRPTPEQVAEASAISRR

SEQ ID NO: 1176863 - protein, 15 aa, Mycobacterium
VRPTRDQSLTPSERR

SEQ ID NO: 1176864 - protein, 10 aa, Mycobacterium
VRQAERARPH

SEQ ID NO: 1176865 - protein, 7 aa, Mycobacterium
VRQPDGT

SEQ ID NO: 1176866 - protein, 6 aa, Mycobacterium
VRQPGD

SEQ ID NO: 1176867 - protein, 6 aa, Mycobacterium
VRQRSR

SEQ ID NO: 1176868 - protein, 27 aa, Mycobacterium
VRQSKVGDTVTTARHGAKEALTGYREP

SEQ ID NO: 1176869 - protein, 4 aa, Mycobacterium
VRRD

SEQ ID NO: 1176870 - protein, 8 aa, Mycobacterium
VRRDNTGY

SEQ ID NO: 1176871 - protein, 7 aa, Mycobacterium
VRRGGAQ

SEQ ID NO: 1176872 - protein, 9 aa, Mycobacterium
VRRPGGPGA

SEQ ID NO: 1176873 - protein, 4 aa, Mycobacterium
VRRQ

SEQ ID NO: 1176874 - protein, 12 aa, Mycobacterium
VRRSNRKLSPEL

SEQ ID NO: 1176875 - protein, 7 aa, Mycobacterium
VRRSNSE

SEQ ID NO: 1176876 - protein, 9 aa, Mycobacterium
VRSADAARA

SEQ ID NO: 1176877 - protein, 6 aa, Mycobacterium
VRSAEA

SEQ ID NO: 1176878 - protein, 9 aa, Mycobacterium
VRSAPVDGA

SEQ ID NO: 1176879 - protein, 14 aa, Mycobacterium
VRSARQGIGADSDD

SEQ ID NO: 1176880 - protein, 24 aa, Mycobacterium
VRSEEAASQRESRYGAASVDPPVD

SEQ ID NO: 1176881 - protein, 6 aa, Mycobacterium
VRSGAA

SEQ ID NO: 1176882 - protein, 16 aa, Mycobacterium
VRSGQRAATEVHDLLS

SEQ ID NO: 1176883 - protein, 11 aa, Mycobacterium
VRSGRDDGSGD

SEQ ID NO: 1176884 - protein, 10 aa, Mycobacterium
VRSPAGKADY

SEQ ID NO: 1176885 - protein, 9 aa, Mycobacterium
VRSPDSACN

SEQ ID NO: 1176886 - protein, 11 aa, Mycobacterium
VRSPYPTGQGY

SEQ ID NO: 1176887 - protein, 32 aa, Mycobacterium
VRSQQQPDDESADALRAAAPEARAEILEPVPL

SEQ ID NO: 1176888 - protein, 13 aa, Mycobacterium
VRSRPADSYRAAA

SEQ ID NO: 1176889 - protein, 10 aa, Mycobacterium
VRTADGRTVA

SEQ ID NO: 1176890 - protein, 13 aa, Mycobacterium
VRTDAAPAQGADQ

SEQ ID NO: 1176891 - protein, 7 aa, Mycobacterium
VRTDQSE

SEQ ID NO: 1176892 - protein, 11 aa, Mycobacterium
VRTEPPHEGAR

SEQ ID NO: 1176893 - protein, 6 aa, Mycobacterium
VRTESP

SEQ ID NO: 1176894 - protein, 19 aa, Mycobacterium
VRTETGKGASRRARREGKV

SEQ ID NO: 1176895 - protein, 4 aa, Mycobacterium
VRTG

SEQ ID NO: 1176896 - protein, 11 aa, Mycobacterium
VRTGEARDGDT

SEQ ID NO: 1176897 - protein, 7 aa, Mycobacterium
VRTGKTA

SEQ ID NO: 1176898 - protein, 10 aa, Mycobacterium
VRTGPLSSAY

SEQ ID NO: 1176899 - protein, 14 aa, Mycobacterium
VRTGRKVRRQKRTF

SEQ ID NO: 1176900 - protein, 6 aa, Mycobacterium
VRTGSD

SEQ ID NO: 1176901 - protein, 8 aa, Mycobacterium
VRTGTAEL

SEQ ID NO: 1176902 - protein, 6 aa, Mycobacterium
VRTPGT

SEQ ID NO: 1176903 - protein, 11 aa, Mycobacterium
VRTRDDAAALR

SEQ ID NO: 1176904 - protein, 9 aa, Mycobacterium
VRTRYGNAA

SEQ ID NO: 1176905 - protein, 11 aa, Mycobacterium
VRTSDTARGER

SEQ ID NO: 1176906 - protein, 6 aa, Mycobacterium
VRTSPE

SEQ ID NO: 1176907 - protein, 7 aa, Mycobacterium
VRYGPLP

SEQ ID NO: 1176908 - protein, 8 aa, Mycobacterium
VSAAGNPS

SEQ ID NO: 1176909 - protein, 13 aa, Mycobacterium
VSADERRRKVEEA

SEQ ID NO: 1176910 - protein, 7 aa, Mycobacterium
VSADGDI

SEQ ID NO: 1176911 - protein, 7 aa, Mycobacterium
VSADTRA

SEQ ID NO: 1176912 - protein, 5 aa, Mycobacterium
VSADV

SEQ ID NO: 1176913 - protein, 8 aa, Mycobacterium
VSAEGTRD

SEQ ID NO: 1176914 - protein, 8 aa, Mycobacterium
VSAESGRT

SEQ ID NO: 1176915 - protein, 10 aa, Mycobacterium
VSAPADSVQR

SEQ ID NO: 1176916 - protein, 17 aa, Mycobacterium
VSAPAHPDKLTPPPALA

SEQ ID NO: 1176917 - protein, 5 aa, Mycobacterium
VSAPE

SEQ ID NO: 1176918 - protein, 8 aa, Mycobacterium
VSAPSPDL

SEQ ID NO: 1176919 - protein, 18 aa, Mycobacterium
VSARDQQQQDGQWTRAKG

SEQ ID NO: 1176920 - protein, 6 aa, Mycobacterium
VSARGE

SEQ ID NO: 1176921 - protein, 7 aa, Mycobacterium
VSASREH

SEQ ID NO: 1176922 - protein, 5 aa, Mycobacterium
VSDAD

SEQ ID NO: 1176923 - protein, 7 aa, Mycobacterium
VSDAGVA

SEQ ID NO: 1176924 - protein, 6 aa, Mycobacterium
VSDDAP

SEQ ID NO: 1176925 - protein, 5 aa, Mycobacterium
VSDDD

SEQ ID NO: 1176926 - protein, 8 aa, Mycobacterium
VSDDGTGT

SEQ ID NO: 1176927 - protein, 8 aa, Mycobacterium
VSDEDPVA

SEQ ID NO: 1176928 - protein, 5 aa, Mycobacterium
VSDGR

SEQ ID NO: 1176929 - protein, 8 aa, Mycobacterium
VSDGRQAL

SEQ ID NO: 1176930 - protein, 11 aa, Mycobacterium
VSDPANPKQVG

SEQ ID NO: 1176931 - protein, 9 aa, Mycobacterium
VSDPDERGM

SEQ ID NO: 1176932 - protein, 12 aa, Mycobacterium
VSDPDSAKEMAA

SEQ ID NO: 1176933 - protein, 8 aa, Mycobacterium
VSDPGDQE

SEQ ID NO: 1176934 - protein, 14 aa, Mycobacterium
VSDPQAGRKAGIAH

SEQ ID NO: 1176935 - protein, 15 aa, Mycobacterium
VSDQPAESADPGPAE

SEQ ID NO: 1176936 - protein, 7 aa, Mycobacterium
VSDQPRR

SEQ ID NO: 1176937 - protein, 9 aa, Mycobacterium
VSDRSGSVT

SEQ ID NO: 1176938 - protein, 6 aa, Mycobacterium
VSDTAR

SEQ ID NO: 1176939 - protein, 4 aa, Mycobacterium
VSEA

SEQ ID NO: 1176940 - protein, 19 aa, Mycobacterium
VSEAGLKDTVSKAQSAADR

SEQ ID NO: 1176941 - protein, 4 aa, Mycobacterium
VSED

SEQ ID NO: 1176942 - protein, 10 aa, Mycobacterium
VSEESRTANF

SEQ ID NO: 1176943 - protein, 5 aa, Mycobacterium
VSEGD

SEQ ID NO: 1176944 - protein, 7 aa, Mycobacterium
VSEGTGV

SEQ ID NO: 1176945 - protein, 8 aa, Mycobacterium
VSEHGVST

SEQ ID NO: 1176946 - protein, 5 aa, Mycobacterium
VSEPD

SEQ ID NO: 1176947 - protein, 6 aa, Mycobacterium
VSERAR

SEQ ID NO: 1176948 - protein, 8 aa, Mycobacterium
VSERPGVT

SEQ ID NO: 1176949 - protein, 13 aa, Mycobacterium
VSEVGGGSGGPRR

SEQ ID NO: 1176950 - protein, 12 aa, Mycobacterium
VSEYSSDPPWAA

SEQ ID NO: 1176951 - protein, 7 aa, Mycobacterium
VSGAEAA

SEQ ID NO: 1176952 - protein, 7 aa, Mycobacterium
VSGAGAR

SEQ ID NO: 1176953 - protein, 7 aa, Mycobacterium
VSGAGAV

SEQ ID NO: 1176954 - protein, 7 aa, Mycobacterium
VSGAPIG

SEQ ID NO: 1176955 - protein, 11 aa, Mycobacterium
VSGDHDAENAL

SEQ ID NO: 1176956 - protein, 9 aa, Mycobacterium
VSGEDRDSV

SEQ ID NO: 1176957 - protein, 9 aa, Mycobacterium
VSGETQGYY

SEQ ID NO: 1176958 - protein, 6 aa, Mycobacterium
VSGGRT

SEQ ID NO: 1176959 - protein, 14 aa, Mycobacterium
VSGGYTRDFTNGGE

SEQ ID NO: 1176960 - protein, 15 aa, Mycobacterium
VSGPGGGYPPPAYPP

SEQ ID NO: 1176961 - protein, 7 aa, Mycobacterium
VSGPSYR

SEQ ID NO: 1176962 - protein, 13 aa, Mycobacterium
VSGREDANGGGRV

SEQ ID NO: 1176963 - protein, 7 aa, Mycobacterium
VSGRGKY

SEQ ID NO: 1176964 - protein, 6 aa, Mycobacterium
VSGRGR

SEQ ID NO: 1176965 - protein, 5 aa, Mycobacterium
VSGRP

SEQ ID NO: 1176966 - protein, 11 aa, Mycobacterium
VSGSDAKESRA

SEQ ID NO: 1176967 - protein, 9 aa, Mycobacterium
VSGTAVDNE

SEQ ID NO: 1176968 - protein, 9 aa, Mycobacterium
VSGTKDPDL

SEQ ID NO: 1176969 - protein, 5 aa, Mycobacterium
VSGVE

SEQ ID NO: 1176970 - protein, 14 aa, Mycobacterium
VSGVGKGRHTSTQS

SEQ ID NO: 1176971 - protein, 4 aa, Mycobacterium
VSGY

SEQ ID NO: 1176972 - protein, 4 aa, Mycobacterium
VSHP

SEQ ID NO: 1176973 - protein, 4 aa, Mycobacterium
VSID

SEQ ID NO: 1176974 - protein, 6 aa, Mycobacterium
VSKDAD

SEQ ID NO: 1176975 - protein, 13 aa, Mycobacterium
VSKDGKSQELKTD

SEQ ID NO: 1176976 - protein, 4 aa, Mycobacterium
VSKG

SEQ ID NO: 1176977 - protein, 10 aa, Mycobacterium
VSNPGGLPVD

SEQ ID NO: 1176978 - protein, 6 aa, Mycobacterium
VSNRAA

SEQ ID NO: 1176979 - protein, 7 aa, Mycobacterium
VSPAARE

SEQ ID NO: 1176980 - protein, 6 aa, Mycobacterium
VSPADA

SEQ ID NO: 1176981 - protein, 5 aa, Mycobacterium
VSPAI

SEQ ID NO: 1176982 - protein, 18 aa, Mycobacterium
VSPAKLKSGEYRQISGNT

SEQ ID NO: 1176983 - protein, 14 aa, Mycobacterium
VSPARRGMDDASAK

SEQ ID NO: 1176984 - protein, 8 aa, Mycobacterium
VSPDDPAR

SEQ ID NO: 1176985 - protein, 8 aa, Mycobacterium
VSPDGSRV

SEQ ID NO: 1176986 - protein, 6 aa, Mycobacterium
VSPEDL

SEQ ID NO: 1176987 - protein, 5 aa, Mycobacterium
VSPGD

SEQ ID NO: 1176988 - protein, 6 aa, Mycobacterium
VSPGQT

SEQ ID NO: 1176989 - protein, 8 aa, Mycobacterium
VSPKGDPA

SEQ ID NO: 1176990 - protein, 8 aa, Mycobacterium
VSPNSADL

SEQ ID NO: 1176991 - protein, 6 aa, Mycobacterium
VSPPDA

SEQ ID NO: 1176992 - protein, 10 aa, Mycobacterium
VSPQNAQALT

SEQ ID NO: 1176993 - protein, 5 aa, Mycobacterium
VSPQT

SEQ ID NO: 1176994 - protein, 5 aa, Mycobacterium
VSPRA

SEQ ID NO: 1176995 - protein, 9 aa, Mycobacterium
VSPREDRDD

SEQ ID NO: 1176996 - protein, 5 aa, Mycobacterium
VSPRT

SEQ ID NO: 1176997 - protein, 8 aa, Mycobacterium
VSQTGKPV

SEQ ID NO: 1176998 - protein, 7 aa, Mycobacterium
VSRGAAD

SEQ ID NO: 1176999 - protein, 11 aa, Mycobacterium
VSRGADGPIAS

SEQ ID NO: 1177000 - protein, 9 aa, Mycobacterium
VSRGPHASK

SEQ ID NO: 1177001 - protein, 6 aa, Mycobacterium
VSRPAV

SEQ ID NO: 1177002 - protein, 8 aa, Mycobacterium
VSRPGLTD

SEQ ID NO: 1177003 - protein, 8 aa, Mycobacterium
VSRPTAGR

SEQ ID NO: 1177004 - protein, 7 aa, Mycobacterium
VSRSSVR

SEQ ID NO: 1177005 - protein, 6 aa, Mycobacterium
VSRTQR

SEQ ID NO: 1177006 - protein, 9 aa, Mycobacterium
VSRTTDPLD

SEQ ID NO: 1177007 - protein, 9 aa, Mycobacterium
VSRVPPHKR

SEQ ID NO: 1177008 - protein, 9 aa, Mycobacterium
VSSAGEQAK

SEQ ID NO: 1177009 - protein, 18 aa, Mycobacterium
VSSAGTGGWHAGDPADRR

SEQ ID NO: 1177010 - protein, 12 aa, Mycobacterium
VSSDASADEIKK

SEQ ID NO: 1177011 - protein, 5 aa, Mycobacterium
VSSGG

SEQ ID NO: 1177012 - protein, 17 aa, Mycobacterium
VSSKVPKADLDQRDSDY

SEQ ID NO: 1177013 - protein, 12 aa, Mycobacterium
VSSPDADDEQIR

SEQ ID NO: 1177014 - protein, 13 aa, Mycobacterium
VSSSSAGPGTRAN

SEQ ID NO: 1177015 - protein, 10 aa, Mycobacterium
VSTEAGARDP

SEQ ID NO: 1177016 - protein, 10 aa, Mycobacterium
VSTEKVSGAV

SEQ ID NO: 1177017 - protein, 16 aa, Mycobacterium
VSTNAPAGAPSGLTTR

SEQ ID NO: 1177018 - protein, 5 aa, Mycobacterium
VSTPA

SEQ ID NO: 1177019 - protein, 8 aa, Mycobacterium
VSTPDGQE

SEQ ID NO: 1177020 - protein, 14 aa, Mycobacterium
VSTPQKAELSRQAG

SEQ ID NO: 1177021 - protein, 12 aa, Mycobacterium
VSTSEKEALAAA

SEQ ID NO: 1177022 - protein, 7 aa, Mycobacterium
VSTTVST

SEQ ID NO: 1177023 - protein, 8 aa, Mycobacterium
VSTVRDGG

SEQ ID NO: 1177024 - protein, 7 aa, Mycobacterium
VSVPEQA

SEQ ID NO: 1177025 - protein, 10 aa, Mycobacterium
VSVSGPAEVR

SEQ ID NO: 1177026 - protein, 17 aa, Mycobacterium
VSYDGQGCSISQASTSV

SEQ ID NO: 1177027 - protein, 6 aa, Mycobacterium
VTAAAS

SEQ ID NO: 1177028 - protein, 18 aa, Mycobacterium
VTAAETEAEQVSRRRSAY

SEQ ID NO: 1177029 - protein, 5 aa, Mycobacterium
VTADG

SEQ ID NO: 1177030 - protein, 5 aa, Mycobacterium
VTADL

SEQ ID NO: 1177031 - protein, 4 aa, Mycobacterium
VTAE

SEQ ID NO: 1177032 - protein, 17 aa, Mycobacterium
VTAEAAAATGVPAGTPV

SEQ ID NO: 1177033 - protein, 6 aa, Mycobacterium
VTAGPT

SEQ ID NO: 1177034 - protein, 7 aa, Mycobacterium
VTAHGGN

SEQ ID NO: 1177035 - protein, 5 aa, Mycobacterium
VTAIG

SEQ ID NO: 1177036 - protein, 7 aa, Mycobacterium
VTAPAGF

SEQ ID NO: 1177037 - protein, 7 aa, Mycobacterium
VTAPGRQ

SEQ ID NO: 1177038 - protein, 7 aa, Mycobacterium
VTAPPAG

SEQ ID NO: 1177039 - protein, 19 aa, Mycobacterium
VTAPRVNDRRVDPDTGVRQ

SEQ ID NO: 1177040 - protein, 5 aa, Mycobacterium
VTARP

SEQ ID NO: 1177041 - protein, 12 aa, Mycobacterium
VTASAEGGEEQR

SEQ ID NO: 1177042 - protein, 5 aa, Mycobacterium
VTASG

SEQ ID NO: 1177043 - protein, 5 aa, Mycobacterium
VTASP

SEQ ID NO: 1177044 - protein, 9 aa, Mycobacterium
VTASSTELA

SEQ ID NO: 1177045 - protein, 15 aa, Mycobacterium
VTATCSAADGPRYGD

SEQ ID NO: 1177046 - protein, 10 aa, Mycobacterium
VTATDDGGVR

SEQ ID NO: 1177047 - protein, 6 aa, Mycobacterium
VTATTT

SEQ ID NO: 1177048 - protein, 9 aa, Mycobacterium
VTDAEDGQF

SEQ ID NO: 1177049 - protein, 18 aa, Mycobacterium
VTDAPWDPGVPDPAAPGV

SEQ ID NO: 1177050 - protein, 15 aa, Mycobacterium
VTDDAEHQRLLDRAE

SEQ ID NO: 1177051 - protein, 8 aa, Mycobacterium
VTDDGRPS

SEQ ID NO: 1177052 - protein, 6 aa, Mycobacterium
VTDDTV

SEQ ID NO: 1177053 - protein, 6 aa, Mycobacterium
VTDEAA

SEQ ID NO: 1177054 - protein, 5 aa, Mycobacterium
VTDEK

SEQ ID NO: 1177055 - protein, 5 aa, Mycobacterium
VTDEQ

SEQ ID NO: 1177056 - protein, 19 aa, Mycobacterium
VTDGSGGRVAPEALQDNEI

SEQ ID NO: 1177057 - protein, 9 aa, Mycobacterium
VTDHATKAG

SEQ ID NO: 1177058 - protein, 9 aa, Mycobacterium
VTDHPGGYA

SEQ ID NO: 1177059 - protein, 4 aa, Mycobacterium
VTDP

SEQ ID NO: 1177060 - protein, 11 aa, Mycobacterium
VTDPAGPAADA

SEQ ID NO: 1177061 - protein, 20 aa, Mycobacterium
VTDPATGLPLDTNDDDGVVD

SEQ ID NO: 1177062 - protein, 10 aa, Mycobacterium
VTDPDDPKNW

SEQ ID NO: 1177063 - protein, 6 aa, Mycobacterium
VTDPEF

SEQ ID NO: 1177064 - protein, 8 aa, Mycobacterium
VTDPEQVS

SEQ ID NO: 1177065 - protein, 7 aa, Mycobacterium
VTDPGAL

SEQ ID NO: 1177066 - protein, 7 aa, Mycobacterium
VTDQPGY

SEQ ID NO: 1177067 - protein, 6 aa, Mycobacterium
VTDRDG

SEQ ID NO: 1177068 - protein, 6 aa, Mycobacterium
VTDRSA

SEQ ID NO: 1177069 - protein, 17 aa, Mycobacterium
VTDSEGKKFGKSTGGGN

SEQ ID NO: 1177070 - protein, 8 aa, Mycobacterium
VTDTGASI

SEQ ID NO: 1177071 - protein, 17 aa, Mycobacterium
VTEAGGSVRQEPNRQPY

SEQ ID NO: 1177072 - protein, 11 aa, Mycobacterium
VTEATGVGREQ

SEQ ID NO: 1177073 - protein, 7 aa, Mycobacterium
VTEATTG

SEQ ID NO: 1177074 - protein, 6 aa, Mycobacterium
VTEDLP

SEQ ID NO: 1177075 - protein, 11 aa, Mycobacterium
VTEGAAPPALE

SEQ ID NO: 1177076 - protein, 10 aa, Mycobacterium
VTEGPPDVGS

SEQ ID NO: 1177077 - protein, 12 aa, Mycobacterium
VTEPELTGTEGN

SEQ ID NO: 1177078 - protein, 10 aa, Mycobacterium
VTEPPDVSAL

SEQ ID NO: 1177079 - protein, 9 aa, Mycobacterium
VTEQGGTVP

SEQ ID NO: 1177080 - protein, 10 aa, Mycobacterium
VTERGDREID

SEQ ID NO: 1177081 - protein, 11 aa, Mycobacterium
VTESANVSEPT

SEQ ID NO: 1177082 - protein, 6 aa, Mycobacterium
VTESDV

SEQ ID NO: 1177083 - protein, 9 aa, Mycobacterium
VTGAARPGT

SEQ ID NO: 1177084 - protein, 14 aa, Mycobacterium
VTGAPDVDAAAAGA

SEQ ID NO: 1177085 - protein, 6 aa, Mycobacterium
VTGCDD

SEQ ID NO: 1177086 - protein, 10 aa, Mycobacterium
VTGDDSLEDE

SEQ ID NO: 1177087 - protein, 10 aa, Mycobacterium
VTGDPDHPMT

SEQ ID NO: 1177088 - protein, 35 aa, Mycobacterium
VTGDPQRGLRQTGPLRVEGDPNPNIEHANRGKRSI

SEQ ID NO: 1177089 - protein, 7 aa, Mycobacterium
VTGEGQV

SEQ ID NO: 1177090 - protein, 8 aa, Mycobacterium
VTGEPDQA

SEQ ID NO: 1177091 - protein, 7 aa, Mycobacterium
VTGGELA

SEQ ID NO: 1177092 - protein, 5 aa, Mycobacterium
VTGGG

SEQ ID NO: 1177093 - protein, 11 aa, Mycobacterium
VTGGSRPEGLD

SEQ ID NO: 1177094 - protein, 6 aa, Mycobacterium
VTGGTD

SEQ ID NO: 1177095 - protein, 11 aa, Mycobacterium
VTGGTGMPDGL

SEQ ID NO: 1177096 - protein, 10 aa, Mycobacterium
VTGGTIPDLP

SEQ ID NO: 1177097 - protein, 7 aa, Mycobacterium
VTGGTRG

SEQ ID NO: 1177098 - protein, 6 aa, Mycobacterium
VTGHGG

SEQ ID NO: 1177099 - protein, 13 aa, Mycobacterium
VTGHPSGTARDVE

SEQ ID NO: 1177100 - protein, 129 aa, Mycobacterium
VTGNDSLTAEGQLEQTQAKERKAANAQEALAEAEAEQARQEVAEARQEGAQERAAVNAETAAQERAARADQAAQKQQAEQAAAQRAAADTAQAETEAQRRAERADAEARAEKAAATAEVADAAAQRNDA

SEQ ID NO: 1177101 - protein, 7 aa, Mycobacterium
VTGPAGT

SEQ ID NO: 1177102 - protein, 10 aa, Mycobacterium
VTGPGQVRTP

SEQ ID NO: 1177103 - protein, 4 aa, Mycobacterium
VTGR

SEQ ID NO: 1177104 - protein, 7 aa, Mycobacterium
VTGSAGP

SEQ ID NO: 1177105 - protein, 7 aa, Mycobacterium
VTGSGDV

SEQ ID NO: 1177106 - protein, 8 aa, Mycobacterium
VTGTNGKK

SEQ ID NO: 1177107 - protein, 4 aa, Mycobacterium
VTGV

SEQ ID NO: 1177108 - protein, 9 aa, Mycobacterium
VTGVKGTYT

SEQ ID NO: 1177109 - protein, 7 aa, Mycobacterium
VTGYDSE

SEQ ID NO: 1177110 - protein, 10 aa, Mycobacterium
VTHSERVPDH

SEQ ID NO: 1177111 - protein, 9 aa, Mycobacterium
VTKGDVTDA

SEQ ID NO: 1177112 - protein, 11 aa, Mycobacterium
VTKGPGSRTAG

SEQ ID NO: 1177113 - protein, 6 aa, Mycobacterium
VTKGTG

SEQ ID NO: 1177114 - protein, 11 aa, Mycobacterium
VTKRGGGAALP

SEQ ID NO: 1177115 - protein, 13 aa, Mycobacterium
VTKSASGACGRNQ

SEQ ID NO: 1177116 - protein, 11 aa, Mycobacterium
VTKSDKAPWYD

SEQ ID NO: 1177117 - protein, 6 aa, Mycobacterium
VTKSGL

SEQ ID NO: 1177118 - protein, 12 aa, Mycobacterium
VTLGGESARVTR

SEQ ID NO: 1177119 - protein, 8 aa, Mycobacterium
VTNTPGVL

SEQ ID NO: 1177120 - protein, 7 aa, Mycobacterium
VTPAQAR

SEQ ID NO: 1177121 - protein, 10 aa, Mycobacterium
VTPAQRRNRR

SEQ ID NO: 1177122 - protein, 5 aa, Mycobacterium
VTPDQ

SEQ ID NO: 1177123 - protein, 6 aa, Mycobacterium
VTPDTR

SEQ ID NO: 1177124 - protein, 4 aa, Mycobacterium
VTPE

SEQ ID NO: 1177125 - protein, 7 aa, Mycobacterium
VTPELEA

SEQ ID NO: 1177126 - protein, 4 aa, Mycobacterium
VTPG

SEQ ID NO: 1177127 - protein, 12 aa, Mycobacterium
VTPGALGVPGTP

SEQ ID NO: 1177128 - protein, 7 aa, Mycobacterium
VTPGDRS

SEQ ID NO: 1177129 - protein, 11 aa, Mycobacterium
VTPGDTGQPYA

SEQ ID NO: 1177130 - protein, 7 aa, Mycobacterium
VTPNPGA

SEQ ID NO: 1177131 - protein, 7 aa, Mycobacterium
VTPNPNL

SEQ ID NO: 1177132 - protein, 7 aa, Mycobacterium
VTPPKPL

SEQ ID NO: 1177133 - protein, 24 aa, Mycobacterium
VTPQGRARAGFDDPVEVPDDAPPL

SEQ ID NO: 1177134 - protein, 16 aa, Mycobacterium
VTPQPHNGCRPPKRRR

SEQ ID NO: 1177135 - protein, 4 aa, Mycobacterium
VTPR

SEQ ID NO: 1177136 - protein, 12 aa, Mycobacterium
VTPRVDQSDDEF

SEQ ID NO: 1177137 - protein, 9 aa, Mycobacterium
VTPSAHTAP

SEQ ID NO: 1177138 - protein, 5 aa, Mycobacterium
VTPTT

SEQ ID NO: 1177139 - protein, 7 aa, Mycobacterium
VTPTTEV

SEQ ID NO: 1177140 - protein, 10 aa, Mycobacterium
VTQGRSRGTV

SEQ ID NO: 1177141 - protein, 6 aa, Mycobacterium
VTQPGD

SEQ ID NO: 1177142 - protein, 8 aa, Mycobacterium
VTQQRGTK

SEQ ID NO: 1177143 - protein, 10 aa, Mycobacterium
VTQRGGASLR

SEQ ID NO: 1177144 - protein, 10 aa, Mycobacterium
VTQTGSGPTV

SEQ ID NO: 1177145 - protein, 6 aa, Mycobacterium
VTRAGG

SEQ ID NO: 1177146 - protein, 6 aa, Mycobacterium
VTREGA

SEQ ID NO: 1177147 - protein, 15 aa, Mycobacterium
VTRGAERRAAIDEDR

SEQ ID NO: 1177148 - protein, 27 aa, Mycobacterium
VTRPDTQDALNADTSADLPRPATGDEL

SEQ ID NO: 1177149 - protein, 6 aa, Mycobacterium
VTRPGG

SEQ ID NO: 1177150 - protein, 9 aa, Mycobacterium
VTRPGQYEA

SEQ ID NO: 1177151 - protein, 8 aa, Mycobacterium
VTRPGRSF

SEQ ID NO: 1177152 - protein, 6 aa, Mycobacterium
VTRQGN

SEQ ID NO: 1177153 - protein, 9 aa, Mycobacterium
VTRRGGREG

SEQ ID NO: 1177154 - protein, 8 aa, Mycobacterium
VTRRPGGG

SEQ ID NO: 1177155 - protein, 11 aa, Mycobacterium
VTRTREALSEQ

SEQ ID NO: 1177156 - protein, 5 aa, Mycobacterium
VTSDG

SEQ ID NO: 1177157 - protein, 6 aa, Mycobacterium
VTSDTA

SEQ ID NO: 1177158 - protein, 13 aa, Mycobacterium
VTSPQEAEAAAAA

SEQ ID NO: 1177159 - protein, 20 aa, Mycobacterium
VTSRSAIAAERGVKGERRTA

SEQ ID NO: 1177160 - protein, 8 aa, Mycobacterium
VTSSPAAR

SEQ ID NO: 1177161 - protein, 15 aa, Mycobacterium
VTSSVGRLQKALDAL

SEQ ID NO: 1177162 - protein, 10 aa, Mycobacterium
VTSTSGPGVA

SEQ ID NO: 1177163 - protein, 6 aa, Mycobacterium
VTTADR

SEQ ID NO: 1177164 - protein, 5 aa, Mycobacterium
VTTAR

SEQ ID NO: 1177165 - protein, 4 aa, Mycobacterium
VTTD

SEQ ID NO: 1177166 - protein, 20 aa, Mycobacterium
VTTDHISPAGSIKPGTPAAQ

SEQ ID NO: 1177167 - protein, 16 aa, Mycobacterium
VTTGADPAAARQVAPK

SEQ ID NO: 1177168 - protein, 10 aa, Mycobacterium
VTTGSGTSGI

SEQ ID NO: 1177169 - protein, 6 aa, Mycobacterium
VTTLET

SEQ ID NO: 1177170 - protein, 8 aa, Mycobacterium
VTTPESQL

SEQ ID NO: 1177171 - protein, 8 aa, Mycobacterium
VTTSAKEA

SEQ ID NO: 1177172 - protein, 7 aa, Mycobacterium
VTTTAAT

SEQ ID NO: 1177173 - protein, 4 aa, Mycobacterium
VTVD

SEQ ID NO: 1177174 - protein, 17 aa, Mycobacterium
VTVSGSRLATNSISPAT

SEQ ID NO: 1177175 - protein, 10 aa, Mycobacterium
VTVTTADGRG

SEQ ID NO: 1177176 - protein, 8 aa, Mycobacterium
VTVTTDST

SEQ ID NO: 1177177 - protein, 7 aa, Mycobacterium
VTYEPDG

SEQ ID NO: 1177178 - protein, 10 aa, Mycobacterium
VTYPRGSEQF

SEQ ID NO: 1177179 - protein, 14 aa, Mycobacterium
VTYRPGARFGPSAI

SEQ ID NO: 1177180 - protein, 10 aa, Mycobacterium
VVDEGGQPCG

SEQ ID NO: 1177181 - protein, 8 aa, Mycobacterium
VVDPDDVE

SEQ ID NO: 1177182 - protein, 4 aa, Mycobacterium
VVEA

SEQ ID NO: 1177183 - protein, 14 aa, Mycobacterium
VVEEKQKDLLDSFY

SEQ ID NO: 1177184 - protein, 7 aa, Mycobacterium
VVGGPNP

SEQ ID NO: 1177185 - protein, 9 aa, Mycobacterium
VVPAGAPAA

SEQ ID NO: 1177186 - protein, 4 aa, Mycobacterium
VVPG

SEQ ID NO: 1177187 - protein, 12 aa, Mycobacterium
VVPPAEDDDSAE

SEQ ID NO: 1177188 - protein, 7 aa, Mycobacterium
VVPQPGG

SEQ ID NO: 1177189 - protein, 5 aa, Mycobacterium
VVPSS

SEQ ID NO: 1177190 - protein, 7 aa, Mycobacterium
VVSERAD

SEQ ID NO: 1177191 - protein, 6 aa, Mycobacterium
VVSGEP

SEQ ID NO: 1177192 - protein, 11 aa, Mycobacterium
VVSGPDGAKLD

SEQ ID NO: 1177193 - protein, 5 aa, Mycobacterium
VVSGS

SEQ ID NO: 1177194 - protein, 7 aa, Mycobacterium
VVSSEGV

SEQ ID NO: 1177195 - protein, 12 aa, Mycobacterium
VVTPTGNGYRRT

SEQ ID NO: 1177196 - protein, 8 aa, Mycobacterium
VYAPQEDS

SEQ ID NO: 1177197 - protein, 4 aa, Mycobacterium
VYPE

SEQ ID NO: 1177198 - protein, 7 aa, Mycobacterium
VYPPPSA

SEQ ID NO: 1177199 - protein, 6 aa, Mycobacterium
VYQGEE

SEQ ID NO: 1177200 - protein, 6 aa, Mycobacterium
VYSDAR

SEQ ID NO: 1177201 - protein, 10 aa, Mycobacterium
VYSDGASEEV

SEQ ID NO: 1177202 - protein, 12 aa, Mycobacterium
VYTPPDSPDAER

SEQ ID NO: 1177203 - protein, 29 aa, Mycobacterium
WAAPAPAPVGAPLPPPADVPLPPAPPVDS

SEQ ID NO: 1177204 - protein, 10 aa, Mycobacterium
WAATAGSGDV

SEQ ID NO: 1177205 - protein, 11 aa, Mycobacterium
WADAGKPRPHL

SEQ ID NO: 1177206 - protein, 8 aa, Mycobacterium
WAEADPDE

SEQ ID NO: 1177207 - protein, 6 aa, Mycobacterium
WAPDGT

SEQ ID NO: 1177208 - protein, 10 aa, Mycobacterium
WAPHGGESRV

SEQ ID NO: 1177209 - protein, 9 aa, Mycobacterium
WAPQTGQRT

SEQ ID NO: 1177210 - protein, 11 aa, Mycobacterium
WAPRGDRRPLP

SEQ ID NO: 1177211 - protein, 17 aa, Mycobacterium
WAPVGGAVDSASQAAQA

SEQ ID NO: 1177212 - protein, 10 aa, Mycobacterium
WARDARPGDT

SEQ ID NO: 1177213 - protein, 11 aa, Mycobacterium
WARPAQPGGSY

SEQ ID NO: 1177214 - protein, 8 aa, Mycobacterium
WARRTNGS

SEQ ID NO: 1177215 - protein, 21 aa, Mycobacterium
WASDPALATQAGRRAAHDEID

SEQ ID NO: 1177216 - protein, 7 aa, Mycobacterium
WASGEQW

SEQ ID NO: 1177217 - protein, 6 aa, Mycobacterium
WATPDL

SEQ ID NO: 1177218 - protein, 12 aa, Mycobacterium
WATTDDDIDRSA

SEQ ID NO: 1177219 - protein, 5 aa, Mycobacterium
WDDGD

SEQ ID NO: 1177220 - protein, 8 aa, Mycobacterium
WDEPNGGL

SEQ ID NO: 1177221 - protein, 11 aa, Mycobacterium
WDESGQPVQGE

SEQ ID NO: 1177222 - protein, 7 aa, Mycobacterium
WDGQDAA

SEQ ID NO: 1177223 - protein, 11 aa, Mycobacterium
WDGQGAGEDAK

SEQ ID NO: 1177224 - protein, 8 aa, Mycobacterium
WDKTDASY

SEQ ID NO: 1177225 - protein, 8 aa, Mycobacterium
WDNTSAEL

SEQ ID NO: 1177226 - protein, 8 aa, Mycobacterium
WDPKAQRP

SEQ ID NO: 1177227 - protein, 11 aa, Mycobacterium
WDPNSKPVKHS

SEQ ID NO: 1177228 - protein, 10 aa, Mycobacterium
WDPRAQRPEP

SEQ ID NO: 1177229 - protein, 11 aa, Mycobacterium
WDPSAGHRCDP

SEQ ID NO: 1177230 - protein, 7 aa, Mycobacterium
WDTNPRW

SEQ ID NO: 1177231 - protein, 10 aa, Mycobacterium
WDTPADGPVG

SEQ ID NO: 1177232 - protein, 10 aa, Mycobacterium
WEEGGPDSDR

SEQ ID NO: 1177233 - protein, 4 aa, Mycobacterium
WEIP

SEQ ID NO: 1177234 - protein, 6 aa, Mycobacterium
WEPNDE

SEQ ID NO: 1177235 - protein, 6 aa, Mycobacterium
WEPPRR

SEQ ID NO: 1177236 - protein, 11 aa, Mycobacterium
WEQPENPKPLG

SEQ ID NO: 1177237 - protein, 10 aa, Mycobacterium
WESRDETSAA

SEQ ID NO: 1177238 - protein, 5 aa, Mycobacterium
WGADD

SEQ ID NO: 1177239 - protein, 5 aa, Mycobacterium
WGDEN

SEQ ID NO: 1177240 - protein, 10 aa, Mycobacterium
WGDGALKDKP

SEQ ID NO: 1177241 - protein, 5 aa, Mycobacterium
WGGRQ

SEQ ID NO: 1177242 - protein, 19 aa, Mycobacterium
WGNGPDDPDDAEKIPVTPD

SEQ ID NO: 1177243 - protein, 9 aa, Mycobacterium
WGPARDVRD

SEQ ID NO: 1177244 - protein, 6 aa, Mycobacterium
WGPGAT

SEQ ID NO: 1177245 - protein, 4 aa, Mycobacterium
WGPR

SEQ ID NO: 1177246 - protein, 5 aa, Mycobacterium
WGPTV

SEQ ID NO: 1177247 - protein, 7 aa, Mycobacterium
WGQDADG

SEQ ID NO: 1177248 - protein, 13 aa, Mycobacterium
WGQTGPRSQQAGH

SEQ ID NO: 1177249 - protein, 9 aa, Mycobacterium
WGRSGERGA

SEQ ID NO: 1177250 - protein, 5 aa, Mycobacterium
WGSPS

SEQ ID NO: 1177251 - protein, 6 aa, Mycobacterium
WGSSSP

SEQ ID NO: 1177252 - protein, 8 aa, Mycobacterium
WKAKPTEL

SEQ ID NO: 1177253 - protein, 10 aa, Mycobacterium
WKANGRPDIE

SEQ ID NO: 1177254 - protein, 8 aa, Mycobacterium
WKDTPPAE

SEQ ID NO: 1177255 - protein, 13 aa, Mycobacterium
WKGNVKKSGFLPS

SEQ ID NO: 1177256 - protein, 22 aa, Mycobacterium
WKPDQYSNPMGPESHYETTGPE

SEQ ID NO: 1177257 - protein, 10 aa, Mycobacterium
WKPSENTENV

SEQ ID NO: 1177258 - protein, 9 aa, Mycobacterium
WKPSPGSVY

SEQ ID NO: 1177259 - protein, 9 aa, Mycobacterium
WKQKDYDEY

SEQ ID NO: 1177260 - protein, 18 aa, Mycobacterium
WNATTAARPPGPSAGQAV

SEQ ID NO: 1177261 - protein, 14 aa, Mycobacterium
WNGTDENVDGAYDD

SEQ ID NO: 1177262 - protein, 14 aa, Mycobacterium
WNPESWTPDAVPSV

SEQ ID NO: 1177263 - protein, 8 aa, Mycobacterium
WPDGPQRQ

SEQ ID NO: 1177264 - protein, 6 aa, Mycobacterium
WPDPSL

SEQ ID NO: 1177265 - protein, 5 aa, Mycobacterium
WPDQA

SEQ ID NO: 1177266 - protein, 7 aa, Mycobacterium
WPDSTKE

SEQ ID NO: 1177267 - protein, 4 aa, Mycobacterium
WPES

SEQ ID NO: 1177268 - protein, 6 aa, Mycobacterium
WPETVP

SEQ ID NO: 1177269 - protein, 9 aa, Mycobacterium
WPGSSDRNF

SEQ ID NO: 1177270 - protein, 6 aa, Mycobacterium
WPKPVP

SEQ ID NO: 1177271 - protein, 4 aa, Mycobacterium
WPKR

SEQ ID NO: 1177272 - protein, 9 aa, Mycobacterium
WPKTSGSRG

SEQ ID NO: 1177273 - protein, 8 aa, Mycobacterium
WPPDDARA

SEQ ID NO: 1177274 - protein, 14 aa, Mycobacterium
WPPYSFTGDVVSAD

SEQ ID NO: 1177275 - protein, 4 aa, Mycobacterium
WPQA

SEQ ID NO: 1177276 - protein, 11 aa, Mycobacterium
WPREGADLTGE

SEQ ID NO: 1177277 - protein, 15 aa, Mycobacterium
WPRPGPKDDKYTQGV

SEQ ID NO: 1177278 - protein, 7 aa, Mycobacterium
WPSGNSG

SEQ ID NO: 1177279 - protein, 12 aa, Mycobacterium
WPSTGVPNNPGA

SEQ ID NO: 1177280 - protein, 5 aa, Mycobacterium
WPTGE

SEQ ID NO: 1177281 - protein, 18 aa, Mycobacterium
WPTGTAAGAPPPSSDEAT

SEQ ID NO: 1177282 - protein, 6 aa, Mycobacterium
WPTGTQ

SEQ ID NO: 1177283 - protein, 9 aa, Mycobacterium
WPTPSGGHV

SEQ ID NO: 1177284 - protein, 4 aa, Mycobacterium
WPVE

SEQ ID NO: 1177285 - protein, 7 aa, Mycobacterium
WQGDTGM

SEQ ID NO: 1177286 - protein, 23 aa, Mycobacterium
WQGRAAAAAIAKAEANLDRQEEL

SEQ ID NO: 1177287 - protein, 12 aa, Mycobacterium
WQPNGRPRRAGV

SEQ ID NO: 1177288 - protein, 7 aa, Mycobacterium
WQPRGAL

SEQ ID NO: 1177289 - protein, 16 aa, Mycobacterium
WQPRGRGRSAHRSRPT

SEQ ID NO: 1177290 - protein, 6 aa, Mycobacterium
WQRGDR

SEQ ID NO: 1177291 - protein, 7 aa, Mycobacterium
WRATGGR

SEQ ID NO: 1177292 - protein, 18 aa, Mycobacterium
WRDPGHRRAARDCADRSS

SEQ ID NO: 1177293 - protein, 8 aa, Mycobacterium
WRNEKPKE

SEQ ID NO: 1177294 - protein, 7 aa, Mycobacterium
WRNPPST

SEQ ID NO: 1177295 - protein, 10 aa, Mycobacterium
WRPGPTADAI

SEQ ID NO: 1177296 - protein, 12 aa, Mycobacterium
WRSDGDPSNDAL

SEQ ID NO: 1177297 - protein, 41 aa, Mycobacterium
WRSPAGPVPEYPRASNDRGAPPVSPSRSAPAARRAADPSIE

SEQ ID NO: 1177298 - protein, 9 aa, Mycobacterium
WSANPTEPG

SEQ ID NO: 1177299 - protein, 9 aa, Mycobacterium
WSERQGESG

SEQ ID NO: 1177300 - protein, 10 aa, Mycobacterium
WSGAPRPVSA

SEQ ID NO: 1177301 - protein, 6 aa, Mycobacterium
WSGGGS

SEQ ID NO: 1177302 - protein, 14 aa, Mycobacterium
WSGGSEPGDEINPA

SEQ ID NO: 1177303 - protein, 6 aa, Mycobacterium
WSGHRR

SEQ ID NO: 1177304 - protein, 16 aa, Mycobacterium
WSGKGGPYIESRRQAE

SEQ ID NO: 1177305 - protein, 5 aa, Mycobacterium
WSGTE

SEQ ID NO: 1177306 - protein, 25 aa, Mycobacterium
WSHQGGTWGLPGGARDSHETPEQAA

SEQ ID NO: 1177307 - protein, 7 aa, Mycobacterium
WSNTGGA

SEQ ID NO: 1177308 - protein, 7 aa, Mycobacterium
WSPGASQ

SEQ ID NO: 1177309 - protein, 8 aa, Mycobacterium
WSPQPDTD

SEQ ID NO: 1177310 - protein, 15 aa, Mycobacterium
WSPTEARESKRRPTT

SEQ ID NO: 1177311 - protein, 5 aa, Mycobacterium
WSRDG

SEQ ID NO: 1177312 - protein, 10 aa, Mycobacterium
WSRPPRQMPG

SEQ ID NO: 1177313 - protein, 6 aa, Mycobacterium
WSSGSE

SEQ ID NO: 1177314 - protein, 5 aa, Mycobacterium
WSSTK

SEQ ID NO: 1177315 - protein, 10 aa, Mycobacterium
WSTDPRSRVP

SEQ ID NO: 1177316 - protein, 8 aa, Mycobacterium
WSTGGQLP

SEQ ID NO: 1177317 - protein, 11 aa, Mycobacterium
WSTGQPASTAD

SEQ ID NO: 1177318 - protein, 4 aa, Mycobacterium
WTAE

SEQ ID NO: 1177319 - protein, 11 aa, Mycobacterium
WTDPKQRSGDV

SEQ ID NO: 1177320 - protein, 13 aa, Mycobacterium
WTDRPRAFARRKG

SEQ ID NO: 1177321 - protein, 4 aa, Mycobacterium
WTEP

SEQ ID NO: 1177322 - protein, 8 aa, Mycobacterium
WTGDPGAV

SEQ ID NO: 1177323 - protein, 5 aa, Mycobacterium
WTPAN

SEQ ID NO: 1177324 - protein, 4 aa, Mycobacterium
WTPG

SEQ ID NO: 1177325 - protein, 10 aa, Mycobacterium
WTSNESKVVE

SEQ ID NO: 1177326 - protein, 7 aa, Mycobacterium
WTSSSRK

SEQ ID NO: 1177327 - protein, 10 aa, Mycobacterium
WTTDNKKALE

SEQ ID NO: 1177328 - protein, 10 aa, Mycobacterium
WVEPTDELTG

SEQ ID NO: 1177329 - protein, 15 aa, Mycobacterium
YAAATSRRVAAEAGV

SEQ ID NO: 1177330 - protein, 7 aa, Mycobacterium
YAADTGT

SEQ ID NO: 1177331 - protein, 10 aa, Mycobacterium
YAANQHAGGA

SEQ ID NO: 1177332 - protein, 26 aa, Mycobacterium
YAAPGANLPHDDAHTGRDDRTTGQRH

SEQ ID NO: 1177333 - protein, 26 aa, Mycobacterium
YAAPGTNLPHDDTHTGRDDRTTGQRH

SEQ ID NO: 1177334 - protein, 14 aa, Mycobacterium
YAARSQERAAAAWS

SEQ ID NO: 1177335 - protein, 9 aa, Mycobacterium
YAASKGALA

SEQ ID NO: 1177336 - protein, 10 aa, Mycobacterium
YAASTASGST

SEQ ID NO: 1177337 - protein, 10 aa, Mycobacterium
YAATASTAYQ

SEQ ID NO: 1177338 - protein, 6 aa, Mycobacterium
YADAGA

SEQ ID NO: 1177339 - protein, 10 aa, Mycobacterium
YADDPRFASA

SEQ ID NO: 1177340 - protein, 5 aa, Mycobacterium
YADES

SEQ ID NO: 1177341 - protein, 6 aa, Mycobacterium
YADGDG

SEQ ID NO: 1177342 - protein, 29 aa, Mycobacterium
YADGLDGGKPEAQPKFEGDGSQVKRNEHH

SEQ ID NO: 1177343 - protein, 8 aa, Mycobacterium
YADNRDSG

SEQ ID NO: 1177344 - protein, 5 aa, Mycobacterium
YADPK

SEQ ID NO: 1177345 - protein, 9 aa, Mycobacterium
YADSPSDEA

SEQ ID NO: 1177346 - protein, 7 aa, Mycobacterium
YAEAERR

SEQ ID NO: 1177347 - protein, 17 aa, Mycobacterium
YAEGSSSAGGGSPYRDT

SEQ ID NO: 1177348 - protein, 6 aa, Mycobacterium
YAEGTI

SEQ ID NO: 1177349 - protein, 4 aa, Mycobacterium
YAEP

SEQ ID NO: 1177350 - protein, 17 aa, Mycobacterium
YAEPAPEAFGRYRTFCG

SEQ ID NO: 1177351 - protein, 18 aa, Mycobacterium
YAEPGTARAYDPESNESI

SEQ ID NO: 1177352 - protein, 6 aa, Mycobacterium
YAESEG

SEQ ID NO: 1177353 - protein, 30 aa, Mycobacterium
YAESGGQIADEGTITGTGASQTAKAAVSDV

SEQ ID NO: 1177354 - protein, 13 aa, Mycobacterium
YAETAGGSPIRAK

SEQ ID NO: 1177355 - protein, 8 aa, Mycobacterium
YAGAPRDP

SEQ ID NO: 1177356 - protein, 13 aa, Mycobacterium
YAGAQPQRIAIEN

SEQ ID NO: 1177357 - protein, 11 aa, Mycobacterium
YAGARKPETVD

SEQ ID NO: 1177358 - protein, 5 aa, Mycobacterium
YAGGM

SEQ ID NO: 1177359 - protein, 12 aa, Mycobacterium
YAGLPTSAGSRA

SEQ ID NO: 1177360 - protein, 15 aa, Mycobacterium
YAGTETSVSEPSGAD

SEQ ID NO: 1177361 - protein, 5 aa, Mycobacterium
YALGG

SEQ ID NO: 1177362 - protein, 12 aa, Mycobacterium
YANELSGGQQQR

SEQ ID NO: 1177363 - protein, 10 aa, Mycobacterium
YANHADPKQV

SEQ ID NO: 1177364 - protein, 6 aa, Mycobacterium
YAPAHR

SEQ ID NO: 1177365 - protein, 9 aa, Mycobacterium
YAPGARQRG

SEQ ID NO: 1177366 - protein, 12 aa, Mycobacterium
YAPHPGEPGAER

SEQ ID NO: 1177367 - protein, 12 aa, Mycobacterium
YAPNEFKDPSGK

SEQ ID NO: 1177368 - protein, 6 aa, Mycobacterium
YAPQGA

SEQ ID NO: 1177369 - protein, 7 aa, Mycobacterium
YAPRRQK

SEQ ID NO: 1177370 - protein, 8 aa, Mycobacterium
YAPTQDGD

SEQ ID NO: 1177371 - protein, 11 aa, Mycobacterium
YAPTSRLGTPD

SEQ ID NO: 1177372 - protein, 8 aa, Mycobacterium
YAPTTGPL

SEQ ID NO: 1177373 - protein, 11 aa, Mycobacterium
YAQPRDGETSA

SEQ ID NO: 1177374 - protein, 8 aa, Mycobacterium
YAQQPADH

SEQ ID NO: 1177375 - protein, 5 aa, Mycobacterium
YAREG

SEQ ID NO: 1177376 - protein, 21 aa, Mycobacterium
YARERPQGRPVTAKDPATPQV

SEQ ID NO: 1177377 - protein, 16 aa, Mycobacterium
YARTSPLQRAGAGGLT

SEQ ID NO: 1177378 - protein, 11 aa, Mycobacterium
YARYDESSATR

SEQ ID NO: 1177379 - protein, 5 aa, Mycobacterium
YASAA

SEQ ID NO: 1177380 - protein, 9 aa, Mycobacterium
YASGTSAKE

SEQ ID NO: 1177381 - protein, 11 aa, Mycobacterium
YASRGRESVTA

SEQ ID NO: 1177382 - protein, 15 aa, Mycobacterium
YASRTRQPASGSPEL

SEQ ID NO: 1177383 - protein, 15 aa, Mycobacterium
YATESGIDLWRESSD

SEQ ID NO: 1177384 - protein, 6 aa, Mycobacterium
YATPGQ

SEQ ID NO: 1177385 - protein, 9 aa, Mycobacterium
YATSQPAAI

SEQ ID NO: 1177386 - protein, 15 aa, Mycobacterium
YCDPKEFQKVGLTVG

SEQ ID NO: 1177387 - protein, 13 aa, Mycobacterium
YCGTSGATAAGGN

SEQ ID NO: 1177388 - protein, 13 aa, Mycobacterium
YDADGAVRKPGQN

SEQ ID NO: 1177389 - protein, 10 aa, Mycobacterium
YDANPLETDE

SEQ ID NO: 1177390 - protein, 12 aa, Mycobacterium
YDDATASYDPST

SEQ ID NO: 1177391 - protein, 22 aa, Mycobacterium
YDDKDPDVVGEPDPLIVGRALE

SEQ ID NO: 1177392 - protein, 11 aa, Mycobacterium
YDDKPNLRTRK

SEQ ID NO: 1177393 - protein, 8 aa, Mycobacterium
YDDPEASL

SEQ ID NO: 1177394 - protein, 5 aa, Mycobacterium
YDDPG

SEQ ID NO: 1177395 - protein, 9 aa, Mycobacterium
YDDSQGVTA

SEQ ID NO: 1177396 - protein, 8 aa, Mycobacterium
YDEDRGRY

SEQ ID NO: 1177397 - protein, 13 aa, Mycobacterium
YDEGDTFDQSSAK

SEQ ID NO: 1177398 - protein, 7 aa, Mycobacterium
YDESDAR

SEQ ID NO: 1177399 - protein, 9 aa, Mycobacterium
YDGARPVRI

SEQ ID NO: 1177400 - protein, 14 aa, Mycobacterium
YDGDPRKAGPDNPA

SEQ ID NO: 1177401 - protein, 4 aa, Mycobacterium
YDGE

SEQ ID NO: 1177402 - protein, 9 aa, Mycobacterium
YDGSLAEGG

SEQ ID NO: 1177403 - protein, 12 aa, Mycobacterium
YDGSTAGPADAE

SEQ ID NO: 1177404 - protein, 5 aa, Mycobacterium
YDGTD

SEQ ID NO: 1177405 - protein, 7 aa, Mycobacterium
YDLPGSP

SEQ ID NO: 1177406 - protein, 7 aa, Mycobacterium
YDLPPDL

SEQ ID NO: 1177407 - protein, 7 aa, Mycobacterium
YDNVDTH

SEQ ID NO: 1177408 - protein, 6 aa, Mycobacterium
YDPANT

SEQ ID NO: 1177409 - protein, 6 aa, Mycobacterium
YDPDAL

SEQ ID NO: 1177410 - protein, 8 aa, Mycobacterium
YDPDEDRS

SEQ ID NO: 1177411 - protein, 8 aa, Mycobacterium
YDPGSTTD

SEQ ID NO: 1177412 - protein, 10 aa, Mycobacterium
YDPKPAAAPS

SEQ ID NO: 1177413 - protein, 8 aa, Mycobacterium
YDPRDPAE

SEQ ID NO: 1177414 - protein, 10 aa, Mycobacterium
YDPRKRLGED

SEQ ID NO: 1177415 - protein, 7 aa, Mycobacterium
YDRAATS

SEQ ID NO: 1177416 - protein, 7 aa, Mycobacterium
YDRAEAA

SEQ ID NO: 1177417 - protein, 9 aa, Mycobacterium
YDRDPARER

SEQ ID NO: 1177418 - protein, 10 aa, Mycobacterium
YDRESSPGEH

SEQ ID NO: 1177419 - protein, 4 aa, Mycobacterium
YDRR

SEQ ID NO: 1177420 - protein, 11 aa, Mycobacterium
YDRTGSVASSL

SEQ ID NO: 1177421 - protein, 9 aa, Mycobacterium
YDSDGTPCE

SEQ ID NO: 1177422 - protein, 4 aa, Mycobacterium
YDSE

SEQ ID NO: 1177423 - protein, 4 aa, Mycobacterium
YDSP

SEQ ID NO: 1177424 - protein, 12 aa, Mycobacterium
YDSSDKGFDGTT

SEQ ID NO: 1177425 - protein, 10 aa, Mycobacterium
YDTATAAAKT

SEQ ID NO: 1177426 - protein, 24 aa, Mycobacterium
YDTPPPPIEAGSEYSQDRDPRYAD

SEQ ID NO: 1177427 - protein, 5 aa, Mycobacterium
YDTSS

SEQ ID NO: 1177428 - protein, 14 aa, Mycobacterium
YDYTEDPTLNWSTP

SEQ ID NO: 1177429 - protein, 9 aa, Mycobacterium
YEASGIAKH

SEQ ID NO: 1177430 - protein, 5 aa, Mycobacterium
YEDGN

SEQ ID NO: 1177431 - protein, 12 aa, Mycobacterium
YEDGTEMSRSEI

SEQ ID NO: 1177432 - protein, 7 aa, Mycobacterium
YEDPDAE

SEQ ID NO: 1177433 - protein, 10 aa, Mycobacterium
YEEAGEQEAD

SEQ ID NO: 1177434 - protein, 5 aa, Mycobacterium
YEEGG

SEQ ID NO: 1177435 - protein, 4 aa, Mycobacterium
YEEP

SEQ ID NO: 1177436 - protein, 10 aa, Mycobacterium
YEGDRPGAPT

SEQ ID NO: 1177437 - protein, 8 aa, Mycobacterium
YEGEDAAR

SEQ ID NO: 1177438 - protein, 7 aa, Mycobacterium
YEGFGPG

SEQ ID NO: 1177439 - protein, 10 aa, Mycobacterium
YEGSREAERL

SEQ ID NO: 1177440 - protein, 6 aa, Mycobacterium
YEHREE

SEQ ID NO: 1177441 - protein, 6 aa, Mycobacterium
YEHSPR

SEQ ID NO: 1177442 - protein, 8 aa, Mycobacterium
YENNSLDT

SEQ ID NO: 1177443 - protein, 13 aa, Mycobacterium
YEPAGNPNGEGPD

SEQ ID NO: 1177444 - protein, 6 aa, Mycobacterium
YEPGSG

SEQ ID NO: 1177445 - protein, 5 aa, Mycobacterium
YEPLT

SEQ ID NO: 1177446 - protein, 5 aa, Mycobacterium
YEPNA

SEQ ID NO: 1177447 - protein, 4 aa, Mycobacterium
YEPP

SEQ ID NO: 1177448 - protein, 8 aa, Mycobacterium
YEPRGGTR

SEQ ID NO: 1177449 - protein, 12 aa, Mycobacterium
YEPTRGSATVTG

SEQ ID NO: 1177450 - protein, 6 aa, Mycobacterium
YEQGGI

SEQ ID NO: 1177451 - protein, 7 aa, Mycobacterium
YERRRSE

SEQ ID NO: 1177452 - protein, 7 aa, Mycobacterium
YERSTGD

SEQ ID NO: 1177453 - protein, 5 aa, Mycobacterium
YESAA

SEQ ID NO: 1177454 - protein, 18 aa, Mycobacterium
YESPAAEDETWDRPDATP

SEQ ID NO: 1177455 - protein, 11 aa, Mycobacterium
YESRSAPVEGG

SEQ ID NO: 1177456 - protein, 7 aa, Mycobacterium
YESTGAY

SEQ ID NO: 1177457 - protein, 6 aa, Mycobacterium
YETERK

SEQ ID NO: 1177458 - protein, 8 aa, Mycobacterium
YETERRPV

SEQ ID NO: 1177459 - protein, 5 aa, Mycobacterium
YFPGP

SEQ ID NO: 1177460 - protein, 12 aa, Mycobacterium
YGAARATLAGAR

SEQ ID NO: 1177461 - protein, 20 aa, Mycobacterium
YGADAGGRLHRTGDQARWSA

SEQ ID NO: 1177462 - protein, 13 aa, Mycobacterium
YGAPGTASATILT

SEQ ID NO: 1177463 - protein, 9 aa, Mycobacterium
YGARSGTGI

SEQ ID NO: 1177464 - protein, 4 aa, Mycobacterium
YGDL

SEQ ID NO: 1177465 - protein, 4 aa, Mycobacterium
YGDQ

SEQ ID NO: 1177466 - protein, 7 aa, Mycobacterium
YGDYNDS

SEQ ID NO: 1177467 - protein, 12 aa, Mycobacterium
YGEDAGDEGDLE

SEQ ID NO: 1177468 - protein, 8 aa, Mycobacterium
YGEDDETV

SEQ ID NO: 1177469 - protein, 12 aa, Mycobacterium
YGEQSCTAGRSS

SEQ ID NO: 1177470 - protein, 8 aa, Mycobacterium
YGEQTRTT

SEQ ID NO: 1177471 - protein, 9 aa, Mycobacterium
YGESADDKT

SEQ ID NO: 1177472 - protein, 12 aa, Mycobacterium
YGFSGKPTSAGW

SEQ ID NO: 1177473 - protein, 7 aa, Mycobacterium
YGGAADP

SEQ ID NO: 1177474 - protein, 12 aa, Mycobacterium
YGGEPDPATVSR

SEQ ID NO: 1177475 - protein, 10 aa, Mycobacterium
YGGGSRWNAG

SEQ ID NO: 1177476 - protein, 20 aa, Mycobacterium
YGGNPGRPTEDGLAADARAA

SEQ ID NO: 1177477 - protein, 12 aa, Mycobacterium
YGGPPDGPWPDA

SEQ ID NO: 1177478 - protein, 15 aa, Mycobacterium
YGGRITSTSDVATRA

SEQ ID NO: 1177479 - protein, 4 aa, Mycobacterium
YGGS

SEQ ID NO: 1177480 - protein, 4 aa, Mycobacterium
YGGT

SEQ ID NO: 1177481 - protein, 16 aa, Mycobacterium
YGGTGYPAGKGAVNGL

SEQ ID NO: 1177482 - protein, 4 aa, Mycobacterium
YGGV

SEQ ID NO: 1177483 - protein, 6 aa, Mycobacterium
YGGYKA

SEQ ID NO: 1177484 - protein, 18 aa, Mycobacterium
YGLTEAGTATLSRPGDSF

SEQ ID NO: 1177485 - protein, 13 aa, Mycobacterium
YGNAPDKQRVQGG

SEQ ID NO: 1177486 - protein, 7 aa, Mycobacterium
YGNEGNV

SEQ ID NO: 1177487 - protein, 10 aa, Mycobacterium
YGNPAEPDTA

SEQ ID NO: 1177488 - protein, 9 aa, Mycobacterium
YGNPDDPDD

SEQ ID NO: 1177489 - protein, 8 aa, Mycobacterium
YGNPTDVA

SEQ ID NO: 1177490 - protein, 9 aa, Mycobacterium
YGNPTGFSG

SEQ ID NO: 1177491 - protein, 7 aa, Mycobacterium
YGNQPSI

SEQ ID NO: 1177492 - protein, 9 aa, Mycobacterium
YGNTASTTH

SEQ ID NO: 1177493 - protein, 8 aa, Mycobacterium
YGPATTAH

SEQ ID NO: 1177494 - protein, 11 aa, Mycobacterium
YGPDGQRRGAG

SEQ ID NO: 1177495 - protein, 10 aa, Mycobacterium
YGPDVEATAA

SEQ ID NO: 1177496 - protein, 30 aa, Mycobacterium
YGPDVTTQATVPADAATTASMRTREPGVAA

SEQ ID NO: 1177497 - protein, 4 aa, Mycobacterium
YGPE

SEQ ID NO: 1177498 - protein, 10 aa, Mycobacterium
YGPEGGAPAD

SEQ ID NO: 1177499 - protein, 7 aa, Mycobacterium
YGPETEA

SEQ ID NO: 1177500 - protein, 17 aa, Mycobacterium
YGPGDRSGEPPAPGTYP

SEQ ID NO: 1177501 - protein, 7 aa, Mycobacterium
YGPGGHP

SEQ ID NO: 1177502 - protein, 5 aa, Mycobacterium
YGPGI

SEQ ID NO: 1177503 - protein, 5 aa, Mycobacterium
YGPQI

SEQ ID NO: 1177504 - protein, 16 aa, Mycobacterium
YGPRSMKKDKSEVKRR

SEQ ID NO: 1177505 - protein, 17 aa, Mycobacterium
YGPRTGGRSKVSGSLRG

SEQ ID NO: 1177506 - protein, 6 aa, Mycobacterium
YGPSGI

SEQ ID NO: 1177507 - protein, 10 aa, Mycobacterium
YGPTSDIDPA

SEQ ID NO: 1177508 - protein, 12 aa, Mycobacterium
YGQSEERGCCVD

SEQ ID NO: 1177509 - protein, 4 aa, Mycobacterium
YGRY

SEQ ID NO: 1177510 - protein, 12 aa, Mycobacterium
YGSAGPDADRAA

SEQ ID NO: 1177511 - protein, 5 aa, Mycobacterium
YGSER

SEQ ID NO: 1177512 - protein, 8 aa, Mycobacterium
YGSGAQAV

SEQ ID NO: 1177513 - protein, 10 aa, Mycobacterium
YGSKAGPLQA

SEQ ID NO: 1177514 - protein, 4 aa, Mycobacterium
YGSN

SEQ ID NO: 1177515 - protein, 15 aa, Mycobacterium
YGSQTVTGPGWPNVD

SEQ ID NO: 1177516 - protein, 11 aa, Mycobacterium
YGSRSTPVSGA

SEQ ID NO: 1177517 - protein, 10 aa, Mycobacterium
YGSSNAPHDI

SEQ ID NO: 1177518 - protein, 13 aa, Mycobacterium
YGSTETAEKLATT

SEQ ID NO: 1177519 - protein, 8 aa, Mycobacterium
YGTASAGS

SEQ ID NO: 1177520 - protein, 6 aa, Mycobacterium
YGTEGH

SEQ ID NO: 1177521 - protein, 5 aa, Mycobacterium
YGTNN

SEQ ID NO: 1177522 - protein, 6 aa, Mycobacterium
YGVTPG

SEQ ID NO: 1177523 - protein, 8 aa, Mycobacterium
YGVTPQGW

SEQ ID NO: 1177524 - protein, 11 aa, Mycobacterium
YGYDDLPADDV

SEQ ID NO: 1177525 - protein, 4 aa, Mycobacterium
YGYP

SEQ ID NO: 1177526 - protein, 18 aa, Mycobacterium
YGYQGQRPLRESDPPGVP

SEQ ID NO: 1177527 - protein, 5 aa, Mycobacterium
YHEQE

SEQ ID NO: 1177528 - protein, 9 aa, Mycobacterium
YHPHGDSSI

SEQ ID NO: 1177529 - protein, 18 aa, Mycobacterium
YHPRARSGWDREAGRLPA

SEQ ID NO: 1177530 - protein, 6 aa, Mycobacterium
YHRDGL

SEQ ID NO: 1177531 - protein, 4 aa, Mycobacterium
YHTP

SEQ ID NO: 1177532 - protein, 5 aa, Mycobacterium
YIGPR

SEQ ID NO: 1177533 - protein, 6 aa, Mycobacterium
YITTPG

SEQ ID NO: 1177534 - protein, 4 aa, Mycobacterium
YKDY

SEQ ID NO: 1177535 - protein, 9 aa, Mycobacterium
YKQKPGRDV

SEQ ID NO: 1177536 - protein, 8 aa, Mycobacterium
YKSPVTAS

SEQ ID NO: 1177537 - protein, 7 aa, Mycobacterium
YKTPDAL

SEQ ID NO: 1177538 - protein, 7 aa, Mycobacterium
YLGEQAD

SEQ ID NO: 1177539 - protein, 7 aa, Mycobacterium
YLPGPND

SEQ ID NO: 1177540 - protein, 4 aa, Mycobacterium
YLSE

SEQ ID NO: 1177541 - protein, 7 aa, Mycobacterium
YLTDETP

SEQ ID NO: 1177542 - protein, 4 aa, Mycobacterium
YNEA

SEQ ID NO: 1177543 - protein, 13 aa, Mycobacterium
YNEERGIDPKPLR

SEQ ID NO: 1177544 - protein, 8 aa, Mycobacterium
YNKSSGDV

SEQ ID NO: 1177545 - protein, 4 aa, Mycobacterium
YNPA

SEQ ID NO: 1177546 - protein, 15 aa, Mycobacterium
YNPEPPETRDDTRTP

SEQ ID NO: 1177547 - protein, 4 aa, Mycobacterium
YNRE

SEQ ID NO: 1177548 - protein, 4 aa, Mycobacterium
YNVG

SEQ ID NO: 1177549 - protein, 11 aa, Mycobacterium
YPAASAPARKV

SEQ ID NO: 1177550 - protein, 10 aa, Mycobacterium
YPAATAEDLA

SEQ ID NO: 1177551 - protein, 5 aa, Mycobacterium
YPAGE

SEQ ID NO: 1177552 - protein, 8 aa, Mycobacterium
YPASAGPR

SEQ ID NO: 1177553 - protein, 4 aa, Mycobacterium
YPDA

SEQ ID NO: 1177554 - protein, 5 aa, Mycobacterium
YPDDV

SEQ ID NO: 1177555 - protein, 9 aa, Mycobacterium
YPDGGPHLQ

SEQ ID NO: 1177556 - protein, 16 aa, Mycobacterium
YPDGGSSVRLVNQTAH

SEQ ID NO: 1177557 - protein, 10 aa, Mycobacterium
YPDQPKNYQI

SEQ ID NO: 1177558 - protein, 6 aa, Mycobacterium
YPDREM

SEQ ID NO: 1177559 - protein, 6 aa, Mycobacterium
YPDRNA

SEQ ID NO: 1177560 - protein, 18 aa, Mycobacterium
YPDRNPNEPYSVGDPNAG

SEQ ID NO: 1177561 - protein, 10 aa, Mycobacterium
YPDSEKTTAV

SEQ ID NO: 1177562 - protein, 27 aa, Mycobacterium
YPDSTTEATTDEDEVGRVGANGVPDTV

SEQ ID NO: 1177563 - protein, 10 aa, Mycobacterium
YPEGVPGPDR

SEQ ID NO: 1177564 - protein, 5 aa, Mycobacterium
YPEHG

SEQ ID NO: 1177565 - protein, 4 aa, Mycobacterium
YPEL

SEQ ID NO: 1177566 - protein, 7 aa, Mycobacterium
YPELNES

SEQ ID NO: 1177567 - protein, 10 aa, Mycobacterium
YPEPSFASDG

SEQ ID NO: 1177568 - protein, 4 aa, Mycobacterium
YPGA

SEQ ID NO: 1177569 - protein, 8 aa, Mycobacterium
YPGAEQAT

SEQ ID NO: 1177570 - protein, 11 aa, Mycobacterium
YPGATEPAVDD

SEQ ID NO: 1177571 - protein, 8 aa, Mycobacterium
YPGDAGRE

SEQ ID NO: 1177572 - protein, 7 aa, Mycobacterium
YPGGAGF

SEQ ID NO: 1177573 - protein, 5 aa, Mycobacterium
YPGGK

SEQ ID NO: 1177574 - protein, 6 aa, Mycobacterium
YPGHRD

SEQ ID NO: 1177575 - protein, 11 aa, Mycobacterium
YPGRAGRHDVP

SEQ ID NO: 1177576 - protein, 11 aa, Mycobacterium
YPHNESTFGYS

SEQ ID NO: 1177577 - protein, 9 aa, Mycobacterium
YPKTGVEEI

SEQ ID NO: 1177578 - protein, 9 aa, Mycobacterium
YPKTSGGRG

SEQ ID NO: 1177579 - protein, 8 aa, Mycobacterium
YPLPDTET

SEQ ID NO: 1177580 - protein, 6 aa, Mycobacterium
YPNPND

SEQ ID NO: 1177581 - protein, 7 aa, Mycobacterium
YPPDDEL

SEQ ID NO: 1177582 - protein, 9 aa, Mycobacterium
YPPPADPRL

SEQ ID NO: 1177583 - protein, 5 aa, Mycobacterium
YPPRL

SEQ ID NO: 1177584 - protein, 22 aa, Mycobacterium
YPPRPPDEKVPPTSKLAPVPDA

SEQ ID NO: 1177585 - protein, 6 aa, Mycobacterium
YPQAEE

SEQ ID NO: 1177586 - protein, 5 aa, Mycobacterium
YPQAR

SEQ ID NO: 1177587 - protein, 7 aa, Mycobacterium
YPQETEN

SEQ ID NO: 1177588 - protein, 6 aa, Mycobacterium
YPQGAE

SEQ ID NO: 1177589 - protein, 8 aa, Mycobacterium
YPQGVPPK

SEQ ID NO: 1177590 - protein, 8 aa, Mycobacterium
YPQRGEHL

SEQ ID NO: 1177591 - protein, 4 aa, Mycobacterium
YPQY

SEQ ID NO: 1177592 - protein, 5 aa, Mycobacterium
YPRAR

SEQ ID NO: 1177593 - protein, 4 aa, Mycobacterium
YPRE

SEQ ID NO: 1177594 - protein, 8 aa, Mycobacterium
YPRESPGG

SEQ ID NO: 1177595 - protein, 9 aa, Mycobacterium
YPRGTEEQR

SEQ ID NO: 1177596 - protein, 6 aa, Mycobacterium
YPRSEA

SEQ ID NO: 1177597 - protein, 9 aa, Mycobacterium
YPSDGRATS

SEQ ID NO: 1177598 - protein, 5 aa, Mycobacterium
YPSGE

SEQ ID NO: 1177599 - protein, 14 aa, Mycobacterium
YPSPALASPTGTLG

SEQ ID NO: 1177600 - protein, 7 aa, Mycobacterium
YPSPEVE

SEQ ID NO: 1177601 - protein, 8 aa, Mycobacterium
YPSTRRDW

SEQ ID NO: 1177602 - protein, 7 aa, Mycobacterium
YPTKPGS

SEQ ID NO: 1177603 - protein, 4 aa, Mycobacterium
YPTT

SEQ ID NO: 1177604 - protein, 6 aa, Mycobacterium
YPVQQG

SEQ ID NO: 1177605 - protein, 7 aa, Mycobacterium
YQAESQL

SEQ ID NO: 1177606 - protein, 4 aa, Mycobacterium
YQAG

SEQ ID NO: 1177607 - protein, 5 aa, Mycobacterium
YQANT

SEQ ID NO: 1177608 - protein, 13 aa, Mycobacterium
YQDSDGNVDFPEG

SEQ ID NO: 1177609 - protein, 24 aa, Mycobacterium
YQGKESAEAGTGGRGGESGNPSTS

SEQ ID NO: 1177610 - protein, 10 aa, Mycobacterium
YQNPTESFTD

SEQ ID NO: 1177611 - protein, 11 aa, Mycobacterium
YQPAGDQPAAI

SEQ ID NO: 1177612 - protein, 7 aa, Mycobacterium
YQPAMTN

SEQ ID NO: 1177613 - protein, 9 aa, Mycobacterium
YQPDPSLAR

SEQ ID NO: 1177614 - protein, 8 aa, Mycobacterium
YQQEATAI

SEQ ID NO: 1177615 - protein, 5 aa, Mycobacterium
YQRPE

SEQ ID NO: 1177616 - protein, 6 aa, Mycobacterium
YQRTTA

SEQ ID NO: 1177617 - protein, 9 aa, Mycobacterium
YQSRQDPAI

SEQ ID NO: 1177618 - protein, 19 aa, Mycobacterium
YRAGEGVGPANRVPTLPGA

SEQ ID NO: 1177619 - protein, 11 aa, Mycobacterium
YRAGRPPLDVS

SEQ ID NO: 1177620 - protein, 8 aa, Mycobacterium
YRATTGTV

SEQ ID NO: 1177621 - protein, 10 aa, Mycobacterium
YRATTTREIA

SEQ ID NO: 1177622 - protein, 4 aa, Mycobacterium
YRDR

SEQ ID NO: 1177623 - protein, 8 aa, Mycobacterium
YRDRSHKP

SEQ ID NO: 1177624 - protein, 6 aa, Mycobacterium
YRDTAA

SEQ ID NO: 1177625 - protein, 6 aa, Mycobacterium
YRDTSM

SEQ ID NO: 1177626 - protein, 11 aa, Mycobacterium
YREGVAKAESL

SEQ ID NO: 1177627 - protein, 7 aa, Mycobacterium
YRGAPNE

SEQ ID NO: 1177628 - protein, 9 aa, Mycobacterium
YRGGPRTDE

SEQ ID NO: 1177629 - protein, 7 aa, Mycobacterium
YRGPTGT

SEQ ID NO: 1177630 - protein, 5 aa, Mycobacterium
YRGRP

SEQ ID NO: 1177631 - protein, 5 aa, Mycobacterium
YRHDP

SEQ ID NO: 1177632 - protein, 9 aa, Mycobacterium
YRIEGQKTA

SEQ ID NO: 1177633 - protein, 5 aa, Mycobacterium
YRKDN

SEQ ID NO: 1177634 - protein, 4 aa, Mycobacterium
YRNP

SEQ ID NO: 1177635 - protein, 13 aa, Mycobacterium
YRPDPAEPSQAAA

SEQ ID NO: 1177636 - protein, 12 aa, Mycobacterium
YRPDSSAPKVVG

SEQ ID NO: 1177637 - protein, 8 aa, Mycobacterium
YRPGRPNA

SEQ ID NO: 1177638 - protein, 14 aa, Mycobacterium
YRPGRRPVTAANSA

SEQ ID NO: 1177639 - protein, 7 aa, Mycobacterium
YRPGTTV

SEQ ID NO: 1177640 - protein, 8 aa, Mycobacterium
YRPPARPD

SEQ ID NO: 1177641 - protein, 17 aa, Mycobacterium
YRPSSGSVTFDGKPLGR

SEQ ID NO: 1177642 - protein, 5 aa, Mycobacterium
YRPTA

SEQ ID NO: 1177643 - protein, 6 aa, Mycobacterium
YRQSRD

SEQ ID NO: 1177644 - protein, 7 aa, Mycobacterium
YRRARGR

SEQ ID NO: 1177645 - protein, 17 aa, Mycobacterium
YRRDSDGNHWTLVRSRT

SEQ ID NO: 1177646 - protein, 6 aa, Mycobacterium
YRREGD

SEQ ID NO: 1177647 - protein, 5 aa, Mycobacterium
YRRHN

SEQ ID NO: 1177648 - protein, 4 aa, Mycobacterium
YRSA

SEQ ID NO: 1177649 - protein, 5 aa, Mycobacterium
YRSAG

SEQ ID NO: 1177650 - protein, 10 aa, Mycobacterium
YRSEADGGFS

SEQ ID NO: 1177651 - protein, 14 aa, Mycobacterium
YRSESDRLSGPYGR

SEQ ID NO: 1177652 - protein, 8 aa, Mycobacterium
YRSGRGTT

SEQ ID NO: 1177653 - protein, 9 aa, Mycobacterium
YRSGRGTTA

SEQ ID NO: 1177654 - protein, 5 aa, Mycobacterium
YRSTQ

SEQ ID NO: 1177655 - protein, 5 aa, Mycobacterium
YRTKG

SEQ ID NO: 1177656 - protein, 11 aa, Mycobacterium
YRTQQSRYETA

SEQ ID NO: 1177657 - protein, 10 aa, Mycobacterium
YRVGGPASTI

SEQ ID NO: 1177658 - protein, 8 aa, Mycobacterium
YSAPSDSI

SEQ ID NO: 1177659 - protein, 10 aa, Mycobacterium
YSAQEATKAL

SEQ ID NO: 1177660 - protein, 10 aa, Mycobacterium
YSASKGAVKQ

SEQ ID NO: 1177661 - protein, 7 aa, Mycobacterium
YSDGGAH

SEQ ID NO: 1177662 - protein, 8 aa, Mycobacterium
YSDPGMDG

SEQ ID NO: 1177663 - protein, 8 aa, Mycobacterium
YSDPPALA

SEQ ID NO: 1177664 - protein, 9 aa, Mycobacterium
YSEDSRAEV

SEQ ID NO: 1177665 - protein, 8 aa, Mycobacterium
YSEEENRH

SEQ ID NO: 1177666 - protein, 11 aa, Mycobacterium
YSEPGAGSDLA

SEQ ID NO: 1177667 - protein, 14 aa, Mycobacterium
YSERTGDGRLRQPS

SEQ ID NO: 1177668 - protein, 6 aa, Mycobacterium
YSGDVD

SEQ ID NO: 1177669 - protein, 18 aa, Mycobacterium
YSGEGSTDLDVVVEITRL

SEQ ID NO: 1177670 - protein, 13 aa, Mycobacterium
YSGPRARGMASSA

SEQ ID NO: 1177671 - protein, 9 aa, Mycobacterium
YSGRPSPLY

SEQ ID NO: 1177672 - protein, 5 aa, Mycobacterium
YSHSA

SEQ ID NO: 1177673 - protein, 4 aa, Mycobacterium
YSKG

SEQ ID NO: 1177674 - protein, 8 aa, Mycobacterium
YSNRSAER

SEQ ID NO: 1177675 - protein, 15 aa, Mycobacterium
YSNTGGQMSKSTPLG

SEQ ID NO: 1177676 - protein, 9 aa, Mycobacterium
YSPASAEGA

SEQ ID NO: 1177677 - protein, 4 aa, Mycobacterium
YSPE

SEQ ID NO: 1177678 - protein, 7 aa, Mycobacterium
YSPEAHT

SEQ ID NO: 1177679 - protein, 8 aa, Mycobacterium
YSPGAAGH

SEQ ID NO: 1177680 - protein, 18 aa, Mycobacterium
YSPPPDQPVAPGGGRAQA

SEQ ID NO: 1177681 - protein, 7 aa, Mycobacterium
YSQGGGV

SEQ ID NO: 1177682 - protein, 6 aa, Mycobacterium
YSQREG

SEQ ID NO: 1177683 - protein, 12 aa, Mycobacterium
YSQTDLATHSRR

SEQ ID NO: 1177684 - protein, 7 aa, Mycobacterium
YSRGGRA

SEQ ID NO: 1177685 - protein, 7 aa, Mycobacterium
YSRPPQA

SEQ ID NO: 1177686 - protein, 7 aa, Mycobacterium
YSSAKAG

SEQ ID NO: 1177687 - protein, 6 aa, Mycobacterium
YSSARG

SEQ ID NO: 1177688 - protein, 14 aa, Mycobacterium
YSSGTPALGVGPGN

SEQ ID NO: 1177689 - protein, 14 aa, Mycobacterium
YSSYTPDPATGGHT

SEQ ID NO: 1177690 - protein, 8 aa, Mycobacterium
YSTDESPV

SEQ ID NO: 1177691 - protein, 17 aa, Mycobacterium
YSTEPADWAADRSKELQ

SEQ ID NO: 1177692 - protein, 6 aa, Mycobacterium
YSTQAS

SEQ ID NO: 1177693 - protein, 6 aa, Mycobacterium
YSTSQF

SEQ ID NO: 1177694 - protein, 10 aa, Mycobacterium
YTADHGTVTV

SEQ ID NO: 1177695 - protein, 12 aa, Mycobacterium
YTADPRKDPDAQ

SEQ ID NO: 1177696 - protein, 8 aa, Mycobacterium
YTASEASD

SEQ ID NO: 1177697 - protein, 7 aa, Mycobacterium
YTDDQRE

SEQ ID NO: 1177698 - protein, 6 aa, Mycobacterium
YTDPSW

SEQ ID NO: 1177699 - protein, 10 aa, Mycobacterium
YTDVASPSEL

SEQ ID NO: 1177700 - protein, 15 aa, Mycobacterium
YTEDEAPNAKGGVDK

SEQ ID NO: 1177701 - protein, 18 aa, Mycobacterium
YTEGTGYSFEKETRTAEQ

SEQ ID NO: 1177702 - protein, 7 aa, Mycobacterium
YTGDYEN

SEQ ID NO: 1177703 - protein, 5 aa, Mycobacterium
YTGEL

SEQ ID NO: 1177704 - protein, 4 aa, Mycobacterium
YTGP

SEQ ID NO: 1177705 - protein, 8 aa, Mycobacterium
YTGRESHA

SEQ ID NO: 1177706 - protein, 13 aa, Mycobacterium
YTGSTDPTEREQL

SEQ ID NO: 1177707 - protein, 11 aa, Mycobacterium
YTLADGTAERV

SEQ ID NO: 1177708 - protein, 4 aa, Mycobacterium
YTLE

SEQ ID NO: 1177709 - protein, 12 aa, Mycobacterium
YTPAEAGGANPE

SEQ ID NO: 1177710 - protein, 10 aa, Mycobacterium
YTPASKAELG

SEQ ID NO: 1177711 - protein, 11 aa, Mycobacterium
YTPEEAAERGL

SEQ ID NO: 1177712 - protein, 19 aa, Mycobacterium
YTPGLRTQGSVGPKENRLP

SEQ ID NO: 1177713 - protein, 8 aa, Mycobacterium
YTPKDSPN

SEQ ID NO: 1177714 - protein, 13 aa, Mycobacterium
YTPSRTVTDGDGR

SEQ ID NO: 1177715 - protein, 6 aa, Mycobacterium
YTQPGD

SEQ ID NO: 1177716 - protein, 5 aa, Mycobacterium
YTRAK

SEQ ID NO: 1177717 - protein, 13 aa, Mycobacterium
YTREHGEDDPAIS

SEQ ID NO: 1177718 - protein, 6 aa, Mycobacterium
YTRGER

SEQ ID NO: 1177719 - protein, 7 aa, Mycobacterium
YVPENDS

SEQ ID NO: 1177720 - protein, 10 aa, Mycobacterium
YVREDPTKSV

SEQ ID NO: 1177721 - protein, 20 aa, Mycobacterium
YYAPAAQSLRRTVEDADGVT

SEQ ID NO: 1177722 - protein, 10 aa, Mycobacterium
YYATSDPDTF

SEQ ID NO: 1177723 - protein, 5 aa, Mycobacterium
YYGNP

SEQ ID NO: 1177724 - protein, 6 aa, Mycobacterium
YYPETN

SEQ ID NO: 1177725 - protein, 23 aa, Mycobacterium
YYPETPGGKPTGRSVEPKPFDAK

SEQ ID NO: 1177726 - protein, 7 aa, Mycobacterium
YYRSGSG

SEQ ID NO: 1177727 - protein, 11 aa, Mycobacterium
YYSGPDQRETL

SEQ ID NO: 1177728 - protein, 14 aa, Mycobacterium
AAAAAAADSTVTPR

SEQ ID NO: 1177729 - protein, 14 aa, Mycobacterium
AAAAAADEYGENLR

SEQ ID NO: 1177730 - protein, 16 aa, Mycobacterium
AAAAALASDGLTGWPR

SEQ ID NO: 1177731 - protein, 7 aa, Mycobacterium
AAAAARL

SEQ ID NO: 1177732 - protein, 12 aa, Mycobacterium
AAAAESTAATAL

SEQ ID NO: 1177733 - protein, 13 aa, Mycobacterium
AAAAGDMAADSGS

SEQ ID NO: 1177734 - protein, 6 aa, Mycobacterium
AAAAGN

SEQ ID NO: 1177735 - protein, 12 aa, Mycobacterium
AAAAKLTAAGLP

SEQ ID NO: 1177736 - protein, 10 aa, Mycobacterium
AAAAPANAAR

SEQ ID NO: 1177737 - protein, 8 aa, Mycobacterium
AAAAQAAG

SEQ ID NO: 1177738 - protein, 10 aa, Mycobacterium
AAAARSAADH

SEQ ID NO: 1177739 - protein, 8 aa, Mycobacterium
AAADAGRS

SEQ ID NO: 1177740 - protein, 13 aa, Mycobacterium
AAADGAARGEGRA

SEQ ID NO: 1177741 - protein, 8 aa, Mycobacterium
AAADPAQL

SEQ ID NO: 1177742 - protein, 12 aa, Mycobacterium
AAADTAAEAAAA

SEQ ID NO: 1177743 - protein, 15 aa, Mycobacterium
AAAEAVDARTAGVRG

SEQ ID NO: 1177744 - protein, 5 aa, Mycobacterium
AAAEE

SEQ ID NO: 1177745 - protein, 11 aa, Mycobacterium
AAAEPVPASSL

SEQ ID NO: 1177746 - protein, 7 aa, Mycobacterium
AAAESGI

SEQ ID NO: 1177747 - protein, 25 aa, Mycobacterium
AAAETPGPAGDTAHAPMSASGLSAD

SEQ ID NO: 1177748 - protein, 8 aa, Mycobacterium
AAAGDAPT

SEQ ID NO: 1177749 - protein, 8 aa, Mycobacterium
AAAGEDVA

SEQ ID NO: 1177750 - protein, 8 aa, Mycobacterium
AAAGEGTN

SEQ ID NO: 1177751 - protein, 16 aa, Mycobacterium
AAAGGGESTPAAEVAD

SEQ ID NO: 1177752 - protein, 8 aa, Mycobacterium
AAAGLGRA

SEQ ID NO: 1177753 - protein, 8 aa, Mycobacterium
AAAGPREN

SEQ ID NO: 1177754 - protein, 9 aa, Mycobacterium
AAAGSKGVA

SEQ ID NO: 1177755 - protein, 12 aa, Mycobacterium
AAAGVTATSGTF

SEQ ID NO: 1177756 - protein, 13 aa, Mycobacterium
AAAHGKNLNDGQA

SEQ ID NO: 1177757 - protein, 11 aa, Mycobacterium
AAAKPAETAAR

SEQ ID NO: 1177758 - protein, 8 aa, Mycobacterium
AAAKSFNA

SEQ ID NO: 1177759 - protein, 17 aa, Mycobacterium
AAALQDDNDTLDAQADA

SEQ ID NO: 1177760 - protein, 18 aa, Mycobacterium
AAANDGFGGTAAPGFSPA

SEQ ID NO: 1177761 - protein, 10 aa, Mycobacterium
AAANGRDPGA

SEQ ID NO: 1177762 - protein, 9 aa, Mycobacterium
AAAPAYESA

SEQ ID NO: 1177763 - protein, 9 aa, Mycobacterium
AAAPDGSGA

SEQ ID NO: 1177764 - protein, 6 aa, Mycobacterium
AAAPLA

SEQ ID NO: 1177765 - protein, 10 aa, Mycobacterium
AAAPPPPVSV

SEQ ID NO: 1177766 - protein, 41 aa, Mycobacterium
AAAPPPTRRPTRPTRGSKERRITEKKRRGTIKEGRRGGWGP

SEQ ID NO: 1177767 - protein, 10 aa, Mycobacterium
AAAPRTVDDV

SEQ ID NO: 1177768 - protein, 24 aa, Mycobacterium
AAAPSDEPLDSQAFSAKPSGPRPR

SEQ ID NO: 1177769 - protein, 15 aa, Mycobacterium
AAAPTNPVATPGAGT

SEQ ID NO: 1177770 - protein, 7 aa, Mycobacterium
AAAQAQG

SEQ ID NO: 1177771 - protein, 4 aa, Mycobacterium
AAAR

SEQ ID NO: 1177772 - protein, 24 aa, Mycobacterium
AAAREDYEEARTAAVKGGAVTNDQ

SEQ ID NO: 1177773 - protein, 5 aa, Mycobacterium
AAARG

SEQ ID NO: 1177774 - protein, 19 aa, Mycobacterium
AAARPDPRISDAVDRDDTR

SEQ ID NO: 1177775 - protein, 13 aa, Mycobacterium
AAARRLSTAGHAR

SEQ ID NO: 1177776 - protein, 8 aa, Mycobacterium
AAARTSKP

SEQ ID NO: 1177777 - protein, 8 aa, Mycobacterium
AAASAGRD

SEQ ID NO: 1177778 - protein, 5 aa, Mycobacterium
AAATA

SEQ ID NO: 1177779 - protein, 8 aa, Mycobacterium
AAATDAED

SEQ ID NO: 1177780 - protein, 9 aa, Mycobacterium
AAATDEGPV

SEQ ID NO: 1177781 - protein, 12 aa, Mycobacterium
AAATDTTNVTEL

SEQ ID NO: 1177782 - protein, 25 aa, Mycobacterium
AAATGGPAADAKLTEASEAIARLVR

SEQ ID NO: 1177783 - protein, 5 aa, Mycobacterium
AAATM

SEQ ID NO: 1177784 - protein, 9 aa, Mycobacterium
AAATVGPQA

SEQ ID NO: 1177785 - protein, 5 aa, Mycobacterium
AADAA

SEQ ID NO: 1177786 - protein, 15 aa, Mycobacterium
AADANAADGTDEQRI

SEQ ID NO: 1177787 - protein, 7 aa, Mycobacterium
AADARPD

SEQ ID NO: 1177788 - protein, 7 aa, Mycobacterium
AADATGL

SEQ ID NO: 1177789 - protein, 16 aa, Mycobacterium
AADDPQAVHARAVLAA

SEQ ID NO: 1177790 - protein, 8 aa, Mycobacterium
AADDRPTR

SEQ ID NO: 1177791 - protein, 4 aa, Mycobacterium
AADE

SEQ ID NO: 1177792 - protein, 5 aa, Mycobacterium
AADFD

SEQ ID NO: 1177793 - protein, 23 aa, Mycobacterium
AADGDTARELARTQATGPPTSIA

SEQ ID NO: 1177794 - protein, 6 aa, Mycobacterium
AADGEL

SEQ ID NO: 1177795 - protein, 7 aa, Mycobacterium
AADGGTA

SEQ ID NO: 1177796 - protein, 5 aa, Mycobacterium
AADGL

SEQ ID NO: 1177797 - protein, 14 aa, Mycobacterium
AADGLGDAVDSTLD

SEQ ID NO: 1177798 - protein, 13 aa, Mycobacterium
AADGPGAPGGAQT

SEQ ID NO: 1177799 - protein, 5 aa, Mycobacterium
AADLG

SEQ ID NO: 1177800 - protein, 12 aa, Mycobacterium
AADNLRGQGPAI

SEQ ID NO: 1177801 - protein, 8 aa, Mycobacterium
AADPGAAV

SEQ ID NO: 1177802 - protein, 7 aa, Mycobacterium
AADQPRG

SEQ ID NO: 1177803 - protein, 8 aa, Mycobacterium
AADRADFT

SEQ ID NO: 1177804 - protein, 9 aa, Mycobacterium
AADRGATDV

SEQ ID NO: 1177805 - protein, 13 aa, Mycobacterium
AADRRVNTYSGGM

SEQ ID NO: 1177806 - protein, 10 aa, Mycobacterium
AADSDRQRWN

SEQ ID NO: 1177807 - protein, 13 aa, Mycobacterium
AADSTERGRSPLA

SEQ ID NO: 1177808 - protein, 8 aa, Mycobacterium
AADTAPAW

SEQ ID NO: 1177809 - protein, 10 aa, Mycobacterium
AADTDPDVDT

SEQ ID NO: 1177810 - protein, 13 aa, Mycobacterium
AADTSGGRTPSAM

SEQ ID NO: 1177811 - protein, 4 aa, Mycobacterium
AADY

SEQ ID NO: 1177812 - protein, 50 aa, Mycobacterium
AAEAAEEDAETRDGDMAQSADATGSAAPVQGPTSEPSPSGRALAPSVDRE

SEQ ID NO: 1177813 - protein, 11 aa, Mycobacterium
AAEAEKAFTGE

SEQ ID NO: 1177814 - protein, 7 aa, Mycobacterium
AAEAGRI

SEQ ID NO: 1177815 - protein, 13 aa, Mycobacterium
AAEAKKRGDAAEV

SEQ ID NO: 1177816 - protein, 6 aa, Mycobacterium
AAEALE

SEQ ID NO: 1177817 - protein, 5 aa, Mycobacterium
AAEGA

SEQ ID NO: 1177818 - protein, 11 aa, Mycobacterium
AAEPAGPDGVP

SEQ ID NO: 1177819 - protein, 13 aa, Mycobacterium
AAEPVMGPPGLEQ

SEQ ID NO: 1177820 - protein, 7 aa, Mycobacterium
AAERGEL

SEQ ID NO: 1177821 - protein, 10 aa, Mycobacterium
AAERGGPGLA

SEQ ID NO: 1177822 - protein, 10 aa, Mycobacterium
AAERGRHPRA

SEQ ID NO: 1177823 - protein, 13 aa, Mycobacterium
AAESQVSDLPDAD

SEQ ID NO: 1177824 - protein, 5 aa, Mycobacterium
AAGAA

SEQ ID NO: 1177825 - protein, 7 aa, Mycobacterium
AAGAAAQ

SEQ ID NO: 1177826 - protein, 5 aa, Mycobacterium
AAGAE

SEQ ID NO: 1177827 - protein, 12 aa, Mycobacterium
AAGAGFDSSPGM

SEQ ID NO: 1177828 - protein, 5 aa, Mycobacterium
AAGAL

SEQ ID NO: 1177829 - protein, 25 aa, Mycobacterium
AAGATAQGSAAAYDEAHIRAAALLR

SEQ ID NO: 1177830 - protein, 6 aa, Mycobacterium
AAGATY

SEQ ID NO: 1177831 - protein, 9 aa, Mycobacterium
AAGDRADRP

SEQ ID NO: 1177832 - protein, 14 aa, Mycobacterium
AAGEQYPDIEEAIP

SEQ ID NO: 1177833 - protein, 6 aa, Mycobacterium
AAGGNI

SEQ ID NO: 1177834 - protein, 16 aa, Mycobacterium
AAGHEAGIAGNTAEKY

SEQ ID NO: 1177835 - protein, 7 aa, Mycobacterium
AAGIAEP

SEQ ID NO: 1177836 - protein, 7 aa, Mycobacterium
AAGLGRA

SEQ ID NO: 1177837 - protein, 8 aa, Mycobacterium
AAGNRVEY

SEQ ID NO: 1177838 - protein, 9 aa, Mycobacterium
AAGPAPEFR

SEQ ID NO: 1177839 - protein, 4 aa, Mycobacterium
AAGQ

SEQ ID NO: 1177840 - protein, 11 aa, Mycobacterium
AAGQSAGTRHH

SEQ ID NO: 1177841 - protein, 6 aa, Mycobacterium
AAGQTA

SEQ ID NO: 1177842 - protein, 4 aa, Mycobacterium
AAGR

SEQ ID NO: 1177843 - protein, 8 aa, Mycobacterium
AAGREVSA

SEQ ID NO: 1177844 - protein, 8 aa, Mycobacterium
AAGRGGMP

SEQ ID NO: 1177845 - protein, 6 aa, Mycobacterium
AAGRRQ

SEQ ID NO: 1177846 - protein, 7 aa, Mycobacterium
AAGSPRK

SEQ ID NO: 1177847 - protein, 8 aa, Mycobacterium
AAGSVAGK

SEQ ID NO: 1177848 - protein, 9 aa, Mycobacterium
AAGTDYADL

SEQ ID NO: 1177849 - protein, 14 aa, Mycobacterium
AAGTTPPDDEAPDH

SEQ ID NO: 1177850 - protein, 7 aa, Mycobacterium
AAGVGQG

SEQ ID NO: 1177851 - protein, 5 aa, Mycobacterium
AAGVP

SEQ ID NO: 1177852 - protein, 14 aa, Mycobacterium
AAGVPANKRGRGLA

SEQ ID NO: 1177853 - protein, 9 aa, Mycobacterium
AAGVSSVPQ

SEQ ID NO: 1177854 - protein, 10 aa, Mycobacterium
AAHAAGEDTF

SEQ ID NO: 1177855 - protein, 5 aa, Mycobacterium
AAHAG

SEQ ID NO: 1177856 - protein, 14 aa, Mycobacterium
AAHDADAAATYPPD

SEQ ID NO: 1177857 - protein, 7 aa, Mycobacterium
AAHDPEL

SEQ ID NO: 1177858 - protein, 6 aa, Mycobacterium
AAHNAK

SEQ ID NO: 1177859 - protein, 4 aa, Mycobacterium
AAHP

SEQ ID NO: 1177860 - protein, 7 aa, Mycobacterium
AAHPNRF

SEQ ID NO: 1177861 - protein, 42 aa, Mycobacterium
AAHQPAAGQGVRHDGNPHPGAARRRVGPGQPHRRGSARRGHR

SEQ ID NO: 1177862 - protein, 14 aa, Mycobacterium
AAHRRGHDRELVGS

SEQ ID NO: 1177863 - protein, 24 aa, Mycobacterium
AAIAEDGGVDIDGAPAGKSDRLTA

SEQ ID NO: 1177864 - protein, 7 aa, Mycobacterium
AAIGPQA

SEQ ID NO: 1177865 - protein, 9 aa, Mycobacterium
AAIKSGSQD

SEQ ID NO: 1177866 - protein, 11 aa, Mycobacterium
AAINPGNSGGA

SEQ ID NO: 1177867 - protein, 10 aa, Mycobacterium
AAKAASERTV

SEQ ID NO: 1177868 - protein, 11 aa, Mycobacterium
AAKAREGWQTN

SEQ ID NO: 1177869 - protein, 27 aa, Mycobacterium
AAKKAAERSQASAGERADQRLAEQQRA

SEQ ID NO: 1177870 - protein, 11 aa, Mycobacterium
AAKNAADASTR

SEQ ID NO: 1177871 - protein, 7 aa, Mycobacterium
AAKQDDL

SEQ ID NO: 1177872 - protein, 10 aa, Mycobacterium
AAKRDGDTLG

SEQ ID NO: 1177873 - protein, 10 aa, Mycobacterium
AAKSQQGDAR

SEQ ID NO: 1177874 - protein, 7 aa, Mycobacterium
AAKVDKG

SEQ ID NO: 1177875 - protein, 6 aa, Mycobacterium
AALESA

SEQ ID NO: 1177876 - protein, 12 aa, Mycobacterium
AALGDTLTGTAG

SEQ ID NO: 1177877 - protein, 5 aa, Mycobacterium
AALGG

SEQ ID NO: 1177878 - protein, 21 aa, Mycobacterium
AALGGSASSLSGSGAGGMSHA

SEQ ID NO: 1177879 - protein, 10 aa, Mycobacterium
AALPDAPEQL

SEQ ID NO: 1177880 - protein, 9 aa, Mycobacterium
AALTDANAA

SEQ ID NO: 1177881 - protein, 22 aa, Mycobacterium
AAMQAPSPSGTSQPPIAATTGA

SEQ ID NO: 1177882 - protein, 6 aa, Mycobacterium
AAMTRP

SEQ ID NO: 1177883 - protein, 4 aa, Mycobacterium
AANA

SEQ ID NO: 1177884 - protein, 10 aa, Mycobacterium
AANDSENIND

SEQ ID NO: 1177885 - protein, 7 aa, Mycobacterium
AANEPER

SEQ ID NO: 1177886 - protein, 15 aa, Mycobacterium
AANTDALAAFAERGV

SEQ ID NO: 1177887 - protein, 8 aa, Mycobacterium
AAPAAEAA

SEQ ID NO: 1177888 - protein, 10 aa, Mycobacterium
AAPAAPSNRV

SEQ ID NO: 1177889 - protein, 10 aa, Mycobacterium
AAPDSPSADA

SEQ ID NO: 1177890 - protein, 5 aa, Mycobacterium
AAPDV

SEQ ID NO: 1177891 - protein, 8 aa, Mycobacterium
AAPEDALP

SEQ ID NO: 1177892 - protein, 8 aa, Mycobacterium
AAPEGRAR

SEQ ID NO: 1177893 - protein, 10 aa, Mycobacterium
AAPEPHPPWP

SEQ ID NO: 1177894 - protein, 6 aa, Mycobacterium
AAPGAH

SEQ ID NO: 1177895 - protein, 9 aa, Mycobacterium
AAPGGEAAA

SEQ ID NO: 1177896 - protein, 7 aa, Mycobacterium
AAPGLPD

SEQ ID NO: 1177897 - protein, 9 aa, Mycobacterium
AAPGQRDHS

SEQ ID NO: 1177898 - protein, 12 aa, Mycobacterium
AAPGRGGSLNGT

SEQ ID NO: 1177899 - protein, 12 aa, Mycobacterium
AAPKPDESSADV

SEQ ID NO: 1177900 - protein, 26 aa, Mycobacterium
AAPLASSGWTVPNSESRITDPETGAE

SEQ ID NO: 1177901 - protein, 8 aa, Mycobacterium
AAPLQAPT

SEQ ID NO: 1177902 - protein, 10 aa, Mycobacterium
AAPLTGAGHS

SEQ ID NO: 1177903 - protein, 9 aa, Mycobacterium
AAPNGAAQA

SEQ ID NO: 1177904 - protein, 8 aa, Mycobacterium
AAPNRRTA

SEQ ID NO: 1177905 - protein, 12 aa, Mycobacterium
AAPPAARASAAR

SEQ ID NO: 1177906 - protein, 12 aa, Mycobacterium
AAPPAPSGETAD

SEQ ID NO: 1177907 - protein, 6 aa, Mycobacterium
AAPPEG

SEQ ID NO: 1177908 - protein, 5 aa, Mycobacterium
AAPRA

SEQ ID NO: 1177909 - protein, 6 aa, Mycobacterium
AAPRAV

SEQ ID NO: 1177910 - protein, 7 aa, Mycobacterium
AAPRKIS

SEQ ID NO: 1177911 - protein, 7 aa, Mycobacterium
AAPRYAE

SEQ ID NO: 1177912 - protein, 4 aa, Mycobacterium
AAPS

SEQ ID NO: 1177913 - protein, 7 aa, Mycobacterium
AAPSANV

SEQ ID NO: 1177914 - protein, 6 aa, Mycobacterium
AAPSEV

SEQ ID NO: 1177915 - protein, 4 aa, Mycobacterium
AAPT

SEQ ID NO: 1177916 - protein, 10 aa, Mycobacterium
AAPTAAGPGF

SEQ ID NO: 1177917 - protein, 19 aa, Mycobacterium
AAPTEELRTPAPEPVASDG

SEQ ID NO: 1177918 - protein, 8 aa, Mycobacterium
AAPTPPAD

SEQ ID NO: 1177919 - protein, 10 aa, Mycobacterium
AAQADTDIPA

SEQ ID NO: 1177920 - protein, 8 aa, Mycobacterium
AAQARRRE

SEQ ID NO: 1177921 - protein, 8 aa, Mycobacterium
AAQATRTA

SEQ ID NO: 1177922 - protein, 8 aa, Mycobacterium
AAQGGTGA

SEQ ID NO: 1177923 - protein, 4 aa, Mycobacterium
AAQP

SEQ ID NO: 1177924 - protein, 7 aa, Mycobacterium
AAQPDPV

SEQ ID NO: 1177925 - protein, 7 aa, Mycobacterium
AAQPEQA

SEQ ID NO: 1177926 - protein, 26 aa, Mycobacterium
AAQRPQPPRTYTPSEHRERRRTGLPA

SEQ ID NO: 1177927 - protein, 16 aa, Mycobacterium
AAQTDWEARGAKGRAK

SEQ ID NO: 1177928 - protein, 4 aa, Mycobacterium
AARA

SEQ ID NO: 1177929 - protein, 12 aa, Mycobacterium
AARADDSAPLTL

SEQ ID NO: 1177930 - protein, 7 aa, Mycobacterium
AARARAD

SEQ ID NO: 1177931 - protein, 15 aa, Mycobacterium
AARASADGAPPQLTQ

SEQ ID NO: 1177932 - protein, 10 aa, Mycobacterium
AARCATTNCR

SEQ ID NO: 1177933 - protein, 10 aa, Mycobacterium
AARDDGAESV

SEQ ID NO: 1177934 - protein, 15 aa, Mycobacterium
AARDLERQRNESSDL

SEQ ID NO: 1177935 - protein, 5 aa, Mycobacterium
AARER

SEQ ID NO: 1177936 - protein, 11 aa, Mycobacterium
AARETFNRRRG

SEQ ID NO: 1177937 - protein, 8 aa, Mycobacterium
AARGDDGT

SEQ ID NO: 1177938 - protein, 6 aa, Mycobacterium
AARGRA

SEQ ID NO: 1177939 - protein, 7 aa, Mycobacterium
AARGTGR

SEQ ID NO: 1177940 - protein, 13 aa, Mycobacterium
AARGYADERRADR

SEQ ID NO: 1177941 - protein, 6 aa, Mycobacterium
AARHGA

SEQ ID NO: 1177942 - protein, 15 aa, Mycobacterium
AARKEKRPAVFTDDK

SEQ ID NO: 1177943 - protein, 10 aa, Mycobacterium
AARKKLSEAG

SEQ ID NO: 1177944 - protein, 8 aa, Mycobacterium
AARNTVDA

SEQ ID NO: 1177945 - protein, 27 aa, Mycobacterium
AARPGEDWSGSSEFSGDNPLGMGEGAQ

SEQ ID NO: 1177946 - protein, 7 aa, Mycobacterium
AARPLRD

SEQ ID NO: 1177947 - protein, 13 aa, Mycobacterium
AARQERRHGQTIS

SEQ ID NO: 1177948 - protein, 12 aa, Mycobacterium
AARQLKAGRSRS

SEQ ID NO: 1177949 - protein, 8 aa, Mycobacterium
AARRATPH

SEQ ID NO: 1177950 - protein, 13 aa, Mycobacterium
AARREELKAEAAA

SEQ ID NO: 1177951 - protein, 8 aa, Mycobacterium
AARSGADG

SEQ ID NO: 1177952 - protein, 7 aa, Mycobacterium
AARSKRL

SEQ ID NO: 1177953 - protein, 8 aa, Mycobacterium
AARSQTSA

SEQ ID NO: 1177954 - protein, 15 aa, Mycobacterium
AARTGPERSAWSGPR

SEQ ID NO: 1177955 - protein, 13 aa, Mycobacterium
AARTRATAVGAAD

SEQ ID NO: 1177956 - protein, 5 aa, Mycobacterium
AARTT

SEQ ID NO: 1177957 - protein, 13 aa, Mycobacterium
AARTVDGDRPPTN

SEQ ID NO: 1177958 - protein, 4 aa, Mycobacterium
AARV

SEQ ID NO: 1177959 - protein, 7 aa, Mycobacterium
AARVSDQ

SEQ ID NO: 1177960 - protein, 14 aa, Mycobacterium
AASAAAQSAGREVK

SEQ ID NO: 1177961 - protein, 7 aa, Mycobacterium
AASAGDE

SEQ ID NO: 1177962 - protein, 8 aa, Mycobacterium
AASAQAVT

SEQ ID NO: 1177963 - protein, 11 aa, Mycobacterium
AASDRRTPRLT

SEQ ID NO: 1177964 - protein, 25 aa, Mycobacterium
AASGAPGYPTTAGTPELRASAKAAL

SEQ ID NO: 1177965 - protein, 13 aa, Mycobacterium
AASGDLRQDAAEH

SEQ ID NO: 1177966 - protein, 5 aa, Mycobacterium
AASGR

SEQ ID NO: 1177967 - protein, 8 aa, Mycobacterium
AASGRETV

SEQ ID NO: 1177968 - protein, 10 aa, Mycobacterium
AASGSDNAEV

SEQ ID NO: 1177969 - protein, 4 aa, Mycobacterium
AASM

SEQ ID NO: 1177970 - protein, 9 aa, Mycobacterium
AASNGPGDV

SEQ ID NO: 1177971 - protein, 19 aa, Mycobacterium
AASNSGGGLRPLPPAMFYR

SEQ ID NO: 1177972 - protein, 21 aa, Mycobacterium
AASPVSGDDLRRAANRIAAVL

SEQ ID NO: 1177973 - protein, 8 aa, Mycobacterium
AASQTGDL

SEQ ID NO: 1177974 - protein, 14 aa, Mycobacterium
AASRPQAARTSVSS

SEQ ID NO: 1177975 - protein, 19 aa, Mycobacterium
AASRPRPEYLAARDMRRVG

SEQ ID NO: 1177976 - protein, 14 aa, Mycobacterium
AASRQEAIAALHQL

SEQ ID NO: 1177977 - protein, 7 aa, Mycobacterium
AASRSTA

SEQ ID NO: 1177978 - protein, 17 aa, Mycobacterium
AASSAPPPGGSLAPPVT

SEQ ID NO: 1177979 - protein, 15 aa, Mycobacterium
AASTNRQACVTLVTS

SEQ ID NO: 1177980 - protein, 7 aa, Mycobacterium
AASTQQT

SEQ ID NO: 1177981 - protein, 9 aa, Mycobacterium
AATAGAGSL

SEQ ID NO: 1177982 - protein, 5 aa, Mycobacterium
AATAH

SEQ ID NO: 1177983 - protein, 5 aa, Mycobacterium
AATAL

SEQ ID NO: 1177984 - protein, 8 aa, Mycobacterium
AATALRGS

SEQ ID NO: 1177985 - protein, 9 aa, Mycobacterium
AATARTAED

SEQ ID NO: 1177986 - protein, 12 aa, Mycobacterium
AATDAESDPDRR

SEQ ID NO: 1177987 - protein, 17 aa, Mycobacterium
AATERNRAFFDKLGLPS

SEQ ID NO: 1177988 - protein, 13 aa, Mycobacterium
AATFDGNPRTPEV

SEQ ID NO: 1177989 - protein, 4 aa, Mycobacterium
AATG

SEQ ID NO: 1177990 - protein, 8 aa, Mycobacterium
AATGDPDL

SEQ ID NO: 1177991 - protein, 5 aa, Mycobacterium
AATGF

SEQ ID NO: 1177992 - protein, 6 aa, Mycobacterium
AATGKP

SEQ ID NO: 1177993 - protein, 11 aa, Mycobacterium
AATGKTTPRKD

SEQ ID NO: 1177994 - protein, 13 aa, Mycobacterium
AATGRLSSTEPNL

SEQ ID NO: 1177995 - protein, 8 aa, Mycobacterium
AATGSEKL

SEQ ID NO: 1177996 - protein, 8 aa, Mycobacterium
AATGTPLV

SEQ ID NO: 1177997 - protein, 6 aa, Mycobacterium
AATGVR

SEQ ID NO: 1177998 - protein, 9 aa, Mycobacterium
AATIGQPAY

SEQ ID NO: 1177999 - protein, 6 aa, Mycobacterium
AATKAL

SEQ ID NO: 1178000 - protein, 5 aa, Mycobacterium
AATKG

SEQ ID NO: 1178001 - protein, 8 aa, Mycobacterium
AATLSPPS

SEQ ID NO: 1178002 - protein, 10 aa, Mycobacterium
AATNADRVRT

SEQ ID NO: 1178003 - protein, 10 aa, Mycobacterium
AATNAESSAM

SEQ ID NO: 1178004 - protein, 8 aa, Mycobacterium
AATPEAVN

SEQ ID NO: 1178005 - protein, 6 aa, Mycobacterium
AATPGR

SEQ ID NO: 1178006 - protein, 6 aa, Mycobacterium
AATPLR

SEQ ID NO: 1178007 - protein, 8 aa, Mycobacterium
AATPMTET

SEQ ID NO: 1178008 - protein, 23 aa, Mycobacterium
AATPPAKCGSNATANSSAPDAPR

SEQ ID NO: 1178009 - protein, 15 aa, Mycobacterium
AATPRTGTTSPLGGV

SEQ ID NO: 1178010 - protein, 4 aa, Mycobacterium
AATQ

SEQ ID NO: 1178011 - protein, 7 aa, Mycobacterium
AATQPAV

SEQ ID NO: 1178012 - protein, 8 aa, Mycobacterium
AATQPSIE

SEQ ID NO: 1178013 - protein, 7 aa, Mycobacterium
AATSDGK

SEQ ID NO: 1178014 - protein, 34 aa, Mycobacterium
AATSPNTANPPERTRRRRRRSSLSDLAPRPDAPP

SEQ ID NO: 1178015 - protein, 11 aa, Mycobacterium
AATTGVEDAGD

SEQ ID NO: 1178016 - protein, 20 aa, Mycobacterium
AATTSRPPLAPPRRPPGRRE

SEQ ID NO: 1178017 - protein, 5 aa, Mycobacterium
AAVEQ

SEQ ID NO: 1178018 - protein, 6 aa, Mycobacterium
AAVGDR

SEQ ID NO: 1178019 - protein, 5 aa, Mycobacterium
AAVPA

SEQ ID NO: 1178020 - protein, 10 aa, Mycobacterium
AAVRAQGGVP

SEQ ID NO: 1178021 - protein, 7 aa, Mycobacterium
AAVSAGI

SEQ ID NO: 1178022 - protein, 18 aa, Mycobacterium
AAVSAPTRITAPDDQIRS

SEQ ID NO: 1178023 - protein, 7 aa, Mycobacterium
AAVTAGS

SEQ ID NO: 1178024 - protein, 4 aa, Mycobacterium
AAWP

SEQ ID NO: 1178025 - protein, 6 aa, Mycobacterium
AAYGAA

SEQ ID NO: 1178026 - protein, 13 aa, Mycobacterium
ACAEQPSFRTRAA

SEQ ID NO: 1178027 - protein, 4 aa, Mycobacterium
ACGS

SEQ ID NO: 1178028 - protein, 7 aa, Mycobacterium
ACPAGEN

SEQ ID NO: 1178029 - protein, 11 aa, Mycobacterium
ADAADAVRAGT

SEQ ID NO: 1178030 - protein, 12 aa, Mycobacterium
ADAADPAQTAAA

SEQ ID NO: 1178031 - protein, 10 aa, Mycobacterium
ADAANRVSGP

SEQ ID NO: 1178032 - protein, 15 aa, Mycobacterium
ADAAVRARSPGHGHT

SEQ ID NO: 1178033 - protein, 9 aa, Mycobacterium
ADADAKAIG

SEQ ID NO: 1178034 - protein, 12 aa, Mycobacterium
ADADDPDDPDHE

SEQ ID NO: 1178035 - protein, 5 aa, Mycobacterium
ADADR

SEQ ID NO: 1178036 - protein, 7 aa, Mycobacterium
ADAEQRA

SEQ ID NO: 1178037 - protein, 23 aa, Mycobacterium
ADAERHAARDNYTGRREGAPSVD

SEQ ID NO: 1178038 - protein, 7 aa, Mycobacterium
ADAETPL

SEQ ID NO: 1178039 - protein, 8 aa, Mycobacterium
ADAGAGRT

SEQ ID NO: 1178040 - protein, 9 aa, Mycobacterium
ADAGHGDSI

SEQ ID NO: 1178041 - protein, 8 aa, Mycobacterium
ADAGPDMT

SEQ ID NO: 1178042 - protein, 6 aa, Mycobacterium
ADAGRP

SEQ ID NO: 1178043 - protein, 9 aa, Mycobacterium
ADAGTQAEI

SEQ ID NO: 1178044 - protein, 6 aa, Mycobacterium
ADAGVQ

SEQ ID NO: 1178045 - protein, 9 aa, Mycobacterium
ADAMDEPDN

SEQ ID NO: 1178046 - protein, 18 aa, Mycobacterium
ADAPDPGDITALVDTVLA

SEQ ID NO: 1178047 - protein, 6 aa, Mycobacterium
ADAPGR

SEQ ID NO: 1178048 - protein, 7 aa, Mycobacterium
ADAQGTL

SEQ ID NO: 1178049 - protein, 16 aa, Mycobacterium
ADARRQRKRGTLPART

SEQ ID NO: 1178050 - protein, 7 aa, Mycobacterium
ADATDPY

SEQ ID NO: 1178051 - protein, 7 aa, Mycobacterium
ADDDTLD

SEQ ID NO: 1178052 - protein, 4 aa, Mycobacterium
ADDE

SEQ ID NO: 1178053 - protein, 10 aa, Mycobacterium
ADDEKPGAAA

SEQ ID NO: 1178054 - protein, 8 aa, Mycobacterium
ADDKAAGR

SEQ ID NO: 1178055 - protein, 12 aa, Mycobacterium
ADDKAEADGAAA

SEQ ID NO: 1178056 - protein, 7 aa, Mycobacterium
ADDTGVR

SEQ ID NO: 1178057 - protein, 10 aa, Mycobacterium
ADDYADGGSI

SEQ ID NO: 1178058 - protein, 4 aa, Mycobacterium
ADEA

SEQ ID NO: 1178059 - protein, 13 aa, Mycobacterium
ADEAKAETVSAER

SEQ ID NO: 1178060 - protein, 6 aa, Mycobacterium
ADEDIA

SEQ ID NO: 1178061 - protein, 61 aa, Mycobacterium
ADEGGAAVTGEPTSMPQPTPTGGDDEQPAQPTGGDKPTGPASQPRVSATRTHAASGGAPAA

SEQ ID NO: 1178062 - protein, 14 aa, Mycobacterium
ADEGHQGAGIPRGR

SEQ ID NO: 1178063 - protein, 9 aa, Mycobacterium
ADEHRGRTP

SEQ ID NO: 1178064 - protein, 9 aa, Mycobacterium
ADEPGKRKY

SEQ ID NO: 1178065 - protein, 7 aa, Mycobacterium
ADERDEE

SEQ ID NO: 1178066 - protein, 7 aa, Mycobacterium
ADESDGS

SEQ ID NO: 1178067 - protein, 9 aa, Mycobacterium
ADESDHDRA

SEQ ID NO: 1178068 - protein, 5 aa, Mycobacterium
ADEVA

SEQ ID NO: 1178069 - protein, 10 aa, Mycobacterium
ADFDDSSTQH

SEQ ID NO: 1178070 - protein, 8 aa, Mycobacterium
ADGADVAG

SEQ ID NO: 1178071 - protein, 5 aa, Mycobacterium
ADGDE

SEQ ID NO: 1178072 - protein, 8 aa, Mycobacterium
ADGDRRGE

SEQ ID NO: 1178073 - protein, 14 aa, Mycobacterium
ADGDTSVCSKDATE

SEQ ID NO: 1178074 - protein, 5 aa, Mycobacterium
ADGEG

SEQ ID NO: 1178075 - protein, 16 aa, Mycobacterium
ADGHAAQDSATEARDA

SEQ ID NO: 1178076 - protein, 9 aa, Mycobacterium
ADGKAERFD

SEQ ID NO: 1178077 - protein, 7 aa, Mycobacterium
ADGKRYH

SEQ ID NO: 1178078 - protein, 4 aa, Mycobacterium
ADGM

SEQ ID NO: 1178079 - protein, 15 aa, Mycobacterium
ADGNFGENLTTSGVE

SEQ ID NO: 1178080 - protein, 5 aa, Mycobacterium
ADGNP

SEQ ID NO: 1178081 - protein, 15 aa, Mycobacterium
ADGPGSWDSVAGGTL

SEQ ID NO: 1178082 - protein, 6 aa, Mycobacterium
ADGPIT

SEQ ID NO: 1178083 - protein, 6 aa, Mycobacterium
ADGPSG

SEQ ID NO: 1178084 - protein, 8 aa, Mycobacterium
ADGRPRQV

SEQ ID NO: 1178085 - protein, 8 aa, Mycobacterium
ADGRPTRV

SEQ ID NO: 1178086 - protein, 7 aa, Mycobacterium
ADGRSYG

SEQ ID NO: 1178087 - protein, 8 aa, Mycobacterium
ADGSQGDL

SEQ ID NO: 1178088 - protein, 11 aa, Mycobacterium
ADGSVPEDNPF

SEQ ID NO: 1178089 - protein, 9 aa, Mycobacterium
ADGTNPEAE

SEQ ID NO: 1178090 - protein, 6 aa, Mycobacterium
ADGTVT

SEQ ID NO: 1178091 - protein, 4 aa, Mycobacterium
ADGV

SEQ ID NO: 1178092 - protein, 5 aa, Mycobacterium
ADGVP

SEQ ID NO: 1178093 - protein, 7 aa, Mycobacterium
ADHPEDA

SEQ ID NO: 1178094 - protein, 6 aa, Mycobacterium
ADHSPD

SEQ ID NO: 1178095 - protein, 7 aa, Mycobacterium
ADKDGMD

SEQ ID NO: 1178096 - protein, 4 aa, Mycobacterium
ADKE

SEQ ID NO: 1178097 - protein, 9 aa, Mycobacterium
ADKEPDPAA

SEQ ID NO: 1178098 - protein, 10 aa, Mycobacterium
ADKPEGPWSS

SEQ ID NO: 1178099 - protein, 7 aa, Mycobacterium
ADKTVTQ

SEQ ID NO: 1178100 - protein, 6 aa, Mycobacterium
ADLDDD

SEQ ID NO: 1178101 - protein, 7 aa, Mycobacterium
ADLEPRI

SEQ ID NO: 1178102 - protein, 4 aa, Mycobacterium
ADLK

SEQ ID NO: 1178103 - protein, 5 aa, Mycobacterium
ADLPE

SEQ ID NO: 1178104 - protein, 21 aa, Mycobacterium
ADLPGAMTTPRGTGPCRPAPS

SEQ ID NO: 1178105 - protein, 8 aa, Mycobacterium
ADLRPDLD

SEQ ID NO: 1178106 - protein, 9 aa, Mycobacterium
ADNGDHDPL

SEQ ID NO: 1178107 - protein, 8 aa, Mycobacterium
ADNGSTAH

SEQ ID NO: 1178108 - protein, 4 aa, Mycobacterium
ADNP

SEQ ID NO: 1178109 - protein, 15 aa, Mycobacterium
ADNSPETNVGGEHPN

SEQ ID NO: 1178110 - protein, 14 aa, Mycobacterium
ADPAGGRRTAVDRG

SEQ ID NO: 1178111 - protein, 6 aa, Mycobacterium
ADPALA

SEQ ID NO: 1178112 - protein, 9 aa, Mycobacterium
ADPAPASAV

SEQ ID NO: 1178113 - protein, 6 aa, Mycobacterium
ADPAQL

SEQ ID NO: 1178114 - protein, 7 aa, Mycobacterium
ADPARDA

SEQ ID NO: 1178115 - protein, 5 aa, Mycobacterium
ADPAS

SEQ ID NO: 1178116 - protein, 9 aa, Mycobacterium
ADPASDKPA

SEQ ID NO: 1178117 - protein, 5 aa, Mycobacterium
ADPDD

SEQ ID NO: 1178118 - protein, 17 aa, Mycobacterium
ADPDGYRTSERDARDND

SEQ ID NO: 1178119 - protein, 6 aa, Mycobacterium
ADPDPD

SEQ ID NO: 1178120 - protein, 7 aa, Mycobacterium
ADPDRAA

SEQ ID NO: 1178121 - protein, 7 aa, Mycobacterium
ADPGAYD

SEQ ID NO: 1178122 - protein, 11 aa, Mycobacterium
ADPGDTLQERA

SEQ ID NO: 1178123 - protein, 6 aa, Mycobacterium
ADPGHS

SEQ ID NO: 1178124 - protein, 6 aa, Mycobacterium
ADPKIA

SEQ ID NO: 1178125 - protein, 30 aa, Mycobacterium
ADPNDVSPSVPANFTPDPALPADPLPEAVS

SEQ ID NO: 1178126 - protein, 20 aa, Mycobacterium
ADPPRSRPSRPPQQGRIPGD

SEQ ID NO: 1178127 - protein, 29 aa, Mycobacterium
ADPQSHPADQPAPGPRDRVPPDWVAQLRA

SEQ ID NO: 1178128 - protein, 16 aa, Mycobacterium
ADPRAATNPGGTGEAT

SEQ ID NO: 1178129 - protein, 7 aa, Mycobacterium
ADPRGLA

SEQ ID NO: 1178130 - protein, 5 aa, Mycobacterium
ADPRK

SEQ ID NO: 1178131 - protein, 9 aa, Mycobacterium
ADPRTNSYG

SEQ ID NO: 1178132 - protein, 8 aa, Mycobacterium
ADPSPYLS

SEQ ID NO: 1178133 - protein, 7 aa, Mycobacterium
ADPVGLD

SEQ ID NO: 1178134 - protein, 15 aa, Mycobacterium
ADPVRPVGTGGEQRV

SEQ ID NO: 1178135 - protein, 8 aa, Mycobacterium
ADQDAGRD

SEQ ID NO: 1178136 - protein, 4 aa, Mycobacterium
ADQG

SEQ ID NO: 1178137 - protein, 22 aa, Mycobacterium
ADQHDDARRAVESCPARAIDIE

SEQ ID NO: 1178138 - protein, 10 aa, Mycobacterium
ADQPGPEGGR

SEQ ID NO: 1178139 - protein, 16 aa, Mycobacterium
ADQSATFADATSVPRA

SEQ ID NO: 1178140 - protein, 7 aa, Mycobacterium
ADQSSGL

SEQ ID NO: 1178141 - protein, 9 aa, Mycobacterium
ADQTTSDEV

SEQ ID NO: 1178142 - protein, 4 aa, Mycobacterium
ADRA

SEQ ID NO: 1178143 - protein, 10 aa, Mycobacterium
ADRAADSPHR

SEQ ID NO: 1178144 - protein, 7 aa, Mycobacterium
ADRAERD

SEQ ID NO: 1178145 - protein, 7 aa, Mycobacterium
ADRAGTG

SEQ ID NO: 1178146 - protein, 8 aa, Mycobacterium
ADRAQLSA

SEQ ID NO: 1178147 - protein, 6 aa, Mycobacterium
ADRDGL

SEQ ID NO: 1178148 - protein, 9 aa, Mycobacterium
ADREASRGA

SEQ ID NO: 1178149 - protein, 10 aa, Mycobacterium
ADREQKRGND

SEQ ID NO: 1178150 - protein, 8 aa, Mycobacterium
ADRPPRSL

SEQ ID NO: 1178151 - protein, 9 aa, Mycobacterium
ADRTGPAAH

SEQ ID NO: 1178152 - protein, 14 aa, Mycobacterium
ADRVKGGTYPNPPV

SEQ ID NO: 1178153 - protein, 8 aa, Mycobacterium
ADRVPSPG

SEQ ID NO: 1178154 - protein, 10 aa, Mycobacterium
ADRYSTDLEP

SEQ ID NO: 1178155 - protein, 5 aa, Mycobacterium
ADSAA

SEQ ID NO: 1178156 - protein, 15 aa, Mycobacterium
ADSEQAAGDELSKEA

SEQ ID NO: 1178157 - protein, 8 aa, Mycobacterium
ADSESDQT

SEQ ID NO: 1178158 - protein, 7 aa, Mycobacterium
ADSGVTP

SEQ ID NO: 1178159 - protein, 4 aa, Mycobacterium
ADSI

SEQ ID NO: 1178160 - protein, 8 aa, Mycobacterium
ADSPQGLT

SEQ ID NO: 1178161 - protein, 26 aa, Mycobacterium
ADSTRDEPAPGPSAAVPRPGDDSEPG

SEQ ID NO: 1178162 - protein, 19 aa, Mycobacterium
ADTARKNYADAVAKNGRMW

SEQ ID NO: 1178163 - protein, 9 aa, Mycobacterium
ADTARQTRV

SEQ ID NO: 1178164 - protein, 11 aa, Mycobacterium
ADTDGKYSRED

SEQ ID NO: 1178165 - protein, 16 aa, Mycobacterium
ADTDTLRTAAERLDET

SEQ ID NO: 1178166 - protein, 4 aa, Mycobacterium
ADTG

SEQ ID NO: 1178167 - protein, 12 aa, Mycobacterium
ADTGAREVSDEV

SEQ ID NO: 1178168 - protein, 16 aa, Mycobacterium
ADTGGAGAHGADVEQC

SEQ ID NO: 1178169 - protein, 6 aa, Mycobacterium
ADTGRA

SEQ ID NO: 1178170 - protein, 5 aa, Mycobacterium
ADTRA

SEQ ID NO: 1178171 - protein, 4 aa, Mycobacterium
ADTS

SEQ ID NO: 1178172 - protein, 15 aa, Mycobacterium
ADTSAEERKAAGDKW

SEQ ID NO: 1178173 - protein, 5 aa, Mycobacterium
ADTSG

SEQ ID NO: 1178174 - protein, 6 aa, Mycobacterium
ADTTLG

SEQ ID NO: 1178175 - protein, 6 aa, Mycobacterium
ADVDAA

SEQ ID NO: 1178176 - protein, 12 aa, Mycobacterium
ADVDDPGGAVAT

SEQ ID NO: 1178177 - protein, 8 aa, Mycobacterium
ADVPTGPG

SEQ ID NO: 1178178 - protein, 6 aa, Mycobacterium
ADVTQL

SEQ ID NO: 1178179 - protein, 13 aa, Mycobacterium
ADVTTVRRTAEQA

SEQ ID NO: 1178180 - protein, 4 aa, Mycobacterium
ADWG

SEQ ID NO: 1178181 - protein, 9 aa, Mycobacterium
AEAAATVAR

SEQ ID NO: 1178182 - protein, 5 aa, Mycobacterium
AEAAD

SEQ ID NO: 1178183 - protein, 6 aa, Mycobacterium
AEAAGA

SEQ ID NO: 1178184 - protein, 6 aa, Mycobacterium
AEAAGY

SEQ ID NO: 1178185 - protein, 9 aa, Mycobacterium
AEAAPTNNI

SEQ ID NO: 1178186 - protein, 10 aa, Mycobacterium
AEAARRPHGD

SEQ ID NO: 1178187 - protein, 12 aa, Mycobacterium
AEAARRPHGDRT

SEQ ID NO: 1178188 - protein, 10 aa, Mycobacterium
AEAATATATA

SEQ ID NO: 1178189 - protein, 8 aa, Mycobacterium
AEAAVSRT

SEQ ID NO: 1178190 - protein, 4 aa, Mycobacterium
AEAD

SEQ ID NO: 1178191 - protein, 10 aa, Mycobacterium
AEADKLRTSL

SEQ ID NO: 1178192 - protein, 6 aa, Mycobacterium
AEAEAI

SEQ ID NO: 1178193 - protein, 5 aa, Mycobacterium
AEAGA

SEQ ID NO: 1178194 - protein, 18 aa, Mycobacterium
AEAGATVDEEEDYNPDVV

SEQ ID NO: 1178195 - protein, 21 aa, Mycobacterium
AEAGIESSSQATEAASSDPIP

SEQ ID NO: 1178196 - protein, 4 aa, Mycobacterium
AEAI

SEQ ID NO: 1178197 - protein, 5 aa, Mycobacterium
AEAPD

SEQ ID NO: 1178198 - protein, 7 aa, Mycobacterium
AEAPTAG

SEQ ID NO: 1178199 - protein, 5 aa, Mycobacterium
AEARA

SEQ ID NO: 1178200 - protein, 11 aa, Mycobacterium
AEAREQSAPGA

SEQ ID NO: 1178201 - protein, 11 aa, Mycobacterium
AEARVSRNGTV

SEQ ID NO: 1178202 - protein, 11 aa, Mycobacterium
AEASEEARNAL

SEQ ID NO: 1178203 - protein, 23 aa, Mycobacterium
AEASGELKPGGTIVEPTSGNTGV

SEQ ID NO: 1178204 - protein, 23 aa, Mycobacterium
AEASGELKPGGTLVEPTSGNTGV

SEQ ID NO: 1178205 - protein, 9 aa, Mycobacterium
AEASGLPQP

SEQ ID NO: 1178206 - protein, 6 aa, Mycobacterium
AEATDL

SEQ ID NO: 1178207 - protein, 7 aa, Mycobacterium
AEATDPQ

SEQ ID NO: 1178208 - protein, 8 aa, Mycobacterium
AEATEGSA

SEQ ID NO: 1178209 - protein, 10 aa, Mycobacterium
AEATPPQMGA

SEQ ID NO: 1178210 - protein, 6 aa, Mycobacterium
AEAVES

SEQ ID NO: 1178211 - protein, 9 aa, Mycobacterium
AECGSPDAI

SEQ ID NO: 1178212 - protein, 6 aa, Mycobacterium
AECPGA

SEQ ID NO: 1178213 - protein, 5 aa, Mycobacterium
AECRK

SEQ ID NO: 1178214 - protein, 5 aa, Mycobacterium
AEDAP

SEQ ID NO: 1178215 - protein, 7 aa, Mycobacterium
AEDEQDA

SEQ ID NO: 1178216 - protein, 21 aa, Mycobacterium
AEDEQPAEQGEPEPAACPQDS

SEQ ID NO: 1178217 - protein, 8 aa, Mycobacterium
AEDEQRRE

SEQ ID NO: 1178218 - protein, 4 aa, Mycobacterium
AEDG

SEQ ID NO: 1178219 - protein, 14 aa, Mycobacterium
AEDGRDETLSAGRD

SEQ ID NO: 1178220 - protein, 15 aa, Mycobacterium
AEDNTVEKTLDPATA

SEQ ID NO: 1178221 - protein, 8 aa, Mycobacterium
AEDPPSRI

SEQ ID NO: 1178222 - protein, 7 aa, Mycobacterium
AEDPSWE

SEQ ID NO: 1178223 - protein, 5 aa, Mycobacterium
AEDPT

SEQ ID NO: 1178224 - protein, 6 aa, Mycobacterium
AEDPTH

SEQ ID NO: 1178225 - protein, 11 aa, Mycobacterium
AEDRARRHGGL

SEQ ID NO: 1178226 - protein, 6 aa, Mycobacterium
AEDVPD

SEQ ID NO: 1178227 - protein, 19 aa, Mycobacterium
AEEEIQTARDNAEKAKAAA

SEQ ID NO: 1178228 - protein, 5 aa, Mycobacterium
AEEPD

SEQ ID NO: 1178229 - protein, 11 aa, Mycobacterium
AEERERVQASA

SEQ ID NO: 1178230 - protein, 7 aa, Mycobacterium
AEESADL

SEQ ID NO: 1178231 - protein, 12 aa, Mycobacterium
AEETDRNPPRLE

SEQ ID NO: 1178232 - protein, 5 aa, Mycobacterium
AEETL

SEQ ID NO: 1178233 - protein, 10 aa, Mycobacterium
AEGAAVPRAS

SEQ ID NO: 1178234 - protein, 5 aa, Mycobacterium
AEGAG

SEQ ID NO: 1178235 - protein, 7 aa, Mycobacterium
AEGATRD

SEQ ID NO: 1178236 - protein, 8 aa, Mycobacterium
AEGDETTL

SEQ ID NO: 1178237 - protein, 28 aa, Mycobacterium
AEGDPDTPRRSRAYRESHTDVSDGAAAT

SEQ ID NO: 1178238 - protein, 5 aa, Mycobacterium
AEGDR

SEQ ID NO: 1178239 - protein, 11 aa, Mycobacterium
AEGEHRPDSLG

SEQ ID NO: 1178240 - protein, 10 aa, Mycobacterium
AEGERLPSPL

SEQ ID NO: 1178241 - protein, 4 aa, Mycobacterium
AEGG

SEQ ID NO: 1178242 - protein, 23 aa, Mycobacterium
AEGGEQADAKLAEASAAIARLVR

SEQ ID NO: 1178243 - protein, 12 aa, Mycobacterium
AEGKATELANRE

SEQ ID NO: 1178244 - protein, 13 aa, Mycobacterium
AEGKATELANREG

SEQ ID NO: 1178245 - protein, 12 aa, Mycobacterium
AEGMERAQTLSD

SEQ ID NO: 1178246 - protein, 8 aa, Mycobacterium
AEGPIQPD

SEQ ID NO: 1178247 - protein, 7 aa, Mycobacterium
AEGRPAV

SEQ ID NO: 1178248 - protein, 9 aa, Mycobacterium
AEGSEPDPL

SEQ ID NO: 1178249 - protein, 5 aa, Mycobacterium
AEGYT

SEQ ID NO: 1178250 - protein, 8 aa, Mycobacterium
AEHRAGEH

SEQ ID NO: 1178251 - protein, 4 aa, Mycobacterium
AEHT

SEQ ID NO: 1178252 - protein, 4 aa, Mycobacterium
AEIN

SEQ ID NO: 1178253 - protein, 5 aa, Mycobacterium
AELPA

SEQ ID NO: 1178254 - protein, 6 aa, Mycobacterium
AELPDK

SEQ ID NO: 1178255 - protein, 4 aa, Mycobacterium
AELR

SEQ ID NO: 1178256 - protein, 9 aa, Mycobacterium
AELSDPEVK

SEQ ID NO: 1178257 - protein, 4 aa, Mycobacterium
AENE

SEQ ID NO: 1178258 - protein, 17 aa, Mycobacterium
AENGEPDPLTEKPDDVY

SEQ ID NO: 1178259 - protein, 5 aa, Mycobacterium
AEPAV

SEQ ID NO: 1178260 - protein, 34 aa, Mycobacterium
AEPGTTAVDGVRERANQRAAARRGAAVRRKKGQL

SEQ ID NO: 1178261 - protein, 5 aa, Mycobacterium
AEPKQ

SEQ ID NO: 1178262 - protein, 18 aa, Mycobacterium
AEPPASWGSDGQKIRTPA

SEQ ID NO: 1178263 - protein, 8 aa, Mycobacterium
AEPQAPSD

SEQ ID NO: 1178264 - protein, 14 aa, Mycobacterium
AEPSDNRDRCYSTP

SEQ ID NO: 1178265 - protein, 27 aa, Mycobacterium
AEPTAVNSSSAKGTVVGTTPRGKTIPG

SEQ ID NO: 1178266 - protein, 11 aa, Mycobacterium
AEPVEPEPNTL

SEQ ID NO: 1178267 - protein, 64 aa, Mycobacterium
AEPVPPPPVEAPPPPPPPVEAPPPPPPPVEAPPPPAVEAPLPPPPVEAAPPPPEEAAPPPPVAE

SEQ ID NO: 1178268 - protein, 14 aa, Mycobacterium
AEQASTGKRPTYAS

SEQ ID NO: 1178269 - protein, 7 aa, Mycobacterium
AEQDYDA

SEQ ID NO: 1178270 - protein, 5 aa, Mycobacterium
AEQHD

SEQ ID NO: 1178271 - protein, 10 aa, Mycobacterium
AEQPGLQIPS

SEQ ID NO: 1178272 - protein, 7 aa, Mycobacterium
AEQRGDL

SEQ ID NO: 1178273 - protein, 7 aa, Mycobacterium
AEQRLGD

SEQ ID NO: 1178274 - protein, 6 aa, Mycobacterium
AEQSVE

SEQ ID NO: 1178275 - protein, 6 aa, Mycobacterium
AEQTKT

SEQ ID NO: 1178276 - protein, 8 aa, Mycobacterium
AERAGITS

SEQ ID NO: 1178277 - protein, 20 aa, Mycobacterium
AERAHRDLQGRKTVGSVVLV

SEQ ID NO: 1178278 - protein, 9 aa, Mycobacterium
AERARAGAG

SEQ ID NO: 1178279 - protein, 11 aa, Mycobacterium
AERDGLLQPGS

SEQ ID NO: 1178280 - protein, 55 aa, Mycobacterium; identical to SEQ ID NO: 419177

SEQ ID NO: 1178281 - protein, 5 aa, Mycobacterium
AERER

SEQ ID NO: 1178282 - protein, 7 aa, Mycobacterium
AERGRVG

SEQ ID NO: 1178283 - protein, 7 aa, Mycobacterium
AERNDGR

SEQ ID NO: 1178284 - protein, 7 aa, Mycobacterium
AERQPGD

SEQ ID NO: 1178285 - protein, 11 aa, Mycobacterium
AERRPTAADTA

SEQ ID NO: 1178286 - protein, 4 aa, Mycobacterium
AERS

SEQ ID NO: 1178287 - protein, 23 aa, Mycobacterium
AERTGTALDGRNDRVGAGAPAQL

SEQ ID NO: 1178288 - protein, 6 aa, Mycobacterium
AERYRT

SEQ ID NO: 1178289 - protein, 4 aa, Mycobacterium
AESD

SEQ ID NO: 1178290 - protein, 6 aa, Mycobacterium
AESDGG

SEQ ID NO: 1178291 - protein, 7 aa, Mycobacterium
AESITTA

SEQ ID NO: 1178292 - protein, 8 aa, Mycobacterium
AESNPGSK

SEQ ID NO: 1178293 - protein, 13 aa, Mycobacterium
AESSASAGANAEL

SEQ ID NO: 1178294 - protein, 14 aa, Mycobacterium
AESSSPDANGVDRR

SEQ ID NO: 1178295 - protein, 5 aa, Mycobacterium
AESTV

SEQ ID NO: 1178296 - protein, 6 aa, Mycobacterium
AETDAL

SEQ ID NO: 1178297 - protein, 5 aa, Mycobacterium
AETDP

SEQ ID NO: 1178298 - protein, 6 aa, Mycobacterium
AETDPH

SEQ ID NO: 1178299 - protein, 7 aa, Mycobacterium
AETDPVR

SEQ ID NO: 1178300 - protein, 12 aa, Mycobacterium
AETEPHRLGEGS

SEQ ID NO: 1178301 - protein, 6 aa, Mycobacterium
AETGVT

SEQ ID NO: 1178302 - protein, 20 aa, Mycobacterium
AETHARQNCSREDVRARAGG

SEQ ID NO: 1178303 - protein, 9 aa, Mycobacterium
AETNPDYPT

SEQ ID NO: 1178304 - protein, 8 aa, Mycobacterium
AETQATQV

SEQ ID NO: 1178305 - protein, 9 aa, Mycobacterium
AETRQGTRV

SEQ ID NO: 1178306 - protein, 10 aa, Mycobacterium
AETTPPQMGA

SEQ ID NO: 1178307 - protein, 6 aa, Mycobacterium
AEVDAG

SEQ ID NO: 1178308 - protein, 14 aa, Mycobacterium
AEVTDEGNTYRGRD

SEQ ID NO: 1178309 - protein, 23 aa, Mycobacterium
AEWASGLPGEHNIGGPISTETRV

SEQ ID NO: 1178310 - protein, 10 aa, Mycobacterium
AEYEGDHHRT

SEQ ID NO: 1178311 - protein, 8 aa, Mycobacterium
AEYGPSGV

SEQ ID NO: 1178312 - protein, 11 aa, Mycobacterium
AEYRPITDTEA

SEQ ID NO: 1178313 - protein, 11 aa, Mycobacterium
AFAPEPGESSA

SEQ ID NO: 1178314 - protein, 7 aa, Mycobacterium
AFNPQRS

SEQ ID NO: 1178315 - protein, 4 aa, Mycobacterium
AFSA

SEQ ID NO: 1178316 - protein, 6 aa, Mycobacterium
AFSEQE

SEQ ID NO: 1178317 - protein, 9 aa, Mycobacterium
AFTNQQSDL

SEQ ID NO: 1178318 - protein, 16 aa, Mycobacterium
AFTRTGTNGVAQVDTQ

SEQ ID NO: 1178319 - protein, 17 aa, Mycobacterium
AGAAAADTDDDGALPDG

SEQ ID NO: 1178320 - protein, 14 aa, Mycobacterium
AGAAARGGGTLPEV

SEQ ID NO: 1178321 - protein, 5 aa, Mycobacterium
AGAAI

SEQ ID NO: 1178322 - protein, 9 aa, Mycobacterium
AGAASPKET

SEQ ID NO: 1178323 - protein, 10 aa, Mycobacterium
AGADVDDPRG

SEQ ID NO: 1178324 - protein, 4 aa, Mycobacterium
AGAE

SEQ ID NO: 1178325 - protein, 5 aa, Mycobacterium
AGAEA

SEQ ID NO: 1178326 - protein, 6 aa, Mycobacterium
AGAERA

SEQ ID NO: 1178327 - protein, 19 aa, Mycobacterium
AGAESGAEEATRSTLDPTV

SEQ ID NO: 1178328 - protein, 5 aa, Mycobacterium
AGAGA

SEQ ID NO: 1178329 - protein, 7 aa, Mycobacterium
AGAGAVG

SEQ ID NO: 1178330 - protein, 7 aa, Mycobacterium
AGAGRSH

SEQ ID NO: 1178331 - protein, 8 aa, Mycobacterium
AGALTEGD

SEQ ID NO: 1178332 - protein, 13 aa, Mycobacterium
AGAPAPVPAAPAV

SEQ ID NO: 1178333 - protein, 13 aa, Mycobacterium
AGAPLIERGRYRS

SEQ ID NO: 1178334 - protein, 7 aa, Mycobacterium
AGAQFGA

SEQ ID NO: 1178335 - protein, 8 aa, Mycobacterium
AGARPEEV

SEQ ID NO: 1178336 - protein, 9 aa, Mycobacterium
AGARPGDRI

SEQ ID NO: 1178337 - protein, 4 aa, Mycobacterium
AGAT

SEQ ID NO: 1178338 - protein, 7 aa, Mycobacterium
AGATMPD

SEQ ID NO: 1178339 - protein, 12 aa, Mycobacterium
AGATRPPYADAG

SEQ ID NO: 1178340 - protein, 7 aa, Mycobacterium
AGATYTE

SEQ ID NO: 1178341 - protein, 9 aa, Mycobacterium
AGAVRDEAA

SEQ ID NO: 1178342 - protein, 8 aa, Mycobacterium
AGAYAGHS

SEQ ID NO: 1178343 - protein, 12 aa, Mycobacterium
AGCSGRAGPEAG

SEQ ID NO: 1178344 - protein, 11 aa, Mycobacterium
AGDADKISAGT

SEQ ID NO: 1178345 - protein, 15 aa, Mycobacterium
AGDCAPTAEAIDDTL

SEQ ID NO: 1178346 - protein, 9 aa, Mycobacterium
AGDDLTEAA

SEQ ID NO: 1178347 - protein, 11 aa, Mycobacterium
AGDGSDPQRVN

SEQ ID NO: 1178348 - protein, 6 aa, Mycobacterium
AGDGTQ

SEQ ID NO: 1178349 - protein, 6 aa, Mycobacterium
AGDGYN

SEQ ID NO: 1178350 - protein, 6 aa, Mycobacterium
AGDHYR

SEQ ID NO: 1178351 - protein, 4 aa, Mycobacterium
AGDL

SEQ ID NO: 1178352 - protein, 15 aa, Mycobacterium
AGDPGELPADEIAPE

SEQ ID NO: 1178353 - protein, 8 aa, Mycobacterium
AGDPGPDV

SEQ ID NO: 1178354 - protein, 11 aa, Mycobacterium
AGDPVPTEGEM

SEQ ID NO: 1178355 - protein, 16 aa, Mycobacterium
AGDRGQRLQHRRLPGR

SEQ ID NO: 1178356 - protein, 7 aa, Mycobacterium
AGDRNPV

SEQ ID NO: 1178357 - protein, 8 aa, Mycobacterium
AGDRPQAE

SEQ ID NO: 1178358 - protein, 4 aa, Mycobacterium
AGDT

SEQ ID NO: 1178359 - protein, 7 aa, Mycobacterium
AGDTETV

SEQ ID NO: 1178360 - protein, 8 aa, Mycobacterium
AGDTNRDT

SEQ ID NO: 1178361 - protein, 5 aa, Mycobacterium
AGDTP

SEQ ID NO: 1178362 - protein, 7 aa, Mycobacterium
AGDYEAA

SEQ ID NO: 1178363 - protein, 6 aa, Mycobacterium
AGEAEL

SEQ ID NO: 1178364 - protein, 5 aa, Mycobacterium
AGEAW

SEQ ID NO: 1178365 - protein, 13 aa, Mycobacterium
AGECGGEAASLAE

SEQ ID NO: 1178366 - protein, 8 aa, Mycobacterium
AGEGAPFT

SEQ ID NO: 1178367 - protein, 7 aa, Mycobacterium
AGEHAGK

SEQ ID NO: 1178368 - protein, 7 aa, Mycobacterium
AGELPDN

SEQ ID NO: 1178369 - protein, 5 aa, Mycobacterium
AGELS

SEQ ID NO: 1178370 - protein, 6 aa, Mycobacterium
AGEPQI

SEQ ID NO: 1178371 - protein, 4 aa, Mycobacterium
AGES

SEQ ID NO: 1178372 - protein, 6 aa, Mycobacterium
AGEYNS

SEQ ID NO: 1178373 - protein, 7 aa, Mycobacterium
AGEYNSM

SEQ ID NO: 1178374 - protein, 7 aa, Mycobacterium
AGEYPGP

SEQ ID NO: 1178375 - protein, 5 aa, Mycobacterium
AGFNN

SEQ ID NO: 1178376 - protein, 19 aa, Mycobacterium
AGFPNANSALTAARDVLEG

SEQ ID NO: 1178377 - protein, 5 aa, Mycobacterium
AGFSQ

SEQ ID NO: 1178378 - protein, 4 aa, Mycobacterium
AGGA

SEQ ID NO: 1178379 - protein, 5 aa, Mycobacterium
AGGAQ

SEQ ID NO: 1178380 - protein, 5 aa, Mycobacterium
AGGAT

SEQ ID NO: 1178381 - protein, 7 aa, Mycobacterium
AGGAVGG

SEQ ID NO: 1178382 - protein, 4 aa, Mycobacterium
AGGD

SEQ ID NO: 1178383 - protein, 10 aa, Mycobacterium
AGGDPGLSAQ

SEQ ID NO: 1178384 - protein, 29 aa, Mycobacterium
AGGDRNYDEDITDYSPDAVAARAEAARSA

SEQ ID NO: 1178385 - protein, 6 aa, Mycobacterium
AGGDTL

SEQ ID NO: 1178386 - protein, 9 aa, Mycobacterium
AGGERTGTS

SEQ ID NO: 1178387 - protein, 7 aa, Mycobacterium
AGGFSEE

SEQ ID NO: 1178388 - protein, 7 aa, Mycobacterium
AGGGLGR

SEQ ID NO: 1178389 - protein, 7 aa, Mycobacterium
AGGPQKC

SEQ ID NO: 1178390 - protein, 6 aa, Mycobacterium
AGGPVE

SEQ ID NO: 1178391 - protein, 6 aa, Mycobacterium
AGGQGR

SEQ ID NO: 1178392 - protein, 11 aa, Mycobacterium
AGGRGNAEAQD

SEQ ID NO: 1178393 - protein, 9 aa, Mycobacterium
AGGSGMSGM

SEQ ID NO: 1178394 - protein, 12 aa, Mycobacterium
AGGTAVTAPGAV

SEQ ID NO: 1178395 - protein, 6 aa, Mycobacterium
AGGTTG

SEQ ID NO: 1178396 - protein, 9 aa, Mycobacterium
AGGVPASDA

SEQ ID NO: 1178397 - protein, 7 aa, Mycobacterium
AGGVRPD

SEQ ID NO: 1178398 - protein, 6 aa, Mycobacterium
AGGYTV

SEQ ID NO: 1178399 - protein, 4 aa, Mycobacterium
AGHA

SEQ ID NO: 1178400 - protein, 8 aa, Mycobacterium
AGHASSER

SEQ ID NO: 1178401 - protein, 13 aa, Mycobacterium
AGHFKGKDPTVPV

SEQ ID NO: 1178402 - protein, 14 aa, Mycobacterium
AGHGSEPDGDSETV

SEQ ID NO: 1178403 - protein, 9 aa, Mycobacterium
AGHLPPNEQ

SEQ ID NO: 1178404 - protein, 6 aa, Mycobacterium
AGHQIA

SEQ ID NO: 1178405 - protein, 15 aa, Mycobacterium
AGHYGHEEAPEEANE

SEQ ID NO: 1178406 - protein, 7 aa, Mycobacterium
AGIEGYP

SEQ ID NO: 1178407 - protein, 5 aa, Mycobacterium
AGIGK

SEQ ID NO: 1178408 - protein, 14 aa, Mycobacterium
AGIPGAKLGSERDL

SEQ ID NO: 1178409 - protein, 14 aa, Mycobacterium
AGKAAAAAEELGNT

SEQ ID NO: 1178410 - protein, 37 aa, Mycobacterium
AGKEGDEEAGTYVGRTGSDDALDDEQTGAEARSQQQG

SEQ ID NO: 1178411 - protein, 4 aa, Mycobacterium
AGKG

SEQ ID NO: 1178412 - protein, 15 aa, Mycobacterium
AGKLERASDQSPEGG

SEQ ID NO: 1178413 - protein, 6 aa, Mycobacterium
AGKNGL

SEQ ID NO: 1178414 - protein, 12 aa, Mycobacterium
AGKTGSGKGAGR

SEQ ID NO: 1178415 - protein, 6 aa, Mycobacterium
AGLDPA

SEQ ID NO: 1178416 - protein, 7 aa, Mycobacterium
AGLEKRR

SEQ ID NO: 1178417 - protein, 9 aa, Mycobacterium
AGLGDGDDL

SEQ ID NO: 1178418 - protein, 11 aa, Mycobacterium
AGLGGAEPPAR

SEQ ID NO: 1178419 - protein, 14 aa, Mycobacterium
AGLKATPGNGHYAA

SEQ ID NO: 1178420 - protein, 7 aa, Mycobacterium
AGLPAEP

SEQ ID NO: 1178421 - protein, 8 aa, Mycobacterium
AGLPAKAV

SEQ ID NO: 1178422 - protein, 5 aa, Mycobacterium
AGLPD

SEQ ID NO: 1178423 - protein, 5 aa, Mycobacterium
AGLPG

SEQ ID NO: 1178424 - protein, 17 aa, Mycobacterium
AGLPGAGASGSGAGGGM

SEQ ID NO: 1178425 - protein, 19 aa, Mycobacterium
AGLPGSAEDKGAQAAAAAL

SEQ ID NO: 1178426 - protein, 4 aa, Mycobacterium
AGLQ

SEQ ID NO: 1178427 - protein, 14 aa, Mycobacterium
AGMAQTQQSPAHQE

SEQ ID NO: 1178428 - protein, 4 aa, Mycobacterium
AGMS

SEQ ID NO: 1178429 - protein, 7 aa, Mycobacterium
AGNEATI

SEQ ID NO: 1178430 - protein, 15 aa, Mycobacterium
AGNTAYAAAKSAEWG

SEQ ID NO: 1178431 - protein, 10 aa, Mycobacterium
AGPADLAAGR

SEQ ID NO: 1178432 - protein, 8 aa, Mycobacterium
AGPENSQF

SEQ ID NO: 1178433 - protein, 6 aa, Mycobacterium
AGPGPQ

SEQ ID NO: 1178434 - protein, 7 aa, Mycobacterium
AGPIGDE

SEQ ID NO: 1178435 - protein, 14 aa, Mycobacterium
AGPIPTGAPRFPGT

SEQ ID NO: 1178436 - protein, 5 aa, Mycobacterium
AGPKV

SEQ ID NO: 1178437 - protein, 6 aa, Mycobacterium
AGPPAA

SEQ ID NO: 1178438 - protein, 15 aa, Mycobacterium
AGPQAVSSGGPHSPV

SEQ ID NO: 1178439 - protein, 8 aa, Mycobacterium
AGPRGELQ

SEQ ID NO: 1178440 - protein, 5 aa, Mycobacterium
AGPRQ

SEQ ID NO: 1178441 - protein, 11 aa, Mycobacterium
AGPSAEPTAVD

SEQ ID NO: 1178442 - protein, 6 aa, Mycobacterium
AGPSAR

SEQ ID NO: 1178443 - protein, 6 aa, Mycobacterium
AGPSVR

SEQ ID NO: 1178444 - protein, 6 aa, Mycobacterium
AGPTGM

SEQ ID NO: 1178445 - protein, 10 aa, Mycobacterium
AGPTGRQTLT

SEQ ID NO: 1178446 - protein, 8 aa, Mycobacterium
AGPTPLQP

SEQ ID NO: 1178447 - protein, 4 aa, Mycobacterium
AGQP

SEQ ID NO: 1178448 - protein, 5 aa, Mycobacterium
AGQPV

SEQ ID NO: 1178449 - protein, 8 aa, Mycobacterium
AGQSAAAL

SEQ ID NO: 1178450 - protein, 20 aa, Mycobacterium
AGQTAAARERRESADAAAAK

SEQ ID NO: 1178451 - protein, 21 aa, Mycobacterium
AGQTAAARERRESADAAAAKD

SEQ ID NO: 1178452 - protein, 6 aa, Mycobacterium
AGQTMG

SEQ ID NO: 1178453 - protein, 8 aa, Mycobacterium
AGRADTVD

SEQ ID NO: 1178454 - protein, 7 aa, Mycobacterium
AGRDDTL

SEQ ID NO: 1178455 - protein, 12 aa, Mycobacterium
AGRDRAPTVPGH

SEQ ID NO: 1178456 - protein, 10 aa, Mycobacterium
AGRDRYSPFP

SEQ ID NO: 1178457 - protein, 4 aa, Mycobacterium
AGRE

SEQ ID NO: 1178458 - protein, 6 aa, Mycobacterium
AGRESD

SEQ ID NO: 1178459 - protein, 18 aa, Mycobacterium
AGRFPTDEPLNAQGHRQA

SEQ ID NO: 1178460 - protein, 8 aa, Mycobacterium
AGRGDQLN

SEQ ID NO: 1178461 - protein, 10 aa, Mycobacterium
AGRGEDGGLR

SEQ ID NO: 1178462 - protein, 5 aa, Mycobacterium
AGRGY

SEQ ID NO: 1178463 - protein, 10 aa, Mycobacterium
AGRKRAETDR

SEQ ID NO: 1178464 - protein, 5 aa, Mycobacterium
AGRMP

SEQ ID NO: 1178465 - protein, 7 aa, Mycobacterium
AGRNRIT

SEQ ID NO: 1178466 - protein, 8 aa, Mycobacterium
AGRPGATV

SEQ ID NO: 1178467 - protein, 4 aa, Mycobacterium
AGRR

SEQ ID NO: 1178468 - protein, 16 aa, Mycobacterium
AGRSEEDGESGFSNGT

SEQ ID NO: 1178469 - protein, 20 aa, Mycobacterium
AGRTPAGEDVDDQDAAAAIA

SEQ ID NO: 1178470 - protein, 9 aa, Mycobacterium
AGRVGAPED

SEQ ID NO: 1178471 - protein, 9 aa, Mycobacterium
AGRYTPTPA

SEQ ID NO: 1178472 - protein, 10 aa, Mycobacterium
AGSADRIAQR

SEQ ID NO: 1178473 - protein, 5 aa, Mycobacterium
AGSDH

SEQ ID NO: 1178474 - protein, 6 aa, Mycobacterium
AGSEEV

SEQ ID NO: 1178475 - protein, 4 aa, Mycobacterium
AGSF

SEQ ID NO: 1178476 - protein, 6 aa, Mycobacterium
AGSGSI

SEQ ID NO: 1178477 - protein, 13 aa, Mycobacterium
AGSPPGDDRVRAA

SEQ ID NO: 1178478 - protein, 7 aa, Mycobacterium
AGSQTLA

SEQ ID NO: 1178479 - protein, 6 aa, Mycobacterium
AGSRKH

SEQ ID NO: 1178480 - protein, 10 aa, Mycobacterium
AGSSNLEAQR

SEQ ID NO: 1178481 - protein, 12 aa, Mycobacterium
AGSTDHRAVPPA

SEQ ID NO: 1178482 - protein, 8 aa, Mycobacterium
AGSTVTTG

SEQ ID NO: 1178483 - protein, 17 aa, Mycobacterium
AGTAAHPAREGRAQEVA

SEQ ID NO: 1178484 - protein, 13 aa, Mycobacterium
AGTAFGQAASGVA

SEQ ID NO: 1178485 - protein, 10 aa, Mycobacterium
AGTAPDHPHS

SEQ ID NO: 1178486 - protein, 8 aa, Mycobacterium
AGTAPGAR

SEQ ID NO: 1178487 - protein, 18 aa, Mycobacterium
AGTERPFTGEYTDTETKG

SEQ ID NO: 1178488 - protein, 12 aa, Mycobacterium
AGTGHGTARERE

SEQ ID NO: 1178489 - protein, 6 aa, Mycobacterium
AGTGTN

SEQ ID NO: 1178490 - protein, 9 aa, Mycobacterium
AGTKLTSAA

SEQ ID NO: 1178491 - protein, 27 aa, Mycobacterium
AGTPAEVSRVDRSRTAPYLAARLGHST

SEQ ID NO: 1178492 - protein, 9 aa, Mycobacterium
AGTPEPRHD

SEQ ID NO: 1178493 - protein, 8 aa, Mycobacterium
AGTPGARS

SEQ ID NO: 1178494 - protein, 7 aa, Mycobacterium
AGTPGKR

SEQ ID NO: 1178495 - protein, 6 aa, Mycobacterium
AGTPVE

SEQ ID NO: 1178496 - protein, 9 aa, Mycobacterium
AGTQPGAVS

SEQ ID NO: 1178497 - protein, 10 aa, Mycobacterium
AGTQQPSSGR

SEQ ID NO: 1178498 - protein, 12 aa, Mycobacterium
AGTRADRLSGGT

SEQ ID NO: 1178499 - protein, 5 aa, Mycobacterium
AGTRP

SEQ ID NO: 1178500 - protein, 8 aa, Mycobacterium
AGVDDGDV

SEQ ID NO: 1178501 - protein, 10 aa, Mycobacterium
AGVDPDRLEP

SEQ ID NO: 1178502 - protein, 7 aa, Mycobacterium
AGVGSSV

SEQ ID NO: 1178503 - protein, 4 aa, Mycobacterium
AGVP

SEQ ID NO: 1178504 - protein, 5 aa, Mycobacterium
AGVPA

SEQ ID NO: 1178505 - protein, 6 aa, Mycobacterium
AGVRAG

SEQ ID NO: 1178506 - protein, 8 aa, Mycobacterium
AGVRPGVE

SEQ ID NO: 1178507 - protein, 9 aa, Mycobacterium
AGVTETQRA

SEQ ID NO: 1178508 - protein, 14 aa, Mycobacterium
AGWGRAENAATARK

SEQ ID NO: 1178509 - protein, 8 aa, Mycobacterium
AGWRPDPR

SEQ ID NO: 1178510 - protein, 6 aa, Mycobacterium
AHADRV

SEQ ID NO: 1178511 - protein, 8 aa, Mycobacterium
AHAEGGSR

SEQ ID NO: 1178512 - protein, 7 aa, Mycobacterium
AHAEPAP

SEQ ID NO: 1178513 - protein, 13 aa, Mycobacterium
AHAETPGAGAAGG

SEQ ID NO: 1178514 - protein, 14 aa, Mycobacterium
AHATAKEIAANPPL

SEQ ID NO: 1178515 - protein, 5 aa, Mycobacterium
AHEQN

SEQ ID NO: 1178516 - protein, 8 aa, Mycobacterium
AHGAAQGH

SEQ ID NO: 1178517 - protein, 8 aa, Mycobacterium
AHGDHRAA

SEQ ID NO: 1178518 - protein, 10 aa, Mycobacterium
AHGEESLDET

SEQ ID NO: 1178519 - protein, 19 aa, Mycobacterium
AHGGTTIAGANPLKENPCV

SEQ ID NO: 1178520 - protein, 5 aa, Mycobacterium
AHGTD

SEQ ID NO: 1178521 - protein, 4 aa, Mycobacterium
AHGV

SEQ ID NO: 1178522 - protein, 10 aa, Mycobacterium
AHKERSGSSF

SEQ ID NO: 1178523 - protein, 7 aa, Mycobacterium
AHKKPFQ

SEQ ID NO: 1178524 - protein, 4 aa, Mycobacterium
AHKR

SEQ ID NO: 1178525 - protein, 7 aa, Mycobacterium
AHNAAEQ

SEQ ID NO: 1178526 - protein, 6 aa, Mycobacterium
AHPEGM

SEQ ID NO: 1178527 - protein, 9 aa, Mycobacterium
AHPRYRSTG

SEQ ID NO: 1178528 - protein, 6 aa, Mycobacterium
AHPSAD

SEQ ID NO: 1178529 - protein, 10 aa, Mycobacterium
AHQGPLPDEM

SEQ ID NO: 1178530 - protein, 12 aa, Mycobacterium
AHQGSEARPTRH

SEQ ID NO: 1178531 - protein, 5 aa, Mycobacterium
AHQTT

SEQ ID NO: 1178532 - protein, 6 aa, Mycobacterium
AHRSQY

SEQ ID NO: 1178533 - protein, 5 aa, Mycobacterium
AHSGA

SEQ ID NO: 1178534 - protein, 5 aa, Mycobacterium
AHSGD

SEQ ID NO: 1178535 - protein, 6 aa, Mycobacterium
AHTEPR

SEQ ID NO: 1178536 - protein, 4 aa, Mycobacterium
AIAG

SEQ ID NO: 1178537 - protein, 9 aa, Mycobacterium
AIAQETEEQ

SEQ ID NO: 1178538 - protein, 8 aa, Mycobacterium
AIARERGD

SEQ ID NO: 1178539 - protein, 9 aa, Mycobacterium
AIASDGADA

SEQ ID NO: 1178540 - protein, 5 aa, Mycobacterium
AIDGS

SEQ ID NO: 1178541 - protein, 7 aa, Mycobacterium
AIEDTLQ

SEQ ID NO: 1178542 - protein, 29 aa, Mycobacterium
AIGTAADTAAAGGAAAALRKQDADAQLKL

SEQ ID NO: 1178543 - protein, 6 aa, Mycobacterium
AINDND

SEQ ID NO: 1178544 - protein, 7 aa, Mycobacterium
AINNDGS

SEQ ID NO: 1178545 - protein, 12 aa, Mycobacterium
AINPTPHPEARA

SEQ ID NO: 1178546 - protein, 5 aa, Mycobacterium
AIPDG

SEQ ID NO: 1178547 - protein, 17 aa, Mycobacterium
AIPGQDRPVGTEPDNGA

SEQ ID NO: 1178548 - protein, 8 aa, Mycobacterium
AKAAASEA

SEQ ID NO: 1178549 - protein, 8 aa, Mycobacterium
AKAGDGKV

SEQ ID NO: 1178550 - protein, 5 aa, Mycobacterium
AKAMR

SEQ ID NO: 1178551 - protein, 9 aa, Mycobacterium
AKDGRGART

SEQ ID NO: 1178552 - protein, 11 aa, Mycobacterium
AKDLASGDTVY

SEQ ID NO: 1178553 - protein, 6 aa, Mycobacterium
AKDPAA

SEQ ID NO: 1178554 - protein, 6 aa, Mycobacterium
AKDPAL

SEQ ID NO: 1178555 - protein, 5 aa, Mycobacterium
AKDWR

SEQ ID NO: 1178556 - protein, 18 aa, Mycobacterium
AKEAGADAPVGDDPYRAA

SEQ ID NO: 1178557 - protein, 20 aa, Mycobacterium
AKEAPGWTVTTSDDGGEHRA

SEQ ID NO: 1178558 - protein, 8 aa, Mycobacterium
AKEGESPI

SEQ ID NO: 1178559 - protein, 4 aa, Mycobacterium
AKEQ

SEQ ID NO: 1178560 - protein, 13 aa, Mycobacterium
AKERADAHETGEI

SEQ ID NO: 1178561 - protein, 6 aa, Mycobacterium
AKERTD

SEQ ID NO: 1178562 - protein, 11 aa, Mycobacterium
AKESGRKSARI

SEQ ID NO: 1178563 - protein, 14 aa, Mycobacterium
AKFGADKPTSDPME

SEQ ID NO: 1178564 - protein, 16 aa, Mycobacterium
AKGAPREGFPPGTPWD

SEQ ID NO: 1178565 - protein, 9 aa, Mycobacterium
AKGHRQSAH

SEQ ID NO: 1178566 - protein, 11 aa, Mycobacterium
AKGLRDGRDYD

SEQ ID NO: 1178567 - protein, 43 aa, Mycobacterium
AKGNADGWPDTKNPKFADAQERSNQAAAGGDEWHDPREDGNLP

SEQ ID NO: 1178568 - protein, 7 aa, Mycobacterium
AKGQEEI

SEQ ID NO: 1178569 - protein, 13 aa, Mycobacterium
AKGQTHTGGPRVT

SEQ ID NO: 1178570 - protein, 10 aa, Mycobacterium
AKKRGHGDDA

SEQ ID NO: 1178571 - protein, 6 aa, Mycobacterium
AKLGED

SEQ ID NO: 1178572 - protein, 11 aa, Mycobacterium
AKLGPDKDIPH

SEQ ID NO: 1178573 - protein, 8 aa, Mycobacterium
AKLPGEAE

SEQ ID NO: 1178574 - protein, 10 aa, Mycobacterium
AKNAANANAQ

SEQ ID NO: 1178575 - protein, 23 aa, Mycobacterium
AKPGEFGPPAAPTPQPREHGTSQ

SEQ ID NO: 1178576 - protein, 6 aa, Mycobacterium
AKQADR

SEQ ID NO: 1178577 - protein, 11 aa, Mycobacterium
AKQGASYGHTK

SEQ ID NO: 1178578 - protein, 6 aa, Mycobacterium
AKQVEG

SEQ ID NO: 1178579 - protein, 9 aa, Mycobacterium
AKRDGDTLG

SEQ ID NO: 1178580 - protein, 15 aa, Mycobacterium
AKRDGIAPGSPEADR

SEQ ID NO: 1178581 - protein, 10 aa, Mycobacterium
AKRDRKPDFT

SEQ ID NO: 1178582 - protein, 8 aa, Mycobacterium
AKRDTAAD

SEQ ID NO: 1178583 - protein, 8 aa, Mycobacterium
AKRGRSRG

SEQ ID NO: 1178584 - protein, 15 aa, Mycobacterium
AKRPSTRTQDDYTDV

SEQ ID NO: 1178585 - protein, 15 aa, Mycobacterium
AKRTGRGRALGPAQR

SEQ ID NO: 1178586 - protein, 6 aa, Mycobacterium
AKSPRR

SEQ ID NO: 1178587 - protein, 7 aa, Mycobacterium
AKSTVKG

SEQ ID NO: 1178588 - protein, 7 aa, Mycobacterium
AKTAANI

SEQ ID NO: 1178589 - protein, 7 aa, Mycobacterium
AKTAGAG

SEQ ID NO: 1178590 - protein, 7 aa, Mycobacterium
AKTATAR

SEQ ID NO: 1178591 - protein, 7 aa, Mycobacterium
AKTRDGR

SEQ ID NO: 1178592 - protein, 24 aa, Mycobacterium
AKVDELEARGAVGATSPAHAGEKA

SEQ ID NO: 1178593 - protein, 7 aa, Mycobacterium
AKVDGSE

SEQ ID NO: 1178594 - protein, 6 aa, Mycobacterium
AKVEPY

SEQ ID NO: 1178595 - protein, 8 aa, Mycobacterium
AKVPTESG

SEQ ID NO: 1178596 - protein, 13 aa, Mycobacterium
ALADSADNHRAAA

SEQ ID NO: 1178597 - protein, 5 aa, Mycobacterium
ALAGD

SEQ ID NO: 1178598 - protein, 8 aa, Mycobacterium
ALDGSEPI

SEQ ID NO: 1178599 - protein, 5 aa, Mycobacterium
ALDRS

SEQ ID NO: 1178600 - protein, 11 aa, Mycobacterium
ALEARKPDPLA

SEQ ID NO: 1178601 - protein, 6 aa, Mycobacterium
ALEDGD

SEQ ID NO: 1178602 - protein, 15 aa, Mycobacterium
ALGDPPDLDEPDDAL

SEQ ID NO: 1178603 - protein, 12 aa, Mycobacterium
ALGLPGSDHSWA

SEQ ID NO: 1178604 - protein, 5 aa, Mycobacterium
ALGPG

SEQ ID NO: 1178605 - protein, 7 aa, Mycobacterium
ALGPRSL

SEQ ID NO: 1178606 - protein, 13 aa, Mycobacterium
ALKSAGDQLNSAV

SEQ ID NO: 1178607 - protein, 8 aa, Mycobacterium
ALPAEATE

SEQ ID NO: 1178608 - protein, 7 aa, Mycobacterium
ALPAGVE

SEQ ID NO: 1178609 - protein, 23 aa, Mycobacterium
ALPAPELTSTADFREPGTDTERE

SEQ ID NO: 1178610 - protein, 12 aa, Mycobacterium
ALPAPRVSEAEA

SEQ ID NO: 1178611 - protein, 15 aa, Mycobacterium
ALPATDDDDEPTDPY

SEQ ID NO: 1178612 - protein, 4 aa, Mycobacterium
ALPD

SEQ ID NO: 1178613 - protein, 12 aa, Mycobacterium
ALPDGPGRDTGE

SEQ ID NO: 1178614 - protein, 7 aa, Mycobacterium
ALPDTEP

SEQ ID NO: 1178615 - protein, 7 aa, Mycobacterium
ALPGETD

SEQ ID NO: 1178616 - protein, 17 aa, Mycobacterium
ALPGGTNLEQSTSRTYG

SEQ ID NO: 1178617 - protein, 5 aa, Mycobacterium
ALPPE

SEQ ID NO: 1178618 - protein, 8 aa, Mycobacterium
ALPPEKQP

SEQ ID NO: 1178619 - protein, 10 aa, Mycobacterium
ALPPPAPGSV

SEQ ID NO: 1178620 - protein, 8 aa, Mycobacterium
ALPPPGQF

SEQ ID NO: 1178621 - protein, 8 aa, Mycobacterium
ALPPTDDE

SEQ ID NO: 1178622 - protein, 5 aa, Mycobacterium
ALPPV

SEQ ID NO: 1178623 - protein, 9 aa, Mycobacterium
ALPSPGSDA

SEQ ID NO: 1178624 - protein, 10 aa, Mycobacterium
ALPSPGSDAQ

SEQ ID NO: 1178625 - protein, 5 aa, Mycobacterium
ALPTA

SEQ ID NO: 1178626 - protein, 5 aa, Mycobacterium
ALPTN

SEQ ID NO: 1178627 - protein, 4 aa, Mycobacterium
ALQA

SEQ ID NO: 1178628 - protein, 7 aa, Mycobacterium
ALQGYSD

SEQ ID NO: 1178629 - protein, 8 aa, Mycobacterium
ALRAPDKA

SEQ ID NO: 1178630 - protein, 14 aa, Mycobacterium
ALRDADKSAPLGEG

SEQ ID NO: 1178631 - protein, 11 aa, Mycobacterium
ALRDNGIQASV

SEQ ID NO: 1178632 - protein, 9 aa, Mycobacterium
ALRNSDGDY

SEQ ID NO: 1178633 - protein, 8 aa, Mycobacterium
ALRPDKAG

SEQ ID NO: 1178634 - protein, 12 aa, Mycobacterium
ALSAPDYAGAKE

SEQ ID NO: 1178635 - protein, 10 aa, Mycobacterium
ALSGGPDAVR

SEQ ID NO: 1178636 - protein, 9 aa, Mycobacterium
ALSGRGLPQ

SEQ ID NO: 1178637 - protein, 6 aa, Mycobacterium
ALSPEQ

SEQ ID NO: 1178638 - protein, 6 aa, Mycobacterium
ALSPVG

SEQ ID NO: 1178639 - protein, 8 aa, Mycobacterium
ALSSSTPA

SEQ ID NO: 1178640 - protein, 5 aa, Mycobacterium
ALSYG

SEQ ID NO: 1178641 - protein, 7 aa, Mycobacterium
ALTDRGA

SEQ ID NO: 1178642 - protein, 8 aa, Mycobacterium
ALTDYPHP

SEQ ID NO: 1178643 - protein, 11 aa, Mycobacterium
ALTGDDTEAQL

SEQ ID NO: 1178644 - protein, 12 aa, Mycobacterium
ALTTPAATLPSR

SEQ ID NO: 1178645 - protein, 5 aa, Mycobacterium
AMPRP

SEQ ID NO: 1178646 - protein, 10 aa, Mycobacterium
AMSADSPVTA

SEQ ID NO: 1178647 - protein, 15 aa, Mycobacterium
AMTPGNKNGWSQEQG

SEQ ID NO: 1178648 - protein, 18 aa, Mycobacterium
ANAAPPSAPDADIDGATA

SEQ ID NO: 1178649 - protein, 8 aa, Mycobacterium
ANAGPALT

SEQ ID NO: 1178650 - protein, 9 aa, Mycobacterium
ANANVAAPI

SEQ ID NO: 1178651 - protein, 10 aa, Mycobacterium
ANANVAAPIN

SEQ ID NO: 1178652 - protein, 9 aa, Mycobacterium
ANAPSVSGH

SEQ ID NO: 1178653 - protein, 7 aa, Mycobacterium
ANASLGP

SEQ ID NO: 1178654 - protein, 6 aa, Mycobacterium
ANCSPA

SEQ ID NO: 1178655 - protein, 5 aa, Mycobacterium
ANDKG

SEQ ID NO: 1178656 - protein, 7 aa, Mycobacterium
ANDPTSV

SEQ ID NO: 1178657 - protein, 10 aa, Mycobacterium
ANEDAADALT

SEQ ID NO: 1178658 - protein, 6 aa, Mycobacterium
ANEPER

SEQ ID NO: 1178659 - protein, 7 aa, Mycobacterium
ANESARL

SEQ ID NO: 1178660 - protein, 6 aa, Mycobacterium
ANFTDQ

SEQ ID NO: 1178661 - protein, 21 aa, Mycobacterium
ANGAEGRPTKPITVKSDERGE

SEQ ID NO: 1178662 - protein, 7 aa, Mycobacterium
ANGDPAL

SEQ ID NO: 1178663 - protein, 6 aa, Mycobacterium
ANGGWT

SEQ ID NO: 1178664 - protein, 7 aa, Mycobacterium
ANGIGAA

SEQ ID NO: 1178665 - protein, 9 aa, Mycobacterium
ANGSHGGPQ

SEQ ID NO: 1178666 - protein, 15 aa, Mycobacterium
ANGTTCQQRSVESTL

SEQ ID NO: 1178667 - protein, 9 aa, Mycobacterium
ANPAGKVSA

SEQ ID NO: 1178668 - protein, 11 aa, Mycobacterium
ANPALTKDEQS

SEQ ID NO: 1178669 - protein, 16 aa, Mycobacterium
ANPASKVKRPGVARKE

SEQ ID NO: 1178670 - protein, 8 aa, Mycobacterium
ANPDGTGE

SEQ ID NO: 1178671 - protein, 9 aa, Mycobacterium
ANPPANPRV

SEQ ID NO: 1178672 - protein, 17 aa, Mycobacterium
ANPPDRSAGGVDLTPPM

SEQ ID NO: 1178673 - protein, 8 aa, Mycobacterium
ANPRAAER

SEQ ID NO: 1178674 - protein, 8 aa, Mycobacterium
ANPTGGPV

SEQ ID NO: 1178675 - protein, 32 aa, Mycobacterium
ANQNEAGTTYNAADAEGAEGYNAVPTPDVGIR

SEQ ID NO: 1178676 - protein, 7 aa, Mycobacterium
ANRDEDI

SEQ ID NO: 1178677 - protein, 10 aa, Mycobacterium
ANRDERAFPD

SEQ ID NO: 1178678 - protein, 13 aa, Mycobacterium
ANRDEREFGSDAA

SEQ ID NO: 1178679 - protein, 7 aa, Mycobacterium
ANRDESK

SEQ ID NO: 1178680 - protein, 11 aa, Mycobacterium
ANRQSSNPDHK

SEQ ID NO: 1178681 - protein, 9 aa, Mycobacterium
ANRRTASNY

SEQ ID NO: 1178682 - protein, 13 aa, Mycobacterium
ANSKAAVQADHDT

SEQ ID NO: 1178683 - protein, 19 aa, Mycobacterium
ANSKEKEEVLTPATPGAEA

SEQ ID NO: 1178684 - protein, 11 aa, Mycobacterium
ANTAEEQSFQT

SEQ ID NO: 1178685 - protein, 8 aa, Mycobacterium
ANTAENPF

SEQ ID NO: 1178686 - protein, 12 aa, Mycobacterium
ANTGAPGTVSAA

SEQ ID NO: 1178687 - protein, 9 aa, Mycobacterium
ANTTAPETA

SEQ ID NO: 1178688 - protein, 7 aa, Mycobacterium
ANVGRRA

SEQ ID NO: 1178689 - protein, 7 aa, Mycobacterium
ANWDTPD

SEQ ID NO: 1178690 - protein, 7 aa, Mycobacterium
ANYDERR

SEQ ID NO: 1178691 - protein, 9 aa, Mycobacterium
ANYQGPSAE

SEQ ID NO: 1178692 - protein, 5 aa, Mycobacterium
ANYTR

SEQ ID NO: 1178693 - protein, 21 aa, Mycobacterium
APAAATSAAAAPASVAPAPRE

SEQ ID NO: 1178694 - protein, 14 aa, Mycobacterium
APAAFDPARRRAGK

SEQ ID NO: 1178695 - protein, 11 aa, Mycobacterium
APAAGEVPEAE

SEQ ID NO: 1178696 - protein, 6 aa, Mycobacterium
APAALA

SEQ ID NO: 1178697 - protein, 16 aa, Mycobacterium
APAAPDAPAEPAAPRN

SEQ ID NO: 1178698 - protein, 5 aa, Mycobacterium
APAAR

SEQ ID NO: 1178699 - protein, 6 aa, Mycobacterium
APAEPD

SEQ ID NO: 1178700 - protein, 10 aa, Mycobacterium
APAGAGKTTA

SEQ ID NO: 1178701 - protein, 10 aa, Mycobacterium
APAGGGTSRP

SEQ ID NO: 1178702 - protein, 6 aa, Mycobacterium
APAGST

SEQ ID NO: 1178703 - protein, 8 aa, Mycobacterium
APALGDDT

SEQ ID NO: 1178704 - protein, 71 aa, Mycobacterium
APAPAAGEGNGAPASGQGGEPAGGSAGSGATGSAGGAGGGSAPAAATGGSGAAASAAGGGQPGPAAEAADR

SEQ ID NO: 1178705 - protein, 15 aa, Mycobacterium
APAPADGEKNPLRDN

SEQ ID NO: 1178706 - protein, 18 aa, Mycobacterium
APAPAPAPAPAPAPVLPP

SEQ ID NO: 1178707 - protein, 5 aa, Mycobacterium
APAPD

SEQ ID NO: 1178708 - protein, 22 aa, Mycobacterium
APAPLPPAPEALPPAPAPAAPF

SEQ ID NO: 1178709 - protein, 12 aa, Mycobacterium
APAPSTSGMSGR

SEQ ID NO: 1178710 - protein, 7 aa, Mycobacterium
APAQRRG

SEQ ID NO: 1178711 - protein, 4 aa, Mycobacterium
APAS

SEQ ID NO: 1178712 - protein, 11 aa, Mycobacterium
APATPTRTDKV

SEQ ID NO: 1178713 - protein, 5 aa, Mycobacterium
APAVK

SEQ ID NO: 1178714 - protein, 7 aa, Mycobacterium
APDAGAL

SEQ ID NO: 1178715 - protein, 18 aa, Mycobacterium
APDDTGYGAGYGEEPGPL

SEQ ID NO: 1178716 - protein, 15 aa, Mycobacterium
APDGNPLVAESGAGR

SEQ ID NO: 1178717 - protein, 15 aa, Mycobacterium
APDPALAGANPALST

SEQ ID NO: 1178718 - protein, 7 aa, Mycobacterium
APDQTPL

SEQ ID NO: 1178719 - protein, 5 aa, Mycobacterium
APDSI

SEQ ID NO: 1178720 - protein, 6 aa, Mycobacterium
APDTWR

SEQ ID NO: 1178721 - protein, 11 aa, Mycobacterium
APEAPTPAQFD

SEQ ID NO: 1178722 - protein, 6 aa, Mycobacterium
APEDVK

SEQ ID NO: 1178723 - protein, 9 aa, Mycobacterium
APEGDGTRL

SEQ ID NO: 1178724 - protein, 5 aa, Mycobacterium
APEGG

SEQ ID NO: 1178725 - protein, 5 aa, Mycobacterium
APEHS

SEQ ID NO: 1178726 - protein, 5 aa, Mycobacterium
APEKA

SEQ ID NO: 1178727 - protein, 6 aa, Mycobacterium
APEKVP

SEQ ID NO: 1178728 - protein, 16 aa, Mycobacterium
APEPFHPANREERKSL

SEQ ID NO: 1178729 - protein, 6 aa, Mycobacterium
APEPWS

SEQ ID NO: 1178730 - protein, 5 aa, Mycobacterium
APEQR

SEQ ID NO: 1178731 - protein, 5 aa, Mycobacterium
APERV

SEQ ID NO: 1178732 - protein, 7 aa, Mycobacterium
APEVGVP

SEQ ID NO: 1178733 - protein, 9 aa, Mycobacterium
APFAGTDRR

SEQ ID NO: 1178734 - protein, 5 aa, Mycobacterium
APFDE

SEQ ID NO: 1178735 - protein, 4 aa, Mycobacterium
APFG

SEQ ID NO: 1178736 - protein, 7 aa, Mycobacterium
APGADLN

SEQ ID NO: 1178737 - protein, 4 aa, Mycobacterium
APGD

SEQ ID NO: 1178738 - protein, 4 aa, Mycobacterium
APGE

SEQ ID NO: 1178739 - protein, 9 aa, Mycobacterium
APGGGDQHA

SEQ ID NO: 1178740 - protein, 5 aa, Mycobacterium
APGHA

SEQ ID NO: 1178741 - protein, 6 aa, Mycobacterium
APGHAD

SEQ ID NO: 1178742 - protein, 8 aa, Mycobacterium
APGPLRKG

SEQ ID NO: 1178743 - protein, 7 aa, Mycobacterium
APGPQTV

SEQ ID NO: 1178744 - protein, 4 aa, Mycobacterium
APGQ

SEQ ID NO: 1178745 - protein, 5 aa, Mycobacterium
APGVP

SEQ ID NO: 1178746 - protein, 158 aa, Mycobacterium
APHAPAAAHSPETSARSPESRVPDTRAPEGRTPEARSPEPRAPETPRAQQPAATGPTPGQMPTAPVNPAGHAATAPGEPTHARPEPQASRPDGDKRDNSPSASHPATHHTARPPTGDRPANQSDAPGSNQGAGSAQDPSPHHSGQMGNPANARTYGPH

SEQ ID NO: 1178747 - protein, 6 aa, Mycobacterium
APHTTR

SEQ ID NO: 1178748 - protein, 8 aa, Mycobacterium
APIATEEA

SEQ ID NO: 1178749 - protein, 5 aa, Mycobacterium
APIDE

SEQ ID NO: 1178750 - protein, 8 aa, Mycobacterium
APKDAPMP

SEQ ID NO: 1178751 - protein, 15 aa, Mycobacterium
APKDEKTTPSDGSHA

SEQ ID NO: 1178752 - protein, 8 aa, Mycobacterium
APKENAEN

SEQ ID NO: 1178753 - protein, 8 aa, Mycobacterium
APKHRRRA

SEQ ID NO: 1178754 - protein, 6 aa, Mycobacterium
APLAQR

SEQ ID NO: 1178755 - protein, 5 aa, Mycobacterium
APLDP

SEQ ID NO: 1178756 - protein, 7 aa, Mycobacterium
APLGEAA

SEQ ID NO: 1178757 - protein, 14 aa, Mycobacterium
APLTARAASEAVTI

SEQ ID NO: 1178758 - protein, 14 aa, Mycobacterium
APNAAAEGLAPRTP

SEQ ID NO: 1178759 - protein, 4 aa, Mycobacterium
APNH

SEQ ID NO: 1178760 - protein, 13 aa, Mycobacterium
APPALPTAESDHT

SEQ ID NO: 1178761 - protein, 9 aa, Mycobacterium
APPAPEPLT

SEQ ID NO: 1178762 - protein, 4 aa, Mycobacterium
APPE

SEQ ID NO: 1178763 - protein, 12 aa, Mycobacterium
APPEADAKELAD

SEQ ID NO: 1178764 - protein, 6 aa, Mycobacterium
APPEVR

SEQ ID NO: 1178765 - protein, 7 aa, Mycobacterium
APPGDGQ

SEQ ID NO: 1178766 - protein, 6 aa, Mycobacterium
APPIST

SEQ ID NO: 1178767 - protein, 12 aa, Mycobacterium
APPLPDAKVPTL

SEQ ID NO: 1178768 - protein, 7 aa, Mycobacterium
APPPALT

SEQ ID NO: 1178769 - protein, 13 aa, Mycobacterium
APPPPHAGPGRVP

SEQ ID NO: 1178770 - protein, 19 aa, Mycobacterium
APPPVAPPADLPPVPPPYD

SEQ ID NO: 1178771 - protein, 8 aa, Mycobacterium
APPSAGDI

SEQ ID NO: 1178772 - protein, 4 aa, Mycobacterium
APPV

SEQ ID NO: 1178773 - protein, 5 aa, Mycobacterium
APPVA

SEQ ID NO: 1178774 - protein, 5 aa, Mycobacterium
APQAD

SEQ ID NO: 1178775 - protein, 7 aa, Mycobacterium
APQADVA

SEQ ID NO: 1178776 - protein, 18 aa, Mycobacterium
APQAPVSEDQESDTDDQP

SEQ ID NO: 1178777 - protein, 5 aa, Mycobacterium
APQAR

SEQ ID NO: 1178778 - protein, 18 aa, Mycobacterium
APQPQSEATFDTDPAGAL

SEQ ID NO: 1178779 - protein, 5 aa, Mycobacterium
APQQL

SEQ ID NO: 1178780 - protein, 7 aa, Mycobacterium
APQRVDP

SEQ ID NO: 1178781 - protein, 21 aa, Mycobacterium
APRGAPAGPAAPAPPAGGHGG

SEQ ID NO: 1178782 - protein, 11 aa, Mycobacterium
APRHSDVTEDQ

SEQ ID NO: 1178783 - protein, 6 aa, Mycobacterium
APRIPS

SEQ ID NO: 1178784 - protein, 15 aa, Mycobacterium
APRRERDADPGGRPV

SEQ ID NO: 1178785 - protein, 6 aa, Mycobacterium
APRRKT

SEQ ID NO: 1178786 - protein, 6 aa, Mycobacterium
APRSEL

SEQ ID NO: 1178787 - protein, 7 aa, Mycobacterium
APSAGNA

SEQ ID NO: 1178788 - protein, 13 aa, Mycobacterium
APSANLDPTKQYP

SEQ ID NO: 1178789 - protein, 16 aa, Mycobacterium
APSAPSAAGAAAGPTL

SEQ ID NO: 1178790 - protein, 18 aa, Mycobacterium
APSARAGRYGAAADATLA

SEQ ID NO: 1178791 - protein, 43 aa, Mycobacterium
APSEPQPAQTPNPGTPSETPERLTPAETPERLTPAEAPERLSP

SEQ ID NO: 1178792 - protein, 4 aa, Mycobacterium
APSG

SEQ ID NO: 1178793 - protein, 6 aa, Mycobacterium
APSNIT

SEQ ID NO: 1178794 - protein, 7 aa, Mycobacterium
APSTDRI

SEQ ID NO: 1178795 - protein, 4 aa, Mycobacterium
APSV

SEQ ID NO: 1178796 - protein, 6 aa, Mycobacterium
APSVPG

SEQ ID NO: 1178797 - protein, 6 aa, Mycobacterium
APTAEQ

SEQ ID NO: 1178798 - protein, 7 aa, Mycobacterium
APTDLSD

SEQ ID NO: 1178799 - protein, 11 aa, Mycobacterium
APTESTAQARF

SEQ ID NO: 1178800 - protein, 9 aa, Mycobacterium
APTGGAPVT

SEQ ID NO: 1178801 - protein, 14 aa, Mycobacterium
APTIEENRAPTPRL

SEQ ID NO: 1178802 - protein, 5 aa, Mycobacterium
APTKQ

SEQ ID NO: 1178803 - protein, 4 aa, Mycobacterium
APTQ

SEQ ID NO: 1178804 - protein, 4 aa, Mycobacterium
APTR

SEQ ID NO: 1178805 - protein, 13 aa, Mycobacterium
APTRPVTAPLDGP

SEQ ID NO: 1178806 - protein, 6 aa, Mycobacterium
APTSRD

SEQ ID NO: 1178807 - protein, 18 aa, Mycobacterium
APTTIEQAGGQAGYPAPP

SEQ ID NO: 1178808 - protein, 9 aa, Mycobacterium
APTTQTVNG

SEQ ID NO: 1178809 - protein, 5 aa, Mycobacterium
APTVS

SEQ ID NO: 1178810 - protein, 4 aa, Mycobacterium
APVA

SEQ ID NO: 1178811 - protein, 5 aa, Mycobacterium
APVEA

SEQ ID NO: 1178812 - protein, 51 aa, Mycobacterium
APVPPATVTETTTPPTTSPSPTTTATTTVSETTPPTTTTVPTSPESPTPPA

SEQ ID NO: 1178813 - protein, 8 aa, Mycobacterium
APVPPGEP

SEQ ID NO: 1178814 - protein, 6 aa, Mycobacterium
APVSTS

SEQ ID NO: 1178815 - protein, 7 aa, Mycobacterium
APVSTSG

SEQ ID NO: 1178816 - protein, 9 aa, Mycobacterium
APWPAGPTC

SEQ ID NO: 1178817 - protein, 10 aa, Mycobacterium
APWPAGPTCA

SEQ ID NO: 1178818 - protein, 4 aa, Mycobacterium
APWR

SEQ ID NO: 1178819 - protein, 4 aa, Mycobacterium
AQAA

SEQ ID NO: 1178820 - protein, 7 aa, Mycobacterium
AQAAGAD

SEQ ID NO: 1178821 - protein, 8 aa, Mycobacterium
AQAAPGLE

SEQ ID NO: 1178822 - protein, 6 aa, Mycobacterium
AQAAPR

SEQ ID NO: 1178823 - protein, 6 aa, Mycobacterium
AQAGGM

SEQ ID NO: 1178824 - protein, 5 aa, Mycobacterium
AQAPR

SEQ ID NO: 1178825 - protein, 6 aa, Mycobacterium
AQAPVD

SEQ ID NO: 1178826 - protein, 7 aa, Mycobacterium
AQDTPGR

SEQ ID NO: 1178827 - protein, 15 aa, Mycobacterium
AQEAVDGKVNPSRIT

SEQ ID NO: 1178828 - protein, 12 aa, Mycobacterium
AQEGALSQIDED

SEQ ID NO: 1178829 - protein, 10 aa, Mycobacterium
AQEGKGGGEY

SEQ ID NO: 1178830 - protein, 12 aa, Mycobacterium
AQEQTYRTGATA

SEQ ID NO: 1178831 - protein, 5 aa, Mycobacterium
AQGEA

SEQ ID NO: 1178832 - protein, 8 aa, Mycobacterium
AQGEIKGD

SEQ ID NO: 1178833 - protein, 10 aa, Mycobacterium
AQGGDTSRLA

SEQ ID NO: 1178834 - protein, 8 aa, Mycobacterium
AQGRTLTA

SEQ ID NO: 1178835 - protein, 17 aa, Mycobacterium
AQGTPEDVAANTDSYTG

SEQ ID NO: 1178836 - protein, 7 aa, Mycobacterium
AQHAEGA

SEQ ID NO: 1178837 - protein, 7 aa, Mycobacterium
AQNTTAE

SEQ ID NO: 1178838 - protein, 24 aa, Mycobacterium
AQPAGDDRFTAQTGVAAADERQVV

SEQ ID NO: 1178839 - protein, 9 aa, Mycobacterium
AQPKDVSGL

SEQ ID NO: 1178840 - protein, 10 aa, Mycobacterium
AQPPEENPQG

SEQ ID NO: 1178841 - protein, 10 aa, Mycobacterium
AQQERGKDGQ

SEQ ID NO: 1178842 - protein, 8 aa, Mycobacterium
AQQRYGAA

SEQ ID NO: 1178843 - protein, 18 aa, Mycobacterium
AQRAAERVAAERDGRAEA

SEQ ID NO: 1178844 - protein, 8 aa, Mycobacterium
AQRATAES

SEQ ID NO: 1178845 - protein, 7 aa, Mycobacterium
AQRDADT

SEQ ID NO: 1178846 - protein, 8 aa, Mycobacterium
AQRDNPTS

SEQ ID NO: 1178847 - protein, 7 aa, Mycobacterium
AQRNPAE

SEQ ID NO: 1178848 - protein, 4 aa, Mycobacterium
AQRP

SEQ ID NO: 1178849 - protein, 6 aa, Mycobacterium
AQRPAM

SEQ ID NO: 1178850 - protein, 8 aa, Mycobacterium
AQRPTDGT

SEQ ID NO: 1178851 - protein, 11 aa, Mycobacterium
AQSAAQNAMST

SEQ ID NO: 1178852 - protein, 16 aa, Mycobacterium
AQSARDAAATHTDSAD

SEQ ID NO: 1178853 - protein, 7 aa, Mycobacterium
AQSDRAL

SEQ ID NO: 1178854 - protein, 11 aa, Mycobacterium
AQSDTGLPAAR

SEQ ID NO: 1178855 - protein, 8 aa, Mycobacterium
AQSTQRQS

SEQ ID NO: 1178856 - protein, 4 aa, Mycobacterium
AQTD

SEQ ID NO: 1178857 - protein, 10 aa, Mycobacterium
AQTREQAAEL

SEQ ID NO: 1178858 - protein, 8 aa, Mycobacterium
AQVDPDNN

SEQ ID NO: 1178859 - protein, 8 aa, Mycobacterium
AQVGPDQQ

SEQ ID NO: 1178860 - protein, 7 aa, Mycobacterium
AQVNPED

SEQ ID NO: 1178861 - protein, 6 aa, Mycobacterium
AQYPDQ

SEQ ID NO: 1178862 - protein, 6 aa, Mycobacterium
AQYSKS

SEQ ID NO: 1178863 - protein, 8 aa, Mycobacterium
ARAAAAER

SEQ ID NO: 1178864 - protein, 10 aa, Mycobacterium
ARAADKPDDL

SEQ ID NO: 1178865 - protein, 13 aa, Mycobacterium
ARADGDRAEDARA

SEQ ID NO: 1178866 - protein, 7 aa, Mycobacterium
ARAEAES

SEQ ID NO: 1178867 - protein, 11 aa, Mycobacterium
ARAEDEAPPTA

SEQ ID NO: 1178868 - protein, 8 aa, Mycobacterium
ARAGEHTD

SEQ ID NO: 1178869 - protein, 10 aa, Mycobacterium
ARAKDDPALA

SEQ ID NO: 1178870 - protein, 8 aa, Mycobacterium
ARANSTIE

SEQ ID NO: 1178871 - protein, 13 aa, Mycobacterium
ARARAGALSEAGE

SEQ ID NO: 1178872 - protein, 8 aa, Mycobacterium
ARARSTYE

SEQ ID NO: 1178873 - protein, 10 aa, Mycobacterium
ARASAGEYAA

SEQ ID NO: 1178874 - protein, 10 aa, Mycobacterium
ARASAPKGSV

SEQ ID NO: 1178875 - protein, 6 aa, Mycobacterium
ARASRA

SEQ ID NO: 1178876 - protein, 7 aa, Mycobacterium
ARDAGED

SEQ ID NO: 1178877 - protein, 10 aa, Mycobacterium
ARDAGEPMAE

SEQ ID NO: 1178878 - protein, 6 aa, Mycobacterium
ARDDTD

SEQ ID NO: 1178879 - protein, 7 aa, Mycobacterium
ARDGLAA

SEQ ID NO: 1178880 - protein, 6 aa, Mycobacterium
ARDGSL

SEQ ID NO: 1178881 - protein, 9 aa, Mycobacterium
ARDPDAPAL

SEQ ID NO: 1178882 - protein, 9 aa, Mycobacterium
AREAAAHAP

SEQ ID NO: 1178883 - protein, 4 aa, Mycobacterium
AREG

SEQ ID NO: 1178884 - protein, 7 aa, Mycobacterium
AREGEAA

SEQ ID NO: 1178885 - protein, 9 aa, Mycobacterium
AREGGDLQR

SEQ ID NO: 1178886 - protein, 4 aa, Mycobacterium
AREL

SEQ ID NO: 1178887 - protein, 15 aa, Mycobacterium
ARELTDEVTARGTMD

SEQ ID NO: 1178888 - protein, 8 aa, Mycobacterium
ARELTDGP

SEQ ID NO: 1178889 - protein, 6 aa, Mycobacterium
ARERGL

SEQ ID NO: 1178890 - protein, 5 aa, Mycobacterium
ARERR

SEQ ID NO: 1178891 - protein, 21 aa, Mycobacterium
ARESRRGPPSTPRKTRRAATV

SEQ ID NO: 1178892 - protein, 7 aa, Mycobacterium
ARETFRD

SEQ ID NO: 1178893 - protein, 4 aa, Mycobacterium
AREV

SEQ ID NO: 1178894 - protein, 5 aa, Mycobacterium
ARFPN

SEQ ID NO: 1178895 - protein, 8 aa, Mycobacterium
ARFSPPKA

SEQ ID NO: 1178896 - protein, 6 aa, Mycobacterium
ARGAKP

SEQ ID NO: 1178897 - protein, 5 aa, Mycobacterium
ARGAV

SEQ ID NO: 1178898 - protein, 11 aa, Mycobacterium
ARGGLDDAADA

SEQ ID NO: 1178899 - protein, 5 aa, Mycobacterium
ARGGR

SEQ ID NO: 1178900 - protein, 7 aa, Mycobacterium
ARGHGNI

SEQ ID NO: 1178901 - protein, 4 aa, Mycobacterium
ARGI

SEQ ID NO: 1178902 - protein, 75 aa, Mycobacterium
ARGMGQPAEPGSVAGSGHDRGVGSDGSDRSDGNHDGDRDAGLRTQVGPESVPAASEHGTPDEGLGSPWDGPTGRH

SEQ ID NO: 1178903 - protein, 6 aa, Mycobacterium
ARGMGR

SEQ ID NO: 1178904 - protein, 5 aa, Mycobacterium
ARGNP

SEQ ID NO: 1178905 - protein, 6 aa, Mycobacterium
ARGQIG

SEQ ID NO: 1178906 - protein, 12 aa, Mycobacterium
ARGTAKRQPDLG

SEQ ID NO: 1178907 - protein, 7 aa, Mycobacterium
ARHATGR

SEQ ID NO: 1178908 - protein, 5 aa, Mycobacterium
ARHGD

SEQ ID NO: 1178909 - protein, 11 aa, Mycobacterium
ARHGDPDGPAS

SEQ ID NO: 1178910 - protein, 20 aa, Mycobacterium
ARHGLHNPNARYRKEATLDD

SEQ ID NO: 1178911 - protein, 12 aa, Mycobacterium
ARHGSLDSEGID

SEQ ID NO: 1178912 - protein, 5 aa, Mycobacterium
ARHPD

SEQ ID NO: 1178913 - protein, 7 aa, Mycobacterium
ARHPGAI

SEQ ID NO: 1178914 - protein, 7 aa, Mycobacterium
ARHPNNP

SEQ ID NO: 1178915 - protein, 9 aa, Mycobacterium
ARHRGTGRE

SEQ ID NO: 1178916 - protein, 8 aa, Mycobacterium
ARKTDVTN

SEQ ID NO: 1178917 - protein, 8 aa, Mycobacterium
ARNGVSEN

SEQ ID NO: 1178918 - protein, 6 aa, Mycobacterium
ARNLGS

SEQ ID NO: 1178919 - protein, 4 aa, Mycobacterium
ARNP

SEQ ID NO: 1178920 - protein, 4 aa, Mycobacterium
ARPA

SEQ ID NO: 1178921 - protein, 13 aa, Mycobacterium
ARPAEAADRAVPG

SEQ ID NO: 1178922 - protein, 9 aa, Mycobacterium
ARPDAASPA

SEQ ID NO: 1178923 - protein, 9 aa, Mycobacterium
ARPDLTGLP

SEQ ID NO: 1178924 - protein, 6 aa, Mycobacterium
ARPGQI

SEQ ID NO: 1178925 - protein, 8 aa, Mycobacterium
ARPGQPGA

SEQ ID NO: 1178926 - protein, 7 aa, Mycobacterium
ARPHDAL

SEQ ID NO: 1178927 - protein, 17 aa, Mycobacterium
ARPHRAGGPTSAANGLG

SEQ ID NO: 1178928 - protein, 5 aa, Mycobacterium
ARPKA

SEQ ID NO: 1178929 - protein, 7 aa, Mycobacterium
ARPLSEV

SEQ ID NO: 1178930 - protein, 11 aa, Mycobacterium
ARPPVPSGRAE

SEQ ID NO: 1178931 - protein, 5 aa, Mycobacterium
ARPQR

SEQ ID NO: 1178932 - protein, 7 aa, Mycobacterium
ARQAGGD

SEQ ID NO: 1178933 - protein, 10 aa, Mycobacterium
ARQGDSGTTV

SEQ ID NO: 1178934 - protein, 7 aa, Mycobacterium
ARQLGPR

SEQ ID NO: 1178935 - protein, 22 aa, Mycobacterium
ARQPALADAGRALENAAARPGV

SEQ ID NO: 1178936 - protein, 6 aa, Mycobacterium
ARQPFK

SEQ ID NO: 1178937 - protein, 7 aa, Mycobacterium
ARQSGVP

SEQ ID NO: 1178938 - protein, 9 aa, Mycobacterium
ARRAGAELP

SEQ ID NO: 1178939 - protein, 7 aa, Mycobacterium
ARRAGVS

SEQ ID NO: 1178940 - protein, 7 aa, Mycobacterium
ARRARGD

SEQ ID NO: 1178941 - protein, 26 aa, Mycobacterium
ARRESGFDEDSDDDGLDRPAAAVEDD

SEQ ID NO: 1178942 - protein, 5 aa, Mycobacterium
ARRGD

SEQ ID NO: 1178943 - protein, 14 aa, Mycobacterium
ARRGSAVTASPSAG

SEQ ID NO: 1178944 - protein, 9 aa, Mycobacterium
ARRLETPAT

SEQ ID NO: 1178945 - protein, 22 aa, Mycobacterium
ARRLTGPEADDALTDYRSRHPR

SEQ ID NO: 1178946 - protein, 6 aa, Mycobacterium
ARRNSQ

SEQ ID NO: 1178947 - protein, 7 aa, Mycobacterium
ARRPDGT

SEQ ID NO: 1178948 - protein, 9 aa, Mycobacterium
ARRPHGQRT

SEQ ID NO: 1178949 - protein, 29 aa, Mycobacterium
ARRPTPRKESPHRAGPSAPARRPSIGPRM

SEQ ID NO: 1178950 - protein, 5 aa, Mycobacterium
ARRRG

SEQ ID NO: 1178951 - protein, 11 aa, Mycobacterium
ARRRRSTVGRQ

SEQ ID NO: 1178952 - protein, 13 aa, Mycobacterium
ARRTPSNQAHVTN

SEQ ID NO: 1178953 - protein, 14 aa, Mycobacterium
ARRTPSNQAHVTNQ

SEQ ID NO: 1178954 - protein, 9 aa, Mycobacterium
ARSAEAGEV

SEQ ID NO: 1178955 - protein, 5 aa, Mycobacterium
ARSGA

SEQ ID NO: 1178956 - protein, 9 aa, Mycobacterium
ARSGASRAD

SEQ ID NO: 1178957 - protein, 7 aa, Mycobacterium
ARSGGEC

SEQ ID NO: 1178958 - protein, 8 aa, Mycobacterium
ARSGLATD

SEQ ID NO: 1178959 - protein, 7 aa, Mycobacterium
ARSPEAL

SEQ ID NO: 1178960 - protein, 7 aa, Mycobacterium
ARSPEQA

SEQ ID NO: 1178961 - protein, 5 aa, Mycobacterium
ARSRE

SEQ ID NO: 1178962 - protein, 6 aa, Mycobacterium
ARSREI

SEQ ID NO: 1178963 - protein, 9 aa, Mycobacterium
ARSSEEVPR

SEQ ID NO: 1178964 - protein, 17 aa, Mycobacterium
ARSSTKGMVTGEPGDPV

SEQ ID NO: 1178965 - protein, 4 aa, Mycobacterium
ARST

SEQ ID NO: 1178966 - protein, 4 aa, Mycobacterium
ARSV

SEQ ID NO: 1178967 - protein, 13 aa, Mycobacterium
ARSVTANQRDRAE

SEQ ID NO: 1178968 - protein, 5 aa, Mycobacterium
ARSYP

SEQ ID NO: 1178969 - protein, 10 aa, Mycobacterium
ARTADAELGE

SEQ ID NO: 1178970 - protein, 6 aa, Mycobacterium
ARTAVQ

SEQ ID NO: 1178971 - protein, 7 aa, Mycobacterium
ARTEESL

SEQ ID NO: 1178972 - protein, 10 aa, Mycobacterium
ARTEGYTGKR

SEQ ID NO: 1178973 - protein, 10 aa, Mycobacterium
ARTEPLPAGE

SEQ ID NO: 1178974 - protein, 16 aa, Mycobacterium
ARTGAPATAGRRPLPG

SEQ ID NO: 1178975 - protein, 5 aa, Mycobacterium
ARTPA

SEQ ID NO: 1178976 - protein, 6 aa, Mycobacterium
ARTQGA

SEQ ID NO: 1178977 - protein, 7 aa, Mycobacterium
ARTRAEL

SEQ ID NO: 1178978 - protein, 13 aa, Mycobacterium
ARTRDRRPDLLGD

SEQ ID NO: 1178979 - protein, 7 aa, Mycobacterium
ARTRGPV

SEQ ID NO: 1178980 - protein, 6 aa, Mycobacterium
ARTVEE

SEQ ID NO: 1178981 - protein, 10 aa, Mycobacterium
ARVEGGTTVP

SEQ ID NO: 1178982 - protein, 6 aa, Mycobacterium
ARVSDQ

SEQ ID NO: 1178983 - protein, 7 aa, Mycobacterium
ARVSESP

SEQ ID NO: 1178984 - protein, 10 aa, Mycobacterium
ARYQSEAARD

SEQ ID NO: 1178985 - protein, 4 aa, Mycobacterium
ASAA

SEQ ID NO: 1178986 - protein, 5 aa, Mycobacterium
ASAAD

SEQ ID NO: 1178987 - protein, 12 aa, Mycobacterium
ASAAVGAAEQTR

SEQ ID NO: 1178988 - protein, 7 aa, Mycobacterium
ASADLDE

SEQ ID NO: 1178989 - protein, 8 aa, Mycobacterium
ASADPVGR

SEQ ID NO: 1178990 - protein, 14 aa, Mycobacterium
ASAEGYYRDEIFGQ

SEQ ID NO: 1178991 - protein, 4 aa, Mycobacterium
ASAF

SEQ ID NO: 1178992 - protein, 4 aa, Mycobacterium
ASAG

SEQ ID NO: 1178993 - protein, 5 aa, Mycobacterium
ASAHA

SEQ ID NO: 1178994 - protein, 12 aa, Mycobacterium
ASAIPGAEEPGC

SEQ ID NO: 1178995 - protein, 4 aa, Mycobacterium
ASAL

SEQ ID NO: 1178996 - protein, 22 aa, Mycobacterium
ASALTAPPAPSAPAAAAPPSIT

SEQ ID NO: 1178997 - protein, 7 aa, Mycobacterium
ASANQMS

SEQ ID NO: 1178998 - protein, 7 aa, Mycobacterium
ASAPAPN

SEQ ID NO: 1178999 - protein, 9 aa, Mycobacterium
ASAPGPGNT

SEQ ID NO: 1179000 - protein, 15 aa, Mycobacterium
ASAPGSAGGVDQARY

SEQ ID NO: 1179001 - protein, 9 aa, Mycobacterium
ASAPLPSTT

SEQ ID NO: 1179002 - protein, 8 aa, Mycobacterium
ASAPRPVR

SEQ ID NO: 1179003 - protein, 6 aa, Mycobacterium
ASARSV

SEQ ID NO: 1179004 - protein, 6 aa, Mycobacterium
ASATDE

SEQ ID NO: 1179005 - protein, 8 aa, Mycobacterium
ASATDVSK

SEQ ID NO: 1179006 - protein, 7 aa, Mycobacterium
ASDDDPR

SEQ ID NO: 1179007 - protein, 9 aa, Mycobacterium
ASDESYGAE

SEQ ID NO: 1179008 - protein, 16 aa, Mycobacterium
ASDHDAVADSLGTAAN

SEQ ID NO: 1179009 - protein, 34 aa, Mycobacterium
ASDMPAAARPVEPAKTFTRRSQVADAPAPAPAPV

SEQ ID NO: 1179010 - protein, 28 aa, Mycobacterium
ASDPESDSRDPIAAPVPATGGSGTGTAV

SEQ ID NO: 1179011 - protein, 7 aa, Mycobacterium
ASDPGAR

SEQ ID NO: 1179012 - protein, 7 aa, Mycobacterium
ASDSPVI

SEQ ID NO: 1179013 - protein, 4 aa, Mycobacterium
ASDT

SEQ ID NO: 1179014 - protein, 4 aa, Mycobacterium
ASEA

SEQ ID NO: 1179015 - protein, 13 aa, Mycobacterium
ASEAAAKDEGTTY

SEQ ID NO: 1179016 - protein, 5 aa, Mycobacterium
ASEAE

SEQ ID NO: 1179017 - protein, 9 aa, Mycobacterium
ASEAERTAV

SEQ ID NO: 1179018 - protein, 14 aa, Mycobacterium
ASEATGDGSRTGDP

SEQ ID NO: 1179019 - protein, 4 aa, Mycobacterium
ASEE

SEQ ID NO: 1179020 - protein, 7 aa, Mycobacterium
ASEIPER

SEQ ID NO: 1179021 - protein, 12 aa, Mycobacterium
ASELGKKNPTVT

SEQ ID NO: 1179022 - protein, 7 aa, Mycobacterium
ASEPRTR

SEQ ID NO: 1179023 - protein, 7 aa, Mycobacterium
ASESQRR

SEQ ID NO: 1179024 - protein, 7 aa, Mycobacterium
ASGAGDR

SEQ ID NO: 1179025 - protein, 19 aa, Mycobacterium
ASGALDTDDLDAQAARNQA

SEQ ID NO: 1179026 - protein, 9 aa, Mycobacterium
ASGAPSPNT

SEQ ID NO: 1179027 - protein, 6 aa, Mycobacterium
ASGASV

SEQ ID NO: 1179028 - protein, 10 aa, Mycobacterium
ASGAVRGTVA

SEQ ID NO: 1179029 - protein, 4 aa, Mycobacterium
ASGD

SEQ ID NO: 1179030 - protein, 16 aa, Mycobacterium
ASGETTVEGASITGSV

SEQ ID NO: 1179031 - protein, 17 aa, Mycobacterium
ASGFGRATAEALTKRGA

SEQ ID NO: 1179032 - protein, 4 aa, Mycobacterium
ASGH

SEQ ID NO: 1179033 - protein, 9 aa, Mycobacterium
ASGKGTKDA

SEQ ID NO: 1179034 - protein, 10 aa, Mycobacterium
ASGKNGYPRE

SEQ ID NO: 1179035 - protein, 13 aa, Mycobacterium
ASGLARPEPGITS

SEQ ID NO: 1179036 - protein, 7 aa, Mycobacterium
ASGPALS

SEQ ID NO: 1179037 - protein, 8 aa, Mycobacterium
ASGPKEAC

SEQ ID NO: 1179038 - protein, 6 aa, Mycobacterium
ASGPMP

SEQ ID NO: 1179039 - protein, 10 aa, Mycobacterium
ASGPPTPTGR

SEQ ID NO: 1179040 - protein, 6 aa, Mycobacterium
ASGQID

SEQ ID NO: 1179041 - protein, 5 aa, Mycobacterium
ASGRF

SEQ ID NO: 1179042 - protein, 6 aa, Mycobacterium
ASGRFG

SEQ ID NO: 1179043 - protein, 8 aa, Mycobacterium
ASGSDHAT

SEQ ID NO: 1179044 - protein, 8 aa, Mycobacterium
ASGSEGIA

SEQ ID NO: 1179045 - protein, 7 aa, Mycobacterium
ASGSLGQ

SEQ ID NO: 1179046 - protein, 9 aa, Mycobacterium
ASGSTPHGY

SEQ ID NO: 1179047 - protein, 14 aa, Mycobacterium
ASGTADELKQQTGV

SEQ ID NO: 1179048 - protein, 25 aa, Mycobacterium
ASGTGNAAIPAAQKGAAVTASDLTP

SEQ ID NO: 1179049 - protein, 9 aa, Mycobacterium
ASGTSLPFA

SEQ ID NO: 1179050 - protein, 5 aa, Mycobacterium
ASGTV

SEQ ID NO: 1179051 - protein, 5 aa, Mycobacterium
ASGVP

SEQ ID NO: 1179052 - protein, 6 aa, Mycobacterium
ASHAER

SEQ ID NO: 1179053 - protein, 9 aa, Mycobacterium
ASHPSPVST

SEQ ID NO: 1179054 - protein, 5 aa, Mycobacterium
ASKAR

SEQ ID NO: 1179055 - protein, 7 aa, Mycobacterium
ASKGKAD

SEQ ID NO: 1179056 - protein, 9 aa, Mycobacterium
ASKRSAELA

SEQ ID NO: 1179057 - protein, 13 aa, Mycobacterium
ASKSAGPGTRSNI

SEQ ID NO: 1179058 - protein, 7 aa, Mycobacterium
ASKSRLD

SEQ ID NO: 1179059 - protein, 6 aa, Mycobacterium
ASKYGL

SEQ ID NO: 1179060 - protein, 7 aa, Mycobacterium
ASKYGLR

SEQ ID NO: 1179061 - protein, 10 aa, Mycobacterium
ASLAPAEPRA

SEQ ID NO: 1179062 - protein, 6 aa, Mycobacterium
ASLDAS

SEQ ID NO: 1179063 - protein, 4 aa, Mycobacterium
ASLT

SEQ ID NO: 1179064 - protein, 15 aa, Mycobacterium
ASLTGSVRNDPRGEA

SEQ ID NO: 1179065 - protein, 10 aa, Mycobacterium
ASMTPATASI

SEQ ID NO: 1179066 - protein, 11 aa, Mycobacterium
ASNRDPRKFEN

SEQ ID NO: 1179067 - protein, 10 aa, Mycobacterium
ASPESVTDAV

SEQ ID NO: 1179068 - protein, 4 aa, Mycobacterium
ASPF

SEQ ID NO: 1179069 - protein, 9 aa, Mycobacterium
ASPGASTAV

SEQ ID NO: 1179070 - protein, 5 aa, Mycobacterium
ASPGS

SEQ ID NO: 1179071 - protein, 9 aa, Mycobacterium
ASPNPMRPS

SEQ ID NO: 1179072 - protein, 15 aa, Mycobacterium
ASPVDEDDPQRSTAG

SEQ ID NO: 1179073 - protein, 6 aa, Mycobacterium
ASPVVS

SEQ ID NO: 1179074 - protein, 15 aa, Mycobacterium
ASQAHEAAGTDWDTA

SEQ ID NO: 1179075 - protein, 4 aa, Mycobacterium
ASQG

SEQ ID NO: 1179076 - protein, 9 aa, Mycobacterium
ASQTTTADK

SEQ ID NO: 1179077 - protein, 6 aa, Mycobacterium
ASRAAG

SEQ ID NO: 1179078 - protein, 5 aa, Mycobacterium
ASRAE

SEQ ID NO: 1179079 - protein, 9 aa, Mycobacterium
ASRAEQGLP

SEQ ID NO: 1179080 - protein, 10 aa, Mycobacterium
ASRGRPDLSW

SEQ ID NO: 1179081 - protein, 5 aa, Mycobacterium
ASRPR

SEQ ID NO: 1179082 - protein, 7 aa, Mycobacterium
ASRPSRV

SEQ ID NO: 1179083 - protein, 5 aa, Mycobacterium
ASRRG

SEQ ID NO: 1179084 - protein, 7 aa, Mycobacterium
ASRTADE

SEQ ID NO: 1179085 - protein, 8 aa, Mycobacterium
ASRTADPW

SEQ ID NO: 1179086 - protein, 15 aa, Mycobacterium
ASSAPPESKTEGDAY

SEQ ID NO: 1179087 - protein, 9 aa, Mycobacterium
ASSEEADEL

SEQ ID NO: 1179088 - protein, 12 aa, Mycobacterium
ASSEPRPSGAGT

SEQ ID NO: 1179089 - protein, 9 aa, Mycobacterium
ASSGIGEET

SEQ ID NO: 1179090 - protein, 6 aa, Mycobacterium
ASSLGG

SEQ ID NO: 1179091 - protein, 4 aa, Mycobacterium
ASSQ

SEQ ID NO: 1179092 - protein, 16 aa, Mycobacterium
ASSTPAPTSTGMPGHN

SEQ ID NO: 1179093 - protein, 7 aa, Mycobacterium
ASSYCSG

SEQ ID NO: 1179094 - protein, 8 aa, Mycobacterium
ASTAQTLS

SEQ ID NO: 1179095 - protein, 4 aa, Mycobacterium
ASTD

SEQ ID NO: 1179096 - protein, 4 aa, Mycobacterium
ASTG

SEQ ID NO: 1179097 - protein, 10 aa, Mycobacterium
ASTPVTDDPV

SEQ ID NO: 1179098 - protein, 13 aa, Mycobacterium
ASTRSSSGMTSPG

SEQ ID NO: 1179099 - protein, 6 aa, Mycobacterium
ASTTSL

SEQ ID NO: 1179100 - protein, 4 aa, Mycobacterium
ASTV

SEQ ID NO: 1179101 - protein, 19 aa, Mycobacterium
ASTVGVPARNAPVSVPEAR

SEQ ID NO: 1179102 - protein, 9 aa, Mycobacterium
ASVNDPKAV

SEQ ID NO: 1179103 - protein, 7 aa, Mycobacterium
ASVTATA

SEQ ID NO: 1179104 - protein, 4 aa, Mycobacterium
ASYH

SEQ ID NO: 1179105 - protein, 7 aa, Mycobacterium
ATAAESH

SEQ ID NO: 1179106 - protein, 35 aa, Mycobacterium
ATAAIGAGRYQRTDGRTVHRNGHRPKTVSTTSGDV

SEQ ID NO: 1179107 - protein, 9 aa, Mycobacterium
ATAAQAVQG

SEQ ID NO: 1179108 - protein, 14 aa, Mycobacterium
ATADGAGDKARNAR

SEQ ID NO: 1179109 - protein, 15 aa, Mycobacterium
ATADNSVAGPGTGKR

SEQ ID NO: 1179110 - protein, 6 aa, Mycobacterium
ATAEAI

SEQ ID NO: 1179111 - protein, 9 aa, Mycobacterium
ATAEGGEDQ

SEQ ID NO: 1179112 - protein, 6 aa, Mycobacterium
ATAGIA

SEQ ID NO: 1179113 - protein, 5 aa, Mycobacterium
ATAHG

SEQ ID NO: 1179114 - protein, 10 aa, Mycobacterium
ATAKPAGADR

SEQ ID NO: 1179115 - protein, 6 aa, Mycobacterium
ATAPAV

SEQ ID NO: 1179116 - protein, 6 aa, Mycobacterium
ATAPDR

SEQ ID NO: 1179117 - protein, 4 aa, Mycobacterium
ATAT

SEQ ID NO: 1179118 - protein, 5 aa, Mycobacterium
ATDAG

SEQ ID NO: 1179119 - protein, 12 aa, Mycobacterium
ATDCSPAATDTL

SEQ ID NO: 1179120 - protein, 10 aa, Mycobacterium
ATDDGAASRE

SEQ ID NO: 1179121 - protein, 4 aa, Mycobacterium
ATDL

SEQ ID NO: 1179122 - protein, 14 aa, Mycobacterium
ATDLDEGHQSAKAA

SEQ ID NO: 1179123 - protein, 14 aa, Mycobacterium
ATDPGDGPPAPVRA

SEQ ID NO: 1179124 - protein, 19 aa, Mycobacterium
ATDSARTELAGHSAGPIGG

SEQ ID NO: 1179125 - protein, 7 aa, Mycobacterium
ATDTGAL

SEQ ID NO: 1179126 - protein, 5 aa, Mycobacterium
ATDTT

SEQ ID NO: 1179127 - protein, 6 aa, Mycobacterium
ATEARR

SEQ ID NO: 1179128 - protein, 19 aa, Mycobacterium
ATEATRAALSDTGADTAAV

SEQ ID NO: 1179129 - protein, 13 aa, Mycobacterium
ATEETPDTDHPVI

SEQ ID NO: 1179130 - protein, 10 aa, Mycobacterium
ATENARRPKA

SEQ ID NO: 1179131 - protein, 7 aa, Mycobacterium
ATEPAGL

SEQ ID NO: 1179132 - protein, 28 aa, Mycobacterium
ATESAPVASGCPVTSGGYDGPPPLGPDS

SEQ ID NO: 1179133 - protein, 36 aa, Mycobacterium
ATESAQPLNAPSTSSSNRSNASSRSSSIPRSGPGSS

SEQ ID NO: 1179134 - protein, 9 aa, Mycobacterium
ATETGAPLT

SEQ ID NO: 1179135 - protein, 11 aa, Mycobacterium
ATFAEGDRLDA

SEQ ID NO: 1179136 - protein, 5 aa, Mycobacterium
ATGAD

SEQ ID NO: 1179137 - protein, 9 aa, Mycobacterium
ATGAPTAAH

SEQ ID NO: 1179138 - protein, 6 aa, Mycobacterium
ATGARS

SEQ ID NO: 1179139 - protein, 7 aa, Mycobacterium
ATGARSV

SEQ ID NO: 1179140 - protein, 53 aa, Mycobacterium
ATGCRGRPSSNTRARPSSSDPARPPSSTKWRTPSSTPARRIPEREHSHRHSRR

SEQ ID NO: 1179141 - protein, 5 aa, Mycobacterium
ATGDA

SEQ ID NO: 1179142 - protein, 6 aa, Mycobacterium
ATGDDR

SEQ ID NO: 1179143 - protein, 5 aa, Mycobacterium
ATGEL

SEQ ID NO: 1179144 - protein, 7 aa, Mycobacterium
ATGLDTS

SEQ ID NO: 1179145 - protein, 6 aa, Mycobacterium
ATGRGI

SEQ ID NO: 1179146 - protein, 12 aa, Mycobacterium
ATGRLSSTEPNL

SEQ ID NO: 1179147 - protein, 13 aa, Mycobacterium
ATGRPIPPTQDPP

SEQ ID NO: 1179148 - protein, 7 aa, Mycobacterium
ATGRQNL

SEQ ID NO: 1179149 - protein, 7 aa, Mycobacterium
ATGSHDY

SEQ ID NO: 1179150 - protein, 4 aa, Mycobacterium
ATGT

SEQ ID NO: 1179151 - protein, 14 aa, Mycobacterium
ATGTDADRQSIRTE

SEQ ID NO: 1179152 - protein, 7 aa, Mycobacterium
ATGTETA

SEQ ID NO: 1179153 - protein, 9 aa, Mycobacterium
ATGTGEGGI

SEQ ID NO: 1179154 - protein, 9 aa, Mycobacterium
ATGTRAHSA

SEQ ID NO: 1179155 - protein, 9 aa, Mycobacterium
ATGTTSDAR

SEQ ID NO: 1179156 - protein, 9 aa, Mycobacterium
ATGVDGDAG

SEQ ID NO: 1179157 - protein, 10 aa, Mycobacterium
ATGVPRQDRY

SEQ ID NO: 1179158 - protein, 6 aa, Mycobacterium
ATHPDP

SEQ ID NO: 1179159 - protein, 4 aa, Mycobacterium
ATIG

SEQ ID NO: 1179160 - protein, 7 aa, Mycobacterium
ATIGNAD

SEQ ID NO: 1179161 - protein, 27 aa, Mycobacterium
ATKRRSDAPKDLARSEDTGFVQPAGRR

SEQ ID NO: 1179162 - protein, 21 aa, Mycobacterium
ATLESREAKHEPRSLAEQRDT

SEQ ID NO: 1179163 - protein, 16 aa, Mycobacterium
ATLRGEAEVLEALLGN

SEQ ID NO: 1179164 - protein, 15 aa, Mycobacterium
ATMGGDSAQAQSGSI

SEQ ID NO: 1179165 - protein, 8 aa, Mycobacterium
ATNGGGGY

SEQ ID NO: 1179166 - protein, 9 aa, Mycobacterium
ATNITRDTG

SEQ ID NO: 1179167 - protein, 10 aa, Mycobacterium
ATNKGLDLTP

SEQ ID NO: 1179168 - protein, 8 aa, Mycobacterium
ATPAAKPG

SEQ ID NO: 1179169 - protein, 5 aa, Mycobacterium
ATPEV

SEQ ID NO: 1179170 - protein, 7 aa, Mycobacterium
ATPMTET

SEQ ID NO: 1179171 - protein, 17 aa, Mycobacterium
ATPQGTSTISGALRSRD

SEQ ID NO: 1179172 - protein, 7 aa, Mycobacterium
ATPSTHT

SEQ ID NO: 1179173 - protein, 5 aa, Mycobacterium
ATPTT

SEQ ID NO: 1179174 - protein, 18 aa, Mycobacterium
ATPTTGSAATPAPAALTP

SEQ ID NO: 1179175 - protein, 6 aa, Mycobacterium
ATPVIG

SEQ ID NO: 1179176 - protein, 5 aa, Mycobacterium
ATQPE

SEQ ID NO: 1179177 - protein, 15 aa, Mycobacterium
ATQTGHEWSGPASGL

SEQ ID NO: 1179178 - protein, 6 aa, Mycobacterium
ATRDEQ

SEQ ID NO: 1179179 - protein, 9 aa, Mycobacterium
ATRGAGRGI

SEQ ID NO: 1179180 - protein, 25 aa, Mycobacterium
ATRNPRGGRPRRRLSTTETTKEPTP

SEQ ID NO: 1179181 - protein, 5 aa, Mycobacterium
ATRTI

SEQ ID NO: 1179182 - protein, 6 aa, Mycobacterium
ATRYTE

SEQ ID NO: 1179183 - protein, 9 aa, Mycobacterium
ATSAQLTSQ

SEQ ID NO: 1179184 - protein, 4 aa, Mycobacterium
ATSC

SEQ ID NO: 1179185 - protein, 34 aa, Mycobacterium
ATSDGRGSRGDRDGRGRRDDRGGRGRDGGDKSNY

SEQ ID NO: 1179186 - protein, 6 aa, Mycobacterium
ATSEDL

SEQ ID NO: 1179187 - protein, 7 aa, Mycobacterium
ATSEQID

SEQ ID NO: 1179188 - protein, 10 aa, Mycobacterium
ATSGPGEQTP

SEQ ID NO: 1179189 - protein, 10 aa, Mycobacterium
ATSGPVDEQN

SEQ ID NO: 1179190 - protein, 7 aa, Mycobacterium
ATSPGAI

SEQ ID NO: 1179191 - protein, 9 aa, Mycobacterium
ATSPSRDEF

SEQ ID NO: 1179192 - protein, 5 aa, Mycobacterium
ATSTL

SEQ ID NO: 1179193 - protein, 52 aa, Mycobacterium
ATTAGMGGGIPSTQPPAPASPSPALSAGGGHAAPVSAAPGGGVSPAAAQPGM

SEQ ID NO: 1179194 - protein, 5 aa, Mycobacterium
ATTAL

SEQ ID NO: 1179195 - protein, 8 aa, Mycobacterium
ATTDLSNG

SEQ ID NO: 1179196 - protein, 7 aa, Mycobacterium
ATTPAAT

SEQ ID NO: 1179197 - protein, 6 aa, Mycobacterium
ATTPDE

SEQ ID NO: 1179198 - protein, 7 aa, Mycobacterium
ATTPDYV

SEQ ID NO: 1179199 - protein, 9 aa, Mycobacterium
ATTPTQQRA

SEQ ID NO: 1179200 - protein, 8 aa, Mycobacterium
ATTRHAGE

SEQ ID NO: 1179201 - protein, 9 aa, Mycobacterium
ATTRTDRER

SEQ ID NO: 1179202 - protein, 6 aa, Mycobacterium
ATTTGM

SEQ ID NO: 1179203 - protein, 4 aa, Mycobacterium
ATTW

SEQ ID NO: 1179204 - protein, 8 aa, Mycobacterium
ATVEEDGS

SEQ ID NO: 1179205 - protein, 6 aa, Mycobacterium
ATVGQT

SEQ ID NO: 1179206 - protein, 17 aa, Mycobacterium
ATVHGEDLGPTGPLPRQ

SEQ ID NO: 1179207 - protein, 9 aa, Mycobacterium
ATVRNADQQ

SEQ ID NO: 1179208 - protein, 8 aa, Mycobacterium
ATVSGTDR

SEQ ID NO: 1179209 - protein, 5 aa, Mycobacterium
ATWAA

SEQ ID NO: 1179210 - protein, 8 aa, Mycobacterium
ATWAPAHG

SEQ ID NO: 1179211 - protein, 7 aa, Mycobacterium
ATWTEQQ

SEQ ID NO: 1179212 - protein, 19 aa, Mycobacterium
ATYTSQDHEAARTYDAPTD

SEQ ID NO: 1179213 - protein, 6 aa, Mycobacterium
AVAGGH

SEQ ID NO: 1179214 - protein, 8 aa, Mycobacterium
AVARRGDV

SEQ ID NO: 1179215 - protein, 10 aa, Mycobacterium
AVASRGPDTL

SEQ ID NO: 1179216 - protein, 5 aa, Mycobacterium
AVATG

SEQ ID NO: 1179217 - protein, 9 aa, Mycobacterium
AVATRDPRG

SEQ ID NO: 1179218 - protein, 12 aa, Mycobacterium
AVDKDAKRRMGA

SEQ ID NO: 1179219 - protein, 9 aa, Mycobacterium
AVDPDGPTQ

SEQ ID NO: 1179220 - protein, 16 aa, Mycobacterium
AVEAGDRKLARLRAAR

SEQ ID NO: 1179221 - protein, 10 aa, Mycobacterium
AVENRPGART

SEQ ID NO: 1179222 - protein, 47 aa, Mycobacterium
AVEQPRAASDRPRRRSTPQGHGERQGRPQGGGAGTRSRGPRRRPQAA

SEQ ID NO: 1179223 - protein, 6 aa, Mycobacterium
AVERGG

SEQ ID NO: 1179224 - protein, 8 aa, Mycobacterium
AVERRAQR

SEQ ID NO: 1179225 - protein, 4 aa, Mycobacterium
AVGA

SEQ ID NO: 1179226 - protein, 5 aa, Mycobacterium
AVGAD

SEQ ID NO: 1179227 - protein, 9 aa, Mycobacterium
AVGDAAAAG

SEQ ID NO: 1179228 - protein, 6 aa, Mycobacterium
AVGESL

SEQ ID NO: 1179229 - protein, 11 aa, Mycobacterium
AVGGDSAGGGL

SEQ ID NO: 1179230 - protein, 11 aa, Mycobacterium
AVGGGSVGAQR

SEQ ID NO: 1179231 - protein, 23 aa, Mycobacterium
AVGGPAADNKLTEASEAIARLVR

SEQ ID NO: 1179232 - protein, 4 aa, Mycobacterium
AVGS

SEQ ID NO: 1179233 - protein, 6 aa, Mycobacterium
AVGSDR

SEQ ID NO: 1179234 - protein, 13 aa, Mycobacterium
AVITGGSKGIGAA

SEQ ID NO: 1179235 - protein, 10 aa, Mycobacterium
AVKSVDTARG

SEQ ID NO: 1179236 - protein, 4 aa, Mycobacterium
AVNQ

SEQ ID NO: 1179237 - protein, 20 aa, Mycobacterium
AVNQDGASSGLTVPNGGAQQ

SEQ ID NO: 1179238 - protein, 14 aa, Mycobacterium
AVPAKDGWSPLSGV

SEQ ID NO: 1179239 - protein, 12 aa, Mycobacterium
AVPDDDTWQTSQ

SEQ ID NO: 1179240 - protein, 5 aa, Mycobacterium
AVPGG

SEQ ID NO: 1179241 - protein, 14 aa, Mycobacterium
AVPGIDGDCGGEAA

SEQ ID NO: 1179242 - protein, 4 aa, Mycobacterium
AVPP

SEQ ID NO: 1179243 - protein, 11 aa, Mycobacterium
AVPPGPTRSEL

SEQ ID NO: 1179244 - protein, 5 aa, Mycobacterium
AVPQG

SEQ ID NO: 1179245 - protein, 53 aa, Mycobacterium
AVPTETTASEPAAEPLTDGPVVSGQPSERKGDEPSQLSNDSPVPPAPEQVKER

SEQ ID NO: 1179246 - protein, 24 aa, Mycobacterium
AVQGTAGQSVQAAAGLAQQAGGLA

SEQ ID NO: 1179247 - protein, 14 aa, Mycobacterium
AVQRDQTDVLCGGE

SEQ ID NO: 1179248 - protein, 10 aa, Mycobacterium
AVQTDQDVDG

SEQ ID NO: 1179249 - protein, 12 aa, Mycobacterium
AVRAGAKQIDGS

SEQ ID NO: 1179250 - protein, 16 aa, Mycobacterium
AVRSQAELGAAGELPP

SEQ ID NO: 1179251 - protein, 7 aa, Mycobacterium
AVSAPTR

SEQ ID NO: 1179252 - protein, 9 aa, Mycobacterium
AVSGRNYEV

SEQ ID NO: 1179253 - protein, 7 aa, Mycobacterium
AVSGSGP

SEQ ID NO: 1179254 - protein, 14 aa, Mycobacterium
AVTADLEALRDLVE

SEQ ID NO: 1179255 - protein, 10 aa, Mycobacterium
AVTDGDSSAW

SEQ ID NO: 1179256 - protein, 10 aa, Mycobacterium
AVTGDVAGAA

SEQ ID NO: 1179257 - protein, 10 aa, Mycobacterium
AVTGSTAPLA

SEQ ID NO: 1179258 - protein, 14 aa, Mycobacterium
AVTNPDGNGVRGKD

SEQ ID NO: 1179259 - protein, 6 aa, Mycobacterium
AVTPQK

SEQ ID NO: 1179260 - protein, 8 aa, Mycobacterium
AVTPSPHL

SEQ ID NO: 1179261 - protein, 6 aa, Mycobacterium
AVTTAE

SEQ ID NO: 1179262 - protein, 8 aa, Mycobacterium
AWNPTQSQ

SEQ ID NO: 1179263 - protein, 6 aa, Mycobacterium
AWTGGS

SEQ ID NO: 1179264 - protein, 24 aa, Mycobacterium
AYAGEDLGEELEPHAPAVPRDAAD

SEQ ID NO: 1179265 - protein, 8 aa, Mycobacterium
AYDEARAR

SEQ ID NO: 1179266 - protein, 6 aa, Mycobacterium
AYDRNT

SEQ ID NO: 1179267 - protein, 5 aa, Mycobacterium
AYEGP

SEQ ID NO: 1179268 - protein, 10 aa, Mycobacterium
AYEKQNAEEV

SEQ ID NO: 1179269 - protein, 22 aa, Mycobacterium
AYGEPVSDSVQPVPPSVRRLIN

SEQ ID NO: 1179270 - protein, 8 aa, Mycobacterium
AYGPGTDQ

SEQ ID NO: 1179271 - protein, 5 aa, Mycobacterium
AYGQS

SEQ ID NO: 1179272 - protein, 13 aa, Mycobacterium
AYKAQDHDGVAGY

SEQ ID NO: 1179273 - protein, 23 aa, Mycobacterium
AYNRSPDKVDALSAEGARPARTV

SEQ ID NO: 1179274 - protein, 7 aa, Mycobacterium
AYPDART

SEQ ID NO: 1179275 - protein, 13 aa, Mycobacterium
AYPELPDAPTPDL

SEQ ID NO: 1179276 - protein, 7 aa, Mycobacterium
AYPEPDK

SEQ ID NO: 1179277 - protein, 5 aa, Mycobacterium
AYPET

SEQ ID NO: 1179278 - protein, 5 aa, Mycobacterium
AYRDE

SEQ ID NO: 1179279 - protein, 5 aa, Mycobacterium
AYRGR

SEQ ID NO: 1179280 - protein, 22 aa, Mycobacterium
AYRTGDGPKMPDGGVIPSDRTA

SEQ ID NO: 1179281 - protein, 13 aa, Mycobacterium
AYSDGHESEQTHT

SEQ ID NO: 1179282 - protein, 12 aa, Mycobacterium
AYSQYGRGRHPA

SEQ ID NO: 1179283 - protein, 19 aa, Mycobacterium
AYSRSRAQRTARLVVESLT

SEQ ID NO: 1179284 - protein, 8 aa, Mycobacterium
AYSTTTDD

SEQ ID NO: 1179285 - protein, 10 aa, Mycobacterium
AYTDGADPAV

SEQ ID NO: 1179286 - protein, 19 aa, Mycobacterium
AYTPKAGGQVTLHRRPQPL

SEQ ID NO: 1179287 - protein, 13 aa, Mycobacterium
CADPGGDLPVNTD

SEQ ID NO: 1179288 - protein, 6 aa, Mycobacterium
CCDGSS

SEQ ID NO: 1179289 - protein, 8 aa, Mycobacterium
CDAEGRHR

SEQ ID NO: 1179290 - protein, 11 aa, Mycobacterium
CDGGDSNGGTY

SEQ ID NO: 1179291 - protein, 20 aa, Mycobacterium
CDTTNGLPGLTADEREALND

SEQ ID NO: 1179292 - protein, 5 aa, Mycobacterium
CEDGH

SEQ ID NO: 1179293 - protein, 13 aa, Mycobacterium
CEESRAGARKSAA

SEQ ID NO: 1179294 - protein, 7 aa, Mycobacterium
CEQSEAA

SEQ ID NO: 1179295 - protein, 16 aa, Mycobacterium
CESPLPPADEIPDSRQ

SEQ ID NO: 1179296 - protein, 10 aa, Mycobacterium
CGGEKAPDRL

SEQ ID NO: 1179297 - protein, 9 aa, Mycobacterium
CGGPAPRSL

SEQ ID NO: 1179298 - protein, 11 aa, Mycobacterium
CGGTPAEGEKL

SEQ ID NO: 1179299 - protein, 12 aa, Mycobacterium
CGTGQNKTPPLE

SEQ ID NO: 1179300 - protein, 4 aa, Mycobacterium
CKSG

SEQ ID NO: 1179301 - protein, 5 aa, Mycobacterium
CPDGD

SEQ ID NO: 1179302 - protein, 4 aa, Mycobacterium
CPEH

SEQ ID NO: 1179303 - protein, 17 aa, Mycobacterium
CPGGESVEAVSERADRA

SEQ ID NO: 1179304 - protein, 10 aa, Mycobacterium
CPGSAGAWRP

SEQ ID NO: 1179305 - protein, 4 aa, Mycobacterium
CPLN

SEQ ID NO: 1179306 - protein, 6 aa, Mycobacterium
CPLNDG

SEQ ID NO: 1179307 - protein, 15 aa, Mycobacterium
CPPGGRFPFATAAAG

SEQ ID NO: 1179308 - protein, 8 aa, Mycobacterium
CQGRQVDD

SEQ ID NO: 1179309 - protein, 9 aa, Mycobacterium
CQPDPGGRR

SEQ ID NO: 1179310 - protein, 14 aa, Mycobacterium
CRPADGDETVSARW

SEQ ID NO: 1179311 - protein, 10 aa, Mycobacterium
CRPGDGLGIS

SEQ ID NO: 1179312 - protein, 9 aa, Mycobacterium
CSPDPADSA

SEQ ID NO: 1179313 - protein, 20 aa, Mycobacterium
CTGNRLPAEVDATAAEDTRQ

SEQ ID NO: 1179314 - protein, 5 aa, Mycobacterium
DAAAA

SEQ ID NO: 1179315 - protein, 8 aa, Mycobacterium
DAAAPQDI

SEQ ID NO: 1179316 - protein, 5 aa, Mycobacterium
DAAAQ

SEQ ID NO: 1179317 - protein, 6 aa, Mycobacterium
DAAASS

SEQ ID NO: 1179318 - protein, 5 aa, Mycobacterium
DAAAV

SEQ ID NO: 1179319 - protein, 8 aa, Mycobacterium
DAAEADPE

SEQ ID NO: 1179320 - protein, 5 aa, Mycobacterium
DAAGA

SEQ ID NO: 1179321 - protein, 7 aa, Mycobacterium
DAAGEGI

SEQ ID NO: 1179322 - protein, 7 aa, Mycobacterium
DAAGEGL

SEQ ID NO: 1179323 - protein, 16 aa, Mycobacterium
DAAGELAGLGARDTLR

SEQ ID NO: 1179324 - protein, 6 aa, Mycobacterium
DAAGGA

SEQ ID NO: 1179325 - protein, 41 aa, Mycobacterium
DAAGPPPQPPQPPQPSPPPPSGEPPPRPGPGRYQHIPVTVQ

SEQ ID NO: 1179326 - protein, 5 aa, Mycobacterium
DAAGV

SEQ ID NO: 1179327 - protein, 8 aa, Mycobacterium
DAAKAGDW

SEQ ID NO: 1179328 - protein, 7 aa, Mycobacterium
DAANARD

SEQ ID NO: 1179329 - protein, 12 aa, Mycobacterium
DAAPEPHYTPSR

SEQ ID NO: 1179330 - protein, 15 aa, Mycobacterium
DAAPRKGKAEKSPIG

SEQ ID NO: 1179331 - protein, 23 aa, Mycobacterium
DAAPTTRRRPKLSELAPRPDAPP

SEQ ID NO: 1179332 - protein, 5 aa, Mycobacterium
DAARV

SEQ ID NO: 1179333 - protein, 6 aa, Mycobacterium
DAARYA

SEQ ID NO: 1179334 - protein, 6 aa, Mycobacterium
DAASGT

SEQ ID NO: 1179335 - protein, 9 aa, Mycobacterium
DAASPAAQV

SEQ ID NO: 1179336 - protein, 12 aa, Mycobacterium
DAASTPTSDTVL

SEQ ID NO: 1179337 - protein, 8 aa, Mycobacterium
DAATPMPA

SEQ ID NO: 1179338 - protein, 8 aa, Mycobacterium
DAATSPAA

SEQ ID NO: 1179339 - protein, 5 aa, Mycobacterium
DAAVD

SEQ ID NO: 1179340 - protein, 13 aa, Mycobacterium
DADADGYGRGEGA

SEQ ID NO: 1179341 - protein, 8 aa, Mycobacterium
DADAPRSI

SEQ ID NO: 1179342 - protein, 13 aa, Mycobacterium
DADDSDAEAARKE

SEQ ID NO: 1179343 - protein, 7 aa, Mycobacterium
DADGAIT

SEQ ID NO: 1179344 - protein, 7 aa, Mycobacterium
DADGGGP

SEQ ID NO: 1179345 - protein, 5 aa, Mycobacterium
DADGT

SEQ ID NO: 1179346 - protein, 7 aa, Mycobacterium
DADPALG

SEQ ID NO: 1179347 - protein, 16 aa, Mycobacterium
DADPWSRDRGPRHDGS

SEQ ID NO: 1179348 - protein, 7 aa, Mycobacterium
DADQTAL

SEQ ID NO: 1179349 - protein, 6 aa, Mycobacterium
DADRAR

SEQ ID NO: 1179350 - protein, 13 aa, Mycobacterium
DADREALARAEGD

SEQ ID NO: 1179351 - protein, 8 aa, Mycobacterium
DADRGRGL

SEQ ID NO: 1179352 - protein, 10 aa, Mycobacterium
DADRPAPTRF

SEQ ID NO: 1179353 - protein, 11 aa, Mycobacterium
DAEAARRPHGD

SEQ ID NO: 1179354 - protein, 13 aa, Mycobacterium
DAEAARRPHGDRT

SEQ ID NO: 1179355 - protein, 7 aa, Mycobacterium
DAEEARD

SEQ ID NO: 1179356 - protein, 13 aa, Mycobacterium
DAEESLPSAGLRA

SEQ ID NO: 1179357 - protein, 6 aa, Mycobacterium
DAEHDR

SEQ ID NO: 1179358 - protein, 7 aa, Mycobacterium
DAERHGA

SEQ ID NO: 1179359 - protein, 5 aa, Mycobacterium
DAERM

SEQ ID NO: 1179360 - protein, 17 aa, Mycobacterium
DAESVATLTGGVDKGPG

SEQ ID NO: 1179361 - protein, 5 aa, Mycobacterium
DAETR

SEQ ID NO: 1179362 - protein, 6 aa, Mycobacterium
DAETRA

SEQ ID NO: 1179363 - protein, 6 aa, Mycobacterium
DAFGPP

SEQ ID NO: 1179364 - protein, 11 aa, Mycobacterium
DAFTRQEGQHS

SEQ ID NO: 1179365 - protein, 4 aa, Mycobacterium
DAGA

SEQ ID NO: 1179366 - protein, 17 aa, Mycobacterium
DAGASGFGAGPDGWGGP

SEQ ID NO: 1179367 - protein, 6 aa, Mycobacterium
DAGDDR

SEQ ID NO: 1179368 - protein, 4 aa, Mycobacterium
DAGE

SEQ ID NO: 1179369 - protein, 7 aa, Mycobacterium
DAGEKAG

SEQ ID NO: 1179370 - protein, 8 aa, Mycobacterium
DAGERTTV

SEQ ID NO: 1179371 - protein, 7 aa, Mycobacterium
DAGESAR

SEQ ID NO: 1179372 - protein, 8 aa, Mycobacterium
DAGGAHRP

SEQ ID NO: 1179373 - protein, 8 aa, Mycobacterium
DAGGRPVT

SEQ ID NO: 1179374 - protein, 4 aa, Mycobacterium
DAGK

SEQ ID NO: 1179375 - protein, 7 aa, Mycobacterium
DAGNEGI

SEQ ID NO: 1179376 - protein, 14 aa, Mycobacterium
DAGPPPRPTISTGI

SEQ ID NO: 1179377 - protein, 7 aa, Mycobacterium
DAGRDAE

SEQ ID NO: 1179378 - protein, 7 aa, Mycobacterium
DAGTPVK

SEQ ID NO: 1179379 - protein, 5 aa, Mycobacterium
DAGTV

SEQ ID NO: 1179380 - protein, 4 aa, Mycobacterium
DAGV

SEQ ID NO: 1179381 - protein, 16 aa, Mycobacterium
DAHADDPADGGDGKSL

SEQ ID NO: 1179382 - protein, 7 aa, Mycobacterium
DAHARPG

SEQ ID NO: 1179383 - protein, 17 aa, Mycobacterium
DAHRSASRNKSDPTDVV

SEQ ID NO: 1179384 - protein, 5 aa, Mycobacterium
DAIDD

SEQ ID NO: 1179385 - protein, 9 aa, Mycobacterium
DAIRSTRKG

SEQ ID NO: 1179386 - protein, 12 aa, Mycobacterium
DALDGNGEKLRD

SEQ ID NO: 1179387 - protein, 11 aa, Mycobacterium
DALEGASPAAA

SEQ ID NO: 1179388 - protein, 14 aa, Mycobacterium
DALPSDTATVTGEQ

SEQ ID NO: 1179389 - protein, 8 aa, Mycobacterium
DALQTGAV

SEQ ID NO: 1179390 - protein, 39 aa, Mycobacterium
DALTSPGGAPGAAPAPTVPAGFGGGAPGALGGATPTASL

SEQ ID NO: 1179391 - protein, 9 aa, Mycobacterium
DAPADAASK

SEQ ID NO: 1179392 - protein, 13 aa, Mycobacterium
DAPAEASGGQVSF

SEQ ID NO: 1179393 - protein, 10 aa, Mycobacterium
DAPEAPEPLP

SEQ ID NO: 1179394 - protein, 14 aa, Mycobacterium
DAPFGGVGRSGMGA

SEQ ID NO: 1179395 - protein, 4 aa, Mycobacterium
DAPL

SEQ ID NO: 1179396 - protein, 13 aa, Mycobacterium
DAPPGPEATPGHR

SEQ ID NO: 1179397 - protein, 13 aa, Mycobacterium
DAPPLSNADLDAA

SEQ ID NO: 1179398 - protein, 5 aa, Mycobacterium
DAPSI

SEQ ID NO: 1179399 - protein, 10 aa, Mycobacterium
DAPSYHGSPV

SEQ ID NO: 1179400 - protein, 4 aa, Mycobacterium
DAPT

SEQ ID NO: 1179401 - protein, 8 aa, Mycobacterium
DAPTNEQA

SEQ ID NO: 1179402 - protein, 4 aa, Mycobacterium
DAQF

SEQ ID NO: 1179403 - protein, 7 aa, Mycobacterium
DAQQRRR

SEQ ID NO: 1179404 - protein, 8 aa, Mycobacterium
DAQRRGAW

SEQ ID NO: 1179405 - protein, 4 aa, Mycobacterium
DAQS

SEQ ID NO: 1179406 - protein, 13 aa, Mycobacterium
DAQVDSPDLTGPY

SEQ ID NO: 1179407 - protein, 24 aa, Mycobacterium
DARAQRRAARHTDTTGITAIIRAW

SEQ ID NO: 1179408 - protein, 7 aa, Mycobacterium
DAREAVG

SEQ ID NO: 1179409 - protein, 10 aa, Mycobacterium
DARGKSLTSK

SEQ ID NO: 1179410 - protein, 6 aa, Mycobacterium
DARGNI

SEQ ID NO: 1179411 - protein, 7 aa, Mycobacterium
DARHPSD

SEQ ID NO: 1179412 - protein, 17 aa, Mycobacterium
DARQTAETTVTEARQRA

SEQ ID NO: 1179413 - protein, 10 aa, Mycobacterium
DARRAGPSTL

SEQ ID NO: 1179414 - protein, 7 aa, Mycobacterium
DARSVAG

SEQ ID NO: 1179415 - protein, 5 aa, Mycobacterium
DASDA

SEQ ID NO: 1179416 - protein, 6 aa, Mycobacterium
DASGAR

SEQ ID NO: 1179417 - protein, 12 aa, Mycobacterium
DASGGRQTAVTG

SEQ ID NO: 1179418 - protein, 5 aa, Mycobacterium
DASGI

SEQ ID NO: 1179419 - protein, 11 aa, Mycobacterium
DASRDDTEAVA

SEQ ID NO: 1179420 - protein, 5 aa, Mycobacterium
DASRR

SEQ ID NO: 1179421 - protein, 7 aa, Mycobacterium
DASSAHD

SEQ ID NO: 1179422 - protein, 9 aa, Mycobacterium
DASTATDTW

SEQ ID NO: 1179423 - protein, 8 aa, Mycobacterium
DASTTGLP

SEQ ID NO: 1179424 - protein, 7 aa, Mycobacterium
DASTYTD

SEQ ID NO: 1179425 - protein, 8 aa, Mycobacterium
DATAAPRE

SEQ ID NO: 1179426 - protein, 7 aa, Mycobacterium
DATDKGS

SEQ ID NO: 1179427 - protein, 8 aa, Mycobacterium
DATDSAVG

SEQ ID NO: 1179428 - protein, 5 aa, Mycobacterium
DATEL

SEQ ID NO: 1179429 - protein, 7 aa, Mycobacterium
DATPGTV

SEQ ID NO: 1179430 - protein, 7 aa, Mycobacterium
DATPKEV

SEQ ID NO: 1179431 - protein, 6 aa, Mycobacterium
DATRAK

SEQ ID NO: 1179432 - protein, 7 aa, Mycobacterium
DATRARD

SEQ ID NO: 1179433 - protein, 5 aa, Mycobacterium
DATRQ

SEQ ID NO: 1179434 - protein, 7 aa, Mycobacterium
DATRTPV

SEQ ID NO: 1179435 - protein, 11 aa, Mycobacterium
DAVATNTAGDG

SEQ ID NO: 1179436 - protein, 9 aa, Mycobacterium
DAVDSDGVS

SEQ ID NO: 1179437 - protein, 14 aa, Mycobacterium
DAVEQTGAGLGPTF

SEQ ID NO: 1179438 - protein, 8 aa, Mycobacterium
DAVNQTKQ

SEQ ID NO: 1179439 - protein, 15 aa, Mycobacterium
DAVPQGATPAPMPPA

SEQ ID NO: 1179440 - protein, 7 aa, Mycobacterium
DAVSTGG

SEQ ID NO: 1179441 - protein, 5 aa, Mycobacterium
DAWPG

SEQ ID NO: 1179442 - protein, 6 aa, Mycobacterium
DAYDGG

SEQ ID NO: 1179443 - protein, 13 aa, Mycobacterium
DAYDRDSPRAGEA

SEQ ID NO: 1179444 - protein, 19 aa, Mycobacterium
DAYPGADDELSMRDNNTSA

SEQ ID NO: 1179445 - protein, 19 aa, Mycobacterium
DDAAARKRLDDTFDSGDPK

SEQ ID NO: 1179446 - protein, 9 aa, Mycobacterium
DDADAASIE

SEQ ID NO: 1179447 - protein, 20 aa, Mycobacterium
DDADEARAAISATASSYERM

SEQ ID NO: 1179448 - protein, 5 aa, Mycobacterium
DDADG

SEQ ID NO: 1179449 - protein, 7 aa, Mycobacterium
DDADLAD

SEQ ID NO: 1179450 - protein, 6 aa, Mycobacterium
DDADLS

SEQ ID NO: 1179451 - protein, 6 aa, Mycobacterium
DDAGGA

SEQ ID NO: 1179452 - protein, 7 aa, Mycobacterium
DDAGYEY

SEQ ID NO: 1179453 - protein, 4 aa, Mycobacterium
DDAP

SEQ ID NO: 1179454 - protein, 6 aa, Mycobacterium
DDAPAR

SEQ ID NO: 1179455 - protein, 7 aa, Mycobacterium
DDAPVAP

SEQ ID NO: 1179456 - protein, 8 aa, Mycobacterium
DDAPVSGY

SEQ ID NO: 1179457 - protein, 10 aa, Mycobacterium
DDARAEAARA

SEQ ID NO: 1179458 - protein, 7 aa, Mycobacterium
DDARRGV

SEQ ID NO: 1179459 - protein, 7 aa, Mycobacterium
DDASANA

SEQ ID NO: 1179460 - protein, 4 aa, Mycobacterium
DDAV

SEQ ID NO: 1179461 - protein, 10 aa, Mycobacterium
DDAYKVPGSQ

SEQ ID NO: 1179462 - protein, 8 aa, Mycobacterium
DDDEKQRL

SEQ ID NO: 1179463 - protein, 7 aa, Mycobacterium
DDDENPQ

SEQ ID NO: 1179464 - protein, 9 aa, Mycobacterium
DDDEPTIPD

SEQ ID NO: 1179465 - protein, 5 aa, Mycobacterium
DDDEV

SEQ ID NO: 1179466 - protein, 15 aa, Mycobacterium
DDDEVITTAETDPAA

SEQ ID NO: 1179467 - protein, 15 aa, Mycobacterium
DDDGVDRIVYAWRIA

SEQ ID NO: 1179468 - protein, 7 aa, Mycobacterium
DDDGYRG

SEQ ID NO: 1179469 - protein, 9 aa, Mycobacterium
DDDIDPRRI

SEQ ID NO: 1179470 - protein, 11 aa, Mycobacterium
DDDTPIDRTPA

SEQ ID NO: 1179471 - protein, 11 aa, Mycobacterium
DDDTTPPPFER

SEQ ID NO: 1179472 - protein, 10 aa, Mycobacterium
DDDVKDNDLN

SEQ ID NO: 1179473 - protein, 5 aa, Mycobacterium
DDEAV

SEQ ID NO: 1179474 - protein, 7 aa, Mycobacterium
DDEGLPD

SEQ ID NO: 1179475 - protein, 7 aa, Mycobacterium
DDEGRDA

SEQ ID NO: 1179476 - protein, 10 aa, Mycobacterium
DDEKVSPRTR

SEQ ID NO: 1179477 - protein, 4 aa, Mycobacterium
DDEQ

SEQ ID NO: 1179478 - protein, 6 aa, Mycobacterium
DDERQS

SEQ ID NO: 1179479 - protein, 7 aa, Mycobacterium
DDFAAGA

SEQ ID NO: 1179480 - protein, 7 aa, Mycobacterium
DDGAGPA

SEQ ID NO: 1179481 - protein, 7 aa, Mycobacterium
DDGAVDH

SEQ ID NO: 1179482 - protein, 9 aa, Mycobacterium
DDGDERVSE

SEQ ID NO: 1179483 - protein, 9 aa, Mycobacterium
DDGDGPQEG

SEQ ID NO: 1179484 - protein, 6 aa, Mycobacterium
DDGDIQ

SEQ ID NO: 1179485 - protein, 5 aa, Mycobacterium
DDGEL

SEQ ID NO: 1179486 - protein, 10 aa, Mycobacterium
DDGGLAPDTV

SEQ ID NO: 1179487 - protein, 5 aa, Mycobacterium
DDGHT

SEQ ID NO: 1179488 - protein, 4 aa, Mycobacterium
DDGI

SEQ ID NO: 1179489 - protein, 10 aa, Mycobacterium
DDGNELPAGR

SEQ ID NO: 1179490 - protein, 12 aa, Mycobacterium
DDGNEVKPGSGV

SEQ ID NO: 1179491 - protein, 4 aa, Mycobacterium
DDGP

SEQ ID NO: 1179492 - protein, 21 aa, Mycobacterium
DDGQGWTGIPDGGGHEGDTGS

SEQ ID NO: 1179493 - protein, 19 aa, Mycobacterium
DDGSLRTNAKAADSSRQTL

SEQ ID NO: 1179494 - protein, 4 aa, Mycobacterium
DDGT

SEQ ID NO: 1179495 - protein, 14 aa, Mycobacterium
DDGTERIVYAWRIA

SEQ ID NO: 1179496 - protein, 8 aa, Mycobacterium
DDGVPPAV

SEQ ID NO: 1179497 - protein, 7 aa, Mycobacterium
DDGYPTD

SEQ ID NO: 1179498 - protein, 4 aa, Mycobacterium
DDID

SEQ ID NO: 1179499 - protein, 4 aa, Mycobacterium
DDIV

SEQ ID NO: 1179500 - protein, 5 aa, Mycobacterium
DDIYG

SEQ ID NO: 1179501 - protein, 4 aa, Mycobacterium
DDKR

SEQ ID NO: 1179502 - protein, 19 aa, Mycobacterium
DDKSPHWTGSTNSKRTYGH

SEQ ID NO: 1179503 - protein, 13 aa, Mycobacterium
DDMTDEQFEQDAA

SEQ ID NO: 1179504 - protein, 8 aa, Mycobacterium
DDPADPAL

SEQ ID NO: 1179505 - protein, 8 aa, Mycobacterium
DDPAPEGL

SEQ ID NO: 1179506 - protein, 8 aa, Mycobacterium
DDPARAAP

SEQ ID NO: 1179507 - protein, 26 aa, Mycobacterium
DDPERDKSKKDPDAGSGPGGSPSDPF

SEQ ID NO: 1179508 - protein, 8 aa, Mycobacterium
DDPGAGKT

SEQ ID NO: 1179509 - protein, 5 aa, Mycobacterium
DDPGE

SEQ ID NO: 1179510 - protein, 17 aa, Mycobacterium
DDPGPLRGIDDDRDEAL

SEQ ID NO: 1179511 - protein, 5 aa, Mycobacterium
DDPIT

SEQ ID NO: 1179512 - protein, 28 aa, Mycobacterium
DDPLAIPPGTRRPGSRRAARRPGPRQLS

SEQ ID NO: 1179513 - protein, 9 aa, Mycobacterium
DDPPGQCRQ

SEQ ID NO: 1179514 - protein, 5 aa, Mycobacterium
DDPRH

SEQ ID NO: 1179515 - protein, 8 aa, Mycobacterium
DDPRSEQV

SEQ ID NO: 1179516 - protein, 8 aa, Mycobacterium
DDPTGVPD

SEQ ID NO: 1179517 - protein, 8 aa, Mycobacterium
DDPTPAQI

SEQ ID NO: 1179518 - protein, 8 aa, Mycobacterium
DDRDPAEV

SEQ ID NO: 1179519 - protein, 7 aa, Mycobacterium
DDRETGE

SEQ ID NO: 1179520 - protein, 7 aa, Mycobacterium
DDRFPNY

SEQ ID NO: 1179521 - protein, 8 aa, Mycobacterium
DDRHGPNL

SEQ ID NO: 1179522 - protein, 7 aa, Mycobacterium
DDRTRAA

SEQ ID NO: 1179523 - protein, 17 aa, Mycobacterium
DDRTWSDPAKAYEKLDP

SEQ ID NO: 1179524 - protein, 8 aa, Mycobacterium
DDSGNARA

SEQ ID NO: 1179525 - protein, 7 aa, Mycobacterium
DDSGVVT

SEQ ID NO: 1179526 - protein, 12 aa, Mycobacterium
DDSLPSKPYAIP

SEQ ID NO: 1179527 - protein, 8 aa, Mycobacterium
DDSRSDLD

SEQ ID NO: 1179528 - protein, 5 aa, Mycobacterium
DDSTH

SEQ ID NO: 1179529 - protein, 6 aa, Mycobacterium
DDTAAI

SEQ ID NO: 1179530 - protein, 16 aa, Mycobacterium
DDTFAGSHPSKNPVRT

SEQ ID NO: 1179531 - protein, 7 aa, Mycobacterium
DDTTTAP

SEQ ID NO: 1179532 - protein, 12 aa, Mycobacterium
DDVGYPRRAVTE

SEQ ID NO: 1179533 - protein, 6 aa, Mycobacterium
DDVPDD

SEQ ID NO: 1179534 - protein, 13 aa, Mycobacterium
DDVPPCGSDEVSR

SEQ ID NO: 1179535 - protein, 9 aa, Mycobacterium
DDVQGWPGE

SEQ ID NO: 1179536 - protein, 7 aa, Mycobacterium
DDVRGDA

SEQ ID NO: 1179537 - protein, 15 aa, Mycobacterium
DDVSKGDDSPRRHSP

SEQ ID NO: 1179538 - protein, 8 aa, Mycobacterium
DDVSQSGV

SEQ ID NO: 1179539 - protein, 9 aa, Mycobacterium
DDWRDGPRT

SEQ ID NO: 1179540 - protein, 28 aa, Mycobacterium
DDYAAEAQQRWGDTEAWRQSRQRTARMS

SEQ ID NO: 1179541 - protein, 7 aa, Mycobacterium
DDYEYTG

SEQ ID NO: 1179542 - protein, 8 aa, Mycobacterium
DEAAGRDA

SEQ ID NO: 1179543 - protein, 6 aa, Mycobacterium
DEAEVR

SEQ ID NO: 1179544 - protein, 10 aa, Mycobacterium
DEAGEAADPY

SEQ ID NO: 1179545 - protein, 8 aa, Mycobacterium
DEAGVPAP

SEQ ID NO: 1179546 - protein, 9 aa, Mycobacterium
DEALEGAGR

SEQ ID NO: 1179547 - protein, 9 aa, Mycobacterium
DEAPDTAGA

SEQ ID NO: 1179548 - protein, 24 aa, Mycobacterium
DEAPEVIDEGDDETIEEETATSIT

SEQ ID NO: 1179549 - protein, 6 aa, Mycobacterium
DEAQEL

SEQ ID NO: 1179550 - protein, 6 aa, Mycobacterium
DEAQKR

SEQ ID NO: 1179551 - protein, 12 aa, Mycobacterium
DEASKRLDGIRE

SEQ ID NO: 1179552 - protein, 19 aa, Mycobacterium
DEATLASDEPKNLADPTTR

SEQ ID NO: 1179553 - protein, 5 aa, Mycobacterium
DEDDA

SEQ ID NO: 1179554 - protein, 18 aa, Mycobacterium
DEDDGEAPATDGERRTEG

SEQ ID NO: 1179555 - protein, 12 aa, Mycobacterium
DEDDNEVPRGTV

SEQ ID NO: 1179556 - protein, 17 aa, Mycobacterium
DEDGKGQITRATGPRWD

SEQ ID NO: 1179557 - protein, 8 aa, Mycobacterium
DEDRPLRR

SEQ ID NO: 1179558 - protein, 7 aa, Mycobacterium
DEEAVGN

SEQ ID NO: 1179559 - protein, 7 aa, Mycobacterium
DEEGGRV

SEQ ID NO: 1179560 - protein, 7 aa, Mycobacterium
DEEHPAA

SEQ ID NO: 1179561 - protein, 7 aa, Mycobacterium
DEEPAAH

SEQ ID NO: 1179562 - protein, 7 aa, Mycobacterium
DEEPSDY

SEQ ID NO: 1179563 - protein, 4 aa, Mycobacterium
DEFD

SEQ ID NO: 1179564 - protein, 6 aa, Mycobacterium
DEGAVA

SEQ ID NO: 1179565 - protein, 5 aa, Mycobacterium
DEGGA

SEQ ID NO: 1179566 - protein, 12 aa, Mycobacterium
DEGKALADELGD

SEQ ID NO: 1179567 - protein, 7 aa, Mycobacterium
DEGNRWP

SEQ ID NO: 1179568 - protein, 8 aa, Mycobacterium
DEGSGSAD

SEQ ID NO: 1179569 - protein, 19 aa, Mycobacterium
DEGVGDVTYPPKGTFRNGA

SEQ ID NO: 1179570 - protein, 15 aa, Mycobacterium
DEHGPTVKTGPEYGD

SEQ ID NO: 1179571 - protein, 11 aa, Mycobacterium
DEHPADEPDQW

SEQ ID NO: 1179572 - protein, 11 aa, Mycobacterium
DEHPHSPAPLD

SEQ ID NO: 1179573 - protein, 6 aa, Mycobacterium
DEIGGT

SEQ ID NO: 1179574 - protein, 13 aa, Mycobacterium
DEISPVADQSVRA

SEQ ID NO: 1179575 - protein, 99 aa, Mycobacterium
DEKSGDEVVDETPAEEAPQEEAPDEDAPEEEEALDEETLEDTLEEDASEEETGGDDTTEQEPSEEQNANDDNANDDNANDPGEKETGTENTGGDAGGAE

SEQ ID NO: 1179576 - protein, 8 aa, Mycobacterium
DEKSWQQR

SEQ ID NO: 1179577 - protein, 33 aa, Mycobacterium
DELEEGRVEQPETQTLQQTKNALPPLTAADKDD

SEQ ID NO: 1179578 - protein, 5 aa, Mycobacterium
DELGE

SEQ ID NO: 1179579 - protein, 7 aa, Mycobacterium
DELGSNA

SEQ ID NO: 1179580 - protein, 4 aa, Mycobacterium
DELN

SEQ ID NO: 1179581 - protein, 19 aa, Mycobacterium
DELPRRGDWPPGATSDDTA

SEQ ID NO: 1179582 - protein, 12 aa, Mycobacterium
DELQSGSNPGAI

SEQ ID NO: 1179583 - protein, 8 aa, Mycobacterium
DELSGTAA

SEQ ID NO: 1179584 - protein, 11 aa, Mycobacterium
DELTDEPPVKE

SEQ ID NO: 1179585 - protein, 45 aa, Mycobacterium
DENGEPKFGKDEGGEGTGGQDGGQDKAKDKAEDKAEDKAEASSES

SEQ ID NO: 1179586 - protein, 9 aa, Mycobacterium
DENNAAIYG

SEQ ID NO: 1179587 - protein, 7 aa, Mycobacterium
DENRPAW

SEQ ID NO: 1179588 - protein, 4 aa, Mycobacterium
DENS

SEQ ID NO: 1179589 - protein, 9 aa, Mycobacterium
DEPATRPAV

SEQ ID NO: 1179590 - protein, 9 aa, Mycobacterium
DEPDGEVSD

SEQ ID NO: 1179591 - protein, 8 aa, Mycobacterium
DEPDSADG

SEQ ID NO: 1179592 - protein, 8 aa, Mycobacterium
DEPGTGKT

SEQ ID NO: 1179593 - protein, 5 aa, Mycobacterium
DEPIG

SEQ ID NO: 1179594 - protein, 19 aa, Mycobacterium
DEPRERSVPAESAEPAEEH

SEQ ID NO: 1179595 - protein, 6 aa, Mycobacterium
DEPRLS

SEQ ID NO: 1179596 - protein, 5 aa, Mycobacterium
DEPTT

SEQ ID NO: 1179597 - protein, 7 aa, Mycobacterium
DEPWATT

SEQ ID NO: 1179598 - protein, 7 aa, Mycobacterium
DEPWSTT

SEQ ID NO: 1179599 - protein, 12 aa, Mycobacterium
DEPYQASTEDEV

SEQ ID NO: 1179600 - protein, 4 aa, Mycobacterium
DEQK

SEQ ID NO: 1179601 - protein, 8 aa, Mycobacterium
DEQKGRRG

SEQ ID NO: 1179602 - protein, 4 aa, Mycobacterium
DEQP

SEQ ID NO: 1179603 - protein, 5 aa, Mycobacterium
DEQSA

SEQ ID NO: 1179604 - protein, 18 aa, Mycobacterium
DEQSATRQDADVTCRVKS

SEQ ID NO: 1179605 - protein, 16 aa, Mycobacterium
DERGNDGGLPLRPWWS

SEQ ID NO: 1179606 - protein, 7 aa, Mycobacterium
DERPDAK

SEQ ID NO: 1179607 - protein, 20 aa, Mycobacterium
DERPVAERAEAKQISAESTF

SEQ ID NO: 1179608 - protein, 4 aa, Mycobacterium
DERT

SEQ ID NO: 1179609 - protein, 19 aa, Mycobacterium
DERVGAAATADARGFPDRA

SEQ ID NO: 1179610 - protein, 4 aa, Mycobacterium
DERY

SEQ ID NO: 1179611 - protein, 12 aa, Mycobacterium
DESDVDDYDEFS

SEQ ID NO: 1179612 - protein, 5 aa, Mycobacterium
DESDW

SEQ ID NO: 1179613 - protein, 8 aa, Mycobacterium
DESGGALH

SEQ ID NO: 1179614 - protein, 5 aa, Mycobacterium
DESGT

SEQ ID NO: 1179615 - protein, 9 aa, Mycobacterium
DETGSTNAD

SEQ ID NO: 1179616 - protein, 5 aa, Mycobacterium
DETTP

SEQ ID NO: 1179617 - protein, 5 aa, Mycobacterium
DETVT

SEQ ID NO: 1179618 - protein, 5 aa, Mycobacterium
DEVAT

SEQ ID NO: 1179619 - protein, 10 aa, Mycobacterium
DEVDGERRAT

SEQ ID NO: 1179620 - protein, 14 aa, Mycobacterium
DEVPNGKPEPDPYR

SEQ ID NO: 1179621 - protein, 5 aa, Mycobacterium
DEWAE

SEQ ID NO: 1179622 - protein, 7 aa, Mycobacterium
DFAGTDL

SEQ ID NO: 1179623 - protein, 23 aa, Mycobacterium
DFDDSDSISVHTGDTEPQDHATT

SEQ ID NO: 1179624 - protein, 7 aa, Mycobacterium
DFTPTEY

SEQ ID NO: 1179625 - protein, 6 aa, Mycobacterium
DGAAQL

SEQ ID NO: 1179626 - protein, 7 aa, Mycobacterium
DGAASPI

SEQ ID NO: 1179627 - protein, 4 aa, Mycobacterium
DGAE

SEQ ID NO: 1179628 - protein, 10 aa, Mycobacterium
DGAGAQARYA

SEQ ID NO: 1179629 - protein, 14 aa, Mycobacterium
DGAGRPTPVNAGQG

SEQ ID NO: 1179630 - protein, 4 aa, Mycobacterium
DGAH

SEQ ID NO: 1179631 - protein, 6 aa, Mycobacterium
DGAHRT

SEQ ID NO: 1179632 - protein, 6 aa, Mycobacterium
DGAKGV

SEQ ID NO: 1179633 - protein, 4 aa, Mycobacterium
DGAL

SEQ ID NO: 1179634 - protein, 13 aa, Mycobacterium
DGALRDAGLPNVT

SEQ ID NO: 1179635 - protein, 5 aa, Mycobacterium
DGALT

SEQ ID NO: 1179636 - protein, 14 aa, Mycobacterium
DGAPDGWPFEDGED

SEQ ID NO: 1179637 - protein, 8 aa, Mycobacterium
DGAPPQWP

SEQ ID NO: 1179638 - protein, 5 aa, Mycobacterium
DGAPV

SEQ ID NO: 1179639 - protein, 7 aa, Mycobacterium
DGAQGSE

SEQ ID NO: 1179640 - protein, 21 aa, Mycobacterium
DGAQVSATTAARQAADPSRRL

SEQ ID NO: 1179641 - protein, 5 aa, Mycobacterium
DGASL

SEQ ID NO: 1179642 - protein, 10 aa, Mycobacterium
DGASTGAADT

SEQ ID NO: 1179643 - protein, 4 aa, Mycobacterium
DGAV

SEQ ID NO: 1179644 - protein, 11 aa, Mycobacterium
DGCAGHSDGDV

SEQ ID NO: 1179645 - protein, 5 aa, Mycobacterium
DGCAT

SEQ ID NO: 1179646 - protein, 7 aa, Mycobacterium
DGDDDVH

SEQ ID NO: 1179647 - protein, 5 aa, Mycobacterium
DGDED

SEQ ID NO: 1179648 - protein, 13 aa, Mycobacterium
DGDEPLARRAESS

SEQ ID NO: 1179649 - protein, 10 aa, Mycobacterium
DGDPATAWST

SEQ ID NO: 1179650 - protein, 6 aa, Mycobacterium
DGDQEK

SEQ ID NO: 1179651 - protein, 7 aa, Mycobacterium
DGDRDAV

SEQ ID NO: 1179652 - protein, 7 aa, Mycobacterium
DGDRFSA

SEQ ID NO: 1179653 - protein, 7 aa, Mycobacterium
DGDTETF

SEQ ID NO: 1179654 - protein, 19 aa, Mycobacterium
DGDTPRLGPADHTSTLEAA

SEQ ID NO: 1179655 - protein, 7 aa, Mycobacterium
DGEASVS

SEQ ID NO: 1179656 - protein, 4 aa, Mycobacterium
DGEF

SEQ ID NO: 1179657 - protein, 16 aa, Mycobacterium
DGEGKPPVTDGPFAET

SEQ ID NO: 1179658 - protein, 4 aa, Mycobacterium
DGEI

SEQ ID NO: 1179659 - protein, 5 aa, Mycobacterium
DGELG

SEQ ID NO: 1179660 - protein, 8 aa, Mycobacterium
DGEPPPDI

SEQ ID NO: 1179661 - protein, 6 aa, Mycobacterium
DGEPTA

SEQ ID NO: 1179662 - protein, 7 aa, Mycobacterium
DGEPTAH

SEQ ID NO: 1179663 - protein, 13 aa, Mycobacterium
DGETLADTHEATD

SEQ ID NO: 1179664 - protein, 6 aa, Mycobacterium
DGFQGL

SEQ ID NO: 1179665 - protein, 5 aa, Mycobacterium
DGGAP

SEQ ID NO: 1179666 - protein, 6 aa, Mycobacterium
DGGDPL

SEQ ID NO: 1179667 - protein, 9 aa, Mycobacterium
DGGDVPARI

SEQ ID NO: 1179668 - protein, 6 aa, Mycobacterium
DGGEEV

SEQ ID NO: 1179669 - protein, 6 aa, Mycobacterium
DGGGNV

SEQ ID NO: 1179670 - protein, 7 aa, Mycobacterium
DGGGQRV

SEQ ID NO: 1179671 - protein, 8 aa, Mycobacterium
DGGHTRNK

SEQ ID NO: 1179672 - protein, 11 aa, Mycobacterium
DGGHTVQGRSN

SEQ ID NO: 1179673 - protein, 5 aa, Mycobacterium
DGGKH

SEQ ID NO: 1179674 - protein, 4 aa, Mycobacterium
DGGL

SEQ ID NO: 1179675 - protein, 12 aa, Mycobacterium
DGGLRGQESDEV

SEQ ID NO: 1179676 - protein, 5 aa, Mycobacterium
DGGPD

SEQ ID NO: 1179677 - protein, 6 aa, Mycobacterium
DGGRAR

SEQ ID NO: 1179678 - protein, 6 aa, Mycobacterium
DGGRGG

SEQ ID NO: 1179679 - protein, 9 aa, Mycobacterium
DGGSLGEAA

SEQ ID NO: 1179680 - protein, 9 aa, Mycobacterium
DGGTPWPER

SEQ ID NO: 1179681 - protein, 4 aa, Mycobacterium
DGGY

SEQ ID NO: 1179682 - protein, 11 aa, Mycobacterium
DGHDKDAYKTL

SEQ ID NO: 1179683 - protein, 8 aa, Mycobacterium
DGHRARAE

SEQ ID NO: 1179684 - protein, 25 aa, Mycobacterium
DGIAAGRYESAAAGGVDTASDAPIA

SEQ ID NO: 1179685 - protein, 13 aa, Mycobacterium
DGIGTEATASART

SEQ ID NO: 1179686 - protein, 5 aa, Mycobacterium
DGKIQ

SEQ ID NO: 1179687 - protein, 17 aa, Mycobacterium
DGKPKTAGSRLTNPAYA

SEQ ID NO: 1179688 - protein, 10 aa, Mycobacterium
DGLPAEIRED

SEQ ID NO: 1179689 - protein, 11 aa, Mycobacterium
DGLPAEIREDP

SEQ ID NO: 1179690 - protein, 10 aa, Mycobacterium
DGLTAEDTAA

SEQ ID NO: 1179691 - protein, 12 aa, Mycobacterium
DGLTANPKTLPP

SEQ ID NO: 1179692 - protein, 10 aa, Mycobacterium
DGNSTNNRRQ

SEQ ID NO: 1179693 - protein, 5 aa, Mycobacterium
DGPAA

SEQ ID NO: 1179694 - protein, 9 aa, Mycobacterium
DGPEPCDKD

SEQ ID NO: 1179695 - protein, 16 aa, Mycobacterium
DGPEPCDKERARKRGV

SEQ ID NO: 1179696 - protein, 16 aa, Mycobacterium
DGPEQVNVGSGTDATI

SEQ ID NO: 1179697 - protein, 9 aa, Mycobacterium
DGPGAPRSV

SEQ ID NO: 1179698 - protein, 6 aa, Mycobacterium
DGPGIP

SEQ ID NO: 1179699 - protein, 7 aa, Mycobacterium
DGPGIPE

SEQ ID NO: 1179700 - protein, 5 aa, Mycobacterium
DGPLA

SEQ ID NO: 1179701 - protein, 6 aa, Mycobacterium
DGPMTA

SEQ ID NO: 1179702 - protein, 4 aa, Mycobacterium
DGPT

SEQ ID NO: 1179703 - protein, 11 aa, Mycobacterium
DGPYPDGWTDE

SEQ ID NO: 1179704 - protein, 7 aa, Mycobacterium
DGQHSAG

SEQ ID NO: 1179705 - protein, 20 aa, Mycobacterium
DGQPTWGDKPDIEAAAEARA

SEQ ID NO: 1179706 - protein, 4 aa, Mycobacterium
DGQR

SEQ ID NO: 1179707 - protein, 16 aa, Mycobacterium
DGQTSGWASVGGTPSM

SEQ ID NO: 1179708 - protein, 10 aa, Mycobacterium
DGRAARRAAD

SEQ ID NO: 1179709 - protein, 6 aa, Mycobacterium
DGRAGD

SEQ ID NO: 1179710 - protein, 10 aa, Mycobacterium
DGREARDDVE

SEQ ID NO: 1179711 - protein, 6 aa, Mycobacterium
DGRGDG

SEQ ID NO: 1179712 - protein, 5 aa, Mycobacterium
DGRGG

SEQ ID NO: 1179713 - protein, 8 aa, Mycobacterium
DGRGLPTG

SEQ ID NO: 1179714 - protein, 5 aa, Mycobacterium
DGRGT

SEQ ID NO: 1179715 - protein, 7 aa, Mycobacterium
DGRKDNT

SEQ ID NO: 1179716 - protein, 14 aa, Mycobacterium
DGRPATATAEESLE

SEQ ID NO: 1179717 - protein, 5 aa, Mycobacterium
DGRPH

SEQ ID NO: 1179718 - protein, 7 aa, Mycobacterium
DGRRRTR

SEQ ID NO: 1179719 - protein, 6 aa, Mycobacterium
DGRTTS

SEQ ID NO: 1179720 - protein, 5 aa, Mycobacterium
DGRTV

SEQ ID NO: 1179721 - protein, 16 aa, Mycobacterium
DGRTVPVAESDGPVSE

SEQ ID NO: 1179722 - protein, 4 aa, Mycobacterium
DGRV

SEQ ID NO: 1179723 - protein, 14 aa, Mycobacterium
DGSAAGRDHTAHGE

SEQ ID NO: 1179724 - protein, 6 aa, Mycobacterium
DGSAAQ

SEQ ID NO: 1179725 - protein, 6 aa, Mycobacterium
DGSDLA

SEQ ID NO: 1179726 - protein, 8 aa, Mycobacterium
DGSDSALQ

SEQ ID NO: 1179727 - protein, 13 aa, Mycobacterium
DGSEMTDEDWDSG

SEQ ID NO: 1179728 - protein, 8 aa, Mycobacterium
DGSGNELL

SEQ ID NO: 1179729 - protein, 4 aa, Mycobacterium
DGSI

SEQ ID NO: 1179730 - protein, 4 aa, Mycobacterium
DGSP

SEQ ID NO: 1179731 - protein, 25 aa, Mycobacterium
DGSPPVDPVAGEPLDRSGADGCADG

SEQ ID NO: 1179732 - protein, 15 aa, Mycobacterium
DGSPTGLVGKQRTGR

SEQ ID NO: 1179733 - protein, 5 aa, Mycobacterium
DGSSI

SEQ ID NO: 1179734 - protein, 6 aa, Mycobacterium
DGSTAR

SEQ ID NO: 1179735 - protein, 10 aa, Mycobacterium
DGSTDGEQRE

SEQ ID NO: 1179736 - protein, 25 aa, Mycobacterium
DGSVSVADDGRGLPVDSDPVNGKNG

SEQ ID NO: 1179737 - protein, 13 aa, Mycobacterium
DGTAAEKAGDAVR

SEQ ID NO: 1179738 - protein, 4 aa, Mycobacterium
DGTK

SEQ ID NO: 1179739 - protein, 12 aa, Mycobacterium
DGTREYSLPPRS

SEQ ID NO: 1179740 - protein, 9 aa, Mycobacterium
DGTSSARVD

SEQ ID NO: 1179741 - protein, 7 aa, Mycobacterium
DGTTEYN

SEQ ID NO: 1179742 - protein, 4 aa, Mycobacterium
DGTV

SEQ ID NO: 1179743 - protein, 12 aa, Mycobacterium
DGTVTGSVSGGC

SEQ ID NO: 1179744 - protein, 8 aa, Mycobacterium
DGVDRGDD

SEQ ID NO: 1179745 - protein, 6 aa, Mycobacterium
DGVETT

SEQ ID NO: 1179746 - protein, 4 aa, Mycobacterium
DGVG

SEQ ID NO: 1179747 - protein, 6 aa, Mycobacterium
DGVGFT

SEQ ID NO: 1179748 - protein, 9 aa, Mycobacterium
DGVKIGDST

SEQ ID NO: 1179749 - protein, 14 aa, Mycobacterium
DGVRVTTPAGTYRA

SEQ ID NO: 1179750 - protein, 9 aa, Mycobacterium
DGVVGGPFE

SEQ ID NO: 1179751 - protein, 8 aa, Mycobacterium
DGWRANPE

SEQ ID NO: 1179752 - protein, 6 aa, Mycobacterium
DHAATA

SEQ ID NO: 1179753 - protein, 5 aa, Mycobacterium
DHAPH

SEQ ID NO: 1179754 - protein, 7 aa, Mycobacterium
DHDGDVG

SEQ ID NO: 1179755 - protein, 36 aa, Mycobacterium
DHDPAGAGGRDADRVPADGGVVDQPTGADTTTSVDH

SEQ ID NO: 1179756 - protein, 7 aa, Mycobacterium
DHDTPEL

SEQ ID NO: 1179757 - protein, 22 aa, Mycobacterium
DHDTPTGTTTGTPAGGRPPMPA

SEQ ID NO: 1179758 - protein, 9 aa, Mycobacterium
DHETFSSAQ

SEQ ID NO: 1179759 - protein, 25 aa, Mycobacterium
DHGDHGDTDDTDHKDARGFGRPPMP

SEQ ID NO: 1179760 - protein, 21 aa, Mycobacterium
DHGDHGDTDDTDHKDARVSAG

SEQ ID NO: 1179761 - protein, 5 aa, Mycobacterium
DHGSA

SEQ ID NO: 1179762 - protein, 6 aa, Mycobacterium
DHPGEG

SEQ ID NO: 1179763 - protein, 6 aa, Mycobacterium
DHQRQQ

SEQ ID NO: 1179764 - protein, 11 aa, Mycobacterium
DHRDTQRTNNP

SEQ ID NO: 1179765 - protein, 7 aa, Mycobacterium
DHRKAAG

SEQ ID NO: 1179766 - protein, 6 aa, Mycobacterium
DHRPAW

SEQ ID NO: 1179767 - protein, 6 aa, Mycobacterium
DHTAET

SEQ ID NO: 1179768 - protein, 74 aa, Mycobacterium
DHTSPGIEQDENPYRYTEKPEAGADAPEPVADAPTDTAGTSVTQPGVSPGSEAGQGRSAVSDEGLAASGPVTQA

SEQ ID NO: 1179769 - protein, 4 aa, Mycobacterium
DHVG

SEQ ID NO: 1179770 - protein, 6 aa, Mycobacterium
DIDDRV

SEQ ID NO: 1179771 - protein, 7 aa, Mycobacterium
DIGSSGA

SEQ ID NO: 1179772 - protein, 4 aa, Mycobacterium
DIKP

SEQ ID NO: 1179773 - protein, 6 aa, Mycobacterium
DIPEGK

SEQ ID NO: 1179774 - protein, 5 aa, Mycobacterium
DIPGR

SEQ ID NO: 1179775 - protein, 7 aa, Mycobacterium
DIPGSAL

SEQ ID NO: 1179776 - protein, 5 aa, Mycobacterium
DIPPE

SEQ ID NO: 1179777 - protein, 7 aa, Mycobacterium
DISTDEI

SEQ ID NO: 1179778 - protein, 7 aa, Mycobacterium
DITESRE

SEQ ID NO: 1179779 - protein, 5 aa, Mycobacterium
DITTP

SEQ ID NO: 1179780 - protein, 8 aa, Mycobacterium
DKAEETQG

SEQ ID NO: 1179781 - protein, 14 aa, Mycobacterium
DKAEQAAAAGADIV

SEQ ID NO: 1179782 - protein, 15 aa, Mycobacterium
DKARTDLEAAEKQVG

SEQ ID NO: 1179783 - protein, 5 aa, Mycobacterium
DKDVE

SEQ ID NO: 1179784 - protein, 7 aa, Mycobacterium
DKFATPR

SEQ ID NO: 1179785 - protein, 12 aa, Mycobacterium
DKHTEHEQYNRY

SEQ ID NO: 1179786 - protein, 45 aa, Mycobacterium
DKLESSDRDKSSDSDKSSDDEKSSDDDESDDSDDSEKSEKSDSEK

SEQ ID NO: 1179787 - protein, 8 aa, Mycobacterium
DKLSHYSD

SEQ ID NO: 1179788 - protein, 4 aa, Mycobacterium
DKNP

SEQ ID NO: 1179789 - protein, 5 aa, Mycobacterium
DKNPI

SEQ ID NO: 1179790 - protein, 9 aa, Mycobacterium
DKPDTPIAD

SEQ ID NO: 1179791 - protein, 10 aa, Mycobacterium
DKPDTPIADE

SEQ ID NO: 1179792 - protein, 8 aa, Mycobacterium
DKPGKGAF

SEQ ID NO: 1179793 - protein, 7 aa, Mycobacterium
DKPMPID

SEQ ID NO: 1179794 - protein, 8 aa, Mycobacterium
DKPVPTAG

SEQ ID NO: 1179795 - protein, 21 aa, Mycobacterium
DKRAAERAKERKQKRCRTAPG

SEQ ID NO: 1179796 - protein, 8 aa, Mycobacterium
DKRDPAEA

SEQ ID NO: 1179797 - protein, 8 aa, Mycobacterium
DKRIEAEA

SEQ ID NO: 1179798 - protein, 9 aa, Mycobacterium
DKSARPAAV

SEQ ID NO: 1179799 - protein, 6 aa, Mycobacterium
DKSDPE

SEQ ID NO: 1179800 - protein, 6 aa, Mycobacterium
DKSPVA

SEQ ID NO: 1179801 - protein, 5 aa, Mycobacterium
DKTEV

SEQ ID NO: 1179802 - protein, 4 aa, Mycobacterium
DKTL

SEQ ID NO: 1179803 - protein, 24 aa, Mycobacterium
DKVGDIETDATPGFIGSKSDAPVL

SEQ ID NO: 1179804 - protein, 16 aa, Mycobacterium
DKVTTSPAFRSSAKSK

SEQ ID NO: 1179805 - protein, 16 aa, Mycobacterium
DLAARADLRVSGPSPA

SEQ ID NO: 1179806 - protein, 12 aa, Mycobacterium
DLAASKDESTTV

SEQ ID NO: 1179807 - protein, 7 aa, Mycobacterium
DLAEQAG

SEQ ID NO: 1179808 - protein, 22 aa, Mycobacterium
DLAGDPELGDRTGRDRNRTRID

SEQ ID NO: 1179809 - protein, 100 aa, Mycobacterium
DLAQKARDAVEGAAGRVGIGSSSDDAGGPAALPSGAKAATGSGRAAPIEVPAKKTPAKKTAAKTAPAKKTAPAKKAPVKKAPVKKTAVKATPAKTEAANM

SEQ ID NO: 1179810 - protein, 4 aa, Mycobacterium
DLDA

SEQ ID NO: 1179811 - protein, 9 aa, Mycobacterium
DLDAQSPAA

SEQ ID NO: 1179812 - protein, 13 aa, Mycobacterium
DLDDPATDPHLPI

SEQ ID NO: 1179813 - protein, 8 aa, Mycobacterium
DLDKAREV

SEQ ID NO: 1179814 - protein, 11 aa, Mycobacterium
DLEEPTADDAA

SEQ ID NO: 1179815 - protein, 39 aa, Mycobacterium
DLESTSGGSQVQDYPDESTTRHRHHEDDAPTASIPVARE

SEQ ID NO: 1179816 - protein, 9 aa, Mycobacterium
DLGDEHEKR

SEQ ID NO: 1179817 - protein, 5 aa, Mycobacterium
DLGDR

SEQ ID NO: 1179818 - protein, 4 aa, Mycobacterium
DLGN

SEQ ID NO: 1179819 - protein, 5 aa, Mycobacterium
DLGND

SEQ ID NO: 1179820 - protein, 7 aa, Mycobacterium
DLGTGDQ

SEQ ID NO: 1179821 - protein, 8 aa, Mycobacterium
DLKQNSAL

SEQ ID NO: 1179822 - protein, 4 aa, Mycobacterium
DLPG

SEQ ID NO: 1179823 - protein, 5 aa, Mycobacterium
DLPGG

SEQ ID NO: 1179824 - protein, 5 aa, Mycobacterium
DLPGQ

SEQ ID NO: 1179825 - protein, 8 aa, Mycobacterium
DLPGRGST

SEQ ID NO: 1179826 - protein, 9 aa, Mycobacterium
DLPTADADI

SEQ ID NO: 1179827 - protein, 30 aa, Mycobacterium
DLPTGGELPKAPPAAPPVDTNAQPANYGTM

SEQ ID NO: 1179828 - protein, 37 aa, Mycobacterium; identical to SEQ ID NO: 452339

SEQ ID NO: 1179829 - protein, 8 aa, Mycobacterium
DLRSGSTS

SEQ ID NO: 1179830 - protein, 8 aa, Mycobacterium
DLSDADVD

SEQ ID NO: 1179831 - protein, 6 aa, Mycobacterium
DLSRAA

SEQ ID NO: 1179832 - protein, 18 aa, Mycobacterium
DLTGSRVTATEGKRLAAK

SEQ ID NO: 1179833 - protein, 14 aa, Mycobacterium
DLTPAEAESTRHGR

SEQ ID NO: 1179834 - protein, 10 aa, Mycobacterium
DLTRTGGRGH

SEQ ID NO: 1179835 - protein, 12 aa, Mycobacterium
DMADDGSEASAL

SEQ ID NO: 1179836 - protein, 7 aa, Mycobacterium
DMEPPDA

SEQ ID NO: 1179837 - protein, 9 aa, Mycobacterium
DMEPPDAGH

SEQ ID NO: 1179838 - protein, 82 aa, Mycobacterium
DMGGAEKDEKAKLEDELREKKDEPSEEKEPEGAAPGEATGERAPEVGPRHAAPEAPQTGPAPEPQPPAPKPAPTRPADSSIL

SEQ ID NO: 1179839 - protein, 7 aa, Mycobacterium
DMGPGSS

SEQ ID NO: 1179840 - protein, 7 aa, Mycobacterium
DNAPGAV

SEQ ID NO: 1179841 - protein, 6 aa, Mycobacterium
DNEDEA

SEQ ID NO: 1179842 - protein, 8 aa, Mycobacterium
DNGDLDEM

SEQ ID NO: 1179843 - protein, 6 aa, Mycobacterium
DNGTAV

SEQ ID NO: 1179844 - protein, 6 aa, Mycobacterium
DNHAEE

SEQ ID NO: 1179845 - protein, 8 aa, Mycobacterium
DNLPVGPD

SEQ ID NO: 1179846 - protein, 8 aa, Mycobacterium
DNMDRGGG

SEQ ID NO: 1179847 - protein, 23 aa, Mycobacterium
DNNPSPESLDEAQSKIKAALAEL

SEQ ID NO: 1179848 - protein, 6 aa, Mycobacterium
DNNREA

SEQ ID NO: 1179849 - protein, 10 aa, Mycobacterium
DNPDLASERE

SEQ ID NO: 1179850 - protein, 5 aa, Mycobacterium
DNPNL

SEQ ID NO: 1179851 - protein, 7 aa, Mycobacterium
DNPQTRE

SEQ ID NO: 1179852 - protein, 6 aa, Mycobacterium
DNPVPM

SEQ ID NO: 1179853 - protein, 4 aa, Mycobacterium
DNRA

SEQ ID NO: 1179854 - protein, 7 aa, Mycobacterium
DNTTRVS

SEQ ID NO: 1179855 - protein, 5 aa, Mycobacterium
DNTYP

SEQ ID NO: 1179856 - protein, 5 aa, Mycobacterium
DNVGH

SEQ ID NO: 1179857 - protein, 7 aa, Mycobacterium
DPAAHPH

SEQ ID NO: 1179858 - protein, 7 aa, Mycobacterium
DPAAPNG

SEQ ID NO: 1179859 - protein, 11 aa, Mycobacterium
DPAATAEAIDP

SEQ ID NO: 1179860 - protein, 8 aa, Mycobacterium
DPAFTGGA

SEQ ID NO: 1179861 - protein, 42 aa, Mycobacterium
DPAGRTRPDAPGWPSTSPACSSPASVTPGSPRSASVSTLSCR

SEQ ID NO: 1179862 - protein, 5 aa, Mycobacterium
DPAGT

SEQ ID NO: 1179863 - protein, 7 aa, Mycobacterium
DPARGGA

SEQ ID NO: 1179864 - protein, 5 aa, Mycobacterium
DPARL

SEQ ID NO: 1179865 - protein, 8 aa, Mycobacterium
DPARPELG

SEQ ID NO: 1179866 - protein, 8 aa, Mycobacterium
DPARRTRY

SEQ ID NO: 1179867 - protein, 55 aa, Mycobacterium
DPASGSSADGDSPSDVADEPPSEPGEPSDPSSPSFSPASPPTGASGTIPAPGVES

SEQ ID NO: 1179868 - protein, 29 aa, Mycobacterium
DPATSGRSATRWRSSSNGWARSSSHSDAL

SEQ ID NO: 1179869 - protein, 24 aa, Mycobacterium
DPDAGTAASPGIGGPTGRRIDTRP

SEQ ID NO: 1179870 - protein, 9 aa, Mycobacterium
DPDARGGRI

SEQ ID NO: 1179871 - protein, 9 aa, Mycobacterium
DPDATTTQK

SEQ ID NO: 1179872 - protein, 6 aa, Mycobacterium
DPDAYD

SEQ ID NO: 1179873 - protein, 4 aa, Mycobacterium
DPDD

SEQ ID NO: 1179874 - protein, 8 aa, Mycobacterium
DPDEPGKP

SEQ ID NO: 1179875 - protein, 15 aa, Mycobacterium
DPDGTYANDPTGLPP

SEQ ID NO: 1179876 - protein, 4 aa, Mycobacterium
DPDI

SEQ ID NO: 1179877 - protein, 16 aa, Mycobacterium
DPDKTAEAQDPSGTMS

SEQ ID NO: 1179878 - protein, 8 aa, Mycobacterium
DPDPHTAA

SEQ ID NO: 1179879 - protein, 7 aa, Mycobacterium
DPDQNRI

SEQ ID NO: 1179880 - protein, 5 aa, Mycobacterium
DPDRK

SEQ ID NO: 1179881 - protein, 12 aa, Mycobacterium
DPDRLGENYPLS

SEQ ID NO: 1179882 - protein, 20 aa, Mycobacterium
DPDSKAYYQRKRDEGKRPIP

SEQ ID NO: 1179883 - protein, 10 aa, Mycobacterium
DPDVAGTPHE

SEQ ID NO: 1179884 - protein, 5 aa, Mycobacterium
DPDVR

SEQ ID NO: 1179885 - protein, 7 aa, Mycobacterium
DPDVRTS

SEQ ID NO: 1179886 - protein, 8 aa, Mycobacterium
DPDYQGRG

SEQ ID NO: 1179887 - protein, 7 aa, Mycobacterium
DPEAARS

SEQ ID NO: 1179888 - protein, 8 aa, Mycobacterium
DPEAARSA

SEQ ID NO: 1179889 - protein, 4 aa, Mycobacterium
DPEH

SEQ ID NO: 1179890 - protein, 4 aa, Mycobacterium
DPEN

SEQ ID NO: 1179891 - protein, 10 aa, Mycobacterium
DPEPGAPGKV

SEQ ID NO: 1179892 - protein, 6 aa, Mycobacterium
DPERGR

SEQ ID NO: 1179893 - protein, 5 aa, Mycobacterium
DPERL

SEQ ID NO: 1179894 - protein, 11 aa, Mycobacterium
DPESARSVETA

SEQ ID NO: 1179895 - protein, 13 aa, Mycobacterium
DPETAQQSPPATT

SEQ ID NO: 1179896 - protein, 7 aa, Mycobacterium
DPEVAAE

SEQ ID NO: 1179897 - protein, 4 aa, Mycobacterium
DPEW

SEQ ID NO: 1179898 - protein, 13 aa, Mycobacterium
DPFADDPCDPSAA

SEQ ID NO: 1179899 - protein, 5 aa, Mycobacterium
DPFSG

SEQ ID NO: 1179900 - protein, 6 aa, Mycobacterium
DPFTAT

SEQ ID NO: 1179901 - protein, 10 aa, Mycobacterium
DPGAESPKET

SEQ ID NO: 1179902 - protein, 5 aa, Mycobacterium
DPGAM

SEQ ID NO: 1179903 - protein, 8 aa, Mycobacterium
DPGASGFE

SEQ ID NO: 1179904 - protein, 19 aa, Mycobacterium
DPGGAAAGPNAGPAIPSSL

SEQ ID NO: 1179905 - protein, 7 aa, Mycobacterium
DPGMDGT

SEQ ID NO: 1179906 - protein, 11 aa, Mycobacterium
DPGNDPDPDRP

SEQ ID NO: 1179907 - protein, 13 aa, Mycobacterium
DPGPAEKYSPEGY

SEQ ID NO: 1179908 - protein, 9 aa, Mycobacterium
DPGPREGNV

SEQ ID NO: 1179909 - protein, 8 aa, Mycobacterium
DPGQVSPV

SEQ ID NO: 1179910 - protein, 6 aa, Mycobacterium
DPGRTL

SEQ ID NO: 1179911 - protein, 5 aa, Mycobacterium
DPGRW

SEQ ID NO: 1179912 - protein, 7 aa, Mycobacterium
DPHELGA

SEQ ID NO: 1179913 - protein, 8 aa, Mycobacterium
DPHNQPGR

SEQ ID NO: 1179914 - protein, 4 aa, Mycobacterium
DPHP

SEQ ID NO: 1179915 - protein, 7 aa, Mycobacterium
DPHPGNY

SEQ ID NO: 1179916 - protein, 4 aa, Mycobacterium
DPIA

SEQ ID NO: 1179917 - protein, 6 aa, Mycobacterium
DPITDR

SEQ ID NO: 1179918 - protein, 10 aa, Mycobacterium
DPKAAEKGKL

SEQ ID NO: 1179919 - protein, 7 aa, Mycobacterium
DPKGYAE

SEQ ID NO: 1179920 - protein, 10 aa, Mycobacterium
DPKVQDSVKN

SEQ ID NO: 1179921 - protein, 16 aa, Mycobacterium
DPLTDTKKWPAPTTAE

SEQ ID NO: 1179922 - protein, 4 aa, Mycobacterium
DPMT

SEQ ID NO: 1179923 - protein, 11 aa, Mycobacterium
DPNGGEPQRVA

SEQ ID NO: 1179924 - protein, 7 aa, Mycobacterium
DPNSRAT

SEQ ID NO: 1179925 - protein, 4 aa, Mycobacterium
DPPA

SEQ ID NO: 1179926 - protein, 7 aa, Mycobacterium
DPPAATV

SEQ ID NO: 1179927 - protein, 5 aa, Mycobacterium
DPPAP

SEQ ID NO: 1179928 - protein, 7 aa, Mycobacterium
DPPDGRG

SEQ ID NO: 1179929 - protein, 15 aa, Mycobacterium
DPPHATQQPGPREKR

SEQ ID NO: 1179930 - protein, 5 aa, Mycobacterium
DPPPL

SEQ ID NO: 1179931 - protein, 5 aa, Mycobacterium
DPQIG

SEQ ID NO: 1179932 - protein, 9 aa, Mycobacterium
DPQPGTGFA

SEQ ID NO: 1179933 - protein, 6 aa, Mycobacterium
DPRDTR

SEQ ID NO: 1179934 - protein, 7 aa, Mycobacterium
DPRFMPP

SEQ ID NO: 1179935 - protein, 5 aa, Mycobacterium
DPRHS

SEQ ID NO: 1179936 - protein, 6 aa, Mycobacterium
DPRLGS

SEQ ID NO: 1179937 - protein, 4 aa, Mycobacterium
DPRP

SEQ ID NO: 1179938 - protein, 7 aa, Mycobacterium
DPRSLPE

SEQ ID NO: 1179939 - protein, 5 aa, Mycobacterium
DPRTS

SEQ ID NO: 1179940 - protein, 15 aa, Mycobacterium
DPSELRAEETAQVGT

SEQ ID NO: 1179941 - protein, 5 aa, Mycobacterium
DPSGE

SEQ ID NO: 1179942 - protein, 17 aa, Mycobacterium
DPSGKPQSVQVTLGKMQ

SEQ ID NO: 1179943 - protein, 10 aa, Mycobacterium
DPSRGTGLGK

SEQ ID NO: 1179944 - protein, 9 aa, Mycobacterium
DPSSDGLAR

SEQ ID NO: 1179945 - protein, 6 aa, Mycobacterium
DPSTMT

SEQ ID NO: 1179946 - protein, 7 aa, Mycobacterium
DPTDPRE

SEQ ID NO: 1179947 - protein, 7 aa, Mycobacterium
DPTGQEW

SEQ ID NO: 1179948 - protein, 4 aa, Mycobacterium
DPTL

SEQ ID NO: 1179949 - protein, 4 aa, Mycobacterium
DPTR

SEQ ID NO: 1179950 - protein, 7 aa, Mycobacterium
DPTRGGM

SEQ ID NO: 1179951 - protein, 9 aa, Mycobacterium
DPVAATSEL

SEQ ID NO: 1179952 - protein, 16 aa, Mycobacterium
DPVCGPGGSTTAHASY

SEQ ID NO: 1179953 - protein, 10 aa, Mycobacterium
DPVSDYPAGT

SEQ ID NO: 1179954 - protein, 4 aa, Mycobacterium
DPWT

SEQ ID NO: 1179955 - protein, 5 aa, Mycobacterium
DPYPT

SEQ ID NO: 1179956 - protein, 5 aa, Mycobacterium
DPYTG

SEQ ID NO: 1179957 - protein, 9 aa, Mycobacterium
DQAAEEHYR

SEQ ID NO: 1179958 - protein, 16 aa, Mycobacterium
DQDDRQVLDWKFSALH

SEQ ID NO: 1179959 - protein, 11 aa, Mycobacterium
DQDGSNPGDDV

SEQ ID NO: 1179960 - protein, 9 aa, Mycobacterium
DQDSGDASL

SEQ ID NO: 1179961 - protein, 14 aa, Mycobacterium
DQERKRGHHHRVDS

SEQ ID NO: 1179962 - protein, 4 aa, Mycobacterium
DQEW

SEQ ID NO: 1179963 - protein, 16 aa, Mycobacterium
DQGITDTAARRSYAKG

SEQ ID NO: 1179964 - protein, 7 aa, Mycobacterium
DQGNPTF

SEQ ID NO: 1179965 - protein, 12 aa, Mycobacterium
DQGNRKVRDHPE

SEQ ID NO: 1179966 - protein, 4 aa, Mycobacterium
DQGR

SEQ ID NO: 1179967 - protein, 6 aa, Mycobacterium
DQGYGG

SEQ ID NO: 1179968 - protein, 4 aa, Mycobacterium
DQHS

SEQ ID NO: 1179969 - protein, 6 aa, Mycobacterium
DQIAAT

SEQ ID NO: 1179970 - protein, 7 aa, Mycobacterium
DQIEGSY

SEQ ID NO: 1179971 - protein, 7 aa, Mycobacterium
DQITPAP

SEQ ID NO: 1179972 - protein, 5 aa, Mycobacterium
DQKPV

SEQ ID NO: 1179973 - protein, 4 aa, Mycobacterium
DQLG

SEQ ID NO: 1179974 - protein, 6 aa, Mycobacterium
DQLGRD

SEQ ID NO: 1179975 - protein, 7 aa, Mycobacterium
DQNRVQP

SEQ ID NO: 1179976 - protein, 8 aa, Mycobacterium
DQPRAEAA

SEQ ID NO: 1179977 - protein, 12 aa, Mycobacterium
DQRADAEGEPFE

SEQ ID NO: 1179978 - protein, 15 aa, Mycobacterium
DQRGYGGSTRPDAVE

SEQ ID NO: 1179979 - protein, 7 aa, Mycobacterium
DQRRAAG

SEQ ID NO: 1179980 - protein, 11 aa, Mycobacterium
DQTGGPDPYCS

SEQ ID NO: 1179981 - protein, 4 aa, Mycobacterium
DQTQ

SEQ ID NO: 1179982 - protein, 9 aa, Mycobacterium
DQTRSAGKR

SEQ ID NO: 1179983 - protein, 9 aa, Mycobacterium
DQTYSTPIE

SEQ ID NO: 1179984 - protein, 6 aa, Mycobacterium
DQVPDS

SEQ ID NO: 1179985 - protein, 17 aa, Mycobacterium
DRAAPDPSAAAEPEFSD

SEQ ID NO: 1179986 - protein, 8 aa, Mycobacterium
DRAEDELA

SEQ ID NO: 1179987 - protein, 6 aa, Mycobacterium
DRAERD

SEQ ID NO: 1179988 - protein, 5 aa, Mycobacterium
DRAEV

SEQ ID NO: 1179989 - protein, 5 aa, Mycobacterium
DRAGE

SEQ ID NO: 1179990 - protein, 10 aa, Mycobacterium
DRAPLDGRGD

SEQ ID NO: 1179991 - protein, 7 aa, Mycobacterium
DRAQGAL

SEQ ID NO: 1179992 - protein, 10 aa, Mycobacterium
DRARDDDEIT

SEQ ID NO: 1179993 - protein, 7 aa, Mycobacterium
DRARPEG

SEQ ID NO: 1179994 - protein, 16 aa, Mycobacterium
DRARRAGTRPRSDRTI

SEQ ID NO: 1179995 - protein, 16 aa, Mycobacterium
DRASAEAIGDGAATQW

SEQ ID NO: 1179996 - protein, 13 aa, Mycobacterium
DRASEATGDGHGW

SEQ ID NO: 1179997 - protein, 9 aa, Mycobacterium
DRCGYSPRA

SEQ ID NO: 1179998 - protein, 4 aa, Mycobacterium
DRDA

SEQ ID NO: 1179999 - protein, 13 aa, Mycobacterium
DRDAAAPTLDQAR

SEQ ID NO: 1180000 - protein, 15 aa, Mycobacterium
DRDAARKAGKPEPEW

SEQ ID NO: 1180001 - protein, 6 aa, Mycobacterium
DRDAPT

SEQ ID NO: 1180002 - protein, 29 aa, Mycobacterium
DRDDHGDHHPTASTDADRARAELESLGVT

SEQ ID NO: 1180003 - protein, 14 aa, Mycobacterium
DRDGQDATGGPLPA

SEQ ID NO: 1180004 - protein, 8 aa, Mycobacterium
DRDGRPCS

SEQ ID NO: 1180005 - protein, 6 aa, Mycobacterium
DRDGSD

SEQ ID NO: 1180006 - protein, 10 aa, Mycobacterium
DRDREVPPEL

SEQ ID NO: 1180007 - protein, 21 aa, Mycobacterium
DREDSANNDIHRAAGDKTGYY

SEQ ID NO: 1180008 - protein, 13 aa, Mycobacterium
DREPSEGPLTADP

SEQ ID NO: 1180009 - protein, 6 aa, Mycobacterium
DRETGD

SEQ ID NO: 1180010 - protein, 9 aa, Mycobacterium
DRGARNLTD

SEQ ID NO: 1180011 - protein, 11 aa, Mycobacterium
DRGCPEPAPIR

SEQ ID NO: 1180012 - protein, 7 aa, Mycobacterium
DRGDVRR

SEQ ID NO: 1180013 - protein, 8 aa, Mycobacterium
DRGRAGSQ

SEQ ID NO: 1180014 - protein, 7 aa, Mycobacterium
DRGSALG

SEQ ID NO: 1180015 - protein, 7 aa, Mycobacterium
DRGVHRP

SEQ ID NO: 1180016 - protein, 4 aa, Mycobacterium
DRGW

SEQ ID NO: 1180017 - protein, 5 aa, Mycobacterium
DRHNH

SEQ ID NO: 1180018 - protein, 17 aa, Mycobacterium
DRIEGGAPAKDAPNTVS

SEQ ID NO: 1180019 - protein, 6 aa, Mycobacterium
DRKTAR

SEQ ID NO: 1180020 - protein, 6 aa, Mycobacterium
DRKTVA

SEQ ID NO: 1180021 - protein, 13 aa, Mycobacterium
DRLDGAPGAFASA

SEQ ID NO: 1180022 - protein, 4 aa, Mycobacterium
DRNE

SEQ ID NO: 1180023 - protein, 11 aa, Mycobacterium
DRNPTGSIKDR

SEQ ID NO: 1180024 - protein, 7 aa, Mycobacterium
DRPAKAA

SEQ ID NO: 1180025 - protein, 5 aa, Mycobacterium
DRPAT

SEQ ID NO: 1180026 - protein, 13 aa, Mycobacterium
DRPGKAYSTGNRQ

SEQ ID NO: 1180027 - protein, 6 aa, Mycobacterium
DRPGRL

SEQ ID NO: 1180028 - protein, 9 aa, Mycobacterium
DRPSAEQTD

SEQ ID NO: 1180029 - protein, 27 aa, Mycobacterium
DRPSFGSSITGAAPSVPAAALPAGSVE

SEQ ID NO: 1180030 - protein, 18 aa, Mycobacterium
DRQLPDDTSDDTVEAVGS

SEQ ID NO: 1180031 - protein, 10 aa, Mycobacterium
DRQTDPTAHP

SEQ ID NO: 1180032 - protein, 11 aa, Mycobacterium
DRRADRGQQCQ

SEQ ID NO: 1180033 - protein, 8 aa, Mycobacterium
DRRGTGWG

SEQ ID NO: 1180034 - protein, 18 aa, Mycobacterium
DRRHRDRRAGVAPRSTAL

SEQ ID NO: 1180035 - protein, 4 aa, Mycobacterium
DRRR

SEQ ID NO: 1180036 - protein, 7 aa, Mycobacterium
DRRRFGY

SEQ ID NO: 1180037 - protein, 9 aa, Mycobacterium
DRRRQARRE

SEQ ID NO: 1180038 - protein, 22 aa, Mycobacterium
DRRSSVRNIPDPSRGDEGGEPL

SEQ ID NO: 1180039 - protein, 8 aa, Mycobacterium
DRRTREQR

SEQ ID NO: 1180040 - protein, 4 aa, Mycobacterium
DRSQ

SEQ ID NO: 1180041 - protein, 8 aa, Mycobacterium
DRTDPDDD

SEQ ID NO: 1180042 - protein, 7 aa, Mycobacterium
DRTQRSL

SEQ ID NO: 1180043 - protein, 4 aa, Mycobacterium
DRTR

SEQ ID NO: 1180044 - protein, 10 aa, Mycobacterium
DRTRSTGLQS

SEQ ID NO: 1180045 - protein, 7 aa, Mycobacterium
DRTVTSR

SEQ ID NO: 1180046 - protein, 9 aa, Mycobacterium
DRVERRQQA

SEQ ID NO: 1180047 - protein, 5 aa, Mycobacterium
DRVTV

SEQ ID NO: 1180048 - protein, 6 aa, Mycobacterium
DSAAPT

SEQ ID NO: 1180049 - protein, 10 aa, Mycobacterium
DSAASNGIRM

SEQ ID NO: 1180050 - protein, 18 aa, Mycobacterium
DSAATRLADAGQRLQDGL

SEQ ID NO: 1180051 - protein, 5 aa, Mycobacterium
DSAAV

SEQ ID NO: 1180052 - protein, 33 aa, Mycobacterium
DSAGASPVARRRSTYAVSQSAGMEGDGETYTGV

SEQ ID NO: 1180053 - protein, 6 aa, Mycobacterium
DSAGGV

SEQ ID NO: 1180054 - protein, 23 aa, Mycobacterium
DSAGPLLSGGDGPYGIRPEGSAA

SEQ ID NO: 1180055 - protein, 12 aa, Mycobacterium
DSAGRAPRRRRR

SEQ ID NO: 1180056 - protein, 24 aa, Mycobacterium
DSARADYEQSRHGRHADTTPKGST

SEQ ID NO: 1180057 - protein, 7 aa, Mycobacterium
DSARPRR

SEQ ID NO: 1180058 - protein, 5 aa, Mycobacterium
DSAYG

SEQ ID NO: 1180059 - protein, 7 aa, Mycobacterium
DSDDTPM

SEQ ID NO: 1180060 - protein, 5 aa, Mycobacterium
DSDEA

SEQ ID NO: 1180061 - protein, 9 aa, Mycobacterium
DSDEAGQIR

SEQ ID NO: 1180062 - protein, 6 aa, Mycobacterium
DSDESW

SEQ ID NO: 1180063 - protein, 14 aa, Mycobacterium
DSDRLRGELPAREE

SEQ ID NO: 1180064 - protein, 10 aa, Mycobacterium
DSDYKSDLGC

SEQ ID NO: 1180065 - protein, 11 aa, Mycobacterium
DSEKPSRVGEL

SEQ ID NO: 1180066 - protein, 12 aa, Mycobacterium
DSETEADDKAAH

SEQ ID NO: 1180067 - protein, 8 aa, Mycobacterium
DSETPLSA

SEQ ID NO: 1180068 - protein, 8 aa, Mycobacterium
DSGAHSEA

SEQ ID NO: 1180069 - protein, 5 aa, Mycobacterium
DSGAT

SEQ ID NO: 1180070 - protein, 6 aa, Mycobacterium
DSGDWD

SEQ ID NO: 1180071 - protein, 10 aa, Mycobacterium
DSGKHSASYA

SEQ ID NO: 1180072 - protein, 14 aa, Mycobacterium
DSGLAGEVKTSGAK

SEQ ID NO: 1180073 - protein, 6 aa, Mycobacterium
DSGNGV

SEQ ID NO: 1180074 - protein, 6 aa, Mycobacterium
DSGPGR

SEQ ID NO: 1180075 - protein, 5 aa, Mycobacterium
DSGPI

SEQ ID NO: 1180076 - protein, 6 aa, Mycobacterium
DSGPLI

SEQ ID NO: 1180077 - protein, 7 aa, Mycobacterium
DSGTPIE

SEQ ID NO: 1180078 - protein, 8 aa, Mycobacterium
DSGVTPAA

SEQ ID NO: 1180079 - protein, 4 aa, Mycobacterium
DSKQ

SEQ ID NO: 1180080 - protein, 12 aa, Mycobacterium
DSLRGSVSGDEA

SEQ ID NO: 1180081 - protein, 4 aa, Mycobacterium
DSLT

SEQ ID NO: 1180082 - protein, 6 aa, Mycobacterium
DSMDTS

SEQ ID NO: 1180083 - protein, 10 aa, Mycobacterium
DSPAQGLSRT

SEQ ID NO: 1180084 - protein, 9 aa, Mycobacterium
DSPGAGSTW

SEQ ID NO: 1180085 - protein, 9 aa, Mycobacterium
DSPGSNSAL

SEQ ID NO: 1180086 - protein, 5 aa, Mycobacterium
DSPIQ

SEQ ID NO: 1180087 - protein, 7 aa, Mycobacterium
DSPLPID

SEQ ID NO: 1180088 - protein, 15 aa, Mycobacterium
DSPLSITEQANEKAE

SEQ ID NO: 1180089 - protein, 7 aa, Mycobacterium
DSPPEKK

SEQ ID NO: 1180090 - protein, 9 aa, Mycobacterium
DSPTGPVGE

SEQ ID NO: 1180091 - protein, 4 aa, Mycobacterium
DSQH

SEQ ID NO: 1180092 - protein, 6 aa, Mycobacterium
DSQPLR

SEQ ID NO: 1180093 - protein, 6 aa, Mycobacterium
DSRGER

SEQ ID NO: 1180094 - protein, 7 aa, Mycobacterium
DSRGPYY

SEQ ID NO: 1180095 - protein, 17 aa, Mycobacterium
DSRLSTDADIAKAAEDF

SEQ ID NO: 1180096 - protein, 5 aa, Mycobacterium
DSSAT

SEQ ID NO: 1180097 - protein, 6 aa, Mycobacterium
DSSGII

SEQ ID NO: 1180098 - protein, 5 aa, Mycobacterium
DSSLE

SEQ ID NO: 1180099 - protein, 7 aa, Mycobacterium
DSSYGTR

SEQ ID NO: 1180100 - protein, 9 aa, Mycobacterium
DSTDQAASG

SEQ ID NO: 1180101 - protein, 4 aa, Mycobacterium
DSTG

SEQ ID NO: 1180102 - protein, 5 aa, Mycobacterium
DSTIK

SEQ ID NO: 1180103 - protein, 9 aa, Mycobacterium
DSTLAREAT

SEQ ID NO: 1180104 - protein, 4 aa, Mycobacterium
DSVF

SEQ ID NO: 1180105 - protein, 6 aa, Mycobacterium
DSVSAE

SEQ ID NO: 1180106 - protein, 8 aa, Mycobacterium
DSVTQDSV

SEQ ID NO: 1180107 - protein, 7 aa, Mycobacterium
DSYPVDD

SEQ ID NO: 1180108 - protein, 9 aa, Mycobacterium
DTAAEAERM

SEQ ID NO: 1180109 - protein, 7 aa, Mycobacterium
DTAGATI

SEQ ID NO: 1180110 - protein, 50 aa, Mycobacterium
DTDETDTATTDPATEDADVAGGEVSEEAATPADSEPAAEAAPVEDEDPAV

SEQ ID NO: 1180111 - protein, 10 aa, Mycobacterium
DTDGERETAA

SEQ ID NO: 1180112 - protein, 10 aa, Mycobacterium
DTDNTYGAPR

SEQ ID NO: 1180113 - protein, 7 aa, Mycobacterium
DTDPGQR

SEQ ID NO: 1180114 - protein, 21 aa, Mycobacterium
DTDRARADLADAEDIAARTGG

SEQ ID NO: 1180115 - protein, 4 aa, Mycobacterium
DTDT

SEQ ID NO: 1180116 - protein, 14 aa, Mycobacterium
DTDYTDDGSWDNDP

SEQ ID NO: 1180117 - protein, 6 aa, Mycobacterium
DTEDDA

SEQ ID NO: 1180118 - protein, 5 aa, Mycobacterium
DTEGG

SEQ ID NO: 1180119 - protein, 20 aa, Mycobacterium
DTEKGKRAADEITAAHPEAA

SEQ ID NO: 1180120 - protein, 7 aa, Mycobacterium
DTEKPWA

SEQ ID NO: 1180121 - protein, 4 aa, Mycobacterium
DTEP

SEQ ID NO: 1180122 - protein, 7 aa, Mycobacterium
DTEPDAT

SEQ ID NO: 1180123 - protein, 25 aa, Mycobacterium
DTEPEPSTGRDPDELEAEADHTAAH

SEQ ID NO: 1180124 - protein, 8 aa, Mycobacterium
DTFGPGGS

SEQ ID NO: 1180125 - protein, 8 aa, Mycobacterium
DTGAAAPE

SEQ ID NO: 1180126 - protein, 12 aa, Mycobacterium
DTGDEAQKQQHI

SEQ ID NO: 1180127 - protein, 10 aa, Mycobacterium
DTGGINPGDK

SEQ ID NO: 1180128 - protein, 6 aa, Mycobacterium
DTGGPV

SEQ ID NO: 1180129 - protein, 4 aa, Mycobacterium
DTGH

SEQ ID NO: 1180130 - protein, 5 aa, Mycobacterium
DTGTG

SEQ ID NO: 1180131 - protein, 5 aa, Mycobacterium
DTHTR

SEQ ID NO: 1180132 - protein, 11 aa, Mycobacterium
DTIATGGSING

SEQ ID NO: 1180133 - protein, 12 aa, Mycobacterium
DTIATGGSINGI

SEQ ID NO: 1180134 - protein, 9 aa, Mycobacterium
DTIGKRDEQ

SEQ ID NO: 1180135 - protein, 14 aa, Mycobacterium
DTPAQRMAQLLSQA

SEQ ID NO: 1180136 - protein, 8 aa, Mycobacterium
DTPDPDLT

SEQ ID NO: 1180137 - protein, 13 aa, Mycobacterium
DTPDRLGPARAEL

SEQ ID NO: 1180138 - protein, 12 aa, Mycobacterium
DTQDEEPAGGLT

SEQ ID NO: 1180139 - protein, 7 aa, Mycobacterium
DTQHERD

SEQ ID NO: 1180140 - protein, 8 aa, Mycobacterium
DTRAGQEQ

SEQ ID NO: 1180141 - protein, 4 aa, Mycobacterium
DTRD

SEQ ID NO: 1180142 - protein, 6 aa, Mycobacterium
DTRDAQ

SEQ ID NO: 1180143 - protein, 5 aa, Mycobacterium
DTRGD

SEQ ID NO: 1180144 - protein, 8 aa, Mycobacterium
DTRPGAQC

SEQ ID NO: 1180145 - protein, 8 aa, Mycobacterium
DTRPHGTT

SEQ ID NO: 1180146 - protein, 26 aa, Mycobacterium
DTSAQAAATPPDPTYSAAAPEAPITE

SEQ ID NO: 1180147 - protein, 7 aa, Mycobacterium
DTSDRSI

SEQ ID NO: 1180148 - protein, 5 aa, Mycobacterium
DTSMS

SEQ ID NO: 1180149 - protein, 7 aa, Mycobacterium
DTTDTGM

SEQ ID NO: 1180150 - protein, 7 aa, Mycobacterium
DTTHGND

SEQ ID NO: 1180151 - protein, 14 aa, Mycobacterium
DTTMPETITTERRD

SEQ ID NO: 1180152 - protein, 10 aa, Mycobacterium
DTVDGPAADL

SEQ ID NO: 1180153 - protein, 8 aa, Mycobacterium
DTVNQSQE

SEQ ID NO: 1180154 - protein, 9 aa, Mycobacterium
DTVRGLNGN

SEQ ID NO: 1180155 - protein, 6 aa, Mycobacterium
DVAAGY

SEQ ID NO: 1180156 - protein, 9 aa, Mycobacterium
DVAQRDSDG

SEQ ID NO: 1180157 - protein, 7 aa, Mycobacterium
DVARTGA

SEQ ID NO: 1180158 - protein, 5 aa, Mycobacterium
DVATA

SEQ ID NO: 1180159 - protein, 8 aa, Mycobacterium
DVATPAEA

SEQ ID NO: 1180160 - protein, 6 aa, Mycobacterium
DVDDPA

SEQ ID NO: 1180161 - protein, 5 aa, Mycobacterium
DVDRE

SEQ ID NO: 1180162 - protein, 7 aa, Mycobacterium
DVEGTGL

SEQ ID NO: 1180163 - protein, 13 aa, Mycobacterium
DVGDGVESVRPGQ

SEQ ID NO: 1180164 - protein, 5 aa, Mycobacterium
DVGET

SEQ ID NO: 1180165 - protein, 67 aa, Mycobacterium
DVNAGTQIDGDYGSDNVEDNSVSTSVETNTSTSTESKIEDNSSSYESNIGSGNDTAIGSGNETNTSL

SEQ ID NO: 1180166 - protein, 13 aa, Mycobacterium
DVNPSNASRTCDR

SEQ ID NO: 1180167 - protein, 7 aa, Mycobacterium
DVNRVPS

SEQ ID NO: 1180168 - protein, 20 aa, Mycobacterium
DVPEDNITETTNTKGGRTTS

SEQ ID NO: 1180169 - protein, 7 aa, Mycobacterium
DVPESLS

SEQ ID NO: 1180170 - protein, 18 aa, Mycobacterium
DVPPRADGVYSPGGGPVE

SEQ ID NO: 1180171 - protein, 14 aa, Mycobacterium
DVPQTKPGSAGAAI

SEQ ID NO: 1180172 - protein, 10 aa, Mycobacterium
DVPTAPPVAP

SEQ ID NO: 1180173 - protein, 4 aa, Mycobacterium
DVRP

SEQ ID NO: 1180174 - protein, 10 aa, Mycobacterium
DVSAEIRGDA

SEQ ID NO: 1180175 - protein, 13 aa, Mycobacterium
DVTEAADGQPVHT

SEQ ID NO: 1180176 - protein, 11 aa, Mycobacterium
DVTGPNGEPWP

SEQ ID NO: 1180177 - protein, 4 aa, Mycobacterium
DVTP

SEQ ID NO: 1180178 - protein, 10 aa, Mycobacterium
DVYSSTVPPH

SEQ ID NO: 1180179 - protein, 15 aa, Mycobacterium
DWAGPSAKHATPLPD

SEQ ID NO: 1180180 - protein, 18 aa, Mycobacterium
DWPAAEASTPSHRSQASG

SEQ ID NO: 1180181 - protein, 12 aa, Mycobacterium
DWSSNDDGLSPL

SEQ ID NO: 1180182 - protein, 25 aa, Mycobacterium
DYAPAFGAKKTGVNNAAPPPRVPGT

SEQ ID NO: 1180183 - protein, 13 aa, Mycobacterium
DYAPGSGERTRLT

SEQ ID NO: 1180184 - protein, 6 aa, Mycobacterium
DYAQAD

SEQ ID NO: 1180185 - protein, 6 aa, Mycobacterium
DYDQTR

SEQ ID NO: 1180186 - protein, 5 aa, Mycobacterium
DYENK

SEQ ID NO: 1180187 - protein, 6 aa, Mycobacterium
DYEYTG

SEQ ID NO: 1180188 - protein, 19 aa, Mycobacterium
DYNGGREIYPDTQPLDRGR

SEQ ID NO: 1180189 - protein, 4 aa, Mycobacterium
DYPA

SEQ ID NO: 1180190 - protein, 8 aa, Mycobacterium
DYPDTAPA

SEQ ID NO: 1180191 - protein, 8 aa, Mycobacterium
DYRGQTQT

SEQ ID NO: 1180192 - protein, 15 aa, Mycobacterium
DYTGPGSGLDGTDPT

SEQ ID NO: 1180193 - protein, 9 aa, Mycobacterium
EAAAGPDAR

SEQ ID NO: 1180194 - protein, 8 aa, Mycobacterium
EAAAMDPQ

SEQ ID NO: 1180195 - protein, 14 aa, Mycobacterium
EAADRSTSRDAYGN

SEQ ID NO: 1180196 - protein, 11 aa, Mycobacterium
EAADTMDKDAA

SEQ ID NO: 1180197 - protein, 8 aa, Mycobacterium
EAAGAAEG

SEQ ID NO: 1180198 - protein, 7 aa, Mycobacterium
EAAGGSF

SEQ ID NO: 1180199 - protein, 6 aa, Mycobacterium
EAAGVA

SEQ ID NO: 1180200 - protein, 7 aa, Mycobacterium
EAANPEL

SEQ ID NO: 1180201 - protein, 6 aa, Mycobacterium
EAAPEE

SEQ ID NO: 1180202 - protein, 5 aa, Mycobacterium
EAAPQ

SEQ ID NO: 1180203 - protein, 6 aa, Mycobacterium
EAAPSL

SEQ ID NO: 1180204 - protein, 36 aa, Mycobacterium
EAARAAAEGAESTRDQIARKGRASYVGDAARGAVDP

SEQ ID NO: 1180205 - protein, 8 aa, Mycobacterium
EAAREGTE

SEQ ID NO: 1180206 - protein, 12 aa, Mycobacterium
EAASPPTAGDGD

SEQ ID NO: 1180207 - protein, 7 aa, Mycobacterium
EAAVERA

SEQ ID NO: 1180208 - protein, 7 aa, Mycobacterium
EADADPA

SEQ ID NO: 1180209 - protein, 31 aa, Mycobacterium
EADDSETVEVGGSGRNASRGRRAQGEPGRAV

SEQ ID NO: 1180210 - protein, 7 aa, Mycobacterium
EADESGF

SEQ ID NO: 1180211 - protein, 7 aa, Mycobacterium
EADPISA

SEQ ID NO: 1180212 - protein, 21 aa, Mycobacterium
EADPQATPGRETTLSDGLTAS

SEQ ID NO: 1180213 - protein, 9 aa, Mycobacterium
EADSPYADT

SEQ ID NO: 1180214 - protein, 8 aa, Mycobacterium
EAEGVPAD

SEQ ID NO: 1180215 - protein, 8 aa, Mycobacterium
EAEKDSVT

SEQ ID NO: 1180216 - protein, 7 aa, Mycobacterium
EAEKGSQ

SEQ ID NO: 1180217 - protein, 11 aa, Mycobacterium
EAELEGASPDA

SEQ ID NO: 1180218 - protein, 6 aa, Mycobacterium
EAENLR

SEQ ID NO: 1180219 - protein, 6 aa, Mycobacterium
EAEPRP

SEQ ID NO: 1180220 - protein, 4 aa, Mycobacterium
EAEQ

SEQ ID NO: 1180221 - protein, 7 aa, Mycobacterium
EAERADP

SEQ ID NO: 1180222 - protein, 13 aa, Mycobacterium
EAERDRHGAADSW

SEQ ID NO: 1180223 - protein, 9 aa, Mycobacterium
EAETDPVAA

SEQ ID NO: 1180224 - protein, 4 aa, Mycobacterium
EAFG

SEQ ID NO: 1180225 - protein, 6 aa, Mycobacterium
EAGAAE

SEQ ID NO: 1180226 - protein, 14 aa, Mycobacterium
EAGAGPGPAAAAAA

SEQ ID NO: 1180227 - protein, 8 aa, Mycobacterium
EAGASTPN

SEQ ID NO: 1180228 - protein, 8 aa, Mycobacterium
EAGAVETT

SEQ ID NO: 1180229 - protein, 4 aa, Mycobacterium
EAGE

SEQ ID NO: 1180230 - protein, 8 aa, Mycobacterium
EAGETAIG

SEQ ID NO: 1180231 - protein, 15 aa, Mycobacterium
EAGGGDLPELSSDST

SEQ ID NO: 1180232 - protein, 10 aa, Mycobacterium
EAGGGPAPAV

SEQ ID NO: 1180233 - protein, 9 aa, Mycobacterium
EAGIGPGRT

SEQ ID NO: 1180234 - protein, 8 aa, Mycobacterium
EAGISSED

SEQ ID NO: 1180235 - protein, 14 aa, Mycobacterium
EAGPDTDAPPPGTV

SEQ ID NO: 1180236 - protein, 7 aa, Mycobacterium
EAGPPQQ

SEQ ID NO: 1180237 - protein, 5 aa, Mycobacterium
EAGRR

SEQ ID NO: 1180238 - protein, 8 aa, Mycobacterium
EAGSRGGA

SEQ ID NO: 1180239 - protein, 6 aa, Mycobacterium
EAGTGD

SEQ ID NO: 1180240 - protein, 5 aa, Mycobacterium
EAGVD

SEQ ID NO: 1180241 - protein, 11 aa, Mycobacterium
EAGVPDRNTLT

SEQ ID NO: 1180242 - protein, 7 aa, Mycobacterium
EAGVPRD

SEQ ID NO: 1180243 - protein, 8 aa, Mycobacterium
EAKEALGT

SEQ ID NO: 1180244 - protein, 4 aa, Mycobacterium
EAKF

SEQ ID NO: 1180245 - protein, 6 aa, Mycobacterium
EAKGRQ

SEQ ID NO: 1180246 - protein, 7 aa, Mycobacterium
EAKLRGS

SEQ ID NO: 1180247 - protein, 8 aa, Mycobacterium
EAKTSKNF

SEQ ID NO: 1180248 - protein, 9 aa, Mycobacterium
EAKVRGEAR

SEQ ID NO: 1180249 - protein, 9 aa, Mycobacterium
EALAGAGDT

SEQ ID NO: 1180250 - protein, 8 aa, Mycobacterium
EALGPRGE

SEQ ID NO: 1180251 - protein, 8 aa, Mycobacterium
EALGVGDD

SEQ ID NO: 1180252 - protein, 6 aa, Mycobacterium
EANGIE

SEQ ID NO: 1180253 - protein, 4 aa, Mycobacterium
EANL

SEQ ID NO: 1180254 - protein, 11 aa, Mycobacterium
EAPAPPHVGPG

SEQ ID NO: 1180255 - protein, 14 aa, Mycobacterium
EAPDPSTDGIDPLS

SEQ ID NO: 1180256 - protein, 4 aa, Mycobacterium
EAPI

SEQ ID NO: 1180257 - protein, 4 aa, Mycobacterium
EAPL

SEQ ID NO: 1180258 - protein, 6 aa, Mycobacterium
EAPNGA

SEQ ID NO: 1180259 - protein, 7 aa, Mycobacterium
EAPNGAH

SEQ ID NO: 1180260 - protein, 9 aa, Mycobacterium
EAPPRPFTY

SEQ ID NO: 1180261 - protein, 21 aa, Mycobacterium
EAPVASTDAAPAVTASGKTPL

SEQ ID NO: 1180262 - protein, 22 aa, Mycobacterium
EAPVRQDDAHSGDAQLTSPMPG

SEQ ID NO: 1180263 - protein, 7 aa, Mycobacterium
EAQELQD

SEQ ID NO: 1180264 - protein, 19 aa, Mycobacterium
EAQKEQGRYGAATTTEESQ

SEQ ID NO: 1180265 - protein, 11 aa, Mycobacterium
EAQPRYSAARR

SEQ ID NO: 1180266 - protein, 13 aa, Mycobacterium
EAQQNFGSQQAEL

SEQ ID NO: 1180267 - protein, 12 aa, Mycobacterium
EARDPDAGSSVA

SEQ ID NO: 1180268 - protein, 8 aa, Mycobacterium
EARDTEDI

SEQ ID NO: 1180269 - protein, 8 aa, Mycobacterium
EARKDEAI

SEQ ID NO: 1180270 - protein, 14 aa, Mycobacterium
EARPDSMRTNQEAA

SEQ ID NO: 1180271 - protein, 8 aa, Mycobacterium
EARSALDG

SEQ ID NO: 1180272 - protein, 4 aa, Mycobacterium
EARV

SEQ ID NO: 1180273 - protein, 11 aa, Mycobacterium
EARVTKQTAGA

SEQ ID NO: 1180274 - protein, 9 aa, Mycobacterium
EASAPTAIG

SEQ ID NO: 1180275 - protein, 19 aa, Mycobacterium
EASDEEGTAVVRLVDAGRL

SEQ ID NO: 1180276 - protein, 6 aa, Mycobacterium
EASGWG

SEQ ID NO: 1180277 - protein, 5 aa, Mycobacterium
EASRR

SEQ ID NO: 1180278 - protein, 4 aa, Mycobacterium
EASV

SEQ ID NO: 1180279 - protein, 5 aa, Mycobacterium
EASYF

SEQ ID NO: 1180280 - protein, 5 aa, Mycobacterium
EASYQ

SEQ ID NO: 1180281 - protein, 11 aa, Mycobacterium
EATARAAAEGA

SEQ ID NO: 1180282 - protein, 8 aa, Mycobacterium
EATPQAVD

SEQ ID NO: 1180283 - protein, 11 aa, Mycobacterium
EATPSWSPQYQ

SEQ ID NO: 1180284 - protein, 5 aa, Mycobacterium
EATQT

SEQ ID NO: 1180285 - protein, 6 aa, Mycobacterium
EAVESA

SEQ ID NO: 1180286 - protein, 10 aa, Mycobacterium
EAYPGGFDKS

SEQ ID NO: 1180287 - protein, 8 aa, Mycobacterium
ECGAATDE

SEQ ID NO: 1180288 - protein, 6 aa, Mycobacterium
ECPDGT

SEQ ID NO: 1180289 - protein, 6 aa, Mycobacterium
EDAAEA

SEQ ID NO: 1180290 - protein, 8 aa, Mycobacterium
EDAAEPDR

SEQ ID NO: 1180291 - protein, 9 aa, Mycobacterium
EDAAGRGHE

SEQ ID NO: 1180292 - protein, 7 aa, Mycobacterium
EDADEIA

SEQ ID NO: 1180293 - protein, 4 aa, Mycobacterium
EDAE

SEQ ID NO: 1180294 - protein, 5 aa, Mycobacterium
EDAEF

SEQ ID NO: 1180295 - protein, 23 aa, Mycobacterium
EDAEPEGEPSDPRTRGAQTDKDP

SEQ ID NO: 1180296 - protein, 6 aa, Mycobacterium
EDAERM

SEQ ID NO: 1180297 - protein, 89 aa, Mycobacterium
EDAHEDEDDKEEDDEEAEEQKAEPDPESEPEEPAAVEKPEAATVDATADEPMPSPPVPEPPAPTPPPAPAAPLAEPIAPPPGPDSATPC

SEQ ID NO: 1180298 - protein, 11 aa, Mycobacterium
EDAPPDAERDR

SEQ ID NO: 1180299 - protein, 7 aa, Mycobacterium
EDAQSPF

SEQ ID NO: 1180300 - protein, 4 aa, Mycobacterium
EDAS

SEQ ID NO: 1180301 - protein, 4 aa, Mycobacterium
EDCR

SEQ ID NO: 1180302 - protein, 4 aa, Mycobacterium
EDDA

SEQ ID NO: 1180303 - protein, 8 aa, Mycobacterium
EDDARRAV

SEQ ID NO: 1180304 - protein, 9 aa, Mycobacterium
EDDARRAVQ

SEQ ID NO: 1180305 - protein, 7 aa, Mycobacterium
EDDRLGD

SEQ ID NO: 1180306 - protein, 5 aa, Mycobacterium
EDDVA

SEQ ID NO: 1180307 - protein, 8 aa, Mycobacterium
EDEAATLA

SEQ ID NO: 1180308 - protein, 5 aa, Mycobacterium
EDELT

SEQ ID NO: 1180309 - protein, 5 aa, Mycobacterium
EDERD

SEQ ID NO: 1180310 - protein, 12 aa, Mycobacterium
EDGCAGHSDGDV

SEQ ID NO: 1180311 - protein, 4 aa, Mycobacterium
EDGD

SEQ ID NO: 1180312 - protein, 9 aa, Mycobacterium
EDGDPVTGI

SEQ ID NO: 1180313 - protein, 26 aa, Mycobacterium
EDGGDRVKPRSTRRSDGARRPSRQIV

SEQ ID NO: 1180314 - protein, 8 aa, Mycobacterium
EDGGDSGL

SEQ ID NO: 1180315 - protein, 6 aa, Mycobacterium
EDGGEF

SEQ ID NO: 1180316 - protein, 16 aa, Mycobacterium
EDGNAILGEDGQPQPR

SEQ ID NO: 1180317 - protein, 7 aa, Mycobacterium
EDGPSIP

SEQ ID NO: 1180318 - protein, 8 aa, Mycobacterium
EDGTRLEA

SEQ ID NO: 1180319 - protein, 6 aa, Mycobacterium
EDGTTI

SEQ ID NO: 1180320 - protein, 8 aa, Mycobacterium
EDGWRDEQ

SEQ ID NO: 1180321 - protein, 5 aa, Mycobacterium
EDLAE

SEQ ID NO: 1180322 - protein, 14 aa, Mycobacterium
EDLPTRDLNPSETK

SEQ ID NO: 1180323 - protein, 6 aa, Mycobacterium
EDLTRR

SEQ ID NO: 1180324 - protein, 8 aa, Mycobacterium
EDPERGEQ

SEQ ID NO: 1180325 - protein, 6 aa, Mycobacterium
EDPHAE

SEQ ID NO: 1180326 - protein, 45 aa, Mycobacterium
EDPVVDPEPEAEAPAAETAPAAESPAPAAPAAPAAPSGGPRPDDI

SEQ ID NO: 1180327 - protein, 8 aa, Mycobacterium
EDQRPADD

SEQ ID NO: 1180328 - protein, 4 aa, Mycobacterium
EDRA

SEQ ID NO: 1180329 - protein, 4 aa, Mycobacterium
EDRE

SEQ ID NO: 1180330 - protein, 20 aa, Mycobacterium
EDRLSGLSKREARKHLLPAA

SEQ ID NO: 1180331 - protein, 5 aa, Mycobacterium
EDRRH

SEQ ID NO: 1180332 - protein, 4 aa, Mycobacterium
EDRY

SEQ ID NO: 1180333 - protein, 7 aa, Mycobacterium
EDSDDGP

SEQ ID NO: 1180334 - protein, 15 aa, Mycobacterium
EDSDQSPSALHPAPR

SEQ ID NO: 1180335 - protein, 6 aa, Mycobacterium
EDSRTV

SEQ ID NO: 1180336 - protein, 6 aa, Mycobacterium
EDTKRT

SEQ ID NO: 1180337 - protein, 20 aa, Mycobacterium
EDVPDGPEPGGAAAGGRGME

SEQ ID NO: 1180338 - protein, 4 aa, Mycobacterium
EDVR

SEQ ID NO: 1180339 - protein, 16 aa, Mycobacterium
EDYDRVPADDPNPEQI

SEQ ID NO: 1180340 - protein, 9 aa, Mycobacterium
EDYKRPNAD

SEQ ID NO: 1180341 - protein, 4 aa, Mycobacterium
EEAA

SEQ ID NO: 1180342 - protein, 11 aa, Mycobacterium
EEAADSRVAEG

SEQ ID NO: 1180343 - protein, 5 aa, Mycobacterium
EEAAP

SEQ ID NO: 1180344 - protein, 9 aa, Mycobacterium
EEAAPALGP

SEQ ID NO: 1180345 - protein, 12 aa, Mycobacterium
EEALSGASEATR

SEQ ID NO: 1180346 - protein, 10 aa, Mycobacterium
EEAPAPALPG

SEQ ID NO: 1180347 - protein, 8 aa, Mycobacterium
EEAPKLDG

SEQ ID NO: 1180348 - protein, 6 aa, Mycobacterium
EEAQRA

SEQ ID NO: 1180349 - protein, 65 aa, Mycobacterium
EEARGAARSQGKDVGRGRTSPARRVAGTGRRRSWSGPGPDSRDPQTLGAATRDLARTRGWSPKVA

SEQ ID NO: 1180350 - protein, 7 aa, Mycobacterium
EEATQAY

SEQ ID NO: 1180351 - protein, 15 aa, Mycobacterium
EEATRDRPHQRTAQR

SEQ ID NO: 1180352 - protein, 5 aa, Mycobacterium
EEAVK

SEQ ID NO: 1180353 - protein, 9 aa, Mycobacterium
EEEPDKGSN

SEQ ID NO: 1180354 - protein, 5 aa, Mycobacterium
EEEVG

SEQ ID NO: 1180355 - protein, 5 aa, Mycobacterium
EEFAA

SEQ ID NO: 1180356 - protein, 7 aa, Mycobacterium
EEIPKPG

SEQ ID NO: 1180357 - protein, 11 aa, Mycobacterium
EELADQPDKMA

SEQ ID NO: 1180358 - protein, 8 aa, Mycobacterium
EELPYDTG

SEQ ID NO: 1180359 - protein, 8 aa, Mycobacterium
EEMRSSPP

SEQ ID NO: 1180360 - protein, 9 aa, Mycobacterium
EENAKARGA

SEQ ID NO: 1180361 - protein, 8 aa, Mycobacterium
EEQGLDEA

SEQ ID NO: 1180362 - protein, 15 aa, Mycobacterium
EEQGVPPEKLAGTIQ

SEQ ID NO: 1180363 - protein, 8 aa, Mycobacterium
EERAADSE

SEQ ID NO: 1180364 - protein, 5 aa, Mycobacterium
EERDH

SEQ ID NO: 1180365 - protein, 10 aa, Mycobacterium
EERDSADTVI

SEQ ID NO: 1180366 - protein, 6 aa, Mycobacterium
EERERN

SEQ ID NO: 1180367 - protein, 6 aa, Mycobacterium
EERGNQ

SEQ ID NO: 1180368 - protein, 9 aa, Mycobacterium
EERRTADRE

SEQ ID NO: 1180369 - protein, 14 aa, Mycobacterium
EERSAELSAATTAR

SEQ ID NO: 1180370 - protein, 4 aa, Mycobacterium
EESA

SEQ ID NO: 1180371 - protein, 18 aa, Mycobacterium
EESGSNGTPLNGAEAPVD

SEQ ID NO: 1180372 - protein, 5 aa, Mycobacterium
EESHG

SEQ ID NO: 1180373 - protein, 21 aa, Mycobacterium
EETDTTPEKPATKRVNPGTKI

SEQ ID NO: 1180374 - protein, 10 aa, Mycobacterium
EETGSAAPSE

SEQ ID NO: 1180375 - protein, 4 aa, Mycobacterium
EETI

SEQ ID NO: 1180376 - protein, 111 aa, Mycobacterium
EETLDAARTQTEAETQPAPEATPEQGAQPTSEPAPEPEPEDEAQPEPEAEPHAETEPEPEAEAGPTPEAGVEADPEAEADPKAEPEAEAGPTPEAEAEAAVTPTPRQSACP

SEQ ID NO: 1180377 - protein, 98 aa, Mycobacterium
EETLDAARTQTETQPEPEAEPHAETEPQHEPEAEDEAQPEPEAEPQAEPEPEPEAEAGPTPEAEAEATPEPEAGPEAEAAPLAEAATQPPPTPQQSAC

SEQ ID NO: 1180378 - protein, 98 aa, Mycobacterium
EETLDAARTQTETQPEPEPEPEEEAQPEPEAQAETEPEPEPEDEAQPEPEAQAETEPEPEPEDEAQPEPEAEPQAETEPAPEPEAEAAATLTPQQSAC

SEQ ID NO: 1180379 - protein, 10 aa, Mycobacterium
EETSPQTKSA

SEQ ID NO: 1180380 - protein, 6 aa, Mycobacterium
EEVKSV

SEQ ID NO: 1180381 - protein, 10 aa, Mycobacterium
EEWGGGGQPY

SEQ ID NO: 1180382 - protein, 7 aa, Mycobacterium
EFAEDPA

SEQ ID NO: 1180383 - protein, 5 aa, Mycobacterium
EFGRR

SEQ ID NO: 1180384 - protein, 11 aa, Mycobacterium
EFPSNRTQGAM

SEQ ID NO: 1180385 - protein, 9 aa, Mycobacterium
EFRPDRSNV

SEQ ID NO: 1180386 - protein, 20 aa, Mycobacterium
EFSSGSSRAQGPITKTGNTH

SEQ ID NO: 1180387 - protein, 10 aa, Mycobacterium
EFTQTTSAAI

SEQ ID NO: 1180388 - protein, 8 aa, Mycobacterium
EGARIGDK

SEQ ID NO: 1180389 - protein, 8 aa, Mycobacterium
EGATADAD

SEQ ID NO: 1180390 - protein, 11 aa, Mycobacterium
EGDATLSPSGR

SEQ ID NO: 1180391 - protein, 7 aa, Mycobacterium
EGDQLGD

SEQ ID NO: 1180392 - protein, 4 aa, Mycobacterium
EGDW

SEQ ID NO: 1180393 - protein, 4 aa, Mycobacterium
EGEF

SEQ ID NO: 1180394 - protein, 4 aa, Mycobacterium
EGEL

SEQ ID NO: 1180395 - protein, 14 aa, Mycobacterium
EGERRQAGKRWRPS

SEQ ID NO: 1180396 - protein, 12 aa, Mycobacterium
EGESGREPAAPS

SEQ ID NO: 1180397 - protein, 4 aa, Mycobacterium
EGFL

SEQ ID NO: 1180398 - protein, 4 aa, Mycobacterium
EGGG

SEQ ID NO: 1180399 - protein, 7 aa, Mycobacterium
EGGGASK

SEQ ID NO: 1180400 - protein, 6 aa, Mycobacterium
EGGPDR

SEQ ID NO: 1180401 - protein, 4 aa, Mycobacterium
EGGR

SEQ ID NO: 1180402 - protein, 7 aa, Mycobacterium
EGGRAAL

SEQ ID NO: 1180403 - protein, 30 aa, Mycobacterium
EGHRSDLSDCPPAKLSRGAPSKRIGDQGRY

SEQ ID NO: 1180404 - protein, 5 aa, Mycobacterium
EGIKG

SEQ ID NO: 1180405 - protein, 6 aa, Mycobacterium
EGIPPP

SEQ ID NO: 1180406 - protein, 9 aa, Mycobacterium
EGKGENLTR

SEQ ID NO: 1180407 - protein, 4 aa, Mycobacterium
EGLG

SEQ ID NO: 1180408 - protein, 6 aa, Mycobacterium
EGLPSP

SEQ ID NO: 1180409 - protein, 10 aa, Mycobacterium
EGNPDSPISR

SEQ ID NO: 1180410 - protein, 15 aa, Mycobacterium
EGPGITEDAKTGARL

SEQ ID NO: 1180411 - protein, 9 aa, Mycobacterium
EGPKGGPGM

SEQ ID NO: 1180412 - protein, 11 aa, Mycobacterium
EGPLRDATAGR

SEQ ID NO: 1180413 - protein, 13 aa, Mycobacterium
EGPPGNGKTSLAE

SEQ ID NO: 1180414 - protein, 10 aa, Mycobacterium
EGPRISGTEP

SEQ ID NO: 1180415 - protein, 7 aa, Mycobacterium
EGQPGPV

SEQ ID NO: 1180416 - protein, 6 aa, Mycobacterium
EGRDGY

SEQ ID NO: 1180417 - protein, 12 aa, Mycobacterium
EGRELGDTSTLV

SEQ ID NO: 1180418 - protein, 6 aa, Mycobacterium
EGRGDI

SEQ ID NO: 1180419 - protein, 4 aa, Mycobacterium
EGRP

SEQ ID NO: 1180420 - protein, 5 aa, Mycobacterium
EGSGN

SEQ ID NO: 1180421 - protein, 4 aa, Mycobacterium
EGSP

SEQ ID NO: 1180422 - protein, 8 aa, Mycobacterium
EGSTHGYD

SEQ ID NO: 1180423 - protein, 7 aa, Mycobacterium
EGSTVAG

SEQ ID NO: 1180424 - protein, 8 aa, Mycobacterium
EGTATGSG

SEQ ID NO: 1180425 - protein, 15 aa, Mycobacterium
EGTEPSPGQNGGPTV

SEQ ID NO: 1180426 - protein, 7 aa, Mycobacterium
EGTGDHS

SEQ ID NO: 1180427 - protein, 9 aa, Mycobacterium
EGTLGRDSQ

SEQ ID NO: 1180428 - protein, 4 aa, Mycobacterium
EGTR

SEQ ID NO: 1180429 - protein, 15 aa, Mycobacterium
EGTRLTDQARSSKIK

SEQ ID NO: 1180430 - protein, 7 aa, Mycobacterium
EGTRTGK

SEQ ID NO: 1180431 - protein, 11 aa, Mycobacterium
EGVDEQGEPID

SEQ ID NO: 1180432 - protein, 5 aa, Mycobacterium
EGVNP

SEQ ID NO: 1180433 - protein, 4 aa, Mycobacterium
EGVT

SEQ ID NO: 1180434 - protein, 20 aa, Mycobacterium
EGYAQVSTKVTAEVASVLEN

SEQ ID NO: 1180435 - protein, 15 aa, Mycobacterium
EHAGPGVPGHHRDAS

SEQ ID NO: 1180436 - protein, 9 aa, Mycobacterium
EHATDEGKA

SEQ ID NO: 1180437 - protein, 10 aa, Mycobacterium
EHDSSHDLGV

SEQ ID NO: 1180438 - protein, 5 aa, Mycobacterium
EHGDR

SEQ ID NO: 1180439 - protein, 4 aa, Mycobacterium
EHGE

SEQ ID NO: 1180440 - protein, 9 aa, Mycobacterium
EHGGIDAPA

SEQ ID NO: 1180441 - protein, 9 aa, Mycobacterium
EHGTPSDVD

SEQ ID NO: 1180442 - protein, 18 aa, Mycobacterium
EHHAEQDEPEPVPCQKDS

SEQ ID NO: 1180443 - protein, 5 aa, Mycobacterium
EHIES

SEQ ID NO: 1180444 - protein, 13 aa, Mycobacterium
EHLKGKTGYSPER

SEQ ID NO: 1180445 - protein, 8 aa, Mycobacterium
EHPEPGAP

SEQ ID NO: 1180446 - protein, 8 aa, Mycobacterium
EHPETAPT

SEQ ID NO: 1180447 - protein, 8 aa, Mycobacterium
EHPNHPQS

SEQ ID NO: 1180448 - protein, 7 aa, Mycobacterium
EHRTDEG

SEQ ID NO: 1180449 - protein, 7 aa, Mycobacterium
EHRTGEG

SEQ ID NO: 1180450 - protein, 18 aa, Mycobacterium
EHSASGPGFGRGPGRGPG

SEQ ID NO: 1180451 - protein, 11 aa, Mycobacterium
EHSEQLSDDHK

SEQ ID NO: 1180452 - protein, 17 aa, Mycobacterium
EHSPTGASEQALPTRAA

SEQ ID NO: 1180453 - protein, 14 aa, Mycobacterium
EHTTRTGAAPTSIA

SEQ ID NO: 1180454 - protein, 8 aa, Mycobacterium
EHVGGSPL

SEQ ID NO: 1180455 - protein, 15 aa, Mycobacterium
EIAAPAAPELREHPT

SEQ ID NO: 1180456 - protein, 4 aa, Mycobacterium
EIAE

SEQ ID NO: 1180457 - protein, 4 aa, Mycobacterium
EIAR

SEQ ID NO: 1180458 - protein, 4 aa, Mycobacterium
EIEG

SEQ ID NO: 1180459 - protein, 10 aa, Mycobacterium
EIGGPAGHTE

SEQ ID NO: 1180460 - protein, 4 aa, Mycobacterium
EIGN

SEQ ID NO: 1180461 - protein, 5 aa, Mycobacterium
EIGPS

SEQ ID NO: 1180462 - protein, 5 aa, Mycobacterium
EINQS

SEQ ID NO: 1180463 - protein, 16 aa, Mycobacterium
EIPGGVRTTTESDAAD

SEQ ID NO: 1180464 - protein, 8 aa, Mycobacterium
EIPPDGSC

SEQ ID NO: 1180465 - protein, 5 aa, Mycobacterium
EITRG

SEQ ID NO: 1180466 - protein, 6 aa, Mycobacterium
EKADRT

SEQ ID NO: 1180467 - protein, 7 aa, Mycobacterium
EKADRTY

SEQ ID NO: 1180468 - protein, 6 aa, Mycobacterium
EKAGCR

SEQ ID NO: 1180469 - protein, 8 aa, Mycobacterium
EKAQAAGH

SEQ ID NO: 1180470 - protein, 12 aa, Mycobacterium
EKARAASAQMRE

SEQ ID NO: 1180471 - protein, 9 aa, Mycobacterium
EKDAETGER

SEQ ID NO: 1180472 - protein, 6 aa, Mycobacterium
EKDPDT

SEQ ID NO: 1180473 - protein, 6 aa, Mycobacterium
EKDPET

SEQ ID NO: 1180474 - protein, 9 aa, Mycobacterium
EKGATKDGF

SEQ ID NO: 1180475 - protein, 4 aa, Mycobacterium
EKGE

SEQ ID NO: 1180476 - protein, 8 aa, Mycobacterium
EKGRAGER

SEQ ID NO: 1180477 - protein, 20 aa, Mycobacterium
EKHNEANGEDNRDGESHNRS

SEQ ID NO: 1180478 - protein, 7 aa, Mycobacterium
EKIEGSD

SEQ ID NO: 1180479 - protein, 11 aa, Mycobacterium
EKLDEERNRLD

SEQ ID NO: 1180480 - protein, 6 aa, Mycobacterium
EKPFGR

SEQ ID NO: 1180481 - protein, 7 aa, Mycobacterium
EKPRAEG

SEQ ID NO: 1180482 - protein, 4 aa, Mycobacterium
EKRS

SEQ ID NO: 1180483 - protein, 14 aa, Mycobacterium
EKSRAAARTGAGWQ

SEQ ID NO: 1180484 - protein, 8 aa, Mycobacterium
EKTDDTVP

SEQ ID NO: 1180485 - protein, 5 aa, Mycobacterium
EKVPD

SEQ ID NO: 1180486 - protein, 8 aa, Mycobacterium
EKVTPAVR

SEQ ID NO: 1180487 - protein, 5 aa, Mycobacterium
EKWGE

SEQ ID NO: 1180488 - protein, 4 aa, Mycobacterium
EKYG

SEQ ID NO: 1180489 - protein, 8 aa, Mycobacterium
ELADNDAL

SEQ ID NO: 1180490 - protein, 5 aa, Mycobacterium
ELAEQ

SEQ ID NO: 1180491 - protein, 10 aa, Mycobacterium
ELANSDSHAE

SEQ ID NO: 1180492 - protein, 10 aa, Mycobacterium
ELDEDAEGAL

SEQ ID NO: 1180493 - protein, 7 aa, Mycobacterium
ELDPRRT

SEQ ID NO: 1180494 - protein, 6 aa, Mycobacterium
ELEGQG

SEQ ID NO: 1180495 - protein, 18 aa, Mycobacterium
ELESRKDELEEAWLAAAE

SEQ ID NO: 1180496 - protein, 10 aa, Mycobacterium
ELGAEGADYQ

SEQ ID NO: 1180497 - protein, 8 aa, Mycobacterium
ELGDRGET

SEQ ID NO: 1180498 - protein, 7 aa, Mycobacterium
ELGTGPI

SEQ ID NO: 1180499 - protein, 13 aa, Mycobacterium
ELGTGPVSYEDSI

SEQ ID NO: 1180500 - protein, 6 aa, Mycobacterium
ELPADT

SEQ ID NO: 1180501 - protein, 13 aa, Mycobacterium
ELPANTTATVGQT

SEQ ID NO: 1180502 - protein, 12 aa, Mycobacterium
ELPGAREKLTGA

SEQ ID NO: 1180503 - protein, 5 aa, Mycobacterium
ELPPG

SEQ ID NO: 1180504 - protein, 18 aa, Mycobacterium
ELPTAAGRQAESVEGAVN

SEQ ID NO: 1180505 - protein, 7 aa, Mycobacterium
ELPTEPA

SEQ ID NO: 1180506 - protein, 5 aa, Mycobacterium
ELQPR

SEQ ID NO: 1180507 - protein, 5 aa, Mycobacterium
ELRPR

SEQ ID NO: 1180508 - protein, 13 aa, Mycobacterium
ELRSNSPMVGTPA

SEQ ID NO: 1180509 - protein, 16 aa, Mycobacterium
ELSTATAVDTTGRRRP

SEQ ID NO: 1180510 - protein, 8 aa, Mycobacterium
ELTDPENA

SEQ ID NO: 1180511 - protein, 4 aa, Mycobacterium
ELTG

SEQ ID NO: 1180512 - protein, 4 aa, Mycobacterium
ELTP

SEQ ID NO: 1180513 - protein, 8 aa, Mycobacterium
ELTPAGAA

SEQ ID NO: 1180514 - protein, 5 aa, Mycobacterium
ELTSR

SEQ ID NO: 1180515 - protein, 8 aa, Mycobacterium
ELTSRRGR

SEQ ID NO: 1180516 - protein, 21 aa, Mycobacterium
EMGQGPVQAQSDGAGHRLTGS

SEQ ID NO: 1180517 - protein, 9 aa, Mycobacterium
EMPTSQFGP

SEQ ID NO: 1180518 - protein, 34 aa, Mycobacterium; identical to SEQ ID NO: 1106880

SEQ ID NO: 1180519 - protein, 4 aa, Mycobacterium
EMRP

SEQ ID NO: 1180520 - protein, 6 aa, Mycobacterium
EMSGGR

SEQ ID NO: 1180521 - protein, 9 aa, Mycobacterium
EMTAEDDEI

SEQ ID NO: 1180522 - protein, 5 aa, Mycobacterium
ENAAG

SEQ ID NO: 1180523 - protein, 8 aa, Mycobacterium
ENADARGA

SEQ ID NO: 1180524 - protein, 12 aa, Mycobacterium
ENAGVSQGLTPR

SEQ ID NO: 1180525 - protein, 4 aa, Mycobacterium
ENAP

SEQ ID NO: 1180526 - protein, 5 aa, Mycobacterium
ENATV

SEQ ID NO: 1180527 - protein, 11 aa, Mycobacterium
ENAVADKSAYE

SEQ ID NO: 1180528 - protein, 6 aa, Mycobacterium
ENGTGP

SEQ ID NO: 1180529 - protein, 8 aa, Mycobacterium
ENHRGGTV

SEQ ID NO: 1180530 - protein, 8 aa, Mycobacterium
ENLGRQDL

SEQ ID NO: 1180531 - protein, 8 aa, Mycobacterium
ENNPGGLP

SEQ ID NO: 1180532 - protein, 15 aa, Mycobacterium
ENQALRADKTRLSTE

SEQ ID NO: 1180533 - protein, 15 aa, Mycobacterium
ENQRVPGRPRPGVQD

SEQ ID NO: 1180534 - protein, 6 aa, Mycobacterium
ENRQTA

SEQ ID NO: 1180535 - protein, 4 aa, Mycobacterium
ENVY

SEQ ID NO: 1180536 - protein, 15 aa, Mycobacterium
EPADPASVPVHTNGA

SEQ ID NO: 1180537 - protein, 21 aa, Mycobacterium
EPAGGVGQHDGAHARRARRPH

SEQ ID NO: 1180538 - protein, 8 aa, Mycobacterium
EPAGGVVP

SEQ ID NO: 1180539 - protein, 7 aa, Mycobacterium
EPAGHSS

SEQ ID NO: 1180540 - protein, 18 aa, Mycobacterium
EPAGPAAPRRSSDPSVAD

SEQ ID NO: 1180541 - protein, 9 aa, Mycobacterium
EPAPEGDGM

SEQ ID NO: 1180542 - protein, 8 aa, Mycobacterium
EPARPAAA

SEQ ID NO: 1180543 - protein, 6 aa, Mycobacterium
EPASYT

SEQ ID NO: 1180544 - protein, 4 aa, Mycobacterium
EPDA

SEQ ID NO: 1180545 - protein, 22 aa, Mycobacterium
EPDAGSDVGAGRTKAVKQDDGS

SEQ ID NO: 1180546 - protein, 10 aa, Mycobacterium
EPDERSRGGS

SEQ ID NO: 1180547 - protein, 4 aa, Mycobacterium
EPDG

SEQ ID NO: 1180548 - protein, 8 aa, Mycobacterium
EPDGPAAL

SEQ ID NO: 1180549 - protein, 17 aa, Mycobacterium
EPDPREMHAGPAAQVGG

SEQ ID NO: 1180550 - protein, 7 aa, Mycobacterium
EPEHHTP

SEQ ID NO: 1180551 - protein, 13 aa, Mycobacterium
EPEHTADTTGAGT

SEQ ID NO: 1180552 - protein, 6 aa, Mycobacterium
EPERHH

SEQ ID NO: 1180553 - protein, 9 aa, Mycobacterium
EPGAGSDLA

SEQ ID NO: 1180554 - protein, 10 aa, Mycobacterium
EPGAGSDLAG

SEQ ID NO: 1180555 - protein, 8 aa, Mycobacterium
EPGKEHRI

SEQ ID NO: 1180556 - protein, 5 aa, Mycobacterium
EPGQR

SEQ ID NO: 1180557 - protein, 36 aa, Mycobacterium
EPGTPPPGVAGQDAYGIGGPSVTLPNQTPPPAPPVQ

SEQ ID NO: 1180558 - protein, 5 aa, Mycobacterium
EPHGV

SEQ ID NO: 1180559 - protein, 5 aa, Mycobacterium
EPHRD

SEQ ID NO: 1180560 - protein, 16 aa, Mycobacterium
EPIDPDDEGMSDYSGP

SEQ ID NO: 1180561 - protein, 4 aa, Mycobacterium
EPIR

SEQ ID NO: 1180562 - protein, 9 aa, Mycobacterium
EPISSQGAS

SEQ ID NO: 1180563 - protein, 12 aa, Mycobacterium
EPKYTQMSGSRD

SEQ ID NO: 1180564 - protein, 4 aa, Mycobacterium
EPLA

SEQ ID NO: 1180565 - protein, 6 aa, Mycobacterium
EPLDTQ

SEQ ID NO: 1180566 - protein, 13 aa, Mycobacterium
EPLTPGGFRAPNT

SEQ ID NO: 1180567 - protein, 4 aa, Mycobacterium
EPMG

SEQ ID NO: 1180568 - protein, 19 aa, Mycobacterium
EPNAPVKSAYDDNVTDYRD

SEQ ID NO: 1180569 - protein, 10 aa, Mycobacterium
EPPAAPDPLR

SEQ ID NO: 1180570 - protein, 9 aa, Mycobacterium
EPPAGRTVA

SEQ ID NO: 1180571 - protein, 9 aa, Mycobacterium
EPPAGSGLK

SEQ ID NO: 1180572 - protein, 8 aa, Mycobacterium
EPPDPDGK

SEQ ID NO: 1180573 - protein, 10 aa, Mycobacterium
EPPGAPDPLR

SEQ ID NO: 1180574 - protein, 10 aa, Mycobacterium
EPPGTVPDRG

SEQ ID NO: 1180575 - protein, 40 aa, Mycobacterium
EPPKKTSPKKTEQKKPDRKPEKPAADSGGQERRRRRDKAK

SEQ ID NO: 1180576 - protein, 42 aa, Mycobacterium
EPPPQPEPEPEPDAVSDADVEPKPLPGPADLQPSITTTSDEQ

SEQ ID NO: 1180577 - protein, 7 aa, Mycobacterium
EPPQGGS

SEQ ID NO: 1180578 - protein, 5 aa, Mycobacterium
EPPTD

SEQ ID NO: 1180579 - protein, 6 aa, Mycobacterium
EPQPTQ

SEQ ID NO: 1180580 - protein, 4 aa, Mycobacterium
EPRH

SEQ ID NO: 1180581 - protein, 5 aa, Mycobacterium
EPRPY

SEQ ID NO: 1180582 - protein, 4 aa, Mycobacterium
EPSP

SEQ ID NO: 1180583 - protein, 8 aa, Mycobacterium
EPSRAPGL

SEQ ID NO: 1180584 - protein, 4 aa, Mycobacterium
EPSV

SEQ ID NO: 1180585 - protein, 14 aa, Mycobacterium
EPTACPSITEGEYR

SEQ ID NO: 1180586 - protein, 5 aa, Mycobacterium
EPTDA

SEQ ID NO: 1180587 - protein, 8 aa, Mycobacterium
EPTDPPEL

SEQ ID NO: 1180588 - protein, 7 aa, Mycobacterium
EPTEDGT

SEQ ID NO: 1180589 - protein, 6 aa, Mycobacterium
EPTRAE

SEQ ID NO: 1180590 - protein, 5 aa, Mycobacterium
EPWRG

SEQ ID NO: 1180591 - protein, 12 aa, Mycobacterium
EQAAGAAGHDLG

SEQ ID NO: 1180592 - protein, 7 aa, Mycobacterium
EQADAQM

SEQ ID NO: 1180593 - protein, 14 aa, Mycobacterium
EQALETRNDAQAAR

SEQ ID NO: 1180594 - protein, 7 aa, Mycobacterium
EQARETV

SEQ ID NO: 1180595 - protein, 21 aa, Mycobacterium
EQATTYTATYTASSGANLAQV

SEQ ID NO: 1180596 - protein, 7 aa, Mycobacterium
EQDGSRQ

SEQ ID NO: 1180597 - protein, 4 aa, Mycobacterium
EQDP

SEQ ID NO: 1180598 - protein, 7 aa, Mycobacterium
EQDYGKT

SEQ ID NO: 1180599 - protein, 7 aa, Mycobacterium
EQEKNGI

SEQ ID NO: 1180600 - protein, 9 aa, Mycobacterium
EQGALDDPS

SEQ ID NO: 1180601 - protein, 15 aa, Mycobacterium
EQGVGGYEQGYARDR

SEQ ID NO: 1180602 - protein, 14 aa, Mycobacterium
EQHERAARAHEDAA

SEQ ID NO: 1180603 - protein, 5 aa, Mycobacterium
EQIER

SEQ ID NO: 1180604 - protein, 4 aa, Mycobacterium
EQLD

SEQ ID NO: 1180605 - protein, 5 aa, Mycobacterium
EQLEK

SEQ ID NO: 1180606 - protein, 5 aa, Mycobacterium
EQLPD

SEQ ID NO: 1180607 - protein, 4 aa, Mycobacterium
EQMS

SEQ ID NO: 1180608 - protein, 15 aa, Mycobacterium
EQPGDQEDRAGEPFV

SEQ ID NO: 1180609 - protein, 6 aa, Mycobacterium
EQPRRS

SEQ ID NO: 1180610 - protein, 6 aa, Mycobacterium
EQPTVE

SEQ ID NO: 1180611 - protein, 9 aa, Mycobacterium
EQRENVTGA

SEQ ID NO: 1180612 - protein, 17 aa, Mycobacterium
EQRNGRIQRNGNQHATA

SEQ ID NO: 1180613 - protein, 6 aa, Mycobacterium
EQRNSD

SEQ ID NO: 1180614 - protein, 5 aa, Mycobacterium
EQRPI

SEQ ID NO: 1180615 - protein, 4 aa, Mycobacterium
EQRR

SEQ ID NO: 1180616 - protein, 7 aa, Mycobacterium
EQRRERW

SEQ ID NO: 1180617 - protein, 8 aa, Mycobacterium
EQRREYRR

SEQ ID NO: 1180618 - protein, 8 aa, Mycobacterium
EQRTRPGQ

SEQ ID NO: 1180619 - protein, 9 aa, Mycobacterium
EQRVPPEKL

SEQ ID NO: 1180620 - protein, 9 aa, Mycobacterium
EQSDQQIAD

SEQ ID NO: 1180621 - protein, 9 aa, Mycobacterium
EQSLAGQQC

SEQ ID NO: 1180622 - protein, 6 aa, Mycobacterium
EQSPGV

SEQ ID NO: 1180623 - protein, 7 aa, Mycobacterium
EQSRGVA

SEQ ID NO: 1180624 - protein, 8 aa, Mycobacterium
EQSRGVAR

SEQ ID NO: 1180625 - protein, 5 aa, Mycobacterium
EQSVE

SEQ ID NO: 1180626 - protein, 7 aa, Mycobacterium
EQSWTSR

SEQ ID NO: 1180627 - protein, 4 aa, Mycobacterium
EQTG

SEQ ID NO: 1180628 - protein, 6 aa, Mycobacterium
EQTLPG

SEQ ID NO: 1180629 - protein, 10 aa, Mycobacterium
EQVEAQRAEA

SEQ ID NO: 1180630 - protein, 5 aa, Mycobacterium
EQVED

SEQ ID NO: 1180631 - protein, 9 aa, Mycobacterium
EQVQPGPVR

SEQ ID NO: 1180632 - protein, 4 aa, Mycobacterium
EQVS

SEQ ID NO: 1180633 - protein, 10 aa, Mycobacterium
EQYGGGGGGI

SEQ ID NO: 1180634 - protein, 10 aa, Mycobacterium
ERAALTTDEV

SEQ ID NO: 1180635 - protein, 23 aa, Mycobacterium
ERADIAEDATCREPAPATSNARR

SEQ ID NO: 1180636 - protein, 13 aa, Mycobacterium
ERAGKGKTLRTNR

SEQ ID NO: 1180637 - protein, 12 aa, Mycobacterium
ERAGQSQGLTPR

SEQ ID NO: 1180638 - protein, 7 aa, Mycobacterium
ERAGVRR

SEQ ID NO: 1180639 - protein, 6 aa, Mycobacterium
ERAGVS

SEQ ID NO: 1180640 - protein, 8 aa, Mycobacterium
ERANSTQE

SEQ ID NO: 1180641 - protein, 14 aa, Mycobacterium
ERAPDGVTVTDEHR

SEQ ID NO: 1180642 - protein, 23 aa, Mycobacterium
ERAQSQTDLAAKAASYKVPTATV

SEQ ID NO: 1180643 - protein, 11 aa, Mycobacterium
ERARDTDPRRL

SEQ ID NO: 1180644 - protein, 10 aa, Mycobacterium
ERASGSPAER

SEQ ID NO: 1180645 - protein, 4 aa, Mycobacterium
ERAV

SEQ ID NO: 1180646 - protein, 9 aa, Mycobacterium
ERAVPPYET

SEQ ID NO: 1180647 - protein, 4 aa, Mycobacterium
ERDG

SEQ ID NO: 1180648 - protein, 8 aa, Mycobacterium
ERDPAVEP

SEQ ID NO: 1180649 - protein, 15 aa, Mycobacterium
ERDPPPSDAPPLPIP

SEQ ID NO: 1180650 - protein, 7 aa, Mycobacterium
EREESAL

SEQ ID NO: 1180651 - protein, 6 aa, Mycobacterium
EREIET

SEQ ID NO: 1180652 - protein, 11 aa, Mycobacterium
ERGDATETKEV

SEQ ID NO: 1180653 - protein, 15 aa, Mycobacterium
ERGDQYRADVPAPEH

SEQ ID NO: 1180654 - protein, 10 aa, Mycobacterium
ERGEQPVAQR

SEQ ID NO: 1180655 - protein, 10 aa, Mycobacterium
ERGGDREPTV

SEQ ID NO: 1180656 - protein, 10 aa, Mycobacterium
ERGGTDGAIR

SEQ ID NO: 1180657 - protein, 4 aa, Mycobacterium
ERGL

SEQ ID NO: 1180658 - protein, 7 aa, Mycobacterium
ERGSGRR

SEQ ID NO: 1180659 - protein, 6 aa, Mycobacterium
ERHHTA

SEQ ID NO: 1180660 - protein, 16 aa, Mycobacterium
ERHRAKTGRAAVNRPA

SEQ ID NO: 1180661 - protein, 6 aa, Mycobacterium
ERHRRE

SEQ ID NO: 1180662 - protein, 7 aa, Mycobacterium
ERKRPDD

SEQ ID NO: 1180663 - protein, 4 aa, Mycobacterium
ERLE

SEQ ID NO: 1180664 - protein, 11 aa, Mycobacterium
ERLEEGIERGA

SEQ ID NO: 1180665 - protein, 6 aa, Mycobacterium
ERLGEH

SEQ ID NO: 1180666 - protein, 4 aa, Mycobacterium
ERLP

SEQ ID NO: 1180667 - protein, 34 aa, Mycobacterium
ERLREGRTIGDERLREGRTIGDERLREERTIGDE

SEQ ID NO: 1180668 - protein, 5 aa, Mycobacterium
ERLSH

SEQ ID NO: 1180669 - protein, 10 aa, Mycobacterium
ERNGHTPPDI

SEQ ID NO: 1180670 - protein, 8 aa, Mycobacterium
ERPADPFR

SEQ ID NO: 1180671 - protein, 6 aa, Mycobacterium
ERPDEV

SEQ ID NO: 1180672 - protein, 4 aa, Mycobacterium
ERPI

SEQ ID NO: 1180673 - protein, 8 aa, Mycobacterium
ERPPEDTV

SEQ ID NO: 1180674 - protein, 9 aa, Mycobacterium
ERPVDLPPG

SEQ ID NO: 1180675 - protein, 23 aa, Mycobacterium
ERQEQRGAHRDHPPRLDPPTDRQ

SEQ ID NO: 1180676 - protein, 17 aa, Mycobacterium
ERQTPEMEASGTTAGTP

SEQ ID NO: 1180677 - protein, 4 aa, Mycobacterium
ERRG

SEQ ID NO: 1180678 - protein, 12 aa, Mycobacterium
ERRGASTTVRSD

SEQ ID NO: 1180679 - protein, 11 aa, Mycobacterium
ERRHDDDWGDL

SEQ ID NO: 1180680 - protein, 10 aa, Mycobacterium
ERRHRGDDLG

SEQ ID NO: 1180681 - protein, 8 aa, Mycobacterium
ERRQSERD

SEQ ID NO: 1180682 - protein, 6 aa, Mycobacterium
ERRREP

SEQ ID NO: 1180683 - protein, 7 aa, Mycobacterium
ERRRGGM

SEQ ID NO: 1180684 - protein, 4 aa, Mycobacterium
ERRS

SEQ ID NO: 1180685 - protein, 6 aa, Mycobacterium
ERRSVD

SEQ ID NO: 1180686 - protein, 11 aa, Mycobacterium
ERSAGVAPPGV

SEQ ID NO: 1180687 - protein, 9 aa, Mycobacterium
ERSEKAAAD

SEQ ID NO: 1180688 - protein, 9 aa, Mycobacterium
ERSGGQPGA

SEQ ID NO: 1180689 - protein, 7 aa, Mycobacterium
ERSGPER

SEQ ID NO: 1180690 - protein, 4 aa, Mycobacterium
ERSL

SEQ ID NO: 1180691 - protein, 11 aa, Mycobacterium
ERSRALGSGPQ

SEQ ID NO: 1180692 - protein, 15 aa, Mycobacterium
ERSRVAAGAESRRQN

SEQ ID NO: 1180693 - protein, 10 aa, Mycobacterium
ERSTSAPPAG

SEQ ID NO: 1180694 - protein, 21 aa, Mycobacterium
ERTGGSDLGALETTATRRGDA

SEQ ID NO: 1180695 - protein, 10 aa, Mycobacterium
ERTGSPESLA

SEQ ID NO: 1180696 - protein, 13 aa, Mycobacterium
ERTHNDHRAPQPG

SEQ ID NO: 1180697 - protein, 4 aa, Mycobacterium
ERTK

SEQ ID NO: 1180698 - protein, 11 aa, Mycobacterium
ERTQPAMSSRA

SEQ ID NO: 1180699 - protein, 7 aa, Mycobacterium
ERTRADR

SEQ ID NO: 1180700 - protein, 14 aa, Mycobacterium
ERVPDDTRGNALTE

SEQ ID NO: 1180701 - protein, 12 aa, Mycobacterium
ERVRAGEPQALS

SEQ ID NO: 1180702 - protein, 16 aa, Mycobacterium
ERYDPSGVFRTGQVVR

SEQ ID NO: 1180703 - protein, 6 aa, Mycobacterium
ERYGRE

SEQ ID NO: 1180704 - protein, 11 aa, Mycobacterium
ESAADRGLPFD

SEQ ID NO: 1180705 - protein, 21 aa, Mycobacterium
ESAGAEVRQGAEVTGPELDAN

SEQ ID NO: 1180706 - protein, 10 aa, Mycobacterium
ESAGTDSDLR

SEQ ID NO: 1180707 - protein, 6 aa, Mycobacterium
ESAGVS

SEQ ID NO: 1180708 - protein, 28 aa, Mycobacterium
ESAQGRLDRSGSRAAARATLEGGAAHPA

SEQ ID NO: 1180709 - protein, 10 aa, Mycobacterium
ESARGTLGPG

SEQ ID NO: 1180710 - protein, 9 aa, Mycobacterium
ESARQFATR

SEQ ID NO: 1180711 - protein, 10 aa, Mycobacterium
ESARQFATRS

SEQ ID NO: 1180712 - protein, 7 aa, Mycobacterium
ESDGWDP

SEQ ID NO: 1180713 - protein, 9 aa, Mycobacterium
ESDPDGLEL

SEQ ID NO: 1180714 - protein, 7 aa, Mycobacterium
ESEDEAI

SEQ ID NO: 1180715 - protein, 7 aa, Mycobacterium
ESEEFGE

SEQ ID NO: 1180716 - protein, 9 aa, Mycobacterium
ESERGLSSI

SEQ ID NO: 1180717 - protein, 21 aa, Mycobacterium
ESFEEADRHPPVYDPSTRSVT

SEQ ID NO: 1180718 - protein, 13 aa, Mycobacterium
ESGAAKVIDPRGN

SEQ ID NO: 1180719 - protein, 12 aa, Mycobacterium
ESGDESDRENAQ

SEQ ID NO: 1180720 - protein, 10 aa, Mycobacterium
ESGEATEADV

SEQ ID NO: 1180721 - protein, 7 aa, Mycobacterium
ESGELAS

SEQ ID NO: 1180722 - protein, 7 aa, Mycobacterium
ESGGDTS

SEQ ID NO: 1180723 - protein, 10 aa, Mycobacterium
ESGGPELADE

SEQ ID NO: 1180724 - protein, 6 aa, Mycobacterium
ESGQGR

SEQ ID NO: 1180725 - protein, 7 aa, Mycobacterium
ESGRVEQ

SEQ ID NO: 1180726 - protein, 5 aa, Mycobacterium
ESGSL

SEQ ID NO: 1180727 - protein, 6 aa, Mycobacterium
ESGTDR

SEQ ID NO: 1180728 - protein, 6 aa, Mycobacterium
ESGVPT

SEQ ID NO: 1180729 - protein, 5 aa, Mycobacterium
ESGVT

SEQ ID NO: 1180730 - protein, 8 aa, Mycobacterium
ESGYDERE

SEQ ID NO: 1180731 - protein, 9 aa, Mycobacterium
ESGYGEAPT

SEQ ID NO: 1180732 - protein, 6 aa, Mycobacterium
ESIPID

SEQ ID NO: 1180733 - protein, 4 aa, Mycobacterium
ESKG

SEQ ID NO: 1180734 - protein, 15 aa, Mycobacterium
ESKGRNGSPAGHTAA

SEQ ID NO: 1180735 - protein, 4 aa, Mycobacterium
ESKW

SEQ ID NO: 1180736 - protein, 5 aa, Mycobacterium
ESLAR

SEQ ID NO: 1180737 - protein, 9 aa, Mycobacterium
ESLEPVPTS

SEQ ID NO: 1180738 - protein, 7 aa, Mycobacterium
ESLGARD

SEQ ID NO: 1180739 - protein, 5 aa, Mycobacterium
ESLSS

SEQ ID NO: 1180740 - protein, 7 aa, Mycobacterium
ESLTKPK

SEQ ID NO: 1180741 - protein, 4 aa, Mycobacterium
ESMP

SEQ ID NO: 1180742 - protein, 9 aa, Mycobacterium
ESNDIATDA

SEQ ID NO: 1180743 - protein, 15 aa, Mycobacterium
ESNGYPMATRDELDE

SEQ ID NO: 1180744 - protein, 5 aa, Mycobacterium
ESPDT

SEQ ID NO: 1180745 - protein, 5 aa, Mycobacterium
ESPIS

SEQ ID NO: 1180746 - protein, 8 aa, Mycobacterium
ESPRRGET

SEQ ID NO: 1180747 - protein, 8 aa, Mycobacterium
ESPSNLPE

SEQ ID NO: 1180748 - protein, 9 aa, Mycobacterium
ESQLDTPGV

SEQ ID NO: 1180749 - protein, 5 aa, Mycobacterium
ESRGG

SEQ ID NO: 1180750 - protein, 14 aa, Mycobacterium
ESSGAEDADDVAAV

SEQ ID NO: 1180751 - protein, 13 aa, Mycobacterium
ESSNDGDESEVDE

SEQ ID NO: 1180752 - protein, 16 aa, Mycobacterium
ESSRSSRTNGARTKRH

SEQ ID NO: 1180753 - protein, 24 aa, Mycobacterium
ESSTSAAQNAAAQRDADPDTAGGA

SEQ ID NO: 1180754 - protein, 4 aa, Mycobacterium
ESSV

SEQ ID NO: 1180755 - protein, 8 aa, Mycobacterium
ESTAGSAL

SEQ ID NO: 1180756 - protein, 6 aa, Mycobacterium
ESTGGF

SEQ ID NO: 1180757 - protein, 7 aa, Mycobacterium
ESTKADL

SEQ ID NO: 1180758 - protein, 10 aa, Mycobacterium
ESTRRGRAVT

SEQ ID NO: 1180759 - protein, 19 aa, Mycobacterium
ESTVASGPSTPPPVQPSPD

SEQ ID NO: 1180760 - protein, 11 aa, Mycobacterium
ESVGAGACPNI

SEQ ID NO: 1180761 - protein, 9 aa, Mycobacterium
ESVNSSYKT

SEQ ID NO: 1180762 - protein, 5 aa, Mycobacterium
ESVRT

SEQ ID NO: 1180763 - protein, 7 aa, Mycobacterium
ESYRRGE

SEQ ID NO: 1180764 - protein, 5 aa, Mycobacterium
ETADA

SEQ ID NO: 1180765 - protein, 8 aa, Mycobacterium
ETAKPGVV

SEQ ID NO: 1180766 - protein, 11 aa, Mycobacterium
ETAKQRRLERE

SEQ ID NO: 1180767 - protein, 8 aa, Mycobacterium
ETARERAD

SEQ ID NO: 1180768 - protein, 11 aa, Mycobacterium
ETASGTRAGAD

SEQ ID NO: 1180769 - protein, 8 aa, Mycobacterium
ETATRGDG

SEQ ID NO: 1180770 - protein, 6 aa, Mycobacterium
ETDAVT

SEQ ID NO: 1180771 - protein, 7 aa, Mycobacterium
ETDDDRN

SEQ ID NO: 1180772 - protein, 6 aa, Mycobacterium
ETDGRA

SEQ ID NO: 1180773 - protein, 12 aa, Mycobacterium
ETDQSGELSTRD

SEQ ID NO: 1180774 - protein, 4 aa, Mycobacterium
ETEF

SEQ ID NO: 1180775 - protein, 7 aa, Mycobacterium
ETEQKMA

SEQ ID NO: 1180776 - protein, 14 aa, Mycobacterium
ETETSVDSAEWDAD

SEQ ID NO: 1180777 - protein, 7 aa, Mycobacterium
ETGEHER

SEQ ID NO: 1180778 - protein, 13 aa, Mycobacterium
ETLRAANDRNVDE

SEQ ID NO: 1180779 - protein, 4 aa, Mycobacterium
ETLT

SEQ ID NO: 1180780 - protein, 6 aa, Mycobacterium
ETNHEI

SEQ ID NO: 1180781 - protein, 4 aa, Mycobacterium
ETNT

SEQ ID NO: 1180782 - protein, 8 aa, Mycobacterium
ETPGEVPT

SEQ ID NO: 1180783 - protein, 27 aa, Mycobacterium
ETPNRSGRAPSDGPGADVTASAPRRGP

SEQ ID NO: 1180784 - protein, 5 aa, Mycobacterium
ETPSG

SEQ ID NO: 1180785 - protein, 4 aa, Mycobacterium
ETPY

SEQ ID NO: 1180786 - protein, 18 aa, Mycobacterium
ETRDPEKAARIQEEDDAM

SEQ ID NO: 1180787 - protein, 6 aa, Mycobacterium
ETRGNP

SEQ ID NO: 1180788 - protein, 5 aa, Mycobacterium
ETSEN

SEQ ID NO: 1180789 - protein, 7 aa, Mycobacterium
ETSEVHP

SEQ ID NO: 1180790 - protein, 4 aa, Mycobacterium
ETSG

SEQ ID NO: 1180791 - protein, 5 aa, Mycobacterium
ETSLG

SEQ ID NO: 1180792 - protein, 10 aa, Mycobacterium
ETSRGRGKRT

SEQ ID NO: 1180793 - protein, 14 aa, Mycobacterium
ETSYGPDGIGTTTG

SEQ ID NO: 1180794 - protein, 7 aa, Mycobacterium
ETTEKGA

SEQ ID NO: 1180795 - protein, 5 aa, Mycobacterium
ETTGN

SEQ ID NO: 1180796 - protein, 12 aa, Mycobacterium
ETTLDDEHPGAV

SEQ ID NO: 1180797 - protein, 7 aa, Mycobacterium
ETTPTPN

SEQ ID NO: 1180798 - protein, 5 aa, Mycobacterium
ETTTN

SEQ ID NO: 1180799 - protein, 4 aa, Mycobacterium
ETVD

SEQ ID NO: 1180800 - protein, 20 aa, Mycobacterium
EVAGGEEAQSPGAEPGDGVP

SEQ ID NO: 1180801 - protein, 5 aa, Mycobacterium
EVARR

SEQ ID NO: 1180802 - protein, 8 aa, Mycobacterium
EVDAANAK

SEQ ID NO: 1180803 - protein, 4 aa, Mycobacterium
EVDG

SEQ ID NO: 1180804 - protein, 10 aa, Mycobacterium
EVDGQRVTTR

SEQ ID NO: 1180805 - protein, 16 aa, Mycobacterium
EVEDDGDTDGFTQPGA

SEQ ID NO: 1180806 - protein, 13 aa, Mycobacterium
EVEEPDGTRRQLE

SEQ ID NO: 1180807 - protein, 7 aa, Mycobacterium
EVETGGM

SEQ ID NO: 1180808 - protein, 4 aa, Mycobacterium
EVGR

SEQ ID NO: 1180809 - protein, 4 aa, Mycobacterium
EVPG

SEQ ID NO: 1180810 - protein, 9 aa, Mycobacterium
EVPGLSAGQ

SEQ ID NO: 1180811 - protein, 4 aa, Mycobacterium
EVPV

SEQ ID NO: 1180812 - protein, 15 aa, Mycobacterium
EVQAAQREAQSAFGD

SEQ ID NO: 1180813 - protein, 35 aa, Mycobacterium
EVREPSGPAPSGPAPDAAPDSFAGETPEEADKAGE

SEQ ID NO: 1180814 - protein, 12 aa, Mycobacterium
EVRGQRGYGVFR

SEQ ID NO: 1180815 - protein, 12 aa, Mycobacterium
EVSDADDPDIDD

SEQ ID NO: 1180816 - protein, 12 aa, Mycobacterium
EVSDDQENEASR

SEQ ID NO: 1180817 - protein, 8 aa, Mycobacterium
EVSDVDGV

SEQ ID NO: 1180818 - protein, 8 aa, Mycobacterium
EVTGSLDD

SEQ ID NO: 1180819 - protein, 8 aa, Mycobacterium
EVTNENPF

SEQ ID NO: 1180820 - protein, 6 aa, Mycobacterium
EVTPPP

SEQ ID NO: 1180821 - protein, 7 aa, Mycobacterium
EWGPQRP

SEQ ID NO: 1180822 - protein, 5 aa, Mycobacterium
EWGRT

SEQ ID NO: 1180823 - protein, 5 aa, Mycobacterium
EYADD

SEQ ID NO: 1180824 - protein, 46 aa, Mycobacterium
EYAKTDEQAAGALGSSMRGSDGSGTPAAGGGGAAWQSAGAQPGVGE

SEQ ID NO: 1180825 - protein, 13 aa, Mycobacterium
EYEGVSARGRGMA

SEQ ID NO: 1180826 - protein, 11 aa, Mycobacterium
EYEPGEPRGTD

SEQ ID NO: 1180827 - protein, 11 aa, Mycobacterium
EYGPVRGTDDG

SEQ ID NO: 1180828 - protein, 9 aa, Mycobacterium
EYKRDDGEG

SEQ ID NO: 1180829 - protein, 8 aa, Mycobacterium
EYPDRDPR

SEQ ID NO: 1180830 - protein, 15 aa, Mycobacterium
EYPNLDEPALPPGEA

SEQ ID NO: 1180831 - protein, 10 aa, Mycobacterium
EYPRDWPRPQ

SEQ ID NO: 1180832 - protein, 10 aa, Mycobacterium
EYQGETLPAG

SEQ ID NO: 1180833 - protein, 6 aa, Mycobacterium
EYQHTP

SEQ ID NO: 1180834 - protein, 5 aa, Mycobacterium
EYRES

SEQ ID NO: 1180835 - protein, 4 aa, Mycobacterium
EYRP

SEQ ID NO: 1180836 - protein, 8 aa, Mycobacterium
EYSAGDTP

SEQ ID NO: 1180837 - protein, 4 aa, Mycobacterium
EYTD

SEQ ID NO: 1180838 - protein, 8 aa, Mycobacterium
FAGGTAAV

SEQ ID NO: 1180839 - protein, 5 aa, Mycobacterium
FAGQG

SEQ ID NO: 1180840 - protein, 26 aa, Mycobacterium
FAKPGKSADYQQMGAQAARAALADAG

SEQ ID NO: 1180841 - protein, 5 aa, Mycobacterium
FAPDE

SEQ ID NO: 1180842 - protein, 8 aa, Mycobacterium
FAPSARDH

SEQ ID NO: 1180843 - protein, 7 aa, Mycobacterium
FAPTETA

SEQ ID NO: 1180844 - protein, 4 aa, Mycobacterium
FAQR

SEQ ID NO: 1180845 - protein, 7 aa, Mycobacterium
FASAADL

SEQ ID NO: 1180846 - protein, 9 aa, Mycobacterium
FASEADRPT

SEQ ID NO: 1180847 - protein, 11 aa, Mycobacterium
FDASQGMPRST

SEQ ID NO: 1180848 - protein, 10 aa, Mycobacterium
FDDGDPPARL

SEQ ID NO: 1180849 - protein, 13 aa, Mycobacterium
FDGPSEGQPENPY

SEQ ID NO: 1180850 - protein, 10 aa, Mycobacterium
FDGTPTQAVG

SEQ ID NO: 1180851 - protein, 6 aa, Mycobacterium
FDKDRD

SEQ ID NO: 1180852 - protein, 4 aa, Mycobacterium
FDNE

SEQ ID NO: 1180853 - protein, 18 aa, Mycobacterium
FDPESGVHSGSADPYSSG

SEQ ID NO: 1180854 - protein, 4 aa, Mycobacterium
FDPT

SEQ ID NO: 1180855 - protein, 6 aa, Mycobacterium
FDPTTS

SEQ ID NO: 1180856 - protein, 5 aa, Mycobacterium
FDQRA

SEQ ID NO: 1180857 - protein, 9 aa, Mycobacterium
FDRSTAAAV

SEQ ID NO: 1180858 - protein, 9 aa, Mycobacterium
FDSGGDTNT

SEQ ID NO: 1180859 - protein, 10 aa, Mycobacterium
FDSGSGWPSF

SEQ ID NO: 1180860 - protein, 9 aa, Mycobacterium
FDTGGTEGM

SEQ ID NO: 1180861 - protein, 4 aa, Mycobacterium
FDTR

SEQ ID NO: 1180862 - protein, 18 aa, Mycobacterium
FEEAERRRAEGRSYTKND

SEQ ID NO: 1180863 - protein, 8 aa, Mycobacterium
FEGGGASK

SEQ ID NO: 1180864 - protein, 9 aa, Mycobacterium
FEGHPDNAA

SEQ ID NO: 1180865 - protein, 6 aa, Mycobacterium
FEPESR

SEQ ID NO: 1180866 - protein, 6 aa, Mycobacterium
FEPNGV

SEQ ID NO: 1180867 - protein, 5 aa, Mycobacterium
FERRA

SEQ ID NO: 1180868 - protein, 4 aa, Mycobacterium
FETE

SEQ ID NO: 1180869 - protein, 8 aa, Mycobacterium
FEVPPDDA

SEQ ID NO: 1180870 - protein, 11 aa, Mycobacterium
FGAAGSGHAGA

SEQ ID NO: 1180871 - protein, 11 aa, Mycobacterium
FGDDPNRYTTA

SEQ ID NO: 1180872 - protein, 7 aa, Mycobacterium
FGDPSGD

SEQ ID NO: 1180873 - protein, 36 aa, Mycobacterium
FGGGADISADATDNSADVNVNGANDVANNAAAEAQE

SEQ ID NO: 1180874 - protein, 19 aa, Mycobacterium
FGGGGAGAGASNAGPGSVP

SEQ ID NO: 1180875 - protein, 11 aa, Mycobacterium
FGPAGGGHGGG

SEQ ID NO: 1180876 - protein, 4 aa, Mycobacterium
FGPD

SEQ ID NO: 1180877 - protein, 5 aa, Mycobacterium
FGPGG

SEQ ID NO: 1180878 - protein, 8 aa, Mycobacterium
FGPQGGTR

SEQ ID NO: 1180879 - protein, 13 aa, Mycobacterium
FGPTTPELERTDL

SEQ ID NO: 1180880 - protein, 8 aa, Mycobacterium
FGRDGDDL

SEQ ID NO: 1180881 - protein, 10 aa, Mycobacterium
FGRDSDFSGW

SEQ ID NO: 1180882 - protein, 4 aa, Mycobacterium
FGSE

SEQ ID NO: 1180883 - protein, 4 aa, Mycobacterium
FGST

SEQ ID NO: 1180884 - protein, 7 aa, Mycobacterium
FGTPTFT

SEQ ID NO: 1180885 - protein, 5 aa, Mycobacterium
FGVGG

SEQ ID NO: 1180886 - protein, 11 aa, Mycobacterium
FHESGGPKANI

SEQ ID NO: 1180887 - protein, 5 aa, Mycobacterium
FHQGE

SEQ ID NO: 1180888 - protein, 55 aa, Mycobacterium
FHTPEKGRNNFSYSASKAAAHADQTPGDRTGAEDPRQRDRARPVSVADDQGAARR

SEQ ID NO: 1180889 - protein, 7 aa, Mycobacterium
FKGEEAA

SEQ ID NO: 1180890 - protein, 10 aa, Mycobacterium
FKKSSENTRA

SEQ ID NO: 1180891 - protein, 7 aa, Mycobacterium
FKPDLTQ

SEQ ID NO: 1180892 - protein, 9 aa, Mycobacterium
FKRKGHSAR

SEQ ID NO: 1180893 - protein, 7 aa, Mycobacterium
FNSPAGD

SEQ ID NO: 1180894 - protein, 7 aa, Mycobacterium
FNSTPDM

SEQ ID NO: 1180895 - protein, 5 aa, Mycobacterium
FPATN

SEQ ID NO: 1180896 - protein, 5 aa, Mycobacterium
FPDKD

SEQ ID NO: 1180897 - protein, 4 aa, Mycobacterium
FPDR

SEQ ID NO: 1180898 - protein, 6 aa, Mycobacterium
FPEQHA

SEQ ID NO: 1180899 - protein, 11 aa, Mycobacterium
FPPPDPRPVEE

SEQ ID NO: 1180900 - protein, 34 aa, Mycobacterium
FPPPPPGAPLPPPPPGAPLPPPPPGAPLPPPPVA

SEQ ID NO: 1180901 - protein, 12 aa, Mycobacterium
FPPQTAGQVPLG

SEQ ID NO: 1180902 - protein, 12 aa, Mycobacterium
FPSDGSTSNRSA

SEQ ID NO: 1180903 - protein, 5 aa, Mycobacterium
FPTEP

SEQ ID NO: 1180904 - protein, 8 aa, Mycobacterium
FPTPPGSD

SEQ ID NO: 1180905 - protein, 6 aa, Mycobacterium
FPTPSR

SEQ ID NO: 1180906 - protein, 4 aa, Mycobacterium
FPTR

SEQ ID NO: 1180907 - protein, 10 aa, Mycobacterium
FPYSNTVGPE

SEQ ID NO: 1180908 - protein, 9 aa, Mycobacterium
FQGTHPSVG

SEQ ID NO: 1180909 - protein, 6 aa, Mycobacterium
FQTGQP

SEQ ID NO: 1180910 - protein, 15 aa, Mycobacterium
FRDPAADEPQAPPEW

SEQ ID NO: 1180911 - protein, 18 aa, Mycobacterium
FRDTSADTVRHRGGVWSD

SEQ ID NO: 1180912 - protein, 6 aa, Mycobacterium
FRPGDD

SEQ ID NO: 1180913 - protein, 8 aa, Mycobacterium
FRTTDEYQ

SEQ ID NO: 1180914 - protein, 6 aa, Mycobacterium
FSDEDG

SEQ ID NO: 1180915 - protein, 7 aa, Mycobacterium
FSDTPDY

SEQ ID NO: 1180916 - protein, 8 aa, Mycobacterium
FSLGSSKR

SEQ ID NO: 1180917 - protein, 10 aa, Mycobacterium
FSNGNSNPAL

SEQ ID NO: 1180918 - protein, 15 aa, Mycobacterium
FSPGPNDEDSPARRV

SEQ ID NO: 1180919 - protein, 10 aa, Mycobacterium
FSPGRDTPVN

SEQ ID NO: 1180920 - protein, 11 aa, Mycobacterium
FSPSAAARTLN

SEQ ID NO: 1180921 - protein, 9 aa, Mycobacterium
FSSTTRKSL

SEQ ID NO: 1180922 - protein, 7 aa, Mycobacterium
FSTGADM

SEQ ID NO: 1180923 - protein, 4 aa, Mycobacterium
FTAG

SEQ ID NO: 1180924 - protein, 10 aa, Mycobacterium
FTASDETETV

SEQ ID NO: 1180925 - protein, 7 aa, Mycobacterium
FTASEPN

SEQ ID NO: 1180926 - protein, 7 aa, Mycobacterium
FTDPEQR

SEQ ID NO: 1180927 - protein, 4 aa, Mycobacterium
FTGG

SEQ ID NO: 1180928 - protein, 9 aa, Mycobacterium
FTPAAPPRF

SEQ ID NO: 1180929 - protein, 4 aa, Mycobacterium
FTPE

SEQ ID NO: 1180930 - protein, 9 aa, Mycobacterium
FTPEGDDIT

SEQ ID NO: 1180931 - protein, 12 aa, Mycobacterium
FTPGALRPAAGS

SEQ ID NO: 1180932 - protein, 11 aa, Mycobacterium
FTPGDRAAARA

SEQ ID NO: 1180933 - protein, 7 aa, Mycobacterium
FTPPTDI

SEQ ID NO: 1180934 - protein, 6 aa, Mycobacterium
FTPRQV

SEQ ID NO: 1180935 - protein, 9 aa, Mycobacterium
FTPRSSDRL

SEQ ID NO: 1180936 - protein, 8 aa, Mycobacterium
FVGPPQDG

SEQ ID NO: 1180937 - protein, 11 aa, Mycobacterium
FYAAGGGPLYT

SEQ ID NO: 1180938 - protein, 9 aa, Mycobacterium
GAAAARARQ

SEQ ID NO: 1180939 - protein, 16 aa, Mycobacterium
GAAAASSPKDTAARAE

SEQ ID NO: 1180940 - protein, 13 aa, Mycobacterium
GAAAERQETDAEL

SEQ ID NO: 1180941 - protein, 15 aa, Mycobacterium
GAADDDAGFAPREPT

SEQ ID NO: 1180942 - protein, 10 aa, Mycobacterium
GAADEQADVR

SEQ ID NO: 1180943 - protein, 10 aa, Mycobacterium
GAADREWDPD

SEQ ID NO: 1180944 - protein, 12 aa, Mycobacterium
GAADWSKRPLPD

SEQ ID NO: 1180945 - protein, 12 aa, Mycobacterium
GAAEIARARTPH

SEQ ID NO: 1180946 - protein, 5 aa, Mycobacterium
GAAER

SEQ ID NO: 1180947 - protein, 5 aa, Mycobacterium
GAAET

SEQ ID NO: 1180948 - protein, 5 aa, Mycobacterium
GAAGL

SEQ ID NO: 1180949 - protein, 6 aa, Mycobacterium
GAAGLS

SEQ ID NO: 1180950 - protein, 11 aa, Mycobacterium
GAAGRDRARAR

SEQ ID NO: 1180951 - protein, 5 aa, Mycobacterium
GAAID

SEQ ID NO: 1180952 - protein, 10 aa, Mycobacterium
GAAIGDQPRF

SEQ ID NO: 1180953 - protein, 4 aa, Mycobacterium
GAAP

SEQ ID NO: 1180954 - protein, 11 aa, Mycobacterium
GAAPAARPSVE

SEQ ID NO: 1180955 - protein, 21 aa, Mycobacterium
GAAPTTAADSLANSARGLAPV

SEQ ID NO: 1180956 - protein, 10 aa, Mycobacterium
GAAQADNVAD

SEQ ID NO: 1180957 - protein, 5 aa, Mycobacterium
GAARD

SEQ ID NO: 1180958 - protein, 9 aa, Mycobacterium
GAARKPTVS

SEQ ID NO: 1180959 - protein, 11 aa, Mycobacterium
GAARPAKDRPI

SEQ ID NO: 1180960 - protein, 6 aa, Mycobacterium
GAASPI

SEQ ID NO: 1180961 - protein, 5 aa, Mycobacterium
GAATR

SEQ ID NO: 1180962 - protein, 6 aa, Mycobacterium
GADAAR

SEQ ID NO: 1180963 - protein, 12 aa, Mycobacterium
GADAGARGLPRQ

SEQ ID NO: 1180964 - protein, 4 aa, Mycobacterium
GADG

SEQ ID NO: 1180965 - protein, 7 aa, Mycobacterium
GADGATG

SEQ ID NO: 1180966 - protein, 5 aa, Mycobacterium
GADPQ

SEQ ID NO: 1180967 - protein, 4 aa, Mycobacterium
GADR

SEQ ID NO: 1180968 - protein, 29 aa, Mycobacterium
GAEANASQKVADDPDAKITEKPEVTDEHR

SEQ ID NO: 1180969 - protein, 6 aa, Mycobacterium
GAEEGD

SEQ ID NO: 1180970 - protein, 7 aa, Mycobacterium
GAEEGRD

SEQ ID NO: 1180971 - protein, 9 aa, Mycobacterium
GAEPTAERR

SEQ ID NO: 1180972 - protein, 26 aa, Mycobacterium
GAERKKSQFPQLDPPADDYPTFPDKS

SEQ ID NO: 1180973 - protein, 7 aa, Mycobacterium
GAETADG

SEQ ID NO: 1180974 - protein, 5 aa, Mycobacterium
GAEYP

SEQ ID NO: 1180975 - protein, 9 aa, Mycobacterium
GAGAGGGIG

SEQ ID NO: 1180976 - protein, 9 aa, Mycobacterium
GAGAQPRGM

SEQ ID NO: 1180977 - protein, 9 aa, Mycobacterium
GAGDYLPPY

SEQ ID NO: 1180978 - protein, 7 aa, Mycobacterium
GAGEKLK

SEQ ID NO: 1180979 - protein, 8 aa, Mycobacterium
GAGEPSRH

SEQ ID NO: 1180980 - protein, 6 aa, Mycobacterium
GAGETL

SEQ ID NO: 1180981 - protein, 9 aa, Mycobacterium
GAGKKPVTV

SEQ ID NO: 1180982 - protein, 8 aa, Mycobacterium
GAGKVDKG

SEQ ID NO: 1180983 - protein, 7 aa, Mycobacterium
GAGPIGA

SEQ ID NO: 1180984 - protein, 5 aa, Mycobacterium
GAGQF

SEQ ID NO: 1180985 - protein, 7 aa, Mycobacterium
GAGRALE

SEQ ID NO: 1180986 - protein, 8 aa, Mycobacterium
GAGRGIGR

SEQ ID NO: 1180987 - protein, 7 aa, Mycobacterium
GAGRGLG

SEQ ID NO: 1180988 - protein, 5 aa, Mycobacterium
GAGRL

SEQ ID NO: 1180989 - protein, 13 aa, Mycobacterium
GAGSSGAPTPGCG

SEQ ID NO: 1180990 - protein, 4 aa, Mycobacterium
GAGT

SEQ ID NO: 1180991 - protein, 7 aa, Mycobacterium
GAGTGTN

SEQ ID NO: 1180992 - protein, 5 aa, Mycobacterium
GAHYP

SEQ ID NO: 1180993 - protein, 15 aa, Mycobacterium
GAIDSRSGERGGLQR

SEQ ID NO: 1180994 - protein, 11 aa, Mycobacterium
GAIGRNRGGRI

SEQ ID NO: 1180995 - protein, 7 aa, Mycobacterium
GAIPPEA

SEQ ID NO: 1180996 - protein, 8 aa, Mycobacterium
GAKKPSVA

SEQ ID NO: 1180997 - protein, 7 aa, Mycobacterium
GAKPTAV

SEQ ID NO: 1180998 - protein, 12 aa, Mycobacterium
GALASSREVTGR

SEQ ID NO: 1180999 - protein, 20 aa, Mycobacterium
GALEGSRDDRAAQANGGTKT

SEQ ID NO: 1181000 - protein, 15 aa, Mycobacterium
GANATAARTVTAPTS

SEQ ID NO: 1181001 - protein, 4 aa, Mycobacterium
GANH

SEQ ID NO: 1181002 - protein, 8 aa, Mycobacterium
GANRGETK

SEQ ID NO: 1181003 - protein, 7 aa, Mycobacterium
GANRGLG

SEQ ID NO: 1181004 - protein, 37 aa, Mycobacterium
GANSRRSGRAQQVNTYTDDAVDEDADADSDGGTFAMT

SEQ ID NO: 1181005 - protein, 4 aa, Mycobacterium
GAPA

SEQ ID NO: 1181006 - protein, 7 aa, Mycobacterium
GAPAERP

SEQ ID NO: 1181007 - protein, 19 aa, Mycobacterium
GAPAPTGFRGPGYSTSPTL

SEQ ID NO: 1181008 - protein, 6 aa, Mycobacterium
GAPARH

SEQ ID NO: 1181009 - protein, 23 aa, Mycobacterium
GAPARRRDTGAAASPVGDGAGPR

SEQ ID NO: 1181010 - protein, 13 aa, Mycobacterium
GAPDDVQAGKQAQ

SEQ ID NO: 1181011 - protein, 6 aa, Mycobacterium
GAPDTV

SEQ ID NO: 1181012 - protein, 13 aa, Mycobacterium
GAPEGPDEALRTE

SEQ ID NO: 1181013 - protein, 9 aa, Mycobacterium
GAPGDATGV

SEQ ID NO: 1181014 - protein, 7 aa, Mycobacterium
GAPGQWS

SEQ ID NO: 1181015 - protein, 5 aa, Mycobacterium
GAPGY

SEQ ID NO: 1181016 - protein, 9 aa, Mycobacterium
GAPIPAPPN

SEQ ID NO: 1181017 - protein, 18 aa, Mycobacterium
GAPLQQTDRVTPPASTPV

SEQ ID NO: 1181018 - protein, 8 aa, Mycobacterium
GAPNDRRL

SEQ ID NO: 1181019 - protein, 4 aa, Mycobacterium
GAPP

SEQ ID NO: 1181020 - protein, 5 aa, Mycobacterium
GAPPH

SEQ ID NO: 1181021 - protein, 17 aa, Mycobacterium
GAPRAVTHGPQLDAPLE

SEQ ID NO: 1181022 - protein, 6 aa, Mycobacterium
GAPRNR

SEQ ID NO: 1181023 - protein, 5 aa, Mycobacterium
GAPSV

SEQ ID NO: 1181024 - protein, 11 aa, Mycobacterium
GAPTYTLGSTP

SEQ ID NO: 1181025 - protein, 7 aa, Mycobacterium
GAPVGSA

SEQ ID NO: 1181026 - protein, 9 aa, Mycobacterium
GAPVTARDI

SEQ ID NO: 1181027 - protein, 4 aa, Mycobacterium
GAQA

SEQ ID NO: 1181028 - protein, 13 aa, Mycobacterium
GAQASGRTALERA

SEQ ID NO: 1181029 - protein, 5 aa, Mycobacterium
GAQAW

SEQ ID NO: 1181030 - protein, 16 aa, Mycobacterium
GAQSAESRPLTYGQSV

SEQ ID NO: 1181031 - protein, 5 aa, Mycobacterium
GARAT

SEQ ID NO: 1181032 - protein, 19 aa, Mycobacterium
GARDAGAECDRIPDATPGV

SEQ ID NO: 1181033 - protein, 7 aa, Mycobacterium
GARDFGS

SEQ ID NO: 1181034 - protein, 11 aa, Mycobacterium
GARFDEATPGR

SEQ ID NO: 1181035 - protein, 5 aa, Mycobacterium
GARGV

SEQ ID NO: 1181036 - protein, 6 aa, Mycobacterium
GARPPD

SEQ ID NO: 1181037 - protein, 5 aa, Mycobacterium
GARPV

SEQ ID NO: 1181038 - protein, 20 aa, Mycobacterium
GARPVSVDPRTISASTPVDA

SEQ ID NO: 1181039 - protein, 8 aa, Mycobacterium
GARRTPTF

SEQ ID NO: 1181040 - protein, 8 aa, Mycobacterium
GARSDGHD

SEQ ID NO: 1181041 - protein, 9 aa, Mycobacterium
GARSDGHDF

SEQ ID NO: 1181042 - protein, 8 aa, Mycobacterium
GASAEQPL

SEQ ID NO: 1181043 - protein, 9 aa, Mycobacterium
GASAPAPDQ

SEQ ID NO: 1181044 - protein, 6 aa, Mycobacterium
GASGQR

SEQ ID NO: 1181045 - protein, 9 aa, Mycobacterium
GASLTPDEL

SEQ ID NO: 1181046 - protein, 9 aa, Mycobacterium
GASPRPGLD

SEQ ID NO: 1181047 - protein, 5 aa, Mycobacterium
GASRS

SEQ ID NO: 1181048 - protein, 8 aa, Mycobacterium
GASSALQD

SEQ ID NO: 1181049 - protein, 9 aa, Mycobacterium
GASSGIGAA

SEQ ID NO: 1181050 - protein, 10 aa, Mycobacterium
GASYPTTDQT

SEQ ID NO: 1181051 - protein, 9 aa, Mycobacterium
GATAAGAYS

SEQ ID NO: 1181052 - protein, 12 aa, Mycobacterium
GATAHAAGGPVS

SEQ ID NO: 1181053 - protein, 13 aa, Mycobacterium
GATERSGLSADDV

SEQ ID NO: 1181054 - protein, 9 aa, Mycobacterium
GATGNFTQT

SEQ ID NO: 1181055 - protein, 19 aa, Mycobacterium
GATGSVSVTGSTDAAAPAV

SEQ ID NO: 1181056 - protein, 4 aa, Mycobacterium
GATH

SEQ ID NO: 1181057 - protein, 6 aa, Mycobacterium
GATNRE

SEQ ID NO: 1181058 - protein, 17 aa, Mycobacterium
GATRGGKPFAGPEIATR

SEQ ID NO: 1181059 - protein, 9 aa, Mycobacterium
GATRQSPSL

SEQ ID NO: 1181060 - protein, 6 aa, Mycobacterium
GATRRN

SEQ ID NO: 1181061 - protein, 5 aa, Mycobacterium
GATTA

SEQ ID NO: 1181062 - protein, 14 aa, Mycobacterium
GAVEGVKGKAKEVA

SEQ ID NO: 1181063 - protein, 18 aa, Mycobacterium
GAVEQRTVEADPSDVPGL

SEQ ID NO: 1181064 - protein, 11 aa, Mycobacterium
GAVRDPDTGEW

SEQ ID NO: 1181065 - protein, 17 aa, Mycobacterium
GAVRTRTRGARPGGSKR

SEQ ID NO: 1181066 - protein, 9 aa, Mycobacterium
GAWPATAVT

SEQ ID NO: 1181067 - protein, 8 aa, Mycobacterium
GCDPAGFD

SEQ ID NO: 1181068 - protein, 5 aa, Mycobacterium
GCGRP

SEQ ID NO: 1181069 - protein, 5 aa, Mycobacterium
GCPDA

SEQ ID NO: 1181070 - protein, 11 aa, Mycobacterium
GCRSGKTYTTP

SEQ ID NO: 1181071 - protein, 4 aa, Mycobacterium
GCTA

SEQ ID NO: 1181072 - protein, 4 aa, Mycobacterium
GCTH

SEQ ID NO: 1181073 - protein, 7 aa, Mycobacterium
GDAARYA

SEQ ID NO: 1181074 - protein, 7 aa, Mycobacterium
GDADNAV

SEQ ID NO: 1181075 - protein, 15 aa, Mycobacterium
GDADPDVAVPARRED

SEQ ID NO: 1181076 - protein, 19 aa, Mycobacterium
GDAGGYKSEPMWGPGGSEA

SEQ ID NO: 1181077 - protein, 6 aa, Mycobacterium
GDAGPI

SEQ ID NO: 1181078 - protein, 13 aa, Mycobacterium
GDALRADPARHHT

SEQ ID NO: 1181079 - protein, 13 aa, Mycobacterium
GDANRQDLVEPTR

SEQ ID NO: 1181080 - protein, 5 aa, Mycobacterium
GDASH

SEQ ID NO: 1181081 - protein, 8 aa, Mycobacterium
GDATGATV

SEQ ID NO: 1181082 - protein, 13 aa, Mycobacterium
GDDADVPVSDREE

SEQ ID NO: 1181083 - protein, 9 aa, Mycobacterium
GDDAVAQGG

SEQ ID NO: 1181084 - protein, 7 aa, Mycobacterium
GDDDGRW

SEQ ID NO: 1181085 - protein, 5 aa, Mycobacterium
GDDEP

SEQ ID NO: 1181086 - protein, 10 aa, Mycobacterium
GDDLDSAAAA

SEQ ID NO: 1181087 - protein, 7 aa, Mycobacterium
GDDPAEI

SEQ ID NO: 1181088 - protein, 17 aa, Mycobacterium
GDDPAVPAVTEPPPRTG

SEQ ID NO: 1181089 - protein, 10 aa, Mycobacterium
GDDSDLPAGL

SEQ ID NO: 1181090 - protein, 12 aa, Mycobacterium
GDDVASPSFAGP

SEQ ID NO: 1181091 - protein, 9 aa, Mycobacterium
GDETASGSV

SEQ ID NO: 1181092 - protein, 5 aa, Mycobacterium
GDEVP

SEQ ID NO: 1181093 - protein, 6 aa, Mycobacterium
GDEVPR

SEQ ID NO: 1181094 - protein, 14 aa, Mycobacterium
GDFGPGSAMARSTK

SEQ ID NO: 1181095 - protein, 7 aa, Mycobacterium
GDGAGSE

SEQ ID NO: 1181096 - protein, 23 aa, Mycobacterium
GDGAPGAPAPDHSRGRLSKDGAP

SEQ ID NO: 1181097 - protein, 9 aa, Mycobacterium
GDGATAVEH

SEQ ID NO: 1181098 - protein, 8 aa, Mycobacterium
GDGDSLSI

SEQ ID NO: 1181099 - protein, 17 aa, Mycobacterium
GDGDWRDSEVAARSAEF

SEQ ID NO: 1181100 - protein, 5 aa, Mycobacterium
GDGGD

SEQ ID NO: 1181101 - protein, 5 aa, Mycobacterium
GDGGE

SEQ ID NO: 1181102 - protein, 8 aa, Mycobacterium
GDGGYLDD

SEQ ID NO: 1181103 - protein, 10 aa, Mycobacterium
GDGHGDGRDL

SEQ ID NO: 1181104 - protein, 21 aa, Mycobacterium
GDGHQPDPALVPPTGAQAVPD

SEQ ID NO: 1181105 - protein, 15 aa, Mycobacterium
GDGPPDTSASGVSSH

SEQ ID NO: 1181106 - protein, 8 aa, Mycobacterium
GDGQQPDV

SEQ ID NO: 1181107 - protein, 10 aa, Mycobacterium
GDGSCSRLPR

SEQ ID NO: 1181108 - protein, 11 aa, Mycobacterium
GDGTGEPSSFT

SEQ ID NO: 1181109 - protein, 5 aa, Mycobacterium
GDGTV

SEQ ID NO: 1181110 - protein, 12 aa, Mycobacterium
GDHGDPPLPGGT

SEQ ID NO: 1181111 - protein, 6 aa, Mycobacterium
GDHPEY

SEQ ID NO: 1181112 - protein, 4 aa, Mycobacterium
GDIE

SEQ ID NO: 1181113 - protein, 8 aa, Mycobacterium
GDIEAQRD

SEQ ID NO: 1181114 - protein, 33 aa, Mycobacterium
GDIPPPPGWNQPPGPPGLYTPDDDAPAIPSPAL

SEQ ID NO: 1181115 - protein, 10 aa, Mycobacterium
GDIPTRPGTR

SEQ ID NO: 1181116 - protein, 14 aa, Mycobacterium
GDIRQANSYYEDPH

SEQ ID NO: 1181117 - protein, 8 aa, Mycobacterium
GDKARAEL

SEQ ID NO: 1181118 - protein, 13 aa, Mycobacterium
GDKAYRDFSDPEA

SEQ ID NO: 1181119 - protein, 8 aa, Mycobacterium
GDKGEADL

SEQ ID NO: 1181120 - protein, 27 aa, Mycobacterium
GDKPASSTGLPKNNRRGNRLPRDERRG

SEQ ID NO: 1181121 - protein, 6 aa, Mycobacterium
GDLAGQ

SEQ ID NO: 1181122 - protein, 7 aa, Mycobacterium
GDLARAG

SEQ ID NO: 1181123 - protein, 13 aa, Mycobacterium
GDLPGTARIGAPE

SEQ ID NO: 1181124 - protein, 7 aa, Mycobacterium
GDLPSEL

SEQ ID NO: 1181125 - protein, 15 aa, Mycobacterium
GDLQGAVDAQAGRRG

SEQ ID NO: 1181126 - protein, 10 aa, Mycobacterium
GDLSGGERRR

SEQ ID NO: 1181127 - protein, 4 aa, Mycobacterium
GDLT

SEQ ID NO: 1181128 - protein, 14 aa, Mycobacterium
GDLTGDGVDAGPAH

SEQ ID NO: 1181129 - protein, 9 aa, Mycobacterium
GDNERTING

SEQ ID NO: 1181130 - protein, 6 aa, Mycobacterium
GDNPYD

SEQ ID NO: 1181131 - protein, 8 aa, Mycobacterium
GDPADRGT

SEQ ID NO: 1181132 - protein, 26 aa, Mycobacterium
GDPAVAAGGRPAAVSTSAQEPERKAN

SEQ ID NO: 1181133 - protein, 7 aa, Mycobacterium
GDPDQSV

SEQ ID NO: 1181134 - protein, 7 aa, Mycobacterium
GDPIDGA

SEQ ID NO: 1181135 - protein, 18 aa, Mycobacterium
GDPKEERTRQFLDRILNP

SEQ ID NO: 1181136 - protein, 6 aa, Mycobacterium
GDPLDS

SEQ ID NO: 1181137 - protein, 5 aa, Mycobacterium
GDPPR

SEQ ID NO: 1181138 - protein, 4 aa, Mycobacterium
GDPS

SEQ ID NO: 1181139 - protein, 13 aa, Mycobacterium
GDPSASAAAAAAV

SEQ ID NO: 1181140 - protein, 6 aa, Mycobacterium
GDPTDA

SEQ ID NO: 1181141 - protein, 10 aa, Mycobacterium
GDPTDGATQV

SEQ ID NO: 1181142 - protein, 4 aa, Mycobacterium
GDPV

SEQ ID NO: 1181143 - protein, 5 aa, Mycobacterium
GDPVK

SEQ ID NO: 1181144 - protein, 17 aa, Mycobacterium
GDPVTGEDGEPPITAKG

SEQ ID NO: 1181145 - protein, 5 aa, Mycobacterium
GDPYG

SEQ ID NO: 1181146 - protein, 6 aa, Mycobacterium
GDQLDD

SEQ ID NO: 1181147 - protein, 5 aa, Mycobacterium
GDQLP

SEQ ID NO: 1181148 - protein, 7 aa, Mycobacterium
GDQWRDT

SEQ ID NO: 1181149 - protein, 17 aa, Mycobacterium
GDQYNAGRKIPPAQAKR

SEQ ID NO: 1181150 - protein, 10 aa, Mycobacterium
GDRDSSAGLS

SEQ ID NO: 1181151 - protein, 31 aa, Mycobacterium
GDRGADLAEPSHLSGHGGERRYSVDSGRRDM

SEQ ID NO: 1181152 - protein, 5 aa, Mycobacterium
GDRLG

SEQ ID NO: 1181153 - protein, 5 aa, Mycobacterium
GDRPV

SEQ ID NO: 1181154 - protein, 4 aa, Mycobacterium
GDSA

SEQ ID NO: 1181155 - protein, 8 aa, Mycobacterium
GDSADHPP

SEQ ID NO: 1181156 - protein, 7 aa, Mycobacterium
GDSAQID

SEQ ID NO: 1181157 - protein, 4 aa, Mycobacterium
GDSF

SEQ ID NO: 1181158 - protein, 27 aa, Mycobacterium
GDSGENLTIPDERSEEPPAIVEPAKPA

SEQ ID NO: 1181159 - protein, 5 aa, Mycobacterium
GDSQI

SEQ ID NO: 1181160 - protein, 5 aa, Mycobacterium
GDSRA

SEQ ID NO: 1181161 - protein, 9 aa, Mycobacterium
GDSTRAREK

SEQ ID NO: 1181162 - protein, 7 aa, Mycobacterium
GDTATAT

SEQ ID NO: 1181163 - protein, 9 aa, Mycobacterium
GDTSAEAEA

SEQ ID NO: 1181164 - protein, 7 aa, Mycobacterium
GDTVTRG

SEQ ID NO: 1181165 - protein, 4 aa, Mycobacterium
GDVG

SEQ ID NO: 1181166 - protein, 10 aa, Mycobacterium
GDVPLEPTAG

SEQ ID NO: 1181167 - protein, 4 aa, Mycobacterium
GDYM

SEQ ID NO: 1181168 - protein, 5 aa, Mycobacterium
GDYPA

SEQ ID NO: 1181169 - protein, 10 aa, Mycobacterium
GDYRRPGQQS

SEQ ID NO: 1181170 - protein, 5 aa, Mycobacterium
GEAAA

SEQ ID NO: 1181171 - protein, 22 aa, Mycobacterium
GEAADGKEPLSETELEKLFLAL

SEQ ID NO: 1181172 - protein, 12 aa, Mycobacterium
GEADIASDARAD

SEQ ID NO: 1181173 - protein, 5 aa, Mycobacterium
GEAKH

SEQ ID NO: 1181174 - protein, 4 aa, Mycobacterium
GEAV

SEQ ID NO: 1181175 - protein, 6 aa, Mycobacterium
GECPGA

SEQ ID NO: 1181176 - protein, 4 aa, Mycobacterium
GEDA

SEQ ID NO: 1181177 - protein, 7 aa, Mycobacterium
GEDARPW

SEQ ID NO: 1181178 - protein, 18 aa, Mycobacterium
GEDARRRGEGGGRPHHHH

SEQ ID NO: 1181179 - protein, 17 aa, Mycobacterium
GEDLPQPGDSATEDNLR

SEQ ID NO: 1181180 - protein, 7 aa, Mycobacterium
GEDPDVA

SEQ ID NO: 1181181 - protein, 6 aa, Mycobacterium
GEEEHG

SEQ ID NO: 1181182 - protein, 7 aa, Mycobacterium
GEEGRAW

SEQ ID NO: 1181183 - protein, 54 aa, Mycobacterium
GEELDDEDFEDAEDAEDSDDSDEDEDEDEDEDSDDSDEDEIDLDNDDDEEDDDI

SEQ ID NO: 1181184 - protein, 4 aa, Mycobacterium
GEEN

SEQ ID NO: 1181185 - protein, 10 aa, Mycobacterium
GEEQATRQQF

SEQ ID NO: 1181186 - protein, 16 aa, Mycobacterium
GEETGGAAAFRPDDAD

SEQ ID NO: 1181187 - protein, 6 aa, Mycobacterium
GEFEGR

SEQ ID NO: 1181188 - protein, 8 aa, Mycobacterium
GEGAAREP

SEQ ID NO: 1181189 - protein, 10 aa, Mycobacterium
GEGASKAGAV

SEQ ID NO: 1181190 - protein, 11 aa, Mycobacterium
GEGGNLGVTSR

SEQ ID NO: 1181191 - protein, 6 aa, Mycobacterium
GEGRGL

SEQ ID NO: 1181192 - protein, 10 aa, Mycobacterium
GEHQVEGARK

SEQ ID NO: 1181193 - protein, 5 aa, Mycobacterium
GEIAT

SEQ ID NO: 1181194 - protein, 12 aa, Mycobacterium
GEIDPDRTAADE

SEQ ID NO: 1181195 - protein, 24 aa, Mycobacterium
GEIRSADNSPFAPALPASQDGNEL

SEQ ID NO: 1181196 - protein, 7 aa, Mycobacterium
GEKGPTA

SEQ ID NO: 1181197 - protein, 7 aa, Mycobacterium
GEKMSKS

SEQ ID NO: 1181198 - protein, 8 aa, Mycobacterium
GEKMSKSL

SEQ ID NO: 1181199 - protein, 11 aa, Mycobacterium
GENEVQAARPL

SEQ ID NO: 1181200 - protein, 9 aa, Mycobacterium
GENGSGKST

SEQ ID NO: 1181201 - protein, 6 aa, Mycobacterium
GEPAEA

SEQ ID NO: 1181202 - protein, 6 aa, Mycobacterium
GEPART

SEQ ID NO: 1181203 - protein, 6 aa, Mycobacterium
GEPCRQ

SEQ ID NO: 1181204 - protein, 11 aa, Mycobacterium
GEPESARERLQ

SEQ ID NO: 1181205 - protein, 10 aa, Mycobacterium
GEPPAEAPNA

SEQ ID NO: 1181206 - protein, 8 aa, Mycobacterium
GEPPDQVA

SEQ ID NO: 1181207 - protein, 23 aa, Mycobacterium
GEPQRAPTRQVPPGRSKYDSNGR

SEQ ID NO: 1181208 - protein, 5 aa, Mycobacterium
GEPRL

SEQ ID NO: 1181209 - protein, 15 aa, Mycobacterium
GEPSTEAGPSDGKGL

SEQ ID NO: 1181210 - protein, 4 aa, Mycobacterium
GEPT

SEQ ID NO: 1181211 - protein, 8 aa, Mycobacterium
GEQKATNY

SEQ ID NO: 1181212 - protein, 4 aa, Mycobacterium
GEQL

SEQ ID NO: 1181213 - protein, 10 aa, Mycobacterium
GERDGGEEKL

SEQ ID NO: 1181214 - protein, 13 aa, Mycobacterium
GERGRNDGIPNVN

SEQ ID NO: 1181215 - protein, 5 aa, Mycobacterium
GERMD

SEQ ID NO: 1181216 - protein, 5 aa, Mycobacterium
GERPV

SEQ ID NO: 1181217 - protein, 11 aa, Mycobacterium
GERQPATRRAA

SEQ ID NO: 1181218 - protein, 5 aa, Mycobacterium
GERRR

SEQ ID NO: 1181219 - protein, 6 aa, Mycobacterium
GERSGQ

SEQ ID NO: 1181220 - protein, 6 aa, Mycobacterium
GERTDQ

SEQ ID NO: 1181221 - protein, 10 aa, Mycobacterium
GESGGTPRQL

SEQ ID NO: 1181222 - protein, 8 aa, Mycobacterium
GESLPERT

SEQ ID NO: 1181223 - protein, 9 aa, Mycobacterium
GESRRSARK

SEQ ID NO: 1181224 - protein, 5 aa, Mycobacterium
GESSG

SEQ ID NO: 1181225 - protein, 4 aa, Mycobacterium
GETI

SEQ ID NO: 1181226 - protein, 5 aa, Mycobacterium
GETKP

SEQ ID NO: 1181227 - protein, 13 aa, Mycobacterium
GETPARSSSGLTT

SEQ ID NO: 1181228 - protein, 4 aa, Mycobacterium
GETQ

SEQ ID NO: 1181229 - protein, 6 aa, Mycobacterium
GETSKP

SEQ ID NO: 1181230 - protein, 4 aa, Mycobacterium
GETY

SEQ ID NO: 1181231 - protein, 6 aa, Mycobacterium
GEVAAG

SEQ ID NO: 1181232 - protein, 20 aa, Mycobacterium
GEVESKASARNPATPADYKA

SEQ ID NO: 1181233 - protein, 8 aa, Mycobacterium
GEVGPSAT

SEQ ID NO: 1181234 - protein, 15 aa, Mycobacterium
GEVGSDGAGDTVTVR

SEQ ID NO: 1181235 - protein, 12 aa, Mycobacterium
GEVSDDESLGGA

SEQ ID NO: 1181236 - protein, 7 aa, Mycobacterium
GFAPPEV

SEQ ID NO: 1181237 - protein, 6 aa, Mycobacterium
GFDEDR

SEQ ID NO: 1181238 - protein, 9 aa, Mycobacterium
GFDEEDADL

SEQ ID NO: 1181239 - protein, 8 aa, Mycobacterium
GFEGKKKA

SEQ ID NO: 1181240 - protein, 14 aa, Mycobacterium
GFETTSGESVVPDE

SEQ ID NO: 1181241 - protein, 19 aa, Mycobacterium
GFGGDPDKVTVAGESAGGM

SEQ ID NO: 1181242 - protein, 14 aa, Mycobacterium
GFGGSIGGELGGGI

SEQ ID NO: 1181243 - protein, 25 aa, Mycobacterium
GFNPAGVTSLAGGALGTGPSKPLMP

SEQ ID NO: 1181244 - protein, 6 aa, Mycobacterium
GFPEEY

SEQ ID NO: 1181245 - protein, 15 aa, Mycobacterium
GFPPGAPYKGPTGKD

SEQ ID NO: 1181246 - protein, 16 aa, Mycobacterium
GFPPGAPYKGPTGKDF

SEQ ID NO: 1181247 - protein, 8 aa, Mycobacterium
GFPPPTTQ

SEQ ID NO: 1181248 - protein, 15 aa, Mycobacterium
GFRGEVESEQAIARS

SEQ ID NO: 1181249 - protein, 8 aa, Mycobacterium
GFSATGGL

SEQ ID NO: 1181250 - protein, 9 aa, Mycobacterium
GFTTPDPSY

SEQ ID NO: 1181251 - protein, 12 aa, Mycobacterium
GGAAEDPTTQRL

SEQ ID NO: 1181252 - protein, 15 aa, Mycobacterium
GGADPRREGMVMGDG

SEQ ID NO: 1181253 - protein, 5 aa, Mycobacterium
GGADQ

SEQ ID NO: 1181254 - protein, 8 aa, Mycobacterium
GGAEADAV

SEQ ID NO: 1181255 - protein, 8 aa, Mycobacterium
GGAGATFA

SEQ ID NO: 1181256 - protein, 14 aa, Mycobacterium
GGAGMARPGAVSRA

SEQ ID NO: 1181257 - protein, 10 aa, Mycobacterium
GGAHDTGEVA

SEQ ID NO: 1181258 - protein, 4 aa, Mycobacterium
GGAI

SEQ ID NO: 1181259 - protein, 4 aa, Mycobacterium
GGAL

SEQ ID NO: 1181260 - protein, 18 aa, Mycobacterium
GGALARQHSGAHGPPSSL

SEQ ID NO: 1181261 - protein, 8 aa, Mycobacterium
GGAPAALA

SEQ ID NO: 1181262 - protein, 7 aa, Mycobacterium
GGAQGNR

SEQ ID NO: 1181263 - protein, 9 aa, Mycobacterium
GGAQSPRET

SEQ ID NO: 1181264 - protein, 18 aa, Mycobacterium
GGAVGASRAAVDSGYYPG

SEQ ID NO: 1181265 - protein, 15 aa, Mycobacterium
GGDDLTGAAHGAGFA

SEQ ID NO: 1181266 - protein, 17 aa, Mycobacterium
GGDDPEFTDATRAAATP

SEQ ID NO: 1181267 - protein, 21 aa, Mycobacterium
GGDETKFPGEISGGMRKRAGL

SEQ ID NO: 1181268 - protein, 5 aa, Mycobacterium
GGDLA

SEQ ID NO: 1181269 - protein, 9 aa, Mycobacterium
GGDSARARA

SEQ ID NO: 1181270 - protein, 5 aa, Mycobacterium
GGDSL

SEQ ID NO: 1181271 - protein, 24 aa, Mycobacterium
GGEDNGKDQGGKAQTKSRPSQRRR

SEQ ID NO: 1181272 - protein, 5 aa, Mycobacterium
GGEDY

SEQ ID NO: 1181273 - protein, 7 aa, Mycobacterium
GGEEATL

SEQ ID NO: 1181274 - protein, 5 aa, Mycobacterium
GGELG

SEQ ID NO: 1181275 - protein, 7 aa, Mycobacterium
GGELGRY

SEQ ID NO: 1181276 - protein, 7 aa, Mycobacterium
GGELPKP

SEQ ID NO: 1181277 - protein, 14 aa, Mycobacterium
GGEPFSRTVDSSDI

SEQ ID NO: 1181278 - protein, 9 aa, Mycobacterium
GGERRNDPD

SEQ ID NO: 1181279 - protein, 9 aa, Mycobacterium
GGFTDSSHR

SEQ ID NO: 1181280 - protein, 14 aa, Mycobacterium
GGFTGGAKDLTRPT

SEQ ID NO: 1181281 - protein, 19 aa, Mycobacterium
GGGAGAAGPGPAAPGSSPA

SEQ ID NO: 1181282 - protein, 5 aa, Mycobacterium
GGGAM

SEQ ID NO: 1181283 - protein, 5 aa, Mycobacterium
GGGDG

SEQ ID NO: 1181284 - protein, 7 aa, Mycobacterium
GGGEGFG

SEQ ID NO: 1181285 - protein, 22 aa, Mycobacterium
GGGEQPAATTPTSDAPAEPPAG

SEQ ID NO: 1181286 - protein, 6 aa, Mycobacterium
GGGLGR

SEQ ID NO: 1181287 - protein, 13 aa, Mycobacterium
GGGLPEGASGDAI

SEQ ID NO: 1181288 - protein, 15 aa, Mycobacterium
GGGNAAGGDGGNGGG

SEQ ID NO: 1181289 - protein, 19 aa, Mycobacterium
GGGNAAGPSRGIDSGANTV

SEQ ID NO: 1181290 - protein, 19 aa, Mycobacterium
GGGNANGPARGIDQGANTV

SEQ ID NO: 1181291 - protein, 19 aa, Mycobacterium
GGGNANGPSRGIDQGANTV

SEQ ID NO: 1181292 - protein, 8 aa, Mycobacterium
GGGPAWPR

SEQ ID NO: 1181293 - protein, 12 aa, Mycobacterium
GGGPLGNEEEAD

SEQ ID NO: 1181294 - protein, 9 aa, Mycobacterium
GGGPTPGPV

SEQ ID NO: 1181295 - protein, 5 aa, Mycobacterium
GGGRY

SEQ ID NO: 1181296 - protein, 5 aa, Mycobacterium
GGGSS

SEQ ID NO: 1181297 - protein, 26 aa, Mycobacterium
GGGSSQESAELAQQRAHESLRSAQDA

SEQ ID NO: 1181298 - protein, 5 aa, Mycobacterium
GGGTR

SEQ ID NO: 1181299 - protein, 26 aa, Mycobacterium
GGHAPRRPSYRPAAPPARRAAGAAPQ

SEQ ID NO: 1181300 - protein, 11 aa, Mycobacterium
GGHPLPEWTPG

SEQ ID NO: 1181301 - protein, 8 aa, Mycobacterium
GGHPVGAT

SEQ ID NO: 1181302 - protein, 4 aa, Mycobacterium
GGHR

SEQ ID NO: 1181303 - protein, 9 aa, Mycobacterium
GGIRDDESL

SEQ ID NO: 1181304 - protein, 7 aa, Mycobacterium
GGIRTGM

SEQ ID NO: 1181305 - protein, 8 aa, Mycobacterium
GGIRTGMD

SEQ ID NO: 1181306 - protein, 17 aa, Mycobacterium
GGITADNDLTDGDGRQR

SEQ ID NO: 1181307 - protein, 15 aa, Mycobacterium
GGKKVRSTTPEAAGR

SEQ ID NO: 1181308 - protein, 4 aa, Mycobacterium
GGKN

SEQ ID NO: 1181309 - protein, 8 aa, Mycobacterium
GGKPFQPK

SEQ ID NO: 1181310 - protein, 30 aa, Mycobacterium
GGKPGVPQAPFEEPDELDTDGSRVPDGQRP

SEQ ID NO: 1181311 - protein, 10 aa, Mycobacterium
GGKQPAPAPV

SEQ ID NO: 1181312 - protein, 8 aa, Mycobacterium
GGLASGIG

SEQ ID NO: 1181313 - protein, 8 aa, Mycobacterium
GGLDGEPV

SEQ ID NO: 1181314 - protein, 8 aa, Mycobacterium
GGLDPQSG

SEQ ID NO: 1181315 - protein, 9 aa, Mycobacterium
GGLGPAAGA

SEQ ID NO: 1181316 - protein, 5 aa, Mycobacterium
GGLNG

SEQ ID NO: 1181317 - protein, 5 aa, Mycobacterium
GGLPH

SEQ ID NO: 1181318 - protein, 4 aa, Mycobacterium
GGLS

SEQ ID NO: 1181319 - protein, 9 aa, Mycobacterium
GGLSGAPHG

SEQ ID NO: 1181320 - protein, 8 aa, Mycobacterium
GGLSPSGP

SEQ ID NO: 1181321 - protein, 16 aa, Mycobacterium
GGNAEQAARNSGPDRA

SEQ ID NO: 1181322 - protein, 8 aa, Mycobacterium
GGNPSPWR

SEQ ID NO: 1181323 - protein, 16 aa, Mycobacterium
GGPAESIRSSLLRVTS

SEQ ID NO: 1181324 - protein, 9 aa, Mycobacterium
GGPEAHHKK

SEQ ID NO: 1181325 - protein, 10 aa, Mycobacterium
GGPEAHHKKS

SEQ ID NO: 1181326 - protein, 6 aa, Mycobacterium
GGPGDR

SEQ ID NO: 1181327 - protein, 12 aa, Mycobacterium
GGPKALPPMTEG

SEQ ID NO: 1181328 - protein, 18 aa, Mycobacterium
GGPLAAPSASMGLGAGGR

SEQ ID NO: 1181329 - protein, 7 aa, Mycobacterium
GGPPADY

SEQ ID NO: 1181330 - protein, 19 aa, Mycobacterium
GGPQPPHRHRRPAVGGAQE

SEQ ID NO: 1181331 - protein, 4 aa, Mycobacterium
GGPR

SEQ ID NO: 1181332 - protein, 8 aa, Mycobacterium
GGPRPLDT

SEQ ID NO: 1181333 - protein, 9 aa, Mycobacterium
GGPVGSGKT

SEQ ID NO: 1181334 - protein, 4 aa, Mycobacterium
GGQA

SEQ ID NO: 1181335 - protein, 17 aa, Mycobacterium
GGQAKASTTARAEASVM

SEQ ID NO: 1181336 - protein, 9 aa, Mycobacterium
GGQCEETDD

SEQ ID NO: 1181337 - protein, 7 aa, Mycobacterium
GGQNAHT

SEQ ID NO: 1181338 - protein, 8 aa, Mycobacterium
GGQPFTEE

SEQ ID NO: 1181339 - protein, 12 aa, Mycobacterium
GGQRRRDAVTSP

SEQ ID NO: 1181340 - protein, 15 aa, Mycobacterium
GGRATGKLGASTSKA

SEQ ID NO: 1181341 - protein, 8 aa, Mycobacterium
GGRFTGTV

SEQ ID NO: 1181342 - protein, 7 aa, Mycobacterium
GGRGAHE

SEQ ID NO: 1181343 - protein, 7 aa, Mycobacterium
GGRGPAT

SEQ ID NO: 1181344 - protein, 6 aa, Mycobacterium
GGRGPL

SEQ ID NO: 1181345 - protein, 4 aa, Mycobacterium
GGRI

SEQ ID NO: 1181346 - protein, 16 aa, Mycobacterium
GGRLAKSARPLTDEEE

SEQ ID NO: 1181347 - protein, 7 aa, Mycobacterium
GGRNRAV

SEQ ID NO: 1181348 - protein, 12 aa, Mycobacterium
GGRPAPLTRADA

SEQ ID NO: 1181349 - protein, 13 aa, Mycobacterium
GGRRDGDDPSTTL

SEQ ID NO: 1181350 - protein, 10 aa, Mycobacterium
GGRRGEQDER

SEQ ID NO: 1181351 - protein, 8 aa, Mycobacterium
GGRRVTGT

SEQ ID NO: 1181352 - protein, 4 aa, Mycobacterium
GGRS

SEQ ID NO: 1181353 - protein, 14 aa, Mycobacterium
GGRTARLERDEDGR

SEQ ID NO: 1181354 - protein, 9 aa, Mycobacterium
GGRTDQFGK

SEQ ID NO: 1181355 - protein, 11 aa, Mycobacterium
GGRTGCRTTAD

SEQ ID NO: 1181356 - protein, 4 aa, Mycobacterium
GGSA

SEQ ID NO: 1181357 - protein, 5 aa, Mycobacterium
GGSDL

SEQ ID NO: 1181358 - protein, 6 aa, Mycobacterium
GGSDLG

SEQ ID NO: 1181359 - protein, 6 aa, Mycobacterium
GGSEGK

SEQ ID NO: 1181360 - protein, 8 aa, Mycobacterium
GGSGAVNG

SEQ ID NO: 1181361 - protein, 8 aa, Mycobacterium
GGSGIGRA

SEQ ID NO: 1181362 - protein, 9 aa, Mycobacterium
GGSHEGGLP

SEQ ID NO: 1181363 - protein, 8 aa, Mycobacterium
GGSITTAE

SEQ ID NO: 1181364 - protein, 9 aa, Mycobacterium
GGSPQGRAL

SEQ ID NO: 1181365 - protein, 9 aa, Mycobacterium
GGSQAPAPV

SEQ ID NO: 1181366 - protein, 15 aa, Mycobacterium
GGSSLTEDAATAATD

SEQ ID NO: 1181367 - protein, 16 aa, Mycobacterium
GGSTATTVSFLVGLPP

SEQ ID NO: 1181368 - protein, 6 aa, Mycobacterium
GGTAYG

SEQ ID NO: 1181369 - protein, 5 aa, Mycobacterium
GGTEP

SEQ ID NO: 1181370 - protein, 9 aa, Mycobacterium
GGTQDTPAL

SEQ ID NO: 1181371 - protein, 7 aa, Mycobacterium
GGTTAIA

SEQ ID NO: 1181372 - protein, 6 aa, Mycobacterium
GGTTGL

SEQ ID NO: 1181373 - protein, 9 aa, Mycobacterium
GGTTGTPKG

SEQ ID NO: 1181374 - protein, 7 aa, Mycobacterium
GGTTVAG

SEQ ID NO: 1181375 - protein, 8 aa, Mycobacterium
GGTVSHGP

SEQ ID NO: 1181376 - protein, 11 aa, Mycobacterium
GGVAAGASWGN

SEQ ID NO: 1181377 - protein, 11 aa, Mycobacterium
GGVDGSNHREC

SEQ ID NO: 1181378 - protein, 5 aa, Mycobacterium
GGVGQ

SEQ ID NO: 1181379 - protein, 12 aa, Mycobacterium
GGVGSSADNALA

SEQ ID NO: 1181380 - protein, 19 aa, Mycobacterium
GGVPAARAAGLTADAVDPR

SEQ ID NO: 1181381 - protein, 5 aa, Mycobacterium
GGVPK

SEQ ID NO: 1181382 - protein, 17 aa, Mycobacterium
GGVPYENPSNAAHDKAP

SEQ ID NO: 1181383 - protein, 5 aa, Mycobacterium
GGVRG

SEQ ID NO: 1181384 - protein, 14 aa, Mycobacterium
GGVSSSPSTSAAGF

SEQ ID NO: 1181385 - protein, 37 aa, Mycobacterium
GGVSTATQAAWQRTTDGWSGSGADSAGAFAAATTAAV

SEQ ID NO: 1181386 - protein, 6 aa, Mycobacterium
GGVTNP

SEQ ID NO: 1181387 - protein, 11 aa, Mycobacterium
GGVTSAVDTEE

SEQ ID NO: 1181388 - protein, 5 aa, Mycobacterium
GGVVS

SEQ ID NO: 1181389 - protein, 5 aa, Mycobacterium
GGYAE

SEQ ID NO: 1181390 - protein, 9 aa, Mycobacterium
GGYGGPGFN

SEQ ID NO: 1181391 - protein, 8 aa, Mycobacterium
GHAGPLSA

SEQ ID NO: 1181392 - protein, 7 aa, Mycobacterium
GHAPSAW

SEQ ID NO: 1181393 - protein, 16 aa, Mycobacterium
GHASTADVTDALVAQL

SEQ ID NO: 1181394 - protein, 4 aa, Mycobacterium
GHAT

SEQ ID NO: 1181395 - protein, 9 aa, Mycobacterium
GHDPGDPHV

SEQ ID NO: 1181396 - protein, 10 aa, Mycobacterium
GHDPQDPLAS

SEQ ID NO: 1181397 - protein, 7 aa, Mycobacterium
GHDPQHG

SEQ ID NO: 1181398 - protein, 5 aa, Mycobacterium
GHDSE

SEQ ID NO: 1181399 - protein, 4 aa, Mycobacterium
GHER

SEQ ID NO: 1181400 - protein, 4 aa, Mycobacterium
GHET

SEQ ID NO: 1181401 - protein, 8 aa, Mycobacterium
GHETTASS

SEQ ID NO: 1181402 - protein, 7 aa, Mycobacterium
GHGDDAP

SEQ ID NO: 1181403 - protein, 10 aa, Mycobacterium
GHGTDLRGPT

SEQ ID NO: 1181404 - protein, 8 aa, Mycobacterium
GHGTIDGR

SEQ ID NO: 1181405 - protein, 25 aa, Mycobacterium
GHIPGARNVSSRATLTDEGALRDPD

SEQ ID NO: 1181406 - protein, 8 aa, Mycobacterium
GHKPHEKT

SEQ ID NO: 1181407 - protein, 9 aa, Mycobacterium
GHLNGGASD

SEQ ID NO: 1181408 - protein, 11 aa, Mycobacterium
GHPAPEEPERG

SEQ ID NO: 1181409 - protein, 4 aa, Mycobacterium
GHPD

SEQ ID NO: 1181410 - protein, 4 aa, Mycobacterium
GHPG

SEQ ID NO: 1181411 - protein, 6 aa, Mycobacterium
GHPHTR

SEQ ID NO: 1181412 - protein, 4 aa, Mycobacterium
GHQS

SEQ ID NO: 1181413 - protein, 6 aa, Mycobacterium
GHRAPG

SEQ ID NO: 1181414 - protein, 4 aa, Mycobacterium
GHRP

SEQ ID NO: 1181415 - protein, 8 aa, Mycobacterium
GHTSSSPL

SEQ ID NO: 1181416 - protein, 17 aa, Mycobacterium
GHYPQDIEATTADASPL

SEQ ID NO: 1181417 - protein, 5 aa, Mycobacterium
GIANR

SEQ ID NO: 1181418 - protein, 8 aa, Mycobacterium
GIEDRDTR

SEQ ID NO: 1181419 - protein, 7 aa, Mycobacterium
GIEEISG

SEQ ID NO: 1181420 - protein, 10 aa, Mycobacterium
GIEPGRFTED

SEQ ID NO: 1181421 - protein, 7 aa, Mycobacterium
GIEPNPL

SEQ ID NO: 1181422 - protein, 4 aa, Mycobacterium
GIEQ

SEQ ID NO: 1181423 - protein, 4 aa, Mycobacterium
GIER

SEQ ID NO: 1181424 - protein, 4 aa, Mycobacterium
GIEY

SEQ ID NO: 1181425 - protein, 4 aa, Mycobacterium
GIGE

SEQ ID NO: 1181426 - protein, 7 aa, Mycobacterium
GIGGARA

SEQ ID NO: 1181427 - protein, 16 aa, Mycobacterium
GIGPGLGAADDPPTVS

SEQ ID NO: 1181428 - protein, 13 aa, Mycobacterium
GIGSWPGANPRQA

SEQ ID NO: 1181429 - protein, 6 aa, Mycobacterium
GIGTGD

SEQ ID NO: 1181430 - protein, 5 aa, Mycobacterium
GIPDE

SEQ ID NO: 1181431 - protein, 6 aa, Mycobacterium
GIPGSQ

SEQ ID NO: 1181432 - protein, 9 aa, Mycobacterium
GIRPAPGYP

SEQ ID NO: 1181433 - protein, 19 aa, Mycobacterium
GIRPSADGAPFRAGRSARN

SEQ ID NO: 1181434 - protein, 12 aa, Mycobacterium
GKAAGQIRDDVD

SEQ ID NO: 1181435 - protein, 43 aa, Mycobacterium
GKAATSPASVANKMPGSFGDEAQNAANQSDDPAKQALNPENMG

SEQ ID NO: 1181436 - protein, 12 aa, Mycobacterium
GKAGGAIGRNDS

SEQ ID NO: 1181437 - protein, 7 aa, Mycobacterium
GKAIEDG

SEQ ID NO: 1181438 - protein, 13 aa, Mycobacterium
GKDTAQALAEADG

SEQ ID NO: 1181439 - protein, 10 aa, Mycobacterium
GKEGVEPQSE

SEQ ID NO: 1181440 - protein, 11 aa, Mycobacterium
GKEGVEPQSEQ

SEQ ID NO: 1181441 - protein, 11 aa, Mycobacterium
GKFRADPSKVD

SEQ ID NO: 1181442 - protein, 7 aa, Mycobacterium
GKGDPQV

SEQ ID NO: 1181443 - protein, 9 aa, Mycobacterium
GKGLTGSSL

SEQ ID NO: 1181444 - protein, 14 aa, Mycobacterium
GKHKPSTVLSEGEQ

SEQ ID NO: 1181445 - protein, 6 aa, Mycobacterium
GKIAEA

SEQ ID NO: 1181446 - protein, 4 aa, Mycobacterium
GKNP

SEQ ID NO: 1181447 - protein, 7 aa, Mycobacterium
GKPGDGW

SEQ ID NO: 1181448 - protein, 4 aa, Mycobacterium
GKPI

SEQ ID NO: 1181449 - protein, 7 aa, Mycobacterium
GKPLQRD

SEQ ID NO: 1181450 - protein, 43 aa, Mycobacterium
GKPRRAGESLREPPGDGGDSPAWSRKRGAYQAPQLPRSGGAVP

SEQ ID NO: 1181451 - protein, 6 aa, Mycobacterium
GKPTVL

SEQ ID NO: 1181452 - protein, 14 aa, Mycobacterium
GKPTWVPATEDRGE

SEQ ID NO: 1181453 - protein, 7 aa, Mycobacterium
GKQHQID

SEQ ID NO: 1181454 - protein, 8 aa, Mycobacterium
GKQQPDGF

SEQ ID NO: 1181455 - protein, 13 aa, Mycobacterium
GKRRQRLAEALPV

SEQ ID NO: 1181456 - protein, 13 aa, Mycobacterium
GKRRSNQAENGIQ

SEQ ID NO: 1181457 - protein, 8 aa, Mycobacterium
GKRTPKDI

SEQ ID NO: 1181458 - protein, 10 aa, Mycobacterium
GKRVESRQAE

SEQ ID NO: 1181459 - protein, 4 aa, Mycobacterium
GKSG

SEQ ID NO: 1181460 - protein, 7 aa, Mycobacterium
GKSIRRP

SEQ ID NO: 1181461 - protein, 5 aa, Mycobacterium
GKSRW

SEQ ID NO: 1181462 - protein, 5 aa, Mycobacterium
GKSTL

SEQ ID NO: 1181463 - protein, 11 aa, Mycobacterium
GKTEKRIATTA

SEQ ID NO: 1181464 - protein, 4 aa, Mycobacterium
GKTS

SEQ ID NO: 1181465 - protein, 22 aa, Mycobacterium
GKVGSGRRGPTPSADPSPASES

SEQ ID NO: 1181466 - protein, 6 aa, Mycobacterium
GKVPGL

SEQ ID NO: 1181467 - protein, 9 aa, Mycobacterium
GKWYPGEPL

SEQ ID NO: 1181468 - protein, 20 aa, Mycobacterium
GLADRTGRLTAGTREAGAAV

SEQ ID NO: 1181469 - protein, 15 aa, Mycobacterium
GLAKDTRDGGAGLSA

SEQ ID NO: 1181470 - protein, 8 aa, Mycobacterium
GLAKPDGI

SEQ ID NO: 1181471 - protein, 8 aa, Mycobacterium
GLAPGQDR

SEQ ID NO: 1181472 - protein, 10 aa, Mycobacterium
GLAPTKSAGM

SEQ ID NO: 1181473 - protein, 12 aa, Mycobacterium
GLAREGKRGPMD

SEQ ID NO: 1181474 - protein, 10 aa, Mycobacterium
GLASADPNNT

SEQ ID NO: 1181475 - protein, 10 aa, Mycobacterium
GLDERPAAAA

SEQ ID NO: 1181476 - protein, 12 aa, Mycobacterium
GLDGANKPDLAA

SEQ ID NO: 1181477 - protein, 6 aa, Mycobacterium
GLESSP

SEQ ID NO: 1181478 - protein, 11 aa, Mycobacterium
GLGEDGPTHQP

SEQ ID NO: 1181479 - protein, 10 aa, Mycobacterium
GLGGQNRKIE

SEQ ID NO: 1181480 - protein, 11 aa, Mycobacterium
GLGKETPSELD

SEQ ID NO: 1181481 - protein, 12 aa, Mycobacterium
GLHGPKGKPCPA

SEQ ID NO: 1181482 - protein, 4 aa, Mycobacterium
GLNN

SEQ ID NO: 1181483 - protein, 11 aa, Mycobacterium
GLNPTGSFKDR

SEQ ID NO: 1181484 - protein, 7 aa, Mycobacterium
GLPAPRR

SEQ ID NO: 1181485 - protein, 9 aa, Mycobacterium
GLPDGTAVT

SEQ ID NO: 1181486 - protein, 7 aa, Mycobacterium
GLPEDER

SEQ ID NO: 1181487 - protein, 7 aa, Mycobacterium
GLPETPY

SEQ ID NO: 1181488 - protein, 11 aa, Mycobacterium
GLPGAATIDDD

SEQ ID NO: 1181489 - protein, 10 aa, Mycobacterium
GLPGGGPQVR

SEQ ID NO: 1181490 - protein, 30 aa, Mycobacterium
GLPGPSADLDGIATNASEAAGAVPARHANG

SEQ ID NO: 1181491 - protein, 8 aa, Mycobacterium
GLPGSVPD

SEQ ID NO: 1181492 - protein, 6 aa, Mycobacterium
GLPKGT

SEQ ID NO: 1181493 - protein, 9 aa, Mycobacterium
GLPPASTRA

SEQ ID NO: 1181494 - protein, 7 aa, Mycobacterium
GLPPRER

SEQ ID NO: 1181495 - protein, 4 aa, Mycobacterium
GLPT

SEQ ID NO: 1181496 - protein, 9 aa, Mycobacterium
GLPTEGGTY

SEQ ID NO: 1181497 - protein, 7 aa, Mycobacterium
GLPTEPD

SEQ ID NO: 1181498 - protein, 10 aa, Mycobacterium
GLRGKARGMG

SEQ ID NO: 1181499 - protein, 9 aa, Mycobacterium
GLSPGTPAE

SEQ ID NO: 1181500 - protein, 9 aa, Mycobacterium
GLTEGNAVT

SEQ ID NO: 1181501 - protein, 13 aa, Mycobacterium
GLTGSDPASLSPA

SEQ ID NO: 1181502 - protein, 7 aa, Mycobacterium
GLTPGSK

SEQ ID NO: 1181503 - protein, 21 aa, Mycobacterium
GMAAPDPAETEGEGTQPDPEI

SEQ ID NO: 1181504 - protein, 18 aa, Mycobacterium
GMAPTGTESAMEDNSGIM

SEQ ID NO: 1181505 - protein, 12 aa, Mycobacterium
GMDPASETGPLV

SEQ ID NO: 1181506 - protein, 12 aa, Mycobacterium
GMGRATAERLRA

SEQ ID NO: 1181507 - protein, 10 aa, Mycobacterium
GMKANDAKRL

SEQ ID NO: 1181508 - protein, 6 aa, Mycobacterium
GMNPGV

SEQ ID NO: 1181509 - protein, 11 aa, Mycobacterium
GMPAAKPATAV

SEQ ID NO: 1181510 - protein, 7 aa, Mycobacterium
GNAARSL

SEQ ID NO: 1181511 - protein, 19 aa, Mycobacterium
GNAGTELRPQNPPPETEAA

SEQ ID NO: 1181512 - protein, 12 aa, Mycobacterium
GNDEAKKQTAID

SEQ ID NO: 1181513 - protein, 11 aa, Mycobacterium
GNDGMGRTRTS

SEQ ID NO: 1181514 - protein, 7 aa, Mycobacterium
GNDNPEL

SEQ ID NO: 1181515 - protein, 6 aa, Mycobacterium
GNEAIY

SEQ ID NO: 1181516 - protein, 11 aa, Mycobacterium
GNEDGRGDGSV

SEQ ID NO: 1181517 - protein, 13 aa, Mycobacterium
GNELTSGNTKDAV

SEQ ID NO: 1181518 - protein, 6 aa, Mycobacterium
GNGADA

SEQ ID NO: 1181519 - protein, 8 aa, Mycobacterium
GNHAEGKV

SEQ ID NO: 1181520 - protein, 5 aa, Mycobacterium
GNIQP

SEQ ID NO: 1181521 - protein, 6 aa, Mycobacterium
GNKRTA

SEQ ID NO: 1181522 - protein, 6 aa, Mycobacterium
GNLGHP

SEQ ID NO: 1181523 - protein, 19 aa, Mycobacterium
GNLPTTPWTTDGDGRGPAW

SEQ ID NO: 1181524 - protein, 7 aa, Mycobacterium
GNPAEGI

SEQ ID NO: 1181525 - protein, 11 aa, Mycobacterium
GNPANLGDGIR

SEQ ID NO: 1181526 - protein, 9 aa, Mycobacterium
GNPNGHSSA

SEQ ID NO: 1181527 - protein, 10 aa, Mycobacterium
GNPNGHSSAY

SEQ ID NO: 1181528 - protein, 5 aa, Mycobacterium
GNQPW

SEQ ID NO: 1181529 - protein, 6 aa, Mycobacterium
GNRAAT

SEQ ID NO: 1181530 - protein, 8 aa, Mycobacterium
GNRADYDG

SEQ ID NO: 1181531 - protein, 6 aa, Mycobacterium
GNRDER

SEQ ID NO: 1181532 - protein, 4 aa, Mycobacterium
GNRI

SEQ ID NO: 1181533 - protein, 7 aa, Mycobacterium
GNRTAIS

SEQ ID NO: 1181534 - protein, 7 aa, Mycobacterium
GNRVPGL

SEQ ID NO: 1181535 - protein, 9 aa, Mycobacterium
GNSGAVPAD

SEQ ID NO: 1181536 - protein, 7 aa, Mycobacterium
GNVDGPG

SEQ ID NO: 1181537 - protein, 12 aa, Mycobacterium
GNVWSSGAATAA

SEQ ID NO: 1181538 - protein, 6 aa, Mycobacterium
GPAARP

SEQ ID NO: 1181539 - protein, 4 aa, Mycobacterium
GPAD

SEQ ID NO: 1181540 - protein, 5 aa, Mycobacterium
GPAEA

SEQ ID NO: 1181541 - protein, 7 aa, Mycobacterium
GPAECPG

SEQ ID NO: 1181542 - protein, 13 aa, Mycobacterium
GPAEYQSAHRDRY

SEQ ID NO: 1181543 - protein, 15 aa, Mycobacterium
GPAKRDSVGRPLPDT

SEQ ID NO: 1181544 - protein, 9 aa, Mycobacterium
GPALPSNAI

SEQ ID NO: 1181545 - protein, 5 aa, Mycobacterium
GPARR

SEQ ID NO: 1181546 - protein, 4 aa, Mycobacterium
GPAT

SEQ ID NO: 1181547 - protein, 6 aa, Mycobacterium
GPATSY

SEQ ID NO: 1181548 - protein, 8 aa, Mycobacterium
GPDATQAV

SEQ ID NO: 1181549 - protein, 10 aa, Mycobacterium
GPDDVGHTGG

SEQ ID NO: 1181550 - protein, 5 aa, Mycobacterium
GPDGF

SEQ ID NO: 1181551 - protein, 16 aa, Mycobacterium
GPDNRSVDKDGGWSTR

SEQ ID NO: 1181552 - protein, 12 aa, Mycobacterium
GPDPEPHYRPSA

SEQ ID NO: 1181553 - protein, 6 aa, Mycobacterium
GPDVRG

SEQ ID NO: 1181554 - protein, 7 aa, Mycobacterium
GPEDAAE

SEQ ID NO: 1181555 - protein, 5 aa, Mycobacterium
GPEEI

SEQ ID NO: 1181556 - protein, 17 aa, Mycobacterium
GPEKAVAEADPKPDDYL

SEQ ID NO: 1181557 - protein, 11 aa, Mycobacterium
GPEKSGEGLPH

SEQ ID NO: 1181558 - protein, 4 aa, Mycobacterium
GPEL

SEQ ID NO: 1181559 - protein, 7 aa, Mycobacterium
GPENAPP

SEQ ID NO: 1181560 - protein, 6 aa, Mycobacterium
GPETLP

SEQ ID NO: 1181561 - protein, 16 aa, Mycobacterium
GPEYGIEGGPEANEDR

SEQ ID NO: 1181562 - protein, 9 aa, Mycobacterium
GPFDERPGL

SEQ ID NO: 1181563 - protein, 11 aa, Mycobacterium
GPGADPAEALA

SEQ ID NO: 1181564 - protein, 10 aa, Mycobacterium
GPGDDPADHP

SEQ ID NO: 1181565 - protein, 7 aa, Mycobacterium
GPGDPGL

SEQ ID NO: 1181566 - protein, 47 aa, Mycobacterium
GPGEDGSAEVQRSNGGPRHAAPGGATRRERREAARKQAKTSKPTRRR

SEQ ID NO: 1181567 - protein, 4 aa, Mycobacterium
GPGF

SEQ ID NO: 1181568 - protein, 8 aa, Mycobacterium
GPGGTLTG

SEQ ID NO: 1181569 - protein, 4 aa, Mycobacterium
GPGQ

SEQ ID NO: 1181570 - protein, 4 aa, Mycobacterium
GPGR

SEQ ID NO: 1181571 - protein, 9 aa, Mycobacterium
GPGSAKRLT

SEQ ID NO: 1181572 - protein, 13 aa, Mycobacterium
GPGVFGPPRDHDQ

SEQ ID NO: 1181573 - protein, 5 aa, Mycobacterium
GPHGI

SEQ ID NO: 1181574 - protein, 8 aa, Mycobacterium
GPIPPQGR

SEQ ID NO: 1181575 - protein, 7 aa, Mycobacterium
GPKAAEK

SEQ ID NO: 1181576 - protein, 6 aa, Mycobacterium
GPLAAH

SEQ ID NO: 1181577 - protein, 6 aa, Mycobacterium
GPLTDG

SEQ ID NO: 1181578 - protein, 11 aa, Mycobacterium
GPMTRGGRTGE

SEQ ID NO: 1181579 - protein, 5 aa, Mycobacterium
GPMYG

SEQ ID NO: 1181580 - protein, 10 aa, Mycobacterium
GPPAPQPDND

SEQ ID NO: 1181581 - protein, 11 aa, Mycobacterium
GPPARTSKPKF

SEQ ID NO: 1181582 - protein, 6 aa, Mycobacterium
GPPEAP

SEQ ID NO: 1181583 - protein, 8 aa, Mycobacterium
GPPERYGP

SEQ ID NO: 1181584 - protein, 11 aa, Mycobacterium
GPPGTGKSQTI

SEQ ID NO: 1181585 - protein, 7 aa, Mycobacterium
GPPGVGK

SEQ ID NO: 1181586 - protein, 7 aa, Mycobacterium
GPPLGGI

SEQ ID NO: 1181587 - protein, 8 aa, Mycobacterium
GPPNQPGT

SEQ ID NO: 1181588 - protein, 6 aa, Mycobacterium
GPPPDA

SEQ ID NO: 1181589 - protein, 10 aa, Mycobacterium
GPQAPEQFTP

SEQ ID NO: 1181590 - protein, 8 aa, Mycobacterium
GPQPLKPG

SEQ ID NO: 1181591 - protein, 4 aa, Mycobacterium
GPQR

SEQ ID NO: 1181592 - protein, 4 aa, Mycobacterium
GPQV

SEQ ID NO: 1181593 - protein, 7 aa, Mycobacterium
GPRAQRQ

SEQ ID NO: 1181594 - protein, 5 aa, Mycobacterium
GPRDR

SEQ ID NO: 1181595 - protein, 7 aa, Mycobacterium
GPREQAI

SEQ ID NO: 1181596 - protein, 14 aa, Mycobacterium
GPRFDRDPDKYAAV

SEQ ID NO: 1181597 - protein, 14 aa, Mycobacterium
GPRFDRDPDKYASA

SEQ ID NO: 1181598 - protein, 9 aa, Mycobacterium
GPRGGPEEV

SEQ ID NO: 1181599 - protein, 19 aa, Mycobacterium
GPRRAYGGQSADVRRRQRR

SEQ ID NO: 1181600 - protein, 6 aa, Mycobacterium
GPRSEE

SEQ ID NO: 1181601 - protein, 6 aa, Mycobacterium
GPRSIK

SEQ ID NO: 1181602 - protein, 6 aa, Mycobacterium
GPRSTS

SEQ ID NO: 1181603 - protein, 6 aa, Mycobacterium
GPSAAR

SEQ ID NO: 1181604 - protein, 8 aa, Mycobacterium
GPSAYTAE

SEQ ID NO: 1181605 - protein, 5 aa, Mycobacterium
GPSDV

SEQ ID NO: 1181606 - protein, 40 aa, Mycobacterium
GPSGGAQAEAEGADEADADSDADSDTEADSDTEADEADEA

SEQ ID NO: 1181607 - protein, 12 aa, Mycobacterium
GPSPLSEPETRN

SEQ ID NO: 1181608 - protein, 6 aa, Mycobacterium
GPTELR

SEQ ID NO: 1181609 - protein, 7 aa, Mycobacterium
GPTETTV

SEQ ID NO: 1181610 - protein, 8 aa, Mycobacterium
GPTETTVE

SEQ ID NO: 1181611 - protein, 8 aa, Mycobacterium
GPTFTDSG

SEQ ID NO: 1181612 - protein, 9 aa, Mycobacterium
GPTFTDSGG

SEQ ID NO: 1181613 - protein, 17 aa, Mycobacterium
GPTGAKDETDDRHASGA

SEQ ID NO: 1181614 - protein, 8 aa, Mycobacterium
GPTPATRK

SEQ ID NO: 1181615 - protein, 21 aa, Mycobacterium
GPTPEAGQASRRDRFLELMLR

SEQ ID NO: 1181616 - protein, 14 aa, Mycobacterium
GPTPENPDFSGSKD

SEQ ID NO: 1181617 - protein, 6 aa, Mycobacterium
GPTPSD

SEQ ID NO: 1181618 - protein, 5 aa, Mycobacterium
GPVAT

SEQ ID NO: 1181619 - protein, 4 aa, Mycobacterium
GPVG

SEQ ID NO: 1181620 - protein, 5 aa, Mycobacterium
GPVNG

SEQ ID NO: 1181621 - protein, 19 aa, Mycobacterium
GPVPAARPAGAPDEPGAGM

SEQ ID NO: 1181622 - protein, 11 aa, Mycobacterium
GPVSGSARTAE

SEQ ID NO: 1181623 - protein, 5 aa, Mycobacterium
GPVSR

SEQ ID NO: 1181624 - protein, 4 aa, Mycobacterium
GPVY

SEQ ID NO: 1181625 - protein, 14 aa, Mycobacterium
GQAAAAAAAESKRP

SEQ ID NO: 1181626 - protein, 4 aa, Mycobacterium
GQAG

SEQ ID NO: 1181627 - protein, 6 aa, Mycobacterium
GQAGEL

SEQ ID NO: 1181628 - protein, 6 aa, Mycobacterium
GQAGQA

SEQ ID NO: 1181629 - protein, 4 aa, Mycobacterium
GQAP

SEQ ID NO: 1181630 - protein, 12 aa, Mycobacterium
GQATGRQVEGAT

SEQ ID NO: 1181631 - protein, 5 aa, Mycobacterium
GQDGS

SEQ ID NO: 1181632 - protein, 8 aa, Mycobacterium
GQDPRLAP

SEQ ID NO: 1181633 - protein, 10 aa, Mycobacterium
GQEQELRQSR

SEQ ID NO: 1181634 - protein, 13 aa, Mycobacterium
GQESDDSDDVETL

SEQ ID NO: 1181635 - protein, 10 aa, Mycobacterium
GQFENRRRAQ

SEQ ID NO: 1181636 - protein, 17 aa, Mycobacterium
GQGAKGGGSKPGLTAPA

SEQ ID NO: 1181637 - protein, 10 aa, Mycobacterium
GQGGARSGRL

SEQ ID NO: 1181638 - protein, 15 aa, Mycobacterium
GQGSPERDFGPRSED

SEQ ID NO: 1181639 - protein, 6 aa, Mycobacterium
GQLPGA

SEQ ID NO: 1181640 - protein, 9 aa, Mycobacterium
GQLSPDGVS

SEQ ID NO: 1181641 - protein, 6 aa, Mycobacterium
GQNAHT

SEQ ID NO: 1181642 - protein, 7 aa, Mycobacterium
GQNPDKS

SEQ ID NO: 1181643 - protein, 9 aa, Mycobacterium
GQPAANPVV

SEQ ID NO: 1181644 - protein, 5 aa, Mycobacterium
GQPAT

SEQ ID NO: 1181645 - protein, 7 aa, Mycobacterium
GQPDQPH

SEQ ID NO: 1181646 - protein, 6 aa, Mycobacterium
GQPDSI

SEQ ID NO: 1181647 - protein, 9 aa, Mycobacterium
GQPQRKGSE

SEQ ID NO: 1181648 - protein, 5 aa, Mycobacterium
GQPRY

SEQ ID NO: 1181649 - protein, 13 aa, Mycobacterium
GQPVDDPDIPGKL

SEQ ID NO: 1181650 - protein, 12 aa, Mycobacterium
GQPVDDPEIPGK

SEQ ID NO: 1181651 - protein, 5 aa, Mycobacterium
GQQAT

SEQ ID NO: 1181652 - protein, 6 aa, Mycobacterium
GQRASY

SEQ ID NO: 1181653 - protein, 12 aa, Mycobacterium
GQRGASAPRPAR

SEQ ID NO: 1181654 - protein, 5 aa, Mycobacterium
GQRHT

SEQ ID NO: 1181655 - protein, 6 aa, Mycobacterium
GQRKPM

SEQ ID NO: 1181656 - protein, 8 aa, Mycobacterium
GQRKPMAS

SEQ ID NO: 1181657 - protein, 6 aa, Mycobacterium
GQRSAD

SEQ ID NO: 1181658 - protein, 4 aa, Mycobacterium
GQRY

SEQ ID NO: 1181659 - protein, 12 aa, Mycobacterium
GQSAALQLIEQP

SEQ ID NO: 1181660 - protein, 7 aa, Mycobacterium
GQSGARF

SEQ ID NO: 1181661 - protein, 8 aa, Mycobacterium
GQSLNADA

SEQ ID NO: 1181662 - protein, 8 aa, Mycobacterium
GQSRPRTR

SEQ ID NO: 1181663 - protein, 4 aa, Mycobacterium
GQSS

SEQ ID NO: 1181664 - protein, 19 aa, Mycobacterium
GQTAASRGPGCRSGGLGDG

SEQ ID NO: 1181665 - protein, 5 aa, Mycobacterium
GQTAK

SEQ ID NO: 1181666 - protein, 6 aa, Mycobacterium
GQTIPA

SEQ ID NO: 1181667 - protein, 7 aa, Mycobacterium
GQTTTPY

SEQ ID NO: 1181668 - protein, 6 aa, Mycobacterium
GQTWQP

SEQ ID NO: 1181669 - protein, 18 aa, Mycobacterium
GQYASEMTGAGAWPETDE

SEQ ID NO: 1181670 - protein, 14 aa, Mycobacterium
GQYGGQGVPSDDRS

SEQ ID NO: 1181671 - protein, 9 aa, Mycobacterium
GRAASTRRE

SEQ ID NO: 1181672 - protein, 6 aa, Mycobacterium
GRADEP

SEQ ID NO: 1181673 - protein, 6 aa, Mycobacterium
GRADTC

SEQ ID NO: 1181674 - protein, 5 aa, Mycobacterium
GRALA

SEQ ID NO: 1181675 - protein, 29 aa, Mycobacterium
GRANSRRAVPTGTVPDSPAVGGDPADRHP

SEQ ID NO: 1181676 - protein, 26 aa, Mycobacterium
GRAPGETTVPDRCDPPKLDDADARTA

SEQ ID NO: 1181677 - protein, 9 aa, Mycobacterium
GRASPPTDR

SEQ ID NO: 1181678 - protein, 8 aa, Mycobacterium
GRATGSIE

SEQ ID NO: 1181679 - protein, 14 aa, Mycobacterium
GRATIDPNHTPAVE

SEQ ID NO: 1181680 - protein, 6 aa, Mycobacterium
GRDDDM

SEQ ID NO: 1181681 - protein, 5 aa, Mycobacterium
GRDDP

SEQ ID NO: 1181682 - protein, 6 aa, Mycobacterium
GRDDPA

SEQ ID NO: 1181683 - protein, 11 aa, Mycobacterium
GRDLEAQDYSE

SEQ ID NO: 1181684 - protein, 11 aa, Mycobacterium
GRDLESQDYSE

SEQ ID NO: 1181685 - protein, 11 aa, Mycobacterium
GRDNRDESKIR

SEQ ID NO: 1181686 - protein, 14 aa, Mycobacterium
GRDPERGGTAAASH

SEQ ID NO: 1181687 - protein, 6 aa, Mycobacterium
GRDPIG

SEQ ID NO: 1181688 - protein, 7 aa, Mycobacterium
GRDVGAE

SEQ ID NO: 1181689 - protein, 23 aa, Mycobacterium
GREQAAALDASGRLRSGDAGPVA

SEQ ID NO: 1181690 - protein, 7 aa, Mycobacterium
GRFEGPG

SEQ ID NO: 1181691 - protein, 5 aa, Mycobacterium
GRGAG

SEQ ID NO: 1181692 - protein, 20 aa, Mycobacterium
GRGAQEGRTALSAPGGTRVR

SEQ ID NO: 1181693 - protein, 9 aa, Mycobacterium
GRGARTIPD

SEQ ID NO: 1181694 - protein, 13 aa, Mycobacterium
GRGDKEGGDGAAV

SEQ ID NO: 1181695 - protein, 16 aa, Mycobacterium
GRGGGTTYKLPEGSFE

SEQ ID NO: 1181696 - protein, 6 aa, Mycobacterium
GRGHTY

SEQ ID NO: 1181697 - protein, 6 aa, Mycobacterium
GRGMPR

SEQ ID NO: 1181698 - protein, 6 aa, Mycobacterium
GRGYTS

SEQ ID NO: 1181699 - protein, 6 aa, Mycobacterium
GRHAEA

SEQ ID NO: 1181700 - protein, 8 aa, Mycobacterium
GRHEDYEA

SEQ ID NO: 1181701 - protein, 5 aa, Mycobacterium
GRHEQ

SEQ ID NO: 1181702 - protein, 10 aa, Mycobacterium
GRIANTETQF

SEQ ID NO: 1181703 - protein, 11 aa, Mycobacterium
GRIDAADRAQF

SEQ ID NO: 1181704 - protein, 4 aa, Mycobacterium
GRIG

SEQ ID NO: 1181705 - protein, 5 aa, Mycobacterium
GRIPT

SEQ ID NO: 1181706 - protein, 4 aa, Mycobacterium
GRIS

SEQ ID NO: 1181707 - protein, 9 aa, Mycobacterium
GRISTESAS

SEQ ID NO: 1181708 - protein, 9 aa, Mycobacterium
GRKAAGGTA

SEQ ID NO: 1181709 - protein, 9 aa, Mycobacterium
GRKEAAGDD

SEQ ID NO: 1181710 - protein, 47 aa, Mycobacterium
GRKPGSSRGQAQPAPKRTAREKTLAKQAARAAAGKGARKPGRAGRGR

SEQ ID NO: 1181711 - protein, 8 aa, Mycobacterium
GRKTGMPR

SEQ ID NO: 1181712 - protein, 8 aa, Mycobacterium
GRLGSHNG

SEQ ID NO: 1181713 - protein, 4 aa, Mycobacterium
GRLR

SEQ ID NO: 1181714 - protein, 9 aa, Mycobacterium
GRLSEGTER

SEQ ID NO: 1181715 - protein, 7 aa, Mycobacterium
GRLTATG

SEQ ID NO: 1181716 - protein, 9 aa, Mycobacterium
GRNGDGKTT

SEQ ID NO: 1181717 - protein, 15 aa, Mycobacterium
GRNPDAVEQAAQRVS

SEQ ID NO: 1181718 - protein, 6 aa, Mycobacterium
GRNPEE

SEQ ID NO: 1181719 - protein, 7 aa, Mycobacterium
GRPAPMA

SEQ ID NO: 1181720 - protein, 8 aa, Mycobacterium
GRPATERF

SEQ ID NO: 1181721 - protein, 5 aa, Mycobacterium
GRPDR

SEQ ID NO: 1181722 - protein, 7 aa, Mycobacterium
GRPEAAA

SEQ ID NO: 1181723 - protein, 5 aa, Mycobacterium
GRPGV

SEQ ID NO: 1181724 - protein, 6 aa, Mycobacterium
GRPQGR

SEQ ID NO: 1181725 - protein, 13 aa, Mycobacterium
GRPRGDERGGDSA

SEQ ID NO: 1181726 - protein, 8 aa, Mycobacterium
GRPRPGET

SEQ ID NO: 1181727 - protein, 6 aa, Mycobacterium
GRQVPG

SEQ ID NO: 1181728 - protein, 9 aa, Mycobacterium
GRRAKDPVA

SEQ ID NO: 1181729 - protein, 13 aa, Mycobacterium
GRREADSAEGTSM

SEQ ID NO: 1181730 - protein, 5 aa, Mycobacterium
GRREG

SEQ ID NO: 1181731 - protein, 14 aa, Mycobacterium
GRREPIPLPPKTSY

SEQ ID NO: 1181732 - protein, 23 aa, Mycobacterium
GRRLKPPQDLPTKIAPDRFDPPE

SEQ ID NO: 1181733 - protein, 5 aa, Mycobacterium
GRRMP

SEQ ID NO: 1181734 - protein, 6 aa, Mycobacterium
GRRNQP

SEQ ID NO: 1181735 - protein, 7 aa, Mycobacterium
GRRPATV

SEQ ID NO: 1181736 - protein, 4 aa, Mycobacterium
GRRR

SEQ ID NO: 1181737 - protein, 117 aa, Mycobacterium
GRRRPAPEEAVDEDVYDDEDEDEQDLLESEDDVDDLSDDDEDQAVDEETDEDTDLDEEPEEEPEPEPPPRRRRAARQPAAAKTAMRRSSRATADDVPATSAARHGRSATKRAPIRRG

SEQ ID NO: 1181738 - protein, 16 aa, Mycobacterium
GRRRSREAQAATGKDD

SEQ ID NO: 1181739 - protein, 6 aa, Mycobacterium
GRRSRD

SEQ ID NO: 1181740 - protein, 6 aa, Mycobacterium
GRSAAD

SEQ ID NO: 1181741 - protein, 6 aa, Mycobacterium
GRSATF

SEQ ID NO: 1181742 - protein, 4 aa, Mycobacterium
GRSE

SEQ ID NO: 1181743 - protein, 13 aa, Mycobacterium
GRSGERPPSHPPV

SEQ ID NO: 1181744 - protein, 14 aa, Mycobacterium
GRSGNRGPTAAPQN

SEQ ID NO: 1181745 - protein, 12 aa, Mycobacterium
GRSREFSSATPD

SEQ ID NO: 1181746 - protein, 5 aa, Mycobacterium
GRSSR

SEQ ID NO: 1181747 - protein, 6 aa, Mycobacterium
GRSTES

SEQ ID NO: 1181748 - protein, 9 aa, Mycobacterium
GRSTHDSAQ

SEQ ID NO: 1181749 - protein, 10 aa, Mycobacterium
GRTAAESLNL

SEQ ID NO: 1181750 - protein, 9 aa, Mycobacterium
GRTDADADT

SEQ ID NO: 1181751 - protein, 8 aa, Mycobacterium
GRTDGVAV

SEQ ID NO: 1181752 - protein, 5 aa, Mycobacterium
GRTEA

SEQ ID NO: 1181753 - protein, 13 aa, Mycobacterium
GRTQRGHRGLEVV

SEQ ID NO: 1181754 - protein, 4 aa, Mycobacterium
GRTS

SEQ ID NO: 1181755 - protein, 6 aa, Mycobacterium
GRVDSH

SEQ ID NO: 1181756 - protein, 13 aa, Mycobacterium
GRVETSTDAREDL

SEQ ID NO: 1181757 - protein, 4 aa, Mycobacterium
GRVP

SEQ ID NO: 1181758 - protein, 6 aa, Mycobacterium
GRVPRQ

SEQ ID NO: 1181759 - protein, 8 aa, Mycobacterium
GRVSGTPV

SEQ ID NO: 1181760 - protein, 22 aa, Mycobacterium
GSAAARAAAAEAVEQGAGQGSV

SEQ ID NO: 1181761 - protein, 5 aa, Mycobacterium
GSAEE

SEQ ID NO: 1181762 - protein, 9 aa, Mycobacterium
GSAELGDDA

SEQ ID NO: 1181763 - protein, 14 aa, Mycobacterium
GSAFPYRKDPEDKN

SEQ ID NO: 1181764 - protein, 7 aa, Mycobacterium
GSAGFGT

SEQ ID NO: 1181765 - protein, 9 aa, Mycobacterium
GSAGKTSTC

SEQ ID NO: 1181766 - protein, 6 aa, Mycobacterium
GSAGSV

SEQ ID NO: 1181767 - protein, 10 aa, Mycobacterium
GSAGTAEQLG

SEQ ID NO: 1181768 - protein, 5 aa, Mycobacterium
GSAHR

SEQ ID NO: 1181769 - protein, 10 aa, Mycobacterium
GSAKHAQRHV

SEQ ID NO: 1181770 - protein, 6 aa, Mycobacterium
GSAPFA

SEQ ID NO: 1181771 - protein, 5 aa, Mycobacterium
GSAPI

SEQ ID NO: 1181772 - protein, 8 aa, Mycobacterium
GSAPSGEI

SEQ ID NO: 1181773 - protein, 11 aa, Mycobacterium
GSARATGMPYG

SEQ ID NO: 1181774 - protein, 6 aa, Mycobacterium
GSASGR

SEQ ID NO: 1181775 - protein, 10 aa, Mycobacterium
GSATADSARQ

SEQ ID NO: 1181776 - protein, 8 aa, Mycobacterium
GSATVGGV

SEQ ID NO: 1181777 - protein, 7 aa, Mycobacterium
GSAVGKE

SEQ ID NO: 1181778 - protein, 9 aa, Mycobacterium
GSCRSGSKF

SEQ ID NO: 1181779 - protein, 4 aa, Mycobacterium
GSDE

SEQ ID NO: 1181780 - protein, 9 aa, Mycobacterium
GSDFGATDD

SEQ ID NO: 1181781 - protein, 7 aa, Mycobacterium
GSDGSTV

SEQ ID NO: 1181782 - protein, 21 aa, Mycobacterium
GSDLASQTGTGGAGPVGFAGT

SEQ ID NO: 1181783 - protein, 12 aa, Mycobacterium
GSDTEHGERTGY

SEQ ID NO: 1181784 - protein, 16 aa, Mycobacterium
GSEANRQRAAEAGRQQ

SEQ ID NO: 1181785 - protein, 6 aa, Mycobacterium
GSEDER

SEQ ID NO: 1181786 - protein, 14 aa, Mycobacterium
GSEEALEAAGESLH

SEQ ID NO: 1181787 - protein, 6 aa, Mycobacterium
GSEHSQ

SEQ ID NO: 1181788 - protein, 4 aa, Mycobacterium
GSEL

SEQ ID NO: 1181789 - protein, 4 aa, Mycobacterium
GSEP

SEQ ID NO: 1181790 - protein, 11 aa, Mycobacterium
GSGASDPAAWD

SEQ ID NO: 1181791 - protein, 12 aa, Mycobacterium
GSGATHASRDKF

SEQ ID NO: 1181792 - protein, 14 aa, Mycobacterium
GSGATLGSALTDTA

SEQ ID NO: 1181793 - protein, 19 aa, Mycobacterium
GSGATVEGQVTGEETHGGV

SEQ ID NO: 1181794 - protein, 22 aa, Mycobacterium
GSGAVEPANAGPYVDRTRTDPG

SEQ ID NO: 1181795 - protein, 4 aa, Mycobacterium
GSGD

SEQ ID NO: 1181796 - protein, 12 aa, Mycobacterium
GSGDKRRNNKAR

SEQ ID NO: 1181797 - protein, 5 aa, Mycobacterium
GSGDP

SEQ ID NO: 1181798 - protein, 6 aa, Mycobacterium
GSGDPV

SEQ ID NO: 1181799 - protein, 7 aa, Mycobacterium
GSGGDFN

SEQ ID NO: 1181800 - protein, 22 aa, Mycobacterium
GSGQGKAGKASGVRRIDDDDRV

SEQ ID NO: 1181801 - protein, 6 aa, Mycobacterium
GSGSPA

SEQ ID NO: 1181802 - protein, 14 aa, Mycobacterium
GSGSSNGSGTATAA

SEQ ID NO: 1181803 - protein, 6 aa, Mycobacterium
GSGYGS

SEQ ID NO: 1181804 - protein, 18 aa, Mycobacterium
GSHDPAPGKQWGGATPLA

SEQ ID NO: 1181805 - protein, 14 aa, Mycobacterium
GSIKPGDPTSKRTV

SEQ ID NO: 1181806 - protein, 14 aa, Mycobacterium
GSIPEGTDFTQDSR

SEQ ID NO: 1181807 - protein, 19 aa, Mycobacterium
GSIPTTTSGKIRRTASAEL

SEQ ID NO: 1181808 - protein, 6 aa, Mycobacterium
GSIPVE

SEQ ID NO: 1181809 - protein, 7 aa, Mycobacterium
GSKAAEQ

SEQ ID NO: 1181810 - protein, 8 aa, Mycobacterium
GSKGTPQI

SEQ ID NO: 1181811 - protein, 9 aa, Mycobacterium
GSLAGTSDG

SEQ ID NO: 1181812 - protein, 8 aa, Mycobacterium
GSLDQEED

SEQ ID NO: 1181813 - protein, 25 aa, Mycobacterium
GSMGPPAGAVPPPAPTVPAGGPGAA

SEQ ID NO: 1181814 - protein, 7 aa, Mycobacterium
GSMSGST

SEQ ID NO: 1181815 - protein, 6 aa, Mycobacterium
GSMTQD

SEQ ID NO: 1181816 - protein, 9 aa, Mycobacterium
GSMVSGDES

SEQ ID NO: 1181817 - protein, 7 aa, Mycobacterium
GSNGTEL

SEQ ID NO: 1181818 - protein, 21 aa, Mycobacterium
GSPDTRAPHAEGNFPTPSGKC

SEQ ID NO: 1181819 - protein, 5 aa, Mycobacterium
GSPGG

SEQ ID NO: 1181820 - protein, 9 aa, Mycobacterium
GSPGSLTTA

SEQ ID NO: 1181821 - protein, 8 aa, Mycobacterium
GSPGTGRH

SEQ ID NO: 1181822 - protein, 17 aa, Mycobacterium
GSPPMLSGSGTADAEAE

SEQ ID NO: 1181823 - protein, 9 aa, Mycobacterium
GSPRPGNYQ

SEQ ID NO: 1181824 - protein, 8 aa, Mycobacterium
GSPSSQRL

SEQ ID NO: 1181825 - protein, 10 aa, Mycobacterium
GSPTAAPADE

SEQ ID NO: 1181826 - protein, 9 aa, Mycobacterium
GSPTEAADQ

SEQ ID NO: 1181827 - protein, 8 aa, Mycobacterium
GSQEDVKT

SEQ ID NO: 1181828 - protein, 11 aa, Mycobacterium
GSQLATAAGGD

SEQ ID NO: 1181829 - protein, 11 aa, Mycobacterium
GSQSIGRTSTL

SEQ ID NO: 1181830 - protein, 8 aa, Mycobacterium
GSQTLEER

SEQ ID NO: 1181831 - protein, 6 aa, Mycobacterium
GSRAAL

SEQ ID NO: 1181832 - protein, 6 aa, Mycobacterium
GSRDRC

SEQ ID NO: 1181833 - protein, 7 aa, Mycobacterium
GSREEMK

SEQ ID NO: 1181834 - protein, 6 aa, Mycobacterium
GSRLER

SEQ ID NO: 1181835 - protein, 12 aa, Mycobacterium
GSRPGDPALAKG

SEQ ID NO: 1181836 - protein, 24 aa, Mycobacterium
GSRRSTGRRGAPAHRQRARPPRLS

SEQ ID NO: 1181837 - protein, 20 aa, Mycobacterium
GSRVGGAEQPLRGRPPQARP

SEQ ID NO: 1181838 - protein, 6 aa, Mycobacterium
GSSAPY

SEQ ID NO: 1181839 - protein, 19 aa, Mycobacterium
GSSESGAQMSTYASAGAEV

SEQ ID NO: 1181840 - protein, 6 aa, Mycobacterium
GSSHPL

SEQ ID NO: 1181841 - protein, 4 aa, Mycobacterium
GSSI

SEQ ID NO: 1181842 - protein, 96 aa, Mycobacterium
GSSTGAEGGAQHQDSTGRELPADSPEATERQDNPASEAPGTDTGGGAGEPVADSRQVSDDPPADLQEGEPDPADDGKPDREAAKYRRERNEARAEV

SEQ ID NO: 1181843 - protein, 4 aa, Mycobacterium
GSSV

SEQ ID NO: 1181844 - protein, 9 aa, Mycobacterium
GSTGAGKST

SEQ ID NO: 1181845 - protein, 4 aa, Mycobacterium
GSTM

SEQ ID NO: 1181846 - protein, 5 aa, Mycobacterium
GSTPL

SEQ ID NO: 1181847 - protein, 8 aa, Mycobacterium
GSTPTGRR

SEQ ID NO: 1181848 - protein, 15 aa, Mycobacterium
GSVRPSASASSPSAV

SEQ ID NO: 1181849 - protein, 6 aa, Mycobacterium
GSVRTG

SEQ ID NO: 1181850 - protein, 4 aa, Mycobacterium
GSYA

SEQ ID NO: 1181851 - protein, 5 aa, Mycobacterium
GSYAA

SEQ ID NO: 1181852 - protein, 8 aa, Mycobacterium
GSYDGYGN

SEQ ID NO: 1181853 - protein, 9 aa, Mycobacterium
GSYEATQRI

SEQ ID NO: 1181854 - protein, 6 aa, Mycobacterium
GTAATN

SEQ ID NO: 1181855 - protein, 7 aa, Mycobacterium
GTAEQRD

SEQ ID NO: 1181856 - protein, 26 aa, Mycobacterium
GTAGGRDEVPTASTPTSNRPRGDDSW

SEQ ID NO: 1181857 - protein, 8 aa, Mycobacterium
GTAGPGTT

SEQ ID NO: 1181858 - protein, 9 aa, Mycobacterium
GTAGQRVPE

SEQ ID NO: 1181859 - protein, 41 aa, Mycobacterium
GTAPAPAPAGGSNNADGSAPPPLPITPPRTQAAPAPPPRHA

SEQ ID NO: 1181860 - protein, 14 aa, Mycobacterium
GTAPMGDEDDPRAV

SEQ ID NO: 1181861 - protein, 4 aa, Mycobacterium
GTAS

SEQ ID NO: 1181862 - protein, 5 aa, Mycobacterium
GTCDP

SEQ ID NO: 1181863 - protein, 4 aa, Mycobacterium
GTCE

SEQ ID NO: 1181864 - protein, 11 aa, Mycobacterium
GTDAGDQAPKG

SEQ ID NO: 1181865 - protein, 18 aa, Mycobacterium
GTDGEPIYRRNDDAANRR

SEQ ID NO: 1181866 - protein, 8 aa, Mycobacterium
GTDGPNYH

SEQ ID NO: 1181867 - protein, 5 aa, Mycobacterium
GTDGV

SEQ ID NO: 1181868 - protein, 39 aa, Mycobacterium
GTDIDGTGASGAPGDGTGASGAPGDGTGASGAPGDGTEL

SEQ ID NO: 1181869 - protein, 8 aa, Mycobacterium
GTDITDEA

SEQ ID NO: 1181870 - protein, 9 aa, Mycobacterium
GTDITDEAQ

SEQ ID NO: 1181871 - protein, 5 aa, Mycobacterium
GTDKI

SEQ ID NO: 1181872 - protein, 8 aa, Mycobacterium
GTDPSSDI

SEQ ID NO: 1181873 - protein, 14 aa, Mycobacterium
GTDSGGGAGIQADS

SEQ ID NO: 1181874 - protein, 4 aa, Mycobacterium
GTDV

SEQ ID NO: 1181875 - protein, 5 aa, Mycobacterium
GTDVK

SEQ ID NO: 1181876 - protein, 10 aa, Mycobacterium
GTDWSTHSAG

SEQ ID NO: 1181877 - protein, 6 aa, Mycobacterium
GTEASW

SEQ ID NO: 1181878 - protein, 5 aa, Mycobacterium
GTEDA

SEQ ID NO: 1181879 - protein, 6 aa, Mycobacterium
GTEDLA

SEQ ID NO: 1181880 - protein, 7 aa, Mycobacterium
GTEEQRR

SEQ ID NO: 1181881 - protein, 5 aa, Mycobacterium
GTEKL

SEQ ID NO: 1181882 - protein, 8 aa, Mycobacterium
GTELKSGE

SEQ ID NO: 1181883 - protein, 6 aa, Mycobacterium
GTFRPA

SEQ ID NO: 1181884 - protein, 9 aa, Mycobacterium
GTGAGRGGM

SEQ ID NO: 1181885 - protein, 5 aa, Mycobacterium
GTGGG

SEQ ID NO: 1181886 - protein, 6 aa, Mycobacterium
GTGGQT

SEQ ID NO: 1181887 - protein, 7 aa, Mycobacterium
GTGGQTR

SEQ ID NO: 1181888 - protein, 9 aa, Mycobacterium
GTGGTVAGT

SEQ ID NO: 1181889 - protein, 5 aa, Mycobacterium
GTGQM

SEQ ID NO: 1181890 - protein, 8 aa, Mycobacterium
GTGSVVPG

SEQ ID NO: 1181891 - protein, 7 aa, Mycobacterium
GTHADGA

SEQ ID NO: 1181892 - protein, 4 aa, Mycobacterium
GTIQ

SEQ ID NO: 1181893 - protein, 12 aa, Mycobacterium
GTKADRRPASEA

SEQ ID NO: 1181894 - protein, 19 aa, Mycobacterium
GTKPAFDNRRHKYEAFPEL

SEQ ID NO: 1181895 - protein, 9 aa, Mycobacterium
GTKQKANRI

SEQ ID NO: 1181896 - protein, 4 aa, Mycobacterium
GTLG

SEQ ID NO: 1181897 - protein, 9 aa, Mycobacterium
GTLSGPQQV

SEQ ID NO: 1181898 - protein, 12 aa, Mycobacterium
GTLTSNGALSSA

SEQ ID NO: 1181899 - protein, 5 aa, Mycobacterium
GTNPR

SEQ ID NO: 1181900 - protein, 10 aa, Mycobacterium
GTPCEPRSVA

SEQ ID NO: 1181901 - protein, 5 aa, Mycobacterium
GTPEQ

SEQ ID NO: 1181902 - protein, 12 aa, Mycobacterium
GTPFAPTRPETV

SEQ ID NO: 1181903 - protein, 10 aa, Mycobacterium
GTPGDDTTSD

SEQ ID NO: 1181904 - protein, 10 aa, Mycobacterium
GTPGPDPNNQ

SEQ ID NO: 1181905 - protein, 13 aa, Mycobacterium
GTPHSVRKDARPS

SEQ ID NO: 1181906 - protein, 13 aa, Mycobacterium
GTPKKGDAQSYGR

SEQ ID NO: 1181907 - protein, 4 aa, Mycobacterium
GTPL

SEQ ID NO: 1181908 - protein, 5 aa, Mycobacterium
GTPLQ

SEQ ID NO: 1181909 - protein, 22 aa, Mycobacterium
GTPSCEYNESEALGSDAPKPDD

SEQ ID NO: 1181910 - protein, 10 aa, Mycobacterium
GTPSSDPPLE

SEQ ID NO: 1181911 - protein, 9 aa, Mycobacterium
GTPTADRPL

SEQ ID NO: 1181912 - protein, 5 aa, Mycobacterium
GTPTY

SEQ ID NO: 1181913 - protein, 5 aa, Mycobacterium
GTPYL

SEQ ID NO: 1181914 - protein, 7 aa, Mycobacterium
GTPYRSE

SEQ ID NO: 1181915 - protein, 4 aa, Mycobacterium
GTQA

SEQ ID NO: 1181916 - protein, 7 aa, Mycobacterium
GTQATPA

SEQ ID NO: 1181917 - protein, 13 aa, Mycobacterium
GTQIGSDSRAAIR

SEQ ID NO: 1181918 - protein, 8 aa, Mycobacterium
GTQRSAPI

SEQ ID NO: 1181919 - protein, 6 aa, Mycobacterium
GTRDNA

SEQ ID NO: 1181920 - protein, 9 aa, Mycobacterium
GTREMSPAA

SEQ ID NO: 1181921 - protein, 6 aa, Mycobacterium
GTRIPY

SEQ ID NO: 1181922 - protein, 4 aa, Mycobacterium
GTRL

SEQ ID NO: 1181923 - protein, 15 aa, Mycobacterium
GTRPPDSGRVTHTSG

SEQ ID NO: 1181924 - protein, 4 aa, Mycobacterium
GTRT

SEQ ID NO: 1181925 - protein, 13 aa, Mycobacterium
GTSEPGGNASISA

SEQ ID NO: 1181926 - protein, 22 aa, Mycobacterium
GTSGRNAARRAAQRADSARRHP

SEQ ID NO: 1181927 - protein, 11 aa, Mycobacterium
GTSNATAMATR

SEQ ID NO: 1181928 - protein, 13 aa, Mycobacterium
GTTADADEITDTA

SEQ ID NO: 1181929 - protein, 29 aa, Mycobacterium
GTTAPTGRSRRNGGEQSTASEHLTIRGGF

SEQ ID NO: 1181930 - protein, 6 aa, Mycobacterium
GTTAQH

SEQ ID NO: 1181931 - protein, 14 aa, Mycobacterium
GTTGAGDDIVTQTR

SEQ ID NO: 1181932 - protein, 13 aa, Mycobacterium
GTTGESPTTTDDE

SEQ ID NO: 1181933 - protein, 14 aa, Mycobacterium
GTTGESPTTTDDEK

SEQ ID NO: 1181934 - protein, 5 aa, Mycobacterium
GTTGL

SEQ ID NO: 1181935 - protein, 10 aa, Mycobacterium
GTTRRTDRAR

SEQ ID NO: 1181936 - protein, 9 aa, Mycobacterium
GTTSKPKLV

SEQ ID NO: 1181937 - protein, 6 aa, Mycobacterium
GTTTAR

SEQ ID NO: 1181938 - protein, 11 aa, Mycobacterium
GTTTAREGRAA

SEQ ID NO: 1181939 - protein, 5 aa, Mycobacterium
GTVEP

SEQ ID NO: 1181940 - protein, 6 aa, Mycobacterium
GTVEPD

SEQ ID NO: 1181941 - protein, 10 aa, Mycobacterium
GTVTADGREY

SEQ ID NO: 1181942 - protein, 5 aa, Mycobacterium
GTYYD

SEQ ID NO: 1181943 - protein, 18 aa, Mycobacterium
GVAGPNRRTFGHGGSGGS

SEQ ID NO: 1181944 - protein, 5 aa, Mycobacterium
GVAPA

SEQ ID NO: 1181945 - protein, 8 aa, Mycobacterium
GVAQSSGF

SEQ ID NO: 1181946 - protein, 14 aa, Mycobacterium
GVARAGAAAAARRR

SEQ ID NO: 1181947 - protein, 5 aa, Mycobacterium
GVARY

SEQ ID NO: 1181948 - protein, 5 aa, Mycobacterium
GVASG

SEQ ID NO: 1181949 - protein, 7 aa, Mycobacterium
GVASRDS

SEQ ID NO: 1181950 - protein, 6 aa, Mycobacterium
GVATAR

SEQ ID NO: 1181951 - protein, 17 aa, Mycobacterium
GVDAANEAGAFIRKNLG

SEQ ID NO: 1181952 - protein, 23 aa, Mycobacterium
GVDGAGRRRQNGPVSGRPGGVAG

SEQ ID NO: 1181953 - protein, 9 aa, Mycobacterium
GVDPGPTDI

SEQ ID NO: 1181954 - protein, 5 aa, Mycobacterium
GVEGA

SEQ ID NO: 1181955 - protein, 6 aa, Mycobacterium
GVEKGP

SEQ ID NO: 1181956 - protein, 10 aa, Mycobacterium
GVEPAATRRE

SEQ ID NO: 1181957 - protein, 8 aa, Mycobacterium
GVGGAETL

SEQ ID NO: 1181958 - protein, 10 aa, Mycobacterium
GVGGPAAYAA

SEQ ID NO: 1181959 - protein, 12 aa, Mycobacterium
GVGNGKERPNTP

SEQ ID NO: 1181960 - protein, 7 aa, Mycobacterium
GVGPDGR

SEQ ID NO: 1181961 - protein, 5 aa, Mycobacterium
GVHGP

SEQ ID NO: 1181962 - protein, 5 aa, Mycobacterium
GVNPK

SEQ ID NO: 1181963 - protein, 5 aa, Mycobacterium
GVPGV

SEQ ID NO: 1181964 - protein, 7 aa, Mycobacterium
GVPKAGV

SEQ ID NO: 1181965 - protein, 13 aa, Mycobacterium
GVPKGSGEPHKTK

SEQ ID NO: 1181966 - protein, 8 aa, Mycobacterium
GVPPEQIE

SEQ ID NO: 1181967 - protein, 12 aa, Mycobacterium
GVPPRSLAGSDT

SEQ ID NO: 1181968 - protein, 8 aa, Mycobacterium
GVPTSGYA

SEQ ID NO: 1181969 - protein, 50 aa, Mycobacterium
GVPVPPPAEPADSDKAEPAKRTRRRKPDKSEEPDHEPDAEPEPDPGDSAT

SEQ ID NO: 1181970 - protein, 6 aa, Mycobacterium
GVQAKS

SEQ ID NO: 1181971 - protein, 13 aa, Mycobacterium
GVQKGSGEPHKTK

SEQ ID NO: 1181972 - protein, 4 aa, Mycobacterium
GVQR

SEQ ID NO: 1181973 - protein, 11 aa, Mycobacterium
GVQVTDDGRGI

SEQ ID NO: 1181974 - protein, 13 aa, Mycobacterium
GVREAADKGDAIF

SEQ ID NO: 1181975 - protein, 7 aa, Mycobacterium
GVSGEPA

SEQ ID NO: 1181976 - protein, 5 aa, Mycobacterium
GVSGG

SEQ ID NO: 1181977 - protein, 5 aa, Mycobacterium
GVSKA

SEQ ID NO: 1181978 - protein, 6 aa, Mycobacterium
GVSPGF

SEQ ID NO: 1181979 - protein, 6 aa, Mycobacterium
GVSREE

SEQ ID NO: 1181980 - protein, 12 aa, Mycobacterium
GVSRGELTEAGA

SEQ ID NO: 1181981 - protein, 7 aa, Mycobacterium
GVTDPAS

SEQ ID NO: 1181982 - protein, 17 aa, Mycobacterium
GVTPSGPLAADGKHRAE

SEQ ID NO: 1181983 - protein, 4 aa, Mycobacterium
GVTS

SEQ ID NO: 1181984 - protein, 6 aa, Mycobacterium
GVVTTT

SEQ ID NO: 1181985 - protein, 13 aa, Mycobacterium
GWARAENAATARK

SEQ ID NO: 1181986 - protein, 17 aa, Mycobacterium
GWATGVSDRDTANAENI

SEQ ID NO: 1181987 - protein, 12 aa, Mycobacterium
GWKGGAASAFGT

SEQ ID NO: 1181988 - protein, 9 aa, Mycobacterium
GWPATAAEA

SEQ ID NO: 1181989 - protein, 27 aa, Mycobacterium
GWTTQRPGNGRTQWTPPEDHDTGQPRI

SEQ ID NO: 1181990 - protein, 6 aa, Mycobacterium
GYAGGR

SEQ ID NO: 1181991 - protein, 8 aa, Mycobacterium
GYDAVPGG

SEQ ID NO: 1181992 - protein, 17 aa, Mycobacterium
GYGERSTERTNSRNGYR

SEQ ID NO: 1181993 - protein, 5 aa, Mycobacterium
GYGPD

SEQ ID NO: 1181994 - protein, 7 aa, Mycobacterium
GYGPETP

SEQ ID NO: 1181995 - protein, 6 aa, Mycobacterium
GYGSSL

SEQ ID NO: 1181996 - protein, 4 aa, Mycobacterium
GYGT

SEQ ID NO: 1181997 - protein, 38 aa, Mycobacterium
GYKRNDPKSESGGDDARTTADDDDSDSDSDRDPTAGRP

SEQ ID NO: 1181998 - protein, 8 aa, Mycobacterium
GYNENNQR

SEQ ID NO: 1181999 - protein, 4 aa, Mycobacterium
GYPD

SEQ ID NO: 1182000 - protein, 6 aa, Mycobacterium
GYPDAT

SEQ ID NO: 1182001 - protein, 7 aa, Mycobacterium
GYPEATT

SEQ ID NO: 1182002 - protein, 5 aa, Mycobacterium
GYPGG

SEQ ID NO: 1182003 - protein, 9 aa, Mycobacterium
GYRESTESW

SEQ ID NO: 1182004 - protein, 5 aa, Mycobacterium
GYSKE

SEQ ID NO: 1182005 - protein, 9 aa, Mycobacterium
GYTSDERKY

SEQ ID NO: 1182006 - protein, 5 aa, Mycobacterium
GYVGE

SEQ ID NO: 1182007 - protein, 8 aa, Mycobacterium
HAAAGLPR

SEQ ID NO: 1182008 - protein, 15 aa, Mycobacterium
HAAEKPTATILTELA

SEQ ID NO: 1182009 - protein, 10 aa, Mycobacterium
HADGRGTVET

SEQ ID NO: 1182010 - protein, 7 aa, Mycobacterium
HADPATR

SEQ ID NO: 1182011 - protein, 7 aa, Mycobacterium
HADTYPQ

SEQ ID NO: 1182012 - protein, 6 aa, Mycobacterium
HAEQAG

SEQ ID NO: 1182013 - protein, 37 aa, Mycobacterium
HAEQRGVPVNTDEDAGDARDEEERDEGPKGALTHPSS

SEQ ID NO: 1182014 - protein, 13 aa, Mycobacterium
HAGPDSPAMRGAD

SEQ ID NO: 1182015 - protein, 5 aa, Mycobacterium
HAGPE

SEQ ID NO: 1182016 - protein, 8 aa, Mycobacterium
HAGTPGLD

SEQ ID NO: 1182017 - protein, 4 aa, Mycobacterium
HAGV

SEQ ID NO: 1182018 - protein, 12 aa, Mycobacterium
HANGQDSQQDYD

SEQ ID NO: 1182019 - protein, 9 aa, Mycobacterium
HANSGKDHI

SEQ ID NO: 1182020 - protein, 6 aa, Mycobacterium
HAPGGH

SEQ ID NO: 1182021 - protein, 18 aa, Mycobacterium
HAPHDELRRGERPIPPDH

SEQ ID NO: 1182022 - protein, 4 aa, Mycobacterium
HAPR

SEQ ID NO: 1182023 - protein, 7 aa, Mycobacterium
HARADAV

SEQ ID NO: 1182024 - protein, 5 aa, Mycobacterium
HARGS

SEQ ID NO: 1182025 - protein, 8 aa, Mycobacterium
HARLGGPG

SEQ ID NO: 1182026 - protein, 4 aa, Mycobacterium
HARP

SEQ ID NO: 1182027 - protein, 20 aa, Mycobacterium
HARSNDEGAHARSTESGAGD

SEQ ID NO: 1182028 - protein, 4 aa, Mycobacterium
HATK

SEQ ID NO: 1182029 - protein, 28 aa, Mycobacterium
HATRGKPKTRDVERSDDRSDSQTGEIGG

SEQ ID NO: 1182030 - protein, 24 aa, Mycobacterium
HDASDSDEDSEAAALAEQQRVDTA

SEQ ID NO: 1182031 - protein, 45 aa, Mycobacterium
HDDDHDHPAPSTGGRKSWSKAPSFADDEERAAAVREATRRDRERY

SEQ ID NO: 1182032 - protein, 5 aa, Mycobacterium
HDDPD

SEQ ID NO: 1182033 - protein, 6 aa, Mycobacterium
HDGGTP

SEQ ID NO: 1182034 - protein, 7 aa, Mycobacterium
HDGPCGS

SEQ ID NO: 1182035 - protein, 9 aa, Mycobacterium
HDGSDPRLR

SEQ ID NO: 1182036 - protein, 10 aa, Mycobacterium
HDHGREPTTI

SEQ ID NO: 1182037 - protein, 8 aa, Mycobacterium
HDHPHTET

SEQ ID NO: 1182038 - protein, 6 aa, Mycobacterium
HDKDEV

SEQ ID NO: 1182039 - protein, 6 aa, Mycobacterium
HDPQEF

SEQ ID NO: 1182040 - protein, 5 aa, Mycobacterium
HDPQT

SEQ ID NO: 1182041 - protein, 9 aa, Mycobacterium
HDSSEATVS

SEQ ID NO: 1182042 - protein, 4 aa, Mycobacterium
HDST

SEQ ID NO: 1182043 - protein, 4 aa, Mycobacterium
HDVT

SEQ ID NO: 1182044 - protein, 8 aa, Mycobacterium
HEAHGKTT

SEQ ID NO: 1182045 - protein, 5 aa, Mycobacterium
HEASG

SEQ ID NO: 1182046 - protein, 5 aa, Mycobacterium
HEEDG

SEQ ID NO: 1182047 - protein, 6 aa, Mycobacterium
HEEDGR

SEQ ID NO: 1182048 - protein, 8 aa, Mycobacterium
HEGEGTHP

SEQ ID NO: 1182049 - protein, 15 aa, Mycobacterium
HEGEVTRDGYSGDDA

SEQ ID NO: 1182050 - protein, 5 aa, Mycobacterium
HEGKP

SEQ ID NO: 1182051 - protein, 7 aa, Mycobacterium
HEGNEAS

SEQ ID NO: 1182052 - protein, 6 aa, Mycobacterium
HEGPGR

SEQ ID NO: 1182053 - protein, 6 aa, Mycobacterium
HEPNAA

SEQ ID NO: 1182054 - protein, 8 aa, Mycobacterium
HEPTTGAV

SEQ ID NO: 1182055 - protein, 7 aa, Mycobacterium
HERLTES

SEQ ID NO: 1182056 - protein, 6 aa, Mycobacterium
HETEEM

SEQ ID NO: 1182057 - protein, 9 aa, Mycobacterium
HETPGHDSA

SEQ ID NO: 1182058 - protein, 7 aa, Mycobacterium
HETRPGK

SEQ ID NO: 1182059 - protein, 4 aa, Mycobacterium
HGAP

SEQ ID NO: 1182060 - protein, 7 aa, Mycobacterium
HGATAGA

SEQ ID NO: 1182061 - protein, 4 aa, Mycobacterium
HGDG

SEQ ID NO: 1182062 - protein, 6 aa, Mycobacterium
HGDGWE

SEQ ID NO: 1182063 - protein, 13 aa, Mycobacterium
HGDPSWESRPSYL

SEQ ID NO: 1182064 - protein, 7 aa, Mycobacterium
HGDPTGI

SEQ ID NO: 1182065 - protein, 6 aa, Mycobacterium
HGDPVA

SEQ ID NO: 1182066 - protein, 4 aa, Mycobacterium
HGDS

SEQ ID NO: 1182067 - protein, 7 aa, Mycobacterium
HGEDPEF

SEQ ID NO: 1182068 - protein, 5 aa, Mycobacterium
HGEDV

SEQ ID NO: 1182069 - protein, 12 aa, Mycobacterium
HGEGAGAPATEA

SEQ ID NO: 1182070 - protein, 9 aa, Mycobacterium
HGGNSSGIV

SEQ ID NO: 1182071 - protein, 7 aa, Mycobacterium
HGGRDRT

SEQ ID NO: 1182072 - protein, 7 aa, Mycobacterium
HGITDAD

SEQ ID NO: 1182073 - protein, 12 aa, Mycobacterium
HGLENGKSRWPN

SEQ ID NO: 1182074 - protein, 7 aa, Mycobacterium
HGLPESR

SEQ ID NO: 1182075 - protein, 4 aa, Mycobacterium
HGMS

SEQ ID NO: 1182076 - protein, 7 aa, Mycobacterium
HGPFTTA

SEQ ID NO: 1182077 - protein, 6 aa, Mycobacterium
HGPGAV

SEQ ID NO: 1182078 - protein, 4 aa, Mycobacterium
HGPI

SEQ ID NO: 1182079 - protein, 8 aa, Mycobacterium
HGRDAEQV

SEQ ID NO: 1182080 - protein, 5 aa, Mycobacterium
HGRGV

SEQ ID NO: 1182081 - protein, 9 aa, Mycobacterium
HGSAGATKA

SEQ ID NO: 1182082 - protein, 24 aa, Mycobacterium
HGSDPDPRSWAEKRAEEDAALGRT

SEQ ID NO: 1182083 - protein, 8 aa, Mycobacterium
HGSQYTSR

SEQ ID NO: 1182084 - protein, 11 aa, Mycobacterium
HGTGTSLGDPI

SEQ ID NO: 1182085 - protein, 8 aa, Mycobacterium
HGTPRAGP

SEQ ID NO: 1182086 - protein, 10 aa, Mycobacterium
HGVEPTEAGT

SEQ ID NO: 1182087 - protein, 4 aa, Mycobacterium
HGYG

SEQ ID NO: 1182088 - protein, 6 aa, Mycobacterium
HHPEDI

SEQ ID NO: 1182089 - protein, 7 aa, Mycobacterium
HIGGGDV

SEQ ID NO: 1182090 - protein, 6 aa, Mycobacterium
HIRDTG

SEQ ID NO: 1182091 - protein, 12 aa, Mycobacterium
HISDQADGTVTQ

SEQ ID NO: 1182092 - protein, 10 aa, Mycobacterium
HISPDGRGRR

SEQ ID NO: 1182093 - protein, 12 aa, Mycobacterium
HITPDARRADLD

SEQ ID NO: 1182094 - protein, 9 aa, Mycobacterium
HKPSPASWP

SEQ ID NO: 1182095 - protein, 7 aa, Mycobacterium
HKQPADT

SEQ ID NO: 1182096 - protein, 7 aa, Mycobacterium
HKRDRLG

SEQ ID NO: 1182097 - protein, 13 aa, Mycobacterium
HKRRLEQRRVDEE

SEQ ID NO: 1182098 - protein, 9 aa, Mycobacterium
HLESNDDEI

SEQ ID NO: 1182099 - protein, 5 aa, Mycobacterium
HLPGS

SEQ ID NO: 1182100 - protein, 7 aa, Mycobacterium
HLPPTAP

SEQ ID NO: 1182101 - protein, 10 aa, Mycobacterium
HMPDEDTDWS

SEQ ID NO: 1182102 - protein, 7 aa, Mycobacterium
HMSGPRP

SEQ ID NO: 1182103 - protein, 9 aa, Mycobacterium
HMTASGDER

SEQ ID NO: 1182104 - protein, 10 aa, Mycobacterium
HNDKPRRPHD

SEQ ID NO: 1182105 - protein, 7 aa, Mycobacterium
HNESANR

SEQ ID NO: 1182106 - protein, 5 aa, Mycobacterium
HNHPS

SEQ ID NO: 1182107 - protein, 7 aa, Mycobacterium
HNKDTAI

SEQ ID NO: 1182108 - protein, 9 aa, Mycobacterium
HNTPLPGDP

SEQ ID NO: 1182109 - protein, 8 aa, Mycobacterium
HNTPNIPN

SEQ ID NO: 1182110 - protein, 46 aa, Mycobacterium
HNYANADAASTVGGPGPTGGVGSEPSETKAGDAATGPNSNTVSPPT

SEQ ID NO: 1182111 - protein, 4 aa, Mycobacterium
HNYE

SEQ ID NO: 1182112 - protein, 12 aa, Mycobacterium
HPAAGPAVADPD

SEQ ID NO: 1182113 - protein, 7 aa, Mycobacterium
HPARNTR

SEQ ID NO: 1182114 - protein, 4 aa, Mycobacterium
HPAV

SEQ ID NO: 1182115 - protein, 10 aa, Mycobacterium
HPDAGKSTLT

SEQ ID NO: 1182116 - protein, 13 aa, Mycobacterium
HPDDESSKGAATM

SEQ ID NO: 1182117 - protein, 6 aa, Mycobacterium
HPDGRR

SEQ ID NO: 1182118 - protein, 6 aa, Mycobacterium
HPDPIE

SEQ ID NO: 1182119 - protein, 5 aa, Mycobacterium
HPDQA

SEQ ID NO: 1182120 - protein, 8 aa, Mycobacterium
HPDVQSPR

SEQ ID NO: 1182121 - protein, 6 aa, Mycobacterium
HPEAHQ

SEQ ID NO: 1182122 - protein, 13 aa, Mycobacterium
HPGEQRTFTGKAG

SEQ ID NO: 1182123 - protein, 6 aa, Mycobacterium
HPGIGP

SEQ ID NO: 1182124 - protein, 4 aa, Mycobacterium
HPGL

SEQ ID NO: 1182125 - protein, 24 aa, Mycobacterium
HPGLYTPEQVNAGYPSDTDEGDVE

SEQ ID NO: 1182126 - protein, 4 aa, Mycobacterium
HPIG

SEQ ID NO: 1182127 - protein, 5 aa, Mycobacterium
HPIGT

SEQ ID NO: 1182128 - protein, 4 aa, Mycobacterium
HPIP

SEQ ID NO: 1182129 - protein, 4 aa, Mycobacterium
HPLA

SEQ ID NO: 1182130 - protein, 5 aa, Mycobacterium
HPPGV

SEQ ID NO: 1182131 - protein, 11 aa, Mycobacterium
HPRAKRCSADA

SEQ ID NO: 1182132 - protein, 6 aa, Mycobacterium
HPRTNF

SEQ ID NO: 1182133 - protein, 7 aa, Mycobacterium
HPSNTGH

SEQ ID NO: 1182134 - protein, 4 aa, Mycobacterium
HPTV

SEQ ID NO: 1182135 - protein, 4 aa, Mycobacterium
HPTW

SEQ ID NO: 1182136 - protein, 5 aa, Mycobacterium
HQADG

SEQ ID NO: 1182137 - protein, 7 aa, Mycobacterium
HQATTEA

SEQ ID NO: 1182138 - protein, 13 aa, Mycobacterium
HQGPKGALCSIRK

SEQ ID NO: 1182139 - protein, 8 aa, Mycobacterium
HQNSRDRR

SEQ ID NO: 1182140 - protein, 12 aa, Mycobacterium
HQPQRAAAMPAS

SEQ ID NO: 1182141 - protein, 15 aa, Mycobacterium
HQPTKMSGGEQQRTA

SEQ ID NO: 1182142 - protein, 9 aa, Mycobacterium
HQRSAPPSA

SEQ ID NO: 1182143 - protein, 11 aa, Mycobacterium
HQRSDAPDHDA

SEQ ID NO: 1182144 - protein, 9 aa, Mycobacterium
HQTPSAGEL

SEQ ID NO: 1182145 - protein, 15 aa, Mycobacterium
HRAEPDLKSGRGGLR

SEQ ID NO: 1182146 - protein, 17 aa, Mycobacterium
HRAGGLGAGVEETPTEL

SEQ ID NO: 1182147 - protein, 9 aa, Mycobacterium
HRATGPLPR

SEQ ID NO: 1182148 - protein, 4 aa, Mycobacterium
HRDP

SEQ ID NO: 1182149 - protein, 5 aa, Mycobacterium
HREPG

SEQ ID NO: 1182150 - protein, 5 aa, Mycobacterium
HRGFR

SEQ ID NO: 1182151 - protein, 6 aa, Mycobacterium
HRGQSV

SEQ ID NO: 1182152 - protein, 8 aa, Mycobacterium
HRGSGHDR

SEQ ID NO: 1182153 - protein, 10 aa, Mycobacterium
HRLKPTEDHE

SEQ ID NO: 1182154 - protein, 7 aa, Mycobacterium
HRNGDPL

SEQ ID NO: 1182155 - protein, 4 aa, Mycobacterium
HRPD

SEQ ID NO: 1182156 - protein, 15 aa, Mycobacterium
HRPDDIDRNGGRPDA

SEQ ID NO: 1182157 - protein, 9 aa, Mycobacterium
HRPGDGDAL

SEQ ID NO: 1182158 - protein, 10 aa, Mycobacterium
HRPGRRGRVR

SEQ ID NO: 1182159 - protein, 4 aa, Mycobacterium
HRPV

SEQ ID NO: 1182160 - protein, 19 aa, Mycobacterium
HRRAQLEGRSVPQKQGKLF

SEQ ID NO: 1182161 - protein, 15 aa, Mycobacterium
HRSANARQSLAGRAG

SEQ ID NO: 1182162 - protein, 6 aa, Mycobacterium
HRSEPL

SEQ ID NO: 1182163 - protein, 12 aa, Mycobacterium
HRSGTPARPVRE

SEQ ID NO: 1182164 - protein, 4 aa, Mycobacterium
HRSK

SEQ ID NO: 1182165 - protein, 8 aa, Mycobacterium
HRSVPGVT

SEQ ID NO: 1182166 - protein, 10 aa, Mycobacterium
HRTKGSQIGN

SEQ ID NO: 1182167 - protein, 20 aa, Mycobacterium
HRTTPTPPALPDVDTGAVTD

SEQ ID NO: 1182168 - protein, 22 aa, Mycobacterium
HRTTTSCSPSVDLDEKSSPLGR

SEQ ID NO: 1182169 - protein, 6 aa, Mycobacterium
HSAEEA

SEQ ID NO: 1182170 - protein, 29 aa, Mycobacterium
HSDSGTQSNSESENPIIDSPEPKAHAPLT

SEQ ID NO: 1182171 - protein, 7 aa, Mycobacterium
HSGADAL

SEQ ID NO: 1182172 - protein, 5 aa, Mycobacterium
HSGGS

SEQ ID NO: 1182173 - protein, 21 aa, Mycobacterium
HSNAAAAADVAGGRADAGIST

SEQ ID NO: 1182174 - protein, 6 aa, Mycobacterium
HSPGDA

SEQ ID NO: 1182175 - protein, 5 aa, Mycobacterium
HSRGE

SEQ ID NO: 1182176 - protein, 8 aa, Mycobacterium
HSRPDTTQ

SEQ ID NO: 1182177 - protein, 9 aa, Mycobacterium
HSTDPSTDF

SEQ ID NO: 1182178 - protein, 4 aa, Mycobacterium
HSTG

SEQ ID NO: 1182179 - protein, 4 aa, Mycobacterium
HSTL

SEQ ID NO: 1182180 - protein, 6 aa, Mycobacterium
HSTPQA

SEQ ID NO: 1182181 - protein, 6 aa, Mycobacterium
HSYQTA

SEQ ID NO: 1182182 - protein, 11 aa, Mycobacterium
HTDERGRQTLR

SEQ ID NO: 1182183 - protein, 11 aa, Mycobacterium
HTDGATHGSGA

SEQ ID NO: 1182184 - protein, 7 aa, Mycobacterium
HTEKAAA

SEQ ID NO: 1182185 - protein, 5 aa, Mycobacterium
HTEQP

SEQ ID NO: 1182186 - protein, 14 aa, Mycobacterium
HTGSSGTARRQDLS

SEQ ID NO: 1182187 - protein, 13 aa, Mycobacterium
HTGSTSTRAERTA

SEQ ID NO: 1182188 - protein, 7 aa, Mycobacterium
HTPNTAH

SEQ ID NO: 1182189 - protein, 7 aa, Mycobacterium
HTPTTSE

SEQ ID NO: 1182190 - protein, 7 aa, Mycobacterium
HTRDESF

SEQ ID NO: 1182191 - protein, 19 aa, Mycobacterium
HTSDETARAAVDGLGTALG

SEQ ID NO: 1182192 - protein, 6 aa, Mycobacterium
HTSGTF

SEQ ID NO: 1182193 - protein, 9 aa, Mycobacterium
HTSTDADVD

SEQ ID NO: 1182194 - protein, 13 aa, Mycobacterium
HTTWNDPDSEFES

SEQ ID NO: 1182195 - protein, 6 aa, Mycobacterium
HTYTDA

SEQ ID NO: 1182196 - protein, 27 aa, Mycobacterium
HVDATEDDGSAEFQPEDGGAAPPSPRE

SEQ ID NO: 1182197 - protein, 6 aa, Mycobacterium
HVPAPP

SEQ ID NO: 1182198 - protein, 6 aa, Mycobacterium
HVPARP

SEQ ID NO: 1182199 - protein, 6 aa, Mycobacterium
HVRAGE

SEQ ID NO: 1182200 - protein, 37 aa, Mycobacterium
HWEPKGEKGPSDQRAESGGPNAKGESAEGVNANASKK

SEQ ID NO: 1182201 - protein, 7 aa, Mycobacterium
HYASGGW

SEQ ID NO: 1182202 - protein, 5 aa, Mycobacterium
IAAGS

SEQ ID NO: 1182203 - protein, 8 aa, Mycobacterium
IADGDSDF

SEQ ID NO: 1182204 - protein, 6 aa, Mycobacterium
IADPDA

SEQ ID NO: 1182205 - protein, 12 aa, Mycobacterium
IAECPRAALNRR

SEQ ID NO: 1182206 - protein, 7 aa, Mycobacterium
IAEPEQV

SEQ ID NO: 1182207 - protein, 12 aa, Mycobacterium
IAEQSKGDLYDA

SEQ ID NO: 1182208 - protein, 5 aa, Mycobacterium
IAESV

SEQ ID NO: 1182209 - protein, 7 aa, Mycobacterium
IAGGATY

SEQ ID NO: 1182210 - protein, 5 aa, Mycobacterium
IAGPG

SEQ ID NO: 1182211 - protein, 15 aa, Mycobacterium
IAGPGPGRQQQRLGP

SEQ ID NO: 1182212 - protein, 20 aa, Mycobacterium
IAKGAKALTGGERRNGPGSF

SEQ ID NO: 1182213 - protein, 20 aa, Mycobacterium
IAPGPTATDFNGGAMRDSEA

SEQ ID NO: 1182214 - protein, 11 aa, Mycobacterium
IAQAAPPAEVY

SEQ ID NO: 1182215 - protein, 14 aa, Mycobacterium
IARGRAAAGDGAPQ

SEQ ID NO: 1182216 - protein, 29 aa, Mycobacterium
IARKPRRSSAGRASRQGPDVRPSGVRKRG

SEQ ID NO: 1182217 - protein, 7 aa, Mycobacterium
IASEQGA

SEQ ID NO: 1182218 - protein, 5 aa, Mycobacterium
IASPA

SEQ ID NO: 1182219 - protein, 6 aa, Mycobacterium
IASPGS

SEQ ID NO: 1182220 - protein, 5 aa, Mycobacterium
IATTT

SEQ ID NO: 1182221 - protein, 10 aa, Mycobacterium
IDAAQGSTAG

SEQ ID NO: 1182222 - protein, 7 aa, Mycobacterium
IDAEAGQ

SEQ ID NO: 1182223 - protein, 5 aa, Mycobacterium
IDASA

SEQ ID NO: 1182224 - protein, 13 aa, Mycobacterium
IDASGTKSSFRTG

SEQ ID NO: 1182225 - protein, 5 aa, Mycobacterium
IDDDT

SEQ ID NO: 1182226 - protein, 8 aa, Mycobacterium
IDDGDHGR

SEQ ID NO: 1182227 - protein, 5 aa, Mycobacterium
IDEGK

SEQ ID NO: 1182228 - protein, 17 aa, Mycobacterium
IDEGTKPGKSTSDSAEL

SEQ ID NO: 1182229 - protein, 5 aa, Mycobacterium
IDERR

SEQ ID NO: 1182230 - protein, 25 aa, Mycobacterium
IDETNAAPKDSGPIYPGPNYPGPNY

SEQ ID NO: 1182231 - protein, 8 aa, Mycobacterium
IDGGASPQ

SEQ ID NO: 1182232 - protein, 19 aa, Mycobacterium
IDGGPAKPTDKPPRPFEEG

SEQ ID NO: 1182233 - protein, 9 aa, Mycobacterium
IDGQRRKLR

SEQ ID NO: 1182234 - protein, 13 aa, Mycobacterium
IDHTTPPPAGSKQ

SEQ ID NO: 1182235 - protein, 14 aa, Mycobacterium
IDNAERKEGQRPPI

SEQ ID NO: 1182236 - protein, 9 aa, Mycobacterium
IDNGQFPDT

SEQ ID NO: 1182237 - protein, 9 aa, Mycobacterium
IDNGQYSEA

SEQ ID NO: 1182238 - protein, 4 aa, Mycobacterium
IDPA

SEQ ID NO: 1182239 - protein, 13 aa, Mycobacterium
IDPAVNRPDGTDA

SEQ ID NO: 1182240 - protein, 16 aa, Mycobacterium
IDPDPRRRFASSEEMS

SEQ ID NO: 1182241 - protein, 6 aa, Mycobacterium
IDPKRD

SEQ ID NO: 1182242 - protein, 6 aa, Mycobacterium
IDPQRD

SEQ ID NO: 1182243 - protein, 7 aa, Mycobacterium
IDPSPPF

SEQ ID NO: 1182244 - protein, 9 aa, Mycobacterium
IDPSQNRYA

SEQ ID NO: 1182245 - protein, 8 aa, Mycobacterium
IDRDGAQQ

SEQ ID NO: 1182246 - protein, 4 aa, Mycobacterium
IDSL

SEQ ID NO: 1182247 - protein, 8 aa, Mycobacterium
IDTARPAR

SEQ ID NO: 1182248 - protein, 17 aa, Mycobacterium
IDTDTSSVSVPAAQGVA

SEQ ID NO: 1182249 - protein, 5 aa, Mycobacterium
IDTPP

SEQ ID NO: 1182250 - protein, 6 aa, Mycobacterium
IEAQTD

SEQ ID NO: 1182251 - protein, 28 aa, Mycobacterium
IEARSNPWDPETEPSESDFVDPGAKDRK

SEQ ID NO: 1182252 - protein, 12 aa, Mycobacterium
IEATDSDWDREK

SEQ ID NO: 1182253 - protein, 12 aa, Mycobacterium
IEDDDDKAADTQ

SEQ ID NO: 1182254 - protein, 5 aa, Mycobacterium
IEDGA

SEQ ID NO: 1182255 - protein, 6 aa, Mycobacterium
IEDSTD

SEQ ID NO: 1182256 - protein, 11 aa, Mycobacterium
IEEGQQVKRTG

SEQ ID NO: 1182257 - protein, 10 aa, Mycobacterium
IEEVGSDRTD

SEQ ID NO: 1182258 - protein, 5 aa, Mycobacterium
IEGAG

SEQ ID NO: 1182259 - protein, 11 aa, Mycobacterium
IEGAGVKAPEI

SEQ ID NO: 1182260 - protein, 15 aa, Mycobacterium
IEPDTLPDPEVEGAT

SEQ ID NO: 1182261 - protein, 12 aa, Mycobacterium
IERGELSTDTDI

SEQ ID NO: 1182262 - protein, 10 aa, Mycobacterium
IERRGRGTVV

SEQ ID NO: 1182263 - protein, 11 aa, Mycobacterium
IESGNKSNVIP

SEQ ID NO: 1182264 - protein, 24 aa, Mycobacterium
IESGRAGGASVLTGGGRAQGVGSK

SEQ ID NO: 1182265 - protein, 20 aa, Mycobacterium
IESTKCSDTGPAFPGDPQYP

SEQ ID NO: 1182266 - protein, 11 aa, Mycobacterium
IETNTETIRRH

SEQ ID NO: 1182267 - protein, 14 aa, Mycobacterium
IGADASAPEPTAEW

SEQ ID NO: 1182268 - protein, 6 aa, Mycobacterium
IGAERD

SEQ ID NO: 1182269 - protein, 5 aa, Mycobacterium
IGAHG

SEQ ID NO: 1182270 - protein, 16 aa, Mycobacterium
IGAPGRPAAYASVGRA

SEQ ID NO: 1182271 - protein, 17 aa, Mycobacterium
IGATASDGRTPGTPSDT

SEQ ID NO: 1182272 - protein, 5 aa, Mycobacterium
IGDPE

SEQ ID NO: 1182273 - protein, 7 aa, Mycobacterium
IGGPAPL

SEQ ID NO: 1182274 - protein, 10 aa, Mycobacterium
IGKRDPAEYL

SEQ ID NO: 1182275 - protein, 83 aa, Mycobacterium
IGPAMQPASAPMAAPAAPTEVAPPAAPAPSNPTTSTAAHAPVAPVSPPATGGGVPMAGGPAMPPPPMPLGPPPTPSPAAPVVP

SEQ ID NO: 1182276 - protein, 6 aa, Mycobacterium
IGPGPH

SEQ ID NO: 1182277 - protein, 5 aa, Mycobacterium
IGPPI

SEQ ID NO: 1182278 - protein, 6 aa, Mycobacterium
IGPPIT

SEQ ID NO: 1182279 - protein, 6 aa, Mycobacterium
IGPQAV

SEQ ID NO: 1182280 - protein, 4 aa, Mycobacterium
IGRA

SEQ ID NO: 1182281 - protein, 7 aa, Mycobacterium
IGRDTDG

SEQ ID NO: 1182282 - protein, 6 aa, Mycobacterium
IGRGSY

SEQ ID NO: 1182283 - protein, 9 aa, Mycobacterium
IGRSESAKE

SEQ ID NO: 1182284 - protein, 11 aa, Mycobacterium
IGSQPHSYTTV

SEQ ID NO: 1182285 - protein, 8 aa, Mycobacterium
IGTDVSHE

SEQ ID NO: 1182286 - protein, 9 aa, Mycobacterium
IGVTDPRER

SEQ ID NO: 1182287 - protein, 10 aa, Mycobacterium
IHGTGDDEPI

SEQ ID NO: 1182288 - protein, 8 aa, Mycobacterium
IKDGQFPD

SEQ ID NO: 1182289 - protein, 10 aa, Mycobacterium
IKGTDPAGRR

SEQ ID NO: 1182290 - protein, 17 aa, Mycobacterium
INETTNQVIPPNTSHMT

SEQ ID NO: 1182291 - protein, 7 aa, Mycobacterium
INPPVPP

SEQ ID NO: 1182292 - protein, 12 aa, Mycobacterium
IPDDDDANIVNR

SEQ ID NO: 1182293 - protein, 11 aa, Mycobacterium
IPDGSRGATLA

SEQ ID NO: 1182294 - protein, 6 aa, Mycobacterium
IPDPVT

SEQ ID NO: 1182295 - protein, 4 aa, Mycobacterium
IPDR

SEQ ID NO: 1182296 - protein, 8 aa, Mycobacterium
IPDTDKPE

SEQ ID NO: 1182297 - protein, 6 aa, Mycobacterium
IPDTPV

SEQ ID NO: 1182298 - protein, 9 aa, Mycobacterium
IPGATVDEA

SEQ ID NO: 1182299 - protein, 6 aa, Mycobacterium
IPGGID

SEQ ID NO: 1182300 - protein, 10 aa, Mycobacterium
IPHDDTGSFR

SEQ ID NO: 1182301 - protein, 12 aa, Mycobacterium
IPHSRGLGSSAA

SEQ ID NO: 1182302 - protein, 8 aa, Mycobacterium
IPNEAIKD

SEQ ID NO: 1182303 - protein, 4 aa, Mycobacterium
IPPG

SEQ ID NO: 1182304 - protein, 6 aa, Mycobacterium
IPPGRV

SEQ ID NO: 1182305 - protein, 6 aa, Mycobacterium
IPQGGR

SEQ ID NO: 1182306 - protein, 20 aa, Mycobacterium
IPRPEWSEAGVGSDSHSGAT

SEQ ID NO: 1182307 - protein, 16 aa, Mycobacterium
IPRPSTHVTDAANGSR

SEQ ID NO: 1182308 - protein, 105 aa, Mycobacterium
IPTEAGGSVGEPKARAAAKRSERPARGERDGDRDGDDKPARSRSRNRRRTRAGKPVTGHVEGSAEQPAVEAADGNGDGDTEAGGESGQAGRRRRRRRPRKAAPAT

SEQ ID NO: 1182309 - protein, 7 aa, Mycobacterium
IPTSTAL

SEQ ID NO: 1182310 - protein, 12 aa, Mycobacterium
IQDRSAAAVRPG

SEQ ID NO: 1182311 - protein, 13 aa, Mycobacterium
IQPGQQLTSEQAS

SEQ ID NO: 1182312 - protein, 4 aa, Mycobacterium
IQPK

SEQ ID NO: 1182313 - protein, 13 aa, Mycobacterium
IQQESQGLSREVE

SEQ ID NO: 1182314 - protein, 18 aa, Mycobacterium
IQQSAAAATEREAVPPRR

SEQ ID NO: 1182315 - protein, 14 aa, Mycobacterium
IQSGGGQAQGVPTG

SEQ ID NO: 1182316 - protein, 14 aa, Mycobacterium
IQSTGYTRQLERNR

SEQ ID NO: 1182317 - protein, 5 aa, Mycobacterium
IQSTL

SEQ ID NO: 1182318 - protein, 6 aa, Mycobacterium
IREAAT

SEQ ID NO: 1182319 - protein, 7 aa, Mycobacterium
IRGGDGP

SEQ ID NO: 1182320 - protein, 7 aa, Mycobacterium
IRGPGDV

SEQ ID NO: 1182321 - protein, 32 aa, Mycobacterium
IRPEPPAPPVAPPPAPAPPPSPPPVRPPAEPV

SEQ ID NO: 1182322 - protein, 13 aa, Mycobacterium
IRPPTASAVGAPR

SEQ ID NO: 1182323 - protein, 11 aa, Mycobacterium
IRRKPVGASVG

SEQ ID NO: 1182324 - protein, 4 aa, Mycobacterium
IRRR

SEQ ID NO: 1182325 - protein, 6 aa, Mycobacterium
IRTGDL

SEQ ID NO: 1182326 - protein, 31 aa, Mycobacterium
ISAATGATGRFADGAGAVDARDRQPGVTTQV

SEQ ID NO: 1182327 - protein, 9 aa, Mycobacterium
ISDEDAPHR

SEQ ID NO: 1182328 - protein, 19 aa, Mycobacterium
ISDPGYGIHPTTAARIDAR

SEQ ID NO: 1182329 - protein, 9 aa, Mycobacterium
ISDQGSHID

SEQ ID NO: 1182330 - protein, 7 aa, Mycobacterium
ISEAPTT

SEQ ID NO: 1182331 - protein, 5 aa, Mycobacterium
ISEET

SEQ ID NO: 1182332 - protein, 5 aa, Mycobacterium
ISEPD

SEQ ID NO: 1182333 - protein, 4 aa, Mycobacterium
ISEQ

SEQ ID NO: 1182334 - protein, 15 aa, Mycobacterium
ISEQTAAGEPALPPS

SEQ ID NO: 1182335 - protein, 9 aa, Mycobacterium
ISGDTTVTD

SEQ ID NO: 1182336 - protein, 6 aa, Mycobacterium
ISGEAS

SEQ ID NO: 1182337 - protein, 9 aa, Mycobacterium
ISGEYPKPW

SEQ ID NO: 1182338 - protein, 7 aa, Mycobacterium
ISGQERT

SEQ ID NO: 1182339 - protein, 8 aa, Mycobacterium
ISGQSRAR

SEQ ID NO: 1182340 - protein, 6 aa, Mycobacterium
ISNGDK

SEQ ID NO: 1182341 - protein, 8 aa, Mycobacterium
ISNPDKAL

SEQ ID NO: 1182342 - protein, 6 aa, Mycobacterium
ISPDGK

SEQ ID NO: 1182343 - protein, 197 aa, Mycobacterium
ISPTSPNGFDAPSSPRGLDGPPGPPNPPGPTGTAGGGESSGIRGGDGPPPDPPGRAAGPSDDGPGGVDGPPPRSPESPGPGNVDSPTGGEPSAPNHAPTQNDPQPPVAQRPPESAGPPPSPDRTPAGTSHPDAGTAPSPGGHAGDSAPGHGSPNIVESNGQADARPSADSPAIQAPAADTHDGSDRTTADTNPVARQ

SEQ ID NO: 1182344 - protein, 5 aa, Mycobacterium
ISSLS

SEQ ID NO: 1182345 - protein, 17 aa, Mycobacterium
ISVAPKQDLATAAAGKG

SEQ ID NO: 1182346 - protein, 4 aa, Mycobacterium
ITAD

SEQ ID NO: 1182347 - protein, 25 aa, Mycobacterium
ITARTADGPLQRDLDPDDAKRAADR

SEQ ID NO: 1182348 - protein, 7 aa, Mycobacterium
ITDANQV

SEQ ID NO: 1182349 - protein, 6 aa, Mycobacterium
ITDPQE

SEQ ID NO: 1182350 - protein, 9 aa, Mycobacterium
ITDRRPPRA

SEQ ID NO: 1182351 - protein, 6 aa, Mycobacterium
ITEAER

SEQ ID NO: 1182352 - protein, 10 aa, Mycobacterium
ITEDRSLGEQ

SEQ ID NO: 1182353 - protein, 14 aa, Mycobacterium
ITEETGASISIEDD

SEQ ID NO: 1182354 - protein, 6 aa, Mycobacterium
ITGGHR

SEQ ID NO: 1182355 - protein, 10 aa, Mycobacterium
ITGKDEEDLV

SEQ ID NO: 1182356 - protein, 10 aa, Mycobacterium
ITGRDGEKLA

SEQ ID NO: 1182357 - protein, 15 aa, Mycobacterium
ITGSGVCTTDGQSHD

SEQ ID NO: 1182358 - protein, 17 aa, Mycobacterium
ITGTGSLRKYNKQTTAP

SEQ ID NO: 1182359 - protein, 8 aa, Mycobacterium
ITPEGTET

SEQ ID NO: 1182360 - protein, 5 aa, Mycobacterium
ITPRT

SEQ ID NO: 1182361 - protein, 7 aa, Mycobacterium
ITPSGEV

SEQ ID NO: 1182362 - protein, 10 aa, Mycobacterium
ITPTADAADL

SEQ ID NO: 1182363 - protein, 5 aa, Mycobacterium
ITRAT

SEQ ID NO: 1182364 - protein, 7 aa, Mycobacterium
ITRRDDV

SEQ ID NO: 1182365 - protein, 14 aa, Mycobacterium
ITRTSKKIETPAAT

SEQ ID NO: 1182366 - protein, 4 aa, Mycobacterium
ITSG

SEQ ID NO: 1182367 - protein, 8 aa, Mycobacterium
ITSNGQPV

SEQ ID NO: 1182368 - protein, 11 aa, Mycobacterium
ITSTDATPLNG

SEQ ID NO: 1182369 - protein, 10 aa, Mycobacterium
ITTGPLGQGL

SEQ ID NO: 1182370 - protein, 23 aa, Mycobacterium
ITTPSGPPHPGQPAWNTQRASAM

SEQ ID NO: 1182371 - protein, 8 aa, Mycobacterium
IVEETGAN

SEQ ID NO: 1182372 - protein, 5 aa, Mycobacterium
IVSSA

SEQ ID NO: 1182373 - protein, 17 aa, Mycobacterium
IYQSGDDGATVSVLSTV

SEQ ID NO: 1182374 - protein, 7 aa, Mycobacterium
KAAASEA

SEQ ID NO: 1182375 - protein, 9 aa, Mycobacterium
KAADKLPGT

SEQ ID NO: 1182376 - protein, 5 aa, Mycobacterium
KAADL

SEQ ID NO: 1182377 - protein, 8 aa, Mycobacterium
KAAEGASH

SEQ ID NO: 1182378 - protein, 5 aa, Mycobacterium
KAAEI

SEQ ID NO: 1182379 - protein, 21 aa, Mycobacterium
KAAGGRAAANYDSVAEPEGAE

SEQ ID NO: 1182380 - protein, 8 aa, Mycobacterium
KAAKGGSI

SEQ ID NO: 1182381 - protein, 5 aa, Mycobacterium
KAALS

SEQ ID NO: 1182382 - protein, 8 aa, Mycobacterium
KAAPPQDF

SEQ ID NO: 1182383 - protein, 9 aa, Mycobacterium
KAAQDPEIK

SEQ ID NO: 1182384 - protein, 9 aa, Mycobacterium
KAAQGPEIE

SEQ ID NO: 1182385 - protein, 11 aa, Mycobacterium
KAASLRDKEKT

SEQ ID NO: 1182386 - protein, 6 aa, Mycobacterium
KADAST

SEQ ID NO: 1182387 - protein, 8 aa, Mycobacterium
KADGPDRV

SEQ ID NO: 1182388 - protein, 12 aa, Mycobacterium
KADLTGPIPPDA

SEQ ID NO: 1182389 - protein, 17 aa, Mycobacterium
KAEAQARDLQGAGTVTA

SEQ ID NO: 1182390 - protein, 16 aa, Mycobacterium
KAEGKSEPRAGRDPVN

SEQ ID NO: 1182391 - protein, 7 aa, Mycobacterium
KAERHQR

SEQ ID NO: 1182392 - protein, 10 aa, Mycobacterium
KAFAASGDDY

SEQ ID NO: 1182393 - protein, 10 aa, Mycobacterium
KAFGARDLSG

SEQ ID NO: 1182394 - protein, 7 aa, Mycobacterium
KAGAETR

SEQ ID NO: 1182395 - protein, 8 aa, Mycobacterium
KAGDGPVV

SEQ ID NO: 1182396 - protein, 4 aa, Mycobacterium
KAGI

SEQ ID NO: 1182397 - protein, 8 aa, Mycobacterium
KAGLNNLT

SEQ ID NO: 1182398 - protein, 7 aa, Mycobacterium
KAGLSSI

SEQ ID NO: 1182399 - protein, 6 aa, Mycobacterium
KAGPAV

SEQ ID NO: 1182400 - protein, 8 aa, Mycobacterium
KAGSAQTM

SEQ ID NO: 1182401 - protein, 7 aa, Mycobacterium
KAGTQRE

SEQ ID NO: 1182402 - protein, 8 aa, Mycobacterium
KAGVAPSA

SEQ ID NO: 1182403 - protein, 6 aa, Mycobacterium
KAIANA

SEQ ID NO: 1182404 - protein, 4 aa, Mycobacterium
KAIN

SEQ ID NO: 1182405 - protein, 28 aa, Mycobacterium
KAKKSSVPNDNIERARKRGAGEEAGGAD

SEQ ID NO: 1182406 - protein, 9 aa, Mycobacterium
KAKTPTDNG

SEQ ID NO: 1182407 - protein, 8 aa, Mycobacterium
KALQDSQM

SEQ ID NO: 1182408 - protein, 6 aa, Mycobacterium
KANPLQ

SEQ ID NO: 1182409 - protein, 13 aa, Mycobacterium
KANRDPKQFEDPD

SEQ ID NO: 1182410 - protein, 16 aa, Mycobacterium
KAPARAALRTPEGKTL

SEQ ID NO: 1182411 - protein, 6 aa, Mycobacterium
KAPEAF

SEQ ID NO: 1182412 - protein, 10 aa, Mycobacterium
KAPEGATDEL

SEQ ID NO: 1182413 - protein, 6 aa, Mycobacterium
KAPGWG

SEQ ID NO: 1182414 - protein, 5 aa, Mycobacterium
KAPRT

SEQ ID NO: 1182415 - protein, 23 aa, Mycobacterium
KAREEMSTDAADEDADAPAPGTI

SEQ ID NO: 1182416 - protein, 4 aa, Mycobacterium
KARG

SEQ ID NO: 1182417 - protein, 6 aa, Mycobacterium
KARGTD

SEQ ID NO: 1182418 - protein, 6 aa, Mycobacterium
KARTAE

SEQ ID NO: 1182419 - protein, 43 aa, Mycobacterium; identical to SEQ ID NO: 1109060

SEQ ID NO: 1182420 - protein, 12 aa, Mycobacterium
KASAWAEASDWR

SEQ ID NO: 1182421 - protein, 12 aa, Mycobacterium
KASLAGPPRAFT

SEQ ID NO: 1182422 - protein, 10 aa, Mycobacterium
KASRSRAARK

SEQ ID NO: 1182423 - protein, 7 aa, Mycobacterium
KASVDAD

SEQ ID NO: 1182424 - protein, 6 aa, Mycobacterium
KATRRA

SEQ ID NO: 1182425 - protein, 7 aa, Mycobacterium
KATTVTE

SEQ ID NO: 1182426 - protein, 14 aa, Mycobacterium
KAVSRGQTTEEKSA

SEQ ID NO: 1182427 - protein, 7 aa, Mycobacterium
KAYDPDS

SEQ ID NO: 1182428 - protein, 7 aa, Mycobacterium
KCGGDGM

SEQ ID NO: 1182429 - protein, 9 aa, Mycobacterium
KCNADPRTV

SEQ ID NO: 1182430 - protein, 13 aa, Mycobacterium
KDAAAQPDSGTAH

SEQ ID NO: 1182431 - protein, 9 aa, Mycobacterium
KDADENATV

SEQ ID NO: 1182432 - protein, 9 aa, Mycobacterium
KDAGEDVTE

SEQ ID NO: 1182433 - protein, 6 aa, Mycobacterium
KDAPVC

SEQ ID NO: 1182434 - protein, 5 aa, Mycobacterium
KDARL

SEQ ID NO: 1182435 - protein, 11 aa, Mycobacterium
KDEEGNPRFSA

SEQ ID NO: 1182436 - protein, 9 aa, Mycobacterium
KDEEKTRQT

SEQ ID NO: 1182437 - protein, 7 aa, Mycobacterium
KDGESGE

SEQ ID NO: 1182438 - protein, 7 aa, Mycobacterium
KDKDEVH

SEQ ID NO: 1182439 - protein, 11 aa, Mycobacterium
KDKGTGKENTI

SEQ ID NO: 1182440 - protein, 4 aa, Mycobacterium
KDLR

SEQ ID NO: 1182441 - protein, 7 aa, Mycobacterium
KDMASGS

SEQ ID NO: 1182442 - protein, 11 aa, Mycobacterium
KDMTGVPSKDR

SEQ ID NO: 1182443 - protein, 13 aa, Mycobacterium
KDPGALELPDDEM

SEQ ID NO: 1182444 - protein, 9 aa, Mycobacterium
KDPNTTGSL

SEQ ID NO: 1182445 - protein, 12 aa, Mycobacterium
KDPVGHKGARLT

SEQ ID NO: 1182446 - protein, 13 aa, Mycobacterium
KDPVGHKGARLTT

SEQ ID NO: 1182447 - protein, 10 aa, Mycobacterium
KDRPQTTFGT

SEQ ID NO: 1182448 - protein, 4 aa, Mycobacterium
KDRV

SEQ ID NO: 1182449 - protein, 16 aa, Mycobacterium
KDRVGAGGVVSEPELR

SEQ ID NO: 1182450 - protein, 6 aa, Mycobacterium
KDSGPW

SEQ ID NO: 1182451 - protein, 6 aa, Mycobacterium
KDTRQR

SEQ ID NO: 1182452 - protein, 7 aa, Mycobacterium
KDVNGDY

SEQ ID NO: 1182453 - protein, 13 aa, Mycobacterium
KEAFGTQKRQRQM

SEQ ID NO: 1182454 - protein, 75 aa, Mycobacterium
KEAGGSANAPQEASSEPSQTKPENNVQQTAYQRPDKADAGEAGKEKPTAPASPPAAASPSSPSTGGGGSSNPSSV

SEQ ID NO: 1182455 - protein, 14 aa, Mycobacterium
KECGGDGPSTLSAR

SEQ ID NO: 1182456 - protein, 8 aa, Mycobacterium
KEDGGAHS

SEQ ID NO: 1182457 - protein, 24 aa, Mycobacterium
KEDRAGGDDAVRPEFGSPPTEDSD

SEQ ID NO: 1182458 - protein, 6 aa, Mycobacterium
KEFTGA

SEQ ID NO: 1182459 - protein, 8 aa, Mycobacterium
KEGAMTPG

SEQ ID NO: 1182460 - protein, 5 aa, Mycobacterium
KEGDF

SEQ ID NO: 1182461 - protein, 9 aa, Mycobacterium
KEGGDGAAV

SEQ ID NO: 1182462 - protein, 6 aa, Mycobacterium
KEGIDS

SEQ ID NO: 1182463 - protein, 6 aa, Mycobacterium
KEGNER

SEQ ID NO: 1182464 - protein, 15 aa, Mycobacterium
KEGSKSREKVTEQGL

SEQ ID NO: 1182465 - protein, 8 aa, Mycobacterium
KEIPEDGK

SEQ ID NO: 1182466 - protein, 5 aa, Mycobacterium
KEKKD

SEQ ID NO: 1182467 - protein, 16 aa, Mycobacterium
KEKPNYPKWNIPAESK

SEQ ID NO: 1182468 - protein, 11 aa, Mycobacterium
KENPEAGVQPW

SEQ ID NO: 1182469 - protein, 6 aa, Mycobacterium
KEPSQI

SEQ ID NO: 1182470 - protein, 7 aa, Mycobacterium
KEQATVG

SEQ ID NO: 1182471 - protein, 4 aa, Mycobacterium
KEQL

SEQ ID NO: 1182472 - protein, 14 aa, Mycobacterium
KERAQTPGEKHAQS

SEQ ID NO: 1182473 - protein, 5 aa, Mycobacterium
KESLE

SEQ ID NO: 1182474 - protein, 7 aa, Mycobacterium
KETTGSA

SEQ ID NO: 1182475 - protein, 10 aa, Mycobacterium
KEVTPARTGV

SEQ ID NO: 1182476 - protein, 8 aa, Mycobacterium
KFKDPNDP

SEQ ID NO: 1182477 - protein, 4 aa, Mycobacterium
KGAA

SEQ ID NO: 1182478 - protein, 9 aa, Mycobacterium
KGAGGGDGG

SEQ ID NO: 1182479 - protein, 10 aa, Mycobacterium
KGAGGGDGGL

SEQ ID NO: 1182480 - protein, 6 aa, Mycobacterium
KGAPTV

SEQ ID NO: 1182481 - protein, 8 aa, Mycobacterium
KGDAAASW

SEQ ID NO: 1182482 - protein, 8 aa, Mycobacterium
KGDAARPG

SEQ ID NO: 1182483 - protein, 7 aa, Mycobacterium
KGDKGYV

SEQ ID NO: 1182484 - protein, 11 aa, Mycobacterium
KGDLKADDRVA

SEQ ID NO: 1182485 - protein, 7 aa, Mycobacterium
KGEDRRQ

SEQ ID NO: 1182486 - protein, 11 aa, Mycobacterium
KGEDYTPLGST

SEQ ID NO: 1182487 - protein, 7 aa, Mycobacterium
KGELHNR

SEQ ID NO: 1182488 - protein, 4 aa, Mycobacterium
KGEN

SEQ ID NO: 1182489 - protein, 11 aa, Mycobacterium
KGEPFTPDEPT

SEQ ID NO: 1182490 - protein, 8 aa, Mycobacterium
KGERPGRK

SEQ ID NO: 1182491 - protein, 14 aa, Mycobacterium
KGEVERNATNRIGE

SEQ ID NO: 1182492 - protein, 32 aa, Mycobacterium
KGFTPGATGNFEGGAVTGSQVRAAKADDLGAQ

SEQ ID NO: 1182493 - protein, 7 aa, Mycobacterium
KGGDYLA

SEQ ID NO: 1182494 - protein, 8 aa, Mycobacterium
KGGDYLAD

SEQ ID NO: 1182495 - protein, 6 aa, Mycobacterium
KGGMEL

SEQ ID NO: 1182496 - protein, 6 aa, Mycobacterium
KGGSVK

SEQ ID NO: 1182497 - protein, 14 aa, Mycobacterium
KGGTSNNDHRNRQH

SEQ ID NO: 1182498 - protein, 6 aa, Mycobacterium
KGKLPS

SEQ ID NO: 1182499 - protein, 8 aa, Mycobacterium
KGLAPGGH

SEQ ID NO: 1182500 - protein, 9 aa, Mycobacterium
KGLNDSKIE

SEQ ID NO: 1182501 - protein, 6 aa, Mycobacterium
KGLSTH

SEQ ID NO: 1182502 - protein, 7 aa, Mycobacterium
KGQDIDY

SEQ ID NO: 1182503 - protein, 7 aa, Mycobacterium
KGQRRIG

SEQ ID NO: 1182504 - protein, 5 aa, Mycobacterium
KGRDE

SEQ ID NO: 1182505 - protein, 7 aa, Mycobacterium
KGRDKFT

SEQ ID NO: 1182506 - protein, 10 aa, Mycobacterium
KGRGRADDTE

SEQ ID NO: 1182507 - protein, 5 aa, Mycobacterium
KGRTV

SEQ ID NO: 1182508 - protein, 6 aa, Mycobacterium
KGRVGE

SEQ ID NO: 1182509 - protein, 8 aa, Mycobacterium
KGSALSTA

SEQ ID NO: 1182510 - protein, 18 aa, Mycobacterium
KGWTGPREVDGKKVEGTW

SEQ ID NO: 1182511 - protein, 7 aa, Mycobacterium
KHAPAVT

SEQ ID NO: 1182512 - protein, 6 aa, Mycobacterium
KHEADR

SEQ ID NO: 1182513 - protein, 9 aa, Mycobacterium
KHSRSTGRI

SEQ ID NO: 1182514 - protein, 8 aa, Mycobacterium
KHSVNNPY

SEQ ID NO: 1182515 - protein, 13 aa, Mycobacterium
KIKSGSANPAPKL

SEQ ID NO: 1182516 - protein, 7 aa, Mycobacterium
KINPEAV

SEQ ID NO: 1182517 - protein, 5 aa, Mycobacterium
KIPGL

SEQ ID NO: 1182518 - protein, 14 aa, Mycobacterium
KIPGPKNPGPENFE

SEQ ID NO: 1182519 - protein, 7 aa, Mycobacterium
KIRRAEV

SEQ ID NO: 1182520 - protein, 8 aa, Mycobacterium
KISDTTVK

SEQ ID NO: 1182521 - protein, 6 aa, Mycobacterium
KISGED

SEQ ID NO: 1182522 - protein, 4 aa, Mycobacterium
KISH

SEQ ID NO: 1182523 - protein, 9 aa, Mycobacterium
KKAAEARAD

SEQ ID NO: 1182524 - protein, 17 aa, Mycobacterium
KKDGLSGYPSRSESEHD

SEQ ID NO: 1182525 - protein, 8 aa, Mycobacterium
KKELENDP

SEQ ID NO: 1182526 - protein, 15 aa, Mycobacterium
KKGAKDGLAGPDSVP

SEQ ID NO: 1182527 - protein, 8 aa, Mycobacterium
KKGQLAGD

SEQ ID NO: 1182528 - protein, 10 aa, Mycobacterium
KKGYETPNGT

SEQ ID NO: 1182529 - protein, 9 aa, Mycobacterium
KKLQTRETI

SEQ ID NO: 1182530 - protein, 7 aa, Mycobacterium
KKWSPQE

SEQ ID NO: 1182531 - protein, 18 aa, Mycobacterium
KLAPGGAGPGDPPEPFPS

SEQ ID NO: 1182532 - protein, 12 aa, Mycobacterium
KLDPANRLTPGS

SEQ ID NO: 1182533 - protein, 90 aa, Mycobacterium
KLGAEAAKKAASPPLKPAALAKPNAAAGKGGGGGGKGGGGGSPIKPVSSLGGATHASSLAGTPPSSPPSTPIKPAATAGASPSASGSGGM

SEQ ID NO: 1182534 - protein, 6 aa, Mycobacterium
KLGDQH

SEQ ID NO: 1182535 - protein, 10 aa, Mycobacterium
KLGKSTPKPP

SEQ ID NO: 1182536 - protein, 17 aa, Mycobacterium
KLGPDTTAEDLQTVTGD

SEQ ID NO: 1182537 - protein, 11 aa, Mycobacterium
KLGTRSVASGE

SEQ ID NO: 1182538 - protein, 7 aa, Mycobacterium
KLPPEEA

SEQ ID NO: 1182539 - protein, 6 aa, Mycobacterium
KLPSGA

SEQ ID NO: 1182540 - protein, 6 aa, Mycobacterium
KLQNQE

SEQ ID NO: 1182541 - protein, 4 aa, Mycobacterium
KLSN

SEQ ID NO: 1182542 - protein, 9 aa, Mycobacterium
KLTHSGDRR

SEQ ID NO: 1182543 - protein, 9 aa, Mycobacterium
KLTQRGYDE

SEQ ID NO: 1182544 - protein, 17 aa, Mycobacterium
KMAENRAAKQAAKQAVS

SEQ ID NO: 1182545 - protein, 8 aa, Mycobacterium
KMDDPGDD

SEQ ID NO: 1182546 - protein, 5 aa, Mycobacterium
KMDPQ

SEQ ID NO: 1182547 - protein, 13 aa, Mycobacterium
KMGTDRRQATEAV

SEQ ID NO: 1182548 - protein, 4 aa, Mycobacterium
KMPE

SEQ ID NO: 1182549 - protein, 8 aa, Mycobacterium
KMSSSTIE

SEQ ID NO: 1182550 - protein, 5 aa, Mycobacterium
KNADR

SEQ ID NO: 1182551 - protein, 9 aa, Mycobacterium
KNAQGPEIE

SEQ ID NO: 1182552 - protein, 4 aa, Mycobacterium
KNAT

SEQ ID NO: 1182553 - protein, 16 aa, Mycobacterium
KNGPGPTTPPHPPVHD

SEQ ID NO: 1182554 - protein, 8 aa, Mycobacterium
KNKDFSQR

SEQ ID NO: 1182555 - protein, 8 aa, Mycobacterium
KNLSDSTV

SEQ ID NO: 1182556 - protein, 22 aa, Mycobacterium
KNTAPKGSNNKVIPGREGEGYL

SEQ ID NO: 1182557 - protein, 16 aa, Mycobacterium
KNTGTNHGGTTAHPAR

SEQ ID NO: 1182558 - protein, 5 aa, Mycobacterium
KNTPR

SEQ ID NO: 1182559 - protein, 17 aa, Mycobacterium
KNYAGTSPLTIASGRKR

SEQ ID NO: 1182560 - protein, 6 aa, Mycobacterium
KPADLV

SEQ ID NO: 1182561 - protein, 25 aa, Mycobacterium
KPAERGSRRRKHHQPDTNKECDGPL

SEQ ID NO: 1182562 - protein, 10 aa, Mycobacterium
KPAGKESEGI

SEQ ID NO: 1182563 - protein, 5 aa, Mycobacterium
KPAKL

SEQ ID NO: 1182564 - protein, 4 aa, Mycobacterium
KPGD

SEQ ID NO: 1182565 - protein, 5 aa, Mycobacterium
KPGEA

SEQ ID NO: 1182566 - protein, 16 aa, Mycobacterium
KPGGTEISAKAGGAGR

SEQ ID NO: 1182567 - protein, 14 aa, Mycobacterium
KPGPLDETAESCRE

SEQ ID NO: 1182568 - protein, 6 aa, Mycobacterium
KPGTTV

SEQ ID NO: 1182569 - protein, 4 aa, Mycobacterium
KPGV

SEQ ID NO: 1182570 - protein, 10 aa, Mycobacterium
KPHRESMGDE

SEQ ID NO: 1182571 - protein, 4 aa, Mycobacterium
KPID

SEQ ID NO: 1182572 - protein, 4 aa, Mycobacterium
KPLG

SEQ ID NO: 1182573 - protein, 15 aa, Mycobacterium
KPLGGPDGGNGGRGG

SEQ ID NO: 1182574 - protein, 16 aa, Mycobacterium
KPLGGPDGGNGGRGGS

SEQ ID NO: 1182575 - protein, 8 aa, Mycobacterium
KPLQSPHP

SEQ ID NO: 1182576 - protein, 6 aa, Mycobacterium
KPLTNS

SEQ ID NO: 1182577 - protein, 5 aa, Mycobacterium
KPMIA

SEQ ID NO: 1182578 - protein, 9 aa, Mycobacterium
KPMSSGWES

SEQ ID NO: 1182579 - protein, 6 aa, Mycobacterium
KPMTEE

SEQ ID NO: 1182580 - protein, 26 aa, Mycobacterium
KPPIGPPDTSSVQPASYMPTPPEGPF

SEQ ID NO: 1182581 - protein, 7 aa, Mycobacterium
KPPLPEP

SEQ ID NO: 1182582 - protein, 15 aa, Mycobacterium
KPPWAPEEKGWTAGS

SEQ ID NO: 1182583 - protein, 11 aa, Mycobacterium
KPREAAKQRRD

SEQ ID NO: 1182584 - protein, 6 aa, Mycobacterium
KPSGPF

SEQ ID NO: 1182585 - protein, 6 aa, Mycobacterium
KPSRGL

SEQ ID NO: 1182586 - protein, 8 aa, Mycobacterium
KPVRSVTK

SEQ ID NO: 1182587 - protein, 6 aa, Mycobacterium
KPYQRH

SEQ ID NO: 1182588 - protein, 14 aa, Mycobacterium
KQAASRAETLTEKK

SEQ ID NO: 1182589 - protein, 8 aa, Mycobacterium
KQAPASPA

SEQ ID NO: 1182590 - protein, 5 aa, Mycobacterium
KQART

SEQ ID NO: 1182591 - protein, 10 aa, Mycobacterium
KQASPGAPRV

SEQ ID NO: 1182592 - protein, 16 aa, Mycobacterium
KQHSDGTATISGTLTP

SEQ ID NO: 1182593 - protein, 9 aa, Mycobacterium
KQPAASQDT

SEQ ID NO: 1182594 - protein, 8 aa, Mycobacterium
KQREEWES

SEQ ID NO: 1182595 - protein, 8 aa, Mycobacterium
KQRHEYTR

SEQ ID NO: 1182596 - protein, 21 aa, Mycobacterium
KQRPAAEAAGPAGAGGPGGVE

SEQ ID NO: 1182597 - protein, 12 aa, Mycobacterium
KQSIGRATNNVA

SEQ ID NO: 1182598 - protein, 6 aa, Mycobacterium
KQSVAG

SEQ ID NO: 1182599 - protein, 13 aa, Mycobacterium
KQVPYSKRAPRLA

SEQ ID NO: 1182600 - protein, 12 aa, Mycobacterium
KQVSGTAGDYQV

SEQ ID NO: 1182601 - protein, 9 aa, Mycobacterium
KQYTSRRGP

SEQ ID NO: 1182602 - protein, 4 aa, Mycobacterium
KRDA

SEQ ID NO: 1182603 - protein, 6 aa, Mycobacterium
KREEHI

SEQ ID NO: 1182604 - protein, 32 aa, Mycobacterium
KRGGGGGEDDDLSGGAGAGQERREKLAEETDD

SEQ ID NO: 1182605 - protein, 7 aa, Mycobacterium
KRGIDPQ

SEQ ID NO: 1182606 - protein, 27 aa, Mycobacterium
KRGRKKRDRKHSKANHGKRPNAGSKSV

SEQ ID NO: 1182607 - protein, 7 aa, Mycobacterium
KRLDDGS

SEQ ID NO: 1182608 - protein, 10 aa, Mycobacterium
KRPDGTLQHP

SEQ ID NO: 1182609 - protein, 7 aa, Mycobacterium
KRPGPGM

SEQ ID NO: 1182610 - protein, 9 aa, Mycobacterium
KRPKAEIKE

SEQ ID NO: 1182611 - protein, 4 aa, Mycobacterium
KRPL

SEQ ID NO: 1182612 - protein, 6 aa, Mycobacterium
KRPVTA

SEQ ID NO: 1182613 - protein, 11 aa, Mycobacterium
KRQGPGAAGER

SEQ ID NO: 1182614 - protein, 13 aa, Mycobacterium
KRRDEYARKSGEA

SEQ ID NO: 1182615 - protein, 7 aa, Mycobacterium
KRRIDPV

SEQ ID NO: 1182616 - protein, 7 aa, Mycobacterium
KRRPGKE

SEQ ID NO: 1182617 - protein, 5 aa, Mycobacterium
KRRRA

SEQ ID NO: 1182618 - protein, 5 aa, Mycobacterium
KRSED

SEQ ID NO: 1182619 - protein, 11 aa, Mycobacterium
KRTAGESTRTA

SEQ ID NO: 1182620 - protein, 7 aa, Mycobacterium
KRTASAA

SEQ ID NO: 1182621 - protein, 5 aa, Mycobacterium
KRTPA

SEQ ID NO: 1182622 - protein, 6 aa, Mycobacterium
KRTTEA

SEQ ID NO: 1182623 - protein, 9 aa, Mycobacterium
KSADSPLSV

SEQ ID NO: 1182624 - protein, 8 aa, Mycobacterium
KSASGSVR

SEQ ID NO: 1182625 - protein, 7 aa, Mycobacterium
KSAVMGP

SEQ ID NO: 1182626 - protein, 6 aa, Mycobacterium
KSDGPS

SEQ ID NO: 1182627 - protein, 8 aa, Mycobacterium
KSDMSTLT

SEQ ID NO: 1182628 - protein, 8 aa, Mycobacterium
KSDRGYTA

SEQ ID NO: 1182629 - protein, 6 aa, Mycobacterium
KSDSMY

SEQ ID NO: 1182630 - protein, 19 aa, Mycobacterium
KSGAAGPTEREQDALTPET

SEQ ID NO: 1182631 - protein, 6 aa, Mycobacterium
KSGAET

SEQ ID NO: 1182632 - protein, 6 aa, Mycobacterium
KSGARD

SEQ ID NO: 1182633 - protein, 11 aa, Mycobacterium
KSGLRGSGRTV

SEQ ID NO: 1182634 - protein, 12 aa, Mycobacterium
KSGTARLSPSGH

SEQ ID NO: 1182635 - protein, 14 aa, Mycobacterium
KSITTFGPYSPGQA

SEQ ID NO: 1182636 - protein, 6 aa, Mycobacterium
KSLRSR

SEQ ID NO: 1182637 - protein, 13 aa, Mycobacterium
KSLSARRNERSSD

SEQ ID NO: 1182638 - protein, 10 aa, Mycobacterium
KSRAKVADPP

SEQ ID NO: 1182639 - protein, 8 aa, Mycobacterium
KSRGAGPR

SEQ ID NO: 1182640 - protein, 6 aa, Mycobacterium
KSRRWA

SEQ ID NO: 1182641 - protein, 7 aa, Mycobacterium
KSRTRGY

SEQ ID NO: 1182642 - protein, 11 aa, Mycobacterium
KSSAAAAQARA

SEQ ID NO: 1182643 - protein, 16 aa, Mycobacterium
KSTRKDPADLPAEPDR

SEQ ID NO: 1182644 - protein, 4 aa, Mycobacterium
KSTV

SEQ ID NO: 1182645 - protein, 8 aa, Mycobacterium
KSTYGQPD

SEQ ID NO: 1182646 - protein, 7 aa, Mycobacterium
KSVKDAK

SEQ ID NO: 1182647 - protein, 66 aa, Mycobacterium
KTAAAKAPAKRAAKGTTTTRGPAKKDGAAPRGRGKKSTAPEAGAADALADDDLDTDDTLEAEPDID

SEQ ID NO: 1182648 - protein, 5 aa, Mycobacterium
KTATP

SEQ ID NO: 1182649 - protein, 8 aa, Mycobacterium
KTGGVSED

SEQ ID NO: 1182650 - protein, 5 aa, Mycobacterium
KTLNT

SEQ ID NO: 1182651 - protein, 9 aa, Mycobacterium
KTNTGGAPA

SEQ ID NO: 1182652 - protein, 6 aa, Mycobacterium
KTPTMP

SEQ ID NO: 1182653 - protein, 4 aa, Mycobacterium
KTQK

SEQ ID NO: 1182654 - protein, 13 aa, Mycobacterium
KTRPEAPFDSDAG

SEQ ID NO: 1182655 - protein, 8 aa, Mycobacterium
KTSADANV

SEQ ID NO: 1182656 - protein, 8 aa, Mycobacterium
KTSARRDG

SEQ ID NO: 1182657 - protein, 7 aa, Mycobacterium
KTSDPSI

SEQ ID NO: 1182658 - protein, 7 aa, Mycobacterium
KTSSSDL

SEQ ID NO: 1182659 - protein, 15 aa, Mycobacterium
KTTAVRTPGGYRLTG

SEQ ID NO: 1182660 - protein, 49 aa, Mycobacterium
KTTKLPAPPARSAAEKAQQTSAAGAADPQTNGAASTQQPAAVGATTGED

SEQ ID NO: 1182661 - protein, 8 aa, Mycobacterium
KVEGDTSV

SEQ ID NO: 1182662 - protein, 9 aa, Mycobacterium
KVEGKQGTR

SEQ ID NO: 1182663 - protein, 9 aa, Mycobacterium
KVEGRSRAA

SEQ ID NO: 1182664 - protein, 13 aa, Mycobacterium
KVEPPGGEISRQV

SEQ ID NO: 1182665 - protein, 8 aa, Mycobacterium
KVGGAAHG

SEQ ID NO: 1182666 - protein, 7 aa, Mycobacterium
KVPPERW

SEQ ID NO: 1182667 - protein, 6 aa, Mycobacterium
KVPRDR

SEQ ID NO: 1182668 - protein, 6 aa, Mycobacterium
KVSDDD

SEQ ID NO: 1182669 - protein, 8 aa, Mycobacterium
KVSPPFKQ

SEQ ID NO: 1182670 - protein, 6 aa, Mycobacterium
KVSPTV

SEQ ID NO: 1182671 - protein, 16 aa, Mycobacterium
KVTDPATLDEQAAAEL

SEQ ID NO: 1182672 - protein, 12 aa, Mycobacterium
KVTPETQEREAA

SEQ ID NO: 1182673 - protein, 5 aa, Mycobacterium
KWPSM

SEQ ID NO: 1182674 - protein, 6 aa, Mycobacterium
KYATQG

SEQ ID NO: 1182675 - protein, 7 aa, Mycobacterium
KYDGTLG

SEQ ID NO: 1182676 - protein, 12 aa, Mycobacterium
KYERKPAGSAVD

SEQ ID NO: 1182677 - protein, 4 aa, Mycobacterium
KYLP

SEQ ID NO: 1182678 - protein, 6 aa, Mycobacterium
LAADDQ

SEQ ID NO: 1182679 - protein, 9 aa, Mycobacterium
LAADGADVS

SEQ ID NO: 1182680 - protein, 10 aa, Mycobacterium
LAAEPDPALT

SEQ ID NO: 1182681 - protein, 8 aa, Mycobacterium
LAAGASRQ

SEQ ID NO: 1182682 - protein, 10 aa, Mycobacterium
LAAGRETTLQ

SEQ ID NO: 1182683 - protein, 5 aa, Mycobacterium
LAANG

SEQ ID NO: 1182684 - protein, 19 aa, Mycobacterium
LAAPEIQADEELKATGTKE

SEQ ID NO: 1182685 - protein, 11 aa, Mycobacterium
LAARAGKVRQS

SEQ ID NO: 1182686 - protein, 11 aa, Mycobacterium
LAARGAGAAIP

SEQ ID NO: 1182687 - protein, 6 aa, Mycobacterium
LADESP

SEQ ID NO: 1182688 - protein, 20 aa, Mycobacterium
LADNERERDVLSDKAARVRQ

SEQ ID NO: 1182689 - protein, 14 aa, Mycobacterium
LADPAAPKTQASDR

SEQ ID NO: 1182690 - protein, 6 aa, Mycobacterium
LADQTL

SEQ ID NO: 1182691 - protein, 4 aa, Mycobacterium
LADS

SEQ ID NO: 1182692 - protein, 4 aa, Mycobacterium
LAEA

SEQ ID NO: 1182693 - protein, 7 aa, Mycobacterium
LAEETND

SEQ ID NO: 1182694 - protein, 8 aa, Mycobacterium
LAEHPDVA

SEQ ID NO: 1182695 - protein, 4 aa, Mycobacterium
LAEP

SEQ ID NO: 1182696 - protein, 12 aa, Mycobacterium
LAEQAAPPAESV

SEQ ID NO: 1182697 - protein, 10 aa, Mycobacterium
LAEQSGKRIR

SEQ ID NO: 1182698 - protein, 4 aa, Mycobacterium
LAER

SEQ ID NO: 1182699 - protein, 8 aa, Mycobacterium
LAESPPRI

SEQ ID NO: 1182700 - protein, 8 aa, Mycobacterium
LAETSSGV

SEQ ID NO: 1182701 - protein, 26 aa, Mycobacterium
LAGATPDQRWTGAASDAYATANERQQ

SEQ ID NO: 1182702 - protein, 18 aa, Mycobacterium
LAGDGGASVHAGFVAVTD

SEQ ID NO: 1182703 - protein, 11 aa, Mycobacterium
LAGDQGAAARV

SEQ ID NO: 1182704 - protein, 7 aa, Mycobacterium
LAGEPRG

SEQ ID NO: 1182705 - protein, 23 aa, Mycobacterium
LAGGADSRAAFAAGRDATRFPGG

SEQ ID NO: 1182706 - protein, 13 aa, Mycobacterium
LAGGEKGKPRYDY

SEQ ID NO: 1182707 - protein, 10 aa, Mycobacterium
LAGNGNSDDY

SEQ ID NO: 1182708 - protein, 11 aa, Mycobacterium
LAGSTDERNRP

SEQ ID NO: 1182709 - protein, 8 aa, Mycobacterium
LAKAQGIP

SEQ ID NO: 1182710 - protein, 6 aa, Mycobacterium
LAKEPA

SEQ ID NO: 1182711 - protein, 15 aa, Mycobacterium
LAKKDSDPQPPIAEA

SEQ ID NO: 1182712 - protein, 9 aa, Mycobacterium
LAKTASDQM

SEQ ID NO: 1182713 - protein, 5 aa, Mycobacterium
LAPDG

SEQ ID NO: 1182714 - protein, 4 aa, Mycobacterium
LAPE

SEQ ID NO: 1182715 - protein, 8 aa, Mycobacterium
LAPEGTPF

SEQ ID NO: 1182716 - protein, 4 aa, Mycobacterium
LAPP

SEQ ID NO: 1182717 - protein, 16 aa, Mycobacterium
LAPPRNMGSATSSGLP

SEQ ID NO: 1182718 - protein, 19 aa, Mycobacterium
LAPTAAVPEPQESVEHASD

SEQ ID NO: 1182719 - protein, 8 aa, Mycobacterium
LAPTSRSD

SEQ ID NO: 1182720 - protein, 4 aa, Mycobacterium
LAPY

SEQ ID NO: 1182721 - protein, 8 aa, Mycobacterium
LAQGPDDN

SEQ ID NO: 1182722 - protein, 6 aa, Mycobacterium
LAQPGR

SEQ ID NO: 1182723 - protein, 8 aa, Mycobacterium
LAQPQTRT

SEQ ID NO: 1182724 - protein, 12 aa, Mycobacterium
LAQTAQAADAAG

SEQ ID NO: 1182725 - protein, 7 aa, Mycobacterium
LAQTEPF

SEQ ID NO: 1182726 - protein, 12 aa, Mycobacterium
LARGGTGRGTMP

SEQ ID NO: 1182727 - protein, 4 aa, Mycobacterium
LARR

SEQ ID NO: 1182728 - protein, 13 aa, Mycobacterium
LARRKKDAAADGE

SEQ ID NO: 1182729 - protein, 6 aa, Mycobacterium
LASPQP

SEQ ID NO: 1182730 - protein, 7 aa, Mycobacterium
LASPRDL

SEQ ID NO: 1182731 - protein, 8 aa, Mycobacterium
LASRGNAL

SEQ ID NO: 1182732 - protein, 7 aa, Mycobacterium
LASSSYA

SEQ ID NO: 1182733 - protein, 11 aa, Mycobacterium
LASTSEDPDGL

SEQ ID NO: 1182734 - protein, 9 aa, Mycobacterium
LATADPQLA

SEQ ID NO: 1182735 - protein, 10 aa, Mycobacterium
LATDGSDAAR

SEQ ID NO: 1182736 - protein, 5 aa, Mycobacterium
LAVER

SEQ ID NO: 1182737 - protein, 7 aa, Mycobacterium
LAVNGSK

SEQ ID NO: 1182738 - protein, 5 aa, Mycobacterium
LDAGE

SEQ ID NO: 1182739 - protein, 7 aa, Mycobacterium
LDAGGVP

SEQ ID NO: 1182740 - protein, 9 aa, Mycobacterium
LDDAAGAAM

SEQ ID NO: 1182741 - protein, 7 aa, Mycobacterium
LDDRNAE

SEQ ID NO: 1182742 - protein, 6 aa, Mycobacterium
LDEARQ

SEQ ID NO: 1182743 - protein, 4 aa, Mycobacterium
LDGA

SEQ ID NO: 1182744 - protein, 38 aa, Mycobacterium
LDGAGAGGGAGAVGAATGAAGGGAAGAAGAAGAGQEMG

SEQ ID NO: 1182745 - protein, 4 aa, Mycobacterium
LDGT

SEQ ID NO: 1182746 - protein, 13 aa, Mycobacterium
LDKGSDDRPEDDQ

SEQ ID NO: 1182747 - protein, 4 aa, Mycobacterium
LDPA

SEQ ID NO: 1182748 - protein, 6 aa, Mycobacterium
LDPAAT

SEQ ID NO: 1182749 - protein, 8 aa, Mycobacterium
LDPDGQSG

SEQ ID NO: 1182750 - protein, 14 aa, Mycobacterium
LDPEVAEHDPPQAL

SEQ ID NO: 1182751 - protein, 187 aa, Mycobacterium
LDPPPGAAPVPPISSNGDPRKGKIQPAGEGAPGEPGSGGGAQPGGRPGAQPGGQAAAAPMGGGSPAGQGGAQPAGASSGGGGSPSGGGGSPAGGGGAPAAPAAGGGLPGGLPGGGPDGLPPLDDPALKPAAASGGGAGGGSGGGAGGGGGGVPPSPLQPAVGAETVAPGAAGTGRAGAAAAGPAGAM

SEQ ID NO: 1182752 - protein, 8 aa, Mycobacterium
LDPPPPGV

SEQ ID NO: 1182753 - protein, 9 aa, Mycobacterium
LDPSSAAEM

SEQ ID NO: 1182754 - protein, 9 aa, Mycobacterium
LDPTDEKAQ

SEQ ID NO: 1182755 - protein, 12 aa, Mycobacterium
LDPTNPDGIPAN

SEQ ID NO: 1182756 - protein, 9 aa, Mycobacterium
LDRADKEQG

SEQ ID NO: 1182757 - protein, 11 aa, Mycobacterium
LDRSSLGDVGV

SEQ ID NO: 1182758 - protein, 4 aa, Mycobacterium
LDRT

SEQ ID NO: 1182759 - protein, 11 aa, Mycobacterium
LDSARTQGKQR

SEQ ID NO: 1182760 - protein, 53 aa, Mycobacterium
LDTDDDSSDDGDDADTPDAKAKAAPKGGAVPAAPATEDEEIAEPSEKDKASGD

SEQ ID NO: 1182761 - protein, 8 aa, Mycobacterium
LDTTGHGS

SEQ ID NO: 1182762 - protein, 7 aa, Mycobacterium
LDTVSST

SEQ ID NO: 1182763 - protein, 14 aa, Mycobacterium
LDVSDTASDADGVS

SEQ ID NO: 1182764 - protein, 7 aa, Mycobacterium
LEAAAKS

SEQ ID NO: 1182765 - protein, 7 aa, Mycobacterium
LEAAEQP

SEQ ID NO: 1182766 - protein, 14 aa, Mycobacterium
LEAAGGSARIAVAD

SEQ ID NO: 1182767 - protein, 8 aa, Mycobacterium
LEADTTRL

SEQ ID NO: 1182768 - protein, 6 aa, Mycobacterium
LEAEEI

SEQ ID NO: 1182769 - protein, 7 aa, Mycobacterium
LEDDGSV

SEQ ID NO: 1182770 - protein, 4 aa, Mycobacterium
LEDG

SEQ ID NO: 1182771 - protein, 5 aa, Mycobacterium
LEDPR

SEQ ID NO: 1182772 - protein, 15 aa, Mycobacterium
LEEGDGRGEAADGQH

SEQ ID NO: 1182773 - protein, 5 aa, Mycobacterium
LEEVG

SEQ ID NO: 1182774 - protein, 10 aa, Mycobacterium
LEGEEGDHPF

SEQ ID NO: 1182775 - protein, 5 aa, Mycobacterium
LEGQG

SEQ ID NO: 1182776 - protein, 5 aa, Mycobacterium
LEGRD

SEQ ID NO: 1182777 - protein, 11 aa, Mycobacterium
LEPAAGTIKRG

SEQ ID NO: 1182778 - protein, 16 aa, Mycobacterium
LEPDPRYRGSLQDTRD

SEQ ID NO: 1182779 - protein, 45 aa, Mycobacterium
LEPPPQPQPAPEPDPDAVSDADVEPKPLPDPADLQPSITTTSDEQ

SEQ ID NO: 1182780 - protein, 42 aa, Mycobacterium
LEPPPQPQPEPEPVSDADVEPKPLPDPADLQPSITTTSDEQY

SEQ ID NO: 1182781 - protein, 10 aa, Mycobacterium
LEPPSRSQAT

SEQ ID NO: 1182782 - protein, 7 aa, Mycobacterium
LEPTNDA

SEQ ID NO: 1182783 - protein, 15 aa, Mycobacterium
LEQNAANGRERAEAI

SEQ ID NO: 1182784 - protein, 8 aa, Mycobacterium
LEQTQQGR

SEQ ID NO: 1182785 - protein, 6 aa, Mycobacterium
LERGDP

SEQ ID NO: 1182786 - protein, 4 aa, Mycobacterium
LESD

SEQ ID NO: 1182787 - protein, 5 aa, Mycobacterium
LESER

SEQ ID NO: 1182788 - protein, 9 aa, Mycobacterium
LESGELTRR

SEQ ID NO: 1182789 - protein, 8 aa, Mycobacterium
LESTGARP

SEQ ID NO: 1182790 - protein, 6 aa, Mycobacterium
LETGIG

SEQ ID NO: 1182791 - protein, 5 aa, Mycobacterium
LGAAA

SEQ ID NO: 1182792 - protein, 4 aa, Mycobacterium
LGAE

SEQ ID NO: 1182793 - protein, 5 aa, Mycobacterium
LGAEL

SEQ ID NO: 1182794 - protein, 5 aa, Mycobacterium
LGAGG

SEQ ID NO: 1182795 - protein, 5 aa, Mycobacterium
LGAGK

SEQ ID NO: 1182796 - protein, 10 aa, Mycobacterium
LGAPATAALT

SEQ ID NO: 1182797 - protein, 16 aa, Mycobacterium
LGAPGGGGLPASTPIT

SEQ ID NO: 1182798 - protein, 10 aa, Mycobacterium
LGDDAANPRY

SEQ ID NO: 1182799 - protein, 6 aa, Mycobacterium
LGDDAR

SEQ ID NO: 1182800 - protein, 11 aa, Mycobacterium
LGDDPGGVDYG

SEQ ID NO: 1182801 - protein, 6 aa, Mycobacterium
LGDGRA

SEQ ID NO: 1182802 - protein, 4 aa, Mycobacterium
LGDI

SEQ ID NO: 1182803 - protein, 10 aa, Mycobacterium
LGEDGPTHQP

SEQ ID NO: 1182804 - protein, 5 aa, Mycobacterium
LGEGG

SEQ ID NO: 1182805 - protein, 4 aa, Mycobacterium
LGEN

SEQ ID NO: 1182806 - protein, 5 aa, Mycobacterium
LGEPI

SEQ ID NO: 1182807 - protein, 5 aa, Mycobacterium
LGEQA

SEQ ID NO: 1182808 - protein, 5 aa, Mycobacterium
LGERG

SEQ ID NO: 1182809 - protein, 4 aa, Mycobacterium
LGES

SEQ ID NO: 1182810 - protein, 9 aa, Mycobacterium
LGESLGESL

SEQ ID NO: 1182811 - protein, 15 aa, Mycobacterium
LGESSPTDAVKDQYD

SEQ ID NO: 1182812 - protein, 11 aa, Mycobacterium
LGESVESGDRI

SEQ ID NO: 1182813 - protein, 18 aa, Mycobacterium
LGGATSTTATFETHSPDN

SEQ ID NO: 1182814 - protein, 8 aa, Mycobacterium
LGGAVGPN

SEQ ID NO: 1182815 - protein, 6 aa, Mycobacterium
LGGDSL

SEQ ID NO: 1182816 - protein, 9 aa, Mycobacterium
LGGGEPTPA

SEQ ID NO: 1182817 - protein, 10 aa, Mycobacterium
LGGGGLLPSE

SEQ ID NO: 1182818 - protein, 9 aa, Mycobacterium
LGGGGRAAT

SEQ ID NO: 1182819 - protein, 4 aa, Mycobacterium
LGGP

SEQ ID NO: 1182820 - protein, 18 aa, Mycobacterium
LGGRAGDAGANDAEVSAV

SEQ ID NO: 1182821 - protein, 12 aa, Mycobacterium
LGGRSGPQLEDA

SEQ ID NO: 1182822 - protein, 7 aa, Mycobacterium
LGGSNPS

SEQ ID NO: 1182823 - protein, 6 aa, Mycobacterium
LGGSTV

SEQ ID NO: 1182824 - protein, 17 aa, Mycobacterium
LGKPPTRLTSAPKGSDY

SEQ ID NO: 1182825 - protein, 5 aa, Mycobacterium
LGKPY

SEQ ID NO: 1182826 - protein, 7 aa, Mycobacterium
LGKTRET

SEQ ID NO: 1182827 - protein, 8 aa, Mycobacterium
LGLPGTQV

SEQ ID NO: 1182828 - protein, 12 aa, Mycobacterium
LGNDSAETRTDH

SEQ ID NO: 1182829 - protein, 8 aa, Mycobacterium
LGNGKADY

SEQ ID NO: 1182830 - protein, 5 aa, Mycobacterium
LGNRK

SEQ ID NO: 1182831 - protein, 8 aa, Mycobacterium
LGPDGAAM

SEQ ID NO: 1182832 - protein, 5 aa, Mycobacterium
LGPDL

SEQ ID NO: 1182833 - protein, 7 aa, Mycobacterium
LGPEAAP

SEQ ID NO: 1182834 - protein, 12 aa, Mycobacterium
LGPEAGVSDTSV

SEQ ID NO: 1182835 - protein, 6 aa, Mycobacterium
LGPGGQ

SEQ ID NO: 1182836 - protein, 7 aa, Mycobacterium
LGPKGRA

SEQ ID NO: 1182837 - protein, 6 aa, Mycobacterium
LGPLAP

SEQ ID NO: 1182838 - protein, 9 aa, Mycobacterium
LGPPDTARR

SEQ ID NO: 1182839 - protein, 5 aa, Mycobacterium
LGPSD

SEQ ID NO: 1182840 - protein, 5 aa, Mycobacterium
LGQDG

SEQ ID NO: 1182841 - protein, 8 aa, Mycobacterium
LGQGPQQL

SEQ ID NO: 1182842 - protein, 10 aa, Mycobacterium
LGQNGPYGQV

SEQ ID NO: 1182843 - protein, 5 aa, Mycobacterium
LGRGG

SEQ ID NO: 1182844 - protein, 7 aa, Mycobacterium
LGRIGPR

SEQ ID NO: 1182845 - protein, 6 aa, Mycobacterium
LGRRDT

SEQ ID NO: 1182846 - protein, 12 aa, Mycobacterium
LGRRQAVGEHRA

SEQ ID NO: 1182847 - protein, 18 aa, Mycobacterium
LGRTARPRGGRSGGAVPD

SEQ ID NO: 1182848 - protein, 8 aa, Mycobacterium
LGSESKTF

SEQ ID NO: 1182849 - protein, 7 aa, Mycobacterium
LGSGLTG

SEQ ID NO: 1182850 - protein, 12 aa, Mycobacterium
LGSGPGTRGVDG

SEQ ID NO: 1182851 - protein, 9 aa, Mycobacterium
LGSSSDLRV

SEQ ID NO: 1182852 - protein, 4 aa, Mycobacterium
LGST

SEQ ID NO: 1182853 - protein, 8 aa, Mycobacterium
LGSTDDTV

SEQ ID NO: 1182854 - protein, 7 aa, Mycobacterium
LGSTDMG

SEQ ID NO: 1182855 - protein, 7 aa, Mycobacterium
LGTAPDD

SEQ ID NO: 1182856 - protein, 10 aa, Mycobacterium
LGTDPGTARR

SEQ ID NO: 1182857 - protein, 6 aa, Mycobacterium
LGTGQE

SEQ ID NO: 1182858 - protein, 6 aa, Mycobacterium
LGTGSV

SEQ ID NO: 1182859 - protein, 6 aa, Mycobacterium
LGTIAT

SEQ ID NO: 1182860 - protein, 4 aa, Mycobacterium
LGTT

SEQ ID NO: 1182861 - protein, 6 aa, Mycobacterium
LGVGGT

SEQ ID NO: 1182862 - protein, 36 aa, Mycobacterium
LHDRPSANGRGSGGRAERDVPGDAASSRFDGDRTVG

SEQ ID NO: 1182863 - protein, 6 aa, Mycobacterium
LHEEPE

SEQ ID NO: 1182864 - protein, 5 aa, Mycobacterium
LHGDA

SEQ ID NO: 1182865 - protein, 11 aa, Mycobacterium
LHPGAEASQQA

SEQ ID NO: 1182866 - protein, 15 aa, Mycobacterium
LHQRPPVAEGTTTLY

SEQ ID NO: 1182867 - protein, 16 aa, Mycobacterium
LKEGSKSREKVTEQGL

SEQ ID NO: 1182868 - protein, 10 aa, Mycobacterium
LKGAPVPAPR

SEQ ID NO: 1182869 - protein, 7 aa, Mycobacterium
LKPNQYG

SEQ ID NO: 1182870 - protein, 5 aa, Mycobacterium
LKPPH

SEQ ID NO: 1182871 - protein, 7 aa, Mycobacterium
LKPRGAA

SEQ ID NO: 1182872 - protein, 11 aa, Mycobacterium
LKTEEGRDRTQ

SEQ ID NO: 1182873 - protein, 13 aa, Mycobacterium
LNAGRTDTPLRTG

SEQ ID NO: 1182874 - protein, 5 aa, Mycobacterium
LNDPD

SEQ ID NO: 1182875 - protein, 10 aa, Mycobacterium
LNDPGNKTFV

SEQ ID NO: 1182876 - protein, 4 aa, Mycobacterium
LNEV

SEQ ID NO: 1182877 - protein, 6 aa, Mycobacterium
LNGGDG

SEQ ID NO: 1182878 - protein, 12 aa, Mycobacterium
LNGRRGGAYRTG

SEQ ID NO: 1182879 - protein, 5 aa, Mycobacterium
LNGTK

SEQ ID NO: 1182880 - protein, 10 aa, Mycobacterium
LNGTRTPYTV

SEQ ID NO: 1182881 - protein, 12 aa, Mycobacterium
LNPRPLRRLHGR

SEQ ID NO: 1182882 - protein, 9 aa, Mycobacterium
LNPSRRGHV

SEQ ID NO: 1182883 - protein, 10 aa, Mycobacterium
LNPTGSFKDR

SEQ ID NO: 1182884 - protein, 9 aa, Mycobacterium
LNQPSGGLE

SEQ ID NO: 1182885 - protein, 9 aa, Mycobacterium
LNRGNGQAI

SEQ ID NO: 1182886 - protein, 9 aa, Mycobacterium
LNTAGGQLG

SEQ ID NO: 1182887 - protein, 8 aa, Mycobacterium
LNTAPGVS

SEQ ID NO: 1182888 - protein, 5 aa, Mycobacterium
LNTND

SEQ ID NO: 1182889 - protein, 9 aa, Mycobacterium
LNTRPRPTL

SEQ ID NO: 1182890 - protein, 6 aa, Mycobacterium
LNVSGG

SEQ ID NO: 1182891 - protein, 6 aa, Mycobacterium
LPAAET

SEQ ID NO: 1182892 - protein, 11 aa, Mycobacterium
LPADGTADGSR

SEQ ID NO: 1182893 - protein, 14 aa, Mycobacterium
LPADQDVAQPPKAD

SEQ ID NO: 1182894 - protein, 5 aa, Mycobacterium
LPAED

SEQ ID NO: 1182895 - protein, 8 aa, Mycobacterium
LPAEPDDT

SEQ ID NO: 1182896 - protein, 12 aa, Mycobacterium
LPAGDPAGNEQW

SEQ ID NO: 1182897 - protein, 11 aa, Mycobacterium
LPAGKSGRATF

SEQ ID NO: 1182898 - protein, 5 aa, Mycobacterium
LPAGQ

SEQ ID NO: 1182899 - protein, 11 aa, Mycobacterium
LPAGQTEEVDR

SEQ ID NO: 1182900 - protein, 6 aa, Mycobacterium
LPAGTR

SEQ ID NO: 1182901 - protein, 6 aa, Mycobacterium
LPAGVE

SEQ ID NO: 1182902 - protein, 17 aa, Mycobacterium
LPAPGDVRGLPAGTQFQ

SEQ ID NO: 1182903 - protein, 12 aa, Mycobacterium
LPAPQPDPVAPA

SEQ ID NO: 1182904 - protein, 22 aa, Mycobacterium
LPATGPDALEPTGPPGPAPSVP

SEQ ID NO: 1182905 - protein, 8 aa, Mycobacterium
LPDARGPL

SEQ ID NO: 1182906 - protein, 9 aa, Mycobacterium
LPDEPEPGT

SEQ ID NO: 1182907 - protein, 7 aa, Mycobacterium
LPDGARQ

SEQ ID NO: 1182908 - protein, 8 aa, Mycobacterium
LPDGARQL

SEQ ID NO: 1182909 - protein, 6 aa, Mycobacterium
LPDGDP

SEQ ID NO: 1182910 - protein, 7 aa, Mycobacterium
LPDGQAP

SEQ ID NO: 1182911 - protein, 15 aa, Mycobacterium
LPDGSTATAPNPVAA

SEQ ID NO: 1182912 - protein, 15 aa, Mycobacterium
LPDGSTSFKRSPGGL

SEQ ID NO: 1182913 - protein, 5 aa, Mycobacterium
LPDGT

SEQ ID NO: 1182914 - protein, 8 aa, Mycobacterium
LPDNDPDA

SEQ ID NO: 1182915 - protein, 7 aa, Mycobacterium
LPDPEQH

SEQ ID NO: 1182916 - protein, 7 aa, Mycobacterium
LPDPPRV

SEQ ID NO: 1182917 - protein, 13 aa, Mycobacterium
LPDPRSTAPRDPD

SEQ ID NO: 1182918 - protein, 7 aa, Mycobacterium
LPDREDK

SEQ ID NO: 1182919 - protein, 5 aa, Mycobacterium
LPDRP

SEQ ID NO: 1182920 - protein, 8 aa, Mycobacterium
LPDRPATT

SEQ ID NO: 1182921 - protein, 8 aa, Mycobacterium
LPDTDDAN

SEQ ID NO: 1182922 - protein, 15 aa, Mycobacterium
LPEASGDAADNVGGG

SEQ ID NO: 1182923 - protein, 4 aa, Mycobacterium
LPED

SEQ ID NO: 1182924 - protein, 14 aa, Mycobacterium
LPEDPDVKPRPLGK

SEQ ID NO: 1182925 - protein, 11 aa, Mycobacterium
LPEGDDIGKAV

SEQ ID NO: 1182926 - protein, 11 aa, Mycobacterium
LPEGDGDDDGL

SEQ ID NO: 1182927 - protein, 5 aa, Mycobacterium
LPEGL

SEQ ID NO: 1182928 - protein, 34 aa, Mycobacterium
LPEGPPSGDPVGAGDDDRSTDKRSDESPERPPDA

SEQ ID NO: 1182929 - protein, 21 aa, Mycobacterium
LPEHDARARMKAQAADEQRRA

SEQ ID NO: 1182930 - protein, 4 aa, Mycobacterium
LPEP

SEQ ID NO: 1182931 - protein, 5 aa, Mycobacterium
LPEQP

SEQ ID NO: 1182932 - protein, 5 aa, Mycobacterium
LPERE

SEQ ID NO: 1182933 - protein, 4 aa, Mycobacterium
LPEY

SEQ ID NO: 1182934 - protein, 6 aa, Mycobacterium
LPGANS

SEQ ID NO: 1182935 - protein, 9 aa, Mycobacterium
LPGDDPDYL

SEQ ID NO: 1182936 - protein, 8 aa, Mycobacterium
LPGDGARQ

SEQ ID NO: 1182937 - protein, 7 aa, Mycobacterium
LPGEPIS

SEQ ID NO: 1182938 - protein, 8 aa, Mycobacterium
LPGGTADT

SEQ ID NO: 1182939 - protein, 6 aa, Mycobacterium
LPGNGE

SEQ ID NO: 1182940 - protein, 6 aa, Mycobacterium
LPGPFN

SEQ ID NO: 1182941 - protein, 12 aa, Mycobacterium
LPGPLSKTTSVQ

SEQ ID NO: 1182942 - protein, 15 aa, Mycobacterium
LPIAPATPRELAAAA

SEQ ID NO: 1182943 - protein, 9 aa, Mycobacterium
LPNPDDPSH

SEQ ID NO: 1182944 - protein, 16 aa, Mycobacterium
LPPADAKQLAGGETVP

SEQ ID NO: 1182945 - protein, 14 aa, Mycobacterium
LPPAGEDLAYLGRS

SEQ ID NO: 1182946 - protein, 119 aa, Mycobacterium
LPPAPGQVPAQPASTGAAPTVPTPTGSSGTPLPTGSQGTPIGSAGTPAGTPGQPLPPAADGSQGTPAAAAPGPAAPASAAPAVLPPAAAGQLAPAAPAGSQGTPAATTPVTTPVTPPPA

SEQ ID NO: 1182947 - protein, 25 aa, Mycobacterium
LPPDAQRSRAQRELAQAQAAARALE

SEQ ID NO: 1182948 - protein, 16 aa, Mycobacterium
LPPDPAGRTSYDPGDI

SEQ ID NO: 1182949 - protein, 9 aa, Mycobacterium
LPPDQSPAR

SEQ ID NO: 1182950 - protein, 9 aa, Mycobacterium
LPPDSAAKP

SEQ ID NO: 1182951 - protein, 6 aa, Mycobacterium
LPPDTR

SEQ ID NO: 1182952 - protein, 6 aa, Mycobacterium
LPPDYI

SEQ ID NO: 1182953 - protein, 4 aa, Mycobacterium
LPPE

SEQ ID NO: 1182954 - protein, 9 aa, Mycobacterium
LPPEGPPVF

SEQ ID NO: 1182955 - protein, 25 aa, Mycobacterium
LPPEVPEDPRRSGATPPALPTGQQA

SEQ ID NO: 1182956 - protein, 6 aa, Mycobacterium
LPPGHD

SEQ ID NO: 1182957 - protein, 6 aa, Mycobacterium
LPPGKH

SEQ ID NO: 1182958 - protein, 30 aa, Mycobacterium
LPPGPLGPPPSASAAIAPATGAGPSVGGAH

SEQ ID NO: 1182959 - protein, 5 aa, Mycobacterium
LPPGR

SEQ ID NO: 1182960 - protein, 23 aa, Mycobacterium
LPPPDGYAAGADGNLAPLPPPTC

SEQ ID NO: 1182961 - protein, 17 aa, Mycobacterium
LPPPPAPPPPPPPPAWN

SEQ ID NO: 1182962 - protein, 6 aa, Mycobacterium
LPPPPI

SEQ ID NO: 1182963 - protein, 4 aa, Mycobacterium
LPPR

SEQ ID NO: 1182964 - protein, 11 aa, Mycobacterium
LPPSSAAPRTT

SEQ ID NO: 1182965 - protein, 6 aa, Mycobacterium
LPPVGG

SEQ ID NO: 1182966 - protein, 7 aa, Mycobacterium
LPPYPEA

SEQ ID NO: 1182967 - protein, 4 aa, Mycobacterium
LPQR

SEQ ID NO: 1182968 - protein, 6 aa, Mycobacterium
LPRDDA

SEQ ID NO: 1182969 - protein, 4 aa, Mycobacterium
LPRR

SEQ ID NO: 1182970 - protein, 15 aa, Mycobacterium
LPRSDAESAAAAAAI

SEQ ID NO: 1182971 - protein, 6 aa, Mycobacterium
LPSEDR

SEQ ID NO: 1182972 - protein, 5 aa, Mycobacterium
LPSGF

SEQ ID NO: 1182973 - protein, 8 aa, Mycobacterium
LPSGGSVA

SEQ ID NO: 1182974 - protein, 16 aa, Mycobacterium
LPSPASKSWRSRREIR

SEQ ID NO: 1182975 - protein, 11 aa, Mycobacterium
LPTDDSGYRIQ

SEQ ID NO: 1182976 - protein, 5 aa, Mycobacterium
LPTDE

SEQ ID NO: 1182977 - protein, 6 aa, Mycobacterium
LPTEPG

SEQ ID NO: 1182978 - protein, 15 aa, Mycobacterium
LPTEVDEPQRWIDRV

SEQ ID NO: 1182979 - protein, 8 aa, Mycobacterium
LPTPNDDR

SEQ ID NO: 1182980 - protein, 8 aa, Mycobacterium
LPTPTANA

SEQ ID NO: 1182981 - protein, 5 aa, Mycobacterium
LPTSV

SEQ ID NO: 1182982 - protein, 5 aa, Mycobacterium
LQAAP

SEQ ID NO: 1182983 - protein, 24 aa, Mycobacterium
LQAHSPSLRSPQDRRLPPDTAAWV

SEQ ID NO: 1182984 - protein, 9 aa, Mycobacterium
LQAQDEKVA

SEQ ID NO: 1182985 - protein, 6 aa, Mycobacterium
LQAQTQ

SEQ ID NO: 1182986 - protein, 21 aa, Mycobacterium
LQARAGGGNGNKPEAEAAEPL

SEQ ID NO: 1182987 - protein, 10 aa, Mycobacterium
LQARDSAVTD

SEQ ID NO: 1182988 - protein, 7 aa, Mycobacterium
LQARTDV

SEQ ID NO: 1182989 - protein, 6 aa, Mycobacterium
LQERPG

SEQ ID NO: 1182990 - protein, 9 aa, Mycobacterium
LQGGGLGYA

SEQ ID NO: 1182991 - protein, 51 aa, Mycobacterium
LQGGPPSRGEPGAWTGDGESDHRQADRSRDGSTESPDGSDSQGVRGGETNG

SEQ ID NO: 1182992 - protein, 6 aa, Mycobacterium
LQGHPG

SEQ ID NO: 1182993 - protein, 5 aa, Mycobacterium
LQNGF

SEQ ID NO: 1182994 - protein, 6 aa, Mycobacterium
LQPGDD

SEQ ID NO: 1182995 - protein, 6 aa, Mycobacterium
LQPGQS

SEQ ID NO: 1182996 - protein, 9 aa, Mycobacterium
LQPQPGFSS

SEQ ID NO: 1182997 - protein, 10 aa, Mycobacterium
LQQERSRETK

SEQ ID NO: 1182998 - protein, 86 aa, Mycobacterium
LQQHSPSYIPGAPGPEKPTFEEPTAPREPLPPKPDQGGPDLRTATGLSVGGGQTARGQQGEYLTTAQGARLHDTDHSLKAGERGPT

SEQ ID NO: 1182999 - protein, 14 aa, Mycobacterium
LQRPSGEHQPGRTS

SEQ ID NO: 1183000 - protein, 18 aa, Mycobacterium
LQSESRAAQRRAEESASE

SEQ ID NO: 1183001 - protein, 11 aa, Mycobacterium
LRAGRSRNDQV

SEQ ID NO: 1183002 - protein, 4 aa, Mycobacterium
LRAS

SEQ ID NO: 1183003 - protein, 11 aa, Mycobacterium
LRDAKGRTARD

SEQ ID NO: 1183004 - protein, 14 aa, Mycobacterium
LRDDNVNPRNHISV

SEQ ID NO: 1183005 - protein, 17 aa, Mycobacterium
LRDGDPDEKLRDDGPTI

SEQ ID NO: 1183006 - protein, 9 aa, Mycobacterium
LRDPAATAA

SEQ ID NO: 1183007 - protein, 10 aa, Mycobacterium
LRDPPDQPSL

SEQ ID NO: 1183008 - protein, 10 aa, Mycobacterium
LRDSPDKISN

SEQ ID NO: 1183009 - protein, 4 aa, Mycobacterium
LREG

SEQ ID NO: 1183010 - protein, 15 aa, Mycobacterium
LREQGLDPVETPEEY

SEQ ID NO: 1183011 - protein, 8 aa, Mycobacterium
LRETNTTA

SEQ ID NO: 1183012 - protein, 6 aa, Mycobacterium
LRGARP

SEQ ID NO: 1183013 - protein, 11 aa, Mycobacterium
LRGEAGDRQVA

SEQ ID NO: 1183014 - protein, 9 aa, Mycobacterium
LRGGDPAGI

SEQ ID NO: 1183015 - protein, 18 aa, Mycobacterium
LRGPACNDQKSTPDYNTD

SEQ ID NO: 1183016 - protein, 14 aa, Mycobacterium
LRGPTGPGTTPRSG

SEQ ID NO: 1183017 - protein, 26 aa, Mycobacterium
LRGSEPPAVDLDGPPDPAPDDDEDIA

SEQ ID NO: 1183018 - protein, 8 aa, Mycobacterium
LRHSRRER

SEQ ID NO: 1183019 - protein, 4 aa, Mycobacterium
LRNG

SEQ ID NO: 1183020 - protein, 6 aa, Mycobacterium
LRNGRL

SEQ ID NO: 1183021 - protein, 17 aa, Mycobacterium
LRPEAARPHAFDGDDRT

SEQ ID NO: 1183022 - protein, 10 aa, Mycobacterium
LRPGPRHAPT

SEQ ID NO: 1183023 - protein, 22 aa, Mycobacterium
LRPGRGRGASAPEVKAATSVPD

SEQ ID NO: 1183024 - protein, 6 aa, Mycobacterium
LRPRSR

SEQ ID NO: 1183025 - protein, 6 aa, Mycobacterium
LRPTHD

SEQ ID NO: 1183026 - protein, 7 aa, Mycobacterium
LRPTTRG

SEQ ID NO: 1183027 - protein, 12 aa, Mycobacterium
LRRKTEARREHG

SEQ ID NO: 1183028 - protein, 6 aa, Mycobacterium
LRRRAG

SEQ ID NO: 1183029 - protein, 7 aa, Mycobacterium
LRSAESE

SEQ ID NO: 1183030 - protein, 8 aa, Mycobacterium
LRSEREQG

SEQ ID NO: 1183031 - protein, 8 aa, Mycobacterium
LRSPDSDD

SEQ ID NO: 1183032 - protein, 6 aa, Mycobacterium
LSAPRA

SEQ ID NO: 1183033 - protein, 17 aa, Mycobacterium
LSASKGAARRTIAEGGV

SEQ ID NO: 1183034 - protein, 11 aa, Mycobacterium
LSDEPEPEPEP

SEQ ID NO: 1183035 - protein, 4 aa, Mycobacterium
LSDG

SEQ ID NO: 1183036 - protein, 8 aa, Mycobacterium
LSDGTPAR

SEQ ID NO: 1183037 - protein, 9 aa, Mycobacterium
LSDRARNGR

SEQ ID NO: 1183038 - protein, 4 aa, Mycobacterium
LSDS

SEQ ID NO: 1183039 - protein, 19 aa, Mycobacterium
LSDTKAMAQAAHGSAPDIA

SEQ ID NO: 1183040 - protein, 9 aa, Mycobacterium
LSEADDDAS

SEQ ID NO: 1183041 - protein, 10 aa, Mycobacterium
LSEAEAERSV

SEQ ID NO: 1183042 - protein, 12 aa, Mycobacterium
LSEEGADDPVRL

SEQ ID NO: 1183043 - protein, 5 aa, Mycobacterium
LSEER

SEQ ID NO: 1183044 - protein, 9 aa, Mycobacterium
LSEPTDAQR

SEQ ID NO: 1183045 - protein, 7 aa, Mycobacterium
LSEQESL

SEQ ID NO: 1183046 - protein, 11 aa, Mycobacterium
LSERSAASIEA

SEQ ID NO: 1183047 - protein, 6 aa, Mycobacterium
LSESLR

SEQ ID NO: 1183048 - protein, 4 aa, Mycobacterium
LSET

SEQ ID NO: 1183049 - protein, 4 aa, Mycobacterium
LSGA

SEQ ID NO: 1183050 - protein, 15 aa, Mycobacterium
LSGAGPVDVDNDSYR

SEQ ID NO: 1183051 - protein, 17 aa, Mycobacterium
LSGAGRGPIAAAPDPTL

SEQ ID NO: 1183052 - protein, 16 aa, Mycobacterium
LSGAQAEQRARQDAAE

SEQ ID NO: 1183053 - protein, 7 aa, Mycobacterium
LSGDPYR

SEQ ID NO: 1183054 - protein, 7 aa, Mycobacterium
LSGGERR

SEQ ID NO: 1183055 - protein, 13 aa, Mycobacterium
LSGHGNAPHATER

SEQ ID NO: 1183056 - protein, 8 aa, Mycobacterium
LSGMEGET

SEQ ID NO: 1183057 - protein, 5 aa, Mycobacterium
LSGPR

SEQ ID NO: 1183058 - protein, 9 aa, Mycobacterium
LSGRGLPQR

SEQ ID NO: 1183059 - protein, 5 aa, Mycobacterium
LSGRQ

SEQ ID NO: 1183060 - protein, 12 aa, Mycobacterium
LSGRQRKIRSTV

SEQ ID NO: 1183061 - protein, 13 aa, Mycobacterium
LSGRRDDDAQSYT

SEQ ID NO: 1183062 - protein, 16 aa, Mycobacterium
LSIGPDDFGGATRGSR

SEQ ID NO: 1183063 - protein, 5 aa, Mycobacterium
LSITQ

SEQ ID NO: 1183064 - protein, 5 aa, Mycobacterium
LSNRE

SEQ ID NO: 1183065 - protein, 10 aa, Mycobacterium
LSPDDPASWT

SEQ ID NO: 1183066 - protein, 8 aa, Mycobacterium
LSPDEPLP

SEQ ID NO: 1183067 - protein, 15 aa, Mycobacterium
LSPGATFRSTATANA

SEQ ID NO: 1183068 - protein, 10 aa, Mycobacterium
LSPKQDAEIE

SEQ ID NO: 1183069 - protein, 5 aa, Mycobacterium
LSPMQ

SEQ ID NO: 1183070 - protein, 9 aa, Mycobacterium
LSPREVGQS

SEQ ID NO: 1183071 - protein, 7 aa, Mycobacterium
LSPTTTV

SEQ ID NO: 1183072 - protein, 5 aa, Mycobacterium
LSRAS

SEQ ID NO: 1183073 - protein, 10 aa, Mycobacterium
LSREGSDFGD

SEQ ID NO: 1183074 - protein, 13 aa, Mycobacterium
LSRPAEQCKILVT

SEQ ID NO: 1183075 - protein, 14 aa, Mycobacterium
LSRPGAGRQGQRLT

SEQ ID NO: 1183076 - protein, 9 aa, Mycobacterium
LSRPGGERR

SEQ ID NO: 1183077 - protein, 12 aa, Mycobacterium
LSRQAEQTTEAM

SEQ ID NO: 1183078 - protein, 7 aa, Mycobacterium
LSRRGRD

SEQ ID NO: 1183079 - protein, 7 aa, Mycobacterium
LSRSQRD

SEQ ID NO: 1183080 - protein, 9 aa, Mycobacterium
LSRTDPQAA

SEQ ID NO: 1183081 - protein, 6 aa, Mycobacterium
LSSGAT

SEQ ID NO: 1183082 - protein, 8 aa, Mycobacterium
LSTDEKRD

SEQ ID NO: 1183083 - protein, 14 aa, Mycobacterium
LSTQGAGPIAAASA

SEQ ID NO: 1183084 - protein, 9 aa, Mycobacterium
LSTSPEPMR

SEQ ID NO: 1183085 - protein, 4 aa, Mycobacterium
LSTT

SEQ ID NO: 1183086 - protein, 5 aa, Mycobacterium
LTAET

SEQ ID NO: 1183087 - protein, 10 aa, Mycobacterium
LTAGGGLCDP

SEQ ID NO: 1183088 - protein, 11 aa, Mycobacterium
LTAPASEDSGL

SEQ ID NO: 1183089 - protein, 11 aa, Mycobacterium
LTASGASFDTY

SEQ ID NO: 1183090 - protein, 7 aa, Mycobacterium
LTDAESA

SEQ ID NO: 1183091 - protein, 6 aa, Mycobacterium
LTDDGR

SEQ ID NO: 1183092 - protein, 11 aa, Mycobacterium
LTDDQGRKEGS

SEQ ID NO: 1183093 - protein, 14 aa, Mycobacterium
LTDPAHPFRSGDAA

SEQ ID NO: 1183094 - protein, 7 aa, Mycobacterium
LTDPENA

SEQ ID NO: 1183095 - protein, 8 aa, Mycobacterium
LTDSAGRA

SEQ ID NO: 1183096 - protein, 7 aa, Mycobacterium
LTDSGGV

SEQ ID NO: 1183097 - protein, 10 aa, Mycobacterium
LTDSGSENDF

SEQ ID NO: 1183098 - protein, 7 aa, Mycobacterium
LTDTSDD

SEQ ID NO: 1183099 - protein, 5 aa, Mycobacterium
LTEFG

SEQ ID NO: 1183100 - protein, 8 aa, Mycobacterium
LTENDPAR

SEQ ID NO: 1183101 - protein, 12 aa, Mycobacterium
LTEPSRAEVQAR

SEQ ID NO: 1183102 - protein, 5 aa, Mycobacterium
LTEPT

SEQ ID NO: 1183103 - protein, 5 aa, Mycobacterium
LTEQC

SEQ ID NO: 1183104 - protein, 14 aa, Mycobacterium
LTETGRDQATQTAA

SEQ ID NO: 1183105 - protein, 4 aa, Mycobacterium
LTGE

SEQ ID NO: 1183106 - protein, 9 aa, Mycobacterium
LTGGGGTDL

SEQ ID NO: 1183107 - protein, 5 aa, Mycobacterium
LTGRV

SEQ ID NO: 1183108 - protein, 5 aa, Mycobacterium
LTGSD

SEQ ID NO: 1183109 - protein, 19 aa, Mycobacterium
LTHSATTQAQAIDDGIPDP

SEQ ID NO: 1183110 - protein, 6 aa, Mycobacterium
LTNFGS

SEQ ID NO: 1183111 - protein, 5 aa, Mycobacterium
LTNKQ

SEQ ID NO: 1183112 - protein, 6 aa, Mycobacterium
LTPAQL

SEQ ID NO: 1183113 - protein, 6 aa, Mycobacterium
LTPAQW

SEQ ID NO: 1183114 - protein, 16 aa, Mycobacterium
LTPATGAVPSEQTRPQ

SEQ ID NO: 1183115 - protein, 6 aa, Mycobacterium
LTPGAS

SEQ ID NO: 1183116 - protein, 5 aa, Mycobacterium
LTPQD

SEQ ID NO: 1183117 - protein, 16 aa, Mycobacterium
LTPSGAPLGTTERVDA

SEQ ID NO: 1183118 - protein, 5 aa, Mycobacterium
LTPTA

SEQ ID NO: 1183119 - protein, 12 aa, Mycobacterium
LTQTHPDIPEQI

SEQ ID NO: 1183120 - protein, 8 aa, Mycobacterium
LTRPTARE

SEQ ID NO: 1183121 - protein, 10 aa, Mycobacterium
LTRTAQSRST

SEQ ID NO: 1183122 - protein, 6 aa, Mycobacterium
LTTGRA

SEQ ID NO: 1183123 - protein, 12 aa, Mycobacterium
LVPEEAAGDNAP

SEQ ID NO: 1183124 - protein, 7 aa, Mycobacterium
LVPGGPA

SEQ ID NO: 1183125 - protein, 6 aa, Mycobacterium
LVPPGS

SEQ ID NO: 1183126 - protein, 18 aa, Mycobacterium
LVPSGEDEEIQSSEAKVG

SEQ ID NO: 1183127 - protein, 7 aa, Mycobacterium
LYGPNDN

SEQ ID NO: 1183128 - protein, 4 aa, Mycobacterium
LYSP

SEQ ID NO: 1183129 - protein, 15 aa, Mycobacterium
MADPPPPPPLPPDSP

SEQ ID NO: 1183130 - protein, 6 aa, Mycobacterium
MAGDPT

SEQ ID NO: 1183131 - protein, 12 aa, Mycobacterium
MASRSRADVPGG

SEQ ID NO: 1183132 - protein, 17 aa, Mycobacterium
MASSAPQAATSAIQGPA

SEQ ID NO: 1183133 - protein, 7 aa, Mycobacterium
MASTPGL

SEQ ID NO: 1183134 - protein, 9 aa, Mycobacterium
MATDPNQRL

SEQ ID NO: 1183135 - protein, 5 aa, Mycobacterium
MDPAT

SEQ ID NO: 1183136 - protein, 10 aa, Mycobacterium
MDQESATAHR

SEQ ID NO: 1183137 - protein, 12 aa, Mycobacterium
MDTPPAPEDLPD

SEQ ID NO: 1183138 - protein, 13 aa, Mycobacterium
MESGGTEATELNG

SEQ ID NO: 1183139 - protein, 7 aa, Mycobacterium
METPPSP

SEQ ID NO: 1183140 - protein, 4 aa, Mycobacterium
MGAG

SEQ ID NO: 1183141 - protein, 8 aa, Mycobacterium
MGDAGLTG

SEQ ID NO: 1183142 - protein, 4 aa, Mycobacterium
MGGM

SEQ ID NO: 1183143 - protein, 6 aa, Mycobacterium
MGPGSS

SEQ ID NO: 1183144 - protein, 10 aa, Mycobacterium
MGPPATTPPP

SEQ ID NO: 1183145 - protein, 9 aa, Mycobacterium
MGRPGTVDE

SEQ ID NO: 1183146 - protein, 7 aa, Mycobacterium
MGSREKN

SEQ ID NO: 1183147 - protein, 6 aa, Mycobacterium
MKGSDH

SEQ ID NO: 1183148 - protein, 6 aa, Mycobacterium
MKRDTG

SEQ ID NO: 1183149 - protein, 9 aa, Mycobacterium
MKSAGGGSI

SEQ ID NO: 1183150 - protein, 6 aa, Mycobacterium
MNPAED

SEQ ID NO: 1183151 - protein, 5 aa, Mycobacterium
MNRED

SEQ ID NO: 1183152 - protein, 18 aa, Mycobacterium
MPADGNMGDMPGMAGGGH

SEQ ID NO: 1183153 - protein, 4 aa, Mycobacterium
MPAE

SEQ ID NO: 1183154 - protein, 6 aa, Mycobacterium
MPAEDT

SEQ ID NO: 1183155 - protein, 6 aa, Mycobacterium
MPDQVD

SEQ ID NO: 1183156 - protein, 4 aa, Mycobacterium
MPGM

SEQ ID NO: 1183157 - protein, 24 aa, Mycobacterium
MPGPNAPGGDMGPHHGGTSSGPMM

SEQ ID NO: 1183158 - protein, 5 aa, Mycobacterium
MPPDV

SEQ ID NO: 1183159 - protein, 8 aa, Mycobacterium
MPPPSSGG

SEQ ID NO: 1183160 - protein, 6 aa, Mycobacterium
MPPSGR

SEQ ID NO: 1183161 - protein, 12 aa, Mycobacterium
MPQPQQLPGPNA

SEQ ID NO: 1183162 - protein, 5 aa, Mycobacterium
MPREE

SEQ ID NO: 1183163 - protein, 8 aa, Mycobacterium
MPSAGSYS

SEQ ID NO: 1183164 - protein, 4 aa, Mycobacterium
MPSR

SEQ ID NO: 1183165 - protein, 5 aa, Mycobacterium
MPSRD

SEQ ID NO: 1183166 - protein, 18 aa, Mycobacterium
MPTTQADSINADLLEFIR

SEQ ID NO: 1183167 - protein, 11 aa, Mycobacterium
MQEQVSSSLRS

SEQ ID NO: 1183168 - protein, 4 aa, Mycobacterium
MQHG

SEQ ID NO: 1183169 - protein, 22 aa, Mycobacterium
MRDPSRTPEPVPPLPPKAGNND

SEQ ID NO: 1183170 - protein, 7 aa, Mycobacterium
MRGGGDT

SEQ ID NO: 1183171 - protein, 13 aa, Mycobacterium
MRGQTCPFCIPMM

SEQ ID NO: 1183172 - protein, 12 aa, Mycobacterium
MRKDATEDKNPI

SEQ ID NO: 1183173 - protein, 8 aa, Mycobacterium
MRPDQPTQ

SEQ ID NO: 1183174 - protein, 7 aa, Mycobacterium
MRPNTTL

SEQ ID NO: 1183175 - protein, 8 aa, Mycobacterium
MRPPSAAA

SEQ ID NO: 1183176 - protein, 5 aa, Mycobacterium
MSDAK

SEQ ID NO: 1183177 - protein, 24 aa, Mycobacterium
MSDDSSETRTGGRRGADAGLTERQ

SEQ ID NO: 1183178 - protein, 7 aa, Mycobacterium
MSDGDRV

SEQ ID NO: 1183179 - protein, 8 aa, Mycobacterium
MSDPQSVK

SEQ ID NO: 1183180 - protein, 15 aa, Mycobacterium
MSDRGLTPSPQSRDM

SEQ ID NO: 1183181 - protein, 7 aa, Mycobacterium
MSDSASE

SEQ ID NO: 1183182 - protein, 11 aa, Mycobacterium
MSEPSAGSDLA

SEQ ID NO: 1183183 - protein, 16 aa, Mycobacterium
MSGAGRRSKERDRAEL

SEQ ID NO: 1183184 - protein, 4 aa, Mycobacterium
MSPP

SEQ ID NO: 1183185 - protein, 10 aa, Mycobacterium
MSSGYGSASL

SEQ ID NO: 1183186 - protein, 7 aa, Mycobacterium
MTADPAA

SEQ ID NO: 1183187 - protein, 11 aa, Mycobacterium
MTAGDAARRVQ

SEQ ID NO: 1183188 - protein, 10 aa, Mycobacterium
MTESDGKRAS

SEQ ID NO: 1183189 - protein, 13 aa, Mycobacterium
MTGTSPSAFARAS

SEQ ID NO: 1183190 - protein, 14 aa, Mycobacterium
MTPGASVQEYDGPA

SEQ ID NO: 1183191 - protein, 5 aa, Mycobacterium
MTPPM

SEQ ID NO: 1183192 - protein, 12 aa, Mycobacterium
MTQNTAPATTDT

SEQ ID NO: 1183193 - protein, 12 aa, Mycobacterium
MTSGSNTSVRLG

SEQ ID NO: 1183194 - protein, 7 aa, Mycobacterium
MTTTEAS

SEQ ID NO: 1183195 - protein, 7 aa, Mycobacterium
MVGESKG

SEQ ID NO: 1183196 - protein, 8 aa, Mycobacterium
NAAASSIK

SEQ ID NO: 1183197 - protein, 7 aa, Mycobacterium
NAAATAV

SEQ ID NO: 1183198 - protein, 5 aa, Mycobacterium
NAAPA

SEQ ID NO: 1183199 - protein, 7 aa, Mycobacterium
NAAQAKR

SEQ ID NO: 1183200 - protein, 9 aa, Mycobacterium
NAATGRPVY

SEQ ID NO: 1183201 - protein, 10 aa, Mycobacterium
NADAASALRG

SEQ ID NO: 1183202 - protein, 8 aa, Mycobacterium
NADDGSYD

SEQ ID NO: 1183203 - protein, 4 aa, Mycobacterium
NADH

SEQ ID NO: 1183204 - protein, 13 aa, Mycobacterium
NADPNGGDVTVEF

SEQ ID NO: 1183205 - protein, 4 aa, Mycobacterium
NADR

SEQ ID NO: 1183206 - protein, 7 aa, Mycobacterium
NAEADVR

SEQ ID NO: 1183207 - protein, 17 aa, Mycobacterium
NAEQGLPHGSARPFGYE

SEQ ID NO: 1183208 - protein, 11 aa, Mycobacterium
NAGDGTHEHPT

SEQ ID NO: 1183209 - protein, 9 aa, Mycobacterium
NAGGGETKS

SEQ ID NO: 1183210 - protein, 5 aa, Mycobacterium
NAGGP

SEQ ID NO: 1183211 - protein, 10 aa, Mycobacterium
NAGRRNSYDA

SEQ ID NO: 1183212 - protein, 19 aa, Mycobacterium
NAGTASKGQSVGDTPGADF

SEQ ID NO: 1183213 - protein, 8 aa, Mycobacterium
NAKAAVEE

SEQ ID NO: 1183214 - protein, 6 aa, Mycobacterium
NANPEC

SEQ ID NO: 1183215 - protein, 7 aa, Mycobacterium
NANPTLT

SEQ ID NO: 1183216 - protein, 6 aa, Mycobacterium
NANTGQ

SEQ ID NO: 1183217 - protein, 9 aa, Mycobacterium
NAPGASTQR

SEQ ID NO: 1183218 - protein, 16 aa, Mycobacterium
NAPGSARLRGRDGDGE

SEQ ID NO: 1183219 - protein, 9 aa, Mycobacterium
NAPPSVKAH

SEQ ID NO: 1183220 - protein, 9 aa, Mycobacterium
NAPQRAAAA

SEQ ID NO: 1183221 - protein, 6 aa, Mycobacterium
NAQDLN

SEQ ID NO: 1183222 - protein, 6 aa, Mycobacterium
NAQGVD

SEQ ID NO: 1183223 - protein, 7 aa, Mycobacterium
NAQGVEA

SEQ ID NO: 1183224 - protein, 7 aa, Mycobacterium
NAQQPGI

SEQ ID NO: 1183225 - protein, 22 aa, Mycobacterium
NARDAAATAQRELEASQRGIED

SEQ ID NO: 1183226 - protein, 20 aa, Mycobacterium
NARHGMDNPNARYRKESSVE

SEQ ID NO: 1183227 - protein, 6 aa, Mycobacterium
NARNPR

SEQ ID NO: 1183228 - protein, 7 aa, Mycobacterium
NARSFSD

SEQ ID NO: 1183229 - protein, 8 aa, Mycobacterium
NATDSAVG

SEQ ID NO: 1183230 - protein, 5 aa, Mycobacterium
NATPQ

SEQ ID NO: 1183231 - protein, 7 aa, Mycobacterium
NAVEKPV

SEQ ID NO: 1183232 - protein, 6 aa, Mycobacterium
NAYATA

SEQ ID NO: 1183233 - protein, 5 aa, Mycobacterium
NDATP

SEQ ID NO: 1183234 - protein, 10 aa, Mycobacterium
NDGAARGEDP

SEQ ID NO: 1183235 - protein, 11 aa, Mycobacterium
NDGAPPDERVN

SEQ ID NO: 1183236 - protein, 8 aa, Mycobacterium
NDGETVGI

SEQ ID NO: 1183237 - protein, 6 aa, Mycobacterium
NDGGPF

SEQ ID NO: 1183238 - protein, 12 aa, Mycobacterium
NDKVTDMNAPPG

SEQ ID NO: 1183239 - protein, 7 aa, Mycobacterium
NDPDRRN

SEQ ID NO: 1183240 - protein, 4 aa, Mycobacterium
NDPL

SEQ ID NO: 1183241 - protein, 7 aa, Mycobacterium
NDPPEHQ

SEQ ID NO: 1183242 - protein, 5 aa, Mycobacterium
NDPSV

SEQ ID NO: 1183243 - protein, 6 aa, Mycobacterium
NDRRKR

SEQ ID NO: 1183244 - protein, 5 aa, Mycobacterium
NDSSP

SEQ ID NO: 1183245 - protein, 6 aa, Mycobacterium
NDTVGA

SEQ ID NO: 1183246 - protein, 17 aa, Mycobacterium
NDWSKQVKAAADASQFT

SEQ ID NO: 1183247 - protein, 8 aa, Mycobacterium
NEARRRDG

SEQ ID NO: 1183248 - protein, 27 aa, Mycobacterium
NEGASAAGEEPAEHEPQADTTQDTSVE

SEQ ID NO: 1183249 - protein, 6 aa, Mycobacterium
NEGLRS

SEQ ID NO: 1183250 - protein, 6 aa, Mycobacterium
NEGTTF

SEQ ID NO: 1183251 - protein, 7 aa, Mycobacterium
NEHPPQR

SEQ ID NO: 1183252 - protein, 5 aa, Mycobacterium
NEIGI

SEQ ID NO: 1183253 - protein, 21 aa, Mycobacterium
NEKHNEANGEDNRDGESHNRS

SEQ ID NO: 1183254 - protein, 5 aa, Mycobacterium
NEPAA

SEQ ID NO: 1183255 - protein, 6 aa, Mycobacterium
NEPAAV

SEQ ID NO: 1183256 - protein, 10 aa, Mycobacterium
NEPDERAELA

SEQ ID NO: 1183257 - protein, 8 aa, Mycobacterium
NEPPPRDS

SEQ ID NO: 1183258 - protein, 9 aa, Mycobacterium
NEPTEVGDA

SEQ ID NO: 1183259 - protein, 22 aa, Mycobacterium
NEQKFGNGEKDEKKDDAEALGN

SEQ ID NO: 1183260 - protein, 7 aa, Mycobacterium
NETGTRA

SEQ ID NO: 1183261 - protein, 4 aa, Mycobacterium
NETI

SEQ ID NO: 1183262 - protein, 5 aa, Mycobacterium
NETTR

SEQ ID NO: 1183263 - protein, 5 aa, Mycobacterium
NFPGG

SEQ ID NO: 1183264 - protein, 12 aa, Mycobacterium
NFRNGERNPNAF

SEQ ID NO: 1183265 - protein, 7 aa, Mycobacterium
NGAEAAT

SEQ ID NO: 1183266 - protein, 5 aa, Mycobacterium
NGAFG

SEQ ID NO: 1183267 - protein, 11 aa, Mycobacterium
NGAGDPAGLTD

SEQ ID NO: 1183268 - protein, 8 aa, Mycobacterium
NGAGKTTT

SEQ ID NO: 1183269 - protein, 9 aa, Mycobacterium
NGARNQTDV

SEQ ID NO: 1183270 - protein, 10 aa, Mycobacterium
NGDDPAAVTD

SEQ ID NO: 1183271 - protein, 13 aa, Mycobacterium
NGDGTVLEGEPGE

SEQ ID NO: 1183272 - protein, 9 aa, Mycobacterium
NGEPGPGRR

SEQ ID NO: 1183273 - protein, 12 aa, Mycobacterium
NGFAPTADRREP

SEQ ID NO: 1183274 - protein, 4 aa, Mycobacterium
NGFL

SEQ ID NO: 1183275 - protein, 6 aa, Mycobacterium
NGGAVT

SEQ ID NO: 1183276 - protein, 7 aa, Mycobacterium
NGGGGAK

SEQ ID NO: 1183277 - protein, 7 aa, Mycobacterium
NGGTAAD

SEQ ID NO: 1183278 - protein, 7 aa, Mycobacterium
NGGTTDL

SEQ ID NO: 1183279 - protein, 5 aa, Mycobacterium
NGGWT

SEQ ID NO: 1183280 - protein, 9 aa, Mycobacterium
NGHAPGDGQ

SEQ ID NO: 1183281 - protein, 12 aa, Mycobacterium
NGIARQDGGRSW

SEQ ID NO: 1183282 - protein, 6 aa, Mycobacterium
NGIPPR

SEQ ID NO: 1183283 - protein, 8 aa, Mycobacterium
NGKGGQPV

SEQ ID NO: 1183284 - protein, 15 aa, Mycobacterium
NGLRGTPNSAHYTTS

SEQ ID NO: 1183285 - protein, 9 aa, Mycobacterium
NGPGDPAAA

SEQ ID NO: 1183286 - protein, 18 aa, Mycobacterium
NGQDGSAGSGQGAGSGQG

SEQ ID NO: 1183287 - protein, 4 aa, Mycobacterium
NGQT

SEQ ID NO: 1183288 - protein, 4 aa, Mycobacterium
NGQY

SEQ ID NO: 1183289 - protein, 10 aa, Mycobacterium
NGRGRLSDAG

SEQ ID NO: 1183290 - protein, 7 aa, Mycobacterium
NGRPEGR

SEQ ID NO: 1183291 - protein, 11 aa, Mycobacterium
NGSEAKVGSTY

SEQ ID NO: 1183292 - protein, 8 aa, Mycobacterium
NGSLSDTA

SEQ ID NO: 1183293 - protein, 8 aa, Mycobacterium
NGSQIPRE

SEQ ID NO: 1183294 - protein, 9 aa, Mycobacterium
NGTGKTGYS

SEQ ID NO: 1183295 - protein, 7 aa, Mycobacterium
NGTGKTS

SEQ ID NO: 1183296 - protein, 9 aa, Mycobacterium
NGTKASAAS

SEQ ID NO: 1183297 - protein, 5 aa, Mycobacterium
NGTKR

SEQ ID NO: 1183298 - protein, 10 aa, Mycobacterium
NGTVPEADRP

SEQ ID NO: 1183299 - protein, 7 aa, Mycobacterium
NGVGGTS

SEQ ID NO: 1183300 - protein, 10 aa, Mycobacterium
NGVQVPANDE

SEQ ID NO: 1183301 - protein, 11 aa, Mycobacterium
NGVSQSASRLG

SEQ ID NO: 1183302 - protein, 6 aa, Mycobacterium
NGVTRE

SEQ ID NO: 1183303 - protein, 5 aa, Mycobacterium
NGVTT

SEQ ID NO: 1183304 - protein, 4 aa, Mycobacterium
NHEP

SEQ ID NO: 1183305 - protein, 6 aa, Mycobacterium
NHGDDS

SEQ ID NO: 1183306 - protein, 7 aa, Mycobacterium
NHNPTGL

SEQ ID NO: 1183307 - protein, 8 aa, Mycobacterium
NHRQPRRV

SEQ ID NO: 1183308 - protein, 7 aa, Mycobacterium
NHRSEPA

SEQ ID NO: 1183309 - protein, 15 aa, Mycobacterium
NHSGPAAPPAPRRKP

SEQ ID NO: 1183310 - protein, 12 aa, Mycobacterium
NKAEVEIPSPYA

SEQ ID NO: 1183311 - protein, 9 aa, Mycobacterium
NKGRYGSPA

SEQ ID NO: 1183312 - protein, 6 aa, Mycobacterium
NKHPGV

SEQ ID NO: 1183313 - protein, 11 aa, Mycobacterium
NLDPSRNGGTW

SEQ ID NO: 1183314 - protein, 11 aa, Mycobacterium
NLGRASEEGSG

SEQ ID NO: 1183315 - protein, 10 aa, Mycobacterium
NLGSAGRRGL

SEQ ID NO: 1183316 - protein, 12 aa, Mycobacterium
NLRGDEAFPRAA

SEQ ID NO: 1183317 - protein, 14 aa, Mycobacterium
NLTEISSAKCIISQ

SEQ ID NO: 1183318 - protein, 5 aa, Mycobacterium
NLTPR

SEQ ID NO: 1183319 - protein, 12 aa, Mycobacterium
NMPSATAQRPGD

SEQ ID NO: 1183320 - protein, 6 aa, Mycobacterium
NNAAER

SEQ ID NO: 1183321 - protein, 6 aa, Mycobacterium
NNNSRA

SEQ ID NO: 1183322 - protein, 6 aa, Mycobacterium
NNRRGV

SEQ ID NO: 1183323 - protein, 7 aa, Mycobacterium
NNSQEAI

SEQ ID NO: 1183324 - protein, 6 aa, Mycobacterium
NNTVGG

SEQ ID NO: 1183325 - protein, 42 aa, Mycobacterium
NNVPPPPALPGPPPPPGPGQQLSPAQTGPLPGNPPFLPPGSQ

SEQ ID NO: 1183326 - protein, 6 aa, Mycobacterium
NPADLD

SEQ ID NO: 1183327 - protein, 42 aa, Mycobacterium
NPAIGEGSTPAADATAEPEPAAAPATAAPKSLPSDTADGAAP

SEQ ID NO: 1183328 - protein, 14 aa, Mycobacterium
NPDCPGNRDTQPTK

SEQ ID NO: 1183329 - protein, 8 aa, Mycobacterium
NPDGSRDA

SEQ ID NO: 1183330 - protein, 10 aa, Mycobacterium
NPDRRHGTER

SEQ ID NO: 1183331 - protein, 8 aa, Mycobacterium
NPDVPPPF

SEQ ID NO: 1183332 - protein, 11 aa, Mycobacterium
NPDWADNPKTY

SEQ ID NO: 1183333 - protein, 107 aa, Mycobacterium
NPEPTTDSSASENGQQTRTAAPKAPPEPAPAPAPKTPDSKTPDSKSQAPKQDSKPQESKPQAKAKPAESKSSTKPADAKSEKSGKSGTNGAAKPAAQPADDSDQNQV

SEQ ID NO: 1183334 - protein, 7 aa, Mycobacterium
NPETRTV

SEQ ID NO: 1183335 - protein, 6 aa, Mycobacterium
NPFPPL

SEQ ID NO: 1183336 - protein, 4 aa, Mycobacterium
NPGA

SEQ ID NO: 1183337 - protein, 14 aa, Mycobacterium
NPGATQSLAGMPRG

SEQ ID NO: 1183338 - protein, 8 aa, Mycobacterium
NPGGEPGA

SEQ ID NO: 1183339 - protein, 5 aa, Mycobacterium
NPGGL

SEQ ID NO: 1183340 - protein, 9 aa, Mycobacterium
NPGGNNHRA

SEQ ID NO: 1183341 - protein, 18 aa, Mycobacterium
NPIADGVDDRTAAASGVA

SEQ ID NO: 1183342 - protein, 8 aa, Mycobacterium
NPKDVGRF

SEQ ID NO: 1183343 - protein, 7 aa, Mycobacterium
NPLDTTG

SEQ ID NO: 1183344 - protein, 5 aa, Mycobacterium
NPMEP

SEQ ID NO: 1183345 - protein, 15 aa, Mycobacterium
NPPRPYTPTDIPRDP

SEQ ID NO: 1183346 - protein, 6 aa, Mycobacterium
NPRPGI

SEQ ID NO: 1183347 - protein, 7 aa, Mycobacterium
NPSEELR

SEQ ID NO: 1183348 - protein, 11 aa, Mycobacterium
NPSGTGTTNGR

SEQ ID NO: 1183349 - protein, 8 aa, Mycobacterium
NPTRRGAA

SEQ ID NO: 1183350 - protein, 7 aa, Mycobacterium
NPTRRGE

SEQ ID NO: 1183351 - protein, 7 aa, Mycobacterium
NPVAEKS

SEQ ID NO: 1183352 - protein, 8 aa, Mycobacterium
NPVSADAA

SEQ ID NO: 1183353 - protein, 23 aa, Mycobacterium
NQGASSTHQGDGDDGSDEQVPAT

SEQ ID NO: 1183354 - protein, 13 aa, Mycobacterium
NQGGAAAAAGLPS

SEQ ID NO: 1183355 - protein, 8 aa, Mycobacterium
NQGSPRSK

SEQ ID NO: 1183356 - protein, 11 aa, Mycobacterium
NQKGSAGTPLE

SEQ ID NO: 1183357 - protein, 9 aa, Mycobacterium
NQKWRPANL

SEQ ID NO: 1183358 - protein, 7 aa, Mycobacterium
NQQARRQ

SEQ ID NO: 1183359 - protein, 15 aa, Mycobacterium
NQTLEAAKSGLPEGI

SEQ ID NO: 1183360 - protein, 7 aa, Mycobacterium
NRAGAAH

SEQ ID NO: 1183361 - protein, 12 aa, Mycobacterium
NRATADGSRERL

SEQ ID NO: 1183362 - protein, 11 aa, Mycobacterium
NRDPSHFDEPG

SEQ ID NO: 1183363 - protein, 8 aa, Mycobacterium
NREPSDTR

SEQ ID NO: 1183364 - protein, 16 aa, Mycobacterium
NRETGFRPRPVRKSEA

SEQ ID NO: 1183365 - protein, 6 aa, Mycobacterium
NREVDG

SEQ ID NO: 1183366 - protein, 5 aa, Mycobacterium
NRGEE

SEQ ID NO: 1183367 - protein, 11 aa, Mycobacterium
NRGIRPESKFD

SEQ ID NO: 1183368 - protein, 14 aa, Mycobacterium
NRGPEQRTDKVPQL

SEQ ID NO: 1183369 - protein, 11 aa, Mycobacterium
NRGSGKSVTAQ

SEQ ID NO: 1183370 - protein, 9 aa, Mycobacterium
NRGWSASES

SEQ ID NO: 1183371 - protein, 19 aa, Mycobacterium
NRHGRDRGRDRDQQYGLDI

SEQ ID NO: 1183372 - protein, 7 aa, Mycobacterium
NRLPDGT

SEQ ID NO: 1183373 - protein, 6 aa, Mycobacterium
NRLPEA

SEQ ID NO: 1183374 - protein, 11 aa, Mycobacterium
NRLPSPGSRRN

SEQ ID NO: 1183375 - protein, 10 aa, Mycobacterium
NRNGSRSWST

SEQ ID NO: 1183376 - protein, 5 aa, Mycobacterium
NRPDH

SEQ ID NO: 1183377 - protein, 4 aa, Mycobacterium
NRPR

SEQ ID NO: 1183378 - protein, 10 aa, Mycobacterium
NRPTVSEEAV

SEQ ID NO: 1183379 - protein, 13 aa, Mycobacterium
NRRPGPQTGQSGF

SEQ ID NO: 1183380 - protein, 7 aa, Mycobacterium
NRRPPTG

SEQ ID NO: 1183381 - protein, 7 aa, Mycobacterium
NRRREPG

SEQ ID NO: 1183382 - protein, 8 aa, Mycobacterium
NRSKRSVT

SEQ ID NO: 1183383 - protein, 7 aa, Mycobacterium
NRTPAAL

SEQ ID NO: 1183384 - protein, 5 aa, Mycobacterium
NSDIV

SEQ ID NO: 1183385 - protein, 10 aa, Mycobacterium
NSEQDGGAAQ

SEQ ID NO: 1183386 - protein, 15 aa, Mycobacterium
NSETGRTWGKTEPGW

SEQ ID NO: 1183387 - protein, 7 aa, Mycobacterium
NSGGHSR

SEQ ID NO: 1183388 - protein, 11 aa, Mycobacterium
NSGGTKLSKGD

SEQ ID NO: 1183389 - protein, 5 aa, Mycobacterium
NSGRL

SEQ ID NO: 1183390 - protein, 10 aa, Mycobacterium
NSPDKVAPAT

SEQ ID NO: 1183391 - protein, 5 aa, Mycobacterium
NSPPR

SEQ ID NO: 1183392 - protein, 12 aa, Mycobacterium
NSPYGAAARRAR

SEQ ID NO: 1183393 - protein, 5 aa, Mycobacterium
NSQGT

SEQ ID NO: 1183394 - protein, 4 aa, Mycobacterium
NSRC

SEQ ID NO: 1183395 - protein, 27 aa, Mycobacterium
NSSISRRSAIRPPKETDPYRRRERPTV

SEQ ID NO: 1183396 - protein, 7 aa, Mycobacterium
NSTQNCR

SEQ ID NO: 1183397 - protein, 5 aa, Mycobacterium
NSYMT

SEQ ID NO: 1183398 - protein, 9 aa, Mycobacterium
NTAALNTAT

SEQ ID NO: 1183399 - protein, 10 aa, Mycobacterium
NTAAQKVRSG

SEQ ID NO: 1183400 - protein, 7 aa, Mycobacterium
NTAGGTR

SEQ ID NO: 1183401 - protein, 4 aa, Mycobacterium
NTDE

SEQ ID NO: 1183402 - protein, 8 aa, Mycobacterium
NTDPSREK

SEQ ID NO: 1183403 - protein, 4 aa, Mycobacterium
NTGG

SEQ ID NO: 1183404 - protein, 5 aa, Mycobacterium
NTGGE

SEQ ID NO: 1183405 - protein, 7 aa, Mycobacterium
NTGNAMS

SEQ ID NO: 1183406 - protein, 9 aa, Mycobacterium
NTGPDDAEA

SEQ ID NO: 1183407 - protein, 19 aa, Mycobacterium
NTGRRTSHMPNRPFPDGTG

SEQ ID NO: 1183408 - protein, 8 aa, Mycobacterium
NTKANGEW

SEQ ID NO: 1183409 - protein, 8 aa, Mycobacterium
NTLPSLRE

SEQ ID NO: 1183410 - protein, 8 aa, Mycobacterium
NTPGGNGD

SEQ ID NO: 1183411 - protein, 6 aa, Mycobacterium
NTPPSH

SEQ ID NO: 1183412 - protein, 8 aa, Mycobacterium
NTQGVVNS

SEQ ID NO: 1183413 - protein, 5 aa, Mycobacterium
NTQRR

SEQ ID NO: 1183414 - protein, 6 aa, Mycobacterium
NTQTGD

SEQ ID NO: 1183415 - protein, 9 aa, Mycobacterium
NTSHRRASA

SEQ ID NO: 1183416 - protein, 28 aa, Mycobacterium
NTTISRAGLKTPGVEELGPGGVSGAPVA

SEQ ID NO: 1183417 - protein, 8 aa, Mycobacterium
NVAPTTTI

SEQ ID NO: 1183418 - protein, 6 aa, Mycobacterium
NVETSD

SEQ ID NO: 1183419 - protein, 10 aa, Mycobacterium
NVGRTDKPVS

SEQ ID NO: 1183420 - protein, 8 aa, Mycobacterium
NVQGDERD

SEQ ID NO: 1183421 - protein, 5 aa, Mycobacterium
NVRTR

SEQ ID NO: 1183422 - protein, 4 aa, Mycobacterium
NVSG

SEQ ID NO: 1183423 - protein, 5 aa, Mycobacterium
NVTPE

SEQ ID NO: 1183424 - protein, 7 aa, Mycobacterium
NWSDTDN

SEQ ID NO: 1183425 - protein, 4 aa, Mycobacterium
NYDE

SEQ ID NO: 1183426 - protein, 12 aa, Mycobacterium
NYGTGSASGSAC

SEQ ID NO: 1183427 - protein, 9 aa, Mycobacterium
PAAADSAKL

SEQ ID NO: 1183428 - protein, 24 aa, Mycobacterium
PAAAPPGQAGEDLANEPEVGTGYR

SEQ ID NO: 1183429 - protein, 8 aa, Mycobacterium
PAAAQHDL

SEQ ID NO: 1183430 - protein, 5 aa, Mycobacterium
PAAAT

SEQ ID NO: 1183431 - protein, 5 aa, Mycobacterium
PAAAV

SEQ ID NO: 1183432 - protein, 9 aa, Mycobacterium
PAADPDRYA

SEQ ID NO: 1183433 - protein, 12 aa, Mycobacterium
PAAEAHRRHGRG

SEQ ID NO: 1183434 - protein, 8 aa, Mycobacterium
PAAEKSNL

SEQ ID NO: 1183435 - protein, 7 aa, Mycobacterium
PAAELTD

SEQ ID NO: 1183436 - protein, 4 aa, Mycobacterium
PAAG

SEQ ID NO: 1183437 - protein, 7 aa, Mycobacterium
PAAGPEF

SEQ ID NO: 1183438 - protein, 8 aa, Mycobacterium
PAAPELSA

SEQ ID NO: 1183439 - protein, 7 aa, Mycobacterium
PAAPPGF

SEQ ID NO: 1183440 - protein, 19 aa, Mycobacterium
PAAPSALTGTGVSSGGGAP

SEQ ID NO: 1183441 - protein, 4 aa, Mycobacterium
PAAR

SEQ ID NO: 1183442 - protein, 5 aa, Mycobacterium
PAATP

SEQ ID NO: 1183443 - protein, 10 aa, Mycobacterium
PAAVGPGVIP

SEQ ID NO: 1183444 - protein, 47 aa, Mycobacterium
PADANGISDAEPADECDETVPAEPDSPTQSADSAGEPGGPAPPEGRA

SEQ ID NO: 1183445 - protein, 10 aa, Mycobacterium
PADDADHAAR

SEQ ID NO: 1183446 - protein, 8 aa, Mycobacterium
PADDPMTP

SEQ ID NO: 1183447 - protein, 7 aa, Mycobacterium
PADDSDR

SEQ ID NO: 1183448 - protein, 7 aa, Mycobacterium
PADEIDA

SEQ ID NO: 1183449 - protein, 7 aa, Mycobacterium
PADELPS

SEQ ID NO: 1183450 - protein, 5 aa, Mycobacterium
PADER

SEQ ID NO: 1183451 - protein, 14 aa, Mycobacterium
PADFSGGCAQRSCE

SEQ ID NO: 1183452 - protein, 6 aa, Mycobacterium
PADGTA

SEQ ID NO: 1183453 - protein, 18 aa, Mycobacterium
PADGTYPSGTAAYEKRNI

SEQ ID NO: 1183454 - protein, 5 aa, Mycobacterium
PADLP

SEQ ID NO: 1183455 - protein, 13 aa, Mycobacterium
PADLQGSASYRRR

SEQ ID NO: 1183456 - protein, 4 aa, Mycobacterium
PADQ

SEQ ID NO: 1183457 - protein, 7 aa, Mycobacterium
PADRTEI

SEQ ID NO: 1183458 - protein, 10 aa, Mycobacterium
PADSANDPAV

SEQ ID NO: 1183459 - protein, 10 aa, Mycobacterium
PADSDPDAGF

SEQ ID NO: 1183460 - protein, 49 aa, Mycobacterium
PADTPAYRKGGAAVDNSGERRSDADIRTATAAPAVGERSDDAGRDGGRT

SEQ ID NO: 1183461 - protein, 4 aa, Mycobacterium
PAEA

SEQ ID NO: 1183462 - protein, 9 aa, Mycobacterium
PAEDQPDHT

SEQ ID NO: 1183463 - protein, 7 aa, Mycobacterium
PAEPEHK

SEQ ID NO: 1183464 - protein, 10 aa, Mycobacterium
PAERRQPALA

SEQ ID NO: 1183465 - protein, 7 aa, Mycobacterium
PAESAGD

SEQ ID NO: 1183466 - protein, 4 aa, Mycobacterium
PAEV

SEQ ID NO: 1183467 - protein, 7 aa, Mycobacterium
PAFGTEE

SEQ ID NO: 1183468 - protein, 4 aa, Mycobacterium
PAFT

SEQ ID NO: 1183469 - protein, 11 aa, Mycobacterium
PAGAKPPAAAR

SEQ ID NO: 1183470 - protein, 16 aa, Mycobacterium
PAGDEDTGGGAGPFPA

SEQ ID NO: 1183471 - protein, 5 aa, Mycobacterium
PAGGE

SEQ ID NO: 1183472 - protein, 4 aa, Mycobacterium
PAGL

SEQ ID NO: 1183473 - protein, 8 aa, Mycobacterium
PAGPAARE

SEQ ID NO: 1183474 - protein, 7 aa, Mycobacterium
PAGPTCA

SEQ ID NO: 1183475 - protein, 7 aa, Mycobacterium
PAGPVET

SEQ ID NO: 1183476 - protein, 8 aa, Mycobacterium
PAGSALNK

SEQ ID NO: 1183477 - protein, 12 aa, Mycobacterium
PAGSGGADGGLG

SEQ ID NO: 1183478 - protein, 4 aa, Mycobacterium
PAGT

SEQ ID NO: 1183479 - protein, 12 aa, Mycobacterium
PAGTGKSSVSRG

SEQ ID NO: 1183480 - protein, 15 aa, Mycobacterium
PAHDGPRGSASDRDV

SEQ ID NO: 1183481 - protein, 13 aa, Mycobacterium
PAHDKGSSHGGSR

SEQ ID NO: 1183482 - protein, 9 aa, Mycobacterium
PAHQGSDPR

SEQ ID NO: 1183483 - protein, 5 aa, Mycobacterium
PAHTG

SEQ ID NO: 1183484 - protein, 10 aa, Mycobacterium
PAIAPPGDAI

SEQ ID NO: 1183485 - protein, 23 aa, Mycobacterium
PAIRPKTAAEEQQAVTDYQPDGD

SEQ ID NO: 1183486 - protein, 10 aa, Mycobacterium
PAKSLDDPNV

SEQ ID NO: 1183487 - protein, 4 aa, Mycobacterium
PAKT

SEQ ID NO: 1183488 - protein, 10 aa, Mycobacterium
PAKTEPGGKV

SEQ ID NO: 1183489 - protein, 5 aa, Mycobacterium
PALAA

SEQ ID NO: 1183490 - protein, 4 aa, Mycobacterium
PALD

SEQ ID NO: 1183491 - protein, 7 aa, Mycobacterium
PALPEGL

SEQ ID NO: 1183492 - protein, 5 aa, Mycobacterium
PALRD

SEQ ID NO: 1183493 - protein, 13 aa, Mycobacterium
PANPNHPSDLGKG

SEQ ID NO: 1183494 - protein, 23 aa, Mycobacterium
PAPAEGAGPIPDLGQRQPAGRRE

SEQ ID NO: 1183495 - protein, 9 aa, Mycobacterium
PAPDAWTDG

SEQ ID NO: 1183496 - protein, 12 aa, Mycobacterium
PAPDDNDHPPDV

SEQ ID NO: 1183497 - protein, 4 aa, Mycobacterium
PAPE

SEQ ID NO: 1183498 - protein, 6 aa, Mycobacterium
PAPGQH

SEQ ID NO: 1183499 - protein, 5 aa, Mycobacterium
PAPGT

SEQ ID NO: 1183500 - protein, 22 aa, Mycobacterium
PAPLPSQPTSPAAESPAGGADV

SEQ ID NO: 1183501 - protein, 5 aa, Mycobacterium
PAPLS

SEQ ID NO: 1183502 - protein, 19 aa, Mycobacterium
PAPPAPGSDPFADAAPGDR

SEQ ID NO: 1183503 - protein, 17 aa, Mycobacterium
PAPSAWPAERDRRELTG

SEQ ID NO: 1183504 - protein, 9 aa, Mycobacterium
PAQAGSITG

SEQ ID NO: 1183505 - protein, 11 aa, Mycobacterium
PAQATAEDPAD

SEQ ID NO: 1183506 - protein, 10 aa, Mycobacterium
PAQDPDDLRR

SEQ ID NO: 1183507 - protein, 4 aa, Mycobacterium
PAQL

SEQ ID NO: 1183508 - protein, 22 aa, Mycobacterium
PAQNTTLATPDVAAPRPLDGPP

SEQ ID NO: 1183509 - protein, 14 aa, Mycobacterium
PAQPGAAEIDNRDT

SEQ ID NO: 1183510 - protein, 8 aa, Mycobacterium
PAQRGNRN

SEQ ID NO: 1183511 - protein, 5 aa, Mycobacterium
PAQRH

SEQ ID NO: 1183512 - protein, 6 aa, Mycobacterium
PARAEA

SEQ ID NO: 1183513 - protein, 6 aa, Mycobacterium
PARAPY

SEQ ID NO: 1183514 - protein, 16 aa, Mycobacterium
PARGRRHADARAPRYH

SEQ ID NO: 1183515 - protein, 4 aa, Mycobacterium
PARI

SEQ ID NO: 1183516 - protein, 7 aa, Mycobacterium
PARIPEA

SEQ ID NO: 1183517 - protein, 10 aa, Mycobacterium
PARLTAATGD

SEQ ID NO: 1183518 - protein, 4 aa, Mycobacterium
PARP

SEQ ID NO: 1183519 - protein, 26 aa, Mycobacterium
PARPGGSEEEITPAGRHRGDDPVGEP

SEQ ID NO: 1183520 - protein, 8 aa, Mycobacterium
PARPSGGV

SEQ ID NO: 1183521 - protein, 14 aa, Mycobacterium
PARQPQQRPEDMGR

SEQ ID NO: 1183522 - protein, 5 aa, Mycobacterium
PARTA

SEQ ID NO: 1183523 - protein, 19 aa, Mycobacterium
PARTADGDAEGSHRPGRKA

SEQ ID NO: 1183524 - protein, 32 aa, Mycobacterium
PASAQSDNSDNATSAQPAAAGGNKLDVNPADL

SEQ ID NO: 1183525 - protein, 17 aa, Mycobacterium
PASDAIEAPKPAAETDV

SEQ ID NO: 1183526 - protein, 15 aa, Mycobacterium
PASDASTSASSRGWP

SEQ ID NO: 1183527 - protein, 7 aa, Mycobacterium
PASEAVN

SEQ ID NO: 1183528 - protein, 12 aa, Mycobacterium
PASGAFTSPDFP

SEQ ID NO: 1183529 - protein, 9 aa, Mycobacterium
PASGRDSNH

SEQ ID NO: 1183530 - protein, 20 aa, Mycobacterium
PASGRLTGADSGAGRLPEAE

SEQ ID NO: 1183531 - protein, 16 aa, Mycobacterium
PASGRNAEAAGGEVTD

SEQ ID NO: 1183532 - protein, 15 aa, Mycobacterium
PASKRPLAAAPPRIT

SEQ ID NO: 1183533 - protein, 8 aa, Mycobacterium
PASKTRTW

SEQ ID NO: 1183534 - protein, 23 aa, Mycobacterium
PASLEPYADTAAKTAGSPAELAA

SEQ ID NO: 1183535 - protein, 8 aa, Mycobacterium
PASPPREV

SEQ ID NO: 1183536 - protein, 8 aa, Mycobacterium
PATARRPV

SEQ ID NO: 1183537 - protein, 6 aa, Mycobacterium
PATDRD

SEQ ID NO: 1183538 - protein, 4 aa, Mycobacterium
PATE

SEQ ID NO: 1183539 - protein, 5 aa, Mycobacterium
PATEQ

SEQ ID NO: 1183540 - protein, 6 aa, Mycobacterium
PATLPK

SEQ ID NO: 1183541 - protein, 9 aa, Mycobacterium
PATPQSDRY

SEQ ID NO: 1183542 - protein, 6 aa, Mycobacterium
PATQDL

SEQ ID NO: 1183543 - protein, 7 aa, Mycobacterium
PATRRDE

SEQ ID NO: 1183544 - protein, 5 aa, Mycobacterium
PATVD

SEQ ID NO: 1183545 - protein, 5 aa, Mycobacterium
PAVAG

SEQ ID NO: 1183546 - protein, 7 aa, Mycobacterium
PAVETSH

SEQ ID NO: 1183547 - protein, 10 aa, Mycobacterium
PCATNDVGDI

SEQ ID NO: 1183548 - protein, 5 aa, Mycobacterium
PCEHP

SEQ ID NO: 1183549 - protein, 8 aa, Mycobacterium
PDAARSLG

SEQ ID NO: 1183550 - protein, 10 aa, Mycobacterium
PDAATAQAAR

SEQ ID NO: 1183551 - protein, 19 aa, Mycobacterium
PDAESPAAETAPAAEVPAA

SEQ ID NO: 1183552 - protein, 8 aa, Mycobacterium
PDAGEPPE

SEQ ID NO: 1183553 - protein, 7 aa, Mycobacterium
PDAGPVA

SEQ ID NO: 1183554 - protein, 12 aa, Mycobacterium
PDAIAAEPHPAA

SEQ ID NO: 1183555 - protein, 10 aa, Mycobacterium
PDAPEGQQGN

SEQ ID NO: 1183556 - protein, 7 aa, Mycobacterium
PDAPVTA

SEQ ID NO: 1183557 - protein, 9 aa, Mycobacterium
PDARGTTHT

SEQ ID NO: 1183558 - protein, 7 aa, Mycobacterium
PDASLTE

SEQ ID NO: 1183559 - protein, 11 aa, Mycobacterium
PDDASLPEARR

SEQ ID NO: 1183560 - protein, 4 aa, Mycobacterium
PDDF

SEQ ID NO: 1183561 - protein, 8 aa, Mycobacterium
PDDGEPDW

SEQ ID NO: 1183562 - protein, 10 aa, Mycobacterium
PDDPAEQQEL

SEQ ID NO: 1183563 - protein, 12 aa, Mycobacterium
PDDTDAPGESEM

SEQ ID NO: 1183564 - protein, 5 aa, Mycobacterium
PDEAR

SEQ ID NO: 1183565 - protein, 13 aa, Mycobacterium
PDEGWARHAAPPF

SEQ ID NO: 1183566 - protein, 19 aa, Mycobacterium
PDELDEAVTSASREAAAAF

SEQ ID NO: 1183567 - protein, 10 aa, Mycobacterium
PDEQIPDGNT

SEQ ID NO: 1183568 - protein, 6 aa, Mycobacterium
PDFGSD

SEQ ID NO: 1183569 - protein, 4 aa, Mycobacterium
PDFS

SEQ ID NO: 1183570 - protein, 14 aa, Mycobacterium
PDGALRDAGLPNVT

SEQ ID NO: 1183571 - protein, 15 aa, Mycobacterium
PDGDDGHRGVSATRK

SEQ ID NO: 1183572 - protein, 7 aa, Mycobacterium
PDGESIG

SEQ ID NO: 1183573 - protein, 4 aa, Mycobacterium
PDGF

SEQ ID NO: 1183574 - protein, 21 aa, Mycobacterium
PDGGLPHDRRKAQRQEQLTRR

SEQ ID NO: 1183575 - protein, 5 aa, Mycobacterium
PDGGV

SEQ ID NO: 1183576 - protein, 4 aa, Mycobacterium
PDGL

SEQ ID NO: 1183577 - protein, 8 aa, Mycobacterium
PDGPQSPL

SEQ ID NO: 1183578 - protein, 9 aa, Mycobacterium
PDGQGGYRL

SEQ ID NO: 1183579 - protein, 14 aa, Mycobacterium
PDGQKAPGKTVPDP

SEQ ID NO: 1183580 - protein, 5 aa, Mycobacterium
PDGQP

SEQ ID NO: 1183581 - protein, 7 aa, Mycobacterium
PDGQPGQ

SEQ ID NO: 1183582 - protein, 8 aa, Mycobacterium
PDGRSYRA

SEQ ID NO: 1183583 - protein, 15 aa, Mycobacterium
PDGSIAGAIAYRHLS

SEQ ID NO: 1183584 - protein, 7 aa, Mycobacterium
PDGSMGQ

SEQ ID NO: 1183585 - protein, 6 aa, Mycobacterium
PDHAGD

SEQ ID NO: 1183586 - protein, 6 aa, Mycobacterium
PDHGGC

SEQ ID NO: 1183587 - protein, 7 aa, Mycobacterium
PDKASVA

SEQ ID NO: 1183588 - protein, 15 aa, Mycobacterium
PDKFTASPMAPGRRR

SEQ ID NO: 1183589 - protein, 6 aa, Mycobacterium
PDKNPH

SEQ ID NO: 1183590 - protein, 14 aa, Mycobacterium
PDLPDDPEPPAPIA

SEQ ID NO: 1183591 - protein, 22 aa, Mycobacterium
PDNHRDVAKPEDLPANLQPGST

SEQ ID NO: 1183592 - protein, 5 aa, Mycobacterium
PDNPD

SEQ ID NO: 1183593 - protein, 5 aa, Mycobacterium
PDNPE

SEQ ID NO: 1183594 - protein, 5 aa, Mycobacterium
PDNPQ

SEQ ID NO: 1183595 - protein, 8 aa, Mycobacterium
PDNPRSAE

SEQ ID NO: 1183596 - protein, 5 aa, Mycobacterium
PDNRD

SEQ ID NO: 1183597 - protein, 4 aa, Mycobacterium
PDPA

SEQ ID NO: 1183598 - protein, 5 aa, Mycobacterium
PDPAI

SEQ ID NO: 1183599 - protein, 9 aa, Mycobacterium
PDPATASVE

SEQ ID NO: 1183600 - protein, 11 aa, Mycobacterium
PDPDAATSFEE

SEQ ID NO: 1183601 - protein, 9 aa, Mycobacterium
PDPGGDPVE

SEQ ID NO: 1183602 - protein, 7 aa, Mycobacterium
PDPRQIP

SEQ ID NO: 1183603 - protein, 4 aa, Mycobacterium
PDPV

SEQ ID NO: 1183604 - protein, 4 aa, Mycobacterium
PDQA

SEQ ID NO: 1183605 - protein, 5 aa, Mycobacterium
PDQTE

SEQ ID NO: 1183606 - protein, 7 aa, Mycobacterium
PDRDSFA

SEQ ID NO: 1183607 - protein, 7 aa, Mycobacterium
PDRGAPG

SEQ ID NO: 1183608 - protein, 5 aa, Mycobacterium
PDRPA

SEQ ID NO: 1183609 - protein, 4 aa, Mycobacterium
PDRR

SEQ ID NO: 1183610 - protein, 5 aa, Mycobacterium
PDRRA

SEQ ID NO: 1183611 - protein, 4 aa, Mycobacterium
PDRV

SEQ ID NO: 1183612 - protein, 11 aa, Mycobacterium
PDSAEDPIEDD

SEQ ID NO: 1183613 - protein, 6 aa, Mycobacterium
PDSGRV

SEQ ID NO: 1183614 - protein, 7 aa, Mycobacterium
PDSGRVR

SEQ ID NO: 1183615 - protein, 4 aa, Mycobacterium
PDSQ

SEQ ID NO: 1183616 - protein, 5 aa, Mycobacterium
PDSTI

SEQ ID NO: 1183617 - protein, 4 aa, Mycobacterium
PDSV

SEQ ID NO: 1183618 - protein, 15 aa, Mycobacterium
PDTDEAAGRAWPSRR

SEQ ID NO: 1183619 - protein, 4 aa, Mycobacterium
PDTG

SEQ ID NO: 1183620 - protein, 13 aa, Mycobacterium
PDTGELTGERNGV

SEQ ID NO: 1183621 - protein, 5 aa, Mycobacterium
PDVAD

SEQ ID NO: 1183622 - protein, 8 aa, Mycobacterium
PDYTEPIP

SEQ ID NO: 1183623 - protein, 6 aa, Mycobacterium
PEADRR

SEQ ID NO: 1183624 - protein, 8 aa, Mycobacterium
PEALSRTD

SEQ ID NO: 1183625 - protein, 14 aa, Mycobacterium
PEAPLAHTKERQQL

SEQ ID NO: 1183626 - protein, 14 aa, Mycobacterium
PEARKRVAAKRSEV

SEQ ID NO: 1183627 - protein, 12 aa, Mycobacterium
PEATSRIAEATA

SEQ ID NO: 1183628 - protein, 9 aa, Mycobacterium
PEDRIRETG

SEQ ID NO: 1183629 - protein, 7 aa, Mycobacterium
PEDRYPG

SEQ ID NO: 1183630 - protein, 5 aa, Mycobacterium
PEDVK

SEQ ID NO: 1183631 - protein, 7 aa, Mycobacterium
PEEAAGL

SEQ ID NO: 1183632 - protein, 5 aa, Mycobacterium
PEEAS

SEQ ID NO: 1183633 - protein, 7 aa, Mycobacterium
PEEDRPE

SEQ ID NO: 1183634 - protein, 5 aa, Mycobacterium
PEELQ

SEQ ID NO: 1183635 - protein, 11 aa, Mycobacterium
PEGAPDSGRGV

SEQ ID NO: 1183636 - protein, 10 aa, Mycobacterium
PEGLTRDQIG

SEQ ID NO: 1183637 - protein, 12 aa, Mycobacterium
PEGTQFDAKTPG

SEQ ID NO: 1183638 - protein, 8 aa, Mycobacterium
PEHPRRYD

SEQ ID NO: 1183639 - protein, 4 aa, Mycobacterium
PEIA

SEQ ID NO: 1183640 - protein, 5 aa, Mycobacterium
PEKDG

SEQ ID NO: 1183641 - protein, 10 aa, Mycobacterium
PEKERAEQDV

SEQ ID NO: 1183642 - protein, 11 aa, Mycobacterium
PEKTDLARPSV

SEQ ID NO: 1183643 - protein, 11 aa, Mycobacterium
PELAGDTAEGL

SEQ ID NO: 1183644 - protein, 4 aa, Mycobacterium
PELD

SEQ ID NO: 1183645 - protein, 11 aa, Mycobacterium
PELRGAAEAAR

SEQ ID NO: 1183646 - protein, 12 aa, Mycobacterium
PELSSGSPGDMT

SEQ ID NO: 1183647 - protein, 36 aa, Mycobacterium
PEPEPPKGDASKGDASKTDASKTEAPKTSSSASRRV

SEQ ID NO: 1183648 - protein, 5 aa, Mycobacterium
PEPET

SEQ ID NO: 1183649 - protein, 4 aa, Mycobacterium
PEPT

SEQ ID NO: 1183650 - protein, 7 aa, Mycobacterium
PEQAAAR

SEQ ID NO: 1183651 - protein, 5 aa, Mycobacterium
PEQEG

SEQ ID NO: 1183652 - protein, 6 aa, Mycobacterium
PEQVNT

SEQ ID NO: 1183653 - protein, 10 aa, Mycobacterium
PERGHTTPEI

SEQ ID NO: 1183654 - protein, 13 aa, Mycobacterium
PERKDDAHAAAGR

SEQ ID NO: 1183655 - protein, 4 aa, Mycobacterium
PERR

SEQ ID NO: 1183656 - protein, 5 aa, Mycobacterium
PERTR

SEQ ID NO: 1183657 - protein, 9 aa, Mycobacterium
PERVRDTPL

SEQ ID NO: 1183658 - protein, 4 aa, Mycobacterium
PESD

SEQ ID NO: 1183659 - protein, 8 aa, Mycobacterium
PESDPTAW

SEQ ID NO: 1183660 - protein, 7 aa, Mycobacterium
PESTPSA

SEQ ID NO: 1183661 - protein, 7 aa, Mycobacterium
PETAREG

SEQ ID NO: 1183662 - protein, 13 aa, Mycobacterium
PETPAGDLPALPA

SEQ ID NO: 1183663 - protein, 8 aa, Mycobacterium
PETREKAL

SEQ ID NO: 1183664 - protein, 6 aa, Mycobacterium
PETTGI

SEQ ID NO: 1183665 - protein, 10 aa, Mycobacterium
PEVANAQNTE

SEQ ID NO: 1183666 - protein, 4 aa, Mycobacterium
PEVY

SEQ ID NO: 1183667 - protein, 23 aa, Mycobacterium
PFDERSGGTEDEERAPVRGSAGP

SEQ ID NO: 1183668 - protein, 6 aa, Mycobacterium
PFDETR

SEQ ID NO: 1183669 - protein, 18 aa, Mycobacterium
PFESESKYPYTPNGSREF

SEQ ID NO: 1183670 - protein, 7 aa, Mycobacterium
PFGEGTG

SEQ ID NO: 1183671 - protein, 11 aa, Mycobacterium
PFGGVGPSGMG

SEQ ID NO: 1183672 - protein, 6 aa, Mycobacterium
PFGPEE

SEQ ID NO: 1183673 - protein, 5 aa, Mycobacterium
PFKKQ

SEQ ID NO: 1183674 - protein, 8 aa, Mycobacterium
PFNGDEET

SEQ ID NO: 1183675 - protein, 5 aa, Mycobacterium
PFPEG

SEQ ID NO: 1183676 - protein, 13 aa, Mycobacterium
PFPPDAPTPRPAA

SEQ ID NO: 1183677 - protein, 4 aa, Mycobacterium
PFTN

SEQ ID NO: 1183678 - protein, 6 aa, Mycobacterium
PGADGD

SEQ ID NO: 1183679 - protein, 8 aa, Mycobacterium
PGAGCTEE

SEQ ID NO: 1183680 - protein, 6 aa, Mycobacterium
PGAGKS

SEQ ID NO: 1183681 - protein, 11 aa, Mycobacterium
PGAKPNSDNPI

SEQ ID NO: 1183682 - protein, 7 aa, Mycobacterium
PGAPEQL

SEQ ID NO: 1183683 - protein, 8 aa, Mycobacterium
PGAPPSLA

SEQ ID NO: 1183684 - protein, 17 aa, Mycobacterium
PGAVDSDTRRAEAEQLT

SEQ ID NO: 1183685 - protein, 7 aa, Mycobacterium
PGCGGDE

SEQ ID NO: 1183686 - protein, 13 aa, Mycobacterium
PGDAIGRADLTGG

SEQ ID NO: 1183687 - protein, 4 aa, Mycobacterium
PGDG

SEQ ID NO: 1183688 - protein, 7 aa, Mycobacterium
PGDSDGS

SEQ ID NO: 1183689 - protein, 4 aa, Mycobacterium
PGEE

SEQ ID NO: 1183690 - protein, 7 aa, Mycobacterium
PGEQGGA

SEQ ID NO: 1183691 - protein, 6 aa, Mycobacterium
PGERTG

SEQ ID NO: 1183692 - protein, 6 aa, Mycobacterium
PGEVEM

SEQ ID NO: 1183693 - protein, 7 aa, Mycobacterium
PGFPPTA

SEQ ID NO: 1183694 - protein, 14 aa, Mycobacterium
PGGDPGRLDPVRDG

SEQ ID NO: 1183695 - protein, 56 aa, Mycobacterium
PGGGMGGGGPVSPVTSGPPAAGPNVGGGTPTSPAAGPVGSGGVGPSGASAAGGTQI

SEQ ID NO: 1183696 - protein, 6 aa, Mycobacterium
PGGGTQ

SEQ ID NO: 1183697 - protein, 13 aa, Mycobacterium
PGGHKLDDATEDR

SEQ ID NO: 1183698 - protein, 5 aa, Mycobacterium
PGGKT

SEQ ID NO: 1183699 - protein, 91 aa, Mycobacterium
PGGPGGVAGPDGAAGAIPGGPSGAAGPEGAAGAIPGGPVGEAGPGGASAAIPGGPVGEAGLGGASGAIPGGPSGSVGPDGVEGCIPAVGCI

SEQ ID NO: 1183700 - protein, 15 aa, Mycobacterium
PGGRLGHDEDLTTSV

SEQ ID NO: 1183701 - protein, 5 aa, Mycobacterium
PGGSA

SEQ ID NO: 1183702 - protein, 7 aa, Mycobacterium
PGGSAPE

SEQ ID NO: 1183703 - protein, 5 aa, Mycobacterium
PGGSM

SEQ ID NO: 1183704 - protein, 10 aa, Mycobacterium
PGGSQRRYTL

SEQ ID NO: 1183705 - protein, 9 aa, Mycobacterium
PGGSSTPLL

SEQ ID NO: 1183706 - protein, 8 aa, Mycobacterium
PGGTAPGQ

SEQ ID NO: 1183707 - protein, 8 aa, Mycobacterium
PGGTPAKW

SEQ ID NO: 1183708 - protein, 11 aa, Mycobacterium
PGHDTKVDDPS

SEQ ID NO: 1183709 - protein, 4 aa, Mycobacterium
PGHE

SEQ ID NO: 1183710 - protein, 8 aa, Mycobacterium
PGHKPGQY

SEQ ID NO: 1183711 - protein, 4 aa, Mycobacterium
PGHP

SEQ ID NO: 1183712 - protein, 6 aa, Mycobacterium
PGHTAD

SEQ ID NO: 1183713 - protein, 7 aa, Mycobacterium
PGHTPES

SEQ ID NO: 1183714 - protein, 6 aa, Mycobacterium
PGKHAA

SEQ ID NO: 1183715 - protein, 11 aa, Mycobacterium
PGKVRRRGAEA

SEQ ID NO: 1183716 - protein, 14 aa, Mycobacterium
PGLEPSVSGYVNRA

SEQ ID NO: 1183717 - protein, 7 aa, Mycobacterium
PGLGRTA

SEQ ID NO: 1183718 - protein, 5 aa, Mycobacterium
PGLQT

SEQ ID NO: 1183719 - protein, 7 aa, Mycobacterium
PGLSDDE

SEQ ID NO: 1183720 - protein, 7 aa, Mycobacterium
PGLTEAD

SEQ ID NO: 1183721 - protein, 14 aa, Mycobacterium
PGMAPYDASKAGVE

SEQ ID NO: 1183722 - protein, 27 aa, Mycobacterium
PGMCNPDDPEPCTSGAPSQEQIDNDHR

SEQ ID NO: 1183723 - protein, 6 aa, Mycobacterium
PGNEVV

SEQ ID NO: 1183724 - protein, 7 aa, Mycobacterium
PGNPAYA

SEQ ID NO: 1183725 - protein, 5 aa, Mycobacterium
PGPAL

SEQ ID NO: 1183726 - protein, 18 aa, Mycobacterium
PGPGSEPGESRIYQPGDD

SEQ ID NO: 1183727 - protein, 5 aa, Mycobacterium
PGPGV

SEQ ID NO: 1183728 - protein, 8 aa, Mycobacterium
PGPLQTNN

SEQ ID NO: 1183729 - protein, 6 aa, Mycobacterium
PGPVAT

SEQ ID NO: 1183730 - protein, 5 aa, Mycobacterium
PGQAP

SEQ ID NO: 1183731 - protein, 9 aa, Mycobacterium
PGQELEGKT

SEQ ID NO: 1183732 - protein, 10 aa, Mycobacterium
PGQGNNKPAR

SEQ ID NO: 1183733 - protein, 6 aa, Mycobacterium
PGQPAA

SEQ ID NO: 1183734 - protein, 7 aa, Mycobacterium
PGQPIRT

SEQ ID NO: 1183735 - protein, 12 aa, Mycobacterium
PGQQTEAHRHTS

SEQ ID NO: 1183736 - protein, 6 aa, Mycobacterium
PGQTPA

SEQ ID NO: 1183737 - protein, 13 aa, Mycobacterium
PGRADAHSESVTS

SEQ ID NO: 1183738 - protein, 10 aa, Mycobacterium
PGRAGATNTT

SEQ ID NO: 1183739 - protein, 12 aa, Mycobacterium
PGRDDTTGEPID

SEQ ID NO: 1183740 - protein, 4 aa, Mycobacterium
PGRE

SEQ ID NO: 1183741 - protein, 6 aa, Mycobacterium
PGRRAR

SEQ ID NO: 1183742 - protein, 4 aa, Mycobacterium
PGRT

SEQ ID NO: 1183743 - protein, 11 aa, Mycobacterium
PGRYAKFGSPT

SEQ ID NO: 1183744 - protein, 5 aa, Mycobacterium
PGSDS

SEQ ID NO: 1183745 - protein, 16 aa, Mycobacterium
PGSGAVAGGTRGEPSA

SEQ ID NO: 1183746 - protein, 8 aa, Mycobacterium
PGSIASEA

SEQ ID NO: 1183747 - protein, 16 aa, Mycobacterium
PGSLSGRYPVGNTGRV

SEQ ID NO: 1183748 - protein, 4 aa, Mycobacterium
PGSV

SEQ ID NO: 1183749 - protein, 7 aa, Mycobacterium
PGTDVTR

SEQ ID NO: 1183750 - protein, 13 aa, Mycobacterium
PGTGHGGLRTRRG

SEQ ID NO: 1183751 - protein, 9 aa, Mycobacterium
PGTGSSVRD

SEQ ID NO: 1183752 - protein, 11 aa, Mycobacterium
PGTKEPVGPDD

SEQ ID NO: 1183753 - protein, 7 aa, Mycobacterium
PGVEPSE

SEQ ID NO: 1183754 - protein, 4 aa, Mycobacterium
PGVQ

SEQ ID NO: 1183755 - protein, 7 aa, Mycobacterium
PGVVDPA

SEQ ID NO: 1183756 - protein, 5 aa, Mycobacterium
PGWQD

SEQ ID NO: 1183757 - protein, 11 aa, Mycobacterium
PGWRKRDADGA

SEQ ID NO: 1183758 - protein, 12 aa, Mycobacterium
PGYDETDDERQR

SEQ ID NO: 1183759 - protein, 8 aa, Mycobacterium
PHAPTGAD

SEQ ID NO: 1183760 - protein, 6 aa, Mycobacterium
PHDALD

SEQ ID NO: 1183761 - protein, 10 aa, Mycobacterium
PHPKASDASL

SEQ ID NO: 1183762 - protein, 10 aa, Mycobacterium
PHPPGGLTGY

SEQ ID NO: 1183763 - protein, 6 aa, Mycobacterium
PHPTPG

SEQ ID NO: 1183764 - protein, 6 aa, Mycobacterium
PHPTSS

SEQ ID NO: 1183765 - protein, 31 aa, Mycobacterium
PHQQGPDRRGPGRSAPTGRLPGARRPAGLGR

SEQ ID NO: 1183766 - protein, 6 aa, Mycobacterium
PHQYTD

SEQ ID NO: 1183767 - protein, 6 aa, Mycobacterium
PHRRAR

SEQ ID NO: 1183768 - protein, 8 aa, Mycobacterium
PHRTPSGI

SEQ ID NO: 1183769 - protein, 4 aa, Mycobacterium
PHSD

SEQ ID NO: 1183770 - protein, 5 aa, Mycobacterium
PHSPN

SEQ ID NO: 1183771 - protein, 5 aa, Mycobacterium
PHTPF

SEQ ID NO: 1183772 - protein, 11 aa, Mycobacterium
PIEDARRGGDA

SEQ ID NO: 1183773 - protein, 7 aa, Mycobacterium
PIGPPAH

SEQ ID NO: 1183774 - protein, 8 aa, Mycobacterium
PIGQPERL

SEQ ID NO: 1183775 - protein, 12 aa, Mycobacterium
PIPDPNTPTGSR

SEQ ID NO: 1183776 - protein, 31 aa, Mycobacterium
PIPERPDAASAPPEDRSGADFTADPVRSKSR

SEQ ID NO: 1183777 - protein, 15 aa, Mycobacterium
PIPPGPEFTKPDGGL

SEQ ID NO: 1183778 - protein, 4 aa, Mycobacterium
PIPV

SEQ ID NO: 1183779 - protein, 11 aa, Mycobacterium
PIQPKPIQRPH

SEQ ID NO: 1183780 - protein, 5 aa, Mycobacterium
PIRTP

SEQ ID NO: 1183781 - protein, 18 aa, Mycobacterium
PIRTSNAGQGFQGFWRPT

SEQ ID NO: 1183782 - protein, 13 aa, Mycobacterium
PITGDESTKEPDI

SEQ ID NO: 1183783 - protein, 15 aa, Mycobacterium
PKAADSSGQQTDPRT

SEQ ID NO: 1183784 - protein, 9 aa, Mycobacterium
PKAPTDADS

SEQ ID NO: 1183785 - protein, 10 aa, Mycobacterium
PKDAPKEAPP

SEQ ID NO: 1183786 - protein, 4 aa, Mycobacterium
PKED

SEQ ID NO: 1183787 - protein, 5 aa, Mycobacterium
PKEVP

SEQ ID NO: 1183788 - protein, 5 aa, Mycobacterium
PKFPN

SEQ ID NO: 1183789 - protein, 9 aa, Mycobacterium
PKGAYDTAR

SEQ ID NO: 1183790 - protein, 5 aa, Mycobacterium
PKGKE

SEQ ID NO: 1183791 - protein, 12 aa, Mycobacterium
PKHKRDPGLSEG

SEQ ID NO: 1183792 - protein, 6 aa, Mycobacterium
PKIDPV

SEQ ID NO: 1183793 - protein, 6 aa, Mycobacterium
PKPDNA

SEQ ID NO: 1183794 - protein, 10 aa, Mycobacterium
PKPDYDDVRG

SEQ ID NO: 1183795 - protein, 4 aa, Mycobacterium
PKRL

SEQ ID NO: 1183796 - protein, 8 aa, Mycobacterium
PKRPTKNF

SEQ ID NO: 1183797 - protein, 20 aa, Mycobacterium
PKRRRTRAQNRARRIQQERR

SEQ ID NO: 1183798 - protein, 5 aa, Mycobacterium
PKSAQ

SEQ ID NO: 1183799 - protein, 8 aa, Mycobacterium
PKSAQPAA

SEQ ID NO: 1183800 - protein, 4 aa, Mycobacterium
PKSS

SEQ ID NO: 1183801 - protein, 7 aa, Mycobacterium
PKVAEAK

SEQ ID NO: 1183802 - protein, 7 aa, Mycobacterium
PKVPFDP

SEQ ID NO: 1183803 - protein, 7 aa, Mycobacterium
PKYGHPI

SEQ ID NO: 1183804 - protein, 5 aa, Mycobacterium
PKYTE

SEQ ID NO: 1183805 - protein, 4 aa, Mycobacterium
PLAA

SEQ ID NO: 1183806 - protein, 5 aa, Mycobacterium
PLAPY

SEQ ID NO: 1183807 - protein, 9 aa, Mycobacterium
PLATDPALG

SEQ ID NO: 1183808 - protein, 5 aa, Mycobacterium
PLDGG

SEQ ID NO: 1183809 - protein, 12 aa, Mycobacterium
PLGAVSGPPLTS

SEQ ID NO: 1183810 - protein, 5 aa, Mycobacterium
PLGEE

SEQ ID NO: 1183811 - protein, 11 aa, Mycobacterium
PLGEQRAAADG

SEQ ID NO: 1183812 - protein, 18 aa, Mycobacterium
PLGPASPSVPARVWSGGP

SEQ ID NO: 1183813 - protein, 10 aa, Mycobacterium
PLHGDSGPIT

SEQ ID NO: 1183814 - protein, 8 aa, Mycobacterium
PLHSEPGA

SEQ ID NO: 1183815 - protein, 6 aa, Mycobacterium
PLKAPQ

SEQ ID NO: 1183816 - protein, 9 aa, Mycobacterium
PLKSDREIA

SEQ ID NO: 1183817 - protein, 12 aa, Mycobacterium
PLPAGEPSWTDG

SEQ ID NO: 1183818 - protein, 15 aa, Mycobacterium
PLPGAEGTGPGATSY

SEQ ID NO: 1183819 - protein, 6 aa, Mycobacterium
PLPGPL

SEQ ID NO: 1183820 - protein, 5 aa, Mycobacterium
PLPNP

SEQ ID NO: 1183821 - protein, 5 aa, Mycobacterium
PLPPG

SEQ ID NO: 1183822 - protein, 4 aa, Mycobacterium
PLPR

SEQ ID NO: 1183823 - protein, 14 aa, Mycobacterium
PLQGTPAPPALSGN

SEQ ID NO: 1183824 - protein, 13 aa, Mycobacterium
PLRDDAGKARRSA

SEQ ID NO: 1183825 - protein, 8 aa, Mycobacterium
PLSGDPYR

SEQ ID NO: 1183826 - protein, 8 aa, Mycobacterium
PLSPRGVK

SEQ ID NO: 1183827 - protein, 10 aa, Mycobacterium
PLTKGEAADR

SEQ ID NO: 1183828 - protein, 4 aa, Mycobacterium
PLTS

SEQ ID NO: 1183829 - protein, 6 aa, Mycobacterium
PMANGG

SEQ ID NO: 1183830 - protein, 5 aa, Mycobacterium
PMDYR

SEQ ID NO: 1183831 - protein, 9 aa, Mycobacterium
PMGDAGLTG

SEQ ID NO: 1183832 - protein, 10 aa, Mycobacterium
PMGGAAGGRL

SEQ ID NO: 1183833 - protein, 4 aa, Mycobacterium
PMGQ

SEQ ID NO: 1183834 - protein, 11 aa, Mycobacterium
PMGQPTKVDGG

SEQ ID NO: 1183835 - protein, 17 aa, Mycobacterium
PMGSDGGAWANDPETNY

SEQ ID NO: 1183836 - protein, 10 aa, Mycobacterium
PNADGAEVTT

SEQ ID NO: 1183837 - protein, 4 aa, Mycobacterium
PNAP

SEQ ID NO: 1183838 - protein, 5 aa, Mycobacterium
PNAPI

SEQ ID NO: 1183839 - protein, 12 aa, Mycobacterium
PNCGSSKPTIFS

SEQ ID NO: 1183840 - protein, 10 aa, Mycobacterium
PNGKALESAL

SEQ ID NO: 1183841 - protein, 8 aa, Mycobacterium
PNHPGGPA

SEQ ID NO: 1183842 - protein, 16 aa, Mycobacterium
PNKGEEDLRPAQGEGY

SEQ ID NO: 1183843 - protein, 6 aa, Mycobacterium
PNKPTI

SEQ ID NO: 1183844 - protein, 11 aa, Mycobacterium
PNPKAAAQQRN

SEQ ID NO: 1183845 - protein, 7 aa, Mycobacterium
PNPPASW

SEQ ID NO: 1183846 - protein, 4 aa, Mycobacterium
PNQT

SEQ ID NO: 1183847 - protein, 8 aa, Mycobacterium
PNSEKWET

SEQ ID NO: 1183848 - protein, 9 aa, Mycobacterium
PNSEKWETE

SEQ ID NO: 1183849 - protein, 18 aa, Mycobacterium
PNSGAVSAAGGASPLSSA

SEQ ID NO: 1183850 - protein, 9 aa, Mycobacterium
PNTNPPGGS

SEQ ID NO: 1183851 - protein, 5 aa, Mycobacterium
PNTPG

SEQ ID NO: 1183852 - protein, 6 aa, Mycobacterium
PNTRAR

SEQ ID NO: 1183853 - protein, 7 aa, Mycobacterium
PNVEPSA

SEQ ID NO: 1183854 - protein, 5 aa, Mycobacterium
PNVPA

SEQ ID NO: 1183855 - protein, 4 aa, Mycobacterium
PNVT

SEQ ID NO: 1183856 - protein, 15 aa, Mycobacterium
PNYSVPAGNRPLTAE

SEQ ID NO: 1183857 - protein, 19 aa, Mycobacterium
PPAAGRRRPSGVRARAEIA

SEQ ID NO: 1183858 - protein, 12 aa, Mycobacterium
PPADPADGIAEA

SEQ ID NO: 1183859 - protein, 21 aa, Mycobacterium
PPADRAEPAWRSRPRSPGERR

SEQ ID NO: 1183860 - protein, 17 aa, Mycobacterium
PPADRGRPGALSGPDLL

SEQ ID NO: 1183861 - protein, 4 aa, Mycobacterium
PPAE

SEQ ID NO: 1183862 - protein, 12 aa, Mycobacterium
PPAGEPREGGNS

SEQ ID NO: 1183863 - protein, 17 aa, Mycobacterium
PPAPVTPSRTHEVSSPR

SEQ ID NO: 1183864 - protein, 4 aa, Mycobacterium
PPCV

SEQ ID NO: 1183865 - protein, 4 aa, Mycobacterium
PPDA

SEQ ID NO: 1183866 - protein, 6 aa, Mycobacterium
PPDQTR

SEQ ID NO: 1183867 - protein, 4 aa, Mycobacterium
PPEK

SEQ ID NO: 1183868 - protein, 7 aa, Mycobacterium
PPEVSEQ

SEQ ID NO: 1183869 - protein, 4 aa, Mycobacterium
PPGD

SEQ ID NO: 1183870 - protein, 4 aa, Mycobacterium
PPGH

SEQ ID NO: 1183871 - protein, 6 aa, Mycobacterium
PPGQDD

SEQ ID NO: 1183872 - protein, 8 aa, Mycobacterium
PPGSDIPS

SEQ ID NO: 1183873 - protein, 19 aa, Mycobacterium
PPGSDTQDRVNKGLTSYND

SEQ ID NO: 1183874 - protein, 57 aa, Mycobacterium
PPGSPRSDTGTDPGDGSGDGEGDGYGCGSGAGDAAVPGELPAAADLGSGKGLSGAAA

SEQ ID NO: 1183875 - protein, 5 aa, Mycobacterium
PPGVP

SEQ ID NO: 1183876 - protein, 10 aa, Mycobacterium
PPHNYTQAEV

SEQ ID NO: 1183877 - protein, 7 aa, Mycobacterium
PPHPHTG

SEQ ID NO: 1183878 - protein, 5 aa, Mycobacterium
PPHSY

SEQ ID NO: 1183879 - protein, 13 aa, Mycobacterium
PPIDAPARGKLGA

SEQ ID NO: 1183880 - protein, 5 aa, Mycobacterium
PPKAA

SEQ ID NO: 1183881 - protein, 8 aa, Mycobacterium
PPKAQQAI

SEQ ID NO: 1183882 - protein, 7 aa, Mycobacterium
PPKTANY

SEQ ID NO: 1183883 - protein, 23 aa, Mycobacterium
PPLPESRLPPPSTMAGSPWNHPA

SEQ ID NO: 1183884 - protein, 14 aa, Mycobacterium
PPLRESATNPLQGG

SEQ ID NO: 1183885 - protein, 13 aa, Mycobacterium
PPLRGPSLTPVST

SEQ ID NO: 1183886 - protein, 6 aa, Mycobacterium
PPMPPA

SEQ ID NO: 1183887 - protein, 8 aa, Mycobacterium
PPNELDRG

SEQ ID NO: 1183888 - protein, 8 aa, Mycobacterium
PPNNRPSL

SEQ ID NO: 1183889 - protein, 39 aa, Mycobacterium
PPPAAPAGSGAGATRPTWTPGGTASGSDAPTTPSPAAEV

SEQ ID NO: 1183890 - protein, 18 aa, Mycobacterium
PPPPPPPPPAPPPPPPPP

SEQ ID NO: 1183891 - protein, 4 aa, Mycobacterium
PPPT

SEQ ID NO: 1183892 - protein, 8 aa, Mycobacterium
PPQHTDAR

SEQ ID NO: 1183893 - protein, 6 aa, Mycobacterium
PPRAGG

SEQ ID NO: 1183894 - protein, 10 aa, Mycobacterium
PPRAGRVEAR

SEQ ID NO: 1183895 - protein, 15 aa, Mycobacterium
PPRRQPPKSVPPLRR

SEQ ID NO: 1183896 - protein, 5 aa, Mycobacterium
PPSFE

SEQ ID NO: 1183897 - protein, 6 aa, Mycobacterium
PPSGTH

SEQ ID NO: 1183898 - protein, 11 aa, Mycobacterium
PPSGVFTPGDL

SEQ ID NO: 1183899 - protein, 5 aa, Mycobacterium
PPSLR

SEQ ID NO: 1183900 - protein, 7 aa, Mycobacterium
PPSRTDE

SEQ ID NO: 1183901 - protein, 4 aa, Mycobacterium
PPSV

SEQ ID NO: 1183902 - protein, 16 aa, Mycobacterium
PPTVSERPTQSPRDMP

SEQ ID NO: 1183903 - protein, 10 aa, Mycobacterium
PPVATAGHSQ

SEQ ID NO: 1183904 - protein, 6 aa, Mycobacterium
PPVGEG

SEQ ID NO: 1183905 - protein, 9 aa, Mycobacterium
PPVQGAEAE

SEQ ID NO: 1183906 - protein, 9 aa, Mycobacterium
PPVRGDDGA

SEQ ID NO: 1183907 - protein, 20 aa, Mycobacterium
PPVSQPQGLGAAAGGGRRHR

SEQ ID NO: 1183908 - protein, 7 aa, Mycobacterium
PPYETGA

SEQ ID NO: 1183909 - protein, 4 aa, Mycobacterium
PPYI

SEQ ID NO: 1183910 - protein, 14 aa, Mycobacterium
PPYSQEADRAPFTA

SEQ ID NO: 1183911 - protein, 23 aa, Mycobacterium
PQAAPADSDTAAAVIDDDQRRVT

SEQ ID NO: 1183912 - protein, 6 aa, Mycobacterium
PQANAT

SEQ ID NO: 1183913 - protein, 9 aa, Mycobacterium
PQANDEARK

SEQ ID NO: 1183914 - protein, 4 aa, Mycobacterium
PQAW

SEQ ID NO: 1183915 - protein, 7 aa, Mycobacterium
PQDPETL

SEQ ID NO: 1183916 - protein, 4 aa, Mycobacterium
PQGG

SEQ ID NO: 1183917 - protein, 16 aa, Mycobacterium
PQGHQPRPRTFTQSSK

SEQ ID NO: 1183918 - protein, 28 aa, Mycobacterium
PQGPPGGFDYGDGSPMWPQGQPGPDGTW

SEQ ID NO: 1183919 - protein, 17 aa, Mycobacterium
PQLDEAQTAAASPSREK

SEQ ID NO: 1183920 - protein, 11 aa, Mycobacterium
PQLSAADGRGP

SEQ ID NO: 1183921 - protein, 10 aa, Mycobacterium
PQLSDSDAAD

SEQ ID NO: 1183922 - protein, 4 aa, Mycobacterium
PQPA

SEQ ID NO: 1183923 - protein, 14 aa, Mycobacterium
PQPDATLEEAQENK

SEQ ID NO: 1183924 - protein, 5 aa, Mycobacterium
PQPHG

SEQ ID NO: 1183925 - protein, 6 aa, Mycobacterium
PQPINK

SEQ ID NO: 1183926 - protein, 6 aa, Mycobacterium
PQQHSP

SEQ ID NO: 1183927 - protein, 18 aa, Mycobacterium
PQQLPQVSQGTHPEPVDA

SEQ ID NO: 1183928 - protein, 33 aa, Mycobacterium
PQRQATRTPRRHHTARAGRINRNGGRLKHPDPQ

SEQ ID NO: 1183929 - protein, 12 aa, Mycobacterium
PQSTANTDETMA

SEQ ID NO: 1183930 - protein, 4 aa, Mycobacterium
PQTD

SEQ ID NO: 1183931 - protein, 6 aa, Mycobacterium
PQTPPF

SEQ ID NO: 1183932 - protein, 5 aa, Mycobacterium
PRAEA

SEQ ID NO: 1183933 - protein, 7 aa, Mycobacterium
PRAELGE

SEQ ID NO: 1183934 - protein, 4 aa, Mycobacterium
PRAF

SEQ ID NO: 1183935 - protein, 10 aa, Mycobacterium
PRAGQTATRL

SEQ ID NO: 1183936 - protein, 11 aa, Mycobacterium
PRALGSDAAAV

SEQ ID NO: 1183937 - protein, 4 aa, Mycobacterium
PRAR

SEQ ID NO: 1183938 - protein, 5 aa, Mycobacterium
PRDAD

SEQ ID NO: 1183939 - protein, 4 aa, Mycobacterium
PRDD

SEQ ID NO: 1183940 - protein, 5 aa, Mycobacterium
PRDEA

SEQ ID NO: 1183941 - protein, 10 aa, Mycobacterium
PRDRDGSFTP

SEQ ID NO: 1183942 - protein, 4 aa, Mycobacterium
PRDS

SEQ ID NO: 1183943 - protein, 4 aa, Mycobacterium
PRGA

SEQ ID NO: 1183944 - protein, 13 aa, Mycobacterium
PRGAAPKRAGRPT

SEQ ID NO: 1183945 - protein, 14 aa, Mycobacterium
PRGADPHADTDPDT

SEQ ID NO: 1183946 - protein, 5 aa, Mycobacterium
PRGAR

SEQ ID NO: 1183947 - protein, 5 aa, Mycobacterium
PRGLT

SEQ ID NO: 1183948 - protein, 4 aa, Mycobacterium
PRHG

SEQ ID NO: 1183949 - protein, 8 aa, Mycobacterium
PRHGRTPS

SEQ ID NO: 1183950 - protein, 4 aa, Mycobacterium
PRHR

SEQ ID NO: 1183951 - protein, 13 aa, Mycobacterium
PRHRREEKSAIER

SEQ ID NO: 1183952 - protein, 9 aa, Mycobacterium
PRIDPATEA

SEQ ID NO: 1183953 - protein, 10 aa, Mycobacterium
PRIPQRPHEP

SEQ ID NO: 1183954 - protein, 8 aa, Mycobacterium
PRKRTNPV

SEQ ID NO: 1183955 - protein, 4 aa, Mycobacterium
PRKS

SEQ ID NO: 1183956 - protein, 5 aa, Mycobacterium
PRNRG

SEQ ID NO: 1183957 - protein, 7 aa, Mycobacterium
PRPALPD

SEQ ID NO: 1183958 - protein, 22 aa, Mycobacterium
PRPAPEPDKDADGEPKPVPVPQ

SEQ ID NO: 1183959 - protein, 20 aa, Mycobacterium
PRPAPEPEKDADGEPKPVPV

SEQ ID NO: 1183960 - protein, 8 aa, Mycobacterium
PRPDYYPT

SEQ ID NO: 1183961 - protein, 20 aa, Mycobacterium
PRPEPEPDKDADGEPKPVPV

SEQ ID NO: 1183962 - protein, 6 aa, Mycobacterium
PRPKVT

SEQ ID NO: 1183963 - protein, 8 aa, Mycobacterium
PRPPRSAT

SEQ ID NO: 1183964 - protein, 6 aa, Mycobacterium
PRPRTQ

SEQ ID NO: 1183965 - protein, 9 aa, Mycobacterium
PRPSGNTYA

SEQ ID NO: 1183966 - protein, 4 aa, Mycobacterium
PRPT

SEQ ID NO: 1183967 - protein, 4 aa, Mycobacterium
PRPV

SEQ ID NO: 1183968 - protein, 5 aa, Mycobacterium
PRPVH

SEQ ID NO: 1183969 - protein, 7 aa, Mycobacterium
PRQSAPD

SEQ ID NO: 1183970 - protein, 23 aa, Mycobacterium
PRQSGVDAFGQGRVDRPGQCSQP

SEQ ID NO: 1183971 - protein, 18 aa, Mycobacterium
PRRASAAPARTASGSVAV

SEQ ID NO: 1183972 - protein, 25 aa, Mycobacterium
PRREGTEDLEELDDGEVDDTDDPDL

SEQ ID NO: 1183973 - protein, 6 aa, Mycobacterium
PRRGEV

SEQ ID NO: 1183974 - protein, 6 aa, Mycobacterium
PRRPER

SEQ ID NO: 1183975 - protein, 27 aa, Mycobacterium
PRRQQVESYTDLDDRRQPPQDQAAEQS

SEQ ID NO: 1183976 - protein, 9 aa, Mycobacterium
PRSAGPDGL

SEQ ID NO: 1183977 - protein, 8 aa, Mycobacterium
PRSDSSVA

SEQ ID NO: 1183978 - protein, 12 aa, Mycobacterium
PRSEKPRNRRKT

SEQ ID NO: 1183979 - protein, 10 aa, Mycobacterium
PRSPEWTGAG

SEQ ID NO: 1183980 - protein, 12 aa, Mycobacterium
PRSRGGGDIRPE

SEQ ID NO: 1183981 - protein, 6 aa, Mycobacterium
PRSRGR

SEQ ID NO: 1183982 - protein, 5 aa, Mycobacterium
PRSSL

SEQ ID NO: 1183983 - protein, 15 aa, Mycobacterium
PRSTSPSDPLPDTAD

SEQ ID NO: 1183984 - protein, 10 aa, Mycobacterium
PRSYPPSREP

SEQ ID NO: 1183985 - protein, 4 aa, Mycobacterium
PRTA

SEQ ID NO: 1183986 - protein, 7 aa, Mycobacterium
PRVDPDS

SEQ ID NO: 1183987 - protein, 9 aa, Mycobacterium
PRVGEQRSA

SEQ ID NO: 1183988 - protein, 5 aa, Mycobacterium
PRYAR

SEQ ID NO: 1183989 - protein, 9 aa, Mycobacterium
PSADEEAAY

SEQ ID NO: 1183990 - protein, 7 aa, Mycobacterium
PSALTGH

SEQ ID NO: 1183991 - protein, 7 aa, Mycobacterium
PSARTSV

SEQ ID NO: 1183992 - protein, 8 aa, Mycobacterium
PSATTLNG

SEQ ID NO: 1183993 - protein, 4 aa, Mycobacterium
PSCG

SEQ ID NO: 1183994 - protein, 13 aa, Mycobacterium
PSCPNCTAGGRWS

SEQ ID NO: 1183995 - protein, 51 aa, Mycobacterium
PSDDPVPTSQDRSGAIEPADGGKVGDAESGPPRSADDTGEPGGPAPPGNRA

SEQ ID NO: 1183996 - protein, 7 aa, Mycobacterium
PSDEIQV

SEQ ID NO: 1183997 - protein, 6 aa, Mycobacterium
PSDGAV

SEQ ID NO: 1183998 - protein, 20 aa, Mycobacterium
PSDTADAVTDRYPPLAEGEV

SEQ ID NO: 1183999 - protein, 7 aa, Mycobacterium
PSELPSA

SEQ ID NO: 1184000 - protein, 4 aa, Mycobacterium
PSGG

SEQ ID NO: 1184001 - protein, 8 aa, Mycobacterium
PSGGEHGW

SEQ ID NO: 1184002 - protein, 5 aa, Mycobacterium
PSGGI

SEQ ID NO: 1184003 - protein, 7 aa, Mycobacterium
PSGIPGG

SEQ ID NO: 1184004 - protein, 4 aa, Mycobacterium
PSGV

SEQ ID NO: 1184005 - protein, 5 aa, Mycobacterium
PSGVN

SEQ ID NO: 1184006 - protein, 18 aa, Mycobacterium
PSKAADLPTTYAGRELQK

SEQ ID NO: 1184007 - protein, 7 aa, Mycobacterium
PSKTASY

SEQ ID NO: 1184008 - protein, 8 aa, Mycobacterium
PSLPRYSA

SEQ ID NO: 1184009 - protein, 8 aa, Mycobacterium
PSMEPGRA

SEQ ID NO: 1184010 - protein, 6 aa, Mycobacterium
PSMPSG

SEQ ID NO: 1184011 - protein, 22 aa, Mycobacterium
PSNPYPLATPEDLAETERSVKE

SEQ ID NO: 1184012 - protein, 10 aa, Mycobacterium
PSNVASPAGA

SEQ ID NO: 1184013 - protein, 21 aa, Mycobacterium
PSPPPGLAGPDDTRRTRADAD

SEQ ID NO: 1184014 - protein, 5 aa, Mycobacterium
PSPRH

SEQ ID NO: 1184015 - protein, 5 aa, Mycobacterium
PSPTY

SEQ ID NO: 1184016 - protein, 7 aa, Mycobacterium
PSPVNSG

SEQ ID NO: 1184017 - protein, 23 aa, Mycobacterium
PSQAEIPEPAPIDDGVGPQVDGE

SEQ ID NO: 1184018 - protein, 7 aa, Mycobacterium
PSQAQRD

SEQ ID NO: 1184019 - protein, 10 aa, Mycobacterium
PSQPQSGESV

SEQ ID NO: 1184020 - protein, 9 aa, Mycobacterium
PSQTDPAPE

SEQ ID NO: 1184021 - protein, 9 aa, Mycobacterium
PSRRWGGDA

SEQ ID NO: 1184022 - protein, 11 aa, Mycobacterium
PSRWDPNSTRK

SEQ ID NO: 1184023 - protein, 9 aa, Mycobacterium
PSSSTAGRL

SEQ ID NO: 1184024 - protein, 9 aa, Mycobacterium
PSSVPSDRS

SEQ ID NO: 1184025 - protein, 9 aa, Mycobacterium
PSSWTSAPS

SEQ ID NO: 1184026 - protein, 10 aa, Mycobacterium
PSSYDAGDTI

SEQ ID NO: 1184027 - protein, 4 aa, Mycobacterium
PSTI

SEQ ID NO: 1184028 - protein, 10 aa, Mycobacterium
PSTKSLPVPV

SEQ ID NO: 1184029 - protein, 9 aa, Mycobacterium
PSTTSPPFG

SEQ ID NO: 1184030 - protein, 18 aa, Mycobacterium
PSTVPSSAASVASQPTRG

SEQ ID NO: 1184031 - protein, 4 aa, Mycobacterium
PSVS

SEQ ID NO: 1184032 - protein, 4 aa, Mycobacterium
PSWS

SEQ ID NO: 1184033 - protein, 7 aa, Mycobacterium
PTAANAG

SEQ ID NO: 1184034 - protein, 9 aa, Mycobacterium
PTADAPGLD

SEQ ID NO: 1184035 - protein, 21 aa, Mycobacterium
PTADAPIQPTKDTKDTTTDRG

SEQ ID NO: 1184036 - protein, 18 aa, Mycobacterium
PTADAPIQPTKDTTTDRG

SEQ ID NO: 1184037 - protein, 16 aa, Mycobacterium
PTADDRPAVPEDLDPD

SEQ ID NO: 1184038 - protein, 18 aa, Mycobacterium
PTAHDDEGRRDPRTNPDW

SEQ ID NO: 1184039 - protein, 7 aa, Mycobacterium
PTALPPG

SEQ ID NO: 1184040 - protein, 22 aa, Mycobacterium
PTAPTDPAPPSADRKPTRARAA

SEQ ID NO: 1184041 - protein, 6 aa, Mycobacterium
PTATAN

SEQ ID NO: 1184042 - protein, 7 aa, Mycobacterium
PTCTGTV

SEQ ID NO: 1184043 - protein, 10 aa, Mycobacterium
PTDASTLETK

SEQ ID NO: 1184044 - protein, 7 aa, Mycobacterium
PTDDDSA

SEQ ID NO: 1184045 - protein, 7 aa, Mycobacterium
PTDDPPT

SEQ ID NO: 1184046 - protein, 7 aa, Mycobacterium
PTDEELR

SEQ ID NO: 1184047 - protein, 5 aa, Mycobacterium
PTDTG

SEQ ID NO: 1184048 - protein, 10 aa, Mycobacterium
PTDVTKADQC

SEQ ID NO: 1184049 - protein, 10 aa, Mycobacterium
PTEDDIAGAR

SEQ ID NO: 1184050 - protein, 10 aa, Mycobacterium
PTEDLRGPGL

SEQ ID NO: 1184051 - protein, 5 aa, Mycobacterium
PTELP

SEQ ID NO: 1184052 - protein, 4 aa, Mycobacterium
PTFA

SEQ ID NO: 1184053 - protein, 4 aa, Mycobacterium
PTGD

SEQ ID NO: 1184054 - protein, 5 aa, Mycobacterium
PTHNS

SEQ ID NO: 1184055 - protein, 4 aa, Mycobacterium
PTIG

SEQ ID NO: 1184056 - protein, 13 aa, Mycobacterium
PTKMSGGEQQRTA

SEQ ID NO: 1184057 - protein, 5 aa, Mycobacterium
PTKVD

SEQ ID NO: 1184058 - protein, 18 aa, Mycobacterium
PTLAKGYRNTVQPDPFAE

SEQ ID NO: 1184059 - protein, 5 aa, Mycobacterium
PTLPV

SEQ ID NO: 1184060 - protein, 9 aa, Mycobacterium
PTPAPAGWR

SEQ ID NO: 1184061 - protein, 20 aa, Mycobacterium
PTPAPANPPPPSGPPLPAEA

SEQ ID NO: 1184062 - protein, 9 aa, Mycobacterium
PTPGHSPGS

SEQ ID NO: 1184063 - protein, 16 aa, Mycobacterium
PTPPVAAPPPRRSGRR

SEQ ID NO: 1184064 - protein, 5 aa, Mycobacterium
PTPSR

SEQ ID NO: 1184065 - protein, 8 aa, Mycobacterium
PTPTGYTN

SEQ ID NO: 1184066 - protein, 11 aa, Mycobacterium
PTRGAGPVGIT

SEQ ID NO: 1184067 - protein, 15 aa, Mycobacterium
PTRLDQPAEPITRAE

SEQ ID NO: 1184068 - protein, 5 aa, Mycobacterium
PTSEG

SEQ ID NO: 1184069 - protein, 12 aa, Mycobacterium
PTSGTTGTPKGA

SEQ ID NO: 1184070 - protein, 11 aa, Mycobacterium
PTTGLDPRSRR

SEQ ID NO: 1184071 - protein, 14 aa, Mycobacterium
PTTREESEGRAAAQ

SEQ ID NO: 1184072 - protein, 12 aa, Mycobacterium
PTTVGDETLAAG

SEQ ID NO: 1184073 - protein, 4 aa, Mycobacterium
PTVE

SEQ ID NO: 1184074 - protein, 10 aa, Mycobacterium
PTVTNGQLDR

SEQ ID NO: 1184075 - protein, 4 aa, Mycobacterium
PTWS

SEQ ID NO: 1184076 - protein, 5 aa, Mycobacterium
PTYGL

SEQ ID NO: 1184077 - protein, 6 aa, Mycobacterium
PTYPPF

SEQ ID NO: 1184078 - protein, 13 aa, Mycobacterium
PVAAGGDTRNQNT

SEQ ID NO: 1184079 - protein, 4 aa, Mycobacterium
PVAG

SEQ ID NO: 1184080 - protein, 12 aa, Mycobacterium
PVAPPAPPQGDP

SEQ ID NO: 1184081 - protein, 9 aa, Mycobacterium
PVAPPPVEA

SEQ ID NO: 1184082 - protein, 10 aa, Mycobacterium
PVDQGGYGFD

SEQ ID NO: 1184083 - protein, 5 aa, Mycobacterium
PVDQP

SEQ ID NO: 1184084 - protein, 7 aa, Mycobacterium
PVDTEDI

SEQ ID NO: 1184085 - protein, 21 aa, Mycobacterium
PVEEADQPKFADDQTRDRRRR

SEQ ID NO: 1184086 - protein, 19 aa, Mycobacterium
PVGDTSDVPEPEDEPESRT

SEQ ID NO: 1184087 - protein, 11 aa, Mycobacterium
PVGEAGGSETV

SEQ ID NO: 1184088 - protein, 5 aa, Mycobacterium
PVGEQ

SEQ ID NO: 1184089 - protein, 10 aa, Mycobacterium
PVGGTDRGDT

SEQ ID NO: 1184090 - protein, 17 aa, Mycobacterium
PVGPDAGLGTDPAGDEF

SEQ ID NO: 1184091 - protein, 14 aa, Mycobacterium
PVGPPPGVEPKPLR

SEQ ID NO: 1184092 - protein, 21 aa, Mycobacterium
PVGPTQPSNSAAPASHTDAPG

SEQ ID NO: 1184093 - protein, 7 aa, Mycobacterium
PVGTPLS

SEQ ID NO: 1184094 - protein, 5 aa, Mycobacterium
PVIEG

SEQ ID NO: 1184095 - protein, 49 aa, Mycobacterium
PVKKTPAKKTPAKKAVEPAKAAAAKKTPAKKTPAKKAPAKKAVKRPGNP

SEQ ID NO: 1184096 - protein, 10 aa, Mycobacterium
PVNPSGGLAS

SEQ ID NO: 1184097 - protein, 8 aa, Mycobacterium
PVNPSGGV

SEQ ID NO: 1184098 - protein, 6 aa, Mycobacterium
PVNTDG

SEQ ID NO: 1184099 - protein, 4 aa, Mycobacterium
PVPA

SEQ ID NO: 1184100 - protein, 11 aa, Mycobacterium
PVPDRHPTPLP

SEQ ID NO: 1184101 - protein, 8 aa, Mycobacterium
PVPGNAER

SEQ ID NO: 1184102 - protein, 6 aa, Mycobacterium
PVPGQG

SEQ ID NO: 1184103 - protein, 5 aa, Mycobacterium
PVPGR

SEQ ID NO: 1184104 - protein, 18 aa, Mycobacterium
PVPGYRAPAERTTGPGTR

SEQ ID NO: 1184105 - protein, 15 aa, Mycobacterium
PVPPPTPPPPPPAHT

SEQ ID NO: 1184106 - protein, 9 aa, Mycobacterium
PVPRDYDPG

SEQ ID NO: 1184107 - protein, 4 aa, Mycobacterium
PVPT

SEQ ID NO: 1184108 - protein, 4 aa, Mycobacterium
PVRK

SEQ ID NO: 1184109 - protein, 8 aa, Mycobacterium
PVRNPHAD

SEQ ID NO: 1184110 - protein, 16 aa, Mycobacterium
PVRSSGMTPYATRLIE

SEQ ID NO: 1184111 - protein, 4 aa, Mycobacterium
PVSD

SEQ ID NO: 1184112 - protein, 10 aa, Mycobacterium
PVSDDAPGRK

SEQ ID NO: 1184113 - protein, 12 aa, Mycobacterium
PVSPTLQDPLPE

SEQ ID NO: 1184114 - protein, 11 aa, Mycobacterium
PVTASRASRVP

SEQ ID NO: 1184115 - protein, 9 aa, Mycobacterium
PVTDGRKSV

SEQ ID NO: 1184116 - protein, 5 aa, Mycobacterium
PVTEP

SEQ ID NO: 1184117 - protein, 23 aa, Mycobacterium
PVTGGDPRVYTDPYPDAKGSDLV

SEQ ID NO: 1184118 - protein, 7 aa, Mycobacterium
PVVDGGT

SEQ ID NO: 1184119 - protein, 5 aa, Mycobacterium
PVVPP

SEQ ID NO: 1184120 - protein, 12 aa, Mycobacterium
PVVTSSANPAEV

SEQ ID NO: 1184121 - protein, 11 aa, Mycobacterium
PWGGAKPSSVA

SEQ ID NO: 1184122 - protein, 11 aa, Mycobacterium
PWQRGTNENTN

SEQ ID NO: 1184123 - protein, 4 aa, Mycobacterium
PWRG

SEQ ID NO: 1184124 - protein, 19 aa, Mycobacterium
PWSDGSVGALGSSYSGAAA

SEQ ID NO: 1184125 - protein, 12 aa, Mycobacterium
PYATPSPRGAVE

SEQ ID NO: 1184126 - protein, 44 aa, Mycobacterium
PYGAESAPPADAQLPAPPADAQLPAPPADAQPPAPPADAQPGGG

SEQ ID NO: 1184127 - protein, 8 aa, Mycobacterium
PYGPRGDA

SEQ ID NO: 1184128 - protein, 32 aa, Mycobacterium
PYPPNYPKMPGEPPRVQPSKKVAEHWDEDGNR

SEQ ID NO: 1184129 - protein, 4 aa, Mycobacterium
PYTG

SEQ ID NO: 1184130 - protein, 5 aa, Mycobacterium
PYTRR

SEQ ID NO: 1184131 - protein, 4 aa, Mycobacterium
PYTT

SEQ ID NO: 1184132 - protein, 4 aa, Mycobacterium
QAAA

SEQ ID NO: 1184133 - protein, 5 aa, Mycobacterium
QAAAA

SEQ ID NO: 1184134 - protein, 12 aa, Mycobacterium
QAAAEQVGAQQR

SEQ ID NO: 1184135 - protein, 8 aa, Mycobacterium
QAAENEVQ

SEQ ID NO: 1184136 - protein, 12 aa, Mycobacterium
QAALNTKSADFG

SEQ ID NO: 1184137 - protein, 5 aa, Mycobacterium
QADER

SEQ ID NO: 1184138 - protein, 10 aa, Mycobacterium
QADPSSLPGA

SEQ ID NO: 1184139 - protein, 6 aa, Mycobacterium
QADRTE

SEQ ID NO: 1184140 - protein, 7 aa, Mycobacterium
QADSDRT

SEQ ID NO: 1184141 - protein, 16 aa, Mycobacterium
QAEADAEFTDEITRGV

SEQ ID NO: 1184142 - protein, 12 aa, Mycobacterium
QAEDDRIGDVRG

SEQ ID NO: 1184143 - protein, 6 aa, Mycobacterium
QAEPAA

SEQ ID NO: 1184144 - protein, 10 aa, Mycobacterium
QAGDPDPVAA

SEQ ID NO: 1184145 - protein, 5 aa, Mycobacterium
QAGFA

SEQ ID NO: 1184146 - protein, 5 aa, Mycobacterium
QAGQI

SEQ ID NO: 1184147 - protein, 7 aa, Mycobacterium
QAGRLPD

SEQ ID NO: 1184148 - protein, 8 aa, Mycobacterium
QAGSRKDT

SEQ ID NO: 1184149 - protein, 5 aa, Mycobacterium
QAGTA

SEQ ID NO: 1184150 - protein, 8 aa, Mycobacterium
QAHGKTPA

SEQ ID NO: 1184151 - protein, 48 aa, Mycobacterium
QAKSGGTVEGSAATEQANGTQAAEGKSDKDDDDDDSGEDPMGGGMGGT

SEQ ID NO: 1184152 - protein, 10 aa, Mycobacterium
QALTDSTDDI

SEQ ID NO: 1184153 - protein, 4 aa, Mycobacterium
QAMP

SEQ ID NO: 1184154 - protein, 25 aa, Mycobacterium
QANEDYTEEFDPSKYGMADSYDEQG

SEQ ID NO: 1184155 - protein, 8 aa, Mycobacterium
QANEQPWT

SEQ ID NO: 1184156 - protein, 7 aa, Mycobacterium
QANGDEF

SEQ ID NO: 1184157 - protein, 12 aa, Mycobacterium
QANNFDKSRIDE

SEQ ID NO: 1184158 - protein, 7 aa, Mycobacterium
QAPESAA

SEQ ID NO: 1184159 - protein, 7 aa, Mycobacterium
QAPFRSG

SEQ ID NO: 1184160 - protein, 7 aa, Mycobacterium
QAPPNLV

SEQ ID NO: 1184161 - protein, 7 aa, Mycobacterium
QAPRCGV

SEQ ID NO: 1184162 - protein, 6 aa, Mycobacterium
QAPRGL

SEQ ID NO: 1184163 - protein, 7 aa, Mycobacterium
QAPSEAA

SEQ ID NO: 1184164 - protein, 5 aa, Mycobacterium
QAPSV

SEQ ID NO: 1184165 - protein, 6 aa, Mycobacterium
QAQGSN

SEQ ID NO: 1184166 - protein, 4 aa, Mycobacterium
QAQL

SEQ ID NO: 1184167 - protein, 5 aa, Mycobacterium
QAQPA

SEQ ID NO: 1184168 - protein, 8 aa, Mycobacterium
QAQRPAAH

SEQ ID NO: 1184169 - protein, 6 aa, Mycobacterium
QAREID

SEQ ID NO: 1184170 - protein, 7 aa, Mycobacterium
QAREIED

SEQ ID NO: 1184171 - protein, 10 aa, Mycobacterium
QARLEAKAND

SEQ ID NO: 1184172 - protein, 8 aa, Mycobacterium
QASGGQVD

SEQ ID NO: 1184173 - protein, 5 aa, Mycobacterium
QATAD

SEQ ID NO: 1184174 - protein, 4 aa, Mycobacterium
QATE

SEQ ID NO: 1184175 - protein, 10 aa, Mycobacterium
QAVDEAGTGF

SEQ ID NO: 1184176 - protein, 9 aa, Mycobacterium
QAVPGGPAT

SEQ ID NO: 1184177 - protein, 8 aa, Mycobacterium
QAYASEAG

SEQ ID NO: 1184178 - protein, 10 aa, Mycobacterium
QCESRPPAVP

SEQ ID NO: 1184179 - protein, 4 aa, Mycobacterium
QDDV

SEQ ID NO: 1184180 - protein, 10 aa, Mycobacterium
QDGAPRDATA

SEQ ID NO: 1184181 - protein, 5 aa, Mycobacterium
QDGPV

SEQ ID NO: 1184182 - protein, 11 aa, Mycobacterium
QDGTEPDHHTH

SEQ ID NO: 1184183 - protein, 4 aa, Mycobacterium
QDGV

SEQ ID NO: 1184184 - protein, 15 aa, Mycobacterium
QDHPRGARGKTLSPR

SEQ ID NO: 1184185 - protein, 11 aa, Mycobacterium
QDIADRATPLR

SEQ ID NO: 1184186 - protein, 11 aa, Mycobacterium
QDKKHRGREPI

SEQ ID NO: 1184187 - protein, 12 aa, Mycobacterium
QDKKHRGREPIS

SEQ ID NO: 1184188 - protein, 6 aa, Mycobacterium
QDLSPD

SEQ ID NO: 1184189 - protein, 8 aa, Mycobacterium
QDPPGLNG

SEQ ID NO: 1184190 - protein, 8 aa, Mycobacterium
QDPSRVPA

SEQ ID NO: 1184191 - protein, 12 aa, Mycobacterium
QDQRVNASEPVA

SEQ ID NO: 1184192 - protein, 12 aa, Mycobacterium
QDQSGRRAATNA

SEQ ID NO: 1184193 - protein, 9 aa, Mycobacterium
QDRGETLTT

SEQ ID NO: 1184194 - protein, 10 aa, Mycobacterium
QDSHGGGGLI

SEQ ID NO: 1184195 - protein, 6 aa, Mycobacterium
QDSSDL

SEQ ID NO: 1184196 - protein, 6 aa, Mycobacterium
QDTADP

SEQ ID NO: 1184197 - protein, 13 aa, Mycobacterium
QDTGQKPDPRTAQ

SEQ ID NO: 1184198 - protein, 4 aa, Mycobacterium
QDTT

SEQ ID NO: 1184199 - protein, 6 aa, Mycobacterium
QDVSTA

SEQ ID NO: 1184200 - protein, 4 aa, Mycobacterium
QDWQ

SEQ ID NO: 1184201 - protein, 10 aa, Mycobacterium
QEDPSTWGET

SEQ ID NO: 1184202 - protein, 11 aa, Mycobacterium
QEGCSGGRGGS

SEQ ID NO: 1184203 - protein, 11 aa, Mycobacterium
QEGPLTADGDT

SEQ ID NO: 1184204 - protein, 8 aa, Mycobacterium
QEQAGVTF

SEQ ID NO: 1184205 - protein, 5 aa, Mycobacterium
QEQHR

SEQ ID NO: 1184206 - protein, 6 aa, Mycobacterium
QEQRWN

SEQ ID NO: 1184207 - protein, 12 aa, Mycobacterium
QERAAQTGASVT

SEQ ID NO: 1184208 - protein, 5 aa, Mycobacterium
QERRY

SEQ ID NO: 1184209 - protein, 24 aa, Mycobacterium
QESDRRQKPGHGEPWSTPDSLDSA

SEQ ID NO: 1184210 - protein, 9 aa, Mycobacterium
QESVPEPEK

SEQ ID NO: 1184211 - protein, 9 aa, Mycobacterium
QFDPTEGYR

SEQ ID NO: 1184212 - protein, 4 aa, Mycobacterium
QFGR

SEQ ID NO: 1184213 - protein, 9 aa, Mycobacterium
QFPTDPDAY

SEQ ID NO: 1184214 - protein, 15 aa, Mycobacterium
QFRDAADSQGFDEAH

SEQ ID NO: 1184215 - protein, 8 aa, Mycobacterium
QFSAPDGG

SEQ ID NO: 1184216 - protein, 17 aa, Mycobacterium
QFSSAPTVHRTGGLSAA

SEQ ID NO: 1184217 - protein, 6 aa, Mycobacterium
QFTGNP

SEQ ID NO: 1184218 - protein, 14 aa, Mycobacterium
QGAEQQVAEKKMEV

SEQ ID NO: 1184219 - protein, 8 aa, Mycobacterium
QGAGGPVP

SEQ ID NO: 1184220 - protein, 6 aa, Mycobacterium
QGAQHA

SEQ ID NO: 1184221 - protein, 5 aa, Mycobacterium
QGDIT

SEQ ID NO: 1184222 - protein, 5 aa, Mycobacterium
QGELG

SEQ ID NO: 1184223 - protein, 5 aa, Mycobacterium
QGELP

SEQ ID NO: 1184224 - protein, 8 aa, Mycobacterium
QGEPADAV

SEQ ID NO: 1184225 - protein, 15 aa, Mycobacterium
QGGAEAGPDLGDAPI

SEQ ID NO: 1184226 - protein, 4 aa, Mycobacterium
QGGE

SEQ ID NO: 1184227 - protein, 26 aa, Mycobacterium
QGGGGDDGVRRHGTDSITGLVRLSGE

SEQ ID NO: 1184228 - protein, 9 aa, Mycobacterium
QGIDPSESA

SEQ ID NO: 1184229 - protein, 7 aa, Mycobacterium
QGKRAQS

SEQ ID NO: 1184230 - protein, 8 aa, Mycobacterium
QGLATGDR

SEQ ID NO: 1184231 - protein, 11 aa, Mycobacterium
QGMDPAEAEPL

SEQ ID NO: 1184232 - protein, 9 aa, Mycobacterium
QGMGGGKSH

SEQ ID NO: 1184233 - protein, 17 aa, Mycobacterium
QGNSARVGSVRSSEVEA

SEQ ID NO: 1184234 - protein, 7 aa, Mycobacterium
QGNTNVS

SEQ ID NO: 1184235 - protein, 8 aa, Mycobacterium
QGPKSAEV

SEQ ID NO: 1184236 - protein, 6 aa, Mycobacterium
QGPNAV

SEQ ID NO: 1184237 - protein, 8 aa, Mycobacterium
QGPPEAVI

SEQ ID NO: 1184238 - protein, 9 aa, Mycobacterium
QGPPGTGKT

SEQ ID NO: 1184239 - protein, 11 aa, Mycobacterium
QGQSRSAHLRT

SEQ ID NO: 1184240 - protein, 7 aa, Mycobacterium
QGRAPHG

SEQ ID NO: 1184241 - protein, 7 aa, Mycobacterium
QGRGETL

SEQ ID NO: 1184242 - protein, 9 aa, Mycobacterium
QGRGSAANS

SEQ ID NO: 1184243 - protein, 4 aa, Mycobacterium
QGSA

SEQ ID NO: 1184244 - protein, 6 aa, Mycobacterium
QGSGKS

SEQ ID NO: 1184245 - protein, 5 aa, Mycobacterium
QGSHA

SEQ ID NO: 1184246 - protein, 5 aa, Mycobacterium
QGSPI

SEQ ID NO: 1184247 - protein, 6 aa, Mycobacterium
QGSQWA

SEQ ID NO: 1184248 - protein, 7 aa, Mycobacterium
QGSREDC

SEQ ID NO: 1184249 - protein, 15 aa, Mycobacterium
QGTQVATLYKREFNE

SEQ ID NO: 1184250 - protein, 10 aa, Mycobacterium
QGVFGQGSAN

SEQ ID NO: 1184251 - protein, 5 aa, Mycobacterium
QGVHA

SEQ ID NO: 1184252 - protein, 29 aa, Mycobacterium
QGVPSTDASRPVSEPAAAVAASTSGQSIE

SEQ ID NO: 1184253 - protein, 5 aa, Mycobacterium
QGWDD

SEQ ID NO: 1184254 - protein, 5 aa, Mycobacterium
QGYSY

SEQ ID NO: 1184255 - protein, 5 aa, Mycobacterium
QHAAK

SEQ ID NO: 1184256 - protein, 8 aa, Mycobacterium
QHARHEAE

SEQ ID NO: 1184257 - protein, 6 aa, Mycobacterium
QHDPVA

SEQ ID NO: 1184258 - protein, 9 aa, Mycobacterium
QHEGEGTHP

SEQ ID NO: 1184259 - protein, 16 aa, Mycobacterium
QHPGNAPSEPHYRPSA

SEQ ID NO: 1184260 - protein, 4 aa, Mycobacterium
QHPT

SEQ ID NO: 1184261 - protein, 12 aa, Mycobacterium
QHRGQRPRSYTT

SEQ ID NO: 1184262 - protein, 6 aa, Mycobacterium
QHRPAT

SEQ ID NO: 1184263 - protein, 4 aa, Mycobacterium
QHRR

SEQ ID NO: 1184264 - protein, 10 aa, Mycobacterium
QIGHQRDRQH

SEQ ID NO: 1184265 - protein, 8 aa, Mycobacterium
QIGTTGAR

SEQ ID NO: 1184266 - protein, 7 aa, Mycobacterium
QIPSPAD

SEQ ID NO: 1184267 - protein, 15 aa, Mycobacterium
QISAEADSEPAEDYA

SEQ ID NO: 1184268 - protein, 11 aa, Mycobacterium
QISSERSARPM

SEQ ID NO: 1184269 - protein, 12 aa, Mycobacterium
QITPSPPPHHRH

SEQ ID NO: 1184270 - protein, 6 aa, Mycobacterium
QKAGPD

SEQ ID NO: 1184271 - protein, 13 aa, Mycobacterium
QKEAGRLRDDVPS

SEQ ID NO: 1184272 - protein, 15 aa, Mycobacterium
QKFGQEPGTYSTEGY

SEQ ID NO: 1184273 - protein, 9 aa, Mycobacterium
QKGPHGGPF

SEQ ID NO: 1184274 - protein, 15 aa, Mycobacterium
QKKKDPDQDTEGRRL

SEQ ID NO: 1184275 - protein, 11 aa, Mycobacterium
QKLASEGPAVK

SEQ ID NO: 1184276 - protein, 9 aa, Mycobacterium
QKNGASAKN

SEQ ID NO: 1184277 - protein, 21 aa, Mycobacterium
QKPLPATKPTESGPKPPPSFA

SEQ ID NO: 1184278 - protein, 7 aa, Mycobacterium
QKPTYQD

SEQ ID NO: 1184279 - protein, 7 aa, Mycobacterium
QKRLPRA

SEQ ID NO: 1184280 - protein, 12 aa, Mycobacterium
QLADTDRAKVQR

SEQ ID NO: 1184281 - protein, 19 aa, Mycobacterium
QLAGSSMGVGESSASYEVG

SEQ ID NO: 1184282 - protein, 5 aa, Mycobacterium
QLASI

SEQ ID NO: 1184283 - protein, 15 aa, Mycobacterium
QLDPTSRSRYTGDRS

SEQ ID NO: 1184284 - protein, 12 aa, Mycobacterium
QLGAPAPRQRDR

SEQ ID NO: 1184285 - protein, 35 aa, Mycobacterium
QLGGTPEGQVPSASPGYSTPPPEGIRDAEDQGDAA

SEQ ID NO: 1184286 - protein, 5 aa, Mycobacterium
QLGKA

SEQ ID NO: 1184287 - protein, 5 aa, Mycobacterium
QLGQQ

SEQ ID NO: 1184288 - protein, 7 aa, Mycobacterium
QLPAGTE

SEQ ID NO: 1184289 - protein, 8 aa, Mycobacterium
QLPAPAHT

SEQ ID NO: 1184290 - protein, 6 aa, Mycobacterium
QLPGTD

SEQ ID NO: 1184291 - protein, 5 aa, Mycobacterium
QLQGE

SEQ ID NO: 1184292 - protein, 8 aa, Mycobacterium
QLRENSDA

SEQ ID NO: 1184293 - protein, 9 aa, Mycobacterium
QLSPYADEH

SEQ ID NO: 1184294 - protein, 26 aa, Mycobacterium
QLTGKPGDGPASSKPGDAGGSPSAGP

SEQ ID NO: 1184295 - protein, 9 aa, Mycobacterium
QNAQGDEAS

SEQ ID NO: 1184296 - protein, 13 aa, Mycobacterium
QNASISDSSMEQN

SEQ ID NO: 1184297 - protein, 9 aa, Mycobacterium
QNDERGINE

SEQ ID NO: 1184298 - protein, 15 aa, Mycobacterium
QNERGVGEGIRDAGI

SEQ ID NO: 1184299 - protein, 20 aa, Mycobacterium
QNGGGFNPPEPTTRGGPDYG

SEQ ID NO: 1184300 - protein, 9 aa, Mycobacterium
QNGSASHAS

SEQ ID NO: 1184301 - protein, 7 aa, Mycobacterium
QNRRPGA

SEQ ID NO: 1184302 - protein, 14 aa, Mycobacterium
QNRRSHPLQGDQTL

SEQ ID NO: 1184303 - protein, 8 aa, Mycobacterium
QNRVPRAA

SEQ ID NO: 1184304 - protein, 6 aa, Mycobacterium
QNTTAE

SEQ ID NO: 1184305 - protein, 9 aa, Mycobacterium
QNTVEKDAT

SEQ ID NO: 1184306 - protein, 48 aa, Mycobacterium
QPAAAPNVGPTPQLQPAHNDPTDADQERDWPTDDLDGSTAAADVGRAE

SEQ ID NO: 1184307 - protein, 9 aa, Mycobacterium
QPAASLKTA

SEQ ID NO: 1184308 - protein, 13 aa, Mycobacterium
QPAEHGPDDPGGV

SEQ ID NO: 1184309 - protein, 8 aa, Mycobacterium
QPAKGERQ

SEQ ID NO: 1184310 - protein, 8 aa, Mycobacterium
QPASGRVY

SEQ ID NO: 1184311 - protein, 4 aa, Mycobacterium
QPCP

SEQ ID NO: 1184312 - protein, 9 aa, Mycobacterium
QPDAESVAA

SEQ ID NO: 1184313 - protein, 5 aa, Mycobacterium
QPDAH

SEQ ID NO: 1184314 - protein, 29 aa, Mycobacterium
QPDAQCRRNQDRNGSVGFDGASDGPDHLA

SEQ ID NO: 1184315 - protein, 6 aa, Mycobacterium
QPDEPA

SEQ ID NO: 1184316 - protein, 5 aa, Mycobacterium
QPDEQ

SEQ ID NO: 1184317 - protein, 8 aa, Mycobacterium
QPDPDGER

SEQ ID NO: 1184318 - protein, 11 aa, Mycobacterium
QPEENLDNETI

SEQ ID NO: 1184319 - protein, 5 aa, Mycobacterium
QPEVY

SEQ ID NO: 1184320 - protein, 19 aa, Mycobacterium
QPGAPAHYGATGPGVDRSV

SEQ ID NO: 1184321 - protein, 5 aa, Mycobacterium
QPGEY

SEQ ID NO: 1184322 - protein, 5 aa, Mycobacterium
QPGLR

SEQ ID NO: 1184323 - protein, 9 aa, Mycobacterium
QPGPVEESI

SEQ ID NO: 1184324 - protein, 5 aa, Mycobacterium
QPGVT

SEQ ID NO: 1184325 - protein, 7 aa, Mycobacterium
QPGYGLS

SEQ ID NO: 1184326 - protein, 16 aa, Mycobacterium
QPHPQGGWQEARRQRV

SEQ ID NO: 1184327 - protein, 6 aa, Mycobacterium
QPIAGE

SEQ ID NO: 1184328 - protein, 5 aa, Mycobacterium
QPIRE

SEQ ID NO: 1184329 - protein, 12 aa, Mycobacterium
QPKCRDARWRPD

SEQ ID NO: 1184330 - protein, 8 aa, Mycobacterium
QPKNTAEY

SEQ ID NO: 1184331 - protein, 5 aa, Mycobacterium
QPLDS

SEQ ID NO: 1184332 - protein, 19 aa, Mycobacterium
QPLGQSATLQTQAADTGVA

SEQ ID NO: 1184333 - protein, 6 aa, Mycobacterium
QPMGDP

SEQ ID NO: 1184334 - protein, 5 aa, Mycobacterium
QPNSA

SEQ ID NO: 1184335 - protein, 15 aa, Mycobacterium
QPPPVDGLPPLPSPS

SEQ ID NO: 1184336 - protein, 12 aa, Mycobacterium
QPRHGNGGDELD

SEQ ID NO: 1184337 - protein, 5 aa, Mycobacterium
QPRPP

SEQ ID NO: 1184338 - protein, 16 aa, Mycobacterium
QPRRDRTLDDRTPAQI

SEQ ID NO: 1184339 - protein, 5 aa, Mycobacterium
QPSNA

SEQ ID NO: 1184340 - protein, 4 aa, Mycobacterium
QPSV

SEQ ID NO: 1184341 - protein, 10 aa, Mycobacterium
QPTEPGEVST

SEQ ID NO: 1184342 - protein, 6 aa, Mycobacterium
QPTGEP

SEQ ID NO: 1184343 - protein, 6 aa, Mycobacterium
QPVGDG

SEQ ID NO: 1184344 - protein, 6 aa, Mycobacterium
QPVPPA

SEQ ID NO: 1184345 - protein, 6 aa, Mycobacterium
QQADSE

SEQ ID NO: 1184346 - protein, 60 aa, Mycobacterium
QQFGGQGGGAQTASGAPAPAPAAAAAGQPAPTAPAQAPQVREGEPEPTEELKRDDEQRTP

SEQ ID NO: 1184347 - protein, 7 aa, Mycobacterium
QQGASAR

SEQ ID NO: 1184348 - protein, 4 aa, Mycobacterium
QQHD

SEQ ID NO: 1184349 - protein, 9 aa, Mycobacterium
QQIPEGGKI

SEQ ID NO: 1184350 - protein, 7 aa, Mycobacterium
QQLGGVP

SEQ ID NO: 1184351 - protein, 5 aa, Mycobacterium
QQLPD

SEQ ID NO: 1184352 - protein, 4 aa, Mycobacterium
QQMG

SEQ ID NO: 1184353 - protein, 4 aa, Mycobacterium
QQPV

SEQ ID NO: 1184354 - protein, 5 aa, Mycobacterium
QQRGD

SEQ ID NO: 1184355 - protein, 9 aa, Mycobacterium
QQRSSTAET

SEQ ID NO: 1184356 - protein, 9 aa, Mycobacterium
QQRSTLDTA

SEQ ID NO: 1184357 - protein, 12 aa, Mycobacterium
QQSLEKRDHYAA

SEQ ID NO: 1184358 - protein, 12 aa, Mycobacterium
QQSLPRSAHDDA

SEQ ID NO: 1184359 - protein, 6 aa, Mycobacterium
QQTGVP

SEQ ID NO: 1184360 - protein, 7 aa, Mycobacterium
QQTPDLP

SEQ ID NO: 1184361 - protein, 9 aa, Mycobacterium
QQYAPKGVD

SEQ ID NO: 1184362 - protein, 7 aa, Mycobacterium
QRAEADG

SEQ ID NO: 1184363 - protein, 6 aa, Mycobacterium
QRAGGD

SEQ ID NO: 1184364 - protein, 12 aa, Mycobacterium
QRAGRAGRRAAS

SEQ ID NO: 1184365 - protein, 9 aa, Mycobacterium
QRASRDVTT

SEQ ID NO: 1184366 - protein, 8 aa, Mycobacterium
QRATPRAY

SEQ ID NO: 1184367 - protein, 7 aa, Mycobacterium
QRCPDRP

SEQ ID NO: 1184368 - protein, 14 aa, Mycobacterium
QRDAVAGAADLGGT

SEQ ID NO: 1184369 - protein, 14 aa, Mycobacterium
QRDAVAGEADLGGT

SEQ ID NO: 1184370 - protein, 6 aa, Mycobacterium
QRDDDG

SEQ ID NO: 1184371 - protein, 9 aa, Mycobacterium
QRDGSPSTL

SEQ ID NO: 1184372 - protein, 12 aa, Mycobacterium
QRDPNSRRRHGD

SEQ ID NO: 1184373 - protein, 4 aa, Mycobacterium
QRET

SEQ ID NO: 1184374 - protein, 6 aa, Mycobacterium
QRGKQD

SEQ ID NO: 1184375 - protein, 4 aa, Mycobacterium
QRGQ

SEQ ID NO: 1184376 - protein, 4 aa, Mycobacterium
QRGT

SEQ ID NO: 1184377 - protein, 37 aa, Mycobacterium
QRKAESLGAKMEDTSGDGAPAQSDSKSDSKGDDADKD

SEQ ID NO: 1184378 - protein, 10 aa, Mycobacterium
QRKPKDAEAK

SEQ ID NO: 1184379 - protein, 31 aa, Mycobacterium
QRLPDSLGGGTDAHIATSGEAVRAAEESIDV

SEQ ID NO: 1184380 - protein, 23 aa, Mycobacterium
QRLTSERSRASATVGGPGPEGSI

SEQ ID NO: 1184381 - protein, 20 aa, Mycobacterium
QRNPTDPTPSRQRASEESLR

SEQ ID NO: 1184382 - protein, 10 aa, Mycobacterium
QRPAGPTPAF

SEQ ID NO: 1184383 - protein, 5 aa, Mycobacterium
QRPDA

SEQ ID NO: 1184384 - protein, 10 aa, Mycobacterium
QRPHGSPRNT

SEQ ID NO: 1184385 - protein, 6 aa, Mycobacterium
QRPHRV

SEQ ID NO: 1184386 - protein, 7 aa, Mycobacterium
QRPQEVA

SEQ ID NO: 1184387 - protein, 6 aa, Mycobacterium
QRPRAD

SEQ ID NO: 1184388 - protein, 18 aa, Mycobacterium
QRQRAKADAAARKQAHTD

SEQ ID NO: 1184389 - protein, 15 aa, Mycobacterium
QRRDLDDAALDSGAE

SEQ ID NO: 1184390 - protein, 6 aa, Mycobacterium
QRREYR

SEQ ID NO: 1184391 - protein, 6 aa, Mycobacterium
QRRSLA

SEQ ID NO: 1184392 - protein, 6 aa, Mycobacterium
QRSGST

SEQ ID NO: 1184393 - protein, 13 aa, Mycobacterium
QRVEAESSALIGS

SEQ ID NO: 1184394 - protein, 5 aa, Mycobacterium
QRYQP

SEQ ID NO: 1184395 - protein, 13 aa, Mycobacterium
QSAAGSRAGDVQA

SEQ ID NO: 1184396 - protein, 9 aa, Mycobacterium
QSAQGTLTG

SEQ ID NO: 1184397 - protein, 8 aa, Mycobacterium
QSDLGPKQ

SEQ ID NO: 1184398 - protein, 17 aa, Mycobacterium
QSDPSEIDRATARPTFN

SEQ ID NO: 1184399 - protein, 4 aa, Mycobacterium
QSED

SEQ ID NO: 1184400 - protein, 4 aa, Mycobacterium
QSER

SEQ ID NO: 1184401 - protein, 5 aa, Mycobacterium
QSGDA

SEQ ID NO: 1184402 - protein, 6 aa, Mycobacterium
QSGGDL

SEQ ID NO: 1184403 - protein, 9 aa, Mycobacterium
QSGGPGSPA

SEQ ID NO: 1184404 - protein, 6 aa, Mycobacterium
QSGMGD

SEQ ID NO: 1184405 - protein, 8 aa, Mycobacterium
QSGPACHT

SEQ ID NO: 1184406 - protein, 12 aa, Mycobacterium
QSGQHVTDHQLK

SEQ ID NO: 1184407 - protein, 4 aa, Mycobacterium
QSGR

SEQ ID NO: 1184408 - protein, 7 aa, Mycobacterium
QSGSLGQ

SEQ ID NO: 1184409 - protein, 9 aa, Mycobacterium
QSGYDERRR

SEQ ID NO: 1184410 - protein, 11 aa, Mycobacterium
QSHGSTAEGEV

SEQ ID NO: 1184411 - protein, 7 aa, Mycobacterium
QSKGSDY

SEQ ID NO: 1184412 - protein, 9 aa, Mycobacterium
QSLPADVRD

SEQ ID NO: 1184413 - protein, 5 aa, Mycobacterium
QSLSN

SEQ ID NO: 1184414 - protein, 11 aa, Mycobacterium
QSPPDRTDAVR

SEQ ID NO: 1184415 - protein, 7 aa, Mycobacterium
QSPQYPQ

SEQ ID NO: 1184416 - protein, 5 aa, Mycobacterium
QSQNE

SEQ ID NO: 1184417 - protein, 5 aa, Mycobacterium
QSQSA

SEQ ID NO: 1184418 - protein, 28 aa, Mycobacterium
QSRVEESRRRAQDARTAAAATNTGEPAD

SEQ ID NO: 1184419 - protein, 8 aa, Mycobacterium
QSSAPGPV

SEQ ID NO: 1184420 - protein, 10 aa, Mycobacterium
QSSTPLRETG

SEQ ID NO: 1184421 - protein, 4 aa, Mycobacterium
QSTA

SEQ ID NO: 1184422 - protein, 9 aa, Mycobacterium
QSTGGRPPF

SEQ ID NO: 1184423 - protein, 14 aa, Mycobacterium
QSVTPEQAGKHPTW

SEQ ID NO: 1184424 - protein, 12 aa, Mycobacterium
QTAAEAARTSVE

SEQ ID NO: 1184425 - protein, 8 aa, Mycobacterium
QTADRAAR

SEQ ID NO: 1184426 - protein, 11 aa, Mycobacterium
QTDDQKWRAQY

SEQ ID NO: 1184427 - protein, 6 aa, Mycobacterium
QTGAVR

SEQ ID NO: 1184428 - protein, 6 aa, Mycobacterium
QTGGGS

SEQ ID NO: 1184429 - protein, 4 aa, Mycobacterium
QTGL

SEQ ID NO: 1184430 - protein, 5 aa, Mycobacterium
QTGLP

SEQ ID NO: 1184431 - protein, 4 aa, Mycobacterium
QTGR

SEQ ID NO: 1184432 - protein, 14 aa, Mycobacterium
QTLPGGRDEFGETI

SEQ ID NO: 1184433 - protein, 4 aa, Mycobacterium
QTLT

SEQ ID NO: 1184434 - protein, 14 aa, Mycobacterium
QTNGSGRIAEADEI

SEQ ID NO: 1184435 - protein, 4 aa, Mycobacterium
QTNV

SEQ ID NO: 1184436 - protein, 8 aa, Mycobacterium
QTPASARD

SEQ ID NO: 1184437 - protein, 9 aa, Mycobacterium
QTPPADATG

SEQ ID NO: 1184438 - protein, 15 aa, Mycobacterium
QTQCTATGGKPADHV

SEQ ID NO: 1184439 - protein, 9 aa, Mycobacterium
QTQESGGSI

SEQ ID NO: 1184440 - protein, 6 aa, Mycobacterium
QTRDDH

SEQ ID NO: 1184441 - protein, 11 aa, Mycobacterium
QTRNDFTTKAR

SEQ ID NO: 1184442 - protein, 8 aa, Mycobacterium
QTSEEVTV

SEQ ID NO: 1184443 - protein, 20 aa, Mycobacterium
QTSRATRRLATTREEGDRGV

SEQ ID NO: 1184444 - protein, 6 aa, Mycobacterium
QTVPAG

SEQ ID NO: 1184445 - protein, 14 aa, Mycobacterium
QVAARAKAKIGQPL

SEQ ID NO: 1184446 - protein, 7 aa, Mycobacterium
QVAEPGD

SEQ ID NO: 1184447 - protein, 7 aa, Mycobacterium
QVASAGD

SEQ ID NO: 1184448 - protein, 18 aa, Mycobacterium
QVDGDGYRGRRRDQTDSR

SEQ ID NO: 1184449 - protein, 5 aa, Mycobacterium
QVDQS

SEQ ID NO: 1184450 - protein, 32 aa, Mycobacterium
QVDSAAADIGAADVGGKTSSAGDALPGSTTQM

SEQ ID NO: 1184451 - protein, 4 aa, Mycobacterium
QVER

SEQ ID NO: 1184452 - protein, 4 aa, Mycobacterium
QVGE

SEQ ID NO: 1184453 - protein, 8 aa, Mycobacterium
QVGERDTE

SEQ ID NO: 1184454 - protein, 7 aa, Mycobacterium
QVPAGGV

SEQ ID NO: 1184455 - protein, 21 aa, Mycobacterium
QVRSPSDPGYVPTAPPALGTE

SEQ ID NO: 1184456 - protein, 5 aa, Mycobacterium
QVTDG

SEQ ID NO: 1184457 - protein, 12 aa, Mycobacterium
QVTTQGRYGHTT

SEQ ID NO: 1184458 - protein, 4 aa, Mycobacterium
QWGS

SEQ ID NO: 1184459 - protein, 6 aa, Mycobacterium
QWRGTE

SEQ ID NO: 1184460 - protein, 6 aa, Mycobacterium
QYGGVD

SEQ ID NO: 1184461 - protein, 8 aa, Mycobacterium
QYKPEGSA

SEQ ID NO: 1184462 - protein, 10 aa, Mycobacterium
RAAAALSDAG

SEQ ID NO: 1184463 - protein, 8 aa, Mycobacterium
RAAADGAN

SEQ ID NO: 1184464 - protein, 37 aa, Mycobacterium
RAAAGGPGGRTGERVGGRGGGGGGGADRRGGADGPGG

SEQ ID NO: 1184465 - protein, 5 aa, Mycobacterium
RAADA

SEQ ID NO: 1184466 - protein, 8 aa, Mycobacterium
RAAGADAI

SEQ ID NO: 1184467 - protein, 6 aa, Mycobacterium
RAAGAR

SEQ ID NO: 1184468 - protein, 8 aa, Mycobacterium
RAAGATTV

SEQ ID NO: 1184469 - protein, 8 aa, Mycobacterium
RAAGDTHH

SEQ ID NO: 1184470 - protein, 17 aa, Mycobacterium
RAAGERLRERPPGRRPD

SEQ ID NO: 1184471 - protein, 9 aa, Mycobacterium
RAAGGRSSI

SEQ ID NO: 1184472 - protein, 8 aa, Mycobacterium
RAAGQAEL

SEQ ID NO: 1184473 - protein, 13 aa, Mycobacterium
RAAGSGADRPGSC

SEQ ID NO: 1184474 - protein, 8 aa, Mycobacterium
RAAGVDAG

SEQ ID NO: 1184475 - protein, 7 aa, Mycobacterium
RAANHPG

SEQ ID NO: 1184476 - protein, 8 aa, Mycobacterium
RAAQTAAE

SEQ ID NO: 1184477 - protein, 7 aa, Mycobacterium
RAARAAH

SEQ ID NO: 1184478 - protein, 13 aa, Mycobacterium
RAARTVKTADGTA

SEQ ID NO: 1184479 - protein, 6 aa, Mycobacterium
RAASSL

SEQ ID NO: 1184480 - protein, 7 aa, Mycobacterium
RADARTA

SEQ ID NO: 1184481 - protein, 15 aa, Mycobacterium
RADAYGGSAENRARL

SEQ ID NO: 1184482 - protein, 9 aa, Mycobacterium
RADDPQRAR

SEQ ID NO: 1184483 - protein, 5 aa, Mycobacterium
RADDR

SEQ ID NO: 1184484 - protein, 4 aa, Mycobacterium
RADH

SEQ ID NO: 1184485 - protein, 6 aa, Mycobacterium
RADPDA

SEQ ID NO: 1184486 - protein, 5 aa, Mycobacterium
RADPH

SEQ ID NO: 1184487 - protein, 5 aa, Mycobacterium
RADPQ

SEQ ID NO: 1184488 - protein, 7 aa, Mycobacterium
RADVDAA

SEQ ID NO: 1184489 - protein, 4 aa, Mycobacterium
RADW

SEQ ID NO: 1184490 - protein, 5 aa, Mycobacterium
RAEAP

SEQ ID NO: 1184491 - protein, 8 aa, Mycobacterium
RAEKGEGL

SEQ ID NO: 1184492 - protein, 4 aa, Mycobacterium
RAEL

SEQ ID NO: 1184493 - protein, 8 aa, Mycobacterium
RAENPAVR

SEQ ID NO: 1184494 - protein, 8 aa, Mycobacterium
RAEPAHGP

SEQ ID NO: 1184495 - protein, 6 aa, Mycobacterium
RAEPID

SEQ ID NO: 1184496 - protein, 5 aa, Mycobacterium
RAEPL

SEQ ID NO: 1184497 - protein, 12 aa, Mycobacterium
RAEPPAAGASCR

SEQ ID NO: 1184498 - protein, 6 aa, Mycobacterium
RAERAD

SEQ ID NO: 1184499 - protein, 9 aa, Mycobacterium
RAERGGERK

SEQ ID NO: 1184500 - protein, 10 aa, Mycobacterium
RAETSTAEGT

SEQ ID NO: 1184501 - protein, 7 aa, Mycobacterium
RAFSAGN

SEQ ID NO: 1184502 - protein, 10 aa, Mycobacterium
RAGAKQIDGS

SEQ ID NO: 1184503 - protein, 9 aa, Mycobacterium
RAGASGTPW

SEQ ID NO: 1184504 - protein, 10 aa, Mycobacterium
RAGDRVRGAV

SEQ ID NO: 1184505 - protein, 9 aa, Mycobacterium
RAGERALTE

SEQ ID NO: 1184506 - protein, 8 aa, Mycobacterium
RAGEVGAS

SEQ ID NO: 1184507 - protein, 9 aa, Mycobacterium
RAGGETASA

SEQ ID NO: 1184508 - protein, 11 aa, Mycobacterium
RAGIDDSPEDA

SEQ ID NO: 1184509 - protein, 6 aa, Mycobacterium
RAGKED

SEQ ID NO: 1184510 - protein, 7 aa, Mycobacterium
RAGLGQS

SEQ ID NO: 1184511 - protein, 20 aa, Mycobacterium
RAGLGRPGPVLGGPDRQPRH

SEQ ID NO: 1184512 - protein, 9 aa, Mycobacterium
RAGLPSEIG

SEQ ID NO: 1184513 - protein, 8 aa, Mycobacterium
RAGNDLTA

SEQ ID NO: 1184514 - protein, 30 aa, Mycobacterium
RAGPALTTARSDQCADHGHRRRGPAGATVA

SEQ ID NO: 1184515 - protein, 20 aa, Mycobacterium
RAGRGAAEHAAAAGPTRAVA

SEQ ID NO: 1184516 - protein, 10 aa, Mycobacterium
RAGRSRNDQV

SEQ ID NO: 1184517 - protein, 10 aa, Mycobacterium
RAGSPTAQIQ

SEQ ID NO: 1184518 - protein, 6 aa, Mycobacterium
RAGSWE

SEQ ID NO: 1184519 - protein, 12 aa, Mycobacterium
RAGTPAAPTRGA

SEQ ID NO: 1184520 - protein, 6 aa, Mycobacterium
RAGTPL

SEQ ID NO: 1184521 - protein, 7 aa, Mycobacterium
RAGVGAG

SEQ ID NO: 1184522 - protein, 8 aa, Mycobacterium
RAGVGPGT

SEQ ID NO: 1184523 - protein, 19 aa, Mycobacterium
RAHAGDHPGRCGRAGVRAQ

SEQ ID NO: 1184524 - protein, 7 aa, Mycobacterium
RAHDGAG

SEQ ID NO: 1184525 - protein, 8 aa, Mycobacterium
RAHDGDAG

SEQ ID NO: 1184526 - protein, 9 aa, Mycobacterium
RAHTDAHST

SEQ ID NO: 1184527 - protein, 10 aa, Mycobacterium
RAHTDPQGLA

SEQ ID NO: 1184528 - protein, 10 aa, Mycobacterium
RAKASTKDSW

SEQ ID NO: 1184529 - protein, 10 aa, Mycobacterium
RAKEAAAAVP

SEQ ID NO: 1184530 - protein, 36 aa, Mycobacterium
RAKGERPNWTRQDESVPIADGADENVPMAGDAENRI

SEQ ID NO: 1184531 - protein, 7 aa, Mycobacterium
RAKPRKI

SEQ ID NO: 1184532 - protein, 8 aa, Mycobacterium
RAKTLGPR

SEQ ID NO: 1184533 - protein, 7 aa, Mycobacterium
RALGTTR

SEQ ID NO: 1184534 - protein, 7 aa, Mycobacterium
RANPDRP

SEQ ID NO: 1184535 - protein, 11 aa, Mycobacterium
RANTVSPGNTY

SEQ ID NO: 1184536 - protein, 8 aa, Mycobacterium
RAPADARE

SEQ ID NO: 1184537 - protein, 6 aa, Mycobacterium
RAPAEV

SEQ ID NO: 1184538 - protein, 10 aa, Mycobacterium
RAPENPYPAA

SEQ ID NO: 1184539 - protein, 7 aa, Mycobacterium
RAPERFR

SEQ ID NO: 1184540 - protein, 5 aa, Mycobacterium
RAPRY

SEQ ID NO: 1184541 - protein, 9 aa, Mycobacterium
RAPSVHNSQ

SEQ ID NO: 1184542 - protein, 10 aa, Mycobacterium
RAPTPDQGAR

SEQ ID NO: 1184543 - protein, 7 aa, Mycobacterium
RAPTPNN

SEQ ID NO: 1184544 - protein, 14 aa, Mycobacterium
RAPVQAEAAAQTEK

SEQ ID NO: 1184545 - protein, 6 aa, Mycobacterium
RARAMP

SEQ ID NO: 1184546 - protein, 16 aa, Mycobacterium
RARAQDRESSKPGTAL

SEQ ID NO: 1184547 - protein, 4 aa, Mycobacterium
RARE

SEQ ID NO: 1184548 - protein, 7 aa, Mycobacterium
RAREDSR

SEQ ID NO: 1184549 - protein, 12 aa, Mycobacterium
RARNEAEATRSA

SEQ ID NO: 1184550 - protein, 39 aa, Mycobacterium
RARRAARSARQHQPPGPGSAPDRGAGGADGGRPAPRRGF

SEQ ID NO: 1184551 - protein, 6 aa, Mycobacterium
RARSTR

SEQ ID NO: 1184552 - protein, 34 aa, Mycobacterium; identical to SEQ ID NO: 1111671

SEQ ID NO: 1184553 - protein, 9 aa, Mycobacterium
RARTSDVPA

SEQ ID NO: 1184554 - protein, 7 aa, Mycobacterium
RARYDDT

SEQ ID NO: 1184555 - protein, 17 aa, Mycobacterium
RASAAARARGDEGNRRL

SEQ ID NO: 1184556 - protein, 16 aa, Mycobacterium
RASADPENVKVLVTVG

SEQ ID NO: 1184557 - protein, 7 aa, Mycobacterium
RASANTI

SEQ ID NO: 1184558 - protein, 11 aa, Mycobacterium
RASAPLPEGMR

SEQ ID NO: 1184559 - protein, 8 aa, Mycobacterium
RASEDDEA

SEQ ID NO: 1184560 - protein, 6 aa, Mycobacterium
RASGAV

SEQ ID NO: 1184561 - protein, 12 aa, Mycobacterium
RASGDVTERQPL

SEQ ID NO: 1184562 - protein, 8 aa, Mycobacterium
RASGGELT

SEQ ID NO: 1184563 - protein, 8 aa, Mycobacterium
RASQPDLA

SEQ ID NO: 1184564 - protein, 18 aa, Mycobacterium
RASRASNSHDIRANEDGS

SEQ ID NO: 1184565 - protein, 6 aa, Mycobacterium
RASYPG

SEQ ID NO: 1184566 - protein, 7 aa, Mycobacterium
RATAETA

SEQ ID NO: 1184567 - protein, 14 aa, Mycobacterium
RATDPSIPADRRAE

SEQ ID NO: 1184568 - protein, 8 aa, Mycobacterium
RATDRGSL

SEQ ID NO: 1184569 - protein, 11 aa, Mycobacterium
RATGARLSTER

SEQ ID NO: 1184570 - protein, 6 aa, Mycobacterium
RATIES

SEQ ID NO: 1184571 - protein, 7 aa, Mycobacterium
RATITAA

SEQ ID NO: 1184572 - protein, 14 aa, Mycobacterium
RATLSGSGDAYSRC

SEQ ID NO: 1184573 - protein, 8 aa, Mycobacterium
RATPPRGR

SEQ ID NO: 1184574 - protein, 7 aa, Mycobacterium
RATQGDH

SEQ ID NO: 1184575 - protein, 4 aa, Mycobacterium
RAVD

SEQ ID NO: 1184576 - protein, 6 aa, Mycobacterium
RAVGDG

SEQ ID NO: 1184577 - protein, 7 aa, Mycobacterium
RAWQTST

SEQ ID NO: 1184578 - protein, 7 aa, Mycobacterium
RAYGSGL

SEQ ID NO: 1184579 - protein, 4 aa, Mycobacterium
RAYV

SEQ ID NO: 1184580 - protein, 5 aa, Mycobacterium
RCAES

SEQ ID NO: 1184581 - protein, 5 aa, Mycobacterium
RCPQA

SEQ ID NO: 1184582 - protein, 6 aa, Mycobacterium
RDADAL

SEQ ID NO: 1184583 - protein, 5 aa, Mycobacterium
RDADP

SEQ ID NO: 1184584 - protein, 9 aa, Mycobacterium
RDAGSAKVK

SEQ ID NO: 1184585 - protein, 6 aa, Mycobacterium
RDALDA

SEQ ID NO: 1184586 - protein, 5 aa, Mycobacterium
RDAMS

SEQ ID NO: 1184587 - protein, 7 aa, Mycobacterium
RDAPPDW

SEQ ID NO: 1184588 - protein, 22 aa, Mycobacterium
RDAPPTSQGRRLTGRHNRQPSI

SEQ ID NO: 1184589 - protein, 6 aa, Mycobacterium
RDAPQA

SEQ ID NO: 1184590 - protein, 9 aa, Mycobacterium
RDAPQLDSA

SEQ ID NO: 1184591 - protein, 6 aa, Mycobacterium
RDATDT

SEQ ID NO: 1184592 - protein, 6 aa, Mycobacterium
RDATNR

SEQ ID NO: 1184593 - protein, 10 aa, Mycobacterium
RDDARGPDAH

SEQ ID NO: 1184594 - protein, 5 aa, Mycobacterium
RDDGI

SEQ ID NO: 1184595 - protein, 8 aa, Mycobacterium
RDDGTRVR

SEQ ID NO: 1184596 - protein, 4 aa, Mycobacterium
RDDR

SEQ ID NO: 1184597 - protein, 8 aa, Mycobacterium
RDDSARQV

SEQ ID NO: 1184598 - protein, 6 aa, Mycobacterium
RDDTSI

SEQ ID NO: 1184599 - protein, 8 aa, Mycobacterium
RDEAQRTG

SEQ ID NO: 1184600 - protein, 14 aa, Mycobacterium
RDEFGGSLENRAKV

SEQ ID NO: 1184601 - protein, 5 aa, Mycobacterium
RDEGA

SEQ ID NO: 1184602 - protein, 16 aa, Mycobacterium
RDFNQEKITGAGKTVD

SEQ ID NO: 1184603 - protein, 15 aa, Mycobacterium
RDGAGDENAAARDQL

SEQ ID NO: 1184604 - protein, 14 aa, Mycobacterium
RDGAKRPVAETVGR

SEQ ID NO: 1184605 - protein, 7 aa, Mycobacterium
RDGDGGL

SEQ ID NO: 1184606 - protein, 7 aa, Mycobacterium
RDGDSVA

SEQ ID NO: 1184607 - protein, 11 aa, Mycobacterium
RDGEATDDAVT

SEQ ID NO: 1184608 - protein, 5 aa, Mycobacterium
RDGER

SEQ ID NO: 1184609 - protein, 4 aa, Mycobacterium
RDGG

SEQ ID NO: 1184610 - protein, 8 aa, Mycobacterium
RDGGDAVG

SEQ ID NO: 1184611 - protein, 10 aa, Mycobacterium
RDGGDGPPLR

SEQ ID NO: 1184612 - protein, 9 aa, Mycobacterium
RDGGDLPDE

SEQ ID NO: 1184613 - protein, 8 aa, Mycobacterium
RDGGTPLP

SEQ ID NO: 1184614 - protein, 7 aa, Mycobacterium
RDGIGAE

SEQ ID NO: 1184615 - protein, 5 aa, Mycobacterium
RDGPF

SEQ ID NO: 1184616 - protein, 9 aa, Mycobacterium
RDGRLRPPP

SEQ ID NO: 1184617 - protein, 5 aa, Mycobacterium
RDGSD

SEQ ID NO: 1184618 - protein, 9 aa, Mycobacterium
RDGSGTPFD

SEQ ID NO: 1184619 - protein, 6 aa, Mycobacterium
RDGVPE

SEQ ID NO: 1184620 - protein, 18 aa, Mycobacterium
RDHGDTDDTSGPGRPPMP

SEQ ID NO: 1184621 - protein, 7 aa, Mycobacterium
RDLDELS

SEQ ID NO: 1184622 - protein, 6 aa, Mycobacterium
RDLTAE

SEQ ID NO: 1184623 - protein, 4 aa, Mycobacterium
RDNG

SEQ ID NO: 1184624 - protein, 5 aa, Mycobacterium
RDNLT

SEQ ID NO: 1184625 - protein, 9 aa, Mycobacterium
RDPAAYRSR

SEQ ID NO: 1184626 - protein, 9 aa, Mycobacterium
RDPAGAPET

SEQ ID NO: 1184627 - protein, 4 aa, Mycobacterium
RDPD

SEQ ID NO: 1184628 - protein, 4 aa, Mycobacterium
RDPE

SEQ ID NO: 1184629 - protein, 16 aa, Mycobacterium
RDPFSGIGKPEPLKGN

SEQ ID NO: 1184630 - protein, 8 aa, Mycobacterium
RDPTRGGM

SEQ ID NO: 1184631 - protein, 21 aa, Mycobacterium
RDQAGEQEHPQHRRPGPSRQH

SEQ ID NO: 1184632 - protein, 5 aa, Mycobacterium
RDQAR

SEQ ID NO: 1184633 - protein, 7 aa, Mycobacterium
RDQGQAV

SEQ ID NO: 1184634 - protein, 5 aa, Mycobacterium
RDQYR

SEQ ID NO: 1184635 - protein, 14 aa, Mycobacterium
RDQYRQRAGRELGD

SEQ ID NO: 1184636 - protein, 26 aa, Mycobacterium
RDRAGRPESVGHATTVGELEELAGGQ

SEQ ID NO: 1184637 - protein, 8 aa, Mycobacterium
RDRDAPRT

SEQ ID NO: 1184638 - protein, 5 aa, Mycobacterium
RDRGT

SEQ ID NO: 1184639 - protein, 9 aa, Mycobacterium
RDRGVDPPT

SEQ ID NO: 1184640 - protein, 9 aa, Mycobacterium
RDRPGNAAA

SEQ ID NO: 1184641 - protein, 4 aa, Mycobacterium
RDRQ

SEQ ID NO: 1184642 - protein, 7 aa, Mycobacterium
RDRREAL

SEQ ID NO: 1184643 - protein, 8 aa, Mycobacterium
RDSCGRRI

SEQ ID NO: 1184644 - protein, 5 aa, Mycobacterium
RDSGA

SEQ ID NO: 1184645 - protein, 9 aa, Mycobacterium
RDSGGTKKV

SEQ ID NO: 1184646 - protein, 20 aa, Mycobacterium
RDTAPPGLGLPPSSSPLGRL

SEQ ID NO: 1184647 - protein, 6 aa, Mycobacterium
RDTDAD

SEQ ID NO: 1184648 - protein, 15 aa, Mycobacterium
RDTIGATSDKLTSVS

SEQ ID NO: 1184649 - protein, 12 aa, Mycobacterium
RDYRGKRELTPV

SEQ ID NO: 1184650 - protein, 14 aa, Mycobacterium
REAADAAGPGRSKQ

SEQ ID NO: 1184651 - protein, 11 aa, Mycobacterium
REAADGLRADY

SEQ ID NO: 1184652 - protein, 8 aa, Mycobacterium
REAADNAR

SEQ ID NO: 1184653 - protein, 13 aa, Mycobacterium
REAANQDIDATNA

SEQ ID NO: 1184654 - protein, 12 aa, Mycobacterium
REAGREVREETM

SEQ ID NO: 1184655 - protein, 6 aa, Mycobacterium
REAGTV

SEQ ID NO: 1184656 - protein, 4 aa, Mycobacterium
REAP

SEQ ID NO: 1184657 - protein, 7 aa, Mycobacterium
REASSDH

SEQ ID NO: 1184658 - protein, 7 aa, Mycobacterium
REAVSEA

SEQ ID NO: 1184659 - protein, 9 aa, Mycobacterium
REDDELDPD

SEQ ID NO: 1184660 - protein, 8 aa, Mycobacterium
REDDPSGA

SEQ ID NO: 1184661 - protein, 9 aa, Mycobacterium
REDGTPSQV

SEQ ID NO: 1184662 - protein, 5 aa, Mycobacterium
REDYE

SEQ ID NO: 1184663 - protein, 12 aa, Mycobacterium
REEAGPKDHTVP

SEQ ID NO: 1184664 - protein, 5 aa, Mycobacterium
REEPI

SEQ ID NO: 1184665 - protein, 8 aa, Mycobacterium
REEPSPGV

SEQ ID NO: 1184666 - protein, 12 aa, Mycobacterium
REESERLGDGPL

SEQ ID NO: 1184667 - protein, 19 aa, Mycobacterium
REFTDRSRDNRLAHQRRVD

SEQ ID NO: 1184668 - protein, 5 aa, Mycobacterium
REGAT

SEQ ID NO: 1184669 - protein, 8 aa, Mycobacterium
REGEEPEI

SEQ ID NO: 1184670 - protein, 4 aa, Mycobacterium
REGF

SEQ ID NO: 1184671 - protein, 5 aa, Mycobacterium
REGGR

SEQ ID NO: 1184672 - protein, 24 aa, Mycobacterium
REGGSSSGGRSSGGMVGGDGGSGM

SEQ ID NO: 1184673 - protein, 40 aa, Mycobacterium
REGKAQQDKADAQQDAARKEAEAEAARGGAKAAEERQKSE

SEQ ID NO: 1184674 - protein, 43 aa, Mycobacterium
REGQAQQDKADAQRDAAKKEAEAEAARGSAKVAEERQKSEQTD

SEQ ID NO: 1184675 - protein, 4 aa, Mycobacterium
REGV

SEQ ID NO: 1184676 - protein, 11 aa, Mycobacterium
REHGTADPAEL

SEQ ID NO: 1184677 - protein, 7 aa, Mycobacterium
REHTAAR

SEQ ID NO: 1184678 - protein, 14 aa, Mycobacterium
REKPLTAADYSRTR

SEQ ID NO: 1184679 - protein, 10 aa, Mycobacterium
REKQTGVGDE

SEQ ID NO: 1184680 - protein, 48 aa, Mycobacterium
REKRTENQPGSGVDTETADGAGSAADGHGPTPSPDRDAGGDTGEPGEW

SEQ ID NO: 1184681 - protein, 4 aa, Mycobacterium
RELP

SEQ ID NO: 1184682 - protein, 8 aa, Mycobacterium
RELPTARQ

SEQ ID NO: 1184683 - protein, 12 aa, Mycobacterium
RELSESEQDEFR

SEQ ID NO: 1184684 - protein, 8 aa, Mycobacterium
RELTQTRA

SEQ ID NO: 1184685 - protein, 4 aa, Mycobacterium
RENR

SEQ ID NO: 1184686 - protein, 7 aa, Mycobacterium
REPAANA

SEQ ID NO: 1184687 - protein, 4 aa, Mycobacterium
REPE

SEQ ID NO: 1184688 - protein, 4 aa, Mycobacterium
REPV

SEQ ID NO: 1184689 - protein, 7 aa, Mycobacterium
REQGLTG

SEQ ID NO: 1184690 - protein, 26 aa, Mycobacterium
REQSRQHADEARRKMSERRTAHDGGI

SEQ ID NO: 1184691 - protein, 13 aa, Mycobacterium
RERANGDGNSTTM

SEQ ID NO: 1184692 - protein, 6 aa, Mycobacterium
RERPGA

SEQ ID NO: 1184693 - protein, 6 aa, Mycobacterium
RERQLD

SEQ ID NO: 1184694 - protein, 16 aa, Mycobacterium
RERRGEVEEASDRIAG

SEQ ID NO: 1184695 - protein, 11 aa, Mycobacterium
RESANWPEGRP

SEQ ID NO: 1184696 - protein, 4 aa, Mycobacterium
RESL

SEQ ID NO: 1184697 - protein, 7 aa, Mycobacterium
RESTGGF

SEQ ID NO: 1184698 - protein, 10 aa, Mycobacterium
RETGQLEQDG

SEQ ID NO: 1184699 - protein, 4 aa, Mycobacterium
RETR

SEQ ID NO: 1184700 - protein, 10 aa, Mycobacterium
REVARQEREI

SEQ ID NO: 1184701 - protein, 5 aa, Mycobacterium
REVGR

SEQ ID NO: 1184702 - protein, 14 aa, Mycobacterium
REVSQEEMQAAMSN

SEQ ID NO: 1184703 - protein, 7 aa, Mycobacterium
RFAPRNT

SEQ ID NO: 1184704 - protein, 5 aa, Mycobacterium
RFPEA

SEQ ID NO: 1184705 - protein, 14 aa, Mycobacterium
RFSEKEATPIANQN

SEQ ID NO: 1184706 - protein, 6 aa, Mycobacterium
RFSTGG

SEQ ID NO: 1184707 - protein, 4 aa, Mycobacterium
RGAA

SEQ ID NO: 1184708 - protein, 10 aa, Mycobacterium
RGAAGGSGTR

SEQ ID NO: 1184709 - protein, 8 aa, Mycobacterium
RGAAGSAQ

SEQ ID NO: 1184710 - protein, 18 aa, Mycobacterium
RGAAPTTVISSPDRGEVR

SEQ ID NO: 1184711 - protein, 5 aa, Mycobacterium
RGADG

SEQ ID NO: 1184712 - protein, 6 aa, Mycobacterium
RGADVT

SEQ ID NO: 1184713 - protein, 13 aa, Mycobacterium
RGAEGGGHGEPRV

SEQ ID NO: 1184714 - protein, 4 aa, Mycobacterium
RGAG

SEQ ID NO: 1184715 - protein, 51 aa, Mycobacterium
RGAGGDTKASKINSYEQPLPEVDESGRPGVEGQSSRPAAPVVNPESQNAVK

SEQ ID NO: 1184716 - protein, 18 aa, Mycobacterium
RGAHQSALDKASRPRTGE

SEQ ID NO: 1184717 - protein, 25 aa, Mycobacterium
RGAKTRAKAAEQAERPRESAPGPDA

SEQ ID NO: 1184718 - protein, 8 aa, Mycobacterium
RGCGQGPC

SEQ ID NO: 1184719 - protein, 14 aa, Mycobacterium
RGDDDLIELIDTVQ

SEQ ID NO: 1184720 - protein, 13 aa, Mycobacterium
RGDKNHPASQGYT

SEQ ID NO: 1184721 - protein, 5 aa, Mycobacterium
RGDLP

SEQ ID NO: 1184722 - protein, 12 aa, Mycobacterium
RGDRLPDEHRGA

SEQ ID NO: 1184723 - protein, 16 aa, Mycobacterium
RGDRLPDSHPAAAYRG

SEQ ID NO: 1184724 - protein, 14 aa, Mycobacterium
RGDRVAATARDTAT

SEQ ID NO: 1184725 - protein, 13 aa, Mycobacterium
RGDRVAFEALVVD

SEQ ID NO: 1184726 - protein, 8 aa, Mycobacterium
RGDSPQHD

SEQ ID NO: 1184727 - protein, 5 aa, Mycobacterium
RGDTL

SEQ ID NO: 1184728 - protein, 6 aa, Mycobacterium
RGDTLR

SEQ ID NO: 1184729 - protein, 9 aa, Mycobacterium
RGDVSEAAP

SEQ ID NO: 1184730 - protein, 16 aa, Mycobacterium
RGECPFGSEGNADGPL

SEQ ID NO: 1184731 - protein, 5 aa, Mycobacterium
RGEES

SEQ ID NO: 1184732 - protein, 7 aa, Mycobacterium
RGEGYQP

SEQ ID NO: 1184733 - protein, 6 aa, Mycobacterium
RGEIEP

SEQ ID NO: 1184734 - protein, 10 aa, Mycobacterium
RGELSPTGRA

SEQ ID NO: 1184735 - protein, 7 aa, Mycobacterium
RGEPSED

SEQ ID NO: 1184736 - protein, 4 aa, Mycobacterium
RGEV

SEQ ID NO: 1184737 - protein, 11 aa, Mycobacterium
RGFASGTPDGL

SEQ ID NO: 1184738 - protein, 37 aa, Mycobacterium
RGFGASRQNGPRADSTCKQQQRSASDRRIPQGADTRS

SEQ ID NO: 1184739 - protein, 14 aa, Mycobacterium
RGGAPAEVTHSGNT

SEQ ID NO: 1184740 - protein, 10 aa, Mycobacterium
RGGETVSATD

SEQ ID NO: 1184741 - protein, 13 aa, Mycobacterium
RGGIRGLKNCLGM

SEQ ID NO: 1184742 - protein, 6 aa, Mycobacterium
RGGSAI

SEQ ID NO: 1184743 - protein, 5 aa, Mycobacterium
RGGSY

SEQ ID NO: 1184744 - protein, 4 aa, Mycobacterium
RGGV

SEQ ID NO: 1184745 - protein, 5 aa, Mycobacterium
RGGVL

SEQ ID NO: 1184746 - protein, 5 aa, Mycobacterium
RGIPR

SEQ ID NO: 1184747 - protein, 5 aa, Mycobacterium
RGIPS

SEQ ID NO: 1184748 - protein, 9 aa, Mycobacterium
RGIRPDDGP

SEQ ID NO: 1184749 - protein, 4 aa, Mycobacterium
RGIT

SEQ ID NO: 1184750 - protein, 4 aa, Mycobacterium
RGLA

SEQ ID NO: 1184751 - protein, 11 aa, Mycobacterium
RGLPDEGEDID

SEQ ID NO: 1184752 - protein, 8 aa, Mycobacterium
RGLPRSAT

SEQ ID NO: 1184753 - protein, 9 aa, Mycobacterium
RGLTGRPEH

SEQ ID NO: 1184754 - protein, 14 aa, Mycobacterium
RGMSGPDAAVAAST

SEQ ID NO: 1184755 - protein, 9 aa, Mycobacterium
RGPDEPAIP

SEQ ID NO: 1184756 - protein, 5 aa, Mycobacterium
RGPDR

SEQ ID NO: 1184757 - protein, 15 aa, Mycobacterium
RGPEADQLSGDDADE

SEQ ID NO: 1184758 - protein, 17 aa, Mycobacterium
RGPEYGIEGGPEANEDR

SEQ ID NO: 1184759 - protein, 5 aa, Mycobacterium
RGPFG

SEQ ID NO: 1184760 - protein, 13 aa, Mycobacterium
RGPNYGGADASGV

SEQ ID NO: 1184761 - protein, 24 aa, Mycobacterium
RGPRGGAVNARAAAQSLGVSPGTV

SEQ ID NO: 1184762 - protein, 7 aa, Mycobacterium
RGPRGQV

SEQ ID NO: 1184763 - protein, 6 aa, Mycobacterium
RGPTGP

SEQ ID NO: 1184764 - protein, 7 aa, Mycobacterium
RGPVHTG

SEQ ID NO: 1184765 - protein, 9 aa, Mycobacterium
RGQELDPAD

SEQ ID NO: 1184766 - protein, 7 aa, Mycobacterium
RGQGKST

SEQ ID NO: 1184767 - protein, 7 aa, Mycobacterium
RGQISPE

SEQ ID NO: 1184768 - protein, 6 aa, Mycobacterium
RGQLDS

SEQ ID NO: 1184769 - protein, 9 aa, Mycobacterium
RGQRCSSDP

SEQ ID NO: 1184770 - protein, 9 aa, Mycobacterium
RGRADGDDL

SEQ ID NO: 1184771 - protein, 5 aa, Mycobacterium
RGRAE

SEQ ID NO: 1184772 - protein, 9 aa, Mycobacterium
RGRGNDDPD

SEQ ID NO: 1184773 - protein, 6 aa, Mycobacterium
RGRKTG

SEQ ID NO: 1184774 - protein, 5 aa, Mycobacterium
RGRQH

SEQ ID NO: 1184775 - protein, 6 aa, Mycobacterium
RGRQLT

SEQ ID NO: 1184776 - protein, 5 aa, Mycobacterium
RGRTG

SEQ ID NO: 1184777 - protein, 7 aa, Mycobacterium
RGRTPGA

SEQ ID NO: 1184778 - protein, 13 aa, Mycobacterium
RGSAQAPETANPV

SEQ ID NO: 1184779 - protein, 6 aa, Mycobacterium
RGSEMA

SEQ ID NO: 1184780 - protein, 4 aa, Mycobacterium
RGSG

SEQ ID NO: 1184781 - protein, 10 aa, Mycobacterium
RGSGQSVHPG

SEQ ID NO: 1184782 - protein, 7 aa, Mycobacterium
RGTCPEC

SEQ ID NO: 1184783 - protein, 45 aa, Mycobacterium
RGTGYAAGRGDRRCTERRQRVRRGRRAPSDHSQRSSAVDSGAKIG

SEQ ID NO: 1184784 - protein, 16 aa, Mycobacterium
RGTLTEGKPDPDTGLP

SEQ ID NO: 1184785 - protein, 7 aa, Mycobacterium
RGTNEGG

SEQ ID NO: 1184786 - protein, 7 aa, Mycobacterium
RGTPRAA

SEQ ID NO: 1184787 - protein, 121 aa, Mycobacterium
RGVAAGPAKRAAKKAPAKKTAAKKTTAAAKKTAPAKKSTAAAKKTAPAKKTAAKKTTAAAKKTAPAKKSTAAAKKTAPAKKAATKAPAKKAAAKAPAKKATAAKKTASKAPARKAPAKKGR

SEQ ID NO: 1184788 - protein, 13 aa, Mycobacterium
RGVDRASADSVAG

SEQ ID NO: 1184789 - protein, 10 aa, Mycobacterium
RGVEGGSGGR

SEQ ID NO: 1184790 - protein, 5 aa, Mycobacterium
RGVGA

SEQ ID NO: 1184791 - protein, 6 aa, Mycobacterium
RGVPTV

SEQ ID NO: 1184792 - protein, 8 aa, Mycobacterium
RGWRTDSI

SEQ ID NO: 1184793 - protein, 5 aa, Mycobacterium
RGYEA

SEQ ID NO: 1184794 - protein, 8 aa, Mycobacterium
RGYPGTGL

SEQ ID NO: 1184795 - protein, 10 aa, Mycobacterium
RGYRGRPDLT

SEQ ID NO: 1184796 - protein, 10 aa, Mycobacterium
RGYTDDEAEG

SEQ ID NO: 1184797 - protein, 7 aa, Mycobacterium
RHADTAE

SEQ ID NO: 1184798 - protein, 8 aa, Mycobacterium
RHAGDRPV

SEQ ID NO: 1184799 - protein, 6 aa, Mycobacterium
RHAQQA

SEQ ID NO: 1184800 - protein, 14 aa, Mycobacterium
RHDAGEPDAQPPQD

SEQ ID NO: 1184801 - protein, 23 aa, Mycobacterium
RHEARGRSTTSPIARVADLITGR

SEQ ID NO: 1184802 - protein, 21 aa, Mycobacterium
RHEPLDPREVRDGRPPEDPDG

SEQ ID NO: 1184803 - protein, 4 aa, Mycobacterium
RHGD

SEQ ID NO: 1184804 - protein, 5 aa, Mycobacterium
RHGGE

SEQ ID NO: 1184805 - protein, 13 aa, Mycobacterium
RHGPGDDPTRVGA

SEQ ID NO: 1184806 - protein, 22 aa, Mycobacterium
RHGRGGGAEGVGRGRPARSEHD

SEQ ID NO: 1184807 - protein, 5 aa, Mycobacterium
RHHGT

SEQ ID NO: 1184808 - protein, 4 aa, Mycobacterium
RHIT

SEQ ID NO: 1184809 - protein, 8 aa, Mycobacterium
RHMDSGGG

SEQ ID NO: 1184810 - protein, 8 aa, Mycobacterium
RHNNPQNR

SEQ ID NO: 1184811 - protein, 7 aa, Mycobacterium
RHPDEPQ

SEQ ID NO: 1184812 - protein, 26 aa, Mycobacterium
RHPDSRGVCGKGASHNAVKGGRRDYP

SEQ ID NO: 1184813 - protein, 13 aa, Mycobacterium
RHPKSSQSGSRRT

SEQ ID NO: 1184814 - protein, 8 aa, Mycobacterium
RHPSETDE

SEQ ID NO: 1184815 - protein, 10 aa, Mycobacterium
RHPSVGEVRG

SEQ ID NO: 1184816 - protein, 13 aa, Mycobacterium
RHQGSHDTSPEDR

SEQ ID NO: 1184817 - protein, 8 aa, Mycobacterium
RHRAGSLA

SEQ ID NO: 1184818 - protein, 9 aa, Mycobacterium
RHRRQPARA

SEQ ID NO: 1184819 - protein, 13 aa, Mycobacterium
RHSRGDAERESRY

SEQ ID NO: 1184820 - protein, 6 aa, Mycobacterium
RHSTEQ

SEQ ID NO: 1184821 - protein, 6 aa, Mycobacterium
RHTDAG

SEQ ID NO: 1184822 - protein, 6 aa, Mycobacterium
RHTDAQ

SEQ ID NO: 1184823 - protein, 14 aa, Mycobacterium
RIGPPNSQPHQGGN

SEQ ID NO: 1184824 - protein, 12 aa, Mycobacterium
RIPADGQGRMDP

SEQ ID NO: 1184825 - protein, 12 aa, Mycobacterium
RIPTGLGTEPGE

SEQ ID NO: 1184826 - protein, 15 aa, Mycobacterium
RITRRDADGTRTVAK

SEQ ID NO: 1184827 - protein, 4 aa, Mycobacterium
RITT

SEQ ID NO: 1184828 - protein, 4 aa, Mycobacterium
RIVS

SEQ ID NO: 1184829 - protein, 9 aa, Mycobacterium
RKAAGDRLA

SEQ ID NO: 1184830 - protein, 17 aa, Mycobacterium
RKAAGERLTDARQLGPR

SEQ ID NO: 1184831 - protein, 25 aa, Mycobacterium
RKAAGERLTDARQLGPRHTLTGERV

SEQ ID NO: 1184832 - protein, 7 aa, Mycobacterium
RKDHESN

SEQ ID NO: 1184833 - protein, 5 aa, Mycobacterium
RKELR

SEQ ID NO: 1184834 - protein, 9 aa, Mycobacterium
RKGGDGLGG

SEQ ID NO: 1184835 - protein, 8 aa, Mycobacterium
RKGPLAAP

SEQ ID NO: 1184836 - protein, 11 aa, Mycobacterium
RKHAANNPKAH

SEQ ID NO: 1184837 - protein, 10 aa, Mycobacterium
RKKQEERAEL

SEQ ID NO: 1184838 - protein, 20 aa, Mycobacterium
RKPASTSVAPPGAESPEQEL

SEQ ID NO: 1184839 - protein, 8 aa, Mycobacterium
RKPDACER

SEQ ID NO: 1184840 - protein, 6 aa, Mycobacterium
RKPDGM

SEQ ID NO: 1184841 - protein, 6 aa, Mycobacterium
RKQPAS

SEQ ID NO: 1184842 - protein, 9 aa, Mycobacterium
RKRGYGTAT

SEQ ID NO: 1184843 - protein, 5 aa, Mycobacterium
RKRHP

SEQ ID NO: 1184844 - protein, 6 aa, Mycobacterium
RKRRQP

SEQ ID NO: 1184845 - protein, 7 aa, Mycobacterium
RKRRQPV

SEQ ID NO: 1184846 - protein, 20 aa, Mycobacterium
RKSEDVRTSYSADVAGKSLP

SEQ ID NO: 1184847 - protein, 5 aa, Mycobacterium
RKSLT

SEQ ID NO: 1184848 - protein, 17 aa, Mycobacterium
RKTAGDRLTDARQLGPR

SEQ ID NO: 1184849 - protein, 7 aa, Mycobacterium
RKTNRSM

SEQ ID NO: 1184850 - protein, 9 aa, Mycobacterium
RKTSDSDLA

SEQ ID NO: 1184851 - protein, 7 aa, Mycobacterium
RKTSVTA

SEQ ID NO: 1184852 - protein, 22 aa, Mycobacterium
RLADSEKALADSQTAIDATQQR

SEQ ID NO: 1184853 - protein, 7 aa, Mycobacterium
RLAPPQQ

SEQ ID NO: 1184854 - protein, 11 aa, Mycobacterium
RLATDTPDEVD

SEQ ID NO: 1184855 - protein, 7 aa, Mycobacterium
RLATEGA

SEQ ID NO: 1184856 - protein, 9 aa, Mycobacterium
RLDAQGRRL

SEQ ID NO: 1184857 - protein, 6 aa, Mycobacterium
RLDEGR

SEQ ID NO: 1184858 - protein, 5 aa, Mycobacterium
RLDER

SEQ ID NO: 1184859 - protein, 9 aa, Mycobacterium
RLDPATPPH

SEQ ID NO: 1184860 - protein, 7 aa, Mycobacterium
RLDPERG

SEQ ID NO: 1184861 - protein, 6 aa, Mycobacterium
RLEPDP

SEQ ID NO: 1184862 - protein, 6 aa, Mycobacterium
RLEPEN

SEQ ID NO: 1184863 - protein, 13 aa, Mycobacterium
RLGEDGATDEDYR

SEQ ID NO: 1184864 - protein, 7 aa, Mycobacterium
RLGEGAI

SEQ ID NO: 1184865 - protein, 9 aa, Mycobacterium
RLGNGKADY

SEQ ID NO: 1184866 - protein, 6 aa, Mycobacterium
RLGPDL

SEQ ID NO: 1184867 - protein, 4 aa, Mycobacterium
RLGR

SEQ ID NO: 1184868 - protein, 14 aa, Mycobacterium
RLGRRSRKGAPDTF

SEQ ID NO: 1184869 - protein, 6 aa, Mycobacterium
RLGSRG

SEQ ID NO: 1184870 - protein, 6 aa, Mycobacterium
RLKPSD

SEQ ID NO: 1184871 - protein, 5 aa, Mycobacterium
RLPEA

SEQ ID NO: 1184872 - protein, 7 aa, Mycobacterium
RLPGGGF

SEQ ID NO: 1184873 - protein, 9 aa, Mycobacterium
RLPGPRPEF

SEQ ID NO: 1184874 - protein, 8 aa, Mycobacterium
RLPKTGSY

SEQ ID NO: 1184875 - protein, 11 aa, Mycobacterium
RLPRYGRRPQD

SEQ ID NO: 1184876 - protein, 5 aa, Mycobacterium
RLPTE

SEQ ID NO: 1184877 - protein, 9 aa, Mycobacterium
RLPTQDAKG

SEQ ID NO: 1184878 - protein, 5 aa, Mycobacterium
RLQAQ

SEQ ID NO: 1184879 - protein, 6 aa, Mycobacterium
RLRAGN

SEQ ID NO: 1184880 - protein, 7 aa, Mycobacterium
RLRDPRQ

SEQ ID NO: 1184881 - protein, 23 aa, Mycobacterium
RLRGETGNSAIDGYQSDDPDRVD

SEQ ID NO: 1184882 - protein, 8 aa, Mycobacterium
RLRGNDSD

SEQ ID NO: 1184883 - protein, 7 aa, Mycobacterium
RLSDADD

SEQ ID NO: 1184884 - protein, 9 aa, Mycobacterium
RLSDGQRGH

SEQ ID NO: 1184885 - protein, 5 aa, Mycobacterium
RLSGE

SEQ ID NO: 1184886 - protein, 12 aa, Mycobacterium
RLSPTTAPPGSP

SEQ ID NO: 1184887 - protein, 8 aa, Mycobacterium
RLTADQKR

SEQ ID NO: 1184888 - protein, 5 aa, Mycobacterium
RLTGR

SEQ ID NO: 1184889 - protein, 5 aa, Mycobacterium
RLTPD

SEQ ID NO: 1184890 - protein, 5 aa, Mycobacterium
RLTPQ

SEQ ID NO: 1184891 - protein, 9 aa, Mycobacterium
RLTRGEPVE

SEQ ID NO: 1184892 - protein, 8 aa, Mycobacterium
RMPSAESD

SEQ ID NO: 1184893 - protein, 12 aa, Mycobacterium
RMTTGAAQPQSC

SEQ ID NO: 1184894 - protein, 8 aa, Mycobacterium
RNADKAAS

SEQ ID NO: 1184895 - protein, 9 aa, Mycobacterium
RNAKAAVEE

SEQ ID NO: 1184896 - protein, 8 aa, Mycobacterium
RNAPAAAI

SEQ ID NO: 1184897 - protein, 14 aa, Mycobacterium
RNDDPLAAAEADGA

SEQ ID NO: 1184898 - protein, 8 aa, Mycobacterium
RNEPDLDD

SEQ ID NO: 1184899 - protein, 8 aa, Mycobacterium
RNESDEPA

SEQ ID NO: 1184900 - protein, 8 aa, Mycobacterium
RNETTGRA

SEQ ID NO: 1184901 - protein, 8 aa, Mycobacterium
RNGGEACT

SEQ ID NO: 1184902 - protein, 9 aa, Mycobacterium
RNGGEACTA

SEQ ID NO: 1184903 - protein, 5 aa, Mycobacterium
RNGID

SEQ ID NO: 1184904 - protein, 8 aa, Mycobacterium
RNGNGGPT

SEQ ID NO: 1184905 - protein, 8 aa, Mycobacterium
RNGPTKTC

SEQ ID NO: 1184906 - protein, 10 aa, Mycobacterium
RNGPTSARGL

SEQ ID NO: 1184907 - protein, 8 aa, Mycobacterium
RNGQPDTD

SEQ ID NO: 1184908 - protein, 7 aa, Mycobacterium
RNNRDLG

SEQ ID NO: 1184909 - protein, 10 aa, Mycobacterium
RNPDGPHEGV

SEQ ID NO: 1184910 - protein, 6 aa, Mycobacterium
RNPGEV

SEQ ID NO: 1184911 - protein, 8 aa, Mycobacterium
RNPSVTPE

SEQ ID NO: 1184912 - protein, 5 aa, Mycobacterium
RNPTR

SEQ ID NO: 1184913 - protein, 7 aa, Mycobacterium
RNQSAGT

SEQ ID NO: 1184914 - protein, 15 aa, Mycobacterium
RNQSNLKSRDQASHK

SEQ ID NO: 1184915 - protein, 7 aa, Mycobacterium
RNRADID

SEQ ID NO: 1184916 - protein, 8 aa, Mycobacterium
RNRDDGVT

SEQ ID NO: 1184917 - protein, 5 aa, Mycobacterium
RNRGR

SEQ ID NO: 1184918 - protein, 5 aa, Mycobacterium
RNRPN

SEQ ID NO: 1184919 - protein, 13 aa, Mycobacterium
RNRPSGEDSTDDD

SEQ ID NO: 1184920 - protein, 10 aa, Mycobacterium
RNRTSRSRSI

SEQ ID NO: 1184921 - protein, 8 aa, Mycobacterium
RNSPNRFE

SEQ ID NO: 1184922 - protein, 21 aa, Mycobacterium
RNSRTGPGGSDYDRPETIEET

SEQ ID NO: 1184923 - protein, 9 aa, Mycobacterium
RNSRTQQMA

SEQ ID NO: 1184924 - protein, 15 aa, Mycobacterium
RNTGAGADGRDVQDV

SEQ ID NO: 1184925 - protein, 10 aa, Mycobacterium
RNTGGAPLEQ

SEQ ID NO: 1184926 - protein, 7 aa, Mycobacterium
RNTGRFS

SEQ ID NO: 1184927 - protein, 4 aa, Mycobacterium
RNTV

SEQ ID NO: 1184928 - protein, 4 aa, Mycobacterium
RNVG

SEQ ID NO: 1184929 - protein, 11 aa, Mycobacterium
RPADSSNEARI

SEQ ID NO: 1184930 - protein, 13 aa, Mycobacterium
RPAEHGPDDPGGV

SEQ ID NO: 1184931 - protein, 7 aa, Mycobacterium
RPAGDGR

SEQ ID NO: 1184932 - protein, 4 aa, Mycobacterium
RPAP

SEQ ID NO: 1184933 - protein, 17 aa, Mycobacterium
RPAPAGRTAGRKGAVEA

SEQ ID NO: 1184934 - protein, 8 aa, Mycobacterium
RPAPARLT

SEQ ID NO: 1184935 - protein, 8 aa, Mycobacterium
RPASSKDT

SEQ ID NO: 1184936 - protein, 8 aa, Mycobacterium
RPASSRDT

SEQ ID NO: 1184937 - protein, 4 aa, Mycobacterium
RPAT

SEQ ID NO: 1184938 - protein, 25 aa, Mycobacterium
RPATGDVSARARAGHDAAADAATEA

SEQ ID NO: 1184939 - protein, 13 aa, Mycobacterium
RPCGPAEGPYADY

SEQ ID NO: 1184940 - protein, 9 aa, Mycobacterium
RPDGLGSNH

SEQ ID NO: 1184941 - protein, 9 aa, Mycobacterium
RPDRDPRSC

SEQ ID NO: 1184942 - protein, 13 aa, Mycobacterium
RPDRHNAFSTGAR

SEQ ID NO: 1184943 - protein, 9 aa, Mycobacterium
RPEETAQAL

SEQ ID NO: 1184944 - protein, 4 aa, Mycobacterium
RPEF

SEQ ID NO: 1184945 - protein, 6 aa, Mycobacterium
RPEPGQ

SEQ ID NO: 1184946 - protein, 5 aa, Mycobacterium
RPETA

SEQ ID NO: 1184947 - protein, 8 aa, Mycobacterium
RPETTEDA

SEQ ID NO: 1184948 - protein, 6 aa, Mycobacterium
RPGDHL

SEQ ID NO: 1184949 - protein, 4 aa, Mycobacterium
RPGE

SEQ ID NO: 1184950 - protein, 4 aa, Mycobacterium
RPGF

SEQ ID NO: 1184951 - protein, 6 aa, Mycobacterium
RPGFHP

SEQ ID NO: 1184952 - protein, 8 aa, Mycobacterium
RPGHGKST

SEQ ID NO: 1184953 - protein, 22 aa, Mycobacterium
RPGLPGDWPEGYDDAERPYTPA

SEQ ID NO: 1184954 - protein, 11 aa, Mycobacterium
RPGPITSAADQ

SEQ ID NO: 1184955 - protein, 5 aa, Mycobacterium
RPGPV

SEQ ID NO: 1184956 - protein, 5 aa, Mycobacterium
RPGRL

SEQ ID NO: 1184957 - protein, 12 aa, Mycobacterium
RPGSGLSDPHPY

SEQ ID NO: 1184958 - protein, 5 aa, Mycobacterium
RPGSP

SEQ ID NO: 1184959 - protein, 5 aa, Mycobacterium
RPGTT

SEQ ID NO: 1184960 - protein, 11 aa, Mycobacterium
RPHQRGAGGEV

SEQ ID NO: 1184961 - protein, 14 aa, Mycobacterium
RPIPATSAGTAGEA

SEQ ID NO: 1184962 - protein, 4 aa, Mycobacterium
RPIT

SEQ ID NO: 1184963 - protein, 8 aa, Mycobacterium
RPKGGIGT

SEQ ID NO: 1184964 - protein, 10 aa, Mycobacterium
RPKRGATPRE

SEQ ID NO: 1184965 - protein, 10 aa, Mycobacterium
RPLPEPGAGE

SEQ ID NO: 1184966 - protein, 6 aa, Mycobacterium
RPLSAT

SEQ ID NO: 1184967 - protein, 11 aa, Mycobacterium
RPLTASYNGYG

SEQ ID NO: 1184968 - protein, 10 aa, Mycobacterium
RPNDERRNRS

SEQ ID NO: 1184969 - protein, 11 aa, Mycobacterium
RPNDERRNRSL

SEQ ID NO: 1184970 - protein, 6 aa, Mycobacterium
RPNEVT

SEQ ID NO: 1184971 - protein, 8 aa, Mycobacterium
RPNGPGWA

SEQ ID NO: 1184972 - protein, 9 aa, Mycobacterium
RPNRRAPKG

SEQ ID NO: 1184973 - protein, 10 aa, Mycobacterium
RPNYGGPIGE

SEQ ID NO: 1184974 - protein, 7 aa, Mycobacterium
RPPDGAP

SEQ ID NO: 1184975 - protein, 11 aa, Mycobacterium
RPPGTSDNRDR

SEQ ID NO: 1184976 - protein, 20 aa, Mycobacterium
RPPKAPRGTRPARKSARTAS

SEQ ID NO: 1184977 - protein, 10 aa, Mycobacterium
RPPRTPADRH

SEQ ID NO: 1184978 - protein, 6 aa, Mycobacterium
RPPVSC

SEQ ID NO: 1184979 - protein, 6 aa, Mycobacterium
RPQERF

SEQ ID NO: 1184980 - protein, 6 aa, Mycobacterium
RPQPGV

SEQ ID NO: 1184981 - protein, 10 aa, Mycobacterium
RPQVGTDGAP

SEQ ID NO: 1184982 - protein, 4 aa, Mycobacterium
RPRI

SEQ ID NO: 1184983 - protein, 5 aa, Mycobacterium
RPRKS

SEQ ID NO: 1184984 - protein, 8 aa, Mycobacterium
RPRRGDLT

SEQ ID NO: 1184985 - protein, 7 aa, Mycobacterium
RPRTIPA

SEQ ID NO: 1184986 - protein, 20 aa, Mycobacterium
RPSNPGCRGRPSCASGPRRP

SEQ ID NO: 1184987 - protein, 7 aa, Mycobacterium
RPSPTSL

SEQ ID NO: 1184988 - protein, 7 aa, Mycobacterium
RPSSGQA

SEQ ID NO: 1184989 - protein, 8 aa, Mycobacterium
RPTAQAKA

SEQ ID NO: 1184990 - protein, 13 aa, Mycobacterium
RPTEARNGPTDPA

SEQ ID NO: 1184991 - protein, 5 aa, Mycobacterium
RPTPF

SEQ ID NO: 1184992 - protein, 10 aa, Mycobacterium
RPTSPDPDGP

SEQ ID NO: 1184993 - protein, 20 aa, Mycobacterium
RPVGGASAVRAGDPIAQADA

SEQ ID NO: 1184994 - protein, 18 aa, Mycobacterium
RPVGQARGRGERADQRGV

SEQ ID NO: 1184995 - protein, 11 aa, Mycobacterium
RPVNPRPRLAT

SEQ ID NO: 1184996 - protein, 6 aa, Mycobacterium
RPVSPG

SEQ ID NO: 1184997 - protein, 8 aa, Mycobacterium
RPWPARGA

SEQ ID NO: 1184998 - protein, 7 aa, Mycobacterium
RPYAPGS

SEQ ID NO: 1184999 - protein, 6 aa, Mycobacterium
RQAFDD

SEQ ID NO: 1185000 - protein, 10 aa, Mycobacterium
RQAFGSNKRR

SEQ ID NO: 1185001 - protein, 4 aa, Mycobacterium
RQAG

SEQ ID NO: 1185002 - protein, 12 aa, Mycobacterium
RQAPAGSGNRPA

SEQ ID NO: 1185003 - protein, 5 aa, Mycobacterium
RQAQA

SEQ ID NO: 1185004 - protein, 9 aa, Mycobacterium
RQAQNYASE

SEQ ID NO: 1185005 - protein, 4 aa, Mycobacterium
RQAR

SEQ ID NO: 1185006 - protein, 13 aa, Mycobacterium
RQASPDGVPGSDV

SEQ ID NO: 1185007 - protein, 12 aa, Mycobacterium
RQASSEAGYNAS

SEQ ID NO: 1185008 - protein, 7 aa, Mycobacterium
RQDISDD

SEQ ID NO: 1185009 - protein, 10 aa, Mycobacterium
RQEDNEGRKV

SEQ ID NO: 1185010 - protein, 12 aa, Mycobacterium
RQGGYTGRGDDP

SEQ ID NO: 1185011 - protein, 14 aa, Mycobacterium
RQGPLEAKADDFGR

SEQ ID NO: 1185012 - protein, 8 aa, Mycobacterium
RQGRAQRR

SEQ ID NO: 1185013 - protein, 6 aa, Mycobacterium
RQHAAR

SEQ ID NO: 1185014 - protein, 16 aa, Mycobacterium
RQLGSGAIDQSGPNAG

SEQ ID NO: 1185015 - protein, 17 aa, Mycobacterium
RQPDGSVVSSRDTGPGL

SEQ ID NO: 1185016 - protein, 9 aa, Mycobacterium
RQPGNPAAQ

SEQ ID NO: 1185017 - protein, 6 aa, Mycobacterium
RQPHSV

SEQ ID NO: 1185018 - protein, 12 aa, Mycobacterium
RQPPHDAAAEQA

SEQ ID NO: 1185019 - protein, 6 aa, Mycobacterium
RQPPHT

SEQ ID NO: 1185020 - protein, 9 aa, Mycobacterium
RQPRPDQDA

SEQ ID NO: 1185021 - protein, 21 aa, Mycobacterium
RQPSTRRNRKTKTTFDDPGQA

SEQ ID NO: 1185022 - protein, 9 aa, Mycobacterium
RQPTRAIGT

SEQ ID NO: 1185023 - protein, 4 aa, Mycobacterium
RQQD

SEQ ID NO: 1185024 - protein, 35 aa, Mycobacterium
RQQPSTDRVRDADPRAASPGPPPPETMPPGRSRGT

SEQ ID NO: 1185025 - protein, 9 aa, Mycobacterium
RQRANGRWE

SEQ ID NO: 1185026 - protein, 7 aa, Mycobacterium
RQRDGKA

SEQ ID NO: 1185027 - protein, 7 aa, Mycobacterium
RQRNGKA

SEQ ID NO: 1185028 - protein, 26 aa, Mycobacterium
RQRPQRLQRQDPPRLRGTARRHEARR

SEQ ID NO: 1185029 - protein, 8 aa, Mycobacterium
RQRRRPST

SEQ ID NO: 1185030 - protein, 6 aa, Mycobacterium
RQRSAF

SEQ ID NO: 1185031 - protein, 4 aa, Mycobacterium
RQRT

SEQ ID NO: 1185032 - protein, 6 aa, Mycobacterium
RQRTGV

SEQ ID NO: 1185033 - protein, 6 aa, Mycobacterium
RQSGTD

SEQ ID NO: 1185034 - protein, 5 aa, Mycobacterium
RQSIG

SEQ ID NO: 1185035 - protein, 6 aa, Mycobacterium
RQTGTA

SEQ ID NO: 1185036 - protein, 22 aa, Mycobacterium
RQTNGPPMTAEAQAKRDTETQA

SEQ ID NO: 1185037 - protein, 9 aa, Mycobacterium
RQTNPDCPD

SEQ ID NO: 1185038 - protein, 6 aa, Mycobacterium
RQTRRR

SEQ ID NO: 1185039 - protein, 10 aa, Mycobacterium
RQTSTRGQAF

SEQ ID NO: 1185040 - protein, 9 aa, Mycobacterium
RQVTPGAGL

SEQ ID NO: 1185041 - protein, 4 aa, Mycobacterium
RRAA

SEQ ID NO: 1185042 - protein, 5 aa, Mycobacterium
RRADE

SEQ ID NO: 1185043 - protein, 12 aa, Mycobacterium
RRAEGASGPEVV

SEQ ID NO: 1185044 - protein, 9 aa, Mycobacterium
RRAETLDGQ

SEQ ID NO: 1185045 - protein, 6 aa, Mycobacterium
RRAGAD

SEQ ID NO: 1185046 - protein, 10 aa, Mycobacterium
RRAGDGGTRQ

SEQ ID NO: 1185047 - protein, 8 aa, Mycobacterium
RRAGEEGL

SEQ ID NO: 1185048 - protein, 4 aa, Mycobacterium
RRAI

SEQ ID NO: 1185049 - protein, 15 aa, Mycobacterium
RRAPENKFPAAVDDG

SEQ ID NO: 1185050 - protein, 13 aa, Mycobacterium
RRASQASRSNPEA

SEQ ID NO: 1185051 - protein, 20 aa, Mycobacterium
RRATEAASGMPKRKRGRGLA

SEQ ID NO: 1185052 - protein, 8 aa, Mycobacterium
RRATRGCT

SEQ ID NO: 1185053 - protein, 7 aa, Mycobacterium
RRDAAAE

SEQ ID NO: 1185054 - protein, 6 aa, Mycobacterium
RRDDGR

SEQ ID NO: 1185055 - protein, 9 aa, Mycobacterium
RRDGSRNGV

SEQ ID NO: 1185056 - protein, 8 aa, Mycobacterium
RRDLAGDD

SEQ ID NO: 1185057 - protein, 4 aa, Mycobacterium
RRDP

SEQ ID NO: 1185058 - protein, 6 aa, Mycobacterium
RRDRHG

SEQ ID NO: 1185059 - protein, 15 aa, Mycobacterium
RRDTAAKGDDRGAKD

SEQ ID NO: 1185060 - protein, 35 aa, Mycobacterium
RREDDADAAPGARVDEAAAQHPPRAGRAGKPRLRQ

SEQ ID NO: 1185061 - protein, 22 aa, Mycobacterium
RREEDSAGRAIPTEYRYEDLVA

SEQ ID NO: 1185062 - protein, 14 aa, Mycobacterium
RREEPLKATAADVE

SEQ ID NO: 1185063 - protein, 4 aa, Mycobacterium
RREG

SEQ ID NO: 1185064 - protein, 12 aa, Mycobacterium
RREIGRGDALRT

SEQ ID NO: 1185065 - protein, 11 aa, Mycobacterium
RREKEDVTEVR

SEQ ID NO: 1185066 - protein, 6 aa, Mycobacterium
RRELQD

SEQ ID NO: 1185067 - protein, 8 aa, Mycobacterium
RRENPQDD

SEQ ID NO: 1185068 - protein, 4 aa, Mycobacterium
RREP

SEQ ID NO: 1185069 - protein, 11 aa, Mycobacterium
RREQVRDERAQ

SEQ ID NO: 1185070 - protein, 6 aa, Mycobacterium
RREVGP

SEQ ID NO: 1185071 - protein, 5 aa, Mycobacterium
RRFTP

SEQ ID NO: 1185072 - protein, 13 aa, Mycobacterium
RRGAGHVGAGGDL

SEQ ID NO: 1185073 - protein, 5 aa, Mycobacterium
RRGAT

SEQ ID NO: 1185074 - protein, 7 aa, Mycobacterium
RRGDPQA

SEQ ID NO: 1185075 - protein, 4 aa, Mycobacterium
RRGE

SEQ ID NO: 1185076 - protein, 22 aa, Mycobacterium
RRGEPTAAVPAVPAAADGAEAP

SEQ ID NO: 1185077 - protein, 26 aa, Mycobacterium
RRGGRNFQQTHDSAVARESLRLWEEI

SEQ ID NO: 1185078 - protein, 13 aa, Mycobacterium
RRGLDAGASTGGF

SEQ ID NO: 1185079 - protein, 13 aa, Mycobacterium
RRGQAARRAAEAK

SEQ ID NO: 1185080 - protein, 9 aa, Mycobacterium
RRGRGQRRT

SEQ ID NO: 1185081 - protein, 8 aa, Mycobacterium
RRKAPRDD

SEQ ID NO: 1185082 - protein, 4 aa, Mycobacterium
RRKG

SEQ ID NO: 1185083 - protein, 4 aa, Mycobacterium
RRKT

SEQ ID NO: 1185084 - protein, 8 aa, Mycobacterium
RRLDPRQA

SEQ ID NO: 1185085 - protein, 6 aa, Mycobacterium
RRLKQR

SEQ ID NO: 1185086 - protein, 8 aa, Mycobacterium
RRLPTPGV

SEQ ID NO: 1185087 - protein, 10 aa, Mycobacterium
RRLRSGPIRG

SEQ ID NO: 1185088 - protein, 9 aa, Mycobacterium
RRNGPKATS

SEQ ID NO: 1185089 - protein, 13 aa, Mycobacterium
RRNRATSRGTRRR

SEQ ID NO: 1185090 - protein, 7 aa, Mycobacterium
RRPAAGV

SEQ ID NO: 1185091 - protein, 9 aa, Mycobacterium
RRPDERDRR

SEQ ID NO: 1185092 - protein, 7 aa, Mycobacterium
RRPDVVD

SEQ ID NO: 1185093 - protein, 10 aa, Mycobacterium
RRPGGAETIA

SEQ ID NO: 1185094 - protein, 12 aa, Mycobacterium
RRPGGSRSPDLG

SEQ ID NO: 1185095 - protein, 4 aa, Mycobacterium
RRPP

SEQ ID NO: 1185096 - protein, 7 aa, Mycobacterium
RRPPAEL

SEQ ID NO: 1185097 - protein, 4 aa, Mycobacterium
RRQP

SEQ ID NO: 1185098 - protein, 14 aa, Mycobacterium
RRQVPDKRAARAGF

SEQ ID NO: 1185099 - protein, 12 aa, Mycobacterium
RRQYDAATATVS

SEQ ID NO: 1185100 - protein, 11 aa, Mycobacterium
RRREKAATREL

SEQ ID NO: 1185101 - protein, 9 aa, Mycobacterium
RRRELSGGK

SEQ ID NO: 1185102 - protein, 9 aa, Mycobacterium
RRRESDTAL

SEQ ID NO: 1185103 - protein, 4 aa, Mycobacterium
RRRH

SEQ ID NO: 1185104 - protein, 6 aa, Mycobacterium
RRRPEA

SEQ ID NO: 1185105 - protein, 16 aa, Mycobacterium
RRRRIPGHERTRGASP

SEQ ID NO: 1185106 - protein, 9 aa, Mycobacterium
RRRRQSGLG

SEQ ID NO: 1185107 - protein, 4 aa, Mycobacterium
RRRS

SEQ ID NO: 1185108 - protein, 15 aa, Mycobacterium
RRRSEPTEEDRGFES

SEQ ID NO: 1185109 - protein, 10 aa, Mycobacterium
RRRSGQTTRT

SEQ ID NO: 1185110 - protein, 8 aa, Mycobacterium
RRRTGGLQ

SEQ ID NO: 1185111 - protein, 9 aa, Mycobacterium
RRRTKRDGW

SEQ ID NO: 1185112 - protein, 5 aa, Mycobacterium
RRRWP

SEQ ID NO: 1185113 - protein, 5 aa, Mycobacterium
RRSAA

SEQ ID NO: 1185114 - protein, 6 aa, Mycobacterium
RRSAVA

SEQ ID NO: 1185115 - protein, 19 aa, Mycobacterium
RRSDGSSVYSRHGTATYTS

SEQ ID NO: 1185116 - protein, 14 aa, Mycobacterium
RRSGAGEPIGHSGG

SEQ ID NO: 1185117 - protein, 11 aa, Mycobacterium
RRSPAAVTAHG

SEQ ID NO: 1185118 - protein, 9 aa, Mycobacterium
RRSSLGEQR

SEQ ID NO: 1185119 - protein, 5 aa, Mycobacterium
RRTAI

SEQ ID NO: 1185120 - protein, 5 aa, Mycobacterium
RRTDQ

SEQ ID NO: 1185121 - protein, 15 aa, Mycobacterium
RRTGRQRLKTPDYQR

SEQ ID NO: 1185122 - protein, 14 aa, Mycobacterium
RRTGSLDSAVQPDS

SEQ ID NO: 1185123 - protein, 5 aa, Mycobacterium
RRTPE

SEQ ID NO: 1185124 - protein, 5 aa, Mycobacterium
RRTPG

SEQ ID NO: 1185125 - protein, 20 aa, Mycobacterium
RRTSPVAGSQRTPPGRPRPC

SEQ ID NO: 1185126 - protein, 5 aa, Mycobacterium
RRTTD

SEQ ID NO: 1185127 - protein, 8 aa, Mycobacterium
RRTTPARA

SEQ ID NO: 1185128 - protein, 11 aa, Mycobacterium
RRTTRDSSLSA

SEQ ID NO: 1185129 - protein, 10 aa, Mycobacterium
RRVDPAPAPL

SEQ ID NO: 1185130 - protein, 6 aa, Mycobacterium
RRVPDR

SEQ ID NO: 1185131 - protein, 6 aa, Mycobacterium
RRVPGR

SEQ ID NO: 1185132 - protein, 6 aa, Mycobacterium
RRVRST

SEQ ID NO: 1185133 - protein, 11 aa, Mycobacterium
RRVTGATRADG

SEQ ID NO: 1185134 - protein, 30 aa, Mycobacterium
RRVTSTKRGRRGATADFRTSAQGSQALRGG

SEQ ID NO: 1185135 - protein, 5 aa, Mycobacterium
RRYGK

SEQ ID NO: 1185136 - protein, 12 aa, Mycobacterium
RRYTGRSSRGAE

SEQ ID NO: 1185137 - protein, 13 aa, Mycobacterium
RSAATHPLKDRQQ

SEQ ID NO: 1185138 - protein, 6 aa, Mycobacterium
RSADAD

SEQ ID NO: 1185139 - protein, 5 aa, Mycobacterium
RSADG

SEQ ID NO: 1185140 - protein, 4 aa, Mycobacterium
RSAE

SEQ ID NO: 1185141 - protein, 24 aa, Mycobacterium
RSAESAGAARSAESAADEEPDSDV

SEQ ID NO: 1185142 - protein, 22 aa, Mycobacterium
RSAGAIDDQPIGLEGSAPDGQP

SEQ ID NO: 1185143 - protein, 10 aa, Mycobacterium
RSAGGVASEL

SEQ ID NO: 1185144 - protein, 6 aa, Mycobacterium
RSAHNH

SEQ ID NO: 1185145 - protein, 11 aa, Mycobacterium
RSAREAAAGGV

SEQ ID NO: 1185146 - protein, 11 aa, Mycobacterium
RSARTRLGDGA

SEQ ID NO: 1185147 - protein, 16 aa, Mycobacterium
RSARYRREAGTPDVDT

SEQ ID NO: 1185148 - protein, 18 aa, Mycobacterium
RSATLPSATTDAATLSAT

SEQ ID NO: 1185149 - protein, 15 aa, Mycobacterium
RSAYQRARQRPAGTS

SEQ ID NO: 1185150 - protein, 9 aa, Mycobacterium
RSDAGAPTR

SEQ ID NO: 1185151 - protein, 4 aa, Mycobacterium
RSDL

SEQ ID NO: 1185152 - protein, 7 aa, Mycobacterium
RSDNAQH

SEQ ID NO: 1185153 - protein, 11 aa, Mycobacterium
RSDRTERGRDG

SEQ ID NO: 1185154 - protein, 7 aa, Mycobacterium
RSDSLRH

SEQ ID NO: 1185155 - protein, 28 aa, Mycobacterium
RSDTARRRREERVSNEPPPGPTESADDT

SEQ ID NO: 1185156 - protein, 7 aa, Mycobacterium
RSEARKG

SEQ ID NO: 1185157 - protein, 6 aa, Mycobacterium
RSEATD

SEQ ID NO: 1185158 - protein, 5 aa, Mycobacterium
RSEES

SEQ ID NO: 1185159 - protein, 13 aa, Mycobacterium
RSEGDLATIGNAD

SEQ ID NO: 1185160 - protein, 4 aa, Mycobacterium
RSEL

SEQ ID NO: 1185161 - protein, 5 aa, Mycobacterium
RSGAR

SEQ ID NO: 1185162 - protein, 12 aa, Mycobacterium
RSGEFDPAAAGM

SEQ ID NO: 1185163 - protein, 7 aa, Mycobacterium
RSGGAAR

SEQ ID NO: 1185164 - protein, 14 aa, Mycobacterium
RSGKTVDADAATSL

SEQ ID NO: 1185165 - protein, 6 aa, Mycobacterium
RSGPLR

SEQ ID NO: 1185166 - protein, 12 aa, Mycobacterium
RSGPVPATDGLG

SEQ ID NO: 1185167 - protein, 8 aa, Mycobacterium
RSGSGKST

SEQ ID NO: 1185168 - protein, 4 aa, Mycobacterium
RSGW

SEQ ID NO: 1185169 - protein, 6 aa, Mycobacterium
RSHPGV

SEQ ID NO: 1185170 - protein, 10 aa, Mycobacterium
RSIKAGDGVS

SEQ ID NO: 1185171 - protein, 8 aa, Mycobacterium
RSKAARKV

SEQ ID NO: 1185172 - protein, 13 aa, Mycobacterium
RSLPDDSQTDEYL

SEQ ID NO: 1185173 - protein, 9 aa, Mycobacterium
RSPGAPSAY

SEQ ID NO: 1185174 - protein, 8 aa, Mycobacterium
RSPGARAY

SEQ ID NO: 1185175 - protein, 61 aa, Mycobacterium
RSPGEAVEPRKVEDKPAKKAAKKAAKKTPAKKTPAKKAAKTAEPQPKTSANGRSQPGVKGR

SEQ ID NO: 1185176 - protein, 7 aa, Mycobacterium
RSPKTAE

SEQ ID NO: 1185177 - protein, 10 aa, Mycobacterium
RSPQQSNPSW

SEQ ID NO: 1185178 - protein, 11 aa, Mycobacterium
RSQQRAAAAWS

SEQ ID NO: 1185179 - protein, 5 aa, Mycobacterium
RSREP

SEQ ID NO: 1185180 - protein, 5 aa, Mycobacterium
RSRGL

SEQ ID NO: 1185181 - protein, 6 aa, Mycobacterium
RSRQAT

SEQ ID NO: 1185182 - protein, 9 aa, Mycobacterium
RSRRPGRSM

SEQ ID NO: 1185183 - protein, 32 aa, Mycobacterium
RSRSPRTQTVDGSPRRSRYHGGSSREPFVAPP

SEQ ID NO: 1185184 - protein, 14 aa, Mycobacterium
RSSELAADQDVEPI

SEQ ID NO: 1185185 - protein, 6 aa, Mycobacterium
RSSGGQ

SEQ ID NO: 1185186 - protein, 9 aa, Mycobacterium
RSSTAERMN

SEQ ID NO: 1185187 - protein, 21 aa, Mycobacterium
RSTAPSPPGVTPPDAAGEARA

SEQ ID NO: 1185188 - protein, 4 aa, Mycobacterium
RSTG

SEQ ID NO: 1185189 - protein, 15 aa, Mycobacterium
RSTGVADAQALGADG

SEQ ID NO: 1185190 - protein, 4 aa, Mycobacterium
RSTL

SEQ ID NO: 1185191 - protein, 10 aa, Mycobacterium
RSTPNPSSRA

SEQ ID NO: 1185192 - protein, 4 aa, Mycobacterium
RSTR

SEQ ID NO: 1185193 - protein, 16 aa, Mycobacterium
RSTTKHVKGRSADSSV

SEQ ID NO: 1185194 - protein, 5 aa, Mycobacterium
RSTVP

SEQ ID NO: 1185195 - protein, 19 aa, Mycobacterium
RSVGAQRALGRRGNAMTAT

SEQ ID NO: 1185196 - protein, 19 aa, Mycobacterium
RSVRGGSSFGSTDPRDHQF

SEQ ID NO: 1185197 - protein, 12 aa, Mycobacterium
RSVTVDGRPVSL

SEQ ID NO: 1185198 - protein, 5 aa, Mycobacterium
RTAAE

SEQ ID NO: 1185199 - protein, 7 aa, Mycobacterium
RTAARGH

SEQ ID NO: 1185200 - protein, 16 aa, Mycobacterium
RTAEKAAELEHRERRR

SEQ ID NO: 1185201 - protein, 4 aa, Mycobacterium
RTAK

SEQ ID NO: 1185202 - protein, 7 aa, Mycobacterium
RTAPVKA

SEQ ID NO: 1185203 - protein, 13 aa, Mycobacterium
RTAQDAARASHRA

SEQ ID NO: 1185204 - protein, 21 aa, Mycobacterium
RTARSAGTDNAVPSRRRSPRC

SEQ ID NO: 1185205 - protein, 10 aa, Mycobacterium
RTASHKPKVD

SEQ ID NO: 1185206 - protein, 10 aa, Mycobacterium
RTASPAEVPP

SEQ ID NO: 1185207 - protein, 6 aa, Mycobacterium
RTCRTP

SEQ ID NO: 1185208 - protein, 6 aa, Mycobacterium
RTCTKQ

SEQ ID NO: 1185209 - protein, 6 aa, Mycobacterium
RTDDRG

SEQ ID NO: 1185210 - protein, 41 aa, Mycobacterium
RTDPENRRPSFSAPSRMSSGSSGTSFGAPRPSPMRSGGGKK

SEQ ID NO: 1185211 - protein, 13 aa, Mycobacterium
RTDQGEYASPVST

SEQ ID NO: 1185212 - protein, 7 aa, Mycobacterium
RTDSDHN

SEQ ID NO: 1185213 - protein, 5 aa, Mycobacterium
RTDTA

SEQ ID NO: 1185214 - protein, 6 aa, Mycobacterium
RTEEGS

SEQ ID NO: 1185215 - protein, 7 aa, Mycobacterium
RTEGPGP

SEQ ID NO: 1185216 - protein, 6 aa, Mycobacterium
RTEGVR

SEQ ID NO: 1185217 - protein, 6 aa, Mycobacterium
RTEPEL

SEQ ID NO: 1185218 - protein, 7 aa, Mycobacterium
RTESADH

SEQ ID NO: 1185219 - protein, 8 aa, Mycobacterium
RTFETPDG

SEQ ID NO: 1185220 - protein, 7 aa, Mycobacterium
RTFTGAS

SEQ ID NO: 1185221 - protein, 5 aa, Mycobacterium
RTGAP

SEQ ID NO: 1185222 - protein, 8 aa, Mycobacterium
RTGAPLTA

SEQ ID NO: 1185223 - protein, 9 aa, Mycobacterium
RTGDDDTAR

SEQ ID NO: 1185224 - protein, 5 aa, Mycobacterium
RTGDL

SEQ ID NO: 1185225 - protein, 7 aa, Mycobacterium
RTGDPLA

SEQ ID NO: 1185226 - protein, 7 aa, Mycobacterium
RTGDQDV

SEQ ID NO: 1185227 - protein, 20 aa, Mycobacterium
RTGDRARITTAAGSAEAGVE

SEQ ID NO: 1185228 - protein, 7 aa, Mycobacterium
RTGEPPV

SEQ ID NO: 1185229 - protein, 24 aa, Mycobacterium
RTGESVREIGSEYRSSHAPLRGSG

SEQ ID NO: 1185230 - protein, 4 aa, Mycobacterium
RTGM

SEQ ID NO: 1185231 - protein, 6 aa, Mycobacterium
RTGPHS

SEQ ID NO: 1185232 - protein, 8 aa, Mycobacterium
RTGVGGGA

SEQ ID NO: 1185233 - protein, 7 aa, Mycobacterium
RTGVSDH

SEQ ID NO: 1185234 - protein, 5 aa, Mycobacterium
RTHPG

SEQ ID NO: 1185235 - protein, 5 aa, Mycobacterium
RTIAS

SEQ ID NO: 1185236 - protein, 8 aa, Mycobacterium
RTIASTST

SEQ ID NO: 1185237 - protein, 6 aa, Mycobacterium
RTLADS

SEQ ID NO: 1185238 - protein, 6 aa, Mycobacterium
RTLSTA

SEQ ID NO: 1185239 - protein, 12 aa, Mycobacterium
RTLSTDPDDPEV

SEQ ID NO: 1185240 - protein, 7 aa, Mycobacterium
RTPADEQ

SEQ ID NO: 1185241 - protein, 20 aa, Mycobacterium
RTPDAGLRASGSSELRDPTD

SEQ ID NO: 1185242 - protein, 5 aa, Mycobacterium
RTPDR

SEQ ID NO: 1185243 - protein, 15 aa, Mycobacterium
RTPDTPEGSLGPLGP

SEQ ID NO: 1185244 - protein, 17 aa, Mycobacterium
RTPETHQSAGLNPGGIE

SEQ ID NO: 1185245 - protein, 17 aa, Mycobacterium
RTPETLQSAGLNPGGIE

SEQ ID NO: 1185246 - protein, 6 aa, Mycobacterium
RTPKPH

SEQ ID NO: 1185247 - protein, 43 aa, Mycobacterium
RTPQPAPRLGEHTETYRRNSIPGRQAGGLAAGNPVSAQPTGAQ

SEQ ID NO: 1185248 - protein, 20 aa, Mycobacterium
RTPTPGASPARPSSFPSAGE

SEQ ID NO: 1185249 - protein, 6 aa, Mycobacterium
RTQLPT

SEQ ID NO: 1185250 - protein, 6 aa, Mycobacterium
RTRAEQ

SEQ ID NO: 1185251 - protein, 10 aa, Mycobacterium
RTRPKSHEGL

SEQ ID NO: 1185252 - protein, 5 aa, Mycobacterium
RTRQR

SEQ ID NO: 1185253 - protein, 8 aa, Mycobacterium
RTRTDDPA

SEQ ID NO: 1185254 - protein, 5 aa, Mycobacterium
RTRTI

SEQ ID NO: 1185255 - protein, 7 aa, Mycobacterium
RTSAEDG

SEQ ID NO: 1185256 - protein, 10 aa, Mycobacterium
RTSEGLPADI

SEQ ID NO: 1185257 - protein, 5 aa, Mycobacterium
RTSEH

SEQ ID NO: 1185258 - protein, 22 aa, Mycobacterium
RTSLSDQPKPPPQKPPKLGPPN

SEQ ID NO: 1185259 - protein, 4 aa, Mycobacterium
RTSM

SEQ ID NO: 1185260 - protein, 4 aa, Mycobacterium
RTSP

SEQ ID NO: 1185261 - protein, 18 aa, Mycobacterium
RTSQPNMADYTITRGNTD

SEQ ID NO: 1185262 - protein, 5 aa, Mycobacterium
RTTEQ

SEQ ID NO: 1185263 - protein, 5 aa, Mycobacterium
RTTGE

SEQ ID NO: 1185264 - protein, 10 aa, Mycobacterium
RTTGETHRNE

SEQ ID NO: 1185265 - protein, 4 aa, Mycobacterium
RTTN

SEQ ID NO: 1185266 - protein, 11 aa, Mycobacterium
RTTSDYPPTSM

SEQ ID NO: 1185267 - protein, 7 aa, Mycobacterium
RTVTRGE

SEQ ID NO: 1185268 - protein, 5 aa, Mycobacterium
RVADG

SEQ ID NO: 1185269 - protein, 5 aa, Mycobacterium
RVANG

SEQ ID NO: 1185270 - protein, 6 aa, Mycobacterium
RVAPDS

SEQ ID NO: 1185271 - protein, 12 aa, Mycobacterium
RVASPSGAPEFG

SEQ ID NO: 1185272 - protein, 6 aa, Mycobacterium
RVDGDR

SEQ ID NO: 1185273 - protein, 7 aa, Mycobacterium
RVDPTAA

SEQ ID NO: 1185274 - protein, 10 aa, Mycobacterium
RVEGLKREDV

SEQ ID NO: 1185275 - protein, 10 aa, Mycobacterium
RVEPQGSEAA

SEQ ID NO: 1185276 - protein, 10 aa, Mycobacterium
RVETGPDGYE

SEQ ID NO: 1185277 - protein, 6 aa, Mycobacterium
RVGARD

SEQ ID NO: 1185278 - protein, 6 aa, Mycobacterium
RVGEGR

SEQ ID NO: 1185279 - protein, 6 aa, Mycobacterium
RVGSTT

SEQ ID NO: 1185280 - protein, 15 aa, Mycobacterium
RVKTTQSDPANQKVP

SEQ ID NO: 1185281 - protein, 16 aa, Mycobacterium
RVPDGGPSLWAMWRQP

SEQ ID NO: 1185282 - protein, 7 aa, Mycobacterium
RVPPTRP

SEQ ID NO: 1185283 - protein, 5 aa, Mycobacterium
RVPQE

SEQ ID NO: 1185284 - protein, 7 aa, Mycobacterium
RVPRGTA

SEQ ID NO: 1185285 - protein, 12 aa, Mycobacterium
RVQPGKRPRSTM

SEQ ID NO: 1185286 - protein, 12 aa, Mycobacterium
RVRPETDRAGDL

SEQ ID NO: 1185287 - protein, 8 aa, Mycobacterium
RVRSDRTA

SEQ ID NO: 1185288 - protein, 12 aa, Mycobacterium
RVRSGRTEEPPL

SEQ ID NO: 1185289 - protein, 8 aa, Mycobacterium
RVRSNESV

SEQ ID NO: 1185290 - protein, 8 aa, Mycobacterium
RVSDGERW

SEQ ID NO: 1185291 - protein, 6 aa, Mycobacterium
RVSPKD

SEQ ID NO: 1185292 - protein, 7 aa, Mycobacterium
RVSPKDV

SEQ ID NO: 1185293 - protein, 9 aa, Mycobacterium
RVTAERTVP

SEQ ID NO: 1185294 - protein, 7 aa, Mycobacterium
RVTGTPD

SEQ ID NO: 1185295 - protein, 24 aa, Mycobacterium
RWGGQNRCQRRSGDRRPGAHARPD

SEQ ID NO: 1185296 - protein, 5 aa, Mycobacterium
RWPRA

SEQ ID NO: 1185297 - protein, 8 aa, Mycobacterium
RWRPRRGE

SEQ ID NO: 1185298 - protein, 11 aa, Mycobacterium
RWRSRRGREMR

SEQ ID NO: 1185299 - protein, 8 aa, Mycobacterium
RWSGPGGL

SEQ ID NO: 1185300 - protein, 16 aa, Mycobacterium
RWTPQWSDDQRAEGYA

SEQ ID NO: 1185301 - protein, 25 aa, Mycobacterium
RYAGPKPIDVGESSTAPTGSAAGPG

SEQ ID NO: 1185302 - protein, 9 aa, Mycobacterium
RYAKENDGG

SEQ ID NO: 1185303 - protein, 4 aa, Mycobacterium
RYGP

SEQ ID NO: 1185304 - protein, 7 aa, Mycobacterium
RYKDQGR

SEQ ID NO: 1185305 - protein, 23 aa, Mycobacterium
RYPEQAPADFDPAYAGERWDEDD

SEQ ID NO: 1185306 - protein, 5 aa, Mycobacterium
RYRRR

SEQ ID NO: 1185307 - protein, 8 aa, Mycobacterium
RYRTSDQR

SEQ ID NO: 1185308 - protein, 9 aa, Mycobacterium
RYTEDEPAV

SEQ ID NO: 1185309 - protein, 10 aa, Mycobacterium
SAAAAARDTG

SEQ ID NO: 1185310 - protein, 20 aa, Mycobacterium
SAAAPPDSAPRLGDGGEDRR

SEQ ID NO: 1185311 - protein, 7 aa, Mycobacterium
SAAAQAA

SEQ ID NO: 1185312 - protein, 8 aa, Mycobacterium
SAAAQAPF

SEQ ID NO: 1185313 - protein, 24 aa, Mycobacterium
SAAARYESVDQAGRDAIEQVALAG

SEQ ID NO: 1185314 - protein, 13 aa, Mycobacterium
SAADTRDRIDRAT

SEQ ID NO: 1185315 - protein, 5 aa, Mycobacterium
SAAGL

SEQ ID NO: 1185316 - protein, 9 aa, Mycobacterium
SAAGSTVAT

SEQ ID NO: 1185317 - protein, 17 aa, Mycobacterium
SAAGVKGTPLHTPYTAS

SEQ ID NO: 1185318 - protein, 22 aa, Mycobacterium
SAAKRADGWGARTRMKDASSTD

SEQ ID NO: 1185319 - protein, 4 aa, Mycobacterium
SAAP

SEQ ID NO: 1185320 - protein, 11 aa, Mycobacterium
SAAPSRSAAAA

SEQ ID NO: 1185321 - protein, 10 aa, Mycobacterium
SAARGRGAQL

SEQ ID NO: 1185322 - protein, 6 aa, Mycobacterium
SAASGH

SEQ ID NO: 1185323 - protein, 29 aa, Mycobacterium
SAASGSAPKPAAARGESDAARERRTAKEL

SEQ ID NO: 1185324 - protein, 13 aa, Mycobacterium
SAATELPGPSGEV

SEQ ID NO: 1185325 - protein, 9 aa, Mycobacterium
SAAYTPGQV

SEQ ID NO: 1185326 - protein, 6 aa, Mycobacterium
SADALG

SEQ ID NO: 1185327 - protein, 5 aa, Mycobacterium
SADAV

SEQ ID NO: 1185328 - protein, 8 aa, Mycobacterium
SADGAGPG

SEQ ID NO: 1185329 - protein, 8 aa, Mycobacterium
SADIERSE

SEQ ID NO: 1185330 - protein, 9 aa, Mycobacterium
SADNGVPGT

SEQ ID NO: 1185331 - protein, 9 aa, Mycobacterium
SADNLPSGG

SEQ ID NO: 1185332 - protein, 7 aa, Mycobacterium
SADPAAA

SEQ ID NO: 1185333 - protein, 5 aa, Mycobacterium
SADVK

SEQ ID NO: 1185334 - protein, 19 aa, Mycobacterium
SAEELESAAAQGDPEPVAA

SEQ ID NO: 1185335 - protein, 8 aa, Mycobacterium
SAEGSPSR

SEQ ID NO: 1185336 - protein, 15 aa, Mycobacterium
SAEGTDCADPVYPIT

SEQ ID NO: 1185337 - protein, 5 aa, Mycobacterium
SAEMA

SEQ ID NO: 1185338 - protein, 17 aa, Mycobacterium
SAEPGESWRWCYIDLRV

SEQ ID NO: 1185339 - protein, 7 aa, Mycobacterium
SAEPLGY

SEQ ID NO: 1185340 - protein, 14 aa, Mycobacterium
SAEPRPEGPVDQQP

SEQ ID NO: 1185341 - protein, 9 aa, Mycobacterium
SAEQREERA

SEQ ID NO: 1185342 - protein, 16 aa, Mycobacterium
SAEQSAQLKAALRKGR

SEQ ID NO: 1185343 - protein, 4 aa, Mycobacterium
SAER

SEQ ID NO: 1185344 - protein, 10 aa, Mycobacterium
SAERAAAQAR

SEQ ID NO: 1185345 - protein, 10 aa, Mycobacterium
SAESTAQQAQ

SEQ ID NO: 1185346 - protein, 7 aa, Mycobacterium
SAETDAL

SEQ ID NO: 1185347 - protein, 6 aa, Mycobacterium
SAETDS

SEQ ID NO: 1185348 - protein, 8 aa, Mycobacterium
SAEVAGPG

SEQ ID NO: 1185349 - protein, 11 aa, Mycobacterium
SAFGPPPSRWP

SEQ ID NO: 1185350 - protein, 6 aa, Mycobacterium
SAGADG

SEQ ID NO: 1185351 - protein, 15 aa, Mycobacterium
SAGAPEVLPFALAAI

SEQ ID NO: 1185352 - protein, 12 aa, Mycobacterium
SAGDAGHSEKEI

SEQ ID NO: 1185353 - protein, 16 aa, Mycobacterium
SAGFPGTMPNPYRERS

SEQ ID NO: 1185354 - protein, 5 aa, Mycobacterium
SAGGH

SEQ ID NO: 1185355 - protein, 4 aa, Mycobacterium
SAGL

SEQ ID NO: 1185356 - protein, 6 aa, Mycobacterium
SAGQRD

SEQ ID NO: 1185357 - protein, 14 aa, Mycobacterium
SAGRADLQPPEGPR

SEQ ID NO: 1185358 - protein, 5 aa, Mycobacterium
SAGRP

SEQ ID NO: 1185359 - protein, 14 aa, Mycobacterium
SAGRPVAYATGSAG

SEQ ID NO: 1185360 - protein, 8 aa, Mycobacterium
SAGSDRAR

SEQ ID NO: 1185361 - protein, 12 aa, Mycobacterium
SAGSRDDAEEIR

SEQ ID NO: 1185362 - protein, 5 aa, Mycobacterium
SAGSY

SEQ ID NO: 1185363 - protein, 6 aa, Mycobacterium
SAGSYG

SEQ ID NO: 1185364 - protein, 21 aa, Mycobacterium
SAGVGAPDGAWAPATVAPGQA

SEQ ID NO: 1185365 - protein, 8 aa, Mycobacterium
SAGVPPSS

SEQ ID NO: 1185366 - protein, 7 aa, Mycobacterium
SAHDPTL

SEQ ID NO: 1185367 - protein, 4 aa, Mycobacterium
SAHK

SEQ ID NO: 1185368 - protein, 15 aa, Mycobacterium
SAHKRRDGGISREGS

SEQ ID NO: 1185369 - protein, 4 aa, Mycobacterium
SAIP

SEQ ID NO: 1185370 - protein, 13 aa, Mycobacterium
SAKAYSAAVETAR

SEQ ID NO: 1185371 - protein, 6 aa, Mycobacterium
SAKDYD

SEQ ID NO: 1185372 - protein, 12 aa, Mycobacterium
SAKGESPGRWTG

SEQ ID NO: 1185373 - protein, 6 aa, Mycobacterium
SALDPE

SEQ ID NO: 1185374 - protein, 8 aa, Mycobacterium
SALGGREA

SEQ ID NO: 1185375 - protein, 19 aa, Mycobacterium
SALKSAGRQRNIESRAAEI

SEQ ID NO: 1185376 - protein, 7 aa, Mycobacterium
SALPPGE

SEQ ID NO: 1185377 - protein, 4 aa, Mycobacterium
SALQ

SEQ ID NO: 1185378 - protein, 13 aa, Mycobacterium
SANRDETRFTDPD

SEQ ID NO: 1185379 - protein, 10 aa, Mycobacterium
SANRDPEAFT

SEQ ID NO: 1185380 - protein, 14 aa, Mycobacterium
SANSQSGWGSGNSE

SEQ ID NO: 1185381 - protein, 4 aa, Mycobacterium
SANY

SEQ ID NO: 1185382 - protein, 6 aa, Mycobacterium
SAPAKP

SEQ ID NO: 1185383 - protein, 23 aa, Mycobacterium
SAPAPLSSVAGTQTTTPAPFPAA

SEQ ID NO: 1185384 - protein, 8 aa, Mycobacterium
SAPASQHA

SEQ ID NO: 1185385 - protein, 6 aa, Mycobacterium
SAPAVK

SEQ ID NO: 1185386 - protein, 7 aa, Mycobacterium
SAPDVAD

SEQ ID NO: 1185387 - protein, 8 aa, Mycobacterium
SAPFADDA

SEQ ID NO: 1185388 - protein, 26 aa, Mycobacterium
SAPGPDPNGGIDLTDEEAAEFLRAIR

SEQ ID NO: 1185389 - protein, 10 aa, Mycobacterium
SAPPVSGGAI

SEQ ID NO: 1185390 - protein, 8 aa, Mycobacterium
SAPRSRAD

SEQ ID NO: 1185391 - protein, 9 aa, Mycobacterium
SAPSRAQAT

SEQ ID NO: 1185392 - protein, 4 aa, Mycobacterium
SAPT

SEQ ID NO: 1185393 - protein, 12 aa, Mycobacterium
SAPTVRPARAKR

SEQ ID NO: 1185394 - protein, 4 aa, Mycobacterium
SAQA

SEQ ID NO: 1185395 - protein, 5 aa, Mycobacterium
SAQLG

SEQ ID NO: 1185396 - protein, 21 aa, Mycobacterium
SAQPGQPGTPAGTVAGSVQGL

SEQ ID NO: 1185397 - protein, 8 aa, Mycobacterium
SAQRQPGL

SEQ ID NO: 1185398 - protein, 8 aa, Mycobacterium
SAQVQGGE

SEQ ID NO: 1185399 - protein, 16 aa, Mycobacterium
SARAGGPGGRRRRSAD

SEQ ID NO: 1185400 - protein, 13 aa, Mycobacterium
SARGNPHGISPTA

SEQ ID NO: 1185401 - protein, 49 aa, Mycobacterium
SARKSGGSGGGPPGADSPTHRTNSANRGAYAVSSTATASGDDVPDVTTD

SEQ ID NO: 1185402 - protein, 5 aa, Mycobacterium
SARPA

SEQ ID NO: 1185403 - protein, 5 aa, Mycobacterium
SARPV

SEQ ID NO: 1185404 - protein, 4 aa, Mycobacterium
SART

SEQ ID NO: 1185405 - protein, 8 aa, Mycobacterium
SARTGEFR

SEQ ID NO: 1185406 - protein, 5 aa, Mycobacterium
SASCH

SEQ ID NO: 1185407 - protein, 5 aa, Mycobacterium
SASDT

SEQ ID NO: 1185408 - protein, 6 aa, Mycobacterium
SASPEL

SEQ ID NO: 1185409 - protein, 4 aa, Mycobacterium
SASR

SEQ ID NO: 1185410 - protein, 6 aa, Mycobacterium
SATAPL

SEQ ID NO: 1185411 - protein, 11 aa, Mycobacterium
SATAPLTETTI

SEQ ID NO: 1185412 - protein, 8 aa, Mycobacterium
SATDDPVH

SEQ ID NO: 1185413 - protein, 8 aa, Mycobacterium
SATEGGIA

SEQ ID NO: 1185414 - protein, 5 aa, Mycobacterium
SATRR

SEQ ID NO: 1185415 - protein, 10 aa, Mycobacterium
SATVREDALN

SEQ ID NO: 1185416 - protein, 12 aa, Mycobacterium
SAVATITETTTV

SEQ ID NO: 1185417 - protein, 5 aa, Mycobacterium
SAVGT

SEQ ID NO: 1185418 - protein, 13 aa, Mycobacterium
SAVNREAGGPGSV

SEQ ID NO: 1185419 - protein, 11 aa, Mycobacterium
SAVPTDPEIGP

SEQ ID NO: 1185420 - protein, 5 aa, Mycobacterium
SCERT

SEQ ID NO: 1185421 - protein, 5 aa, Mycobacterium
SDADA

SEQ ID NO: 1185422 - protein, 10 aa, Mycobacterium
SDADGNTVAY

SEQ ID NO: 1185423 - protein, 10 aa, Mycobacterium
SDADPAGGNR

SEQ ID NO: 1185424 - protein, 5 aa, Mycobacterium
SDAFA

SEQ ID NO: 1185425 - protein, 7 aa, Mycobacterium
SDAFGPP

SEQ ID NO: 1185426 - protein, 4 aa, Mycobacterium
SDAH

SEQ ID NO: 1185427 - protein, 7 aa, Mycobacterium
SDAPGVA

SEQ ID NO: 1185428 - protein, 5 aa, Mycobacterium
SDAQR

SEQ ID NO: 1185429 - protein, 4 aa, Mycobacterium
SDDD

SEQ ID NO: 1185430 - protein, 15 aa, Mycobacterium
SDDDAPIEHTTADDP

SEQ ID NO: 1185431 - protein, 16 aa, Mycobacterium
SDDEEFQRGDSSEEQM

SEQ ID NO: 1185432 - protein, 8 aa, Mycobacterium
SDDKIDTA

SEQ ID NO: 1185433 - protein, 7 aa, Mycobacterium
SDDPATV

SEQ ID NO: 1185434 - protein, 20 aa, Mycobacterium
SDDPDPVTAWPGGPDSFGRG

SEQ ID NO: 1185435 - protein, 9 aa, Mycobacterium
SDDPEQSRA

SEQ ID NO: 1185436 - protein, 7 aa, Mycobacterium
SDDRIGS

SEQ ID NO: 1185437 - protein, 6 aa, Mycobacterium
SDDTII

SEQ ID NO: 1185438 - protein, 15 aa, Mycobacterium
SDELDGKARNRAVRQ

SEQ ID NO: 1185439 - protein, 8 aa, Mycobacterium
SDEWTPQA

SEQ ID NO: 1185440 - protein, 13 aa, Mycobacterium
SDGEKTNTTTQKI

SEQ ID NO: 1185441 - protein, 14 aa, Mycobacterium
SDGEVIASGPTPGF

SEQ ID NO: 1185442 - protein, 14 aa, Mycobacterium
SDGGADELDNARSA

SEQ ID NO: 1185443 - protein, 8 aa, Mycobacterium
SDGHGDSA

SEQ ID NO: 1185444 - protein, 5 aa, Mycobacterium
SDGPS

SEQ ID NO: 1185445 - protein, 7 aa, Mycobacterium
SDGRHVT

SEQ ID NO: 1185446 - protein, 5 aa, Mycobacterium
SDGTL

SEQ ID NO: 1185447 - protein, 4 aa, Mycobacterium
SDGV

SEQ ID NO: 1185448 - protein, 5 aa, Mycobacterium
SDGVN

SEQ ID NO: 1185449 - protein, 5 aa, Mycobacterium
SDHIG

SEQ ID NO: 1185450 - protein, 24 aa, Mycobacterium
SDIPADEIDGSGKLPSTGSFRGSG

SEQ ID NO: 1185451 - protein, 18 aa, Mycobacterium
SDIRPRKGSRAAGTRRGP

SEQ ID NO: 1185452 - protein, 18 aa, Mycobacterium
SDKAAGDRLTDARQLGPR

SEQ ID NO: 1185453 - protein, 14 aa, Mycobacterium
SDKSASIQSNDPAT

SEQ ID NO: 1185454 - protein, 26 aa, Mycobacterium
SDKTAGERLTDARQLGPRHTLTGERV

SEQ ID NO: 1185455 - protein, 4 aa, Mycobacterium
SDLP

SEQ ID NO: 1185456 - protein, 10 aa, Mycobacterium
SDLRAAREAG

SEQ ID NO: 1185457 - protein, 4 aa, Mycobacterium
SDLT

SEQ ID NO: 1185458 - protein, 7 aa, Mycobacterium
SDPAIYP

SEQ ID NO: 1185459 - protein, 6 aa, Mycobacterium
SDPDGL

SEQ ID NO: 1185460 - protein, 11 aa, Mycobacterium
SDPGSRASAEQ

SEQ ID NO: 1185461 - protein, 9 aa, Mycobacterium
SDPRTSVRS

SEQ ID NO: 1185462 - protein, 26 aa, Mycobacterium
SDQAPARPGELPSGTAPGSGASGLQF

SEQ ID NO: 1185463 - protein, 10 aa, Mycobacterium
SDRGDQQQPR

SEQ ID NO: 1185464 - protein, 5 aa, Mycobacterium
SDRTN

SEQ ID NO: 1185465 - protein, 12 aa, Mycobacterium
SDSAGEKLAGAR

SEQ ID NO: 1185466 - protein, 4 aa, Mycobacterium
SDSH

SEQ ID NO: 1185467 - protein, 14 aa, Mycobacterium
SDSRAELSGDTAAG

SEQ ID NO: 1185468 - protein, 7 aa, Mycobacterium
SDSVEDT

SEQ ID NO: 1185469 - protein, 6 aa, Mycobacterium
SDTDGA

SEQ ID NO: 1185470 - protein, 8 aa, Mycobacterium
SDTDTDIG

SEQ ID NO: 1185471 - protein, 9 aa, Mycobacterium
SDTELSPMN

SEQ ID NO: 1185472 - protein, 7 aa, Mycobacterium
SDTGRLD

SEQ ID NO: 1185473 - protein, 9 aa, Mycobacterium
SDTGSGSDT

SEQ ID NO: 1185474 - protein, 10 aa, Mycobacterium
SDTPRPGPCA

SEQ ID NO: 1185475 - protein, 9 aa, Mycobacterium
SDVDGDSAT

SEQ ID NO: 1185476 - protein, 8 aa, Mycobacterium
SDWAREQA

SEQ ID NO: 1185477 - protein, 5 aa, Mycobacterium
SDWPR

SEQ ID NO: 1185478 - protein, 5 aa, Mycobacterium
SEAAP

SEQ ID NO: 1185479 - protein, 5 aa, Mycobacterium
SEAGS

SEQ ID NO: 1185480 - protein, 11 aa, Mycobacterium
SECSPDELDER

SEQ ID NO: 1185481 - protein, 9 aa, Mycobacterium
SEDAEGPGA

SEQ ID NO: 1185482 - protein, 5 aa, Mycobacterium
SEDIT

SEQ ID NO: 1185483 - protein, 17 aa, Mycobacterium
SEDLTPTRYGELRHGTL

SEQ ID NO: 1185484 - protein, 17 aa, Mycobacterium
SEDTAKDINANHRNSRY

SEQ ID NO: 1185485 - protein, 16 aa, Mycobacterium
SEEDGAEKGTSYNRVR

SEQ ID NO: 1185486 - protein, 6 aa, Mycobacterium
SEEGLD

SEQ ID NO: 1185487 - protein, 7 aa, Mycobacterium
SEEGPAK

SEQ ID NO: 1185488 - protein, 14 aa, Mycobacterium
SEEIAERSTTDDVG

SEQ ID NO: 1185489 - protein, 12 aa, Mycobacterium
SEEKDESTMAEE

SEQ ID NO: 1185490 - protein, 4 aa, Mycobacterium
SEET

SEQ ID NO: 1185491 - protein, 6 aa, Mycobacterium
SEGSAP

SEQ ID NO: 1185492 - protein, 15 aa, Mycobacterium
SEHRAQLQNRAAARE

SEQ ID NO: 1185493 - protein, 4 aa, Mycobacterium
SEIR

SEQ ID NO: 1185494 - protein, 7 aa, Mycobacterium
SELPDQE

SEQ ID NO: 1185495 - protein, 5 aa, Mycobacterium
SENET

SEQ ID NO: 1185496 - protein, 35 aa, Mycobacterium
SENKQEEAEAPVTSSGAATVSAPPPGSQNAVPTEP

SEQ ID NO: 1185497 - protein, 8 aa, Mycobacterium
SENPSAMG

SEQ ID NO: 1185498 - protein, 9 aa, Mycobacterium
SENPTKIDY

SEQ ID NO: 1185499 - protein, 9 aa, Mycobacterium
SENSRPTIT

SEQ ID NO: 1185500 - protein, 7 aa, Mycobacterium
SEPAAEV

SEQ ID NO: 1185501 - protein, 8 aa, Mycobacterium
SEPAETAR

SEQ ID NO: 1185502 - protein, 6 aa, Mycobacterium
SEPETA

SEQ ID NO: 1185503 - protein, 7 aa, Mycobacterium
SEPGGTP

SEQ ID NO: 1185504 - protein, 5 aa, Mycobacterium
SEPLG

SEQ ID NO: 1185505 - protein, 95 aa, Mycobacterium
SEPTDSEPVDGTDDGTDDVDLGGDTDEGDDSDLEESVDVTGGDEDAGDEDGGEDEGADANDGGSDNGGTAGDNTSDNGSEGDSSSSNDKGSDGSD

SEQ ID NO: 1185506 - protein, 6 aa, Mycobacterium
SEQEPR

SEQ ID NO: 1185507 - protein, 5 aa, Mycobacterium
SEQGI

SEQ ID NO: 1185508 - protein, 4 aa, Mycobacterium
SEQT

SEQ ID NO: 1185509 - protein, 22 aa, Mycobacterium
SERFSRSSGPGGQGVNTADSRV

SEQ ID NO: 1185510 - protein, 15 aa, Mycobacterium
SERGGAAGAQADRDL

SEQ ID NO: 1185511 - protein, 16 aa, Mycobacterium
SERPGLTVGIEPLLDL

SEQ ID NO: 1185512 - protein, 5 aa, Mycobacterium
SERPR

SEQ ID NO: 1185513 - protein, 9 aa, Mycobacterium
SERPRDEMS

SEQ ID NO: 1185514 - protein, 5 aa, Mycobacterium
SERRP

SEQ ID NO: 1185515 - protein, 8 aa, Mycobacterium
SERRTYHH

SEQ ID NO: 1185516 - protein, 8 aa, Mycobacterium
SESAEKTL

SEQ ID NO: 1185517 - protein, 11 aa, Mycobacterium
SESGTERTQWR

SEQ ID NO: 1185518 - protein, 6 aa, Mycobacterium
SESRAT

SEQ ID NO: 1185519 - protein, 8 aa, Mycobacterium
SESSSPAL

SEQ ID NO: 1185520 - protein, 4 aa, Mycobacterium
SETA

SEQ ID NO: 1185521 - protein, 15 aa, Mycobacterium
SETFGSNSPALTEDG

SEQ ID NO: 1185522 - protein, 5 aa, Mycobacterium
SETGH

SEQ ID NO: 1185523 - protein, 4 aa, Mycobacterium
SETP

SEQ ID NO: 1185524 - protein, 15 aa, Mycobacterium
SETREVGSAPPERRW

SEQ ID NO: 1185525 - protein, 15 aa, Mycobacterium
SETVRAQNAEPGRTS

SEQ ID NO: 1185526 - protein, 5 aa, Mycobacterium
SEVAP

SEQ ID NO: 1185527 - protein, 4 aa, Mycobacterium
SEVR

SEQ ID NO: 1185528 - protein, 11 aa, Mycobacterium
SFDQEVAETQR

SEQ ID NO: 1185529 - protein, 18 aa, Mycobacterium
SFGGGARNARSRPLPSKT

SEQ ID NO: 1185530 - protein, 13 aa, Mycobacterium
SFRGDPTVSAPRY

SEQ ID NO: 1185531 - protein, 7 aa, Mycobacterium
SFSDDTT

SEQ ID NO: 1185532 - protein, 6 aa, Mycobacterium
SFTPGE

SEQ ID NO: 1185533 - protein, 12 aa, Mycobacterium
SGAAADPSSLTP

SEQ ID NO: 1185534 - protein, 8 aa, Mycobacterium
SGAAGIST

SEQ ID NO: 1185535 - protein, 16 aa, Mycobacterium
SGAATAVGGGARSPAT

SEQ ID NO: 1185536 - protein, 4 aa, Mycobacterium
SGAD

SEQ ID NO: 1185537 - protein, 17 aa, Mycobacterium
SGADASGNRKEVESCQQ

SEQ ID NO: 1185538 - protein, 7 aa, Mycobacterium
SGADPGR

SEQ ID NO: 1185539 - protein, 9 aa, Mycobacterium
SGAEAGRRL

SEQ ID NO: 1185540 - protein, 10 aa, Mycobacterium
SGAEAGRRLS

SEQ ID NO: 1185541 - protein, 4 aa, Mycobacterium
SGAG

SEQ ID NO: 1185542 - protein, 5 aa, Mycobacterium
SGAGP

SEQ ID NO: 1185543 - protein, 9 aa, Mycobacterium
SGAPGEGQS

SEQ ID NO: 1185544 - protein, 10 aa, Mycobacterium
SGAQDANSQE

SEQ ID NO: 1185545 - protein, 12 aa, Mycobacterium
SGAQVDTAYEGT

SEQ ID NO: 1185546 - protein, 10 aa, Mycobacterium
SGATGNFTQT

SEQ ID NO: 1185547 - protein, 19 aa, Mycobacterium
SGAVQAYDGREVAPAAATE

SEQ ID NO: 1185548 - protein, 16 aa, Mycobacterium
SGDAAGVNPLTGRATG

SEQ ID NO: 1185549 - protein, 9 aa, Mycobacterium
SGDANCATA

SEQ ID NO: 1185550 - protein, 5 aa, Mycobacterium
SGDDV

SEQ ID NO: 1185551 - protein, 5 aa, Mycobacterium
SGDLE

SEQ ID NO: 1185552 - protein, 7 aa, Mycobacterium
SGDPGEA

SEQ ID NO: 1185553 - protein, 7 aa, Mycobacterium
SGEGADE

SEQ ID NO: 1185554 - protein, 6 aa, Mycobacterium
SGEQRA

SEQ ID NO: 1185555 - protein, 7 aa, Mycobacterium
SGEQRAS

SEQ ID NO: 1185556 - protein, 4 aa, Mycobacterium
SGES

SEQ ID NO: 1185557 - protein, 10 aa, Mycobacterium
SGESAAHPGL

SEQ ID NO: 1185558 - protein, 11 aa, Mycobacterium
SGESEAEAVNT

SEQ ID NO: 1185559 - protein, 8 aa, Mycobacterium
SGEWAGET

SEQ ID NO: 1185560 - protein, 7 aa, Mycobacterium
SGGEAQR

SEQ ID NO: 1185561 - protein, 6 aa, Mycobacterium
SGGGGR

SEQ ID NO: 1185562 - protein, 8 aa, Mycobacterium
SGGGRSEA

SEQ ID NO: 1185563 - protein, 6 aa, Mycobacterium
SGGMAS

SEQ ID NO: 1185564 - protein, 7 aa, Mycobacterium
SGGQQDT

SEQ ID NO: 1185565 - protein, 6 aa, Mycobacterium
SGGRWA

SEQ ID NO: 1185566 - protein, 8 aa, Mycobacterium
SGGRYPAK

SEQ ID NO: 1185567 - protein, 5 aa, Mycobacterium
SGGSR

SEQ ID NO: 1185568 - protein, 10 aa, Mycobacterium
SGGSSSGSAL

SEQ ID NO: 1185569 - protein, 8 aa, Mycobacterium
SGGVEEAV

SEQ ID NO: 1185570 - protein, 11 aa, Mycobacterium
SGGVGGARNGT

SEQ ID NO: 1185571 - protein, 17 aa, Mycobacterium
SGHPDGTLRSADGEWGA

SEQ ID NO: 1185572 - protein, 12 aa, Mycobacterium
SGHQAERTDDGP

SEQ ID NO: 1185573 - protein, 6 aa, Mycobacterium
SGIGME

SEQ ID NO: 1185574 - protein, 12 aa, Mycobacterium
SGIGTPGRAADL

SEQ ID NO: 1185575 - protein, 5 aa, Mycobacterium
SGIPG

SEQ ID NO: 1185576 - protein, 9 aa, Mycobacterium
SGITGDDPL

SEQ ID NO: 1185577 - protein, 12 aa, Mycobacterium
SGITKGRKCRTT

SEQ ID NO: 1185578 - protein, 22 aa, Mycobacterium
SGLDKGEQGRIGPNPDTFDYIP

SEQ ID NO: 1185579 - protein, 10 aa, Mycobacterium
SGLIESPRKA

SEQ ID NO: 1185580 - protein, 4 aa, Mycobacterium
SGLT

SEQ ID NO: 1185581 - protein, 5 aa, Mycobacterium
SGMAE

SEQ ID NO: 1185582 - protein, 25 aa, Mycobacterium
SGMPPADVNTPQATVTAPQAPRPVL

SEQ ID NO: 1185583 - protein, 29 aa, Mycobacterium
SGNLRSAQRAVERTGADVEVTADADAALN

SEQ ID NO: 1185584 - protein, 14 aa, Mycobacterium
SGNQPTKERIQSQV

SEQ ID NO: 1185585 - protein, 4 aa, Mycobacterium
SGNT

SEQ ID NO: 1185586 - protein, 6 aa, Mycobacterium
SGPDLE

SEQ ID NO: 1185587 - protein, 7 aa, Mycobacterium
SGPHHGP

SEQ ID NO: 1185588 - protein, 14 aa, Mycobacterium
SGPTADAIGAAPGE

SEQ ID NO: 1185589 - protein, 13 aa, Mycobacterium
SGPTGSADPTVAR

SEQ ID NO: 1185590 - protein, 16 aa, Mycobacterium
SGPTLTAAEAGSGRGE

SEQ ID NO: 1185591 - protein, 41 aa, Mycobacterium
SGPTPHCGPPVTEAPGPTEWGEAPGVGPWPGDLPDDPRYDP

SEQ ID NO: 1185592 - protein, 6 aa, Mycobacterium
SGQFGA

SEQ ID NO: 1185593 - protein, 18 aa, Mycobacterium
SGQGGTATFADPAEATAA

SEQ ID NO: 1185594 - protein, 7 aa, Mycobacterium
SGQPLSA

SEQ ID NO: 1185595 - protein, 11 aa, Mycobacterium
SGQRLAAGAPK

SEQ ID NO: 1185596 - protein, 6 aa, Mycobacterium
SGQSSL

SEQ ID NO: 1185597 - protein, 8 aa, Mycobacterium
SGQTFGAE

SEQ ID NO: 1185598 - protein, 6 aa, Mycobacterium
SGRAHH

SEQ ID NO: 1185599 - protein, 7 aa, Mycobacterium
SGRDAAA

SEQ ID NO: 1185600 - protein, 10 aa, Mycobacterium
SGRDPATVRA

SEQ ID NO: 1185601 - protein, 7 aa, Mycobacterium
SGREGTT

SEQ ID NO: 1185602 - protein, 5 aa, Mycobacterium
SGRLA

SEQ ID NO: 1185603 - protein, 7 aa, Mycobacterium
SGRPGAA

SEQ ID NO: 1185604 - protein, 12 aa, Mycobacterium
SGRQSKPDRDEV

SEQ ID NO: 1185605 - protein, 9 aa, Mycobacterium
SGRRRSGAQ

SEQ ID NO: 1185606 - protein, 10 aa, Mycobacterium
SGRSAERNAK

SEQ ID NO: 1185607 - protein, 9 aa, Mycobacterium
SGRSSARLT

SEQ ID NO: 1185608 - protein, 15 aa, Mycobacterium
SGSAGAPKGAMYPES

SEQ ID NO: 1185609 - protein, 5 aa, Mycobacterium
SGSGC

SEQ ID NO: 1185610 - protein, 10 aa, Mycobacterium
SGSIEDEHRR

SEQ ID NO: 1185611 - protein, 13 aa, Mycobacterium
SGSLGNTPAVART

SEQ ID NO: 1185612 - protein, 7 aa, Mycobacterium
SGSMGEA

SEQ ID NO: 1185613 - protein, 4 aa, Mycobacterium
SGSR

SEQ ID NO: 1185614 - protein, 7 aa, Mycobacterium
SGSTETV

SEQ ID NO: 1185615 - protein, 7 aa, Mycobacterium
SGSTRVP

SEQ ID NO: 1185616 - protein, 6 aa, Mycobacterium
SGSTTL

SEQ ID NO: 1185617 - protein, 6 aa, Mycobacterium
SGSTTT

SEQ ID NO: 1185618 - protein, 11 aa, Mycobacterium
SGSWVTDTSGR

SEQ ID NO: 1185619 - protein, 8 aa, Mycobacterium
SGTAMAPP

SEQ ID NO: 1185620 - protein, 5 aa, Mycobacterium
SGTAV

SEQ ID NO: 1185621 - protein, 5 aa, Mycobacterium
SGTEL

SEQ ID NO: 1185622 - protein, 8 aa, Mycobacterium
SGTESRPK

SEQ ID NO: 1185623 - protein, 6 aa, Mycobacterium
SGTGMG

SEQ ID NO: 1185624 - protein, 5 aa, Mycobacterium
SGTKP

SEQ ID NO: 1185625 - protein, 12 aa, Mycobacterium
SGTLTDHETGEE

SEQ ID NO: 1185626 - protein, 6 aa, Mycobacterium
SGTTAP

SEQ ID NO: 1185627 - protein, 9 aa, Mycobacterium
SGTTGTPKG

SEQ ID NO: 1185628 - protein, 20 aa, Mycobacterium
SGTTMRSRGGPNHRSRRSSV

SEQ ID NO: 1185629 - protein, 9 aa, Mycobacterium
SGVESGSVI

SEQ ID NO: 1185630 - protein, 15 aa, Mycobacterium
SGVGSPSAALRDDVT

SEQ ID NO: 1185631 - protein, 7 aa, Mycobacterium
SGVRPEA

SEQ ID NO: 1185632 - protein, 9 aa, Mycobacterium
SGVTPGQVG

SEQ ID NO: 1185633 - protein, 18 aa, Mycobacterium
SGWNTSPRTASAAATERS

SEQ ID NO: 1185634 - protein, 14 aa, Mycobacterium
SHAPSYDELDRRTA

SEQ ID NO: 1185635 - protein, 19 aa, Mycobacterium
SHATPVPGRTRTVPKNRAD

SEQ ID NO: 1185636 - protein, 4 aa, Mycobacterium
SHDA

SEQ ID NO: 1185637 - protein, 8 aa, Mycobacterium
SHDPNETG

SEQ ID NO: 1185638 - protein, 14 aa, Mycobacterium
SHEDPDESPHRDLD

SEQ ID NO: 1185639 - protein, 11 aa, Mycobacterium
SHNTEDAAAQR

SEQ ID NO: 1185640 - protein, 5 aa, Mycobacterium
SHPGV

SEQ ID NO: 1185641 - protein, 18 aa, Mycobacterium
SHPPNAAALRGQPSRSDQ

SEQ ID NO: 1185642 - protein, 4 aa, Mycobacterium
SHRD

SEQ ID NO: 1185643 - protein, 6 aa, Mycobacterium
SHRGGR

SEQ ID NO: 1185644 - protein, 12 aa, Mycobacterium
SHSTVHGDNNNA

SEQ ID NO: 1185645 - protein, 7 aa, Mycobacterium
SHTGALA

SEQ ID NO: 1185646 - protein, 8 aa, Mycobacterium
SHTGGAAS

SEQ ID NO: 1185647 - protein, 5 aa, Mycobacterium
SHTSG

SEQ ID NO: 1185648 - protein, 6 aa, Mycobacterium
SIDGTR

SEQ ID NO: 1185649 - protein, 5 aa, Mycobacterium
SIGDE

SEQ ID NO: 1185650 - protein, 13 aa, Mycobacterium
SIGSSETGFGGSS

SEQ ID NO: 1185651 - protein, 5 aa, Mycobacterium
SIHNS

SEQ ID NO: 1185652 - protein, 17 aa, Mycobacterium
SISGGASRPEGIGTTPI

SEQ ID NO: 1185653 - protein, 5 aa, Mycobacterium
SITAD

SEQ ID NO: 1185654 - protein, 7 aa, Mycobacterium
SITADQR

SEQ ID NO: 1185655 - protein, 11 aa, Mycobacterium
SITAPDGRPVN

SEQ ID NO: 1185656 - protein, 10 aa, Mycobacterium
SITDPKKLAR

SEQ ID NO: 1185657 - protein, 8 aa, Mycobacterium
SKAPGDKV

SEQ ID NO: 1185658 - protein, 4 aa, Mycobacterium
SKAV

SEQ ID NO: 1185659 - protein, 6 aa, Mycobacterium
SKAWPG

SEQ ID NO: 1185660 - protein, 6 aa, Mycobacterium
SKAYDD

SEQ ID NO: 1185661 - protein, 7 aa, Mycobacterium
SKDKPGL

SEQ ID NO: 1185662 - protein, 5 aa, Mycobacterium
SKDVK

SEQ ID NO: 1185663 - protein, 31 aa, Mycobacterium
SKEERRRQAGRNQRTKTGQRPDVVAVRGQGA

SEQ ID NO: 1185664 - protein, 9 aa, Mycobacterium
SKGGVGKTT

SEQ ID NO: 1185665 - protein, 13 aa, Mycobacterium
SKGLTVTPDPSMG

SEQ ID NO: 1185666 - protein, 8 aa, Mycobacterium
SKGPTDKL

SEQ ID NO: 1185667 - protein, 6 aa, Mycobacterium
SKGPYA

SEQ ID NO: 1185668 - protein, 8 aa, Mycobacterium
SKKALEAL

SEQ ID NO: 1185669 - protein, 7 aa, Mycobacterium
SKNLGYG

SEQ ID NO: 1185670 - protein, 9 aa, Mycobacterium
SKPAYGRQA

SEQ ID NO: 1185671 - protein, 5 aa, Mycobacterium
SKQAE

SEQ ID NO: 1185672 - protein, 9 aa, Mycobacterium
SKQMPPTSF

SEQ ID NO: 1185673 - protein, 4 aa, Mycobacterium
SKTF

SEQ ID NO: 1185674 - protein, 14 aa, Mycobacterium
SLAASDRKETTKSL

SEQ ID NO: 1185675 - protein, 7 aa, Mycobacterium
SLAATTD

SEQ ID NO: 1185676 - protein, 24 aa, Mycobacterium
SLARQPNQPPPTVPPYRGPSGERA

SEQ ID NO: 1185677 - protein, 28 aa, Mycobacterium
SLASRTSKGPPAEAASRRGAAAQPDPGV

SEQ ID NO: 1185678 - protein, 7 aa, Mycobacterium
SLDDPDD

SEQ ID NO: 1185679 - protein, 20 aa, Mycobacterium
SLDGRRAEAAATVDTTGVEI

SEQ ID NO: 1185680 - protein, 8 aa, Mycobacterium
SLDPATRS

SEQ ID NO: 1185681 - protein, 15 aa, Mycobacterium
SLDPQPPRSRTAGET

SEQ ID NO: 1185682 - protein, 11 aa, Mycobacterium
SLEDADNLPAP

SEQ ID NO: 1185683 - protein, 28 aa, Mycobacterium
SLKPRKSGESVRTGNAPTPTPPRPPQRE

SEQ ID NO: 1185684 - protein, 15 aa, Mycobacterium
SLKRTRGLLSELARA

SEQ ID NO: 1185685 - protein, 5 aa, Mycobacterium
SLLKP

SEQ ID NO: 1185686 - protein, 4 aa, Mycobacterium
SLPL

SEQ ID NO: 1185687 - protein, 9 aa, Mycobacterium
SLPNEPSGT

SEQ ID NO: 1185688 - protein, 9 aa, Mycobacterium
SLPPATTSW

SEQ ID NO: 1185689 - protein, 6 aa, Mycobacterium
SLPPRT

SEQ ID NO: 1185690 - protein, 8 aa, Mycobacterium
SLPRQPQH

SEQ ID NO: 1185691 - protein, 6 aa, Mycobacterium
SLPRTE

SEQ ID NO: 1185692 - protein, 7 aa, Mycobacterium
SLPSTPT

SEQ ID NO: 1185693 - protein, 5 aa, Mycobacterium
SLQPH

SEQ ID NO: 1185694 - protein, 14 aa, Mycobacterium
SLRARPDRQTAQQH

SEQ ID NO: 1185695 - protein, 5 aa, Mycobacterium
SLRPD

SEQ ID NO: 1185696 - protein, 9 aa, Mycobacterium
SLRTDATGT

SEQ ID NO: 1185697 - protein, 7 aa, Mycobacterium
SLSPDAT

SEQ ID NO: 1185698 - protein, 10 aa, Mycobacterium
SLSTTRPAYD

SEQ ID NO: 1185699 - protein, 9 aa, Mycobacterium
SLTDAQEAT

SEQ ID NO: 1185700 - protein, 6 aa, Mycobacterium
SLTDSD

SEQ ID NO: 1185701 - protein, 19 aa, Mycobacterium
SLTEDEIGEYSGEKKEIRP

SEQ ID NO: 1185702 - protein, 7 aa, Mycobacterium
SLTGADA

SEQ ID NO: 1185703 - protein, 7 aa, Mycobacterium
SLTPDER

SEQ ID NO: 1185704 - protein, 24 aa, Mycobacterium
SLYTTPGQHGVSPYPHSEPSQCGR

SEQ ID NO: 1185705 - protein, 5 aa, Mycobacterium
SMGGG

SEQ ID NO: 1185706 - protein, 47 aa, Mycobacterium
SMGGLGSGGGGGLGSGGGVPKMPGGLGGSGLSGSNPLSGGVGQMPGA

SEQ ID NO: 1185707 - protein, 7 aa, Mycobacterium
SMNNGDD

SEQ ID NO: 1185708 - protein, 18 aa, Mycobacterium
SMTPQQKRQVRDEVATGQ

SEQ ID NO: 1185709 - protein, 11 aa, Mycobacterium
SNARSYDEAAQ

SEQ ID NO: 1185710 - protein, 10 aa, Mycobacterium
SNDAATDGAK

SEQ ID NO: 1185711 - protein, 7 aa, Mycobacterium
SNENGDV

SEQ ID NO: 1185712 - protein, 6 aa, Mycobacterium
SNGHSL

SEQ ID NO: 1185713 - protein, 16 aa, Mycobacterium
SNHPLAGGSGVSSGAG

SEQ ID NO: 1185714 - protein, 6 aa, Mycobacterium
SNIGPD

SEQ ID NO: 1185715 - protein, 17 aa, Mycobacterium
SNKPVEPIDSASSDRSV

SEQ ID NO: 1185716 - protein, 7 aa, Mycobacterium
SNKTPVE

SEQ ID NO: 1185717 - protein, 16 aa, Mycobacterium
SNLQATPTREGLRPND

SEQ ID NO: 1185718 - protein, 14 aa, Mycobacterium
SNPADARPLPASAA

SEQ ID NO: 1185719 - protein, 6 aa, Mycobacterium
SNPELR

SEQ ID NO: 1185720 - protein, 5 aa, Mycobacterium
SNPTY

SEQ ID NO: 1185721 - protein, 4 aa, Mycobacterium
SNRG

SEQ ID NO: 1185722 - protein, 8 aa, Mycobacterium
SNRGVSEP

SEQ ID NO: 1185723 - protein, 7 aa, Mycobacterium
SPAAAGE

SEQ ID NO: 1185724 - protein, 5 aa, Mycobacterium
SPAER

SEQ ID NO: 1185725 - protein, 8 aa, Mycobacterium
SPAGSAIE

SEQ ID NO: 1185726 - protein, 9 aa, Mycobacterium
SPAKSVPAA

SEQ ID NO: 1185727 - protein, 9 aa, Mycobacterium
SPAQPDATA

SEQ ID NO: 1185728 - protein, 7 aa, Mycobacterium
SPARSFA

SEQ ID NO: 1185729 - protein, 5 aa, Mycobacterium
SPASA

SEQ ID NO: 1185730 - protein, 14 aa, Mycobacterium
SPATAAADPGITNG

SEQ ID NO: 1185731 - protein, 6 aa, Mycobacterium
SPATRE

SEQ ID NO: 1185732 - protein, 14 aa, Mycobacterium
SPCRTPGSNPSTAA

SEQ ID NO: 1185733 - protein, 5 aa, Mycobacterium
SPDLG

SEQ ID NO: 1185734 - protein, 30 aa, Mycobacterium
SPDYTDRAEARAEKVSGSWGEVDSAELDRE

SEQ ID NO: 1185735 - protein, 4 aa, Mycobacterium
SPEA

SEQ ID NO: 1185736 - protein, 6 aa, Mycobacterium
SPENAR

SEQ ID NO: 1185737 - protein, 8 aa, Mycobacterium
SPERLSGK

SEQ ID NO: 1185738 - protein, 11 aa, Mycobacterium
SPETAREGPSR

SEQ ID NO: 1185739 - protein, 9 aa, Mycobacterium
SPGAGGEHL

SEQ ID NO: 1185740 - protein, 5 aa, Mycobacterium
SPGEQ

SEQ ID NO: 1185741 - protein, 16 aa, Mycobacterium
SPGERDAMETDRHNEA

SEQ ID NO: 1185742 - protein, 23 aa, Mycobacterium
SPGGGGGAGQSPAADQSPEPGGW

SEQ ID NO: 1185743 - protein, 8 aa, Mycobacterium
SPGGLGRR

SEQ ID NO: 1185744 - protein, 6 aa, Mycobacterium
SPGGQP

SEQ ID NO: 1185745 - protein, 9 aa, Mycobacterium
SPGRDTPVN

SEQ ID NO: 1185746 - protein, 12 aa, Mycobacterium
SPGTPDHDRQRE

SEQ ID NO: 1185747 - protein, 5 aa, Mycobacterium
SPGVE

SEQ ID NO: 1185748 - protein, 4 aa, Mycobacterium
SPIA

SEQ ID NO: 1185749 - protein, 5 aa, Mycobacterium
SPITA

SEQ ID NO: 1185750 - protein, 5 aa, Mycobacterium
SPKQR

SEQ ID NO: 1185751 - protein, 23 aa, Mycobacterium
SPKRFEDAKTQVEEVKSGNSRPF

SEQ ID NO: 1185752 - protein, 14 aa, Mycobacterium
SPLATTISTPGAAP

SEQ ID NO: 1185753 - protein, 5 aa, Mycobacterium
SPLEP

SEQ ID NO: 1185754 - protein, 5 aa, Mycobacterium
SPLPG

SEQ ID NO: 1185755 - protein, 6 aa, Mycobacterium
SPLPHP

SEQ ID NO: 1185756 - protein, 8 aa, Mycobacterium
SPLPRAQS

SEQ ID NO: 1185757 - protein, 11 aa, Mycobacterium
SPLSTGDANGY

SEQ ID NO: 1185758 - protein, 9 aa, Mycobacterium
SPLYTDDER

SEQ ID NO: 1185759 - protein, 11 aa, Mycobacterium
SPNQRAYAAPE

SEQ ID NO: 1185760 - protein, 19 aa, Mycobacterium
SPNSFRGKYRGADVGRYAT

SEQ ID NO: 1185761 - protein, 7 aa, Mycobacterium
SPPGSAA

SEQ ID NO: 1185762 - protein, 9 aa, Mycobacterium
SPPPTAPAG

SEQ ID NO: 1185763 - protein, 16 aa, Mycobacterium
SPQAATHSERLTSDTV

SEQ ID NO: 1185764 - protein, 7 aa, Mycobacterium
SPQGVAE

SEQ ID NO: 1185765 - protein, 8 aa, Mycobacterium
SPQPTTAR

SEQ ID NO: 1185766 - protein, 16 aa, Mycobacterium
SPRATTTRTAVRGAGE

SEQ ID NO: 1185767 - protein, 8 aa, Mycobacterium
SPREVADQ

SEQ ID NO: 1185768 - protein, 14 aa, Mycobacterium
SPRQTRLEQAETAT

SEQ ID NO: 1185769 - protein, 10 aa, Mycobacterium
SPRRGSHGTA

SEQ ID NO: 1185770 - protein, 6 aa, Mycobacterium
SPSAPV

SEQ ID NO: 1185771 - protein, 5 aa, Mycobacterium
SPSAY

SEQ ID NO: 1185772 - protein, 8 aa, Mycobacterium
SPSDKGPG

SEQ ID NO: 1185773 - protein, 5 aa, Mycobacterium
SPSGA

SEQ ID NO: 1185774 - protein, 11 aa, Mycobacterium
SPSGGNRAPTA

SEQ ID NO: 1185775 - protein, 11 aa, Mycobacterium
SPSGPRLAGSL

SEQ ID NO: 1185776 - protein, 18 aa, Mycobacterium
SPSGTETVITSNDGASYI

SEQ ID NO: 1185777 - protein, 6 aa, Mycobacterium
SPSQLS

SEQ ID NO: 1185778 - protein, 4 aa, Mycobacterium
SPTA

SEQ ID NO: 1185779 - protein, 10 aa, Mycobacterium
SPTDRQDSEL

SEQ ID NO: 1185780 - protein, 4 aa, Mycobacterium
SPTL

SEQ ID NO: 1185781 - protein, 5 aa, Mycobacterium
SPTNR

SEQ ID NO: 1185782 - protein, 8 aa, Mycobacterium
SPTSGQIR

SEQ ID NO: 1185783 - protein, 13 aa, Mycobacterium
SPVGAPGVAPNGF

SEQ ID NO: 1185784 - protein, 11 aa, Mycobacterium
SPVGDPGSVAR

SEQ ID NO: 1185785 - protein, 9 aa, Mycobacterium
SPVGGGGSI

SEQ ID NO: 1185786 - protein, 13 aa, Mycobacterium
SPVGGQGMNTGLQ

SEQ ID NO: 1185787 - protein, 5 aa, Mycobacterium
SPVPS

SEQ ID NO: 1185788 - protein, 8 aa, Mycobacterium
SPVRGDGL

SEQ ID NO: 1185789 - protein, 5 aa, Mycobacterium
SPYDE

SEQ ID NO: 1185790 - protein, 5 aa, Mycobacterium
SQAPK

SEQ ID NO: 1185791 - protein, 4 aa, Mycobacterium
SQDF

SEQ ID NO: 1185792 - protein, 5 aa, Mycobacterium
SQDSN

SEQ ID NO: 1185793 - protein, 6 aa, Mycobacterium
SQDSNV

SEQ ID NO: 1185794 - protein, 5 aa, Mycobacterium
SQDYR

SEQ ID NO: 1185795 - protein, 14 aa, Mycobacterium
SQEERTTARSTPSV

SEQ ID NO: 1185796 - protein, 4 aa, Mycobacterium
SQFT

SEQ ID NO: 1185797 - protein, 21 aa, Mycobacterium
SQGKGAWPSCGGPLSGATPRN

SEQ ID NO: 1185798 - protein, 12 aa, Mycobacterium
SQHGSDELSATA

SEQ ID NO: 1185799 - protein, 13 aa, Mycobacterium
SQITEPARGLTYP

SEQ ID NO: 1185800 - protein, 7 aa, Mycobacterium
SQKAGPV

SEQ ID NO: 1185801 - protein, 7 aa, Mycobacterium
SQLGPAD

SEQ ID NO: 1185802 - protein, 10 aa, Mycobacterium
SQNDPRSSYR

SEQ ID NO: 1185803 - protein, 9 aa, Mycobacterium
SQNPDDEAA

SEQ ID NO: 1185804 - protein, 10 aa, Mycobacterium
SQNPDQLESA

SEQ ID NO: 1185805 - protein, 6 aa, Mycobacterium
SQPDPR

SEQ ID NO: 1185806 - protein, 11 aa, Mycobacterium
SQPGPVTTAED

SEQ ID NO: 1185807 - protein, 6 aa, Mycobacterium
SQPLPS

SEQ ID NO: 1185808 - protein, 5 aa, Mycobacterium
SQPQA

SEQ ID NO: 1185809 - protein, 6 aa, Mycobacterium
SQQYKP

SEQ ID NO: 1185810 - protein, 13 aa, Mycobacterium
SQRDSAAPAPRSV

SEQ ID NO: 1185811 - protein, 6 aa, Mycobacterium
SQRENV

SEQ ID NO: 1185812 - protein, 6 aa, Mycobacterium
SQREPV

SEQ ID NO: 1185813 - protein, 10 aa, Mycobacterium
SQRGGPRPNV

SEQ ID NO: 1185814 - protein, 8 aa, Mycobacterium
SQSPFAGT

SEQ ID NO: 1185815 - protein, 5 aa, Mycobacterium
SQTNR

SEQ ID NO: 1185816 - protein, 12 aa, Mycobacterium
SRAAQRGRLPGH

SEQ ID NO: 1185817 - protein, 17 aa, Mycobacterium
SRADARNRKDWATADQI

SEQ ID NO: 1185818 - protein, 8 aa, Mycobacterium
SRADGTVF

SEQ ID NO: 1185819 - protein, 10 aa, Mycobacterium
SRAEIEQAKG

SEQ ID NO: 1185820 - protein, 10 aa, Mycobacterium
SRAKSDRRSQ

SEQ ID NO: 1185821 - protein, 8 aa, Mycobacterium
SRAQPGLE

SEQ ID NO: 1185822 - protein, 4 aa, Mycobacterium
SRAV

SEQ ID NO: 1185823 - protein, 7 aa, Mycobacterium
SRAYNTD

SEQ ID NO: 1185824 - protein, 8 aa, Mycobacterium
SRDASPSV

SEQ ID NO: 1185825 - protein, 10 aa, Mycobacterium
SRDDEDSYTI

SEQ ID NO: 1185826 - protein, 11 aa, Mycobacterium
SRDGDGAPYRT

SEQ ID NO: 1185827 - protein, 15 aa, Mycobacterium
SRDGNTAYRAGRDIK

SEQ ID NO: 1185828 - protein, 16 aa, Mycobacterium
SRDGNTAYRAGRDIKA

SEQ ID NO: 1185829 - protein, 5 aa, Mycobacterium
SRDNA

SEQ ID NO: 1185830 - protein, 9 aa, Mycobacterium
SRDPVPAQR

SEQ ID NO: 1185831 - protein, 7 aa, Mycobacterium
SREERSA

SEQ ID NO: 1185832 - protein, 12 aa, Mycobacterium
SRERDGKAYRYR

SEQ ID NO: 1185833 - protein, 15 aa, Mycobacterium
SRERSSLATTTSRED

SEQ ID NO: 1185834 - protein, 5 aa, Mycobacterium
SRFDT

SEQ ID NO: 1185835 - protein, 4 aa, Mycobacterium
SRFP

SEQ ID NO: 1185836 - protein, 6 aa, Mycobacterium
SRFPPA

SEQ ID NO: 1185837 - protein, 19 aa, Mycobacterium
SRGDTPGVPAGSEAPTTKV

SEQ ID NO: 1185838 - protein, 22 aa, Mycobacterium
SRGERQHRSDVTRPHGGFLVDS

SEQ ID NO: 1185839 - protein, 8 aa, Mycobacterium
SRGGAPDI

SEQ ID NO: 1185840 - protein, 5 aa, Mycobacterium
SRGIT

SEQ ID NO: 1185841 - protein, 6 aa, Mycobacterium
SRGQSA

SEQ ID NO: 1185842 - protein, 19 aa, Mycobacterium
SRHVGDDSPAVAAPPTPER

SEQ ID NO: 1185843 - protein, 8 aa, Mycobacterium
SRIEPGTD

SEQ ID NO: 1185844 - protein, 7 aa, Mycobacterium
SRISSED

SEQ ID NO: 1185845 - protein, 22 aa, Mycobacterium
SRKVAGAPGLDGLPAPAEPMTE

SEQ ID NO: 1185846 - protein, 7 aa, Mycobacterium
SRLPADN

SEQ ID NO: 1185847 - protein, 9 aa, Mycobacterium
SRLRGTDER

SEQ ID NO: 1185848 - protein, 5 aa, Mycobacterium
SRPLP

SEQ ID NO: 1185849 - protein, 11 aa, Mycobacterium
SRPPTAEESQR

SEQ ID NO: 1185850 - protein, 6 aa, Mycobacterium
SRPSAE

SEQ ID NO: 1185851 - protein, 57 aa, Mycobacterium
SRPSREGRRGGAGESAGGARARRAQGSKAAAAKKAPASSSKKAATTTEASEEAKGGS

SEQ ID NO: 1185852 - protein, 11 aa, Mycobacterium
SRQTQGSRLSD

SEQ ID NO: 1185853 - protein, 6 aa, Mycobacterium
SRQTYG

SEQ ID NO: 1185854 - protein, 11 aa, Mycobacterium
SRRDRAKSLRQ

SEQ ID NO: 1185855 - protein, 13 aa, Mycobacterium
SRRPDESVIAPDG

SEQ ID NO: 1185856 - protein, 10 aa, Mycobacterium
SRRRTSGADD

SEQ ID NO: 1185857 - protein, 12 aa, Mycobacterium
SRSGRDVTAEYP

SEQ ID NO: 1185858 - protein, 4 aa, Mycobacterium
SRSP

SEQ ID NO: 1185859 - protein, 9 aa, Mycobacterium
SRSVGENGE

SEQ ID NO: 1185860 - protein, 4 aa, Mycobacterium
SRTM

SEQ ID NO: 1185861 - protein, 23 aa, Mycobacterium
SRTVAAPSSRVTAVGHRESSSRQ

SEQ ID NO: 1185862 - protein, 11 aa, Mycobacterium
SRTVSADRTPH

SEQ ID NO: 1185863 - protein, 10 aa, Mycobacterium
SSAANQLGAG

SEQ ID NO: 1185864 - protein, 8 aa, Mycobacterium
SSAESRRL

SEQ ID NO: 1185865 - protein, 6 aa, Mycobacterium
SSAGLL

SEQ ID NO: 1185866 - protein, 8 aa, Mycobacterium
SSALSDEN

SEQ ID NO: 1185867 - protein, 8 aa, Mycobacterium
SSAQADRP

SEQ ID NO: 1185868 - protein, 8 aa, Mycobacterium
SSAQSRDV

SEQ ID NO: 1185869 - protein, 12 aa, Mycobacterium
SSASAGPGTRAN

SEQ ID NO: 1185870 - protein, 10 aa, Mycobacterium
SSDATRNKER

SEQ ID NO: 1185871 - protein, 4 aa, Mycobacterium
SSDF

SEQ ID NO: 1185872 - protein, 9 aa, Mycobacterium
SSDSGAADT

SEQ ID NO: 1185873 - protein, 17 aa, Mycobacterium
SSDSGYSRYTSEWDGAA

SEQ ID NO: 1185874 - protein, 17 aa, Mycobacterium
SSDSGYSRYTSEWDGAQ

SEQ ID NO: 1185875 - protein, 7 aa, Mycobacterium
SSDTLKT

SEQ ID NO: 1185876 - protein, 11 aa, Mycobacterium
SSEAADKAQRG

SEQ ID NO: 1185877 - protein, 13 aa, Mycobacterium
SSGKRDPRELSTQ

SEQ ID NO: 1185878 - protein, 5 aa, Mycobacterium
SSGLP

SEQ ID NO: 1185879 - protein, 6 aa, Mycobacterium
SSGRLG

SEQ ID NO: 1185880 - protein, 14 aa, Mycobacterium
SSGRLSGVTEPGTM

SEQ ID NO: 1185881 - protein, 6 aa, Mycobacterium
SSGSIA

SEQ ID NO: 1185882 - protein, 12 aa, Mycobacterium
SSGTTGRPKGIK

SEQ ID NO: 1185883 - protein, 11 aa, Mycobacterium
SSGTTVRPKGI

SEQ ID NO: 1185884 - protein, 4 aa, Mycobacterium
SSHP

SEQ ID NO: 1185885 - protein, 12 aa, Mycobacterium
SSKVAKTAAATF

SEQ ID NO: 1185886 - protein, 4 aa, Mycobacterium
SSNP

SEQ ID NO: 1185887 - protein, 8 aa, Mycobacterium
SSPAHEDG

SEQ ID NO: 1185888 - protein, 7 aa, Mycobacterium
SSPAVSD

SEQ ID NO: 1185889 - protein, 16 aa, Mycobacterium
SSPGVHDPRSGTPPVG

SEQ ID NO: 1185890 - protein, 7 aa, Mycobacterium
SSPHQHA

SEQ ID NO: 1185891 - protein, 6 aa, Mycobacterium
SSPQQL

SEQ ID NO: 1185892 - protein, 18 aa, Mycobacterium
SSPVSYERSHAPATLPEA

SEQ ID NO: 1185893 - protein, 8 aa, Mycobacterium
SSQFANPN

SEQ ID NO: 1185894 - protein, 17 aa, Mycobacterium
SSQGGRTSFPGVSAYSA

SEQ ID NO: 1185895 - protein, 15 aa, Mycobacterium
SSQQKEIDTMQGMLN

SEQ ID NO: 1185896 - protein, 4 aa, Mycobacterium
SSRP

SEQ ID NO: 1185897 - protein, 13 aa, Mycobacterium
SSRVGRDSSKPGL

SEQ ID NO: 1185898 - protein, 9 aa, Mycobacterium
SSSAAHSNA

SEQ ID NO: 1185899 - protein, 27 aa, Mycobacterium
SSSELYGATPPPQNEETPFYPRSPYAA

SEQ ID NO: 1185900 - protein, 4 aa, Mycobacterium
SSSG

SEQ ID NO: 1185901 - protein, 4 aa, Mycobacterium
SSSL

SEQ ID NO: 1185902 - protein, 10 aa, Mycobacterium
SSTCDEAGHP

SEQ ID NO: 1185903 - protein, 13 aa, Mycobacterium
SSTIRNPATGAVA

SEQ ID NO: 1185904 - protein, 8 aa, Mycobacterium
SSTPQATV

SEQ ID NO: 1185905 - protein, 19 aa, Mycobacterium
SSTPTARKDYIGGAAQTAR

SEQ ID NO: 1185906 - protein, 6 aa, Mycobacterium
SSTVET

SEQ ID NO: 1185907 - protein, 6 aa, Mycobacterium
SSVGAT

SEQ ID NO: 1185908 - protein, 5 aa, Mycobacterium
SSWED

SEQ ID NO: 1185909 - protein, 6 aa, Mycobacterium
SSYAGL

SEQ ID NO: 1185910 - protein, 8 aa, Mycobacterium
STAAEQVG

SEQ ID NO: 1185911 - protein, 5 aa, Mycobacterium
STAAG

SEQ ID NO: 1185912 - protein, 12 aa, Mycobacterium
STAAREDVTSAA

SEQ ID NO: 1185913 - protein, 7 aa, Mycobacterium
STAEDGA

SEQ ID NO: 1185914 - protein, 19 aa, Mycobacterium
STAGIDTSPYSRAKSAAEA

SEQ ID NO: 1185915 - protein, 5 aa, Mycobacterium
STALR

SEQ ID NO: 1185916 - protein, 5 aa, Mycobacterium
STARL

SEQ ID NO: 1185917 - protein, 12 aa, Mycobacterium
STATAAASGPVA

SEQ ID NO: 1185918 - protein, 9 aa, Mycobacterium
STATGSRMT

SEQ ID NO: 1185919 - protein, 8 aa, Mycobacterium
STATGYGC

SEQ ID NO: 1185920 - protein, 7 aa, Mycobacterium
STDPDQL

SEQ ID NO: 1185921 - protein, 8 aa, Mycobacterium
STDSGPVT

SEQ ID NO: 1185922 - protein, 8 aa, Mycobacterium
STEAPEEF

SEQ ID NO: 1185923 - protein, 16 aa, Mycobacterium
STEATVDAGHTRTPEQ

SEQ ID NO: 1185924 - protein, 4 aa, Mycobacterium
STEH

SEQ ID NO: 1185925 - protein, 8 aa, Mycobacterium
STENANTF

SEQ ID NO: 1185926 - protein, 17 aa, Mycobacterium
STENTPEPAARVPSEPV

SEQ ID NO: 1185927 - protein, 8 aa, Mycobacterium
STFGSEQL

SEQ ID NO: 1185928 - protein, 5 aa, Mycobacterium
STGGV

SEQ ID NO: 1185929 - protein, 6 aa, Mycobacterium
STGPFR

SEQ ID NO: 1185930 - protein, 10 aa, Mycobacterium
STGPPGTRGP

SEQ ID NO: 1185931 - protein, 5 aa, Mycobacterium
STGRA

SEQ ID NO: 1185932 - protein, 10 aa, Mycobacterium
STGRPIPDGT

SEQ ID NO: 1185933 - protein, 15 aa, Mycobacterium
STGSTAKTIADKGIP

SEQ ID NO: 1185934 - protein, 10 aa, Mycobacterium
STGTGSGKTE

SEQ ID NO: 1185935 - protein, 6 aa, Mycobacterium
STGTTH

SEQ ID NO: 1185936 - protein, 7 aa, Mycobacterium
STHGPTP

SEQ ID NO: 1185937 - protein, 6 aa, Mycobacterium
STHRDR

SEQ ID NO: 1185938 - protein, 6 aa, Mycobacterium
STIEGG

SEQ ID NO: 1185939 - protein, 8 aa, Mycobacterium
STIPPTDL

SEQ ID NO: 1185940 - protein, 4 aa, Mycobacterium
STIR

SEQ ID NO: 1185941 - protein, 5 aa, Mycobacterium
STITT

SEQ ID NO: 1185942 - protein, 14 aa, Mycobacterium
STKELGVDPERVNV

SEQ ID NO: 1185943 - protein, 6 aa, Mycobacterium
STKRPR

SEQ ID NO: 1185944 - protein, 8 aa, Mycobacterium
STPDPEEI

SEQ ID NO: 1185945 - protein, 4 aa, Mycobacterium
STPL

SEQ ID NO: 1185946 - protein, 11 aa, Mycobacterium
STPVVDGDPTG

SEQ ID NO: 1185947 - protein, 7 aa, Mycobacterium
STQGRQK

SEQ ID NO: 1185948 - protein, 6 aa, Mycobacterium
STQPEI

SEQ ID NO: 1185949 - protein, 12 aa, Mycobacterium
STRGASTRSSKP

SEQ ID NO: 1185950 - protein, 5 aa, Mycobacterium
STRHN

SEQ ID NO: 1185951 - protein, 14 aa, Mycobacterium
STRPYPGDHPVQGT

SEQ ID NO: 1185952 - protein, 4 aa, Mycobacterium
STRS

SEQ ID NO: 1185953 - protein, 18 aa, Mycobacterium
STSRTQRKPRGQTERRGR

SEQ ID NO: 1185954 - protein, 11 aa, Mycobacterium
STTAPEALGGG

SEQ ID NO: 1185955 - protein, 12 aa, Mycobacterium
STTAVAPDAEDT

SEQ ID NO: 1185956 - protein, 6 aa, Mycobacterium
STTPEK

SEQ ID NO: 1185957 - protein, 8 aa, Mycobacterium
STTPGEDG

SEQ ID NO: 1185958 - protein, 6 aa, Mycobacterium
STTVDT

SEQ ID NO: 1185959 - protein, 6 aa, Mycobacterium
STVAEL

SEQ ID NO: 1185960 - protein, 6 aa, Mycobacterium
STVATA

SEQ ID NO: 1185961 - protein, 12 aa, Mycobacterium
STVTSGATITAG

SEQ ID NO: 1185962 - protein, 11 aa, Mycobacterium
STYEDETGTLR

SEQ ID NO: 1185963 - protein, 9 aa, Mycobacterium
SVADAEDAV

SEQ ID NO: 1185964 - protein, 4 aa, Mycobacterium
SVAQ

SEQ ID NO: 1185965 - protein, 7 aa, Mycobacterium
SVAQEAA

SEQ ID NO: 1185966 - protein, 5 aa, Mycobacterium
SVARG

SEQ ID NO: 1185967 - protein, 13 aa, Mycobacterium
SVASTSKTSTGDM

SEQ ID NO: 1185968 - protein, 10 aa, Mycobacterium
SVDEDGAAGS

SEQ ID NO: 1185969 - protein, 5 aa, Mycobacterium
SVDHR

SEQ ID NO: 1185970 - protein, 6 aa, Mycobacterium
SVEDCG

SEQ ID NO: 1185971 - protein, 5 aa, Mycobacterium
SVEGA

SEQ ID NO: 1185972 - protein, 11 aa, Mycobacterium
SVEGERSPREF

SEQ ID NO: 1185973 - protein, 5 aa, Mycobacterium
SVESG

SEQ ID NO: 1185974 - protein, 8 aa, Mycobacterium
SVGKTTTV

SEQ ID NO: 1185975 - protein, 9 aa, Mycobacterium
SVGPEALAT

SEQ ID NO: 1185976 - protein, 14 aa, Mycobacterium
SVGRNSGSPVSRAY

SEQ ID NO: 1185977 - protein, 8 aa, Mycobacterium
SVGSQGVA

SEQ ID NO: 1185978 - protein, 4 aa, Mycobacterium
SVGT

SEQ ID NO: 1185979 - protein, 6 aa, Mycobacterium
SVGTSS

SEQ ID NO: 1185980 - protein, 15 aa, Mycobacterium
SVNSRDARGGTAPVQ

SEQ ID NO: 1185981 - protein, 26 aa, Mycobacterium
SVNTANRQGKRKRTRSGFGQRKSTKR

SEQ ID NO: 1185982 - protein, 10 aa, Mycobacterium
SVNTATGGIE

SEQ ID NO: 1185983 - protein, 9 aa, Mycobacterium
SVPAGDGAV

SEQ ID NO: 1185984 - protein, 5 aa, Mycobacterium
SVPAR

SEQ ID NO: 1185985 - protein, 9 aa, Mycobacterium
SVPDRQRNV

SEQ ID NO: 1185986 - protein, 7 aa, Mycobacterium
SVPDYQG

SEQ ID NO: 1185987 - protein, 6 aa, Mycobacterium
SVPPSV

SEQ ID NO: 1185988 - protein, 7 aa, Mycobacterium
SVQAKQD

SEQ ID NO: 1185989 - protein, 5 aa, Mycobacterium
SVQNT

SEQ ID NO: 1185990 - protein, 6 aa, Mycobacterium
SVQSMR

SEQ ID NO: 1185991 - protein, 15 aa, Mycobacterium
SVRRPAELPEGVGQA

SEQ ID NO: 1185992 - protein, 8 aa, Mycobacterium
SVRTAADR

SEQ ID NO: 1185993 - protein, 15 aa, Mycobacterium
SVSRARTGTLDGDLR

SEQ ID NO: 1185994 - protein, 36 aa, Mycobacterium
SVTDAQESARRRETEPEHAAEEAKPHPGEAPSAPKE

SEQ ID NO: 1185995 - protein, 10 aa, Mycobacterium
SVTKTRAPRT

SEQ ID NO: 1185996 - protein, 13 aa, Mycobacterium
SVTSRAAGALPQG

SEQ ID NO: 1185997 - protein, 5 aa, Mycobacterium
SVYAA

SEQ ID NO: 1185998 - protein, 5 aa, Mycobacterium
SWGGN

SEQ ID NO: 1185999 - protein, 7 aa, Mycobacterium
SWGRPPH

SEQ ID NO: 1186000 - protein, 8 aa, Mycobacterium
SWSDDNAR

SEQ ID NO: 1186001 - protein, 10 aa, Mycobacterium
SYDPDDDDTL

SEQ ID NO: 1186002 - protein, 12 aa, Mycobacterium
SYGQNPRDTLQA

SEQ ID NO: 1186003 - protein, 10 aa, Mycobacterium
SYQRPTDMGR

SEQ ID NO: 1186004 - protein, 6 aa, Mycobacterium
SYQRQR

SEQ ID NO: 1186005 - protein, 4 aa, Mycobacterium
SYRP

SEQ ID NO: 1186006 - protein, 5 aa, Mycobacterium
SYRSA

SEQ ID NO: 1186007 - protein, 11 aa, Mycobacterium
SYSAAKTAEAA

SEQ ID NO: 1186008 - protein, 11 aa, Mycobacterium
SYSAPAAGVGR

SEQ ID NO: 1186009 - protein, 8 aa, Mycobacterium
SYTPGPHR

SEQ ID NO: 1186010 - protein, 17 aa, Mycobacterium
SYTRRDDEEHGFKLGAQ

SEQ ID NO: 1186011 - protein, 5 aa, Mycobacterium
TAAAE

SEQ ID NO: 1186012 - protein, 9 aa, Mycobacterium
TAAAPLGGR

SEQ ID NO: 1186013 - protein, 9 aa, Mycobacterium
TAAAQAQGL

SEQ ID NO: 1186014 - protein, 16 aa, Mycobacterium
TAAASRVKASTKPCAG

SEQ ID NO: 1186015 - protein, 13 aa, Mycobacterium
TAADARNYSSAAR

SEQ ID NO: 1186016 - protein, 11 aa, Mycobacterium
TAAEKRQYADS

SEQ ID NO: 1186017 - protein, 14 aa, Mycobacterium
TAAENQLGEGARAR

SEQ ID NO: 1186018 - protein, 9 aa, Mycobacterium
TAAGEDAAL

SEQ ID NO: 1186019 - protein, 5 aa, Mycobacterium
TAAGN

SEQ ID NO: 1186020 - protein, 10 aa, Mycobacterium
TAAGSGTAAG

SEQ ID NO: 1186021 - protein, 5 aa, Mycobacterium
TAAQY

SEQ ID NO: 1186022 - protein, 13 aa, Mycobacterium
TAASPAALPGPSG

SEQ ID NO: 1186023 - protein, 9 aa, Mycobacterium
TAATGLAER

SEQ ID NO: 1186024 - protein, 8 aa, Mycobacterium
TAATGVNR

SEQ ID NO: 1186025 - protein, 27 aa, Mycobacterium
TACSTDAGGPDLRRRPRGHTNGTAGAG

SEQ ID NO: 1186026 - protein, 6 aa, Mycobacterium
TADAPN

SEQ ID NO: 1186027 - protein, 9 aa, Mycobacterium
TADARQVDN

SEQ ID NO: 1186028 - protein, 10 aa, Mycobacterium
TADDATKTMT

SEQ ID NO: 1186029 - protein, 7 aa, Mycobacterium
TADERSW

SEQ ID NO: 1186030 - protein, 5 aa, Mycobacterium
TADEV

SEQ ID NO: 1186031 - protein, 4 aa, Mycobacterium
TADG

SEQ ID NO: 1186032 - protein, 6 aa, Mycobacterium
TADGLG

SEQ ID NO: 1186033 - protein, 7 aa, Mycobacterium
TADGSAL

SEQ ID NO: 1186034 - protein, 5 aa, Mycobacterium
TADGT

SEQ ID NO: 1186035 - protein, 7 aa, Mycobacterium
TADRDPH

SEQ ID NO: 1186036 - protein, 5 aa, Mycobacterium
TADRP

SEQ ID NO: 1186037 - protein, 6 aa, Mycobacterium
TAEGQE

SEQ ID NO: 1186038 - protein, 10 aa, Mycobacterium
TAEGSASADT

SEQ ID NO: 1186039 - protein, 17 aa, Mycobacterium
TAEHERQQRNYAELQGK

SEQ ID NO: 1186040 - protein, 12 aa, Mycobacterium
TAEPPAGTRARE

SEQ ID NO: 1186041 - protein, 12 aa, Mycobacterium
TAEPPGVGGTGQ

SEQ ID NO: 1186042 - protein, 9 aa, Mycobacterium
TAEQGTTAL

SEQ ID NO: 1186043 - protein, 9 aa, Mycobacterium
TAEQTSTTI

SEQ ID NO: 1186044 - protein, 4 aa, Mycobacterium
TAER

SEQ ID NO: 1186045 - protein, 5 aa, Mycobacterium
TAERE

SEQ ID NO: 1186046 - protein, 8 aa, Mycobacterium
TAEVAEPV

SEQ ID NO: 1186047 - protein, 17 aa, Mycobacterium
TAFDGKRDGVAATATRY

SEQ ID NO: 1186048 - protein, 4 aa, Mycobacterium
TAGA

SEQ ID NO: 1186049 - protein, 8 aa, Mycobacterium
TAGAGLDT

SEQ ID NO: 1186050 - protein, 4 aa, Mycobacterium
TAGG

SEQ ID NO: 1186051 - protein, 5 aa, Mycobacterium
TAGGI

SEQ ID NO: 1186052 - protein, 6 aa, Mycobacterium
TAGLTG

SEQ ID NO: 1186053 - protein, 18 aa, Mycobacterium
TAGPSDGPASTPGPDPAL

SEQ ID NO: 1186054 - protein, 11 aa, Mycobacterium
TAGTSATEFAG

SEQ ID NO: 1186055 - protein, 15 aa, Mycobacterium
TAGTVTVGPDEVAAA

SEQ ID NO: 1186056 - protein, 4 aa, Mycobacterium
TAHE

SEQ ID NO: 1186057 - protein, 10 aa, Mycobacterium
TAHPLDPRPQ

SEQ ID NO: 1186058 - protein, 7 aa, Mycobacterium
TALGAGY

SEQ ID NO: 1186059 - protein, 12 aa, Mycobacterium
TALGDPTAWPQS

SEQ ID NO: 1186060 - protein, 4 aa, Mycobacterium
TALR

SEQ ID NO: 1186061 - protein, 11 aa, Mycobacterium
TAMKSQDKLRT

SEQ ID NO: 1186062 - protein, 8 aa, Mycobacterium
TANRGERY

SEQ ID NO: 1186063 - protein, 8 aa, Mycobacterium
TAPAEGTV

SEQ ID NO: 1186064 - protein, 8 aa, Mycobacterium
TAPAPHHT

SEQ ID NO: 1186065 - protein, 6 aa, Mycobacterium
TAPDAP

SEQ ID NO: 1186066 - protein, 6 aa, Mycobacterium
TAPDSI

SEQ ID NO: 1186067 - protein, 9 aa, Mycobacterium
TAPELDDSE

SEQ ID NO: 1186068 - protein, 8 aa, Mycobacterium
TAPGGDAQ

SEQ ID NO: 1186069 - protein, 5 aa, Mycobacterium
TAPLR

SEQ ID NO: 1186070 - protein, 10 aa, Mycobacterium
TAPNAEAARA

SEQ ID NO: 1186071 - protein, 17 aa, Mycobacterium
TAPNPPQAGGGTEFPRS

SEQ ID NO: 1186072 - protein, 6 aa, Mycobacterium
TAPPAV

SEQ ID NO: 1186073 - protein, 11 aa, Mycobacterium
TAPPSEPATIE

SEQ ID NO: 1186074 - protein, 7 aa, Mycobacterium
TAPRGTE

SEQ ID NO: 1186075 - protein, 11 aa, Mycobacterium
TAPRLPDGTPF

SEQ ID NO: 1186076 - protein, 16 aa, Mycobacterium
TAPVEEKAPAAEAKLP

SEQ ID NO: 1186077 - protein, 9 aa, Mycobacterium
TAQDQGPSF

SEQ ID NO: 1186078 - protein, 7 aa, Mycobacterium
TAQPFSG

SEQ ID NO: 1186079 - protein, 8 aa, Mycobacterium
TARAAGVT

SEQ ID NO: 1186080 - protein, 24 aa, Mycobacterium
TARAEQARRAALNNTPAGEPGQRL

SEQ ID NO: 1186081 - protein, 16 aa, Mycobacterium
TARARANLEREGTPSA

SEQ ID NO: 1186082 - protein, 15 aa, Mycobacterium
TARATRDDEPLDAAT

SEQ ID NO: 1186083 - protein, 6 aa, Mycobacterium
TARGAV

SEQ ID NO: 1186084 - protein, 9 aa, Mycobacterium
TARKKPPFG

SEQ ID NO: 1186085 - protein, 10 aa, Mycobacterium
TARKYGPAAR

SEQ ID NO: 1186086 - protein, 4 aa, Mycobacterium
TARQ

SEQ ID NO: 1186087 - protein, 5 aa, Mycobacterium
TARQA

SEQ ID NO: 1186088 - protein, 5 aa, Mycobacterium
TARRG

SEQ ID NO: 1186089 - protein, 7 aa, Mycobacterium
TARSGIA

SEQ ID NO: 1186090 - protein, 4 aa, Mycobacterium
TART

SEQ ID NO: 1186091 - protein, 11 aa, Mycobacterium
TARTLSPVPPP

SEQ ID NO: 1186092 - protein, 12 aa, Mycobacterium
TASAAPRSEVAA

SEQ ID NO: 1186093 - protein, 10 aa, Mycobacterium
TASDGEGTLG

SEQ ID NO: 1186094 - protein, 8 aa, Mycobacterium
TASDPRFD

SEQ ID NO: 1186095 - protein, 5 aa, Mycobacterium
TASFT

SEQ ID NO: 1186096 - protein, 7 aa, Mycobacterium
TASGEAH

SEQ ID NO: 1186097 - protein, 37 aa, Mycobacterium
TASGGGRNGHVKSSDDKIDFDTRPPKELGGSGEGVNP

SEQ ID NO: 1186098 - protein, 11 aa, Mycobacterium
TASPAATGEPS

SEQ ID NO: 1186099 - protein, 5 aa, Mycobacterium
TASRI

SEQ ID NO: 1186100 - protein, 9 aa, Mycobacterium
TATAGGANP

SEQ ID NO: 1186101 - protein, 6 aa, Mycobacterium
TATAQE

SEQ ID NO: 1186102 - protein, 17 aa, Mycobacterium
TATATVAASSANLGPGF

SEQ ID NO: 1186103 - protein, 7 aa, Mycobacterium
TATGIAG

SEQ ID NO: 1186104 - protein, 5 aa, Mycobacterium
TATND

SEQ ID NO: 1186105 - protein, 7 aa, Mycobacterium
TATPGKQ

SEQ ID NO: 1186106 - protein, 14 aa, Mycobacterium
TATRRDLQDPKTID

SEQ ID NO: 1186107 - protein, 12 aa, Mycobacterium
TATSDARDDEHD

SEQ ID NO: 1186108 - protein, 8 aa, Mycobacterium
TATSGADG

SEQ ID NO: 1186109 - protein, 12 aa, Mycobacterium
TAVEVTTPGQVN

SEQ ID NO: 1186110 - protein, 8 aa, Mycobacterium
TAVPPSWR

SEQ ID NO: 1186111 - protein, 15 aa, Mycobacterium
TAVQQATGHDDTAEE

SEQ ID NO: 1186112 - protein, 8 aa, Mycobacterium
TAVRDGDD

SEQ ID NO: 1186113 - protein, 8 aa, Mycobacterium
TAVRDGDE

SEQ ID NO: 1186114 - protein, 4 aa, Mycobacterium
TAVS

SEQ ID NO: 1186115 - protein, 6 aa, Mycobacterium
TAYGQS

SEQ ID NO: 1186116 - protein, 21 aa, Mycobacterium
TDAATADPRIDGTRTAAMGGS

SEQ ID NO: 1186117 - protein, 6 aa, Mycobacterium
TDADRA

SEQ ID NO: 1186118 - protein, 7 aa, Mycobacterium
TDAEAAT

SEQ ID NO: 1186119 - protein, 18 aa, Mycobacterium
TDAERDARRRETGRPPAL

SEQ ID NO: 1186120 - protein, 6 aa, Mycobacterium
TDAGVR

SEQ ID NO: 1186121 - protein, 4 aa, Mycobacterium
TDAP

SEQ ID NO: 1186122 - protein, 10 aa, Mycobacterium
TDAPPRRAQI

SEQ ID NO: 1186123 - protein, 8 aa, Mycobacterium
TDARRRTA

SEQ ID NO: 1186124 - protein, 17 aa, Mycobacterium
TDASKIAKLSAGASPLF

SEQ ID NO: 1186125 - protein, 8 aa, Mycobacterium
TDDAGAAI

SEQ ID NO: 1186126 - protein, 18 aa, Mycobacterium
TDDEADDARKYAADTGGT

SEQ ID NO: 1186127 - protein, 10 aa, Mycobacterium
TDDEKSQLTR

SEQ ID NO: 1186128 - protein, 4 aa, Mycobacterium
TDDG

SEQ ID NO: 1186129 - protein, 7 aa, Mycobacterium
TDDGRIA

SEQ ID NO: 1186130 - protein, 4 aa, Mycobacterium
TDDL

SEQ ID NO: 1186131 - protein, 9 aa, Mycobacterium
TDDNVYQTE

SEQ ID NO: 1186132 - protein, 10 aa, Mycobacterium
TDDQRTQIEE

SEQ ID NO: 1186133 - protein, 9 aa, Mycobacterium
TDDTGVQSL

SEQ ID NO: 1186134 - protein, 6 aa, Mycobacterium
TDDTVQ

SEQ ID NO: 1186135 - protein, 14 aa, Mycobacterium
TDDVGRGHTDAETL

SEQ ID NO: 1186136 - protein, 8 aa, Mycobacterium
TDEDPRDW

SEQ ID NO: 1186137 - protein, 26 aa, Mycobacterium
TDELRDDDASLTRAARDRDRATPRDL

SEQ ID NO: 1186138 - protein, 11 aa, Mycobacterium
TDENGSRPLAQ

SEQ ID NO: 1186139 - protein, 5 aa, Mycobacterium
TDEPL

SEQ ID NO: 1186140 - protein, 5 aa, Mycobacterium
TDEST

SEQ ID NO: 1186141 - protein, 7 aa, Mycobacterium
TDEVAEA

SEQ ID NO: 1186142 - protein, 6 aa, Mycobacterium
TDFESG

SEQ ID NO: 1186143 - protein, 10 aa, Mycobacterium
TDGDGRGSGP

SEQ ID NO: 1186144 - protein, 11 aa, Mycobacterium
TDGGATPTATA

SEQ ID NO: 1186145 - protein, 7 aa, Mycobacterium
TDGRKRR

SEQ ID NO: 1186146 - protein, 5 aa, Mycobacterium
TDGRP

SEQ ID NO: 1186147 - protein, 10 aa, Mycobacterium
TDGSGRDAAA

SEQ ID NO: 1186148 - protein, 8 aa, Mycobacterium
TDGTRNDG

SEQ ID NO: 1186149 - protein, 7 aa, Mycobacterium
TDGTVAV

SEQ ID NO: 1186150 - protein, 8 aa, Mycobacterium
TDIESADD

SEQ ID NO: 1186151 - protein, 7 aa, Mycobacterium
TDISPSE

SEQ ID NO: 1186152 - protein, 7 aa, Mycobacterium
TDKAQLE

SEQ ID NO: 1186153 - protein, 8 aa, Mycobacterium
TDKAVRQK

SEQ ID NO: 1186154 - protein, 8 aa, Mycobacterium
TDKPMRTK

SEQ ID NO: 1186155 - protein, 4 aa, Mycobacterium
TDLP

SEQ ID NO: 1186156 - protein, 11 aa, Mycobacterium
TDLSGYTPDDL

SEQ ID NO: 1186157 - protein, 5 aa, Mycobacterium
TDLTD

SEQ ID NO: 1186158 - protein, 8 aa, Mycobacterium
TDNAPIGA

SEQ ID NO: 1186159 - protein, 26 aa, Mycobacterium
TDNGPHANSWPDGATTPFRSEKATNW

SEQ ID NO: 1186160 - protein, 7 aa, Mycobacterium
TDPDEEV

SEQ ID NO: 1186161 - protein, 7 aa, Mycobacterium
TDPDTSA

SEQ ID NO: 1186162 - protein, 6 aa, Mycobacterium
TDPGTA

SEQ ID NO: 1186163 - protein, 5 aa, Mycobacterium
TDPPY

SEQ ID NO: 1186164 - protein, 9 aa, Mycobacterium
TDPQTGRTT

SEQ ID NO: 1186165 - protein, 10 aa, Mycobacterium
TDPSATPRHK

SEQ ID NO: 1186166 - protein, 7 aa, Mycobacterium
TDPVPAA

SEQ ID NO: 1186167 - protein, 22 aa, Mycobacterium
TDPVPGDRFGGSPVNADRPSFS

SEQ ID NO: 1186168 - protein, 7 aa, Mycobacterium
TDQAQLE

SEQ ID NO: 1186169 - protein, 7 aa, Mycobacterium
TDQDLAR

SEQ ID NO: 1186170 - protein, 23 aa, Mycobacterium
TDQDQRLAAGRRQKRIDATPGPM

SEQ ID NO: 1186171 - protein, 21 aa, Mycobacterium
TDQTTSDALAATTRLAQTADR

SEQ ID NO: 1186172 - protein, 4 aa, Mycobacterium
TDRA

SEQ ID NO: 1186173 - protein, 10 aa, Mycobacterium
TDRAGSSAYV

SEQ ID NO: 1186174 - protein, 5 aa, Mycobacterium
TDRER

SEQ ID NO: 1186175 - protein, 15 aa, Mycobacterium
TDRGNVARDDDFATS

SEQ ID NO: 1186176 - protein, 18 aa, Mycobacterium
TDRTPPKPDARASGRSIG

SEQ ID NO: 1186177 - protein, 4 aa, Mycobacterium
TDSG

SEQ ID NO: 1186178 - protein, 5 aa, Mycobacterium
TDSTG

SEQ ID NO: 1186179 - protein, 4 aa, Mycobacterium
TDTA

SEQ ID NO: 1186180 - protein, 5 aa, Mycobacterium
TDTAA

SEQ ID NO: 1186181 - protein, 5 aa, Mycobacterium
TDTDC

SEQ ID NO: 1186182 - protein, 6 aa, Mycobacterium
TDTHGV

SEQ ID NO: 1186183 - protein, 7 aa, Mycobacterium
TDTNERA

SEQ ID NO: 1186184 - protein, 8 aa, Mycobacterium
TDTREGET

SEQ ID NO: 1186185 - protein, 4 aa, Mycobacterium
TDWK

SEQ ID NO: 1186186 - protein, 11 aa, Mycobacterium
TDYGDGDQRFE

SEQ ID NO: 1186187 - protein, 20 aa, Mycobacterium
TEADIRQAAEAAQDALARST

SEQ ID NO: 1186188 - protein, 9 aa, Mycobacterium
TEAGETAIG

SEQ ID NO: 1186189 - protein, 10 aa, Mycobacterium
TEAQTSGRPV

SEQ ID NO: 1186190 - protein, 5 aa, Mycobacterium
TEAYG

SEQ ID NO: 1186191 - protein, 7 aa, Mycobacterium
TEDPTRA

SEQ ID NO: 1186192 - protein, 8 aa, Mycobacterium
TEDRGSND

SEQ ID NO: 1186193 - protein, 17 aa, Mycobacterium
TEDVEGDYGESLGEDHR

SEQ ID NO: 1186194 - protein, 28 aa, Mycobacterium
TEEDSGEVDDRYGPAGKQRIEDTGPLTK

SEQ ID NO: 1186195 - protein, 8 aa, Mycobacterium
TEEQKRTY

SEQ ID NO: 1186196 - protein, 6 aa, Mycobacterium
TEESHD

SEQ ID NO: 1186197 - protein, 13 aa, Mycobacterium
TEETGASISIEDD

SEQ ID NO: 1186198 - protein, 5 aa, Mycobacterium
TEFGG

SEQ ID NO: 1186199 - protein, 4 aa, Mycobacterium
TEFH

SEQ ID NO: 1186200 - protein, 12 aa, Mycobacterium
TEGASKRSGARL

SEQ ID NO: 1186201 - protein, 12 aa, Mycobacterium
TEGDDAPKSDRW

SEQ ID NO: 1186202 - protein, 13 aa, Mycobacterium
TEGDHDREHEEQD

SEQ ID NO: 1186203 - protein, 16 aa, Mycobacterium
TEGLADAVGKDGVSSN

SEQ ID NO: 1186204 - protein, 6 aa, Mycobacterium
TEGRGY

SEQ ID NO: 1186205 - protein, 4 aa, Mycobacterium
TEIE

SEQ ID NO: 1186206 - protein, 7 aa, Mycobacterium
TELDETN

SEQ ID NO: 1186207 - protein, 5 aa, Mycobacterium
TELDT

SEQ ID NO: 1186208 - protein, 4 aa, Mycobacterium
TEND

SEQ ID NO: 1186209 - protein, 4 aa, Mycobacterium
TEPA

SEQ ID NO: 1186210 - protein, 11 aa, Mycobacterium
TEPAGTAQPAV

SEQ ID NO: 1186211 - protein, 7 aa, Mycobacterium
TEPDGTL

SEQ ID NO: 1186212 - protein, 12 aa, Mycobacterium
TEPGAGSDLAGI

SEQ ID NO: 1186213 - protein, 18 aa, Mycobacterium
TEPGGGSDAGAPKTTARL

SEQ ID NO: 1186214 - protein, 7 aa, Mycobacterium
TEPGQAL

SEQ ID NO: 1186215 - protein, 7 aa, Mycobacterium
TEPKAAN

SEQ ID NO: 1186216 - protein, 11 aa, Mycobacterium
TEPKTDRSRRR

SEQ ID NO: 1186217 - protein, 6 aa, Mycobacterium
TEPLGY

SEQ ID NO: 1186218 - protein, 8 aa, Mycobacterium
TEPNPALD

SEQ ID NO: 1186219 - protein, 4 aa, Mycobacterium
TEQG

SEQ ID NO: 1186220 - protein, 9 aa, Mycobacterium
TEQGGTATV

SEQ ID NO: 1186221 - protein, 9 aa, Mycobacterium
TEQTSADAA

SEQ ID NO: 1186222 - protein, 12 aa, Mycobacterium
TERAASRAADGR

SEQ ID NO: 1186223 - protein, 10 aa, Mycobacterium
TERAGSSAYV

SEQ ID NO: 1186224 - protein, 7 aa, Mycobacterium
TERTGRP

SEQ ID NO: 1186225 - protein, 8 aa, Mycobacterium
TESEGQVR

SEQ ID NO: 1186226 - protein, 4 aa, Mycobacterium
TESF

SEQ ID NO: 1186227 - protein, 8 aa, Mycobacterium
TESSGTAM

SEQ ID NO: 1186228 - protein, 23 aa, Mycobacterium
TESSWRRAPRPAVDAPDPRPYGA

SEQ ID NO: 1186229 - protein, 4 aa, Mycobacterium
TETE

SEQ ID NO: 1186230 - protein, 9 aa, Mycobacterium
TETHPTAPS

SEQ ID NO: 1186231 - protein, 4 aa, Mycobacterium
TETT

SEQ ID NO: 1186232 - protein, 13 aa, Mycobacterium
TETTDTPQPGEVR

SEQ ID NO: 1186233 - protein, 34 aa, Mycobacterium
TETTGMDAPTPAAATPAATPARAAPAQLSERERE

SEQ ID NO: 1186234 - protein, 17 aa, Mycobacterium
TETTPIPVGDDGSLPAE

SEQ ID NO: 1186235 - protein, 5 aa, Mycobacterium
TETTT

SEQ ID NO: 1186236 - protein, 7 aa, Mycobacterium
TETVPNQ

SEQ ID NO: 1186237 - protein, 8 aa, Mycobacterium
TEVDSSTM

SEQ ID NO: 1186238 - protein, 11 aa, Mycobacterium
TEVGARDPGAR

SEQ ID NO: 1186239 - protein, 9 aa, Mycobacterium
TFAGQRDAI

SEQ ID NO: 1186240 - protein, 23 aa, Mycobacterium
TFAGRGAAEFSRRRTAGDAVNAD

SEQ ID NO: 1186241 - protein, 7 aa, Mycobacterium
TFGPGGS

SEQ ID NO: 1186242 - protein, 10 aa, Mycobacterium
TFNSGSTEIP

SEQ ID NO: 1186243 - protein, 6 aa, Mycobacterium
TFPTEP

SEQ ID NO: 1186244 - protein, 20 aa, Mycobacterium
TFTTPTGTQYHSTAPPSPGM

SEQ ID NO: 1186245 - protein, 11 aa, Mycobacterium
TGAAAGPVNSP

SEQ ID NO: 1186246 - protein, 10 aa, Mycobacterium
TGAAEERLNP

SEQ ID NO: 1186247 - protein, 12 aa, Mycobacterium
TGAAPDTPAAAE

SEQ ID NO: 1186248 - protein, 14 aa, Mycobacterium
TGADLDAARTAAYS

SEQ ID NO: 1186249 - protein, 15 aa, Mycobacterium
TGADRAPARGRPAPR

SEQ ID NO: 1186250 - protein, 4 aa, Mycobacterium
TGAE

SEQ ID NO: 1186251 - protein, 7 aa, Mycobacterium
TGAEPDS

SEQ ID NO: 1186252 - protein, 8 aa, Mycobacterium
TGAGKTFT

SEQ ID NO: 1186253 - protein, 9 aa, Mycobacterium
TGAGPFGEL

SEQ ID NO: 1186254 - protein, 9 aa, Mycobacterium
TGAGTSNTI

SEQ ID NO: 1186255 - protein, 10 aa, Mycobacterium
TGANTSRATV

SEQ ID NO: 1186256 - protein, 10 aa, Mycobacterium
TGAPPTDNTF

SEQ ID NO: 1186257 - protein, 6 aa, Mycobacterium
TGAQAA

SEQ ID NO: 1186258 - protein, 9 aa, Mycobacterium
TGAQETVAG

SEQ ID NO: 1186259 - protein, 4 aa, Mycobacterium
TGAS

SEQ ID NO: 1186260 - protein, 8 aa, Mycobacterium
TGASVSPP

SEQ ID NO: 1186261 - protein, 7 aa, Mycobacterium
TGAYTGS

SEQ ID NO: 1186262 - protein, 4 aa, Mycobacterium
TGDA

SEQ ID NO: 1186263 - protein, 10 aa, Mycobacterium
TGDAATAEDV

SEQ ID NO: 1186264 - protein, 4 aa, Mycobacterium
TGDD

SEQ ID NO: 1186265 - protein, 7 aa, Mycobacterium
TGDRPVQ

SEQ ID NO: 1186266 - protein, 8 aa, Mycobacterium
TGDRPVQV

SEQ ID NO: 1186267 - protein, 12 aa, Mycobacterium
TGDSLERKAETT

SEQ ID NO: 1186268 - protein, 5 aa, Mycobacterium
TGEAD

SEQ ID NO: 1186269 - protein, 4 aa, Mycobacterium
TGEI

SEQ ID NO: 1186270 - protein, 8 aa, Mycobacterium
TGEPRRGD

SEQ ID NO: 1186271 - protein, 5 aa, Mycobacterium
TGEPS

SEQ ID NO: 1186272 - protein, 9 aa, Mycobacterium
TGERCAPGQ

SEQ ID NO: 1186273 - protein, 13 aa, Mycobacterium
TGERYNAAAAADA

SEQ ID NO: 1186274 - protein, 18 aa, Mycobacterium
TGETSTFRASGQADATAQ

SEQ ID NO: 1186275 - protein, 4 aa, Mycobacterium
TGEY

SEQ ID NO: 1186276 - protein, 10 aa, Mycobacterium
TGFTEKELGS

SEQ ID NO: 1186277 - protein, 6 aa, Mycobacterium
TGGAEK

SEQ ID NO: 1186278 - protein, 4 aa, Mycobacterium
TGGF

SEQ ID NO: 1186279 - protein, 4 aa, Mycobacterium
TGGG

SEQ ID NO: 1186280 - protein, 7 aa, Mycobacterium
TGGGCTT

SEQ ID NO: 1186281 - protein, 8 aa, Mycobacterium
TGGGKTEA

SEQ ID NO: 1186282 - protein, 12 aa, Mycobacterium
TGGPGTGKTTTV

SEQ ID NO: 1186283 - protein, 5 aa, Mycobacterium
TGGQR

SEQ ID NO: 1186284 - protein, 7 aa, Mycobacterium
TGGRGLS

SEQ ID NO: 1186285 - protein, 8 aa, Mycobacterium
TGGWSGNE

SEQ ID NO: 1186286 - protein, 20 aa, Mycobacterium
TGHDGGAGTVHANNPAEVPA

SEQ ID NO: 1186287 - protein, 19 aa, Mycobacterium
TGHTGNKPVTESLYPSSPD

SEQ ID NO: 1186288 - protein, 7 aa, Mycobacterium
TGIDTAA

SEQ ID NO: 1186289 - protein, 16 aa, Mycobacterium
TGKPAELDRDEPRRVA

SEQ ID NO: 1186290 - protein, 8 aa, Mycobacterium
TGKPGKHK

SEQ ID NO: 1186291 - protein, 11 aa, Mycobacterium
TGKPREERVES

SEQ ID NO: 1186292 - protein, 6 aa, Mycobacterium
TGKPYD

SEQ ID NO: 1186293 - protein, 5 aa, Mycobacterium
TGLDE

SEQ ID NO: 1186294 - protein, 17 aa, Mycobacterium
TGLDGSEKVDVDGAEHS

SEQ ID NO: 1186295 - protein, 5 aa, Mycobacterium
TGLDH

SEQ ID NO: 1186296 - protein, 5 aa, Mycobacterium
TGLDR

SEQ ID NO: 1186297 - protein, 20 aa, Mycobacterium
TGMIGDPRDTGERTLQTADT

SEQ ID NO: 1186298 - protein, 4 aa, Mycobacterium
TGNG

SEQ ID NO: 1186299 - protein, 6 aa, Mycobacterium
TGNPLR

SEQ ID NO: 1186300 - protein, 5 aa, Mycobacterium
TGPAD

SEQ ID NO: 1186301 - protein, 44 aa, Mycobacterium
TGPADQLPVTDSTGRHLTSGSLARPPNQPPPTVAPYRGPSGERA

SEQ ID NO: 1186302 - protein, 9 aa, Mycobacterium
TGPADQLTV

SEQ ID NO: 1186303 - protein, 44 aa, Mycobacterium
TGPADQLTVTDSTGRELQSGSLARPPNQPPPTVAPYRGPSGERA

SEQ ID NO: 1186304 - protein, 44 aa, Mycobacterium
TGPADQLTVTDSTGRHLTSGSLARPPNQPPPTVAPYRGPSGERA

SEQ ID NO: 1186305 - protein, 6 aa, Mycobacterium
TGPAER

SEQ ID NO: 1186306 - protein, 44 aa, Mycobacterium
TGPASKLTVTDATGRRLESGSLARQPNQPPPQVPPYRGPSGERA

SEQ ID NO: 1186307 - protein, 18 aa, Mycobacterium
TGPASKLTVTDGTGRRLH

SEQ ID NO: 1186308 - protein, 6 aa, Mycobacterium
TGPDGD

SEQ ID NO: 1186309 - protein, 8 aa, Mycobacterium
TGPDSAPW

SEQ ID NO: 1186310 - protein, 9 aa, Mycobacterium
TGPGDNALT

SEQ ID NO: 1186311 - protein, 11 aa, Mycobacterium
TGPGGTAVGSE

SEQ ID NO: 1186312 - protein, 7 aa, Mycobacterium
TGPGVPD

SEQ ID NO: 1186313 - protein, 5 aa, Mycobacterium
TGQDF

SEQ ID NO: 1186314 - protein, 4 aa, Mycobacterium
TGQI

SEQ ID NO: 1186315 - protein, 10 aa, Mycobacterium
TGRAADTPVP

SEQ ID NO: 1186316 - protein, 15 aa, Mycobacterium
TGRATKVAAPGWTSS

SEQ ID NO: 1186317 - protein, 6 aa, Mycobacterium
TGRATW

SEQ ID NO: 1186318 - protein, 20 aa, Mycobacterium
TGRGTDAQDRPDGTPLPGTA

SEQ ID NO: 1186319 - protein, 12 aa, Mycobacterium
TGRHDGLQIVFF

SEQ ID NO: 1186320 - protein, 11 aa, Mycobacterium
TGRPSPTPHPE

SEQ ID NO: 1186321 - protein, 5 aa, Mycobacterium
TGRRA

SEQ ID NO: 1186322 - protein, 8 aa, Mycobacterium
TGRSTPSR

SEQ ID NO: 1186323 - protein, 9 aa, Mycobacterium
TGSDGPRGI

SEQ ID NO: 1186324 - protein, 12 aa, Mycobacterium
TGSGTSSNMNSN

SEQ ID NO: 1186325 - protein, 12 aa, Mycobacterium
TGSGTSSNMNTN

SEQ ID NO: 1186326 - protein, 7 aa, Mycobacterium
TGSPDTA

SEQ ID NO: 1186327 - protein, 18 aa, Mycobacterium
TGSRHPEQAERQKDGHKA

SEQ ID NO: 1186328 - protein, 7 aa, Mycobacterium
TGSVDDS

SEQ ID NO: 1186329 - protein, 10 aa, Mycobacterium
TGTDPDTGEV

SEQ ID NO: 1186330 - protein, 11 aa, Mycobacterium
TGTGPWSSAGS

SEQ ID NO: 1186331 - protein, 6 aa, Mycobacterium
TGTNDH

SEQ ID NO: 1186332 - protein, 4 aa, Mycobacterium
TGTP

SEQ ID NO: 1186333 - protein, 8 aa, Mycobacterium
TGTSESVA

SEQ ID NO: 1186334 - protein, 4 aa, Mycobacterium
TGTV

SEQ ID NO: 1186335 - protein, 8 aa, Mycobacterium
TGVAGEPQ

SEQ ID NO: 1186336 - protein, 6 aa, Mycobacterium
TGVPSF

SEQ ID NO: 1186337 - protein, 8 aa, Mycobacterium
TGVQTGTL

SEQ ID NO: 1186338 - protein, 22 aa, Mycobacterium
TGVRDGRATATVTGSIPGAPVT

SEQ ID NO: 1186339 - protein, 24 aa, Mycobacterium
TGVRLEGPKPRWARPDGGEAGLHP

SEQ ID NO: 1186340 - protein, 8 aa, Mycobacterium
TGVSKSEV

SEQ ID NO: 1186341 - protein, 10 aa, Mycobacterium
TGWPGTPTHS

SEQ ID NO: 1186342 - protein, 7 aa, Mycobacterium
TGYQTSV

SEQ ID NO: 1186343 - protein, 5 aa, Mycobacterium
THAGP

SEQ ID NO: 1186344 - protein, 7 aa, Mycobacterium
THATAEA

SEQ ID NO: 1186345 - protein, 7 aa, Mycobacterium
THDDGLG

SEQ ID NO: 1186346 - protein, 12 aa, Mycobacterium
THGAPDVAGAAA

SEQ ID NO: 1186347 - protein, 9 aa, Mycobacterium
THGPAPLPT

SEQ ID NO: 1186348 - protein, 12 aa, Mycobacterium
THGPAPPPAEPS

SEQ ID NO: 1186349 - protein, 9 aa, Mycobacterium
THGYDTTDH

SEQ ID NO: 1186350 - protein, 5 aa, Mycobacterium
THPEP

SEQ ID NO: 1186351 - protein, 10 aa, Mycobacterium
THPGSDTAKV

SEQ ID NO: 1186352 - protein, 4 aa, Mycobacterium
THQS

SEQ ID NO: 1186353 - protein, 4 aa, Mycobacterium
THRA

SEQ ID NO: 1186354 - protein, 4 aa, Mycobacterium
THRR

SEQ ID NO: 1186355 - protein, 19 aa, Mycobacterium
THSGREHERSTHDGTSGRT

SEQ ID NO: 1186356 - protein, 5 aa, Mycobacterium
THSSH

SEQ ID NO: 1186357 - protein, 6 aa, Mycobacterium
THSTPS

SEQ ID NO: 1186358 - protein, 7 aa, Mycobacterium
THTQSGS

SEQ ID NO: 1186359 - protein, 12 aa, Mycobacterium
TIAASSGATGDD

SEQ ID NO: 1186360 - protein, 5 aa, Mycobacterium
TIEPE

SEQ ID NO: 1186361 - protein, 13 aa, Mycobacterium
TIGAQSEEGRGTT

SEQ ID NO: 1186362 - protein, 5 aa, Mycobacterium
TIPRG

SEQ ID NO: 1186363 - protein, 6 aa, Mycobacterium
TKARTF

SEQ ID NO: 1186364 - protein, 9 aa, Mycobacterium
TKDDLDETA

SEQ ID NO: 1186365 - protein, 10 aa, Mycobacterium
TKDGTLQGPN

SEQ ID NO: 1186366 - protein, 5 aa, Mycobacterium
TKLPD

SEQ ID NO: 1186367 - protein, 10 aa, Mycobacterium
TKPASSVGTA

SEQ ID NO: 1186368 - protein, 14 aa, Mycobacterium
TKPESLGQAGRWQS

SEQ ID NO: 1186369 - protein, 4 aa, Mycobacterium
TKPF

SEQ ID NO: 1186370 - protein, 8 aa, Mycobacterium
TKPPTPDI

SEQ ID NO: 1186371 - protein, 5 aa, Mycobacterium
TKQCP

SEQ ID NO: 1186372 - protein, 7 aa, Mycobacterium
TKRLQTR

SEQ ID NO: 1186373 - protein, 12 aa, Mycobacterium
TKRSRINQRRQR

SEQ ID NO: 1186374 - protein, 20 aa, Mycobacterium
TKSQNPDNPDEDEGGFQPNY

SEQ ID NO: 1186375 - protein, 9 aa, Mycobacterium
TKTPNEPNR

SEQ ID NO: 1186376 - protein, 11 aa, Mycobacterium
TKTRGQFPNDA

SEQ ID NO: 1186377 - protein, 4 aa, Mycobacterium
TKTT

SEQ ID NO: 1186378 - protein, 6 aa, Mycobacterium
TLAPEE

SEQ ID NO: 1186379 - protein, 5 aa, Mycobacterium
TLARR

SEQ ID NO: 1186380 - protein, 19 aa, Mycobacterium
TLDDAAATALRTAAAATGL

SEQ ID NO: 1186381 - protein, 12 aa, Mycobacterium
TLDSSGNPHATA

SEQ ID NO: 1186382 - protein, 7 aa, Mycobacterium
TLETTRA

SEQ ID NO: 1186383 - protein, 5 aa, Mycobacterium
TLGEL

SEQ ID NO: 1186384 - protein, 6 aa, Mycobacterium
TLGGGG

SEQ ID NO: 1186385 - protein, 9 aa, Mycobacterium
TLGPGEPAF

SEQ ID NO: 1186386 - protein, 19 aa, Mycobacterium
TLGPQPPDDDRWTSPHAGE

SEQ ID NO: 1186387 - protein, 15 aa, Mycobacterium
TLPADDDHPYRTGPW

SEQ ID NO: 1186388 - protein, 5 aa, Mycobacterium
TLPAE

SEQ ID NO: 1186389 - protein, 9 aa, Mycobacterium
TLPASRGIA

SEQ ID NO: 1186390 - protein, 10 aa, Mycobacterium
TLPDGTPHTD

SEQ ID NO: 1186391 - protein, 21 aa, Mycobacterium
TLPETSSDERDDRAFEDEAQH

SEQ ID NO: 1186392 - protein, 6 aa, Mycobacterium
TLPGQG

SEQ ID NO: 1186393 - protein, 7 aa, Mycobacterium
TLPQGRL

SEQ ID NO: 1186394 - protein, 22 aa, Mycobacterium
TLQRDAEAAVRAAAADQRAAAE

SEQ ID NO: 1186395 - protein, 16 aa, Mycobacterium
TLRSSARGRHRTEQVA

SEQ ID NO: 1186396 - protein, 7 aa, Mycobacterium
TLTPNPD

SEQ ID NO: 1186397 - protein, 16 aa, Mycobacterium
TLTSEEERAVREGMTE

SEQ ID NO: 1186398 - protein, 14 aa, Mycobacterium
TMNDGEGSGVAPTD

SEQ ID NO: 1186399 - protein, 15 aa, Mycobacterium
TMPGPTAPQPRRDGF

SEQ ID NO: 1186400 - protein, 13 aa, Mycobacterium
TMPPSTGQPCDVR

SEQ ID NO: 1186401 - protein, 5 aa, Mycobacterium
TMRQG

SEQ ID NO: 1186402 - protein, 8 aa, Mycobacterium
TNAASATV

SEQ ID NO: 1186403 - protein, 8 aa, Mycobacterium
TNATTTET

SEQ ID NO: 1186404 - protein, 9 aa, Mycobacterium
TNDPGAREA

SEQ ID NO: 1186405 - protein, 12 aa, Mycobacterium
TNEPERADGYSM

SEQ ID NO: 1186406 - protein, 5 aa, Mycobacterium
TNESG

SEQ ID NO: 1186407 - protein, 8 aa, Mycobacterium
TNGDDSYR

SEQ ID NO: 1186408 - protein, 9 aa, Mycobacterium
TNGSDDAAL

SEQ ID NO: 1186409 - protein, 9 aa, Mycobacterium
TNGSQIPRE

SEQ ID NO: 1186410 - protein, 9 aa, Mycobacterium
TNGTPEDEA

SEQ ID NO: 1186411 - protein, 13 aa, Mycobacterium
TNLAGPATAEAQR

SEQ ID NO: 1186412 - protein, 12 aa, Mycobacterium
TNNDDPAGACRP

SEQ ID NO: 1186413 - protein, 14 aa, Mycobacterium
TNNGETVAEGRSDA

SEQ ID NO: 1186414 - protein, 4 aa, Mycobacterium
TNPV

SEQ ID NO: 1186415 - protein, 8 aa, Mycobacterium
TNQSTERA

SEQ ID NO: 1186416 - protein, 6 aa, Mycobacterium
TNRNSP

SEQ ID NO: 1186417 - protein, 7 aa, Mycobacterium
TNRNSPM

SEQ ID NO: 1186418 - protein, 4 aa, Mycobacterium
TNRT

SEQ ID NO: 1186419 - protein, 4 aa, Mycobacterium
TNSR

SEQ ID NO: 1186420 - protein, 10 aa, Mycobacterium
TNSSTGAPYE

SEQ ID NO: 1186421 - protein, 11 aa, Mycobacterium
TPAAESYEPEQ

SEQ ID NO: 1186422 - protein, 5 aa, Mycobacterium
TPAAT

SEQ ID NO: 1186423 - protein, 4 aa, Mycobacterium
TPAD

SEQ ID NO: 1186424 - protein, 4 aa, Mycobacterium
TPAE

SEQ ID NO: 1186425 - protein, 12 aa, Mycobacterium
TPAEFQENSITR

SEQ ID NO: 1186426 - protein, 5 aa, Mycobacterium
TPAEL

SEQ ID NO: 1186427 - protein, 11 aa, Mycobacterium
TPAEQRAAMGP

SEQ ID NO: 1186428 - protein, 17 aa, Mycobacterium
TPAGDGVTVTESRVGET

SEQ ID NO: 1186429 - protein, 6 aa, Mycobacterium
TPAGGR

SEQ ID NO: 1186430 - protein, 12 aa, Mycobacterium
TPAGQRNTTVPG

SEQ ID NO: 1186431 - protein, 9 aa, Mycobacterium
TPAPARTTD

SEQ ID NO: 1186432 - protein, 5 aa, Mycobacterium
TPAQR

SEQ ID NO: 1186433 - protein, 8 aa, Mycobacterium
TPARPQVQ

SEQ ID NO: 1186434 - protein, 8 aa, Mycobacterium
TPASADLS

SEQ ID NO: 1186435 - protein, 14 aa, Mycobacterium
TPASAQMPPPRPLS

SEQ ID NO: 1186436 - protein, 5 aa, Mycobacterium
TPASL

SEQ ID NO: 1186437 - protein, 5 aa, Mycobacterium
TPAVA

SEQ ID NO: 1186438 - protein, 4 aa, Mycobacterium
TPCD

SEQ ID NO: 1186439 - protein, 9 aa, Mycobacterium
TPDADYRGK

SEQ ID NO: 1186440 - protein, 9 aa, Mycobacterium
TPDGGEPAV

SEQ ID NO: 1186441 - protein, 7 aa, Mycobacterium
TPDGPID

SEQ ID NO: 1186442 - protein, 5 aa, Mycobacterium
TPDGW

SEQ ID NO: 1186443 - protein, 27 aa, Mycobacterium
TPDKRIPEHSAPRGGRCRGTEEKPARA

SEQ ID NO: 1186444 - protein, 4 aa, Mycobacterium
TPDP

SEQ ID NO: 1186445 - protein, 9 aa, Mycobacterium
TPDQSTYNP

SEQ ID NO: 1186446 - protein, 22 aa, Mycobacterium
TPDTGLAGGDRTGAEYNTVRRG

SEQ ID NO: 1186447 - protein, 9 aa, Mycobacterium
TPEEEAAQT

SEQ ID NO: 1186448 - protein, 8 aa, Mycobacterium
TPEEIGGA

SEQ ID NO: 1186449 - protein, 9 aa, Mycobacterium
TPEEIGGAL

SEQ ID NO: 1186450 - protein, 4 aa, Mycobacterium
TPEG

SEQ ID NO: 1186451 - protein, 6 aa, Mycobacterium
TPEGAR

SEQ ID NO: 1186452 - protein, 8 aa, Mycobacterium
TPEHTEQA

SEQ ID NO: 1186453 - protein, 8 aa, Mycobacterium
TPEIPDRL

SEQ ID NO: 1186454 - protein, 4 aa, Mycobacterium
TPEM

SEQ ID NO: 1186455 - protein, 12 aa, Mycobacterium
TPERAKDLKQRP

SEQ ID NO: 1186456 - protein, 6 aa, Mycobacterium
TPESGT

SEQ ID NO: 1186457 - protein, 5 aa, Mycobacterium
TPETD

SEQ ID NO: 1186458 - protein, 7 aa, Mycobacterium
TPGAGTA

SEQ ID NO: 1186459 - protein, 8 aa, Mycobacterium
TPGARTTV

SEQ ID NO: 1186460 - protein, 5 aa, Mycobacterium
TPGDA

SEQ ID NO: 1186461 - protein, 11 aa, Mycobacterium
TPGDDPVPQRA

SEQ ID NO: 1186462 - protein, 17 aa, Mycobacterium
TPGDVAYSDDDGIVVVT

SEQ ID NO: 1186463 - protein, 6 aa, Mycobacterium
TPGEAA

SEQ ID NO: 1186464 - protein, 4 aa, Mycobacterium
TPGG

SEQ ID NO: 1186465 - protein, 5 aa, Mycobacterium
TPGGS

SEQ ID NO: 1186466 - protein, 7 aa, Mycobacterium
TPGHTAD

SEQ ID NO: 1186467 - protein, 13 aa, Mycobacterium
TPGIDTPYDGNDV

SEQ ID NO: 1186468 - protein, 12 aa, Mycobacterium
TPGLEADAKRQG

SEQ ID NO: 1186469 - protein, 20 aa, Mycobacterium
TPGPVPDAEKLKQVKGRGLS

SEQ ID NO: 1186470 - protein, 5 aa, Mycobacterium
TPGRA

SEQ ID NO: 1186471 - protein, 13 aa, Mycobacterium
TPGTAEGFSEAEI

SEQ ID NO: 1186472 - protein, 20 aa, Mycobacterium
TPGYTGGPTLQNNATIPRAR

SEQ ID NO: 1186473 - protein, 8 aa, Mycobacterium
TPHNGYTE

SEQ ID NO: 1186474 - protein, 7 aa, Mycobacterium
TPHRATA

SEQ ID NO: 1186475 - protein, 5 aa, Mycobacterium
TPHRG

SEQ ID NO: 1186476 - protein, 20 aa, Mycobacterium
TPHSVKPGASKTAEASSRTA

SEQ ID NO: 1186477 - protein, 13 aa, Mycobacterium
TPIAHPSPSGEQL

SEQ ID NO: 1186478 - protein, 14 aa, Mycobacterium
TPIDDDKQTHQRDL

SEQ ID NO: 1186479 - protein, 17 aa, Mycobacterium
TPIESVDPAGINTSDAH

SEQ ID NO: 1186480 - protein, 9 aa, Mycobacterium
TPIGKRGGS

SEQ ID NO: 1186481 - protein, 6 aa, Mycobacterium
TPIRGA

SEQ ID NO: 1186482 - protein, 7 aa, Mycobacterium
TPITKAQ

SEQ ID NO: 1186483 - protein, 6 aa, Mycobacterium
TPITQG

SEQ ID NO: 1186484 - protein, 8 aa, Mycobacterium
TPKKVDNG

SEQ ID NO: 1186485 - protein, 8 aa, Mycobacterium
TPKLADGS

SEQ ID NO: 1186486 - protein, 8 aa, Mycobacterium
TPKVGIGT

SEQ ID NO: 1186487 - protein, 5 aa, Mycobacterium
TPLED

SEQ ID NO: 1186488 - protein, 7 aa, Mycobacterium
TPLPDGG

SEQ ID NO: 1186489 - protein, 9 aa, Mycobacterium
TPLPTPDGW

SEQ ID NO: 1186490 - protein, 9 aa, Mycobacterium
TPLTDTRSR

SEQ ID NO: 1186491 - protein, 17 aa, Mycobacterium
TPMPRSTARRCTRAPPM

SEQ ID NO: 1186492 - protein, 5 aa, Mycobacterium
TPNDR

SEQ ID NO: 1186493 - protein, 11 aa, Mycobacterium
TPPDRDTHRRG

SEQ ID NO: 1186494 - protein, 5 aa, Mycobacterium
TPPDT

SEQ ID NO: 1186495 - protein, 4 aa, Mycobacterium
TPPL

SEQ ID NO: 1186496 - protein, 6 aa, Mycobacterium
TPPPFF

SEQ ID NO: 1186497 - protein, 11 aa, Mycobacterium
TPPRARKPQRR

SEQ ID NO: 1186498 - protein, 11 aa, Mycobacterium
TPPRDDDADNP

SEQ ID NO: 1186499 - protein, 6 aa, Mycobacterium
TPPTLD

SEQ ID NO: 1186500 - protein, 7 aa, Mycobacterium
TPQAEDQ

SEQ ID NO: 1186501 - protein, 11 aa, Mycobacterium
TPQEGREKTAA

SEQ ID NO: 1186502 - protein, 4 aa, Mycobacterium
TPQK

SEQ ID NO: 1186503 - protein, 8 aa, Mycobacterium
TPQKHGEL

SEQ ID NO: 1186504 - protein, 5 aa, Mycobacterium
TPQTH

SEQ ID NO: 1186505 - protein, 13 aa, Mycobacterium
TPQTTPPPAPKAT

SEQ ID NO: 1186506 - protein, 5 aa, Mycobacterium
TPRAA

SEQ ID NO: 1186507 - protein, 12 aa, Mycobacterium
TPREPKGPGVAE

SEQ ID NO: 1186508 - protein, 11 aa, Mycobacterium
TPRGKQRGGAL

SEQ ID NO: 1186509 - protein, 6 aa, Mycobacterium
TPRHPL

SEQ ID NO: 1186510 - protein, 4 aa, Mycobacterium
TPRN

SEQ ID NO: 1186511 - protein, 4 aa, Mycobacterium
TPRQ

SEQ ID NO: 1186512 - protein, 11 aa, Mycobacterium
TPSADPTRNAV

SEQ ID NO: 1186513 - protein, 8 aa, Mycobacterium
TPSGTGAV

SEQ ID NO: 1186514 - protein, 8 aa, Mycobacterium
TPSPQSRA

SEQ ID NO: 1186515 - protein, 16 aa, Mycobacterium
TPSRRNAGAHYTPRPL

SEQ ID NO: 1186516 - protein, 7 aa, Mycobacterium
TPSSPTD

SEQ ID NO: 1186517 - protein, 5 aa, Mycobacterium
TPTKW

SEQ ID NO: 1186518 - protein, 5 aa, Mycobacterium
TPTPE

SEQ ID NO: 1186519 - protein, 29 aa, Mycobacterium
TPVEQPAARPRPVASQPKTATARGRSMPP

SEQ ID NO: 1186520 - protein, 8 aa, Mycobacterium
TPVPPARA

SEQ ID NO: 1186521 - protein, 46 aa, Mycobacterium
TPVQTAPAAPPGSSRPTTTAAPATTAPATPTATPTTTPSPAPESGA

SEQ ID NO: 1186522 - protein, 11 aa, Mycobacterium
TPYGEEGDEFD

SEQ ID NO: 1186523 - protein, 6 aa, Mycobacterium
TPYPTL

SEQ ID NO: 1186524 - protein, 8 aa, Mycobacterium
TPYSDTAM

SEQ ID NO: 1186525 - protein, 7 aa, Mycobacterium
TQAGDAY

SEQ ID NO: 1186526 - protein, 17 aa, Mycobacterium
TQARTAAGLSPEAGAGE

SEQ ID NO: 1186527 - protein, 9 aa, Mycobacterium
TQDTAAPRT

SEQ ID NO: 1186528 - protein, 12 aa, Mycobacterium
TQEGGTERPFTG

SEQ ID NO: 1186529 - protein, 6 aa, Mycobacterium
TQIPLT

SEQ ID NO: 1186530 - protein, 19 aa, Mycobacterium
TQKPTDSADAVMHRVSAPV

SEQ ID NO: 1186531 - protein, 14 aa, Mycobacterium
TQKTADAFADDPDA

SEQ ID NO: 1186532 - protein, 4 aa, Mycobacterium
TQLE

SEQ ID NO: 1186533 - protein, 18 aa, Mycobacterium
TQLTDPALDEATPAGTGL

SEQ ID NO: 1186534 - protein, 24 aa, Mycobacterium
TQMPPTTQAPTSQGPVPQRPPNGM

SEQ ID NO: 1186535 - protein, 5 aa, Mycobacterium
TQPEL

SEQ ID NO: 1186536 - protein, 9 aa, Mycobacterium
TQPGRIGAA

SEQ ID NO: 1186537 - protein, 64 aa, Mycobacterium
TQQEQRKGTAMTGYQTGGETLSAPPGHLPDPGLDPNGDSEESKKGDKRDKKSSDEDAADPAKGM

SEQ ID NO: 1186538 - protein, 8 aa, Mycobacterium
TQREVGTR

SEQ ID NO: 1186539 - protein, 4 aa, Mycobacterium
TQRL

SEQ ID NO: 1186540 - protein, 5 aa, Mycobacterium
TQRRH

SEQ ID NO: 1186541 - protein, 10 aa, Mycobacterium
TQSPDEAVSG

SEQ ID NO: 1186542 - protein, 10 aa, Mycobacterium
TQTADGDAEQ

SEQ ID NO: 1186543 - protein, 4 aa, Mycobacterium
TQYN

SEQ ID NO: 1186544 - protein, 9 aa, Mycobacterium
TRAAAELDR

SEQ ID NO: 1186545 - protein, 11 aa, Mycobacterium
TRAAAELDRAA

SEQ ID NO: 1186546 - protein, 12 aa, Mycobacterium
TRAADDGRPLHA

SEQ ID NO: 1186547 - protein, 4 aa, Mycobacterium
TRAD

SEQ ID NO: 1186548 - protein, 6 aa, Mycobacterium
TRADDL

SEQ ID NO: 1186549 - protein, 18 aa, Mycobacterium
TRADLARKQGRPSDAAEI

SEQ ID NO: 1186550 - protein, 5 aa, Mycobacterium
TRAEK

SEQ ID NO: 1186551 - protein, 5 aa, Mycobacterium
TRAGG

SEQ ID NO: 1186552 - protein, 19 aa, Mycobacterium
TRAHQAVDAQDSGSPAGWR

SEQ ID NO: 1186553 - protein, 8 aa, Mycobacterium
TRARTTAV

SEQ ID NO: 1186554 - protein, 9 aa, Mycobacterium
TRASGRSAR

SEQ ID NO: 1186555 - protein, 8 aa, Mycobacterium
TRDGSPVE

SEQ ID NO: 1186556 - protein, 5 aa, Mycobacterium
TRDHD

SEQ ID NO: 1186557 - protein, 11 aa, Mycobacterium
TRDYAQGGCTD

SEQ ID NO: 1186558 - protein, 5 aa, Mycobacterium
TREEH

SEQ ID NO: 1186559 - protein, 7 aa, Mycobacterium
TREQRLA

SEQ ID NO: 1186560 - protein, 8 aa, Mycobacterium
TRETTVDG

SEQ ID NO: 1186561 - protein, 8 aa, Mycobacterium
TRFKPGKA

SEQ ID NO: 1186562 - protein, 14 aa, Mycobacterium
TRGHGASPTPAGPY

SEQ ID NO: 1186563 - protein, 6 aa, Mycobacterium
TRGQDT

SEQ ID NO: 1186564 - protein, 5 aa, Mycobacterium
TRHQE

SEQ ID NO: 1186565 - protein, 9 aa, Mycobacterium
TRKDAARYA

SEQ ID NO: 1186566 - protein, 12 aa, Mycobacterium
TRKDQAQDSPGV

SEQ ID NO: 1186567 - protein, 9 aa, Mycobacterium
TRKPERASD

SEQ ID NO: 1186568 - protein, 5 aa, Mycobacterium
TRPGG

SEQ ID NO: 1186569 - protein, 6 aa, Mycobacterium
TRPHPV

SEQ ID NO: 1186570 - protein, 5 aa, Mycobacterium
TRPLP

SEQ ID NO: 1186571 - protein, 5 aa, Mycobacterium
TRRDV

SEQ ID NO: 1186572 - protein, 6 aa, Mycobacterium
TRREGT

SEQ ID NO: 1186573 - protein, 5 aa, Mycobacterium
TRREL

SEQ ID NO: 1186574 - protein, 5 aa, Mycobacterium
TRREP

SEQ ID NO: 1186575 - protein, 5 aa, Mycobacterium
TRRGD

SEQ ID NO: 1186576 - protein, 10 aa, Mycobacterium
TRRKPPESGI

SEQ ID NO: 1186577 - protein, 13 aa, Mycobacterium
TRRNNRQLPLSGT

SEQ ID NO: 1186578 - protein, 14 aa, Mycobacterium
TRRNRELAEENQRL

SEQ ID NO: 1186579 - protein, 6 aa, Mycobacterium
TRRPAA

SEQ ID NO: 1186580 - protein, 18 aa, Mycobacterium
TRRPKSSPSKLSDEVKEQ

SEQ ID NO: 1186581 - protein, 32 aa, Mycobacterium
TRRSGLPDSRADSDRVRQPGTVSGGAPSLGRR

SEQ ID NO: 1186582 - protein, 16 aa, Mycobacterium
TRRTEPVRRPPAERVS

SEQ ID NO: 1186583 - protein, 8 aa, Mycobacterium
TRSEIEDQ

SEQ ID NO: 1186584 - protein, 5 aa, Mycobacterium
TRSGA

SEQ ID NO: 1186585 - protein, 7 aa, Mycobacterium
TRSHGEV

SEQ ID NO: 1186586 - protein, 14 aa, Mycobacterium
TRTEVGREASEPMR

SEQ ID NO: 1186587 - protein, 21 aa, Mycobacterium
TRTGESTREVPTSASCGPDST

SEQ ID NO: 1186588 - protein, 6 aa, Mycobacterium
TRTQGR

SEQ ID NO: 1186589 - protein, 9 aa, Mycobacterium
TRTRNTGYA

SEQ ID NO: 1186590 - protein, 7 aa, Mycobacterium
TSAAQRA

SEQ ID NO: 1186591 - protein, 8 aa, Mycobacterium
TSAAQRAE

SEQ ID NO: 1186592 - protein, 8 aa, Mycobacterium
TSAEPDLG

SEQ ID NO: 1186593 - protein, 5 aa, Mycobacterium
TSAKA

SEQ ID NO: 1186594 - protein, 12 aa, Mycobacterium
TSALQSTTNART

SEQ ID NO: 1186595 - protein, 8 aa, Mycobacterium
TSANGTET

SEQ ID NO: 1186596 - protein, 4 aa, Mycobacterium
TSAP

SEQ ID NO: 1186597 - protein, 4 aa, Mycobacterium
TSAV

SEQ ID NO: 1186598 - protein, 10 aa, Mycobacterium
TSDDDPRRER

SEQ ID NO: 1186599 - protein, 8 aa, Mycobacterium
TSDDGGSL

SEQ ID NO: 1186600 - protein, 5 aa, Mycobacterium
TSDEV

SEQ ID NO: 1186601 - protein, 14 aa, Mycobacterium
TSDPEGNKITWTQR

SEQ ID NO: 1186602 - protein, 9 aa, Mycobacterium
TSDPHPDDG

SEQ ID NO: 1186603 - protein, 15 aa, Mycobacterium
TSDSADGESACSRGV

SEQ ID NO: 1186604 - protein, 9 aa, Mycobacterium
TSEGASYIP

SEQ ID NO: 1186605 - protein, 9 aa, Mycobacterium
TSEGDEFDV

SEQ ID NO: 1186606 - protein, 8 aa, Mycobacterium
TSEGVPGC

SEQ ID NO: 1186607 - protein, 5 aa, Mycobacterium
TSEPA

SEQ ID NO: 1186608 - protein, 7 aa, Mycobacterium
TSGAGGL

SEQ ID NO: 1186609 - protein, 5 aa, Mycobacterium
TSGAL

SEQ ID NO: 1186610 - protein, 9 aa, Mycobacterium
TSGEEPDVN

SEQ ID NO: 1186611 - protein, 9 aa, Mycobacterium
TSGGSVGSL

SEQ ID NO: 1186612 - protein, 17 aa, Mycobacterium
TSGPAEETTAATAEKVD

SEQ ID NO: 1186613 - protein, 6 aa, Mycobacterium
TSHPAG

SEQ ID NO: 1186614 - protein, 19 aa, Mycobacterium
TSIDSNPDGAVASQSEISA

SEQ ID NO: 1186615 - protein, 8 aa, Mycobacterium
TSITSETI

SEQ ID NO: 1186616 - protein, 17 aa, Mycobacterium
TSKGPRFNPDAVDIQWK

SEQ ID NO: 1186617 - protein, 19 aa, Mycobacterium
TSKIKKSSDPGEDAPTIDL

SEQ ID NO: 1186618 - protein, 16 aa, Mycobacterium
TSKTAGDIDPDSRFPA

SEQ ID NO: 1186619 - protein, 11 aa, Mycobacterium
TSLEQRGVRAG

SEQ ID NO: 1186620 - protein, 14 aa, Mycobacterium
TSMSETTLAPTLSD

SEQ ID NO: 1186621 - protein, 16 aa, Mycobacterium
TSNPSGNDRGGSSSTG

SEQ ID NO: 1186622 - protein, 4 aa, Mycobacterium
TSPA

SEQ ID NO: 1186623 - protein, 7 aa, Mycobacterium
TSPAARD

SEQ ID NO: 1186624 - protein, 22 aa, Mycobacterium
TSPAGDKGFPGTSAYGATKAAL

SEQ ID NO: 1186625 - protein, 18 aa, Mycobacterium
TSPDGSGFRSRRRPGTIQ

SEQ ID NO: 1186626 - protein, 9 aa, Mycobacterium
TSPEEAAQT

SEQ ID NO: 1186627 - protein, 28 aa, Mycobacterium
TSPFDSPGRWGGPPGTPFPRQPEVPAGQ

SEQ ID NO: 1186628 - protein, 4 aa, Mycobacterium
TSPI

SEQ ID NO: 1186629 - protein, 4 aa, Mycobacterium
TSPL

SEQ ID NO: 1186630 - protein, 6 aa, Mycobacterium
TSPQSL

SEQ ID NO: 1186631 - protein, 19 aa, Mycobacterium
TSPSPSKRRTATRDTELGG

SEQ ID NO: 1186632 - protein, 16 aa, Mycobacterium
TSQQQEIDTMNKILAS

SEQ ID NO: 1186633 - protein, 9 aa, Mycobacterium
TSRAQCEDG

SEQ ID NO: 1186634 - protein, 7 aa, Mycobacterium
TSRDPRI

SEQ ID NO: 1186635 - protein, 11 aa, Mycobacterium
TSRGERKQQGQ

SEQ ID NO: 1186636 - protein, 10 aa, Mycobacterium
TSRGKRGRSR

SEQ ID NO: 1186637 - protein, 7 aa, Mycobacterium
TSRGPHA

SEQ ID NO: 1186638 - protein, 8 aa, Mycobacterium
TSRTTRAE

SEQ ID NO: 1186639 - protein, 9 aa, Mycobacterium
TSSDPELTN

SEQ ID NO: 1186640 - protein, 9 aa, Mycobacterium
TSSDPELTS

SEQ ID NO: 1186641 - protein, 7 aa, Mycobacterium
TSSDVDQ

SEQ ID NO: 1186642 - protein, 9 aa, Mycobacterium
TSSEVPQAP

SEQ ID NO: 1186643 - protein, 8 aa, Mycobacterium
TSSTPGGA

SEQ ID NO: 1186644 - protein, 14 aa, Mycobacterium
TSSVRGWGRLPVMV

SEQ ID NO: 1186645 - protein, 4 aa, Mycobacterium
TSSY

SEQ ID NO: 1186646 - protein, 8 aa, Mycobacterium
TSTAGGLG

SEQ ID NO: 1186647 - protein, 5 aa, Mycobacterium
TSTDL

SEQ ID NO: 1186648 - protein, 12 aa, Mycobacterium
TSTIRKGRRVSA

SEQ ID NO: 1186649 - protein, 7 aa, Mycobacterium
TSTPRGL

SEQ ID NO: 1186650 - protein, 4 aa, Mycobacterium
TSTR

SEQ ID NO: 1186651 - protein, 8 aa, Mycobacterium
TSTTAAGR

SEQ ID NO: 1186652 - protein, 17 aa, Mycobacterium
TSVLSPGGRISTPGDDG

SEQ ID NO: 1186653 - protein, 23 aa, Mycobacterium
TSVPPATGPLEPAATRTAARRNP

SEQ ID NO: 1186654 - protein, 21 aa, Mycobacterium
TSVPSTGRRSPTSPAAPNCAR

SEQ ID NO: 1186655 - protein, 6 aa, Mycobacterium
TSYPPK

SEQ ID NO: 1186656 - protein, 9 aa, Mycobacterium
TTADAPAGT

SEQ ID NO: 1186657 - protein, 6 aa, Mycobacterium
TTADGH

SEQ ID NO: 1186658 - protein, 11 aa, Mycobacterium
TTAEDAGPAEE

SEQ ID NO: 1186659 - protein, 46 aa, Mycobacterium
TTAELPPLAQPPPDPGRTAKMPKRRRTRAADNAARVKAEREHNAAA

SEQ ID NO: 1186660 - protein, 46 aa, Mycobacterium
TTAELPPLEQPPPDPGRTAKMPKRRRTRAADNAARVKAEREHNAAA

SEQ ID NO: 1186661 - protein, 17 aa, Mycobacterium
TTAELPPMTAPPPDPNR

SEQ ID NO: 1186662 - protein, 11 aa, Mycobacterium
TTAGQSCGSTS

SEQ ID NO: 1186663 - protein, 7 aa, Mycobacterium
TTAKARE

SEQ ID NO: 1186664 - protein, 46 aa, Mycobacterium
TTAPLPPLEQPPPDPGRTAKMPKRRRTRAADNAARVKAEREHNAAA

SEQ ID NO: 1186665 - protein, 10 aa, Mycobacterium
TTARKKPPFG

SEQ ID NO: 1186666 - protein, 21 aa, Mycobacterium
TTATDRNDRPTDPVVIESVTI

SEQ ID NO: 1186667 - protein, 85 aa, Mycobacterium
TTAVRSEGPPRFPEPAESWSPAPTPTVAAAAPGPPPPATAPAPMTEPAAAAAMPTAPMPTAGALPDMGSGLSGLSGLSGGVGGLG

SEQ ID NO: 1186668 - protein, 7 aa, Mycobacterium
TTDDGGL

SEQ ID NO: 1186669 - protein, 6 aa, Mycobacterium
TTDPAQ

SEQ ID NO: 1186670 - protein, 8 aa, Mycobacterium
TTDPEPLG

SEQ ID NO: 1186671 - protein, 4 aa, Mycobacterium
TTDR

SEQ ID NO: 1186672 - protein, 15 aa, Mycobacterium
TTDTEINGAPVRAGD

SEQ ID NO: 1186673 - protein, 11 aa, Mycobacterium
TTEAIGEQTIT

SEQ ID NO: 1186674 - protein, 14 aa, Mycobacterium
TTEGYVSTPGGAQA

SEQ ID NO: 1186675 - protein, 13 aa, Mycobacterium
TTESDHPPREPAG

SEQ ID NO: 1186676 - protein, 7 aa, Mycobacterium
TTESTGR

SEQ ID NO: 1186677 - protein, 14 aa, Mycobacterium
TTGAADDGPRERKV

SEQ ID NO: 1186678 - protein, 5 aa, Mycobacterium
TTGGA

SEQ ID NO: 1186679 - protein, 13 aa, Mycobacterium
TTGPTLSGTDGLG

SEQ ID NO: 1186680 - protein, 7 aa, Mycobacterium
TTGSANV

SEQ ID NO: 1186681 - protein, 9 aa, Mycobacterium
TTGSRLARP

SEQ ID NO: 1186682 - protein, 6 aa, Mycobacterium
TTGTGF

SEQ ID NO: 1186683 - protein, 9 aa, Mycobacterium
TTGTSNATA

SEQ ID NO: 1186684 - protein, 24 aa, Mycobacterium
TTHRPGNGRTQWTPPTNQDTGQPR

SEQ ID NO: 1186685 - protein, 13 aa, Mycobacterium
TTIGDEDHAGVDT

SEQ ID NO: 1186686 - protein, 22 aa, Mycobacterium
TTKAPKPADPNECPGSRKYVPG

SEQ ID NO: 1186687 - protein, 5 aa, Mycobacterium
TTLSN

SEQ ID NO: 1186688 - protein, 11 aa, Mycobacterium
TTLTRRSSGDY

SEQ ID NO: 1186689 - protein, 6 aa, Mycobacterium
TTMPGG

SEQ ID NO: 1186690 - protein, 11 aa, Mycobacterium
TTNPEASTGDG

SEQ ID NO: 1186691 - protein, 11 aa, Mycobacterium
TTPAPTSGPLR

SEQ ID NO: 1186692 - protein, 11 aa, Mycobacterium
TTPAPTSGSLR

SEQ ID NO: 1186693 - protein, 7 aa, Mycobacterium
TTPAPVR

SEQ ID NO: 1186694 - protein, 11 aa, Mycobacterium
TTPARGDEPPL

SEQ ID NO: 1186695 - protein, 15 aa, Mycobacterium
TTPARTALDPAARYP

SEQ ID NO: 1186696 - protein, 61 aa, Mycobacterium
TTPDVDAAASEKAAAELEEPAPEEGEDNDAAATAEETEDAEPTATESDALESPAASAVLGS

SEQ ID NO: 1186697 - protein, 8 aa, Mycobacterium
TTPEGDRR

SEQ ID NO: 1186698 - protein, 10 aa, Mycobacterium
TTPKDGEPAR

SEQ ID NO: 1186699 - protein, 8 aa, Mycobacterium
TTPLAGRG

SEQ ID NO: 1186700 - protein, 7 aa, Mycobacterium
TTPLTRS

SEQ ID NO: 1186701 - protein, 7 aa, Mycobacterium
TTPPMPE

SEQ ID NO: 1186702 - protein, 7 aa, Mycobacterium
TTPPPVR

SEQ ID NO: 1186703 - protein, 4 aa, Mycobacterium
TTPV

SEQ ID NO: 1186704 - protein, 5 aa, Mycobacterium
TTRNG

SEQ ID NO: 1186705 - protein, 5 aa, Mycobacterium
TTRTA

SEQ ID NO: 1186706 - protein, 13 aa, Mycobacterium
TTSPAAAKSSEYC

SEQ ID NO: 1186707 - protein, 8 aa, Mycobacterium
TTSPQPVR

SEQ ID NO: 1186708 - protein, 4 aa, Mycobacterium
TTSR

SEQ ID NO: 1186709 - protein, 15 aa, Mycobacterium
TTTEESILDGPDAAE

SEQ ID NO: 1186710 - protein, 5 aa, Mycobacterium
TTTEK

SEQ ID NO: 1186711 - protein, 9 aa, Mycobacterium
TTTGGERGL

SEQ ID NO: 1186712 - protein, 7 aa, Mycobacterium
TTTGRRR

SEQ ID NO: 1186713 - protein, 43 aa, Mycobacterium
TTTITVPETTDVDAGKTGDVTPSTDGAAAVDTTVGSGAPTEVE

SEQ ID NO: 1186714 - protein, 6 aa, Mycobacterium
TTTPAV

SEQ ID NO: 1186715 - protein, 5 aa, Mycobacterium
TTTVS

SEQ ID NO: 1186716 - protein, 5 aa, Mycobacterium
TTVAT

SEQ ID NO: 1186717 - protein, 4 aa, Mycobacterium
TTVE

SEQ ID NO: 1186718 - protein, 8 aa, Mycobacterium
TTVEPGSV

SEQ ID NO: 1186719 - protein, 9 aa, Mycobacterium
TTVTPRDPI

SEQ ID NO: 1186720 - protein, 8 aa, Mycobacterium
TVADASYR

SEQ ID NO: 1186721 - protein, 4 aa, Mycobacterium
TVAP

SEQ ID NO: 1186722 - protein, 10 aa, Mycobacterium
TVAQGDTREV

SEQ ID NO: 1186723 - protein, 16 aa, Mycobacterium
TVDDTVARHTSGTPAT

SEQ ID NO: 1186724 - protein, 7 aa, Mycobacterium
TVEADGS

SEQ ID NO: 1186725 - protein, 11 aa, Mycobacterium
TVEEAADAAGV

SEQ ID NO: 1186726 - protein, 7 aa, Mycobacterium
TVEPGGA

SEQ ID NO: 1186727 - protein, 19 aa, Mycobacterium
TVEPPGCAPPRVGPGPEHA

SEQ ID NO: 1186728 - protein, 8 aa, Mycobacterium
TVESGASV

SEQ ID NO: 1186729 - protein, 8 aa, Mycobacterium
TVGDTLGD

SEQ ID NO: 1186730 - protein, 10 aa, Mycobacterium
TVGKTSGAEE

SEQ ID NO: 1186731 - protein, 7 aa, Mycobacterium
TVHPNDD

SEQ ID NO: 1186732 - protein, 5 aa, Mycobacterium
TVNGM

SEQ ID NO: 1186733 - protein, 10 aa, Mycobacterium
TVPAGTAARL

SEQ ID NO: 1186734 - protein, 4 aa, Mycobacterium
TVPK

SEQ ID NO: 1186735 - protein, 10 aa, Mycobacterium
TVPRDGTPTT

SEQ ID NO: 1186736 - protein, 13 aa, Mycobacterium
TVPSGEASWSTSQ

SEQ ID NO: 1186737 - protein, 12 aa, Mycobacterium
TVPVGTAQRLDS

SEQ ID NO: 1186738 - protein, 7 aa, Mycobacterium
TVQPGAQ

SEQ ID NO: 1186739 - protein, 7 aa, Mycobacterium
TVRDTAA

SEQ ID NO: 1186740 - protein, 13 aa, Mycobacterium
TVRSAPDSSGFMP

SEQ ID NO: 1186741 - protein, 9 aa, Mycobacterium
TVRSPTAIG

SEQ ID NO: 1186742 - protein, 5 aa, Mycobacterium
TVRTR

SEQ ID NO: 1186743 - protein, 23 aa, Mycobacterium
TVSIGGDDGGIADDDVDVPPFMR

SEQ ID NO: 1186744 - protein, 7 aa, Mycobacterium
TVSNAEE

SEQ ID NO: 1186745 - protein, 8 aa, Mycobacterium
TVSNAEEF

SEQ ID NO: 1186746 - protein, 36 aa, Mycobacterium
TVSPSEGVRGNATGDTGTGTGVSGADTTGGDLQRAT

SEQ ID NO: 1186747 - protein, 7 aa, Mycobacterium
TVSPTGR

SEQ ID NO: 1186748 - protein, 6 aa, Mycobacterium
TVSVPK

SEQ ID NO: 1186749 - protein, 5 aa, Mycobacterium
TVTAE

SEQ ID NO: 1186750 - protein, 6 aa, Mycobacterium
TVTAPV

SEQ ID NO: 1186751 - protein, 8 aa, Mycobacterium
TVTDDTGT

SEQ ID NO: 1186752 - protein, 17 aa, Mycobacterium
TVTGKPAGGDLSEHKAT

SEQ ID NO: 1186753 - protein, 6 aa, Mycobacterium
TVTSGA

SEQ ID NO: 1186754 - protein, 12 aa, Mycobacterium
TWDGAEDAFDPE

SEQ ID NO: 1186755 - protein, 16 aa, Mycobacterium
TYEPSRQGWEPDPTAF

SEQ ID NO: 1186756 - protein, 6 aa, Mycobacterium
TYGPDR

SEQ ID NO: 1186757 - protein, 7 aa, Mycobacterium
TYGPDRV

SEQ ID NO: 1186758 - protein, 10 aa, Mycobacterium
TYGSSAPYMS

SEQ ID NO: 1186759 - protein, 14 aa, Mycobacterium
TYGVPVNSPDGYRT

SEQ ID NO: 1186760 - protein, 17 aa, Mycobacterium
TYKGPARVTGGPGTGKT

SEQ ID NO: 1186761 - protein, 15 aa, Mycobacterium
TYPGPSADSPDPSTV

SEQ ID NO: 1186762 - protein, 8 aa, Mycobacterium
TYSGATTA

SEQ ID NO: 1186763 - protein, 5 aa, Mycobacterium
VAAAR

SEQ ID NO: 1186764 - protein, 8 aa, Mycobacterium
VAADTARR

SEQ ID NO: 1186765 - protein, 8 aa, Mycobacterium
VAAPAGGA

SEQ ID NO: 1186766 - protein, 14 aa, Mycobacterium
VAAPAPPPPPQLPP

SEQ ID NO: 1186767 - protein, 18 aa, Mycobacterium
VAAPSTPKVPSATPTTAV

SEQ ID NO: 1186768 - protein, 9 aa, Mycobacterium
VAASGSGEL

SEQ ID NO: 1186769 - protein, 11 aa, Mycobacterium
VADGGALSDGV

SEQ ID NO: 1186770 - protein, 8 aa, Mycobacterium
VADHRGGL

SEQ ID NO: 1186771 - protein, 5 aa, Mycobacterium
VADNG

SEQ ID NO: 1186772 - protein, 8 aa, Mycobacterium
VADPPRSE

SEQ ID NO: 1186773 - protein, 12 aa, Mycobacterium
VADQGKRNVSHG

SEQ ID NO: 1186774 - protein, 10 aa, Mycobacterium
VADRGRRRIR

SEQ ID NO: 1186775 - protein, 10 aa, Mycobacterium
VADTTVSEHR

SEQ ID NO: 1186776 - protein, 5 aa, Mycobacterium
VAEAS

SEQ ID NO: 1186777 - protein, 10 aa, Mycobacterium
VAEDRTAPTT

SEQ ID NO: 1186778 - protein, 20 aa, Mycobacterium
VAEDSTADAVRALRDAGVAV

SEQ ID NO: 1186779 - protein, 8 aa, Mycobacterium
VAEGSEPW

SEQ ID NO: 1186780 - protein, 13 aa, Mycobacterium
VAERAEQTEGATL

SEQ ID NO: 1186781 - protein, 19 aa, Mycobacterium
VAERGRQAGRDLGEDQAAA

SEQ ID NO: 1186782 - protein, 14 aa, Mycobacterium
VAESGGETEFASSY

SEQ ID NO: 1186783 - protein, 5 aa, Mycobacterium
VAEVR

SEQ ID NO: 1186784 - protein, 4 aa, Mycobacterium
VAGD

SEQ ID NO: 1186785 - protein, 5 aa, Mycobacterium
VAGDE

SEQ ID NO: 1186786 - protein, 7 aa, Mycobacterium
VAGGSAG

SEQ ID NO: 1186787 - protein, 10 aa, Mycobacterium
VAGTGTAQLD

SEQ ID NO: 1186788 - protein, 11 aa, Mycobacterium
VAGTTESAARN

SEQ ID NO: 1186789 - protein, 12 aa, Mycobacterium
VALGDDDAARSF

SEQ ID NO: 1186790 - protein, 8 aa, Mycobacterium
VALTGEGG

SEQ ID NO: 1186791 - protein, 6 aa, Mycobacterium
VANEIE

SEQ ID NO: 1186792 - protein, 13 aa, Mycobacterium
VANPDPREAIRPG

SEQ ID NO: 1186793 - protein, 7 aa, Mycobacterium
VAPAEPV

SEQ ID NO: 1186794 - protein, 9 aa, Mycobacterium
VAPASPAVP

SEQ ID NO: 1186795 - protein, 18 aa, Mycobacterium
VAPATPSPSEPAGEGLKP

SEQ ID NO: 1186796 - protein, 4 aa, Mycobacterium
VAPP

SEQ ID NO: 1186797 - protein, 30 aa, Mycobacterium
VAPPIGTPSIQPGASKGVRAAGTPDMGGPV

SEQ ID NO: 1186798 - protein, 5 aa, Mycobacterium
VAPSE

SEQ ID NO: 1186799 - protein, 32 aa, Mycobacterium
VAQAAAPAAPVAPNPAATTMPAGAAPPAGGAP

SEQ ID NO: 1186800 - protein, 8 aa, Mycobacterium
VAQERRDD

SEQ ID NO: 1186801 - protein, 7 aa, Mycobacterium
VAQNPAP

SEQ ID NO: 1186802 - protein, 10 aa, Mycobacterium
VAQPDARSTS

SEQ ID NO: 1186803 - protein, 11 aa, Mycobacterium
VAQPGQPGRPV

SEQ ID NO: 1186804 - protein, 7 aa, Mycobacterium
VAQSDRV

SEQ ID NO: 1186805 - protein, 10 aa, Mycobacterium
VAQSSDTAGE

SEQ ID NO: 1186806 - protein, 8 aa, Mycobacterium
VARPGRLP

SEQ ID NO: 1186807 - protein, 6 aa, Mycobacterium
VARTGA

SEQ ID NO: 1186808 - protein, 19 aa, Mycobacterium
VASGAQSVTNWGSGKPRRE

SEQ ID NO: 1186809 - protein, 7 aa, Mycobacterium
VASGARL

SEQ ID NO: 1186810 - protein, 9 aa, Mycobacterium
VASLDPENA

SEQ ID NO: 1186811 - protein, 6 aa, Mycobacterium
VASRSA

SEQ ID NO: 1186812 - protein, 16 aa, Mycobacterium
VASSAEKLAAATQHGA

SEQ ID NO: 1186813 - protein, 9 aa, Mycobacterium
VASSSEADI

SEQ ID NO: 1186814 - protein, 14 aa, Mycobacterium
VASTTRTPALRSSG

SEQ ID NO: 1186815 - protein, 8 aa, Mycobacterium
VATGPDGV

SEQ ID NO: 1186816 - protein, 8 aa, Mycobacterium
VATGRTIA

SEQ ID NO: 1186817 - protein, 7 aa, Mycobacterium
VATGVSR

SEQ ID NO: 1186818 - protein, 14 aa, Mycobacterium
VATPAGVTLIDPRL

SEQ ID NO: 1186819 - protein, 10 aa, Mycobacterium
VATSDPAVDA

SEQ ID NO: 1186820 - protein, 11 aa, Mycobacterium
VATTKGPKSLV

SEQ ID NO: 1186821 - protein, 13 aa, Mycobacterium
VDADRRIGAEGQG

SEQ ID NO: 1186822 - protein, 6 aa, Mycobacterium
VDADSR

SEQ ID NO: 1186823 - protein, 4 aa, Mycobacterium
VDAN

SEQ ID NO: 1186824 - protein, 6 aa, Mycobacterium
VDAPGD

SEQ ID NO: 1186825 - protein, 18 aa, Mycobacterium
VDAQSQARSALRDSQPIA

SEQ ID NO: 1186826 - protein, 8 aa, Mycobacterium
VDARDESD

SEQ ID NO: 1186827 - protein, 39 aa, Mycobacterium
VDATQATDEQRETQEQLDDQHGDSDAPGAHQSRHGVADE

SEQ ID NO: 1186828 - protein, 12 aa, Mycobacterium
VDDDPDTASPAD

SEQ ID NO: 1186829 - protein, 6 aa, Mycobacterium
VDDDRG

SEQ ID NO: 1186830 - protein, 6 aa, Mycobacterium
VDDGDA

SEQ ID NO: 1186831 - protein, 8 aa, Mycobacterium
VDDGQART

SEQ ID NO: 1186832 - protein, 4 aa, Mycobacterium
VDDI

SEQ ID NO: 1186833 - protein, 8 aa, Mycobacterium
VDDPASDG

SEQ ID NO: 1186834 - protein, 14 aa, Mycobacterium
VDDPATRDKLTPRY

SEQ ID NO: 1186835 - protein, 17 aa, Mycobacterium
VDEGAKPGKSTNDSADL

SEQ ID NO: 1186836 - protein, 12 aa, Mycobacterium
VDEPAPMESEAA

SEQ ID NO: 1186837 - protein, 6 aa, Mycobacterium
VDEPLS

SEQ ID NO: 1186838 - protein, 9 aa, Mycobacterium
VDESASIQG

SEQ ID NO: 1186839 - protein, 11 aa, Mycobacterium
VDGAGKRTLTT

SEQ ID NO: 1186840 - protein, 5 aa, Mycobacterium
VDGDV

SEQ ID NO: 1186841 - protein, 9 aa, Mycobacterium
VDGEPPFAS

SEQ ID NO: 1186842 - protein, 11 aa, Mycobacterium
VDGGQLPSAEA

SEQ ID NO: 1186843 - protein, 8 aa, Mycobacterium
VDGGRESI

SEQ ID NO: 1186844 - protein, 21 aa, Mycobacterium
VDGLGRPGQARLPGRHPFGVA

SEQ ID NO: 1186845 - protein, 5 aa, Mycobacterium
VDGNE

SEQ ID NO: 1186846 - protein, 4 aa, Mycobacterium
VDGP

SEQ ID NO: 1186847 - protein, 4 aa, Mycobacterium
VDGV

SEQ ID NO: 1186848 - protein, 5 aa, Mycobacterium
VDGVG

SEQ ID NO: 1186849 - protein, 5 aa, Mycobacterium
VDKPE

SEQ ID NO: 1186850 - protein, 10 aa, Mycobacterium
VDNGPSRNPL

SEQ ID NO: 1186851 - protein, 4 aa, Mycobacterium
VDNR

SEQ ID NO: 1186852 - protein, 6 aa, Mycobacterium
VDNVPD

SEQ ID NO: 1186853 - protein, 10 aa, Mycobacterium
VDPADATDAF

SEQ ID NO: 1186854 - protein, 10 aa, Mycobacterium
VDPADATEEF

SEQ ID NO: 1186855 - protein, 7 aa, Mycobacterium
VDPATGR

SEQ ID NO: 1186856 - protein, 7 aa, Mycobacterium
VDPDEQV

SEQ ID NO: 1186857 - protein, 6 aa, Mycobacterium
VDPGRP

SEQ ID NO: 1186858 - protein, 14 aa, Mycobacterium
VDPGRRGSRRRERV

SEQ ID NO: 1186859 - protein, 27 aa, Mycobacterium
VDPLDEGYSPPERPYAPGAFGPGETLD

SEQ ID NO: 1186860 - protein, 50 aa, Mycobacterium
VDPPGTVSIQPNSSVTWGDGPAPKAASAGPTDGAAVGEATVTTPSVDRPA

SEQ ID NO: 1186861 - protein, 13 aa, Mycobacterium
VDPRDKGGIPAGF

SEQ ID NO: 1186862 - protein, 9 aa, Mycobacterium
VDPSVKDQD

SEQ ID NO: 1186863 - protein, 4 aa, Mycobacterium
VDQQ

SEQ ID NO: 1186864 - protein, 9 aa, Mycobacterium
VDQSRIGQG

SEQ ID NO: 1186865 - protein, 4 aa, Mycobacterium
VDRD

SEQ ID NO: 1186866 - protein, 6 aa, Mycobacterium
VDRQAS

SEQ ID NO: 1186867 - protein, 17 aa, Mycobacterium
VDSAGRVRAADDGAPVD

SEQ ID NO: 1186868 - protein, 14 aa, Mycobacterium
VDSDTGDDKRGRAA

SEQ ID NO: 1186869 - protein, 9 aa, Mycobacterium
VDSGTGCPP

SEQ ID NO: 1186870 - protein, 7 aa, Mycobacterium
VDSQQQL

SEQ ID NO: 1186871 - protein, 8 aa, Mycobacterium
VDSQRTRA

SEQ ID NO: 1186872 - protein, 8 aa, Mycobacterium
VDTDAARA

SEQ ID NO: 1186873 - protein, 19 aa, Mycobacterium
VDTEYGRKTRIDQTSCNTD

SEQ ID NO: 1186874 - protein, 16 aa, Mycobacterium
VDTGAMPGGGRGLPAG

SEQ ID NO: 1186875 - protein, 24 aa, Mycobacterium
VDTGGTSGAGAVAQSQVGTSPGSA

SEQ ID NO: 1186876 - protein, 6 aa, Mycobacterium
VDVPPN

SEQ ID NO: 1186877 - protein, 19 aa, Mycobacterium
VEAEAAKKVATHRAKAGAA

SEQ ID NO: 1186878 - protein, 14 aa, Mycobacterium
VEAGNPEQSATPQE

SEQ ID NO: 1186879 - protein, 7 aa, Mycobacterium
VEANSGE

SEQ ID NO: 1186880 - protein, 8 aa, Mycobacterium
VEDAAAAE

SEQ ID NO: 1186881 - protein, 4 aa, Mycobacterium
VEDG

SEQ ID NO: 1186882 - protein, 7 aa, Mycobacterium
VEDQAGQ

SEQ ID NO: 1186883 - protein, 12 aa, Mycobacterium
VEDTSAEQIAAD

SEQ ID NO: 1186884 - protein, 21 aa, Mycobacterium
VEDVKGKAKEGIGTVTGRDDM

SEQ ID NO: 1186885 - protein, 6 aa, Mycobacterium
VEESRR

SEQ ID NO: 1186886 - protein, 6 aa, Mycobacterium
VEETRK

SEQ ID NO: 1186887 - protein, 7 aa, Mycobacterium
VEGDTSV

SEQ ID NO: 1186888 - protein, 10 aa, Mycobacterium
VEGEGAGQVA

SEQ ID NO: 1186889 - protein, 12 aa, Mycobacterium
VEGGNKELEDLR

SEQ ID NO: 1186890 - protein, 4 aa, Mycobacterium
VEGS

SEQ ID NO: 1186891 - protein, 9 aa, Mycobacterium
VEGSSRPIE

SEQ ID NO: 1186892 - protein, 5 aa, Mycobacterium
VEGTR

SEQ ID NO: 1186893 - protein, 5 aa, Mycobacterium
VEGVP

SEQ ID NO: 1186894 - protein, 7 aa, Mycobacterium
VEHPPSC

SEQ ID NO: 1186895 - protein, 7 aa, Mycobacterium
VEKAADD

SEQ ID NO: 1186896 - protein, 4 aa, Mycobacterium
VELT

SEQ ID NO: 1186897 - protein, 7 aa, Mycobacterium
VEPDPRH

SEQ ID NO: 1186898 - protein, 17 aa, Mycobacterium
VEPQAGAPDTPENLSGA

SEQ ID NO: 1186899 - protein, 11 aa, Mycobacterium
VEPSATTPEAI

SEQ ID NO: 1186900 - protein, 9 aa, Mycobacterium
VEPTQEAQD

SEQ ID NO: 1186901 - protein, 8 aa, Mycobacterium
VEPVSGEI

SEQ ID NO: 1186902 - protein, 15 aa, Mycobacterium
VERDAGHRVLVYKPR

SEQ ID NO: 1186903 - protein, 13 aa, Mycobacterium
VERDGADLVVFVP

SEQ ID NO: 1186904 - protein, 11 aa, Mycobacterium
VERGRLTAASS

SEQ ID NO: 1186905 - protein, 7 aa, Mycobacterium
VERGRSG

SEQ ID NO: 1186906 - protein, 5 aa, Mycobacterium
VERPL

SEQ ID NO: 1186907 - protein, 5 aa, Mycobacterium
VERQG

SEQ ID NO: 1186908 - protein, 11 aa, Mycobacterium
VERRGVPGEPL

SEQ ID NO: 1186909 - protein, 11 aa, Mycobacterium
VERSDNSEQTA

SEQ ID NO: 1186910 - protein, 9 aa, Mycobacterium
VESGQGENE

SEQ ID NO: 1186911 - protein, 10 aa, Mycobacterium
VESRDTPPLT

SEQ ID NO: 1186912 - protein, 19 aa, Mycobacterium
VESTDDERADTPTSVPETE

SEQ ID NO: 1186913 - protein, 12 aa, Mycobacterium
VESVTDGGRRQP

SEQ ID NO: 1186914 - protein, 54 aa, Mycobacterium
VETGGTQTRHSAPDPPDANLSSGNNAPRVSTGPTPGSSSVSSQLSAQGTGPAYG

SEQ ID NO: 1186915 - protein, 10 aa, Mycobacterium
VEVDDTKTNR

SEQ ID NO: 1186916 - protein, 4 aa, Mycobacterium
VEYG

SEQ ID NO: 1186917 - protein, 15 aa, Mycobacterium
VGADATARTADEEVD

SEQ ID NO: 1186918 - protein, 10 aa, Mycobacterium
VGAGDDNTVT

SEQ ID NO: 1186919 - protein, 16 aa, Mycobacterium
VGANTRTGDLASDSAL

SEQ ID NO: 1186920 - protein, 10 aa, Mycobacterium
VGAPAAATAL

SEQ ID NO: 1186921 - protein, 7 aa, Mycobacterium
VGAPDDM

SEQ ID NO: 1186922 - protein, 9 aa, Mycobacterium
VGAPTAERT

SEQ ID NO: 1186923 - protein, 9 aa, Mycobacterium
VGASTSDHP

SEQ ID NO: 1186924 - protein, 5 aa, Mycobacterium
VGDER

SEQ ID NO: 1186925 - protein, 9 aa, Mycobacterium
VGDGAAAVR

SEQ ID NO: 1186926 - protein, 15 aa, Mycobacterium
VGDKTRDATAGQSVT

SEQ ID NO: 1186927 - protein, 5 aa, Mycobacterium
VGDRG

SEQ ID NO: 1186928 - protein, 4 aa, Mycobacterium
VGDS

SEQ ID NO: 1186929 - protein, 9 aa, Mycobacterium
VGELDEGEV

SEQ ID NO: 1186930 - protein, 16 aa, Mycobacterium
VGESGAPAVGDTAPAL

SEQ ID NO: 1186931 - protein, 17 aa, Mycobacterium
VGESGSAAATAASFGTQ

SEQ ID NO: 1186932 - protein, 7 aa, Mycobacterium
VGGDATR

SEQ ID NO: 1186933 - protein, 10 aa, Mycobacterium
VGGEQPTDRP

SEQ ID NO: 1186934 - protein, 6 aa, Mycobacterium
VGGPGE

SEQ ID NO: 1186935 - protein, 7 aa, Mycobacterium
VGGPSEN

SEQ ID NO: 1186936 - protein, 5 aa, Mycobacterium
VGGQQ

SEQ ID NO: 1186937 - protein, 5 aa, Mycobacterium
VGGQR

SEQ ID NO: 1186938 - protein, 10 aa, Mycobacterium
VGGQSRQCPA

SEQ ID NO: 1186939 - protein, 7 aa, Mycobacterium
VGGSERT

SEQ ID NO: 1186940 - protein, 7 aa, Mycobacterium
VGGSNGH

SEQ ID NO: 1186941 - protein, 7 aa, Mycobacterium
VGGSSGA

SEQ ID NO: 1186942 - protein, 12 aa, Mycobacterium
VGGTGRPDGLDK

SEQ ID NO: 1186943 - protein, 11 aa, Mycobacterium
VGGTRGDNGEW

SEQ ID NO: 1186944 - protein, 27 aa, Mycobacterium
VGGTVGDVGDTVSGTVRGTGKGLRSAR

SEQ ID NO: 1186945 - protein, 9 aa, Mycobacterium
VGGVTAPPL

SEQ ID NO: 1186946 - protein, 28 aa, Mycobacterium
VGHPGLPVSQPAHDRQPGAIREATEQRH

SEQ ID NO: 1186947 - protein, 8 aa, Mycobacterium
VGLPRPQV

SEQ ID NO: 1186948 - protein, 7 aa, Mycobacterium
VGNPRAV

SEQ ID NO: 1186949 - protein, 4 aa, Mycobacterium
VGNT

SEQ ID NO: 1186950 - protein, 4 aa, Mycobacterium
VGPA

SEQ ID NO: 1186951 - protein, 12 aa, Mycobacterium
VGPAGADRGAGG

SEQ ID NO: 1186952 - protein, 7 aa, Mycobacterium
VGPDEGF

SEQ ID NO: 1186953 - protein, 5 aa, Mycobacterium
VGPDQ

SEQ ID NO: 1186954 - protein, 10 aa, Mycobacterium
VGPKELKDTA

SEQ ID NO: 1186955 - protein, 4 aa, Mycobacterium
VGPR

SEQ ID NO: 1186956 - protein, 12 aa, Mycobacterium
VGPRGRSVASSH

SEQ ID NO: 1186957 - protein, 14 aa, Mycobacterium
VGRDGEKALQQRAD

SEQ ID NO: 1186958 - protein, 11 aa, Mycobacterium
VGRGEGRSGLA

SEQ ID NO: 1186959 - protein, 7 aa, Mycobacterium
VGRGGPR

SEQ ID NO: 1186960 - protein, 7 aa, Mycobacterium
VGRGPYG

SEQ ID NO: 1186961 - protein, 10 aa, Mycobacterium
VGRKSGKRYR

SEQ ID NO: 1186962 - protein, 10 aa, Mycobacterium
VGRPRRTATG

SEQ ID NO: 1186963 - protein, 11 aa, Mycobacterium
VGSAGDPTSRV

SEQ ID NO: 1186964 - protein, 8 aa, Mycobacterium
VGSGPGAL

SEQ ID NO: 1186965 - protein, 11 aa, Mycobacterium
VGSTADGRPAG

SEQ ID NO: 1186966 - protein, 7 aa, Mycobacterium
VGSTPPV

SEQ ID NO: 1186967 - protein, 15 aa, Mycobacterium
VGTGTGISGQARAQT

SEQ ID NO: 1186968 - protein, 12 aa, Mycobacterium
VGVDATPAGGPA

SEQ ID NO: 1186969 - protein, 4 aa, Mycobacterium
VGVE

SEQ ID NO: 1186970 - protein, 7 aa, Mycobacterium
VHADPSA

SEQ ID NO: 1186971 - protein, 4 aa, Mycobacterium
VHDE

SEQ ID NO: 1186972 - protein, 6 aa, Mycobacterium
VHDGEV

SEQ ID NO: 1186973 - protein, 8 aa, Mycobacterium
VHPAGAPA

SEQ ID NO: 1186974 - protein, 6 aa, Mycobacterium
VHPGDP

SEQ ID NO: 1186975 - protein, 7 aa, Mycobacterium
VHPGDPY

SEQ ID NO: 1186976 - protein, 11 aa, Mycobacterium
VHPTPRSGELG

SEQ ID NO: 1186977 - protein, 22 aa, Mycobacterium
VHTSQRPAAVSPTAPEGGFRKG

SEQ ID NO: 1186978 - protein, 4 aa, Mycobacterium
VIGP

SEQ ID NO: 1186979 - protein, 12 aa, Mycobacterium
VITGGSKGIGAA

SEQ ID NO: 1186980 - protein, 7 aa, Mycobacterium
VKDGEAF

SEQ ID NO: 1186981 - protein, 8 aa, Mycobacterium
VKENAPAF

SEQ ID NO: 1186982 - protein, 10 aa, Mycobacterium
VKPEAQAAKD

SEQ ID NO: 1186983 - protein, 12 aa, Mycobacterium
VKPNTGHLEGGA

SEQ ID NO: 1186984 - protein, 6 aa, Mycobacterium
VKPTDA

SEQ ID NO: 1186985 - protein, 11 aa, Mycobacterium
VKQKDKPLAQA

SEQ ID NO: 1186986 - protein, 5 aa, Mycobacterium
VKRQE

SEQ ID NO: 1186987 - protein, 6 aa, Mycobacterium
VKRTPA

SEQ ID NO: 1186988 - protein, 9 aa, Mycobacterium
VKSADDARL

SEQ ID NO: 1186989 - protein, 6 aa, Mycobacterium
VKSSQI

SEQ ID NO: 1186990 - protein, 11 aa, Mycobacterium
VKSTDPDTKSV

SEQ ID NO: 1186991 - protein, 13 aa, Mycobacterium
VKVTDSDTTPTSL

SEQ ID NO: 1186992 - protein, 10 aa, Mycobacterium
VLGSGSEAVR

SEQ ID NO: 1186993 - protein, 9 aa, Mycobacterium
VLGTPERAG

SEQ ID NO: 1186994 - protein, 46 aa, Mycobacterium
VLPEDGPGDPPSPDQAPSAPGDGRTVKPANLTVPDAGADVQDWRSQ

SEQ ID NO: 1186995 - protein, 10 aa, Mycobacterium
VLTDEARKAE

SEQ ID NO: 1186996 - protein, 4 aa, Mycobacterium
VNAA

SEQ ID NO: 1186997 - protein, 5 aa, Mycobacterium
VNAGA

SEQ ID NO: 1186998 - protein, 6 aa, Mycobacterium
VNANYR

SEQ ID NO: 1186999 - protein, 7 aa, Mycobacterium
VNDDRKR

SEQ ID NO: 1187000 - protein, 19 aa, Mycobacterium
VNEADDGSLRFRGEYLVSV

SEQ ID NO: 1187001 - protein, 15 aa, Mycobacterium
VNGSSEIAAGTGDFT

SEQ ID NO: 1187002 - protein, 5 aa, Mycobacterium
VNGVP

SEQ ID NO: 1187003 - protein, 4 aa, Mycobacterium
VNPD

SEQ ID NO: 1187004 - protein, 9 aa, Mycobacterium
VNPPAPHSS

SEQ ID NO: 1187005 - protein, 6 aa, Mycobacterium
VNPTDW

SEQ ID NO: 1187006 - protein, 17 aa, Mycobacterium
VNQPDADAADGEDPDAE

SEQ ID NO: 1187007 - protein, 11 aa, Mycobacterium
VNQREDRPDLE

SEQ ID NO: 1187008 - protein, 8 aa, Mycobacterium
VNQSGSEV

SEQ ID NO: 1187009 - protein, 7 aa, Mycobacterium
VNSGETH

SEQ ID NO: 1187010 - protein, 4 aa, Mycobacterium
VNTA

SEQ ID NO: 1187011 - protein, 8 aa, Mycobacterium
VNTDAPAL

SEQ ID NO: 1187012 - protein, 9 aa, Mycobacterium
VNVSGSGCS

SEQ ID NO: 1187013 - protein, 12 aa, Mycobacterium
VPAASPSKNGRR

SEQ ID NO: 1187014 - protein, 5 aa, Mycobacterium
VPAGV

SEQ ID NO: 1187015 - protein, 6 aa, Mycobacterium
VPAPPL

SEQ ID NO: 1187016 - protein, 6 aa, Mycobacterium
VPASAP

SEQ ID NO: 1187017 - protein, 12 aa, Mycobacterium
VPASGAVDPVGP

SEQ ID NO: 1187018 - protein, 8 aa, Mycobacterium
VPDGDGQR

SEQ ID NO: 1187019 - protein, 7 aa, Mycobacterium
VPDPAVG

SEQ ID NO: 1187020 - protein, 10 aa, Mycobacterium
VPDPEPGPGQ

SEQ ID NO: 1187021 - protein, 11 aa, Mycobacterium
VPDPQSPAGQA

SEQ ID NO: 1187022 - protein, 6 aa, Mycobacterium
VPDQEG

SEQ ID NO: 1187023 - protein, 8 aa, Mycobacterium
VPDQPGEI

SEQ ID NO: 1187024 - protein, 8 aa, Mycobacterium
VPDTSAPA

SEQ ID NO: 1187025 - protein, 4 aa, Mycobacterium
VPDV

SEQ ID NO: 1187026 - protein, 5 aa, Mycobacterium
VPEHR

SEQ ID NO: 1187027 - protein, 8 aa, Mycobacterium
VPESLQPA

SEQ ID NO: 1187028 - protein, 4 aa, Mycobacterium
VPFP

SEQ ID NO: 1187029 - protein, 4 aa, Mycobacterium
VPGC

SEQ ID NO: 1187030 - protein, 6 aa, Mycobacterium
VPGEPL

SEQ ID NO: 1187031 - protein, 14 aa, Mycobacterium
VPGGAGSAKKIAEN

SEQ ID NO: 1187032 - protein, 10 aa, Mycobacterium
VPGGGAKPHY

SEQ ID NO: 1187033 - protein, 7 aa, Mycobacterium
VPGNGAD

SEQ ID NO: 1187034 - protein, 5 aa, Mycobacterium
VPGQS

SEQ ID NO: 1187035 - protein, 10 aa, Mycobacterium
VPGREGLTPC

SEQ ID NO: 1187036 - protein, 17 aa, Mycobacterium
VPGSERDPEVFDLTKRA

SEQ ID NO: 1187037 - protein, 8 aa, Mycobacterium
VPGSSAKM

SEQ ID NO: 1187038 - protein, 7 aa, Mycobacterium
VPITPGR

SEQ ID NO: 1187039 - protein, 7 aa, Mycobacterium
VPPAGPL

SEQ ID NO: 1187040 - protein, 10 aa, Mycobacterium
VPPDDGTDRH

SEQ ID NO: 1187041 - protein, 15 aa, Mycobacterium
VPPGETLPDRRSRKI

SEQ ID NO: 1187042 - protein, 8 aa, Mycobacterium
VPPHPHTG

SEQ ID NO: 1187043 - protein, 4 aa, Mycobacterium
VPPN

SEQ ID NO: 1187044 - protein, 58 aa, Mycobacterium; identical to SEQ ID NO: 921659

SEQ ID NO: 1187045 - protein, 8 aa, Mycobacterium
VPPSPRRR

SEQ ID NO: 1187046 - protein, 5 aa, Mycobacterium
VPRGR

SEQ ID NO: 1187047 - protein, 15 aa, Mycobacterium
VPRNSNGRVHPGSRV

SEQ ID NO: 1187048 - protein, 9 aa, Mycobacterium
VPRRRDGRR

SEQ ID NO: 1187049 - protein, 8 aa, Mycobacterium
VPSAGYGD

SEQ ID NO: 1187050 - protein, 6 aa, Mycobacterium
VPSQTR

SEQ ID NO: 1187051 - protein, 6 aa, Mycobacterium
VPSTAS

SEQ ID NO: 1187052 - protein, 17 aa, Mycobacterium
VPTAEEVASGDPIDPSK

SEQ ID NO: 1187053 - protein, 4 aa, Mycobacterium
VPTD

SEQ ID NO: 1187054 - protein, 5 aa, Mycobacterium
VPTEQ

SEQ ID NO: 1187055 - protein, 4 aa, Mycobacterium
VPTG

SEQ ID NO: 1187056 - protein, 19 aa, Mycobacterium
VPTGGRGQTQRIDSGAVTE

SEQ ID NO: 1187057 - protein, 8 aa, Mycobacterium
VPTPPTGI

SEQ ID NO: 1187058 - protein, 4 aa, Mycobacterium
VPTT

SEQ ID NO: 1187059 - protein, 5 aa, Mycobacterium
VPVDG

SEQ ID NO: 1187060 - protein, 9 aa, Mycobacterium
VPVDGDAAD

SEQ ID NO: 1187061 - protein, 6 aa, Mycobacterium
VPVPAD

SEQ ID NO: 1187062 - protein, 11 aa, Mycobacterium
VPVPADSSQLN

SEQ ID NO: 1187063 - protein, 7 aa, Mycobacterium
VPVPPDW

SEQ ID NO: 1187064 - protein, 5 aa, Mycobacterium
VPYAG

SEQ ID NO: 1187065 - protein, 11 aa, Mycobacterium
VPYGQTPSDPG

SEQ ID NO: 1187066 - protein, 4 aa, Mycobacterium
VQAQ

SEQ ID NO: 1187067 - protein, 6 aa, Mycobacterium
VQEKQE

SEQ ID NO: 1187068 - protein, 36 aa, Mycobacterium
VQPEGDPGQWSSPPFEPTERDGRLYGRGTADDKAGI

SEQ ID NO: 1187069 - protein, 13 aa, Mycobacterium
VQPTRDSIAQEVT

SEQ ID NO: 1187070 - protein, 7 aa, Mycobacterium
VQPTSDS

SEQ ID NO: 1187071 - protein, 4 aa, Mycobacterium
VQRE

SEQ ID NO: 1187072 - protein, 15 aa, Mycobacterium
VQSDLSPVSDGSPVK

SEQ ID NO: 1187073 - protein, 6 aa, Mycobacterium
VQSGRR

SEQ ID NO: 1187074 - protein, 8 aa, Mycobacterium
VQSTQEGV

SEQ ID NO: 1187075 - protein, 15 aa, Mycobacterium
VQTGTGPVGGTGDDD

SEQ ID NO: 1187076 - protein, 58 aa, Mycobacterium
VQTSDAAAGINQTATGYEAEDTNGASLYGADGGHGAGAAPSVLATPTSGGSAPPAGMP

SEQ ID NO: 1187077 - protein, 10 aa, Mycobacterium
VQVTDDGRGI

SEQ ID NO: 1187078 - protein, 9 aa, Mycobacterium
VRADKQREA

SEQ ID NO: 1187079 - protein, 7 aa, Mycobacterium
VRAGKTR

SEQ ID NO: 1187080 - protein, 10 aa, Mycobacterium
VRAQTRYRPA

SEQ ID NO: 1187081 - protein, 10 aa, Mycobacterium
VRDESSEFTR

SEQ ID NO: 1187082 - protein, 9 aa, Mycobacterium
VRDNERRLA

SEQ ID NO: 1187083 - protein, 10 aa, Mycobacterium
VRETGDPAAE

SEQ ID NO: 1187084 - protein, 7 aa, Mycobacterium
VRGGDAG

SEQ ID NO: 1187085 - protein, 5 aa, Mycobacterium
VRGPG

SEQ ID NO: 1187086 - protein, 7 aa, Mycobacterium
VRHSTAP

SEQ ID NO: 1187087 - protein, 6 aa, Mycobacterium
VRNGTG

SEQ ID NO: 1187088 - protein, 8 aa, Mycobacterium
VRNNPGGR

SEQ ID NO: 1187089 - protein, 133 aa, Mycobacterium
VRPAGRPNIDAPSASPSPGRSPAGPQSQPSPVMASGGSGMPPITSSSPGSPLGSGGSSGGGAPSLGGGSGSGGGGASGVGSSGGSSGGGTSSSPISDGPSSIGDQSSVDPSNGASGPSSGAGGQPPIQSPPIA

SEQ ID NO: 1187090 - protein, 12 aa, Mycobacterium
VRPDGDKNRATS

SEQ ID NO: 1187091 - protein, 10 aa, Mycobacterium
VRPEAEADAE

SEQ ID NO: 1187092 - protein, 10 aa, Mycobacterium
VRPENAASRR

SEQ ID NO: 1187093 - protein, 4 aa, Mycobacterium
VRPG

SEQ ID NO: 1187094 - protein, 12 aa, Mycobacterium
VRPGAGTDEYDV

SEQ ID NO: 1187095 - protein, 6 aa, Mycobacterium
VRPPGR

SEQ ID NO: 1187096 - protein, 6 aa, Mycobacterium
VRPPSM

SEQ ID NO: 1187097 - protein, 10 aa, Mycobacterium
VRPPSYPALA

SEQ ID NO: 1187098 - protein, 9 aa, Mycobacterium
VRPRRGATA

SEQ ID NO: 1187099 - protein, 13 aa, Mycobacterium
VRPRTLAPEQMTG

SEQ ID NO: 1187100 - protein, 21 aa, Mycobacterium
VRPSAAEEARTIAASTNTATL

SEQ ID NO: 1187101 - protein, 4 aa, Mycobacterium
VRQP

SEQ ID NO: 1187102 - protein, 10 aa, Mycobacterium
VRREKSSDRH

SEQ ID NO: 1187103 - protein, 4 aa, Mycobacterium
VRSA

SEQ ID NO: 1187104 - protein, 21 aa, Mycobacterium
VRSATFSKPPLGKRGYDPKSV

SEQ ID NO: 1187105 - protein, 10 aa, Mycobacterium
VRSDPDGDQV

SEQ ID NO: 1187106 - protein, 5 aa, Mycobacterium
VRSGD

SEQ ID NO: 1187107 - protein, 15 aa, Mycobacterium
VRTERRASGFTRGVG

SEQ ID NO: 1187108 - protein, 7 aa, Mycobacterium
VRTPTRA

SEQ ID NO: 1187109 - protein, 7 aa, Mycobacterium
VRTPTTT

SEQ ID NO: 1187110 - protein, 18 aa, Mycobacterium
VSAAQADGDVPADTDAKA

SEQ ID NO: 1187111 - protein, 5 aa, Mycobacterium
VSAAR

SEQ ID NO: 1187112 - protein, 6 aa, Mycobacterium
VSAARR

SEQ ID NO: 1187113 - protein, 7 aa, Mycobacterium
VSAASRR

SEQ ID NO: 1187114 - protein, 10 aa, Mycobacterium
VSADPATQTM

SEQ ID NO: 1187115 - protein, 7 aa, Mycobacterium
VSAEDAG

SEQ ID NO: 1187116 - protein, 10 aa, Mycobacterium
VSAGPDRGPL

SEQ ID NO: 1187117 - protein, 5 aa, Mycobacterium
VSAGQ

SEQ ID NO: 1187118 - protein, 7 aa, Mycobacterium
VSAPPYD

SEQ ID NO: 1187119 - protein, 6 aa, Mycobacterium
VSAQTG

SEQ ID NO: 1187120 - protein, 7 aa, Mycobacterium
VSARRDA

SEQ ID NO: 1187121 - protein, 10 aa, Mycobacterium
VSASGPDGVV

SEQ ID NO: 1187122 - protein, 12 aa, Mycobacterium
VSAYSGKPRREY

SEQ ID NO: 1187123 - protein, 8 aa, Mycobacterium
VSDDATAA

SEQ ID NO: 1187124 - protein, 10 aa, Mycobacterium
VSDDNGETWT

SEQ ID NO: 1187125 - protein, 5 aa, Mycobacterium
VSDEE

SEQ ID NO: 1187126 - protein, 17 aa, Mycobacterium
VSDEHRDAFAGTSKGET

SEQ ID NO: 1187127 - protein, 19 aa, Mycobacterium
VSDGPAREPGARVGTSRTA

SEQ ID NO: 1187128 - protein, 6 aa, Mycobacterium
VSDGRE

SEQ ID NO: 1187129 - protein, 8 aa, Mycobacterium
VSDPGHGW

SEQ ID NO: 1187130 - protein, 6 aa, Mycobacterium
VSEDKR

SEQ ID NO: 1187131 - protein, 10 aa, Mycobacterium
VSEEKHGPID

SEQ ID NO: 1187132 - protein, 13 aa, Mycobacterium
VSGAEDAPLPDGQ

SEQ ID NO: 1187133 - protein, 12 aa, Mycobacterium
VSGAKSDASDAK

SEQ ID NO: 1187134 - protein, 9 aa, Mycobacterium
VSGPTGRST

SEQ ID NO: 1187135 - protein, 8 aa, Mycobacterium
VSGRNYEV

SEQ ID NO: 1187136 - protein, 10 aa, Mycobacterium
VSGSAQPVVT

SEQ ID NO: 1187137 - protein, 6 aa, Mycobacterium
VSGSGN

SEQ ID NO: 1187138 - protein, 7 aa, Mycobacterium
VSGTDDG

SEQ ID NO: 1187139 - protein, 5 aa, Mycobacterium
VSHTD

SEQ ID NO: 1187140 - protein, 10 aa, Mycobacterium
VSIGTPPEGL

SEQ ID NO: 1187141 - protein, 10 aa, Mycobacterium
VSLSTGDTLT

SEQ ID NO: 1187142 - protein, 10 aa, Mycobacterium
VSNREAAAGI

SEQ ID NO: 1187143 - protein, 7 aa, Mycobacterium
VSPADAN

SEQ ID NO: 1187144 - protein, 5 aa, Mycobacterium
VSPDE

SEQ ID NO: 1187145 - protein, 5 aa, Mycobacterium
VSPGF

SEQ ID NO: 1187146 - protein, 7 aa, Mycobacterium
VSPPFKQ

SEQ ID NO: 1187147 - protein, 9 aa, Mycobacterium
VSPPGDDRG

SEQ ID NO: 1187148 - protein, 8 aa, Mycobacterium
VSPQHGPT

SEQ ID NO: 1187149 - protein, 7 aa, Mycobacterium
VSPRGAT

SEQ ID NO: 1187150 - protein, 15 aa, Mycobacterium
VSPRRSTKAAATGPV

SEQ ID NO: 1187151 - protein, 7 aa, Mycobacterium
VSPSEPL

SEQ ID NO: 1187152 - protein, 12 aa, Mycobacterium
VSPSPRKKPQAL

SEQ ID NO: 1187153 - protein, 13 aa, Mycobacterium
VSPVGSHKTNSAV

SEQ ID NO: 1187154 - protein, 14 aa, Mycobacterium
VSPVGSHKTNSAVA

SEQ ID NO: 1187155 - protein, 6 aa, Mycobacterium
VSQTRP

SEQ ID NO: 1187156 - protein, 9 aa, Mycobacterium
VSREEGDYL

SEQ ID NO: 1187157 - protein, 14 aa, Mycobacterium
VSRQRAAKLTEAPD

SEQ ID NO: 1187158 - protein, 108 aa, Mycobacterium
VSSGSSSSSGSSSPLSSSSSSSAASSNPAGAQSSQMANANSAGAGNAAGAGAGGGAGGANAAANAAGRAPGLASLGSGLAESTARMGSGAINTAANAIGNAANVGTNV

SEQ ID NO: 1187159 - protein, 6 aa, Mycobacterium
VSSPTA

SEQ ID NO: 1187160 - protein, 8 aa, Mycobacterium
VSSRDEQI

SEQ ID NO: 1187161 - protein, 9 aa, Mycobacterium
VSSRGRRDI

SEQ ID NO: 1187162 - protein, 11 aa, Mycobacterium
VSSTKTEATET

SEQ ID NO: 1187163 - protein, 15 aa, Mycobacterium
VSTDAKVGKDAGELA

SEQ ID NO: 1187164 - protein, 51 aa, Mycobacterium
VSTESASAKATACGEKQSCTTQFSSSATMAAASAARREKATTRDMARTHSA

SEQ ID NO: 1187165 - protein, 5 aa, Mycobacterium
VSTHG

SEQ ID NO: 1187166 - protein, 7 aa, Mycobacterium
VSTQPAG

SEQ ID NO: 1187167 - protein, 11 aa, Mycobacterium
VSVEGEARPLP

SEQ ID NO: 1187168 - protein, 8 aa, Mycobacterium
VSYRPGAR

SEQ ID NO: 1187169 - protein, 17 aa, Mycobacterium
VTAADTRLTGSPQYPVA

SEQ ID NO: 1187170 - protein, 11 aa, Mycobacterium
VTADPHRAADG

SEQ ID NO: 1187171 - protein, 6 aa, Mycobacterium
VTAEAG

SEQ ID NO: 1187172 - protein, 15 aa, Mycobacterium
VTAGKGDPVTVTGRP

SEQ ID NO: 1187173 - protein, 7 aa, Mycobacterium
VTANSVP

SEQ ID NO: 1187174 - protein, 5 aa, Mycobacterium
VTAPN

SEQ ID NO: 1187175 - protein, 6 aa, Mycobacterium
VTATDQ

SEQ ID NO: 1187176 - protein, 4 aa, Mycobacterium
VTDE

SEQ ID NO: 1187177 - protein, 13 aa, Mycobacterium
VTDEPQERGDAAR

SEQ ID NO: 1187178 - protein, 7 aa, Mycobacterium
VTDGKAV

SEQ ID NO: 1187179 - protein, 13 aa, Mycobacterium
VTDGNDKFQTGTA

SEQ ID NO: 1187180 - protein, 16 aa, Mycobacterium
VTDPTTVSAALGGADA

SEQ ID NO: 1187181 - protein, 12 aa, Mycobacterium
VTDSASDAVSTR

SEQ ID NO: 1187182 - protein, 5 aa, Mycobacterium
VTEGE

SEQ ID NO: 1187183 - protein, 7 aa, Mycobacterium
VTGAQTG

SEQ ID NO: 1187184 - protein, 9 aa, Mycobacterium
VTGEAEDTY

SEQ ID NO: 1187185 - protein, 9 aa, Mycobacterium
VTGGDGHIP

SEQ ID NO: 1187186 - protein, 10 aa, Mycobacterium
VTGGSKGIGR

SEQ ID NO: 1187187 - protein, 11 aa, Mycobacterium
VTGGSKGIGRG

SEQ ID NO: 1187188 - protein, 10 aa, Mycobacterium
VTGPLAGNPE

SEQ ID NO: 1187189 - protein, 4 aa, Mycobacterium
VTGQ

SEQ ID NO: 1187190 - protein, 7 aa, Mycobacterium
VTGQDAA

SEQ ID NO: 1187191 - protein, 29 aa, Mycobacterium
VTGQRAERPDDSGDDASGGTPAAESDPDA

SEQ ID NO: 1187192 - protein, 12 aa, Mycobacterium
VTGRDGSSETLP

SEQ ID NO: 1187193 - protein, 11 aa, Mycobacterium
VTGRPADTPVP

SEQ ID NO: 1187194 - protein, 9 aa, Mycobacterium
VTGSSRGIG

SEQ ID NO: 1187195 - protein, 10 aa, Mycobacterium
VTGSSRGIGR

SEQ ID NO: 1187196 - protein, 21 aa, Mycobacterium
VTGSTEKWDGQATGPHQPAPA

SEQ ID NO: 1187197 - protein, 7 aa, Mycobacterium
VTNPAKA

SEQ ID NO: 1187198 - protein, 30 aa, Mycobacterium
VTPANSGKRIEQRTHGRAKRLSGRGRQQPR

SEQ ID NO: 1187199 - protein, 4 aa, Mycobacterium
VTPD

SEQ ID NO: 1187200 - protein, 9 aa, Mycobacterium
VTPDATTKT

SEQ ID NO: 1187201 - protein, 7 aa, Mycobacterium
VTPDELP

SEQ ID NO: 1187202 - protein, 7 aa, Mycobacterium
VTPDGGL

SEQ ID NO: 1187203 - protein, 7 aa, Mycobacterium
VTPKGGV

SEQ ID NO: 1187204 - protein, 7 aa, Mycobacterium
VTPKRIE

SEQ ID NO: 1187205 - protein, 13 aa, Mycobacterium
VTPRIEEPHYPVQ

SEQ ID NO: 1187206 - protein, 4 aa, Mycobacterium
VTPS

SEQ ID NO: 1187207 - protein, 6 aa, Mycobacterium
VTPSPF

SEQ ID NO: 1187208 - protein, 12 aa, Mycobacterium
VTPVDSKGRFDA

SEQ ID NO: 1187209 - protein, 11 aa, Mycobacterium
VTQTRTGNRTD

SEQ ID NO: 1187210 - protein, 5 aa, Mycobacterium
VTRRP

SEQ ID NO: 1187211 - protein, 9 aa, Mycobacterium
VTRTADDAG

SEQ ID NO: 1187212 - protein, 6 aa, Mycobacterium
VTRTRK

SEQ ID NO: 1187213 - protein, 4 aa, Mycobacterium
VTSE

SEQ ID NO: 1187214 - protein, 14 aa, Mycobacterium
VTSGRAQPKSLPSG

SEQ ID NO: 1187215 - protein, 12 aa, Mycobacterium
VTSPAPRSREHG

SEQ ID NO: 1187216 - protein, 17 aa, Mycobacterium
VTSQKKEIDTMKQILDS

SEQ ID NO: 1187217 - protein, 8 aa, Mycobacterium
VTSSARTA

SEQ ID NO: 1187218 - protein, 7 aa, Mycobacterium
VTSTEAV

SEQ ID NO: 1187219 - protein, 4 aa, Mycobacterium
VTSY

SEQ ID NO: 1187220 - protein, 22 aa, Mycobacterium
VTTDPPPGRSDGEPDNPQAASG

SEQ ID NO: 1187221 - protein, 8 aa, Mycobacterium
VTTEETAA

SEQ ID NO: 1187222 - protein, 12 aa, Mycobacterium
VTTPPETNNGWP

SEQ ID NO: 1187223 - protein, 17 aa, Mycobacterium
VTTRVTGNTEPFPRRTN

SEQ ID NO: 1187224 - protein, 9 aa, Mycobacterium
VTVSAGDGV

SEQ ID NO: 1187225 - protein, 9 aa, Mycobacterium
VVDPGKAQS

SEQ ID NO: 1187226 - protein, 5 aa, Mycobacterium
VVPDE

SEQ ID NO: 1187227 - protein, 5 aa, Mycobacterium
VVTEE

SEQ ID NO: 1187228 - protein, 8 aa, Mycobacterium
VVTSAQSA

SEQ ID NO: 1187229 - protein, 4 aa, Mycobacterium
VYGG

SEQ ID NO: 1187230 - protein, 10 aa, Mycobacterium
VYPTTSATAD

SEQ ID NO: 1187231 - protein, 7 aa, Mycobacterium
WAPEESR

SEQ ID NO: 1187232 - protein, 11 aa, Mycobacterium
WDDDKADGLRA

SEQ ID NO: 1187233 - protein, 12 aa, Mycobacterium
WDDEPTGSACTE

SEQ ID NO: 1187234 - protein, 13 aa, Mycobacterium
WDEPTDANGNGIR

SEQ ID NO: 1187235 - protein, 14 aa, Mycobacterium
WDGAGSEAARDEAS

SEQ ID NO: 1187236 - protein, 8 aa, Mycobacterium
WDGESDES

SEQ ID NO: 1187237 - protein, 26 aa, Mycobacterium
WDGTGNPLHEEEDAPAPLSEPNAADD

SEQ ID NO: 1187238 - protein, 7 aa, Mycobacterium
WDPERAD

SEQ ID NO: 1187239 - protein, 6 aa, Mycobacterium
WDSPDA

SEQ ID NO: 1187240 - protein, 12 aa, Mycobacterium
WDTSKPDGTPQK

SEQ ID NO: 1187241 - protein, 10 aa, Mycobacterium
WEASEGTDTE

SEQ ID NO: 1187242 - protein, 11 aa, Mycobacterium
WEGQGAQAARS

SEQ ID NO: 1187243 - protein, 9 aa, Mycobacterium
WENGGIPQR

SEQ ID NO: 1187244 - protein, 20 aa, Mycobacterium
WENYTGPQWASQSRHGPDTD

SEQ ID NO: 1187245 - protein, 5 aa, Mycobacterium
WEPMG

SEQ ID NO: 1187246 - protein, 11 aa, Mycobacterium
WGDEAKREADA

SEQ ID NO: 1187247 - protein, 4 aa, Mycobacterium
WGGY

SEQ ID NO: 1187248 - protein, 6 aa, Mycobacterium
WGRPPN

SEQ ID NO: 1187249 - protein, 4 aa, Mycobacterium
WGRQ

SEQ ID NO: 1187250 - protein, 5 aa, Mycobacterium
WGTTN

SEQ ID NO: 1187251 - protein, 9 aa, Mycobacterium
WIPTDPKGD

SEQ ID NO: 1187252 - protein, 12 aa, Mycobacterium
WNRGAESAADRP

SEQ ID NO: 1187253 - protein, 13 aa, Mycobacterium
WNRTTTGDTRPGR

SEQ ID NO: 1187254 - protein, 8 aa, Mycobacterium
WPAGPTCA

SEQ ID NO: 1187255 - protein, 4 aa, Mycobacterium
WPDG

SEQ ID NO: 1187256 - protein, 4 aa, Mycobacterium
WPDT

SEQ ID NO: 1187257 - protein, 8 aa, Mycobacterium
WPEDQPQL

SEQ ID NO: 1187258 - protein, 10 aa, Mycobacterium
WQGDTGQTYQ

SEQ ID NO: 1187259 - protein, 8 aa, Mycobacterium
WQTSAAGR

SEQ ID NO: 1187260 - protein, 4 aa, Mycobacterium
WQTT

SEQ ID NO: 1187261 - protein, 4 aa, Mycobacterium
WRAR

SEQ ID NO: 1187262 - protein, 17 aa, Mycobacterium
WRQRATARGDVNPTGGL

SEQ ID NO: 1187263 - protein, 8 aa, Mycobacterium
WSAEPAAP

SEQ ID NO: 1187264 - protein, 7 aa, Mycobacterium
WSGDDGG

SEQ ID NO: 1187265 - protein, 12 aa, Mycobacterium
WSGKGSGEYPTI

SEQ ID NO: 1187266 - protein, 5 aa, Mycobacterium
WSPAH

SEQ ID NO: 1187267 - protein, 8 aa, Mycobacterium
WSPEDPLT

SEQ ID NO: 1187268 - protein, 5 aa, Mycobacterium
WSQTG

SEQ ID NO: 1187269 - protein, 7 aa, Mycobacterium
WSSDDGG

SEQ ID NO: 1187270 - protein, 8 aa, Mycobacterium
WSSEASQR

SEQ ID NO: 1187271 - protein, 8 aa, Mycobacterium
WTAPPRSQ

SEQ ID NO: 1187272 - protein, 5 aa, Mycobacterium
WTATA

SEQ ID NO: 1187273 - protein, 10 aa, Mycobacterium
WTDDGKSAAS

SEQ ID NO: 1187274 - protein, 4 aa, Mycobacterium
WTGA

SEQ ID NO: 1187275 - protein, 15 aa, Mycobacterium
WTGGASADAMGIRPP

SEQ ID NO: 1187276 - protein, 9 aa, Mycobacterium
WTGTGADAA

SEQ ID NO: 1187277 - protein, 38 aa, Mycobacterium
WTSSTPPGTPRPPAARTQTAPPWSCTSTSTTASPPYTS

SEQ ID NO: 1187278 - protein, 26 aa, Mycobacterium
YAAPGTSVPHDDAVTGRDDRTTGQRH

SEQ ID NO: 1187279 - protein, 6 aa, Mycobacterium
YAAQTY

SEQ ID NO: 1187280 - protein, 5 aa, Mycobacterium
YADND

SEQ ID NO: 1187281 - protein, 10 aa, Mycobacterium
YADQPDPDGL

SEQ ID NO: 1187282 - protein, 11 aa, Mycobacterium
YADTDEKPSFH

SEQ ID NO: 1187283 - protein, 9 aa, Mycobacterium
YAESDARVD

SEQ ID NO: 1187284 - protein, 12 aa, Mycobacterium
YAGGVQGKWDPG

SEQ ID NO: 1187285 - protein, 4 aa, Mycobacterium
YAGP

SEQ ID NO: 1187286 - protein, 6 aa, Mycobacterium
YAGRDD

SEQ ID NO: 1187287 - protein, 12 aa, Mycobacterium
YANSSSGELAKP

SEQ ID NO: 1187288 - protein, 5 aa, Mycobacterium
YAPVA

SEQ ID NO: 1187289 - protein, 12 aa, Mycobacterium
YAQADADAALRV

SEQ ID NO: 1187290 - protein, 6 aa, Mycobacterium
YAQTTE

SEQ ID NO: 1187291 - protein, 7 aa, Mycobacterium
YAQTTED

SEQ ID NO: 1187292 - protein, 5 aa, Mycobacterium
YARTD

SEQ ID NO: 1187293 - protein, 6 aa, Mycobacterium
YASGGW

SEQ ID NO: 1187294 - protein, 4 aa, Mycobacterium
YATP

SEQ ID NO: 1187295 - protein, 11 aa, Mycobacterium
YATPSPRGAVE

SEQ ID NO: 1187296 - protein, 7 aa, Mycobacterium
YATSGSS

SEQ ID NO: 1187297 - protein, 4 aa, Mycobacterium
YAVG

SEQ ID NO: 1187298 - protein, 6 aa, Mycobacterium
YDADDP

SEQ ID NO: 1187299 - protein, 12 aa, Mycobacterium
YDAKDPNTTYPP

SEQ ID NO: 1187300 - protein, 14 aa, Mycobacterium
YDGDPETDEPPGAH

SEQ ID NO: 1187301 - protein, 15 aa, Mycobacterium
YDGRLQSNDAVTTAR

SEQ ID NO: 1187302 - protein, 5 aa, Mycobacterium
YDHST

SEQ ID NO: 1187303 - protein, 11 aa, Mycobacterium
YDPTSAWRTPE

SEQ ID NO: 1187304 - protein, 4 aa, Mycobacterium
YDQQ

SEQ ID NO: 1187305 - protein, 9 aa, Mycobacterium
YDSEPDDVA

SEQ ID NO: 1187306 - protein, 5 aa, Mycobacterium
YDSLT

SEQ ID NO: 1187307 - protein, 4 aa, Mycobacterium
YDSW

SEQ ID NO: 1187308 - protein, 6 aa, Mycobacterium
YDYPPG

SEQ ID NO: 1187309 - protein, 16 aa, Mycobacterium
YEAAKGSVAAVHTRDV

SEQ ID NO: 1187310 - protein, 9 aa, Mycobacterium
YEARPDSKL

SEQ ID NO: 1187311 - protein, 31 aa, Mycobacterium
YEKGDPAGRALPNARNGSSAKTVQTEAGPVP

SEQ ID NO: 1187312 - protein, 10 aa, Mycobacterium
YENEDDPEEA

SEQ ID NO: 1187313 - protein, 5 aa, Mycobacterium
YEPTA

SEQ ID NO: 1187314 - protein, 6 aa, Mycobacterium
YERERR

SEQ ID NO: 1187315 - protein, 4 aa, Mycobacterium
YERF

SEQ ID NO: 1187316 - protein, 9 aa, Mycobacterium
YESGATIAA

SEQ ID NO: 1187317 - protein, 8 aa, Mycobacterium
YESQGEEV

SEQ ID NO: 1187318 - protein, 5 aa, Mycobacterium
YETRV

SEQ ID NO: 1187319 - protein, 7 aa, Mycobacterium
YETTEYD

SEQ ID NO: 1187320 - protein, 11 aa, Mycobacterium
YFTPSKKADAS

SEQ ID NO: 1187321 - protein, 22 aa, Mycobacterium
YGADADAQIAERTAAAHSGIPE

SEQ ID NO: 1187322 - protein, 8 aa, Mycobacterium
YGAQGGDW

SEQ ID NO: 1187323 - protein, 6 aa, Mycobacterium
YGATTM

SEQ ID NO: 1187324 - protein, 9 aa, Mycobacterium
YGDDGESVY

SEQ ID NO: 1187325 - protein, 16 aa, Mycobacterium
YGEKRQPQREDPGEHL

SEQ ID NO: 1187326 - protein, 9 aa, Mycobacterium
YGGQEAPYP

SEQ ID NO: 1187327 - protein, 6 aa, Mycobacterium
YGGRRH

SEQ ID NO: 1187328 - protein, 12 aa, Mycobacterium
YGNAASLTTTVE

SEQ ID NO: 1187329 - protein, 7 aa, Mycobacterium
YGQTHDP

SEQ ID NO: 1187330 - protein, 9 aa, Mycobacterium
YGQTRTPTQ

SEQ ID NO: 1187331 - protein, 8 aa, Mycobacterium
YGSEEQRK

SEQ ID NO: 1187332 - protein, 4 aa, Mycobacterium
YGSP

SEQ ID NO: 1187333 - protein, 4 aa, Mycobacterium
YGVN

SEQ ID NO: 1187334 - protein, 5 aa, Mycobacterium
YGVPR

SEQ ID NO: 1187335 - protein, 5 aa, Mycobacterium
YKDPA

SEQ ID NO: 1187336 - protein, 4 aa, Mycobacterium
YKGI

SEQ ID NO: 1187337 - protein, 13 aa, Mycobacterium
YKLPGGTPASPGL

SEQ ID NO: 1187338 - protein, 9 aa, Mycobacterium
YKPGEPPLP

SEQ ID NO: 1187339 - protein, 13 aa, Mycobacterium
YLQPSRKQSLRRK

SEQ ID NO: 1187340 - protein, 18 aa, Mycobacterium
YMNGPSRSLPLASSPEDI

SEQ ID NO: 1187341 - protein, 9 aa, Mycobacterium
YMSEEDKAA

SEQ ID NO: 1187342 - protein, 9 aa, Mycobacterium
YNANPSSVR

SEQ ID NO: 1187343 - protein, 9 aa, Mycobacterium
YNARNAKEQ

SEQ ID NO: 1187344 - protein, 7 aa, Mycobacterium
YNENNQR

SEQ ID NO: 1187345 - protein, 13 aa, Mycobacterium
YNKAQAKAHDAEL

SEQ ID NO: 1187346 - protein, 9 aa, Mycobacterium
YNPARTWTA

SEQ ID NO: 1187347 - protein, 19 aa, Mycobacterium
YNPPNGGPADTDATGAIAK

SEQ ID NO: 1187348 - protein, 7 aa, Mycobacterium
YPAIEGQ

SEQ ID NO: 1187349 - protein, 26 aa, Mycobacterium
YPDGTRTSVHPGPLGDDLEGASRPGH

SEQ ID NO: 1187350 - protein, 20 aa, Mycobacterium
YPDPGADGAGPRIPAAAGGW

SEQ ID NO: 1187351 - protein, 10 aa, Mycobacterium
YPDPGSDPNV

SEQ ID NO: 1187352 - protein, 15 aa, Mycobacterium
YPEARTLPAPRTKRI

SEQ ID NO: 1187353 - protein, 13 aa, Mycobacterium
YPEWDGKRKAYRP

SEQ ID NO: 1187354 - protein, 4 aa, Mycobacterium
YPGD

SEQ ID NO: 1187355 - protein, 6 aa, Mycobacterium
YPGMSG

SEQ ID NO: 1187356 - protein, 4 aa, Mycobacterium
YPHT

SEQ ID NO: 1187357 - protein, 4 aa, Mycobacterium
YPPE

SEQ ID NO: 1187358 - protein, 17 aa, Mycobacterium
YPPPAEFAEQANAKAEM

SEQ ID NO: 1187359 - protein, 12 aa, Mycobacterium
YPPTPGRDERLG

SEQ ID NO: 1187360 - protein, 13 aa, Mycobacterium
YPQARTTRDGQVY

SEQ ID NO: 1187361 - protein, 4 aa, Mycobacterium
YPQL

SEQ ID NO: 1187362 - protein, 11 aa, Mycobacterium
YPRSARPDEPE

SEQ ID NO: 1187363 - protein, 22 aa, Mycobacterium
YPTDTQKAIRSSLSQAAAGQTR

SEQ ID NO: 1187364 - protein, 6 aa, Mycobacterium
YPTEGI

SEQ ID NO: 1187365 - protein, 9 aa, Mycobacterium
YPVGNTGRV

SEQ ID NO: 1187366 - protein, 13 aa, Mycobacterium
YQGQQYPDRKRPR

SEQ ID NO: 1187367 - protein, 9 aa, Mycobacterium
YQPGAGPTI

SEQ ID NO: 1187368 - protein, 29 aa, Mycobacterium
YQPPRPSAPSAPSAPPPVEAPPPQPPPPN

SEQ ID NO: 1187369 - protein, 15 aa, Mycobacterium
YQPTDWETRQLAEAR

SEQ ID NO: 1187370 - protein, 5 aa, Mycobacterium
YQSPV

SEQ ID NO: 1187371 - protein, 4 aa, Mycobacterium
YQTR

SEQ ID NO: 1187372 - protein, 11 aa, Mycobacterium
YRDADRQAAQR

SEQ ID NO: 1187373 - protein, 8 aa, Mycobacterium
YRDDDTRN

SEQ ID NO: 1187374 - protein, 6 aa, Mycobacterium
YRDTAR

SEQ ID NO: 1187375 - protein, 9 aa, Mycobacterium
YREANETVN

SEQ ID NO: 1187376 - protein, 4 aa, Mycobacterium
YREE

SEQ ID NO: 1187377 - protein, 7 aa, Mycobacterium
YRERGGK

SEQ ID NO: 1187378 - protein, 6 aa, Mycobacterium
YRGARG

SEQ ID NO: 1187379 - protein, 7 aa, Mycobacterium
YRGNTTA

SEQ ID NO: 1187380 - protein, 10 aa, Mycobacterium
YRNSKGRVVT

SEQ ID NO: 1187381 - protein, 11 aa, Mycobacterium
YRRDGTESATD

SEQ ID NO: 1187382 - protein, 6 aa, Mycobacterium
YRRTHG

SEQ ID NO: 1187383 - protein, 13 aa, Mycobacterium
YRSAGSFEGPPPW

SEQ ID NO: 1187384 - protein, 10 aa, Mycobacterium
YRSGEHGDVP

SEQ ID NO: 1187385 - protein, 9 aa, Mycobacterium
YRSRETGAL

SEQ ID NO: 1187386 - protein, 5 aa, Mycobacterium
YRSSV

SEQ ID NO: 1187387 - protein, 6 aa, Mycobacterium
YRSTES

SEQ ID NO: 1187388 - protein, 7 aa, Mycobacterium
YRTDSDI

SEQ ID NO: 1187389 - protein, 57 aa, Mycobacterium
YRTDSRESTKTSTNGSAKSSSESTSSSEKSSSSSSSDSSSSSSSSSASSSAPAAAAS

SEQ ID NO: 1187390 - protein, 9 aa, Mycobacterium
YRTPDDGRR

SEQ ID NO: 1187391 - protein, 10 aa, Mycobacterium
YRTRADLPAN

SEQ ID NO: 1187392 - protein, 7 aa, Mycobacterium
YRTRTGR

SEQ ID NO: 1187393 - protein, 25 aa, Mycobacterium
YRTTSLRTAQRAHASEDVFAALAAQ

SEQ ID NO: 1187394 - protein, 9 aa, Mycobacterium
YSAQDPAAA

SEQ ID NO: 1187395 - protein, 10 aa, Mycobacterium
YSAQDPAAAV

SEQ ID NO: 1187396 - protein, 8 aa, Mycobacterium
YSGPAYGE

SEQ ID NO: 1187397 - protein, 6 aa, Mycobacterium
YSGPDN

SEQ ID NO: 1187398 - protein, 9 aa, Mycobacterium
YSGSKGLTS

SEQ ID NO: 1187399 - protein, 19 aa, Mycobacterium
YSGSQYNAGRKVPSSQMQR

SEQ ID NO: 1187400 - protein, 18 aa, Mycobacterium
YSGSQYNAGRKVPSSQMR

SEQ ID NO: 1187401 - protein, 9 aa, Mycobacterium
YSGSTTPGA

SEQ ID NO: 1187402 - protein, 4 aa, Mycobacterium
YSLS

SEQ ID NO: 1187403 - protein, 7 aa, Mycobacterium
YSPSSDQ

SEQ ID NO: 1187404 - protein, 5 aa, Mycobacterium
YSQAS

SEQ ID NO: 1187405 - protein, 7 aa, Mycobacterium
YSSHTSL

SEQ ID NO: 1187406 - protein, 7 aa, Mycobacterium
YSSLDGY

SEQ ID NO: 1187407 - protein, 8 aa, Mycobacterium
YSTRSERL

SEQ ID NO: 1187408 - protein, 5 aa, Mycobacterium
YTAEP

SEQ ID NO: 1187409 - protein, 5 aa, Mycobacterium
YTDGS

SEQ ID NO: 1187410 - protein, 4 aa, Mycobacterium
YTEG

SEQ ID NO: 1187411 - protein, 8 aa, Mycobacterium
YTGDPDNP

SEQ ID NO: 1187412 - protein, 14 aa, Mycobacterium
YTGETRDDARTAEN

SEQ ID NO: 1187413 - protein, 4 aa, Mycobacterium
YTGT

SEQ ID NO: 1187414 - protein, 9 aa, Mycobacterium
YTSGSTKDF

SEQ ID NO: 1187415 - protein, 7 aa, Mycobacterium
YTTEPQV

SEQ ID NO: 1187416 - protein, 8 aa, Mycobacterium
YTTSEDFE

SEQ ID NO: 1187417 - protein, 8 aa, Mycobacterium
YTYPESVA

SEQ ID NO: 1187418 - protein, 11 aa, Mycobacterium
YVETPGDDVGS

SEQ ID NO: 1187419 - protein, 14 aa, Mycobacterium
YVSGGDSPAGTDCS

SEQ ID NO: 1187420 - protein, 17 aa, Mycobacterium
YVSGPSSSYVTAADPAD

SEQ ID NO: 1187421 - protein, 6 aa, Mycobacterium
YVTPDD

SEQ ID NO: 1187422 - protein, 12 aa, Mycobacterium
YWDPRTEPGERD

SEQ ID NO: 1187423 - protein, 7 aa, Mycobacterium
AAAAAAE

SEQ ID NO: 1187424 - protein, 22 aa, Mycobacterium
AAAAAAGREFDREADAKRTAEI

SEQ ID NO: 1187425 - protein, 9 aa, Mycobacterium
AAAAADAGL

SEQ ID NO: 1187426 - protein, 8 aa, Mycobacterium
AAAAARLA

SEQ ID NO: 1187427 - protein, 8 aa, Mycobacterium
AAAAARRR

SEQ ID NO: 1187428 - protein, 18 aa, Mycobacterium
AAAAATDLDDPNIMDAAW

SEQ ID NO: 1187429 - protein, 9 aa, Mycobacterium
AAAAATPHD

SEQ ID NO: 1187430 - protein, 6 aa, Mycobacterium
AAAADA

SEQ ID NO: 1187431 - protein, 14 aa, Mycobacterium
AAAADGAARGEGRA

SEQ ID NO: 1187432 - protein, 13 aa, Mycobacterium
AAAADGDHPAAGS

SEQ ID NO: 1187433 - protein, 5 aa, Mycobacterium
AAAAE

SEQ ID NO: 1187434 - protein, 6 aa, Mycobacterium
AAAAEE

SEQ ID NO: 1187435 - protein, 9 aa, Mycobacterium
AAAAEGRAS

SEQ ID NO: 1187436 - protein, 12 aa, Mycobacterium
AAAAESAAATAL

SEQ ID NO: 1187437 - protein, 9 aa, Mycobacterium
AAAAGGAAH

SEQ ID NO: 1187438 - protein, 17 aa, Mycobacterium
AAAAGSAAGYSPANVHP

SEQ ID NO: 1187439 - protein, 14 aa, Mycobacterium
AAAAGTDAGIGTVG

SEQ ID NO: 1187440 - protein, 10 aa, Mycobacterium
AAAAGTTATG

SEQ ID NO: 1187441 - protein, 13 aa, Mycobacterium
AAAAGVDPASPTF

SEQ ID NO: 1187442 - protein, 9 aa, Mycobacterium
AAAAKLADE

SEQ ID NO: 1187443 - protein, 7 aa, Mycobacterium
AAAALGA

SEQ ID NO: 1187444 - protein, 8 aa, Mycobacterium
AAAANHAR

SEQ ID NO: 1187445 - protein, 5 aa, Mycobacterium
AAAAP

SEQ ID NO: 1187446 - protein, 15 aa, Mycobacterium
AAAAPISAFPSQHSG

SEQ ID NO: 1187447 - protein, 16 aa, Mycobacterium
AAAAPPMSKRLLEALR

SEQ ID NO: 1187448 - protein, 18 aa, Mycobacterium
AAAARATEHAKTREQFGK

SEQ ID NO: 1187449 - protein, 8 aa, Mycobacterium
AAAARNGL

SEQ ID NO: 1187450 - protein, 12 aa, Mycobacterium
AAAARRNGYRPV

SEQ ID NO: 1187451 - protein, 5 aa, Mycobacterium
AAAAS

SEQ ID NO: 1187452 - protein, 7 aa, Mycobacterium
AAAASEV

SEQ ID NO: 1187453 - protein, 14 aa, Mycobacterium
AAAASGAAGEDGLG

SEQ ID NO: 1187454 - protein, 18 aa, Mycobacterium
AAAATARRLATESGADTV

SEQ ID NO: 1187455 - protein, 9 aa, Mycobacterium
AAAAVDDRT

SEQ ID NO: 1187456 - protein, 8 aa, Mycobacterium
AAAAVGDR

SEQ ID NO: 1187457 - protein, 5 aa, Mycobacterium
AAADA

SEQ ID NO: 1187458 - protein, 14 aa, Mycobacterium
AAADAAADSTVTPR

SEQ ID NO: 1187459 - protein, 7 aa, Mycobacterium
AAADAAG

SEQ ID NO: 1187460 - protein, 7 aa, Mycobacterium
AAADADG

SEQ ID NO: 1187461 - protein, 7 aa, Mycobacterium
AAADELD

SEQ ID NO: 1187462 - protein, 16 aa, Mycobacterium
AAADGALQLSGSRAAE

SEQ ID NO: 1187463 - protein, 7 aa, Mycobacterium
AAADGEL

SEQ ID NO: 1187464 - protein, 10 aa, Mycobacterium
AAADGLRADY

SEQ ID NO: 1187465 - protein, 7 aa, Mycobacterium
AAADGQG

SEQ ID NO: 1187466 - protein, 10 aa, Mycobacterium
AAADGTLTGS

SEQ ID NO: 1187467 - protein, 7 aa, Mycobacterium
AAADPAY

SEQ ID NO: 1187468 - protein, 13 aa, Mycobacterium
AAADPDDYADDEA

SEQ ID NO: 1187469 - protein, 10 aa, Mycobacterium
AAADPGITNG

SEQ ID NO: 1187470 - protein, 7 aa, Mycobacterium
AAADPLG

SEQ ID NO: 1187471 - protein, 5 aa, Mycobacterium
AAADR

SEQ ID NO: 1187472 - protein, 16 aa, Mycobacterium
AAADSARARGAPAAAA

SEQ ID NO: 1187473 - protein, 7 aa, Mycobacterium
AAADSRT

SEQ ID NO: 1187474 - protein, 9 aa, Mycobacterium
AAADTGGPV

SEQ ID NO: 1187475 - protein, 7 aa, Mycobacterium
AAADTLR

SEQ ID NO: 1187476 - protein, 25 aa, Mycobacterium
AAADVSGPAGDTAHAPMSASGLSAD

SEQ ID NO: 1187477 - protein, 4 aa, Mycobacterium
AAAE

SEQ ID NO: 1187478 - protein, 6 aa, Mycobacterium
AAAEAA

SEQ ID NO: 1187479 - protein, 14 aa, Mycobacterium
AAAEAAAESTITPR

SEQ ID NO: 1187480 - protein, 9 aa, Mycobacterium
AAAEAAGAE

SEQ ID NO: 1187481 - protein, 11 aa, Mycobacterium
AAAEAARSAEV

SEQ ID NO: 1187482 - protein, 6 aa, Mycobacterium
AAAEAG

SEQ ID NO: 1187483 - protein, 8 aa, Mycobacterium
AAAEAGRS

SEQ ID NO: 1187484 - protein, 12 aa, Mycobacterium
AAAEAPPAPEGA

SEQ ID NO: 1187485 - protein, 9 aa, Mycobacterium
AAAEDVQRF

SEQ ID NO: 1187486 - protein, 7 aa, Mycobacterium
AAAEGPH

SEQ ID NO: 1187487 - protein, 7 aa, Mycobacterium
AAAEGPL

SEQ ID NO: 1187488 - protein, 10 aa, Mycobacterium
AAAELDADAG

SEQ ID NO: 1187489 - protein, 8 aa, Mycobacterium
AAAENRLG

SEQ ID NO: 1187490 - protein, 7 aa, Mycobacterium
AAAEPDL

SEQ ID NO: 1187491 - protein, 7 aa, Mycobacterium
AAAEPLD

SEQ ID NO: 1187492 - protein, 12 aa, Mycobacterium
AAAEPRDGGERG

SEQ ID NO: 1187493 - protein, 8 aa, Mycobacterium
AAAEPRSK

SEQ ID NO: 1187494 - protein, 23 aa, Mycobacterium
AAAEQAQAQTGGVATKERPAVGG

SEQ ID NO: 1187495 - protein, 6 aa, Mycobacterium
AAAEQG

SEQ ID NO: 1187496 - protein, 12 aa, Mycobacterium
AAAEQREETGVT

SEQ ID NO: 1187497 - protein, 13 aa, Mycobacterium
AAAESGSGSPRRG

SEQ ID NO: 1187498 - protein, 15 aa, Mycobacterium
AAAGAADDRGESVSM

SEQ ID NO: 1187499 - protein, 7 aa, Mycobacterium
AAAGAAE

SEQ ID NO: 1187500 - protein, 14 aa, Mycobacterium
AAAGADGIELVEEN

SEQ ID NO: 1187501 - protein, 8 aa, Mycobacterium
AAAGADGV

SEQ ID NO: 1187502 - protein, 14 aa, Mycobacterium
AAAGAENPGKGRYH

SEQ ID NO: 1187503 - protein, 7 aa, Mycobacterium
AAAGAET

SEQ ID NO: 1187504 - protein, 14 aa, Mycobacterium
AAAGALPGLTRPAA

SEQ ID NO: 1187505 - protein, 6 aa, Mycobacterium
AAAGAR

SEQ ID NO: 1187506 - protein, 6 aa, Mycobacterium
AAAGDA

SEQ ID NO: 1187507 - protein, 10 aa, Mycobacterium
AAAGDGVASM

SEQ ID NO: 1187508 - protein, 8 aa, Mycobacterium
AAAGGEKP

SEQ ID NO: 1187509 - protein, 6 aa, Mycobacterium
AAAGGL

SEQ ID NO: 1187510 - protein, 11 aa, Mycobacterium
AAAGGRGGLGN

SEQ ID NO: 1187511 - protein, 5 aa, Mycobacterium
AAAGK

SEQ ID NO: 1187512 - protein, 8 aa, Mycobacterium
AAAGKTVP

SEQ ID NO: 1187513 - protein, 7 aa, Mycobacterium
AAAGLPG

SEQ ID NO: 1187514 - protein, 7 aa, Mycobacterium
AAAGLST

SEQ ID NO: 1187515 - protein, 14 aa, Mycobacterium
AAAGMAPGLPDNPA

SEQ ID NO: 1187516 - protein, 21 aa, Mycobacterium
AAAGPGVSSGSGGVAGGMGAG

SEQ ID NO: 1187517 - protein, 6 aa, Mycobacterium
AAAGPL

SEQ ID NO: 1187518 - protein, 8 aa, Mycobacterium
AAAGPREQ

SEQ ID NO: 1187519 - protein, 9 aa, Mycobacterium
AAAGPRGVA

SEQ ID NO: 1187520 - protein, 8 aa, Mycobacterium
AAAGPTPG

SEQ ID NO: 1187521 - protein, 15 aa, Mycobacterium
AAAGQTTVDEAAQEG

SEQ ID NO: 1187522 - protein, 7 aa, Mycobacterium
AAAGRAA

SEQ ID NO: 1187523 - protein, 8 aa, Mycobacterium
AAAGRAQS

SEQ ID NO: 1187524 - protein, 10 aa, Mycobacterium
AAAGRSEDDF

SEQ ID NO: 1187525 - protein, 8 aa, Mycobacterium
AAAGSKGI

SEQ ID NO: 1187526 - protein, 12 aa, Mycobacterium
AAAGSQTGVLGR

SEQ ID NO: 1187527 - protein, 12 aa, Mycobacterium
AAAGSSTAAHRR

SEQ ID NO: 1187528 - protein, 8 aa, Mycobacterium
AAAGTDKI

SEQ ID NO: 1187529 - protein, 10 aa, Mycobacterium
AAAGTESETV

SEQ ID NO: 1187530 - protein, 10 aa, Mycobacterium
AAAGTPVTYA

SEQ ID NO: 1187531 - protein, 8 aa, Mycobacterium
AAAGVDPD

SEQ ID NO: 1187532 - protein, 9 aa, Mycobacterium
AAAGVRGPR

SEQ ID NO: 1187533 - protein, 5 aa, Mycobacterium
AAAHG

SEQ ID NO: 1187534 - protein, 8 aa, Mycobacterium
AAAHGYTA

SEQ ID NO: 1187535 - protein, 6 aa, Mycobacterium
AAAHRA

SEQ ID NO: 1187536 - protein, 5 aa, Mycobacterium
AAAHS

SEQ ID NO: 1187537 - protein, 12 aa, Mycobacterium
AAAHSDDPPHPH

SEQ ID NO: 1187538 - protein, 4 aa, Mycobacterium
AAAI

SEQ ID NO: 1187539 - protein, 15 aa, Mycobacterium
AAAIGDRELTPDDVP

SEQ ID NO: 1187540 - protein, 10 aa, Mycobacterium
AAAKAADEAG

SEQ ID NO: 1187541 - protein, 9 aa, Mycobacterium
AAAKAADVD

SEQ ID NO: 1187542 - protein, 24 aa, Mycobacterium
AAAKASPLQAEYGQTIDRDSAHER

SEQ ID NO: 1187543 - protein, 9 aa, Mycobacterium
AAAKDVDPE

SEQ ID NO: 1187544 - protein, 10 aa, Mycobacterium
AAAKEHAADG

SEQ ID NO: 1187545 - protein, 25 aa, Mycobacterium
AAAKKPGKAATSAAAAASSEAGGIE

SEQ ID NO: 1187546 - protein, 11 aa, Mycobacterium
AAAKPAEAAAR

SEQ ID NO: 1187547 - protein, 13 aa, Mycobacterium
AAAKRNTAQPIND

SEQ ID NO: 1187548 - protein, 11 aa, Mycobacterium
AAAKSGANAIH

SEQ ID NO: 1187549 - protein, 14 aa, Mycobacterium
AAALGDPKRWPGPR

SEQ ID NO: 1187550 - protein, 18 aa, Mycobacterium
AAALQDDNDTLDAQAGAA

SEQ ID NO: 1187551 - protein, 7 aa, Mycobacterium
AAALSSA

SEQ ID NO: 1187552 - protein, 7 aa, Mycobacterium
AAAMSET

SEQ ID NO: 1187553 - protein, 4 aa, Mycobacterium
AAAN

SEQ ID NO: 1187554 - protein, 14 aa, Mycobacterium
AAANAQNNEGLDPT

SEQ ID NO: 1187555 - protein, 7 aa, Mycobacterium
AAANDEV

SEQ ID NO: 1187556 - protein, 18 aa, Mycobacterium
AAANDGFSGTAAPGFSPA

SEQ ID NO: 1187557 - protein, 9 aa, Mycobacterium
AAANDIDSV

SEQ ID NO: 1187558 - protein, 7 aa, Mycobacterium
AAANGGR

SEQ ID NO: 1187559 - protein, 12 aa, Mycobacterium
AAANGKRSQCFG

SEQ ID NO: 1187560 - protein, 11 aa, Mycobacterium
AAANGRDPGAI

SEQ ID NO: 1187561 - protein, 11 aa, Mycobacterium
AAANGRDPQDI

SEQ ID NO: 1187562 - protein, 8 aa, Mycobacterium
AAANPEAY

SEQ ID NO: 1187563 - protein, 7 aa, Mycobacterium
AAANPGL

SEQ ID NO: 1187564 - protein, 25 aa, Mycobacterium
AAANTPAPRLSTAAPDDPATPSSVT

SEQ ID NO: 1187565 - protein, 12 aa, Mycobacterium
AAAPALDAGRTA

SEQ ID NO: 1187566 - protein, 6 aa, Mycobacterium
AAAPAW

SEQ ID NO: 1187567 - protein, 14 aa, Mycobacterium
AAAPAWGKTSAAER

SEQ ID NO: 1187568 - protein, 10 aa, Mycobacterium
AAAPAYESAG

SEQ ID NO: 1187569 - protein, 10 aa, Mycobacterium
AAAPDHERES

SEQ ID NO: 1187570 - protein, 10 aa, Mycobacterium
AAAPDTATTV

SEQ ID NO: 1187571 - protein, 5 aa, Mycobacterium
AAAPE

SEQ ID NO: 1187572 - protein, 9 aa, Mycobacterium
AAAPEDKRQ

SEQ ID NO: 1187573 - protein, 26 aa, Mycobacterium
AAAPGAAISAGAISTDTAAASAATRV

SEQ ID NO: 1187574 - protein, 8 aa, Mycobacterium
AAAPGAVA

SEQ ID NO: 1187575 - protein, 9 aa, Mycobacterium
AAAPGEGES

SEQ ID NO: 1187576 - protein, 8 aa, Mycobacterium
AAAPHRHG

SEQ ID NO: 1187577 - protein, 8 aa, Mycobacterium
AAAPHSSF

SEQ ID NO: 1187578 - protein, 5 aa, Mycobacterium
AAAPL

SEQ ID NO: 1187579 - protein, 9 aa, Mycobacterium
AAAPLTEDD

SEQ ID NO: 1187580 - protein, 20 aa, Mycobacterium
AAAPNTDEGRFAVPRILGEA

SEQ ID NO: 1187581 - protein, 15 aa, Mycobacterium
AAAPRRAHTTSPDDS

SEQ ID NO: 1187582 - protein, 15 aa, Mycobacterium
AAAPSTGVDTVTGDG

SEQ ID NO: 1187583 - protein, 16 aa, Mycobacterium
AAAPTNPVATPGAGTL

SEQ ID NO: 1187584 - protein, 4 aa, Mycobacterium
AAAQ

SEQ ID NO: 1187585 - protein, 16 aa, Mycobacterium
AAAQAKRDAAAPAEAQ

SEQ ID NO: 1187586 - protein, 9 aa, Mycobacterium
AAAQENAKA

SEQ ID NO: 1187587 - protein, 5 aa, Mycobacterium
AAAQG

SEQ ID NO: 1187588 - protein, 17 aa, Mycobacterium
AAAQKELSGTSGKLGNE

SEQ ID NO: 1187589 - protein, 17 aa, Mycobacterium
AAAQLDEAGPNDGPTVA

SEQ ID NO: 1187590 - protein, 5 aa, Mycobacterium
AAAQR

SEQ ID NO: 1187591 - protein, 7 aa, Mycobacterium
AAAQRAG

SEQ ID NO: 1187592 - protein, 8 aa, Mycobacterium
AAAQSDPD

SEQ ID NO: 1187593 - protein, 8 aa, Mycobacterium
AAARAHPD

SEQ ID NO: 1187594 - protein, 6 aa, Mycobacterium
AAARAR

SEQ ID NO: 1187595 - protein, 9 aa, Mycobacterium
AAARATKKW

SEQ ID NO: 1187596 - protein, 5 aa, Mycobacterium
AAARE

SEQ ID NO: 1187597 - protein, 8 aa, Mycobacterium
AAARENAA

SEQ ID NO: 1187598 - protein, 14 aa, Mycobacterium
AAARGIGVSNTPDV

SEQ ID NO: 1187599 - protein, 11 aa, Mycobacterium
AAARGLGDGTR

SEQ ID NO: 1187600 - protein, 10 aa, Mycobacterium
AAARGLSDAT

SEQ ID NO: 1187601 - protein, 7 aa, Mycobacterium
AAARGVP

SEQ ID NO: 1187602 - protein, 16 aa, Mycobacterium
AAARGVPAQAEMGGKN

SEQ ID NO: 1187603 - protein, 8 aa, Mycobacterium
AAARPAEG

SEQ ID NO: 1187604 - protein, 11 aa, Mycobacterium
AAARPDLTGLP

SEQ ID NO: 1187605 - protein, 19 aa, Mycobacterium
AAARPDPRISDAVDRDDAR

SEQ ID NO: 1187606 - protein, 5 aa, Mycobacterium
AAARR

SEQ ID NO: 1187607 - protein, 6 aa, Mycobacterium
AAARRD

SEQ ID NO: 1187608 - protein, 8 aa, Mycobacterium
AAARRGRT

SEQ ID NO: 1187609 - protein, 8 aa, Mycobacterium
AAARSALT

SEQ ID NO: 1187610 - protein, 5 aa, Mycobacterium
AAART

SEQ ID NO: 1187611 - protein, 12 aa, Mycobacterium
AAARTPRPKHPE

SEQ ID NO: 1187612 - protein, 15 aa, Mycobacterium
AAARTQARIDSGQQT

SEQ ID NO: 1187613 - protein, 14 aa, Mycobacterium
AAARTVDGDRPPTN

SEQ ID NO: 1187614 - protein, 5 aa, Mycobacterium
AAARV

SEQ ID NO: 1187615 - protein, 29 aa, Mycobacterium
AAASAAASLAADYRSRGRGADALAAAQRS

SEQ ID NO: 1187616 - protein, 6 aa, Mycobacterium
AAASAG

SEQ ID NO: 1187617 - protein, 7 aa, Mycobacterium
AAASAGR

SEQ ID NO: 1187618 - protein, 9 aa, Mycobacterium
AAASAGSAL

SEQ ID NO: 1187619 - protein, 11 aa, Mycobacterium
AAASAPDGPRT

SEQ ID NO: 1187620 - protein, 9 aa, Mycobacterium
AAASASLGQ

SEQ ID NO: 1187621 - protein, 6 aa, Mycobacterium
AAASAT

SEQ ID NO: 1187622 - protein, 7 aa, Mycobacterium
AAASAVD

SEQ ID NO: 1187623 - protein, 8 aa, Mycobacterium
AAASDAGV

SEQ ID NO: 1187624 - protein, 9 aa, Mycobacterium
AAASDDLAD

SEQ ID NO: 1187625 - protein, 11 aa, Mycobacterium
AAASERARTEF

SEQ ID NO: 1187626 - protein, 8 aa, Mycobacterium
AAASGAAE

SEQ ID NO: 1187627 - protein, 14 aa, Mycobacterium
AAASGDLRQDAAEH

SEQ ID NO: 1187628 - protein, 6 aa, Mycobacterium
AAASGP

SEQ ID NO: 1187629 - protein, 8 aa, Mycobacterium
AAASGTLG

SEQ ID NO: 1187630 - protein, 9 aa, Mycobacterium
AAASNVADP

SEQ ID NO: 1187631 - protein, 16 aa, Mycobacterium
AAASPGPAAVAGSHGT

SEQ ID NO: 1187632 - protein, 7 aa, Mycobacterium
AAASRPL

SEQ ID NO: 1187633 - protein, 19 aa, Mycobacterium
AAASSAPGYPTTHGTPALR

SEQ ID NO: 1187634 - protein, 12 aa, Mycobacterium
AAASSASEETVA

SEQ ID NO: 1187635 - protein, 21 aa, Mycobacterium
AAASTAGALRRKTNGADPLQQ

SEQ ID NO: 1187636 - protein, 13 aa, Mycobacterium
AAASVENDTDLYE

SEQ ID NO: 1187637 - protein, 4 aa, Mycobacterium
AAAT

SEQ ID NO: 1187638 - protein, 14 aa, Mycobacterium
AAATAAEEYGENLR

SEQ ID NO: 1187639 - protein, 8 aa, Mycobacterium
AAATAEAV

SEQ ID NO: 1187640 - protein, 12 aa, Mycobacterium
AAATASAVAGRR

SEQ ID NO: 1187641 - protein, 16 aa, Mycobacterium
AAATASPLGTEQQLEA

SEQ ID NO: 1187642 - protein, 12 aa, Mycobacterium
AAATDAMGSGRR

SEQ ID NO: 1187643 - protein, 9 aa, Mycobacterium
AAATDGPVP

SEQ ID NO: 1187644 - protein, 7 aa, Mycobacterium
AAATEDR

SEQ ID NO: 1187645 - protein, 6 aa, Mycobacterium
AAATEL

SEQ ID NO: 1187646 - protein, 7 aa, Mycobacterium
AAATEQV

SEQ ID NO: 1187647 - protein, 22 aa, Mycobacterium
AAATERPDRLPGVGSSSHVPSL

SEQ ID NO: 1187648 - protein, 9 aa, Mycobacterium
AAATLGDRI

SEQ ID NO: 1187649 - protein, 9 aa, Mycobacterium
AAATLPEDL

SEQ ID NO: 1187650 - protein, 5 aa, Mycobacterium
AAATN

SEQ ID NO: 1187651 - protein, 8 aa, Mycobacterium
AAATNSLA

SEQ ID NO: 1187652 - protein, 8 aa, Mycobacterium
AAATPETL

SEQ ID NO: 1187653 - protein, 9 aa, Mycobacterium
AAATQGPQF

SEQ ID NO: 1187654 - protein, 6 aa, Mycobacterium
AAATRG

SEQ ID NO: 1187655 - protein, 6 aa, Mycobacterium
AAATST

SEQ ID NO: 1187656 - protein, 12 aa, Mycobacterium
AAATVDTTGVEI

SEQ ID NO: 1187657 - protein, 6 aa, Mycobacterium
AAAVDG

SEQ ID NO: 1187658 - protein, 9 aa, Mycobacterium
AAAVSGDGE

SEQ ID NO: 1187659 - protein, 11 aa, Mycobacterium
AAAVTDPALAA

SEQ ID NO: 1187660 - protein, 8 aa, Mycobacterium
AADAAAGS

SEQ ID NO: 1187661 - protein, 7 aa, Mycobacterium
AADAANS

SEQ ID NO: 1187662 - protein, 19 aa, Mycobacterium
AADAARERARGIAADTAEV

SEQ ID NO: 1187663 - protein, 6 aa, Mycobacterium
AADADL

SEQ ID NO: 1187664 - protein, 9 aa, Mycobacterium
AADADTARS

SEQ ID NO: 1187665 - protein, 8 aa, Mycobacterium
AADAEDAW

SEQ ID NO: 1187666 - protein, 11 aa, Mycobacterium
AADAETSPPFC

SEQ ID NO: 1187667 - protein, 5 aa, Mycobacterium
AADAG

SEQ ID NO: 1187668 - protein, 8 aa, Mycobacterium
AADAGAVR

SEQ ID NO: 1187669 - protein, 7 aa, Mycobacterium
AADAGRP

SEQ ID NO: 1187670 - protein, 11 aa, Mycobacterium
AADAGVAPEHA

SEQ ID NO: 1187671 - protein, 8 aa, Mycobacterium
AADANPDV

SEQ ID NO: 1187672 - protein, 9 aa, Mycobacterium
AADAPDTRR

SEQ ID NO: 1187673 - protein, 12 aa, Mycobacterium
AADAQNAGVARD

SEQ ID NO: 1187674 - protein, 6 aa, Mycobacterium
AADARP

SEQ ID NO: 1187675 - protein, 18 aa, Mycobacterium
AADASAHAAREHARAGAR

SEQ ID NO: 1187676 - protein, 10 aa, Mycobacterium
AADASDASSL

SEQ ID NO: 1187677 - protein, 7 aa, Mycobacterium
AADASGA

SEQ ID NO: 1187678 - protein, 10 aa, Mycobacterium
AADASTRREA

SEQ ID NO: 1187679 - protein, 5 aa, Mycobacterium
AADCP

SEQ ID NO: 1187680 - protein, 5 aa, Mycobacterium
AADDA

SEQ ID NO: 1187681 - protein, 11 aa, Mycobacterium
AADDDEGFYPD

SEQ ID NO: 1187682 - protein, 11 aa, Mycobacterium
AADDEKPGAAA

SEQ ID NO: 1187683 - protein, 11 aa, Mycobacterium
AADDEKYGDWA

SEQ ID NO: 1187684 - protein, 7 aa, Mycobacterium
AADDPDL

SEQ ID NO: 1187685 - protein, 23 aa, Mycobacterium
AADDPEPAKPVARANHDRADSQR

SEQ ID NO: 1187686 - protein, 19 aa, Mycobacterium
AADDPGAAAQRLAGMLSAA

SEQ ID NO: 1187687 - protein, 9 aa, Mycobacterium
AADDPHRRR

SEQ ID NO: 1187688 - protein, 7 aa, Mycobacterium
AADDPSE

SEQ ID NO: 1187689 - protein, 6 aa, Mycobacterium
AADDYQ

SEQ ID NO: 1187690 - protein, 7 aa, Mycobacterium
AADEASA

SEQ ID NO: 1187691 - protein, 9 aa, Mycobacterium
AADEAWSQA

SEQ ID NO: 1187692 - protein, 9 aa, Mycobacterium
AADEKESQL

SEQ ID NO: 1187693 - protein, 6 aa, Mycobacterium
AADELR

SEQ ID NO: 1187694 - protein, 5 aa, Mycobacterium
AADER

SEQ ID NO: 1187695 - protein, 6 aa, Mycobacterium
AADETG

SEQ ID NO: 1187696 - protein, 6 aa, Mycobacterium
AADGAR

SEQ ID NO: 1187697 - protein, 6 aa, Mycobacterium
AADGDT

SEQ ID NO: 1187698 - protein, 23 aa, Mycobacterium
AADGDTARELARTQAAGPPTSIA

SEQ ID NO: 1187699 - protein, 6 aa, Mycobacterium
AADGEA

SEQ ID NO: 1187700 - protein, 11 aa, Mycobacterium
AADGEGELGDT

SEQ ID NO: 1187701 - protein, 7 aa, Mycobacterium
AADGETV

SEQ ID NO: 1187702 - protein, 7 aa, Mycobacterium
AADGGVD

SEQ ID NO: 1187703 - protein, 9 aa, Mycobacterium
AADGGYRIN

SEQ ID NO: 1187704 - protein, 16 aa, Mycobacterium
AADGHSMTEDAATGQC

SEQ ID NO: 1187705 - protein, 8 aa, Mycobacterium
AADGHVDP

SEQ ID NO: 1187706 - protein, 6 aa, Mycobacterium
AADGLI

SEQ ID NO: 1187707 - protein, 35 aa, Mycobacterium
AADGNGDGDTEAGGESGQAGRRRRRRRPRKAAPAT

SEQ ID NO: 1187708 - protein, 5 aa, Mycobacterium
AADGP

SEQ ID NO: 1187709 - protein, 12 aa, Mycobacterium
AADGRDREQVEA

SEQ ID NO: 1187710 - protein, 14 aa, Mycobacterium
AADGRVDASDRARF

SEQ ID NO: 1187711 - protein, 8 aa, Mycobacterium
AADGSGDY

SEQ ID NO: 1187712 - protein, 11 aa, Mycobacterium
AADGSQDSHRP

SEQ ID NO: 1187713 - protein, 8 aa, Mycobacterium
AADGSTVN

SEQ ID NO: 1187714 - protein, 8 aa, Mycobacterium
AADGSTVR

SEQ ID NO: 1187715 - protein, 6 aa, Mycobacterium
AADGTL

SEQ ID NO: 1187716 - protein, 8 aa, Mycobacterium
AADGTRKR

SEQ ID NO: 1187717 - protein, 14 aa, Mycobacterium
AADGTYTSPIENPN

SEQ ID NO: 1187718 - protein, 6 aa, Mycobacterium
AADGVR

SEQ ID NO: 1187719 - protein, 5 aa, Mycobacterium
AADHR

SEQ ID NO: 1187720 - protein, 7 aa, Mycobacterium
AADINAA

SEQ ID NO: 1187721 - protein, 12 aa, Mycobacterium
AADKAAPGLRAS

SEQ ID NO: 1187722 - protein, 6 aa, Mycobacterium
AADKSV

SEQ ID NO: 1187723 - protein, 7 aa, Mycobacterium
AADLEGA

SEQ ID NO: 1187724 - protein, 9 aa, Mycobacterium
AADLRPDLD

SEQ ID NO: 1187725 - protein, 6 aa, Mycobacterium
AADNGT

SEQ ID NO: 1187726 - protein, 6 aa, Mycobacterium
AADNLE

SEQ ID NO: 1187727 - protein, 7 aa, Mycobacterium
AADNPDK

SEQ ID NO: 1187728 - protein, 17 aa, Mycobacterium
AADNPSAERAAVHAELF

SEQ ID NO: 1187729 - protein, 15 aa, Mycobacterium
AADNSIDATASRDFA

SEQ ID NO: 1187730 - protein, 8 aa, Mycobacterium
AADPAAAR

SEQ ID NO: 1187731 - protein, 10 aa, Mycobacterium
AADPAGTYAA

SEQ ID NO: 1187732 - protein, 5 aa, Mycobacterium
AADPD

SEQ ID NO: 1187733 - protein, 7 aa, Mycobacterium
AADPDEL

SEQ ID NO: 1187734 - protein, 7 aa, Mycobacterium
AADPDLP

SEQ ID NO: 1187735 - protein, 7 aa, Mycobacterium
AADPDSG

SEQ ID NO: 1187736 - protein, 7 aa, Mycobacterium
AADPEQV

SEQ ID NO: 1187737 - protein, 7 aa, Mycobacterium
AADPERP

SEQ ID NO: 1187738 - protein, 8 aa, Mycobacterium
AADPGRAA

SEQ ID NO: 1187739 - protein, 5 aa, Mycobacterium
AADPI

SEQ ID NO: 1187740 - protein, 8 aa, Mycobacterium
AADPPARS

SEQ ID NO: 1187741 - protein, 8 aa, Mycobacterium
AADPPTLA

SEQ ID NO: 1187742 - protein, 5 aa, Mycobacterium
AADPR

SEQ ID NO: 1187743 - protein, 9 aa, Mycobacterium
AADPSGEPT

SEQ ID NO: 1187744 - protein, 10 aa, Mycobacterium
AADPSSRQTG

SEQ ID NO: 1187745 - protein, 5 aa, Mycobacterium
AADQA

SEQ ID NO: 1187746 - protein, 17 aa, Mycobacterium
AADQAIQTHGGNGLSAE

SEQ ID NO: 1187747 - protein, 19 aa, Mycobacterium
AADQGEIAGASAAGSPTAW

SEQ ID NO: 1187748 - protein, 6 aa, Mycobacterium
AADQQN

SEQ ID NO: 1187749 - protein, 6 aa, Mycobacterium
AADRAG

SEQ ID NO: 1187750 - protein, 8 aa, Mycobacterium
AADREQAV

SEQ ID NO: 1187751 - protein, 6 aa, Mycobacterium
AADRHG

SEQ ID NO: 1187752 - protein, 5 aa, Mycobacterium
AADRP

SEQ ID NO: 1187753 - protein, 6 aa, Mycobacterium
AADRPD

SEQ ID NO: 1187754 - protein, 9 aa, Mycobacterium
AADRPDRSR

SEQ ID NO: 1187755 - protein, 8 aa, Mycobacterium
AADRTGDS

SEQ ID NO: 1187756 - protein, 6 aa, Mycobacterium
AADRVA

SEQ ID NO: 1187757 - protein, 15 aa, Mycobacterium
AADRVYEDSGVAPED

SEQ ID NO: 1187758 - protein, 7 aa, Mycobacterium
AADSEAT

SEQ ID NO: 1187759 - protein, 13 aa, Mycobacterium
AADSGRSQAEQGQ

SEQ ID NO: 1187760 - protein, 10 aa, Mycobacterium
AADSPAETVA

SEQ ID NO: 1187761 - protein, 9 aa, Mycobacterium
AADSPVSDV

SEQ ID NO: 1187762 - protein, 7 aa, Mycobacterium
AADSRRV

SEQ ID NO: 1187763 - protein, 12 aa, Mycobacterium
AADSVASDTDRR

SEQ ID NO: 1187764 - protein, 10 aa, Mycobacterium
AADTAGGNLV

SEQ ID NO: 1187765 - protein, 22 aa, Mycobacterium
AADTDTRKPAPGGSRFGRFVDT

SEQ ID NO: 1187766 - protein, 7 aa, Mycobacterium
AADTPDC

SEQ ID NO: 1187767 - protein, 8 aa, Mycobacterium
AADTRPDV

SEQ ID NO: 1187768 - protein, 13 aa, Mycobacterium
AADTTFDGRTRDQ

SEQ ID NO: 1187769 - protein, 6 aa, Mycobacterium
AADVAE

SEQ ID NO: 1187770 - protein, 6 aa, Mycobacterium
AADVSP

SEQ ID NO: 1187771 - protein, 6 aa, Mycobacterium
AADVTR

SEQ ID NO: 1187772 - protein, 34 aa, Mycobacterium
AADYQQKTAEAERAEADADRLRRQAAAADDHPKL

SEQ ID NO: 1187773 - protein, 10 aa, Mycobacterium
AAEAAAAGSP

SEQ ID NO: 1187774 - protein, 32 aa, Mycobacterium
AAEAAGSAAETARPAAETAGPAAAKPAESRGA

SEQ ID NO: 1187775 - protein, 10 aa, Mycobacterium
AAEAAKELAD

SEQ ID NO: 1187776 - protein, 6 aa, Mycobacterium
AAEAAV

SEQ ID NO: 1187777 - protein, 5 aa, Mycobacterium
AAEAD

SEQ ID NO: 1187778 - protein, 7 aa, Mycobacterium
AAEADTG

SEQ ID NO: 1187779 - protein, 7 aa, Mycobacterium
AAEADVA

SEQ ID NO: 1187780 - protein, 33 aa, Mycobacterium
AAEAEEAARPTSSSSNGARSEESAGGSLASDAQ

SEQ ID NO: 1187781 - protein, 11 aa, Mycobacterium
AAEAELGPDTR

SEQ ID NO: 1187782 - protein, 10 aa, Mycobacterium
AAEAENPTTP

SEQ ID NO: 1187783 - protein, 10 aa, Mycobacterium
AAEAEPDRAH

SEQ ID NO: 1187784 - protein, 7 aa, Mycobacterium
AAEAESL

SEQ ID NO: 1187785 - protein, 11 aa, Mycobacterium
AAEAGEPVDPV

SEQ ID NO: 1187786 - protein, 7 aa, Mycobacterium
AAEAGKD

SEQ ID NO: 1187787 - protein, 7 aa, Mycobacterium
AAEAGRV

SEQ ID NO: 1187788 - protein, 25 aa, Mycobacterium
AAEAKKRGDAAEAKRIGAARKPTVS

SEQ ID NO: 1187789 - protein, 5 aa, Mycobacterium
AAEAL

SEQ ID NO: 1187790 - protein, 15 aa, Mycobacterium
AAEANAEDGTDEQRI

SEQ ID NO: 1187791 - protein, 10 aa, Mycobacterium
AAEAPGPAQG

SEQ ID NO: 1187792 - protein, 13 aa, Mycobacterium
AAEARRKRKRGML

SEQ ID NO: 1187793 - protein, 32 aa, Mycobacterium
AAEASKAPKEAPKAAPAAEAPAKVPTPAPEGA

SEQ ID NO: 1187794 - protein, 8 aa, Mycobacterium
AAEASRNH

SEQ ID NO: 1187795 - protein, 9 aa, Mycobacterium
AAEATGEVG

SEQ ID NO: 1187796 - protein, 5 aa, Mycobacterium
AAEAV

SEQ ID NO: 1187797 - protein, 13 aa, Mycobacterium
AAEDKRDVRASIV

SEQ ID NO: 1187798 - protein, 7 aa, Mycobacterium
AAEDPNA

SEQ ID NO: 1187799 - protein, 7 aa, Mycobacterium
AAEDPRV

SEQ ID NO: 1187800 - protein, 12 aa, Mycobacterium
AAEDTPGVEDPS

SEQ ID NO: 1187801 - protein, 4 aa, Mycobacterium
AAEE

SEQ ID NO: 1187802 - protein, 13 aa, Mycobacterium
AAEEAFGEAGREG

SEQ ID NO: 1187803 - protein, 15 aa, Mycobacterium
AAEEGRITDEDIERA

SEQ ID NO: 1187804 - protein, 7 aa, Mycobacterium
AAEELGM

SEQ ID NO: 1187805 - protein, 8 aa, Mycobacterium
AAEELRAR

SEQ ID NO: 1187806 - protein, 7 aa, Mycobacterium
AAEELSE

SEQ ID NO: 1187807 - protein, 6 aa, Mycobacterium
AAEERD

SEQ ID NO: 1187808 - protein, 9 aa, Mycobacterium
AAEETGIEA

SEQ ID NO: 1187809 - protein, 12 aa, Mycobacterium
AAEFSSQGVPDD

SEQ ID NO: 1187810 - protein, 6 aa, Mycobacterium
AAEGAD

SEQ ID NO: 1187811 - protein, 6 aa, Mycobacterium
AAEGAT

SEQ ID NO: 1187812 - protein, 6 aa, Mycobacterium
AAEGET

SEQ ID NO: 1187813 - protein, 5 aa, Mycobacterium
AAEGF

SEQ ID NO: 1187814 - protein, 5 aa, Mycobacterium
AAEGK

SEQ ID NO: 1187815 - protein, 26 aa, Mycobacterium
AAEGSSHGYDVTDPTTISAELGGPEG

SEQ ID NO: 1187816 - protein, 5 aa, Mycobacterium
AAEGY

SEQ ID NO: 1187817 - protein, 17 aa, Mycobacterium
AAEHERQQRNYAELQGK

SEQ ID NO: 1187818 - protein, 7 aa, Mycobacterium
AAEHPSA

SEQ ID NO: 1187819 - protein, 12 aa, Mycobacterium
AAEHSGPSAAIH

SEQ ID NO: 1187820 - protein, 12 aa, Mycobacterium
AAEITEKKAGAA

SEQ ID NO: 1187821 - protein, 9 aa, Mycobacterium
AAEKDSGDF

SEQ ID NO: 1187822 - protein, 20 aa, Mycobacterium
AAEKERSGEKPKESAESLNR

SEQ ID NO: 1187823 - protein, 7 aa, Mycobacterium
AAEKLGA

SEQ ID NO: 1187824 - protein, 7 aa, Mycobacterium
AAEKNYG

SEQ ID NO: 1187825 - protein, 4 aa, Mycobacterium
AAEL

SEQ ID NO: 1187826 - protein, 6 aa, Mycobacterium
AAELAS

SEQ ID NO: 1187827 - protein, 6 aa, Mycobacterium
AAELGR

SEQ ID NO: 1187828 - protein, 13 aa, Mycobacterium
AAELGSAETTPDN

SEQ ID NO: 1187829 - protein, 7 aa, Mycobacterium
AAELGSD

SEQ ID NO: 1187830 - protein, 10 aa, Mycobacterium
AAELSSTDPV

SEQ ID NO: 1187831 - protein, 10 aa, Mycobacterium
AAENGATLEP

SEQ ID NO: 1187832 - protein, 5 aa, Mycobacterium
AAENP

SEQ ID NO: 1187833 - protein, 8 aa, Mycobacterium
AAEPAARR

SEQ ID NO: 1187834 - protein, 5 aa, Mycobacterium
AAEPD

SEQ ID NO: 1187835 - protein, 6 aa, Mycobacterium
AAEPEP

SEQ ID NO: 1187836 - protein, 9 aa, Mycobacterium
AAEPEPVAS

SEQ ID NO: 1187837 - protein, 13 aa, Mycobacterium
AAEPGGKDYGVPS

SEQ ID NO: 1187838 - protein, 14 aa, Mycobacterium
AAEPGLRDKVDGKI

SEQ ID NO: 1187839 - protein, 10 aa, Mycobacterium
AAEPPASVEE

SEQ ID NO: 1187840 - protein, 6 aa, Mycobacterium
AAEPSG

SEQ ID NO: 1187841 - protein, 4 aa, Mycobacterium
AAEQ

SEQ ID NO: 1187842 - protein, 6 aa, Mycobacterium
AAEQGL

SEQ ID NO: 1187843 - protein, 20 aa, Mycobacterium
AAEQKSRVTEEWAAEGHGQS

SEQ ID NO: 1187844 - protein, 7 aa, Mycobacterium
AAEQPER

SEQ ID NO: 1187845 - protein, 25 aa, Mycobacterium
AAEQRQSADEAALESAKAELTGYQG

SEQ ID NO: 1187846 - protein, 6 aa, Mycobacterium
AAEQSP

SEQ ID NO: 1187847 - protein, 6 aa, Mycobacterium
AAEQTA

SEQ ID NO: 1187848 - protein, 5 aa, Mycobacterium
AAERA

SEQ ID NO: 1187849 - protein, 9 aa, Mycobacterium
AAERAAERR

SEQ ID NO: 1187850 - protein, 8 aa, Mycobacterium
AAERAGVR

SEQ ID NO: 1187851 - protein, 6 aa, Mycobacterium
AAERDD

SEQ ID NO: 1187852 - protein, 9 aa, Mycobacterium
AAERDEGGF

SEQ ID NO: 1187853 - protein, 7 aa, Mycobacterium
AAERDRI

SEQ ID NO: 1187854 - protein, 14 aa, Mycobacterium
AAERGGPSLAGRLD

SEQ ID NO: 1187855 - protein, 5 aa, Mycobacterium
AAERI

SEQ ID NO: 1187856 - protein, 8 aa, Mycobacterium
AAERITDE

SEQ ID NO: 1187857 - protein, 14 aa, Mycobacterium
AAERKRGAEGSRPR

SEQ ID NO: 1187858 - protein, 11 aa, Mycobacterium
AAERNTDPETG

SEQ ID NO: 1187859 - protein, 8 aa, Mycobacterium
AAERQSQL

SEQ ID NO: 1187860 - protein, 13 aa, Mycobacterium
AAERSRPSDFPKN

SEQ ID NO: 1187861 - protein, 5 aa, Mycobacterium
AAERT

SEQ ID NO: 1187862 - protein, 7 aa, Mycobacterium
AAESADD

SEQ ID NO: 1187863 - protein, 7 aa, Mycobacterium
AAESGRY

SEQ ID NO: 1187864 - protein, 13 aa, Mycobacterium
AAESHLGDGRQTT

SEQ ID NO: 1187865 - protein, 14 aa, Mycobacterium
AAESNRGAHFSPPL

SEQ ID NO: 1187866 - protein, 7 aa, Mycobacterium
AAESPTR

SEQ ID NO: 1187867 - protein, 6 aa, Mycobacterium
AAESRA

SEQ ID NO: 1187868 - protein, 7 aa, Mycobacterium
AAESRGV

SEQ ID NO: 1187869 - protein, 9 aa, Mycobacterium
AAESRTEAR

SEQ ID NO: 1187870 - protein, 7 aa, Mycobacterium
AAETAEA

SEQ ID NO: 1187871 - protein, 10 aa, Mycobacterium
AAETARADDY

SEQ ID NO: 1187872 - protein, 5 aa, Mycobacterium
AAETD

SEQ ID NO: 1187873 - protein, 8 aa, Mycobacterium
AAETEGSK

SEQ ID NO: 1187874 - protein, 6 aa, Mycobacterium
AAETEK

SEQ ID NO: 1187875 - protein, 6 aa, Mycobacterium
AAETEL

SEQ ID NO: 1187876 - protein, 7 aa, Mycobacterium
AAETGSD

SEQ ID NO: 1187877 - protein, 9 aa, Mycobacterium
AAETGSQDL

SEQ ID NO: 1187878 - protein, 31 aa, Mycobacterium
AAETGTAPAAPADESTELSGAELRAAQKEVT

SEQ ID NO: 1187879 - protein, 7 aa, Mycobacterium
AAEVDAD

SEQ ID NO: 1187880 - protein, 7 aa, Mycobacterium
AAEVTDA

SEQ ID NO: 1187881 - protein, 7 aa, Mycobacterium
AAFGADG

SEQ ID NO: 1187882 - protein, 6 aa, Mycobacterium
AAFGAK

SEQ ID NO: 1187883 - protein, 12 aa, Mycobacterium
AAFGDGRDPDRP

SEQ ID NO: 1187884 - protein, 4 aa, Mycobacterium
AAFK

SEQ ID NO: 1187885 - protein, 17 aa, Mycobacterium
AAFPGGAADPGDQSPVH

SEQ ID NO: 1187886 - protein, 14 aa, Mycobacterium
AAFPKRLGKPEEYA

SEQ ID NO: 1187887 - protein, 8 aa, Mycobacterium
AAFQPTPG

SEQ ID NO: 1187888 - protein, 5 aa, Mycobacterium
AAFSA

SEQ ID NO: 1187889 - protein, 6 aa, Mycobacterium
AAFSGA

SEQ ID NO: 1187890 - protein, 7 aa, Mycobacterium
AAGAARI

SEQ ID NO: 1187891 - protein, 13 aa, Mycobacterium
AAGAAVRAAEARG

SEQ ID NO: 1187892 - protein, 12 aa, Mycobacterium
AAGADAEGDRGA

SEQ ID NO: 1187893 - protein, 11 aa, Mycobacterium
AAGADAPAGEV

SEQ ID NO: 1187894 - protein, 8 aa, Mycobacterium
AAGADLGD

SEQ ID NO: 1187895 - protein, 7 aa, Mycobacterium
AAGADRL

SEQ ID NO: 1187896 - protein, 6 aa, Mycobacterium
AAGAER

SEQ ID NO: 1187897 - protein, 7 aa, Mycobacterium
AAGAFGH

SEQ ID NO: 1187898 - protein, 9 aa, Mycobacterium
AAGAGMPDD

SEQ ID NO: 1187899 - protein, 6 aa, Mycobacterium
AAGAGV

SEQ ID NO: 1187900 - protein, 5 aa, Mycobacterium
AAGAK

SEQ ID NO: 1187901 - protein, 6 aa, Mycobacterium
AAGALA

SEQ ID NO: 1187902 - protein, 5 aa, Mycobacterium
AAGAN

SEQ ID NO: 1187903 - protein, 13 aa, Mycobacterium
AAGAPGSTTPRIA

SEQ ID NO: 1187904 - protein, 6 aa, Mycobacterium
AAGARA

SEQ ID NO: 1187905 - protein, 8 aa, Mycobacterium
AAGARHGT

SEQ ID NO: 1187906 - protein, 8 aa, Mycobacterium
AAGARSRR

SEQ ID NO: 1187907 - protein, 8 aa, Mycobacterium
AAGASGGW

SEQ ID NO: 1187908 - protein, 8 aa, Mycobacterium
AAGATMPD

SEQ ID NO: 1187909 - protein, 7 aa, Mycobacterium
AAGATSA

SEQ ID NO: 1187910 - protein, 15 aa, Mycobacterium
AAGATVAGAERDAAL

SEQ ID NO: 1187911 - protein, 6 aa, Mycobacterium
AAGDAA

SEQ ID NO: 1187912 - protein, 9 aa, Mycobacterium
AAGDALGAP

SEQ ID NO: 1187913 - protein, 5 aa, Mycobacterium
AAGDD

SEQ ID NO: 1187914 - protein, 8 aa, Mycobacterium
AAGDDAPH

SEQ ID NO: 1187915 - protein, 16 aa, Mycobacterium
AAGDDAPIEPTTADDP

SEQ ID NO: 1187916 - protein, 9 aa, Mycobacterium
AAGDDGQSF

SEQ ID NO: 1187917 - protein, 6 aa, Mycobacterium
AAGDDL

SEQ ID NO: 1187918 - protein, 9 aa, Mycobacterium
AAGDGADRP

SEQ ID NO: 1187919 - protein, 16 aa, Mycobacterium
AAGDGEAVGDAASAPV

SEQ ID NO: 1187920 - protein, 6 aa, Mycobacterium
AAGDGL

SEQ ID NO: 1187921 - protein, 8 aa, Mycobacterium
AAGDPEDA

SEQ ID NO: 1187922 - protein, 7 aa, Mycobacterium
AAGDPSA

SEQ ID NO: 1187923 - protein, 5 aa, Mycobacterium
AAGDR

SEQ ID NO: 1187924 - protein, 9 aa, Mycobacterium
AAGDRAQAQ

SEQ ID NO: 1187925 - protein, 12 aa, Mycobacterium
AAGDRRRGEAHG

SEQ ID NO: 1187926 - protein, 8 aa, Mycobacterium
AAGDRVQD

SEQ ID NO: 1187927 - protein, 8 aa, Mycobacterium
AAGDSRAA

SEQ ID NO: 1187928 - protein, 6 aa, Mycobacterium
AAGDTQ

SEQ ID NO: 1187929 - protein, 14 aa, Mycobacterium
AAGEAEIASRGAPD

SEQ ID NO: 1187930 - protein, 7 aa, Mycobacterium
AAGEDGM

SEQ ID NO: 1187931 - protein, 6 aa, Mycobacterium
AAGEDI

SEQ ID NO: 1187932 - protein, 8 aa, Mycobacterium
AAGEGITT

SEQ ID NO: 1187933 - protein, 11 aa, Mycobacterium
AAGEGVETGRH

SEQ ID NO: 1187934 - protein, 8 aa, Mycobacterium
AAGEGYSG

SEQ ID NO: 1187935 - protein, 6 aa, Mycobacterium
AAGEMR

SEQ ID NO: 1187936 - protein, 5 aa, Mycobacterium
AAGER

SEQ ID NO: 1187937 - protein, 8 aa, Mycobacterium
AAGETDPR

SEQ ID NO: 1187938 - protein, 14 aa, Mycobacterium
AAGETDQHITPSPD

SEQ ID NO: 1187939 - protein, 10 aa, Mycobacterium
AAGFGAGSDR

SEQ ID NO: 1187940 - protein, 10 aa, Mycobacterium
AAGFNPSEKS

SEQ ID NO: 1187941 - protein, 6 aa, Mycobacterium
AAGFTS

SEQ ID NO: 1187942 - protein, 14 aa, Mycobacterium
AAGFTSVDEANATA

SEQ ID NO: 1187943 - protein, 5 aa, Mycobacterium
AAGGA

SEQ ID NO: 1187944 - protein, 8 aa, Mycobacterium
AAGGEVNA

SEQ ID NO: 1187945 - protein, 6 aa, Mycobacterium
AAGGEY

SEQ ID NO: 1187946 - protein, 30 aa, Mycobacterium
AAGGGESESAAGGGETNPADGDDSGSADQH

SEQ ID NO: 1187947 - protein, 8 aa, Mycobacterium
AAGGGQSA

SEQ ID NO: 1187948 - protein, 15 aa, Mycobacterium
AAGGHHGMPTTVGSH

SEQ ID NO: 1187949 - protein, 8 aa, Mycobacterium
AAGGHVAE

SEQ ID NO: 1187950 - protein, 6 aa, Mycobacterium
AAGGLR

SEQ ID NO: 1187951 - protein, 6 aa, Mycobacterium
AAGGLS

SEQ ID NO: 1187952 - protein, 6 aa, Mycobacterium
AAGGLT

SEQ ID NO: 1187953 - protein, 7 aa, Mycobacterium
AAGGNIA

SEQ ID NO: 1187954 - protein, 8 aa, Mycobacterium
AAGGPGSA

SEQ ID NO: 1187955 - protein, 6 aa, Mycobacterium
AAGGPS

SEQ ID NO: 1187956 - protein, 7 aa, Mycobacterium
AAGGQAL

SEQ ID NO: 1187957 - protein, 5 aa, Mycobacterium
AAGGR

SEQ ID NO: 1187958 - protein, 6 aa, Mycobacterium
AAGGRL

SEQ ID NO: 1187959 - protein, 8 aa, Mycobacterium
AAGGSAAL

SEQ ID NO: 1187960 - protein, 10 aa, Mycobacterium
AAGGSATPAP

SEQ ID NO: 1187961 - protein, 10 aa, Mycobacterium
AAGGSDEDDV

SEQ ID NO: 1187962 - protein, 9 aa, Mycobacterium
AAGGTRPLT

SEQ ID NO: 1187963 - protein, 6 aa, Mycobacterium
AAGGVG

SEQ ID NO: 1187964 - protein, 7 aa, Mycobacterium
AAGGVPA

SEQ ID NO: 1187965 - protein, 6 aa, Mycobacterium
AAGHAE

SEQ ID NO: 1187966 - protein, 6 aa, Mycobacterium
AAGHER

SEQ ID NO: 1187967 - protein, 10 aa, Mycobacterium
AAGHGSYGTV

SEQ ID NO: 1187968 - protein, 13 aa, Mycobacterium
AAGHRDRRGEIAQ

SEQ ID NO: 1187969 - protein, 13 aa, Mycobacterium
AAGIASAEVAGPG

SEQ ID NO: 1187970 - protein, 16 aa, Mycobacterium
AAGIKGTPLHTPYTAS

SEQ ID NO: 1187971 - protein, 7 aa, Mycobacterium
AAGISGP

SEQ ID NO: 1187972 - protein, 5 aa, Mycobacterium
AAGIT

SEQ ID NO: 1187973 - protein, 22 aa, Mycobacterium
AAGKASSGRDPLTGEEKEYLSE

SEQ ID NO: 1187974 - protein, 5 aa, Mycobacterium
AAGKH

SEQ ID NO: 1187975 - protein, 11 aa, Mycobacterium
AAGKHSQAEAD

SEQ ID NO: 1187976 - protein, 6 aa, Mycobacterium
AAGKPG

SEQ ID NO: 1187977 - protein, 5 aa, Mycobacterium
AAGLD

SEQ ID NO: 1187978 - protein, 9 aa, Mycobacterium
AAGLDLGGR

SEQ ID NO: 1187979 - protein, 14 aa, Mycobacterium
AAGLGRAALGGGRL

SEQ ID NO: 1187980 - protein, 7 aa, Mycobacterium
AAGLIGP

SEQ ID NO: 1187981 - protein, 9 aa, Mycobacterium
AAGLPEELS

SEQ ID NO: 1187982 - protein, 7 aa, Mycobacterium
AAGLSGA

SEQ ID NO: 1187983 - protein, 8 aa, Mycobacterium
AAGLTGTL

SEQ ID NO: 1187984 - protein, 7 aa, Mycobacterium
AAGMDAP

SEQ ID NO: 1187985 - protein, 18 aa, Mycobacterium
AAGNPSARGSAHRTDPAD

SEQ ID NO: 1187986 - protein, 15 aa, Mycobacterium
AAGNSWAATAGSGDV

SEQ ID NO: 1187987 - protein, 4 aa, Mycobacterium
AAGP

SEQ ID NO: 1187988 - protein, 19 aa, Mycobacterium
AAGPAAGGAAAEAAEEQSE

SEQ ID NO: 1187989 - protein, 10 aa, Mycobacterium
AAGPAPEFQQ

SEQ ID NO: 1187990 - protein, 9 aa, Mycobacterium
AAGPATTSR

SEQ ID NO: 1187991 - protein, 14 aa, Mycobacterium
AAGPDAAAHQDNDP

SEQ ID NO: 1187992 - protein, 7 aa, Mycobacterium
AAGPDGL

SEQ ID NO: 1187993 - protein, 8 aa, Mycobacterium
AAGPEAMR

SEQ ID NO: 1187994 - protein, 9 aa, Mycobacterium
AAGPGRAPM

SEQ ID NO: 1187995 - protein, 7 aa, Mycobacterium
AAGPNDE

SEQ ID NO: 1187996 - protein, 7 aa, Mycobacterium
AAGPPKI

SEQ ID NO: 1187997 - protein, 8 aa, Mycobacterium
AAGPRGRV

SEQ ID NO: 1187998 - protein, 9 aa, Mycobacterium
AAGPRPAGL

SEQ ID NO: 1187999 - protein, 6 aa, Mycobacterium
AAGPTL

SEQ ID NO: 1188000 - protein, 10 aa, Mycobacterium
AAGPTTPTGR

SEQ ID NO: 1188001 - protein, 7 aa, Mycobacterium
AAGQIKA

SEQ ID NO: 1188002 - protein, 6 aa, Mycobacterium
AAGQKG

SEQ ID NO: 1188003 - protein, 6 aa, Mycobacterium
AAGQPG

SEQ ID NO: 1188004 - protein, 7 aa, Mycobacterium
AAGQPYQ

SEQ ID NO: 1188005 - protein, 10 aa, Mycobacterium
AAGQRTGNPP

SEQ ID NO: 1188006 - protein, 7 aa, Mycobacterium
AAGQSAA

SEQ ID NO: 1188007 - protein, 9 aa, Mycobacterium
AAGQSAPGV

SEQ ID NO: 1188008 - protein, 8 aa, Mycobacterium
AAGQSLHR

SEQ ID NO: 1188009 - protein, 6 aa, Mycobacterium
AAGQVT

SEQ ID NO: 1188010 - protein, 8 aa, Mycobacterium
AAGRATRK

SEQ ID NO: 1188011 - protein, 9 aa, Mycobacterium
AAGRDGAPQ

SEQ ID NO: 1188012 - protein, 8 aa, Mycobacterium
AAGRGTGH

SEQ ID NO: 1188013 - protein, 13 aa, Mycobacterium
AAGRHAEDEKWVW

SEQ ID NO: 1188014 - protein, 5 aa, Mycobacterium
AAGRI

SEQ ID NO: 1188015 - protein, 5 aa, Mycobacterium
AAGRP

SEQ ID NO: 1188016 - protein, 7 aa, Mycobacterium
AAGRPVT

SEQ ID NO: 1188017 - protein, 5 aa, Mycobacterium
AAGRR

SEQ ID NO: 1188018 - protein, 12 aa, Mycobacterium
AAGRRDEARERI

SEQ ID NO: 1188019 - protein, 8 aa, Mycobacterium
AAGRREGA

SEQ ID NO: 1188020 - protein, 7 aa, Mycobacterium
AAGRRSA

SEQ ID NO: 1188021 - protein, 15 aa, Mycobacterium
AAGRSKPRAGRDPVN

SEQ ID NO: 1188022 - protein, 13 aa, Mycobacterium
AAGRTDSGVHATG

SEQ ID NO: 1188023 - protein, 7 aa, Mycobacterium
AAGRTGR

SEQ ID NO: 1188024 - protein, 8 aa, Mycobacterium
AAGRTPGL

SEQ ID NO: 1188025 - protein, 88 aa, Mycobacterium
AAGRVGIGSSSDDAGGPAALPSGAKAATGSGRAAPIEVPAKKTPAKKTAAKTAPAKKTAPAKKAPVKKAPVKKTAVKATPAKTEAANM

SEQ ID NO: 1188026 - protein, 6 aa, Mycobacterium
AAGRYA

SEQ ID NO: 1188027 - protein, 17 aa, Mycobacterium
AAGSAAAASIVASFQEE

SEQ ID NO: 1188028 - protein, 11 aa, Mycobacterium
AAGSAERERAG

SEQ ID NO: 1188029 - protein, 10 aa, Mycobacterium
AAGSDEDKQR

SEQ ID NO: 1188030 - protein, 6 aa, Mycobacterium
AAGSFE

SEQ ID NO: 1188031 - protein, 5 aa, Mycobacterium
AAGSG

SEQ ID NO: 1188032 - protein, 12 aa, Mycobacterium
AAGSGNAAIPAA

SEQ ID NO: 1188033 - protein, 17 aa, Mycobacterium
AAGSGNAAIPAAEAGAT

SEQ ID NO: 1188034 - protein, 8 aa, Mycobacterium
AAGSKGVA

SEQ ID NO: 1188035 - protein, 6 aa, Mycobacterium
AAGSKV

SEQ ID NO: 1188036 - protein, 7 aa, Mycobacterium
AAGSPKL

SEQ ID NO: 1188037 - protein, 7 aa, Mycobacterium
AAGSPVR

SEQ ID NO: 1188038 - protein, 6 aa, Mycobacterium
AAGSQG

SEQ ID NO: 1188039 - protein, 6 aa, Mycobacterium
AAGSRS

SEQ ID NO: 1188040 - protein, 19 aa, Mycobacterium
AAGSSTAVIGPSGSGKSTL

SEQ ID NO: 1188041 - protein, 6 aa, Mycobacterium
AAGSTG

SEQ ID NO: 1188042 - protein, 8 aa, Mycobacterium
AAGTARVD

SEQ ID NO: 1188043 - protein, 7 aa, Mycobacterium
AAGTDGA

SEQ ID NO: 1188044 - protein, 6 aa, Mycobacterium
AAGTDL

SEQ ID NO: 1188045 - protein, 9 aa, Mycobacterium
AAGTDPAAN

SEQ ID NO: 1188046 - protein, 21 aa, Mycobacterium
AAGTEAPPSDVAVPAPPSDVA

SEQ ID NO: 1188047 - protein, 12 aa, Mycobacterium
AAGTLSGGEAQR

SEQ ID NO: 1188048 - protein, 8 aa, Mycobacterium
AAGTPVDY

SEQ ID NO: 1188049 - protein, 7 aa, Mycobacterium
AAGTQGP

SEQ ID NO: 1188050 - protein, 14 aa, Mycobacterium
AAGTRRAPAAPHSV

SEQ ID NO: 1188051 - protein, 5 aa, Mycobacterium
AAGTT

SEQ ID NO: 1188052 - protein, 11 aa, Mycobacterium
AAGTVESVGAG

SEQ ID NO: 1188053 - protein, 9 aa, Mycobacterium
AAGVARAKA

SEQ ID NO: 1188054 - protein, 5 aa, Mycobacterium
AAGVD

SEQ ID NO: 1188055 - protein, 8 aa, Mycobacterium
AAGVDPRE

SEQ ID NO: 1188056 - protein, 9 aa, Mycobacterium
AAGVGPGDA

SEQ ID NO: 1188057 - protein, 7 aa, Mycobacterium
AAGVNPR

SEQ ID NO: 1188058 - protein, 11 aa, Mycobacterium
AAGVPAPSRTM

SEQ ID NO: 1188059 - protein, 9 aa, Mycobacterium
AAGVPTATH

SEQ ID NO: 1188060 - protein, 7 aa, Mycobacterium
AAGYTAA

SEQ ID NO: 1188061 - protein, 5 aa, Mycobacterium
AAHAE

SEQ ID NO: 1188062 - protein, 14 aa, Mycobacterium
AAHAETPGAGAAGG

SEQ ID NO: 1188063 - protein, 10 aa, Mycobacterium
AAHATGAASE

SEQ ID NO: 1188064 - protein, 4 aa, Mycobacterium
AAHD

SEQ ID NO: 1188065 - protein, 14 aa, Mycobacterium
AAHDADAAAAYPPD

SEQ ID NO: 1188066 - protein, 15 aa, Mycobacterium
AAHDQAKAANAPVRA

SEQ ID NO: 1188067 - protein, 11 aa, Mycobacterium
AAHGEHEAAAT

SEQ ID NO: 1188068 - protein, 24 aa, Mycobacterium
AAHGSGGTVEFSRSGKAATVDGAT

SEQ ID NO: 1188069 - protein, 8 aa, Mycobacterium
AAHNRSTA

SEQ ID NO: 1188070 - protein, 7 aa, Mycobacterium
AAHNTKV

SEQ ID NO: 1188071 - protein, 6 aa, Mycobacterium
AAHPDP

SEQ ID NO: 1188072 - protein, 7 aa, Mycobacterium
AAHPDVA

SEQ ID NO: 1188073 - protein, 7 aa, Mycobacterium
AAHPEAA

SEQ ID NO: 1188074 - protein, 8 aa, Mycobacterium
AAHPGRPD

SEQ ID NO: 1188075 - protein, 23 aa, Mycobacterium
AAHPNGFPAVDSDTGDDKRGRAA

SEQ ID NO: 1188076 - protein, 20 aa, Mycobacterium
AAHPQPAASTGQAPAATVPA

SEQ ID NO: 1188077 - protein, 5 aa, Mycobacterium
AAHPR

SEQ ID NO: 1188078 - protein, 7 aa, Mycobacterium
AAHPTSP

SEQ ID NO: 1188079 - protein, 14 aa, Mycobacterium
AAHPTTGDESLPDD

SEQ ID NO: 1188080 - protein, 44 aa, Mycobacterium
AAHQGPDPAQETTSAPAPSPKPSAAVKPRPGPARPGPRPAVPAA

SEQ ID NO: 1188081 - protein, 5 aa, Mycobacterium
AAHQQ

SEQ ID NO: 1188082 - protein, 6 aa, Mycobacterium
AAHRAN

SEQ ID NO: 1188083 - protein, 9 aa, Mycobacterium
AAHRSGGAL

SEQ ID NO: 1188084 - protein, 4 aa, Mycobacterium
AAHS

SEQ ID NO: 1188085 - protein, 13 aa, Mycobacterium
AAHSCPEQAISIE

SEQ ID NO: 1188086 - protein, 14 aa, Mycobacterium
AAHSGALKVLLTAS

SEQ ID NO: 1188087 - protein, 4 aa, Mycobacterium
AAHT

SEQ ID NO: 1188088 - protein, 10 aa, Mycobacterium
AAHTGRDPND

SEQ ID NO: 1188089 - protein, 9 aa, Mycobacterium
AAIAEDGRV

SEQ ID NO: 1188090 - protein, 24 aa, Mycobacterium
AAIAEEGGVELDGARAAKSDKLTA

SEQ ID NO: 1188091 - protein, 8 aa, Mycobacterium
AAIDSDRV

SEQ ID NO: 1188092 - protein, 12 aa, Mycobacterium
AAIEDPAGAGVR

SEQ ID NO: 1188093 - protein, 5 aa, Mycobacterium
AAIPA

SEQ ID NO: 1188094 - protein, 15 aa, Mycobacterium
AAIRNGERRRSKVPT

SEQ ID NO: 1188095 - protein, 7 aa, Mycobacterium
AAISGGT

SEQ ID NO: 1188096 - protein, 7 aa, Mycobacterium
AAISPET

SEQ ID NO: 1188097 - protein, 4 aa, Mycobacterium
AAIT

SEQ ID NO: 1188098 - protein, 7 aa, Mycobacterium
AAKADAV

SEQ ID NO: 1188099 - protein, 7 aa, Mycobacterium
AAKAEGE

SEQ ID NO: 1188100 - protein, 6 aa, Mycobacterium
AAKAGA

SEQ ID NO: 1188101 - protein, 8 aa, Mycobacterium
AAKAGAAG

SEQ ID NO: 1188102 - protein, 18 aa, Mycobacterium
AAKAGATVREAPQNFATG

SEQ ID NO: 1188103 - protein, 10 aa, Mycobacterium
AAKALSDTVT

SEQ ID NO: 1188104 - protein, 8 aa, Mycobacterium
AAKANAKD

SEQ ID NO: 1188105 - protein, 64 aa, Mycobacterium
AAKAPAEKAVAEKAPAKKAVAAKASAKKVAARKAPAKKAAVKKTAVKKAPGKKAPAKKTGNSSP

SEQ ID NO: 1188106 - protein, 7 aa, Mycobacterium
AAKASAD

SEQ ID NO: 1188107 - protein, 17 aa, Mycobacterium
AAKAYAGGLKARGKRGG

SEQ ID NO: 1188108 - protein, 6 aa, Mycobacterium
AAKDIG

SEQ ID NO: 1188109 - protein, 9 aa, Mycobacterium
AAKDVAPED

SEQ ID NO: 1188110 - protein, 8 aa, Mycobacterium
AAKEAMTE

SEQ ID NO: 1188111 - protein, 8 aa, Mycobacterium
AAKGETRN

SEQ ID NO: 1188112 - protein, 12 aa, Mycobacterium
AAKGLSKAVTAE

SEQ ID NO: 1188113 - protein, 8 aa, Mycobacterium
AAKKGRTV

SEQ ID NO: 1188114 - protein, 4 aa, Mycobacterium
AAKN

SEQ ID NO: 1188115 - protein, 8 aa, Mycobacterium
AAKNPALN

SEQ ID NO: 1188116 - protein, 9 aa, Mycobacterium
AAKNREYED

SEQ ID NO: 1188117 - protein, 13 aa, Mycobacterium
AAKPGWENTPFDE

SEQ ID NO: 1188118 - protein, 8 aa, Mycobacterium
AAKPLSPA

SEQ ID NO: 1188119 - protein, 10 aa, Mycobacterium
AAKPVETAAR

SEQ ID NO: 1188120 - protein, 5 aa, Mycobacterium
AAKQH

SEQ ID NO: 1188121 - protein, 44 aa, Mycobacterium
AAKRQGTHSTKTRGEVSGGGKKPYRQKGTGRARQGSTRAPQFTG

SEQ ID NO: 1188122 - protein, 9 aa, Mycobacterium
AAKRTTGLT

SEQ ID NO: 1188123 - protein, 15 aa, Mycobacterium
AAKRVATHRAKAGAA

SEQ ID NO: 1188124 - protein, 13 aa, Mycobacterium
AAKSADPATRANI

SEQ ID NO: 1188125 - protein, 9 aa, Mycobacterium
AAKSDGQNW

SEQ ID NO: 1188126 - protein, 5 aa, Mycobacterium
AAKSL

SEQ ID NO: 1188127 - protein, 18 aa, Mycobacterium
AAKSNTPVSKAIVIRLER

SEQ ID NO: 1188128 - protein, 12 aa, Mycobacterium
AAKTLDGVDPSR

SEQ ID NO: 1188129 - protein, 11 aa, Mycobacterium
AAKVATETPSA

SEQ ID NO: 1188130 - protein, 8 aa, Mycobacterium
AAKYPGDP

SEQ ID NO: 1188131 - protein, 5 aa, Mycobacterium
AALAA

SEQ ID NO: 1188132 - protein, 10 aa, Mycobacterium
AALAEEAQRC

SEQ ID NO: 1188133 - protein, 11 aa, Mycobacterium
AALASASTEAA

SEQ ID NO: 1188134 - protein, 9 aa, Mycobacterium
AALDRTPTQ

SEQ ID NO: 1188135 - protein, 10 aa, Mycobacterium
AALDYPDGRF

SEQ ID NO: 1188136 - protein, 7 aa, Mycobacterium
AALEGPW

SEQ ID NO: 1188137 - protein, 15 aa, Mycobacterium
AALGGPERARERHVS

SEQ ID NO: 1188138 - protein, 10 aa, Mycobacterium
AALGKTPDLG

SEQ ID NO: 1188139 - protein, 5 aa, Mycobacterium
AALGS

SEQ ID NO: 1188140 - protein, 7 aa, Mycobacterium
AALPARS

SEQ ID NO: 1188141 - protein, 5 aa, Mycobacterium
AALPG

SEQ ID NO: 1188142 - protein, 10 aa, Mycobacterium
AALPGLRGSE

SEQ ID NO: 1188143 - protein, 8 aa, Mycobacterium
AALPTAAD

SEQ ID NO: 1188144 - protein, 6 aa, Mycobacterium
AALQSR

SEQ ID NO: 1188145 - protein, 11 aa, Mycobacterium
AALQTTDPRVS

SEQ ID NO: 1188146 - protein, 9 aa, Mycobacterium
AALRNSDEA

SEQ ID NO: 1188147 - protein, 6 aa, Mycobacterium
AALRSP

SEQ ID NO: 1188148 - protein, 11 aa, Mycobacterium
AALSARTQTEV

SEQ ID NO: 1188149 - protein, 11 aa, Mycobacterium
AALSDDGDTVK

SEQ ID NO: 1188150 - protein, 9 aa, Mycobacterium
AALSDNGFG

SEQ ID NO: 1188151 - protein, 11 aa, Mycobacterium
AALSGAETDEV

SEQ ID NO: 1188152 - protein, 8 aa, Mycobacterium
AALSPTSV

SEQ ID NO: 1188153 - protein, 4 aa, Mycobacterium
AALT

SEQ ID NO: 1188154 - protein, 8 aa, Mycobacterium
AALTPDEL

SEQ ID NO: 1188155 - protein, 19 aa, Mycobacterium
AAMSRSAPAETTADAPSAI

SEQ ID NO: 1188156 - protein, 14 aa, Mycobacterium
AANAADDATEAQQP

SEQ ID NO: 1188157 - protein, 14 aa, Mycobacterium
AANAAVDETEAQQP

SEQ ID NO: 1188158 - protein, 8 aa, Mycobacterium
AANADQLA

SEQ ID NO: 1188159 - protein, 9 aa, Mycobacterium
AANADRVRN

SEQ ID NO: 1188160 - protein, 9 aa, Mycobacterium
AANANPPAG

SEQ ID NO: 1188161 - protein, 14 aa, Mycobacterium
AANATAAVTGARRD

SEQ ID NO: 1188162 - protein, 5 aa, Mycobacterium
AANDP

SEQ ID NO: 1188163 - protein, 25 aa, Mycobacterium
AANDPTAAGRRQAAAASAARPQAAV

SEQ ID NO: 1188164 - protein, 8 aa, Mycobacterium
AANEEAAE

SEQ ID NO: 1188165 - protein, 6 aa, Mycobacterium
AANGGS

SEQ ID NO: 1188166 - protein, 25 aa, Mycobacterium
AANGKHEDDDSEHEDDGTAVPPEEV

SEQ ID NO: 1188167 - protein, 8 aa, Mycobacterium
AANGPLAA

SEQ ID NO: 1188168 - protein, 8 aa, Mycobacterium
AANGQSCA

SEQ ID NO: 1188169 - protein, 9 aa, Mycobacterium
AANKPDGRV

SEQ ID NO: 1188170 - protein, 15 aa, Mycobacterium
AANPNAARDALGNRP

SEQ ID NO: 1188171 - protein, 8 aa, Mycobacterium
AANPPHTV

SEQ ID NO: 1188172 - protein, 5 aa, Mycobacterium
AANPQ

SEQ ID NO: 1188173 - protein, 7 aa, Mycobacterium
AANPSDD

SEQ ID NO: 1188174 - protein, 7 aa, Mycobacterium
AANPSTV

SEQ ID NO: 1188175 - protein, 7 aa, Mycobacterium
AANQLQT

SEQ ID NO: 1188176 - protein, 4 aa, Mycobacterium
AANR

SEQ ID NO: 1188177 - protein, 6 aa, Mycobacterium
AANRAE

SEQ ID NO: 1188178 - protein, 23 aa, Mycobacterium
AANRDPRRFEDPDAFDPERKNAR

SEQ ID NO: 1188179 - protein, 13 aa, Mycobacterium
AANRDPRRFTDPD

SEQ ID NO: 1188180 - protein, 135 aa, Mycobacterium
AANRSGSGGSGRDRPGSGTPSPPAAPSAPNSTPDPLPAPAAAGGSPASGGGTPSMGGGSPSSGGGGSAGGSSLGSASGSGSGTAPGSGSGSGSGSGSGSGSPTAGASSQPTAASAAGGDKVAAAAGRSPAGGFTS

SEQ ID NO: 1188181 - protein, 15 aa, Mycobacterium
AANTDALAAFAERGA

SEQ ID NO: 1188182 - protein, 7 aa, Mycobacterium
AANTPTL

SEQ ID NO: 1188183 - protein, 5 aa, Mycobacterium
AANTS

SEQ ID NO: 1188184 - protein, 19 aa, Mycobacterium
AANYGATEAMPSTEIGSRE

SEQ ID NO: 1188185 - protein, 10 aa, Mycobacterium
AAPAAASAQA

SEQ ID NO: 1188186 - protein, 9 aa, Mycobacterium
AAPAAGTPM

SEQ ID NO: 1188187 - protein, 7 aa, Mycobacterium
AAPADDL

SEQ ID NO: 1188188 - protein, 13 aa, Mycobacterium
AAPAERETAPPRR

SEQ ID NO: 1188189 - protein, 9 aa, Mycobacterium
AAPAESGAH

SEQ ID NO: 1188190 - protein, 15 aa, Mycobacterium
AAPAGDPADQPAQSA

SEQ ID NO: 1188191 - protein, 8 aa, Mycobacterium
AAPAGGAA

SEQ ID NO: 1188192 - protein, 19 aa, Mycobacterium
AAPAGRGLTAGQKRRRAVG

SEQ ID NO: 1188193 - protein, 8 aa, Mycobacterium
AAPAGTDW

SEQ ID NO: 1188194 - protein, 12 aa, Mycobacterium
AAPAGTMPEIVA

SEQ ID NO: 1188195 - protein, 17 aa, Mycobacterium
AAPALNTASATNRSGAG

SEQ ID NO: 1188196 - protein, 8 aa, Mycobacterium
AAPAQQDR

SEQ ID NO: 1188197 - protein, 6 aa, Mycobacterium
AAPARR

SEQ ID NO: 1188198 - protein, 8 aa, Mycobacterium
AAPARTAD

SEQ ID NO: 1188199 - protein, 5 aa, Mycobacterium
AAPAT

SEQ ID NO: 1188200 - protein, 19 aa, Mycobacterium
AAPATDQTDLGEMTSRSTQ

SEQ ID NO: 1188201 - protein, 7 aa, Mycobacterium
AAPATER

SEQ ID NO: 1188202 - protein, 14 aa, Mycobacterium
AAPATTLGGGTASD

SEQ ID NO: 1188203 - protein, 6 aa, Mycobacterium
AAPAYQ

SEQ ID NO: 1188204 - protein, 18 aa, Mycobacterium
AAPCPTTVGGRNPATCTG

SEQ ID NO: 1188205 - protein, 7 aa, Mycobacterium
AAPDDAA

SEQ ID NO: 1188206 - protein, 8 aa, Mycobacterium
AAPDDGAR

SEQ ID NO: 1188207 - protein, 7 aa, Mycobacterium
AAPDDPA

SEQ ID NO: 1188208 - protein, 7 aa, Mycobacterium
AAPDDST

SEQ ID NO: 1188209 - protein, 18 aa, Mycobacterium
AAPDHGAPPDTDPKAADD

SEQ ID NO: 1188210 - protein, 6 aa, Mycobacterium
AAPDRP

SEQ ID NO: 1188211 - protein, 9 aa, Mycobacterium
AAPDSGTAR

SEQ ID NO: 1188212 - protein, 10 aa, Mycobacterium
AAPDSPGADA

SEQ ID NO: 1188213 - protein, 10 aa, Mycobacterium
AAPDTSSDTV

SEQ ID NO: 1188214 - protein, 9 aa, Mycobacterium
AAPDYSDDG

SEQ ID NO: 1188215 - protein, 4 aa, Mycobacterium
AAPE

SEQ ID NO: 1188216 - protein, 9 aa, Mycobacterium
AAPEDALPA

SEQ ID NO: 1188217 - protein, 7 aa, Mycobacterium
AAPEGTV

SEQ ID NO: 1188218 - protein, 9 aa, Mycobacterium
AAPEKRTNA

SEQ ID NO: 1188219 - protein, 9 aa, Mycobacterium
AAPEPIGTA

SEQ ID NO: 1188220 - protein, 8 aa, Mycobacterium
AAPESAEE

SEQ ID NO: 1188221 - protein, 7 aa, Mycobacterium
AAPESTV

SEQ ID NO: 1188222 - protein, 15 aa, Mycobacterium
AAPEVTRDAAAQASL

SEQ ID NO: 1188223 - protein, 7 aa, Mycobacterium
AAPFGGV

SEQ ID NO: 1188224 - protein, 17 aa, Mycobacterium
AAPFPPEATAARTGIDP

SEQ ID NO: 1188225 - protein, 8 aa, Mycobacterium
AAPGADGY

SEQ ID NO: 1188226 - protein, 6 aa, Mycobacterium
AAPGAE

SEQ ID NO: 1188227 - protein, 8 aa, Mycobacterium
AAPGANPY

SEQ ID NO: 1188228 - protein, 7 aa, Mycobacterium
AAPGAPL

SEQ ID NO: 1188229 - protein, 7 aa, Mycobacterium
AAPGDIT

SEQ ID NO: 1188230 - protein, 10 aa, Mycobacterium
AAPGDTVTAG

SEQ ID NO: 1188231 - protein, 6 aa, Mycobacterium
AAPGED

SEQ ID NO: 1188232 - protein, 17 aa, Mycobacterium
AAPGEPTLEDPVGTPVK

SEQ ID NO: 1188233 - protein, 9 aa, Mycobacterium
AAPGGETAA

SEQ ID NO: 1188234 - protein, 22 aa, Mycobacterium
AAPGGTNEPAPEPSRDAGHAGG

SEQ ID NO: 1188235 - protein, 8 aa, Mycobacterium
AAPGLPDQ

SEQ ID NO: 1188236 - protein, 16 aa, Mycobacterium
AAPGMAPYDASKAGVE

SEQ ID NO: 1188237 - protein, 6 aa, Mycobacterium
AAPGPH

SEQ ID NO: 1188238 - protein, 12 aa, Mycobacterium
AAPGQSALSSPD

SEQ ID NO: 1188239 - protein, 6 aa, Mycobacterium
AAPGRL

SEQ ID NO: 1188240 - protein, 17 aa, Mycobacterium
AAPGRTAAVATAAEIDL

SEQ ID NO: 1188241 - protein, 8 aa, Mycobacterium
AAPGSLAG

SEQ ID NO: 1188242 - protein, 12 aa, Mycobacterium
AAPGSTPSLDEV

SEQ ID NO: 1188243 - protein, 6 aa, Mycobacterium
AAPGTY

SEQ ID NO: 1188244 - protein, 7 aa, Mycobacterium
AAPGVGA

SEQ ID NO: 1188245 - protein, 5 aa, Mycobacterium
AAPGY

SEQ ID NO: 1188246 - protein, 4 aa, Mycobacterium
AAPH

SEQ ID NO: 1188247 - protein, 6 aa, Mycobacterium
AAPHPR

SEQ ID NO: 1188248 - protein, 6 aa, Mycobacterium
AAPHQR

SEQ ID NO: 1188249 - protein, 10 aa, Mycobacterium
AAPHRDRKSL

SEQ ID NO: 1188250 - protein, 4 aa, Mycobacterium
AAPK

SEQ ID NO: 1188251 - protein, 52 aa, Mycobacterium
AAPKKAAKKAPAAAKKVATKKVATASGGVDYRTARAQRQAALTDEQRQTYEQ

SEQ ID NO: 1188252 - protein, 27 aa, Mycobacterium
AAPLASSGWTVPNSESRITDPETGTEI

SEQ ID NO: 1188253 - protein, 7 aa, Mycobacterium
AAPLRRS

SEQ ID NO: 1188254 - protein, 11 aa, Mycobacterium
AAPLTGAGHSA

SEQ ID NO: 1188255 - protein, 6 aa, Mycobacterium
AAPMTE

SEQ ID NO: 1188256 - protein, 4 aa, Mycobacterium
AAPN

SEQ ID NO: 1188257 - protein, 7 aa, Mycobacterium
AAPNALG

SEQ ID NO: 1188258 - protein, 9 aa, Mycobacterium
AAPNRRTAH

SEQ ID NO: 1188259 - protein, 9 aa, Mycobacterium
AAPPAAPAE

SEQ ID NO: 1188260 - protein, 8 aa, Mycobacterium
AAPPAGHG

SEQ ID NO: 1188261 - protein, 27 aa, Mycobacterium
AAPPAPPALGAIPPGDIAPPGSPVSST

SEQ ID NO: 1188262 - protein, 10 aa, Mycobacterium
AAPPAPSNRV

SEQ ID NO: 1188263 - protein, 5 aa, Mycobacterium
AAPPD

SEQ ID NO: 1188264 - protein, 10 aa, Mycobacterium
AAPPDGLRGT

SEQ ID NO: 1188265 - protein, 7 aa, Mycobacterium
AAPPDRR

SEQ ID NO: 1188266 - protein, 7 aa, Mycobacterium
AAPPDTI

SEQ ID NO: 1188267 - protein, 17 aa, Mycobacterium
AAPPDVEPTPSTTLSAD

SEQ ID NO: 1188268 - protein, 7 aa, Mycobacterium
AAPPEVR

SEQ ID NO: 1188269 - protein, 7 aa, Mycobacterium
AAPPFPR

SEQ ID NO: 1188270 - protein, 21 aa, Mycobacterium
AAPPGAMPPGDIAPPPGGATR

SEQ ID NO: 1188271 - protein, 27 aa, Mycobacterium
AAPPGPRDRPSAATPFPPPPSVTQYDG

SEQ ID NO: 1188272 - protein, 9 aa, Mycobacterium
AAPPGPVQE

SEQ ID NO: 1188273 - protein, 6 aa, Mycobacterium
AAPPGT

SEQ ID NO: 1188274 - protein, 17 aa, Mycobacterium
AAPPLPPAPGGAGAVPA

SEQ ID NO: 1188275 - protein, 9 aa, Mycobacterium
AAPPPAQTR

SEQ ID NO: 1188276 - protein, 9 aa, Mycobacterium
AAPPPGAGS

SEQ ID NO: 1188277 - protein, 8 aa, Mycobacterium
AAPPPGMP

SEQ ID NO: 1188278 - protein, 9 aa, Mycobacterium
AAPPPMDES

SEQ ID NO: 1188279 - protein, 23 aa, Mycobacterium
AAPPPPPVPAAAPVPPPPGQDPA

SEQ ID NO: 1188280 - protein, 35 aa, Mycobacterium
AAPPPPQSGYGYGPGWGHRGSKHYRKQGFGRLFFS

SEQ ID NO: 1188281 - protein, 8 aa, Mycobacterium
AAPPPQVP

SEQ ID NO: 1188282 - protein, 9 aa, Mycobacterium
AAPPRHPAT

SEQ ID NO: 1188283 - protein, 9 aa, Mycobacterium
AAPQATVPA

SEQ ID NO: 1188284 - protein, 7 aa, Mycobacterium
AAPQNLK

SEQ ID NO: 1188285 - protein, 10 aa, Mycobacterium
AAPQPSRDVA

SEQ ID NO: 1188286 - protein, 9 aa, Mycobacterium
AAPQTTREA

SEQ ID NO: 1188287 - protein, 5 aa, Mycobacterium
AAPQV

SEQ ID NO: 1188288 - protein, 13 aa, Mycobacterium
AAPRAATAKPYRA

SEQ ID NO: 1188289 - protein, 7 aa, Mycobacterium
AAPRDGS

SEQ ID NO: 1188290 - protein, 9 aa, Mycobacterium
AAPRTGSAT

SEQ ID NO: 1188291 - protein, 7 aa, Mycobacterium
AAPSALD

SEQ ID NO: 1188292 - protein, 20 aa, Mycobacterium
AAPSARRRGTRAEHTAGGSG

SEQ ID NO: 1188293 - protein, 5 aa, Mycobacterium
AAPSF

SEQ ID NO: 1188294 - protein, 14 aa, Mycobacterium
AAPSPVPASDEYGL

SEQ ID NO: 1188295 - protein, 10 aa, Mycobacterium
AAPSSKNAQP

SEQ ID NO: 1188296 - protein, 7 aa, Mycobacterium
AAPSTPP

SEQ ID NO: 1188297 - protein, 7 aa, Mycobacterium
AAPSVGM

SEQ ID NO: 1188298 - protein, 7 aa, Mycobacterium
AAPSWAP

SEQ ID NO: 1188299 - protein, 5 aa, Mycobacterium
AAPTA

SEQ ID NO: 1188300 - protein, 10 aa, Mycobacterium
AAPTAQPDAP

SEQ ID NO: 1188301 - protein, 14 aa, Mycobacterium
AAPTEAATKQYNDA

SEQ ID NO: 1188302 - protein, 19 aa, Mycobacterium
AAPTEERRTPAPEPVASDG

SEQ ID NO: 1188303 - protein, 8 aa, Mycobacterium
AAPTINDR

SEQ ID NO: 1188304 - protein, 16 aa, Mycobacterium
AAPTPAPAAPVTEDQH

SEQ ID NO: 1188305 - protein, 5 aa, Mycobacterium
AAPTR

SEQ ID NO: 1188306 - protein, 6 aa, Mycobacterium
AAPTTI

SEQ ID NO: 1188307 - protein, 20 aa, Mycobacterium
AAPVAPEPGEPHQAGATVSV

SEQ ID NO: 1188308 - protein, 6 aa, Mycobacterium
AAPVDP

SEQ ID NO: 1188309 - protein, 13 aa, Mycobacterium
AAPVGDRRDRWDT

SEQ ID NO: 1188310 - protein, 5 aa, Mycobacterium
AAPVP

SEQ ID NO: 1188311 - protein, 5 aa, Mycobacterium
AAPVQ

SEQ ID NO: 1188312 - protein, 7 aa, Mycobacterium
AAPVTPD

SEQ ID NO: 1188313 - protein, 6 aa, Mycobacterium
AAPYAS

SEQ ID NO: 1188314 - protein, 5 aa, Mycobacterium
AAPYD

SEQ ID NO: 1188315 - protein, 7 aa, Mycobacterium
AAPYDQL

SEQ ID NO: 1188316 - protein, 4 aa, Mycobacterium
AAQA

SEQ ID NO: 1188317 - protein, 7 aa, Mycobacterium
AAQAAAA

SEQ ID NO: 1188318 - protein, 14 aa, Mycobacterium
AAQAATSPGDPDAL

SEQ ID NO: 1188319 - protein, 10 aa, Mycobacterium
AAQAEAAGAG

SEQ ID NO: 1188320 - protein, 13 aa, Mycobacterium
AAQAGQGATAAEK

SEQ ID NO: 1188321 - protein, 15 aa, Mycobacterium
AAQAGRAAARSGAHT

SEQ ID NO: 1188322 - protein, 11 aa, Mycobacterium
AAQAGRRTDTS

SEQ ID NO: 1188323 - protein, 6 aa, Mycobacterium
AAQANR

SEQ ID NO: 1188324 - protein, 10 aa, Mycobacterium
AAQANTDIPA

SEQ ID NO: 1188325 - protein, 12 aa, Mycobacterium
AAQAPDAPAATC

SEQ ID NO: 1188326 - protein, 7 aa, Mycobacterium
AAQAQQV

SEQ ID NO: 1188327 - protein, 8 aa, Mycobacterium
AAQARQTA

SEQ ID NO: 1188328 - protein, 9 aa, Mycobacterium
AAQATRTAS

SEQ ID NO: 1188329 - protein, 7 aa, Mycobacterium
AAQATSL

SEQ ID NO: 1188330 - protein, 9 aa, Mycobacterium
AAQAVRPGD

SEQ ID NO: 1188331 - protein, 5 aa, Mycobacterium
AAQAY

SEQ ID NO: 1188332 - protein, 16 aa, Mycobacterium
AAQDAAARRIAEAEPG

SEQ ID NO: 1188333 - protein, 5 aa, Mycobacterium
AAQDI

SEQ ID NO: 1188334 - protein, 9 aa, Mycobacterium
AAQDIEGGK

SEQ ID NO: 1188335 - protein, 9 aa, Mycobacterium
AAQDSNDNV

SEQ ID NO: 1188336 - protein, 10 aa, Mycobacterium
AAQEDTDPPL

SEQ ID NO: 1188337 - protein, 8 aa, Mycobacterium
AAQESGPS

SEQ ID NO: 1188338 - protein, 9 aa, Mycobacterium
AAQGAGADQ

SEQ ID NO: 1188339 - protein, 8 aa, Mycobacterium
AAQGDGTV

SEQ ID NO: 1188340 - protein, 7 aa, Mycobacterium
AAQGLPE

SEQ ID NO: 1188341 - protein, 5 aa, Mycobacterium
AAQGP

SEQ ID NO: 1188342 - protein, 8 aa, Mycobacterium
AAQGRDQA

SEQ ID NO: 1188343 - protein, 8 aa, Mycobacterium
AAQGRDRQ

SEQ ID NO: 1188344 - protein, 8 aa, Mycobacterium
AAQHAAAS

SEQ ID NO: 1188345 - protein, 7 aa, Mycobacterium
AAQKDAA

SEQ ID NO: 1188346 - protein, 6 aa, Mycobacterium
AAQNDR

SEQ ID NO: 1188347 - protein, 5 aa, Mycobacterium
AAQNH

SEQ ID NO: 1188348 - protein, 12 aa, Mycobacterium
AAQNVSPGVASN

SEQ ID NO: 1188349 - protein, 9 aa, Mycobacterium
AAQPAAVSR

SEQ ID NO: 1188350 - protein, 21 aa, Mycobacterium
AAQPAMAEAGRALESAAARPG

SEQ ID NO: 1188351 - protein, 7 aa, Mycobacterium
AAQPASQ

SEQ ID NO: 1188352 - protein, 9 aa, Mycobacterium
AAQPGDVPT

SEQ ID NO: 1188353 - protein, 9 aa, Mycobacterium
AAQPGGPYG

SEQ ID NO: 1188354 - protein, 8 aa, Mycobacterium
AAQPGQRG

SEQ ID NO: 1188355 - protein, 90 aa, Mycobacterium
AAQQKEQAADELQRKRDKAATAPQKAGQEARQRVQNARQKADKRTQDVAQSVASRTAQAKREVDEAAGRKVEAAEKAKRSMQNRSRAAEK

SEQ ID NO: 1188356 - protein, 8 aa, Mycobacterium
AAQQPTLT

SEQ ID NO: 1188357 - protein, 58 aa, Mycobacterium
AAQQQAVAQQQAAAQQQQAPAQQQAPEQPAPAQQEPPQPNARRSTMGSAMQQLRTITG

SEQ ID NO: 1188358 - protein, 11 aa, Mycobacterium
AAQRAAEGEVP

SEQ ID NO: 1188359 - protein, 6 aa, Mycobacterium
AAQRDG

SEQ ID NO: 1188360 - protein, 7 aa, Mycobacterium
AAQRDPE

SEQ ID NO: 1188361 - protein, 6 aa, Mycobacterium
AAQRGI

SEQ ID NO: 1188362 - protein, 8 aa, Mycobacterium
AAQRPKSL

SEQ ID NO: 1188363 - protein, 13 aa, Mycobacterium
AAQRQAGKYEAAV

SEQ ID NO: 1188364 - protein, 5 aa, Mycobacterium
AAQRR

SEQ ID NO: 1188365 - protein, 10 aa, Mycobacterium
AAQRYSGSAD

SEQ ID NO: 1188366 - protein, 7 aa, Mycobacterium
AAQSAAS

SEQ ID NO: 1188367 - protein, 5 aa, Mycobacterium
AAQSC

SEQ ID NO: 1188368 - protein, 10 aa, Mycobacterium
AAQSDAERAA

SEQ ID NO: 1188369 - protein, 19 aa, Mycobacterium
AAQSELNRQPRDASPVRVR

SEQ ID NO: 1188370 - protein, 4 aa, Mycobacterium
AAQT

SEQ ID NO: 1188371 - protein, 5 aa, Mycobacterium
AAQTA

SEQ ID NO: 1188372 - protein, 6 aa, Mycobacterium
AAQTAR

SEQ ID NO: 1188373 - protein, 8 aa, Mycobacterium
AAQTDADP

SEQ ID NO: 1188374 - protein, 10 aa, Mycobacterium
AAQTSTSDTL

SEQ ID NO: 1188375 - protein, 15 aa, Mycobacterium
AAQTVADSWADGTEL

SEQ ID NO: 1188376 - protein, 6 aa, Mycobacterium
AAQTYD

SEQ ID NO: 1188377 - protein, 4 aa, Mycobacterium
AAQV

SEQ ID NO: 1188378 - protein, 4 aa, Mycobacterium
AAQY

SEQ ID NO: 1188379 - protein, 8 aa, Mycobacterium
AARAAGHS

SEQ ID NO: 1188380 - protein, 15 aa, Mycobacterium
AARAARGDSPHTSGL

SEQ ID NO: 1188381 - protein, 15 aa, Mycobacterium
AARAAVDAAQASDSG

SEQ ID NO: 1188382 - protein, 7 aa, Mycobacterium
AARADDL

SEQ ID NO: 1188383 - protein, 7 aa, Mycobacterium
AARADPQ

SEQ ID NO: 1188384 - protein, 19 aa, Mycobacterium
AARAGLTAAQRARARQAAL

SEQ ID NO: 1188385 - protein, 11 aa, Mycobacterium
AARAGSLSTER

SEQ ID NO: 1188386 - protein, 23 aa, Mycobacterium
AARARDEGLMSSRGAATATTDSD

SEQ ID NO: 1188387 - protein, 11 aa, Mycobacterium
AARAREGGGPT

SEQ ID NO: 1188388 - protein, 6 aa, Mycobacterium
AARARG

SEQ ID NO: 1188389 - protein, 10 aa, Mycobacterium
AARARGHTNT

SEQ ID NO: 1188390 - protein, 7 aa, Mycobacterium
AARARNR

SEQ ID NO: 1188391 - protein, 16 aa, Mycobacterium
AARASADGAPPQLTQA

SEQ ID NO: 1188392 - protein, 11 aa, Mycobacterium
AARASAEESWP

SEQ ID NO: 1188393 - protein, 8 aa, Mycobacterium
AARASANA

SEQ ID NO: 1188394 - protein, 8 aa, Mycobacterium
AARASELP

SEQ ID NO: 1188395 - protein, 15 aa, Mycobacterium
AARASENGEKPALRQ

SEQ ID NO: 1188396 - protein, 10 aa, Mycobacterium
AARATGMPYG

SEQ ID NO: 1188397 - protein, 7 aa, Mycobacterium
AARDASN

SEQ ID NO: 1188398 - protein, 11 aa, Mycobacterium
AARDGADQLAA

SEQ ID NO: 1188399 - protein, 10 aa, Mycobacterium
AARDGEASAD

SEQ ID NO: 1188400 - protein, 11 aa, Mycobacterium
AARDKANIDDA

SEQ ID NO: 1188401 - protein, 10 aa, Mycobacterium
AARDKANIKD

SEQ ID NO: 1188402 - protein, 16 aa, Mycobacterium
AARDLERRRNESSDLQ

SEQ ID NO: 1188403 - protein, 26 aa, Mycobacterium
AARDPQVSFPAPQSPPRVSSRPANPV

SEQ ID NO: 1188404 - protein, 21 aa, Mycobacterium
AARDREHGRSRPYRPQTNGKV

SEQ ID NO: 1188405 - protein, 8 aa, Mycobacterium
AARDSGID

SEQ ID NO: 1188406 - protein, 7 aa, Mycobacterium
AARDSLE

SEQ ID NO: 1188407 - protein, 7 aa, Mycobacterium
AARDSPA

SEQ ID NO: 1188408 - protein, 7 aa, Mycobacterium
AARDTPD

SEQ ID NO: 1188409 - protein, 8 aa, Mycobacterium
AARDTPDR

SEQ ID NO: 1188410 - protein, 14 aa, Mycobacterium
AARDVPKVAGDATR

SEQ ID NO: 1188411 - protein, 6 aa, Mycobacterium
AAREGL

SEQ ID NO: 1188412 - protein, 9 aa, Mycobacterium
AAREGRTSG

SEQ ID NO: 1188413 - protein, 10 aa, Mycobacterium
AAREKANLKD

SEQ ID NO: 1188414 - protein, 5 aa, Mycobacterium
AAREP

SEQ ID NO: 1188415 - protein, 6 aa, Mycobacterium
AAREPD

SEQ ID NO: 1188416 - protein, 7 aa, Mycobacterium
AAREPRT

SEQ ID NO: 1188417 - protein, 9 aa, Mycobacterium
AARERAESD

SEQ ID NO: 1188418 - protein, 10 aa, Mycobacterium
AARESARGTV

SEQ ID NO: 1188419 - protein, 10 aa, Mycobacterium
AARETFNRRR

SEQ ID NO: 1188420 - protein, 12 aa, Mycobacterium
AARETFNRRRGS

SEQ ID NO: 1188421 - protein, 5 aa, Mycobacterium
AARGA

SEQ ID NO: 1188422 - protein, 10 aa, Mycobacterium
AARGAAERAD

SEQ ID NO: 1188423 - protein, 8 aa, Mycobacterium
AARGAFDE

SEQ ID NO: 1188424 - protein, 8 aa, Mycobacterium
AARGAGAS

SEQ ID NO: 1188425 - protein, 10 aa, Mycobacterium
AARGDAEPVR

SEQ ID NO: 1188426 - protein, 8 aa, Mycobacterium
AARGDTDR

SEQ ID NO: 1188427 - protein, 6 aa, Mycobacterium
AARGGA

SEQ ID NO: 1188428 - protein, 8 aa, Mycobacterium
AARGGEIT

SEQ ID NO: 1188429 - protein, 9 aa, Mycobacterium
AARGGGADL

SEQ ID NO: 1188430 - protein, 8 aa, Mycobacterium
AARGHGAQ

SEQ ID NO: 1188431 - protein, 9 aa, Mycobacterium
AARGIGAAT

SEQ ID NO: 1188432 - protein, 6 aa, Mycobacterium
AARGLQ

SEQ ID NO: 1188433 - protein, 7 aa, Mycobacterium
AARGMGA

SEQ ID NO: 1188434 - protein, 9 aa, Mycobacterium
AARGQKPLE

SEQ ID NO: 1188435 - protein, 8 aa, Mycobacterium
AARGSGSV

SEQ ID NO: 1188436 - protein, 8 aa, Mycobacterium
AARGSTGL

SEQ ID NO: 1188437 - protein, 6 aa, Mycobacterium
AARGTA

SEQ ID NO: 1188438 - protein, 6 aa, Mycobacterium
AARGTE

SEQ ID NO: 1188439 - protein, 13 aa, Mycobacterium
AARGYADERRAER

SEQ ID NO: 1188440 - protein, 7 aa, Mycobacterium
AARHADP

SEQ ID NO: 1188441 - protein, 5 aa, Mycobacterium
AARHG

SEQ ID NO: 1188442 - protein, 7 aa, Mycobacterium
AARHGRT

SEQ ID NO: 1188443 - protein, 14 aa, Mycobacterium
AARKEKRPPSFTDD

SEQ ID NO: 1188444 - protein, 15 aa, Mycobacterium
AARKEKRPPVFTDDK

SEQ ID NO: 1188445 - protein, 9 aa, Mycobacterium
AARKKLSEA

SEQ ID NO: 1188446 - protein, 7 aa, Mycobacterium
AARLGTA

SEQ ID NO: 1188447 - protein, 24 aa, Mycobacterium
AARLTAGQPALADTEPELAQHPSR

SEQ ID NO: 1188448 - protein, 6 aa, Mycobacterium
AARNAR

SEQ ID NO: 1188449 - protein, 4 aa, Mycobacterium
AARP

SEQ ID NO: 1188450 - protein, 10 aa, Mycobacterium
AARPAMPDGV

SEQ ID NO: 1188451 - protein, 5 aa, Mycobacterium
AARPD

SEQ ID NO: 1188452 - protein, 14 aa, Mycobacterium
AARPDLVGSSDLPA

SEQ ID NO: 1188453 - protein, 7 aa, Mycobacterium
AARPEPI

SEQ ID NO: 1188454 - protein, 28 aa, Mycobacterium
AARPGEDWSGSSEFSGDNPLGMGEGAQA

SEQ ID NO: 1188455 - protein, 7 aa, Mycobacterium
AARPNTK

SEQ ID NO: 1188456 - protein, 8 aa, Mycobacterium
AARPPADV

SEQ ID NO: 1188457 - protein, 7 aa, Mycobacterium
AARPQAD

SEQ ID NO: 1188458 - protein, 6 aa, Mycobacterium
AARPRS

SEQ ID NO: 1188459 - protein, 14 aa, Mycobacterium
AARPTSAPHRPLSG

SEQ ID NO: 1188460 - protein, 8 aa, Mycobacterium
AARPTSSR

SEQ ID NO: 1188461 - protein, 9 aa, Mycobacterium
AARQKVEAT

SEQ ID NO: 1188462 - protein, 8 aa, Mycobacterium
AARRASPH

SEQ ID NO: 1188463 - protein, 5 aa, Mycobacterium
AARRC

SEQ ID NO: 1188464 - protein, 20 aa, Mycobacterium
AARRDRAAAAGARAVPAPAA

SEQ ID NO: 1188465 - protein, 12 aa, Mycobacterium
AARREAQSAFGD

SEQ ID NO: 1188466 - protein, 8 aa, Mycobacterium
AARRPETI

SEQ ID NO: 1188467 - protein, 9 aa, Mycobacterium
AARRPHADR

SEQ ID NO: 1188468 - protein, 7 aa, Mycobacterium
AARRQPA

SEQ ID NO: 1188469 - protein, 8 aa, Mycobacterium
AARRRGDT

SEQ ID NO: 1188470 - protein, 12 aa, Mycobacterium
AARRSGAELPTR

SEQ ID NO: 1188471 - protein, 12 aa, Mycobacterium
AARRTGLDNDAA

SEQ ID NO: 1188472 - protein, 9 aa, Mycobacterium
AARRTGQDT

SEQ ID NO: 1188473 - protein, 5 aa, Mycobacterium
AARSG

SEQ ID NO: 1188474 - protein, 8 aa, Mycobacterium
AARSGQPA

SEQ ID NO: 1188475 - protein, 11 aa, Mycobacterium
AARSGRTPDRR

SEQ ID NO: 1188476 - protein, 12 aa, Mycobacterium
AARSGRTPPRGA

SEQ ID NO: 1188477 - protein, 8 aa, Mycobacterium
AARSPEES

SEQ ID NO: 1188478 - protein, 13 aa, Mycobacterium
AARSPGTPDPRWP

SEQ ID NO: 1188479 - protein, 7 aa, Mycobacterium
AARSPRK

SEQ ID NO: 1188480 - protein, 8 aa, Mycobacterium
AARSRGGY

SEQ ID NO: 1188481 - protein, 7 aa, Mycobacterium
AARSRRQ

SEQ ID NO: 1188482 - protein, 5 aa, Mycobacterium
AARST

SEQ ID NO: 1188483 - protein, 22 aa, Mycobacterium
AARSTQTATDNFSSKWGTATRT

SEQ ID NO: 1188484 - protein, 6 aa, Mycobacterium
AARSVA

SEQ ID NO: 1188485 - protein, 10 aa, Mycobacterium
AARTAATRAV

SEQ ID NO: 1188486 - protein, 13 aa, Mycobacterium
AARTAEQLRRSEY

SEQ ID NO: 1188487 - protein, 7 aa, Mycobacterium
AARTCPT

SEQ ID NO: 1188488 - protein, 5 aa, Mycobacterium
AARTD

SEQ ID NO: 1188489 - protein, 8 aa, Mycobacterium
AARTDATA

SEQ ID NO: 1188490 - protein, 6 aa, Mycobacterium
AARTDE

SEQ ID NO: 1188491 - protein, 5 aa, Mycobacterium
AARTE

SEQ ID NO: 1188492 - protein, 6 aa, Mycobacterium
AARTEL

SEQ ID NO: 1188493 - protein, 11 aa, Mycobacterium
AARTGADAVHP

SEQ ID NO: 1188494 - protein, 15 aa, Mycobacterium
AARTGPERSAWSGSR

SEQ ID NO: 1188495 - protein, 11 aa, Mycobacterium
AARTGPPDVPA

SEQ ID NO: 1188496 - protein, 7 aa, Mycobacterium
AARTPLG

SEQ ID NO: 1188497 - protein, 13 aa, Mycobacterium
AARTVDPAKAPTA

SEQ ID NO: 1188498 - protein, 5 aa, Mycobacterium
AARVD

SEQ ID NO: 1188499 - protein, 6 aa, Mycobacterium
AARVEQ

SEQ ID NO: 1188500 - protein, 7 aa, Mycobacterium
AARVGSA

SEQ ID NO: 1188501 - protein, 13 aa, Mycobacterium
AARVRPGTALQGN

SEQ ID NO: 1188502 - protein, 7 aa, Mycobacterium
AARYPGD

SEQ ID NO: 1188503 - protein, 8 aa, Mycobacterium
AARYRDYA

SEQ ID NO: 1188504 - protein, 6 aa, Mycobacterium
AARYTG

SEQ ID NO: 1188505 - protein, 7 aa, Mycobacterium
AARYTGT

SEQ ID NO: 1188506 - protein, 13 aa, Mycobacterium
AASAAAQSAGREV

SEQ ID NO: 1188507 - protein, 9 aa, Mycobacterium
AASADAGRA

SEQ ID NO: 1188508 - protein, 17 aa, Mycobacterium
AASADRPVRHATGSPGD

SEQ ID NO: 1188509 - protein, 9 aa, Mycobacterium
AASAEAAEG

SEQ ID NO: 1188510 - protein, 7 aa, Mycobacterium
AASAEDR

SEQ ID NO: 1188511 - protein, 11 aa, Mycobacterium
AASAGSPTPAL

SEQ ID NO: 1188512 - protein, 11 aa, Mycobacterium
AASAKAQAGAL

SEQ ID NO: 1188513 - protein, 12 aa, Mycobacterium
AASANAPQPREL

SEQ ID NO: 1188514 - protein, 16 aa, Mycobacterium
AASAPTAGTTARTARP

SEQ ID NO: 1188515 - protein, 14 aa, Mycobacterium
AASAQGAADPPPVP

SEQ ID NO: 1188516 - protein, 5 aa, Mycobacterium
AASAS

SEQ ID NO: 1188517 - protein, 11 aa, Mycobacterium
AASASGIAPPA

SEQ ID NO: 1188518 - protein, 6 aa, Mycobacterium
AASASL

SEQ ID NO: 1188519 - protein, 6 aa, Mycobacterium
AASATD

SEQ ID NO: 1188520 - protein, 14 aa, Mycobacterium
AASDAVAEAGVSTV

SEQ ID NO: 1188521 - protein, 6 aa, Mycobacterium
AASDDD

SEQ ID NO: 1188522 - protein, 7 aa, Mycobacterium
AASDERG

SEQ ID NO: 1188523 - protein, 13 aa, Mycobacterium
AASDGGSGERVSR

SEQ ID NO: 1188524 - protein, 8 aa, Mycobacterium
AASDPSPA

SEQ ID NO: 1188525 - protein, 9 aa, Mycobacterium
AASDPSPAL

SEQ ID NO: 1188526 - protein, 9 aa, Mycobacterium
AASDPTNAA

SEQ ID NO: 1188527 - protein, 9 aa, Mycobacterium
AASDSSPYR

SEQ ID NO: 1188528 - protein, 8 aa, Mycobacterium
AASDTAIR

SEQ ID NO: 1188529 - protein, 8 aa, Mycobacterium
AASDTVAE

SEQ ID NO: 1188530 - protein, 11 aa, Mycobacterium
AASEDYNDQRR

SEQ ID NO: 1188531 - protein, 6 aa, Mycobacterium
AASEIG

SEQ ID NO: 1188532 - protein, 6 aa, Mycobacterium
AASEMA

SEQ ID NO: 1188533 - protein, 12 aa, Mycobacterium
AASEQTDGDVLA

SEQ ID NO: 1188534 - protein, 14 aa, Mycobacterium
AASERAAKTIDDAT

SEQ ID NO: 1188535 - protein, 21 aa, Mycobacterium
AASESASRRRAMKSATDNADD

SEQ ID NO: 1188536 - protein, 7 aa, Mycobacterium
AASESEA

SEQ ID NO: 1188537 - protein, 41 aa, Mycobacterium
AASETETGSVRKRGHKAAAQKSTAASPAPPDPFDALFGTKN

SEQ ID NO: 1188538 - protein, 10 aa, Mycobacterium
AASETYSDAA

SEQ ID NO: 1188539 - protein, 5 aa, Mycobacterium
AASGA

SEQ ID NO: 1188540 - protein, 6 aa, Mycobacterium
AASGAA

SEQ ID NO: 1188541 - protein, 26 aa, Mycobacterium
AASGAPGYPTTAGTPELRASAKAALE

SEQ ID NO: 1188542 - protein, 6 aa, Mycobacterium
AASGAR

SEQ ID NO: 1188543 - protein, 10 aa, Mycobacterium
AASGATNKDI

SEQ ID NO: 1188544 - protein, 5 aa, Mycobacterium
AASGD

SEQ ID NO: 1188545 - protein, 9 aa, Mycobacterium
AASGEHGGQ

SEQ ID NO: 1188546 - protein, 7 aa, Mycobacterium
AASGGEA

SEQ ID NO: 1188547 - protein, 11 aa, Mycobacterium
AASGGPELDGD

SEQ ID NO: 1188548 - protein, 12 aa, Mycobacterium
AASGHLDQAAAE

SEQ ID NO: 1188549 - protein, 14 aa, Mycobacterium
AASGHQWDDPGECI

SEQ ID NO: 1188550 - protein, 6 aa, Mycobacterium
AASGIG

SEQ ID NO: 1188551 - protein, 6 aa, Mycobacterium
AASGLS

SEQ ID NO: 1188552 - protein, 9 aa, Mycobacterium
AASGRNGGF

SEQ ID NO: 1188553 - protein, 15 aa, Mycobacterium
AASGSNDQAAIENAQ

SEQ ID NO: 1188554 - protein, 10 aa, Mycobacterium
AASGSNNAEV

SEQ ID NO: 1188555 - protein, 9 aa, Mycobacterium
AASGSVHGR

SEQ ID NO: 1188556 - protein, 7 aa, Mycobacterium
AASGTTV

SEQ ID NO: 1188557 - protein, 6 aa, Mycobacterium
AASGVS

SEQ ID NO: 1188558 - protein, 8 aa, Mycobacterium
AASGVTPD

SEQ ID NO: 1188559 - protein, 5 aa, Mycobacterium
AASKE

SEQ ID NO: 1188560 - protein, 21 aa, Mycobacterium
AASKKPPGDSFADGSYDPSKI

SEQ ID NO: 1188561 - protein, 5 aa, Mycobacterium
AASLP

SEQ ID NO: 1188562 - protein, 5 aa, Mycobacterium
AASME

SEQ ID NO: 1188563 - protein, 19 aa, Mycobacterium
AASNSGGGLRPLPPVMFYR

SEQ ID NO: 1188564 - protein, 7 aa, Mycobacterium
AASPAEA

SEQ ID NO: 1188565 - protein, 8 aa, Mycobacterium
AASPEPTR

SEQ ID NO: 1188566 - protein, 8 aa, Mycobacterium
AASPNAEL

SEQ ID NO: 1188567 - protein, 8 aa, Mycobacterium
AASPSGWS

SEQ ID NO: 1188568 - protein, 6 aa, Mycobacterium
AASPVP

SEQ ID NO: 1188569 - protein, 4 aa, Mycobacterium
AASR

SEQ ID NO: 1188570 - protein, 10 aa, Mycobacterium
AASRADEATF

SEQ ID NO: 1188571 - protein, 6 aa, Mycobacterium
AASRAG

SEQ ID NO: 1188572 - protein, 6 aa, Mycobacterium
AASRDA

SEQ ID NO: 1188573 - protein, 6 aa, Mycobacterium
AASRDI

SEQ ID NO: 1188574 - protein, 9 aa, Mycobacterium
AASRLESSG

SEQ ID NO: 1188575 - protein, 6 aa, Mycobacterium
AASRPR

SEQ ID NO: 1188576 - protein, 14 aa, Mycobacterium
AASRPRAARTSVSS

SEQ ID NO: 1188577 - protein, 19 aa, Mycobacterium
AASRPRPEYLAARDVRRVG

SEQ ID NO: 1188578 - protein, 6 aa, Mycobacterium
AASRRY

SEQ ID NO: 1188579 - protein, 6 aa, Mycobacterium
AASRSK

SEQ ID NO: 1188580 - protein, 11 aa, Mycobacterium
AASRSPRDPEF

SEQ ID NO: 1188581 - protein, 16 aa, Mycobacterium
AASSANLRGAAGDAAQ

SEQ ID NO: 1188582 - protein, 17 aa, Mycobacterium
AASSAPPPGGSSAASVT

SEQ ID NO: 1188583 - protein, 5 aa, Mycobacterium
AASSC

SEQ ID NO: 1188584 - protein, 10 aa, Mycobacterium
AASSDTPYMG

SEQ ID NO: 1188585 - protein, 13 aa, Mycobacterium
AASSSATAEMQGD

SEQ ID NO: 1188586 - protein, 8 aa, Mycobacterium
AASTDPAL

SEQ ID NO: 1188587 - protein, 13 aa, Mycobacterium
AASTGATDATADA

SEQ ID NO: 1188588 - protein, 7 aa, Mycobacterium
AASTPGV

SEQ ID NO: 1188589 - protein, 16 aa, Mycobacterium
AASTRRGAKQLSTAEE

SEQ ID NO: 1188590 - protein, 4 aa, Mycobacterium
AASV

SEQ ID NO: 1188591 - protein, 15 aa, Mycobacterium
AASVAPSGPPAAPVL

SEQ ID NO: 1188592 - protein, 6 aa, Mycobacterium
AASVPG

SEQ ID NO: 1188593 - protein, 11 aa, Mycobacterium
AASVSAPDEET

SEQ ID NO: 1188594 - protein, 15 aa, Mycobacterium
AASVTRTGPATGGRY

SEQ ID NO: 1188595 - protein, 6 aa, Mycobacterium
AASYAS

SEQ ID NO: 1188596 - protein, 6 aa, Mycobacterium
AASYIS

SEQ ID NO: 1188597 - protein, 10 aa, Mycobacterium
AATAAESARV

SEQ ID NO: 1188598 - protein, 23 aa, Mycobacterium
AATAAGARADVEVPEATESPAAA

SEQ ID NO: 1188599 - protein, 7 aa, Mycobacterium
AATADDV

SEQ ID NO: 1188600 - protein, 10 aa, Mycobacterium
AATAEAVGGA

SEQ ID NO: 1188601 - protein, 12 aa, Mycobacterium
AATAESVTDRGR

SEQ ID NO: 1188602 - protein, 8 aa, Mycobacterium
AATAGAGD

SEQ ID NO: 1188603 - protein, 8 aa, Mycobacterium
AATAGAGS

SEQ ID NO: 1188604 - protein, 9 aa, Mycobacterium
AATAGAPGH

SEQ ID NO: 1188605 - protein, 26 aa, Mycobacterium
AATAHPATPAAASRTETGAAAPDSDV

SEQ ID NO: 1188606 - protein, 9 aa, Mycobacterium
AATANPDTI

SEQ ID NO: 1188607 - protein, 6 aa, Mycobacterium
AATAPN

SEQ ID NO: 1188608 - protein, 6 aa, Mycobacterium
AATARG

SEQ ID NO: 1188609 - protein, 7 aa, Mycobacterium
AATARSE

SEQ ID NO: 1188610 - protein, 10 aa, Mycobacterium
AATASSYEVG

SEQ ID NO: 1188611 - protein, 11 aa, Mycobacterium
AATATQGGTAI

SEQ ID NO: 1188612 - protein, 11 aa, Mycobacterium
AATDAESDPDR

SEQ ID NO: 1188613 - protein, 6 aa, Mycobacterium
AATDAG

SEQ ID NO: 1188614 - protein, 7 aa, Mycobacterium
AATDAGI

SEQ ID NO: 1188615 - protein, 6 aa, Mycobacterium
AATDDL

SEQ ID NO: 1188616 - protein, 16 aa, Mycobacterium
AATDDLSQANLAAGGG

SEQ ID NO: 1188617 - protein, 6 aa, Mycobacterium
AATDGA

SEQ ID NO: 1188618 - protein, 20 aa, Mycobacterium
AATDGEGPELEYSNESGPTE

SEQ ID NO: 1188619 - protein, 17 aa, Mycobacterium
AATDPGVRGGQYYGPSG

SEQ ID NO: 1188620 - protein, 8 aa, Mycobacterium
AATDPPQR

SEQ ID NO: 1188621 - protein, 8 aa, Mycobacterium
AATDPSVL

SEQ ID NO: 1188622 - protein, 10 aa, Mycobacterium
AATDQPPARV

SEQ ID NO: 1188623 - protein, 19 aa, Mycobacterium
AATDSAATRSRRIGCVICR

SEQ ID NO: 1188624 - protein, 21 aa, Mycobacterium
AATDTEELTDPPQPQLPPQRE

SEQ ID NO: 1188625 - protein, 11 aa, Mycobacterium
AATDTTKTTLG

SEQ ID NO: 1188626 - protein, 4 aa, Mycobacterium
AATE

SEQ ID NO: 1188627 - protein, 9 aa, Mycobacterium
AATEAQRGN

SEQ ID NO: 1188628 - protein, 17 aa, Mycobacterium
AATEARGGQVDEAADAA

SEQ ID NO: 1188629 - protein, 17 aa, Mycobacterium
AATEATERGLAALRAAL

SEQ ID NO: 1188630 - protein, 9 aa, Mycobacterium
AATEGGEAL

SEQ ID NO: 1188631 - protein, 8 aa, Mycobacterium
AATEGTDI

SEQ ID NO: 1188632 - protein, 15 aa, Mycobacterium
AATEKDRAEALSRHE

SEQ ID NO: 1188633 - protein, 9 aa, Mycobacterium
AATELAGSV

SEQ ID NO: 1188634 - protein, 9 aa, Mycobacterium
AATEPGYAA

SEQ ID NO: 1188635 - protein, 7 aa, Mycobacterium
AATESGI

SEQ ID NO: 1188636 - protein, 16 aa, Mycobacterium
AATETDLKKRKEAVED

SEQ ID NO: 1188637 - protein, 5 aa, Mycobacterium
AATEV

SEQ ID NO: 1188638 - protein, 6 aa, Mycobacterium
AATGAA

SEQ ID NO: 1188639 - protein, 7 aa, Mycobacterium
AATGDSD

SEQ ID NO: 1188640 - protein, 6 aa, Mycobacterium
AATGFA

SEQ ID NO: 1188641 - protein, 8 aa, Mycobacterium
AATGGAIP

SEQ ID NO: 1188642 - protein, 18 aa, Mycobacterium
AATGGDCRASISGGAPLG

SEQ ID NO: 1188643 - protein, 8 aa, Mycobacterium
AATGGESR

SEQ ID NO: 1188644 - protein, 19 aa, Mycobacterium
AATGGVRRGAEVVEAVAIS

SEQ ID NO: 1188645 - protein, 10 aa, Mycobacterium
AATGKTMPRK

SEQ ID NO: 1188646 - protein, 5 aa, Mycobacterium
AATGL

SEQ ID NO: 1188647 - protein, 7 aa, Mycobacterium
AATGLAE

SEQ ID NO: 1188648 - protein, 8 aa, Mycobacterium
AATGLAER

SEQ ID NO: 1188649 - protein, 5 aa, Mycobacterium
AATGN

SEQ ID NO: 1188650 - protein, 14 aa, Mycobacterium
AATGPDDAVADDLE

SEQ ID NO: 1188651 - protein, 7 aa, Mycobacterium
AATGPDV

SEQ ID NO: 1188652 - protein, 11 aa, Mycobacterium
AATGQSTGDGG

SEQ ID NO: 1188653 - protein, 7 aa, Mycobacterium
AATGRGI

SEQ ID NO: 1188654 - protein, 8 aa, Mycobacterium
AATGRPVY

SEQ ID NO: 1188655 - protein, 7 aa, Mycobacterium
AATGRRD

SEQ ID NO: 1188656 - protein, 17 aa, Mycobacterium
AATGSEKLLSGESPVKA

SEQ ID NO: 1188657 - protein, 15 aa, Mycobacterium
AATGTEHGSAAAGGL

SEQ ID NO: 1188658 - protein, 7 aa, Mycobacterium
AATGTWS

SEQ ID NO: 1188659 - protein, 6 aa, Mycobacterium
AATGVD

SEQ ID NO: 1188660 - protein, 7 aa, Mycobacterium
AATGVNR

SEQ ID NO: 1188661 - protein, 6 aa, Mycobacterium
AATHDV

SEQ ID NO: 1188662 - protein, 7 aa, Mycobacterium
AATHTPF

SEQ ID NO: 1188663 - protein, 10 aa, Mycobacterium
AATIDAPAAT

SEQ ID NO: 1188664 - protein, 28 aa, Mycobacterium
AATIRGTDVGTTAGAAGDGLPGSETQWS

SEQ ID NO: 1188665 - protein, 9 aa, Mycobacterium
AATISPDGT

SEQ ID NO: 1188666 - protein, 31 aa, Mycobacterium; identical to SEQ ID NO: 413648

SEQ ID NO: 1188667 - protein, 8 aa, Mycobacterium
AATKGGTI

SEQ ID NO: 1188668 - protein, 9 aa, Mycobacterium
AATKQRRGE

SEQ ID NO: 1188669 - protein, 4 aa, Mycobacterium
AATL

SEQ ID NO: 1188670 - protein, 15 aa, Mycobacterium
AATLDDAGNGADAYS

SEQ ID NO: 1188671 - protein, 8 aa, Mycobacterium
AATLSPSS

SEQ ID NO: 1188672 - protein, 7 aa, Mycobacterium
AATMGGL

SEQ ID NO: 1188673 - protein, 17 aa, Mycobacterium
AATNDPIEAHRNGDVAP

SEQ ID NO: 1188674 - protein, 5 aa, Mycobacterium
AATNE

SEQ ID NO: 1188675 - protein, 4 aa, Mycobacterium
AATP

SEQ ID NO: 1188676 - protein, 11 aa, Mycobacterium
AATPDHPQPYR

SEQ ID NO: 1188677 - protein, 10 aa, Mycobacterium
AATPGESAEV

SEQ ID NO: 1188678 - protein, 13 aa, Mycobacterium
AATPGQPVYAAQS

SEQ ID NO: 1188679 - protein, 20 aa, Mycobacterium
AATPISQARRGTRRTPETGA

SEQ ID NO: 1188680 - protein, 8 aa, Mycobacterium
AATPLGGD

SEQ ID NO: 1188681 - protein, 7 aa, Mycobacterium
AATPLRY

SEQ ID NO: 1188682 - protein, 5 aa, Mycobacterium
AATPN

SEQ ID NO: 1188683 - protein, 9 aa, Mycobacterium
AATPTDAAK

SEQ ID NO: 1188684 - protein, 9 aa, Mycobacterium
AATPTTGEV

SEQ ID NO: 1188685 - protein, 7 aa, Mycobacterium
AATPVIG

SEQ ID NO: 1188686 - protein, 10 aa, Mycobacterium
AATQGNPASA

SEQ ID NO: 1188687 - protein, 7 aa, Mycobacterium
AATQPSI

SEQ ID NO: 1188688 - protein, 6 aa, Mycobacterium
AATQQA

SEQ ID NO: 1188689 - protein, 8 aa, Mycobacterium
AATQRENA

SEQ ID NO: 1188690 - protein, 13 aa, Mycobacterium
AATQSHLSSGQPY

SEQ ID NO: 1188691 - protein, 11 aa, Mycobacterium
AATRDGAEGRI

SEQ ID NO: 1188692 - protein, 5 aa, Mycobacterium
AATRG

SEQ ID NO: 1188693 - protein, 8 aa, Mycobacterium
AATRGKEM

SEQ ID NO: 1188694 - protein, 15 aa, Mycobacterium
AATRGRVTSKSHRKI

SEQ ID NO: 1188695 - protein, 9 aa, Mycobacterium
AATRQQFGR

SEQ ID NO: 1188696 - protein, 6 aa, Mycobacterium
AATRSR

SEQ ID NO: 1188697 - protein, 6 aa, Mycobacterium
AATSDG

SEQ ID NO: 1188698 - protein, 13 aa, Mycobacterium
AATSDGQVYGFAP

SEQ ID NO: 1188699 - protein, 7 aa, Mycobacterium
AATSDTA

SEQ ID NO: 1188700 - protein, 7 aa, Mycobacterium
AATSDWA

SEQ ID NO: 1188701 - protein, 10 aa, Mycobacterium
AATSEAAGQG

SEQ ID NO: 1188702 - protein, 8 aa, Mycobacterium
AATSGAGI

SEQ ID NO: 1188703 - protein, 8 aa, Mycobacterium
AATSGASG

SEQ ID NO: 1188704 - protein, 11 aa, Mycobacterium
AATSMSPRSSH

SEQ ID NO: 1188705 - protein, 14 aa, Mycobacterium
AATSNTLPEQLGEG

SEQ ID NO: 1188706 - protein, 34 aa, Mycobacterium
AATSPNTANPPERTRRRRRRSSLSDLAPRADAPP

SEQ ID NO: 1188707 - protein, 6 aa, Mycobacterium
AATSPP

SEQ ID NO: 1188708 - protein, 8 aa, Mycobacterium
AATSSAPV

SEQ ID NO: 1188709 - protein, 7 aa, Mycobacterium
AATSVEV

SEQ ID NO: 1188710 - protein, 4 aa, Mycobacterium
AATT

SEQ ID NO: 1188711 - protein, 7 aa, Mycobacterium
AATTAQP

SEQ ID NO: 1188712 - protein, 12 aa, Mycobacterium
AATTERDKDHIR

SEQ ID NO: 1188713 - protein, 9 aa, Mycobacterium
AATTGDDIA

SEQ ID NO: 1188714 - protein, 9 aa, Mycobacterium
AATTGVEGP

SEQ ID NO: 1188715 - protein, 7 aa, Mycobacterium
AATTPAA

SEQ ID NO: 1188716 - protein, 10 aa, Mycobacterium
AATTPAADAG

SEQ ID NO: 1188717 - protein, 12 aa, Mycobacterium
AATTRLAQTADR

SEQ ID NO: 1188718 - protein, 6 aa, Mycobacterium
AATTSR

SEQ ID NO: 1188719 - protein, 5 aa, Mycobacterium
AATTT

SEQ ID NO: 1188720 - protein, 21 aa, Mycobacterium
AATTTSRPPLAPPRRPPGRRE

SEQ ID NO: 1188721 - protein, 10 aa, Mycobacterium
AATYGTPDTA

SEQ ID NO: 1188722 - protein, 8 aa, Mycobacterium
AAVARGVG

SEQ ID NO: 1188723 - protein, 5 aa, Mycobacterium
AAVDG

SEQ ID NO: 1188724 - protein, 4 aa, Mycobacterium
AAVE

SEQ ID NO: 1188725 - protein, 13 aa, Mycobacterium
AAVEKAAKDGGYE

SEQ ID NO: 1188726 - protein, 6 aa, Mycobacterium
AAVESG

SEQ ID NO: 1188727 - protein, 14 aa, Mycobacterium
AAVGAAAAAAPSWA

SEQ ID NO: 1188728 - protein, 5 aa, Mycobacterium
AAVGE

SEQ ID NO: 1188729 - protein, 6 aa, Mycobacterium
AAVGGR

SEQ ID NO: 1188730 - protein, 10 aa, Mycobacterium
AAVGGTTSMA

SEQ ID NO: 1188731 - protein, 12 aa, Mycobacterium
AAVGRPAPTKSA

SEQ ID NO: 1188732 - protein, 5 aa, Mycobacterium
AAVGS

SEQ ID NO: 1188733 - protein, 9 aa, Mycobacterium
AAVGSPADQ

SEQ ID NO: 1188734 - protein, 4 aa, Mycobacterium
AAVK

SEQ ID NO: 1188735 - protein, 6 aa, Mycobacterium
AAVNAD

SEQ ID NO: 1188736 - protein, 6 aa, Mycobacterium
AAVPER

SEQ ID NO: 1188737 - protein, 6 aa, Mycobacterium
AAVPQG

SEQ ID NO: 1188738 - protein, 54 aa, Mycobacterium
AAVPTETTASEPAAEPLTDGPVVSGQPSERKGDETGQLSNDSPVPPAPEQVKER

SEQ ID NO: 1188739 - protein, 7 aa, Mycobacterium
AAVRGDR

SEQ ID NO: 1188740 - protein, 15 aa, Mycobacterium
AAVRGDRAGSNQTTI

SEQ ID NO: 1188741 - protein, 17 aa, Mycobacterium
AAVSGGLVGGSADAPEF

SEQ ID NO: 1188742 - protein, 11 aa, Mycobacterium
AAVSGLSDGGA

SEQ ID NO: 1188743 - protein, 22 aa, Mycobacterium
AAVSPYGSGALAGSSLGLDPDA

SEQ ID NO: 1188744 - protein, 12 aa, Mycobacterium
AAVSSGERALTE

SEQ ID NO: 1188745 - protein, 23 aa, Mycobacterium
AAVSSGTNLTDAAADAGFASPSH

SEQ ID NO: 1188746 - protein, 4 aa, Mycobacterium
AAVT

SEQ ID NO: 1188747 - protein, 6 aa, Mycobacterium
AAVTGG

SEQ ID NO: 1188748 - protein, 11 aa, Mycobacterium
AAVTPEPPRPR

SEQ ID NO: 1188749 - protein, 7 aa, Mycobacterium
AAWTPGA

SEQ ID NO: 1188750 - protein, 11 aa, Mycobacterium
AAYEDRDETYR

SEQ ID NO: 1188751 - protein, 6 aa, Mycobacterium
AAYEGP

SEQ ID NO: 1188752 - protein, 7 aa, Mycobacterium
AAYGAAD

SEQ ID NO: 1188753 - protein, 10 aa, Mycobacterium
AAYGNEAAVG

SEQ ID NO: 1188754 - protein, 10 aa, Mycobacterium
AAYGQTTIST

SEQ ID NO: 1188755 - protein, 16 aa, Mycobacterium
AAYNKAAGADAKERTL

SEQ ID NO: 1188756 - protein, 5 aa, Mycobacterium
AAYPD

SEQ ID NO: 1188757 - protein, 8 aa, Mycobacterium
AAYPEPDK

SEQ ID NO: 1188758 - protein, 8 aa, Mycobacterium
AAYPGSPF

SEQ ID NO: 1188759 - protein, 6 aa, Mycobacterium
AAYQSN

SEQ ID NO: 1188760 - protein, 12 aa, Mycobacterium
AAYRGGRPPLEL

SEQ ID NO: 1188761 - protein, 14 aa, Mycobacterium
AAYSSDRSQRQRDR

SEQ ID NO: 1188762 - protein, 11 aa, Mycobacterium
AAYSSNGQCRQ

SEQ ID NO: 1188763 - protein, 6 aa, Mycobacterium
AAYTSQ

SEQ ID NO: 1188764 - protein, 9 aa, Mycobacterium
ACARTEPEL

SEQ ID NO: 1188765 - protein, 14 aa, Mycobacterium
ACASPTRSDDGGDM

SEQ ID NO: 1188766 - protein, 12 aa, Mycobacterium
ACATGNDAIRNG

SEQ ID NO: 1188767 - protein, 24 aa, Mycobacterium
ACDVGSDTGSPTSPDYGPHGNGFN

SEQ ID NO: 1188768 - protein, 14 aa, Mycobacterium
ACEESRAGARKSAA

SEQ ID NO: 1188769 - protein, 4 aa, Mycobacterium
ACEP

SEQ ID NO: 1188770 - protein, 8 aa, Mycobacterium
ACGARGKD

SEQ ID NO: 1188771 - protein, 5 aa, Mycobacterium
ACGDP

SEQ ID NO: 1188772 - protein, 5 aa, Mycobacterium
ACGGD

SEQ ID NO: 1188773 - protein, 5 aa, Mycobacterium
ACGGS

SEQ ID NO: 1188774 - protein, 11 aa, Mycobacterium
ACGPNHADRRP

SEQ ID NO: 1188775 - protein, 6 aa, Mycobacterium
ACGTGS

SEQ ID NO: 1188776 - protein, 14 aa, Mycobacterium
ACGTTKERIEDPDN

SEQ ID NO: 1188777 - protein, 5 aa, Mycobacterium
ACNSN

SEQ ID NO: 1188778 - protein, 5 aa, Mycobacterium
ACPAP

SEQ ID NO: 1188779 - protein, 6 aa, Mycobacterium
ACPDDI

SEQ ID NO: 1188780 - protein, 7 aa, Mycobacterium
ACPEDER

SEQ ID NO: 1188781 - protein, 13 aa, Mycobacterium
ACPGVASGRAYTD

SEQ ID NO: 1188782 - protein, 5 aa, Mycobacterium
ACPTC

SEQ ID NO: 1188783 - protein, 12 aa, Mycobacterium
ACSNTEKVFEKY

SEQ ID NO: 1188784 - protein, 13 aa, Mycobacterium
ACSPASDPGVHGR

SEQ ID NO: 1188785 - protein, 6 aa, Mycobacterium
ACSPEQ

SEQ ID NO: 1188786 - protein, 8 aa, Mycobacterium
ACSSGSEA

SEQ ID NO: 1188787 - protein, 9 aa, Mycobacterium
ACTPGNAKE

SEQ ID NO: 1188788 - protein, 7 aa, Mycobacterium
ADAAAEV

SEQ ID NO: 1188789 - protein, 11 aa, Mycobacterium
ADAAAPDDAGD

SEQ ID NO: 1188790 - protein, 6 aa, Mycobacterium
ADAAAS

SEQ ID NO: 1188791 - protein, 10 aa, Mycobacterium
ADAADNDEVR

SEQ ID NO: 1188792 - protein, 6 aa, Mycobacterium
ADAADR

SEQ ID NO: 1188793 - protein, 16 aa, Mycobacterium
ADAAEADRKRAAGADL

SEQ ID NO: 1188794 - protein, 9 aa, Mycobacterium
ADAAGAQAL

SEQ ID NO: 1188795 - protein, 6 aa, Mycobacterium
ADAAGV

SEQ ID NO: 1188796 - protein, 5 aa, Mycobacterium
ADAAK

SEQ ID NO: 1188797 - protein, 14 aa, Mycobacterium
ADAAPDWPSGTQND

SEQ ID NO: 1188798 - protein, 8 aa, Mycobacterium
ADAAPIGQ

SEQ ID NO: 1188799 - protein, 18 aa, Mycobacterium
ADAASRARRQEQRETREA

SEQ ID NO: 1188800 - protein, 12 aa, Mycobacterium
ADAASSLQSSIT

SEQ ID NO: 1188801 - protein, 12 aa, Mycobacterium
ADAATATGDPRW

SEQ ID NO: 1188802 - protein, 8 aa, Mycobacterium
ADAATDGD

SEQ ID NO: 1188803 - protein, 6 aa, Mycobacterium
ADAAVS

SEQ ID NO: 1188804 - protein, 8 aa, Mycobacterium
ADADAREG

SEQ ID NO: 1188805 - protein, 11 aa, Mycobacterium
ADADASVGSGE

SEQ ID NO: 1188806 - protein, 5 aa, Mycobacterium
ADADD

SEQ ID NO: 1188807 - protein, 6 aa, Mycobacterium
ADADEQ

SEQ ID NO: 1188808 - protein, 9 aa, Mycobacterium
ADADGDAVT

SEQ ID NO: 1188809 - protein, 8 aa, Mycobacterium
ADADGELT

SEQ ID NO: 1188810 - protein, 8 aa, Mycobacterium
ADADLAGR

SEQ ID NO: 1188811 - protein, 10 aa, Mycobacterium
ADAEAAANAD

SEQ ID NO: 1188812 - protein, 13 aa, Mycobacterium
ADAEARTAAGRAE

SEQ ID NO: 1188813 - protein, 13 aa, Mycobacterium
ADAEDDDSDHDMG

SEQ ID NO: 1188814 - protein, 16 aa, Mycobacterium
ADAEGPAGGASSSVND

SEQ ID NO: 1188815 - protein, 8 aa, Mycobacterium
ADAEGPLR

SEQ ID NO: 1188816 - protein, 8 aa, Mycobacterium
ADAEGVTK

SEQ ID NO: 1188817 - protein, 7 aa, Mycobacterium
ADAEPVP

SEQ ID NO: 1188818 - protein, 12 aa, Mycobacterium
ADAERRAARGNY

SEQ ID NO: 1188819 - protein, 11 aa, Mycobacterium
ADAESDEASLG

SEQ ID NO: 1188820 - protein, 14 aa, Mycobacterium
ADAESGTATRGRTQ

SEQ ID NO: 1188821 - protein, 12 aa, Mycobacterium
ADAESRARLDQR

SEQ ID NO: 1188822 - protein, 8 aa, Mycobacterium
ADAETPLR

SEQ ID NO: 1188823 - protein, 5 aa, Mycobacterium
ADAFR

SEQ ID NO: 1188824 - protein, 5 aa, Mycobacterium
ADAGD

SEQ ID NO: 1188825 - protein, 5 aa, Mycobacterium
ADAGF

SEQ ID NO: 1188826 - protein, 8 aa, Mycobacterium
ADAGGRPI

SEQ ID NO: 1188827 - protein, 5 aa, Mycobacterium
ADAGK

SEQ ID NO: 1188828 - protein, 10 aa, Mycobacterium
ADAGPKRQAA

SEQ ID NO: 1188829 - protein, 8 aa, Mycobacterium
ADAGPSLT

SEQ ID NO: 1188830 - protein, 12 aa, Mycobacterium
ADAGQRTASRRN

SEQ ID NO: 1188831 - protein, 8 aa, Mycobacterium
ADAGRAAY

SEQ ID NO: 1188832 - protein, 16 aa, Mycobacterium
ADAGSDVQDWRSQEGL

SEQ ID NO: 1188833 - protein, 12 aa, Mycobacterium
ADAGSPSSRDLG

SEQ ID NO: 1188834 - protein, 6 aa, Mycobacterium
ADAGVA

SEQ ID NO: 1188835 - protein, 6 aa, Mycobacterium
ADAHTT

SEQ ID NO: 1188836 - protein, 4 aa, Mycobacterium
ADAI

SEQ ID NO: 1188837 - protein, 18 aa, Mycobacterium
ADANDGNRADGSPGYQAS

SEQ ID NO: 1188838 - protein, 6 aa, Mycobacterium
ADANEH

SEQ ID NO: 1188839 - protein, 5 aa, Mycobacterium
ADANG

SEQ ID NO: 1188840 - protein, 6 aa, Mycobacterium
ADAPAA

SEQ ID NO: 1188841 - protein, 8 aa, Mycobacterium
ADAPADAV

SEQ ID NO: 1188842 - protein, 15 aa, Mycobacterium
ADAPASHDAQTSVLE

SEQ ID NO: 1188843 - protein, 7 aa, Mycobacterium
ADAPDEF

SEQ ID NO: 1188844 - protein, 7 aa, Mycobacterium
ADAPERV

SEQ ID NO: 1188845 - protein, 10 aa, Mycobacterium
ADAPLGDAAA

SEQ ID NO: 1188846 - protein, 6 aa, Mycobacterium
ADAPPM

SEQ ID NO: 1188847 - protein, 5 aa, Mycobacterium
ADAPR

SEQ ID NO: 1188848 - protein, 9 aa, Mycobacterium
ADAPSTVND

SEQ ID NO: 1188849 - protein, 8 aa, Mycobacterium
ADAQGLPE

SEQ ID NO: 1188850 - protein, 6 aa, Mycobacterium
ADAQGT

SEQ ID NO: 1188851 - protein, 6 aa, Mycobacterium
ADAQRP

SEQ ID NO: 1188852 - protein, 17 aa, Mycobacterium
ADAQTDESLGPADRPDT

SEQ ID NO: 1188853 - protein, 8 aa, Mycobacterium
ADAQTRRD

SEQ ID NO: 1188854 - protein, 11 aa, Mycobacterium
ADARAPASAPW

SEQ ID NO: 1188855 - protein, 6 aa, Mycobacterium
ADAREG

SEQ ID NO: 1188856 - protein, 14 aa, Mycobacterium
ADAREQAKTRSQTK

SEQ ID NO: 1188857 - protein, 6 aa, Mycobacterium
ADARGR

SEQ ID NO: 1188858 - protein, 6 aa, Mycobacterium
ADARPD

SEQ ID NO: 1188859 - protein, 16 aa, Mycobacterium
ADARSRNNQSRRSYYT

SEQ ID NO: 1188860 - protein, 9 aa, Mycobacterium
ADASAASQR

SEQ ID NO: 1188861 - protein, 9 aa, Mycobacterium
ADASAEDMS

SEQ ID NO: 1188862 - protein, 19 aa, Mycobacterium
ADASALGYAEADPTADVEG

SEQ ID NO: 1188863 - protein, 11 aa, Mycobacterium
ADASDTGLPAG

SEQ ID NO: 1188864 - protein, 9 aa, Mycobacterium
ADASGDALG

SEQ ID NO: 1188865 - protein, 6 aa, Mycobacterium
ADASGL

SEQ ID NO: 1188866 - protein, 6 aa, Mycobacterium
ADASPI

SEQ ID NO: 1188867 - protein, 9 aa, Mycobacterium
ADASSDREK

SEQ ID NO: 1188868 - protein, 9 aa, Mycobacterium
ADASTDDGI

SEQ ID NO: 1188869 - protein, 18 aa, Mycobacterium
ADASTGTPGTPGPGGVAT

SEQ ID NO: 1188870 - protein, 4 aa, Mycobacterium
ADAT

SEQ ID NO: 1188871 - protein, 8 aa, Mycobacterium
ADATEGSA

SEQ ID NO: 1188872 - protein, 8 aa, Mycobacterium
ADATGAAV

SEQ ID NO: 1188873 - protein, 9 aa, Mycobacterium
ADATGRHRS

SEQ ID NO: 1188874 - protein, 7 aa, Mycobacterium
ADATGRQ

SEQ ID NO: 1188875 - protein, 13 aa, Mycobacterium
ADATPPADWDRPL

SEQ ID NO: 1188876 - protein, 12 aa, Mycobacterium
ADATPTKGDPTR

SEQ ID NO: 1188877 - protein, 9 aa, Mycobacterium
ADATSGQYT

SEQ ID NO: 1188878 - protein, 4 aa, Mycobacterium
ADAV

SEQ ID NO: 1188879 - protein, 6 aa, Mycobacterium
ADAVAP

SEQ ID NO: 1188880 - protein, 17 aa, Mycobacterium
ADAVRPQGRSCAPGDRS

SEQ ID NO: 1188881 - protein, 9 aa, Mycobacterium
ADAVSRDPQ

SEQ ID NO: 1188882 - protein, 10 aa, Mycobacterium
ADCRPDGESA

SEQ ID NO: 1188883 - protein, 5 aa, Mycobacterium
ADDAA

SEQ ID NO: 1188884 - protein, 6 aa, Mycobacterium
ADDAAR

SEQ ID NO: 1188885 - protein, 7 aa, Mycobacterium
ADDAAYA

SEQ ID NO: 1188886 - protein, 5 aa, Mycobacterium
ADDAD

SEQ ID NO: 1188887 - protein, 13 aa, Mycobacterium
ADDAGEQPGSSSD

SEQ ID NO: 1188888 - protein, 5 aa, Mycobacterium
ADDAL

SEQ ID NO: 1188889 - protein, 6 aa, Mycobacterium
ADDAPV

SEQ ID NO: 1188890 - protein, 11 aa, Mycobacterium
ADDASGSWDPH

SEQ ID NO: 1188891 - protein, 16 aa, Mycobacterium
ADDATASGDVAVGSGA

SEQ ID NO: 1188892 - protein, 7 aa, Mycobacterium
ADDATLA

SEQ ID NO: 1188893 - protein, 11 aa, Mycobacterium
ADDAYKVPGSQ

SEQ ID NO: 1188894 - protein, 15 aa, Mycobacterium
ADDDAAGFDPQEPTV

SEQ ID NO: 1188895 - protein, 10 aa, Mycobacterium
ADDDDFGQAG

SEQ ID NO: 1188896 - protein, 7 aa, Mycobacterium
ADDDQKK

SEQ ID NO: 1188897 - protein, 7 aa, Mycobacterium
ADDDRSV

SEQ ID NO: 1188898 - protein, 7 aa, Mycobacterium
ADDDSAE

SEQ ID NO: 1188899 - protein, 6 aa, Mycobacterium
ADDDTA

SEQ ID NO: 1188900 - protein, 10 aa, Mycobacterium
ADDDTGGQEM

SEQ ID NO: 1188901 - protein, 7 aa, Mycobacterium
ADDDTTI

SEQ ID NO: 1188902 - protein, 5 aa, Mycobacterium
ADDDY

SEQ ID NO: 1188903 - protein, 8 aa, Mycobacterium
ADDEEDLG

SEQ ID NO: 1188904 - protein, 6 aa, Mycobacterium
ADDEES

SEQ ID NO: 1188905 - protein, 7 aa, Mycobacterium
ADDEPYQ

SEQ ID NO: 1188906 - protein, 8 aa, Mycobacterium
ADDETRAV

SEQ ID NO: 1188907 - protein, 16 aa, Mycobacterium
ADDGAEHLSEDEVAEV

SEQ ID NO: 1188908 - protein, 9 aa, Mycobacterium
ADDGAGPAT

SEQ ID NO: 1188909 - protein, 9 aa, Mycobacterium
ADDGGPLSR

SEQ ID NO: 1188910 - protein, 9 aa, Mycobacterium
ADDGGSLDA

SEQ ID NO: 1188911 - protein, 10 aa, Mycobacterium
ADDGTGDPAK

SEQ ID NO: 1188912 - protein, 7 aa, Mycobacterium
ADDGTPL

SEQ ID NO: 1188913 - protein, 13 aa, Mycobacterium
ADDGTVLGAGETG

SEQ ID NO: 1188914 - protein, 6 aa, Mycobacterium
ADDGVA

SEQ ID NO: 1188915 - protein, 16 aa, Mycobacterium
ADDIDPGDHTPGFDLF

SEQ ID NO: 1188916 - protein, 6 aa, Mycobacterium
ADDIPP

SEQ ID NO: 1188917 - protein, 13 aa, Mycobacterium
ADDKADADKAAAD

SEQ ID NO: 1188918 - protein, 10 aa, Mycobacterium
ADDKGGNRAF

SEQ ID NO: 1188919 - protein, 4 aa, Mycobacterium
ADDL

SEQ ID NO: 1188920 - protein, 11 aa, Mycobacterium
ADDLGGSNSGQ

SEQ ID NO: 1188921 - protein, 13 aa, Mycobacterium
ADDLTAQGHRAPG

SEQ ID NO: 1188922 - protein, 6 aa, Mycobacterium
ADDMAR

SEQ ID NO: 1188923 - protein, 8 aa, Mycobacterium
ADDPADPR

SEQ ID NO: 1188924 - protein, 13 aa, Mycobacterium
ADDPALTRANPVD

SEQ ID NO: 1188925 - protein, 11 aa, Mycobacterium
ADDPATDPRQR

SEQ ID NO: 1188926 - protein, 7 aa, Mycobacterium
ADDPCDA

SEQ ID NO: 1188927 - protein, 16 aa, Mycobacterium
ADDPELGADPQRNNDF

SEQ ID NO: 1188928 - protein, 6 aa, Mycobacterium
ADDPEW

SEQ ID NO: 1188929 - protein, 6 aa, Mycobacterium
ADDPGE

SEQ ID NO: 1188930 - protein, 7 aa, Mycobacterium
ADDPLRR

SEQ ID NO: 1188931 - protein, 6 aa, Mycobacterium
ADDPMA

SEQ ID NO: 1188932 - protein, 8 aa, Mycobacterium
ADDPQHRA

SEQ ID NO: 1188933 - protein, 6 aa, Mycobacterium
ADDPQW

SEQ ID NO: 1188934 - protein, 8 aa, Mycobacterium
ADDPRLAR

SEQ ID NO: 1188935 - protein, 9 aa, Mycobacterium
ADDPRRNTT

SEQ ID NO: 1188936 - protein, 7 aa, Mycobacterium
ADDPRRR

SEQ ID NO: 1188937 - protein, 8 aa, Mycobacterium
ADDPRVSP

SEQ ID NO: 1188938 - protein, 7 aa, Mycobacterium
ADDRAKT

SEQ ID NO: 1188939 - protein, 6 aa, Mycobacterium
ADDRDH

SEQ ID NO: 1188940 - protein, 8 aa, Mycobacterium
ADDREARQ

SEQ ID NO: 1188941 - protein, 8 aa, Mycobacterium
ADDRGEKF

SEQ ID NO: 1188942 - protein, 9 aa, Mycobacterium
ADDRHGPNL

SEQ ID NO: 1188943 - protein, 8 aa, Mycobacterium
ADDRRAGA

SEQ ID NO: 1188944 - protein, 9 aa, Mycobacterium
ADDSDLDDA

SEQ ID NO: 1188945 - protein, 6 aa, Mycobacterium
ADDSGT

SEQ ID NO: 1188946 - protein, 12 aa, Mycobacterium
ADDSPSAKRARL

SEQ ID NO: 1188947 - protein, 7 aa, Mycobacterium
ADDSRES

SEQ ID NO: 1188948 - protein, 7 aa, Mycobacterium
ADDSVDQ

SEQ ID NO: 1188949 - protein, 8 aa, Mycobacterium
ADDTDTWP

SEQ ID NO: 1188950 - protein, 4 aa, Mycobacterium
ADDV

SEQ ID NO: 1188951 - protein, 11 aa, Mycobacterium
ADDVDAAGDRV

SEQ ID NO: 1188952 - protein, 4 aa, Mycobacterium
ADDY

SEQ ID NO: 1188953 - protein, 5 aa, Mycobacterium
ADEAA

SEQ ID NO: 1188954 - protein, 11 aa, Mycobacterium
ADEARAAGQDI

SEQ ID NO: 1188955 - protein, 8 aa, Mycobacterium
ADEARPSR

SEQ ID NO: 1188956 - protein, 9 aa, Mycobacterium
ADEARREAL

SEQ ID NO: 1188957 - protein, 7 aa, Mycobacterium
ADEASAL

SEQ ID NO: 1188958 - protein, 4 aa, Mycobacterium
ADED

SEQ ID NO: 1188959 - protein, 11 aa, Mycobacterium
ADEDGQSFTDD

SEQ ID NO: 1188960 - protein, 8 aa, Mycobacterium
ADEDPAGL

SEQ ID NO: 1188961 - protein, 7 aa, Mycobacterium
ADEDQRR

SEQ ID NO: 1188962 - protein, 7 aa, Mycobacterium
ADEEDRH

SEQ ID NO: 1188963 - protein, 8 aa, Mycobacterium
ADEERAAS

SEQ ID NO: 1188964 - protein, 7 aa, Mycobacterium
ADEESAR

SEQ ID NO: 1188965 - protein, 6 aa, Mycobacterium
ADEFTR

SEQ ID NO: 1188966 - protein, 7 aa, Mycobacterium
ADEGAAK

SEQ ID NO: 1188967 - protein, 6 aa, Mycobacterium
ADEGLD

SEQ ID NO: 1188968 - protein, 18 aa, Mycobacterium
ADEGPTAKRIRPRAQGRA

SEQ ID NO: 1188969 - protein, 8 aa, Mycobacterium
ADEGRGKR

SEQ ID NO: 1188970 - protein, 7 aa, Mycobacterium
ADEGRYS

SEQ ID NO: 1188971 - protein, 7 aa, Mycobacterium
ADEGWSS

SEQ ID NO: 1188972 - protein, 5 aa, Mycobacterium
ADEHG

SEQ ID NO: 1188973 - protein, 4 aa, Mycobacterium
ADEI

SEQ ID NO: 1188974 - protein, 7 aa, Mycobacterium
ADEIDAA

SEQ ID NO: 1188975 - protein, 6 aa, Mycobacterium
ADEIGG

SEQ ID NO: 1188976 - protein, 10 aa, Mycobacterium
ADELAEPALP

SEQ ID NO: 1188977 - protein, 5 aa, Mycobacterium
ADELG

SEQ ID NO: 1188978 - protein, 11 aa, Mycobacterium
ADELRTAKQQP

SEQ ID NO: 1188979 - protein, 6 aa, Mycobacterium
ADELTG

SEQ ID NO: 1188980 - protein, 4 aa, Mycobacterium
ADEN

SEQ ID NO: 1188981 - protein, 15 aa, Mycobacterium
ADENGTRFTNDGTGR

SEQ ID NO: 1188982 - protein, 10 aa, Mycobacterium
ADEPDPDVTK

SEQ ID NO: 1188983 - protein, 7 aa, Mycobacterium
ADEPRLS

SEQ ID NO: 1188984 - protein, 8 aa, Mycobacterium
ADEPSPAG

SEQ ID NO: 1188985 - protein, 13 aa, Mycobacterium
ADEPSSDTPAYQQ

SEQ ID NO: 1188986 - protein, 7 aa, Mycobacterium
ADEPVEE

SEQ ID NO: 1188987 - protein, 5 aa, Mycobacterium
ADEQA

SEQ ID NO: 1188988 - protein, 5 aa, Mycobacterium
ADEQP

SEQ ID NO: 1188989 - protein, 17 aa, Mycobacterium
ADEQRHRLPPSREPDDG

SEQ ID NO: 1188990 - protein, 7 aa, Mycobacterium
ADEQSRL

SEQ ID NO: 1188991 - protein, 4 aa, Mycobacterium
ADER

SEQ ID NO: 1188992 - protein, 5 aa, Mycobacterium
ADERI

SEQ ID NO: 1188993 - protein, 8 aa, Mycobacterium
ADESDGSL

SEQ ID NO: 1188994 - protein, 9 aa, Mycobacterium
ADESDHDQA

SEQ ID NO: 1188995 - protein, 12 aa, Mycobacterium
ADESEHAGAVDE

SEQ ID NO: 1188996 - protein, 12 aa, Mycobacterium
ADESIPAGERAK

SEQ ID NO: 1188997 - protein, 8 aa, Mycobacterium
ADESYGAE

SEQ ID NO: 1188998 - protein, 8 aa, Mycobacterium
ADETEVRY

SEQ ID NO: 1188999 - protein, 4 aa, Mycobacterium
ADEV

SEQ ID NO: 1189000 - protein, 11 aa, Mycobacterium
ADEVDEPDAID

SEQ ID NO: 1189001 - protein, 21 aa, Mycobacterium
ADEVTATNAEDGVARVLERWW

SEQ ID NO: 1189002 - protein, 14 aa, Mycobacterium
ADEYGQPGNYAAGA

SEQ ID NO: 1189003 - protein, 4 aa, Mycobacterium
ADFA

SEQ ID NO: 1189004 - protein, 6 aa, Mycobacterium
ADFAGS

SEQ ID NO: 1189005 - protein, 6 aa, Mycobacterium
ADFDEA

SEQ ID NO: 1189006 - protein, 8 aa, Mycobacterium
ADFPEATT

SEQ ID NO: 1189007 - protein, 5 aa, Mycobacterium
ADFRD

SEQ ID NO: 1189008 - protein, 12 aa, Mycobacterium
ADFSDEGERYRH

SEQ ID NO: 1189009 - protein, 12 aa, Mycobacterium
ADFSDSEHTGSA

SEQ ID NO: 1189010 - protein, 8 aa, Mycobacterium
ADGAALGD

SEQ ID NO: 1189011 - protein, 8 aa, Mycobacterium
ADGAATED

SEQ ID NO: 1189012 - protein, 9 aa, Mycobacterium
ADGADRGDD

SEQ ID NO: 1189013 - protein, 7 aa, Mycobacterium
ADGADSL

SEQ ID NO: 1189014 - protein, 7 aa, Mycobacterium
ADGADVA

SEQ ID NO: 1189015 - protein, 14 aa, Mycobacterium
ADGAEVSRGKGADC

SEQ ID NO: 1189016 - protein, 12 aa, Mycobacterium
ADGAGEGSDEHY

SEQ ID NO: 1189017 - protein, 21 aa, Mycobacterium
ADGAGGAAVPGVAPNALTSSA

SEQ ID NO: 1189018 - protein, 6 aa, Mycobacterium
ADGAGT

SEQ ID NO: 1189019 - protein, 8 aa, Mycobacterium
ADGAINRG

SEQ ID NO: 1189020 - protein, 5 aa, Mycobacterium
ADGAL

SEQ ID NO: 1189021 - protein, 18 aa, Mycobacterium
ADGALSTPPAATPDPTAA

SEQ ID NO: 1189022 - protein, 9 aa, Mycobacterium
ADGANAEAE

SEQ ID NO: 1189023 - protein, 15 aa, Mycobacterium
ADGAPAKQGRRMPGT

SEQ ID NO: 1189024 - protein, 14 aa, Mycobacterium
ADGAPLAMSPRNSL

SEQ ID NO: 1189025 - protein, 14 aa, Mycobacterium
ADGAPLVAESGAGR

SEQ ID NO: 1189026 - protein, 9 aa, Mycobacterium
ADGARSKVA

SEQ ID NO: 1189027 - protein, 8 aa, Mycobacterium
ADGASAAL

SEQ ID NO: 1189028 - protein, 6 aa, Mycobacterium
ADGASF

SEQ ID NO: 1189029 - protein, 5 aa, Mycobacterium
ADGAV

SEQ ID NO: 1189030 - protein, 8 aa, Mycobacterium
ADGDEVPA

SEQ ID NO: 1189031 - protein, 14 aa, Mycobacterium
ADGDGDGAADSAEY

SEQ ID NO: 1189032 - protein, 6 aa, Mycobacterium
ADGDGR

SEQ ID NO: 1189033 - protein, 12 aa, Mycobacterium
ADGDGSVLAVAR

SEQ ID NO: 1189034 - protein, 6 aa, Mycobacterium
ADGDLA

SEQ ID NO: 1189035 - protein, 16 aa, Mycobacterium
ADGDPPTRAQAGGRAW

SEQ ID NO: 1189036 - protein, 8 aa, Mycobacterium
ADGDQEKL

SEQ ID NO: 1189037 - protein, 7 aa, Mycobacterium
ADGDSDY

SEQ ID NO: 1189038 - protein, 8 aa, Mycobacterium
ADGDSDYL

SEQ ID NO: 1189039 - protein, 48 aa, Mycobacterium
ADGDSPSDVADEPPSEPGEPSDPSSPSFSPASPPTGASGTIPAPGVES

SEQ ID NO: 1189040 - protein, 9 aa, Mycobacterium
ADGDTTTAD

SEQ ID NO: 1189041 - protein, 14 aa, Mycobacterium
ADGDTTVDQIDGAG

SEQ ID NO: 1189042 - protein, 21 aa, Mycobacterium
ADGEAGRIDRSSRPHTSPMRT

SEQ ID NO: 1189043 - protein, 7 aa, Mycobacterium
ADGEAGT

SEQ ID NO: 1189044 - protein, 8 aa, Mycobacterium
ADGEECSR

SEQ ID NO: 1189045 - protein, 8 aa, Mycobacterium
ADGEHAVE

SEQ ID NO: 1189046 - protein, 13 aa, Mycobacterium
ADGEKAAAADGRA

SEQ ID NO: 1189047 - protein, 7 aa, Mycobacterium
ADGELSR

SEQ ID NO: 1189048 - protein, 8 aa, Mycobacterium
ADGEPGEI

SEQ ID NO: 1189049 - protein, 15 aa, Mycobacterium
ADGERYTAQSPTPRA

SEQ ID NO: 1189050 - protein, 8 aa, Mycobacterium
ADGESAEY

SEQ ID NO: 1189051 - protein, 8 aa, Mycobacterium
ADGESPHE

SEQ ID NO: 1189052 - protein, 10 aa, Mycobacterium
ADGETASQVR

SEQ ID NO: 1189053 - protein, 7 aa, Mycobacterium
ADGFERS

SEQ ID NO: 1189054 - protein, 6 aa, Mycobacterium
ADGFPS

SEQ ID NO: 1189055 - protein, 4 aa, Mycobacterium
ADGG

SEQ ID NO: 1189056 - protein, 8 aa, Mycobacterium
ADGGAHSV

SEQ ID NO: 1189057 - protein, 6 aa, Mycobacterium
ADGGGP

SEQ ID NO: 1189058 - protein, 6 aa, Mycobacterium
ADGGGS

SEQ ID NO: 1189059 - protein, 5 aa, Mycobacterium
ADGGI

SEQ ID NO: 1189060 - protein, 8 aa, Mycobacterium
ADGGIPAR

SEQ ID NO: 1189061 - protein, 5 aa, Mycobacterium
ADGGM

SEQ ID NO: 1189062 - protein, 13 aa, Mycobacterium
ADGGPATTEPWSP

SEQ ID NO: 1189063 - protein, 6 aa, Mycobacterium
ADGGRD

SEQ ID NO: 1189064 - protein, 10 aa, Mycobacterium
ADGGSSAVRG

SEQ ID NO: 1189065 - protein, 8 aa, Mycobacterium
ADGGTFAG

SEQ ID NO: 1189066 - protein, 15 aa, Mycobacterium
ADGHAAQDSATEARE

SEQ ID NO: 1189067 - protein, 26 aa, Mycobacterium
ADGHLSPTPATGRGPDDRQPGFDQQP

SEQ ID NO: 1189068 - protein, 20 aa, Mycobacterium
ADGHSRANVGRSSAEATAQI

SEQ ID NO: 1189069 - protein, 6 aa, Mycobacterium
ADGIDR

SEQ ID NO: 1189070 - protein, 6 aa, Mycobacterium
ADGKAA

SEQ ID NO: 1189071 - protein, 8 aa, Mycobacterium
ADGKPTRV

SEQ ID NO: 1189072 - protein, 8 aa, Mycobacterium
ADGKRYHT

SEQ ID NO: 1189073 - protein, 4 aa, Mycobacterium
ADGL

SEQ ID NO: 1189074 - protein, 49 aa, Mycobacterium
ADGLNGRKLEAQPKSAGDGSDVKRNAHHKRAVGKGDPQIYAGQAGEAKF

SEQ ID NO: 1189075 - protein, 13 aa, Mycobacterium
ADGLTDEGRRDDL

SEQ ID NO: 1189076 - protein, 7 aa, Mycobacterium
ADGMADE

SEQ ID NO: 1189077 - protein, 5 aa, Mycobacterium
ADGMS

SEQ ID NO: 1189078 - protein, 5 aa, Mycobacterium
ADGNF

SEQ ID NO: 1189079 - protein, 10 aa, Mycobacterium
ADGNGDGVGD

SEQ ID NO: 1189080 - protein, 7 aa, Mycobacterium
ADGNPER

SEQ ID NO: 1189081 - protein, 7 aa, Mycobacterium
ADGNPYG

SEQ ID NO: 1189082 - protein, 5 aa, Mycobacterium
ADGNR

SEQ ID NO: 1189083 - protein, 4 aa, Mycobacterium
ADGP

SEQ ID NO: 1189084 - protein, 7 aa, Mycobacterium
ADGPALD

SEQ ID NO: 1189085 - protein, 10 aa, Mycobacterium
ADGPASLRQH

SEQ ID NO: 1189086 - protein, 7 aa, Mycobacterium
ADGPDAV

SEQ ID NO: 1189087 - protein, 7 aa, Mycobacterium
ADGPHSA

SEQ ID NO: 1189088 - protein, 7 aa, Mycobacterium
ADGPKTH

SEQ ID NO: 1189089 - protein, 9 aa, Mycobacterium
ADGPLRADD

SEQ ID NO: 1189090 - protein, 18 aa, Mycobacterium
ADGPLTRTTVTRRDVGPH

SEQ ID NO: 1189091 - protein, 5 aa, Mycobacterium
ADGQE

SEQ ID NO: 1189092 - protein, 6 aa, Mycobacterium
ADGQEA

SEQ ID NO: 1189093 - protein, 18 aa, Mycobacterium
ADGQPTGVAAARLLAAEF

SEQ ID NO: 1189094 - protein, 12 aa, Mycobacterium
ADGREGDGGRWA

SEQ ID NO: 1189095 - protein, 6 aa, Mycobacterium
ADGRGA

SEQ ID NO: 1189096 - protein, 6 aa, Mycobacterium
ADGRHR

SEQ ID NO: 1189097 - protein, 6 aa, Mycobacterium
ADGRLD

SEQ ID NO: 1189098 - protein, 9 aa, Mycobacterium
ADGRPAPGV

SEQ ID NO: 1189099 - protein, 7 aa, Mycobacterium
ADGRPRQ

SEQ ID NO: 1189100 - protein, 10 aa, Mycobacterium
ADGRPRRAGV

SEQ ID NO: 1189101 - protein, 23 aa, Mycobacterium
ADGRRDEETVAAQPVDAPPRLTR

SEQ ID NO: 1189102 - protein, 5 aa, Mycobacterium
ADGRT

SEQ ID NO: 1189103 - protein, 6 aa, Mycobacterium
ADGRTA

SEQ ID NO: 1189104 - protein, 7 aa, Mycobacterium
ADGRTGR

SEQ ID NO: 1189105 - protein, 6 aa, Mycobacterium
ADGRTI

SEQ ID NO: 1189106 - protein, 8 aa, Mycobacterium
ADGRTVEG

SEQ ID NO: 1189107 - protein, 16 aa, Mycobacterium
ADGRTVNSYPLPEATG

SEQ ID NO: 1189108 - protein, 11 aa, Mycobacterium
ADGRVSGSAPY

SEQ ID NO: 1189109 - protein, 9 aa, Mycobacterium
ADGSAVTPA

SEQ ID NO: 1189110 - protein, 5 aa, Mycobacterium
ADGSD

SEQ ID NO: 1189111 - protein, 10 aa, Mycobacterium
ADGSDALDGL

SEQ ID NO: 1189112 - protein, 9 aa, Mycobacterium
ADGSHGDTG

SEQ ID NO: 1189113 - protein, 9 aa, Mycobacterium
ADGSHPPEQ

SEQ ID NO: 1189114 - protein, 17 aa, Mycobacterium
ADGSLQSSPVSGGVDAE

SEQ ID NO: 1189115 - protein, 11 aa, Mycobacterium
ADGSLTSEGSH

SEQ ID NO: 1189116 - protein, 8 aa, Mycobacterium
ADGSNPFD

SEQ ID NO: 1189117 - protein, 8 aa, Mycobacterium
ADGSPERV

SEQ ID NO: 1189118 - protein, 6 aa, Mycobacterium
ADGSPH

SEQ ID NO: 1189119 - protein, 6 aa, Mycobacterium
ADGSPL

SEQ ID NO: 1189120 - protein, 7 aa, Mycobacterium
ADGSQID

SEQ ID NO: 1189121 - protein, 5 aa, Mycobacterium
ADGSR

SEQ ID NO: 1189122 - protein, 7 aa, Mycobacterium
ADGSTQI

SEQ ID NO: 1189123 - protein, 10 aa, Mycobacterium
ADGSVTDRAD

SEQ ID NO: 1189124 - protein, 13 aa, Mycobacterium
ADGTATGRALRSA

SEQ ID NO: 1189125 - protein, 12 aa, Mycobacterium
ADGTEQNPNGVG

SEQ ID NO: 1189126 - protein, 9 aa, Mycobacterium
ADGTGCAPS

SEQ ID NO: 1189127 - protein, 5 aa, Mycobacterium
ADGTH

SEQ ID NO: 1189128 - protein, 9 aa, Mycobacterium
ADGTHRDID

SEQ ID NO: 1189129 - protein, 5 aa, Mycobacterium
ADGTN

SEQ ID NO: 1189130 - protein, 9 aa, Mycobacterium
ADGTNAEAE

SEQ ID NO: 1189131 - protein, 8 aa, Mycobacterium
ADGTPIPG

SEQ ID NO: 1189132 - protein, 9 aa, Mycobacterium
ADGTRLEAG

SEQ ID NO: 1189133 - protein, 8 aa, Mycobacterium
ADGTRPRE

SEQ ID NO: 1189134 - protein, 9 aa, Mycobacterium
ADGTSSLEL

SEQ ID NO: 1189135 - protein, 7 aa, Mycobacterium
ADGTSSV

SEQ ID NO: 1189136 - protein, 14 aa, Mycobacterium
ADGTTEFKRSPGGL

SEQ ID NO: 1189137 - protein, 7 aa, Mycobacterium
ADGTTVA

SEQ ID NO: 1189138 - protein, 5 aa, Mycobacterium
ADGTV

SEQ ID NO: 1189139 - protein, 7 aa, Mycobacterium
ADGTVTE

SEQ ID NO: 1189140 - protein, 15 aa, Mycobacterium
ADGTVVSRGKDLGEL

SEQ ID NO: 1189141 - protein, 6 aa, Mycobacterium
ADGTYD

SEQ ID NO: 1189142 - protein, 9 aa, Mycobacterium
ADGTYRPQP

SEQ ID NO: 1189143 - protein, 11 aa, Mycobacterium
ADGVASAKRRA

SEQ ID NO: 1189144 - protein, 12 aa, Mycobacterium
ADGVLGSPGAVE

SEQ ID NO: 1189145 - protein, 7 aa, Mycobacterium
ADGVRAG

SEQ ID NO: 1189146 - protein, 10 aa, Mycobacterium
ADGVTAESSA

SEQ ID NO: 1189147 - protein, 6 aa, Mycobacterium
ADGVTV

SEQ ID NO: 1189148 - protein, 5 aa, Mycobacterium
ADGWQ

SEQ ID NO: 1189149 - protein, 9 aa, Mycobacterium
ADHADAAAA

SEQ ID NO: 1189150 - protein, 6 aa, Mycobacterium
ADHEGL

SEQ ID NO: 1189151 - protein, 9 aa, Mycobacterium
ADHGREPTN

SEQ ID NO: 1189152 - protein, 8 aa, Mycobacterium
ADHPADRL

SEQ ID NO: 1189153 - protein, 6 aa, Mycobacterium
ADHPDE

SEQ ID NO: 1189154 - protein, 7 aa, Mycobacterium
ADHPGTR

SEQ ID NO: 1189155 - protein, 5 aa, Mycobacterium
ADHRV

SEQ ID NO: 1189156 - protein, 8 aa, Mycobacterium
ADHSAGRR

SEQ ID NO: 1189157 - protein, 15 aa, Mycobacterium
ADHSTSPADDGIAEP

SEQ ID NO: 1189158 - protein, 7 aa, Mycobacterium
ADHTGGI

SEQ ID NO: 1189159 - protein, 23 aa, Mycobacterium
ADIDTEATPGFRGTKSDAPTLQA

SEQ ID NO: 1189160 - protein, 18 aa, Mycobacterium
ADIEDESGGDLLDEDADE

SEQ ID NO: 1189161 - protein, 7 aa, Mycobacterium
ADIERSE

SEQ ID NO: 1189162 - protein, 9 aa, Mycobacterium
ADIGTGEQI

SEQ ID NO: 1189163 - protein, 8 aa, Mycobacterium
ADIPPTRF

SEQ ID NO: 1189164 - protein, 6 aa, Mycobacterium
ADIQQD

SEQ ID NO: 1189165 - protein, 10 aa, Mycobacterium
ADIQSKQEGF

SEQ ID NO: 1189166 - protein, 7 aa, Mycobacterium
ADITDGA

SEQ ID NO: 1189167 - protein, 5 aa, Mycobacterium
ADITG

SEQ ID NO: 1189168 - protein, 7 aa, Mycobacterium
ADITTKA

SEQ ID NO: 1189169 - protein, 4 aa, Mycobacterium
ADKG

SEQ ID NO: 1189170 - protein, 12 aa, Mycobacterium
ADKGEKLPAAQR

SEQ ID NO: 1189171 - protein, 24 aa, Mycobacterium
ADKGRRAADAIRTTTPDARISTRP

SEQ ID NO: 1189172 - protein, 11 aa, Mycobacterium
ADKIHTDNPYV

SEQ ID NO: 1189173 - protein, 9 aa, Mycobacterium
ADKKDRVEV

SEQ ID NO: 1189174 - protein, 8 aa, Mycobacterium
ADKPAGPW

SEQ ID NO: 1189175 - protein, 22 aa, Mycobacterium
ADKPEKAAAPAGDPTGGMGGMD

SEQ ID NO: 1189176 - protein, 5 aa, Mycobacterium
ADKQG

SEQ ID NO: 1189177 - protein, 8 aa, Mycobacterium
ADKQNPHS

SEQ ID NO: 1189178 - protein, 8 aa, Mycobacterium
ADKSSRPT

SEQ ID NO: 1189179 - protein, 4 aa, Mycobacterium
ADKT

SEQ ID NO: 1189180 - protein, 12 aa, Mycobacterium
ADKYSRAAGQPL

SEQ ID NO: 1189181 - protein, 5 aa, Mycobacterium
ADLAD

SEQ ID NO: 1189182 - protein, 5 aa, Mycobacterium
ADLDR

SEQ ID NO: 1189183 - protein, 4 aa, Mycobacterium
ADLG

SEQ ID NO: 1189184 - protein, 5 aa, Mycobacterium
ADLGA

SEQ ID NO: 1189185 - protein, 5 aa, Mycobacterium
ADLGD

SEQ ID NO: 1189186 - protein, 10 aa, Mycobacterium
ADLGDEHEKR

SEQ ID NO: 1189187 - protein, 5 aa, Mycobacterium
ADLGP

SEQ ID NO: 1189188 - protein, 5 aa, Mycobacterium
ADLNG

SEQ ID NO: 1189189 - protein, 6 aa, Mycobacterium
ADLPDG

SEQ ID NO: 1189190 - protein, 5 aa, Mycobacterium
ADLPG

SEQ ID NO: 1189191 - protein, 7 aa, Mycobacterium
ADLPGGF

SEQ ID NO: 1189192 - protein, 11 aa, Mycobacterium
ADLPGGRVPSE

SEQ ID NO: 1189193 - protein, 8 aa, Mycobacterium
ADLPRPTA

SEQ ID NO: 1189194 - protein, 10 aa, Mycobacterium
ADLQSKQSQL

SEQ ID NO: 1189195 - protein, 11 aa, Mycobacterium
ADLQSKQSRLQ

SEQ ID NO: 1189196 - protein, 15 aa, Mycobacterium
ADLSERAAGLAPEGV

SEQ ID NO: 1189197 - protein, 7 aa, Mycobacterium
ADLSTPV

SEQ ID NO: 1189198 - protein, 5 aa, Mycobacterium
ADLTA

SEQ ID NO: 1189199 - protein, 5 aa, Mycobacterium
ADLTE

SEQ ID NO: 1189200 - protein, 10 aa, Mycobacterium
ADLTGPIPSD

SEQ ID NO: 1189201 - protein, 7 aa, Mycobacterium
ADLTPQA

SEQ ID NO: 1189202 - protein, 7 aa, Mycobacterium
ADLTQTG

SEQ ID NO: 1189203 - protein, 7 aa, Mycobacterium
ADNAADA

SEQ ID NO: 1189204 - protein, 6 aa, Mycobacterium
ADNAAQ

SEQ ID NO: 1189205 - protein, 9 aa, Mycobacterium
ADNAEVRAR

SEQ ID NO: 1189206 - protein, 6 aa, Mycobacterium
ADNAQA

SEQ ID NO: 1189207 - protein, 8 aa, Mycobacterium
ADNASSGA

SEQ ID NO: 1189208 - protein, 10 aa, Mycobacterium
ADNDPDAHRQ

SEQ ID NO: 1189209 - protein, 6 aa, Mycobacterium
ADNDPL

SEQ ID NO: 1189210 - protein, 4 aa, Mycobacterium
ADNE

SEQ ID NO: 1189211 - protein, 5 aa, Mycobacterium
ADNGN

SEQ ID NO: 1189212 - protein, 8 aa, Mycobacterium
ADNGSTAR

SEQ ID NO: 1189213 - protein, 5 aa, Mycobacterium
ADNGY

SEQ ID NO: 1189214 - protein, 8 aa, Mycobacterium
ADNLPSGD

SEQ ID NO: 1189215 - protein, 7 aa, Mycobacterium
ADNPAMS

SEQ ID NO: 1189216 - protein, 4 aa, Mycobacterium
ADNR

SEQ ID NO: 1189217 - protein, 15 aa, Mycobacterium
ADNTESERYSPGERY

SEQ ID NO: 1189218 - protein, 8 aa, Mycobacterium
ADNYQDKA

SEQ ID NO: 1189219 - protein, 6 aa, Mycobacterium
ADPAAA

SEQ ID NO: 1189220 - protein, 12 aa, Mycobacterium
ADPAARAAGLGP

SEQ ID NO: 1189221 - protein, 7 aa, Mycobacterium
ADPADVR

SEQ ID NO: 1189222 - protein, 13 aa, Mycobacterium
ADPAEPGPSGVSR

SEQ ID NO: 1189223 - protein, 11 aa, Mycobacterium
ADPAGAPPSRR

SEQ ID NO: 1189224 - protein, 14 aa, Mycobacterium
ADPAGGRRAAVDRG

SEQ ID NO: 1189225 - protein, 15 aa, Mycobacterium
ADPAGIGLTSPDDLA

SEQ ID NO: 1189226 - protein, 8 aa, Mycobacterium
ADPAGISE

SEQ ID NO: 1189227 - protein, 8 aa, Mycobacterium
ADPAGQLG

SEQ ID NO: 1189228 - protein, 5 aa, Mycobacterium
ADPAI

SEQ ID NO: 1189229 - protein, 5 aa, Mycobacterium
ADPAL

SEQ ID NO: 1189230 - protein, 5 aa, Mycobacterium
ADPAP

SEQ ID NO: 1189231 - protein, 12 aa, Mycobacterium
ADPAPAGASQLP

SEQ ID NO: 1189232 - protein, 8 aa, Mycobacterium
ADPAPASA

SEQ ID NO: 1189233 - protein, 5 aa, Mycobacterium
ADPAR

SEQ ID NO: 1189234 - protein, 7 aa, Mycobacterium
ADPARRV

SEQ ID NO: 1189235 - protein, 7 aa, Mycobacterium
ADPASIE

SEQ ID NO: 1189236 - protein, 7 aa, Mycobacterium
ADPASTP

SEQ ID NO: 1189237 - protein, 12 aa, Mycobacterium
ADPATAAARDQL

SEQ ID NO: 1189238 - protein, 8 aa, Mycobacterium
ADPATLSR

SEQ ID NO: 1189239 - protein, 5 aa, Mycobacterium
ADPAV

SEQ ID NO: 1189240 - protein, 9 aa, Mycobacterium
ADPDAAGKM

SEQ ID NO: 1189241 - protein, 21 aa, Mycobacterium
ADPDALRASSSSRRREAPDRN

SEQ ID NO: 1189242 - protein, 7 aa, Mycobacterium
ADPDART

SEQ ID NO: 1189243 - protein, 7 aa, Mycobacterium
ADPDDAD

SEQ ID NO: 1189244 - protein, 7 aa, Mycobacterium
ADPDDAE

SEQ ID NO: 1189245 - protein, 8 aa, Mycobacterium
ADPDFDTR

SEQ ID NO: 1189246 - protein, 19 aa, Mycobacterium
ADPDGGNLADRAGRQSAAT

SEQ ID NO: 1189247 - protein, 8 aa, Mycobacterium
ADPDNDQR

SEQ ID NO: 1189248 - protein, 8 aa, Mycobacterium
ADPDRADD

SEQ ID NO: 1189249 - protein, 8 aa, Mycobacterium
ADPDRAER

SEQ ID NO: 1189250 - protein, 7 aa, Mycobacterium
ADPDSIA

SEQ ID NO: 1189251 - protein, 7 aa, Mycobacterium
ADPDTEN

SEQ ID NO: 1189252 - protein, 10 aa, Mycobacterium
ADPDTGYARD

SEQ ID NO: 1189253 - protein, 6 aa, Mycobacterium
ADPDTY

SEQ ID NO: 1189254 - protein, 9 aa, Mycobacterium
ADPEAAGKM

SEQ ID NO: 1189255 - protein, 5 aa, Mycobacterium
ADPED

SEQ ID NO: 1189256 - protein, 8 aa, Mycobacterium
ADPEGELG

SEQ ID NO: 1189257 - protein, 14 aa, Mycobacterium
ADPEGRSPAGSQLR

SEQ ID NO: 1189258 - protein, 6 aa, Mycobacterium
ADPERH

SEQ ID NO: 1189259 - protein, 7 aa, Mycobacterium
ADPERRA

SEQ ID NO: 1189260 - protein, 16 aa, Mycobacterium
ADPEVVAGRRNLANAL

SEQ ID NO: 1189261 - protein, 7 aa, Mycobacterium
ADPGADH

SEQ ID NO: 1189262 - protein, 11 aa, Mycobacterium
ADPGDVPAGLE

SEQ ID NO: 1189263 - protein, 9 aa, Mycobacterium
ADPGGPGCG

SEQ ID NO: 1189264 - protein, 5 aa, Mycobacterium
ADPGI

SEQ ID NO: 1189265 - protein, 5 aa, Mycobacterium
ADPGL

SEQ ID NO: 1189266 - protein, 7 aa, Mycobacterium
ADPGLGA

SEQ ID NO: 1189267 - protein, 7 aa, Mycobacterium
ADPGPGF

SEQ ID NO: 1189268 - protein, 6 aa, Mycobacterium
ADPGQR

SEQ ID NO: 1189269 - protein, 8 aa, Mycobacterium
ADPGRPTN

SEQ ID NO: 1189270 - protein, 7 aa, Mycobacterium
ADPGRRG

SEQ ID NO: 1189271 - protein, 12 aa, Mycobacterium
ADPGRVDPQGRR

SEQ ID NO: 1189272 - protein, 6 aa, Mycobacterium
ADPGSF

SEQ ID NO: 1189273 - protein, 7 aa, Mycobacterium
ADPGVRS

SEQ ID NO: 1189274 - protein, 5 aa, Mycobacterium
ADPHA

SEQ ID NO: 1189275 - protein, 7 aa, Mycobacterium
ADPIEAT

SEQ ID NO: 1189276 - protein, 6 aa, Mycobacterium
ADPLGA

SEQ ID NO: 1189277 - protein, 12 aa, Mycobacterium
ADPLGAGRGEVG

SEQ ID NO: 1189278 - protein, 6 aa, Mycobacterium
ADPLGG

SEQ ID NO: 1189279 - protein, 11 aa, Mycobacterium
ADPLPATPRRD

SEQ ID NO: 1189280 - protein, 6 aa, Mycobacterium
ADPLSH

SEQ ID NO: 1189281 - protein, 4 aa, Mycobacterium
ADPN

SEQ ID NO: 1189282 - protein, 4 aa, Mycobacterium
ADPP

SEQ ID NO: 1189283 - protein, 8 aa, Mycobacterium
ADPPAPTI

SEQ ID NO: 1189284 - protein, 14 aa, Mycobacterium
ADPPDTAEPDDTWD

SEQ ID NO: 1189285 - protein, 6 aa, Mycobacterium
ADPPEL

SEQ ID NO: 1189286 - protein, 5 aa, Mycobacterium
ADPPI

SEQ ID NO: 1189287 - protein, 15 aa, Mycobacterium
ADPPPRASVHERTGT

SEQ ID NO: 1189288 - protein, 8 aa, Mycobacterium
ADPPPVTG

SEQ ID NO: 1189289 - protein, 16 aa, Mycobacterium
ADPPTSAGASSRLPEP

SEQ ID NO: 1189290 - protein, 14 aa, Mycobacterium
ADPQRARRYGVDGR

SEQ ID NO: 1189291 - protein, 11 aa, Mycobacterium
ADPQRKADERR

SEQ ID NO: 1189292 - protein, 17 aa, Mycobacterium
ADPQRRRRYQQARGKGG

SEQ ID NO: 1189293 - protein, 9 aa, Mycobacterium
ADPRGGGAS

SEQ ID NO: 1189294 - protein, 9 aa, Mycobacterium
ADPRGLADS

SEQ ID NO: 1189295 - protein, 8 aa, Mycobacterium
ADPRNRAG

SEQ ID NO: 1189296 - protein, 8 aa, Mycobacterium
ADPRRPQV

SEQ ID NO: 1189297 - protein, 6 aa, Mycobacterium
ADPRSG

SEQ ID NO: 1189298 - protein, 7 aa, Mycobacterium
ADPRVDA

SEQ ID NO: 1189299 - protein, 14 aa, Mycobacterium
ADPSAHRLATPSGR

SEQ ID NO: 1189300 - protein, 10 aa, Mycobacterium
ADPSAPLSDV

SEQ ID NO: 1189301 - protein, 6 aa, Mycobacterium
ADPSAV

SEQ ID NO: 1189302 - protein, 9 aa, Mycobacterium
ADPSHKASA

SEQ ID NO: 1189303 - protein, 8 aa, Mycobacterium
ADPSPEEA

SEQ ID NO: 1189304 - protein, 8 aa, Mycobacterium
ADPSPENA

SEQ ID NO: 1189305 - protein, 10 aa, Mycobacterium
ADPSRGPVAT

SEQ ID NO: 1189306 - protein, 8 aa, Mycobacterium
ADPSRPVA

SEQ ID NO: 1189307 - protein, 6 aa, Mycobacterium
ADPSSD

SEQ ID NO: 1189308 - protein, 9 aa, Mycobacterium
ADPSSLPGA

SEQ ID NO: 1189309 - protein, 8 aa, Mycobacterium
ADPSTRSR

SEQ ID NO: 1189310 - protein, 6 aa, Mycobacterium
ADPSVA

SEQ ID NO: 1189311 - protein, 5 aa, Mycobacterium
ADPTA

SEQ ID NO: 1189312 - protein, 8 aa, Mycobacterium
ADPTAGAA

SEQ ID NO: 1189313 - protein, 11 aa, Mycobacterium
ADPTAYADDQR

SEQ ID NO: 1189314 - protein, 10 aa, Mycobacterium
ADPTEPRDRG

SEQ ID NO: 1189315 - protein, 14 aa, Mycobacterium
ADPTGAGFNLSSIQ

SEQ ID NO: 1189316 - protein, 13 aa, Mycobacterium
ADPTPAGSSQLPA

SEQ ID NO: 1189317 - protein, 6 aa, Mycobacterium
ADPTPV

SEQ ID NO: 1189318 - protein, 11 aa, Mycobacterium
ADPTQLGTAPV

SEQ ID NO: 1189319 - protein, 5 aa, Mycobacterium
ADPTR

SEQ ID NO: 1189320 - protein, 7 aa, Mycobacterium
ADPTRDA

SEQ ID NO: 1189321 - protein, 11 aa, Mycobacterium
ADPVDDERQRL

SEQ ID NO: 1189322 - protein, 6 aa, Mycobacterium
ADPVDP

SEQ ID NO: 1189323 - protein, 9 aa, Mycobacterium
ADPVGLDEA

SEQ ID NO: 1189324 - protein, 9 aa, Mycobacterium
ADPVPPGAC

SEQ ID NO: 1189325 - protein, 6 aa, Mycobacterium
ADPVRA

SEQ ID NO: 1189326 - protein, 15 aa, Mycobacterium
ADPVRPVGTGGGQRV

SEQ ID NO: 1189327 - protein, 9 aa, Mycobacterium
ADPVSARGS

SEQ ID NO: 1189328 - protein, 20 aa, Mycobacterium
ADPVWDSSGELAATEQGRAV

SEQ ID NO: 1189329 - protein, 5 aa, Mycobacterium
ADPYP

SEQ ID NO: 1189330 - protein, 12 aa, Mycobacterium
ADQASAGDQFTL

SEQ ID NO: 1189331 - protein, 5 aa, Mycobacterium
ADQDR

SEQ ID NO: 1189332 - protein, 7 aa, Mycobacterium
ADQHQAR

SEQ ID NO: 1189333 - protein, 14 aa, Mycobacterium
ADQIDSAAAESSDG

SEQ ID NO: 1189334 - protein, 9 aa, Mycobacterium
ADQKTDPAV

SEQ ID NO: 1189335 - protein, 4 aa, Mycobacterium
ADQL

SEQ ID NO: 1189336 - protein, 6 aa, Mycobacterium
ADQLGG

SEQ ID NO: 1189337 - protein, 4 aa, Mycobacterium
ADQP

SEQ ID NO: 1189338 - protein, 10 aa, Mycobacterium
ADQPGPDGGR

SEQ ID NO: 1189339 - protein, 6 aa, Mycobacterium
ADQPLG

SEQ ID NO: 1189340 - protein, 19 aa, Mycobacterium
ADQPLPAPPAGFTPRVRQQ

SEQ ID NO: 1189341 - protein, 17 aa, Mycobacterium
ADQPNATLRRKQARQAA

SEQ ID NO: 1189342 - protein, 8 aa, Mycobacterium
ADQPNGYT

SEQ ID NO: 1189343 - protein, 13 aa, Mycobacterium
ADQPVVEDPAGNG

SEQ ID NO: 1189344 - protein, 5 aa, Mycobacterium
ADQPW

SEQ ID NO: 1189345 - protein, 8 aa, Mycobacterium
ADQRRAAG

SEQ ID NO: 1189346 - protein, 6 aa, Mycobacterium
ADQSSV

SEQ ID NO: 1189347 - protein, 9 aa, Mycobacterium
ADQSTNDEV

SEQ ID NO: 1189348 - protein, 5 aa, Mycobacterium
ADQTR

SEQ ID NO: 1189349 - protein, 4 aa, Mycobacterium
ADQV

SEQ ID NO: 1189350 - protein, 13 aa, Mycobacterium
ADQVDAEGAYPAA

SEQ ID NO: 1189351 - protein, 5 aa, Mycobacterium
ADQVP

SEQ ID NO: 1189352 - protein, 20 aa, Mycobacterium
ADQWESDAASVAEGLAETKR

SEQ ID NO: 1189353 - protein, 7 aa, Mycobacterium
ADRADFT

SEQ ID NO: 1189354 - protein, 9 aa, Mycobacterium
ADRADTLRT

SEQ ID NO: 1189355 - protein, 17 aa, Mycobacterium
ADRAELEGVSADRAPQI

SEQ ID NO: 1189356 - protein, 8 aa, Mycobacterium
ADRAGITS

SEQ ID NO: 1189357 - protein, 14 aa, Mycobacterium
ADRAGSSAQDATEV

SEQ ID NO: 1189358 - protein, 11 aa, Mycobacterium
ADRAKPAVPFG

SEQ ID NO: 1189359 - protein, 12 aa, Mycobacterium
ADRALSKSDEEQ

SEQ ID NO: 1189360 - protein, 9 aa, Mycobacterium
ADRAPRALE

SEQ ID NO: 1189361 - protein, 23 aa, Mycobacterium
ADRAQLSASLNRTRGLLSELARA

SEQ ID NO: 1189362 - protein, 8 aa, Mycobacterium
ADRATASA

SEQ ID NO: 1189363 - protein, 6 aa, Mycobacterium
ADRDQM

SEQ ID NO: 1189364 - protein, 9 aa, Mycobacterium
ADRDRQRWN

SEQ ID NO: 1189365 - protein, 5 aa, Mycobacterium
ADREA

SEQ ID NO: 1189366 - protein, 21 aa, Mycobacterium
ADREASRGALGLSPKQDAEIE

SEQ ID NO: 1189367 - protein, 10 aa, Mycobacterium
ADREEADRLT

SEQ ID NO: 1189368 - protein, 7 aa, Mycobacterium
ADRFGDA

SEQ ID NO: 1189369 - protein, 4 aa, Mycobacterium
ADRG

SEQ ID NO: 1189370 - protein, 11 aa, Mycobacterium
ADRGADARPVA

SEQ ID NO: 1189371 - protein, 7 aa, Mycobacterium
ADRGAGW

SEQ ID NO: 1189372 - protein, 6 aa, Mycobacterium
ADRGAL

SEQ ID NO: 1189373 - protein, 13 aa, Mycobacterium
ADRGDVDPKGGLQ

SEQ ID NO: 1189374 - protein, 6 aa, Mycobacterium
ADRGGI

SEQ ID NO: 1189375 - protein, 8 aa, Mycobacterium
ADRGGREV

SEQ ID NO: 1189376 - protein, 10 aa, Mycobacterium
ADRGNGHPPQ

SEQ ID NO: 1189377 - protein, 7 aa, Mycobacterium
ADRGRVG

SEQ ID NO: 1189378 - protein, 8 aa, Mycobacterium
ADRGSALS

SEQ ID NO: 1189379 - protein, 5 aa, Mycobacterium
ADRGT

SEQ ID NO: 1189380 - protein, 5 aa, Mycobacterium
ADRGV

SEQ ID NO: 1189381 - protein, 6 aa, Mycobacterium
ADRGWG

SEQ ID NO: 1189382 - protein, 4 aa, Mycobacterium
ADRI

SEQ ID NO: 1189383 - protein, 11 aa, Mycobacterium
ADRISSPAVGE

SEQ ID NO: 1189384 - protein, 6 aa, Mycobacterium
ADRKGG

SEQ ID NO: 1189385 - protein, 4 aa, Mycobacterium
ADRL

SEQ ID NO: 1189386 - protein, 9 aa, Mycobacterium
ADRNGRTAL

SEQ ID NO: 1189387 - protein, 22 aa, Mycobacterium
ADRNGVSTDEVAGNPGRYGLTD

SEQ ID NO: 1189388 - protein, 5 aa, Mycobacterium
ADRNS

SEQ ID NO: 1189389 - protein, 5 aa, Mycobacterium
ADRPA

SEQ ID NO: 1189390 - protein, 9 aa, Mycobacterium
ADRPASRKA

SEQ ID NO: 1189391 - protein, 7 aa, Mycobacterium
ADRPERV

SEQ ID NO: 1189392 - protein, 11 aa, Mycobacterium
ADRPESDRDRM

SEQ ID NO: 1189393 - protein, 6 aa, Mycobacterium
ADRPGA

SEQ ID NO: 1189394 - protein, 22 aa, Mycobacterium
ADRPGEDTGAGGDVSQAAYTGD

SEQ ID NO: 1189395 - protein, 6 aa, Mycobacterium
ADRPGR

SEQ ID NO: 1189396 - protein, 12 aa, Mycobacterium
ADRPKQFATTDP

SEQ ID NO: 1189397 - protein, 5 aa, Mycobacterium
ADRPQ

SEQ ID NO: 1189398 - protein, 6 aa, Mycobacterium
ADRPYS

SEQ ID NO: 1189399 - protein, 12 aa, Mycobacterium
ADRQRAPQDPLP

SEQ ID NO: 1189400 - protein, 14 aa, Mycobacterium
ADRQVRPVAPGATA

SEQ ID NO: 1189401 - protein, 4 aa, Mycobacterium
ADRR

SEQ ID NO: 1189402 - protein, 13 aa, Mycobacterium
ADRRGRSLTEGDV

SEQ ID NO: 1189403 - protein, 10 aa, Mycobacterium
ADRRPYTGSL

SEQ ID NO: 1189404 - protein, 8 aa, Mycobacterium
ADRRTAAT

SEQ ID NO: 1189405 - protein, 5 aa, Mycobacterium
ADRRY

SEQ ID NO: 1189406 - protein, 10 aa, Mycobacterium
ADRSPDAPKL

SEQ ID NO: 1189407 - protein, 16 aa, Mycobacterium
ADRSRRPLTSPNELSP

SEQ ID NO: 1189408 - protein, 16 aa, Mycobacterium
ADRSSLRALHASIRAN

SEQ ID NO: 1189409 - protein, 6 aa, Mycobacterium
ADRTAL

SEQ ID NO: 1189410 - protein, 10 aa, Mycobacterium
ADRTGPAAHD

SEQ ID NO: 1189411 - protein, 18 aa, Mycobacterium
ADRTGRLTAGTREAGAAV

SEQ ID NO: 1189412 - protein, 7 aa, Mycobacterium
ADRTGSK

SEQ ID NO: 1189413 - protein, 7 aa, Mycobacterium
ADRTPDA

SEQ ID NO: 1189414 - protein, 7 aa, Mycobacterium
ADRTSTV

SEQ ID NO: 1189415 - protein, 12 aa, Mycobacterium
ADRVDGATAAIP

SEQ ID NO: 1189416 - protein, 9 aa, Mycobacterium
ADRVPSPGL

SEQ ID NO: 1189417 - protein, 7 aa, Mycobacterium
ADRVSGT

SEQ ID NO: 1189418 - protein, 4 aa, Mycobacterium
ADRW

SEQ ID NO: 1189419 - protein, 16 aa, Mycobacterium
ADRYPAQLSGGQQQRV

SEQ ID NO: 1189420 - protein, 7 aa, Mycobacterium
ADRYPEA

SEQ ID NO: 1189421 - protein, 10 aa, Mycobacterium
ADSADPTQVA

SEQ ID NO: 1189422 - protein, 8 aa, Mycobacterium
ADSAEVGA

SEQ ID NO: 1189423 - protein, 8 aa, Mycobacterium
ADSAPTEV

SEQ ID NO: 1189424 - protein, 32 aa, Mycobacterium
ADSARAAALGRKIESASAPDPSRPDSEARSDV

SEQ ID NO: 1189425 - protein, 13 aa, Mycobacterium
ADSAVAKKGNDFA

SEQ ID NO: 1189426 - protein, 11 aa, Mycobacterium
ADSCDAGDDVT

SEQ ID NO: 1189427 - protein, 8 aa, Mycobacterium
ADSDERLT

SEQ ID NO: 1189428 - protein, 9 aa, Mycobacterium
ADSDGNRPD

SEQ ID NO: 1189429 - protein, 16 aa, Mycobacterium
ADSEDTALPVSSGTRA

SEQ ID NO: 1189430 - protein, 6 aa, Mycobacterium
ADSEGT

SEQ ID NO: 1189431 - protein, 8 aa, Mycobacterium
ADSETARR

SEQ ID NO: 1189432 - protein, 9 aa, Mycobacterium
ADSETPLSA

SEQ ID NO: 1189433 - protein, 10 aa, Mycobacterium
ADSGADRADL

SEQ ID NO: 1189434 - protein, 43 aa, Mycobacterium
ADSGELPNTVTATNSASSEQAGAPAAAPAADEAPAATRARRGA

SEQ ID NO: 1189435 - protein, 5 aa, Mycobacterium
ADSGF

SEQ ID NO: 1189436 - protein, 9 aa, Mycobacterium
ADSGHGDSI

SEQ ID NO: 1189437 - protein, 7 aa, Mycobacterium
ADSGISS

SEQ ID NO: 1189438 - protein, 15 aa, Mycobacterium
ADSGLAGAVKTSGAK

SEQ ID NO: 1189439 - protein, 13 aa, Mycobacterium
ADSGNNRVMIWRR

SEQ ID NO: 1189440 - protein, 7 aa, Mycobacterium
ADSGPSV

SEQ ID NO: 1189441 - protein, 6 aa, Mycobacterium
ADSGVA

SEQ ID NO: 1189442 - protein, 7 aa, Mycobacterium
ADSHDTY

SEQ ID NO: 1189443 - protein, 11 aa, Mycobacterium
ADSHKSSRLAE

SEQ ID NO: 1189444 - protein, 11 aa, Mycobacterium
ADSLKSPKRQR

SEQ ID NO: 1189445 - protein, 7 aa, Mycobacterium
ADSNGRD

SEQ ID NO: 1189446 - protein, 14 aa, Mycobacterium
ADSPAAQSDSSTDA

SEQ ID NO: 1189447 - protein, 6 aa, Mycobacterium
ADSPHR

SEQ ID NO: 1189448 - protein, 9 aa, Mycobacterium
ADSPNVGRR

SEQ ID NO: 1189449 - protein, 19 aa, Mycobacterium
ADSPPARAADCADSEAALS

SEQ ID NO: 1189450 - protein, 6 aa, Mycobacterium
ADSPQQ

SEQ ID NO: 1189451 - protein, 7 aa, Mycobacterium
ADSPQQL

SEQ ID NO: 1189452 - protein, 21 aa, Mycobacterium
ADSPTSSGRSSYAKTKGYADR

SEQ ID NO: 1189453 - protein, 5 aa, Mycobacterium
ADSQE

SEQ ID NO: 1189454 - protein, 8 aa, Mycobacterium
ADSRDDAI

SEQ ID NO: 1189455 - protein, 7 aa, Mycobacterium
ADSSQSA

SEQ ID NO: 1189456 - protein, 6 aa, Mycobacterium
ADSSVK

SEQ ID NO: 1189457 - protein, 6 aa, Mycobacterium
ADSTDV

SEQ ID NO: 1189458 - protein, 26 aa, Mycobacterium
ADSTRDEPAPGPSAAVPRPGDGSEPG

SEQ ID NO: 1189459 - protein, 16 aa, Mycobacterium
ADSVDAAPVSPTTQAY

SEQ ID NO: 1189460 - protein, 9 aa, Mycobacterium
ADSVTTPEI

SEQ ID NO: 1189461 - protein, 7 aa, Mycobacterium
ADTAADA

SEQ ID NO: 1189462 - protein, 10 aa, Mycobacterium
ADTAAQSRVP

SEQ ID NO: 1189463 - protein, 6 aa, Mycobacterium
ADTAAR

SEQ ID NO: 1189464 - protein, 10 aa, Mycobacterium
ADTADEIEGN

SEQ ID NO: 1189465 - protein, 12 aa, Mycobacterium
ADTADTAAQPCY

SEQ ID NO: 1189466 - protein, 7 aa, Mycobacterium
ADTAGVE

SEQ ID NO: 1189467 - protein, 13 aa, Mycobacterium
ADTALADAAPLSH

SEQ ID NO: 1189468 - protein, 7 aa, Mycobacterium
ADTATNR

SEQ ID NO: 1189469 - protein, 4 aa, Mycobacterium
ADTD

SEQ ID NO: 1189470 - protein, 18 aa, Mycobacterium
ADTDEPARGGNSSAAEPA

SEQ ID NO: 1189471 - protein, 8 aa, Mycobacterium
ADTDPAPW

SEQ ID NO: 1189472 - protein, 8 aa, Mycobacterium
ADTDPLTG

SEQ ID NO: 1189473 - protein, 8 aa, Mycobacterium
ADTDQSRA

SEQ ID NO: 1189474 - protein, 6 aa, Mycobacterium
ADTEAD

SEQ ID NO: 1189475 - protein, 8 aa, Mycobacterium
ADTEDGRS

SEQ ID NO: 1189476 - protein, 14 aa, Mycobacterium
ADTEINGAPVRAGD

SEQ ID NO: 1189477 - protein, 16 aa, Mycobacterium
ADTGAEALETARKRGW

SEQ ID NO: 1189478 - protein, 6 aa, Mycobacterium
ADTGAI

SEQ ID NO: 1189479 - protein, 7 aa, Mycobacterium
ADTGRGF

SEQ ID NO: 1189480 - protein, 8 aa, Mycobacterium
ADTGSGSI

SEQ ID NO: 1189481 - protein, 4 aa, Mycobacterium
ADTH

SEQ ID NO: 1189482 - protein, 4 aa, Mycobacterium
ADTI

SEQ ID NO: 1189483 - protein, 7 aa, Mycobacterium
ADTKKRM

SEQ ID NO: 1189484 - protein, 11 aa, Mycobacterium
ADTLDDEDTVG

SEQ ID NO: 1189485 - protein, 5 aa, Mycobacterium
ADTLG

SEQ ID NO: 1189486 - protein, 11 aa, Mycobacterium
ADTMDSAAEKV

SEQ ID NO: 1189487 - protein, 4 aa, Mycobacterium
ADTN

SEQ ID NO: 1189488 - protein, 7 aa, Mycobacterium
ADTPAAA

SEQ ID NO: 1189489 - protein, 7 aa, Mycobacterium
ADTPAEH

SEQ ID NO: 1189490 - protein, 11 aa, Mycobacterium
ADTPHGRDPEI

SEQ ID NO: 1189491 - protein, 8 aa, Mycobacterium
ADTPRAHI

SEQ ID NO: 1189492 - protein, 7 aa, Mycobacterium
ADTPTSA

SEQ ID NO: 1189493 - protein, 20 aa, Mycobacterium
ADTPVADGLTDADGRITGLG

SEQ ID NO: 1189494 - protein, 8 aa, Mycobacterium
ADTRNMTR

SEQ ID NO: 1189495 - protein, 16 aa, Mycobacterium
ADTSAEERKAAGDKRS

SEQ ID NO: 1189496 - protein, 9 aa, Mycobacterium
ADTSAGGDA

SEQ ID NO: 1189497 - protein, 12 aa, Mycobacterium
ADTTANPTARSM

SEQ ID NO: 1189498 - protein, 5 aa, Mycobacterium
ADTTD

SEQ ID NO: 1189499 - protein, 7 aa, Mycobacterium
ADTTGLP

SEQ ID NO: 1189500 - protein, 9 aa, Mycobacterium
ADTTRQTRV

SEQ ID NO: 1189501 - protein, 11 aa, Mycobacterium
ADTTTGARGDR

SEQ ID NO: 1189502 - protein, 4 aa, Mycobacterium
ADTV

SEQ ID NO: 1189503 - protein, 10 aa, Mycobacterium
ADTVADATAS

SEQ ID NO: 1189504 - protein, 9 aa, Mycobacterium
ADTVSGDPH

SEQ ID NO: 1189505 - protein, 6 aa, Mycobacterium
ADTWTA

SEQ ID NO: 1189506 - protein, 4 aa, Mycobacterium
ADTY

SEQ ID NO: 1189507 - protein, 6 aa, Mycobacterium
ADTYTQ

SEQ ID NO: 1189508 - protein, 9 aa, Mycobacterium
ADVAADSGS

SEQ ID NO: 1189509 - protein, 7 aa, Mycobacterium
ADVAEDA

SEQ ID NO: 1189510 - protein, 11 aa, Mycobacterium
ADVAELGAQDI

SEQ ID NO: 1189511 - protein, 4 aa, Mycobacterium
ADVD

SEQ ID NO: 1189512 - protein, 12 aa, Mycobacterium
ADVDENSRFPQE

SEQ ID NO: 1189513 - protein, 6 aa, Mycobacterium
ADVDTA

SEQ ID NO: 1189514 - protein, 10 aa, Mycobacterium
ADVDTHNADP

SEQ ID NO: 1189515 - protein, 15 aa, Mycobacterium
ADVEDDGVPAAGTRL

SEQ ID NO: 1189516 - protein, 10 aa, Mycobacterium
ADVEETSDKI

SEQ ID NO: 1189517 - protein, 4 aa, Mycobacterium
ADVG

SEQ ID NO: 1189518 - protein, 17 aa, Mycobacterium
ADVGQRVASPSGAPEFG

SEQ ID NO: 1189519 - protein, 7 aa, Mycobacterium
ADVKTRS

SEQ ID NO: 1189520 - protein, 4 aa, Mycobacterium
ADVP

SEQ ID NO: 1189521 - protein, 4 aa, Mycobacterium
ADVR

SEQ ID NO: 1189522 - protein, 7 aa, Mycobacterium
ADVRDAA

SEQ ID NO: 1189523 - protein, 12 aa, Mycobacterium
ADVSNSDQLGDA

SEQ ID NO: 1189524 - protein, 6 aa, Mycobacterium
ADVSPR

SEQ ID NO: 1189525 - protein, 4 aa, Mycobacterium
ADVT

SEQ ID NO: 1189526 - protein, 21 aa, Mycobacterium
ADVTASDVATARQTVRPSLDP

SEQ ID NO: 1189527 - protein, 16 aa, Mycobacterium
ADVTDEDIRRLRKVLL

SEQ ID NO: 1189528 - protein, 6 aa, Mycobacterium
ADVTPR

SEQ ID NO: 1189529 - protein, 6 aa, Mycobacterium
ADVVQD

SEQ ID NO: 1189530 - protein, 4 aa, Mycobacterium
ADWA

SEQ ID NO: 1189531 - protein, 4 aa, Mycobacterium
ADWD

SEQ ID NO: 1189532 - protein, 4 aa, Mycobacterium
ADYA

SEQ ID NO: 1189533 - protein, 7 aa, Mycobacterium
ADYAGTG

SEQ ID NO: 1189534 - protein, 5 aa, Mycobacterium
ADYAR

SEQ ID NO: 1189535 - protein, 20 aa, Mycobacterium
ADYDDSTLDADLPGRAATAG

SEQ ID NO: 1189536 - protein, 5 aa, Mycobacterium
ADYER

SEQ ID NO: 1189537 - protein, 7 aa, Mycobacterium
ADYPEQR

SEQ ID NO: 1189538 - protein, 4 aa, Mycobacterium
ADYQ

SEQ ID NO: 1189539 - protein, 13 aa, Mycobacterium
ADYSAALAAFLSP

SEQ ID NO: 1189540 - protein, 17 aa, Mycobacterium
AEAAAASRAAAEDTTDR

SEQ ID NO: 1189541 - protein, 10 aa, Mycobacterium
AEAAAPVSRP

SEQ ID NO: 1189542 - protein, 11 aa, Mycobacterium
AEAAATAARGA

SEQ ID NO: 1189543 - protein, 8 aa, Mycobacterium
AEAADGAA

SEQ ID NO: 1189544 - protein, 12 aa, Mycobacterium
AEAAEAIPFFEL

SEQ ID NO: 1189545 - protein, 13 aa, Mycobacterium
AEAAEEAVSAEAE

SEQ ID NO: 1189546 - protein, 7 aa, Mycobacterium
AEAAELG

SEQ ID NO: 1189547 - protein, 5 aa, Mycobacterium
AEAAG

SEQ ID NO: 1189548 - protein, 25 aa, Mycobacterium
AEAAGEAVEPEPQPAGDGASAGPLV

SEQ ID NO: 1189549 - protein, 7 aa, Mycobacterium
AEAAGKF

SEQ ID NO: 1189550 - protein, 20 aa, Mycobacterium
AEAAGKPKDLTSVEKSDLEE

SEQ ID NO: 1189551 - protein, 10 aa, Mycobacterium
AEAAKYAPKP

SEQ ID NO: 1189552 - protein, 32 aa, Mycobacterium
AEAAPEGRPEQGPRASARPEQGPRASARPARF

SEQ ID NO: 1189553 - protein, 8 aa, Mycobacterium
AEAAPQPQ

SEQ ID NO: 1189554 - protein, 10 aa, Mycobacterium
AEAAQDAGQT

SEQ ID NO: 1189555 - protein, 16 aa, Mycobacterium
AEAARPHRVTHRKLTR

SEQ ID NO: 1189556 - protein, 11 aa, Mycobacterium
AEAARRPHADR

SEQ ID NO: 1189557 - protein, 7 aa, Mycobacterium
AEAATST

SEQ ID NO: 1189558 - protein, 15 aa, Mycobacterium
AEAAVAGGDDLTPTL

SEQ ID NO: 1189559 - protein, 8 aa, Mycobacterium
AEAAVSPA

SEQ ID NO: 1189560 - protein, 13 aa, Mycobacterium
AEADAEAAAAAEA

SEQ ID NO: 1189561 - protein, 10 aa, Mycobacterium
AEADESDGSL

SEQ ID NO: 1189562 - protein, 6 aa, Mycobacterium
AEADGP

SEQ ID NO: 1189563 - protein, 5 aa, Mycobacterium
AEADP

SEQ ID NO: 1189564 - protein, 8 aa, Mycobacterium
AEADQDDM

SEQ ID NO: 1189565 - protein, 37 aa, Mycobacterium
AEADQESTISQGDGDAGTTTDSGTSGDSGSTDGGSTA

SEQ ID NO: 1189566 - protein, 22 aa, Mycobacterium
AEADSIEKQYQRGKLNKDERNE

SEQ ID NO: 1189567 - protein, 4 aa, Mycobacterium
AEAE

SEQ ID NO: 1189568 - protein, 9 aa, Mycobacterium
AEAEAAPRE

SEQ ID NO: 1189569 - protein, 24 aa, Mycobacterium
AEAEAMDEADVEKESVKVRKPAPK

SEQ ID NO: 1189570 - protein, 12 aa, Mycobacterium
AEAEASRNPTLG

SEQ ID NO: 1189571 - protein, 5 aa, Mycobacterium
AEAEK

SEQ ID NO: 1189572 - protein, 8 aa, Mycobacterium
AEAEKTRK

SEQ ID NO: 1189573 - protein, 7 aa, Mycobacterium
AEAEQAG

SEQ ID NO: 1189574 - protein, 6 aa, Mycobacterium
AEAERR

SEQ ID NO: 1189575 - protein, 19 aa, Mycobacterium
AEAESLRDTIKNGKGQKKL

SEQ ID NO: 1189576 - protein, 4 aa, Mycobacterium
AEAF

SEQ ID NO: 1189577 - protein, 5 aa, Mycobacterium
AEAFG

SEQ ID NO: 1189578 - protein, 17 aa, Mycobacterium
AEAGAEIARRSRGTPRI

SEQ ID NO: 1189579 - protein, 11 aa, Mycobacterium
AEAGASAPGVR

SEQ ID NO: 1189580 - protein, 6 aa, Mycobacterium
AEAGAT

SEQ ID NO: 1189581 - protein, 8 aa, Mycobacterium
AEAGERAI

SEQ ID NO: 1189582 - protein, 5 aa, Mycobacterium
AEAGG

SEQ ID NO: 1189583 - protein, 10 aa, Mycobacterium
AEAGGNPQLA

SEQ ID NO: 1189584 - protein, 7 aa, Mycobacterium
AEAGGPE

SEQ ID NO: 1189585 - protein, 17 aa, Mycobacterium
AEAGHPIAADKSTDEVV

SEQ ID NO: 1189586 - protein, 6 aa, Mycobacterium
AEAGMS

SEQ ID NO: 1189587 - protein, 11 aa, Mycobacterium
AEAGPDDHTVP

SEQ ID NO: 1189588 - protein, 30 aa, Mycobacterium
AEAGQGGWRTVPGSERDAGHAEGRQSQISG

SEQ ID NO: 1189589 - protein, 10 aa, Mycobacterium
AEAGQTLADD

SEQ ID NO: 1189590 - protein, 9 aa, Mycobacterium
AEAGYPPSR

SEQ ID NO: 1189591 - protein, 21 aa, Mycobacterium
AEAIPAAAPGDRHNQPREASG

SEQ ID NO: 1189592 - protein, 6 aa, Mycobacterium
AEAMRG

SEQ ID NO: 1189593 - protein, 6 aa, Mycobacterium
AEAPAA

SEQ ID NO: 1189594 - protein, 15 aa, Mycobacterium
AEAPHSSATHDSTEQ

SEQ ID NO: 1189595 - protein, 8 aa, Mycobacterium
AEAPLGSY

SEQ ID NO: 1189596 - protein, 6 aa, Mycobacterium
AEAPRV

SEQ ID NO: 1189597 - protein, 8 aa, Mycobacterium
AEAPTRDQ

SEQ ID NO: 1189598 - protein, 4 aa, Mycobacterium
AEAQ

SEQ ID NO: 1189599 - protein, 6 aa, Mycobacterium
AEAQAH

SEQ ID NO: 1189600 - protein, 7 aa, Mycobacterium
AEAQPRP

SEQ ID NO: 1189601 - protein, 8 aa, Mycobacterium
AEAQQGTW

SEQ ID NO: 1189602 - protein, 22 aa, Mycobacterium
AEAQRVAAKGARTVSFPDSPVP

SEQ ID NO: 1189603 - protein, 5 aa, Mycobacterium
AEAQS

SEQ ID NO: 1189604 - protein, 7 aa, Mycobacterium
AEAQTAG

SEQ ID NO: 1189605 - protein, 7 aa, Mycobacterium
AEARFGT

SEQ ID NO: 1189606 - protein, 10 aa, Mycobacterium
AEARNKIRPD

SEQ ID NO: 1189607 - protein, 5 aa, Mycobacterium
AEARP

SEQ ID NO: 1189608 - protein, 15 aa, Mycobacterium
AEARPVDADDDSDTH

SEQ ID NO: 1189609 - protein, 5 aa, Mycobacterium
AEARQ

SEQ ID NO: 1189610 - protein, 6 aa, Mycobacterium
AEARQL

SEQ ID NO: 1189611 - protein, 7 aa, Mycobacterium
AEARRGA

SEQ ID NO: 1189612 - protein, 7 aa, Mycobacterium
AEARRRR

SEQ ID NO: 1189613 - protein, 10 aa, Mycobacterium
AEARRRVEAA

SEQ ID NO: 1189614 - protein, 21 aa, Mycobacterium
AEARSFTGSQAGVVTTGTHGN

SEQ ID NO: 1189615 - protein, 18 aa, Mycobacterium
AEARTAEQIGAYGQPPLS

SEQ ID NO: 1189616 - protein, 7 aa, Mycobacterium
AEASAHG

SEQ ID NO: 1189617 - protein, 7 aa, Mycobacterium
AEASEAW

SEQ ID NO: 1189618 - protein, 8 aa, Mycobacterium
AEASGVTA

SEQ ID NO: 1189619 - protein, 10 aa, Mycobacterium
AEASRHRGQP

SEQ ID NO: 1189620 - protein, 6 aa, Mycobacterium
AEASSH

SEQ ID NO: 1189621 - protein, 4 aa, Mycobacterium
AEAT

SEQ ID NO: 1189622 - protein, 6 aa, Mycobacterium
AEATAT

SEQ ID NO: 1189623 - protein, 16 aa, Mycobacterium
AEATEYPDEAEALSAK

SEQ ID NO: 1189624 - protein, 15 aa, Mycobacterium
AEATGQSVAPGQQRY

SEQ ID NO: 1189625 - protein, 6 aa, Mycobacterium
AEATMA

SEQ ID NO: 1189626 - protein, 6 aa, Mycobacterium
AEATPE

SEQ ID NO: 1189627 - protein, 8 aa, Mycobacterium
AEATRRTF

SEQ ID NO: 1189628 - protein, 8 aa, Mycobacterium
AEAVAGTP

SEQ ID NO: 1189629 - protein, 10 aa, Mycobacterium
AEAVPAPDPV

SEQ ID NO: 1189630 - protein, 5 aa, Mycobacterium
AEAVR

SEQ ID NO: 1189631 - protein, 9 aa, Mycobacterium
AEAVRRNDE

SEQ ID NO: 1189632 - protein, 19 aa, Mycobacterium
AEAYESMDSGRARYRMVLT

SEQ ID NO: 1189633 - protein, 6 aa, Mycobacterium
AEAYGD

SEQ ID NO: 1189634 - protein, 7 aa, Mycobacterium
AEAYNGP

SEQ ID NO: 1189635 - protein, 5 aa, Mycobacterium
AECGE

SEQ ID NO: 1189636 - protein, 8 aa, Mycobacterium
AECGTTHR

SEQ ID NO: 1189637 - protein, 4 aa, Mycobacterium
AEDA

SEQ ID NO: 1189638 - protein, 9 aa, Mycobacterium
AEDAATAYA

SEQ ID NO: 1189639 - protein, 6 aa, Mycobacterium
AEDADL

SEQ ID NO: 1189640 - protein, 6 aa, Mycobacterium
AEDADT

SEQ ID NO: 1189641 - protein, 5 aa, Mycobacterium
AEDAE

SEQ ID NO: 1189642 - protein, 6 aa, Mycobacterium
AEDAPA

SEQ ID NO: 1189643 - protein, 11 aa, Mycobacterium
AEDATDADRRD

SEQ ID NO: 1189644 - protein, 9 aa, Mycobacterium
AEDATSHDK

SEQ ID NO: 1189645 - protein, 4 aa, Mycobacterium
AEDC

SEQ ID NO: 1189646 - protein, 11 aa, Mycobacterium
AEDDGDRLSTS

SEQ ID NO: 1189647 - protein, 7 aa, Mycobacterium
AEDDPTK

SEQ ID NO: 1189648 - protein, 8 aa, Mycobacterium
AEDDSRDK

SEQ ID NO: 1189649 - protein, 5 aa, Mycobacterium
AEDDY

SEQ ID NO: 1189650 - protein, 4 aa, Mycobacterium
AEDF

SEQ ID NO: 1189651 - protein, 9 aa, Mycobacterium
AEDGGDKAE

SEQ ID NO: 1189652 - protein, 9 aa, Mycobacterium
AEDGGTRLT

SEQ ID NO: 1189653 - protein, 8 aa, Mycobacterium
AEDGPRGL

SEQ ID NO: 1189654 - protein, 15 aa, Mycobacterium
AEDGRDETPSAGRDL

SEQ ID NO: 1189655 - protein, 6 aa, Mycobacterium
AEDGRE

SEQ ID NO: 1189656 - protein, 11 aa, Mycobacterium
AEDGSDDRASV

SEQ ID NO: 1189657 - protein, 10 aa, Mycobacterium
AEDIAARTGG

SEQ ID NO: 1189658 - protein, 13 aa, Mycobacterium
AEDKGKALADELG

SEQ ID NO: 1189659 - protein, 15 aa, Mycobacterium
AEDNTVEKTLDPGTA

SEQ ID NO: 1189660 - protein, 13 aa, Mycobacterium
AEDPANNWQPQPG

SEQ ID NO: 1189661 - protein, 12 aa, Mycobacterium
AEDPARGFLPTG

SEQ ID NO: 1189662 - protein, 7 aa, Mycobacterium
AEDPDVA

SEQ ID NO: 1189663 - protein, 9 aa, Mycobacterium
AEDPETGGD

SEQ ID NO: 1189664 - protein, 5 aa, Mycobacterium
AEDPH

SEQ ID NO: 1189665 - protein, 9 aa, Mycobacterium
AEDPPSRAR

SEQ ID NO: 1189666 - protein, 6 aa, Mycobacterium
AEDPRF

SEQ ID NO: 1189667 - protein, 7 aa, Mycobacterium
AEDPRGD

SEQ ID NO: 1189668 - protein, 8 aa, Mycobacterium
AEDPRGDI

SEQ ID NO: 1189669 - protein, 8 aa, Mycobacterium
AEDPSWET

SEQ ID NO: 1189670 - protein, 10 aa, Mycobacterium
AEDPTASKIA

SEQ ID NO: 1189671 - protein, 7 aa, Mycobacterium
AEDPTIA

SEQ ID NO: 1189672 - protein, 6 aa, Mycobacterium
AEDPTK

SEQ ID NO: 1189673 - protein, 6 aa, Mycobacterium
AEDPTL

SEQ ID NO: 1189674 - protein, 5 aa, Mycobacterium
AEDPV

SEQ ID NO: 1189675 - protein, 4 aa, Mycobacterium
AEDQ

SEQ ID NO: 1189676 - protein, 12 aa, Mycobacterium
AEDRARRHGGLT

SEQ ID NO: 1189677 - protein, 6 aa, Mycobacterium
AEDRAT

SEQ ID NO: 1189678 - protein, 18 aa, Mycobacterium
AEDRDSHLPADRRPARGI

SEQ ID NO: 1189679 - protein, 34 aa, Mycobacterium
AEDSDDGVAVGGDGGDGGRIGDGGDGGKATGTFA

SEQ ID NO: 1189680 - protein, 5 aa, Mycobacterium
AEDST

SEQ ID NO: 1189681 - protein, 8 aa, Mycobacterium
AEDTAALA

SEQ ID NO: 1189682 - protein, 7 aa, Mycobacterium
AEDTEEL

SEQ ID NO: 1189683 - protein, 11 aa, Mycobacterium
AEDTPAAAAIK

SEQ ID NO: 1189684 - protein, 7 aa, Mycobacterium
AEDTRRV

SEQ ID NO: 1189685 - protein, 7 aa, Mycobacterium
AEDTTVR

SEQ ID NO: 1189686 - protein, 5 aa, Mycobacterium
AEDVG

SEQ ID NO: 1189687 - protein, 4 aa, Mycobacterium
AEDY

SEQ ID NO: 1189688 - protein, 11 aa, Mycobacterium
AEEAAGKARSA

SEQ ID NO: 1189689 - protein, 10 aa, Mycobacterium
AEEAAPALGP

SEQ ID NO: 1189690 - protein, 13 aa, Mycobacterium
AEEAGKLTPTQRN

SEQ ID NO: 1189691 - protein, 17 aa, Mycobacterium
AEEAKSFADRARTHGLT

SEQ ID NO: 1189692 - protein, 7 aa, Mycobacterium
AEEAPTL

SEQ ID NO: 1189693 - protein, 10 aa, Mycobacterium
AEEARRYGTE

SEQ ID NO: 1189694 - protein, 11 aa, Mycobacterium
AEEAYQKARRV

SEQ ID NO: 1189695 - protein, 10 aa, Mycobacterium
AEEDDTVEVG

SEQ ID NO: 1189696 - protein, 16 aa, Mycobacterium
AEEDRTLPPRLESPEP

SEQ ID NO: 1189697 - protein, 17 aa, Mycobacterium
AEEEPENVDYPKDPEFR

SEQ ID NO: 1189698 - protein, 4 aa, Mycobacterium
AEEG

SEQ ID NO: 1189699 - protein, 15 aa, Mycobacterium
AEEGGSDEVAEADAE

SEQ ID NO: 1189700 - protein, 6 aa, Mycobacterium
AEEGRH

SEQ ID NO: 1189701 - protein, 4 aa, Mycobacterium
AEEH

SEQ ID NO: 1189702 - protein, 4 aa, Mycobacterium
AEEI

SEQ ID NO: 1189703 - protein, 6 aa, Mycobacterium
AEEKAA

SEQ ID NO: 1189704 - protein, 6 aa, Mycobacterium
AEELGM

SEQ ID NO: 1189705 - protein, 5 aa, Mycobacterium
AEEMG

SEQ ID NO: 1189706 - protein, 10 aa, Mycobacterium
AEENEAGGPL

SEQ ID NO: 1189707 - protein, 6 aa, Mycobacterium
AEEPRT

SEQ ID NO: 1189708 - protein, 7 aa, Mycobacterium
AEEQRPY

SEQ ID NO: 1189709 - protein, 21 aa, Mycobacterium
AEERARRRDAQNVAAGLPGDY

SEQ ID NO: 1189710 - protein, 7 aa, Mycobacterium
AEERDAS

SEQ ID NO: 1189711 - protein, 14 aa, Mycobacterium
AEERQRVSQEWSTG

SEQ ID NO: 1189712 - protein, 4 aa, Mycobacterium
AEES

SEQ ID NO: 1189713 - protein, 5 aa, Mycobacterium
AEESG

SEQ ID NO: 1189714 - protein, 7 aa, Mycobacterium
AEESGAD

SEQ ID NO: 1189715 - protein, 6 aa, Mycobacterium
AEESQA

SEQ ID NO: 1189716 - protein, 14 aa, Mycobacterium
AEETADAVGSTAGA

SEQ ID NO: 1189717 - protein, 6 aa, Mycobacterium
AEETGF

SEQ ID NO: 1189718 - protein, 7 aa, Mycobacterium
AEETGIQ

SEQ ID NO: 1189719 - protein, 8 aa, Mycobacterium
AEETGKPL

SEQ ID NO: 1189720 - protein, 12 aa, Mycobacterium
AEETGTAALPAP

SEQ ID NO: 1189721 - protein, 6 aa, Mycobacterium
AEETGY

SEQ ID NO: 1189722 - protein, 5 aa, Mycobacterium
AEETV

SEQ ID NO: 1189723 - protein, 4 aa, Mycobacterium
AEEV

SEQ ID NO: 1189724 - protein, 11 aa, Mycobacterium
AEFATDGDGEA

SEQ ID NO: 1189725 - protein, 4 aa, Mycobacterium
AEFD

SEQ ID NO: 1189726 - protein, 14 aa, Mycobacterium
AEFDDTNQAETTLR

SEQ ID NO: 1189727 - protein, 5 aa, Mycobacterium
AEFEP

SEQ ID NO: 1189728 - protein, 4 aa, Mycobacterium
AEFG

SEQ ID NO: 1189729 - protein, 12 aa, Mycobacterium
AEFGGRDDRSAE

SEQ ID NO: 1189730 - protein, 9 aa, Mycobacterium
AEFGNGTTT

SEQ ID NO: 1189731 - protein, 16 aa, Mycobacterium
AEFRDAADSQGFDEAH

SEQ ID NO: 1189732 - protein, 5 aa, Mycobacterium
AEGAA

SEQ ID NO: 1189733 - protein, 6 aa, Mycobacterium
AEGAEH

SEQ ID NO: 1189734 - protein, 13 aa, Mycobacterium
AEGAQNSGRSPDD

SEQ ID NO: 1189735 - protein, 5 aa, Mycobacterium
AEGAR

SEQ ID NO: 1189736 - protein, 7 aa, Mycobacterium
AEGARRA

SEQ ID NO: 1189737 - protein, 6 aa, Mycobacterium
AEGATV

SEQ ID NO: 1189738 - protein, 4 aa, Mycobacterium
AEGD

SEQ ID NO: 1189739 - protein, 28 aa, Mycobacterium
AEGDADTPRRSRAYRESHTDVSDGAAAT

SEQ ID NO: 1189740 - protein, 7 aa, Mycobacterium
AEGDPHR

SEQ ID NO: 1189741 - protein, 8 aa, Mycobacterium
AEGDQTTL

SEQ ID NO: 1189742 - protein, 6 aa, Mycobacterium
AEGEQL

SEQ ID NO: 1189743 - protein, 6 aa, Mycobacterium
AEGGAW

SEQ ID NO: 1189744 - protein, 12 aa, Mycobacterium
AEGGDAATQAAM

SEQ ID NO: 1189745 - protein, 8 aa, Mycobacterium
AEGGEGGT

SEQ ID NO: 1189746 - protein, 6 aa, Mycobacterium
AEGGEL

SEQ ID NO: 1189747 - protein, 6 aa, Mycobacterium
AEGGGT

SEQ ID NO: 1189748 - protein, 11 aa, Mycobacterium
AEGGNPGAKSS

SEQ ID NO: 1189749 - protein, 7 aa, Mycobacterium
AEGGRAR

SEQ ID NO: 1189750 - protein, 9 aa, Mycobacterium
AEGGRRGAV

SEQ ID NO: 1189751 - protein, 5 aa, Mycobacterium
AEGGV

SEQ ID NO: 1189752 - protein, 4 aa, Mycobacterium
AEGH

SEQ ID NO: 1189753 - protein, 12 aa, Mycobacterium
AEGHVPGKEDEI

SEQ ID NO: 1189754 - protein, 8 aa, Mycobacterium
AEGIPYED

SEQ ID NO: 1189755 - protein, 4 aa, Mycobacterium
AEGK

SEQ ID NO: 1189756 - protein, 7 aa, Mycobacterium
AEGKGDK

SEQ ID NO: 1189757 - protein, 8 aa, Mycobacterium
AEGLDGAE

SEQ ID NO: 1189758 - protein, 9 aa, Mycobacterium
AEGNEAFTG

SEQ ID NO: 1189759 - protein, 7 aa, Mycobacterium
AEGNPEK

SEQ ID NO: 1189760 - protein, 7 aa, Mycobacterium
AEGPAAV

SEQ ID NO: 1189761 - protein, 7 aa, Mycobacterium
AEGPALD

SEQ ID NO: 1189762 - protein, 6 aa, Mycobacterium
AEGPDG

SEQ ID NO: 1189763 - protein, 7 aa, Mycobacterium
AEGPDRA

SEQ ID NO: 1189764 - protein, 6 aa, Mycobacterium
AEGPGE

SEQ ID NO: 1189765 - protein, 7 aa, Mycobacterium
AEGPKNV

SEQ ID NO: 1189766 - protein, 7 aa, Mycobacterium
AEGPPLY

SEQ ID NO: 1189767 - protein, 8 aa, Mycobacterium
AEGPTSTV

SEQ ID NO: 1189768 - protein, 5 aa, Mycobacterium
AEGPV

SEQ ID NO: 1189769 - protein, 9 aa, Mycobacterium
AEGQKSTHG

SEQ ID NO: 1189770 - protein, 8 aa, Mycobacterium
AEGQPAPA

SEQ ID NO: 1189771 - protein, 8 aa, Mycobacterium
AEGQPGPV

SEQ ID NO: 1189772 - protein, 7 aa, Mycobacterium
AEGQPRH

SEQ ID NO: 1189773 - protein, 8 aa, Mycobacterium
AEGREPYQ

SEQ ID NO: 1189774 - protein, 14 aa, Mycobacterium
AEGRNTGKPDHVTA

SEQ ID NO: 1189775 - protein, 8 aa, Mycobacterium
AEGRPGPV

SEQ ID NO: 1189776 - protein, 8 aa, Mycobacterium
AEGSAAKG

SEQ ID NO: 1189777 - protein, 15 aa, Mycobacterium
AEGSAATADGAIDGD

SEQ ID NO: 1189778 - protein, 7 aa, Mycobacterium
AEGSPSR

SEQ ID NO: 1189779 - protein, 6 aa, Mycobacterium
AEGTEF

SEQ ID NO: 1189780 - protein, 5 aa, Mycobacterium
AEGTL

SEQ ID NO: 1189781 - protein, 23 aa, Mycobacterium
AEGTVASGVDENPQAEPSGPVDE

SEQ ID NO: 1189782 - protein, 10 aa, Mycobacterium
AEGVKSEFPD

SEQ ID NO: 1189783 - protein, 14 aa, Mycobacterium
AEGVRAAEAGGGAV

SEQ ID NO: 1189784 - protein, 5 aa, Mycobacterium
AEGVS

SEQ ID NO: 1189785 - protein, 5 aa, Mycobacterium
AEHAR

SEQ ID NO: 1189786 - protein, 5 aa, Mycobacterium
AEHDR

SEQ ID NO: 1189787 - protein, 8 aa, Mycobacterium
AEHDRPRR

SEQ ID NO: 1189788 - protein, 6 aa, Mycobacterium
AEHEGK

SEQ ID NO: 1189789 - protein, 7 aa, Mycobacterium
AEHEGKP

SEQ ID NO: 1189790 - protein, 10 aa, Mycobacterium
AEHGGIDAPA

SEQ ID NO: 1189791 - protein, 6 aa, Mycobacterium
AEHGPP

SEQ ID NO: 1189792 - protein, 10 aa, Mycobacterium
AEHGPSAAAI

SEQ ID NO: 1189793 - protein, 5 aa, Mycobacterium
AEHGS

SEQ ID NO: 1189794 - protein, 13 aa, Mycobacterium
AEHGTVEHDDSGL

SEQ ID NO: 1189795 - protein, 9 aa, Mycobacterium
AEHGVSRSV

SEQ ID NO: 1189796 - protein, 6 aa, Mycobacterium
AEHPDA

SEQ ID NO: 1189797 - protein, 7 aa, Mycobacterium
AEHPDDK

SEQ ID NO: 1189798 - protein, 10 aa, Mycobacterium
AEHPDEVAEA

SEQ ID NO: 1189799 - protein, 8 aa, Mycobacterium
AEHPDKVE

SEQ ID NO: 1189800 - protein, 8 aa, Mycobacterium
AEHPGATS

SEQ ID NO: 1189801 - protein, 6 aa, Mycobacterium
AEHPGS

SEQ ID NO: 1189802 - protein, 6 aa, Mycobacterium
AEHPRL

SEQ ID NO: 1189803 - protein, 8 aa, Mycobacterium
AEHRGEGI

SEQ ID NO: 1189804 - protein, 9 aa, Mycobacterium
AEHSGNRRA

SEQ ID NO: 1189805 - protein, 13 aa, Mycobacterium
AEHYSNDGHRACN

SEQ ID NO: 1189806 - protein, 6 aa, Mycobacterium
AEIDPT

SEQ ID NO: 1189807 - protein, 13 aa, Mycobacterium
AEIDTADAQNLEE

SEQ ID NO: 1189808 - protein, 9 aa, Mycobacterium
AEIGSPRSW

SEQ ID NO: 1189809 - protein, 6 aa, Mycobacterium
AEIPAS

SEQ ID NO: 1189810 - protein, 12 aa, Mycobacterium
AEIPPPDERRAY

SEQ ID NO: 1189811 - protein, 6 aa, Mycobacterium
AEIRER

SEQ ID NO: 1189812 - protein, 5 aa, Mycobacterium
AEIRS

SEQ ID NO: 1189813 - protein, 6 aa, Mycobacterium
AEIRSQ

SEQ ID NO: 1189814 - protein, 6 aa, Mycobacterium
AEISAG

SEQ ID NO: 1189815 - protein, 5 aa, Mycobacterium
AEISK

SEQ ID NO: 1189816 - protein, 5 aa, Mycobacterium
AEKAG

SEQ ID NO: 1189817 - protein, 8 aa, Mycobacterium
AEKANAAA

SEQ ID NO: 1189818 - protein, 10 aa, Mycobacterium
AEKEPDPSAA

SEQ ID NO: 1189819 - protein, 15 aa, Mycobacterium
AEKERIQEATTPMAE

SEQ ID NO: 1189820 - protein, 6 aa, Mycobacterium
AEKGVA

SEQ ID NO: 1189821 - protein, 4 aa, Mycobacterium
AEKH

SEQ ID NO: 1189822 - protein, 15 aa, Mycobacterium
AEKKAAKNLLVGSSA

SEQ ID NO: 1189823 - protein, 9 aa, Mycobacterium
AEKLGGEDV

SEQ ID NO: 1189824 - protein, 8 aa, Mycobacterium
AEKLTQES

SEQ ID NO: 1189825 - protein, 9 aa, Mycobacterium
AEKPGDPGV

SEQ ID NO: 1189826 - protein, 6 aa, Mycobacterium
AEKQAR

SEQ ID NO: 1189827 - protein, 15 aa, Mycobacterium
AEKRDSRFEDAARRD

SEQ ID NO: 1189828 - protein, 9 aa, Mycobacterium
AEKSAAQGI

SEQ ID NO: 1189829 - protein, 8 aa, Mycobacterium
AEKSLKGA

SEQ ID NO: 1189830 - protein, 12 aa, Mycobacterium
AELAADPHAERY

SEQ ID NO: 1189831 - protein, 10 aa, Mycobacterium
AELADATDRE

SEQ ID NO: 1189832 - protein, 11 aa, Mycobacterium
AELAGSADERS

SEQ ID NO: 1189833 - protein, 16 aa, Mycobacterium
AELANAKERANASIAP

SEQ ID NO: 1189834 - protein, 9 aa, Mycobacterium
AELARSNSD

SEQ ID NO: 1189835 - protein, 15 aa, Mycobacterium
AELDAPSVAGHERRL

SEQ ID NO: 1189836 - protein, 5 aa, Mycobacterium
AELDE

SEQ ID NO: 1189837 - protein, 18 aa, Mycobacterium
AELDSKARNRSVRQRARE

SEQ ID NO: 1189838 - protein, 12 aa, Mycobacterium
AELEGKTVQQRG

SEQ ID NO: 1189839 - protein, 10 aa, Mycobacterium
AELGADPDRL

SEQ ID NO: 1189840 - protein, 7 aa, Mycobacterium
AELGAEA

SEQ ID NO: 1189841 - protein, 6 aa, Mycobacterium
AELGAT

SEQ ID NO: 1189842 - protein, 6 aa, Mycobacterium
AELGDT

SEQ ID NO: 1189843 - protein, 7 aa, Mycobacterium
AELGEAA

SEQ ID NO: 1189844 - protein, 6 aa, Mycobacterium
AELGNP

SEQ ID NO: 1189845 - protein, 7 aa, Mycobacterium
AELGPRD

SEQ ID NO: 1189846 - protein, 8 aa, Mycobacterium
AELKDPAP

SEQ ID NO: 1189847 - protein, 8 aa, Mycobacterium
AELNGIRG

SEQ ID NO: 1189848 - protein, 13 aa, Mycobacterium
AELNQRSQHKTPG

SEQ ID NO: 1189849 - protein, 4 aa, Mycobacterium
AELP

SEQ ID NO: 1189850 - protein, 6 aa, Mycobacterium
AELPAA

SEQ ID NO: 1189851 - protein, 7 aa, Mycobacterium
AELPADP

SEQ ID NO: 1189852 - protein, 8 aa, Mycobacterium
AELPAEDS

SEQ ID NO: 1189853 - protein, 6 aa, Mycobacterium
AELPDR

SEQ ID NO: 1189854 - protein, 12 aa, Mycobacterium
AELPENALPPEA

SEQ ID NO: 1189855 - protein, 5 aa, Mycobacterium
AELPP

SEQ ID NO: 1189856 - protein, 13 aa, Mycobacterium
AELPTAGSGDAEL

SEQ ID NO: 1189857 - protein, 7 aa, Mycobacterium
AELRPRA

SEQ ID NO: 1189858 - protein, 6 aa, Mycobacterium
AELSAT

SEQ ID NO: 1189859 - protein, 7 aa, Mycobacterium
AELSETG

SEQ ID NO: 1189860 - protein, 5 aa, Mycobacterium
AELSP

SEQ ID NO: 1189861 - protein, 5 aa, Mycobacterium
AELTD

SEQ ID NO: 1189862 - protein, 25 aa, Mycobacterium
AELTTAPGGTPAGDQGAVGKTFDGA

SEQ ID NO: 1189863 - protein, 8 aa, Mycobacterium
AELTTRET

SEQ ID NO: 1189864 - protein, 8 aa, Mycobacterium
AEMPDQVD

SEQ ID NO: 1189865 - protein, 6 aa, Mycobacterium
AEMSDG

SEQ ID NO: 1189866 - protein, 16 aa, Mycobacterium
AENDDVNRYKASKQAD

SEQ ID NO: 1189867 - protein, 10 aa, Mycobacterium
AENGADATPL

SEQ ID NO: 1189868 - protein, 10 aa, Mycobacterium
AENGSQQAHR

SEQ ID NO: 1189869 - protein, 8 aa, Mycobacterium
AENKGGRY

SEQ ID NO: 1189870 - protein, 11 aa, Mycobacterium
AENMPSARRRA

SEQ ID NO: 1189871 - protein, 6 aa, Mycobacterium
AENNGW

SEQ ID NO: 1189872 - protein, 5 aa, Mycobacterium
AENPA

SEQ ID NO: 1189873 - protein, 5 aa, Mycobacterium
AENPD

SEQ ID NO: 1189874 - protein, 7 aa, Mycobacterium
AENPDLS

SEQ ID NO: 1189875 - protein, 9 aa, Mycobacterium
AENPDRRRE

SEQ ID NO: 1189876 - protein, 9 aa, Mycobacterium
AENPQGDDI

SEQ ID NO: 1189877 - protein, 7 aa, Mycobacterium
AENPTWE

SEQ ID NO: 1189878 - protein, 16 aa, Mycobacterium
AENQRVPGRPRPGVQD

SEQ ID NO: 1189879 - protein, 6 aa, Mycobacterium
AENQTV

SEQ ID NO: 1189880 - protein, 4 aa, Mycobacterium
AENS

SEQ ID NO: 1189881 - protein, 8 aa, Mycobacterium
AENSETAY

SEQ ID NO: 1189882 - protein, 20 aa, Mycobacterium
AENTDDAKASTILDEVLAAA

SEQ ID NO: 1189883 - protein, 18 aa, Mycobacterium
AENTNGLHTDTDRRRAEL

SEQ ID NO: 1189884 - protein, 22 aa, Mycobacterium
AEPAAKYSRTRPSDRKLLVGRH

SEQ ID NO: 1189885 - protein, 9 aa, Mycobacterium
AEPAGDAST

SEQ ID NO: 1189886 - protein, 24 aa, Mycobacterium
AEPAGEDTFTAQTGPAGEDERQVV

SEQ ID NO: 1189887 - protein, 7 aa, Mycobacterium
AEPAHGP

SEQ ID NO: 1189888 - protein, 6 aa, Mycobacterium
AEPAIN

SEQ ID NO: 1189889 - protein, 23 aa, Mycobacterium
AEPAKSAGLPGTDTEHRSDFARD

SEQ ID NO: 1189890 - protein, 18 aa, Mycobacterium
AEPANVTIGGGSSPGGPD

SEQ ID NO: 1189891 - protein, 6 aa, Mycobacterium
AEPARG

SEQ ID NO: 1189892 - protein, 8 aa, Mycobacterium
AEPATVSE

SEQ ID NO: 1189893 - protein, 9 aa, Mycobacterium
AEPAYADGE

SEQ ID NO: 1189894 - protein, 11 aa, Mycobacterium
AEPDAASRAAV

SEQ ID NO: 1189895 - protein, 7 aa, Mycobacterium
AEPDAEA

SEQ ID NO: 1189896 - protein, 6 aa, Mycobacterium
AEPDER

SEQ ID NO: 1189897 - protein, 13 aa, Mycobacterium
AEPDSGAAVIPPD

SEQ ID NO: 1189898 - protein, 8 aa, Mycobacterium
AEPDTDES

SEQ ID NO: 1189899 - protein, 5 aa, Mycobacterium
AEPEE

SEQ ID NO: 1189900 - protein, 9 aa, Mycobacterium
AEPEGPARR

SEQ ID NO: 1189901 - protein, 10 aa, Mycobacterium
AEPELAPGAQ

SEQ ID NO: 1189902 - protein, 9 aa, Mycobacterium
AEPEPDGRR

SEQ ID NO: 1189903 - protein, 9 aa, Mycobacterium
AEPERSRIE

SEQ ID NO: 1189904 - protein, 7 aa, Mycobacterium
AEPESAL

SEQ ID NO: 1189905 - protein, 7 aa, Mycobacterium
AEPGANT

SEQ ID NO: 1189906 - protein, 5 aa, Mycobacterium
AEPGD

SEQ ID NO: 1189907 - protein, 6 aa, Mycobacterium
AEPGEK

SEQ ID NO: 1189908 - protein, 8 aa, Mycobacterium
AEPGGPVR

SEQ ID NO: 1189909 - protein, 6 aa, Mycobacterium
AEPGIR

SEQ ID NO: 1189910 - protein, 5 aa, Mycobacterium
AEPGR

SEQ ID NO: 1189911 - protein, 13 aa, Mycobacterium
AEPGRPEDGGDEG

SEQ ID NO: 1189912 - protein, 8 aa, Mycobacterium
AEPGRSSP

SEQ ID NO: 1189913 - protein, 5 aa, Mycobacterium
AEPGS

SEQ ID NO: 1189914 - protein, 34 aa, Mycobacterium
AEPGTTAVDGMRERANQRAAARRGAAVRRKKGQL

SEQ ID NO: 1189915 - protein, 6 aa, Mycobacterium
AEPGWA

SEQ ID NO: 1189916 - protein, 7 aa, Mycobacterium
AEPKATQ

SEQ ID NO: 1189917 - protein, 14 aa, Mycobacterium
AEPLGEAADASDAI

SEQ ID NO: 1189918 - protein, 9 aa, Mycobacterium
AEPPAPVDP

SEQ ID NO: 1189919 - protein, 6 aa, Mycobacterium
AEPQRL

SEQ ID NO: 1189920 - protein, 15 aa, Mycobacterium
AEPRAKTRNLRRDPR

SEQ ID NO: 1189921 - protein, 5 aa, Mycobacterium
AEPRI

SEQ ID NO: 1189922 - protein, 9 aa, Mycobacterium
AEPRSEHKK

SEQ ID NO: 1189923 - protein, 5 aa, Mycobacterium
AEPSS

SEQ ID NO: 1189924 - protein, 7 aa, Mycobacterium
AEPTAST

SEQ ID NO: 1189925 - protein, 13 aa, Mycobacterium
AEPTAVNSSSAKG

SEQ ID NO: 1189926 - protein, 5 aa, Mycobacterium
AEPTD

SEQ ID NO: 1189927 - protein, 9 aa, Mycobacterium
AEPTDPPEL

SEQ ID NO: 1189928 - protein, 7 aa, Mycobacterium
AEPTPRE

SEQ ID NO: 1189929 - protein, 6 aa, Mycobacterium
AEPTST

SEQ ID NO: 1189930 - protein, 7 aa, Mycobacterium
AEPTTPL

SEQ ID NO: 1189931 - protein, 10 aa, Mycobacterium
AEPTVGGDVT

SEQ ID NO: 1189932 - protein, 7 aa, Mycobacterium
AEPVAGA

SEQ ID NO: 1189933 - protein, 7 aa, Mycobacterium
AEPVDDD

SEQ ID NO: 1189934 - protein, 7 aa, Mycobacterium
AEPVDPV

SEQ ID NO: 1189935 - protein, 6 aa, Mycobacterium
AEPVGD

SEQ ID NO: 1189936 - protein, 6 aa, Mycobacterium
AEPVTE

SEQ ID NO: 1189937 - protein, 5 aa, Mycobacterium
AEPVY

SEQ ID NO: 1189938 - protein, 4 aa, Mycobacterium
AEQA

SEQ ID NO: 1189939 - protein, 8 aa, Mycobacterium
AEQADEEL

SEQ ID NO: 1189940 - protein, 7 aa, Mycobacterium
AEQAGRR

SEQ ID NO: 1189941 - protein, 20 aa, Mycobacterium
AEQAHRDLQGRKTVGSVVLL

SEQ ID NO: 1189942 - protein, 7 aa, Mycobacterium
AEQAKEY

SEQ ID NO: 1189943 - protein, 20 aa, Mycobacterium
AEQAKGATTTFGRAAGDEDA

SEQ ID NO: 1189944 - protein, 9 aa, Mycobacterium
AEQAKGPEI

SEQ ID NO: 1189945 - protein, 9 aa, Mycobacterium
AEQASTRTG

SEQ ID NO: 1189946 - protein, 5 aa, Mycobacterium
AEQDE

SEQ ID NO: 1189947 - protein, 6 aa, Mycobacterium
AEQEAI

SEQ ID NO: 1189948 - protein, 9 aa, Mycobacterium
AEQHADEVD

SEQ ID NO: 1189949 - protein, 6 aa, Mycobacterium
AEQHGY

SEQ ID NO: 1189950 - protein, 4 aa, Mycobacterium
AEQI

SEQ ID NO: 1189951 - protein, 7 aa, Mycobacterium
AEQIRTG

SEQ ID NO: 1189952 - protein, 10 aa, Mycobacterium
AEQKAEARAL

SEQ ID NO: 1189953 - protein, 6 aa, Mycobacterium
AEQKTA

SEQ ID NO: 1189954 - protein, 9 aa, Mycobacterium
AEQNEDPTY

SEQ ID NO: 1189955 - protein, 5 aa, Mycobacterium
AEQPA

SEQ ID NO: 1189956 - protein, 9 aa, Mycobacterium
AEQPDGARV

SEQ ID NO: 1189957 - protein, 7 aa, Mycobacterium
AEQPGED

SEQ ID NO: 1189958 - protein, 11 aa, Mycobacterium
AEQPGLQIPSE

SEQ ID NO: 1189959 - protein, 10 aa, Mycobacterium
AEQPGLQLPS

SEQ ID NO: 1189960 - protein, 8 aa, Mycobacterium
AEQPTGQR

SEQ ID NO: 1189961 - protein, 5 aa, Mycobacterium
AEQPW

SEQ ID NO: 1189962 - protein, 7 aa, Mycobacterium
AEQQQKK

SEQ ID NO: 1189963 - protein, 10 aa, Mycobacterium
AEQQRQLQDR

SEQ ID NO: 1189964 - protein, 6 aa, Mycobacterium
AEQQTL

SEQ ID NO: 1189965 - protein, 4 aa, Mycobacterium
AEQR

SEQ ID NO: 1189966 - protein, 17 aa, Mycobacterium
AEQRHADQLRKSGDPYI

SEQ ID NO: 1189967 - protein, 9 aa, Mycobacterium
AEQRRAGRK

SEQ ID NO: 1189968 - protein, 8 aa, Mycobacterium
AEQRRENE

SEQ ID NO: 1189969 - protein, 9 aa, Mycobacterium
AEQRRLAEA

SEQ ID NO: 1189970 - protein, 4 aa, Mycobacterium
AEQS

SEQ ID NO: 1189971 - protein, 15 aa, Mycobacterium
AEQSAQLKAALRKGR

SEQ ID NO: 1189972 - protein, 11 aa, Mycobacterium
AEQSDDAQPGV

SEQ ID NO: 1189973 - protein, 12 aa, Mycobacterium
AEQSDDATEAGL

SEQ ID NO: 1189974 - protein, 8 aa, Mycobacterium
AEQSESAM

SEQ ID NO: 1189975 - protein, 6 aa, Mycobacterium
AEQSSW

SEQ ID NO: 1189976 - protein, 4 aa, Mycobacterium
AEQT

SEQ ID NO: 1189977 - protein, 6 aa, Mycobacterium
AEQTAT

SEQ ID NO: 1189978 - protein, 8 aa, Mycobacterium
AEQTDDKA

SEQ ID NO: 1189979 - protein, 10 aa, Mycobacterium
AEQTGLPTAP

SEQ ID NO: 1189980 - protein, 13 aa, Mycobacterium
AEQVAKSKSQELS

SEQ ID NO: 1189981 - protein, 5 aa, Mycobacterium
AEQVG

SEQ ID NO: 1189982 - protein, 5 aa, Mycobacterium
AERAA

SEQ ID NO: 1189983 - protein, 10 aa, Mycobacterium
AERADAMPAE

SEQ ID NO: 1189984 - protein, 22 aa, Mycobacterium
AERADTAEDATCREPAPATSNV

SEQ ID NO: 1189985 - protein, 5 aa, Mycobacterium
AERAG

SEQ ID NO: 1189986 - protein, 6 aa, Mycobacterium
AERAGA

SEQ ID NO: 1189987 - protein, 7 aa, Mycobacterium
AERAGIT

SEQ ID NO: 1189988 - protein, 6 aa, Mycobacterium
AERAGK

SEQ ID NO: 1189989 - protein, 8 aa, Mycobacterium
AERAGRDL

SEQ ID NO: 1189990 - protein, 8 aa, Mycobacterium
AERAGTRL

SEQ ID NO: 1189991 - protein, 6 aa, Mycobacterium
AERAGV

SEQ ID NO: 1189992 - protein, 6 aa, Mycobacterium
AERAHA

SEQ ID NO: 1189993 - protein, 20 aa, Mycobacterium
AERAHRDLQGRKTVGSVVLI

SEQ ID NO: 1189994 - protein, 13 aa, Mycobacterium
AERANAQAPTYRV

SEQ ID NO: 1189995 - protein, 6 aa, Mycobacterium
AERAPI

SEQ ID NO: 1189996 - protein, 10 aa, Mycobacterium
AERARAGAGA

SEQ ID NO: 1189997 - protein, 10 aa, Mycobacterium
AERARDGAAT

SEQ ID NO: 1189998 - protein, 10 aa, Mycobacterium
AERARSTAGA

SEQ ID NO: 1189999 - protein, 8 aa, Mycobacterium
AERASLTS

SEQ ID NO: 1190000 - protein, 4 aa, Mycobacterium
AERC

SEQ ID NO: 1190001 - protein, 4 aa, Mycobacterium
AERD

SEQ ID NO: 1190002 - protein, 5 aa, Mycobacterium
AERDA

SEQ ID NO: 1190003 - protein, 11 aa, Mycobacterium
AERDRTGELGD

SEQ ID NO: 1190004 - protein, 15 aa, Mycobacterium
AERDSGRAPAGSSAE

SEQ ID NO: 1190005 - protein, 5 aa, Mycobacterium
AERDY

SEQ ID NO: 1190006 - protein, 17 aa, Mycobacterium
AEREARARAQRAREARV

SEQ ID NO: 1190007 - protein, 8 aa, Mycobacterium
AEREFERS

SEQ ID NO: 1190008 - protein, 7 aa, Mycobacterium
AEREGPD

SEQ ID NO: 1190009 - protein, 8 aa, Mycobacterium
AEREGREL

SEQ ID NO: 1190010 - protein, 8 aa, Mycobacterium
AEREGRLQ

SEQ ID NO: 1190011 - protein, 11 aa, Mycobacterium
AEREHRQQTRL

SEQ ID NO: 1190012 - protein, 11 aa, Mycobacterium
AEREPELRRQA

SEQ ID NO: 1190013 - protein, 15 aa, Mycobacterium
AEREQTAEYAAAARQ

SEQ ID NO: 1190014 - protein, 11 aa, Mycobacterium
AERERAAKRLG

SEQ ID NO: 1190015 - protein, 7 aa, Mycobacterium
AERERQH

SEQ ID NO: 1190016 - protein, 6 aa, Mycobacterium
AERERS

SEQ ID NO: 1190017 - protein, 7 aa, Mycobacterium
AERETAE

SEQ ID NO: 1190018 - protein, 6 aa, Mycobacterium
AERETY

SEQ ID NO: 1190019 - protein, 7 aa, Mycobacterium
AERGAAA

SEQ ID NO: 1190020 - protein, 14 aa, Mycobacterium
AERGAAELGEHATA

SEQ ID NO: 1190021 - protein, 8 aa, Mycobacterium
AERGADGV

SEQ ID NO: 1190022 - protein, 7 aa, Mycobacterium
AERGELR

SEQ ID NO: 1190023 - protein, 11 aa, Mycobacterium
AERGEQPVAQR

SEQ ID NO: 1190024 - protein, 8 aa, Mycobacterium
AERGGTPV

SEQ ID NO: 1190025 - protein, 6 aa, Mycobacterium
AERGKK

SEQ ID NO: 1190026 - protein, 6 aa, Mycobacterium
AERGNP

SEQ ID NO: 1190027 - protein, 8 aa, Mycobacterium
AERGPAPL

SEQ ID NO: 1190028 - protein, 11 aa, Mycobacterium
AERGPTSTRMS

SEQ ID NO: 1190029 - protein, 6 aa, Mycobacterium
AERGRE

SEQ ID NO: 1190030 - protein, 6 aa, Mycobacterium
AERHPG

SEQ ID NO: 1190031 - protein, 17 aa, Mycobacterium
AERHRAKTGRAAVNRPA

SEQ ID NO: 1190032 - protein, 8 aa, Mycobacterium
AERKGDLK

SEQ ID NO: 1190033 - protein, 25 aa, Mycobacterium
AERKKSQFPQLDPPADDYPTFPDKS

SEQ ID NO: 1190034 - protein, 5 aa, Mycobacterium
AERLE

SEQ ID NO: 1190035 - protein, 6 aa, Mycobacterium
AERLTD

SEQ ID NO: 1190036 - protein, 9 aa, Mycobacterium
AERPAGATL

SEQ ID NO: 1190037 - protein, 7 aa, Mycobacterium
AERPALG

SEQ ID NO: 1190038 - protein, 8 aa, Mycobacterium
AERPDDAV

SEQ ID NO: 1190039 - protein, 8 aa, Mycobacterium
AERPDDFS

SEQ ID NO: 1190040 - protein, 6 aa, Mycobacterium
AERPEE

SEQ ID NO: 1190041 - protein, 7 aa, Mycobacterium
AERPEPI

SEQ ID NO: 1190042 - protein, 16 aa, Mycobacterium
AERPGDDGAVPDTGSL

SEQ ID NO: 1190043 - protein, 8 aa, Mycobacterium
AERPPRSL

SEQ ID NO: 1190044 - protein, 20 aa, Mycobacterium
AERPVNPADHPGAPRENLQP

SEQ ID NO: 1190045 - protein, 4 aa, Mycobacterium
AERQ

SEQ ID NO: 1190046 - protein, 7 aa, Mycobacterium
AERQPGE

SEQ ID NO: 1190047 - protein, 9 aa, Mycobacterium
AERQTGELS

SEQ ID NO: 1190048 - protein, 7 aa, Mycobacterium
AERRARR

SEQ ID NO: 1190049 - protein, 7 aa, Mycobacterium
AERRGGI

SEQ ID NO: 1190050 - protein, 6 aa, Mycobacterium
AERRPL

SEQ ID NO: 1190051 - protein, 6 aa, Mycobacterium
AERRRY

SEQ ID NO: 1190052 - protein, 15 aa, Mycobacterium
AERSEKKESNGRSEF

SEQ ID NO: 1190053 - protein, 8 aa, Mycobacterium
AERSERQR

SEQ ID NO: 1190054 - protein, 7 aa, Mycobacterium
AERSIRA

SEQ ID NO: 1190055 - protein, 14 aa, Mycobacterium
AERSRENTAAVASQ

SEQ ID NO: 1190056 - protein, 5 aa, Mycobacterium
AERTG

SEQ ID NO: 1190057 - protein, 9 aa, Mycobacterium
AERTGDARS

SEQ ID NO: 1190058 - protein, 10 aa, Mycobacterium
AERTGLAPGS

SEQ ID NO: 1190059 - protein, 8 aa, Mycobacterium
AERTGSLE

SEQ ID NO: 1190060 - protein, 24 aa, Mycobacterium
AERTGTELDGRNDRVGGGAPAQVM

SEQ ID NO: 1190061 - protein, 12 aa, Mycobacterium
AERTKAVNEPTW

SEQ ID NO: 1190062 - protein, 14 aa, Mycobacterium
AERTNPAGRTGGIA

SEQ ID NO: 1190063 - protein, 6 aa, Mycobacterium
AERTPA

SEQ ID NO: 1190064 - protein, 6 aa, Mycobacterium
AERTPP

SEQ ID NO: 1190065 - protein, 6 aa, Mycobacterium
AERTTA

SEQ ID NO: 1190066 - protein, 6 aa, Mycobacterium
AERTTV

SEQ ID NO: 1190067 - protein, 10 aa, Mycobacterium
AERVARDRDE

SEQ ID NO: 1190068 - protein, 9 aa, Mycobacterium
AERVSPDPA

SEQ ID NO: 1190069 - protein, 5 aa, Mycobacterium
AERWE

SEQ ID NO: 1190070 - protein, 7 aa, Mycobacterium
AERYGRE

SEQ ID NO: 1190071 - protein, 10 aa, Mycobacterium
AESAAGPDAR

SEQ ID NO: 1190072 - protein, 11 aa, Mycobacterium
AESAPETYRQA

SEQ ID NO: 1190073 - protein, 9 aa, Mycobacterium
AESARNSGL

SEQ ID NO: 1190074 - protein, 7 aa, Mycobacterium
AESATPA

SEQ ID NO: 1190075 - protein, 7 aa, Mycobacterium
AESCGQD

SEQ ID NO: 1190076 - protein, 5 aa, Mycobacterium
AESDN

SEQ ID NO: 1190077 - protein, 5 aa, Mycobacterium
AESDP

SEQ ID NO: 1190078 - protein, 15 aa, Mycobacterium
AESDTRAKEHSASLG

SEQ ID NO: 1190079 - protein, 7 aa, Mycobacterium
AESEGKF

SEQ ID NO: 1190080 - protein, 6 aa, Mycobacterium
AESEHL

SEQ ID NO: 1190081 - protein, 14 aa, Mycobacterium
AESEQTGVGSEPEV

SEQ ID NO: 1190082 - protein, 5 aa, Mycobacterium
AESGF

SEQ ID NO: 1190083 - protein, 18 aa, Mycobacterium
AESGSNGTPLNGAEAPVD

SEQ ID NO: 1190084 - protein, 6 aa, Mycobacterium
AESLAD

SEQ ID NO: 1190085 - protein, 5 aa, Mycobacterium
AESLE

SEQ ID NO: 1190086 - protein, 5 aa, Mycobacterium
AESLG

SEQ ID NO: 1190087 - protein, 4 aa, Mycobacterium
AESM

SEQ ID NO: 1190088 - protein, 5 aa, Mycobacterium
AESMP

SEQ ID NO: 1190089 - protein, 4 aa, Mycobacterium
AESP

SEQ ID NO: 1190090 - protein, 8 aa, Mycobacterium
AESPMESE

SEQ ID NO: 1190091 - protein, 11 aa, Mycobacterium
AESPNASGEQL

SEQ ID NO: 1190092 - protein, 6 aa, Mycobacterium
AESQSL

SEQ ID NO: 1190093 - protein, 6 aa, Mycobacterium
AESRES

SEQ ID NO: 1190094 - protein, 65 aa, Mycobacterium
AESRRRSMSESGTLASTGSRRSPTMAPSSSPIATASGTYRRRSSCRTTSAWQPRTSRSPRANAVD

SEQ ID NO: 1190095 - protein, 8 aa, Mycobacterium
AESSPSIV

SEQ ID NO: 1190096 - protein, 13 aa, Mycobacterium
AESSSPDANGVDR

SEQ ID NO: 1190097 - protein, 8 aa, Mycobacterium
AESSTRIR

SEQ ID NO: 1190098 - protein, 13 aa, Mycobacterium
AESSVQAQLDHLR

SEQ ID NO: 1190099 - protein, 4 aa, Mycobacterium
AEST

SEQ ID NO: 1190100 - protein, 6 aa, Mycobacterium
AESTAW

SEQ ID NO: 1190101 - protein, 9 aa, Mycobacterium
AESTPGDTR

SEQ ID NO: 1190102 - protein, 11 aa, Mycobacterium
AESTPQQLGAK

SEQ ID NO: 1190103 - protein, 11 aa, Mycobacterium
AESTVARDRRA

SEQ ID NO: 1190104 - protein, 8 aa, Mycobacterium
AESTVGEN

SEQ ID NO: 1190105 - protein, 4 aa, Mycobacterium
AESV

SEQ ID NO: 1190106 - protein, 4 aa, Mycobacterium
AESY

SEQ ID NO: 1190107 - protein, 17 aa, Mycobacterium
AETAADINENHRNSKYL

SEQ ID NO: 1190108 - protein, 10 aa, Mycobacterium
AETAAGSELA

SEQ ID NO: 1190109 - protein, 6 aa, Mycobacterium
AETAGQ

SEQ ID NO: 1190110 - protein, 7 aa, Mycobacterium
AETAGSE

SEQ ID NO: 1190111 - protein, 7 aa, Mycobacterium
AETAKES

SEQ ID NO: 1190112 - protein, 9 aa, Mycobacterium
AETATGDAE

SEQ ID NO: 1190113 - protein, 4 aa, Mycobacterium
AETD

SEQ ID NO: 1190114 - protein, 17 aa, Mycobacterium
AETDAAAETEAAAETEA

SEQ ID NO: 1190115 - protein, 10 aa, Mycobacterium
AETDARNGAA

SEQ ID NO: 1190116 - protein, 6 aa, Mycobacterium
AETDGG

SEQ ID NO: 1190117 - protein, 14 aa, Mycobacterium
AETDNTKAANRLAS

SEQ ID NO: 1190118 - protein, 24 aa, Mycobacterium
AETDPSGFRTREPAVQDGSGEDAV

SEQ ID NO: 1190119 - protein, 7 aa, Mycobacterium
AETDSGT

SEQ ID NO: 1190120 - protein, 18 aa, Mycobacterium
AETEADADVGDRANDAVR

SEQ ID NO: 1190121 - protein, 11 aa, Mycobacterium
AETEEQETQRA

SEQ ID NO: 1190122 - protein, 5 aa, Mycobacterium
AETEN

SEQ ID NO: 1190123 - protein, 24 aa, Mycobacterium
AETERCRRSGTAQTRPYAALAARA

SEQ ID NO: 1190124 - protein, 5 aa, Mycobacterium
AETET

SEQ ID NO: 1190125 - protein, 7 aa, Mycobacterium
AETGADQ

SEQ ID NO: 1190126 - protein, 5 aa, Mycobacterium
AETGE

SEQ ID NO: 1190127 - protein, 7 aa, Mycobacterium
AETGGPE

SEQ ID NO: 1190128 - protein, 9 aa, Mycobacterium
AETGNGRLK

SEQ ID NO: 1190129 - protein, 11 aa, Mycobacterium
AETGSDDGSRR

SEQ ID NO: 1190130 - protein, 7 aa, Mycobacterium
AETGVTR

SEQ ID NO: 1190131 - protein, 5 aa, Mycobacterium
AETHD

SEQ ID NO: 1190132 - protein, 11 aa, Mycobacterium
AETIGAGLDGG

SEQ ID NO: 1190133 - protein, 7 aa, Mycobacterium
AETKKLP

SEQ ID NO: 1190134 - protein, 11 aa, Mycobacterium
AETNPAEGIDA

SEQ ID NO: 1190135 - protein, 4 aa, Mycobacterium
AETP

SEQ ID NO: 1190136 - protein, 9 aa, Mycobacterium
AETPIERKP

SEQ ID NO: 1190137 - protein, 11 aa, Mycobacterium
AETPIERKPPW

SEQ ID NO: 1190138 - protein, 6 aa, Mycobacterium
AETPVP

SEQ ID NO: 1190139 - protein, 7 aa, Mycobacterium
AETRDDG

SEQ ID NO: 1190140 - protein, 10 aa, Mycobacterium
AETRQGTRVG

SEQ ID NO: 1190141 - protein, 8 aa, Mycobacterium
AETSEAHE

SEQ ID NO: 1190142 - protein, 6 aa, Mycobacterium
AETSLG

SEQ ID NO: 1190143 - protein, 8 aa, Mycobacterium
AETSPNYQ

SEQ ID NO: 1190144 - protein, 16 aa, Mycobacterium
AETTRQLAEAARSRGV

SEQ ID NO: 1190145 - protein, 11 aa, Mycobacterium
AETTSSLTPSR

SEQ ID NO: 1190146 - protein, 19 aa, Mycobacterium
AETTSTAPRRRSARCRPSP

SEQ ID NO: 1190147 - protein, 4 aa, Mycobacterium
AETV

SEQ ID NO: 1190148 - protein, 11 aa, Mycobacterium
AETVGGTTAVS

SEQ ID NO: 1190149 - protein, 5 aa, Mycobacterium
AETVP

SEQ ID NO: 1190150 - protein, 16 aa, Mycobacterium
AETVTTGVGDQATASE

SEQ ID NO: 1190151 - protein, 4 aa, Mycobacterium
AETY

SEQ ID NO: 1190152 - protein, 6 aa, Mycobacterium
AETYGE

SEQ ID NO: 1190153 - protein, 6 aa, Mycobacterium
AETYQD

SEQ ID NO: 1190154 - protein, 25 aa, Mycobacterium
AETYRGPQQGESAADTATSGAVDPA

SEQ ID NO: 1190155 - protein, 26 aa, Mycobacterium
AETYRGPQQGESAADTATSGAVDPAD

SEQ ID NO: 1190156 - protein, 4 aa, Mycobacterium
AEVA

SEQ ID NO: 1190157 - protein, 7 aa, Mycobacterium
AEVAPGI

SEQ ID NO: 1190158 - protein, 13 aa, Mycobacterium
AEVDGNGIRVQPN

SEQ ID NO: 1190159 - protein, 8 aa, Mycobacterium
AEVETGGM

SEQ ID NO: 1190160 - protein, 14 aa, Mycobacterium
AEVGGLARTPTDGD

SEQ ID NO: 1190161 - protein, 9 aa, Mycobacterium
AEVGTSGAF

SEQ ID NO: 1190162 - protein, 11 aa, Mycobacterium
AEVPDARPRSY

SEQ ID NO: 1190163 - protein, 8 aa, Mycobacterium
AEVPGQQR

SEQ ID NO: 1190164 - protein, 10 aa, Mycobacterium
AEVPKSSAEN

SEQ ID NO: 1190165 - protein, 6 aa, Mycobacterium
AEVSES

SEQ ID NO: 1190166 - protein, 6 aa, Mycobacterium
AEVSPR

SEQ ID NO: 1190167 - protein, 32 aa, Mycobacterium
AEVSRNEHRTKNLPEQKAVEEAQAAHREASDR

SEQ ID NO: 1190168 - protein, 14 aa, Mycobacterium
AEVTDEGRTYRGRD

SEQ ID NO: 1190169 - protein, 5 aa, Mycobacterium
AEVTG

SEQ ID NO: 1190170 - protein, 9 aa, Mycobacterium
AEVTGEDPF

SEQ ID NO: 1190171 - protein, 10 aa, Mycobacterium
AEWDEREQTP

SEQ ID NO: 1190172 - protein, 11 aa, Mycobacterium
AEWEDDNGDKR

SEQ ID NO: 1190173 - protein, 15 aa, Mycobacterium
AEYDPQGRFHSWMGR

SEQ ID NO: 1190174 - protein, 6 aa, Mycobacterium
AEYGDP

SEQ ID NO: 1190175 - protein, 12 aa, Mycobacterium
AEYGGAIETRYS

SEQ ID NO: 1190176 - protein, 5 aa, Mycobacterium
AEYPD

SEQ ID NO: 1190177 - protein, 9 aa, Mycobacterium
AEYSAGDTP

SEQ ID NO: 1190178 - protein, 17 aa, Mycobacterium
AEYTQTDRTEKPVGKNI

SEQ ID NO: 1190179 - protein, 15 aa, Mycobacterium
AFASRSTAGGPEPLL

SEQ ID NO: 1190180 - protein, 9 aa, Mycobacterium
AFDDSGAAV

SEQ ID NO: 1190181 - protein, 5 aa, Mycobacterium
AFDGE

SEQ ID NO: 1190182 - protein, 4 aa, Mycobacterium
AFEG

SEQ ID NO: 1190183 - protein, 6 aa, Mycobacterium
AFERSR

SEQ ID NO: 1190184 - protein, 12 aa, Mycobacterium
AFESDDPRGGEA

SEQ ID NO: 1190185 - protein, 7 aa, Mycobacterium
AFESGEA

SEQ ID NO: 1190186 - protein, 7 aa, Mycobacterium
AFGAAPG

SEQ ID NO: 1190187 - protein, 6 aa, Mycobacterium
AFGDSY

SEQ ID NO: 1190188 - protein, 8 aa, Mycobacterium
AFGGDPGR

SEQ ID NO: 1190189 - protein, 7 aa, Mycobacterium
AFGGGGH

SEQ ID NO: 1190190 - protein, 6 aa, Mycobacterium
AFGGPA

SEQ ID NO: 1190191 - protein, 8 aa, Mycobacterium
AFGGPGGN

SEQ ID NO: 1190192 - protein, 5 aa, Mycobacterium
AFGGR

SEQ ID NO: 1190193 - protein, 7 aa, Mycobacterium
AFGGSSA

SEQ ID NO: 1190194 - protein, 6 aa, Mycobacterium
AFGPEV

SEQ ID NO: 1190195 - protein, 4 aa, Mycobacterium
AFGQ

SEQ ID NO: 1190196 - protein, 5 aa, Mycobacterium
AFGQT

SEQ ID NO: 1190197 - protein, 9 aa, Mycobacterium
AFKPDTANG

SEQ ID NO: 1190198 - protein, 49 aa, Mycobacterium
AFPDGSGRRRPVPPPPWNSEDTAAQGNPGGLSPTVPTIAPRRDGGGRPL

SEQ ID NO: 1190199 - protein, 8 aa, Mycobacterium
AFPEGGTV

SEQ ID NO: 1190200 - protein, 7 aa, Mycobacterium
AFPEPDK

SEQ ID NO: 1190201 - protein, 21 aa, Mycobacterium
AFPGTPVVTSGGDDAVATVPQ

SEQ ID NO: 1190202 - protein, 12 aa, Mycobacterium
AFPPTPTTPSLP

SEQ ID NO: 1190203 - protein, 28 aa, Mycobacterium
AFPTSAVGSPAFNPRTAKREARALTAGY

SEQ ID NO: 1190204 - protein, 5 aa, Mycobacterium
AFPYE

SEQ ID NO: 1190205 - protein, 19 aa, Mycobacterium
AFRKDGTITAGSASQISDG

SEQ ID NO: 1190206 - protein, 7 aa, Mycobacterium
AFRPPSS

SEQ ID NO: 1190207 - protein, 5 aa, Mycobacterium
AFSAG

SEQ ID NO: 1190208 - protein, 18 aa, Mycobacterium
AFSASADPENVKVLVTVG

SEQ ID NO: 1190209 - protein, 12 aa, Mycobacterium
AFSGETKATGGV

SEQ ID NO: 1190210 - protein, 7 aa, Mycobacterium
AFSGRYA

SEQ ID NO: 1190211 - protein, 7 aa, Mycobacterium
AFTDAGP

SEQ ID NO: 1190212 - protein, 9 aa, Mycobacterium
AFTEEENRA

SEQ ID NO: 1190213 - protein, 6 aa, Mycobacterium
AFTPTA

SEQ ID NO: 1190214 - protein, 10 aa, Mycobacterium
AFTRQEGQHS

SEQ ID NO: 1190215 - protein, 7 aa, Mycobacterium
AFVSGGD

SEQ ID NO: 1190216 - protein, 17 aa, Mycobacterium
AGAAAADTDDDGALPGG

SEQ ID NO: 1190217 - protein, 9 aa, Mycobacterium
AGAAAGAAF

SEQ ID NO: 1190218 - protein, 9 aa, Mycobacterium
AGAAAGKPV

SEQ ID NO: 1190219 - protein, 14 aa, Mycobacterium
AGAAARRGGTLPEV

SEQ ID NO: 1190220 - protein, 7 aa, Mycobacterium
AGAAASL

SEQ ID NO: 1190221 - protein, 5 aa, Mycobacterium
AGAAE

SEQ ID NO: 1190222 - protein, 5 aa, Mycobacterium
AGAAL

SEQ ID NO: 1190223 - protein, 12 aa, Mycobacterium
AGAAPGQVFARW

SEQ ID NO: 1190224 - protein, 36 aa, Mycobacterium
AGAAPSLPNMAGGKKPDAINGGDAQAGGKAGGNTVS

SEQ ID NO: 1190225 - protein, 15 aa, Mycobacterium
AGAARIDTKATTTAQ

SEQ ID NO: 1190226 - protein, 12 aa, Mycobacterium
AGAARTLFGKDP

SEQ ID NO: 1190227 - protein, 5 aa, Mycobacterium
AGAAS

SEQ ID NO: 1190228 - protein, 11 aa, Mycobacterium
AGAATSAAESI

SEQ ID NO: 1190229 - protein, 5 aa, Mycobacterium
AGAAV

SEQ ID NO: 1190230 - protein, 12 aa, Mycobacterium
AGADDVGRAEED

SEQ ID NO: 1190231 - protein, 6 aa, Mycobacterium
AGADGA

SEQ ID NO: 1190232 - protein, 8 aa, Mycobacterium
AGADGRVE

SEQ ID NO: 1190233 - protein, 12 aa, Mycobacterium
AGADGTRAAKAD

SEQ ID NO: 1190234 - protein, 8 aa, Mycobacterium
AGADPDDP

SEQ ID NO: 1190235 - protein, 6 aa, Mycobacterium
AGADPQ

SEQ ID NO: 1190236 - protein, 10 aa, Mycobacterium
AGADSRTEVH

SEQ ID NO: 1190237 - protein, 6 aa, Mycobacterium
AGAEHP

SEQ ID NO: 1190238 - protein, 9 aa, Mycobacterium
AGAESPKET

SEQ ID NO: 1190239 - protein, 9 aa, Mycobacterium
AGAESPQET

SEQ ID NO: 1190240 - protein, 6 aa, Mycobacterium
AGAETI

SEQ ID NO: 1190241 - protein, 5 aa, Mycobacterium
AGAFG

SEQ ID NO: 1190242 - protein, 4 aa, Mycobacterium
AGAG

SEQ ID NO: 1190243 - protein, 70 aa, Mycobacterium
AGAGDPAATGPTPPEPPASDTPPAGDADQDDDTDDQGDDDQGDQVGRRNREAQYRRRAQAAEAERDQLRG

SEQ ID NO: 1190244 - protein, 7 aa, Mycobacterium
AGAGESI

SEQ ID NO: 1190245 - protein, 18 aa, Mycobacterium
AGAGFSSGADHKSAGSVP

SEQ ID NO: 1190246 - protein, 10 aa, Mycobacterium
AGAGGGGPRR

SEQ ID NO: 1190247 - protein, 5 aa, Mycobacterium
AGAGM

SEQ ID NO: 1190248 - protein, 5 aa, Mycobacterium
AGAGQ

SEQ ID NO: 1190249 - protein, 7 aa, Mycobacterium
AGAGQDV

SEQ ID NO: 1190250 - protein, 5 aa, Mycobacterium
AGAGR

SEQ ID NO: 1190251 - protein, 7 aa, Mycobacterium
AGAGRGF

SEQ ID NO: 1190252 - protein, 5 aa, Mycobacterium
AGAGT

SEQ ID NO: 1190253 - protein, 8 aa, Mycobacterium
AGAGTLSI

SEQ ID NO: 1190254 - protein, 6 aa, Mycobacterium
AGAGVD

SEQ ID NO: 1190255 - protein, 4 aa, Mycobacterium
AGAH

SEQ ID NO: 1190256 - protein, 5 aa, Mycobacterium
AGAHY

SEQ ID NO: 1190257 - protein, 12 aa, Mycobacterium
AGAIPGAEEPGC

SEQ ID NO: 1190258 - protein, 9 aa, Mycobacterium
AGAKQIDGS

SEQ ID NO: 1190259 - protein, 5 aa, Mycobacterium
AGAKR

SEQ ID NO: 1190260 - protein, 4 aa, Mycobacterium
AGAL

SEQ ID NO: 1190261 - protein, 7 aa, Mycobacterium
AGANGVP

SEQ ID NO: 1190262 - protein, 22 aa, Mycobacterium
AGANTGRPHRRKERIPPGPQAL

SEQ ID NO: 1190263 - protein, 8 aa, Mycobacterium
AGAPADPD

SEQ ID NO: 1190264 - protein, 5 aa, Mycobacterium
AGAPD

SEQ ID NO: 1190265 - protein, 6 aa, Mycobacterium
AGAPGG

SEQ ID NO: 1190266 - protein, 10 aa, Mycobacterium
AGAPGGDSYA

SEQ ID NO: 1190267 - protein, 7 aa, Mycobacterium
AGAPGRA

SEQ ID NO: 1190268 - protein, 7 aa, Mycobacterium
AGAPGWN

SEQ ID NO: 1190269 - protein, 7 aa, Mycobacterium
AGAPKHP

SEQ ID NO: 1190270 - protein, 16 aa, Mycobacterium
AGAPLADDAPDPGCGF

SEQ ID NO: 1190271 - protein, 14 aa, Mycobacterium
AGAPPGDDRVAATR

SEQ ID NO: 1190272 - protein, 7 aa, Mycobacterium
AGAPPLE

SEQ ID NO: 1190273 - protein, 13 aa, Mycobacterium
AGAPPRSTGPAKT

SEQ ID NO: 1190274 - protein, 14 aa, Mycobacterium
AGAPPSLLDPPSGC

SEQ ID NO: 1190275 - protein, 8 aa, Mycobacterium
AGAPPVPK

SEQ ID NO: 1190276 - protein, 8 aa, Mycobacterium
AGAPRNAP

SEQ ID NO: 1190277 - protein, 8 aa, Mycobacterium
AGAPRPVS

SEQ ID NO: 1190278 - protein, 8 aa, Mycobacterium
AGAPTSAI

SEQ ID NO: 1190279 - protein, 7 aa, Mycobacterium
AGAPTVK

SEQ ID NO: 1190280 - protein, 11 aa, Mycobacterium
AGAPVAEPAAA

SEQ ID NO: 1190281 - protein, 8 aa, Mycobacterium
AGAQFGAA

SEQ ID NO: 1190282 - protein, 5 aa, Mycobacterium
AGAQP

SEQ ID NO: 1190283 - protein, 8 aa, Mycobacterium
AGAQQCEA

SEQ ID NO: 1190284 - protein, 10 aa, Mycobacterium
AGAQRRVTEA

SEQ ID NO: 1190285 - protein, 18 aa, Mycobacterium
AGAQTEAAPAATGGGGWQ

SEQ ID NO: 1190286 - protein, 6 aa, Mycobacterium
AGAQTG

SEQ ID NO: 1190287 - protein, 5 aa, Mycobacterium
AGARD

SEQ ID NO: 1190288 - protein, 7 aa, Mycobacterium
AGARDEI

SEQ ID NO: 1190289 - protein, 9 aa, Mycobacterium
AGAREHGSV

SEQ ID NO: 1190290 - protein, 5 aa, Mycobacterium
AGARG

SEQ ID NO: 1190291 - protein, 14 aa, Mycobacterium
AGARGGRATERELA

SEQ ID NO: 1190292 - protein, 6 aa, Mycobacterium
AGARKI

SEQ ID NO: 1190293 - protein, 37 aa, Mycobacterium
AGARPSMPNTAGGGGQQPQADPRQQQGQQQGPNSGPM

SEQ ID NO: 1190294 - protein, 10 aa, Mycobacterium
AGARPTPGVT

SEQ ID NO: 1190295 - protein, 5 aa, Mycobacterium
AGARR

SEQ ID NO: 1190296 - protein, 7 aa, Mycobacterium
AGARSAD

SEQ ID NO: 1190297 - protein, 8 aa, Mycobacterium
AGARSAVR

SEQ ID NO: 1190298 - protein, 5 aa, Mycobacterium
AGARY

SEQ ID NO: 1190299 - protein, 12 aa, Mycobacterium
AGARYTWDGETT

SEQ ID NO: 1190300 - protein, 4 aa, Mycobacterium
AGAS

SEQ ID NO: 1190301 - protein, 5 aa, Mycobacterium
AGASA

SEQ ID NO: 1190302 - protein, 7 aa, Mycobacterium
AGASIRD

SEQ ID NO: 1190303 - protein, 12 aa, Mycobacterium
AGASRRDPALGP

SEQ ID NO: 1190304 - protein, 8 aa, Mycobacterium
AGASTGGF

SEQ ID NO: 1190305 - protein, 7 aa, Mycobacterium
AGATCGD

SEQ ID NO: 1190306 - protein, 7 aa, Mycobacterium
AGATDAL

SEQ ID NO: 1190307 - protein, 8 aa, Mycobacterium
AGATEDVA

SEQ ID NO: 1190308 - protein, 6 aa, Mycobacterium
AGATFA

SEQ ID NO: 1190309 - protein, 8 aa, Mycobacterium
AGATVRTG

SEQ ID NO: 1190310 - protein, 11 aa, Mycobacterium
AGATVTQTDDG

SEQ ID NO: 1190311 - protein, 4 aa, Mycobacterium
AGAV

SEQ ID NO: 1190312 - protein, 6 aa, Mycobacterium
AGAVAA

SEQ ID NO: 1190313 - protein, 7 aa, Mycobacterium
AGAVGTE

SEQ ID NO: 1190314 - protein, 8 aa, Mycobacterium
AGAVPAAD

SEQ ID NO: 1190315 - protein, 8 aa, Mycobacterium
AGAVPGPF

SEQ ID NO: 1190316 - protein, 11 aa, Mycobacterium
AGAYPSTEQTL

SEQ ID NO: 1190317 - protein, 7 aa, Mycobacterium
AGCGPAG

SEQ ID NO: 1190318 - protein, 17 aa, Mycobacterium
AGCGPGSRFSRATAGVG

SEQ ID NO: 1190319 - protein, 4 aa, Mycobacterium
AGCP

SEQ ID NO: 1190320 - protein, 19 aa, Mycobacterium
AGCPGEGPGTHWLPISLTP

SEQ ID NO: 1190321 - protein, 9 aa, Mycobacterium
AGCSGPADL

SEQ ID NO: 1190322 - protein, 5 aa, Mycobacterium
AGCSR

SEQ ID NO: 1190323 - protein, 9 aa, Mycobacterium
AGCTPDEPR

SEQ ID NO: 1190324 - protein, 7 aa, Mycobacterium
AGCTQAG

SEQ ID NO: 1190325 - protein, 4 aa, Mycobacterium
AGDA

SEQ ID NO: 1190326 - protein, 29 aa, Mycobacterium
AGDAAAARSTAQMPAPGPPTSTARAASGL

SEQ ID NO: 1190327 - protein, 8 aa, Mycobacterium
AGDAAWTP

SEQ ID NO: 1190328 - protein, 11 aa, Mycobacterium
AGDADAISAGT

SEQ ID NO: 1190329 - protein, 9 aa, Mycobacterium
AGDAEKAGD

SEQ ID NO: 1190330 - protein, 12 aa, Mycobacterium
AGDAEQAARTAG

SEQ ID NO: 1190331 - protein, 6 aa, Mycobacterium
AGDAPM

SEQ ID NO: 1190332 - protein, 13 aa, Mycobacterium
AGDAPNEPAPSVT

SEQ ID NO: 1190333 - protein, 5 aa, Mycobacterium
AGDAR

SEQ ID NO: 1190334 - protein, 15 aa, Mycobacterium
AGDCAPTAEAIDDAL

SEQ ID NO: 1190335 - protein, 9 aa, Mycobacterium
AGDDAVDAA

SEQ ID NO: 1190336 - protein, 16 aa, Mycobacterium
AGDDDGAVARSEEART

SEQ ID NO: 1190337 - protein, 9 aa, Mycobacterium
AGDDDLAEQ

SEQ ID NO: 1190338 - protein, 8 aa, Mycobacterium
AGDDEDAV

SEQ ID NO: 1190339 - protein, 12 aa, Mycobacterium
AGDDERRSVDAP

SEQ ID NO: 1190340 - protein, 7 aa, Mycobacterium
AGDDEWP

SEQ ID NO: 1190341 - protein, 9 aa, Mycobacterium
AGDDLAGEA

SEQ ID NO: 1190342 - protein, 9 aa, Mycobacterium
AGDDPEVNE

SEQ ID NO: 1190343 - protein, 10 aa, Mycobacterium
AGDDPRRDGD

SEQ ID NO: 1190344 - protein, 6 aa, Mycobacterium
AGDDSV

SEQ ID NO: 1190345 - protein, 9 aa, Mycobacterium
AGDDTDPVR

SEQ ID NO: 1190346 - protein, 8 aa, Mycobacterium
AGDEDEAD

SEQ ID NO: 1190347 - protein, 7 aa, Mycobacterium
AGDEITG

SEQ ID NO: 1190348 - protein, 9 aa, Mycobacterium
AGDEPGADR

SEQ ID NO: 1190349 - protein, 8 aa, Mycobacterium
AGDEPGGT

SEQ ID NO: 1190350 - protein, 7 aa, Mycobacterium
AGDEQAA

SEQ ID NO: 1190351 - protein, 7 aa, Mycobacterium
AGDERGT

SEQ ID NO: 1190352 - protein, 9 aa, Mycobacterium
AGDEVTGAT

SEQ ID NO: 1190353 - protein, 5 aa, Mycobacterium
AGDGD

SEQ ID NO: 1190354 - protein, 18 aa, Mycobacterium
AGDGDWRDSDIPSRSAEF

SEQ ID NO: 1190355 - protein, 6 aa, Mycobacterium
AGDGGG

SEQ ID NO: 1190356 - protein, 14 aa, Mycobacterium
AGDGLPCSARTAGD

SEQ ID NO: 1190357 - protein, 5 aa, Mycobacterium
AGDGP

SEQ ID NO: 1190358 - protein, 8 aa, Mycobacterium
AGDGPGVS

SEQ ID NO: 1190359 - protein, 16 aa, Mycobacterium
AGDGSVNGAVLLMEPL

SEQ ID NO: 1190360 - protein, 11 aa, Mycobacterium
AGDGTHEHPTQ

SEQ ID NO: 1190361 - protein, 7 aa, Mycobacterium
AGDGTLG

SEQ ID NO: 1190362 - protein, 5 aa, Mycobacterium
AGDGV

SEQ ID NO: 1190363 - protein, 19 aa, Mycobacterium
AGDGYEVTTPKSDAGTRDV

SEQ ID NO: 1190364 - protein, 8 aa, Mycobacterium
AGDHPPTI

SEQ ID NO: 1190365 - protein, 8 aa, Mycobacterium
AGDKPSLR

SEQ ID NO: 1190366 - protein, 5 aa, Mycobacterium
AGDLD

SEQ ID NO: 1190367 - protein, 5 aa, Mycobacterium
AGDLQ

SEQ ID NO: 1190368 - protein, 5 aa, Mycobacterium
AGDPA

SEQ ID NO: 1190369 - protein, 21 aa, Mycobacterium
AGDPAPPPAPPPVGPPPVPQV

SEQ ID NO: 1190370 - protein, 14 aa, Mycobacterium
AGDPAVVTGPVAPD

SEQ ID NO: 1190371 - protein, 7 aa, Mycobacterium
AGDPDIA

SEQ ID NO: 1190372 - protein, 7 aa, Mycobacterium
AGDPDQS

SEQ ID NO: 1190373 - protein, 8 aa, Mycobacterium
AGDPDTVN

SEQ ID NO: 1190374 - protein, 5 aa, Mycobacterium
AGDPE

SEQ ID NO: 1190375 - protein, 8 aa, Mycobacterium
AGDPESPT

SEQ ID NO: 1190376 - protein, 7 aa, Mycobacterium
AGDPGKP

SEQ ID NO: 1190377 - protein, 9 aa, Mycobacterium
AGDPGPDVE

SEQ ID NO: 1190378 - protein, 18 aa, Mycobacterium
AGDPKLAGTQLGPLASEE

SEQ ID NO: 1190379 - protein, 10 aa, Mycobacterium
AGDPPPHPAD

SEQ ID NO: 1190380 - protein, 8 aa, Mycobacterium
AGDPRGRD

SEQ ID NO: 1190381 - protein, 6 aa, Mycobacterium
AGDPWT

SEQ ID NO: 1190382 - protein, 11 aa, Mycobacterium
AGDQFSGIGGA

SEQ ID NO: 1190383 - protein, 6 aa, Mycobacterium
AGDRDA

SEQ ID NO: 1190384 - protein, 8 aa, Mycobacterium
AGDRDELA

SEQ ID NO: 1190385 - protein, 8 aa, Mycobacterium
AGDRDTAT

SEQ ID NO: 1190386 - protein, 7 aa, Mycobacterium
AGDREPY

SEQ ID NO: 1190387 - protein, 5 aa, Mycobacterium
AGDRM

SEQ ID NO: 1190388 - protein, 6 aa, Mycobacterium
AGDRPV

SEQ ID NO: 1190389 - protein, 7 aa, Mycobacterium
AGDRPVR

SEQ ID NO: 1190390 - protein, 8 aa, Mycobacterium
AGDRSNPT

SEQ ID NO: 1190391 - protein, 7 aa, Mycobacterium
AGDRTRA

SEQ ID NO: 1190392 - protein, 6 aa, Mycobacterium
AGDRVA

SEQ ID NO: 1190393 - protein, 10 aa, Mycobacterium
AGDSAGGNLA

SEQ ID NO: 1190394 - protein, 6 aa, Mycobacterium
AGDSGF

SEQ ID NO: 1190395 - protein, 5 aa, Mycobacterium
AGDSL

SEQ ID NO: 1190396 - protein, 15 aa, Mycobacterium
AGDSPLAADAVTASP

SEQ ID NO: 1190397 - protein, 6 aa, Mycobacterium
AGDSSI

SEQ ID NO: 1190398 - protein, 7 aa, Mycobacterium
AGDSSTF

SEQ ID NO: 1190399 - protein, 5 aa, Mycobacterium
AGDTA

SEQ ID NO: 1190400 - protein, 6 aa, Mycobacterium
AGDTAQ

SEQ ID NO: 1190401 - protein, 8 aa, Mycobacterium
AGDTDSGV

SEQ ID NO: 1190402 - protein, 13 aa, Mycobacterium
AGDTITAADLDGE

SEQ ID NO: 1190403 - protein, 10 aa, Mycobacterium
AGDTTSPGLE

SEQ ID NO: 1190404 - protein, 7 aa, Mycobacterium
AGDTTYG

SEQ ID NO: 1190405 - protein, 6 aa, Mycobacterium
AGDVES

SEQ ID NO: 1190406 - protein, 9 aa, Mycobacterium
AGDVGGAPI

SEQ ID NO: 1190407 - protein, 5 aa, Mycobacterium
AGDVS

SEQ ID NO: 1190408 - protein, 23 aa, Mycobacterium
AGDVTAAEAASDSATRSFGPSEV

SEQ ID NO: 1190409 - protein, 6 aa, Mycobacterium
AGDVTG

SEQ ID NO: 1190410 - protein, 12 aa, Mycobacterium
AGDWAGGEGTPL

SEQ ID NO: 1190411 - protein, 13 aa, Mycobacterium
AGDWASGEGTPLE

SEQ ID NO: 1190412 - protein, 6 aa, Mycobacterium
AGEAAG

SEQ ID NO: 1190413 - protein, 7 aa, Mycobacterium
AGEAEPT

SEQ ID NO: 1190414 - protein, 5 aa, Mycobacterium
AGEAG

SEQ ID NO: 1190415 - protein, 9 aa, Mycobacterium
AGEAGRSTA

SEQ ID NO: 1190416 - protein, 5 aa, Mycobacterium
AGEAM

SEQ ID NO: 1190417 - protein, 8 aa, Mycobacterium
AGEAQVGN

SEQ ID NO: 1190418 - protein, 11 aa, Mycobacterium
AGEARARARQA

SEQ ID NO: 1190419 - protein, 14 aa, Mycobacterium
AGECGGEAASLAEE

SEQ ID NO: 1190420 - protein, 4 aa, Mycobacterium
AGED

SEQ ID NO: 1190421 - protein, 6 aa, Mycobacterium
AGEDDV

SEQ ID NO: 1190422 - protein, 8 aa, Mycobacterium
AGEDEAAL

SEQ ID NO: 1190423 - protein, 11 aa, Mycobacterium
AGEDGSARADH

SEQ ID NO: 1190424 - protein, 8 aa, Mycobacterium
AGEDNSPF

SEQ ID NO: 1190425 - protein, 11 aa, Mycobacterium
AGEDRVDPAPV

SEQ ID NO: 1190426 - protein, 14 aa, Mycobacterium
AGEDVSTEIRGDAV

SEQ ID NO: 1190427 - protein, 11 aa, Mycobacterium
AGEESRTGGPV

SEQ ID NO: 1190428 - protein, 17 aa, Mycobacterium
AGEETGGAAAFRPDDAD

SEQ ID NO: 1190429 - protein, 12 aa, Mycobacterium
AGEEVPQTKEEI

SEQ ID NO: 1190430 - protein, 4 aa, Mycobacterium
AGEG

SEQ ID NO: 1190431 - protein, 17 aa, Mycobacterium
AGEGAGPANRVPSLPGA

SEQ ID NO: 1190432 - protein, 6 aa, Mycobacterium
AGEGAM

SEQ ID NO: 1190433 - protein, 9 aa, Mycobacterium
AGEGAPFTG

SEQ ID NO: 1190434 - protein, 16 aa, Mycobacterium
AGEGAPYTGLKPEGLD

SEQ ID NO: 1190435 - protein, 9 aa, Mycobacterium
AGEGDPEQV

SEQ ID NO: 1190436 - protein, 5 aa, Mycobacterium
AGEGI

SEQ ID NO: 1190437 - protein, 6 aa, Mycobacterium
AGEGLR

SEQ ID NO: 1190438 - protein, 9 aa, Mycobacterium
AGEGPSREK

SEQ ID NO: 1190439 - protein, 6 aa, Mycobacterium
AGEGSA

SEQ ID NO: 1190440 - protein, 10 aa, Mycobacterium
AGEGTAAAVD

SEQ ID NO: 1190441 - protein, 7 aa, Mycobacterium
AGEGTTV

SEQ ID NO: 1190442 - protein, 8 aa, Mycobacterium
AGEHAGKE

SEQ ID NO: 1190443 - protein, 8 aa, Mycobacterium
AGEHGYPT

SEQ ID NO: 1190444 - protein, 11 aa, Mycobacterium
AGEHQVEGARK

SEQ ID NO: 1190445 - protein, 4 aa, Mycobacterium
AGEI

SEQ ID NO: 1190446 - protein, 6 aa, Mycobacterium
AGEIDT

SEQ ID NO: 1190447 - protein, 5 aa, Mycobacterium
AGEIR

SEQ ID NO: 1190448 - protein, 12 aa, Mycobacterium
AGEKASGDAPPE

SEQ ID NO: 1190449 - protein, 6 aa, Mycobacterium
AGELAS

SEQ ID NO: 1190450 - protein, 6 aa, Mycobacterium
AGELSN

SEQ ID NO: 1190451 - protein, 9 aa, Mycobacterium
AGEPAKVSE

SEQ ID NO: 1190452 - protein, 6 aa, Mycobacterium
AGEPAV

SEQ ID NO: 1190453 - protein, 9 aa, Mycobacterium
AGEPGAGTR

SEQ ID NO: 1190454 - protein, 15 aa, Mycobacterium
AGEPGPHGGSAVATN

SEQ ID NO: 1190455 - protein, 6 aa, Mycobacterium
AGEPGV

SEQ ID NO: 1190456 - protein, 9 aa, Mycobacterium
AGEPHLPGY

SEQ ID NO: 1190457 - protein, 6 aa, Mycobacterium
AGEPID

SEQ ID NO: 1190458 - protein, 5 aa, Mycobacterium
AGEPL

SEQ ID NO: 1190459 - protein, 7 aa, Mycobacterium
AGEPLNP

SEQ ID NO: 1190460 - protein, 11 aa, Mycobacterium
AGEPRAFAEND

SEQ ID NO: 1190461 - protein, 8 aa, Mycobacterium
AGEPSNAV

SEQ ID NO: 1190462 - protein, 7 aa, Mycobacterium
AGEPTRC

SEQ ID NO: 1190463 - protein, 5 aa, Mycobacterium
AGEQL

SEQ ID NO: 1190464 - protein, 8 aa, Mycobacterium
AGEQPSDF

SEQ ID NO: 1190465 - protein, 8 aa, Mycobacterium
AGEQVGGA

SEQ ID NO: 1190466 - protein, 8 aa, Mycobacterium
AGERAVGG

SEQ ID NO: 1190467 - protein, 8 aa, Mycobacterium
AGERDGQD

SEQ ID NO: 1190468 - protein, 5 aa, Mycobacterium
AGERF

SEQ ID NO: 1190469 - protein, 7 aa, Mycobacterium
AGERGRE

SEQ ID NO: 1190470 - protein, 14 aa, Mycobacterium
AGERGSPDTWRDPR

SEQ ID NO: 1190471 - protein, 5 aa, Mycobacterium
AGERS

SEQ ID NO: 1190472 - protein, 8 aa, Mycobacterium
AGESADDF

SEQ ID NO: 1190473 - protein, 8 aa, Mycobacterium
AGESEVQD

SEQ ID NO: 1190474 - protein, 8 aa, Mycobacterium
AGESGARR

SEQ ID NO: 1190475 - protein, 5 aa, Mycobacterium
AGESP

SEQ ID NO: 1190476 - protein, 6 aa, Mycobacterium
AGESPR

SEQ ID NO: 1190477 - protein, 6 aa, Mycobacterium
AGESVR

SEQ ID NO: 1190478 - protein, 4 aa, Mycobacterium
AGET

SEQ ID NO: 1190479 - protein, 8 aa, Mycobacterium
AGETMQPQ

SEQ ID NO: 1190480 - protein, 7 aa, Mycobacterium
AGETSKP

SEQ ID NO: 1190481 - protein, 13 aa, Mycobacterium
AGETVGEIRPQSQ

SEQ ID NO: 1190482 - protein, 8 aa, Mycobacterium
AGEYEING

SEQ ID NO: 1190483 - protein, 15 aa, Mycobacterium
AGEYSTDPENQLQQE

SEQ ID NO: 1190484 - protein, 6 aa, Mycobacterium
AGFGTN

SEQ ID NO: 1190485 - protein, 5 aa, Mycobacterium
AGFKD

SEQ ID NO: 1190486 - protein, 4 aa, Mycobacterium
AGFP

SEQ ID NO: 1190487 - protein, 19 aa, Mycobacterium
AGFPNANSALTAAREVLEG

SEQ ID NO: 1190488 - protein, 4 aa, Mycobacterium
AGFS

SEQ ID NO: 1190489 - protein, 8 aa, Mycobacterium
AGFSGQSL

SEQ ID NO: 1190490 - protein, 5 aa, Mycobacterium
AGGAA

SEQ ID NO: 1190491 - protein, 10 aa, Mycobacterium
AGGAAADAVA

SEQ ID NO: 1190492 - protein, 7 aa, Mycobacterium
AGGADRP

SEQ ID NO: 1190493 - protein, 9 aa, Mycobacterium
AGGAPAPAV

SEQ ID NO: 1190494 - protein, 7 aa, Mycobacterium
AGGAPVQ

SEQ ID NO: 1190495 - protein, 5 aa, Mycobacterium
AGGAR

SEQ ID NO: 1190496 - protein, 7 aa, Mycobacterium
AGGASGD

SEQ ID NO: 1190497 - protein, 9 aa, Mycobacterium
AGGASGGTI

SEQ ID NO: 1190498 - protein, 10 aa, Mycobacterium
AGGATADLSR

SEQ ID NO: 1190499 - protein, 17 aa, Mycobacterium
AGGATPAAVGAGGTDDT

SEQ ID NO: 1190500 - protein, 5 aa, Mycobacterium
AGGAV

SEQ ID NO: 1190501 - protein, 11 aa, Mycobacterium
AGGDDDDESVV

SEQ ID NO: 1190502 - protein, 6 aa, Mycobacterium
AGGDGA

SEQ ID NO: 1190503 - protein, 12 aa, Mycobacterium
AGGDGEADGPLT

SEQ ID NO: 1190504 - protein, 9 aa, Mycobacterium
AGGDGTRGL

SEQ ID NO: 1190505 - protein, 5 aa, Mycobacterium
AGGDI

SEQ ID NO: 1190506 - protein, 9 aa, Mycobacterium
AGGDLATSL

SEQ ID NO: 1190507 - protein, 12 aa, Mycobacterium
AGGDPESVGLTA

SEQ ID NO: 1190508 - protein, 9 aa, Mycobacterium
AGGDPGLAA

SEQ ID NO: 1190509 - protein, 9 aa, Mycobacterium
AGGDPGVTA

SEQ ID NO: 1190510 - protein, 30 aa, Mycobacterium
AGGDRNYDEDITDYSPDAVAARAEAARSAL

SEQ ID NO: 1190511 - protein, 9 aa, Mycobacterium
AGGDSGTLT

SEQ ID NO: 1190512 - protein, 8 aa, Mycobacterium
AGGDVAPT

SEQ ID NO: 1190513 - protein, 8 aa, Mycobacterium
AGGDWGQP

SEQ ID NO: 1190514 - protein, 7 aa, Mycobacterium
AGGEAHE

SEQ ID NO: 1190515 - protein, 11 aa, Mycobacterium
AGGEAVTSGAN

SEQ ID NO: 1190516 - protein, 9 aa, Mycobacterium
AGGEETGRR

SEQ ID NO: 1190517 - protein, 6 aa, Mycobacterium
AGGEHL

SEQ ID NO: 1190518 - protein, 7 aa, Mycobacterium
AGGELRV

SEQ ID NO: 1190519 - protein, 6 aa, Mycobacterium
AGGESA

SEQ ID NO: 1190520 - protein, 19 aa, Mycobacterium
AGGESGAEEATRSTLDPTV

SEQ ID NO: 1190521 - protein, 8 aa, Mycobacterium
AGGESTAA

SEQ ID NO: 1190522 - protein, 23 aa, Mycobacterium
AGGESVTDADLSPATSPGGGTGL

SEQ ID NO: 1190523 - protein, 9 aa, Mycobacterium
AGGFGSAGA

SEQ ID NO: 1190524 - protein, 14 aa, Mycobacterium
AGGGADVAATTTPE

SEQ ID NO: 1190525 - protein, 5 aa, Mycobacterium
AGGGD

SEQ ID NO: 1190526 - protein, 34 aa, Mycobacterium
AGGGFLPSEGPGDPPTPDQAPAAAGQGRTVKPAD

SEQ ID NO: 1190527 - protein, 10 aa, Mycobacterium
AGGGGHAPGG

SEQ ID NO: 1190528 - protein, 5 aa, Mycobacterium
AGGGH

SEQ ID NO: 1190529 - protein, 5 aa, Mycobacterium
AGGGL

SEQ ID NO: 1190530 - protein, 6 aa, Mycobacterium
AGGGMQ

SEQ ID NO: 1190531 - protein, 7 aa, Mycobacterium
AGGGNTD

SEQ ID NO: 1190532 - protein, 16 aa, Mycobacterium
AGGGPFGGANVYSREK

SEQ ID NO: 1190533 - protein, 9 aa, Mycobacterium
AGGGPGAKL

SEQ ID NO: 1190534 - protein, 12 aa, Mycobacterium
AGGGQGGGVVIE

SEQ ID NO: 1190535 - protein, 9 aa, Mycobacterium
AGGGRARRL

SEQ ID NO: 1190536 - protein, 6 aa, Mycobacterium
AGGGRN

SEQ ID NO: 1190537 - protein, 7 aa, Mycobacterium
AGGGSVG

SEQ ID NO: 1190538 - protein, 7 aa, Mycobacterium
AGGGTMR

SEQ ID NO: 1190539 - protein, 5 aa, Mycobacterium
AGGGV

SEQ ID NO: 1190540 - protein, 11 aa, Mycobacterium
AGGGVAGHNGL

SEQ ID NO: 1190541 - protein, 4 aa, Mycobacterium
AGGH

SEQ ID NO: 1190542 - protein, 9 aa, Mycobacterium
AGGKEDLDD

SEQ ID NO: 1190543 - protein, 6 aa, Mycobacterium
AGGKNG

SEQ ID NO: 1190544 - protein, 7 aa, Mycobacterium
AGGKSTL

SEQ ID NO: 1190545 - protein, 7 aa, Mycobacterium
AGGLGGP

SEQ ID NO: 1190546 - protein, 8 aa, Mycobacterium
AGGLPRDK

SEQ ID NO: 1190547 - protein, 5 aa, Mycobacterium
AGGPM

SEQ ID NO: 1190548 - protein, 10 aa, Mycobacterium
AGGPRPGNYE

SEQ ID NO: 1190549 - protein, 5 aa, Mycobacterium
AGGPS

SEQ ID NO: 1190550 - protein, 18 aa, Mycobacterium
AGGPSTPELAAAGTNAGG

SEQ ID NO: 1190551 - protein, 7 aa, Mycobacterium
AGGPVRL

SEQ ID NO: 1190552 - protein, 8 aa, Mycobacterium
AGGQGRYA

SEQ ID NO: 1190553 - protein, 7 aa, Mycobacterium
AGGQSSE

SEQ ID NO: 1190554 - protein, 6 aa, Mycobacterium
AGGQVR

SEQ ID NO: 1190555 - protein, 7 aa, Mycobacterium
AGGRADT

SEQ ID NO: 1190556 - protein, 8 aa, Mycobacterium
AGGRAIKG

SEQ ID NO: 1190557 - protein, 8 aa, Mycobacterium
AGGRPPTA

SEQ ID NO: 1190558 - protein, 5 aa, Mycobacterium
AGGRR

SEQ ID NO: 1190559 - protein, 7 aa, Mycobacterium
AGGRRTS

SEQ ID NO: 1190560 - protein, 16 aa, Mycobacterium
AGGRSPQRGNGRVAYP

SEQ ID NO: 1190561 - protein, 8 aa, Mycobacterium
AGGSAAHD

SEQ ID NO: 1190562 - protein, 6 aa, Mycobacterium
AGGSAS

SEQ ID NO: 1190563 - protein, 9 aa, Mycobacterium
AGGSDISPQ

SEQ ID NO: 1190564 - protein, 8 aa, Mycobacterium
AGGSGNHH

SEQ ID NO: 1190565 - protein, 6 aa, Mycobacterium
AGGSHA

SEQ ID NO: 1190566 - protein, 5 aa, Mycobacterium
AGGSL

SEQ ID NO: 1190567 - protein, 10 aa, Mycobacterium
AGGSLDESMH

SEQ ID NO: 1190568 - protein, 5 aa, Mycobacterium
AGGSP

SEQ ID NO: 1190569 - protein, 7 aa, Mycobacterium
AGGSRED

SEQ ID NO: 1190570 - protein, 6 aa, Mycobacterium
AGGSTY

SEQ ID NO: 1190571 - protein, 20 aa, Mycobacterium
AGGTATQSEINAARTAQQIA

SEQ ID NO: 1190572 - protein, 16 aa, Mycobacterium
AGGTDPVEKATPGTIR

SEQ ID NO: 1190573 - protein, 6 aa, Mycobacterium
AGGTFN

SEQ ID NO: 1190574 - protein, 7 aa, Mycobacterium
AGGTGGW

SEQ ID NO: 1190575 - protein, 8 aa, Mycobacterium
AGGTHDNW

SEQ ID NO: 1190576 - protein, 7 aa, Mycobacterium
AGGTPAA

SEQ ID NO: 1190577 - protein, 8 aa, Mycobacterium
AGGTREPI

SEQ ID NO: 1190578 - protein, 6 aa, Mycobacterium
AGGVAG

SEQ ID NO: 1190579 - protein, 5 aa, Mycobacterium
AGGVD

SEQ ID NO: 1190580 - protein, 7 aa, Mycobacterium
AGGVDPV

SEQ ID NO: 1190581 - protein, 13 aa, Mycobacterium
AGGVDTASDAPIA

SEQ ID NO: 1190582 - protein, 6 aa, Mycobacterium
AGGVGA

SEQ ID NO: 1190583 - protein, 6 aa, Mycobacterium
AGGVGT

SEQ ID NO: 1190584 - protein, 6 aa, Mycobacterium
AGGVSD

SEQ ID NO: 1190585 - protein, 6 aa, Mycobacterium
AGGVSE

SEQ ID NO: 1190586 - protein, 7 aa, Mycobacterium
AGGVTPI

SEQ ID NO: 1190587 - protein, 11 aa, Mycobacterium
AGGYIESRRAA

SEQ ID NO: 1190588 - protein, 17 aa, Mycobacterium
AGGYTAHPKRDPGTGEL

SEQ ID NO: 1190589 - protein, 13 aa, Mycobacterium
AGHAPDPAAEYTT

SEQ ID NO: 1190590 - protein, 5 aa, Mycobacterium
AGHAS

SEQ ID NO: 1190591 - protein, 5 aa, Mycobacterium
AGHAT

SEQ ID NO: 1190592 - protein, 7 aa, Mycobacterium
AGHDPRR

SEQ ID NO: 1190593 - protein, 7 aa, Mycobacterium
AGHEPEA

SEQ ID NO: 1190594 - protein, 7 aa, Mycobacterium
AGHERRT

SEQ ID NO: 1190595 - protein, 6 aa, Mycobacterium
AGHFPT

SEQ ID NO: 1190596 - protein, 4 aa, Mycobacterium
AGHG

SEQ ID NO: 1190597 - protein, 5 aa, Mycobacterium
AGHGE

SEQ ID NO: 1190598 - protein, 8 aa, Mycobacterium
AGHGINDP

SEQ ID NO: 1190599 - protein, 9 aa, Mycobacterium
AGHGPDEAA

SEQ ID NO: 1190600 - protein, 6 aa, Mycobacterium
AGHGPT

SEQ ID NO: 1190601 - protein, 7 aa, Mycobacterium
AGHGQDS

SEQ ID NO: 1190602 - protein, 15 aa, Mycobacterium
AGHGRHSSTGLPSAE

SEQ ID NO: 1190603 - protein, 8 aa, Mycobacterium
AGHGSGRT

SEQ ID NO: 1190604 - protein, 16 aa, Mycobacterium
AGHKGQGASVNVTPES

SEQ ID NO: 1190605 - protein, 9 aa, Mycobacterium
AGHLPPNKQ

SEQ ID NO: 1190606 - protein, 6 aa, Mycobacterium
AGHPGV

SEQ ID NO: 1190607 - protein, 10 aa, Mycobacterium
AGHPLDDEDR

SEQ ID NO: 1190608 - protein, 6 aa, Mycobacterium
AGHPSV

SEQ ID NO: 1190609 - protein, 7 aa, Mycobacterium
AGHRRRA

SEQ ID NO: 1190610 - protein, 6 aa, Mycobacterium
AGHSAA

SEQ ID NO: 1190611 - protein, 6 aa, Mycobacterium
AGHSVS

SEQ ID NO: 1190612 - protein, 20 aa, Mycobacterium
AGHTGCGSRELGYGRGEVED

SEQ ID NO: 1190613 - protein, 11 aa, Mycobacterium
AGHTTSTGRPW

SEQ ID NO: 1190614 - protein, 6 aa, Mycobacterium
AGIANR

SEQ ID NO: 1190615 - protein, 7 aa, Mycobacterium
AGIASRR

SEQ ID NO: 1190616 - protein, 5 aa, Mycobacterium
AGIAT

SEQ ID NO: 1190617 - protein, 13 aa, Mycobacterium
AGIATDSKGSGTA

SEQ ID NO: 1190618 - protein, 6 aa, Mycobacterium
AGIDAG

SEQ ID NO: 1190619 - protein, 10 aa, Mycobacterium
AGIEDGDQAP

SEQ ID NO: 1190620 - protein, 10 aa, Mycobacterium
AGIEPDPRVG

SEQ ID NO: 1190621 - protein, 7 aa, Mycobacterium
AGIEPSD

SEQ ID NO: 1190622 - protein, 12 aa, Mycobacterium
AGIGADAPSRPR

SEQ ID NO: 1190623 - protein, 67 aa, Mycobacterium
AGIGEPELPELDEPPLDEPEDLDEPDDPEEQDREEDAVAEDAVADEEGVVDGEDVTDVAAPDEEQCD

SEQ ID NO: 1190624 - protein, 6 aa, Mycobacterium
AGIGGK

SEQ ID NO: 1190625 - protein, 7 aa, Mycobacterium
AGIGKSR

SEQ ID NO: 1190626 - protein, 7 aa, Mycobacterium
AGIGPGD

SEQ ID NO: 1190627 - protein, 14 aa, Mycobacterium
AGINASPGLASYSA

SEQ ID NO: 1190628 - protein, 13 aa, Mycobacterium
AGINPRTLRGTST

SEQ ID NO: 1190629 - protein, 15 aa, Mycobacterium
AGIRSDGSSGSGLLG

SEQ ID NO: 1190630 - protein, 21 aa, Mycobacterium
AGISEEDHANPGAAGPPTDVL

SEQ ID NO: 1190631 - protein, 7 aa, Mycobacterium
AGISPED

SEQ ID NO: 1190632 - protein, 7 aa, Mycobacterium
AGISPGS

SEQ ID NO: 1190633 - protein, 5 aa, Mycobacterium
AGISR

SEQ ID NO: 1190634 - protein, 6 aa, Mycobacterium
AGITGS

SEQ ID NO: 1190635 - protein, 7 aa, Mycobacterium
AGITPDE

SEQ ID NO: 1190636 - protein, 5 aa, Mycobacterium
AGKAA

SEQ ID NO: 1190637 - protein, 14 aa, Mycobacterium
AGKAAAAAEEIGNT

SEQ ID NO: 1190638 - protein, 9 aa, Mycobacterium
AGKAASGSF

SEQ ID NO: 1190639 - protein, 9 aa, Mycobacterium
AGKAATAGL

SEQ ID NO: 1190640 - protein, 5 aa, Mycobacterium
AGKAG

SEQ ID NO: 1190641 - protein, 13 aa, Mycobacterium
AGKAGPGHRPPVS

SEQ ID NO: 1190642 - protein, 6 aa, Mycobacterium
AGKAGT

SEQ ID NO: 1190643 - protein, 5 aa, Mycobacterium
AGKAI

SEQ ID NO: 1190644 - protein, 5 aa, Mycobacterium
AGKDG

SEQ ID NO: 1190645 - protein, 9 aa, Mycobacterium
AGKETVTVN

SEQ ID NO: 1190646 - protein, 11 aa, Mycobacterium
AGKGLTGTGYD

SEQ ID NO: 1190647 - protein, 10 aa, Mycobacterium
AGKPDTSEKP

SEQ ID NO: 1190648 - protein, 8 aa, Mycobacterium
AGKPGSYM

SEQ ID NO: 1190649 - protein, 9 aa, Mycobacterium
AGKPLQRDS

SEQ ID NO: 1190650 - protein, 10 aa, Mycobacterium
AGKPLSDADV

SEQ ID NO: 1190651 - protein, 8 aa, Mycobacterium
AGKPPEEW

SEQ ID NO: 1190652 - protein, 10 aa, Mycobacterium
AGKPSPLTDT

SEQ ID NO: 1190653 - protein, 6 aa, Mycobacterium
AGKRGR

SEQ ID NO: 1190654 - protein, 8 aa, Mycobacterium
AGKRLGEQ

SEQ ID NO: 1190655 - protein, 9 aa, Mycobacterium
AGKSTVSAT

SEQ ID NO: 1190656 - protein, 8 aa, Mycobacterium
AGKTGTDA

SEQ ID NO: 1190657 - protein, 7 aa, Mycobacterium
AGKTHKK

SEQ ID NO: 1190658 - protein, 4 aa, Mycobacterium
AGLA

SEQ ID NO: 1190659 - protein, 5 aa, Mycobacterium
AGLAD

SEQ ID NO: 1190660 - protein, 8 aa, Mycobacterium
AGLADGTP

SEQ ID NO: 1190661 - protein, 12 aa, Mycobacterium
AGLANPNTNGVP

SEQ ID NO: 1190662 - protein, 6 aa, Mycobacterium
AGLASA

SEQ ID NO: 1190663 - protein, 4 aa, Mycobacterium
AGLD

SEQ ID NO: 1190664 - protein, 5 aa, Mycobacterium
AGLDP

SEQ ID NO: 1190665 - protein, 7 aa, Mycobacterium
AGLDPGS

SEQ ID NO: 1190666 - protein, 6 aa, Mycobacterium
AGLDRS

SEQ ID NO: 1190667 - protein, 9 aa, Mycobacterium
AGLEADDRG

SEQ ID NO: 1190668 - protein, 8 aa, Mycobacterium
AGLEGYPT

SEQ ID NO: 1190669 - protein, 8 aa, Mycobacterium
AGLEKRRD

SEQ ID NO: 1190670 - protein, 7 aa, Mycobacterium
AGLEPAD

SEQ ID NO: 1190671 - protein, 17 aa, Mycobacterium
AGLEPRRARARTANKAA

SEQ ID NO: 1190672 - protein, 9 aa, Mycobacterium
AGLEPVADG

SEQ ID NO: 1190673 - protein, 10 aa, Mycobacterium
AGLGDGDDLH

SEQ ID NO: 1190674 - protein, 7 aa, Mycobacterium
AGLGGGE

SEQ ID NO: 1190675 - protein, 8 aa, Mycobacterium
AGLGKGDP

SEQ ID NO: 1190676 - protein, 6 aa, Mycobacterium
AGLGPE

SEQ ID NO: 1190677 - protein, 6 aa, Mycobacterium
AGLGPG

SEQ ID NO: 1190678 - protein, 7 aa, Mycobacterium
AGLGSQD

SEQ ID NO: 1190679 - protein, 13 aa, Mycobacterium
AGLGSTAAGAALT

SEQ ID NO: 1190680 - protein, 7 aa, Mycobacterium
AGLGTGS

SEQ ID NO: 1190681 - protein, 12 aa, Mycobacterium
AGLKATPGNAHY

SEQ ID NO: 1190682 - protein, 4 aa, Mycobacterium
AGLN

SEQ ID NO: 1190683 - protein, 8 aa, Mycobacterium
AGLPAKRD

SEQ ID NO: 1190684 - protein, 12 aa, Mycobacterium
AGLPAPIDGPTL

SEQ ID NO: 1190685 - protein, 8 aa, Mycobacterium
AGLPAPRR

SEQ ID NO: 1190686 - protein, 14 aa, Mycobacterium
AGLPATPICSPSAE

SEQ ID NO: 1190687 - protein, 13 aa, Mycobacterium
AGLPDGAGVDAEP

SEQ ID NO: 1190688 - protein, 28 aa, Mycobacterium
AGLPDSAEDKGAQAAAAALSTALTLRQL

SEQ ID NO: 1190689 - protein, 7 aa, Mycobacterium
AGLPKGT

SEQ ID NO: 1190690 - protein, 8 aa, Mycobacterium
AGLPPATY

SEQ ID NO: 1190691 - protein, 5 aa, Mycobacterium
AGLPR

SEQ ID NO: 1190692 - protein, 13 aa, Mycobacterium
AGLPTSGGSGDGR

SEQ ID NO: 1190693 - protein, 10 aa, Mycobacterium
AGLQEGADRD

SEQ ID NO: 1190694 - protein, 6 aa, Mycobacterium
AGLQGT

SEQ ID NO: 1190695 - protein, 15 aa, Mycobacterium
AGLQYGGTAGLGPVG

SEQ ID NO: 1190696 - protein, 7 aa, Mycobacterium
AGLRPGV

SEQ ID NO: 1190697 - protein, 7 aa, Mycobacterium
AGLSGGD

SEQ ID NO: 1190698 - protein, 7 aa, Mycobacterium
AGLSGSD

SEQ ID NO: 1190699 - protein, 13 aa, Mycobacterium
AGLSREGKRGPMD

SEQ ID NO: 1190700 - protein, 12 aa, Mycobacterium
AGLSREGRRGPM

SEQ ID NO: 1190701 - protein, 5 aa, Mycobacterium
AGLSS

SEQ ID NO: 1190702 - protein, 5 aa, Mycobacterium
AGLTA

SEQ ID NO: 1190703 - protein, 6 aa, Mycobacterium
AGLTDK

SEQ ID NO: 1190704 - protein, 10 aa, Mycobacterium
AGLTGPDAER

SEQ ID NO: 1190705 - protein, 5 aa, Mycobacterium
AGLTK

SEQ ID NO: 1190706 - protein, 22 aa, Mycobacterium
AGLTPGDVDGLASTGQGTLPPV

SEQ ID NO: 1190707 - protein, 13 aa, Mycobacterium
AGLTPGRVDSTPT

SEQ ID NO: 1190708 - protein, 8 aa, Mycobacterium
AGLTPSDV

SEQ ID NO: 1190709 - protein, 7 aa, Mycobacterium
AGLTPVK

SEQ ID NO: 1190710 - protein, 15 aa, Mycobacterium
AGLTPVPDGVDARTA

SEQ ID NO: 1190711 - protein, 9 aa, Mycobacterium
AGLTREQER

SEQ ID NO: 1190712 - protein, 12 aa, Mycobacterium
AGLVTPDDHENF

SEQ ID NO: 1190713 - protein, 6 aa, Mycobacterium
AGMDAD

SEQ ID NO: 1190714 - protein, 7 aa, Mycobacterium
AGMDKQQ

SEQ ID NO: 1190715 - protein, 11 aa, Mycobacterium
AGMGAGAGNAP

SEQ ID NO: 1190716 - protein, 7 aa, Mycobacterium
AGMGPDD

SEQ ID NO: 1190717 - protein, 9 aa, Mycobacterium
AGMGPDQGR

SEQ ID NO: 1190718 - protein, 5 aa, Mycobacterium
AGMNT

SEQ ID NO: 1190719 - protein, 6 aa, Mycobacterium
AGMPTP

SEQ ID NO: 1190720 - protein, 8 aa, Mycobacterium
AGMRSSGL

SEQ ID NO: 1190721 - protein, 8 aa, Mycobacterium
AGMTPRRD

SEQ ID NO: 1190722 - protein, 8 aa, Mycobacterium
AGNAAQPV

SEQ ID NO: 1190723 - protein, 8 aa, Mycobacterium
AGNAARSL

SEQ ID NO: 1190724 - protein, 6 aa, Mycobacterium
AGNAGV

SEQ ID NO: 1190725 - protein, 8 aa, Mycobacterium
AGNALPSQ

SEQ ID NO: 1190726 - protein, 8 aa, Mycobacterium
AGNASAPV

SEQ ID NO: 1190727 - protein, 13 aa, Mycobacterium
AGNASGTNDAAAG

SEQ ID NO: 1190728 - protein, 6 aa, Mycobacterium
AGNATL

SEQ ID NO: 1190729 - protein, 6 aa, Mycobacterium
AGNCSR

SEQ ID NO: 1190730 - protein, 4 aa, Mycobacterium
AGNG

SEQ ID NO: 1190731 - protein, 18 aa, Mycobacterium
AGNGAEVTVSSDDEDALN

SEQ ID NO: 1190732 - protein, 11 aa, Mycobacterium
AGNGMAGHTAP

SEQ ID NO: 1190733 - protein, 6 aa, Mycobacterium
AGNGPL

SEQ ID NO: 1190734 - protein, 19 aa, Mycobacterium
AGNHGAEASNRRFGENGRD

SEQ ID NO: 1190735 - protein, 7 aa, Mycobacterium
AGNLGGG

SEQ ID NO: 1190736 - protein, 8 aa, Mycobacterium
AGNNDEYQ

SEQ ID NO: 1190737 - protein, 6 aa, Mycobacterium
AGNNDP

SEQ ID NO: 1190738 - protein, 7 aa, Mycobacterium
AGNPAQR

SEQ ID NO: 1190739 - protein, 18 aa, Mycobacterium
AGNPISASDPTMGVVKTV

SEQ ID NO: 1190740 - protein, 16 aa, Mycobacterium
AGNPITANYNTATGEL

SEQ ID NO: 1190741 - protein, 8 aa, Mycobacterium
AGNPQPGT

SEQ ID NO: 1190742 - protein, 5 aa, Mycobacterium
AGNPR

SEQ ID NO: 1190743 - protein, 4 aa, Mycobacterium
AGNR

SEQ ID NO: 1190744 - protein, 5 aa, Mycobacterium
AGNRA

SEQ ID NO: 1190745 - protein, 12 aa, Mycobacterium
AGNRGPTAAPQN

SEQ ID NO: 1190746 - protein, 6 aa, Mycobacterium
AGNRTF

SEQ ID NO: 1190747 - protein, 15 aa, Mycobacterium
AGNTAYAAAKSAQWG

SEQ ID NO: 1190748 - protein, 5 aa, Mycobacterium
AGNTG

SEQ ID NO: 1190749 - protein, 10 aa, Mycobacterium
AGPAADPDTL

SEQ ID NO: 1190750 - protein, 11 aa, Mycobacterium
AGPAAQAGGRY

SEQ ID NO: 1190751 - protein, 7 aa, Mycobacterium
AGPAEAE

SEQ ID NO: 1190752 - protein, 11 aa, Mycobacterium
AGPAELAAGRE

SEQ ID NO: 1190753 - protein, 6 aa, Mycobacterium
AGPAGR

SEQ ID NO: 1190754 - protein, 16 aa, Mycobacterium
AGPAKIPAPGPGPGQT

SEQ ID NO: 1190755 - protein, 16 aa, Mycobacterium
AGPALSTEAEEGGLAG

SEQ ID NO: 1190756 - protein, 40 aa, Mycobacterium
AGPAPRRYAPTPTPGRGGPRTPTRPTSTALYGKSGTSPSW

SEQ ID NO: 1190757 - protein, 14 aa, Mycobacterium
AGPAPSDPRVAQQI

SEQ ID NO: 1190758 - protein, 9 aa, Mycobacterium
AGPARRLPE

SEQ ID NO: 1190759 - protein, 5 aa, Mycobacterium
AGPAT

SEQ ID NO: 1190760 - protein, 16 aa, Mycobacterium
AGPATIPLPGPGPGQT

SEQ ID NO: 1190761 - protein, 7 aa, Mycobacterium
AGPCTAR

SEQ ID NO: 1190762 - protein, 6 aa, Mycobacterium
AGPDAL

SEQ ID NO: 1190763 - protein, 8 aa, Mycobacterium
AGPDAVQS

SEQ ID NO: 1190764 - protein, 6 aa, Mycobacterium
AGPDGH

SEQ ID NO: 1190765 - protein, 6 aa, Mycobacterium
AGPDGL

SEQ ID NO: 1190766 - protein, 6 aa, Mycobacterium
AGPDGR

SEQ ID NO: 1190767 - protein, 9 aa, Mycobacterium
AGPDGWGGP

SEQ ID NO: 1190768 - protein, 5 aa, Mycobacterium
AGPDL

SEQ ID NO: 1190769 - protein, 9 aa, Mycobacterium
AGPDNPVAD

SEQ ID NO: 1190770 - protein, 8 aa, Mycobacterium
AGPDRNEK

SEQ ID NO: 1190771 - protein, 15 aa, Mycobacterium
AGPDSDLDGDGVPDA

SEQ ID NO: 1190772 - protein, 7 aa, Mycobacterium
AGPDVTV

SEQ ID NO: 1190773 - protein, 6 aa, Mycobacterium
AGPEEG

SEQ ID NO: 1190774 - protein, 8 aa, Mycobacterium
AGPEGGYG

SEQ ID NO: 1190775 - protein, 21 aa, Mycobacterium
AGPEHPHSAQQPVPFEIKQVA

SEQ ID NO: 1190776 - protein, 7 aa, Mycobacterium
AGPEIGV

SEQ ID NO: 1190777 - protein, 7 aa, Mycobacterium
AGPEYGG

SEQ ID NO: 1190778 - protein, 4 aa, Mycobacterium
AGPF

SEQ ID NO: 1190779 - protein, 8 aa, Mycobacterium
AGPGAHGY

SEQ ID NO: 1190780 - protein, 6 aa, Mycobacterium
AGPGEG

SEQ ID NO: 1190781 - protein, 6 aa, Mycobacterium
AGPGGY

SEQ ID NO: 1190782 - protein, 9 aa, Mycobacterium
AGPGSGSPQ

SEQ ID NO: 1190783 - protein, 6 aa, Mycobacterium
AGPGTI

SEQ ID NO: 1190784 - protein, 6 aa, Mycobacterium
AGPGTK

SEQ ID NO: 1190785 - protein, 5 aa, Mycobacterium
AGPGV

SEQ ID NO: 1190786 - protein, 11 aa, Mycobacterium
AGPGYTLGGDP

SEQ ID NO: 1190787 - protein, 18 aa, Mycobacterium
AGPHAALGSRAPDAVDGG

SEQ ID NO: 1190788 - protein, 12 aa, Mycobacterium
AGPIDAPDPKVD

SEQ ID NO: 1190789 - protein, 6 aa, Mycobacterium
AGPIDP

SEQ ID NO: 1190790 - protein, 7 aa, Mycobacterium
AGPIGSG

SEQ ID NO: 1190791 - protein, 7 aa, Mycobacterium
AGPITSA

SEQ ID NO: 1190792 - protein, 6 aa, Mycobacterium
AGPKAI

SEQ ID NO: 1190793 - protein, 7 aa, Mycobacterium
AGPKVGP

SEQ ID NO: 1190794 - protein, 10 aa, Mycobacterium
AGPLANDDDD

SEQ ID NO: 1190795 - protein, 5 aa, Mycobacterium
AGPLG

SEQ ID NO: 1190796 - protein, 14 aa, Mycobacterium
AGPLQKQGIPKASR

SEQ ID NO: 1190797 - protein, 6 aa, Mycobacterium
AGPLTG

SEQ ID NO: 1190798 - protein, 12 aa, Mycobacterium
AGPMSATGAARL

SEQ ID NO: 1190799 - protein, 10 aa, Mycobacterium
AGPMVGEPSY

SEQ ID NO: 1190800 - protein, 4 aa, Mycobacterium
AGPP

SEQ ID NO: 1190801 - protein, 7 aa, Mycobacterium
AGPPEQV

SEQ ID NO: 1190802 - protein, 7 aa, Mycobacterium
AGPPPIR

SEQ ID NO: 1190803 - protein, 13 aa, Mycobacterium
AGPPPRPTISTGI

SEQ ID NO: 1190804 - protein, 7 aa, Mycobacterium
AGPRAGW

SEQ ID NO: 1190805 - protein, 6 aa, Mycobacterium
AGPRHI

SEQ ID NO: 1190806 - protein, 7 aa, Mycobacterium
AGPRIGK

SEQ ID NO: 1190807 - protein, 5 aa, Mycobacterium
AGPRL

SEQ ID NO: 1190808 - protein, 5 aa, Mycobacterium
AGPRP

SEQ ID NO: 1190809 - protein, 6 aa, Mycobacterium
AGPRSC

SEQ ID NO: 1190810 - protein, 6 aa, Mycobacterium
AGPRVD

SEQ ID NO: 1190811 - protein, 7 aa, Mycobacterium
AGPSARI

SEQ ID NO: 1190812 - protein, 31 aa, Mycobacterium
AGPSFSAGHDLGSSDDVRERAPGPGQHPTYQ

SEQ ID NO: 1190813 - protein, 6 aa, Mycobacterium
AGPSGL

SEQ ID NO: 1190814 - protein, 5 aa, Mycobacterium
AGPSV

SEQ ID NO: 1190815 - protein, 8 aa, Mycobacterium
AGPSVGKE

SEQ ID NO: 1190816 - protein, 6 aa, Mycobacterium
AGPTAR

SEQ ID NO: 1190817 - protein, 7 aa, Mycobacterium
AGPTEFT

SEQ ID NO: 1190818 - protein, 9 aa, Mycobacterium
AGPTPPQPR

SEQ ID NO: 1190819 - protein, 7 aa, Mycobacterium
AGPTTEI

SEQ ID NO: 1190820 - protein, 7 aa, Mycobacterium
AGPTTGA

SEQ ID NO: 1190821 - protein, 9 aa, Mycobacterium
AGPTTTLYS

SEQ ID NO: 1190822 - protein, 4 aa, Mycobacterium
AGPV

SEQ ID NO: 1190823 - protein, 15 aa, Mycobacterium
AGPVANAASNGLPAF

SEQ ID NO: 1190824 - protein, 5 aa, Mycobacterium
AGPVG

SEQ ID NO: 1190825 - protein, 10 aa, Mycobacterium
AGPVQARGAA

SEQ ID NO: 1190826 - protein, 6 aa, Mycobacterium
AGPVTG

SEQ ID NO: 1190827 - protein, 7 aa, Mycobacterium
AGPVTGP

SEQ ID NO: 1190828 - protein, 9 aa, Mycobacterium
AGQAENADS

SEQ ID NO: 1190829 - protein, 12 aa, Mycobacterium
AGQAGAATDGEW

SEQ ID NO: 1190830 - protein, 9 aa, Mycobacterium
AGQAGGANI

SEQ ID NO: 1190831 - protein, 22 aa, Mycobacterium
AGQAGTRVAQSSEGSPPEERCC

SEQ ID NO: 1190832 - protein, 8 aa, Mycobacterium
AGQARPEV

SEQ ID NO: 1190833 - protein, 4 aa, Mycobacterium
AGQD

SEQ ID NO: 1190834 - protein, 23 aa, Mycobacterium
AGQEQYQSARPPAGGEAESPHRA

SEQ ID NO: 1190835 - protein, 4 aa, Mycobacterium
AGQG

SEQ ID NO: 1190836 - protein, 5 aa, Mycobacterium
AGQGA

SEQ ID NO: 1190837 - protein, 16 aa, Mycobacterium
AGQGEGADWDRTKDDV

SEQ ID NO: 1190838 - protein, 7 aa, Mycobacterium
AGQGFSG

SEQ ID NO: 1190839 - protein, 10 aa, Mycobacterium
AGQGGFGGRT

SEQ ID NO: 1190840 - protein, 6 aa, Mycobacterium
AGQGKS

SEQ ID NO: 1190841 - protein, 5 aa, Mycobacterium
AGQGN

SEQ ID NO: 1190842 - protein, 8 aa, Mycobacterium
AGQGTAGL

SEQ ID NO: 1190843 - protein, 7 aa, Mycobacterium
AGQGVGR

SEQ ID NO: 1190844 - protein, 5 aa, Mycobacterium
AGQHG

SEQ ID NO: 1190845 - protein, 7 aa, Mycobacterium
AGQIAAG

SEQ ID NO: 1190846 - protein, 13 aa, Mycobacterium
AGQIAKELTGGAV

SEQ ID NO: 1190847 - protein, 13 aa, Mycobacterium
AGQLESGCAPSDL

SEQ ID NO: 1190848 - protein, 7 aa, Mycobacterium
AGQNVGS

SEQ ID NO: 1190849 - protein, 7 aa, Mycobacterium
AGQPGVN

SEQ ID NO: 1190850 - protein, 9 aa, Mycobacterium
AGQPPPAEL

SEQ ID NO: 1190851 - protein, 12 aa, Mycobacterium
AGQQQGGYSGQP

SEQ ID NO: 1190852 - protein, 5 aa, Mycobacterium
AGQQV

SEQ ID NO: 1190853 - protein, 6 aa, Mycobacterium
AGQRDQ

SEQ ID NO: 1190854 - protein, 7 aa, Mycobacterium
AGQRGIQ

SEQ ID NO: 1190855 - protein, 12 aa, Mycobacterium
AGQSAGTPSSRQ

SEQ ID NO: 1190856 - protein, 8 aa, Mycobacterium
AGQSAQRD

SEQ ID NO: 1190857 - protein, 14 aa, Mycobacterium
AGQSHDLPSRSTEL

SEQ ID NO: 1190858 - protein, 12 aa, Mycobacterium
AGQSPGPGMGNG

SEQ ID NO: 1190859 - protein, 8 aa, Mycobacterium
AGQSRHVD

SEQ ID NO: 1190860 - protein, 8 aa, Mycobacterium
AGQTDGIR

SEQ ID NO: 1190861 - protein, 9 aa, Mycobacterium
AGQTGIPVE

SEQ ID NO: 1190862 - protein, 7 aa, Mycobacterium
AGQTPVR

SEQ ID NO: 1190863 - protein, 8 aa, Mycobacterium
AGRAAARD

SEQ ID NO: 1190864 - protein, 9 aa, Mycobacterium
AGRAAGKRI

SEQ ID NO: 1190865 - protein, 8 aa, Mycobacterium
AGRAGRKR

SEQ ID NO: 1190866 - protein, 7 aa, Mycobacterium
AGRAHRA

SEQ ID NO: 1190867 - protein, 6 aa, Mycobacterium
AGRALE

SEQ ID NO: 1190868 - protein, 7 aa, Mycobacterium
AGRARPG

SEQ ID NO: 1190869 - protein, 8 aa, Mycobacterium
AGRASAVE

SEQ ID NO: 1190870 - protein, 8 aa, Mycobacterium
AGRASGLR

SEQ ID NO: 1190871 - protein, 5 aa, Mycobacterium
AGRAV

SEQ ID NO: 1190872 - protein, 18 aa, Mycobacterium
AGRAVKDAAQDDIQRGEN

SEQ ID NO: 1190873 - protein, 10 aa, Mycobacterium
AGRDAGQAVR

SEQ ID NO: 1190874 - protein, 7 aa, Mycobacterium
AGRDASF

SEQ ID NO: 1190875 - protein, 8 aa, Mycobacterium
AGRDATVD

SEQ ID NO: 1190876 - protein, 7 aa, Mycobacterium
AGRDDEI

SEQ ID NO: 1190877 - protein, 25 aa, Mycobacterium
AGRDDGRKARAKSSGVRRLDDDDRV

SEQ ID NO: 1190878 - protein, 11 aa, Mycobacterium
AGRDDKPDFTE

SEQ ID NO: 1190879 - protein, 8 aa, Mycobacterium
AGRDEDRD

SEQ ID NO: 1190880 - protein, 13 aa, Mycobacterium
AGRDEPIPSTIED

SEQ ID NO: 1190881 - protein, 9 aa, Mycobacterium
AGRDGGQIG

SEQ ID NO: 1190882 - protein, 7 aa, Mycobacterium
AGRDGRL

SEQ ID NO: 1190883 - protein, 13 aa, Mycobacterium
AGRDHAAAAAAPQ

SEQ ID NO: 1190884 - protein, 7 aa, Mycobacterium
AGRDPIG

SEQ ID NO: 1190885 - protein, 10 aa, Mycobacterium
AGREASASNM

SEQ ID NO: 1190886 - protein, 5 aa, Mycobacterium
AGREI

SEQ ID NO: 1190887 - protein, 8 aa, Mycobacterium
AGREPSRP

SEQ ID NO: 1190888 - protein, 7 aa, Mycobacterium
AGRETRD

SEQ ID NO: 1190889 - protein, 5 aa, Mycobacterium
AGRGA

SEQ ID NO: 1190890 - protein, 24 aa, Mycobacterium
AGRGAGSTYAQSGGNNGTRGLERA

SEQ ID NO: 1190891 - protein, 7 aa, Mycobacterium
AGRGDTE

SEQ ID NO: 1190892 - protein, 9 aa, Mycobacterium
AGRGETAAA

SEQ ID NO: 1190893 - protein, 7 aa, Mycobacterium
AGRGGSL

SEQ ID NO: 1190894 - protein, 8 aa, Mycobacterium
AGRGGVAN

SEQ ID NO: 1190895 - protein, 7 aa, Mycobacterium
AGRGIGR

SEQ ID NO: 1190896 - protein, 5 aa, Mycobacterium
AGRGL

SEQ ID NO: 1190897 - protein, 7 aa, Mycobacterium
AGRGPER

SEQ ID NO: 1190898 - protein, 8 aa, Mycobacterium
AGRGQGRA

SEQ ID NO: 1190899 - protein, 6 aa, Mycobacterium
AGRGRT

SEQ ID NO: 1190900 - protein, 7 aa, Mycobacterium
AGRGSFG

SEQ ID NO: 1190901 - protein, 7 aa, Mycobacterium
AGRGSLQ

SEQ ID NO: 1190902 - protein, 8 aa, Mycobacterium
AGRGVGRG

SEQ ID NO: 1190903 - protein, 4 aa, Mycobacterium
AGRI

SEQ ID NO: 1190904 - protein, 10 aa, Mycobacterium
AGRKAAGGTA

SEQ ID NO: 1190905 - protein, 8 aa, Mycobacterium
AGRKRPAG

SEQ ID NO: 1190906 - protein, 11 aa, Mycobacterium
AGRKSGKRYRT

SEQ ID NO: 1190907 - protein, 6 aa, Mycobacterium
AGRMPR

SEQ ID NO: 1190908 - protein, 25 aa, Mycobacterium
AGRNADKLAAAAEEIKAQTGDGAGE

SEQ ID NO: 1190909 - protein, 6 aa, Mycobacterium
AGRNGA

SEQ ID NO: 1190910 - protein, 11 aa, Mycobacterium
AGRNPKLGYDN

SEQ ID NO: 1190911 - protein, 8 aa, Mycobacterium
AGRNRITK

SEQ ID NO: 1190912 - protein, 9 aa, Mycobacterium
AGRNTVDPT

SEQ ID NO: 1190913 - protein, 12 aa, Mycobacterium
AGRPAEITGRSS

SEQ ID NO: 1190914 - protein, 6 aa, Mycobacterium
AGRPAG

SEQ ID NO: 1190915 - protein, 10 aa, Mycobacterium
AGRPAGKPLQ

SEQ ID NO: 1190916 - protein, 7 aa, Mycobacterium
AGRPAPE

SEQ ID NO: 1190917 - protein, 10 aa, Mycobacterium
AGRPAYSGSQ

SEQ ID NO: 1190918 - protein, 11 aa, Mycobacterium
AGRPDPDAGES

SEQ ID NO: 1190919 - protein, 5 aa, Mycobacterium
AGRPE

SEQ ID NO: 1190920 - protein, 7 aa, Mycobacterium
AGRPEDD

SEQ ID NO: 1190921 - protein, 7 aa, Mycobacterium
AGRPELS

SEQ ID NO: 1190922 - protein, 7 aa, Mycobacterium
AGRPGDT

SEQ ID NO: 1190923 - protein, 7 aa, Mycobacterium
AGRPIPT

SEQ ID NO: 1190924 - protein, 8 aa, Mycobacterium
AGRPPREV

SEQ ID NO: 1190925 - protein, 6 aa, Mycobacterium
AGRPQL

SEQ ID NO: 1190926 - protein, 7 aa, Mycobacterium
AGRPSAF

SEQ ID NO: 1190927 - protein, 10 aa, Mycobacterium
AGRPSPGPMT

SEQ ID NO: 1190928 - protein, 14 aa, Mycobacterium
AGRPVVTDGGDSGA

SEQ ID NO: 1190929 - protein, 6 aa, Mycobacterium
AGRQDT

SEQ ID NO: 1190930 - protein, 7 aa, Mycobacterium
AGRQGDA

SEQ ID NO: 1190931 - protein, 9 aa, Mycobacterium
AGRQGQTDH

SEQ ID NO: 1190932 - protein, 19 aa, Mycobacterium
AGRQSATRMGSLLSAVIAR

SEQ ID NO: 1190933 - protein, 10 aa, Mycobacterium
AGRRAEATVS

SEQ ID NO: 1190934 - protein, 7 aa, Mycobacterium
AGRRDDT

SEQ ID NO: 1190935 - protein, 5 aa, Mycobacterium
AGRRE

SEQ ID NO: 1190936 - protein, 6 aa, Mycobacterium
AGRRGG

SEQ ID NO: 1190937 - protein, 12 aa, Mycobacterium
AGRRGYGPPMPG

SEQ ID NO: 1190938 - protein, 13 aa, Mycobacterium
AGRRIADEEVDSG

SEQ ID NO: 1190939 - protein, 18 aa, Mycobacterium
AGRRKYKGRGSAAETEFR

SEQ ID NO: 1190940 - protein, 7 aa, Mycobacterium
AGRRQPP

SEQ ID NO: 1190941 - protein, 18 aa, Mycobacterium
AGRRRGPGAVRPGPDDVR

SEQ ID NO: 1190942 - protein, 9 aa, Mycobacterium
AGRRRPSQP

SEQ ID NO: 1190943 - protein, 11 aa, Mycobacterium
AGRRYERTVDP

SEQ ID NO: 1190944 - protein, 10 aa, Mycobacterium
AGRSAAERHQ

SEQ ID NO: 1190945 - protein, 16 aa, Mycobacterium
AGRSDEDGESGFSNGI

SEQ ID NO: 1190946 - protein, 17 aa, Mycobacterium
AGRSGSLGLAPAQAAES

SEQ ID NO: 1190947 - protein, 6 aa, Mycobacterium
AGRSQD

SEQ ID NO: 1190948 - protein, 10 aa, Mycobacterium
AGRSRARSRY

SEQ ID NO: 1190949 - protein, 7 aa, Mycobacterium
AGRSRET

SEQ ID NO: 1190950 - protein, 6 aa, Mycobacterium
AGRSTD

SEQ ID NO: 1190951 - protein, 10 aa, Mycobacterium
AGRTGRTADV

SEQ ID NO: 1190952 - protein, 7 aa, Mycobacterium
AGRTPKL

SEQ ID NO: 1190953 - protein, 9 aa, Mycobacterium
AGRTPSGTW

SEQ ID NO: 1190954 - protein, 9 aa, Mycobacterium
AGRTQARYQ

SEQ ID NO: 1190955 - protein, 11 aa, Mycobacterium
AGRTRGHPARA

SEQ ID NO: 1190956 - protein, 8 aa, Mycobacterium
AGRTRYQQ

SEQ ID NO: 1190957 - protein, 11 aa, Mycobacterium
AGRTVTDEEMP

SEQ ID NO: 1190958 - protein, 4 aa, Mycobacterium
AGRV

SEQ ID NO: 1190959 - protein, 10 aa, Mycobacterium
AGRVGAPEDV

SEQ ID NO: 1190960 - protein, 5 aa, Mycobacterium
AGRYA

SEQ ID NO: 1190961 - protein, 14 aa, Mycobacterium
AGRYPDGTRLPTES

SEQ ID NO: 1190962 - protein, 10 aa, Mycobacterium
AGRYTPTPAV

SEQ ID NO: 1190963 - protein, 8 aa, Mycobacterium
AGSAAAQR

SEQ ID NO: 1190964 - protein, 12 aa, Mycobacterium
AGSADHRAVPPA

SEQ ID NO: 1190965 - protein, 25 aa, Mycobacterium
AGSAEGVTPVDSEVPTGMPAGGFGD

SEQ ID NO: 1190966 - protein, 6 aa, Mycobacterium
AGSAEP

SEQ ID NO: 1190967 - protein, 6 aa, Mycobacterium
AGSAGT

SEQ ID NO: 1190968 - protein, 5 aa, Mycobacterium
AGSAK

SEQ ID NO: 1190969 - protein, 11 aa, Mycobacterium
AGSAKHAQRHV

SEQ ID NO: 1190970 - protein, 8 aa, Mycobacterium
AGSAPENL

SEQ ID NO: 1190971 - protein, 9 aa, Mycobacterium
AGSARDASA

SEQ ID NO: 1190972 - protein, 10 aa, Mycobacterium
AGSARTYGAD

SEQ ID NO: 1190973 - protein, 6 aa, Mycobacterium
AGSASI

SEQ ID NO: 1190974 - protein, 8 aa, Mycobacterium
AGSAVGKE

SEQ ID NO: 1190975 - protein, 8 aa, Mycobacterium
AGSDAADG

SEQ ID NO: 1190976 - protein, 8 aa, Mycobacterium
AGSDANDV

SEQ ID NO: 1190977 - protein, 6 aa, Mycobacterium
AGSDDV

SEQ ID NO: 1190978 - protein, 8 aa, Mycobacterium
AGSDEVDA

SEQ ID NO: 1190979 - protein, 7 aa, Mycobacterium
AGSDPWA

SEQ ID NO: 1190980 - protein, 5 aa, Mycobacterium
AGSDR

SEQ ID NO: 1190981 - protein, 6 aa, Mycobacterium
AGSDVG

SEQ ID NO: 1190982 - protein, 6 aa, Mycobacterium
AGSEDS

SEQ ID NO: 1190983 - protein, 5 aa, Mycobacterium
AGSEF

SEQ ID NO: 1190984 - protein, 7 aa, Mycobacterium
AGSETTT

SEQ ID NO: 1190985 - protein, 5 aa, Mycobacterium
AGSGA

SEQ ID NO: 1190986 - protein, 10 aa, Mycobacterium
AGSGAAAGGS

SEQ ID NO: 1190987 - protein, 22 aa, Mycobacterium
AGSGAARGTDEQRSSGSIDASR

SEQ ID NO: 1190988 - protein, 10 aa, Mycobacterium
AGSGAPPAQV

SEQ ID NO: 1190989 - protein, 8 aa, Mycobacterium
AGSGGDFN

SEQ ID NO: 1190990 - protein, 13 aa, Mycobacterium
AGSGGTHASRDKF

SEQ ID NO: 1190991 - protein, 6 aa, Mycobacterium
AGSGLS

SEQ ID NO: 1190992 - protein, 10 aa, Mycobacterium
AGSGNESASR

SEQ ID NO: 1190993 - protein, 5 aa, Mycobacterium
AGSGP

SEQ ID NO: 1190994 - protein, 6 aa, Mycobacterium
AGSGPI

SEQ ID NO: 1190995 - protein, 5 aa, Mycobacterium
AGSGR

SEQ ID NO: 1190996 - protein, 8 aa, Mycobacterium
AGSGREGL

SEQ ID NO: 1190997 - protein, 15 aa, Mycobacterium
AGSGRGRDSGLTERQ

SEQ ID NO: 1190998 - protein, 9 aa, Mycobacterium
AGSGSREET

SEQ ID NO: 1190999 - protein, 8 aa, Mycobacterium
AGSHAAAH

SEQ ID NO: 1191000 - protein, 13 aa, Mycobacterium
AGSIPPPAPPPVG

SEQ ID NO: 1191001 - protein, 11 aa, Mycobacterium
AGSKAQELSPG

SEQ ID NO: 1191002 - protein, 6 aa, Mycobacterium
AGSKTL

SEQ ID NO: 1191003 - protein, 11 aa, Mycobacterium
AGSKYADLPGA

SEQ ID NO: 1191004 - protein, 13 aa, Mycobacterium
AGSLDSAVEPDSM

SEQ ID NO: 1191005 - protein, 19 aa, Mycobacterium
AGSNGDRPMTGQEKGAWWW

SEQ ID NO: 1191006 - protein, 6 aa, Mycobacterium
AGSNRL

SEQ ID NO: 1191007 - protein, 4 aa, Mycobacterium
AGSP

SEQ ID NO: 1191008 - protein, 7 aa, Mycobacterium
AGSPAPF

SEQ ID NO: 1191009 - protein, 14 aa, Mycobacterium
AGSPPGDDRVRAAR

SEQ ID NO: 1191010 - protein, 10 aa, Mycobacterium
AGSPRPGNYQ

SEQ ID NO: 1191011 - protein, 8 aa, Mycobacterium
AGSPRRDE

SEQ ID NO: 1191012 - protein, 8 aa, Mycobacterium
AGSPSRDA

SEQ ID NO: 1191013 - protein, 9 aa, Mycobacterium
AGSPTAPIQ

SEQ ID NO: 1191014 - protein, 15 aa, Mycobacterium
AGSPTDTRSFDDRPE

SEQ ID NO: 1191015 - protein, 20 aa, Mycobacterium
AGSQPLGAGRPARLTSPPGL

SEQ ID NO: 1191016 - protein, 8 aa, Mycobacterium
AGSRAGTL

SEQ ID NO: 1191017 - protein, 9 aa, Mycobacterium
AGSREDAEH

SEQ ID NO: 1191018 - protein, 6 aa, Mycobacterium
AGSRGD

SEQ ID NO: 1191019 - protein, 8 aa, Mycobacterium
AGSRGGTT

SEQ ID NO: 1191020 - protein, 7 aa, Mycobacterium
AGSRGGV

SEQ ID NO: 1191021 - protein, 5 aa, Mycobacterium
AGSRI

SEQ ID NO: 1191022 - protein, 6 aa, Mycobacterium
AGSRNK

SEQ ID NO: 1191023 - protein, 7 aa, Mycobacterium
AGSRPLC

SEQ ID NO: 1191024 - protein, 12 aa, Mycobacterium
AGSRTGDDAVAS

SEQ ID NO: 1191025 - protein, 8 aa, Mycobacterium
AGSRTGRV

SEQ ID NO: 1191026 - protein, 8 aa, Mycobacterium
AGSRVPGS

SEQ ID NO: 1191027 - protein, 18 aa, Mycobacterium
AGSSGTFTTVNPATEETL

SEQ ID NO: 1191028 - protein, 9 aa, Mycobacterium
AGSSGTLNM

SEQ ID NO: 1191029 - protein, 11 aa, Mycobacterium
AGSSNLEAQRR

SEQ ID NO: 1191030 - protein, 11 aa, Mycobacterium
AGSSRAANQAT

SEQ ID NO: 1191031 - protein, 6 aa, Mycobacterium
AGSSSR

SEQ ID NO: 1191032 - protein, 5 aa, Mycobacterium
AGSSV

SEQ ID NO: 1191033 - protein, 7 aa, Mycobacterium
AGSTGDA

SEQ ID NO: 1191034 - protein, 9 aa, Mycobacterium
AGSTSGVAG

SEQ ID NO: 1191035 - protein, 8 aa, Mycobacterium
AGSTYTAT

SEQ ID NO: 1191036 - protein, 19 aa, Mycobacterium
AGSVETARQRAREANADRR

SEQ ID NO: 1191037 - protein, 6 aa, Mycobacterium
AGSVPE

SEQ ID NO: 1191038 - protein, 5 aa, Mycobacterium
AGSVT

SEQ ID NO: 1191039 - protein, 4 aa, Mycobacterium
AGSW

SEQ ID NO: 1191040 - protein, 8 aa, Mycobacterium
AGSYDRDS

SEQ ID NO: 1191041 - protein, 4 aa, Mycobacterium
AGTA

SEQ ID NO: 1191042 - protein, 5 aa, Mycobacterium
AGTAA

SEQ ID NO: 1191043 - protein, 13 aa, Mycobacterium
AGTAAGISGVLRQ

SEQ ID NO: 1191044 - protein, 11 aa, Mycobacterium
AGTAAPSDGEL

SEQ ID NO: 1191045 - protein, 10 aa, Mycobacterium
AGTADAGTVH

SEQ ID NO: 1191046 - protein, 7 aa, Mycobacterium
AGTADDY

SEQ ID NO: 1191047 - protein, 9 aa, Mycobacterium
AGTAGGAAD

SEQ ID NO: 1191048 - protein, 7 aa, Mycobacterium
AGTAIDA

SEQ ID NO: 1191049 - protein, 9 aa, Mycobacterium
AGTAPGARL

SEQ ID NO: 1191050 - protein, 11 aa, Mycobacterium
AGTARDEGDYL

SEQ ID NO: 1191051 - protein, 6 aa, Mycobacterium
AGTATA

SEQ ID NO: 1191052 - protein, 11 aa, Mycobacterium
AGTATDTTESL

SEQ ID NO: 1191053 - protein, 5 aa, Mycobacterium
AGTAV

SEQ ID NO: 1191054 - protein, 16 aa, Mycobacterium
AGTAVGPLGSATVRPP

SEQ ID NO: 1191055 - protein, 7 aa, Mycobacterium
AGTDDTI

SEQ ID NO: 1191056 - protein, 9 aa, Mycobacterium
AGTDLNGTT

SEQ ID NO: 1191057 - protein, 8 aa, Mycobacterium
AGTDPAAN

SEQ ID NO: 1191058 - protein, 15 aa, Mycobacterium
AGTDQPVDSSPALNA

SEQ ID NO: 1191059 - protein, 5 aa, Mycobacterium
AGTDR

SEQ ID NO: 1191060 - protein, 10 aa, Mycobacterium
AGTEAEESER

SEQ ID NO: 1191061 - protein, 6 aa, Mycobacterium
AGTEDA

SEQ ID NO: 1191062 - protein, 6 aa, Mycobacterium
AGTEEP

SEQ ID NO: 1191063 - protein, 5 aa, Mycobacterium
AGTEK

SEQ ID NO: 1191064 - protein, 24 aa, Mycobacterium
AGTELGPLAGGDELGSLAIDLDMT

SEQ ID NO: 1191065 - protein, 9 aa, Mycobacterium
AGTEPGPEA

SEQ ID NO: 1191066 - protein, 6 aa, Mycobacterium
AGTEQG

SEQ ID NO: 1191067 - protein, 8 aa, Mycobacterium
AGTEQSAF

SEQ ID NO: 1191068 - protein, 5 aa, Mycobacterium
AGTER

SEQ ID NO: 1191069 - protein, 18 aa, Mycobacterium
AGTERPFTGEYTDTETEG

SEQ ID NO: 1191070 - protein, 19 aa, Mycobacterium
AGTERPFTGEYTDTKTDGV

SEQ ID NO: 1191071 - protein, 4 aa, Mycobacterium
AGTF

SEQ ID NO: 1191072 - protein, 7 aa, Mycobacterium
AGTGEPV

SEQ ID NO: 1191073 - protein, 5 aa, Mycobacterium
AGTGL

SEQ ID NO: 1191074 - protein, 7 aa, Mycobacterium
AGTGPSM

SEQ ID NO: 1191075 - protein, 6 aa, Mycobacterium
AGTGTE

SEQ ID NO: 1191076 - protein, 9 aa, Mycobacterium
AGTHAAQTG

SEQ ID NO: 1191077 - protein, 8 aa, Mycobacterium
AGTKFGDA

SEQ ID NO: 1191078 - protein, 7 aa, Mycobacterium
AGTKRGA

SEQ ID NO: 1191079 - protein, 10 aa, Mycobacterium
AGTLSGPQQV

SEQ ID NO: 1191080 - protein, 13 aa, Mycobacterium
AGTNIDGPTAWDG

SEQ ID NO: 1191081 - protein, 10 aa, Mycobacterium
AGTNPAERAR

SEQ ID NO: 1191082 - protein, 8 aa, Mycobacterium
AGTNSKPG

SEQ ID NO: 1191083 - protein, 12 aa, Mycobacterium
AGTPAETLPRSR

SEQ ID NO: 1191084 - protein, 27 aa, Mycobacterium
AGTPAEVSRAERSRTAPYLAARLGHST

SEQ ID NO: 1191085 - protein, 19 aa, Mycobacterium
AGTPARRLGTAGWDAAKEA

SEQ ID NO: 1191086 - protein, 10 aa, Mycobacterium
AGTPEPRHDE

SEQ ID NO: 1191087 - protein, 9 aa, Mycobacterium
AGTPEVDPD

SEQ ID NO: 1191088 - protein, 6 aa, Mycobacterium
AGTPEW

SEQ ID NO: 1191089 - protein, 8 aa, Mycobacterium
AGTPGKRL

SEQ ID NO: 1191090 - protein, 8 aa, Mycobacterium
AGTPGKRM

SEQ ID NO: 1191091 - protein, 10 aa, Mycobacterium
AGTQGANASF

SEQ ID NO: 1191092 - protein, 9 aa, Mycobacterium
AGTQPGAVT

SEQ ID NO: 1191093 - protein, 11 aa, Mycobacterium
AGTREVGDGRR

SEQ ID NO: 1191094 - protein, 7 aa, Mycobacterium
AGTRMRS

SEQ ID NO: 1191095 - protein, 8 aa, Mycobacterium
AGTRRGTV

SEQ ID NO: 1191096 - protein, 6 aa, Mycobacterium
AGTRSA

SEQ ID NO: 1191097 - protein, 4 aa, Mycobacterium
AGTS

SEQ ID NO: 1191098 - protein, 8 aa, Mycobacterium
AGTSDPAA

SEQ ID NO: 1191099 - protein, 10 aa, Mycobacterium
AGTSFATPDK

SEQ ID NO: 1191100 - protein, 12 aa, Mycobacterium
AGTSGEAPSGSR

SEQ ID NO: 1191101 - protein, 15 aa, Mycobacterium
AGTSIPARAEDESLT

SEQ ID NO: 1191102 - protein, 15 aa, Mycobacterium
AGTSMAGGTSAGPVN

SEQ ID NO: 1191103 - protein, 7 aa, Mycobacterium
AGTSRRV

SEQ ID NO: 1191104 - protein, 8 aa, Mycobacterium
AGTSSVQR

SEQ ID NO: 1191105 - protein, 4 aa, Mycobacterium
AGTT

SEQ ID NO: 1191106 - protein, 9 aa, Mycobacterium
AGTTERSRC

SEQ ID NO: 1191107 - protein, 11 aa, Mycobacterium
AGTTEVSDATT

SEQ ID NO: 1191108 - protein, 11 aa, Mycobacterium
AGTTGDLDAQA

SEQ ID NO: 1191109 - protein, 9 aa, Mycobacterium
AGTTGYSEE

SEQ ID NO: 1191110 - protein, 7 aa, Mycobacterium
AGTTKRV

SEQ ID NO: 1191111 - protein, 10 aa, Mycobacterium
AGTTPKPINQ

SEQ ID NO: 1191112 - protein, 13 aa, Mycobacterium
AGTTPPDDEAPDH

SEQ ID NO: 1191113 - protein, 7 aa, Mycobacterium
AGTTTPR

SEQ ID NO: 1191114 - protein, 6 aa, Mycobacterium
AGTTTR

SEQ ID NO: 1191115 - protein, 14 aa, Mycobacterium
AGTVRGAAQRGCPD

SEQ ID NO: 1191116 - protein, 4 aa, Mycobacterium
AGTW

SEQ ID NO: 1191117 - protein, 7 aa, Mycobacterium
AGTYDTA

SEQ ID NO: 1191118 - protein, 5 aa, Mycobacterium
AGTYS

SEQ ID NO: 1191119 - protein, 9 aa, Mycobacterium
AGVAESRDL

SEQ ID NO: 1191120 - protein, 5 aa, Mycobacterium
AGVAK

SEQ ID NO: 1191121 - protein, 8 aa, Mycobacterium
AGVDADAR

SEQ ID NO: 1191122 - protein, 12 aa, Mycobacterium
AGVDDAAPLTAD

SEQ ID NO: 1191123 - protein, 9 aa, Mycobacterium
AGVDDGDVY

SEQ ID NO: 1191124 - protein, 6 aa, Mycobacterium
AGVDDS

SEQ ID NO: 1191125 - protein, 11 aa, Mycobacterium
AGVDGSNVESN

SEQ ID NO: 1191126 - protein, 5 aa, Mycobacterium
AGVDP

SEQ ID NO: 1191127 - protein, 11 aa, Mycobacterium
AGVDPDRLRDA

SEQ ID NO: 1191128 - protein, 9 aa, Mycobacterium
AGVDPNRLE

SEQ ID NO: 1191129 - protein, 14 aa, Mycobacterium
AGVERSLKARQFDV

SEQ ID NO: 1191130 - protein, 20 aa, Mycobacterium
AGVGAPDGAWAPATVAPGQA

SEQ ID NO: 1191131 - protein, 6 aa, Mycobacterium
AGVGAR

SEQ ID NO: 1191132 - protein, 8 aa, Mycobacterium
AGVGGDGH

SEQ ID NO: 1191133 - protein, 11 aa, Mycobacterium
AGVGGPAAYAA

SEQ ID NO: 1191134 - protein, 12 aa, Mycobacterium
AGVGGSMGSVAG

SEQ ID NO: 1191135 - protein, 5 aa, Mycobacterium
AGVGK

SEQ ID NO: 1191136 - protein, 16 aa, Mycobacterium
AGVGKTTLARSAADRL

SEQ ID NO: 1191137 - protein, 8 aa, Mycobacterium
AGVGPETS

SEQ ID NO: 1191138 - protein, 11 aa, Mycobacterium
AGVGPKELKEA

SEQ ID NO: 1191139 - protein, 5 aa, Mycobacterium
AGVGR

SEQ ID NO: 1191140 - protein, 7 aa, Mycobacterium
AGVGTGQ

SEQ ID NO: 1191141 - protein, 13 aa, Mycobacterium
AGVGVDDTGDWHN

SEQ ID NO: 1191142 - protein, 6 aa, Mycobacterium
AGVHGP

SEQ ID NO: 1191143 - protein, 5 aa, Mycobacterium
AGVLP

SEQ ID NO: 1191144 - protein, 14 aa, Mycobacterium
AGVNGAEPRTLGPA

SEQ ID NO: 1191145 - protein, 27 aa, Mycobacterium
AGVNGDSGATAAAGNAGGVGGAGGLGG

SEQ ID NO: 1191146 - protein, 9 aa, Mycobacterium
AGVNGSGKH

SEQ ID NO: 1191147 - protein, 7 aa, Mycobacterium
AGVPAEP

SEQ ID NO: 1191148 - protein, 8 aa, Mycobacterium
AGVPALTS

SEQ ID NO: 1191149 - protein, 8 aa, Mycobacterium
AGVPASDA

SEQ ID NO: 1191150 - protein, 6 aa, Mycobacterium
AGVPEG

SEQ ID NO: 1191151 - protein, 14 aa, Mycobacterium
AGVPGAKLGSERDL

SEQ ID NO: 1191152 - protein, 6 aa, Mycobacterium
AGVPGS

SEQ ID NO: 1191153 - protein, 14 aa, Mycobacterium
AGVPGTKLGSEREL

SEQ ID NO: 1191154 - protein, 29 aa, Mycobacterium
AGVPNDEDLQAGRIRDAEATRNKLSQLCS

SEQ ID NO: 1191155 - protein, 15 aa, Mycobacterium
AGVPSGDAPSDAPAL

SEQ ID NO: 1191156 - protein, 7 aa, Mycobacterium
AGVQTTV

SEQ ID NO: 1191157 - protein, 4 aa, Mycobacterium
AGVR

SEQ ID NO: 1191158 - protein, 7 aa, Mycobacterium
AGVRAGD

SEQ ID NO: 1191159 - protein, 8 aa, Mycobacterium
AGVRPEDA

SEQ ID NO: 1191160 - protein, 18 aa, Mycobacterium
AGVRPYQDTGRVAADPEY

SEQ ID NO: 1191161 - protein, 5 aa, Mycobacterium
AGVSR

SEQ ID NO: 1191162 - protein, 7 aa, Mycobacterium
AGVSRGG

SEQ ID NO: 1191163 - protein, 5 aa, Mycobacterium
AGVTA

SEQ ID NO: 1191164 - protein, 14 aa, Mycobacterium
AGVTADSNGKPLEL

SEQ ID NO: 1191165 - protein, 5 aa, Mycobacterium
AGVTE

SEQ ID NO: 1191166 - protein, 5 aa, Mycobacterium
AGVTH

SEQ ID NO: 1191167 - protein, 7 aa, Mycobacterium
AGVTPSD

SEQ ID NO: 1191168 - protein, 8 aa, Mycobacterium
AGVTTPAE

SEQ ID NO: 1191169 - protein, 9 aa, Mycobacterium
AGVTTYSTE

SEQ ID NO: 1191170 - protein, 6 aa, Mycobacterium
AGWPET

SEQ ID NO: 1191171 - protein, 10 aa, Mycobacterium
AGWQGSEKVP

SEQ ID NO: 1191172 - protein, 11 aa, Mycobacterium
AGWRADNTDID

SEQ ID NO: 1191173 - protein, 7 aa, Mycobacterium
AGWRPDE

SEQ ID NO: 1191174 - protein, 4 aa, Mycobacterium
AGWS

SEQ ID NO: 1191175 - protein, 11 aa, Mycobacterium
AGWSPSAAAAP

SEQ ID NO: 1191176 - protein, 9 aa, Mycobacterium
AGYDPKGLE

SEQ ID NO: 1191177 - protein, 9 aa, Mycobacterium
AGYDPSVGS

SEQ ID NO: 1191178 - protein, 9 aa, Mycobacterium
AGYDTSPGM

SEQ ID NO: 1191179 - protein, 18 aa, Mycobacterium
AGYGERSSERTNSRNGYR

SEQ ID NO: 1191180 - protein, 6 aa, Mycobacterium
AGYHGA

SEQ ID NO: 1191181 - protein, 5 aa, Mycobacterium
AGYMD

SEQ ID NO: 1191182 - protein, 4 aa, Mycobacterium
AGYP

SEQ ID NO: 1191183 - protein, 5 aa, Mycobacterium
AGYPA

SEQ ID NO: 1191184 - protein, 8 aa, Mycobacterium
AGYPDEQA

SEQ ID NO: 1191185 - protein, 6 aa, Mycobacterium
AGYPEY

SEQ ID NO: 1191186 - protein, 8 aa, Mycobacterium
AGYQADGA

SEQ ID NO: 1191187 - protein, 6 aa, Mycobacterium
AGYQNP

SEQ ID NO: 1191188 - protein, 5 aa, Mycobacterium
AGYRD

SEQ ID NO: 1191189 - protein, 6 aa, Mycobacterium
AGYRQP

SEQ ID NO: 1191190 - protein, 12 aa, Mycobacterium
AGYRRAGEGADA

SEQ ID NO: 1191191 - protein, 5 aa, Mycobacterium
AGYSR

SEQ ID NO: 1191192 - protein, 6 aa, Mycobacterium
AGYTRG

SEQ ID NO: 1191193 - protein, 7 aa, Mycobacterium
AHAAAEQ

SEQ ID NO: 1191194 - protein, 7 aa, Mycobacterium
AHAAGTL

SEQ ID NO: 1191195 - protein, 7 aa, Mycobacterium
AHAGDST

SEQ ID NO: 1191196 - protein, 8 aa, Mycobacterium
AHAGPNEH

SEQ ID NO: 1191197 - protein, 7 aa, Mycobacterium
AHANGAR

SEQ ID NO: 1191198 - protein, 7 aa, Mycobacterium
AHAPFGG

SEQ ID NO: 1191199 - protein, 15 aa, Mycobacterium
AHATAKEIAANPPLT

SEQ ID NO: 1191200 - protein, 11 aa, Mycobacterium
AHDAAEVGEVP

SEQ ID NO: 1191201 - protein, 8 aa, Mycobacterium
AHDAEDAV

SEQ ID NO: 1191202 - protein, 6 aa, Mycobacterium
AHDDAP

SEQ ID NO: 1191203 - protein, 7 aa, Mycobacterium
AHDERAL

SEQ ID NO: 1191204 - protein, 10 aa, Mycobacterium
AHDERGVGGP

SEQ ID NO: 1191205 - protein, 11 aa, Mycobacterium
AHDGAAGRVAT

SEQ ID NO: 1191206 - protein, 5 aa, Mycobacterium
AHDRT

SEQ ID NO: 1191207 - protein, 17 aa, Mycobacterium
AHDSPDGVVPQQYPPDD

SEQ ID NO: 1191208 - protein, 8 aa, Mycobacterium
AHDSTEGV

SEQ ID NO: 1191209 - protein, 6 aa, Mycobacterium
AHEDAA

SEQ ID NO: 1191210 - protein, 7 aa, Mycobacterium
AHEDPDE

SEQ ID NO: 1191211 - protein, 8 aa, Mycobacterium
AHEEGGDR

SEQ ID NO: 1191212 - protein, 5 aa, Mycobacterium
AHEEI

SEQ ID NO: 1191213 - protein, 4 aa, Mycobacterium
AHEF

SEQ ID NO: 1191214 - protein, 8 aa, Mycobacterium
AHEQPAPV

SEQ ID NO: 1191215 - protein, 8 aa, Mycobacterium
AHESTDRL

SEQ ID NO: 1191216 - protein, 6 aa, Mycobacterium
AHETST

SEQ ID NO: 1191217 - protein, 9 aa, Mycobacterium
AHGAAQGHA

SEQ ID NO: 1191218 - protein, 13 aa, Mycobacterium
AHGAGSACGKNLS

SEQ ID NO: 1191219 - protein, 5 aa, Mycobacterium
AHGAS

SEQ ID NO: 1191220 - protein, 8 aa, Mycobacterium
AHGATPDA

SEQ ID NO: 1191221 - protein, 8 aa, Mycobacterium
AHGDPRTV

SEQ ID NO: 1191222 - protein, 18 aa, Mycobacterium
AHGDTTDLPPALAPRVPA

SEQ ID NO: 1191223 - protein, 5 aa, Mycobacterium
AHGEA

SEQ ID NO: 1191224 - protein, 20 aa, Mycobacterium
AHGGGAGEKKRNPALSPDEP

SEQ ID NO: 1191225 - protein, 18 aa, Mycobacterium
AHGNQADGEEGLPAAAPG

SEQ ID NO: 1191226 - protein, 9 aa, Mycobacterium
AHGRNDALG

SEQ ID NO: 1191227 - protein, 6 aa, Mycobacterium
AHGRRE

SEQ ID NO: 1191228 - protein, 6 aa, Mycobacterium
AHGSPV

SEQ ID NO: 1191229 - protein, 7 aa, Mycobacterium
AHGTDAL

SEQ ID NO: 1191230 - protein, 9 aa, Mycobacterium
AHGTNAASA

SEQ ID NO: 1191231 - protein, 14 aa, Mycobacterium
AHHDPADSAHRQVE

SEQ ID NO: 1191232 - protein, 8 aa, Mycobacterium
AHHNEDRK

SEQ ID NO: 1191233 - protein, 22 aa, Mycobacterium
AHHSTYPAAVNSDTTSSANQSL

SEQ ID NO: 1191234 - protein, 6 aa, Mycobacterium
AHIGGS

SEQ ID NO: 1191235 - protein, 12 aa, Mycobacterium
AHIGGSAAEDDG

SEQ ID NO: 1191236 - protein, 8 aa, Mycobacterium
AHISGESL

SEQ ID NO: 1191237 - protein, 12 aa, Mycobacterium
AHKAGRLGNDED

SEQ ID NO: 1191238 - protein, 11 aa, Mycobacterium
AHKERSGSSFA

SEQ ID NO: 1191239 - protein, 7 aa, Mycobacterium
AHKNRQR

SEQ ID NO: 1191240 - protein, 6 aa, Mycobacterium
AHKPYR

SEQ ID NO: 1191241 - protein, 5 aa, Mycobacterium
AHKRY

SEQ ID NO: 1191242 - protein, 11 aa, Mycobacterium
AHKSRGADAEL

SEQ ID NO: 1191243 - protein, 4 aa, Mycobacterium
AHKT

SEQ ID NO: 1191244 - protein, 5 aa, Mycobacterium
AHKVS

SEQ ID NO: 1191245 - protein, 8 aa, Mycobacterium
AHLPPTAP

SEQ ID NO: 1191246 - protein, 5 aa, Mycobacterium
AHNAA

SEQ ID NO: 1191247 - protein, 13 aa, Mycobacterium
AHNAGEDVRPKDA

SEQ ID NO: 1191248 - protein, 7 aa, Mycobacterium
AHNDPIS

SEQ ID NO: 1191249 - protein, 11 aa, Mycobacterium
AHNEDAGAAAA

SEQ ID NO: 1191250 - protein, 10 aa, Mycobacterium
AHPDASSGQR

SEQ ID NO: 1191251 - protein, 7 aa, Mycobacterium
AHPEGMQ

SEQ ID NO: 1191252 - protein, 15 aa, Mycobacterium
AHPGGIGGTYSGNPV

SEQ ID NO: 1191253 - protein, 5 aa, Mycobacterium
AHPGH

SEQ ID NO: 1191254 - protein, 9 aa, Mycobacterium
AHPGRAGIR

SEQ ID NO: 1191255 - protein, 12 aa, Mycobacterium
AHPGTSSTELGR

SEQ ID NO: 1191256 - protein, 6 aa, Mycobacterium
AHPGTT

SEQ ID NO: 1191257 - protein, 6 aa, Mycobacterium
AHPGVT

SEQ ID NO: 1191258 - protein, 21 aa, Mycobacterium
AHPGYSATNLQGHSGNPLGEK

SEQ ID NO: 1191259 - protein, 5 aa, Mycobacterium
AHPRD

SEQ ID NO: 1191260 - protein, 7 aa, Mycobacterium
AHPRYRS

SEQ ID NO: 1191261 - protein, 9 aa, Mycobacterium
AHPSPAANG

SEQ ID NO: 1191262 - protein, 6 aa, Mycobacterium
AHPSSV

SEQ ID NO: 1191263 - protein, 9 aa, Mycobacterium
AHPSTEQAV

SEQ ID NO: 1191264 - protein, 8 aa, Mycobacterium
AHPTAEQT

SEQ ID NO: 1191265 - protein, 9 aa, Mycobacterium
AHPTATHRP

SEQ ID NO: 1191266 - protein, 6 aa, Mycobacterium
AHPTGA

SEQ ID NO: 1191267 - protein, 9 aa, Mycobacterium
AHPTPLPGG

SEQ ID NO: 1191268 - protein, 5 aa, Mycobacterium
AHPVA

SEQ ID NO: 1191269 - protein, 7 aa, Mycobacterium
AHQGGRL

SEQ ID NO: 1191270 - protein, 7 aa, Mycobacterium
AHQGRNR

SEQ ID NO: 1191271 - protein, 10 aa, Mycobacterium
AHQHGDKVSV

SEQ ID NO: 1191272 - protein, 10 aa, Mycobacterium
AHQSTYPAAV

SEQ ID NO: 1191273 - protein, 4 aa, Mycobacterium
AHRA

SEQ ID NO: 1191274 - protein, 16 aa, Mycobacterium
AHRAASRNKSDPTDVV

SEQ ID NO: 1191275 - protein, 7 aa, Mycobacterium
AHRAEPD

SEQ ID NO: 1191276 - protein, 9 aa, Mycobacterium
AHRAKAGAA

SEQ ID NO: 1191277 - protein, 7 aa, Mycobacterium
AHRAPRG

SEQ ID NO: 1191278 - protein, 14 aa, Mycobacterium
AHRGAEAHRVAIES

SEQ ID NO: 1191279 - protein, 8 aa, Mycobacterium
AHRGGGAL

SEQ ID NO: 1191280 - protein, 6 aa, Mycobacterium
AHRGRA

SEQ ID NO: 1191281 - protein, 9 aa, Mycobacterium
AHRPAPGDR

SEQ ID NO: 1191282 - protein, 6 aa, Mycobacterium
AHRPEA

SEQ ID NO: 1191283 - protein, 8 aa, Mycobacterium
AHRPQGSD

SEQ ID NO: 1191284 - protein, 10 aa, Mycobacterium
AHRQGATSVT

SEQ ID NO: 1191285 - protein, 6 aa, Mycobacterium
AHRRET

SEQ ID NO: 1191286 - protein, 11 aa, Mycobacterium
AHRRGEPAFTG

SEQ ID NO: 1191287 - protein, 6 aa, Mycobacterium
AHRSAD

SEQ ID NO: 1191288 - protein, 8 aa, Mycobacterium
AHRSATEA

SEQ ID NO: 1191289 - protein, 18 aa, Mycobacterium
AHSADQNKTWQSMLLPPS

SEQ ID NO: 1191290 - protein, 10 aa, Mycobacterium
AHSASATGTM

SEQ ID NO: 1191291 - protein, 5 aa, Mycobacterium
AHSDS

SEQ ID NO: 1191292 - protein, 6 aa, Mycobacterium
AHSEST

SEQ ID NO: 1191293 - protein, 6 aa, Mycobacterium
AHSGAT

SEQ ID NO: 1191294 - protein, 11 aa, Mycobacterium
AHSGHTSHRDE

SEQ ID NO: 1191295 - protein, 22 aa, Mycobacterium
AHSNAAAAADVAGGRADAGIST

SEQ ID NO: 1191296 - protein, 7 aa, Mycobacterium
AHSNDKE

SEQ ID NO: 1191297 - protein, 6 aa, Mycobacterium
AHSPLR

SEQ ID NO: 1191298 - protein, 4 aa, Mycobacterium
AHSR

SEQ ID NO: 1191299 - protein, 6 aa, Mycobacterium
AHSRGV

SEQ ID NO: 1191300 - protein, 7 aa, Mycobacterium
AHSRPRG

SEQ ID NO: 1191301 - protein, 7 aa, Mycobacterium
AHSRSPQ

SEQ ID NO: 1191302 - protein, 13 aa, Mycobacterium
AHSSQAGEASKRL

SEQ ID NO: 1191303 - protein, 5 aa, Mycobacterium
AHSSY

SEQ ID NO: 1191304 - protein, 7 aa, Mycobacterium
AHSTPDV

SEQ ID NO: 1191305 - protein, 12 aa, Mycobacterium
AHSYPDARRTAA

SEQ ID NO: 1191306 - protein, 15 aa, Mycobacterium
AHTAAAAGKESNNLI

SEQ ID NO: 1191307 - protein, 14 aa, Mycobacterium
AHTAGDKTQWGAPP

SEQ ID NO: 1191308 - protein, 19 aa, Mycobacterium
AHTAVESGSATGKVVVEPN

SEQ ID NO: 1191309 - protein, 9 aa, Mycobacterium
AHTAVTRQS

SEQ ID NO: 1191310 - protein, 5 aa, Mycobacterium
AHTDH

SEQ ID NO: 1191311 - protein, 7 aa, Mycobacterium
AHTDPRS

SEQ ID NO: 1191312 - protein, 10 aa, Mycobacterium
AHTGGGNRLP

SEQ ID NO: 1191313 - protein, 23 aa, Mycobacterium
AHTHDHDGSPSHDHGDHSGYHTA

SEQ ID NO: 1191314 - protein, 15 aa, Mycobacterium
AHTPADTLTDTVARA

SEQ ID NO: 1191315 - protein, 5 aa, Mycobacterium
AHTRE

SEQ ID NO: 1191316 - protein, 8 aa, Mycobacterium
AHTRERQQ

SEQ ID NO: 1191317 - protein, 8 aa, Mycobacterium
AHTTGRGM

SEQ ID NO: 1191318 - protein, 5 aa, Mycobacterium
AHTTI

SEQ ID NO: 1191319 - protein, 9 aa, Mycobacterium
AIADSPKKR

SEQ ID NO: 1191320 - protein, 6 aa, Mycobacterium
AIAEET

SEQ ID NO: 1191321 - protein, 6 aa, Mycobacterium
AIAEQN

SEQ ID NO: 1191322 - protein, 12 aa, Mycobacterium
AIAPGTENGRAS

SEQ ID NO: 1191323 - protein, 10 aa, Mycobacterium
AIAQETEEQY

SEQ ID NO: 1191324 - protein, 11 aa, Mycobacterium
AIATEPTEALS

SEQ ID NO: 1191325 - protein, 14 aa, Mycobacterium
AIDAGGGGSRAVQR

SEQ ID NO: 1191326 - protein, 6 aa, Mycobacterium
AIDDGD

SEQ ID NO: 1191327 - protein, 27 aa, Mycobacterium
AIDETERRRAKQTAYNKEHGIDPKPLR

SEQ ID NO: 1191328 - protein, 6 aa, Mycobacterium
AIDGST

SEQ ID NO: 1191329 - protein, 8 aa, Mycobacterium
AIDPDGEV

SEQ ID NO: 1191330 - protein, 8 aa, Mycobacterium
AIDPDHGS

SEQ ID NO: 1191331 - protein, 18 aa, Mycobacterium
AIEDQRDADLEARAQKLE

SEQ ID NO: 1191332 - protein, 7 aa, Mycobacterium
AIEESGV

SEQ ID NO: 1191333 - protein, 9 aa, Mycobacterium
AIEGDPKVT

SEQ ID NO: 1191334 - protein, 7 aa, Mycobacterium
AIEPDAA

SEQ ID NO: 1191335 - protein, 4 aa, Mycobacterium
AIGG

SEQ ID NO: 1191336 - protein, 7 aa, Mycobacterium
AIGGGPA

SEQ ID NO: 1191337 - protein, 17 aa, Mycobacterium
AINAPADAHIHEVIVRP

SEQ ID NO: 1191338 - protein, 6 aa, Mycobacterium
AINERQ

SEQ ID NO: 1191339 - protein, 10 aa, Mycobacterium
AINKGRSDGL

SEQ ID NO: 1191340 - protein, 13 aa, Mycobacterium
AINRDNAAQHYQT

SEQ ID NO: 1191341 - protein, 10 aa, Mycobacterium
AIPADPEGSV

SEQ ID NO: 1191342 - protein, 8 aa, Mycobacterium
AIPADPQG

SEQ ID NO: 1191343 - protein, 4 aa, Mycobacterium
AIPG

SEQ ID NO: 1191344 - protein, 7 aa, Mycobacterium
AIPGDNG

SEQ ID NO: 1191345 - protein, 6 aa, Mycobacterium
AIPGPR

SEQ ID NO: 1191346 - protein, 16 aa, Mycobacterium
AIPGQDRPVGSQPDSA

SEQ ID NO: 1191347 - protein, 26 aa, Mycobacterium
AIPPADVSRETWNSPEVDTPIGAEAE

SEQ ID NO: 1191348 - protein, 5 aa, Mycobacterium
AIPRG

SEQ ID NO: 1191349 - protein, 12 aa, Mycobacterium
AIPRTTSGKLAR

SEQ ID NO: 1191350 - protein, 7 aa, Mycobacterium
AIPSDGV

SEQ ID NO: 1191351 - protein, 5 aa, Mycobacterium
AIPSE

SEQ ID NO: 1191352 - protein, 14 aa, Mycobacterium
AIPSPDERGERITD

SEQ ID NO: 1191353 - protein, 6 aa, Mycobacterium
AIQQES

SEQ ID NO: 1191354 - protein, 10 aa, Mycobacterium
AIQTPPGDIA

SEQ ID NO: 1191355 - protein, 11 aa, Mycobacterium
AIRANGPDVGL

SEQ ID NO: 1191356 - protein, 11 aa, Mycobacterium
AIREDTPAGSV

SEQ ID NO: 1191357 - protein, 14 aa, Mycobacterium
AIRGPRTLGLVLGK

SEQ ID NO: 1191358 - protein, 7 aa, Mycobacterium
AIRGRTG

SEQ ID NO: 1191359 - protein, 9 aa, Mycobacterium
AISAGDTQI

SEQ ID NO: 1191360 - protein, 12 aa, Mycobacterium
AISGASDSVLSS

SEQ ID NO: 1191361 - protein, 10 aa, Mycobacterium
AISGELPVPS

SEQ ID NO: 1191362 - protein, 10 aa, Mycobacterium
AISPGGRTRM

SEQ ID NO: 1191363 - protein, 5 aa, Mycobacterium
AISSS

SEQ ID NO: 1191364 - protein, 6 aa, Mycobacterium
AISTGG

SEQ ID NO: 1191365 - protein, 5 aa, Mycobacterium
AITAG

SEQ ID NO: 1191366 - protein, 5 aa, Mycobacterium
AITDP

SEQ ID NO: 1191367 - protein, 9 aa, Mycobacterium
AITEAGSGI

SEQ ID NO: 1191368 - protein, 8 aa, Mycobacterium
AITEPEGL

SEQ ID NO: 1191369 - protein, 10 aa, Mycobacterium
AITGPAAGTD

SEQ ID NO: 1191370 - protein, 4 aa, Mycobacterium
AITP

SEQ ID NO: 1191371 - protein, 6 aa, Mycobacterium
AITPRT

SEQ ID NO: 1191372 - protein, 6 aa, Mycobacterium
AITQGN

SEQ ID NO: 1191373 - protein, 6 aa, Mycobacterium
AITRRG

SEQ ID NO: 1191374 - protein, 4 aa, Mycobacterium
AITT

SEQ ID NO: 1191375 - protein, 7 aa, Mycobacterium
AITTNPY

SEQ ID NO: 1191376 - protein, 6 aa, Mycobacterium
AKAAAE

SEQ ID NO: 1191377 - protein, 8 aa, Mycobacterium
AKAAAREL

SEQ ID NO: 1191378 - protein, 8 aa, Mycobacterium
AKAAGATI

SEQ ID NO: 1191379 - protein, 11 aa, Mycobacterium
AKAAGDAVRNG

SEQ ID NO: 1191380 - protein, 9 aa, Mycobacterium
AKAAGGSIN

SEQ ID NO: 1191381 - protein, 18 aa, Mycobacterium
AKAAGKYPQEFSGGQRQR

SEQ ID NO: 1191382 - protein, 6 aa, Mycobacterium
AKAALS

SEQ ID NO: 1191383 - protein, 10 aa, Mycobacterium
AKAASASNPH

SEQ ID NO: 1191384 - protein, 8 aa, Mycobacterium
AKADAAGI

SEQ ID NO: 1191385 - protein, 9 aa, Mycobacterium
AKADPRDRP

SEQ ID NO: 1191386 - protein, 15 aa, Mycobacterium
AKADRRSGDGKPLYS

SEQ ID NO: 1191387 - protein, 7 aa, Mycobacterium
AKAEAKG

SEQ ID NO: 1191388 - protein, 6 aa, Mycobacterium
AKAEEL

SEQ ID NO: 1191389 - protein, 8 aa, Mycobacterium
AKAEEPTL

SEQ ID NO: 1191390 - protein, 9 aa, Mycobacterium
AKAESAMPP

SEQ ID NO: 1191391 - protein, 11 aa, Mycobacterium
AKAFGARDLSG

SEQ ID NO: 1191392 - protein, 8 aa, Mycobacterium
AKAFGTPG

SEQ ID NO: 1191393 - protein, 10 aa, Mycobacterium
AKAGAPARPS

SEQ ID NO: 1191394 - protein, 15 aa, Mycobacterium
AKAGDDGSPDTKSGP

SEQ ID NO: 1191395 - protein, 8 aa, Mycobacterium
AKAGDGTV

SEQ ID NO: 1191396 - protein, 7 aa, Mycobacterium
AKAGDRT

SEQ ID NO: 1191397 - protein, 8 aa, Mycobacterium
AKAGKDHV

SEQ ID NO: 1191398 - protein, 7 aa, Mycobacterium
AKAGMEN

SEQ ID NO: 1191399 - protein, 10 aa, Mycobacterium
AKAKFAEREG

SEQ ID NO: 1191400 - protein, 8 aa, Mycobacterium
AKAKGQTF

SEQ ID NO: 1191401 - protein, 8 aa, Mycobacterium
AKAKLEAK

SEQ ID NO: 1191402 - protein, 11 aa, Mycobacterium
AKAKRGNPQAR

SEQ ID NO: 1191403 - protein, 7 aa, Mycobacterium
AKALRES

SEQ ID NO: 1191404 - protein, 7 aa, Mycobacterium
AKANGAK

SEQ ID NO: 1191405 - protein, 7 aa, Mycobacterium
AKAQADR

SEQ ID NO: 1191406 - protein, 36 aa, Mycobacterium
AKAQGKHSNIGYDAPKGMDETKSKIRLGTGDPRIST

SEQ ID NO: 1191407 - protein, 9 aa, Mycobacterium
AKARQCGET

SEQ ID NO: 1191408 - protein, 7 aa, Mycobacterium
AKARQWR

SEQ ID NO: 1191409 - protein, 11 aa, Mycobacterium
AKARSNEGSGI

SEQ ID NO: 1191410 - protein, 16 aa, Mycobacterium
AKASASTYSRYIATRL

SEQ ID NO: 1191411 - protein, 13 aa, Mycobacterium
AKASLAGPPRAFT

SEQ ID NO: 1191412 - protein, 8 aa, Mycobacterium
AKATAAGA

SEQ ID NO: 1191413 - protein, 6 aa, Mycobacterium
AKATEV

SEQ ID NO: 1191414 - protein, 8 aa, Mycobacterium
AKATGLQS

SEQ ID NO: 1191415 - protein, 19 aa, Mycobacterium
AKATSRDTVRSRSFTGKPA

SEQ ID NO: 1191416 - protein, 9 aa, Mycobacterium
AKATYDERR

SEQ ID NO: 1191417 - protein, 11 aa, Mycobacterium
AKAVAEEATKR

SEQ ID NO: 1191418 - protein, 9 aa, Mycobacterium
AKAVTDKPS

SEQ ID NO: 1191419 - protein, 9 aa, Mycobacterium
AKDAALSET

SEQ ID NO: 1191420 - protein, 10 aa, Mycobacterium
AKDASGTGVT

SEQ ID NO: 1191421 - protein, 7 aa, Mycobacterium
AKDATKR

SEQ ID NO: 1191422 - protein, 7 aa, Mycobacterium
AKDETQA

SEQ ID NO: 1191423 - protein, 12 aa, Mycobacterium
AKDETQRPIPPL

SEQ ID NO: 1191424 - protein, 8 aa, Mycobacterium
AKDGHQPL

SEQ ID NO: 1191425 - protein, 10 aa, Mycobacterium
AKDGRGARTV

SEQ ID NO: 1191426 - protein, 8 aa, Mycobacterium
AKDGSGGW

SEQ ID NO: 1191427 - protein, 18 aa, Mycobacterium
AKDHADSTVSTANAEADS

SEQ ID NO: 1191428 - protein, 10 aa, Mycobacterium
AKDLASGDTV

SEQ ID NO: 1191429 - protein, 7 aa, Mycobacterium
AKDPALA

SEQ ID NO: 1191430 - protein, 7 aa, Mycobacterium
AKDQDVE

SEQ ID NO: 1191431 - protein, 4 aa, Mycobacterium
AKDW

SEQ ID NO: 1191432 - protein, 109 aa, Mycobacterium
AKEAAPGANMPTDQCGDEVPGTGEPDGGEESGSDEPGSSESTGSSESTGGEPSGDEVSGSSESTGDESDSGDEVSGGGEAAEQTGDRSARTSARAGRDTRTQDQRNHDG

SEQ ID NO: 1191433 - protein, 77 aa, Mycobacterium
AKEAAPGANMPTDQPGSDEPAGDEEPGSDEPDSDESDSGDEVSGGGEAAEQTGDRSARTSARAGRDTRTQDQRNHDG

SEQ ID NO: 1191434 - protein, 14 aa, Mycobacterium
AKEAFGTQKRQRQM

SEQ ID NO: 1191435 - protein, 8 aa, Mycobacterium
AKEAGLDP

SEQ ID NO: 1191436 - protein, 6 aa, Mycobacterium
AKEAPG

SEQ ID NO: 1191437 - protein, 6 aa, Mycobacterium
AKEGLG

SEQ ID NO: 1191438 - protein, 14 aa, Mycobacterium
AKEGVEVKPENQTL

SEQ ID NO: 1191439 - protein, 6 aa, Mycobacterium
AKEHNA

SEQ ID NO: 1191440 - protein, 10 aa, Mycobacterium
AKEIADQHGK

SEQ ID NO: 1191441 - protein, 22 aa, Mycobacterium
AKEPGGEKAVAKREKKGIPSAR

SEQ ID NO: 1191442 - protein, 6 aa, Mycobacterium
AKEQKA

SEQ ID NO: 1191443 - protein, 10 aa, Mycobacterium
AKERRRADGS

SEQ ID NO: 1191444 - protein, 17 aa, Mycobacterium
AKETADAGSPVAGRPVE

SEQ ID NO: 1191445 - protein, 9 aa, Mycobacterium
AKETPGWTV

SEQ ID NO: 1191446 - protein, 11 aa, Mycobacterium
AKEVETKEQIA

SEQ ID NO: 1191447 - protein, 5 aa, Mycobacterium
AKEWT

SEQ ID NO: 1191448 - protein, 5 aa, Mycobacterium
AKFGL

SEQ ID NO: 1191449 - protein, 7 aa, Mycobacterium
AKFNPDV

SEQ ID NO: 1191450 - protein, 8 aa, Mycobacterium
AKFPTPQG

SEQ ID NO: 1191451 - protein, 17 aa, Mycobacterium
AKGAARAGATQEEAAEA

SEQ ID NO: 1191452 - protein, 19 aa, Mycobacterium
AKGAKALTGGERRNGPGSF

SEQ ID NO: 1191453 - protein, 7 aa, Mycobacterium
AKGAPTI

SEQ ID NO: 1191454 - protein, 20 aa, Mycobacterium
AKGARALTGGKRGSGPGSFY

SEQ ID NO: 1191455 - protein, 11 aa, Mycobacterium
AKGEDGPEPQD

SEQ ID NO: 1191456 - protein, 13 aa, Mycobacterium
AKGEPAPEDGYAG

SEQ ID NO: 1191457 - protein, 5 aa, Mycobacterium
AKGEQ

SEQ ID NO: 1191458 - protein, 11 aa, Mycobacterium
AKGESAPEFTA

SEQ ID NO: 1191459 - protein, 10 aa, Mycobacterium
AKGETDQPVS

SEQ ID NO: 1191460 - protein, 8 aa, Mycobacterium
AKGETTDR

SEQ ID NO: 1191461 - protein, 6 aa, Mycobacterium
AKGGDR

SEQ ID NO: 1191462 - protein, 15 aa, Mycobacterium
AKGGPGGKPGCGSLP

SEQ ID NO: 1191463 - protein, 5 aa, Mycobacterium
AKGGT

SEQ ID NO: 1191464 - protein, 28 aa, Mycobacterium
AKGHDDDFNRGDSAYDNYYGDPTLPNPN

SEQ ID NO: 1191465 - protein, 15 aa, Mycobacterium
AKGHPGAQARDDALS

SEQ ID NO: 1191466 - protein, 9 aa, Mycobacterium
AKGHRQRAH

SEQ ID NO: 1191467 - protein, 56 aa, Mycobacterium
AKGIDDKAQPLTYTGPSEDGGVEVKRSGGGTPSTGGTRKERREAARQQKTGRHAKR

SEQ ID NO: 1191468 - protein, 8 aa, Mycobacterium
AKGISNFH

SEQ ID NO: 1191469 - protein, 14 aa, Mycobacterium
AKGKAALLRELSEV

SEQ ID NO: 1191470 - protein, 15 aa, Mycobacterium
AKGLPAAGGEPAKNI

SEQ ID NO: 1191471 - protein, 10 aa, Mycobacterium
AKGLRDGTHY

SEQ ID NO: 1191472 - protein, 43 aa, Mycobacterium
AKGNADGWPDTKNPKFAEAQERSNQAAAGGDEWHDPREDGNLP

SEQ ID NO: 1191473 - protein, 12 aa, Mycobacterium
AKGNAYETTEGV

SEQ ID NO: 1191474 - protein, 11 aa, Mycobacterium
AKGPLTGADDS

SEQ ID NO: 1191475 - protein, 5 aa, Mycobacterium
AKGRA

SEQ ID NO: 1191476 - protein, 8 aa, Mycobacterium
AKGRGPVV

SEQ ID NO: 1191477 - protein, 8 aa, Mycobacterium
AKGRGRNM

SEQ ID NO: 1191478 - protein, 6 aa, Mycobacterium
AKGRRV

SEQ ID NO: 1191479 - protein, 12 aa, Mycobacterium
AKGVERKGQTMP

SEQ ID NO: 1191480 - protein, 12 aa, Mycobacterium
AKGWDGFAVAVV

SEQ ID NO: 1191481 - protein, 14 aa, Mycobacterium
AKGWPEDGIEPGTR

SEQ ID NO: 1191482 - protein, 4 aa, Mycobacterium
AKGY

SEQ ID NO: 1191483 - protein, 24 aa, Mycobacterium
AKGYDLPDYPGDPKTDEEKAVKER

SEQ ID NO: 1191484 - protein, 28 aa, Mycobacterium
AKHAESQKVDKFPKEVTDDANKVAATPV

SEQ ID NO: 1191485 - protein, 8 aa, Mycobacterium
AKHAPAVT

SEQ ID NO: 1191486 - protein, 11 aa, Mycobacterium
AKHARAQGSPL

SEQ ID NO: 1191487 - protein, 8 aa, Mycobacterium
AKHDEEHS

SEQ ID NO: 1191488 - protein, 9 aa, Mycobacterium
AKHPGISGR

SEQ ID NO: 1191489 - protein, 13 aa, Mycobacterium
AKIASAKLPGEAE

SEQ ID NO: 1191490 - protein, 13 aa, Mycobacterium
AKIASAKLSGEAE

SEQ ID NO: 1191491 - protein, 4 aa, Mycobacterium
AKIG

SEQ ID NO: 1191492 - protein, 12 aa, Mycobacterium
AKIGPDKDIPHV

SEQ ID NO: 1191493 - protein, 10 aa, Mycobacterium
AKKAAEARAD

SEQ ID NO: 1191494 - protein, 7 aa, Mycobacterium
AKKGSLN

SEQ ID NO: 1191495 - protein, 9 aa, Mycobacterium
AKKGVGTGI

SEQ ID NO: 1191496 - protein, 9 aa, Mycobacterium
AKKLGSDKA

SEQ ID NO: 1191497 - protein, 9 aa, Mycobacterium
AKKRRDGNQ

SEQ ID NO: 1191498 - protein, 12 aa, Mycobacterium
AKKTRESLQTTA

SEQ ID NO: 1191499 - protein, 5 aa, Mycobacterium
AKLAE

SEQ ID NO: 1191500 - protein, 4 aa, Mycobacterium
AKLE

SEQ ID NO: 1191501 - protein, 12 aa, Mycobacterium
AKLGPDKDIPHV

SEQ ID NO: 1191502 - protein, 7 aa, Mycobacterium
AKLSGGE

SEQ ID NO: 1191503 - protein, 11 aa, Mycobacterium
AKMPTERPQMP

SEQ ID NO: 1191504 - protein, 8 aa, Mycobacterium
AKNAAKLR

SEQ ID NO: 1191505 - protein, 7 aa, Mycobacterium
AKNDSQS

SEQ ID NO: 1191506 - protein, 5 aa, Mycobacterium
AKNEV

SEQ ID NO: 1191507 - protein, 6 aa, Mycobacterium
AKNPFS

SEQ ID NO: 1191508 - protein, 7 aa, Mycobacterium
AKNPPHT

SEQ ID NO: 1191509 - protein, 7 aa, Mycobacterium
AKPADLD

SEQ ID NO: 1191510 - protein, 7 aa, Mycobacterium
AKPATLA

SEQ ID NO: 1191511 - protein, 6 aa, Mycobacterium
AKPAYE

SEQ ID NO: 1191512 - protein, 8 aa, Mycobacterium
AKPDGNRG

SEQ ID NO: 1191513 - protein, 4 aa, Mycobacterium
AKPG

SEQ ID NO: 1191514 - protein, 7 aa, Mycobacterium
AKPGLVS

SEQ ID NO: 1191515 - protein, 9 aa, Mycobacterium
AKPPKGQEF

SEQ ID NO: 1191516 - protein, 6 aa, Mycobacterium
AKPPLL

SEQ ID NO: 1191517 - protein, 10 aa, Mycobacterium
AKPPTATQGT

SEQ ID NO: 1191518 - protein, 8 aa, Mycobacterium
AKPQIGVG

SEQ ID NO: 1191519 - protein, 10 aa, Mycobacterium
AKPSSSKGRY

SEQ ID NO: 1191520 - protein, 9 aa, Mycobacterium
AKPTEFSPR

SEQ ID NO: 1191521 - protein, 4 aa, Mycobacterium
AKPV

SEQ ID NO: 1191522 - protein, 11 aa, Mycobacterium
AKPYSGDTYTL

SEQ ID NO: 1191523 - protein, 33 aa, Mycobacterium
AKQAEGDRDSHGAGRVGAEGFDGGCASGELAQP

SEQ ID NO: 1191524 - protein, 9 aa, Mycobacterium
AKQEPINGE

SEQ ID NO: 1191525 - protein, 4 aa, Mycobacterium
AKQG

SEQ ID NO: 1191526 - protein, 6 aa, Mycobacterium
AKQGRQ

SEQ ID NO: 1191527 - protein, 9 aa, Mycobacterium
AKQIETPAA

SEQ ID NO: 1191528 - protein, 6 aa, Mycobacterium
AKQKVP

SEQ ID NO: 1191529 - protein, 21 aa, Mycobacterium
AKQQKTRERRIRRTQEELEEG

SEQ ID NO: 1191530 - protein, 7 aa, Mycobacterium
AKQRDSV

SEQ ID NO: 1191531 - protein, 21 aa, Mycobacterium
AKQRKKAAERGEGENKKANVN

SEQ ID NO: 1191532 - protein, 13 aa, Mycobacterium
AKQSIGRATNNVA

SEQ ID NO: 1191533 - protein, 9 aa, Mycobacterium
AKQSPEDLD

SEQ ID NO: 1191534 - protein, 7 aa, Mycobacterium
AKRADHN

SEQ ID NO: 1191535 - protein, 7 aa, Mycobacterium
AKRDAAA

SEQ ID NO: 1191536 - protein, 6 aa, Mycobacterium
AKRDDD

SEQ ID NO: 1191537 - protein, 12 aa, Mycobacterium
AKRDEKPDFTER

SEQ ID NO: 1191538 - protein, 11 aa, Mycobacterium
AKREGDKYRVN

SEQ ID NO: 1191539 - protein, 6 aa, Mycobacterium
AKREGW

SEQ ID NO: 1191540 - protein, 8 aa, Mycobacterium
AKRERGRY

SEQ ID NO: 1191541 - protein, 8 aa, Mycobacterium
AKRGYPDD

SEQ ID NO: 1191542 - protein, 8 aa, Mycobacterium
AKRSAQAA

SEQ ID NO: 1191543 - protein, 8 aa, Mycobacterium
AKRTSADA

SEQ ID NO: 1191544 - protein, 11 aa, Mycobacterium
AKSAAAAGAGD

SEQ ID NO: 1191545 - protein, 17 aa, Mycobacterium
AKSADDGDGEGPGDGGQ

SEQ ID NO: 1191546 - protein, 7 aa, Mycobacterium
AKSAGKK

SEQ ID NO: 1191547 - protein, 6 aa, Mycobacterium
AKSDAM

SEQ ID NO: 1191548 - protein, 7 aa, Mycobacterium
AKSGIPD

SEQ ID NO: 1191549 - protein, 8 aa, Mycobacterium
AKSGKTTI

SEQ ID NO: 1191550 - protein, 8 aa, Mycobacterium
AKSGTERI

SEQ ID NO: 1191551 - protein, 9 aa, Mycobacterium
AKSGTGELR

SEQ ID NO: 1191552 - protein, 8 aa, Mycobacterium
AKSGVRRS

SEQ ID NO: 1191553 - protein, 6 aa, Mycobacterium
AKSKLN

SEQ ID NO: 1191554 - protein, 8 aa, Mycobacterium
AKSLKSVG

SEQ ID NO: 1191555 - protein, 6 aa, Mycobacterium
AKSNVE

SEQ ID NO: 1191556 - protein, 7 aa, Mycobacterium
AKSPNTA

SEQ ID NO: 1191557 - protein, 8 aa, Mycobacterium
AKSQNALG

SEQ ID NO: 1191558 - protein, 15 aa, Mycobacterium
AKSQTAAYGSLPAQG

SEQ ID NO: 1191559 - protein, 9 aa, Mycobacterium
AKSSFTPDG

SEQ ID NO: 1191560 - protein, 6 aa, Mycobacterium
AKSTAR

SEQ ID NO: 1191561 - protein, 7 aa, Mycobacterium
AKSTVVR

SEQ ID NO: 1191562 - protein, 8 aa, Mycobacterium
AKSVAAGT

SEQ ID NO: 1191563 - protein, 6 aa, Mycobacterium
AKTADK

SEQ ID NO: 1191564 - protein, 8 aa, Mycobacterium
AKTATGRL

SEQ ID NO: 1191565 - protein, 11 aa, Mycobacterium
AKTEPLEEGGR

SEQ ID NO: 1191566 - protein, 8 aa, Mycobacterium
AKTGEGTA

SEQ ID NO: 1191567 - protein, 10 aa, Mycobacterium
AKTGKQRTNT

SEQ ID NO: 1191568 - protein, 6 aa, Mycobacterium
AKTGLP

SEQ ID NO: 1191569 - protein, 6 aa, Mycobacterium
AKTGNL

SEQ ID NO: 1191570 - protein, 16 aa, Mycobacterium
AKTLGPRRGLTGTPLP

SEQ ID NO: 1191571 - protein, 10 aa, Mycobacterium
AKTNPRAQTR

SEQ ID NO: 1191572 - protein, 11 aa, Mycobacterium
AKTPGDPDALY

SEQ ID NO: 1191573 - protein, 10 aa, Mycobacterium
AKTPKQKRNR

SEQ ID NO: 1191574 - protein, 11 aa, Mycobacterium
AKTPSAPKDPL

SEQ ID NO: 1191575 - protein, 11 aa, Mycobacterium
AKTRDLTDKPF

SEQ ID NO: 1191576 - protein, 9 aa, Mycobacterium
AKTRHNEVA

SEQ ID NO: 1191577 - protein, 13 aa, Mycobacterium
AKTRTKGLDTSGL

SEQ ID NO: 1191578 - protein, 4 aa, Mycobacterium
AKTS

SEQ ID NO: 1191579 - protein, 7 aa, Mycobacterium
AKTSRRT

SEQ ID NO: 1191580 - protein, 4 aa, Mycobacterium
AKTT

SEQ ID NO: 1191581 - protein, 8 aa, Mycobacterium
AKTTSQAH

SEQ ID NO: 1191582 - protein, 7 aa, Mycobacterium
AKTWPPS

SEQ ID NO: 1191583 - protein, 7 aa, Mycobacterium
AKVKPGY

SEQ ID NO: 1191584 - protein, 20 aa, Mycobacterium
AKVNADRAGRREVWTVHAVR

SEQ ID NO: 1191585 - protein, 7 aa, Mycobacterium
AKVPPIA

SEQ ID NO: 1191586 - protein, 7 aa, Mycobacterium
AKVPTSR

SEQ ID NO: 1191587 - protein, 10 aa, Mycobacterium
AKVQSGELSY

SEQ ID NO: 1191588 - protein, 14 aa, Mycobacterium
AKVSTTAVREGDSW

SEQ ID NO: 1191589 - protein, 9 aa, Mycobacterium
AKVTTDAKA

SEQ ID NO: 1191590 - protein, 15 aa, Mycobacterium
AKYAGVGRPAPTKSA

SEQ ID NO: 1191591 - protein, 4 aa, Mycobacterium
AKYD

SEQ ID NO: 1191592 - protein, 11 aa, Mycobacterium
AKYPDGSTPPV

SEQ ID NO: 1191593 - protein, 5 aa, Mycobacterium
ALAAE

SEQ ID NO: 1191594 - protein, 13 aa, Mycobacterium
ALAAENSGAARDA

SEQ ID NO: 1191595 - protein, 5 aa, Mycobacterium
ALAAG

SEQ ID NO: 1191596 - protein, 6 aa, Mycobacterium
ALAAGG

SEQ ID NO: 1191597 - protein, 12 aa, Mycobacterium
ALAASDGEMGRG

SEQ ID NO: 1191598 - protein, 9 aa, Mycobacterium
ALADAEEKL

SEQ ID NO: 1191599 - protein, 7 aa, Mycobacterium
ALADPGV

SEQ ID NO: 1191600 - protein, 9 aa, Mycobacterium
ALADSGRLA

SEQ ID NO: 1191601 - protein, 7 aa, Mycobacterium
ALAEAGA

SEQ ID NO: 1191602 - protein, 17 aa, Mycobacterium
ALAEAGKAVEPGVTTDQ

SEQ ID NO: 1191603 - protein, 9 aa, Mycobacterium
ALAEGNAGE

SEQ ID NO: 1191604 - protein, 15 aa, Mycobacterium
ALAEQAARQDAAEQA

SEQ ID NO: 1191605 - protein, 12 aa, Mycobacterium
ALAGAAGKETAE

SEQ ID NO: 1191606 - protein, 6 aa, Mycobacterium
ALAGAG

SEQ ID NO: 1191607 - protein, 17 aa, Mycobacterium
ALAGAGTAFGQAASGVA

SEQ ID NO: 1191608 - protein, 10 aa, Mycobacterium
ALAGAPDATD

SEQ ID NO: 1191609 - protein, 6 aa, Mycobacterium
ALAGGT

SEQ ID NO: 1191610 - protein, 20 aa, Mycobacterium
ALAGRAPAKPQAELSAEDTE

SEQ ID NO: 1191611 - protein, 5 aa, Mycobacterium
ALAGT

SEQ ID NO: 1191612 - protein, 9 aa, Mycobacterium
ALANRGSGG

SEQ ID NO: 1191613 - protein, 12 aa, Mycobacterium
ALAPAGADEVSA

SEQ ID NO: 1191614 - protein, 9 aa, Mycobacterium
ALAPKAGAR

SEQ ID NO: 1191615 - protein, 8 aa, Mycobacterium
ALAPSRRT

SEQ ID NO: 1191616 - protein, 5 aa, Mycobacterium
ALAQD

SEQ ID NO: 1191617 - protein, 6 aa, Mycobacterium
ALAQQD

SEQ ID NO: 1191618 - protein, 7 aa, Mycobacterium
ALASHST

SEQ ID NO: 1191619 - protein, 10 aa, Mycobacterium
ALASPGDERE

SEQ ID NO: 1191620 - protein, 11 aa, Mycobacterium
ALASPTARGRF

SEQ ID NO: 1191621 - protein, 11 aa, Mycobacterium
ALASRARKAPG

SEQ ID NO: 1191622 - protein, 8 aa, Mycobacterium
ALASSSGL

SEQ ID NO: 1191623 - protein, 12 aa, Mycobacterium
ALATTDSGGTGV

SEQ ID NO: 1191624 - protein, 9 aa, Mycobacterium
ALATTGATF

SEQ ID NO: 1191625 - protein, 6 aa, Mycobacterium
ALATYT

SEQ ID NO: 1191626 - protein, 4 aa, Mycobacterium
ALDA

SEQ ID NO: 1191627 - protein, 8 aa, Mycobacterium
ALDAGDDQ

SEQ ID NO: 1191628 - protein, 7 aa, Mycobacterium
ALDDGPT

SEQ ID NO: 1191629 - protein, 7 aa, Mycobacterium
ALDDPDQ

SEQ ID NO: 1191630 - protein, 8 aa, Mycobacterium
ALDEPIDS

SEQ ID NO: 1191631 - protein, 7 aa, Mycobacterium
ALDGGAA

SEQ ID NO: 1191632 - protein, 9 aa, Mycobacterium
ALDGGDEPF

SEQ ID NO: 1191633 - protein, 9 aa, Mycobacterium
ALDGGFADT

SEQ ID NO: 1191634 - protein, 5 aa, Mycobacterium
ALDGK

SEQ ID NO: 1191635 - protein, 8 aa, Mycobacterium
ALDGPDGP

SEQ ID NO: 1191636 - protein, 10 aa, Mycobacterium
ALDKPGRDKL

SEQ ID NO: 1191637 - protein, 16 aa, Mycobacterium
ALDKSGNAIPAGVERE

SEQ ID NO: 1191638 - protein, 14 aa, Mycobacterium
ALDPAGILNPGKLI

SEQ ID NO: 1191639 - protein, 7 aa, Mycobacterium
ALDPASD

SEQ ID NO: 1191640 - protein, 15 aa, Mycobacterium
ALDPEVAEHDPPQAL

SEQ ID NO: 1191641 - protein, 7 aa, Mycobacterium
ALDPGEP

SEQ ID NO: 1191642 - protein, 8 aa, Mycobacterium
ALDPGKLP

SEQ ID NO: 1191643 - protein, 14 aa, Mycobacterium
ALDPGSVPAATPAV

SEQ ID NO: 1191644 - protein, 7 aa, Mycobacterium
ALDPKGE

SEQ ID NO: 1191645 - protein, 8 aa, Mycobacterium
ALDTGGPV

SEQ ID NO: 1191646 - protein, 9 aa, Mycobacterium
ALDTPGAEG

SEQ ID NO: 1191647 - protein, 10 aa, Mycobacterium
ALEAGRDTVP

SEQ ID NO: 1191648 - protein, 12 aa, Mycobacterium
ALEARKPDPLAV

SEQ ID NO: 1191649 - protein, 7 aa, Mycobacterium
ALEDNPD

SEQ ID NO: 1191650 - protein, 7 aa, Mycobacterium
ALEEGGA

SEQ ID NO: 1191651 - protein, 7 aa, Mycobacterium
ALEGDEK

SEQ ID NO: 1191652 - protein, 10 aa, Mycobacterium
ALEGGPHGVT

SEQ ID NO: 1191653 - protein, 6 aa, Mycobacterium
ALEKPG

SEQ ID NO: 1191654 - protein, 8 aa, Mycobacterium
ALEPDEVE

SEQ ID NO: 1191655 - protein, 15 aa, Mycobacterium
ALEQGEADQSDGAEL

SEQ ID NO: 1191656 - protein, 9 aa, Mycobacterium
ALERQQAAD

SEQ ID NO: 1191657 - protein, 9 aa, Mycobacterium
ALERSTRES

SEQ ID NO: 1191658 - protein, 10 aa, Mycobacterium
ALESQDGSDV

SEQ ID NO: 1191659 - protein, 7 aa, Mycobacterium
ALETGDT

SEQ ID NO: 1191660 - protein, 7 aa, Mycobacterium
ALGADDA

SEQ ID NO: 1191661 - protein, 10 aa, Mycobacterium
ALGDDGEAQR

SEQ ID NO: 1191662 - protein, 8 aa, Mycobacterium
ALGEEGRS

SEQ ID NO: 1191663 - protein, 28 aa, Mycobacterium
ALGEGTELGVGDGAEPAGGAEPGDEPRL

SEQ ID NO: 1191664 - protein, 6 aa, Mycobacterium
ALGGAT

SEQ ID NO: 1191665 - protein, 15 aa, Mycobacterium
ALGGDRADTADHPVS

SEQ ID NO: 1191666 - protein, 8 aa, Mycobacterium
ALGGPAAL

SEQ ID NO: 1191667 - protein, 7 aa, Mycobacterium
ALGGPDL

SEQ ID NO: 1191668 - protein, 18 aa, Mycobacterium
ALGGQPPATRIPNLSGQY

SEQ ID NO: 1191669 - protein, 6 aa, Mycobacterium
ALGGQQ

SEQ ID NO: 1191670 - protein, 8 aa, Mycobacterium
ALGGSTVP

SEQ ID NO: 1191671 - protein, 10 aa, Mycobacterium
ALGKPDKKAV

SEQ ID NO: 1191672 - protein, 13 aa, Mycobacterium
ALGLPGSDHSWAS

SEQ ID NO: 1191673 - protein, 8 aa, Mycobacterium
ALGLPGSS

SEQ ID NO: 1191674 - protein, 5 aa, Mycobacterium
ALGPD

SEQ ID NO: 1191675 - protein, 6 aa, Mycobacterium
ALGPDD

SEQ ID NO: 1191676 - protein, 17 aa, Mycobacterium
ALGPDEQDAHAGSAGRP

SEQ ID NO: 1191677 - protein, 10 aa, Mycobacterium
ALGPDTDPDV

SEQ ID NO: 1191678 - protein, 6 aa, Mycobacterium
ALGPGA

SEQ ID NO: 1191679 - protein, 13 aa, Mycobacterium
ALGPGGISGPPVA

SEQ ID NO: 1191680 - protein, 14 aa, Mycobacterium
ALGPRRGLTGTPLP

SEQ ID NO: 1191681 - protein, 14 aa, Mycobacterium
ALGQGSYSDLDADT

SEQ ID NO: 1191682 - protein, 8 aa, Mycobacterium
ALGSGSPA

SEQ ID NO: 1191683 - protein, 14 aa, Mycobacterium
ALGSSSAKRGATRG

SEQ ID NO: 1191684 - protein, 13 aa, Mycobacterium
ALGSYADPAWAAE

SEQ ID NO: 1191685 - protein, 4 aa, Mycobacterium
ALGT

SEQ ID NO: 1191686 - protein, 5 aa, Mycobacterium
ALGTD

SEQ ID NO: 1191687 - protein, 7 aa, Mycobacterium
ALGTPSE

SEQ ID NO: 1191688 - protein, 16 aa, Mycobacterium
ALHDTARPDREPHAVA

SEQ ID NO: 1191689 - protein, 4 aa, Mycobacterium
ALKD

SEQ ID NO: 1191690 - protein, 13 aa, Mycobacterium
ALKGDGGSSWGNQ

SEQ ID NO: 1191691 - protein, 17 aa, Mycobacterium
ALKSASPQERRRAVEEN

SEQ ID NO: 1191692 - protein, 12 aa, Mycobacterium
ALKSDGTSTRAD

SEQ ID NO: 1191693 - protein, 12 aa, Mycobacterium
ALLPKGAYDTAR

SEQ ID NO: 1191694 - protein, 7 aa, Mycobacterium
ALNEPAE

SEQ ID NO: 1191695 - protein, 10 aa, Mycobacterium
ALNGATEQDR

SEQ ID NO: 1191696 - protein, 10 aa, Mycobacterium
ALNKPSNSDV

SEQ ID NO: 1191697 - protein, 12 aa, Mycobacterium
ALNNDGSTKMTY

SEQ ID NO: 1191698 - protein, 8 aa, Mycobacterium
ALNNSGTT

SEQ ID NO: 1191699 - protein, 5 aa, Mycobacterium
ALNPE

SEQ ID NO: 1191700 - protein, 4 aa, Mycobacterium
ALNS

SEQ ID NO: 1191701 - protein, 6 aa, Mycobacterium
ALNSGR

SEQ ID NO: 1191702 - protein, 4 aa, Mycobacterium
ALPA

SEQ ID NO: 1191703 - protein, 8 aa, Mycobacterium
ALPAPELT

SEQ ID NO: 1191704 - protein, 14 aa, Mycobacterium
ALPAPNSAVELPGG

SEQ ID NO: 1191705 - protein, 13 aa, Mycobacterium
ALPAPRVSEAEAQ

SEQ ID NO: 1191706 - protein, 10 aa, Mycobacterium
ALPASRESSY

SEQ ID NO: 1191707 - protein, 8 aa, Mycobacterium
ALPDAPDI

SEQ ID NO: 1191708 - protein, 6 aa, Mycobacterium
ALPDDP

SEQ ID NO: 1191709 - protein, 6 aa, Mycobacterium
ALPDGA

SEQ ID NO: 1191710 - protein, 8 aa, Mycobacterium
ALPDSEPR

SEQ ID NO: 1191711 - protein, 8 aa, Mycobacterium
ALPDTEPR

SEQ ID NO: 1191712 - protein, 15 aa, Mycobacterium
ALPDTGAHIRTGSSI

SEQ ID NO: 1191713 - protein, 7 aa, Mycobacterium
ALPDTRT

SEQ ID NO: 1191714 - protein, 22 aa, Mycobacterium
ALPEPEIAPTTEFREPAAGTEA

SEQ ID NO: 1191715 - protein, 24 aa, Mycobacterium
ALPERGEPIADPKRPWKEPRPAPL

SEQ ID NO: 1191716 - protein, 5 aa, Mycobacterium
ALPGA

SEQ ID NO: 1191717 - protein, 7 aa, Mycobacterium
ALPGDPT

SEQ ID NO: 1191718 - protein, 6 aa, Mycobacterium
ALPGGD

SEQ ID NO: 1191719 - protein, 8 aa, Mycobacterium
ALPGGQPE

SEQ ID NO: 1191720 - protein, 17 aa, Mycobacterium
ALPGGSPADDKARETAT

SEQ ID NO: 1191721 - protein, 7 aa, Mycobacterium
ALPGKAI

SEQ ID NO: 1191722 - protein, 5 aa, Mycobacterium
ALPGQ

SEQ ID NO: 1191723 - protein, 9 aa, Mycobacterium
ALPGTDIDP

SEQ ID NO: 1191724 - protein, 12 aa, Mycobacterium
ALPNPPAGHESA

SEQ ID NO: 1191725 - protein, 14 aa, Mycobacterium
ALPPGRPGDPERDD

SEQ ID NO: 1191726 - protein, 7 aa, Mycobacterium
ALPPKRR

SEQ ID NO: 1191727 - protein, 9 aa, Mycobacterium
ALPPPGQFQ

SEQ ID NO: 1191728 - protein, 8 aa, Mycobacterium
ALPPPQAG

SEQ ID NO: 1191729 - protein, 6 aa, Mycobacterium
ALPPQR

SEQ ID NO: 1191730 - protein, 9 aa, Mycobacterium
ALPPQSRSS

SEQ ID NO: 1191731 - protein, 8 aa, Mycobacterium
ALPPSDSL

SEQ ID NO: 1191732 - protein, 9 aa, Mycobacterium
ALPPTDDEL

SEQ ID NO: 1191733 - protein, 7 aa, Mycobacterium
ALPQPPR

SEQ ID NO: 1191734 - protein, 6 aa, Mycobacterium
ALPQRD

SEQ ID NO: 1191735 - protein, 6 aa, Mycobacterium
ALPQRQ

SEQ ID NO: 1191736 - protein, 6 aa, Mycobacterium
ALPQTA

SEQ ID NO: 1191737 - protein, 5 aa, Mycobacterium
ALPRQ

SEQ ID NO: 1191738 - protein, 7 aa, Mycobacterium
ALPRSNG

SEQ ID NO: 1191739 - protein, 6 aa, Mycobacterium
ALPRTE

SEQ ID NO: 1191740 - protein, 16 aa, Mycobacterium
ALPSEKEIRRREEAGI

SEQ ID NO: 1191741 - protein, 9 aa, Mycobacterium
ALPSPAHRR

SEQ ID NO: 1191742 - protein, 8 aa, Mycobacterium
ALPSPREA

SEQ ID NO: 1191743 - protein, 8 aa, Mycobacterium
ALPSRDER

SEQ ID NO: 1191744 - protein, 6 aa, Mycobacterium
ALPSYS

SEQ ID NO: 1191745 - protein, 11 aa, Mycobacterium
ALPTDDDSAGR

SEQ ID NO: 1191746 - protein, 7 aa, Mycobacterium
ALPTEGT

SEQ ID NO: 1191747 - protein, 8 aa, Mycobacterium
ALPTGEDI

SEQ ID NO: 1191748 - protein, 16 aa, Mycobacterium
ALPVGTDGAADDGASE

SEQ ID NO: 1191749 - protein, 5 aa, Mycobacterium
ALPYG

SEQ ID NO: 1191750 - protein, 5 aa, Mycobacterium
ALQAG

SEQ ID NO: 1191751 - protein, 11 aa, Mycobacterium
ALQDAAKAYAG

SEQ ID NO: 1191752 - protein, 6 aa, Mycobacterium
ALQDGQ

SEQ ID NO: 1191753 - protein, 7 aa, Mycobacterium
ALQDNGI

SEQ ID NO: 1191754 - protein, 8 aa, Mycobacterium
ALQESRDR

SEQ ID NO: 1191755 - protein, 9 aa, Mycobacterium
ALQESRDRV

SEQ ID NO: 1191756 - protein, 4 aa, Mycobacterium
ALQG

SEQ ID NO: 1191757 - protein, 13 aa, Mycobacterium
ALQGTPAPPTVSG

SEQ ID NO: 1191758 - protein, 8 aa, Mycobacterium
ALQTTSDP

SEQ ID NO: 1191759 - protein, 7 aa, Mycobacterium
ALRANGR

SEQ ID NO: 1191760 - protein, 29 aa, Mycobacterium
ALRASDSSPDIKPRSRDVTDGLEKTAARG

SEQ ID NO: 1191761 - protein, 29 aa, Mycobacterium
ALRASDSTPDIKPRSRDVTDGLEKTAARG

SEQ ID NO: 1191762 - protein, 13 aa, Mycobacterium
ALRDDGTAAKGGR

SEQ ID NO: 1191763 - protein, 5 aa, Mycobacterium
ALRDG

SEQ ID NO: 1191764 - protein, 8 aa, Mycobacterium
ALRDGGFS

SEQ ID NO: 1191765 - protein, 10 aa, Mycobacterium
ALRDNGIQAS

SEQ ID NO: 1191766 - protein, 4 aa, Mycobacterium
ALRE

SEQ ID NO: 1191767 - protein, 11 aa, Mycobacterium
ALRERTGSDAH

SEQ ID NO: 1191768 - protein, 14 aa, Mycobacterium
ALRGESGVSAATRD

SEQ ID NO: 1191769 - protein, 8 aa, Mycobacterium
ALRGGADD

SEQ ID NO: 1191770 - protein, 12 aa, Mycobacterium
ALRGSATSRDET

SEQ ID NO: 1191771 - protein, 11 aa, Mycobacterium
ALRPDRRGQLG

SEQ ID NO: 1191772 - protein, 6 aa, Mycobacterium
ALRPGD

SEQ ID NO: 1191773 - protein, 7 aa, Mycobacterium
ALRPRPE

SEQ ID NO: 1191774 - protein, 5 aa, Mycobacterium
ALRQQ

SEQ ID NO: 1191775 - protein, 5 aa, Mycobacterium
ALRSG

SEQ ID NO: 1191776 - protein, 7 aa, Mycobacterium
ALRSGDA

SEQ ID NO: 1191777 - protein, 12 aa, Mycobacterium
ALSAPDYAEAKE

SEQ ID NO: 1191778 - protein, 14 aa, Mycobacterium
ALSAPERRRAERAV

SEQ ID NO: 1191779 - protein, 31 aa, Mycobacterium
ALSDQASPAGIPSTAPVTPTGAPQPVNGRPG

SEQ ID NO: 1191780 - protein, 10 aa, Mycobacterium
ALSDRARNGR

SEQ ID NO: 1191781 - protein, 7 aa, Mycobacterium
ALSEAEN

SEQ ID NO: 1191782 - protein, 12 aa, Mycobacterium
ALSERLRKKARG

SEQ ID NO: 1191783 - protein, 7 aa, Mycobacterium
ALSGDKL

SEQ ID NO: 1191784 - protein, 8 aa, Mycobacterium
ALSGDPGV

SEQ ID NO: 1191785 - protein, 12 aa, Mycobacterium
ALSGTGLSERDK

SEQ ID NO: 1191786 - protein, 6 aa, Mycobacterium
ALSPER

SEQ ID NO: 1191787 - protein, 7 aa, Mycobacterium
ALSPRSR

SEQ ID NO: 1191788 - protein, 10 aa, Mycobacterium
ALSPSRASDF

SEQ ID NO: 1191789 - protein, 6 aa, Mycobacterium
ALSPVD

SEQ ID NO: 1191790 - protein, 7 aa, Mycobacterium
ALSQQPA

SEQ ID NO: 1191791 - protein, 8 aa, Mycobacterium
ALSRRDVR

SEQ ID NO: 1191792 - protein, 8 aa, Mycobacterium
ALSRSGGD

SEQ ID NO: 1191793 - protein, 13 aa, Mycobacterium
ALSSKGSRLAADT

SEQ ID NO: 1191794 - protein, 9 aa, Mycobacterium
ALSSRKRGL

SEQ ID NO: 1191795 - protein, 10 aa, Mycobacterium
ALSSSAPIDD

SEQ ID NO: 1191796 - protein, 13 aa, Mycobacterium
ALSTSSTGAVPPT

SEQ ID NO: 1191797 - protein, 13 aa, Mycobacterium
ALSTTAPEALGGG

SEQ ID NO: 1191798 - protein, 7 aa, Mycobacterium
ALTADGP

SEQ ID NO: 1191799 - protein, 11 aa, Mycobacterium
ALTAPAPHHTR

SEQ ID NO: 1191800 - protein, 9 aa, Mycobacterium
ALTDAEKQR

SEQ ID NO: 1191801 - protein, 8 aa, Mycobacterium
ALTDRGAV

SEQ ID NO: 1191802 - protein, 10 aa, Mycobacterium
ALTDYPRPSV

SEQ ID NO: 1191803 - protein, 6 aa, Mycobacterium
ALTERR

SEQ ID NO: 1191804 - protein, 6 aa, Mycobacterium
ALTGAS

SEQ ID NO: 1191805 - protein, 11 aa, Mycobacterium
ALTGDDTETQL

SEQ ID NO: 1191806 - protein, 5 aa, Mycobacterium
ALTGL

SEQ ID NO: 1191807 - protein, 9 aa, Mycobacterium
ALTGQRTRA

SEQ ID NO: 1191808 - protein, 11 aa, Mycobacterium
ALTKGDQPTVA

SEQ ID NO: 1191809 - protein, 7 aa, Mycobacterium
ALTPAQQ

SEQ ID NO: 1191810 - protein, 6 aa, Mycobacterium
ALTPGR

SEQ ID NO: 1191811 - protein, 10 aa, Mycobacterium
ALTPPASAPV

SEQ ID NO: 1191812 - protein, 7 aa, Mycobacterium
ALTPQQQ

SEQ ID NO: 1191813 - protein, 6 aa, Mycobacterium
ALTQTN

SEQ ID NO: 1191814 - protein, 6 aa, Mycobacterium
ALTSEA

SEQ ID NO: 1191815 - protein, 4 aa, Mycobacterium
ALTT

SEQ ID NO: 1191816 - protein, 5 aa, Mycobacterium
ALTTA

SEQ ID NO: 1191817 - protein, 8 aa, Mycobacterium
ALTTRAAE

SEQ ID NO: 1191818 - protein, 8 aa, Mycobacterium
AMAAPDEA

SEQ ID NO: 1191819 - protein, 6 aa, Mycobacterium
AMAGGS

SEQ ID NO: 1191820 - protein, 11 aa, Mycobacterium
AMAGRGPVVDQ

SEQ ID NO: 1191821 - protein, 12 aa, Mycobacterium
AMAGTDDTGTAW

SEQ ID NO: 1191822 - protein, 9 aa, Mycobacterium
AMDGGADNG

SEQ ID NO: 1191823 - protein, 8 aa, Mycobacterium
AMESGVPT

SEQ ID NO: 1191824 - protein, 27 aa, Mycobacterium
AMESTDYKDLDEVPEQVASTTAAAARN

SEQ ID NO: 1191825 - protein, 6 aa, Mycobacterium
AMETQR

SEQ ID NO: 1191826 - protein, 6 aa, Mycobacterium
AMGGRQ

SEQ ID NO: 1191827 - protein, 11 aa, Mycobacterium
AMGPPATTPPP

SEQ ID NO: 1191828 - protein, 5 aa, Mycobacterium
AMGPR

SEQ ID NO: 1191829 - protein, 8 aa, Mycobacterium
AMGRSKRE

SEQ ID NO: 1191830 - protein, 21 aa, Mycobacterium
AMGTENSNPVHRTGPGPMGPS

SEQ ID NO: 1191831 - protein, 22 aa, Mycobacterium
AMKEKSREFADQGNKVYLPVVT

SEQ ID NO: 1191832 - protein, 19 aa, Mycobacterium
AMNGTDAWEPVPAAHDGDF

SEQ ID NO: 1191833 - protein, 7 aa, Mycobacterium
AMPEGDK

SEQ ID NO: 1191834 - protein, 5 aa, Mycobacterium
AMPGS

SEQ ID NO: 1191835 - protein, 4 aa, Mycobacterium
AMPL

SEQ ID NO: 1191836 - protein, 4 aa, Mycobacterium
AMPP

SEQ ID NO: 1191837 - protein, 6 aa, Mycobacterium
AMPPGT

SEQ ID NO: 1191838 - protein, 5 aa, Mycobacterium
AMPTA

SEQ ID NO: 1191839 - protein, 17 aa, Mycobacterium
AMRERSELARKGIARGR

SEQ ID NO: 1191840 - protein, 6 aa, Mycobacterium
AMRPSY

SEQ ID NO: 1191841 - protein, 11 aa, Mycobacterium
AMSNGRPETRF

SEQ ID NO: 1191842 - protein, 8 aa, Mycobacterium
AMSPAGGV

SEQ ID NO: 1191843 - protein, 5 aa, Mycobacterium
AMTDT

SEQ ID NO: 1191844 - protein, 4 aa, Mycobacterium
AMTP

SEQ ID NO: 1191845 - protein, 11 aa, Mycobacterium
AMTTDGPTTFS

SEQ ID NO: 1191846 - protein, 5 aa, Mycobacterium
AMYNT

SEQ ID NO: 1191847 - protein, 15 aa, Mycobacterium
ANAAEGRHHGGSRPY

SEQ ID NO: 1191848 - protein, 19 aa, Mycobacterium
ANAAPPSAPDADIDGATAA

SEQ ID NO: 1191849 - protein, 4 aa, Mycobacterium
ANAD

SEQ ID NO: 1191850 - protein, 8 aa, Mycobacterium
ANADPGDV

SEQ ID NO: 1191851 - protein, 6 aa, Mycobacterium
ANADQI

SEQ ID NO: 1191852 - protein, 9 aa, Mycobacterium
ANADTENGI

SEQ ID NO: 1191853 - protein, 11 aa, Mycobacterium
ANAGRTGRRGL

SEQ ID NO: 1191854 - protein, 8 aa, Mycobacterium
ANAGSPEL

SEQ ID NO: 1191855 - protein, 15 aa, Mycobacterium
ANAGTLGSSGPRARE

SEQ ID NO: 1191856 - protein, 8 aa, Mycobacterium
ANALATGL

SEQ ID NO: 1191857 - protein, 12 aa, Mycobacterium
ANAPKGIRTPNV

SEQ ID NO: 1191858 - protein, 9 aa, Mycobacterium
ANAPRGDID

SEQ ID NO: 1191859 - protein, 10 aa, Mycobacterium
ANAQNSREGF

SEQ ID NO: 1191860 - protein, 8 aa, Mycobacterium
ANAQQPGI

SEQ ID NO: 1191861 - protein, 8 aa, Mycobacterium
ANAQSPAG

SEQ ID NO: 1191862 - protein, 4 aa, Mycobacterium
ANAT

SEQ ID NO: 1191863 - protein, 10 aa, Mycobacterium
ANATTSRIDQ

SEQ ID NO: 1191864 - protein, 6 aa, Mycobacterium
ANCEKR

SEQ ID NO: 1191865 - protein, 7 aa, Mycobacterium
ANDAQAT

SEQ ID NO: 1191866 - protein, 6 aa, Mycobacterium
ANDCNT

SEQ ID NO: 1191867 - protein, 8 aa, Mycobacterium
ANDDYPQG

SEQ ID NO: 1191868 - protein, 7 aa, Mycobacterium
ANDEQEM

SEQ ID NO: 1191869 - protein, 5 aa, Mycobacterium
ANDEV

SEQ ID NO: 1191870 - protein, 10 aa, Mycobacterium
ANDGQASRFD

SEQ ID NO: 1191871 - protein, 12 aa, Mycobacterium
ANDHEDGNGQFE

SEQ ID NO: 1191872 - protein, 14 aa, Mycobacterium
ANDNRRRAAERAGA

SEQ ID NO: 1191873 - protein, 7 aa, Mycobacterium
ANDPDAA

SEQ ID NO: 1191874 - protein, 7 aa, Mycobacterium
ANDPDGR

SEQ ID NO: 1191875 - protein, 8 aa, Mycobacterium
ANDPDTAR

SEQ ID NO: 1191876 - protein, 8 aa, Mycobacterium
ANDPPEHQ

SEQ ID NO: 1191877 - protein, 8 aa, Mycobacterium
ANDPPTGT

SEQ ID NO: 1191878 - protein, 7 aa, Mycobacterium
ANDPTAV

SEQ ID NO: 1191879 - protein, 13 aa, Mycobacterium
ANDRQASGKPVPE

SEQ ID NO: 1191880 - protein, 7 aa, Mycobacterium
ANDTAVS

SEQ ID NO: 1191881 - protein, 6 aa, Mycobacterium
ANDTDF

SEQ ID NO: 1191882 - protein, 5 aa, Mycobacterium
ANDTR

SEQ ID NO: 1191883 - protein, 9 aa, Mycobacterium
ANDTTLTDA

SEQ ID NO: 1191884 - protein, 9 aa, Mycobacterium
ANDTTRHAS

SEQ ID NO: 1191885 - protein, 4 aa, Mycobacterium
ANEA

SEQ ID NO: 1191886 - protein, 10 aa, Mycobacterium
ANEAERAAPG

SEQ ID NO: 1191887 - protein, 14 aa, Mycobacterium
ANEAGRALGRGTVG

SEQ ID NO: 1191888 - protein, 8 aa, Mycobacterium
ANEARRRD

SEQ ID NO: 1191889 - protein, 11 aa, Mycobacterium
ANEDASDALTE

SEQ ID NO: 1191890 - protein, 13 aa, Mycobacterium
ANEDQPPASADPR

SEQ ID NO: 1191891 - protein, 7 aa, Mycobacterium
ANEEARR

SEQ ID NO: 1191892 - protein, 19 aa, Mycobacterium
ANETRKATEAAGGTYEPHP

SEQ ID NO: 1191893 - protein, 13 aa, Mycobacterium
ANEYSGQRKPPAV

SEQ ID NO: 1191894 - protein, 8 aa, Mycobacterium
ANFGNTGQ

SEQ ID NO: 1191895 - protein, 21 aa, Mycobacterium
ANGAEGRPTKPVTVKSDERGE

SEQ ID NO: 1191896 - protein, 6 aa, Mycobacterium
ANGAER

SEQ ID NO: 1191897 - protein, 7 aa, Mycobacterium
ANGAPEA

SEQ ID NO: 1191898 - protein, 14 aa, Mycobacterium
ANGDAVTDKKTIDR

SEQ ID NO: 1191899 - protein, 10 aa, Mycobacterium
ANGEPVGASG

SEQ ID NO: 1191900 - protein, 6 aa, Mycobacterium
ANGGGD

SEQ ID NO: 1191901 - protein, 11 aa, Mycobacterium
ANGGKVGGPFE

SEQ ID NO: 1191902 - protein, 8 aa, Mycobacterium
ANGIGAAL

SEQ ID NO: 1191903 - protein, 8 aa, Mycobacterium
ANGIGAAV

SEQ ID NO: 1191904 - protein, 6 aa, Mycobacterium
ANGKAD

SEQ ID NO: 1191905 - protein, 12 aa, Mycobacterium
ANGKPQLTSDAS

SEQ ID NO: 1191906 - protein, 6 aa, Mycobacterium
ANGLTG

SEQ ID NO: 1191907 - protein, 9 aa, Mycobacterium
ANGNYDERL

SEQ ID NO: 1191908 - protein, 8 aa, Mycobacterium
ANGPDGAD

SEQ ID NO: 1191909 - protein, 11 aa, Mycobacterium
ANGQAPVGLSG

SEQ ID NO: 1191910 - protein, 4 aa, Mycobacterium
ANGS

SEQ ID NO: 1191911 - protein, 10 aa, Mycobacterium
ANGSAPEHNK

SEQ ID NO: 1191912 - protein, 8 aa, Mycobacterium
ANGSIPGR

SEQ ID NO: 1191913 - protein, 6 aa, Mycobacterium
ANGSNE

SEQ ID NO: 1191914 - protein, 12 aa, Mycobacterium
ANGSRDLPAGHP

SEQ ID NO: 1191915 - protein, 17 aa, Mycobacterium
ANGTAYAQERAQREARL

SEQ ID NO: 1191916 - protein, 7 aa, Mycobacterium
ANGTGQA

SEQ ID NO: 1191917 - protein, 14 aa, Mycobacterium
ANGTTCQQRSIETT

SEQ ID NO: 1191918 - protein, 11 aa, Mycobacterium
ANGTTCQQRSV

SEQ ID NO: 1191919 - protein, 8 aa, Mycobacterium
ANGTTPLS

SEQ ID NO: 1191920 - protein, 4 aa, Mycobacterium
ANGW

SEQ ID NO: 1191921 - protein, 5 aa, Mycobacterium
ANHAN

SEQ ID NO: 1191922 - protein, 20 aa, Mycobacterium
ANHEPQLQSARDLRAAAAAR

SEQ ID NO: 1191923 - protein, 8 aa, Mycobacterium
ANHGGSKH

SEQ ID NO: 1191924 - protein, 8 aa, Mycobacterium
ANHRNSRY

SEQ ID NO: 1191925 - protein, 7 aa, Mycobacterium
ANHTEGA

SEQ ID NO: 1191926 - protein, 8 aa, Mycobacterium
ANIGDAAA

SEQ ID NO: 1191927 - protein, 8 aa, Mycobacterium
ANIGSIDS

SEQ ID NO: 1191928 - protein, 8 aa, Mycobacterium
ANIPPERY

SEQ ID NO: 1191929 - protein, 5 aa, Mycobacterium
ANIQD

SEQ ID NO: 1191930 - protein, 19 aa, Mycobacterium
ANISGRPPAVTAAQAREQL

SEQ ID NO: 1191931 - protein, 6 aa, Mycobacterium
ANKAGV

SEQ ID NO: 1191932 - protein, 9 aa, Mycobacterium
ANKNPDNGV

SEQ ID NO: 1191933 - protein, 5 aa, Mycobacterium
ANKPV

SEQ ID NO: 1191934 - protein, 6 aa, Mycobacterium
ANLQAE

SEQ ID NO: 1191935 - protein, 13 aa, Mycobacterium
ANLSAGEAAAVGG

SEQ ID NO: 1191936 - protein, 6 aa, Mycobacterium
ANLTPR

SEQ ID NO: 1191937 - protein, 5 aa, Mycobacterium
ANNAE

SEQ ID NO: 1191938 - protein, 6 aa, Mycobacterium
ANNPGL

SEQ ID NO: 1191939 - protein, 8 aa, Mycobacterium
ANNQGESG

SEQ ID NO: 1191940 - protein, 6 aa, Mycobacterium
ANPAAQ

SEQ ID NO: 1191941 - protein, 5 aa, Mycobacterium
ANPAF

SEQ ID NO: 1191942 - protein, 7 aa, Mycobacterium
ANPAGGA

SEQ ID NO: 1191943 - protein, 7 aa, Mycobacterium
ANPAGQL

SEQ ID NO: 1191944 - protein, 12 aa, Mycobacterium
ANPALTKDEQSF

SEQ ID NO: 1191945 - protein, 6 aa, Mycobacterium
ANPATP

SEQ ID NO: 1191946 - protein, 15 aa, Mycobacterium
ANPDGDVLWKPGAQG

SEQ ID NO: 1191947 - protein, 9 aa, Mycobacterium
ANPDGTGEL

SEQ ID NO: 1191948 - protein, 15 aa, Mycobacterium
ANPDPAAARPPALTT

SEQ ID NO: 1191949 - protein, 15 aa, Mycobacterium
ANPDPEAVKPPALAN

SEQ ID NO: 1191950 - protein, 12 aa, Mycobacterium
ANPDPPTSAQVT

SEQ ID NO: 1191951 - protein, 9 aa, Mycobacterium
ANPDRGTLS

SEQ ID NO: 1191952 - protein, 13 aa, Mycobacterium
ANPEAHTQPWDQK

SEQ ID NO: 1191953 - protein, 7 aa, Mycobacterium
ANPELPQ

SEQ ID NO: 1191954 - protein, 6 aa, Mycobacterium
ANPENV

SEQ ID NO: 1191955 - protein, 8 aa, Mycobacterium
ANPFGPPP

SEQ ID NO: 1191956 - protein, 4 aa, Mycobacterium
ANPG

SEQ ID NO: 1191957 - protein, 12 aa, Mycobacterium
ANPGESVATAQP

SEQ ID NO: 1191958 - protein, 12 aa, Mycobacterium
ANPGFADGATQL

SEQ ID NO: 1191959 - protein, 12 aa, Mycobacterium
ANPGFQPGSRLG

SEQ ID NO: 1191960 - protein, 13 aa, Mycobacterium
ANPGFTPPPSMVS

SEQ ID NO: 1191961 - protein, 5 aa, Mycobacterium
ANPGK

SEQ ID NO: 1191962 - protein, 6 aa, Mycobacterium
ANPGLN

SEQ ID NO: 1191963 - protein, 7 aa, Mycobacterium
ANPGLRE

SEQ ID NO: 1191964 - protein, 5 aa, Mycobacterium
ANPGV

SEQ ID NO: 1191965 - protein, 5 aa, Mycobacterium
ANPGY

SEQ ID NO: 1191966 - protein, 12 aa, Mycobacterium
ANPIDGEPPYAP

SEQ ID NO: 1191967 - protein, 5 aa, Mycobacterium
ANPIS

SEQ ID NO: 1191968 - protein, 5 aa, Mycobacterium
ANPLA

SEQ ID NO: 1191969 - protein, 7 aa, Mycobacterium
ANPLDPA

SEQ ID NO: 1191970 - protein, 12 aa, Mycobacterium
ANPNHPSDLGKG

SEQ ID NO: 1191971 - protein, 7 aa, Mycobacterium
ANPNWSA

SEQ ID NO: 1191972 - protein, 6 aa, Mycobacterium
ANPPGF

SEQ ID NO: 1191973 - protein, 11 aa, Mycobacterium
ANPPKDKSDRD

SEQ ID NO: 1191974 - protein, 4 aa, Mycobacterium
ANPR

SEQ ID NO: 1191975 - protein, 10 aa, Mycobacterium
ANPSAPATGR

SEQ ID NO: 1191976 - protein, 24 aa, Mycobacterium
ANPTKSGAKWAGEAGTADPQASPL

SEQ ID NO: 1191977 - protein, 5 aa, Mycobacterium
ANPTV

SEQ ID NO: 1191978 - protein, 5 aa, Mycobacterium
ANPVL

SEQ ID NO: 1191979 - protein, 7 aa, Mycobacterium
ANPVTGT

SEQ ID NO: 1191980 - protein, 13 aa, Mycobacterium
ANQKGSADTPLED

SEQ ID NO: 1191981 - protein, 14 aa, Mycobacterium
ANQKRQALEDPLGR

SEQ ID NO: 1191982 - protein, 13 aa, Mycobacterium
ANRAAEDDATSVN

SEQ ID NO: 1191983 - protein, 14 aa, Mycobacterium
ANRAGLPTGTDNVR

SEQ ID NO: 1191984 - protein, 11 aa, Mycobacterium
ANRAPSVHNSQ

SEQ ID NO: 1191985 - protein, 9 aa, Mycobacterium
ANRDEQEFP

SEQ ID NO: 1191986 - protein, 13 aa, Mycobacterium
ANRDEREFGPDAA

SEQ ID NO: 1191987 - protein, 10 aa, Mycobacterium
ANRDEREFPD

SEQ ID NO: 1191988 - protein, 8 aa, Mycobacterium
ANRDESKF

SEQ ID NO: 1191989 - protein, 9 aa, Mycobacterium
ANRDESKFR

SEQ ID NO: 1191990 - protein, 12 aa, Mycobacterium
ANRDHRRFPPNG

SEQ ID NO: 1191991 - protein, 11 aa, Mycobacterium
ANRDHTVYDDP

SEQ ID NO: 1191992 - protein, 7 aa, Mycobacterium
ANRDPAV

SEQ ID NO: 1191993 - protein, 7 aa, Mycobacterium
ANRDPEV

SEQ ID NO: 1191994 - protein, 11 aa, Mycobacterium
ANRDPRKFEDP

SEQ ID NO: 1191995 - protein, 11 aa, Mycobacterium
ANRDPRRFADP

SEQ ID NO: 1191996 - protein, 21 aa, Mycobacterium
ANRENTLYSPGPGFAEADPAQ

SEQ ID NO: 1191997 - protein, 10 aa, Mycobacterium
ANRERQAQIT

SEQ ID NO: 1191998 - protein, 10 aa, Mycobacterium
ANRESEQAIH

SEQ ID NO: 1191999 - protein, 9 aa, Mycobacterium
ANRGGYSDV

SEQ ID NO: 1192000 - protein, 5 aa, Mycobacterium
ANRGI

SEQ ID NO: 1192001 - protein, 8 aa, Mycobacterium
ANRGRLET

SEQ ID NO: 1192002 - protein, 4 aa, Mycobacterium
ANRH

SEQ ID NO: 1192003 - protein, 9 aa, Mycobacterium
ANRHTQEEV

SEQ ID NO: 1192004 - protein, 10 aa, Mycobacterium
ANRNAGGAVG

SEQ ID NO: 1192005 - protein, 11 aa, Mycobacterium
ANRPGRSAGAG

SEQ ID NO: 1192006 - protein, 13 aa, Mycobacterium
ANRPHSAHGELTP

SEQ ID NO: 1192007 - protein, 7 aa, Mycobacterium
ANRPPIE

SEQ ID NO: 1192008 - protein, 6 aa, Mycobacterium
ANRPRR

SEQ ID NO: 1192009 - protein, 10 aa, Mycobacterium
ANRQSANPDH

SEQ ID NO: 1192010 - protein, 8 aa, Mycobacterium
ANRRTAAN

SEQ ID NO: 1192011 - protein, 6 aa, Mycobacterium
ANRSAS

SEQ ID NO: 1192012 - protein, 7 aa, Mycobacterium
ANRTRHP

SEQ ID NO: 1192013 - protein, 4 aa, Mycobacterium
ANRV

SEQ ID NO: 1192014 - protein, 11 aa, Mycobacterium
ANSAAGALSGR

SEQ ID NO: 1192015 - protein, 9 aa, Mycobacterium
ANSAAPDAA

SEQ ID NO: 1192016 - protein, 7 aa, Mycobacterium
ANSAEGW

SEQ ID NO: 1192017 - protein, 6 aa, Mycobacterium
ANSARA

SEQ ID NO: 1192018 - protein, 6 aa, Mycobacterium
ANSDYG

SEQ ID NO: 1192019 - protein, 6 aa, Mycobacterium
ANSGAG

SEQ ID NO: 1192020 - protein, 11 aa, Mycobacterium
ANSGDRAPSRT

SEQ ID NO: 1192021 - protein, 5 aa, Mycobacterium
ANSGL

SEQ ID NO: 1192022 - protein, 16 aa, Mycobacterium
ANSGTSPTAPHRRNWP

SEQ ID NO: 1192023 - protein, 13 aa, Mycobacterium
ANSKAAVQADHET

SEQ ID NO: 1192024 - protein, 18 aa, Mycobacterium
ANSKEEEVLTPATPGAEA

SEQ ID NO: 1192025 - protein, 11 aa, Mycobacterium
ANSPDGKAPAR

SEQ ID NO: 1192026 - protein, 12 aa, Mycobacterium
ANSPLDGDGHFE

SEQ ID NO: 1192027 - protein, 9 aa, Mycobacterium
ANSRSGDTR

SEQ ID NO: 1192028 - protein, 6 aa, Mycobacterium
ANSTQE

SEQ ID NO: 1192029 - protein, 12 aa, Mycobacterium
ANTAEEQSFQTE

SEQ ID NO: 1192030 - protein, 9 aa, Mycobacterium
ANTAENPYA

SEQ ID NO: 1192031 - protein, 7 aa, Mycobacterium
ANTAGGL

SEQ ID NO: 1192032 - protein, 6 aa, Mycobacterium
ANTCSE

SEQ ID NO: 1192033 - protein, 6 aa, Mycobacterium
ANTDND

SEQ ID NO: 1192034 - protein, 9 aa, Mycobacterium
ANTGGSCDG

SEQ ID NO: 1192035 - protein, 7 aa, Mycobacterium
ANTGIPT

SEQ ID NO: 1192036 - protein, 6 aa, Mycobacterium
ANTGKQ

SEQ ID NO: 1192037 - protein, 14 aa, Mycobacterium
ANTGTLGASGTLAR

SEQ ID NO: 1192038 - protein, 5 aa, Mycobacterium
ANTHA

SEQ ID NO: 1192039 - protein, 4 aa, Mycobacterium
ANTI

SEQ ID NO: 1192040 - protein, 4 aa, Mycobacterium
ANTL

SEQ ID NO: 1192041 - protein, 8 aa, Mycobacterium
ANTPAVEG

SEQ ID NO: 1192042 - protein, 9 aa, Mycobacterium
ANTPFSTTG

SEQ ID NO: 1192043 - protein, 8 aa, Mycobacterium
ANTPNTAH

SEQ ID NO: 1192044 - protein, 5 aa, Mycobacterium
ANTPT

SEQ ID NO: 1192045 - protein, 23 aa, Mycobacterium
ANTRDGKPVWSDPAAAAEKERPL

SEQ ID NO: 1192046 - protein, 11 aa, Mycobacterium
ANTSAGGLGGA

SEQ ID NO: 1192047 - protein, 6 aa, Mycobacterium
ANTSLN

SEQ ID NO: 1192048 - protein, 15 aa, Mycobacterium
ANTSPLTRGGRTGLR

SEQ ID NO: 1192049 - protein, 6 aa, Mycobacterium
ANTSSS

SEQ ID NO: 1192050 - protein, 6 aa, Mycobacterium
ANVAQE

SEQ ID NO: 1192051 - protein, 16 aa, Mycobacterium
ANVARRSKIDVLIVHT

SEQ ID NO: 1192052 - protein, 6 aa, Mycobacterium
ANVGGI

SEQ ID NO: 1192053 - protein, 8 aa, Mycobacterium
ANVGGTDI

SEQ ID NO: 1192054 - protein, 5 aa, Mycobacterium
ANVNR

SEQ ID NO: 1192055 - protein, 6 aa, Mycobacterium
ANVSTD

SEQ ID NO: 1192056 - protein, 4 aa, Mycobacterium
ANWP

SEQ ID NO: 1192057 - protein, 9 aa, Mycobacterium
ANWPEGQPF

SEQ ID NO: 1192058 - protein, 5 aa, Mycobacterium
ANWPG

SEQ ID NO: 1192059 - protein, 6 aa, Mycobacterium
ANYDSK

SEQ ID NO: 1192060 - protein, 10 aa, Mycobacterium
ANYRATTSTV

SEQ ID NO: 1192061 - protein, 4 aa, Mycobacterium
APAA

SEQ ID NO: 1192062 - protein, 44 aa, Mycobacterium
APAAAAAPGPAPAPGPAPAPGAEVATPVAAPAAPGGLGPNAPVT

SEQ ID NO: 1192063 - protein, 6 aa, Mycobacterium
APAAAV

SEQ ID NO: 1192064 - protein, 21 aa, Mycobacterium
APAAETSAAAAPASVAPAPRE

SEQ ID NO: 1192065 - protein, 8 aa, Mycobacterium
APAAGGVG

SEQ ID NO: 1192066 - protein, 8 aa, Mycobacterium
APAAKERG

SEQ ID NO: 1192067 - protein, 5 aa, Mycobacterium
APAAL

SEQ ID NO: 1192068 - protein, 10 aa, Mycobacterium
APAATTGAAG

SEQ ID NO: 1192069 - protein, 6 aa, Mycobacterium
APACQA

SEQ ID NO: 1192070 - protein, 9 aa, Mycobacterium
APADAGRRF

SEQ ID NO: 1192071 - protein, 9 aa, Mycobacterium
APADDESLS

SEQ ID NO: 1192072 - protein, 12 aa, Mycobacterium
APADEAGNERGL

SEQ ID NO: 1192073 - protein, 15 aa, Mycobacterium
APADFSGGCAQRSCE

SEQ ID NO: 1192074 - protein, 13 aa, Mycobacterium
APADGAGEPTNNA

SEQ ID NO: 1192075 - protein, 7 aa, Mycobacterium
APADGYH

SEQ ID NO: 1192076 - protein, 5 aa, Mycobacterium
APADI

SEQ ID NO: 1192077 - protein, 7 aa, Mycobacterium
APADQPH

SEQ ID NO: 1192078 - protein, 9 aa, Mycobacterium
APADTDMDA

SEQ ID NO: 1192079 - protein, 5 aa, Mycobacterium
APAEA

SEQ ID NO: 1192080 - protein, 8 aa, Mycobacterium
APAEAPER

SEQ ID NO: 1192081 - protein, 8 aa, Mycobacterium
APAEAPQR

SEQ ID NO: 1192082 - protein, 7 aa, Mycobacterium
APAEPRD

SEQ ID NO: 1192083 - protein, 9 aa, Mycobacterium
APAEQGDQI

SEQ ID NO: 1192084 - protein, 6 aa, Mycobacterium
APAEQP

SEQ ID NO: 1192085 - protein, 12 aa, Mycobacterium
APAESSTQDSIN

SEQ ID NO: 1192086 - protein, 5 aa, Mycobacterium
APAEY

SEQ ID NO: 1192087 - protein, 10 aa, Mycobacterium
APAGDGAPPM

SEQ ID NO: 1192088 - protein, 6 aa, Mycobacterium
APAGEF

SEQ ID NO: 1192089 - protein, 6 aa, Mycobacterium
APAGFR

SEQ ID NO: 1192090 - protein, 8 aa, Mycobacterium
APAGGQIA

SEQ ID NO: 1192091 - protein, 6 aa, Mycobacterium
APAGGR

SEQ ID NO: 1192092 - protein, 6 aa, Mycobacterium
APAGLQ

SEQ ID NO: 1192093 - protein, 5 aa, Mycobacterium
APAGS

SEQ ID NO: 1192094 - protein, 9 aa, Mycobacterium
APAGSGKTT

SEQ ID NO: 1192095 - protein, 6 aa, Mycobacterium
APAGTA

SEQ ID NO: 1192096 - protein, 10 aa, Mycobacterium
APAGTGKTTA

SEQ ID NO: 1192097 - protein, 11 aa, Mycobacterium
APAGTRSAPDV

SEQ ID NO: 1192098 - protein, 9 aa, Mycobacterium
APAGVSDDT

SEQ ID NO: 1192099 - protein, 6 aa, Mycobacterium
APAGWE

SEQ ID NO: 1192100 - protein, 5 aa, Mycobacterium
APAHP

SEQ ID NO: 1192101 - protein, 4 aa, Mycobacterium
APAI

SEQ ID NO: 1192102 - protein, 11 aa, Mycobacterium
APAIPSQDPVG

SEQ ID NO: 1192103 - protein, 9 aa, Mycobacterium
APALGDDTA

SEQ ID NO: 1192104 - protein, 7 aa, Mycobacterium
APANDPF

SEQ ID NO: 1192105 - protein, 30 aa, Mycobacterium
APANREQKARLGKLSPEQVTATELAGDPIT

SEQ ID NO: 1192106 - protein, 61 aa, Mycobacterium
APAPAAAPAPGPVPPAAPAPGPALPGPPAAPAPGPVPPPAPAAPAAPLPGPAPTGPAPGPL

SEQ ID NO: 1192107 - protein, 24 aa, Mycobacterium
APAPADDGTYVGTDRDTGEVKYTA

SEQ ID NO: 1192108 - protein, 15 aa, Mycobacterium
APAPAEGEKNPLRDN

SEQ ID NO: 1192109 - protein, 10 aa, Mycobacterium
APAPARPPDV

SEQ ID NO: 1192110 - protein, 9 aa, Mycobacterium
APAPATDDE

SEQ ID NO: 1192111 - protein, 11 aa, Mycobacterium
APAPEPGDGEA

SEQ ID NO: 1192112 - protein, 18 aa, Mycobacterium
APAPGAPVPGVPAPGSHS

SEQ ID NO: 1192113 - protein, 8 aa, Mycobacterium
APAPKPLG

SEQ ID NO: 1192114 - protein, 13 aa, Mycobacterium
APAPKRDPWPHQR

SEQ ID NO: 1192115 - protein, 17 aa, Mycobacterium
APAPLPPAPEALPPAPV

SEQ ID NO: 1192116 - protein, 8 aa, Mycobacterium
APAPPPTL

SEQ ID NO: 1192117 - protein, 12 aa, Mycobacterium
APAPRARTDPRV

SEQ ID NO: 1192118 - protein, 15 aa, Mycobacterium
APAPRGHRPGRGFDT

SEQ ID NO: 1192119 - protein, 16 aa, Mycobacterium
APAPVDVAPPEQLSAE

SEQ ID NO: 1192120 - protein, 25 aa, Mycobacterium
APAPVPPPAAPLDAPLPPPPAPVDP

SEQ ID NO: 1192121 - protein, 26 aa, Mycobacterium
APAPVPPPAAPLDAPLPPPPAPVDPA

SEQ ID NO: 1192122 - protein, 9 aa, Mycobacterium
APAQREDVA

SEQ ID NO: 1192123 - protein, 8 aa, Mycobacterium
APAQRRGR

SEQ ID NO: 1192124 - protein, 8 aa, Mycobacterium
APARENPA

SEQ ID NO: 1192125 - protein, 5 aa, Mycobacterium
APARG

SEQ ID NO: 1192126 - protein, 5 aa, Mycobacterium
APARL

SEQ ID NO: 1192127 - protein, 8 aa, Mycobacterium
APARPSSL

SEQ ID NO: 1192128 - protein, 9 aa, Mycobacterium
APARTRATR

SEQ ID NO: 1192129 - protein, 8 aa, Mycobacterium
APASADLS

SEQ ID NO: 1192130 - protein, 14 aa, Mycobacterium
APASATGQPVEAGG

SEQ ID NO: 1192131 - protein, 8 aa, Mycobacterium
APASDAAG

SEQ ID NO: 1192132 - protein, 18 aa, Mycobacterium
APASDAIEAPKPAAETDV

SEQ ID NO: 1192133 - protein, 14 aa, Mycobacterium
APASGPAPGFAEQT

SEQ ID NO: 1192134 - protein, 8 aa, Mycobacterium
APASIEQA

SEQ ID NO: 1192135 - protein, 13 aa, Mycobacterium
APASNTGEEARPR

SEQ ID NO: 1192136 - protein, 12 aa, Mycobacterium
APASPDADESLP

SEQ ID NO: 1192137 - protein, 6 aa, Mycobacterium
APASTT

SEQ ID NO: 1192138 - protein, 12 aa, Mycobacterium
APATEDAPAIAP

SEQ ID NO: 1192139 - protein, 8 aa, Mycobacterium
APATTTPA

SEQ ID NO: 1192140 - protein, 5 aa, Mycobacterium
APATV

SEQ ID NO: 1192141 - protein, 13 aa, Mycobacterium
APAVHPNPAGIAA

SEQ ID NO: 1192142 - protein, 5 aa, Mycobacterium
APAYQ

SEQ ID NO: 1192143 - protein, 10 aa, Mycobacterium
APDAARDVEA

SEQ ID NO: 1192144 - protein, 5 aa, Mycobacterium
APDAD

SEQ ID NO: 1192145 - protein, 6 aa, Mycobacterium
APDAEA

SEQ ID NO: 1192146 - protein, 7 aa, Mycobacterium
APDAGTV

SEQ ID NO: 1192147 - protein, 10 aa, Mycobacterium
APDAGTVARS

SEQ ID NO: 1192148 - protein, 7 aa, Mycobacterium
APDAKPD

SEQ ID NO: 1192149 - protein, 6 aa, Mycobacterium
APDAKQ

SEQ ID NO: 1192150 - protein, 8 aa, Mycobacterium
APDAPRQA

SEQ ID NO: 1192151 - protein, 5 aa, Mycobacterium
APDAR

SEQ ID NO: 1192152 - protein, 8 aa, Mycobacterium
APDARAGQ

SEQ ID NO: 1192153 - protein, 6 aa, Mycobacterium
APDARV

SEQ ID NO: 1192154 - protein, 5 aa, Mycobacterium
APDAV

SEQ ID NO: 1192155 - protein, 6 aa, Mycobacterium
APDDER

SEQ ID NO: 1192156 - protein, 18 aa, Mycobacterium
APDDTGYGAGHGEEPGPL

SEQ ID NO: 1192157 - protein, 5 aa, Mycobacterium
APDED

SEQ ID NO: 1192158 - protein, 5 aa, Mycobacterium
APDEG

SEQ ID NO: 1192159 - protein, 5 aa, Mycobacterium
APDEN

SEQ ID NO: 1192160 - protein, 6 aa, Mycobacterium
APDERW

SEQ ID NO: 1192161 - protein, 11 aa, Mycobacterium
APDESPPERPL

SEQ ID NO: 1192162 - protein, 5 aa, Mycobacterium
APDFD

SEQ ID NO: 1192163 - protein, 4 aa, Mycobacterium
APDG

SEQ ID NO: 1192164 - protein, 5 aa, Mycobacterium
APDGA

SEQ ID NO: 1192165 - protein, 7 aa, Mycobacterium
APDGAQD

SEQ ID NO: 1192166 - protein, 6 aa, Mycobacterium
APDGRI

SEQ ID NO: 1192167 - protein, 13 aa, Mycobacterium
APDGRSAASWTRS

SEQ ID NO: 1192168 - protein, 6 aa, Mycobacterium
APDGSL

SEQ ID NO: 1192169 - protein, 8 aa, Mycobacterium
APDGSPIT

SEQ ID NO: 1192170 - protein, 14 aa, Mycobacterium
APDGSPLVAESGAG

SEQ ID NO: 1192171 - protein, 8 aa, Mycobacterium
APDGTRDV

SEQ ID NO: 1192172 - protein, 8 aa, Mycobacterium
APDHQHTK

SEQ ID NO: 1192173 - protein, 10 aa, Mycobacterium
APDHQRTKSV

SEQ ID NO: 1192174 - protein, 6 aa, Mycobacterium
APDISG

SEQ ID NO: 1192175 - protein, 5 aa, Mycobacterium
APDNS

SEQ ID NO: 1192176 - protein, 12 aa, Mycobacterium
APDPADLDERTE

SEQ ID NO: 1192177 - protein, 6 aa, Mycobacterium
APDPAL

SEQ ID NO: 1192178 - protein, 15 aa, Mycobacterium
APDPALYPGAAPQDL

SEQ ID NO: 1192179 - protein, 9 aa, Mycobacterium
APDPDDTVG

SEQ ID NO: 1192180 - protein, 6 aa, Mycobacterium
APDPDF

SEQ ID NO: 1192181 - protein, 9 aa, Mycobacterium
APDPDNVDQ

SEQ ID NO: 1192182 - protein, 5 aa, Mycobacterium
APDPF

SEQ ID NO: 1192183 - protein, 6 aa, Mycobacterium
APDPRN

SEQ ID NO: 1192184 - protein, 15 aa, Mycobacterium
APDQREKARASYPAL

SEQ ID NO: 1192185 - protein, 13 aa, Mycobacterium
APDRNYRDRSHKP

SEQ ID NO: 1192186 - protein, 7 aa, Mycobacterium
APDRTTQ

SEQ ID NO: 1192187 - protein, 9 aa, Mycobacterium
APDSATQQA

SEQ ID NO: 1192188 - protein, 8 aa, Mycobacterium
APDSDPHI

SEQ ID NO: 1192189 - protein, 8 aa, Mycobacterium
APDSGLAV

SEQ ID NO: 1192190 - protein, 10 aa, Mycobacterium
APDSPAGREL

SEQ ID NO: 1192191 - protein, 19 aa, Mycobacterium
APDSPFGGYKQSGIGREMG

SEQ ID NO: 1192192 - protein, 11 aa, Mycobacterium
APDSRIDAAGQ

SEQ ID NO: 1192193 - protein, 8 aa, Mycobacterium
APDTDAET

SEQ ID NO: 1192194 - protein, 13 aa, Mycobacterium
APDTDGSDGTELT

SEQ ID NO: 1192195 - protein, 11 aa, Mycobacterium
APDTDRWEGRR

SEQ ID NO: 1192196 - protein, 7 aa, Mycobacterium
APDTGAD

SEQ ID NO: 1192197 - protein, 9 aa, Mycobacterium
APDTPAVAT

SEQ ID NO: 1192198 - protein, 9 aa, Mycobacterium
APDTPTAAA

SEQ ID NO: 1192199 - protein, 5 aa, Mycobacterium
APDTQ

SEQ ID NO: 1192200 - protein, 13 aa, Mycobacterium
APDTVTDGDAQAC

SEQ ID NO: 1192201 - protein, 9 aa, Mycobacterium
APDVDPVGT

SEQ ID NO: 1192202 - protein, 10 aa, Mycobacterium
APDVNGTSQT

SEQ ID NO: 1192203 - protein, 11 aa, Mycobacterium
APEAAAQRYAA

SEQ ID NO: 1192204 - protein, 5 aa, Mycobacterium
APEAE

SEQ ID NO: 1192205 - protein, 15 aa, Mycobacterium
APEAEAVAPQPEPPV

SEQ ID NO: 1192206 - protein, 11 aa, Mycobacterium
APEAPAPAQFD

SEQ ID NO: 1192207 - protein, 6 aa, Mycobacterium
APEAYE

SEQ ID NO: 1192208 - protein, 6 aa, Mycobacterium
APEDGA

SEQ ID NO: 1192209 - protein, 11 aa, Mycobacterium
APEDGREPEWG

SEQ ID NO: 1192210 - protein, 9 aa, Mycobacterium
APEDPASYY

SEQ ID NO: 1192211 - protein, 9 aa, Mycobacterium
APEEARSGI

SEQ ID NO: 1192212 - protein, 6 aa, Mycobacterium
APEEAV

SEQ ID NO: 1192213 - protein, 8 aa, Mycobacterium
APEESPRS

SEQ ID NO: 1192214 - protein, 6 aa, Mycobacterium
APEGEL

SEQ ID NO: 1192215 - protein, 6 aa, Mycobacterium
APEGGG

SEQ ID NO: 1192216 - protein, 7 aa, Mycobacterium
APEGGSF

SEQ ID NO: 1192217 - protein, 8 aa, Mycobacterium
APEGGSRS

SEQ ID NO: 1192218 - protein, 19 aa, Mycobacterium
APEGSPAPNPVDADRHDRY

SEQ ID NO: 1192219 - protein, 4 aa, Mycobacterium
APEH

SEQ ID NO: 1192220 - protein, 4 aa, Mycobacterium
APEI

SEQ ID NO: 1192221 - protein, 6 aa, Mycobacterium
APEKAD

SEQ ID NO: 1192222 - protein, 6 aa, Mycobacterium
APEKVS

SEQ ID NO: 1192223 - protein, 9 aa, Mycobacterium
APELPEGAV

SEQ ID NO: 1192224 - protein, 12 aa, Mycobacterium
APELTSEAGALT

SEQ ID NO: 1192225 - protein, 4 aa, Mycobacterium
APEN

SEQ ID NO: 1192226 - protein, 10 aa, Mycobacterium
APENPPPAQF

SEQ ID NO: 1192227 - protein, 12 aa, Mycobacterium
APENVPPEMRPQ

SEQ ID NO: 1192228 - protein, 4 aa, Mycobacterium
APEP

SEQ ID NO: 1192229 - protein, 8 aa, Mycobacterium
APEPDERL

SEQ ID NO: 1192230 - protein, 5 aa, Mycobacterium
APEPP

SEQ ID NO: 1192231 - protein, 17 aa, Mycobacterium
APEPPQAWSEPVDAGRV

SEQ ID NO: 1192232 - protein, 7 aa, Mycobacterium
APEPSRF

SEQ ID NO: 1192233 - protein, 27 aa, Mycobacterium
APEPTAVNSSSAKGTVVGTTPRGRTIP

SEQ ID NO: 1192234 - protein, 16 aa, Mycobacterium
APEQAAAPGPVQQPDR

SEQ ID NO: 1192235 - protein, 13 aa, Mycobacterium
APEQDADGRLADR

SEQ ID NO: 1192236 - protein, 5 aa, Mycobacterium
APEQV

SEQ ID NO: 1192237 - protein, 6 aa, Mycobacterium
APERFR

SEQ ID NO: 1192238 - protein, 13 aa, Mycobacterium
APERFRGDTEPVD

SEQ ID NO: 1192239 - protein, 5 aa, Mycobacterium
APERP

SEQ ID NO: 1192240 - protein, 8 aa, Mycobacterium
APESGASA

SEQ ID NO: 1192241 - protein, 9 aa, Mycobacterium
APETGLAPD

SEQ ID NO: 1192242 - protein, 12 aa, Mycobacterium
APETLGAGGLGS

SEQ ID NO: 1192243 - protein, 9 aa, Mycobacterium
APEVGVPGE

SEQ ID NO: 1192244 - protein, 4 aa, Mycobacterium
APEY

SEQ ID NO: 1192245 - protein, 27 aa, Mycobacterium
APFDNPDRWGGPPGTPFPRQPDVTAGQ

SEQ ID NO: 1192246 - protein, 5 aa, Mycobacterium
APFGG

SEQ ID NO: 1192247 - protein, 43 aa, Mycobacterium
APFGGAPAPQAQQQAPQHQAPQHQAAQYQAQPVPGGGDGFAGI

SEQ ID NO: 1192248 - protein, 13 aa, Mycobacterium
APFGGVGRSGMGA

SEQ ID NO: 1192249 - protein, 14 aa, Mycobacterium
APFGGYKSSGVGRQ

SEQ ID NO: 1192250 - protein, 14 aa, Mycobacterium
APFPDDSYKAGARQ

SEQ ID NO: 1192251 - protein, 11 aa, Mycobacterium
APFPPPPPGFD

SEQ ID NO: 1192252 - protein, 9 aa, Mycobacterium
APFSAPATR

SEQ ID NO: 1192253 - protein, 5 aa, Mycobacterium
APFWP

SEQ ID NO: 1192254 - protein, 14 aa, Mycobacterium
APFYSPGHKGGRTI

SEQ ID NO: 1192255 - protein, 4 aa, Mycobacterium
APGA

SEQ ID NO: 1192256 - protein, 8 aa, Mycobacterium
APGADVES

SEQ ID NO: 1192257 - protein, 8 aa, Mycobacterium
APGALTAA

SEQ ID NO: 1192258 - protein, 7 aa, Mycobacterium
APGAPGV

SEQ ID NO: 1192259 - protein, 8 aa, Mycobacterium
APGAPVEQ

SEQ ID NO: 1192260 - protein, 6 aa, Mycobacterium
APGAQN

SEQ ID NO: 1192261 - protein, 5 aa, Mycobacterium
APGAR

SEQ ID NO: 1192262 - protein, 13 aa, Mycobacterium
APGARPPESVRST

SEQ ID NO: 1192263 - protein, 18 aa, Mycobacterium
APGARVSGSSTLTGADEP

SEQ ID NO: 1192264 - protein, 18 aa, Mycobacterium
APGAVAGAAGAAGAAAGI

SEQ ID NO: 1192265 - protein, 16 aa, Mycobacterium
APGAVSTGKFNAGPDT

SEQ ID NO: 1192266 - protein, 5 aa, Mycobacterium
APGDD

SEQ ID NO: 1192267 - protein, 8 aa, Mycobacterium
APGDEPEL

SEQ ID NO: 1192268 - protein, 11 aa, Mycobacterium
APGDGRPRPIV

SEQ ID NO: 1192269 - protein, 6 aa, Mycobacterium
APGDPI

SEQ ID NO: 1192270 - protein, 11 aa, Mycobacterium
APGDTDTASAV

SEQ ID NO: 1192271 - protein, 35 aa, Mycobacterium
APGEKKAKTRVGRGEGSKGKTAGRGTKGTKARKNV

SEQ ID NO: 1192272 - protein, 6 aa, Mycobacterium
APGEPA

SEQ ID NO: 1192273 - protein, 7 aa, Mycobacterium
APGETFD

SEQ ID NO: 1192274 - protein, 11 aa, Mycobacterium
APGFDGQPGVI

SEQ ID NO: 1192275 - protein, 12 aa, Mycobacterium
APGGDMGGGGAD

SEQ ID NO: 1192276 - protein, 24 aa, Mycobacterium
APGGEYAERTTGPDDQYPGSDPEV

SEQ ID NO: 1192277 - protein, 8 aa, Mycobacterium
APGGGDQH

SEQ ID NO: 1192278 - protein, 8 aa, Mycobacterium
APGGHEQT

SEQ ID NO: 1192279 - protein, 6 aa, Mycobacterium
APGGIP

SEQ ID NO: 1192280 - protein, 8 aa, Mycobacterium
APGGRTDG

SEQ ID NO: 1192281 - protein, 11 aa, Mycobacterium
APGGSTGWHSH

SEQ ID NO: 1192282 - protein, 7 aa, Mycobacterium
APGGVEN

SEQ ID NO: 1192283 - protein, 9 aa, Mycobacterium
APGHGGALN

SEQ ID NO: 1192284 - protein, 14 aa, Mycobacterium
APGHPPGTTDRADW

SEQ ID NO: 1192285 - protein, 8 aa, Mycobacterium
APGHQRGG

SEQ ID NO: 1192286 - protein, 6 aa, Mycobacterium
APGLPA

SEQ ID NO: 1192287 - protein, 6 aa, Mycobacterium
APGLRG

SEQ ID NO: 1192288 - protein, 10 aa, Mycobacterium
APGPDGAPSV

SEQ ID NO: 1192289 - protein, 13 aa, Mycobacterium
APGPDGTPRPVAT

SEQ ID NO: 1192290 - protein, 6 aa, Mycobacterium
APGPEL

SEQ ID NO: 1192291 - protein, 8 aa, Mycobacterium
APGPGGSA

SEQ ID NO: 1192292 - protein, 10 aa, Mycobacterium
APGPIATERA

SEQ ID NO: 1192293 - protein, 13 aa, Mycobacterium
APGPIATERTREF

SEQ ID NO: 1192294 - protein, 5 aa, Mycobacterium
APGPL

SEQ ID NO: 1192295 - protein, 8 aa, Mycobacterium
APGPLDPV

SEQ ID NO: 1192296 - protein, 15 aa, Mycobacterium
APGPLRKGLGSGLTG

SEQ ID NO: 1192297 - protein, 12 aa, Mycobacterium
APGPPPARREEG

SEQ ID NO: 1192298 - protein, 6 aa, Mycobacterium
APGPVS

SEQ ID NO: 1192299 - protein, 11 aa, Mycobacterium
APGQTTADGTI

SEQ ID NO: 1192300 - protein, 5 aa, Mycobacterium
APGQV

SEQ ID NO: 1192301 - protein, 6 aa, Mycobacterium
APGRVG

SEQ ID NO: 1192302 - protein, 10 aa, Mycobacterium
APGSEGVPRI

SEQ ID NO: 1192303 - protein, 6 aa, Mycobacterium
APGSEL

SEQ ID NO: 1192304 - protein, 8 aa, Mycobacterium
APGSGQTV

SEQ ID NO: 1192305 - protein, 9 aa, Mycobacterium
APGSKVTAE

SEQ ID NO: 1192306 - protein, 7 aa, Mycobacterium
APGTAQG

SEQ ID NO: 1192307 - protein, 6 aa, Mycobacterium
APGTEL

SEQ ID NO: 1192308 - protein, 13 aa, Mycobacterium
APGTLNDQHGHPA

SEQ ID NO: 1192309 - protein, 5 aa, Mycobacterium
APGTM

SEQ ID NO: 1192310 - protein, 8 aa, Mycobacterium
APGTPLRD

SEQ ID NO: 1192311 - protein, 14 aa, Mycobacterium
APGTPPAAPAQEPT

SEQ ID NO: 1192312 - protein, 5 aa, Mycobacterium
APGVG

SEQ ID NO: 1192313 - protein, 6 aa, Mycobacterium
APGVST

SEQ ID NO: 1192314 - protein, 23 aa, Mycobacterium
APGVTETAASRTYVDEDPERDRT

SEQ ID NO: 1192315 - protein, 8 aa, Mycobacterium
APGVTETP

SEQ ID NO: 1192316 - protein, 7 aa, Mycobacterium
APGWPRS

SEQ ID NO: 1192317 - protein, 159 aa, Mycobacterium
APHAPAAAHSPETSARSPESRVPDARAAHGASPENPRTQQPSAAGPTPGLSPTAPVGAATGNGTSPAADVRSESRAPSPEGDRSTAHQRDPVGPHERREQTASAGAQSTNTVENRRIDSPGHSDSNEVLSDNGGLAESPRDYDSHGNTVPTDQLTHPQA

SEQ ID NO: 1192318 - protein, 8 aa, Mycobacterium
APHDGSTI

SEQ ID NO: 1192319 - protein, 6 aa, Mycobacterium
APHDGV

SEQ ID NO: 1192320 - protein, 6 aa, Mycobacterium
APHDPE

SEQ ID NO: 1192321 - protein, 5 aa, Mycobacterium
APHGA

SEQ ID NO: 1192322 - protein, 10 aa, Mycobacterium
APHGKTHMSP

SEQ ID NO: 1192323 - protein, 8 aa, Mycobacterium
APHGPAVR

SEQ ID NO: 1192324 - protein, 4 aa, Mycobacterium
APHK

SEQ ID NO: 1192325 - protein, 6 aa, Mycobacterium
APHNPD

SEQ ID NO: 1192326 - protein, 6 aa, Mycobacterium
APHPPI

SEQ ID NO: 1192327 - protein, 7 aa, Mycobacterium
APHRNRG

SEQ ID NO: 1192328 - protein, 12 aa, Mycobacterium
APHSGRVTRRGG

SEQ ID NO: 1192329 - protein, 6 aa, Mycobacterium
APHSTA

SEQ ID NO: 1192330 - protein, 8 aa, Mycobacterium
APHVKGRN

SEQ ID NO: 1192331 - protein, 4 aa, Mycobacterium
APIA

SEQ ID NO: 1192332 - protein, 10 aa, Mycobacterium
APIDKTRGSF

SEQ ID NO: 1192333 - protein, 16 aa, Mycobacterium
APIDPSDEGLADYSGP

SEQ ID NO: 1192334 - protein, 7 aa, Mycobacterium
APIDSEA

SEQ ID NO: 1192335 - protein, 4 aa, Mycobacterium
APIG

SEQ ID NO: 1192336 - protein, 11 aa, Mycobacterium
APIGATDKAGI

SEQ ID NO: 1192337 - protein, 5 aa, Mycobacterium
APIGD

SEQ ID NO: 1192338 - protein, 5 aa, Mycobacterium
APIGP

SEQ ID NO: 1192339 - protein, 6 aa, Mycobacterium
APIPDQ

SEQ ID NO: 1192340 - protein, 20 aa, Mycobacterium
APIPPGVPPPPPARPAPSSI

SEQ ID NO: 1192341 - protein, 5 aa, Mycobacterium
APIPS

SEQ ID NO: 1192342 - protein, 9 aa, Mycobacterium
APIRDPRTS

SEQ ID NO: 1192343 - protein, 6 aa, Mycobacterium
APIRTP

SEQ ID NO: 1192344 - protein, 45 aa, Mycobacterium
APKAANPVSRNGSQALGRNVSGTGEAAADGEVGPDAGEPPAGAAP

SEQ ID NO: 1192345 - protein, 9 aa, Mycobacterium
APKADPPWE

SEQ ID NO: 1192346 - protein, 8 aa, Mycobacterium
APKADVSQ

SEQ ID NO: 1192347 - protein, 15 aa, Mycobacterium
APKEKATARFAIRTD

SEQ ID NO: 1192348 - protein, 29 aa, Mycobacterium
APKGEKSTPSNGSHALGGGGQVGGVPGGV

SEQ ID NO: 1192349 - protein, 9 aa, Mycobacterium
APKGMRSSA

SEQ ID NO: 1192350 - protein, 8 aa, Mycobacterium
APKLDPQT

SEQ ID NO: 1192351 - protein, 5 aa, Mycobacterium
APKPD

SEQ ID NO: 1192352 - protein, 11 aa, Mycobacterium
APKPDESSADV

SEQ ID NO: 1192353 - protein, 5 aa, Mycobacterium
APLAA

SEQ ID NO: 1192354 - protein, 16 aa, Mycobacterium
APLAQRATKEVASRTA

SEQ ID NO: 1192355 - protein, 10 aa, Mycobacterium
APLATDPALG

SEQ ID NO: 1192356 - protein, 4 aa, Mycobacterium
APLD

SEQ ID NO: 1192357 - protein, 11 aa, Mycobacterium
APLDDASRERL

SEQ ID NO: 1192358 - protein, 11 aa, Mycobacterium
APLDGPTQARP

SEQ ID NO: 1192359 - protein, 11 aa, Mycobacterium
APLEADATPVT

SEQ ID NO: 1192360 - protein, 16 aa, Mycobacterium
APLEGELDEPKPGVVG

SEQ ID NO: 1192361 - protein, 9 aa, Mycobacterium
APLEPGQKD

SEQ ID NO: 1192362 - protein, 8 aa, Mycobacterium
APLGEAAS

SEQ ID NO: 1192363 - protein, 6 aa, Mycobacterium
APLGEE

SEQ ID NO: 1192364 - protein, 5 aa, Mycobacterium
APLNT

SEQ ID NO: 1192365 - protein, 7 aa, Mycobacterium
APLNTPD

SEQ ID NO: 1192366 - protein, 4 aa, Mycobacterium
APLP

SEQ ID NO: 1192367 - protein, 6 aa, Mycobacterium
APLPAD

SEQ ID NO: 1192368 - protein, 10 aa, Mycobacterium
APLPADGEAL

SEQ ID NO: 1192369 - protein, 30 aa, Mycobacterium
APLPPDQRATLRGARPTSEPLPPPAPPNRA

SEQ ID NO: 1192370 - protein, 17 aa, Mycobacterium
APLPPPAPVDAPPAQSA

SEQ ID NO: 1192371 - protein, 7 aa, Mycobacterium
APLPTGR

SEQ ID NO: 1192372 - protein, 6 aa, Mycobacterium
APLQPA

SEQ ID NO: 1192373 - protein, 5 aa, Mycobacterium
APLRP

SEQ ID NO: 1192374 - protein, 5 aa, Mycobacterium
APLRT

SEQ ID NO: 1192375 - protein, 8 aa, Mycobacterium
APLSHPDL

SEQ ID NO: 1192376 - protein, 11 aa, Mycobacterium
APLSQGRGGEE

SEQ ID NO: 1192377 - protein, 15 aa, Mycobacterium
APLTGPAGAAGARAD

SEQ ID NO: 1192378 - protein, 14 aa, Mycobacterium
APLVPGTPDPVKDA

SEQ ID NO: 1192379 - protein, 4 aa, Mycobacterium
APMA

SEQ ID NO: 1192380 - protein, 11 aa, Mycobacterium
APMEPSPYLPT

SEQ ID NO: 1192381 - protein, 12 aa, Mycobacterium
APMRRGRHKNIP

SEQ ID NO: 1192382 - protein, 6 aa, Mycobacterium
APMSAR

SEQ ID NO: 1192383 - protein, 13 aa, Mycobacterium
APMSSRKAAETLA

SEQ ID NO: 1192384 - protein, 14 aa, Mycobacterium
APNAAAEGLAPRAP

SEQ ID NO: 1192385 - protein, 8 aa, Mycobacterium
APNAQKWE

SEQ ID NO: 1192386 - protein, 8 aa, Mycobacterium
APNGPGNV

SEQ ID NO: 1192387 - protein, 8 aa, Mycobacterium
APNGTMKT

SEQ ID NO: 1192388 - protein, 6 aa, Mycobacterium
APNKAV

SEQ ID NO: 1192389 - protein, 5 aa, Mycobacterium
APNLN

SEQ ID NO: 1192390 - protein, 6 aa, Mycobacterium
APNNAH

SEQ ID NO: 1192391 - protein, 37 aa, Mycobacterium
APNPQRLRRRPDGPPPGSVNAVTGKAELSGKYAPRTI

SEQ ID NO: 1192392 - protein, 8 aa, Mycobacterium
APNPTTPL

SEQ ID NO: 1192393 - protein, 9 aa, Mycobacterium
APNRGKRSV

SEQ ID NO: 1192394 - protein, 6 aa, Mycobacterium
APNRQA

SEQ ID NO: 1192395 - protein, 6 aa, Mycobacterium
APNRRG

SEQ ID NO: 1192396 - protein, 12 aa, Mycobacterium
APNYSPGHGAGH

SEQ ID NO: 1192397 - protein, 7 aa, Mycobacterium
APPAAAL

SEQ ID NO: 1192398 - protein, 6 aa, Mycobacterium
APPAAK

SEQ ID NO: 1192399 - protein, 9 aa, Mycobacterium
APPAEDGLA

SEQ ID NO: 1192400 - protein, 9 aa, Mycobacterium
APPAEDPRL

SEQ ID NO: 1192401 - protein, 11 aa, Mycobacterium
APPAPGTPVSR

SEQ ID NO: 1192402 - protein, 80 aa, Mycobacterium
APPAPPGGGAPGGGAPGAGVGTGAPIEGAAGAGGVPAAPLAANAGAATPPAAATGGAGAPIDAAAGAAAPPAPPAPGAPI

SEQ ID NO: 1192403 - protein, 18 aa, Mycobacterium
APPAPVTPSRTHEVSSPR

SEQ ID NO: 1192404 - protein, 9 aa, Mycobacterium
APPDAPAGC

SEQ ID NO: 1192405 - protein, 17 aa, Mycobacterium
APPDEATPPAAPARVVR

SEQ ID NO: 1192406 - protein, 11 aa, Mycobacterium
APPDETVDESR

SEQ ID NO: 1192407 - protein, 13 aa, Mycobacterium
APPDGQSGETTSI

SEQ ID NO: 1192408 - protein, 6 aa, Mycobacterium
APPDGV

SEQ ID NO: 1192409 - protein, 8 aa, Mycobacterium
APPDPDGK

SEQ ID NO: 1192410 - protein, 5 aa, Mycobacterium
APPED

SEQ ID NO: 1192411 - protein, 7 aa, Mycobacterium
APPEDVD

SEQ ID NO: 1192412 - protein, 14 aa, Mycobacterium
APPEPTDGPLPSPP

SEQ ID NO: 1192413 - protein, 7 aa, Mycobacterium
APPGEEP

SEQ ID NO: 1192414 - protein, 12 aa, Mycobacterium
APPGEMERRRAE

SEQ ID NO: 1192415 - protein, 8 aa, Mycobacterium
APPGFATS

SEQ ID NO: 1192416 - protein, 5 aa, Mycobacterium
APPGI

SEQ ID NO: 1192417 - protein, 12 aa, Mycobacterium
APPGISDDAKQA

SEQ ID NO: 1192418 - protein, 5 aa, Mycobacterium
APPGL

SEQ ID NO: 1192419 - protein, 8 aa, Mycobacterium
APPGSGSA

SEQ ID NO: 1192420 - protein, 9 aa, Mycobacterium
APPGTGKTR

SEQ ID NO: 1192421 - protein, 11 aa, Mycobacterium
APPGTPGNPIG

SEQ ID NO: 1192422 - protein, 16 aa, Mycobacterium
APPGTPPVPGGAGSVS

SEQ ID NO: 1192423 - protein, 9 aa, Mycobacterium
APPGVGGSA

SEQ ID NO: 1192424 - protein, 7 aa, Mycobacterium
APPHSPD

SEQ ID NO: 1192425 - protein, 4 aa, Mycobacterium
APPI

SEQ ID NO: 1192426 - protein, 15 aa, Mycobacterium
APPIDEDEQARSRAG

SEQ ID NO: 1192427 - protein, 6 aa, Mycobacterium
APPINV

SEQ ID NO: 1192428 - protein, 13 aa, Mycobacterium
APPISGDSTDDGR

SEQ ID NO: 1192429 - protein, 6 aa, Mycobacterium
APPISS

SEQ ID NO: 1192430 - protein, 4 aa, Mycobacterium
APPK

SEQ ID NO: 1192431 - protein, 6 aa, Mycobacterium
APPKLG

SEQ ID NO: 1192432 - protein, 5 aa, Mycobacterium
APPKS

SEQ ID NO: 1192433 - protein, 6 aa, Mycobacterium
APPLPR

SEQ ID NO: 1192434 - protein, 6 aa, Mycobacterium
APPNLV

SEQ ID NO: 1192435 - protein, 9 aa, Mycobacterium
APPPAMTPP

SEQ ID NO: 1192436 - protein, 14 aa, Mycobacterium
APPPATGPAKTKPA

SEQ ID NO: 1192437 - protein, 6 aa, Mycobacterium
APPPLQ

SEQ ID NO: 1192438 - protein, 20 aa, Mycobacterium
APPPPPLPLPPPPPPQPPPP

SEQ ID NO: 1192439 - protein, 8 aa, Mycobacterium
APPPVSGV

SEQ ID NO: 1192440 - protein, 6 aa, Mycobacterium
APPQAL

SEQ ID NO: 1192441 - protein, 15 aa, Mycobacterium
APPQPWNSSGASTKE

SEQ ID NO: 1192442 - protein, 6 aa, Mycobacterium
APPRDR

SEQ ID NO: 1192443 - protein, 6 aa, Mycobacterium
APPRPT

SEQ ID NO: 1192444 - protein, 18 aa, Mycobacterium
APPSRAGRYGAAADATLA

SEQ ID NO: 1192445 - protein, 7 aa, Mycobacterium
APPSVGD

SEQ ID NO: 1192446 - protein, 13 aa, Mycobacterium
APPTDEPPQGQLA

SEQ ID NO: 1192447 - protein, 6 aa, Mycobacterium
APPTFP

SEQ ID NO: 1192448 - protein, 7 aa, Mycobacterium
APPTTWD

SEQ ID NO: 1192449 - protein, 8 aa, Mycobacterium
APPVDPAE

SEQ ID NO: 1192450 - protein, 19 aa, Mycobacterium
APPVPRRAGVRSAANEAEL

SEQ ID NO: 1192451 - protein, 15 aa, Mycobacterium
APPVRRQVTAVAHPA

SEQ ID NO: 1192452 - protein, 7 aa, Mycobacterium
APPYNRR

SEQ ID NO: 1192453 - protein, 14 aa, Mycobacterium
APPYRAGAATHGYS

SEQ ID NO: 1192454 - protein, 18 aa, Mycobacterium
APQAPVSEDQEYDTDDQP

SEQ ID NO: 1192455 - protein, 4 aa, Mycobacterium
APQC

SEQ ID NO: 1192456 - protein, 4 aa, Mycobacterium
APQG

SEQ ID NO: 1192457 - protein, 8 aa, Mycobacterium
APQGSRLS

SEQ ID NO: 1192458 - protein, 5 aa, Mycobacterium
APQGT

SEQ ID NO: 1192459 - protein, 7 aa, Mycobacterium
APQIGNT

SEQ ID NO: 1192460 - protein, 12 aa, Mycobacterium
APQLSAADGRGP

SEQ ID NO: 1192461 - protein, 16 aa, Mycobacterium
APQPLTTATPGGAQSH

SEQ ID NO: 1192462 - protein, 19 aa, Mycobacterium
APQPQSEATFDTDPAGALA

SEQ ID NO: 1192463 - protein, 6 aa, Mycobacterium
APQQGF

SEQ ID NO: 1192464 - protein, 15 aa, Mycobacterium
APQRRESELAAQRER

SEQ ID NO: 1192465 - protein, 8 aa, Mycobacterium
APQSDGAA

SEQ ID NO: 1192466 - protein, 9 aa, Mycobacterium
APQSDGGPG

SEQ ID NO: 1192467 - protein, 22 aa, Mycobacterium
APQSQRDDGPSKPRKPRGPAPR

SEQ ID NO: 1192468 - protein, 8 aa, Mycobacterium
APQTGAVK

SEQ ID NO: 1192469 - protein, 8 aa, Mycobacterium
APQTGGVV

SEQ ID NO: 1192470 - protein, 7 aa, Mycobacterium
APRAAAD

SEQ ID NO: 1192471 - protein, 18 aa, Mycobacterium
APRADRAGAAPQPAAPGG

SEQ ID NO: 1192472 - protein, 8 aa, Mycobacterium
APRDTGLG

SEQ ID NO: 1192473 - protein, 14 aa, Mycobacterium
APREAHHREGHEKY

SEQ ID NO: 1192474 - protein, 5 aa, Mycobacterium
APREM

SEQ ID NO: 1192475 - protein, 12 aa, Mycobacterium
APREPGESPSDF

SEQ ID NO: 1192476 - protein, 6 aa, Mycobacterium
APREVS

SEQ ID NO: 1192477 - protein, 7 aa, Mycobacterium
APRGDEP

SEQ ID NO: 1192478 - protein, 19 aa, Mycobacterium
APRGHVPQMSNKKQGEASA

SEQ ID NO: 1192479 - protein, 6 aa, Mycobacterium
APRGLR

SEQ ID NO: 1192480 - protein, 11 aa, Mycobacterium
APRGYGQGVHE

SEQ ID NO: 1192481 - protein, 14 aa, Mycobacterium
APRITPGGLATQYS

SEQ ID NO: 1192482 - protein, 10 aa, Mycobacterium
APRKQSDPDM

SEQ ID NO: 1192483 - protein, 5 aa, Mycobacterium
APRKS

SEQ ID NO: 1192484 - protein, 7 aa, Mycobacterium
APRLDNQ

SEQ ID NO: 1192485 - protein, 10 aa, Mycobacterium
APRLPDGTPF

SEQ ID NO: 1192486 - protein, 38 aa, Mycobacterium
APRMPDDRSAGKADGVKESTDGTGDVIDAGGKAGLNDV

SEQ ID NO: 1192487 - protein, 15 aa, Mycobacterium
APRNFDNSDAGSQYT

SEQ ID NO: 1192488 - protein, 7 aa, Mycobacterium
APRNGEF

SEQ ID NO: 1192489 - protein, 8 aa, Mycobacterium
APRNPLPY

SEQ ID NO: 1192490 - protein, 4 aa, Mycobacterium
APRP

SEQ ID NO: 1192491 - protein, 10 aa, Mycobacterium
APRPAQATLA

SEQ ID NO: 1192492 - protein, 5 aa, Mycobacterium
APRPG

SEQ ID NO: 1192493 - protein, 11 aa, Mycobacterium
APRPGANVGSL

SEQ ID NO: 1192494 - protein, 7 aa, Mycobacterium
APRPGDR

SEQ ID NO: 1192495 - protein, 7 aa, Mycobacterium
APRPGTD

SEQ ID NO: 1192496 - protein, 14 aa, Mycobacterium
APRRERAADLGGRP

SEQ ID NO: 1192497 - protein, 6 aa, Mycobacterium
APRRGG

SEQ ID NO: 1192498 - protein, 6 aa, Mycobacterium
APRRSL

SEQ ID NO: 1192499 - protein, 5 aa, Mycobacterium
APRRT

SEQ ID NO: 1192500 - protein, 8 aa, Mycobacterium
APRTAAAA

SEQ ID NO: 1192501 - protein, 6 aa, Mycobacterium
APRTAT

SEQ ID NO: 1192502 - protein, 9 aa, Mycobacterium
APRTAVRRG

SEQ ID NO: 1192503 - protein, 10 aa, Mycobacterium
APRTGAPTIT

SEQ ID NO: 1192504 - protein, 7 aa, Mycobacterium
APRTQYE

SEQ ID NO: 1192505 - protein, 6 aa, Mycobacterium
APRTTT

SEQ ID NO: 1192506 - protein, 8 aa, Mycobacterium
APSAAERV

SEQ ID NO: 1192507 - protein, 11 aa, Mycobacterium
APSADESSTAM

SEQ ID NO: 1192508 - protein, 9 aa, Mycobacterium
APSAENTQP

SEQ ID NO: 1192509 - protein, 15 aa, Mycobacterium
APSANLDPTKQNPSM

SEQ ID NO: 1192510 - protein, 8 aa, Mycobacterium
APSAPPER

SEQ ID NO: 1192511 - protein, 7 aa, Mycobacterium
APSAPRV

SEQ ID NO: 1192512 - protein, 9 aa, Mycobacterium
APSATGDPI

SEQ ID NO: 1192513 - protein, 9 aa, Mycobacterium
APSDTDPVY

SEQ ID NO: 1192514 - protein, 14 aa, Mycobacterium
APSEAARPSEVTSD

SEQ ID NO: 1192515 - protein, 10 aa, Mycobacterium
APSENGYARP

SEQ ID NO: 1192516 - protein, 5 aa, Mycobacterium
APSES

SEQ ID NO: 1192517 - protein, 14 aa, Mycobacterium
APSGALDKEGNPVA

SEQ ID NO: 1192518 - protein, 5 aa, Mycobacterium
APSGI

SEQ ID NO: 1192519 - protein, 5 aa, Mycobacterium
APSGR

SEQ ID NO: 1192520 - protein, 6 aa, Mycobacterium
APSGSC

SEQ ID NO: 1192521 - protein, 4 aa, Mycobacterium
APSL

SEQ ID NO: 1192522 - protein, 5 aa, Mycobacterium
APSLD

SEQ ID NO: 1192523 - protein, 12 aa, Mycobacterium
APSLEQAAPKMA

SEQ ID NO: 1192524 - protein, 6 aa, Mycobacterium
APSLPG

SEQ ID NO: 1192525 - protein, 5 aa, Mycobacterium
APSMT

SEQ ID NO: 1192526 - protein, 6 aa, Mycobacterium
APSNAD

SEQ ID NO: 1192527 - protein, 26 aa, Mycobacterium
APSNNAPTTGAPNLDAPDPGTGAVRG

SEQ ID NO: 1192528 - protein, 7 aa, Mycobacterium
APSNYER

SEQ ID NO: 1192529 - protein, 4 aa, Mycobacterium
APSP

SEQ ID NO: 1192530 - protein, 11 aa, Mycobacterium
APSPALHGHRG

SEQ ID NO: 1192531 - protein, 6 aa, Mycobacterium
APSPHG

SEQ ID NO: 1192532 - protein, 8 aa, Mycobacterium
APSPLGRS

SEQ ID NO: 1192533 - protein, 8 aa, Mycobacterium
APSPNGAL

SEQ ID NO: 1192534 - protein, 7 aa, Mycobacterium
APSPRLK

SEQ ID NO: 1192535 - protein, 9 aa, Mycobacterium
APSPTAHPE

SEQ ID NO: 1192536 - protein, 9 aa, Mycobacterium
APSPTDADR

SEQ ID NO: 1192537 - protein, 6 aa, Mycobacterium
APSQAH

SEQ ID NO: 1192538 - protein, 23 aa, Mycobacterium
APSSNQAPGGVSYSANPNTDTGV

SEQ ID NO: 1192539 - protein, 8 aa, Mycobacterium
APSSPWEV

SEQ ID NO: 1192540 - protein, 9 aa, Mycobacterium
APSVPPPLR

SEQ ID NO: 1192541 - protein, 10 aa, Mycobacterium
APSVPPPLSP

SEQ ID NO: 1192542 - protein, 11 aa, Mycobacterium
APTAGEVPEAE

SEQ ID NO: 1192543 - protein, 23 aa, Mycobacterium
APTANSGPSTPVDAANRKAIERR

SEQ ID NO: 1192544 - protein, 13 aa, Mycobacterium
APTAPVPAPRSGP

SEQ ID NO: 1192545 - protein, 15 aa, Mycobacterium
APTARDGDTPGLNPD

SEQ ID NO: 1192546 - protein, 4 aa, Mycobacterium
APTC

SEQ ID NO: 1192547 - protein, 10 aa, Mycobacterium
APTDALRRGG

SEQ ID NO: 1192548 - protein, 8 aa, Mycobacterium
APTDLSDD

SEQ ID NO: 1192549 - protein, 6 aa, Mycobacterium
APTDPV

SEQ ID NO: 1192550 - protein, 5 aa, Mycobacterium
APTFA

SEQ ID NO: 1192551 - protein, 8 aa, Mycobacterium
APTGANGQ

SEQ ID NO: 1192552 - protein, 5 aa, Mycobacterium
APTGH

SEQ ID NO: 1192553 - protein, 6 aa, Mycobacterium
APTGHS

SEQ ID NO: 1192554 - protein, 12 aa, Mycobacterium
APTGHTYTTHPG

SEQ ID NO: 1192555 - protein, 6 aa, Mycobacterium
APTGIR

SEQ ID NO: 1192556 - protein, 7 aa, Mycobacterium
APTGKAA

SEQ ID NO: 1192557 - protein, 10 aa, Mycobacterium
APTGKAAARL

SEQ ID NO: 1192558 - protein, 14 aa, Mycobacterium
APTIEEDRAPTPRL

SEQ ID NO: 1192559 - protein, 6 aa, Mycobacterium
APTKHQ

SEQ ID NO: 1192560 - protein, 10 aa, Mycobacterium
APTLDGAQRA

SEQ ID NO: 1192561 - protein, 10 aa, Mycobacterium
APTLPGPRAE

SEQ ID NO: 1192562 - protein, 5 aa, Mycobacterium
APTNC

SEQ ID NO: 1192563 - protein, 20 aa, Mycobacterium
APTNTSPVGSAAGAGVTDPV

SEQ ID NO: 1192564 - protein, 7 aa, Mycobacterium
APTPENA

SEQ ID NO: 1192565 - protein, 8 aa, Mycobacterium
APTPRQVG

SEQ ID NO: 1192566 - protein, 13 aa, Mycobacterium
APTPYDGDSPTEV

SEQ ID NO: 1192567 - protein, 12 aa, Mycobacterium
APTQSVQGTATA

SEQ ID NO: 1192568 - protein, 6 aa, Mycobacterium
APTRRM

SEQ ID NO: 1192569 - protein, 5 aa, Mycobacterium
APTRS

SEQ ID NO: 1192570 - protein, 6 aa, Mycobacterium
APTRTD

SEQ ID NO: 1192571 - protein, 4 aa, Mycobacterium
APTS

SEQ ID NO: 1192572 - protein, 5 aa, Mycobacterium
APTSD

SEQ ID NO: 1192573 - protein, 13 aa, Mycobacterium
APTSDTGADARPR

SEQ ID NO: 1192574 - protein, 8 aa, Mycobacterium
APTSEDQI

SEQ ID NO: 1192575 - protein, 10 aa, Mycobacterium
APTSSENSSV

SEQ ID NO: 1192576 - protein, 12 aa, Mycobacterium
APTTGFAGTADD

SEQ ID NO: 1192577 - protein, 15 aa, Mycobacterium
APTTSLPESPQGERN

SEQ ID NO: 1192578 - protein, 4 aa, Mycobacterium
APTV

SEQ ID NO: 1192579 - protein, 6 aa, Mycobacterium
APTVSA

SEQ ID NO: 1192580 - protein, 11 aa, Mycobacterium
APTVTGGGSCA

SEQ ID NO: 1192581 - protein, 11 aa, Mycobacterium
APTVTNGQLDR

SEQ ID NO: 1192582 - protein, 17 aa, Mycobacterium
APTVTPPADGAGDDPAR

SEQ ID NO: 1192583 - protein, 9 aa, Mycobacterium
APVANGANV

SEQ ID NO: 1192584 - protein, 13 aa, Mycobacterium
APVAPPASTDVNP

SEQ ID NO: 1192585 - protein, 10 aa, Mycobacterium
APVAPRPRNS

SEQ ID NO: 1192586 - protein, 4 aa, Mycobacterium
APVD

SEQ ID NO: 1192587 - protein, 49 aa, Mycobacterium
APVDEAGDDVEAAPDETDTADDTAGEDDGDSAGGAGGESGGAGGESGGD

SEQ ID NO: 1192588 - protein, 6 aa, Mycobacterium
APVDEC

SEQ ID NO: 1192589 - protein, 4 aa, Mycobacterium
APVE

SEQ ID NO: 1192590 - protein, 6 aa, Mycobacterium
APVESG

SEQ ID NO: 1192591 - protein, 6 aa, Mycobacterium
APVESQ

SEQ ID NO: 1192592 - protein, 16 aa, Mycobacterium
APVGDGREAAGGADAY

SEQ ID NO: 1192593 - protein, 6 aa, Mycobacterium
APVGGV

SEQ ID NO: 1192594 - protein, 11 aa, Mycobacterium
APVGKRNGALS

SEQ ID NO: 1192595 - protein, 6 aa, Mycobacterium
APVGNN

SEQ ID NO: 1192596 - protein, 5 aa, Mycobacterium
APVGP

SEQ ID NO: 1192597 - protein, 6 aa, Mycobacterium
APVGRA

SEQ ID NO: 1192598 - protein, 5 aa, Mycobacterium
APVKE

SEQ ID NO: 1192599 - protein, 14 aa, Mycobacterium
APVLDSQAESADSI

SEQ ID NO: 1192600 - protein, 6 aa, Mycobacterium
APVNGY

SEQ ID NO: 1192601 - protein, 7 aa, Mycobacterium
APVPDGD

SEQ ID NO: 1192602 - protein, 22 aa, Mycobacterium
APVPEPAAFSGAPDSLLPRPDS

SEQ ID NO: 1192603 - protein, 6 aa, Mycobacterium
APVPGE

SEQ ID NO: 1192604 - protein, 51 aa, Mycobacterium
APVPPATVTETTTPPTTSPSPTTTATTTVTETTPPTTTTVPTSPESPTPPA

SEQ ID NO: 1192605 - protein, 9 aa, Mycobacterium
APVPPGEPL

SEQ ID NO: 1192606 - protein, 22 aa, Mycobacterium
APVPPPPGAPVPPPPGAPVPPA

SEQ ID NO: 1192607 - protein, 11 aa, Mycobacterium
APVREQSRQGM

SEQ ID NO: 1192608 - protein, 5 aa, Mycobacterium
APVRT

SEQ ID NO: 1192609 - protein, 8 aa, Mycobacterium
APVSEPAD

SEQ ID NO: 1192610 - protein, 8 aa, Mycobacterium
APVSPDQA

SEQ ID NO: 1192611 - protein, 7 aa, Mycobacterium
APVSTSS

SEQ ID NO: 1192612 - protein, 8 aa, Mycobacterium
APVSTSSQ

SEQ ID NO: 1192613 - protein, 4 aa, Mycobacterium
APVT

SEQ ID NO: 1192614 - protein, 14 aa, Mycobacterium
APVTAGDSEPMTSS

SEQ ID NO: 1192615 - protein, 11 aa, Mycobacterium
APVTGTAVTTR

SEQ ID NO: 1192616 - protein, 4 aa, Mycobacterium
APWP

SEQ ID NO: 1192617 - protein, 8 aa, Mycobacterium
APYGVEPA

SEQ ID NO: 1192618 - protein, 6 aa, Mycobacterium
APYKSN

SEQ ID NO: 1192619 - protein, 7 aa, Mycobacterium
APYPFTG

SEQ ID NO: 1192620 - protein, 8 aa, Mycobacterium
AQAAAGAV

SEQ ID NO: 1192621 - protein, 10 aa, Mycobacterium
AQAAEKAGFG

SEQ ID NO: 1192622 - protein, 8 aa, Mycobacterium
AQAAGADE

SEQ ID NO: 1192623 - protein, 20 aa, Mycobacterium
AQAANDVAGASLTQAVTLTF

SEQ ID NO: 1192624 - protein, 5 aa, Mycobacterium
AQAAP

SEQ ID NO: 1192625 - protein, 9 aa, Mycobacterium
AQAAPGLEL

SEQ ID NO: 1192626 - protein, 10 aa, Mycobacterium
AQAAPPAEVY

SEQ ID NO: 1192627 - protein, 8 aa, Mycobacterium
AQAAPTRF

SEQ ID NO: 1192628 - protein, 18 aa, Mycobacterium
AQAARGDAAHSASATGTM

SEQ ID NO: 1192629 - protein, 8 aa, Mycobacterium
AQAATEHL

SEQ ID NO: 1192630 - protein, 9 aa, Mycobacterium
AQAAYGDPG

SEQ ID NO: 1192631 - protein, 7 aa, Mycobacterium
AQADGLA

SEQ ID NO: 1192632 - protein, 9 aa, Mycobacterium
AQADGTSMT

SEQ ID NO: 1192633 - protein, 17 aa, Mycobacterium
AQADKSRRPGPAGGELA

SEQ ID NO: 1192634 - protein, 6 aa, Mycobacterium
AQADSV

SEQ ID NO: 1192635 - protein, 14 aa, Mycobacterium
AQAEATAAKIGSGE

SEQ ID NO: 1192636 - protein, 5 aa, Mycobacterium
AQAEH

SEQ ID NO: 1192637 - protein, 24 aa, Mycobacterium
AQAELAAAGARLAEQRAATSDDEL

SEQ ID NO: 1192638 - protein, 10 aa, Mycobacterium
AQAEQAAQSA

SEQ ID NO: 1192639 - protein, 9 aa, Mycobacterium
AQAETERGV

SEQ ID NO: 1192640 - protein, 9 aa, Mycobacterium
AQAGAEAAA

SEQ ID NO: 1192641 - protein, 10 aa, Mycobacterium
AQAGEEQRRA

SEQ ID NO: 1192642 - protein, 8 aa, Mycobacterium
AQAGETIE

SEQ ID NO: 1192643 - protein, 7 aa, Mycobacterium
AQAGGKV

SEQ ID NO: 1192644 - protein, 8 aa, Mycobacterium
AQAGGLAP

SEQ ID NO: 1192645 - protein, 10 aa, Mycobacterium
AQAKAEGGKV

SEQ ID NO: 1192646 - protein, 6 aa, Mycobacterium
AQANPE

SEQ ID NO: 1192647 - protein, 5 aa, Mycobacterium
AQAPA

SEQ ID NO: 1192648 - protein, 12 aa, Mycobacterium
AQAPAASYDDPG

SEQ ID NO: 1192649 - protein, 15 aa, Mycobacterium
AQAPEARPLTYGQSV

SEQ ID NO: 1192650 - protein, 8 aa, Mycobacterium
AQAPGGAK

SEQ ID NO: 1192651 - protein, 6 aa, Mycobacterium
AQAPGL

SEQ ID NO: 1192652 - protein, 14 aa, Mycobacterium
AQAPLEPVSYGVFR

SEQ ID NO: 1192653 - protein, 18 aa, Mycobacterium
AQAPRAPHAPEGAYPGTC

SEQ ID NO: 1192654 - protein, 6 aa, Mycobacterium
AQAPRG

SEQ ID NO: 1192655 - protein, 10 aa, Mycobacterium
AQAPSVRNTQ

SEQ ID NO: 1192656 - protein, 6 aa, Mycobacterium
AQAQEQ

SEQ ID NO: 1192657 - protein, 16 aa, Mycobacterium
AQAQPAAPRGDVSPDD

SEQ ID NO: 1192658 - protein, 27 aa, Mycobacterium
AQAQVQARANRSERIDRDSAWKAKRAA

SEQ ID NO: 1192659 - protein, 20 aa, Mycobacterium
AQARGYDVDKPRNLAKSVTV

SEQ ID NO: 1192660 - protein, 9 aa, Mycobacterium
AQARNADGQ

SEQ ID NO: 1192661 - protein, 8 aa, Mycobacterium
AQARPGQT

SEQ ID NO: 1192662 - protein, 6 aa, Mycobacterium
AQARQV

SEQ ID NO: 1192663 - protein, 6 aa, Mycobacterium
AQARSA

SEQ ID NO: 1192664 - protein, 6 aa, Mycobacterium
AQARTA

SEQ ID NO: 1192665 - protein, 5 aa, Mycobacterium
AQASF

SEQ ID NO: 1192666 - protein, 17 aa, Mycobacterium
AQASGAALADAGIARSD

SEQ ID NO: 1192667 - protein, 22 aa, Mycobacterium
AQATASRDDRQPHLTADDAKDL

SEQ ID NO: 1192668 - protein, 14 aa, Mycobacterium
AQATATDDNQLPGQ

SEQ ID NO: 1192669 - protein, 5 aa, Mycobacterium
AQATE

SEQ ID NO: 1192670 - protein, 10 aa, Mycobacterium
AQATEADYEQ

SEQ ID NO: 1192671 - protein, 11 aa, Mycobacterium
AQAVDEAGTGF

SEQ ID NO: 1192672 - protein, 14 aa, Mycobacterium
AQAVPQPDAAAPEL

SEQ ID NO: 1192673 - protein, 6 aa, Mycobacterium
AQAVPS

SEQ ID NO: 1192674 - protein, 9 aa, Mycobacterium
AQAYSLPPH

SEQ ID NO: 1192675 - protein, 4 aa, Mycobacterium
AQDA

SEQ ID NO: 1192676 - protein, 12 aa, Mycobacterium
AQDAEGVTVRSE

SEQ ID NO: 1192677 - protein, 9 aa, Mycobacterium
AQDAGDQYD

SEQ ID NO: 1192678 - protein, 8 aa, Mycobacterium
AQDAISAS

SEQ ID NO: 1192679 - protein, 9 aa, Mycobacterium
AQDAKPGDR

SEQ ID NO: 1192680 - protein, 5 aa, Mycobacterium
AQDAP

SEQ ID NO: 1192681 - protein, 8 aa, Mycobacterium
AQDCAGDV

SEQ ID NO: 1192682 - protein, 6 aa, Mycobacterium
AQDEAM

SEQ ID NO: 1192683 - protein, 9 aa, Mycobacterium
AQDEQPPYR

SEQ ID NO: 1192684 - protein, 12 aa, Mycobacterium
AQDFDDPDRFDP

SEQ ID NO: 1192685 - protein, 22 aa, Mycobacterium
AQDGETRRYSEIGEQERRDKNW

SEQ ID NO: 1192686 - protein, 11 aa, Mycobacterium
AQDGHGGNRAL

SEQ ID NO: 1192687 - protein, 6 aa, Mycobacterium
AQDGRE

SEQ ID NO: 1192688 - protein, 11 aa, Mycobacterium
AQDHGQSARTA

SEQ ID NO: 1192689 - protein, 6 aa, Mycobacterium
AQDKGP

SEQ ID NO: 1192690 - protein, 7 aa, Mycobacterium
AQDLASG

SEQ ID NO: 1192691 - protein, 9 aa, Mycobacterium
AQDLGGGDI

SEQ ID NO: 1192692 - protein, 22 aa, Mycobacterium
AQDNPHAVNREPLDDDGYQRSP

SEQ ID NO: 1192693 - protein, 99 aa, Mycobacterium
AQDPASSGGKSPAQPAPTAPPGTPPDPGSTPDDAEAESPSAPEGPGAEDDADPSPSPAPEEEDQDSPTSTAEDATAGGAGPDAAADDGSPDSGATDDPG

SEQ ID NO: 1192694 - protein, 12 aa, Mycobacterium
AQDPKSKLSRAH

SEQ ID NO: 1192695 - protein, 7 aa, Mycobacterium
AQDPPPH

SEQ ID NO: 1192696 - protein, 7 aa, Mycobacterium
AQDPRTA

SEQ ID NO: 1192697 - protein, 9 aa, Mycobacterium
AQDRESFGQ

SEQ ID NO: 1192698 - protein, 16 aa, Mycobacterium
AQDRRAPRWADLLMQL

SEQ ID NO: 1192699 - protein, 4 aa, Mycobacterium
AQDS

SEQ ID NO: 1192700 - protein, 7 aa, Mycobacterium
AQDTTGV

SEQ ID NO: 1192701 - protein, 13 aa, Mycobacterium
AQDWPKSEHPRRA

SEQ ID NO: 1192702 - protein, 5 aa, Mycobacterium
AQDYR

SEQ ID NO: 1192703 - protein, 4 aa, Mycobacterium
AQEA

SEQ ID NO: 1192704 - protein, 9 aa, Mycobacterium
AQEADASGF

SEQ ID NO: 1192705 - protein, 14 aa, Mycobacterium
AQEAVDGKVNPSRI

SEQ ID NO: 1192706 - protein, 10 aa, Mycobacterium
AQEDDTVEVG

SEQ ID NO: 1192707 - protein, 14 aa, Mycobacterium
AQEEVWGSDPTVRV

SEQ ID NO: 1192708 - protein, 7 aa, Mycobacterium
AQEGAKY

SEQ ID NO: 1192709 - protein, 8 aa, Mycobacterium
AQEPPPSA

SEQ ID NO: 1192710 - protein, 6 aa, Mycobacterium
AQEQGY

SEQ ID NO: 1192711 - protein, 7 aa, Mycobacterium
AQEQLRE

SEQ ID NO: 1192712 - protein, 7 aa, Mycobacterium
AQEQTYR

SEQ ID NO: 1192713 - protein, 13 aa, Mycobacterium
AQEQTYRAGATSW

SEQ ID NO: 1192714 - protein, 12 aa, Mycobacterium
AQERAEREARLT

SEQ ID NO: 1192715 - protein, 11 aa, Mycobacterium
AQERAQREARL

SEQ ID NO: 1192716 - protein, 7 aa, Mycobacterium
AQERRPA

SEQ ID NO: 1192717 - protein, 9 aa, Mycobacterium
AQERSTRRL

SEQ ID NO: 1192718 - protein, 4 aa, Mycobacterium
AQES

SEQ ID NO: 1192719 - protein, 6 aa, Mycobacterium
AQESFG

SEQ ID NO: 1192720 - protein, 7 aa, Mycobacterium
AQESMRV

SEQ ID NO: 1192721 - protein, 7 aa, Mycobacterium
AQGAWTG

SEQ ID NO: 1192722 - protein, 4 aa, Mycobacterium
AQGC

SEQ ID NO: 1192723 - protein, 12 aa, Mycobacterium
AQGDETSSTGEN

SEQ ID NO: 1192724 - protein, 7 aa, Mycobacterium
AQGERDI

SEQ ID NO: 1192725 - protein, 4 aa, Mycobacterium
AQGF

SEQ ID NO: 1192726 - protein, 10 aa, Mycobacterium
AQGGDPDAAL

SEQ ID NO: 1192727 - protein, 9 aa, Mycobacterium
AQGGDTTRL

SEQ ID NO: 1192728 - protein, 10 aa, Mycobacterium
AQGGEDRDGL

SEQ ID NO: 1192729 - protein, 9 aa, Mycobacterium
AQGGNTNVD

SEQ ID NO: 1192730 - protein, 7 aa, Mycobacterium
AQGGTSF

SEQ ID NO: 1192731 - protein, 5 aa, Mycobacterium
AQGIR

SEQ ID NO: 1192732 - protein, 15 aa, Mycobacterium
AQGKIADRVDADRTA

SEQ ID NO: 1192733 - protein, 5 aa, Mycobacterium
AQGKL

SEQ ID NO: 1192734 - protein, 7 aa, Mycobacterium
AQGKRER

SEQ ID NO: 1192735 - protein, 7 aa, Mycobacterium
AQGKRQR

SEQ ID NO: 1192736 - protein, 11 aa, Mycobacterium
AQGKYETGNRY

SEQ ID NO: 1192737 - protein, 9 aa, Mycobacterium
AQGNEIPEG

SEQ ID NO: 1192738 - protein, 7 aa, Mycobacterium
AQGPDVG

SEQ ID NO: 1192739 - protein, 7 aa, Mycobacterium
AQGPGRL

SEQ ID NO: 1192740 - protein, 9 aa, Mycobacterium
AQGPKSAEV

SEQ ID NO: 1192741 - protein, 112 aa, Mycobacterium
AQGPSASADQPVPISQSSGGGSPGSPGGLGSPGSPSSSTSGSSPISTSGGSSSGSGASSSGSGSGSGGSSSAAASSSGTSPTSGGQSATGAAGGQPTAASPASAAKAQPSPM

SEQ ID NO: 1192742 - protein, 7 aa, Mycobacterium
AQGQQVA

SEQ ID NO: 1192743 - protein, 16 aa, Mycobacterium
AQGRDAAGGGGSEIET

SEQ ID NO: 1192744 - protein, 10 aa, Mycobacterium
AQGRGSAANS

SEQ ID NO: 1192745 - protein, 12 aa, Mycobacterium
AQGRGVGVQPSV

SEQ ID NO: 1192746 - protein, 9 aa, Mycobacterium
AQGRTLSAE

SEQ ID NO: 1192747 - protein, 15 aa, Mycobacterium
AQGSGDGYTLTGSRT

SEQ ID NO: 1192748 - protein, 8 aa, Mycobacterium
AQGSGSVV

SEQ ID NO: 1192749 - protein, 15 aa, Mycobacterium
AQGSPERDFGPRSED

SEQ ID NO: 1192750 - protein, 16 aa, Mycobacterium
AQGTPEDVAANTDSYT

SEQ ID NO: 1192751 - protein, 7 aa, Mycobacterium
AQGVESG

SEQ ID NO: 1192752 - protein, 9 aa, Mycobacterium
AQGYATGQF

SEQ ID NO: 1192753 - protein, 6 aa, Mycobacterium
AQGYGQ

SEQ ID NO: 1192754 - protein, 12 aa, Mycobacterium
AQGYSDSKGIVS

SEQ ID NO: 1192755 - protein, 15 aa, Mycobacterium
AQHARASARADGNAA

SEQ ID NO: 1192756 - protein, 10 aa, Mycobacterium
AQHARHEAEV

SEQ ID NO: 1192757 - protein, 7 aa, Mycobacterium
AQHGSAH

SEQ ID NO: 1192758 - protein, 27 aa, Mycobacterium
AQHPRADAPAPGTPGDRNRRSFNAALE

SEQ ID NO: 1192759 - protein, 4 aa, Mycobacterium
AQIE

SEQ ID NO: 1192760 - protein, 9 aa, Mycobacterium
AQINPDDLA

SEQ ID NO: 1192761 - protein, 10 aa, Mycobacterium
AQKADGKNTD

SEQ ID NO: 1192762 - protein, 120 aa, Mycobacterium
AQKLPAEGPAVKRGVTATSTARKAAKKAPAKKAAVKKAAPAKKAPAKKAAPAKKAAVKKAAPAKKAPAKKAAPAKKAAVKKAAPAKKAPAKKAAVKKAPAKKAAPAKKAPAKKAPAKRGR

SEQ ID NO: 1192763 - protein, 4 aa, Mycobacterium
AQKN

SEQ ID NO: 1192764 - protein, 8 aa, Mycobacterium
AQKRDHRK

SEQ ID NO: 1192765 - protein, 8 aa, Mycobacterium
AQKSNAAM

SEQ ID NO: 1192766 - protein, 7 aa, Mycobacterium
AQLDPTK

SEQ ID NO: 1192767 - protein, 11 aa, Mycobacterium
AQLEGSDPRVS

SEQ ID NO: 1192768 - protein, 8 aa, Mycobacterium
AQLESRSE

SEQ ID NO: 1192769 - protein, 12 aa, Mycobacterium
AQLGRAREAMQD

SEQ ID NO: 1192770 - protein, 17 aa, Mycobacterium
AQLGSATNQGPGGSAYS

SEQ ID NO: 1192771 - protein, 11 aa, Mycobacterium
AQLNPGSEAVD

SEQ ID NO: 1192772 - protein, 9 aa, Mycobacterium
AQLPAPAHT

SEQ ID NO: 1192773 - protein, 7 aa, Mycobacterium
AQLPPDI

SEQ ID NO: 1192774 - protein, 8 aa, Mycobacterium
AQLPRRTK

SEQ ID NO: 1192775 - protein, 4 aa, Mycobacterium
AQLR

SEQ ID NO: 1192776 - protein, 12 aa, Mycobacterium
AQLRERGSPDAV

SEQ ID NO: 1192777 - protein, 16 aa, Mycobacterium
AQLSTPVKDLSGGQQR

SEQ ID NO: 1192778 - protein, 5 aa, Mycobacterium
AQLTA

SEQ ID NO: 1192779 - protein, 28 aa, Mycobacterium
AQLTRASSSQKQRGAPTRHTDGRMHTHM

SEQ ID NO: 1192780 - protein, 4 aa, Mycobacterium
AQMG

SEQ ID NO: 1192781 - protein, 7 aa, Mycobacterium
AQNAASF

SEQ ID NO: 1192782 - protein, 10 aa, Mycobacterium
AQNESAVELQ

SEQ ID NO: 1192783 - protein, 7 aa, Mycobacterium
AQNGDMA

SEQ ID NO: 1192784 - protein, 8 aa, Mycobacterium
AQNKARPV

SEQ ID NO: 1192785 - protein, 4 aa, Mycobacterium
AQNP

SEQ ID NO: 1192786 - protein, 8 aa, Mycobacterium
AQNPWSSR

SEQ ID NO: 1192787 - protein, 6 aa, Mycobacterium
AQNPYG

SEQ ID NO: 1192788 - protein, 15 aa, Mycobacterium
AQNREAKPTADPGAF

SEQ ID NO: 1192789 - protein, 18 aa, Mycobacterium
AQNRGATTVEPSQEGQDN

SEQ ID NO: 1192790 - protein, 7 aa, Mycobacterium
AQNRNDH

SEQ ID NO: 1192791 - protein, 28 aa, Mycobacterium
AQNRSETQLRQAQEKADALQADAERKHS

SEQ ID NO: 1192792 - protein, 11 aa, Mycobacterium
AQNSRADRLAN

SEQ ID NO: 1192793 - protein, 10 aa, Mycobacterium
AQNTKDAHGR

SEQ ID NO: 1192794 - protein, 6 aa, Mycobacterium
AQPAAT

SEQ ID NO: 1192795 - protein, 11 aa, Mycobacterium
AQPAPLSDTVT

SEQ ID NO: 1192796 - protein, 5 aa, Mycobacterium
AQPDD

SEQ ID NO: 1192797 - protein, 5 aa, Mycobacterium
AQPDE

SEQ ID NO: 1192798 - protein, 5 aa, Mycobacterium
AQPDV

SEQ ID NO: 1192799 - protein, 7 aa, Mycobacterium
AQPHSGI

SEQ ID NO: 1192800 - protein, 10 aa, Mycobacterium
AQPIGSDGDA

SEQ ID NO: 1192801 - protein, 8 aa, Mycobacterium
AQPLETAD

SEQ ID NO: 1192802 - protein, 6 aa, Mycobacterium
AQPLPA

SEQ ID NO: 1192803 - protein, 9 aa, Mycobacterium
AQPPHLPAG

SEQ ID NO: 1192804 - protein, 5 aa, Mycobacterium
AQPRV

SEQ ID NO: 1192805 - protein, 6 aa, Mycobacterium
AQPRYE

SEQ ID NO: 1192806 - protein, 5 aa, Mycobacterium
AQPSE

SEQ ID NO: 1192807 - protein, 10 aa, Mycobacterium
AQPSPTSPTG

SEQ ID NO: 1192808 - protein, 4 aa, Mycobacterium
AQPT

SEQ ID NO: 1192809 - protein, 18 aa, Mycobacterium
AQPTPGGGARTLPDPEFS

SEQ ID NO: 1192810 - protein, 8 aa, Mycobacterium
AQPTPPRF

SEQ ID NO: 1192811 - protein, 13 aa, Mycobacterium
AQPVADGDRANPA

SEQ ID NO: 1192812 - protein, 14 aa, Mycobacterium
AQPVSEGDRANPGQ

SEQ ID NO: 1192813 - protein, 21 aa, Mycobacterium
AQPVSREGSDAVTRAATQLAR

SEQ ID NO: 1192814 - protein, 5 aa, Mycobacterium
AQPYG

SEQ ID NO: 1192815 - protein, 4 aa, Mycobacterium
AQQA

SEQ ID NO: 1192816 - protein, 8 aa, Mycobacterium
AQQADQDL

SEQ ID NO: 1192817 - protein, 6 aa, Mycobacterium
AQQAET

SEQ ID NO: 1192818 - protein, 8 aa, Mycobacterium
AQQAGQQV

SEQ ID NO: 1192819 - protein, 9 aa, Mycobacterium
AQQALTRSD

SEQ ID NO: 1192820 - protein, 10 aa, Mycobacterium
AQQARPGDTI

SEQ ID NO: 1192821 - protein, 4 aa, Mycobacterium
AQQC

SEQ ID NO: 1192822 - protein, 4 aa, Mycobacterium
AQQD

SEQ ID NO: 1192823 - protein, 8 aa, Mycobacterium
AQQGQTEL

SEQ ID NO: 1192824 - protein, 4 aa, Mycobacterium
AQQP

SEQ ID NO: 1192825 - protein, 7 aa, Mycobacterium
AQQPADH

SEQ ID NO: 1192826 - protein, 8 aa, Mycobacterium
AQQPAPPL

SEQ ID NO: 1192827 - protein, 4 aa, Mycobacterium
AQQR

SEQ ID NO: 1192828 - protein, 10 aa, Mycobacterium
AQQRDWNAER

SEQ ID NO: 1192829 - protein, 7 aa, Mycobacterium
AQQRTTF

SEQ ID NO: 1192830 - protein, 11 aa, Mycobacterium
AQQSEGGPDMG

SEQ ID NO: 1192831 - protein, 14 aa, Mycobacterium
AQQSLAAAGAHDRG

SEQ ID NO: 1192832 - protein, 11 aa, Mycobacterium
AQQTFTAQQRE

SEQ ID NO: 1192833 - protein, 6 aa, Mycobacterium
AQQTGG

SEQ ID NO: 1192834 - protein, 8 aa, Mycobacterium
AQQTGNPA

SEQ ID NO: 1192835 - protein, 8 aa, Mycobacterium
AQRAGAGA

SEQ ID NO: 1192836 - protein, 12 aa, Mycobacterium
AQRAGTDALEPG

SEQ ID NO: 1192837 - protein, 12 aa, Mycobacterium
AQRAKGRKVTAS

SEQ ID NO: 1192838 - protein, 7 aa, Mycobacterium
AQRALDE

SEQ ID NO: 1192839 - protein, 7 aa, Mycobacterium
AQRARVT

SEQ ID NO: 1192840 - protein, 7 aa, Mycobacterium
AQRASRE

SEQ ID NO: 1192841 - protein, 4 aa, Mycobacterium
AQRC

SEQ ID NO: 1192842 - protein, 7 aa, Mycobacterium
AQRCPDR

SEQ ID NO: 1192843 - protein, 8 aa, Mycobacterium
AQRCPDRP

SEQ ID NO: 1192844 - protein, 9 aa, Mycobacterium
AQRDNPTSF

SEQ ID NO: 1192845 - protein, 8 aa, Mycobacterium
AQRDPAAM

SEQ ID NO: 1192846 - protein, 22 aa, Mycobacterium
AQRDPLAEHPGRVRSNREDHKR

SEQ ID NO: 1192847 - protein, 7 aa, Mycobacterium
AQREDGS

SEQ ID NO: 1192848 - protein, 9 aa, Mycobacterium
AQREGFCPE

SEQ ID NO: 1192849 - protein, 7 aa, Mycobacterium
AQREPDV

SEQ ID NO: 1192850 - protein, 17 aa, Mycobacterium
AQRGADAPDADGPANLR

SEQ ID NO: 1192851 - protein, 14 aa, Mycobacterium
AQRGDTDAARAAAQ

SEQ ID NO: 1192852 - protein, 5 aa, Mycobacterium
AQRGG

SEQ ID NO: 1192853 - protein, 21 aa, Mycobacterium
AQRGRGERKRPSSGWASLTPT

SEQ ID NO: 1192854 - protein, 9 aa, Mycobacterium
AQRHRRSGA

SEQ ID NO: 1192855 - protein, 16 aa, Mycobacterium
AQRLDSAAATLRSHGN

SEQ ID NO: 1192856 - protein, 12 aa, Mycobacterium
AQRLGGSGRTAS

SEQ ID NO: 1192857 - protein, 7 aa, Mycobacterium
AQRPVGA

SEQ ID NO: 1192858 - protein, 7 aa, Mycobacterium
AQRPVPP

SEQ ID NO: 1192859 - protein, 4 aa, Mycobacterium
AQRQ

SEQ ID NO: 1192860 - protein, 16 aa, Mycobacterium
AQRQAREALRESRPVA

SEQ ID NO: 1192861 - protein, 5 aa, Mycobacterium
AQRQL

SEQ ID NO: 1192862 - protein, 8 aa, Mycobacterium
AQRQTWRD

SEQ ID NO: 1192863 - protein, 4 aa, Mycobacterium
AQRR

SEQ ID NO: 1192864 - protein, 8 aa, Mycobacterium
AQRRAGAS

SEQ ID NO: 1192865 - protein, 13 aa, Mycobacterium
AQRRAQKRLPPSV

SEQ ID NO: 1192866 - protein, 7 aa, Mycobacterium
AQRREAE

SEQ ID NO: 1192867 - protein, 11 aa, Mycobacterium
AQRRGPELSDE

SEQ ID NO: 1192868 - protein, 7 aa, Mycobacterium
AQRRPAA

SEQ ID NO: 1192869 - protein, 14 aa, Mycobacterium
AQRRQPELEATTRV

SEQ ID NO: 1192870 - protein, 10 aa, Mycobacterium
AQRRQTADSL

SEQ ID NO: 1192871 - protein, 12 aa, Mycobacterium
AQRRSSGSGRPR

SEQ ID NO: 1192872 - protein, 7 aa, Mycobacterium
AQRRTPP

SEQ ID NO: 1192873 - protein, 16 aa, Mycobacterium
AQRSADADDADGPANL

SEQ ID NO: 1192874 - protein, 10 aa, Mycobacterium
AQRSGLRSGA

SEQ ID NO: 1192875 - protein, 9 aa, Mycobacterium
AQRSPGATR

SEQ ID NO: 1192876 - protein, 10 aa, Mycobacterium
AQRSRAGDNC

SEQ ID NO: 1192877 - protein, 13 aa, Mycobacterium
AQRSRNRDKARAQ

SEQ ID NO: 1192878 - protein, 6 aa, Mycobacterium
AQRTAP

SEQ ID NO: 1192879 - protein, 6 aa, Mycobacterium
AQRWSG

SEQ ID NO: 1192880 - protein, 11 aa, Mycobacterium
AQSAAGDRDAA

SEQ ID NO: 1192881 - protein, 12 aa, Mycobacterium
AQSAAQNAMSTS

SEQ ID NO: 1192882 - protein, 18 aa, Mycobacterium
AQSDRALNIPGEDLPGSV

SEQ ID NO: 1192883 - protein, 12 aa, Mycobacterium
AQSDTGLPAARA

SEQ ID NO: 1192884 - protein, 15 aa, Mycobacterium
AQSEHFGGARSSTRD

SEQ ID NO: 1192885 - protein, 5 aa, Mycobacterium
AQSGA

SEQ ID NO: 1192886 - protein, 9 aa, Mycobacterium
AQSGGGNGG

SEQ ID NO: 1192887 - protein, 10 aa, Mycobacterium
AQSKDVSGLE

SEQ ID NO: 1192888 - protein, 12 aa, Mycobacterium
AQSPDDGARSTI

SEQ ID NO: 1192889 - protein, 6 aa, Mycobacterium
AQSPFA

SEQ ID NO: 1192890 - protein, 6 aa, Mycobacterium
AQSPLD

SEQ ID NO: 1192891 - protein, 39 aa, Mycobacterium
AQSQPFTTEPELRPGPTSSEPPPPPLPAKPFPKACPAPG

SEQ ID NO: 1192892 - protein, 10 aa, Mycobacterium
AQSSAGTDRD

SEQ ID NO: 1192893 - protein, 11 aa, Mycobacterium
AQSSRQTGGSL

SEQ ID NO: 1192894 - protein, 7 aa, Mycobacterium
AQSTGSE

SEQ ID NO: 1192895 - protein, 6 aa, Mycobacterium
AQSTVE

SEQ ID NO: 1192896 - protein, 4 aa, Mycobacterium
AQTA

SEQ ID NO: 1192897 - protein, 9 aa, Mycobacterium
AQTDPAADA

SEQ ID NO: 1192898 - protein, 6 aa, Mycobacterium
AQTDTT

SEQ ID NO: 1192899 - protein, 6 aa, Mycobacterium
AQTDYP

SEQ ID NO: 1192900 - protein, 6 aa, Mycobacterium
AQTGAT

SEQ ID NO: 1192901 - protein, 16 aa, Mycobacterium
AQTGGIPRHSDHPGYG

SEQ ID NO: 1192902 - protein, 7 aa, Mycobacterium
AQTGTAV

SEQ ID NO: 1192903 - protein, 8 aa, Mycobacterium
AQTGTGPT

SEQ ID NO: 1192904 - protein, 8 aa, Mycobacterium
AQTGTPIS

SEQ ID NO: 1192905 - protein, 5 aa, Mycobacterium
AQTGV

SEQ ID NO: 1192906 - protein, 7 aa, Mycobacterium
AQTPAEV

SEQ ID NO: 1192907 - protein, 9 aa, Mycobacterium
AQTPAGRPA

SEQ ID NO: 1192908 - protein, 34 aa, Mycobacterium
AQTPESTEEGTEMKTADPDGQPATVGHADVVLQT

SEQ ID NO: 1192909 - protein, 6 aa, Mycobacterium
AQTPLD

SEQ ID NO: 1192910 - protein, 8 aa, Mycobacterium
AQTRPALS

SEQ ID NO: 1192911 - protein, 9 aa, Mycobacterium
AQTRTGDAR

SEQ ID NO: 1192912 - protein, 17 aa, Mycobacterium
AQTTPPVDSARLNGSGP

SEQ ID NO: 1192913 - protein, 7 aa, Mycobacterium
AQTTSTL

SEQ ID NO: 1192914 - protein, 5 aa, Mycobacterium
AQTTV

SEQ ID NO: 1192915 - protein, 14 aa, Mycobacterium
AQVAEQRRVQGRRR

SEQ ID NO: 1192916 - protein, 12 aa, Mycobacterium
AQVKSDRLDVTE

SEQ ID NO: 1192917 - protein, 14 aa, Mycobacterium
AQVRGDSLEADPEA

SEQ ID NO: 1192918 - protein, 29 aa, Mycobacterium
AQWGPSGSWERSIPSGTNRRRSSGRRSGA

SEQ ID NO: 1192919 - protein, 4 aa, Mycobacterium
AQYE

SEQ ID NO: 1192920 - protein, 12 aa, Mycobacterium
AQYEDQGNPYYS

SEQ ID NO: 1192921 - protein, 5 aa, Mycobacterium
AQYRK

SEQ ID NO: 1192922 - protein, 5 aa, Mycobacterium
AQYSE

SEQ ID NO: 1192923 - protein, 8 aa, Mycobacterium
ARAAADAY

SEQ ID NO: 1192924 - protein, 8 aa, Mycobacterium
ARAAARLS

SEQ ID NO: 1192925 - protein, 8 aa, Mycobacterium
ARAADEDL

SEQ ID NO: 1192926 - protein, 10 aa, Mycobacterium
ARAADTAARM

SEQ ID NO: 1192927 - protein, 7 aa, Mycobacterium
ARAAEPA

SEQ ID NO: 1192928 - protein, 6 aa, Mycobacterium
ARAAER

SEQ ID NO: 1192929 - protein, 5 aa, Mycobacterium
ARAAF

SEQ ID NO: 1192930 - protein, 7 aa, Mycobacterium
ARAAGAK

SEQ ID NO: 1192931 - protein, 15 aa, Mycobacterium
ARAAGGAGNSAAVGR

SEQ ID NO: 1192932 - protein, 11 aa, Mycobacterium
ARAAGHPDLPV

SEQ ID NO: 1192933 - protein, 7 aa, Mycobacterium
ARAAGRE

SEQ ID NO: 1192934 - protein, 13 aa, Mycobacterium
ARAAMRKDRRTEW

SEQ ID NO: 1192935 - protein, 9 aa, Mycobacterium
ARAARDTGA

SEQ ID NO: 1192936 - protein, 12 aa, Mycobacterium
ARAARKHGRPAR

SEQ ID NO: 1192937 - protein, 6 aa, Mycobacterium
ARAARQ

SEQ ID NO: 1192938 - protein, 8 aa, Mycobacterium
ARAATGRS

SEQ ID NO: 1192939 - protein, 15 aa, Mycobacterium
ARADATKVRSGADRA

SEQ ID NO: 1192940 - protein, 11 aa, Mycobacterium
ARADEKMSDYR

SEQ ID NO: 1192941 - protein, 5 aa, Mycobacterium
ARADG

SEQ ID NO: 1192942 - protein, 13 aa, Mycobacterium
ARADGDRADDARA

SEQ ID NO: 1192943 - protein, 9 aa, Mycobacterium
ARADGQLPN

SEQ ID NO: 1192944 - protein, 7 aa, Mycobacterium
ARADQGM

SEQ ID NO: 1192945 - protein, 9 aa, Mycobacterium
ARADRGRAR

SEQ ID NO: 1192946 - protein, 6 aa, Mycobacterium
ARADSL

SEQ ID NO: 1192947 - protein, 12 aa, Mycobacterium
ARADSVTRTETG

SEQ ID NO: 1192948 - protein, 8 aa, Mycobacterium
ARAEAARA

SEQ ID NO: 1192949 - protein, 17 aa, Mycobacterium
ARAEGNRALDAGDHDTA

SEQ ID NO: 1192950 - protein, 5 aa, Mycobacterium
ARAEP

SEQ ID NO: 1192951 - protein, 16 aa, Mycobacterium
ARAERGDRFGTRTRAH

SEQ ID NO: 1192952 - protein, 8 aa, Mycobacterium
ARAERRAI

SEQ ID NO: 1192953 - protein, 10 aa, Mycobacterium
ARAESPMESE

SEQ ID NO: 1192954 - protein, 7 aa, Mycobacterium
ARAESTN

SEQ ID NO: 1192955 - protein, 6 aa, Mycobacterium
ARAESW

SEQ ID NO: 1192956 - protein, 10 aa, Mycobacterium
ARAGAPGVPS

SEQ ID NO: 1192957 - protein, 9 aa, Mycobacterium
ARAGAQGVG

SEQ ID NO: 1192958 - protein, 9 aa, Mycobacterium
ARAGARGDL

SEQ ID NO: 1192959 - protein, 11 aa, Mycobacterium
ARAGDQPHNDA

SEQ ID NO: 1192960 - protein, 10 aa, Mycobacterium
ARAGEAASQQ

SEQ ID NO: 1192961 - protein, 21 aa, Mycobacterium
ARAGEPEGSESPAVASGHPGI

SEQ ID NO: 1192962 - protein, 7 aa, Mycobacterium
ARAGERI

SEQ ID NO: 1192963 - protein, 8 aa, Mycobacterium
ARAGETED

SEQ ID NO: 1192964 - protein, 9 aa, Mycobacterium
ARAGGAEAD

SEQ ID NO: 1192965 - protein, 15 aa, Mycobacterium
ARAGHDAAADAATEA

SEQ ID NO: 1192966 - protein, 5 aa, Mycobacterium
ARAGK

SEQ ID NO: 1192967 - protein, 10 aa, Mycobacterium
ARAGKLDPTR

SEQ ID NO: 1192968 - protein, 9 aa, Mycobacterium
ARAGNRPLQ

SEQ ID NO: 1192969 - protein, 8 aa, Mycobacterium
ARAGQHTD

SEQ ID NO: 1192970 - protein, 16 aa, Mycobacterium
ARAGSLRSSEMSDPTI

SEQ ID NO: 1192971 - protein, 9 aa, Mycobacterium
ARAGTSKPA

SEQ ID NO: 1192972 - protein, 8 aa, Mycobacterium
ARAGTTTA

SEQ ID NO: 1192973 - protein, 8 aa, Mycobacterium
ARAGVGRS

SEQ ID NO: 1192974 - protein, 5 aa, Mycobacterium
ARAHA

SEQ ID NO: 1192975 - protein, 6 aa, Mycobacterium
ARAHRE

SEQ ID NO: 1192976 - protein, 5 aa, Mycobacterium
ARALA

SEQ ID NO: 1192977 - protein, 12 aa, Mycobacterium
ARANGDAALEES

SEQ ID NO: 1192978 - protein, 8 aa, Mycobacterium
ARANRTPV

SEQ ID NO: 1192979 - protein, 7 aa, Mycobacterium
ARANSDL

SEQ ID NO: 1192980 - protein, 8 aa, Mycobacterium
ARAPERID

SEQ ID NO: 1192981 - protein, 9 aa, Mycobacterium
ARAPGRTVR

SEQ ID NO: 1192982 - protein, 5 aa, Mycobacterium
ARAPY

SEQ ID NO: 1192983 - protein, 11 aa, Mycobacterium
ARAQNARADET

SEQ ID NO: 1192984 - protein, 8 aa, Mycobacterium
ARAQNDRA

SEQ ID NO: 1192985 - protein, 7 aa, Mycobacterium
ARAQREM

SEQ ID NO: 1192986 - protein, 12 aa, Mycobacterium
ARAQRVGDPLPF

SEQ ID NO: 1192987 - protein, 7 aa, Mycobacterium
ARAQSDL

SEQ ID NO: 1192988 - protein, 8 aa, Mycobacterium
ARARAAGG

SEQ ID NO: 1192989 - protein, 7 aa, Mycobacterium
ARARAAQ

SEQ ID NO: 1192990 - protein, 11 aa, Mycobacterium
ARAREAAAHAP

SEQ ID NO: 1192991 - protein, 6 aa, Mycobacterium
ARARGR

SEQ ID NO: 1192992 - protein, 6 aa, Mycobacterium
ARARPD

SEQ ID NO: 1192993 - protein, 26 aa, Mycobacterium
ARARRSAEGAKARSRAASKAKGLGTN

SEQ ID NO: 1192994 - protein, 12 aa, Mycobacterium
ARASAGDESRPS

SEQ ID NO: 1192995 - protein, 11 aa, Mycobacterium
ARASAGTSDVP

SEQ ID NO: 1192996 - protein, 10 aa, Mycobacterium
ARASAPEGSV

SEQ ID NO: 1192997 - protein, 5 aa, Mycobacterium
ARASG

SEQ ID NO: 1192998 - protein, 6 aa, Mycobacterium
ARASQG

SEQ ID NO: 1192999 - protein, 9 aa, Mycobacterium
ARASSSFDR

SEQ ID NO: 1193000 - protein, 10 aa, Mycobacterium
ARASTKGDPL

SEQ ID NO: 1193001 - protein, 9 aa, Mycobacterium
ARASTSGLA

SEQ ID NO: 1193002 - protein, 4 aa, Mycobacterium
ARAT

SEQ ID NO: 1193003 - protein, 39 aa, Mycobacterium
ARATDEQRRRRERANAEKKASALRAQAAKMGAKATKAVA

SEQ ID NO: 1193004 - protein, 6 aa, Mycobacterium
ARATKN

SEQ ID NO: 1193005 - protein, 8 aa, Mycobacterium
ARATPEAA

SEQ ID NO: 1193006 - protein, 7 aa, Mycobacterium
ARATSPY

SEQ ID NO: 1193007 - protein, 18 aa, Mycobacterium
ARATSSLGQVQPTSGHRN

SEQ ID NO: 1193008 - protein, 7 aa, Mycobacterium
ARCDTAA

SEQ ID NO: 1193009 - protein, 12 aa, Mycobacterium
ARCESTTSTAAA

SEQ ID NO: 1193010 - protein, 5 aa, Mycobacterium
ARDAA

SEQ ID NO: 1193011 - protein, 8 aa, Mycobacterium
ARDAAEAL

SEQ ID NO: 1193012 - protein, 15 aa, Mycobacterium
ARDADDDAHADRSGD

SEQ ID NO: 1193013 - protein, 7 aa, Mycobacterium
ARDAEGV

SEQ ID NO: 1193014 - protein, 5 aa, Mycobacterium
ARDAG

SEQ ID NO: 1193015 - protein, 7 aa, Mycobacterium
ARDAGAL

SEQ ID NO: 1193016 - protein, 6 aa, Mycobacterium
ARDAGL

SEQ ID NO: 1193017 - protein, 4 aa, Mycobacterium
ARDD

SEQ ID NO: 1193018 - protein, 6 aa, Mycobacterium
ARDDAG

SEQ ID NO: 1193019 - protein, 26 aa, Mycobacterium
ARDDDGQPIPRYPNRADSPPKRVRRR

SEQ ID NO: 1193020 - protein, 5 aa, Mycobacterium
ARDDG

SEQ ID NO: 1193021 - protein, 7 aa, Mycobacterium
ARDDPFH

SEQ ID NO: 1193022 - protein, 8 aa, Mycobacterium
ARDDPRGT

SEQ ID NO: 1193023 - protein, 30 aa, Mycobacterium
ARDEAARIAATAKREYEATTGRAKSEADRL

SEQ ID NO: 1193024 - protein, 8 aa, Mycobacterium
ARDEGGPR

SEQ ID NO: 1193025 - protein, 6 aa, Mycobacterium
ARDEGL

SEQ ID NO: 1193026 - protein, 15 aa, Mycobacterium
ARDELAADRSSLTRA

SEQ ID NO: 1193027 - protein, 4 aa, Mycobacterium
ARDG

SEQ ID NO: 1193028 - protein, 5 aa, Mycobacterium
ARDGE

SEQ ID NO: 1193029 - protein, 10 aa, Mycobacterium
ARDGKLTAED

SEQ ID NO: 1193030 - protein, 6 aa, Mycobacterium
ARDGLA

SEQ ID NO: 1193031 - protein, 5 aa, Mycobacterium
ARDGN

SEQ ID NO: 1193032 - protein, 12 aa, Mycobacterium
ARDGSPTGDNPA

SEQ ID NO: 1193033 - protein, 5 aa, Mycobacterium
ARDGT

SEQ ID NO: 1193034 - protein, 29 aa, Mycobacterium
ARDGVSDVARDGVSDVARDGVSEPPRDGG

SEQ ID NO: 1193035 - protein, 4 aa, Mycobacterium
ARDN

SEQ ID NO: 1193036 - protein, 10 aa, Mycobacterium
ARDNDVEGRD

SEQ ID NO: 1193037 - protein, 7 aa, Mycobacterium
ARDNPNA

SEQ ID NO: 1193038 - protein, 7 aa, Mycobacterium
ARDPGRA

SEQ ID NO: 1193039 - protein, 5 aa, Mycobacterium
ARDPR

SEQ ID NO: 1193040 - protein, 6 aa, Mycobacterium
ARDQAA

SEQ ID NO: 1193041 - protein, 4 aa, Mycobacterium
ARDR

SEQ ID NO: 1193042 - protein, 17 aa, Mycobacterium
ARDRARRAVEQEPAGSR

SEQ ID NO: 1193043 - protein, 8 aa, Mycobacterium
ARDRGKAA

SEQ ID NO: 1193044 - protein, 18 aa, Mycobacterium
ARDSATVGGMASTNAGGL

SEQ ID NO: 1193045 - protein, 10 aa, Mycobacterium
ARDSEAARAA

SEQ ID NO: 1193046 - protein, 9 aa, Mycobacterium
ARDSEGRIP

SEQ ID NO: 1193047 - protein, 10 aa, Mycobacterium
ARDTAVTDDE

SEQ ID NO: 1193048 - protein, 7 aa, Mycobacterium
ARDTDDT

SEQ ID NO: 1193049 - protein, 6 aa, Mycobacterium
ARDTGA

SEQ ID NO: 1193050 - protein, 6 aa, Mycobacterium
ARDTPD

SEQ ID NO: 1193051 - protein, 6 aa, Mycobacterium
AREAGL

SEQ ID NO: 1193052 - protein, 13 aa, Mycobacterium
AREAGTKALDDAG

SEQ ID NO: 1193053 - protein, 16 aa, Mycobacterium
AREATGLDDFGPQDYR

SEQ ID NO: 1193054 - protein, 15 aa, Mycobacterium
AREAVKAAERGGQRA

SEQ ID NO: 1193055 - protein, 9 aa, Mycobacterium
AREDDPSGA

SEQ ID NO: 1193056 - protein, 6 aa, Mycobacterium
AREDGV

SEQ ID NO: 1193057 - protein, 7 aa, Mycobacterium
AREDLEK

SEQ ID NO: 1193058 - protein, 32 aa, Mycobacterium
AREDSDHHADDSSDQDAEAREAAAAEAARRER

SEQ ID NO: 1193059 - protein, 6 aa, Mycobacterium
AREDSE

SEQ ID NO: 1193060 - protein, 7 aa, Mycobacterium
AREEGDY

SEQ ID NO: 1193061 - protein, 7 aa, Mycobacterium
AREELAT

SEQ ID NO: 1193062 - protein, 7 aa, Mycobacterium
AREEPTV

SEQ ID NO: 1193063 - protein, 12 aa, Mycobacterium
AREETEPMPEGP

SEQ ID NO: 1193064 - protein, 8 aa, Mycobacterium
AREGDPAA

SEQ ID NO: 1193065 - protein, 6 aa, Mycobacterium
AREGGA

SEQ ID NO: 1193066 - protein, 10 aa, Mycobacterium
AREGGDLQRY

SEQ ID NO: 1193067 - protein, 8 aa, Mycobacterium
AREGKPGL

SEQ ID NO: 1193068 - protein, 6 aa, Mycobacterium
AREGKV

SEQ ID NO: 1193069 - protein, 11 aa, Mycobacterium
AREGSAADGVQ

SEQ ID NO: 1193070 - protein, 5 aa, Mycobacterium
AREHD

SEQ ID NO: 1193071 - protein, 7 aa, Mycobacterium
AREHGGG

SEQ ID NO: 1193072 - protein, 26 aa, Mycobacterium
AREHGPLPPQSKSFVGGGRDDPKVRD

SEQ ID NO: 1193073 - protein, 7 aa, Mycobacterium
AREITDD

SEQ ID NO: 1193074 - protein, 12 aa, Mycobacterium
AREKADEPTIDT

SEQ ID NO: 1193075 - protein, 10 aa, Mycobacterium
AREKAGDAGA

SEQ ID NO: 1193076 - protein, 27 aa, Mycobacterium
AREKGARVESVAPPSETLPDRKSRKIA

SEQ ID NO: 1193077 - protein, 6 aa, Mycobacterium
ARELAG

SEQ ID NO: 1193078 - protein, 5 aa, Mycobacterium
ARELG

SEQ ID NO: 1193079 - protein, 7 aa, Mycobacterium
ARELSGA

SEQ ID NO: 1193080 - protein, 9 aa, Mycobacterium
ARELTDGPV

SEQ ID NO: 1193081 - protein, 10 aa, Mycobacterium
AREPAAQRGT

SEQ ID NO: 1193082 - protein, 9 aa, Mycobacterium
AREPDEGNQ

SEQ ID NO: 1193083 - protein, 7 aa, Mycobacterium
AREPERK

SEQ ID NO: 1193084 - protein, 5 aa, Mycobacterium
AREPV

SEQ ID NO: 1193085 - protein, 18 aa, Mycobacterium
AREQGATVAYGGEPAAEL

SEQ ID NO: 1193086 - protein, 10 aa, Mycobacterium
AREQSDARPP

SEQ ID NO: 1193087 - protein, 11 aa, Mycobacterium
ARERAETARER

SEQ ID NO: 1193088 - protein, 12 aa, Mycobacterium
ARERGTADPAEL

SEQ ID NO: 1193089 - protein, 9 aa, Mycobacterium
ARERPRPAR

SEQ ID NO: 1193090 - protein, 7 aa, Mycobacterium
ARERTER

SEQ ID NO: 1193091 - protein, 6 aa, Mycobacterium
ARERTR

SEQ ID NO: 1193092 - protein, 5 aa, Mycobacterium
ARERW

SEQ ID NO: 1193093 - protein, 7 aa, Mycobacterium
ARESGKI

SEQ ID NO: 1193094 - protein, 6 aa, Mycobacterium
ARESGL

SEQ ID NO: 1193095 - protein, 12 aa, Mycobacterium
ARESGTKALEDA

SEQ ID NO: 1193096 - protein, 5 aa, Mycobacterium
ARESR

SEQ ID NO: 1193097 - protein, 7 aa, Mycobacterium
ARESRTG

SEQ ID NO: 1193098 - protein, 4 aa, Mycobacterium
ARET

SEQ ID NO: 1193099 - protein, 6 aa, Mycobacterium
ARETAA

SEQ ID NO: 1193100 - protein, 7 aa, Mycobacterium
ARETGAR

SEQ ID NO: 1193101 - protein, 11 aa, Mycobacterium
ARETGRNNFGP

SEQ ID NO: 1193102 - protein, 6 aa, Mycobacterium
ARETLS

SEQ ID NO: 1193103 - protein, 18 aa, Mycobacterium
ARETNRRHGTPSELPPAT

SEQ ID NO: 1193104 - protein, 11 aa, Mycobacterium
ARETSQSTDLA

SEQ ID NO: 1193105 - protein, 9 aa, Mycobacterium
ARFGGTDEA

SEQ ID NO: 1193106 - protein, 13 aa, Mycobacterium
ARFPTAKTSVRDP

SEQ ID NO: 1193107 - protein, 17 aa, Mycobacterium
ARGAAPSSPLNTTVSRN

SEQ ID NO: 1193108 - protein, 7 aa, Mycobacterium
ARGAARA

SEQ ID NO: 1193109 - protein, 13 aa, Mycobacterium
ARGAEDADDVAAV

SEQ ID NO: 1193110 - protein, 12 aa, Mycobacterium
ARGAESTGRDAA

SEQ ID NO: 1193111 - protein, 11 aa, Mycobacterium
ARGALDGPSTD

SEQ ID NO: 1193112 - protein, 10 aa, Mycobacterium
ARGALGKDQK

SEQ ID NO: 1193113 - protein, 7 aa, Mycobacterium
ARGANPV

SEQ ID NO: 1193114 - protein, 4 aa, Mycobacterium
ARGD

SEQ ID NO: 1193115 - protein, 8 aa, Mycobacterium
ARGDGPLA

SEQ ID NO: 1193116 - protein, 6 aa, Mycobacterium
ARGDQT

SEQ ID NO: 1193117 - protein, 6 aa, Mycobacterium
ARGEFP

SEQ ID NO: 1193118 - protein, 10 aa, Mycobacterium
ARGELSADTD

SEQ ID NO: 1193119 - protein, 12 aa, Mycobacterium
ARGELSPTGRAE

SEQ ID NO: 1193120 - protein, 8 aa, Mycobacterium
ARGERQRY

SEQ ID NO: 1193121 - protein, 5 aa, Mycobacterium
ARGEV

SEQ ID NO: 1193122 - protein, 6 aa, Mycobacterium
ARGGAT

SEQ ID NO: 1193123 - protein, 6 aa, Mycobacterium
ARGGGS

SEQ ID NO: 1193124 - protein, 7 aa, Mycobacterium
ARGGGVS

SEQ ID NO: 1193125 - protein, 7 aa, Mycobacterium
ARGGSQE

SEQ ID NO: 1193126 - protein, 13 aa, Mycobacterium
ARGGTTLCQSPDD

SEQ ID NO: 1193127 - protein, 6 aa, Mycobacterium
ARGGVA

SEQ ID NO: 1193128 - protein, 31 aa, Mycobacterium
ARGGYGDAYQTAQAFSTAARAAGARVRQGTA

SEQ ID NO: 1193129 - protein, 6 aa, Mycobacterium
ARGHAG

SEQ ID NO: 1193130 - protein, 18 aa, Mycobacterium
ARGHSPAAQRDAGNRPLS

SEQ ID NO: 1193131 - protein, 5 aa, Mycobacterium
ARGIG

SEQ ID NO: 1193132 - protein, 6 aa, Mycobacterium
ARGIGR

SEQ ID NO: 1193133 - protein, 5 aa, Mycobacterium
ARGIP

SEQ ID NO: 1193134 - protein, 8 aa, Mycobacterium
ARGLPATG

SEQ ID NO: 1193135 - protein, 8 aa, Mycobacterium
ARGNPKLR

SEQ ID NO: 1193136 - protein, 8 aa, Mycobacterium
ARGPDAEP

SEQ ID NO: 1193137 - protein, 16 aa, Mycobacterium
ARGPEADQLSGDDADE

SEQ ID NO: 1193138 - protein, 6 aa, Mycobacterium
ARGPFH

SEQ ID NO: 1193139 - protein, 11 aa, Mycobacterium
ARGPGLPPGDP

SEQ ID NO: 1193140 - protein, 10 aa, Mycobacterium
ARGPWGPSLS

SEQ ID NO: 1193141 - protein, 12 aa, Mycobacterium
ARGQGGERQVDD

SEQ ID NO: 1193142 - protein, 7 aa, Mycobacterium
ARGQGRS

SEQ ID NO: 1193143 - protein, 7 aa, Mycobacterium
ARGQRAY

SEQ ID NO: 1193144 - protein, 4 aa, Mycobacterium
ARGR

SEQ ID NO: 1193145 - protein, 14 aa, Mycobacterium
ARGRGDLRPDADTD

SEQ ID NO: 1193146 - protein, 13 aa, Mycobacterium
ARGRQPRPSGVEK

SEQ ID NO: 1193147 - protein, 5 aa, Mycobacterium
ARGRR

SEQ ID NO: 1193148 - protein, 6 aa, Mycobacterium
ARGSAG

SEQ ID NO: 1193149 - protein, 5 aa, Mycobacterium
ARGSD

SEQ ID NO: 1193150 - protein, 5 aa, Mycobacterium
ARGSG

SEQ ID NO: 1193151 - protein, 15 aa, Mycobacterium
ARGSLRARQRRGENH

SEQ ID NO: 1193152 - protein, 8 aa, Mycobacterium
ARGTALDP

SEQ ID NO: 1193153 - protein, 15 aa, Mycobacterium
ARGTELRSGDRVQGP

SEQ ID NO: 1193154 - protein, 6 aa, Mycobacterium
ARGVGA

SEQ ID NO: 1193155 - protein, 13 aa, Mycobacterium
ARGVPKDGEEPLD

SEQ ID NO: 1193156 - protein, 12 aa, Mycobacterium
ARGWTNATAPAW

SEQ ID NO: 1193157 - protein, 11 aa, Mycobacterium
ARGYRGRPDLT

SEQ ID NO: 1193158 - protein, 6 aa, Mycobacterium
ARHAGE

SEQ ID NO: 1193159 - protein, 8 aa, Mycobacterium
ARHATGRR

SEQ ID NO: 1193160 - protein, 7 aa, Mycobacterium
ARHATQR

SEQ ID NO: 1193161 - protein, 9 aa, Mycobacterium
ARHDGTPRS

SEQ ID NO: 1193162 - protein, 8 aa, Mycobacterium
ARHDTHGA

SEQ ID NO: 1193163 - protein, 13 aa, Mycobacterium
ARHESRDDDPDDT

SEQ ID NO: 1193164 - protein, 10 aa, Mycobacterium
ARHGDDLPGT

SEQ ID NO: 1193165 - protein, 7 aa, Mycobacterium
ARHGDRG

SEQ ID NO: 1193166 - protein, 13 aa, Mycobacterium
ARHGSLDSEGIDL

SEQ ID NO: 1193167 - protein, 13 aa, Mycobacterium
ARHGTLDSEGIDL

SEQ ID NO: 1193168 - protein, 5 aa, Mycobacterium
ARHIT

SEQ ID NO: 1193169 - protein, 4 aa, Mycobacterium
ARHT

SEQ ID NO: 1193170 - protein, 30 aa, Mycobacterium
ARIEARSNPWDPETEPSESDFVDPGAKDRK

SEQ ID NO: 1193171 - protein, 9 aa, Mycobacterium
ARIGRSAGA

SEQ ID NO: 1193172 - protein, 12 aa, Mycobacterium
ARIPASSLRGEN

SEQ ID NO: 1193173 - protein, 13 aa, Mycobacterium
ARIPEGDDGTGLP

SEQ ID NO: 1193174 - protein, 5 aa, Mycobacterium
ARIPG

SEQ ID NO: 1193175 - protein, 6 aa, Mycobacterium
ARISNS

SEQ ID NO: 1193176 - protein, 18 aa, Mycobacterium
ARKAAGERLSDARQLGPR

SEQ ID NO: 1193177 - protein, 10 aa, Mycobacterium
ARKAGERPTW

SEQ ID NO: 1193178 - protein, 18 aa, Mycobacterium
ARKAGTTVKHEDKDGNEV

SEQ ID NO: 1193179 - protein, 11 aa, Mycobacterium
ARKAGWKANNK

SEQ ID NO: 1193180 - protein, 24 aa, Mycobacterium
ARKAGWKANNKRIRRRGLTPSVGH

SEQ ID NO: 1193181 - protein, 8 aa, Mycobacterium
ARKAPEQR

SEQ ID NO: 1193182 - protein, 7 aa, Mycobacterium
ARKATQD

SEQ ID NO: 1193183 - protein, 14 aa, Mycobacterium
ARKDRISVGDREGL

SEQ ID NO: 1193184 - protein, 6 aa, Mycobacterium
ARKEPA

SEQ ID NO: 1193185 - protein, 7 aa, Mycobacterium
ARKHPHS

SEQ ID NO: 1193186 - protein, 14 aa, Mycobacterium
ARKHPSPNAGVAEA

SEQ ID NO: 1193187 - protein, 9 aa, Mycobacterium
ARKKLEDAG

SEQ ID NO: 1193188 - protein, 28 aa, Mycobacterium
ARKPRRSSAGRASRQGPDVRPSGVRKRG

SEQ ID NO: 1193189 - protein, 9 aa, Mycobacterium
ARKPSPPAL

SEQ ID NO: 1193190 - protein, 9 aa, Mycobacterium
ARKPSTETL

SEQ ID NO: 1193191 - protein, 5 aa, Mycobacterium
ARKQE

SEQ ID NO: 1193192 - protein, 9 aa, Mycobacterium
ARKRDDPLA

SEQ ID NO: 1193193 - protein, 38 aa, Mycobacterium
ARKRRAQETAGRSDDVHASRVDDARSRLEDAERAVRDD

SEQ ID NO: 1193194 - protein, 9 aa, Mycobacterium
ARKRRGDKP

SEQ ID NO: 1193195 - protein, 4 aa, Mycobacterium
ARKS

SEQ ID NO: 1193196 - protein, 10 aa, Mycobacterium
ARKTSDSDLA

SEQ ID NO: 1193197 - protein, 4 aa, Mycobacterium
ARLA

SEQ ID NO: 1193198 - protein, 8 aa, Mycobacterium
ARLAPADS

SEQ ID NO: 1193199 - protein, 8 aa, Mycobacterium
ARLAPGAP

SEQ ID NO: 1193200 - protein, 9 aa, Mycobacterium
ARLASGVSR

SEQ ID NO: 1193201 - protein, 4 aa, Mycobacterium
ARLD

SEQ ID NO: 1193202 - protein, 6 aa, Mycobacterium
ARLGDA

SEQ ID NO: 1193203 - protein, 10 aa, Mycobacterium
ARLGDEHPQL

SEQ ID NO: 1193204 - protein, 6 aa, Mycobacterium
ARLGDL

SEQ ID NO: 1193205 - protein, 12 aa, Mycobacterium
ARLGGPRTGADH

SEQ ID NO: 1193206 - protein, 6 aa, Mycobacterium
ARLNAR

SEQ ID NO: 1193207 - protein, 5 aa, Mycobacterium
ARLPK

SEQ ID NO: 1193208 - protein, 6 aa, Mycobacterium
ARLSAG

SEQ ID NO: 1193209 - protein, 5 aa, Mycobacterium
ARMSP

SEQ ID NO: 1193210 - protein, 5 aa, Mycobacterium
ARMTS

SEQ ID NO: 1193211 - protein, 9 aa, Mycobacterium
ARNADKAAS

SEQ ID NO: 1193212 - protein, 13 aa, Mycobacterium
ARNASAAEGLDAE

SEQ ID NO: 1193213 - protein, 7 aa, Mycobacterium
ARNASDG

SEQ ID NO: 1193214 - protein, 9 aa, Mycobacterium
ARNDAISTE

SEQ ID NO: 1193215 - protein, 8 aa, Mycobacterium
ARNDPRVN

SEQ ID NO: 1193216 - protein, 7 aa, Mycobacterium
ARNEEDA

SEQ ID NO: 1193217 - protein, 7 aa, Mycobacterium
ARNESAA

SEQ ID NO: 1193218 - protein, 10 aa, Mycobacterium
ARNESKRASK

SEQ ID NO: 1193219 - protein, 18 aa, Mycobacterium
ARNGPANAYSLTGDGIAP

SEQ ID NO: 1193220 - protein, 76 aa, Mycobacterium
ARNGQRPAQPGQQYGEPPEGTAHPHPPSRPRHGDRGPADQARQHAEGDQRRGSLPGQTGERSRRRRDHPHDHPQRT

SEQ ID NO: 1193221 - protein, 9 aa, Mycobacterium
ARNGSGVNT

SEQ ID NO: 1193222 - protein, 16 aa, Mycobacterium
ARNGSLEIPTTKLTQA

SEQ ID NO: 1193223 - protein, 9 aa, Mycobacterium
ARNGVSEND

SEQ ID NO: 1193224 - protein, 9 aa, Mycobacterium
ARNPDAPAL

SEQ ID NO: 1193225 - protein, 21 aa, Mycobacterium
ARNPGPDEARLSAKPPPGEEL

SEQ ID NO: 1193226 - protein, 9 aa, Mycobacterium
ARNPSTETL

SEQ ID NO: 1193227 - protein, 20 aa, Mycobacterium
ARNRARDRLRRESARPGKEL

SEQ ID NO: 1193228 - protein, 9 aa, Mycobacterium
ARNRRDGRA

SEQ ID NO: 1193229 - protein, 5 aa, Mycobacterium
ARNSG

SEQ ID NO: 1193230 - protein, 9 aa, Mycobacterium
ARNSPPATT

SEQ ID NO: 1193231 - protein, 22 aa, Mycobacterium
ARNTADERSTDVQLTDAGAELR

SEQ ID NO: 1193232 - protein, 5 aa, Mycobacterium
ARNVR

SEQ ID NO: 1193233 - protein, 5 aa, Mycobacterium
ARNVS

SEQ ID NO: 1193234 - protein, 12 aa, Mycobacterium
ARPAAAQELSDS

SEQ ID NO: 1193235 - protein, 8 aa, Mycobacterium
ARPAAGDM

SEQ ID NO: 1193236 - protein, 9 aa, Mycobacterium
ARPAAGLPE

SEQ ID NO: 1193237 - protein, 10 aa, Mycobacterium
ARPAFTDRPE

SEQ ID NO: 1193238 - protein, 5 aa, Mycobacterium
ARPAP

SEQ ID NO: 1193239 - protein, 9 aa, Mycobacterium
ARPAPGLPE

SEQ ID NO: 1193240 - protein, 6 aa, Mycobacterium
ARPASR

SEQ ID NO: 1193241 - protein, 14 aa, Mycobacterium
ARPCGPAEGPYAGY

SEQ ID NO: 1193242 - protein, 9 aa, Mycobacterium
ARPDALDPA

SEQ ID NO: 1193243 - protein, 5 aa, Mycobacterium
ARPDD

SEQ ID NO: 1193244 - protein, 5 aa, Mycobacterium
ARPDF

SEQ ID NO: 1193245 - protein, 7 aa, Mycobacterium
ARPDPAV

SEQ ID NO: 1193246 - protein, 14 aa, Mycobacterium
ARPESADPASYGPL

SEQ ID NO: 1193247 - protein, 7 aa, Mycobacterium
ARPESRG

SEQ ID NO: 1193248 - protein, 5 aa, Mycobacterium
ARPFD

SEQ ID NO: 1193249 - protein, 9 aa, Mycobacterium
ARPGEKTPL

SEQ ID NO: 1193250 - protein, 6 aa, Mycobacterium
ARPGGP

SEQ ID NO: 1193251 - protein, 23 aa, Mycobacterium
ARPGLPGDWPEGYDDAERPYTPA

SEQ ID NO: 1193252 - protein, 9 aa, Mycobacterium
ARPGQPGAL

SEQ ID NO: 1193253 - protein, 9 aa, Mycobacterium
ARPHTKSPA

SEQ ID NO: 1193254 - protein, 14 aa, Mycobacterium
ARPKPKSRRRSKVS

SEQ ID NO: 1193255 - protein, 5 aa, Mycobacterium
ARPLE

SEQ ID NO: 1193256 - protein, 5 aa, Mycobacterium
ARPLG

SEQ ID NO: 1193257 - protein, 10 aa, Mycobacterium
ARPLPLSSRE

SEQ ID NO: 1193258 - protein, 11 aa, Mycobacterium
ARPLPLTPRER

SEQ ID NO: 1193259 - protein, 12 aa, Mycobacterium
ARPLQGAERDEI

SEQ ID NO: 1193260 - protein, 6 aa, Mycobacterium
ARPLRD

SEQ ID NO: 1193261 - protein, 25 aa, Mycobacterium
ARPLSKDAVERPQTSYTAKEPDNSI

SEQ ID NO: 1193262 - protein, 10 aa, Mycobacterium
ARPNNQPRVA

SEQ ID NO: 1193263 - protein, 7 aa, Mycobacterium
ARPPRSA

SEQ ID NO: 1193264 - protein, 11 aa, Mycobacterium
ARPPVPSGRAG

SEQ ID NO: 1193265 - protein, 4 aa, Mycobacterium
ARPR

SEQ ID NO: 1193266 - protein, 8 aa, Mycobacterium
ARPRAAKD

SEQ ID NO: 1193267 - protein, 19 aa, Mycobacterium
ARPSASVPPPEPGSADDSV

SEQ ID NO: 1193268 - protein, 5 aa, Mycobacterium
ARPSD

SEQ ID NO: 1193269 - protein, 33 aa, Mycobacterium
ARPSRGRGTSSARTPFRSSSPPWPTASSSSSSR

SEQ ID NO: 1193270 - protein, 5 aa, Mycobacterium
ARPTA

SEQ ID NO: 1193271 - protein, 7 aa, Mycobacterium
ARPTAGL

SEQ ID NO: 1193272 - protein, 6 aa, Mycobacterium
ARPTDD

SEQ ID NO: 1193273 - protein, 11 aa, Mycobacterium
ARPTDTAPRIG

SEQ ID NO: 1193274 - protein, 9 aa, Mycobacterium
ARPTEEQAW

SEQ ID NO: 1193275 - protein, 6 aa, Mycobacterium
ARPTEI

SEQ ID NO: 1193276 - protein, 10 aa, Mycobacterium
ARPTPLPPGR

SEQ ID NO: 1193277 - protein, 14 aa, Mycobacterium
ARPTTARTVTAPTS

SEQ ID NO: 1193278 - protein, 7 aa, Mycobacterium
ARPTVDC

SEQ ID NO: 1193279 - protein, 16 aa, Mycobacterium
ARPVPAEPVPFSTPRS

SEQ ID NO: 1193280 - protein, 6 aa, Mycobacterium
ARPYGV

SEQ ID NO: 1193281 - protein, 4 aa, Mycobacterium
ARQA

SEQ ID NO: 1193282 - protein, 6 aa, Mycobacterium
ARQDRV

SEQ ID NO: 1193283 - protein, 24 aa, Mycobacterium
ARQESEHSSERRKRANVQRAANGD

SEQ ID NO: 1193284 - protein, 20 aa, Mycobacterium
ARQGKAIGSVSRTSTQGESM

SEQ ID NO: 1193285 - protein, 8 aa, Mycobacterium
ARQGNAAA

SEQ ID NO: 1193286 - protein, 10 aa, Mycobacterium
ARQGPLPDEL

SEQ ID NO: 1193287 - protein, 6 aa, Mycobacterium
ARQGQA

SEQ ID NO: 1193288 - protein, 7 aa, Mycobacterium
ARQGQHI

SEQ ID NO: 1193289 - protein, 11 aa, Mycobacterium
ARQGSATQALG

SEQ ID NO: 1193290 - protein, 11 aa, Mycobacterium
ARQHRTPDPRA

SEQ ID NO: 1193291 - protein, 14 aa, Mycobacterium
ARQHSGAHGPPSSL

SEQ ID NO: 1193292 - protein, 9 aa, Mycobacterium
ARQKDRTQA

SEQ ID NO: 1193293 - protein, 9 aa, Mycobacterium
ARQKSVTET

SEQ ID NO: 1193294 - protein, 15 aa, Mycobacterium
ARQLGPRHTLTGERV

SEQ ID NO: 1193295 - protein, 6 aa, Mycobacterium
ARQNFE

SEQ ID NO: 1193296 - protein, 22 aa, Mycobacterium
ARQPALADAGRALENAAARPGL

SEQ ID NO: 1193297 - protein, 5 aa, Mycobacterium
ARQPL

SEQ ID NO: 1193298 - protein, 11 aa, Mycobacterium
ARQQVANEEVE

SEQ ID NO: 1193299 - protein, 8 aa, Mycobacterium
ARQRARSA

SEQ ID NO: 1193300 - protein, 10 aa, Mycobacterium
ARQREKPREG

SEQ ID NO: 1193301 - protein, 6 aa, Mycobacterium
ARQRGQ

SEQ ID NO: 1193302 - protein, 8 aa, Mycobacterium
ARQRQTSS

SEQ ID NO: 1193303 - protein, 11 aa, Mycobacterium
ARQRRGQAEVP

SEQ ID NO: 1193304 - protein, 6 aa, Mycobacterium
ARQRSL

SEQ ID NO: 1193305 - protein, 6 aa, Mycobacterium
ARQSSR

SEQ ID NO: 1193306 - protein, 8 aa, Mycobacterium
ARQSVADQ

SEQ ID NO: 1193307 - protein, 4 aa, Mycobacterium
ARRA

SEQ ID NO: 1193308 - protein, 16 aa, Mycobacterium
ARRADDVAHRRTSVTG

SEQ ID NO: 1193309 - protein, 9 aa, Mycobacterium
ARRAEDGDG

SEQ ID NO: 1193310 - protein, 9 aa, Mycobacterium
ARRAGDPAR

SEQ ID NO: 1193311 - protein, 7 aa, Mycobacterium
ARRAQTI

SEQ ID NO: 1193312 - protein, 6 aa, Mycobacterium
ARRARP

SEQ ID NO: 1193313 - protein, 10 aa, Mycobacterium
ARRARPTEDL

SEQ ID NO: 1193314 - protein, 9 aa, Mycobacterium
ARRASASTA

SEQ ID NO: 1193315 - protein, 7 aa, Mycobacterium
ARRATPH

SEQ ID NO: 1193316 - protein, 8 aa, Mycobacterium
ARRAVAER

SEQ ID NO: 1193317 - protein, 8 aa, Mycobacterium
ARRAVAET

SEQ ID NO: 1193318 - protein, 5 aa, Mycobacterium
ARRCP

SEQ ID NO: 1193319 - protein, 6 aa, Mycobacterium
ARRDGD

SEQ ID NO: 1193320 - protein, 36 aa, Mycobacterium
ARRDTEAAAVPPSQPDTTSETVNTDAAAATDPATAV

SEQ ID NO: 1193321 - protein, 11 aa, Mycobacterium
ARREAASAFGD

SEQ ID NO: 1193322 - protein, 7 aa, Mycobacterium
ARREGAP

SEQ ID NO: 1193323 - protein, 6 aa, Mycobacterium
ARREQG

SEQ ID NO: 1193324 - protein, 5 aa, Mycobacterium
ARRGA

SEQ ID NO: 1193325 - protein, 12 aa, Mycobacterium
ARRGARSTTALP

SEQ ID NO: 1193326 - protein, 6 aa, Mycobacterium
ARRGDE

SEQ ID NO: 1193327 - protein, 8 aa, Mycobacterium
ARRGDHGL

SEQ ID NO: 1193328 - protein, 5 aa, Mycobacterium
ARRGE

SEQ ID NO: 1193329 - protein, 7 aa, Mycobacterium
ARRGEEL

SEQ ID NO: 1193330 - protein, 6 aa, Mycobacterium
ARRGET

SEQ ID NO: 1193331 - protein, 7 aa, Mycobacterium
ARRGGFP

SEQ ID NO: 1193332 - protein, 11 aa, Mycobacterium
ARRGGHDVGRD

SEQ ID NO: 1193333 - protein, 10 aa, Mycobacterium
ARRGNRKGVV

SEQ ID NO: 1193334 - protein, 14 aa, Mycobacterium
ARRGPAVPASPSAG

SEQ ID NO: 1193335 - protein, 6 aa, Mycobacterium
ARRGSP

SEQ ID NO: 1193336 - protein, 5 aa, Mycobacterium
ARRKG

SEQ ID NO: 1193337 - protein, 12 aa, Mycobacterium
ARRLGRTGAARR

SEQ ID NO: 1193338 - protein, 11 aa, Mycobacterium
ARRLTGPEADD

SEQ ID NO: 1193339 - protein, 13 aa, Mycobacterium
ARRNAGRDPVKDA

SEQ ID NO: 1193340 - protein, 9 aa, Mycobacterium
ARRNPGEAE

SEQ ID NO: 1193341 - protein, 7 aa, Mycobacterium
ARRNRYS

SEQ ID NO: 1193342 - protein, 10 aa, Mycobacterium
ARRPAGLDTD

SEQ ID NO: 1193343 - protein, 6 aa, Mycobacterium
ARRPEF

SEQ ID NO: 1193344 - protein, 13 aa, Mycobacterium
ARRPGRDSSDAAF

SEQ ID NO: 1193345 - protein, 8 aa, Mycobacterium
ARRPGSES

SEQ ID NO: 1193346 - protein, 5 aa, Mycobacterium
ARRPV

SEQ ID NO: 1193347 - protein, 15 aa, Mycobacterium
ARRPVTVSTTGPADW

SEQ ID NO: 1193348 - protein, 21 aa, Mycobacterium
ARRQGRDVSALTSSDCDITDT

SEQ ID NO: 1193349 - protein, 6 aa, Mycobacterium
ARRQSW

SEQ ID NO: 1193350 - protein, 4 aa, Mycobacterium
ARRR

SEQ ID NO: 1193351 - protein, 19 aa, Mycobacterium
ARRRAATTSNTTRSRIAPS

SEQ ID NO: 1193352 - protein, 10 aa, Mycobacterium
ARRRAETRPG

SEQ ID NO: 1193353 - protein, 10 aa, Mycobacterium
ARRRAGDPDA

SEQ ID NO: 1193354 - protein, 26 aa, Mycobacterium
ARRRDAADGEVGQPARSYRDRGVTSP

SEQ ID NO: 1193355 - protein, 6 aa, Mycobacterium
ARRRGI

SEQ ID NO: 1193356 - protein, 6 aa, Mycobacterium
ARRRKR

SEQ ID NO: 1193357 - protein, 11 aa, Mycobacterium
ARRRNASGEST

SEQ ID NO: 1193358 - protein, 7 aa, Mycobacterium
ARRRQAR

SEQ ID NO: 1193359 - protein, 11 aa, Mycobacterium
ARRRRSTVGRE

SEQ ID NO: 1193360 - protein, 5 aa, Mycobacterium
ARRRT

SEQ ID NO: 1193361 - protein, 16 aa, Mycobacterium
ARRRVERKRAAREELD

SEQ ID NO: 1193362 - protein, 16 aa, Mycobacterium
ARRSAEGGGWEAVHPT

SEQ ID NO: 1193363 - protein, 13 aa, Mycobacterium
ARRSDEADAAAGA

SEQ ID NO: 1193364 - protein, 14 aa, Mycobacterium
ARRSFDETDWATNT

SEQ ID NO: 1193365 - protein, 10 aa, Mycobacterium
ARRSGDSGAM

SEQ ID NO: 1193366 - protein, 5 aa, Mycobacterium
ARRSR

SEQ ID NO: 1193367 - protein, 14 aa, Mycobacterium
ARRSRPEPAKLRGG

SEQ ID NO: 1193368 - protein, 8 aa, Mycobacterium
ARRTDPDW

SEQ ID NO: 1193369 - protein, 5 aa, Mycobacterium
ARRTG

SEQ ID NO: 1193370 - protein, 7 aa, Mycobacterium
ARRTIDD

SEQ ID NO: 1193371 - protein, 9 aa, Mycobacterium
ARRTTPARA

SEQ ID NO: 1193372 - protein, 12 aa, Mycobacterium
ARRTVSDPSKRH

SEQ ID NO: 1193373 - protein, 4 aa, Mycobacterium
ARRV

SEQ ID NO: 1193374 - protein, 15 aa, Mycobacterium
ARSAAVNAAAGAEQI

SEQ ID NO: 1193375 - protein, 8 aa, Mycobacterium
ARSADEVT

SEQ ID NO: 1193376 - protein, 5 aa, Mycobacterium
ARSAG

SEQ ID NO: 1193377 - protein, 9 aa, Mycobacterium
ARSAGKKLG

SEQ ID NO: 1193378 - protein, 7 aa, Mycobacterium
ARSAGKL

SEQ ID NO: 1193379 - protein, 10 aa, Mycobacterium
ARSASPDRIA

SEQ ID NO: 1193380 - protein, 7 aa, Mycobacterium
ARSASSR

SEQ ID NO: 1193381 - protein, 10 aa, Mycobacterium
ARSDESDIEK

SEQ ID NO: 1193382 - protein, 12 aa, Mycobacterium
ARSDGKLPGTVD

SEQ ID NO: 1193383 - protein, 5 aa, Mycobacterium
ARSDR

SEQ ID NO: 1193384 - protein, 16 aa, Mycobacterium
ARSDRSFTTEDGERLE

SEQ ID NO: 1193385 - protein, 14 aa, Mycobacterium
ARSEQEGKLPGTIG

SEQ ID NO: 1193386 - protein, 9 aa, Mycobacterium
ARSGAGRAE

SEQ ID NO: 1193387 - protein, 6 aa, Mycobacterium
ARSGAL

SEQ ID NO: 1193388 - protein, 6 aa, Mycobacterium
ARSGAR

SEQ ID NO: 1193389 - protein, 8 aa, Mycobacterium
ARSGASRA

SEQ ID NO: 1193390 - protein, 8 aa, Mycobacterium
ARSGDDKF

SEQ ID NO: 1193391 - protein, 12 aa, Mycobacterium
ARSGDKGGNANV

SEQ ID NO: 1193392 - protein, 11 aa, Mycobacterium
ARSGDKGGSAN

SEQ ID NO: 1193393 - protein, 6 aa, Mycobacterium
ARSGES

SEQ ID NO: 1193394 - protein, 8 aa, Mycobacterium
ARSGHGLS

SEQ ID NO: 1193395 - protein, 9 aa, Mycobacterium
ARSGKTVDL

SEQ ID NO: 1193396 - protein, 8 aa, Mycobacterium
ARSGLTTD

SEQ ID NO: 1193397 - protein, 14 aa, Mycobacterium
ARSGRGSPSSAAGC

SEQ ID NO: 1193398 - protein, 8 aa, Mycobacterium
ARSKAARA

SEQ ID NO: 1193399 - protein, 9 aa, Mycobacterium
ARSKAARKV

SEQ ID NO: 1193400 - protein, 7 aa, Mycobacterium
ARSKADR

SEQ ID NO: 1193401 - protein, 7 aa, Mycobacterium
ARSKLTR

SEQ ID NO: 1193402 - protein, 5 aa, Mycobacterium
ARSKV

SEQ ID NO: 1193403 - protein, 15 aa, Mycobacterium
ARSLHTEEEIAEAET

SEQ ID NO: 1193404 - protein, 15 aa, Mycobacterium
ARSPAHMSGGQRRRA

SEQ ID NO: 1193405 - protein, 27 aa, Mycobacterium
ARSPDPVSGNAARRRNLTDDDLSRTLG

SEQ ID NO: 1193406 - protein, 8 aa, Mycobacterium
ARSPEQAL

SEQ ID NO: 1193407 - protein, 19 aa, Mycobacterium
ARSPLRAARRHETTDGSWR

SEQ ID NO: 1193408 - protein, 9 aa, Mycobacterium
ARSPNPHVS

SEQ ID NO: 1193409 - protein, 6 aa, Mycobacterium
ARSPRR

SEQ ID NO: 1193410 - protein, 8 aa, Mycobacterium
ARSPSGGF

SEQ ID NO: 1193411 - protein, 19 aa, Mycobacterium
ARSQKFGTSSSSELTEELD

SEQ ID NO: 1193412 - protein, 12 aa, Mycobacterium
ARSQPQPGDPKW

SEQ ID NO: 1193413 - protein, 13 aa, Mycobacterium
ARSRAGALSEAGE

SEQ ID NO: 1193414 - protein, 8 aa, Mycobacterium
ARSRASGV

SEQ ID NO: 1193415 - protein, 8 aa, Mycobacterium
ARSRRREE

SEQ ID NO: 1193416 - protein, 33 aa, Mycobacterium
ARSRSGTAHARSESDTAHARSESDTAQTGGAGR

SEQ ID NO: 1193417 - protein, 4 aa, Mycobacterium
ARSS

SEQ ID NO: 1193418 - protein, 10 aa, Mycobacterium
ARSSAEPARA

SEQ ID NO: 1193419 - protein, 10 aa, Mycobacterium
ARSSGADAIH

SEQ ID NO: 1193420 - protein, 10 aa, Mycobacterium
ARSSTGADEV

SEQ ID NO: 1193421 - protein, 10 aa, Mycobacterium
ARSTGAPSGS

SEQ ID NO: 1193422 - protein, 12 aa, Mycobacterium
ARSTRGDAKGTR

SEQ ID NO: 1193423 - protein, 8 aa, Mycobacterium
ARSTYPGD

SEQ ID NO: 1193424 - protein, 5 aa, Mycobacterium
ARSVE

SEQ ID NO: 1193425 - protein, 20 aa, Mycobacterium
ARSVRGGSSFGSTDPRDHQF

SEQ ID NO: 1193426 - protein, 13 aa, Mycobacterium
ARSVTADQRDRAE

SEQ ID NO: 1193427 - protein, 13 aa, Mycobacterium
ARSVTVDGRPVSL

SEQ ID NO: 1193428 - protein, 16 aa, Mycobacterium
ARSVTVDTPYGPPSAA

SEQ ID NO: 1193429 - protein, 10 aa, Mycobacterium
ARSYAPAGFR

SEQ ID NO: 1193430 - protein, 4 aa, Mycobacterium
ARTA

SEQ ID NO: 1193431 - protein, 5 aa, Mycobacterium
ARTAE

SEQ ID NO: 1193432 - protein, 9 aa, Mycobacterium
ARTAENNGF

SEQ ID NO: 1193433 - protein, 9 aa, Mycobacterium
ARTARGMTQ

SEQ ID NO: 1193434 - protein, 7 aa, Mycobacterium
ARTAVQA

SEQ ID NO: 1193435 - protein, 11 aa, Mycobacterium
ARTDAAEADAT

SEQ ID NO: 1193436 - protein, 16 aa, Mycobacterium
ARTDAPATAGRRPLPG

SEQ ID NO: 1193437 - protein, 8 aa, Mycobacterium
ARTDATVS

SEQ ID NO: 1193438 - protein, 12 aa, Mycobacterium
ARTDERGRQTLR

SEQ ID NO: 1193439 - protein, 8 aa, Mycobacterium
ARTDLSPP

SEQ ID NO: 1193440 - protein, 4 aa, Mycobacterium
ARTE

SEQ ID NO: 1193441 - protein, 5 aa, Mycobacterium
ARTEE

SEQ ID NO: 1193442 - protein, 10 aa, Mycobacterium
ARTEFDEPGV

SEQ ID NO: 1193443 - protein, 5 aa, Mycobacterium
ARTEH

SEQ ID NO: 1193444 - protein, 11 aa, Mycobacterium
ARTEPRPAGER

SEQ ID NO: 1193445 - protein, 5 aa, Mycobacterium
ARTET

SEQ ID NO: 1193446 - protein, 9 aa, Mycobacterium
ARTFGQGPR

SEQ ID NO: 1193447 - protein, 4 aa, Mycobacterium
ARTG

SEQ ID NO: 1193448 - protein, 7 aa, Mycobacterium
ARTGAGQ

SEQ ID NO: 1193449 - protein, 14 aa, Mycobacterium
ARTGEEALTATKEL

SEQ ID NO: 1193450 - protein, 13 aa, Mycobacterium
ARTGGGDPAGNPT

SEQ ID NO: 1193451 - protein, 5 aa, Mycobacterium
ARTGI

SEQ ID NO: 1193452 - protein, 5 aa, Mycobacterium
ARTGM

SEQ ID NO: 1193453 - protein, 5 aa, Mycobacterium
ARTGR

SEQ ID NO: 1193454 - protein, 6 aa, Mycobacterium
ARTGRS

SEQ ID NO: 1193455 - protein, 8 aa, Mycobacterium
ARTGSIDD

SEQ ID NO: 1193456 - protein, 17 aa, Mycobacterium
ARTHSEEVSRAADLASA

SEQ ID NO: 1193457 - protein, 8 aa, Mycobacterium
ARTKTVES

SEQ ID NO: 1193458 - protein, 6 aa, Mycobacterium
ARTNEL

SEQ ID NO: 1193459 - protein, 7 aa, Mycobacterium
ARTPAAL

SEQ ID NO: 1193460 - protein, 8 aa, Mycobacterium
ARTPDALA

SEQ ID NO: 1193461 - protein, 11 aa, Mycobacterium
ARTPDTPEGAL

SEQ ID NO: 1193462 - protein, 5 aa, Mycobacterium
ARTPE

SEQ ID NO: 1193463 - protein, 7 aa, Mycobacterium
ARTPGVM

SEQ ID NO: 1193464 - protein, 5 aa, Mycobacterium
ARTPI

SEQ ID NO: 1193465 - protein, 6 aa, Mycobacterium
ARTPSA

SEQ ID NO: 1193466 - protein, 11 aa, Mycobacterium
ARTQAQAGYDD

SEQ ID NO: 1193467 - protein, 8 aa, Mycobacterium
ARTQGPGH

SEQ ID NO: 1193468 - protein, 8 aa, Mycobacterium
ARTQTSKS

SEQ ID NO: 1193469 - protein, 5 aa, Mycobacterium
ARTRA

SEQ ID NO: 1193470 - protein, 6 aa, Mycobacterium
ARTRAE

SEQ ID NO: 1193471 - protein, 18 aa, Mycobacterium
ARTRAELSGKLTQRGYDE

SEQ ID NO: 1193472 - protein, 7 aa, Mycobacterium
ARTREQF

SEQ ID NO: 1193473 - protein, 7 aa, Mycobacterium
ARTRTAA

SEQ ID NO: 1193474 - protein, 5 aa, Mycobacterium
ARTSE

SEQ ID NO: 1193475 - protein, 22 aa, Mycobacterium
ARTSEPPDVQEPSNGPPPASRW

SEQ ID NO: 1193476 - protein, 7 aa, Mycobacterium
ARTSGAI

SEQ ID NO: 1193477 - protein, 6 aa, Mycobacterium
ARTSQF

SEQ ID NO: 1193478 - protein, 7 aa, Mycobacterium
ARTTFAD

SEQ ID NO: 1193479 - protein, 9 aa, Mycobacterium
ARTTGRAAE

SEQ ID NO: 1193480 - protein, 6 aa, Mycobacterium
ARTTHP

SEQ ID NO: 1193481 - protein, 7 aa, Mycobacterium
ARTVEET

SEQ ID NO: 1193482 - protein, 6 aa, Mycobacterium
ARTVPA

SEQ ID NO: 1193483 - protein, 12 aa, Mycobacterium
ARVADGLDPELA

SEQ ID NO: 1193484 - protein, 6 aa, Mycobacterium
ARVANR

SEQ ID NO: 1193485 - protein, 9 aa, Mycobacterium
ARVASNEVS

SEQ ID NO: 1193486 - protein, 11 aa, Mycobacterium
ARVEPTDESFK

SEQ ID NO: 1193487 - protein, 4 aa, Mycobacterium
ARVG

SEQ ID NO: 1193488 - protein, 6 aa, Mycobacterium
ARVGGA

SEQ ID NO: 1193489 - protein, 6 aa, Mycobacterium
ARVGTP

SEQ ID NO: 1193490 - protein, 5 aa, Mycobacterium
ARVPA

SEQ ID NO: 1193491 - protein, 10 aa, Mycobacterium
ARVPEDTPTA

SEQ ID NO: 1193492 - protein, 7 aa, Mycobacterium
ARVPGNG

SEQ ID NO: 1193493 - protein, 6 aa, Mycobacterium
ARVSRK

SEQ ID NO: 1193494 - protein, 7 aa, Mycobacterium
ARVTHTD

SEQ ID NO: 1193495 - protein, 9 aa, Mycobacterium
ARVTNPAGQ

SEQ ID NO: 1193496 - protein, 7 aa, Mycobacterium
ARVTPQS

SEQ ID NO: 1193497 - protein, 11 aa, Mycobacterium
ARVTTQSSISA

SEQ ID NO: 1193498 - protein, 12 aa, Mycobacterium
ARWADGGGDGHY

SEQ ID NO: 1193499 - protein, 9 aa, Mycobacterium
ARWSDDPVT

SEQ ID NO: 1193500 - protein, 6 aa, Mycobacterium
ARYADE

SEQ ID NO: 1193501 - protein, 12 aa, Mycobacterium
ARYAPRGERGIS

SEQ ID NO: 1193502 - protein, 4 aa, Mycobacterium
ARYD

SEQ ID NO: 1193503 - protein, 9 aa, Mycobacterium
ARYDPAQSP

SEQ ID NO: 1193504 - protein, 10 aa, Mycobacterium
ARYDPGGGGI

SEQ ID NO: 1193505 - protein, 6 aa, Mycobacterium
ARYEPS

SEQ ID NO: 1193506 - protein, 5 aa, Mycobacterium
ARYPD

SEQ ID NO: 1193507 - protein, 5 aa, Mycobacterium
ARYPK

SEQ ID NO: 1193508 - protein, 11 aa, Mycobacterium
ARYQSEAARDI

SEQ ID NO: 1193509 - protein, 5 aa, Mycobacterium
ARYSA

SEQ ID NO: 1193510 - protein, 8 aa, Mycobacterium
ASAAADGW

SEQ ID NO: 1193511 - protein, 9 aa, Mycobacterium
ASAAAEHAG

SEQ ID NO: 1193512 - protein, 7 aa, Mycobacterium
ASAAAQT

SEQ ID NO: 1193513 - protein, 7 aa, Mycobacterium
ASAAASS

SEQ ID NO: 1193514 - protein, 14 aa, Mycobacterium
ASAADARAVAMSVL

SEQ ID NO: 1193515 - protein, 25 aa, Mycobacterium
ASAADDPEPAKPVARANHDRADSQR

SEQ ID NO: 1193516 - protein, 10 aa, Mycobacterium
ASAADDVAGV

SEQ ID NO: 1193517 - protein, 14 aa, Mycobacterium
ASAADYAQLGATDL

SEQ ID NO: 1193518 - protein, 7 aa, Mycobacterium
ASAAEGA

SEQ ID NO: 1193519 - protein, 7 aa, Mycobacterium
ASAAELG

SEQ ID NO: 1193520 - protein, 14 aa, Mycobacterium
ASAAGQLRDGINPK

SEQ ID NO: 1193521 - protein, 13 aa, Mycobacterium
ASAAIAADAPAKA

SEQ ID NO: 1193522 - protein, 20 aa, Mycobacterium
ASAAPDEPGQGPGEKYTGPV

SEQ ID NO: 1193523 - protein, 7 aa, Mycobacterium
ASAAQAE

SEQ ID NO: 1193524 - protein, 5 aa, Mycobacterium
ASAAT

SEQ ID NO: 1193525 - protein, 6 aa, Mycobacterium
ASAATL

SEQ ID NO: 1193526 - protein, 12 aa, Mycobacterium
ASAATSTPQLPE

SEQ ID NO: 1193527 - protein, 16 aa, Mycobacterium
ASAAVAEPTTHDPDAR

SEQ ID NO: 1193528 - protein, 4 aa, Mycobacterium
ASAD

SEQ ID NO: 1193529 - protein, 11 aa, Mycobacterium
ASADEAARALQ

SEQ ID NO: 1193530 - protein, 11 aa, Mycobacterium
ASADGTKDPEF

SEQ ID NO: 1193531 - protein, 9 aa, Mycobacterium
ASADKYPAY

SEQ ID NO: 1193532 - protein, 9 aa, Mycobacterium
ASADPAADV

SEQ ID NO: 1193533 - protein, 14 aa, Mycobacterium
ASAEATHARLGGPG

SEQ ID NO: 1193534 - protein, 111 aa, Mycobacterium
ASAEDVGSSANVSTSEPSRPQSTKAPSRQDNADESAASGTSDDNDLGDDRSDESAASGTSDDNDLGDDRSDEAEEPRHSDETVTDEEEAVADQEVATPDLGPVDKPAGVPS

SEQ ID NO: 1193535 - protein, 6 aa, Mycobacterium
ASAEET

SEQ ID NO: 1193536 - protein, 13 aa, Mycobacterium
ASAELRDRDGGRL

SEQ ID NO: 1193537 - protein, 17 aa, Mycobacterium
ASAESSAAHPDLGRSIS

SEQ ID NO: 1193538 - protein, 5 aa, Mycobacterium
ASAGA

SEQ ID NO: 1193539 - protein, 9 aa, Mycobacterium
ASAGASENH

SEQ ID NO: 1193540 - protein, 7 aa, Mycobacterium
ASAGDGC

SEQ ID NO: 1193541 - protein, 5 aa, Mycobacterium
ASAGG

SEQ ID NO: 1193542 - protein, 21 aa, Mycobacterium
ASAGGEAVANTDSVATPEGGR

SEQ ID NO: 1193543 - protein, 9 aa, Mycobacterium
ASAGGGGRG

SEQ ID NO: 1193544 - protein, 13 aa, Mycobacterium
ASAGRPPKHPTAT

SEQ ID NO: 1193545 - protein, 10 aa, Mycobacterium
ASAGSSLRKA

SEQ ID NO: 1193546 - protein, 5 aa, Mycobacterium
ASAGV

SEQ ID NO: 1193547 - protein, 17 aa, Mycobacterium
ASAHGDREAYVEPGART

SEQ ID NO: 1193548 - protein, 18 aa, Mycobacterium
ASAHPDPSALRASAHRRD

SEQ ID NO: 1193549 - protein, 7 aa, Mycobacterium
ASAIDER

SEQ ID NO: 1193550 - protein, 10 aa, Mycobacterium
ASAIQQTADT

SEQ ID NO: 1193551 - protein, 7 aa, Mycobacterium
ASALRRA

SEQ ID NO: 1193552 - protein, 47 aa, Mycobacterium
ASALSPGADAAAGTPPAESTAHPDDDARRSPESEPLQRSEKTRRRGA

SEQ ID NO: 1193553 - protein, 7 aa, Mycobacterium
ASALTDT

SEQ ID NO: 1193554 - protein, 17 aa, Mycobacterium
ASAMPDDRWRGTAADAY

SEQ ID NO: 1193555 - protein, 7 aa, Mycobacterium
ASANDAA

SEQ ID NO: 1193556 - protein, 11 aa, Mycobacterium
ASAPAAVAYGR

SEQ ID NO: 1193557 - protein, 8 aa, Mycobacterium
ASAPAGEV

SEQ ID NO: 1193558 - protein, 5 aa, Mycobacterium
ASAPD

SEQ ID NO: 1193559 - protein, 6 aa, Mycobacterium
ASAPDN

SEQ ID NO: 1193560 - protein, 6 aa, Mycobacterium
ASAPDR

SEQ ID NO: 1193561 - protein, 6 aa, Mycobacterium
ASAPDT

SEQ ID NO: 1193562 - protein, 5 aa, Mycobacterium
ASAPF

SEQ ID NO: 1193563 - protein, 7 aa, Mycobacterium
ASAPFTD

SEQ ID NO: 1193564 - protein, 7 aa, Mycobacterium
ASAPGTV

SEQ ID NO: 1193565 - protein, 8 aa, Mycobacterium
ASAPLPST

SEQ ID NO: 1193566 - protein, 22 aa, Mycobacterium
ASAPPADEIPRSPVTASGEDQV

SEQ ID NO: 1193567 - protein, 10 aa, Mycobacterium
ASAPPHVGPG

SEQ ID NO: 1193568 - protein, 14 aa, Mycobacterium
ASAPPLPGYPRPGG

SEQ ID NO: 1193569 - protein, 5 aa, Mycobacterium
ASAPR

SEQ ID NO: 1193570 - protein, 10 aa, Mycobacterium
ASAPVTDDPV

SEQ ID NO: 1193571 - protein, 13 aa, Mycobacterium
ASAQPALDGSRRE

SEQ ID NO: 1193572 - protein, 14 aa, Mycobacterium
ASAQSRVDETRHTL

SEQ ID NO: 1193573 - protein, 7 aa, Mycobacterium
ASARAAL

SEQ ID NO: 1193574 - protein, 24 aa, Mycobacterium
ASARAGAACASSTSRSRASFCCAR

SEQ ID NO: 1193575 - protein, 5 aa, Mycobacterium
ASARF

SEQ ID NO: 1193576 - protein, 8 aa, Mycobacterium
ASARQRDR

SEQ ID NO: 1193577 - protein, 13 aa, Mycobacterium
ASARSRLAHLMNG

SEQ ID NO: 1193578 - protein, 8 aa, Mycobacterium
ASASDDEL

SEQ ID NO: 1193579 - protein, 7 aa, Mycobacterium
ASASQAC

SEQ ID NO: 1193580 - protein, 18 aa, Mycobacterium
ASASSFRGTDKRGGANGA

SEQ ID NO: 1193581 - protein, 8 aa, Mycobacterium
ASASTQIS

SEQ ID NO: 1193582 - protein, 7 aa, Mycobacterium
ASATDVA

SEQ ID NO: 1193583 - protein, 7 aa, Mycobacterium
ASATDVS

SEQ ID NO: 1193584 - protein, 11 aa, Mycobacterium
ASATGLGDDSA

SEQ ID NO: 1193585 - protein, 14 aa, Mycobacterium
ASATSPQSDGGAGH

SEQ ID NO: 1193586 - protein, 8 aa, Mycobacterium
ASATTGLP

SEQ ID NO: 1193587 - protein, 6 aa, Mycobacterium
ASAVGE

SEQ ID NO: 1193588 - protein, 14 aa, Mycobacterium
ASAVKGAAPAARQV

SEQ ID NO: 1193589 - protein, 13 aa, Mycobacterium
ASAWQAGTESSVD

SEQ ID NO: 1193590 - protein, 6 aa, Mycobacterium
ASAYGL

SEQ ID NO: 1193591 - protein, 17 aa, Mycobacterium
ASAYQRASNDARRRGAL

SEQ ID NO: 1193592 - protein, 4 aa, Mycobacterium
ASCA

SEQ ID NO: 1193593 - protein, 8 aa, Mycobacterium
ASCTSTRA

SEQ ID NO: 1193594 - protein, 12 aa, Mycobacterium
ASDADEKEIKRA

SEQ ID NO: 1193595 - protein, 8 aa, Mycobacterium
ASDALYGE

SEQ ID NO: 1193596 - protein, 6 aa, Mycobacterium
ASDAPY

SEQ ID NO: 1193597 - protein, 5 aa, Mycobacterium
ASDAT

SEQ ID NO: 1193598 - protein, 8 aa, Mycobacterium
ASDDDPYL

SEQ ID NO: 1193599 - protein, 6 aa, Mycobacterium
ASDDIA

SEQ ID NO: 1193600 - protein, 7 aa, Mycobacterium
ASDDPDA

SEQ ID NO: 1193601 - protein, 13 aa, Mycobacterium
ASDDSVQATGVTR

SEQ ID NO: 1193602 - protein, 6 aa, Mycobacterium
ASDEEG

SEQ ID NO: 1193603 - protein, 8 aa, Mycobacterium
ASDEGGRH

SEQ ID NO: 1193604 - protein, 8 aa, Mycobacterium
ASDEHTGQ

SEQ ID NO: 1193605 - protein, 14 aa, Mycobacterium
ASDEISASAPAVPR

SEQ ID NO: 1193606 - protein, 24 aa, Mycobacterium
ASDEPAMSDYGPGHAAACHHPRNT

SEQ ID NO: 1193607 - protein, 8 aa, Mycobacterium
ASDGEFGD

SEQ ID NO: 1193608 - protein, 16 aa, Mycobacterium
ASDGGEACICDLTEPL

SEQ ID NO: 1193609 - protein, 6 aa, Mycobacterium
ASDGGF

SEQ ID NO: 1193610 - protein, 4 aa, Mycobacterium
ASDH

SEQ ID NO: 1193611 - protein, 15 aa, Mycobacterium
ASDKPGVAVETKPAS

SEQ ID NO: 1193612 - protein, 5 aa, Mycobacterium
ASDLG

SEQ ID NO: 1193613 - protein, 4 aa, Mycobacterium
ASDN

SEQ ID NO: 1193614 - protein, 7 aa, Mycobacterium
ASDNDVA

SEQ ID NO: 1193615 - protein, 9 aa, Mycobacterium
ASDNDVRNR

SEQ ID NO: 1193616 - protein, 15 aa, Mycobacterium
ASDPATGRPLSDDEI

SEQ ID NO: 1193617 - protein, 15 aa, Mycobacterium
ASDPDRDRRQAWAAV

SEQ ID NO: 1193618 - protein, 28 aa, Mycobacterium
ASDPESDSGDPIAAPVPATGGSGTGTAV

SEQ ID NO: 1193619 - protein, 7 aa, Mycobacterium
ASDPGWG

SEQ ID NO: 1193620 - protein, 6 aa, Mycobacterium
ASDPTL

SEQ ID NO: 1193621 - protein, 6 aa, Mycobacterium
ASDQAR

SEQ ID NO: 1193622 - protein, 8 aa, Mycobacterium
ASDRGDVE

SEQ ID NO: 1193623 - protein, 11 aa, Mycobacterium
ASDRPSTGDPL

SEQ ID NO: 1193624 - protein, 6 aa, Mycobacterium
ASDRRA

SEQ ID NO: 1193625 - protein, 7 aa, Mycobacterium
ASDSGYA

SEQ ID NO: 1193626 - protein, 7 aa, Mycobacterium
ASDSPNK

SEQ ID NO: 1193627 - protein, 7 aa, Mycobacterium
ASDSTAV

SEQ ID NO: 1193628 - protein, 12 aa, Mycobacterium
ASDSTERGRSTL

SEQ ID NO: 1193629 - protein, 8 aa, Mycobacterium
ASDTDTEV

SEQ ID NO: 1193630 - protein, 7 aa, Mycobacterium
ASDTPVI

SEQ ID NO: 1193631 - protein, 5 aa, Mycobacterium
ASDVE

SEQ ID NO: 1193632 - protein, 10 aa, Mycobacterium
ASEAEGARDW

SEQ ID NO: 1193633 - protein, 7 aa, Mycobacterium
ASEAQRR

SEQ ID NO: 1193634 - protein, 14 aa, Mycobacterium
ASEATGEGSRTGDP

SEQ ID NO: 1193635 - protein, 7 aa, Mycobacterium
ASEEDRE

SEQ ID NO: 1193636 - protein, 6 aa, Mycobacterium
ASEEFA

SEQ ID NO: 1193637 - protein, 20 aa, Mycobacterium
ASEERKKEIERQAAAESTQW

SEQ ID NO: 1193638 - protein, 5 aa, Mycobacterium
ASEGA

SEQ ID NO: 1193639 - protein, 8 aa, Mycobacterium
ASEGADGI

SEQ ID NO: 1193640 - protein, 7 aa, Mycobacterium
ASEGDGE

SEQ ID NO: 1193641 - protein, 14 aa, Mycobacterium
ASEGGVSKGVPTGF

SEQ ID NO: 1193642 - protein, 5 aa, Mycobacterium
ASEGM

SEQ ID NO: 1193643 - protein, 7 aa, Mycobacterium
ASEGRTI

SEQ ID NO: 1193644 - protein, 13 aa, Mycobacterium
ASEGVKEEDIRSD

SEQ ID NO: 1193645 - protein, 7 aa, Mycobacterium
ASEHRRR

SEQ ID NO: 1193646 - protein, 8 aa, Mycobacterium
ASEKAGSL

SEQ ID NO: 1193647 - protein, 9 aa, Mycobacterium
ASEKARAAQ

SEQ ID NO: 1193648 - protein, 8 aa, Mycobacterium
ASEKPGHA

SEQ ID NO: 1193649 - protein, 6 aa, Mycobacterium
ASELEA

SEQ ID NO: 1193650 - protein, 12 aa, Mycobacterium
ASENGRVGDPTR

SEQ ID NO: 1193651 - protein, 7 aa, Mycobacterium
ASEPFGS

SEQ ID NO: 1193652 - protein, 7 aa, Mycobacterium
ASEPGVA

SEQ ID NO: 1193653 - protein, 6 aa, Mycobacterium
ASEPLT

SEQ ID NO: 1193654 - protein, 7 aa, Mycobacterium
ASEPRFD

SEQ ID NO: 1193655 - protein, 6 aa, Mycobacterium
ASEPRT

SEQ ID NO: 1193656 - protein, 18 aa, Mycobacterium
ASEQAQVDRGQPIRSEGD

SEQ ID NO: 1193657 - protein, 5 aa, Mycobacterium
ASEQG

SEQ ID NO: 1193658 - protein, 7 aa, Mycobacterium
ASEQRTR

SEQ ID NO: 1193659 - protein, 7 aa, Mycobacterium
ASERSDA

SEQ ID NO: 1193660 - protein, 8 aa, Mycobacterium
ASERSRRQ

SEQ ID NO: 1193661 - protein, 7 aa, Mycobacterium
ASERSRV

SEQ ID NO: 1193662 - protein, 8 aa, Mycobacterium
ASESGEEV

SEQ ID NO: 1193663 - protein, 6 aa, Mycobacterium
ASESMQ

SEQ ID NO: 1193664 - protein, 7 aa, Mycobacterium
ASESPLP

SEQ ID NO: 1193665 - protein, 6 aa, Mycobacterium
ASETAT

SEQ ID NO: 1193666 - protein, 4 aa, Mycobacterium
ASFA

SEQ ID NO: 1193667 - protein, 13 aa, Mycobacterium
ASFEDGDRNPPVF

SEQ ID NO: 1193668 - protein, 5 aa, Mycobacterium
ASFPG

SEQ ID NO: 1193669 - protein, 9 aa, Mycobacterium
ASGAAGIST

SEQ ID NO: 1193670 - protein, 6 aa, Mycobacterium
ASGAEV

SEQ ID NO: 1193671 - protein, 8 aa, Mycobacterium
ASGAGADA

SEQ ID NO: 1193672 - protein, 6 aa, Mycobacterium
ASGAGN

SEQ ID NO: 1193673 - protein, 7 aa, Mycobacterium
ASGAPLA

SEQ ID NO: 1193674 - protein, 6 aa, Mycobacterium
ASGARL

SEQ ID NO: 1193675 - protein, 5 aa, Mycobacterium
ASGAS

SEQ ID NO: 1193676 - protein, 9 aa, Mycobacterium
ASGDAPAIG

SEQ ID NO: 1193677 - protein, 9 aa, Mycobacterium
ASGDDPEKL

SEQ ID NO: 1193678 - protein, 7 aa, Mycobacterium
ASGDMDA

SEQ ID NO: 1193679 - protein, 8 aa, Mycobacterium
ASGDPAQL

SEQ ID NO: 1193680 - protein, 9 aa, Mycobacterium
ASGDPEHRA

SEQ ID NO: 1193681 - protein, 8 aa, Mycobacterium
ASGDPGEA

SEQ ID NO: 1193682 - protein, 10 aa, Mycobacterium
ASGDPSAPRV

SEQ ID NO: 1193683 - protein, 8 aa, Mycobacterium
ASGDSASL

SEQ ID NO: 1193684 - protein, 6 aa, Mycobacterium
ASGELP

SEQ ID NO: 1193685 - protein, 13 aa, Mycobacterium
ASGEPRARDGSGV

SEQ ID NO: 1193686 - protein, 8 aa, Mycobacterium
ASGERRPG

SEQ ID NO: 1193687 - protein, 5 aa, Mycobacterium
ASGET

SEQ ID NO: 1193688 - protein, 17 aa, Mycobacterium
ASGETTVEGASISGSVD

SEQ ID NO: 1193689 - protein, 18 aa, Mycobacterium
ASGFGRATAEALAKRGAS

SEQ ID NO: 1193690 - protein, 18 aa, Mycobacterium
ASGFGRATAEALTKRGAS

SEQ ID NO: 1193691 - protein, 7 aa, Mycobacterium
ASGGDSV

SEQ ID NO: 1193692 - protein, 7 aa, Mycobacterium
ASGGGLQ

SEQ ID NO: 1193693 - protein, 7 aa, Mycobacterium
ASGGGRD

SEQ ID NO: 1193694 - protein, 7 aa, Mycobacterium
ASGGKAG

SEQ ID NO: 1193695 - protein, 13 aa, Mycobacterium
ASGGLDAAGEPVD

SEQ ID NO: 1193696 - protein, 6 aa, Mycobacterium
ASGGNA

SEQ ID NO: 1193697 - protein, 5 aa, Mycobacterium
ASGGR

SEQ ID NO: 1193698 - protein, 11 aa, Mycobacterium
ASGGRVRTIPR

SEQ ID NO: 1193699 - protein, 6 aa, Mycobacterium
ASGGSI

SEQ ID NO: 1193700 - protein, 10 aa, Mycobacterium
ASGGSTGRPK

SEQ ID NO: 1193701 - protein, 14 aa, Mycobacterium
ASGGTSLGEGPARA

SEQ ID NO: 1193702 - protein, 5 aa, Mycobacterium
ASGHD

SEQ ID NO: 1193703 - protein, 5 aa, Mycobacterium
ASGHG

SEQ ID NO: 1193704 - protein, 5 aa, Mycobacterium
ASGHN

SEQ ID NO: 1193705 - protein, 5 aa, Mycobacterium
ASGHT

SEQ ID NO: 1193706 - protein, 4 aa, Mycobacterium
ASGI

SEQ ID NO: 1193707 - protein, 24 aa, Mycobacterium
ASGKKIGTKSLTSVASTTDATGDE

SEQ ID NO: 1193708 - protein, 11 aa, Mycobacterium
ASGKNGYPPEA

SEQ ID NO: 1193709 - protein, 8 aa, Mycobacterium
ASGKQIPA

SEQ ID NO: 1193710 - protein, 5 aa, Mycobacterium
ASGLV

SEQ ID NO: 1193711 - protein, 15 aa, Mycobacterium
ASGNAPGELHTPPPV

SEQ ID NO: 1193712 - protein, 7 aa, Mycobacterium
ASGNGTV

SEQ ID NO: 1193713 - protein, 7 aa, Mycobacterium
ASGNIDA

SEQ ID NO: 1193714 - protein, 4 aa, Mycobacterium
ASGP

SEQ ID NO: 1193715 - protein, 7 aa, Mycobacterium
ASGPAGR

SEQ ID NO: 1193716 - protein, 8 aa, Mycobacterium
ASGPGGAV

SEQ ID NO: 1193717 - protein, 8 aa, Mycobacterium
ASGPGRLG

SEQ ID NO: 1193718 - protein, 5 aa, Mycobacterium
ASGPH

SEQ ID NO: 1193719 - protein, 8 aa, Mycobacterium
ASGPLDTD

SEQ ID NO: 1193720 - protein, 9 aa, Mycobacterium
ASGPRSAER

SEQ ID NO: 1193721 - protein, 10 aa, Mycobacterium
ASGPSGSPLR

SEQ ID NO: 1193722 - protein, 6 aa, Mycobacterium
ASGPTV

SEQ ID NO: 1193723 - protein, 15 aa, Mycobacterium
ASGPVPPVDPQRLNA

SEQ ID NO: 1193724 - protein, 15 aa, Mycobacterium
ASGQDPSSVPAADVA

SEQ ID NO: 1193725 - protein, 7 aa, Mycobacterium
ASGQEPV

SEQ ID NO: 1193726 - protein, 7 aa, Mycobacterium
ASGQGFR

SEQ ID NO: 1193727 - protein, 6 aa, Mycobacterium
ASGRAA

SEQ ID NO: 1193728 - protein, 7 aa, Mycobacterium
ASGRAAR

SEQ ID NO: 1193729 - protein, 5 aa, Mycobacterium
ASGRG

SEQ ID NO: 1193730 - protein, 21 aa, Mycobacterium
ASGRLTGADTGPGRLPEAEEI

SEQ ID NO: 1193731 - protein, 10 aa, Mycobacterium
ASGRNSETPK

SEQ ID NO: 1193732 - protein, 5 aa, Mycobacterium
ASGRP

SEQ ID NO: 1193733 - protein, 8 aa, Mycobacterium
ASGRSAPL

SEQ ID NO: 1193734 - protein, 12 aa, Mycobacterium
ASGRTKLDAPPD

SEQ ID NO: 1193735 - protein, 4 aa, Mycobacterium
ASGS

SEQ ID NO: 1193736 - protein, 8 aa, Mycobacterium
ASGSDGAL

SEQ ID NO: 1193737 - protein, 9 aa, Mycobacterium
ASGSEGQRR

SEQ ID NO: 1193738 - protein, 14 aa, Mycobacterium
ASGSGDARKIRSAA

SEQ ID NO: 1193739 - protein, 11 aa, Mycobacterium
ASGSGKTTVAT

SEQ ID NO: 1193740 - protein, 14 aa, Mycobacterium
ASGSKDGKPNPASS

SEQ ID NO: 1193741 - protein, 9 aa, Mycobacterium
ASGSRENYR

SEQ ID NO: 1193742 - protein, 7 aa, Mycobacterium
ASGSRMR

SEQ ID NO: 1193743 - protein, 6 aa, Mycobacterium
ASGSTV

SEQ ID NO: 1193744 - protein, 7 aa, Mycobacterium
ASGSVNG

SEQ ID NO: 1193745 - protein, 4 aa, Mycobacterium
ASGT

SEQ ID NO: 1193746 - protein, 10 aa, Mycobacterium
ASGTEAESTL

SEQ ID NO: 1193747 - protein, 25 aa, Mycobacterium
ASGTGNAAIPAARKGAAVTASDLTP

SEQ ID NO: 1193748 - protein, 6 aa, Mycobacterium
ASGTRT

SEQ ID NO: 1193749 - protein, 7 aa, Mycobacterium
ASGTTNM

SEQ ID NO: 1193750 - protein, 7 aa, Mycobacterium
ASGVARR

SEQ ID NO: 1193751 - protein, 8 aa, Mycobacterium
ASGVGKTS

SEQ ID NO: 1193752 - protein, 6 aa, Mycobacterium
ASGYKR

SEQ ID NO: 1193753 - protein, 6 aa, Mycobacterium
ASGYRG

SEQ ID NO: 1193754 - protein, 5 aa, Mycobacterium
ASGYT

SEQ ID NO: 1193755 - protein, 9 aa, Mycobacterium
ASHASGATL

SEQ ID NO: 1193756 - protein, 8 aa, Mycobacterium
ASHENRLT

SEQ ID NO: 1193757 - protein, 19 aa, Mycobacterium
ASHGDWPPGFPEGKRPAYP

SEQ ID NO: 1193758 - protein, 12 aa, Mycobacterium
ASHGGVDDTREL

SEQ ID NO: 1193759 - protein, 4 aa, Mycobacterium
ASHP

SEQ ID NO: 1193760 - protein, 6 aa, Mycobacterium
ASHPGV

SEQ ID NO: 1193761 - protein, 7 aa, Mycobacterium
ASHQAVG

SEQ ID NO: 1193762 - protein, 7 aa, Mycobacterium
ASHQIAR

SEQ ID NO: 1193763 - protein, 4 aa, Mycobacterium
ASHT

SEQ ID NO: 1193764 - protein, 6 aa, Mycobacterium
ASHTPR

SEQ ID NO: 1193765 - protein, 40 aa, Mycobacterium
ASIAEQAANIGGTPSSQMPAGGQITPADHTTQGGNGDNVQ

SEQ ID NO: 1193766 - protein, 10 aa, Mycobacterium
ASIDARGTVS

SEQ ID NO: 1193767 - protein, 5 aa, Mycobacterium
ASIEA

SEQ ID NO: 1193768 - protein, 6 aa, Mycobacterium
ASIGGN

SEQ ID NO: 1193769 - protein, 18 aa, Mycobacterium
ASIGKRDAIANANTPHRL

SEQ ID NO: 1193770 - protein, 12 aa, Mycobacterium
ASIGPAGRYAES

SEQ ID NO: 1193771 - protein, 21 aa, Mycobacterium
ASIQSALDDTYDRVEDAEPPK

SEQ ID NO: 1193772 - protein, 4 aa, Mycobacterium
ASKA

SEQ ID NO: 1193773 - protein, 8 aa, Mycobacterium
ASKCNDEV

SEQ ID NO: 1193774 - protein, 6 aa, Mycobacterium
ASKGKF

SEQ ID NO: 1193775 - protein, 8 aa, Mycobacterium
ASKGKRTD

SEQ ID NO: 1193776 - protein, 4 aa, Mycobacterium
ASKK

SEQ ID NO: 1193777 - protein, 14 aa, Mycobacterium
ASKPGSDGVTPVEH

SEQ ID NO: 1193778 - protein, 8 aa, Mycobacterium
ASKPIEEV

SEQ ID NO: 1193779 - protein, 8 aa, Mycobacterium
ASKPMEDV

SEQ ID NO: 1193780 - protein, 8 aa, Mycobacterium
ASKPQVHS

SEQ ID NO: 1193781 - protein, 14 aa, Mycobacterium
ASKPYDGPPPQAAD

SEQ ID NO: 1193782 - protein, 9 aa, Mycobacterium
ASKQELGDA

SEQ ID NO: 1193783 - protein, 10 aa, Mycobacterium
ASKRSAELAD

SEQ ID NO: 1193784 - protein, 14 aa, Mycobacterium
ASLAAGDAPEPPMR

SEQ ID NO: 1193785 - protein, 10 aa, Mycobacterium
ASLADGALSR

SEQ ID NO: 1193786 - protein, 8 aa, Mycobacterium
ASLGKDRR

SEQ ID NO: 1193787 - protein, 6 aa, Mycobacterium
ASLGMG

SEQ ID NO: 1193788 - protein, 8 aa, Mycobacterium
ASLHGSGR

SEQ ID NO: 1193789 - protein, 7 aa, Mycobacterium
ASLPADV

SEQ ID NO: 1193790 - protein, 6 aa, Mycobacterium
ASLPAE

SEQ ID NO: 1193791 - protein, 8 aa, Mycobacterium
ASLQNRPP

SEQ ID NO: 1193792 - protein, 7 aa, Mycobacterium
ASLSEDE

SEQ ID NO: 1193793 - protein, 11 aa, Mycobacterium
ASLSETDRSHS

SEQ ID NO: 1193794 - protein, 10 aa, Mycobacterium
ASLTDAQEAT

SEQ ID NO: 1193795 - protein, 29 aa, Mycobacterium
ASMPGAAAPIEPDERDEDDFDPKDPSLGS

SEQ ID NO: 1193796 - protein, 6 aa, Mycobacterium
ASMPNV

SEQ ID NO: 1193797 - protein, 6 aa, Mycobacterium
ASMPPA

SEQ ID NO: 1193798 - protein, 6 aa, Mycobacterium
ASMPTE

SEQ ID NO: 1193799 - protein, 36 aa, Mycobacterium
ASMQGSGGSGTPAAGGGSGGGGAAWQSAGAQPGVGE

SEQ ID NO: 1193800 - protein, 11 aa, Mycobacterium
ASMRATYNPGI

SEQ ID NO: 1193801 - protein, 6 aa, Mycobacterium
ASMRDP

SEQ ID NO: 1193802 - protein, 6 aa, Mycobacterium
ASMRGE

SEQ ID NO: 1193803 - protein, 9 aa, Mycobacterium
ASNAARDTA

SEQ ID NO: 1193804 - protein, 10 aa, Mycobacterium
ASNAEADEDE

SEQ ID NO: 1193805 - protein, 11 aa, Mycobacterium
ASNAHAASQPL

SEQ ID NO: 1193806 - protein, 11 aa, Mycobacterium
ASNEQPQPPLG

SEQ ID NO: 1193807 - protein, 6 aa, Mycobacterium
ASNGGF

SEQ ID NO: 1193808 - protein, 6 aa, Mycobacterium
ASNGIM

SEQ ID NO: 1193809 - protein, 13 aa, Mycobacterium
ASNGYPMATPAEL

SEQ ID NO: 1193810 - protein, 6 aa, Mycobacterium
ASNNPM

SEQ ID NO: 1193811 - protein, 16 aa, Mycobacterium
ASNPAANPVHRLSAVA

SEQ ID NO: 1193812 - protein, 6 aa, Mycobacterium
ASNQEI

SEQ ID NO: 1193813 - protein, 12 aa, Mycobacterium
ASNRDPRKFENP

SEQ ID NO: 1193814 - protein, 8 aa, Mycobacterium
ASNRQNGT

SEQ ID NO: 1193815 - protein, 4 aa, Mycobacterium
ASNV

SEQ ID NO: 1193816 - protein, 5 aa, Mycobacterium
ASPAA

SEQ ID NO: 1193817 - protein, 17 aa, Mycobacterium
ASPAALASVTDADAKAL

SEQ ID NO: 1193818 - protein, 6 aa, Mycobacterium
ASPADF

SEQ ID NO: 1193819 - protein, 10 aa, Mycobacterium
ASPAGNGDPL

SEQ ID NO: 1193820 - protein, 15 aa, Mycobacterium
ASPALNGAATVANED

SEQ ID NO: 1193821 - protein, 6 aa, Mycobacterium
ASPALQ

SEQ ID NO: 1193822 - protein, 14 aa, Mycobacterium
ASPAPLPPSDQLTD

SEQ ID NO: 1193823 - protein, 9 aa, Mycobacterium
ASPASADLS

SEQ ID NO: 1193824 - protein, 11 aa, Mycobacterium
ASPASAQASAL

SEQ ID NO: 1193825 - protein, 6 aa, Mycobacterium
ASPASE

SEQ ID NO: 1193826 - protein, 10 aa, Mycobacterium
ASPDADDTAV

SEQ ID NO: 1193827 - protein, 6 aa, Mycobacterium
ASPDAP

SEQ ID NO: 1193828 - protein, 9 aa, Mycobacterium
ASPDDLAET

SEQ ID NO: 1193829 - protein, 6 aa, Mycobacterium
ASPDLS

SEQ ID NO: 1193830 - protein, 23 aa, Mycobacterium
ASPDNLPPGTAMAPQGPRQSPNV

SEQ ID NO: 1193831 - protein, 8 aa, Mycobacterium
ASPDNPFG

SEQ ID NO: 1193832 - protein, 9 aa, Mycobacterium
ASPDPMRPS

SEQ ID NO: 1193833 - protein, 8 aa, Mycobacterium
ASPEGGHM

SEQ ID NO: 1193834 - protein, 8 aa, Mycobacterium
ASPEGPEI

SEQ ID NO: 1193835 - protein, 5 aa, Mycobacterium
ASPEL

SEQ ID NO: 1193836 - protein, 10 aa, Mycobacterium
ASPELDEVEK

SEQ ID NO: 1193837 - protein, 6 aa, Mycobacterium
ASPELG

SEQ ID NO: 1193838 - protein, 9 aa, Mycobacterium
ASPERLSGK

SEQ ID NO: 1193839 - protein, 10 aa, Mycobacterium
ASPERLSGKQ

SEQ ID NO: 1193840 - protein, 7 aa, Mycobacterium
ASPEVSE

SEQ ID NO: 1193841 - protein, 10 aa, Mycobacterium
ASPGLGDPSW

SEQ ID NO: 1193842 - protein, 9 aa, Mycobacterium
ASPGNMGTV

SEQ ID NO: 1193843 - protein, 5 aa, Mycobacterium
ASPGR

SEQ ID NO: 1193844 - protein, 11 aa, Mycobacterium
ASPGSNAVSGN

SEQ ID NO: 1193845 - protein, 7 aa, Mycobacterium
ASPHAES

SEQ ID NO: 1193846 - protein, 4 aa, Mycobacterium
ASPL

SEQ ID NO: 1193847 - protein, 6 aa, Mycobacterium
ASPLAD

SEQ ID NO: 1193848 - protein, 10 aa, Mycobacterium
ASPLPGPAGN

SEQ ID NO: 1193849 - protein, 5 aa, Mycobacterium
ASPLY

SEQ ID NO: 1193850 - protein, 4 aa, Mycobacterium
ASPP

SEQ ID NO: 1193851 - protein, 7 aa, Mycobacterium
ASPPDFE

SEQ ID NO: 1193852 - protein, 8 aa, Mycobacterium
ASPPDFEE

SEQ ID NO: 1193853 - protein, 6 aa, Mycobacterium
ASPPDM

SEQ ID NO: 1193854 - protein, 11 aa, Mycobacterium
ASPPPAPPRWE

SEQ ID NO: 1193855 - protein, 13 aa, Mycobacterium
ASPPTGALRAAVA

SEQ ID NO: 1193856 - protein, 9 aa, Mycobacterium
ASPQPVPTA

SEQ ID NO: 1193857 - protein, 5 aa, Mycobacterium
ASPRA

SEQ ID NO: 1193858 - protein, 8 aa, Mycobacterium
ASPRPGLD

SEQ ID NO: 1193859 - protein, 10 aa, Mycobacterium
ASPRQDVGTV

SEQ ID NO: 1193860 - protein, 9 aa, Mycobacterium
ASPRSDEPW

SEQ ID NO: 1193861 - protein, 6 aa, Mycobacterium
ASPRSV

SEQ ID NO: 1193862 - protein, 6 aa, Mycobacterium
ASPSEL

SEQ ID NO: 1193863 - protein, 6 aa, Mycobacterium
ASPSLR

SEQ ID NO: 1193864 - protein, 15 aa, Mycobacterium
ASPSTTAVRSPKTAE

SEQ ID NO: 1193865 - protein, 7 aa, Mycobacterium
ASPTESN

SEQ ID NO: 1193866 - protein, 8 aa, Mycobacterium
ASPTGDLG

SEQ ID NO: 1193867 - protein, 5 aa, Mycobacterium
ASPTL

SEQ ID NO: 1193868 - protein, 14 aa, Mycobacterium
ASPTRRRSSRPVQR

SEQ ID NO: 1193869 - protein, 4 aa, Mycobacterium
ASPV

SEQ ID NO: 1193870 - protein, 7 aa, Mycobacterium
ASQAASF

SEQ ID NO: 1193871 - protein, 6 aa, Mycobacterium
ASQAEL

SEQ ID NO: 1193872 - protein, 18 aa, Mycobacterium
ASQAHEAAGTDWDTAVEE

SEQ ID NO: 1193873 - protein, 11 aa, Mycobacterium
ASQAKAKQAWA

SEQ ID NO: 1193874 - protein, 19 aa, Mycobacterium
ASQAPSTVEGSRPVPTSDR

SEQ ID NO: 1193875 - protein, 6 aa, Mycobacterium
ASQARQ

SEQ ID NO: 1193876 - protein, 6 aa, Mycobacterium
ASQELR

SEQ ID NO: 1193877 - protein, 9 aa, Mycobacterium
ASQGEAAGL

SEQ ID NO: 1193878 - protein, 22 aa, Mycobacterium
ASQGKGAWPSCGGPLSAATPRN

SEQ ID NO: 1193879 - protein, 22 aa, Mycobacterium
ASQGKGAWPSCGGPLSGATPRN

SEQ ID NO: 1193880 - protein, 4 aa, Mycobacterium
ASQL

SEQ ID NO: 1193881 - protein, 27 aa, Mycobacterium
ASQMGTPYSWGGGKPNGPSRGVDSGAN

SEQ ID NO: 1193882 - protein, 7 aa, Mycobacterium
ASQPPPG

SEQ ID NO: 1193883 - protein, 7 aa, Mycobacterium
ASQPSTL

SEQ ID NO: 1193884 - protein, 8 aa, Mycobacterium
ASQQAKPD

SEQ ID NO: 1193885 - protein, 8 aa, Mycobacterium
ASQQSLPI

SEQ ID NO: 1193886 - protein, 6 aa, Mycobacterium
ASQQTQ

SEQ ID NO: 1193887 - protein, 6 aa, Mycobacterium
ASQRAS

SEQ ID NO: 1193888 - protein, 6 aa, Mycobacterium
ASQREE

SEQ ID NO: 1193889 - protein, 20 aa, Mycobacterium
ASQRESMGNASFADAFGANT

SEQ ID NO: 1193890 - protein, 15 aa, Mycobacterium
ASQRRVNPDPSPEEL

SEQ ID NO: 1193891 - protein, 7 aa, Mycobacterium
ASQTMGN

SEQ ID NO: 1193892 - protein, 7 aa, Mycobacterium
ASQTMGT

SEQ ID NO: 1193893 - protein, 7 aa, Mycobacterium
ASRAAGG

SEQ ID NO: 1193894 - protein, 10 aa, Mycobacterium
ASRAEQGLPY

SEQ ID NO: 1193895 - protein, 10 aa, Mycobacterium
ASRASRNSVT

SEQ ID NO: 1193896 - protein, 6 aa, Mycobacterium
ASRCTP

SEQ ID NO: 1193897 - protein, 8 aa, Mycobacterium
ASRDEKLY

SEQ ID NO: 1193898 - protein, 12 aa, Mycobacterium
ASRDNAAEALRS

SEQ ID NO: 1193899 - protein, 8 aa, Mycobacterium
ASRDPARL

SEQ ID NO: 1193900 - protein, 19 aa, Mycobacterium
ASRESGTAASRGSGTAATN

SEQ ID NO: 1193901 - protein, 15 aa, Mycobacterium
ASREVTRAGEPVSLT

SEQ ID NO: 1193902 - protein, 15 aa, Mycobacterium
ASRGADPRDSTRPMT

SEQ ID NO: 1193903 - protein, 6 aa, Mycobacterium
ASRGID

SEQ ID NO: 1193904 - protein, 7 aa, Mycobacterium
ASRGIGA

SEQ ID NO: 1193905 - protein, 6 aa, Mycobacterium
ASRGLG

SEQ ID NO: 1193906 - protein, 9 aa, Mycobacterium
ASRGRPDLS

SEQ ID NO: 1193907 - protein, 7 aa, Mycobacterium
ASRGVGA

SEQ ID NO: 1193908 - protein, 10 aa, Mycobacterium
ASRLNNEQSA

SEQ ID NO: 1193909 - protein, 5 aa, Mycobacterium
ASRPA

SEQ ID NO: 1193910 - protein, 11 aa, Mycobacterium
ASRPDEVAQAH

SEQ ID NO: 1193911 - protein, 14 aa, Mycobacterium
ASRPEDGRLSDNEL

SEQ ID NO: 1193912 - protein, 7 aa, Mycobacterium
ASRPLQV

SEQ ID NO: 1193913 - protein, 7 aa, Mycobacterium
ASRPPRI

SEQ ID NO: 1193914 - protein, 10 aa, Mycobacterium
ASRPSHGPAT

SEQ ID NO: 1193915 - protein, 18 aa, Mycobacterium
ASRPTGAAPAAMPTSTSV

SEQ ID NO: 1193916 - protein, 4 aa, Mycobacterium
ASRQ

SEQ ID NO: 1193917 - protein, 16 aa, Mycobacterium
ASRQKARAARRLGFDV

SEQ ID NO: 1193918 - protein, 11 aa, Mycobacterium
ASRRANPTDDL

SEQ ID NO: 1193919 - protein, 5 aa, Mycobacterium
ASRRP

SEQ ID NO: 1193920 - protein, 4 aa, Mycobacterium
ASRS

SEQ ID NO: 1193921 - protein, 7 aa, Mycobacterium
ASRSEAV

SEQ ID NO: 1193922 - protein, 6 aa, Mycobacterium
ASRSFT

SEQ ID NO: 1193923 - protein, 8 aa, Mycobacterium
ASRSGSAR

SEQ ID NO: 1193924 - protein, 21 aa, Mycobacterium
ASRSRDLGIPGDDLPGNDAAS

SEQ ID NO: 1193925 - protein, 7 aa, Mycobacterium
ASRSRLR

SEQ ID NO: 1193926 - protein, 5 aa, Mycobacterium
ASRSW

SEQ ID NO: 1193927 - protein, 8 aa, Mycobacterium
ASRTALGS

SEQ ID NO: 1193928 - protein, 28 aa, Mycobacterium
ASRTPAPHDPRRGQHGDRPDQQQEHSEF

SEQ ID NO: 1193929 - protein, 15 aa, Mycobacterium
ASRTTSDGDPPGGWT

SEQ ID NO: 1193930 - protein, 9 aa, Mycobacterium
ASSAAPEAG

SEQ ID NO: 1193931 - protein, 5 aa, Mycobacterium
ASSAC

SEQ ID NO: 1193932 - protein, 8 aa, Mycobacterium
ASSAEAVD

SEQ ID NO: 1193933 - protein, 13 aa, Mycobacterium
ASSAINQIDGLLA

SEQ ID NO: 1193934 - protein, 7 aa, Mycobacterium
ASSAPDW

SEQ ID NO: 1193935 - protein, 10 aa, Mycobacterium
ASSASAYETE

SEQ ID NO: 1193936 - protein, 10 aa, Mycobacterium
ASSDAPGGNR

SEQ ID NO: 1193937 - protein, 7 aa, Mycobacterium
ASSDPRQ

SEQ ID NO: 1193938 - protein, 19 aa, Mycobacterium
ASSDRQPAHSPTEAPTSPA

SEQ ID NO: 1193939 - protein, 10 aa, Mycobacterium
ASSDTKVRPQ

SEQ ID NO: 1193940 - protein, 4 aa, Mycobacterium
ASSE

SEQ ID NO: 1193941 - protein, 7 aa, Mycobacterium
ASSEADW

SEQ ID NO: 1193942 - protein, 6 aa, Mycobacterium
ASSEAV

SEQ ID NO: 1193943 - protein, 7 aa, Mycobacterium
ASSEDLS

SEQ ID NO: 1193944 - protein, 8 aa, Mycobacterium
ASSEEADE

SEQ ID NO: 1193945 - protein, 11 aa, Mycobacterium
ASSEPRPARAG

SEQ ID NO: 1193946 - protein, 28 aa, Mycobacterium
ASSETDGDETGATAIEATDSDDTDAVTD

SEQ ID NO: 1193947 - protein, 5 aa, Mycobacterium
ASSGI

SEQ ID NO: 1193948 - protein, 7 aa, Mycobacterium
ASSGIGE

SEQ ID NO: 1193949 - protein, 10 aa, Mycobacterium
ASSGIGEAAA

SEQ ID NO: 1193950 - protein, 15 aa, Mycobacterium
ASSGLGRESARALAK

SEQ ID NO: 1193951 - protein, 6 aa, Mycobacterium
ASSGMA

SEQ ID NO: 1193952 - protein, 9 aa, Mycobacterium
ASSGNAPIA

SEQ ID NO: 1193953 - protein, 5 aa, Mycobacterium
ASSGV

SEQ ID NO: 1193954 - protein, 7 aa, Mycobacterium
ASSIARD

SEQ ID NO: 1193955 - protein, 9 aa, Mycobacterium
ASSKTPTVT

SEQ ID NO: 1193956 - protein, 8 aa, Mycobacterium
ASSNRPPA

SEQ ID NO: 1193957 - protein, 5 aa, Mycobacterium
ASSNT

SEQ ID NO: 1193958 - protein, 7 aa, Mycobacterium
ASSPAAA

SEQ ID NO: 1193959 - protein, 7 aa, Mycobacterium
ASSPEAI

SEQ ID NO: 1193960 - protein, 8 aa, Mycobacterium
ASSPPATH

SEQ ID NO: 1193961 - protein, 6 aa, Mycobacterium
ASSPQA

SEQ ID NO: 1193962 - protein, 7 aa, Mycobacterium
ASSPQGL

SEQ ID NO: 1193963 - protein, 7 aa, Mycobacterium
ASSPSDA

SEQ ID NO: 1193964 - protein, 7 aa, Mycobacterium
ASSPTLS

SEQ ID NO: 1193965 - protein, 10 aa, Mycobacterium
ASSPWPGSGV

SEQ ID NO: 1193966 - protein, 9 aa, Mycobacterium
ASSQDTNSR

SEQ ID NO: 1193967 - protein, 10 aa, Mycobacterium
ASSQESARAD

SEQ ID NO: 1193968 - protein, 6 aa, Mycobacterium
ASSSGF

SEQ ID NO: 1193969 - protein, 8 aa, Mycobacterium
ASSSGRAT

SEQ ID NO: 1193970 - protein, 8 aa, Mycobacterium
ASSSLSSR

SEQ ID NO: 1193971 - protein, 5 aa, Mycobacterium
ASSSP

SEQ ID NO: 1193972 - protein, 11 aa, Mycobacterium
ASSSVTGGVSG

SEQ ID NO: 1193973 - protein, 8 aa, Mycobacterium
ASSTERGD

SEQ ID NO: 1193974 - protein, 6 aa, Mycobacterium
ASSTGI

SEQ ID NO: 1193975 - protein, 5 aa, Mycobacterium
ASSTQ

SEQ ID NO: 1193976 - protein, 5 aa, Mycobacterium
ASSTR

SEQ ID NO: 1193977 - protein, 6 aa, Mycobacterium
ASSTTD

SEQ ID NO: 1193978 - protein, 9 aa, Mycobacterium
ASSVDDPEV

SEQ ID NO: 1193979 - protein, 7 aa, Mycobacterium
ASSVGAT

SEQ ID NO: 1193980 - protein, 4 aa, Mycobacterium
ASSY

SEQ ID NO: 1193981 - protein, 27 aa, Mycobacterium
ASTAARNPKTTVTERGSNRSSGTHHRS

SEQ ID NO: 1193982 - protein, 10 aa, Mycobacterium
ASTADDVTAR

SEQ ID NO: 1193983 - protein, 8 aa, Mycobacterium
ASTADFNG

SEQ ID NO: 1193984 - protein, 6 aa, Mycobacterium
ASTDAT

SEQ ID NO: 1193985 - protein, 13 aa, Mycobacterium
ASTDDATEYRGTP

SEQ ID NO: 1193986 - protein, 13 aa, Mycobacterium
ASTDEQYPDAQGR

SEQ ID NO: 1193987 - protein, 7 aa, Mycobacterium
ASTDHRP

SEQ ID NO: 1193988 - protein, 11 aa, Mycobacterium
ASTDKDQARSM

SEQ ID NO: 1193989 - protein, 4 aa, Mycobacterium
ASTE

SEQ ID NO: 1193990 - protein, 53 aa, Mycobacterium
ASTEATTAGEVDLDGDGIPDVPAGEAAAAAAAGEGTGLPGEATPGEPGSQDMA

SEQ ID NO: 1193991 - protein, 7 aa, Mycobacterium
ASTEGTT

SEQ ID NO: 1193992 - protein, 7 aa, Mycobacterium
ASTERQR

SEQ ID NO: 1193993 - protein, 5 aa, Mycobacterium
ASTFE

SEQ ID NO: 1193994 - protein, 15 aa, Mycobacterium
ASTGAGAALTAAADR

SEQ ID NO: 1193995 - protein, 8 aa, Mycobacterium
ASTGEPRQ

SEQ ID NO: 1193996 - protein, 6 aa, Mycobacterium
ASTGGP

SEQ ID NO: 1193997 - protein, 5 aa, Mycobacterium
ASTGR

SEQ ID NO: 1193998 - protein, 8 aa, Mycobacterium
ASTGTREF

SEQ ID NO: 1193999 - protein, 5 aa, Mycobacterium
ASTLE

SEQ ID NO: 1194000 - protein, 12 aa, Mycobacterium
ASTNCEVRIVTV

SEQ ID NO: 1194001 - protein, 14 aa, Mycobacterium
ASTNPSLDPKAPQV

SEQ ID NO: 1194002 - protein, 16 aa, Mycobacterium
ASTPDGIDGTQPGGVY

SEQ ID NO: 1194003 - protein, 7 aa, Mycobacterium
ASTPDRD

SEQ ID NO: 1194004 - protein, 6 aa, Mycobacterium
ASTPHQ

SEQ ID NO: 1194005 - protein, 6 aa, Mycobacterium
ASTPLG

SEQ ID NO: 1194006 - protein, 9 aa, Mycobacterium
ASTPSPGMR

SEQ ID NO: 1194007 - protein, 5 aa, Mycobacterium
ASTPV

SEQ ID NO: 1194008 - protein, 9 aa, Mycobacterium
ASTSDPAIE

SEQ ID NO: 1194009 - protein, 10 aa, Mycobacterium
ASTSEDPDGL

SEQ ID NO: 1194010 - protein, 17 aa, Mycobacterium
ASTSGEMREAAAKILRK

SEQ ID NO: 1194011 - protein, 8 aa, Mycobacterium
ASTSQATV

SEQ ID NO: 1194012 - protein, 5 aa, Mycobacterium
ASTSR

SEQ ID NO: 1194013 - protein, 7 aa, Mycobacterium
ASTSSSK

SEQ ID NO: 1194014 - protein, 7 aa, Mycobacterium
ASTSSTH

SEQ ID NO: 1194015 - protein, 20 aa, Mycobacterium
ASTSVASTRRSRAKSDRRSQ

SEQ ID NO: 1194016 - protein, 11 aa, Mycobacterium
ASTTGLPDGSA

SEQ ID NO: 1194017 - protein, 18 aa, Mycobacterium
ASTVEEGGRMSDVTDEAV

SEQ ID NO: 1194018 - protein, 20 aa, Mycobacterium
ASTVGVPARNAPVSVPEARV

SEQ ID NO: 1194019 - protein, 5 aa, Mycobacterium
ASTVP

SEQ ID NO: 1194020 - protein, 14 aa, Mycobacterium
ASVAARATFDPALV

SEQ ID NO: 1194021 - protein, 6 aa, Mycobacterium
ASVAPG

SEQ ID NO: 1194022 - protein, 5 aa, Mycobacterium
ASVDE

SEQ ID NO: 1194023 - protein, 10 aa, Mycobacterium
ASVGPGDGIG

SEQ ID NO: 1194024 - protein, 7 aa, Mycobacterium
ASVGTTR

SEQ ID NO: 1194025 - protein, 9 aa, Mycobacterium
ASVPPSPLT

SEQ ID NO: 1194026 - protein, 9 aa, Mycobacterium
ASVPRNRAG

SEQ ID NO: 1194027 - protein, 11 aa, Mycobacterium
ASVSATAAEAA

SEQ ID NO: 1194028 - protein, 12 aa, Mycobacterium
ASVSNGQKRWDA

SEQ ID NO: 1194029 - protein, 11 aa, Mycobacterium
ASVSSKVGAAR

SEQ ID NO: 1194030 - protein, 7 aa, Mycobacterium
ASVTDAE

SEQ ID NO: 1194031 - protein, 5 aa, Mycobacterium
ASVTK

SEQ ID NO: 1194032 - protein, 9 aa, Mycobacterium
ASVTPPGQM

SEQ ID NO: 1194033 - protein, 6 aa, Mycobacterium
ASVTYA

SEQ ID NO: 1194034 - protein, 14 aa, Mycobacterium
ASVYAASKKALEAL

SEQ ID NO: 1194035 - protein, 11 aa, Mycobacterium
ASWAPAAGKPL

SEQ ID NO: 1194036 - protein, 15 aa, Mycobacterium
ASWPNRTEPGGTRGL

SEQ ID NO: 1194037 - protein, 9 aa, Mycobacterium
ASWTEPKGG

SEQ ID NO: 1194038 - protein, 13 aa, Mycobacterium
ASYAPRSGGRATL

SEQ ID NO: 1194039 - protein, 14 aa, Mycobacterium
ASYARGGEKTPEGL

SEQ ID NO: 1194040 - protein, 4 aa, Mycobacterium
ASYG

SEQ ID NO: 1194041 - protein, 6 aa, Mycobacterium
ASYGQP

SEQ ID NO: 1194042 - protein, 5 aa, Mycobacterium
ASYIT

SEQ ID NO: 1194043 - protein, 11 aa, Mycobacterium
ASYNEDSKEIT

SEQ ID NO: 1194044 - protein, 17 aa, Mycobacterium
ASYPGPGVPDAGFSGAT

SEQ ID NO: 1194045 - protein, 7 aa, Mycobacterium
ASYQRQR

SEQ ID NO: 1194046 - protein, 4 aa, Mycobacterium
ASYV

SEQ ID NO: 1194047 - protein, 4 aa, Mycobacterium
ASYY

SEQ ID NO: 1194048 - protein, 4 aa, Mycobacterium
ATAA

SEQ ID NO: 1194049 - protein, 33 aa, Mycobacterium
ATAAAGTTGTTGRGPGTAAGAGATAGTGTATGA

SEQ ID NO: 1194050 - protein, 12 aa, Mycobacterium
ATAAALDEGDLD

SEQ ID NO: 1194051 - protein, 10 aa, Mycobacterium
ATAADDTPVR

SEQ ID NO: 1194052 - protein, 8 aa, Mycobacterium
ATAAESHT

SEQ ID NO: 1194053 - protein, 9 aa, Mycobacterium
ATAAGAPDG

SEQ ID NO: 1194054 - protein, 21 aa, Mycobacterium
ATAAGAYTMTNGTAKAPAETV

SEQ ID NO: 1194055 - protein, 17 aa, Mycobacterium
ATAAIGAGRYQRTEGRA

SEQ ID NO: 1194056 - protein, 19 aa, Mycobacterium
ATAAPAAGTRQVRSAADHV

SEQ ID NO: 1194057 - protein, 9 aa, Mycobacterium
ATAAPGVVE

SEQ ID NO: 1194058 - protein, 8 aa, Mycobacterium
ATAAQTVE

SEQ ID NO: 1194059 - protein, 10 aa, Mycobacterium
ATAATEGSGD

SEQ ID NO: 1194060 - protein, 19 aa, Mycobacterium
ATAATSAEPTTATTAVEPA

SEQ ID NO: 1194061 - protein, 4 aa, Mycobacterium
ATAD

SEQ ID NO: 1194062 - protein, 11 aa, Mycobacterium
ATADDSTKTLT

SEQ ID NO: 1194063 - protein, 7 aa, Mycobacterium
ATADERR

SEQ ID NO: 1194064 - protein, 8 aa, Mycobacterium
ATADHLSG

SEQ ID NO: 1194065 - protein, 9 aa, Mycobacterium
ATADPRDPR

SEQ ID NO: 1194066 - protein, 9 aa, Mycobacterium
ATAEDGEDQ

SEQ ID NO: 1194067 - protein, 8 aa, Mycobacterium
ATAEEAAK

SEQ ID NO: 1194068 - protein, 9 aa, Mycobacterium
ATAEGGTVL

SEQ ID NO: 1194069 - protein, 5 aa, Mycobacterium
ATAEQ

SEQ ID NO: 1194070 - protein, 6 aa, Mycobacterium
ATAEQV

SEQ ID NO: 1194071 - protein, 8 aa, Mycobacterium
ATAERRSP

SEQ ID NO: 1194072 - protein, 7 aa, Mycobacterium
ATAETAQ

SEQ ID NO: 1194073 - protein, 9 aa, Mycobacterium
ATAEVPESR

SEQ ID NO: 1194074 - protein, 6 aa, Mycobacterium
ATAGAD

SEQ ID NO: 1194075 - protein, 7 aa, Mycobacterium
ATAGASV

SEQ ID NO: 1194076 - protein, 10 aa, Mycobacterium
ATAGDGMAEQ

SEQ ID NO: 1194077 - protein, 13 aa, Mycobacterium
ATAGELGGADNAT

SEQ ID NO: 1194078 - protein, 9 aa, Mycobacterium
ATAGGAGRA

SEQ ID NO: 1194079 - protein, 7 aa, Mycobacterium
ATAGPVS

SEQ ID NO: 1194080 - protein, 6 aa, Mycobacterium
ATAGRM

SEQ ID NO: 1194081 - protein, 6 aa, Mycobacterium
ATAIAK

SEQ ID NO: 1194082 - protein, 6 aa, Mycobacterium
ATAKSM

SEQ ID NO: 1194083 - protein, 9 aa, Mycobacterium
ATALADPSC

SEQ ID NO: 1194084 - protein, 12 aa, Mycobacterium
ATALREDTDALD

SEQ ID NO: 1194085 - protein, 9 aa, Mycobacterium
ATAPAPPEL

SEQ ID NO: 1194086 - protein, 6 aa, Mycobacterium
ATAPDD

SEQ ID NO: 1194087 - protein, 7 aa, Mycobacterium
ATAPDGR

SEQ ID NO: 1194088 - protein, 7 aa, Mycobacterium
ATAPDIE

SEQ ID NO: 1194089 - protein, 14 aa, Mycobacterium
ATAPDLDTTPDTRI

SEQ ID NO: 1194090 - protein, 5 aa, Mycobacterium
ATAPG

SEQ ID NO: 1194091 - protein, 18 aa, Mycobacterium
ATAPGADPSITQTDETTA

SEQ ID NO: 1194092 - protein, 8 aa, Mycobacterium
ATAPGRRA

SEQ ID NO: 1194093 - protein, 7 aa, Mycobacterium
ATAPTAG

SEQ ID NO: 1194094 - protein, 5 aa, Mycobacterium
ATAPV

SEQ ID NO: 1194095 - protein, 17 aa, Mycobacterium
ATAPVDGGEEATTPADD

SEQ ID NO: 1194096 - protein, 7 aa, Mycobacterium
ATAQDPI

SEQ ID NO: 1194097 - protein, 7 aa, Mycobacterium
ATAQNGR

SEQ ID NO: 1194098 - protein, 14 aa, Mycobacterium
ATAQTSMDALGGPQ

SEQ ID NO: 1194099 - protein, 4 aa, Mycobacterium
ATAR

SEQ ID NO: 1194100 - protein, 10 aa, Mycobacterium
ATARHSGVPV

SEQ ID NO: 1194101 - protein, 7 aa, Mycobacterium
ATARNGR

SEQ ID NO: 1194102 - protein, 9 aa, Mycobacterium
ATARSARVA

SEQ ID NO: 1194103 - protein, 6 aa, Mycobacterium
ATASFS

SEQ ID NO: 1194104 - protein, 5 aa, Mycobacterium
ATASG

SEQ ID NO: 1194105 - protein, 5 aa, Mycobacterium
ATASR

SEQ ID NO: 1194106 - protein, 5 aa, Mycobacterium
ATASS

SEQ ID NO: 1194107 - protein, 9 aa, Mycobacterium
ATASSYERM

SEQ ID NO: 1194108 - protein, 7 aa, Mycobacterium
ATASTTV

SEQ ID NO: 1194109 - protein, 7 aa, Mycobacterium
ATATAKP

SEQ ID NO: 1194110 - protein, 7 aa, Mycobacterium
ATATAQA

SEQ ID NO: 1194111 - protein, 6 aa, Mycobacterium
ATATDL

SEQ ID NO: 1194112 - protein, 6 aa, Mycobacterium
ATATEW

SEQ ID NO: 1194113 - protein, 8 aa, Mycobacterium
ATATNRAP

SEQ ID NO: 1194114 - protein, 9 aa, Mycobacterium
ATATPAERS

SEQ ID NO: 1194115 - protein, 7 aa, Mycobacterium
ATATPQV

SEQ ID NO: 1194116 - protein, 7 aa, Mycobacterium
ATATTMP

SEQ ID NO: 1194117 - protein, 9 aa, Mycobacterium
ATATTRAEN

SEQ ID NO: 1194118 - protein, 6 aa, Mycobacterium
ATAVEP

SEQ ID NO: 1194119 - protein, 7 aa, Mycobacterium
ATAVERA

SEQ ID NO: 1194120 - protein, 23 aa, Mycobacterium
ATAVQSARHDQEPVRVQIDPLHI

SEQ ID NO: 1194121 - protein, 14 aa, Mycobacterium
ATAVRTPGGYRLTG

SEQ ID NO: 1194122 - protein, 12 aa, Mycobacterium
ATAVSDDDLGDG

SEQ ID NO: 1194123 - protein, 4 aa, Mycobacterium
ATCG

SEQ ID NO: 1194124 - protein, 10 aa, Mycobacterium
ATCTEPKARV

SEQ ID NO: 1194125 - protein, 10 aa, Mycobacterium
ATDAAGQRAL

SEQ ID NO: 1194126 - protein, 17 aa, Mycobacterium
ATDAAPSPADASAAKVY

SEQ ID NO: 1194127 - protein, 5 aa, Mycobacterium
ATDAD

SEQ ID NO: 1194128 - protein, 6 aa, Mycobacterium
ATDAEA

SEQ ID NO: 1194129 - protein, 7 aa, Mycobacterium
ATDAEAT

SEQ ID NO: 1194130 - protein, 6 aa, Mycobacterium
ATDAEE

SEQ ID NO: 1194131 - protein, 20 aa, Mycobacterium
ATDAPAGSSAFDEPESAETA

SEQ ID NO: 1194132 - protein, 15 aa, Mycobacterium
ATDAPGGSKRGSPIG

SEQ ID NO: 1194133 - protein, 6 aa, Mycobacterium
ATDAQF

SEQ ID NO: 1194134 - protein, 8 aa, Mycobacterium
ATDDMAGE

SEQ ID NO: 1194135 - protein, 9 aa, Mycobacterium
ATDDTTVPC

SEQ ID NO: 1194136 - protein, 5 aa, Mycobacterium
ATDDV

SEQ ID NO: 1194137 - protein, 5 aa, Mycobacterium
ATDEF

SEQ ID NO: 1194138 - protein, 5 aa, Mycobacterium
ATDER

SEQ ID NO: 1194139 - protein, 24 aa, Mycobacterium
ATDESAWDAADPSAVTAQQQAARD

SEQ ID NO: 1194140 - protein, 5 aa, Mycobacterium
ATDGD

SEQ ID NO: 1194141 - protein, 8 aa, Mycobacterium
ATDGELSA

SEQ ID NO: 1194142 - protein, 8 aa, Mycobacterium
ATDGHDAR

SEQ ID NO: 1194143 - protein, 6 aa, Mycobacterium
ATDGLR

SEQ ID NO: 1194144 - protein, 5 aa, Mycobacterium
ATDKQ

SEQ ID NO: 1194145 - protein, 9 aa, Mycobacterium
ATDPANPYG

SEQ ID NO: 1194146 - protein, 13 aa, Mycobacterium
ATDPDDGPPAPLR

SEQ ID NO: 1194147 - protein, 11 aa, Mycobacterium
ATDPEAAKAPT

SEQ ID NO: 1194148 - protein, 7 aa, Mycobacterium
ATDPEAV

SEQ ID NO: 1194149 - protein, 10 aa, Mycobacterium
ATDPELDPDR

SEQ ID NO: 1194150 - protein, 15 aa, Mycobacterium
ATDPETGRPLTDEEI

SEQ ID NO: 1194151 - protein, 7 aa, Mycobacterium
ATDPGSL

SEQ ID NO: 1194152 - protein, 7 aa, Mycobacterium
ATDPLTR

SEQ ID NO: 1194153 - protein, 9 aa, Mycobacterium
ATDPNGDPL

SEQ ID NO: 1194154 - protein, 7 aa, Mycobacterium
ATDPRVR

SEQ ID NO: 1194155 - protein, 10 aa, Mycobacterium
ATDPSPAAQV

SEQ ID NO: 1194156 - protein, 8 aa, Mycobacterium
ATDPSSHR

SEQ ID NO: 1194157 - protein, 9 aa, Mycobacterium
ATDQISGRI

SEQ ID NO: 1194158 - protein, 4 aa, Mycobacterium
ATDR

SEQ ID NO: 1194159 - protein, 10 aa, Mycobacterium
ATDRAAEGER

SEQ ID NO: 1194160 - protein, 10 aa, Mycobacterium
ATDRADAGHQ

SEQ ID NO: 1194161 - protein, 8 aa, Mycobacterium
ATDRASAF

SEQ ID NO: 1194162 - protein, 12 aa, Mycobacterium
ATDRAVRGDERE

SEQ ID NO: 1194163 - protein, 5 aa, Mycobacterium
ATDRG

SEQ ID NO: 1194164 - protein, 7 aa, Mycobacterium
ATDRGVD

SEQ ID NO: 1194165 - protein, 11 aa, Mycobacterium
ATDRRRRPSAK

SEQ ID NO: 1194166 - protein, 10 aa, Mycobacterium
ATDRTGALSP

SEQ ID NO: 1194167 - protein, 10 aa, Mycobacterium
ATDSAGSSAH

SEQ ID NO: 1194168 - protein, 8 aa, Mycobacterium
ATDTNERA

SEQ ID NO: 1194169 - protein, 7 aa, Mycobacterium
ATDTPVL

SEQ ID NO: 1194170 - protein, 15 aa, Mycobacterium
ATDTRPDELKTQGVR

SEQ ID NO: 1194171 - protein, 19 aa, Mycobacterium
ATDVDDDKRLRAARKDNKV

SEQ ID NO: 1194172 - protein, 5 aa, Mycobacterium
ATEAA

SEQ ID NO: 1194173 - protein, 50 aa, Mycobacterium
ATEAAEEDAETRDGDMAQSADATGSAAPVRGPTSEPSPSARALAPSVDQE

SEQ ID NO: 1194174 - protein, 10 aa, Mycobacterium
ATEAGASEVT

SEQ ID NO: 1194175 - protein, 7 aa, Mycobacterium
ATEAQRQ

SEQ ID NO: 1194176 - protein, 7 aa, Mycobacterium
ATEARTG

SEQ ID NO: 1194177 - protein, 19 aa, Mycobacterium
ATEATRAALSDTGADTGAV

SEQ ID NO: 1194178 - protein, 10 aa, Mycobacterium
ATEAYPSRTD

SEQ ID NO: 1194179 - protein, 5 aa, Mycobacterium
ATEDA

SEQ ID NO: 1194180 - protein, 7 aa, Mycobacterium
ATEDAEA

SEQ ID NO: 1194181 - protein, 17 aa, Mycobacterium
ATEDPVPSVPPGTHGGN

SEQ ID NO: 1194182 - protein, 6 aa, Mycobacterium
ATEEAA

SEQ ID NO: 1194183 - protein, 6 aa, Mycobacterium
ATEERF

SEQ ID NO: 1194184 - protein, 7 aa, Mycobacterium
ATEEVGQ

SEQ ID NO: 1194185 - protein, 7 aa, Mycobacterium
ATEGLDT

SEQ ID NO: 1194186 - protein, 6 aa, Mycobacterium
ATEGQL

SEQ ID NO: 1194187 - protein, 8 aa, Mycobacterium
ATEGRDDG

SEQ ID NO: 1194188 - protein, 6 aa, Mycobacterium
ATEHKD

SEQ ID NO: 1194189 - protein, 15 aa, Mycobacterium
ATEHPAGSGTAESLN

SEQ ID NO: 1194190 - protein, 8 aa, Mycobacterium
ATEKRDMA

SEQ ID NO: 1194191 - protein, 10 aa, Mycobacterium
ATEKRPADAA

SEQ ID NO: 1194192 - protein, 4 aa, Mycobacterium
ATEN

SEQ ID NO: 1194193 - protein, 8 aa, Mycobacterium
ATENPEHE

SEQ ID NO: 1194194 - protein, 9 aa, Mycobacterium
ATENSPRCN

SEQ ID NO: 1194195 - protein, 6 aa, Mycobacterium
ATEPDY

SEQ ID NO: 1194196 - protein, 6 aa, Mycobacterium
ATEPGV

SEQ ID NO: 1194197 - protein, 14 aa, Mycobacterium
ATEPQSQPAPPVRA

SEQ ID NO: 1194198 - protein, 8 aa, Mycobacterium
ATEPTAEV

SEQ ID NO: 1194199 - protein, 8 aa, Mycobacterium
ATEPTSGE

SEQ ID NO: 1194200 - protein, 5 aa, Mycobacterium
ATEQT

SEQ ID NO: 1194201 - protein, 11 aa, Mycobacterium
ATERDSAQARL

SEQ ID NO: 1194202 - protein, 7 aa, Mycobacterium
ATERNGG

SEQ ID NO: 1194203 - protein, 6 aa, Mycobacterium
ATERPN

SEQ ID NO: 1194204 - protein, 6 aa, Mycobacterium
ATESCT

SEQ ID NO: 1194205 - protein, 8 aa, Mycobacterium
ATESERVD

SEQ ID NO: 1194206 - protein, 7 aa, Mycobacterium
ATESLRR

SEQ ID NO: 1194207 - protein, 8 aa, Mycobacterium
ATETGAPL

SEQ ID NO: 1194208 - protein, 9 aa, Mycobacterium
ATETGTPVT

SEQ ID NO: 1194209 - protein, 6 aa, Mycobacterium
ATETQH

SEQ ID NO: 1194210 - protein, 7 aa, Mycobacterium
ATEVPAE

SEQ ID NO: 1194211 - protein, 6 aa, Mycobacterium
ATEYTQ

SEQ ID NO: 1194212 - protein, 11 aa, Mycobacterium
ATFASGDRLDA

SEQ ID NO: 1194213 - protein, 5 aa, Mycobacterium
ATFDE

SEQ ID NO: 1194214 - protein, 4 aa, Mycobacterium
ATFT

SEQ ID NO: 1194215 - protein, 13 aa, Mycobacterium
ATFTDDAAKEAAH

SEQ ID NO: 1194216 - protein, 15 aa, Mycobacterium
ATFTPGKRLGPGLDE

SEQ ID NO: 1194217 - protein, 10 aa, Mycobacterium
ATGAARRNRG

SEQ ID NO: 1194218 - protein, 13 aa, Mycobacterium
ATGADLRDEAAQD

SEQ ID NO: 1194219 - protein, 9 aa, Mycobacterium
ATGADLRHE

SEQ ID NO: 1194220 - protein, 16 aa, Mycobacterium
ATGADRAPARGRPAPR

SEQ ID NO: 1194221 - protein, 8 aa, Mycobacterium
ATGAETVA

SEQ ID NO: 1194222 - protein, 16 aa, Mycobacterium
ATGAGEATGDVTVGEE

SEQ ID NO: 1194223 - protein, 12 aa, Mycobacterium
ATGAGGAALGSP

SEQ ID NO: 1194224 - protein, 8 aa, Mycobacterium
ATGAGKGS

SEQ ID NO: 1194225 - protein, 6 aa, Mycobacterium
ATGAHT

SEQ ID NO: 1194226 - protein, 10 aa, Mycobacterium
ATGAKEAPFT

SEQ ID NO: 1194227 - protein, 10 aa, Mycobacterium
ATGAPTAAHS

SEQ ID NO: 1194228 - protein, 5 aa, Mycobacterium
ATGAT

SEQ ID NO: 1194229 - protein, 8 aa, Mycobacterium
ATGATGKP

SEQ ID NO: 1194230 - protein, 7 aa, Mycobacterium
ATGAVRP

SEQ ID NO: 1194231 - protein, 8 aa, Mycobacterium
ATGDDKAN

SEQ ID NO: 1194232 - protein, 5 aa, Mycobacterium
ATGDG

SEQ ID NO: 1194233 - protein, 5 aa, Mycobacterium
ATGDL

SEQ ID NO: 1194234 - protein, 5 aa, Mycobacterium
ATGDM

SEQ ID NO: 1194235 - protein, 6 aa, Mycobacterium
ATGDPT

SEQ ID NO: 1194236 - protein, 11 aa, Mycobacterium
ATGDRTKGNAV

SEQ ID NO: 1194237 - protein, 4 aa, Mycobacterium
ATGE

SEQ ID NO: 1194238 - protein, 5 aa, Mycobacterium
ATGEA

SEQ ID NO: 1194239 - protein, 6 aa, Mycobacterium
ATGEAS

SEQ ID NO: 1194240 - protein, 5 aa, Mycobacterium
ATGEE

SEQ ID NO: 1194241 - protein, 16 aa, Mycobacterium
ATGEGRDGHGRTSDGR

SEQ ID NO: 1194242 - protein, 6 aa, Mycobacterium
ATGEPI

SEQ ID NO: 1194243 - protein, 5 aa, Mycobacterium
ATGEQ

SEQ ID NO: 1194244 - protein, 8 aa, Mycobacterium
ATGERRQL

SEQ ID NO: 1194245 - protein, 9 aa, Mycobacterium
ATGERTAGV

SEQ ID NO: 1194246 - protein, 24 aa, Mycobacterium
ATGFSARAAEHQSVAAQGVEELGR

SEQ ID NO: 1194247 - protein, 5 aa, Mycobacterium
ATGGA

SEQ ID NO: 1194248 - protein, 5 aa, Mycobacterium
ATGGG

SEQ ID NO: 1194249 - protein, 9 aa, Mycobacterium
ATGGGSPAF

SEQ ID NO: 1194250 - protein, 7 aa, Mycobacterium
ATGGVGS

SEQ ID NO: 1194251 - protein, 7 aa, Mycobacterium
ATGGYTR

SEQ ID NO: 1194252 - protein, 7 aa, Mycobacterium
ATGHGAV

SEQ ID NO: 1194253 - protein, 5 aa, Mycobacterium
ATGHV

SEQ ID NO: 1194254 - protein, 4 aa, Mycobacterium
ATGI

SEQ ID NO: 1194255 - protein, 8 aa, Mycobacterium
ATGIDTAA

SEQ ID NO: 1194256 - protein, 9 aa, Mycobacterium
ATGITTAEG

SEQ ID NO: 1194257 - protein, 21 aa, Mycobacterium
ATGITTSGSRGRPAELFRRVG

SEQ ID NO: 1194258 - protein, 5 aa, Mycobacterium
ATGKE

SEQ ID NO: 1194259 - protein, 6 aa, Mycobacterium
ATGKGA

SEQ ID NO: 1194260 - protein, 22 aa, Mycobacterium
ATGKSWTGVTSAGVSGSWDGEA

SEQ ID NO: 1194261 - protein, 6 aa, Mycobacterium
ATGLDR

SEQ ID NO: 1194262 - protein, 7 aa, Mycobacterium
ATGLPTA

SEQ ID NO: 1194263 - protein, 5 aa, Mycobacterium
ATGMG

SEQ ID NO: 1194264 - protein, 21 aa, Mycobacterium
ATGMIGDPRDTGERTLQTADT

SEQ ID NO: 1194265 - protein, 21 aa, Mycobacterium
ATGMIGDPRDVGERTLNTADT

SEQ ID NO: 1194266 - protein, 9 aa, Mycobacterium
ATGNTTGKV

SEQ ID NO: 1194267 - protein, 10 aa, Mycobacterium
ATGPAPPLRG

SEQ ID NO: 1194268 - protein, 20 aa, Mycobacterium
ATGPHADLAGTAAALRESGA

SEQ ID NO: 1194269 - protein, 20 aa, Mycobacterium
ATGPHPSPAEAADELRRRGA

SEQ ID NO: 1194270 - protein, 6 aa, Mycobacterium
ATGPQQ

SEQ ID NO: 1194271 - protein, 5 aa, Mycobacterium
ATGPV

SEQ ID NO: 1194272 - protein, 6 aa, Mycobacterium
ATGQGL

SEQ ID NO: 1194273 - protein, 6 aa, Mycobacterium
ATGQVV

SEQ ID NO: 1194274 - protein, 9 aa, Mycobacterium
ATGRDHDRL

SEQ ID NO: 1194275 - protein, 7 aa, Mycobacterium
ATGRRNL

SEQ ID NO: 1194276 - protein, 6 aa, Mycobacterium
ATGRRR

SEQ ID NO: 1194277 - protein, 5 aa, Mycobacterium
ATGRS

SEQ ID NO: 1194278 - protein, 6 aa, Mycobacterium
ATGRSI

SEQ ID NO: 1194279 - protein, 15 aa, Mycobacterium
ATGRSSDFAAAPARG

SEQ ID NO: 1194280 - protein, 13 aa, Mycobacterium
ATGRTRGDFTTSY

SEQ ID NO: 1194281 - protein, 7 aa, Mycobacterium
ATGRTRS

SEQ ID NO: 1194282 - protein, 10 aa, Mycobacterium
ATGSAPGTTF

SEQ ID NO: 1194283 - protein, 7 aa, Mycobacterium
ATGSATY

SEQ ID NO: 1194284 - protein, 11 aa, Mycobacterium
ATGSDDDHAST

SEQ ID NO: 1194285 - protein, 7 aa, Mycobacterium
ATGSDSV

SEQ ID NO: 1194286 - protein, 8 aa, Mycobacterium
ATGSPSRR

SEQ ID NO: 1194287 - protein, 8 aa, Mycobacterium
ATGSRDIE

SEQ ID NO: 1194288 - protein, 6 aa, Mycobacterium
ATGSSL

SEQ ID NO: 1194289 - protein, 15 aa, Mycobacterium
ATGSSTRLVPGTSLS

SEQ ID NO: 1194290 - protein, 6 aa, Mycobacterium
ATGSSV

SEQ ID NO: 1194291 - protein, 10 aa, Mycobacterium
ATGSSVSPPL

SEQ ID NO: 1194292 - protein, 6 aa, Mycobacterium
ATGSTA

SEQ ID NO: 1194293 - protein, 6 aa, Mycobacterium
ATGTAS

SEQ ID NO: 1194294 - protein, 12 aa, Mycobacterium
ATGTDADRQSIR

SEQ ID NO: 1194295 - protein, 16 aa, Mycobacterium
ATGTPEDVAANPDSYT

SEQ ID NO: 1194296 - protein, 10 aa, Mycobacterium
ATGTRAHSAR

SEQ ID NO: 1194297 - protein, 4 aa, Mycobacterium
ATGV

SEQ ID NO: 1194298 - protein, 14 aa, Mycobacterium
ATGVDESDELGTTA

SEQ ID NO: 1194299 - protein, 9 aa, Mycobacterium
ATGVGGDAG

SEQ ID NO: 1194300 - protein, 6 aa, Mycobacterium
ATGVPA

SEQ ID NO: 1194301 - protein, 9 aa, Mycobacterium
ATGVPRQDR

SEQ ID NO: 1194302 - protein, 11 aa, Mycobacterium
ATGVPRQDRYP

SEQ ID NO: 1194303 - protein, 6 aa, Mycobacterium
ATGVRE

SEQ ID NO: 1194304 - protein, 21 aa, Mycobacterium
ATGVTTSGSRGRPAELFRRAG

SEQ ID NO: 1194305 - protein, 9 aa, Mycobacterium
ATGYRAKGN

SEQ ID NO: 1194306 - protein, 5 aa, Mycobacterium
ATHAD

SEQ ID NO: 1194307 - protein, 6 aa, Mycobacterium
ATHAPH

SEQ ID NO: 1194308 - protein, 4 aa, Mycobacterium
ATHG

SEQ ID NO: 1194309 - protein, 6 aa, Mycobacterium
ATHPEV

SEQ ID NO: 1194310 - protein, 4 aa, Mycobacterium
ATHS

SEQ ID NO: 1194311 - protein, 13 aa, Mycobacterium
ATHSRGTVAGTAT

SEQ ID NO: 1194312 - protein, 12 aa, Mycobacterium
ATHTAANWDDAK

SEQ ID NO: 1194313 - protein, 15 aa, Mycobacterium
ATHTPDGRPRARGAG

SEQ ID NO: 1194314 - protein, 14 aa, Mycobacterium
ATHTSRPPHTAHHG

SEQ ID NO: 1194315 - protein, 8 aa, Mycobacterium
ATIATDEL

SEQ ID NO: 1194316 - protein, 6 aa, Mycobacterium
ATIDPD

SEQ ID NO: 1194317 - protein, 5 aa, Mycobacterium
ATIPA

SEQ ID NO: 1194318 - protein, 8 aa, Mycobacterium
ATKAELGE

SEQ ID NO: 1194319 - protein, 13 aa, Mycobacterium
ATKAGRKALAEDR

SEQ ID NO: 1194320 - protein, 7 aa, Mycobacterium
ATKAQYE

SEQ ID NO: 1194321 - protein, 22 aa, Mycobacterium
ATKAREEATSTSADEDGDDEAA

SEQ ID NO: 1194322 - protein, 19 aa, Mycobacterium
ATKGQADAARVRELVMAAC

SEQ ID NO: 1194323 - protein, 5 aa, Mycobacterium
ATKHH

SEQ ID NO: 1194324 - protein, 16 aa, Mycobacterium
ATKITDNVAPQPINES

SEQ ID NO: 1194325 - protein, 11 aa, Mycobacterium
ATKLGTRTRYE

SEQ ID NO: 1194326 - protein, 7 aa, Mycobacterium
ATKNPSR

SEQ ID NO: 1194327 - protein, 7 aa, Mycobacterium
ATKPERL

SEQ ID NO: 1194328 - protein, 5 aa, Mycobacterium
ATKPK

SEQ ID NO: 1194329 - protein, 7 aa, Mycobacterium
ATLAPGL

SEQ ID NO: 1194330 - protein, 6 aa, Mycobacterium
ATLAQD

SEQ ID NO: 1194331 - protein, 5 aa, Mycobacterium
ATLDE

SEQ ID NO: 1194332 - protein, 11 aa, Mycobacterium
ATLENPSAAAD

SEQ ID NO: 1194333 - protein, 21 aa, Mycobacterium
ATLESREAKHEPRSLGEQRQE

SEQ ID NO: 1194334 - protein, 10 aa, Mycobacterium
ATLGDEHEQR

SEQ ID NO: 1194335 - protein, 6 aa, Mycobacterium
ATLGGD

SEQ ID NO: 1194336 - protein, 19 aa, Mycobacterium
ATLGNTEPAPVKPPEPVSA

SEQ ID NO: 1194337 - protein, 7 aa, Mycobacterium
ATLNPPY

SEQ ID NO: 1194338 - protein, 4 aa, Mycobacterium
ATLP

SEQ ID NO: 1194339 - protein, 10 aa, Mycobacterium
ATLPDPAPPL

SEQ ID NO: 1194340 - protein, 7 aa, Mycobacterium
ATLQGQS

SEQ ID NO: 1194341 - protein, 6 aa, Mycobacterium
ATLQTG

SEQ ID NO: 1194342 - protein, 15 aa, Mycobacterium
ATLRATSKTKSGGLV

SEQ ID NO: 1194343 - protein, 6 aa, Mycobacterium
ATLTPD

SEQ ID NO: 1194344 - protein, 32 aa, Mycobacterium
ATLYPPEGFGAPKNRHGHAAEGGLTGLPEGTE

SEQ ID NO: 1194345 - protein, 14 aa, Mycobacterium
ATMADPADAQRSSG

SEQ ID NO: 1194346 - protein, 6 aa, Mycobacterium
ATMTVP

SEQ ID NO: 1194347 - protein, 7 aa, Mycobacterium
ATNAGGQ

SEQ ID NO: 1194348 - protein, 7 aa, Mycobacterium
ATNATAA

SEQ ID NO: 1194349 - protein, 12 aa, Mycobacterium
ATNCAAPDTGNM

SEQ ID NO: 1194350 - protein, 4 aa, Mycobacterium
ATND

SEQ ID NO: 1194351 - protein, 7 aa, Mycobacterium
ATNDPRE

SEQ ID NO: 1194352 - protein, 11 aa, Mycobacterium
ATNEPKPFQDI

SEQ ID NO: 1194353 - protein, 8 aa, Mycobacterium
ATNGERRR

SEQ ID NO: 1194354 - protein, 9 aa, Mycobacterium
ATNGPPTQG

SEQ ID NO: 1194355 - protein, 7 aa, Mycobacterium
ATNGVGL

SEQ ID NO: 1194356 - protein, 7 aa, Mycobacterium
ATNHNTR

SEQ ID NO: 1194357 - protein, 9 aa, Mycobacterium
ATNPANAKQ

SEQ ID NO: 1194358 - protein, 6 aa, Mycobacterium
ATNPCG

SEQ ID NO: 1194359 - protein, 6 aa, Mycobacterium
ATNPKG

SEQ ID NO: 1194360 - protein, 6 aa, Mycobacterium
ATNPRD

SEQ ID NO: 1194361 - protein, 8 aa, Mycobacterium
ATNPVDRE

SEQ ID NO: 1194362 - protein, 5 aa, Mycobacterium
ATNRE

SEQ ID NO: 1194363 - protein, 5 aa, Mycobacterium
ATNTA

SEQ ID NO: 1194364 - protein, 4 aa, Mycobacterium
ATNW

SEQ ID NO: 1194365 - protein, 7 aa, Mycobacterium
ATPAGAT

SEQ ID NO: 1194366 - protein, 9 aa, Mycobacterium
ATPAGDGSV

SEQ ID NO: 1194367 - protein, 9 aa, Mycobacterium
ATPAGRAHP

SEQ ID NO: 1194368 - protein, 13 aa, Mycobacterium
ATPAGVTLIDPRL

SEQ ID NO: 1194369 - protein, 6 aa, Mycobacterium
ATPAHA

SEQ ID NO: 1194370 - protein, 40 aa, Mycobacterium
ATPAPPPAAPPTAVQPARTPDGPVATGPLAADERSRTDTV

SEQ ID NO: 1194371 - protein, 12 aa, Mycobacterium
ATPAQPAASPSG

SEQ ID NO: 1194372 - protein, 28 aa, Mycobacterium
ATPASGDESTIGEQRQSNPALTQDEQSY

SEQ ID NO: 1194373 - protein, 4 aa, Mycobacterium
ATPD

SEQ ID NO: 1194374 - protein, 7 aa, Mycobacterium
ATPDDLA

SEQ ID NO: 1194375 - protein, 6 aa, Mycobacterium
ATPDEL

SEQ ID NO: 1194376 - protein, 7 aa, Mycobacterium
ATPDENA

SEQ ID NO: 1194377 - protein, 6 aa, Mycobacterium
ATPDQL

SEQ ID NO: 1194378 - protein, 11 aa, Mycobacterium
ATPDRGRSAGS

SEQ ID NO: 1194379 - protein, 22 aa, Mycobacterium
ATPDSWNNNGHASQRLKQARPD

SEQ ID NO: 1194380 - protein, 4 aa, Mycobacterium
ATPE

SEQ ID NO: 1194381 - protein, 7 aa, Mycobacterium
ATPEDLD

SEQ ID NO: 1194382 - protein, 7 aa, Mycobacterium
ATPEDRD

SEQ ID NO: 1194383 - protein, 7 aa, Mycobacterium
ATPEEER

SEQ ID NO: 1194384 - protein, 5 aa, Mycobacterium
ATPEG

SEQ ID NO: 1194385 - protein, 5 aa, Mycobacterium
ATPGA

SEQ ID NO: 1194386 - protein, 10 aa, Mycobacterium
ATPGDAASLN

SEQ ID NO: 1194387 - protein, 6 aa, Mycobacterium
ATPGDL

SEQ ID NO: 1194388 - protein, 12 aa, Mycobacterium
ATPGGEGESSDR

SEQ ID NO: 1194389 - protein, 9 aa, Mycobacterium
ATPGNPHGA

SEQ ID NO: 1194390 - protein, 11 aa, Mycobacterium
ATPGPRDIANP

SEQ ID NO: 1194391 - protein, 7 aa, Mycobacterium
ATPGQIR

SEQ ID NO: 1194392 - protein, 5 aa, Mycobacterium
ATPGS

SEQ ID NO: 1194393 - protein, 19 aa, Mycobacterium
ATPGSPSKRELYDAVLRAR

SEQ ID NO: 1194394 - protein, 14 aa, Mycobacterium
ATPGSYELSQSGGE

SEQ ID NO: 1194395 - protein, 6 aa, Mycobacterium
ATPHAA

SEQ ID NO: 1194396 - protein, 20 aa, Mycobacterium
ATPHPESAAPITGATEPCET

SEQ ID NO: 1194397 - protein, 7 aa, Mycobacterium
ATPKAKT

SEQ ID NO: 1194398 - protein, 14 aa, Mycobacterium
ATPLGPGVDGRPRT

SEQ ID NO: 1194399 - protein, 5 aa, Mycobacterium
ATPNL

SEQ ID NO: 1194400 - protein, 10 aa, Mycobacterium
ATPPALPDGA

SEQ ID NO: 1194401 - protein, 6 aa, Mycobacterium
ATPPAV

SEQ ID NO: 1194402 - protein, 8 aa, Mycobacterium
ATPPDADG

SEQ ID NO: 1194403 - protein, 6 aa, Mycobacterium
ATPPEY

SEQ ID NO: 1194404 - protein, 4 aa, Mycobacterium
ATPQ

SEQ ID NO: 1194405 - protein, 13 aa, Mycobacterium
ATPQAGGSGDTWV

SEQ ID NO: 1194406 - protein, 6 aa, Mycobacterium
ATPQAV

SEQ ID NO: 1194407 - protein, 17 aa, Mycobacterium
ATPQEGRSLGVDPATGH

SEQ ID NO: 1194408 - protein, 6 aa, Mycobacterium
ATPQGR

SEQ ID NO: 1194409 - protein, 18 aa, Mycobacterium
ATPQGTSTISGALRSRDT

SEQ ID NO: 1194410 - protein, 7 aa, Mycobacterium
ATPQTSQ

SEQ ID NO: 1194411 - protein, 4 aa, Mycobacterium
ATPR

SEQ ID NO: 1194412 - protein, 21 aa, Mycobacterium
ATPRDLRAAPDTAGRPAEGTE

SEQ ID NO: 1194413 - protein, 10 aa, Mycobacterium
ATPRDNHASS

SEQ ID NO: 1194414 - protein, 7 aa, Mycobacterium
ATPREAV

SEQ ID NO: 1194415 - protein, 7 aa, Mycobacterium
ATPRGGQ

SEQ ID NO: 1194416 - protein, 26 aa, Mycobacterium
ATPRKRDDPRQGGRRRRSSCISPGGS

SEQ ID NO: 1194417 - protein, 5 aa, Mycobacterium
ATPRM

SEQ ID NO: 1194418 - protein, 6 aa, Mycobacterium
ATPRPL

SEQ ID NO: 1194419 - protein, 7 aa, Mycobacterium
ATPRSLT

SEQ ID NO: 1194420 - protein, 4 aa, Mycobacterium
ATPS

SEQ ID NO: 1194421 - protein, 5 aa, Mycobacterium
ATPSF

SEQ ID NO: 1194422 - protein, 14 aa, Mycobacterium
ATPSVDPTDRSARA

SEQ ID NO: 1194423 - protein, 17 aa, Mycobacterium
ATPSVPDSGPELGSGND

SEQ ID NO: 1194424 - protein, 9 aa, Mycobacterium
ATPTADPDA

SEQ ID NO: 1194425 - protein, 15 aa, Mycobacterium
ATPTEPSRAGRVGGT

SEQ ID NO: 1194426 - protein, 10 aa, Mycobacterium
ATPTRPATVT

SEQ ID NO: 1194427 - protein, 10 aa, Mycobacterium
ATPTSEPFET

SEQ ID NO: 1194428 - protein, 6 aa, Mycobacterium
ATPTTA

SEQ ID NO: 1194429 - protein, 19 aa, Mycobacterium
ATPTTGSAATPAPAALTPT

SEQ ID NO: 1194430 - protein, 5 aa, Mycobacterium
ATPVA

SEQ ID NO: 1194431 - protein, 12 aa, Mycobacterium
ATPVTDKKSIAQ

SEQ ID NO: 1194432 - protein, 4 aa, Mycobacterium
ATQA

SEQ ID NO: 1194433 - protein, 26 aa, Mycobacterium
ATQAEQAAGGAAGGDSAGASGANDDV

SEQ ID NO: 1194434 - protein, 9 aa, Mycobacterium
ATQAGGISA

SEQ ID NO: 1194435 - protein, 10 aa, Mycobacterium
ATQAGQRTVA

SEQ ID NO: 1194436 - protein, 11 aa, Mycobacterium
ATQEPAPNAAQ

SEQ ID NO: 1194437 - protein, 5 aa, Mycobacterium
ATQFD

SEQ ID NO: 1194438 - protein, 6 aa, Mycobacterium
ATQPDS

SEQ ID NO: 1194439 - protein, 6 aa, Mycobacterium
ATQRGE

SEQ ID NO: 1194440 - protein, 4 aa, Mycobacterium
ATQS

SEQ ID NO: 1194441 - protein, 16 aa, Mycobacterium
ATQSGQQWSGPDSGLR

SEQ ID NO: 1194442 - protein, 6 aa, Mycobacterium
ATQTPD

SEQ ID NO: 1194443 - protein, 5 aa, Mycobacterium
ATRAA

SEQ ID NO: 1194444 - protein, 9 aa, Mycobacterium
ATRAAGAHP

SEQ ID NO: 1194445 - protein, 10 aa, Mycobacterium
ATRAGGAHPY

SEQ ID NO: 1194446 - protein, 7 aa, Mycobacterium
ATRAGQR

SEQ ID NO: 1194447 - protein, 8 aa, Mycobacterium
ATRAPRPV

SEQ ID NO: 1194448 - protein, 11 aa, Mycobacterium
ATRARGRAGEA

SEQ ID NO: 1194449 - protein, 48 aa, Mycobacterium
ATRASAGVARSVGTLNSAGVSASVGTMNSAGVTGSIGTAGSAAVAGSA

SEQ ID NO: 1194450 - protein, 12 aa, Mycobacterium
ATRASKAQLQSM

SEQ ID NO: 1194451 - protein, 7 aa, Mycobacterium
ATRDEQR

SEQ ID NO: 1194452 - protein, 7 aa, Mycobacterium
ATRDGHD

SEQ ID NO: 1194453 - protein, 5 aa, Mycobacterium
ATRDV

SEQ ID NO: 1194454 - protein, 5 aa, Mycobacterium
ATRDY

SEQ ID NO: 1194455 - protein, 17 aa, Mycobacterium
ATREGRGWPSDPTLGET

SEQ ID NO: 1194456 - protein, 5 aa, Mycobacterium
ATREQ

SEQ ID NO: 1194457 - protein, 7 aa, Mycobacterium
ATREQQE

SEQ ID NO: 1194458 - protein, 20 aa, Mycobacterium
ATRGDEKLSTAAVGERILGK

SEQ ID NO: 1194459 - protein, 30 aa, Mycobacterium
ATRGEPETGDVERSDDWSDGQAREVGGNYR

SEQ ID NO: 1194460 - protein, 5 aa, Mycobacterium
ATRGL

SEQ ID NO: 1194461 - protein, 15 aa, Mycobacterium
ATRGLQEAIAAAAIP

SEQ ID NO: 1194462 - protein, 5 aa, Mycobacterium
ATRGW

SEQ ID NO: 1194463 - protein, 9 aa, Mycobacterium
ATRIDSGGA

SEQ ID NO: 1194464 - protein, 5 aa, Mycobacterium
ATRIR

SEQ ID NO: 1194465 - protein, 8 aa, Mycobacterium
ATRNSPSL

SEQ ID NO: 1194466 - protein, 5 aa, Mycobacterium
ATRPA

SEQ ID NO: 1194467 - protein, 5 aa, Mycobacterium
ATRPE

SEQ ID NO: 1194468 - protein, 6 aa, Mycobacterium
ATRPGS

SEQ ID NO: 1194469 - protein, 15 aa, Mycobacterium
ATRPLADAAAGQNDP

SEQ ID NO: 1194470 - protein, 5 aa, Mycobacterium
ATRPP

SEQ ID NO: 1194471 - protein, 4 aa, Mycobacterium
ATRQ

SEQ ID NO: 1194472 - protein, 8 aa, Mycobacterium
ATRQPDAA

SEQ ID NO: 1194473 - protein, 9 aa, Mycobacterium
ATRQPDGGW

SEQ ID NO: 1194474 - protein, 9 aa, Mycobacterium
ATRQQPDWD

SEQ ID NO: 1194475 - protein, 11 aa, Mycobacterium
ATRRDLQDPAT

SEQ ID NO: 1194476 - protein, 5 aa, Mycobacterium
ATRRE

SEQ ID NO: 1194477 - protein, 45 aa, Mycobacterium
ATRRPGGRPDRRGRPGDRRSGAHAGPGPGHGRRSAAHREGHRTRG

SEQ ID NO: 1194478 - protein, 10 aa, Mycobacterium
ATRRPQGIQG

SEQ ID NO: 1194479 - protein, 16 aa, Mycobacterium
ATRSHTMPRATASTDA

SEQ ID NO: 1194480 - protein, 4 aa, Mycobacterium
ATRT

SEQ ID NO: 1194481 - protein, 6 aa, Mycobacterium
ATRTAT

SEQ ID NO: 1194482 - protein, 7 aa, Mycobacterium
ATRTEGR

SEQ ID NO: 1194483 - protein, 8 aa, Mycobacterium
ATRTTGYA

SEQ ID NO: 1194484 - protein, 11 aa, Mycobacterium
ATRYPPEGVRG

SEQ ID NO: 1194485 - protein, 7 aa, Mycobacterium
ATRYTEL

SEQ ID NO: 1194486 - protein, 6 aa, Mycobacterium
ATSADF

SEQ ID NO: 1194487 - protein, 5 aa, Mycobacterium
ATSAG

SEQ ID NO: 1194488 - protein, 17 aa, Mycobacterium
ATSAKGSISEDPGPDLA

SEQ ID NO: 1194489 - protein, 20 aa, Mycobacterium
ATSAPGYSSIRPKDKAPVAE

SEQ ID NO: 1194490 - protein, 7 aa, Mycobacterium
ATSAPTA

SEQ ID NO: 1194491 - protein, 6 aa, Mycobacterium
ATSCAD

SEQ ID NO: 1194492 - protein, 14 aa, Mycobacterium
ATSDDAPETASERK

SEQ ID NO: 1194493 - protein, 7 aa, Mycobacterium
ATSDGPV

SEQ ID NO: 1194494 - protein, 6 aa, Mycobacterium
ATSDGT

SEQ ID NO: 1194495 - protein, 6 aa, Mycobacterium
ATSDLQ

SEQ ID NO: 1194496 - protein, 6 aa, Mycobacterium
ATSDPN

SEQ ID NO: 1194497 - protein, 7 aa, Mycobacterium
ATSEEVA

SEQ ID NO: 1194498 - protein, 13 aa, Mycobacterium
ATSEGRSPDGRVT

SEQ ID NO: 1194499 - protein, 7 aa, Mycobacterium
ATSEQAR

SEQ ID NO: 1194500 - protein, 7 aa, Mycobacterium
ATSESVR

SEQ ID NO: 1194501 - protein, 7 aa, Mycobacterium
ATSEVSG

SEQ ID NO: 1194502 - protein, 6 aa, Mycobacterium
ATSGEP

SEQ ID NO: 1194503 - protein, 8 aa, Mycobacterium
ATSGIGVE

SEQ ID NO: 1194504 - protein, 9 aa, Mycobacterium
ATSGKNQSR

SEQ ID NO: 1194505 - protein, 11 aa, Mycobacterium
ATSGPADEQNG

SEQ ID NO: 1194506 - protein, 6 aa, Mycobacterium
ATSGRV

SEQ ID NO: 1194507 - protein, 5 aa, Mycobacterium
ATSHP

SEQ ID NO: 1194508 - protein, 4 aa, Mycobacterium
ATSI

SEQ ID NO: 1194509 - protein, 12 aa, Mycobacterium
ATSLEQRGVRAG

SEQ ID NO: 1194510 - protein, 5 aa, Mycobacterium
ATSMT

SEQ ID NO: 1194511 - protein, 9 aa, Mycobacterium
ATSNPDAHE

SEQ ID NO: 1194512 - protein, 6 aa, Mycobacterium
ATSPAW

SEQ ID NO: 1194513 - protein, 7 aa, Mycobacterium
ATSPCSG

SEQ ID NO: 1194514 - protein, 5 aa, Mycobacterium
ATSPD

SEQ ID NO: 1194515 - protein, 7 aa, Mycobacterium
ATSPGAL

SEQ ID NO: 1194516 - protein, 5 aa, Mycobacterium
ATSPR

SEQ ID NO: 1194517 - protein, 12 aa, Mycobacterium
ATSPRYTDDERA

SEQ ID NO: 1194518 - protein, 13 aa, Mycobacterium
ATSQISYTASKGG

SEQ ID NO: 1194519 - protein, 20 aa, Mycobacterium
ATSRDTVRSAGRTGKPSRQL

SEQ ID NO: 1194520 - protein, 10 aa, Mycobacterium
ATSRGTQTRF

SEQ ID NO: 1194521 - protein, 9 aa, Mycobacterium
ATSSADQPV

SEQ ID NO: 1194522 - protein, 12 aa, Mycobacterium
ATSSKTNSPHGQ

SEQ ID NO: 1194523 - protein, 5 aa, Mycobacterium
ATSTI

SEQ ID NO: 1194524 - protein, 14 aa, Mycobacterium
ATSTTNADGSTAES

SEQ ID NO: 1194525 - protein, 12 aa, Mycobacterium
ATSVAERVGGAS

SEQ ID NO: 1194526 - protein, 12 aa, Mycobacterium
ATSYADNERAVQ

SEQ ID NO: 1194527 - protein, 8 aa, Mycobacterium
ATTAAHGR

SEQ ID NO: 1194528 - protein, 18 aa, Mycobacterium
ATTAAPEAAAGEAAAPEQ

SEQ ID NO: 1194529 - protein, 7 aa, Mycobacterium
ATTAEPV

SEQ ID NO: 1194530 - protein, 5 aa, Mycobacterium
ATTAG

SEQ ID NO: 1194531 - protein, 6 aa, Mycobacterium
ATTAGA

SEQ ID NO: 1194532 - protein, 52 aa, Mycobacterium
ATTAGMGGGIPSAPPPAPASPSPALSAGGGHAAPPVSAAPGGGVSPAGAQAG

SEQ ID NO: 1194533 - protein, 7 aa, Mycobacterium
ATTAQYQ

SEQ ID NO: 1194534 - protein, 14 aa, Mycobacterium
ATTASATNVTLSEN

SEQ ID NO: 1194535 - protein, 22 aa, Mycobacterium
ATTATDRNDRPTDPVVIESVTI

SEQ ID NO: 1194536 - protein, 9 aa, Mycobacterium
ATTDKDRAK

SEQ ID NO: 1194537 - protein, 14 aa, Mycobacterium
ATTDPADERPPQVP

SEQ ID NO: 1194538 - protein, 12 aa, Mycobacterium
ATTEDGERFSDE

SEQ ID NO: 1194539 - protein, 12 aa, Mycobacterium
ATTESGDDTAAK

SEQ ID NO: 1194540 - protein, 7 aa, Mycobacterium
ATTGAIT

SEQ ID NO: 1194541 - protein, 11 aa, Mycobacterium
ATTGDETTRRR

SEQ ID NO: 1194542 - protein, 19 aa, Mycobacterium
ATTGGGRASGQAAGGELSG

SEQ ID NO: 1194543 - protein, 5 aa, Mycobacterium
ATTGL

SEQ ID NO: 1194544 - protein, 14 aa, Mycobacterium
ATTGLRELALRDAG

SEQ ID NO: 1194545 - protein, 5 aa, Mycobacterium
ATTGR

SEQ ID NO: 1194546 - protein, 12 aa, Mycobacterium
ATTGTADTPSKV

SEQ ID NO: 1194547 - protein, 6 aa, Mycobacterium
ATTGWT

SEQ ID NO: 1194548 - protein, 4 aa, Mycobacterium
ATTI

SEQ ID NO: 1194549 - protein, 5 aa, Mycobacterium
ATTIE

SEQ ID NO: 1194550 - protein, 12 aa, Mycobacterium
ATTKRRSPGTGL

SEQ ID NO: 1194551 - protein, 4 aa, Mycobacterium
ATTL

SEQ ID NO: 1194552 - protein, 14 aa, Mycobacterium
ATTLTAKHLADYVR

SEQ ID NO: 1194553 - protein, 12 aa, Mycobacterium
ATTNPDGSTGDG

SEQ ID NO: 1194554 - protein, 8 aa, Mycobacterium
ATTPAATI

SEQ ID NO: 1194555 - protein, 11 aa, Mycobacterium
ATTPDVNGVSR

SEQ ID NO: 1194556 - protein, 6 aa, Mycobacterium
ATTPQG

SEQ ID NO: 1194557 - protein, 6 aa, Mycobacterium
ATTQAA

SEQ ID NO: 1194558 - protein, 6 aa, Mycobacterium
ATTQAQ

SEQ ID NO: 1194559 - protein, 7 aa, Mycobacterium
ATTQAQA

SEQ ID NO: 1194560 - protein, 12 aa, Mycobacterium
ATTRSGALTGPL

SEQ ID NO: 1194561 - protein, 10 aa, Mycobacterium
ATTRSKGGLA

SEQ ID NO: 1194562 - protein, 6 aa, Mycobacterium
ATTRTA

SEQ ID NO: 1194563 - protein, 4 aa, Mycobacterium
ATTS

SEQ ID NO: 1194564 - protein, 13 aa, Mycobacterium
ATTSADDANAAPI

SEQ ID NO: 1194565 - protein, 8 aa, Mycobacterium
ATTSFPNR

SEQ ID NO: 1194566 - protein, 9 aa, Mycobacterium
ATTSKLDDN

SEQ ID NO: 1194567 - protein, 5 aa, Mycobacterium
ATTSL

SEQ ID NO: 1194568 - protein, 7 aa, Mycobacterium
ATTSRAH

SEQ ID NO: 1194569 - protein, 9 aa, Mycobacterium
ATTSRGNVG

SEQ ID NO: 1194570 - protein, 7 aa, Mycobacterium
ATTTGMR

SEQ ID NO: 1194571 - protein, 6 aa, Mycobacterium
ATTTIA

SEQ ID NO: 1194572 - protein, 11 aa, Mycobacterium
ATTTLYPTTNA

SEQ ID NO: 1194573 - protein, 14 aa, Mycobacterium
ATTTPSAAVDPELA

SEQ ID NO: 1194574 - protein, 16 aa, Mycobacterium
ATTTRTIGGGAYPRPG

SEQ ID NO: 1194575 - protein, 5 aa, Mycobacterium
ATTVE

SEQ ID NO: 1194576 - protein, 6 aa, Mycobacterium
ATTWPD

SEQ ID NO: 1194577 - protein, 5 aa, Mycobacterium
ATTWS

SEQ ID NO: 1194578 - protein, 4 aa, Mycobacterium
ATVA

SEQ ID NO: 1194579 - protein, 5 aa, Mycobacterium
ATVAT

SEQ ID NO: 1194580 - protein, 11 aa, Mycobacterium
ATVATITPETS

SEQ ID NO: 1194581 - protein, 13 aa, Mycobacterium
ATVDGDGDKAGYL

SEQ ID NO: 1194582 - protein, 7 aa, Mycobacterium
ATVERTK

SEQ ID NO: 1194583 - protein, 7 aa, Mycobacterium
ATVESAE

SEQ ID NO: 1194584 - protein, 10 aa, Mycobacterium
ATVETNTEAI

SEQ ID NO: 1194585 - protein, 7 aa, Mycobacterium
ATVGAPG

SEQ ID NO: 1194586 - protein, 11 aa, Mycobacterium
ATVGDETLAAG

SEQ ID NO: 1194587 - protein, 7 aa, Mycobacterium
ATVGEGA

SEQ ID NO: 1194588 - protein, 7 aa, Mycobacterium
ATVGGRQ

SEQ ID NO: 1194589 - protein, 7 aa, Mycobacterium
ATVGKPR

SEQ ID NO: 1194590 - protein, 5 aa, Mycobacterium
ATVHA

SEQ ID NO: 1194591 - protein, 5 aa, Mycobacterium
ATVHQ

SEQ ID NO: 1194592 - protein, 23 aa, Mycobacterium
ATVPDSDTVAAAAAAARGLSDAT

SEQ ID NO: 1194593 - protein, 8 aa, Mycobacterium
ATVPPHRP

SEQ ID NO: 1194594 - protein, 4 aa, Mycobacterium
ATVS

SEQ ID NO: 1194595 - protein, 12 aa, Mycobacterium
ATVSAQGNTNVS

SEQ ID NO: 1194596 - protein, 9 aa, Mycobacterium
ATVTDDGSV

SEQ ID NO: 1194597 - protein, 10 aa, Mycobacterium
ATVTTPAEAR

SEQ ID NO: 1194598 - protein, 6 aa, Mycobacterium
ATWAAD

SEQ ID NO: 1194599 - protein, 7 aa, Mycobacterium
ATWAADN

SEQ ID NO: 1194600 - protein, 7 aa, Mycobacterium
ATWGSNP

SEQ ID NO: 1194601 - protein, 12 aa, Mycobacterium
ATWNGTDLKGRE

SEQ ID NO: 1194602 - protein, 10 aa, Mycobacterium
ATWPDKPAVI

SEQ ID NO: 1194603 - protein, 6 aa, Mycobacterium
ATWPTL

SEQ ID NO: 1194604 - protein, 11 aa, Mycobacterium
ATYAPPPQRFE

SEQ ID NO: 1194605 - protein, 6 aa, Mycobacterium
ATYDER

SEQ ID NO: 1194606 - protein, 6 aa, Mycobacterium
ATYDQV

SEQ ID NO: 1194607 - protein, 4 aa, Mycobacterium
ATYE

SEQ ID NO: 1194608 - protein, 13 aa, Mycobacterium
ATYGAGAAGRGPL

SEQ ID NO: 1194609 - protein, 18 aa, Mycobacterium
ATYGPALPDGAPDDGVDR

SEQ ID NO: 1194610 - protein, 6 aa, Mycobacterium
ATYPEA

SEQ ID NO: 1194611 - protein, 6 aa, Mycobacterium
ATYPES

SEQ ID NO: 1194612 - protein, 13 aa, Mycobacterium
ATYPESPSPPATF

SEQ ID NO: 1194613 - protein, 7 aa, Mycobacterium
ATYPGRR

SEQ ID NO: 1194614 - protein, 15 aa, Mycobacterium
ATYRGGEAKTDAKDA

SEQ ID NO: 1194615 - protein, 11 aa, Mycobacterium
AVAAPTDPARR

SEQ ID NO: 1194616 - protein, 15 aa, Mycobacterium
AVAARTAGDSSFDRA

SEQ ID NO: 1194617 - protein, 8 aa, Mycobacterium
AVADPAEA

SEQ ID NO: 1194618 - protein, 8 aa, Mycobacterium
AVAEDSRQ

SEQ ID NO: 1194619 - protein, 6 aa, Mycobacterium
AVAEEA

SEQ ID NO: 1194620 - protein, 14 aa, Mycobacterium
AVAESALAPVAVVR

SEQ ID NO: 1194621 - protein, 10 aa, Mycobacterium
AVAGENIPGG

SEQ ID NO: 1194622 - protein, 15 aa, Mycobacterium
AVAGHDGSPDRDDVP

SEQ ID NO: 1194623 - protein, 7 aa, Mycobacterium
AVAGPEA

SEQ ID NO: 1194624 - protein, 8 aa, Mycobacterium
AVAGPERS

SEQ ID NO: 1194625 - protein, 16 aa, Mycobacterium
AVAPATAPDLASSRGV

SEQ ID NO: 1194626 - protein, 8 aa, Mycobacterium
AVAPDMPG

SEQ ID NO: 1194627 - protein, 5 aa, Mycobacterium
AVAPG

SEQ ID NO: 1194628 - protein, 13 aa, Mycobacterium
AVAPKDKAAARAN

SEQ ID NO: 1194629 - protein, 10 aa, Mycobacterium
AVAPPAPTIL

SEQ ID NO: 1194630 - protein, 5 aa, Mycobacterium
AVASA

SEQ ID NO: 1194631 - protein, 15 aa, Mycobacterium
AVASRAAVRSPKTAE

SEQ ID NO: 1194632 - protein, 4 aa, Mycobacterium
AVAT

SEQ ID NO: 1194633 - protein, 8 aa, Mycobacterium
AVATPAEL

SEQ ID NO: 1194634 - protein, 12 aa, Mycobacterium
AVATPTVRNEAT

SEQ ID NO: 1194635 - protein, 4 aa, Mycobacterium
AVDA

SEQ ID NO: 1194636 - protein, 5 aa, Mycobacterium
AVDAD

SEQ ID NO: 1194637 - protein, 8 aa, Mycobacterium
AVDAGETQ

SEQ ID NO: 1194638 - protein, 8 aa, Mycobacterium
AVDAHSSV

SEQ ID NO: 1194639 - protein, 11 aa, Mycobacterium
AVDAPRPGLRG

SEQ ID NO: 1194640 - protein, 17 aa, Mycobacterium
AVDARGAVTATLDRSPL

SEQ ID NO: 1194641 - protein, 5 aa, Mycobacterium
AVDDG

SEQ ID NO: 1194642 - protein, 8 aa, Mycobacterium
AVDDGNGG

SEQ ID NO: 1194643 - protein, 7 aa, Mycobacterium
AVDDSDR

SEQ ID NO: 1194644 - protein, 9 aa, Mycobacterium
AVDEPGSDA

SEQ ID NO: 1194645 - protein, 4 aa, Mycobacterium
AVDG

SEQ ID NO: 1194646 - protein, 8 aa, Mycobacterium
AVDGKANA

SEQ ID NO: 1194647 - protein, 6 aa, Mycobacterium
AVDNAA

SEQ ID NO: 1194648 - protein, 9 aa, Mycobacterium
AVDPAGPTQ

SEQ ID NO: 1194649 - protein, 10 aa, Mycobacterium
AVDPDGDRIT

SEQ ID NO: 1194650 - protein, 9 aa, Mycobacterium
AVDPDGDRL

SEQ ID NO: 1194651 - protein, 6 aa, Mycobacterium
AVDPGL

SEQ ID NO: 1194652 - protein, 8 aa, Mycobacterium
AVDQRPGF

SEQ ID NO: 1194653 - protein, 12 aa, Mycobacterium
AVDSAASGLLRD

SEQ ID NO: 1194654 - protein, 9 aa, Mycobacterium
AVDSADGRA

SEQ ID NO: 1194655 - protein, 17 aa, Mycobacterium
AVDSPYEAVPAKQRGLT

SEQ ID NO: 1194656 - protein, 10 aa, Mycobacterium
AVDTDAARAV

SEQ ID NO: 1194657 - protein, 6 aa, Mycobacterium
AVDTGA

SEQ ID NO: 1194658 - protein, 6 aa, Mycobacterium
AVDTGE

SEQ ID NO: 1194659 - protein, 12 aa, Mycobacterium
AVEAAPAAGAGE

SEQ ID NO: 1194660 - protein, 5 aa, Mycobacterium
AVEAQ

SEQ ID NO: 1194661 - protein, 5 aa, Mycobacterium
AVEAS

SEQ ID NO: 1194662 - protein, 11 aa, Mycobacterium
AVEDDGEPIDE

SEQ ID NO: 1194663 - protein, 14 aa, Mycobacterium
AVEDHGYRPAPAGL

SEQ ID NO: 1194664 - protein, 14 aa, Mycobacterium
AVEEAASSTPTAAV

SEQ ID NO: 1194665 - protein, 15 aa, Mycobacterium
AVEEPAPVESAAAAA

SEQ ID NO: 1194666 - protein, 7 aa, Mycobacterium
AVEETRK

SEQ ID NO: 1194667 - protein, 7 aa, Mycobacterium
AVEGRSS

SEQ ID NO: 1194668 - protein, 10 aa, Mycobacterium
AVEKGLSTKP

SEQ ID NO: 1194669 - protein, 8 aa, Mycobacterium
AVEPDPRH

SEQ ID NO: 1194670 - protein, 13 aa, Mycobacterium
AVERATAAVEQTS

SEQ ID NO: 1194671 - protein, 6 aa, Mycobacterium
AVERPL

SEQ ID NO: 1194672 - protein, 16 aa, Mycobacterium
AVESGNLSVNSHSSVR

SEQ ID NO: 1194673 - protein, 13 aa, Mycobacterium
AVESQSRAAKAWA

SEQ ID NO: 1194674 - protein, 6 aa, Mycobacterium
AVETEL

SEQ ID NO: 1194675 - protein, 18 aa, Mycobacterium
AVETGPEHTTLRTTSGEV

SEQ ID NO: 1194676 - protein, 53 aa, Mycobacterium
AVETTTGAPAPTSDPPRPSGTSGPRGPSDPPTTSTTPTTATQTSPAPEPDSDQ

SEQ ID NO: 1194677 - protein, 11 aa, Mycobacterium
AVGADKGVSRR

SEQ ID NO: 1194678 - protein, 9 aa, Mycobacterium
AVGADTRDS

SEQ ID NO: 1194679 - protein, 11 aa, Mycobacterium
AVGDGAAAVRQ

SEQ ID NO: 1194680 - protein, 5 aa, Mycobacterium
AVGDT

SEQ ID NO: 1194681 - protein, 5 aa, Mycobacterium
AVGEP

SEQ ID NO: 1194682 - protein, 5 aa, Mycobacterium
AVGGA

SEQ ID NO: 1194683 - protein, 8 aa, Mycobacterium
AVGGAEAG

SEQ ID NO: 1194684 - protein, 7 aa, Mycobacterium
AVGGAKN

SEQ ID NO: 1194685 - protein, 7 aa, Mycobacterium
AVGGDTP

SEQ ID NO: 1194686 - protein, 13 aa, Mycobacterium
AVGGGDEDAHYAA

SEQ ID NO: 1194687 - protein, 10 aa, Mycobacterium
AVGNASEADF

SEQ ID NO: 1194688 - protein, 8 aa, Mycobacterium
AVGNGSTA

SEQ ID NO: 1194689 - protein, 9 aa, Mycobacterium
AVGNPKAVR

SEQ ID NO: 1194690 - protein, 6 aa, Mycobacterium
AVGPGG

SEQ ID NO: 1194691 - protein, 6 aa, Mycobacterium
AVGPGN

SEQ ID NO: 1194692 - protein, 22 aa, Mycobacterium
AVGPQNPQRPPLARSSVTATPT

SEQ ID NO: 1194693 - protein, 8 aa, Mycobacterium
AVGRSTQA

SEQ ID NO: 1194694 - protein, 8 aa, Mycobacterium
AVGRTAEQ

SEQ ID NO: 1194695 - protein, 7 aa, Mycobacterium
AVGRTAT

SEQ ID NO: 1194696 - protein, 8 aa, Mycobacterium
AVGSAADI

SEQ ID NO: 1194697 - protein, 7 aa, Mycobacterium
AVGSDRI

SEQ ID NO: 1194698 - protein, 9 aa, Mycobacterium
AVGSSYDNA

SEQ ID NO: 1194699 - protein, 15 aa, Mycobacterium
AVGVPEDGAERDRAR

SEQ ID NO: 1194700 - protein, 7 aa, Mycobacterium
AVHDEAA

SEQ ID NO: 1194701 - protein, 8 aa, Mycobacterium
AVHGPACP

SEQ ID NO: 1194702 - protein, 4 aa, Mycobacterium
AVKD

SEQ ID NO: 1194703 - protein, 5 aa, Mycobacterium
AVKPT

SEQ ID NO: 1194704 - protein, 7 aa, Mycobacterium
AVKQAAA

SEQ ID NO: 1194705 - protein, 5 aa, Mycobacterium
AVKRN

SEQ ID NO: 1194706 - protein, 11 aa, Mycobacterium
AVKRPGAPYAD

SEQ ID NO: 1194707 - protein, 10 aa, Mycobacterium
AVLGTPERAG

SEQ ID NO: 1194708 - protein, 10 aa, Mycobacterium
AVNDPGSDAW

SEQ ID NO: 1194709 - protein, 25 aa, Mycobacterium
AVNEHRGEHTHGGTEGQYAHDGGFD

SEQ ID NO: 1194710 - protein, 258 aa, Mycobacterium
AVNPDATTVEPAPPPRDVTSQAEPGVPPMTDNPTYRGGQGPGRPADDYYNRPEDERPNRGDEPRGGYPPADQGGYPPPADQGGYPPRGGYPEHGGYPEHGGYPDQGGYPEQGGYPPQSYEQRPPAGYGPPPGGYPDQGYRQPPPGYGPPPGGQPGYGPPSGDYDYGRRPDDGGYGPQGPQGRPSYPDQGGYPDQGGYGGQQYGRQDYAQPDYGRYGEAPAGYQDQGYGEPAGYQDPGYGQGGSYAGYGAQGDYPAAGA

SEQ ID NO: 1194711 - protein, 8 aa, Mycobacterium
AVNPGPLD

SEQ ID NO: 1194712 - protein, 16 aa, Mycobacterium
AVNQDGASGGLTVPNG

SEQ ID NO: 1194713 - protein, 20 aa, Mycobacterium
AVNQDGASGGLTVPNGAAQQ

SEQ ID NO: 1194714 - protein, 20 aa, Mycobacterium
AVNQDGASGGLTVPNGGAQQ

SEQ ID NO: 1194715 - protein, 11 aa, Mycobacterium
AVNQDGRSNGL

SEQ ID NO: 1194716 - protein, 8 aa, Mycobacterium
AVNQVDGA

SEQ ID NO: 1194717 - protein, 16 aa, Mycobacterium
AVNRGGSTLGDFDDAC

SEQ ID NO: 1194718 - protein, 8 aa, Mycobacterium
AVNTGDDG

SEQ ID NO: 1194719 - protein, 9 aa, Mycobacterium
AVPAADATD

SEQ ID NO: 1194720 - protein, 7 aa, Mycobacterium
AVPAPPL

SEQ ID NO: 1194721 - protein, 9 aa, Mycobacterium
AVPATKEDV

SEQ ID NO: 1194722 - protein, 9 aa, Mycobacterium
AVPAVQSDG

SEQ ID NO: 1194723 - protein, 6 aa, Mycobacterium
AVPDGE

SEQ ID NO: 1194724 - protein, 11 aa, Mycobacterium
AVPDGGPLDPS

SEQ ID NO: 1194725 - protein, 17 aa, Mycobacterium
AVPDGRSDTVAASTSLP

SEQ ID NO: 1194726 - protein, 7 aa, Mycobacterium
AVPDNAD

SEQ ID NO: 1194727 - protein, 8 aa, Mycobacterium
AVPDNPTL

SEQ ID NO: 1194728 - protein, 10 aa, Mycobacterium
AVPDNVDPRL

SEQ ID NO: 1194729 - protein, 18 aa, Mycobacterium
AVPDTSAPEATDDPRIPT

SEQ ID NO: 1194730 - protein, 5 aa, Mycobacterium
AVPED

SEQ ID NO: 1194731 - protein, 101 aa, Mycobacterium
AVPEPDAAVDPTSDAETSADESTDTPASPSDQHPVHSDTGEELPSADVDEATTDVAAPAGAAETPTAAETAQTSEQQPAPTSASSPQGTETSIETPTAAAT

SEQ ID NO: 1194732 - protein, 11 aa, Mycobacterium
AVPGAGLDSPG

SEQ ID NO: 1194733 - protein, 14 aa, Mycobacterium
AVPGEMSADGTTWR

SEQ ID NO: 1194734 - protein, 9 aa, Mycobacterium
AVPGPSGSA

SEQ ID NO: 1194735 - protein, 7 aa, Mycobacterium
AVPGVEE

SEQ ID NO: 1194736 - protein, 10 aa, Mycobacterium
AVPKALSEEY

SEQ ID NO: 1194737 - protein, 18 aa, Mycobacterium
AVPKGYAGVAASQRAAET

SEQ ID NO: 1194738 - protein, 6 aa, Mycobacterium
AVPPAL

SEQ ID NO: 1194739 - protein, 7 aa, Mycobacterium
AVPPATP

SEQ ID NO: 1194740 - protein, 7 aa, Mycobacterium
AVPPEDL

SEQ ID NO: 1194741 - protein, 9 aa, Mycobacterium
AVPPETSRL

SEQ ID NO: 1194742 - protein, 5 aa, Mycobacterium
AVPPG

SEQ ID NO: 1194743 - protein, 6 aa, Mycobacterium
AVPPGH

SEQ ID NO: 1194744 - protein, 8 aa, Mycobacterium
AVPPGTPI

SEQ ID NO: 1194745 - protein, 8 aa, Mycobacterium
AVPPPPIP

SEQ ID NO: 1194746 - protein, 6 aa, Mycobacterium
AVPQGL

SEQ ID NO: 1194747 - protein, 9 aa, Mycobacterium
AVPQGRDAT

SEQ ID NO: 1194748 - protein, 9 aa, Mycobacterium
AVPQKDGGW

SEQ ID NO: 1194749 - protein, 5 aa, Mycobacterium
AVPQL

SEQ ID NO: 1194750 - protein, 10 aa, Mycobacterium
AVPQPPEGVS

SEQ ID NO: 1194751 - protein, 12 aa, Mycobacterium
AVPRGVDNPAAS

SEQ ID NO: 1194752 - protein, 5 aa, Mycobacterium
AVPSE

SEQ ID NO: 1194753 - protein, 7 aa, Mycobacterium
AVPSQDE

SEQ ID NO: 1194754 - protein, 6 aa, Mycobacterium
AVPTGS

SEQ ID NO: 1194755 - protein, 10 aa, Mycobacterium
AVQAEDGGRP

SEQ ID NO: 1194756 - protein, 5 aa, Mycobacterium
AVQGR

SEQ ID NO: 1194757 - protein, 24 aa, Mycobacterium
AVQGTAGQSVQAAAGVAQQAGGLA

SEQ ID NO: 1194758 - protein, 13 aa, Mycobacterium
AVQRAGPGSTRLP

SEQ ID NO: 1194759 - protein, 5 aa, Mycobacterium
AVQRT

SEQ ID NO: 1194760 - protein, 22 aa, Mycobacterium
AVQSTSPKTVRPRTLAPEQMTG

SEQ ID NO: 1194761 - protein, 4 aa, Mycobacterium
AVRA

SEQ ID NO: 1194762 - protein, 7 aa, Mycobacterium
AVRAAKD

SEQ ID NO: 1194763 - protein, 8 aa, Mycobacterium
AVRADPAA

SEQ ID NO: 1194764 - protein, 11 aa, Mycobacterium
AVRADRGPDGG

SEQ ID NO: 1194765 - protein, 8 aa, Mycobacterium
AVRAGKAR

SEQ ID NO: 1194766 - protein, 13 aa, Mycobacterium
AVRATGSAEVPSH

SEQ ID NO: 1194767 - protein, 5 aa, Mycobacterium
AVRDD

SEQ ID NO: 1194768 - protein, 7 aa, Mycobacterium
AVRDGDR

SEQ ID NO: 1194769 - protein, 21 aa, Mycobacterium
AVRDGSDDVAATDRRAAHAWG

SEQ ID NO: 1194770 - protein, 11 aa, Mycobacterium
AVRDGTGKLGD

SEQ ID NO: 1194771 - protein, 5 aa, Mycobacterium
AVRET

SEQ ID NO: 1194772 - protein, 8 aa, Mycobacterium
AVRGGTSV

SEQ ID NO: 1194773 - protein, 11 aa, Mycobacterium
AVRGPRADAAY

SEQ ID NO: 1194774 - protein, 5 aa, Mycobacterium
AVRGR

SEQ ID NO: 1194775 - protein, 26 aa, Mycobacterium
AVRGRGAPHPGTGARPTTPAPISSTA

SEQ ID NO: 1194776 - protein, 7 aa, Mycobacterium
AVRGRTL

SEQ ID NO: 1194777 - protein, 8 aa, Mycobacterium
AVRPASPV

SEQ ID NO: 1194778 - protein, 6 aa, Mycobacterium
AVRRRS

SEQ ID NO: 1194779 - protein, 10 aa, Mycobacterium
AVRSDAPPRT

SEQ ID NO: 1194780 - protein, 8 aa, Mycobacterium
AVRTEADA

SEQ ID NO: 1194781 - protein, 8 aa, Mycobacterium
AVSASPDD

SEQ ID NO: 1194782 - protein, 4 aa, Mycobacterium
AVSD

SEQ ID NO: 1194783 - protein, 8 aa, Mycobacterium
AVSDNTHR

SEQ ID NO: 1194784 - protein, 8 aa, Mycobacterium
AVSEGGGL

SEQ ID NO: 1194785 - protein, 4 aa, Mycobacterium
AVSG

SEQ ID NO: 1194786 - protein, 8 aa, Mycobacterium
AVSGQAAR

SEQ ID NO: 1194787 - protein, 8 aa, Mycobacterium
AVSGSGLA

SEQ ID NO: 1194788 - protein, 6 aa, Mycobacterium
AVSGVD

SEQ ID NO: 1194789 - protein, 4 aa, Mycobacterium
AVSK

SEQ ID NO: 1194790 - protein, 6 aa, Mycobacterium
AVSPGD

SEQ ID NO: 1194791 - protein, 11 aa, Mycobacterium
AVSPPNNTGDG

SEQ ID NO: 1194792 - protein, 8 aa, Mycobacterium
AVSPPPEA

SEQ ID NO: 1194793 - protein, 6 aa, Mycobacterium
AVSRGE

SEQ ID NO: 1194794 - protein, 7 aa, Mycobacterium
AVSRGQQ

SEQ ID NO: 1194795 - protein, 7 aa, Mycobacterium
AVSRGSP

SEQ ID NO: 1194796 - protein, 10 aa, Mycobacterium
AVSSAQARMA

SEQ ID NO: 1194797 - protein, 7 aa, Mycobacterium
AVSSGAT

SEQ ID NO: 1194798 - protein, 8 aa, Mycobacterium
AVSSNPDA

SEQ ID NO: 1194799 - protein, 9 aa, Mycobacterium
AVSSQHSVA

SEQ ID NO: 1194800 - protein, 11 aa, Mycobacterium
AVSSTDGNGGT

SEQ ID NO: 1194801 - protein, 7 aa, Mycobacterium
AVSTTTA

SEQ ID NO: 1194802 - protein, 8 aa, Mycobacterium
AVSTTVDQ

SEQ ID NO: 1194803 - protein, 6 aa, Mycobacterium
AVSVPK

SEQ ID NO: 1194804 - protein, 8 aa, Mycobacterium
AVTAAPEG

SEQ ID NO: 1194805 - protein, 8 aa, Mycobacterium
AVTAQKDG

SEQ ID NO: 1194806 - protein, 14 aa, Mycobacterium
AVTATDGRATPPAR

SEQ ID NO: 1194807 - protein, 4 aa, Mycobacterium
AVTD

SEQ ID NO: 1194808 - protein, 11 aa, Mycobacterium
AVTDAKAKATL

SEQ ID NO: 1194809 - protein, 8 aa, Mycobacterium
AVTDGESA

SEQ ID NO: 1194810 - protein, 8 aa, Mycobacterium
AVTEAGGR

SEQ ID NO: 1194811 - protein, 7 aa, Mycobacterium
AVTETRG

SEQ ID NO: 1194812 - protein, 7 aa, Mycobacterium
AVTGADP

SEQ ID NO: 1194813 - protein, 11 aa, Mycobacterium
AVTGDVAGAAE

SEQ ID NO: 1194814 - protein, 6 aa, Mycobacterium
AVTGGD

SEQ ID NO: 1194815 - protein, 21 aa, Mycobacterium
AVTGRPSRRPMSQGANPWSDL

SEQ ID NO: 1194816 - protein, 11 aa, Mycobacterium
AVTGSGRVADD

SEQ ID NO: 1194817 - protein, 10 aa, Mycobacterium
AVTGSPAAKA

SEQ ID NO: 1194818 - protein, 11 aa, Mycobacterium
AVTGSTSPLAH

SEQ ID NO: 1194819 - protein, 5 aa, Mycobacterium
AVTHP

SEQ ID NO: 1194820 - protein, 9 aa, Mycobacterium
AVTNSGRQI

SEQ ID NO: 1194821 - protein, 4 aa, Mycobacterium
AVTP

SEQ ID NO: 1194822 - protein, 6 aa, Mycobacterium
AVTPKT

SEQ ID NO: 1194823 - protein, 6 aa, Mycobacterium
AVTPPV

SEQ ID NO: 1194824 - protein, 5 aa, Mycobacterium
AVTPR

SEQ ID NO: 1194825 - protein, 9 aa, Mycobacterium
AVTPSANVR

SEQ ID NO: 1194826 - protein, 6 aa, Mycobacterium
AVTPTK

SEQ ID NO: 1194827 - protein, 4 aa, Mycobacterium
AVTR

SEQ ID NO: 1194828 - protein, 13 aa, Mycobacterium
AVTSSPIKGTLPD

SEQ ID NO: 1194829 - protein, 16 aa, Mycobacterium
AVTSSQDVDTAKPQPD

SEQ ID NO: 1194830 - protein, 7 aa, Mycobacterium
AVTTAEA

SEQ ID NO: 1194831 - protein, 10 aa, Mycobacterium
AVYSDGKPVT

SEQ ID NO: 1194832 - protein, 10 aa, Mycobacterium
AWAGAADKVG

SEQ ID NO: 1194833 - protein, 9 aa, Mycobacterium
AWAPDARAA

SEQ ID NO: 1194834 - protein, 6 aa, Mycobacterium
AWAPGS

SEQ ID NO: 1194835 - protein, 12 aa, Mycobacterium
AWDGRDPVRELS

SEQ ID NO: 1194836 - protein, 8 aa, Mycobacterium
AWDGSKGE

SEQ ID NO: 1194837 - protein, 4 aa, Mycobacterium
AWED

SEQ ID NO: 1194838 - protein, 4 aa, Mycobacterium
AWEE

SEQ ID NO: 1194839 - protein, 12 aa, Mycobacterium
AWGDEAKREADA

SEQ ID NO: 1194840 - protein, 9 aa, Mycobacterium
AWGGNPERD

SEQ ID NO: 1194841 - protein, 6 aa, Mycobacterium
AWGGYS

SEQ ID NO: 1194842 - protein, 8 aa, Mycobacterium
AWNPTESR

SEQ ID NO: 1194843 - protein, 10 aa, Mycobacterium
AWNRGEDNRV

SEQ ID NO: 1194844 - protein, 10 aa, Mycobacterium
AWPDPATAPR

SEQ ID NO: 1194845 - protein, 10 aa, Mycobacterium
AWPGSSDRNF

SEQ ID NO: 1194846 - protein, 8 aa, Mycobacterium
AWQGDTGL

SEQ ID NO: 1194847 - protein, 5 aa, Mycobacterium
AWQNG

SEQ ID NO: 1194848 - protein, 14 aa, Mycobacterium
AWSGAAANAAETAI

SEQ ID NO: 1194849 - protein, 13 aa, Mycobacterium
AWTGAPDAAPAAM

SEQ ID NO: 1194850 - protein, 5 aa, Mycobacterium
AWTPH

SEQ ID NO: 1194851 - protein, 7 aa, Mycobacterium
AWTTTDG

SEQ ID NO: 1194852 - protein, 9 aa, Mycobacterium
AYAAASPAL

SEQ ID NO: 1194853 - protein, 12 aa, Mycobacterium
AYADQAEARGAW

SEQ ID NO: 1194854 - protein, 34 aa, Mycobacterium
AYAERARRELTAAGEKVRTQPDGTGGELTAQETQ

SEQ ID NO: 1194855 - protein, 11 aa, Mycobacterium
AYAGEDLGEEL

SEQ ID NO: 1194856 - protein, 5 aa, Mycobacterium
AYAGP

SEQ ID NO: 1194857 - protein, 4 aa, Mycobacterium
AYAP

SEQ ID NO: 1194858 - protein, 14 aa, Mycobacterium
AYAQERDPAARTAR

SEQ ID NO: 1194859 - protein, 12 aa, Mycobacterium
AYATGRSEGRWP

SEQ ID NO: 1194860 - protein, 57 aa, Mycobacterium
AYATSTQVSGIDQGGMDTDGDDTTGGTVTDGTVTDGTDVTDGTDGTGTTVDTSPGAL

SEQ ID NO: 1194861 - protein, 13 aa, Mycobacterium
AYDADDAASYPPD

SEQ ID NO: 1194862 - protein, 8 aa, Mycobacterium
AYDERREA

SEQ ID NO: 1194863 - protein, 10 aa, Mycobacterium
AYDGPDPDGF

SEQ ID NO: 1194864 - protein, 8 aa, Mycobacterium
AYDPPHSY

SEQ ID NO: 1194865 - protein, 5 aa, Mycobacterium
AYDSP

SEQ ID NO: 1194866 - protein, 11 aa, Mycobacterium
AYEAAGIGPED

SEQ ID NO: 1194867 - protein, 7 aa, Mycobacterium
AYEDGGA

SEQ ID NO: 1194868 - protein, 7 aa, Mycobacterium
AYENGTY

SEQ ID NO: 1194869 - protein, 13 aa, Mycobacterium
AYGADAAADIAAA

SEQ ID NO: 1194870 - protein, 9 aa, Mycobacterium
AYGASKTAN

SEQ ID NO: 1194871 - protein, 10 aa, Mycobacterium
AYGDDDTRNA

SEQ ID NO: 1194872 - protein, 6 aa, Mycobacterium
AYGDNI

SEQ ID NO: 1194873 - protein, 5 aa, Mycobacterium
AYGDT

SEQ ID NO: 1194874 - protein, 5 aa, Mycobacterium
AYGEA

SEQ ID NO: 1194875 - protein, 15 aa, Mycobacterium
AYGEDDMATAQAGGI

SEQ ID NO: 1194876 - protein, 23 aa, Mycobacterium
AYGGDGGNGGRLAGNGGRGGDAY

SEQ ID NO: 1194877 - protein, 12 aa, Mycobacterium
AYGGEEGFARKG

SEQ ID NO: 1194878 - protein, 7 aa, Mycobacterium
AYGGNRV

SEQ ID NO: 1194879 - protein, 10 aa, Mycobacterium
AYGLNGKPWT

SEQ ID NO: 1194880 - protein, 6 aa, Mycobacterium
AYGPRH

SEQ ID NO: 1194881 - protein, 30 aa, Mycobacterium
AYGPRTGGTSKVSGSVRGSATAAWDFWRAI

SEQ ID NO: 1194882 - protein, 4 aa, Mycobacterium
AYGQ

SEQ ID NO: 1194883 - protein, 8 aa, Mycobacterium
AYGQSKTA

SEQ ID NO: 1194884 - protein, 7 aa, Mycobacterium
AYGSEVA

SEQ ID NO: 1194885 - protein, 7 aa, Mycobacterium
AYGTTSV

SEQ ID NO: 1194886 - protein, 11 aa, Mycobacterium
AYKGPGHPHTN

SEQ ID NO: 1194887 - protein, 8 aa, Mycobacterium
AYKNATEA

SEQ ID NO: 1194888 - protein, 18 aa, Mycobacterium
AYNPATGTYLGPDGRVYT

SEQ ID NO: 1194889 - protein, 5 aa, Mycobacterium
AYPDD

SEQ ID NO: 1194890 - protein, 5 aa, Mycobacterium
AYPDT

SEQ ID NO: 1194891 - protein, 6 aa, Mycobacterium
AYPERL

SEQ ID NO: 1194892 - protein, 12 aa, Mycobacterium
AYPGRVAESDVD

SEQ ID NO: 1194893 - protein, 20 aa, Mycobacterium
AYPPGPGGGPPMGPIPAPKP

SEQ ID NO: 1194894 - protein, 7 aa, Mycobacterium
AYPQIPG

SEQ ID NO: 1194895 - protein, 12 aa, Mycobacterium
AYPRSARPDEPE

SEQ ID NO: 1194896 - protein, 5 aa, Mycobacterium
AYPRT

SEQ ID NO: 1194897 - protein, 5 aa, Mycobacterium
AYPSR

SEQ ID NO: 1194898 - protein, 5 aa, Mycobacterium
AYQTG

SEQ ID NO: 1194899 - protein, 19 aa, Mycobacterium
AYRDPEDLAARTDMSNAAT

SEQ ID NO: 1194900 - protein, 11 aa, Mycobacterium
AYRGEETQARE

SEQ ID NO: 1194901 - protein, 6 aa, Mycobacterium
AYRGRD

SEQ ID NO: 1194902 - protein, 7 aa, Mycobacterium
AYRRSKD

SEQ ID NO: 1194903 - protein, 14 aa, Mycobacterium
AYRRSPRAPIPGDS

SEQ ID NO: 1194904 - protein, 13 aa, Mycobacterium
AYRSPSDEEPGAD

SEQ ID NO: 1194905 - protein, 12 aa, Mycobacterium
AYSARSPHEPRL

SEQ ID NO: 1194906 - protein, 10 aa, Mycobacterium
AYSATGNAHS

SEQ ID NO: 1194907 - protein, 13 aa, Mycobacterium
AYSDDDGIVVIAA

SEQ ID NO: 1194908 - protein, 12 aa, Mycobacterium
AYSGADEPDAAS

SEQ ID NO: 1194909 - protein, 7 aa, Mycobacterium
AYSGRPY

SEQ ID NO: 1194910 - protein, 6 aa, Mycobacterium
AYSGSH

SEQ ID NO: 1194911 - protein, 7 aa, Mycobacterium
AYSKDGA

SEQ ID NO: 1194912 - protein, 4 aa, Mycobacterium
AYSQ

SEQ ID NO: 1194913 - protein, 19 aa, Mycobacterium
AYSRSRAQRTARLVVENLA

SEQ ID NO: 1194914 - protein, 7 aa, Mycobacterium
AYSSASA

SEQ ID NO: 1194915 - protein, 6 aa, Mycobacterium
AYSSFE

SEQ ID NO: 1194916 - protein, 15 aa, Mycobacterium
AYSSGNPALGVGPGN

SEQ ID NO: 1194917 - protein, 19 aa, Mycobacterium
AYSTRSTEQETMRTGDGDG

SEQ ID NO: 1194918 - protein, 7 aa, Mycobacterium
AYSTSKT

SEQ ID NO: 1194919 - protein, 5 aa, Mycobacterium
AYTDG

SEQ ID NO: 1194920 - protein, 15 aa, Mycobacterium
AYTGATEASEREQLE

SEQ ID NO: 1194921 - protein, 11 aa, Mycobacterium
AYTGQDDPTPL

SEQ ID NO: 1194922 - protein, 19 aa, Mycobacterium
AYTPKAGGQVTLRRRPQPL

SEQ ID NO: 1194923 - protein, 14 aa, Mycobacterium
AYTPKDGGRVVMRR

SEQ ID NO: 1194924 - protein, 20 aa, Mycobacterium
AYTPPPPGAGPPPPLPPGYT

SEQ ID NO: 1194925 - protein, 8 aa, Mycobacterium
AYTSNGTA

SEQ ID NO: 1194926 - protein, 6 aa, Mycobacterium
AYTSQR

SEQ ID NO: 1194927 - protein, 17 aa, Mycobacterium
AYTSTWTEDPPGRCRQT

SEQ ID NO: 1194928 - protein, 13 aa, Mycobacterium
AYVPPDAGELLSP

SEQ ID NO: 1194929 - protein, 28 aa, Mycobacterium
AYYDGPELAAPQSRPADETAPGPRGRVP

SEQ ID NO: 1194930 - protein, 8 aa, Mycobacterium
AYYPGTAD

SEQ ID NO: 1194931 - protein, 7 aa, Mycobacterium
CAAASDA

SEQ ID NO: 1194932 - protein, 6 aa, Mycobacterium
CAAEGA

SEQ ID NO: 1194933 - protein, 11 aa, Mycobacterium
CAAGELEDTRP

SEQ ID NO: 1194934 - protein, 8 aa, Mycobacterium
CAAGRSVG

SEQ ID NO: 1194935 - protein, 36 aa, Mycobacterium
CAAGRTGRAGQTRVTPDTWGASAAGRAGRADSTGLA

SEQ ID NO: 1194936 - protein, 8 aa, Mycobacterium
CAAPSGAP

SEQ ID NO: 1194937 - protein, 13 aa, Mycobacterium
CAAQDSAEGTCCA

SEQ ID NO: 1194938 - protein, 12 aa, Mycobacterium
CAATESGIAGYD

SEQ ID NO: 1194939 - protein, 26 aa, Mycobacterium
CADGDRAAMPRVTGGRYGLSSKEFTP

SEQ ID NO: 1194940 - protein, 14 aa, Mycobacterium
CADPGGDLPVNTDG

SEQ ID NO: 1194941 - protein, 9 aa, Mycobacterium
CAEGPTATP

SEQ ID NO: 1194942 - protein, 13 aa, Mycobacterium
CAEGSPLVDPGTG

SEQ ID NO: 1194943 - protein, 9 aa, Mycobacterium
CAEPADQRE

SEQ ID NO: 1194944 - protein, 10 aa, Mycobacterium
CAGSSYSADV

SEQ ID NO: 1194945 - protein, 7 aa, Mycobacterium
CAGTNAV

SEQ ID NO: 1194946 - protein, 18 aa, Mycobacterium
CAKSPTPARLLTPPPPLR

SEQ ID NO: 1194947 - protein, 13 aa, Mycobacterium
CANRDPGHLDSPS

SEQ ID NO: 1194948 - protein, 21 aa, Mycobacterium
CAPESTGRRPKALSRKDKASR

SEQ ID NO: 1194949 - protein, 6 aa, Mycobacterium
CAPGDV

SEQ ID NO: 1194950 - protein, 9 aa, Mycobacterium
CAPGEGATA

SEQ ID NO: 1194951 - protein, 15 aa, Mycobacterium
CAPGRRNPRSIANAP

SEQ ID NO: 1194952 - protein, 15 aa, Mycobacterium
CAPPGNAPTPAERST

SEQ ID NO: 1194953 - protein, 14 aa, Mycobacterium
CAPPPPHAGPGRVP

SEQ ID NO: 1194954 - protein, 7 aa, Mycobacterium
CAPTSSM

SEQ ID NO: 1194955 - protein, 6 aa, Mycobacterium
CARGGG

SEQ ID NO: 1194956 - protein, 9 aa, Mycobacterium
CARSGGDID

SEQ ID NO: 1194957 - protein, 9 aa, Mycobacterium
CASDADGGM

SEQ ID NO: 1194958 - protein, 4 aa, Mycobacterium
CASG

SEQ ID NO: 1194959 - protein, 7 aa, Mycobacterium
CASGEEA

SEQ ID NO: 1194960 - protein, 5 aa, Mycobacterium
CASGS

SEQ ID NO: 1194961 - protein, 11 aa, Mycobacterium
CASGSQALQSA

SEQ ID NO: 1194962 - protein, 6 aa, Mycobacterium
CASGSV

SEQ ID NO: 1194963 - protein, 7 aa, Mycobacterium
CATGNSS

SEQ ID NO: 1194964 - protein, 8 aa, Mycobacterium
CATGNSTI

SEQ ID NO: 1194965 - protein, 26 aa, Mycobacterium
CATGTTARGDHPPMTEAELEKLFLSL

SEQ ID NO: 1194966 - protein, 16 aa, Mycobacterium
CATPDAPGDHLPPTDT

SEQ ID NO: 1194967 - protein, 23 aa, Mycobacterium
CATSSPTCAHSSPTTPTTSRSTA

SEQ ID NO: 1194968 - protein, 8 aa, Mycobacterium
CCDGSSPM

SEQ ID NO: 1194969 - protein, 9 aa, Mycobacterium
CCDGSSPMC

SEQ ID NO: 1194970 - protein, 4 aa, Mycobacterium
CDAD

SEQ ID NO: 1194971 - protein, 18 aa, Mycobacterium
CDAEGAPAYLESTKESNV

SEQ ID NO: 1194972 - protein, 14 aa, Mycobacterium
CDASGEISSARDWA

SEQ ID NO: 1194973 - protein, 8 aa, Mycobacterium
CDDPGSPA

SEQ ID NO: 1194974 - protein, 6 aa, Mycobacterium
CDEANA

SEQ ID NO: 1194975 - protein, 25 aa, Mycobacterium
CDEHGADDAPPGPPAGTVPSAWSGP

SEQ ID NO: 1194976 - protein, 5 aa, Mycobacterium
CDGAQ

SEQ ID NO: 1194977 - protein, 7 aa, Mycobacterium
CDGPTSL

SEQ ID NO: 1194978 - protein, 6 aa, Mycobacterium
CDGRGS

SEQ ID NO: 1194979 - protein, 8 aa, Mycobacterium
CDGRRGEE

SEQ ID NO: 1194980 - protein, 4 aa, Mycobacterium
CDPE

SEQ ID NO: 1194981 - protein, 4 aa, Mycobacterium
CDPG

SEQ ID NO: 1194982 - protein, 4 aa, Mycobacterium
CDPQ

SEQ ID NO: 1194983 - protein, 10 aa, Mycobacterium
CDPQPQPGGL

SEQ ID NO: 1194984 - protein, 16 aa, Mycobacterium
CDPSGGRATAAAIPGA

SEQ ID NO: 1194985 - protein, 13 aa, Mycobacterium
CDTARSVDYTGAG

SEQ ID NO: 1194986 - protein, 8 aa, Mycobacterium
CDTATKTV

SEQ ID NO: 1194987 - protein, 10 aa, Mycobacterium
CDTDPADYPF

SEQ ID NO: 1194988 - protein, 21 aa, Mycobacterium
CEADSVAPTGGAPADFNSAGG

SEQ ID NO: 1194989 - protein, 5 aa, Mycobacterium
CEDAP

SEQ ID NO: 1194990 - protein, 4 aa, Mycobacterium
CEDP

SEQ ID NO: 1194991 - protein, 26 aa, Mycobacterium
CEGLDKADGAATRDRPDEGDPTGFSR

SEQ ID NO: 1194992 - protein, 9 aa, Mycobacterium
CEKGGSTFY

SEQ ID NO: 1194993 - protein, 4 aa, Mycobacterium
CEPA

SEQ ID NO: 1194994 - protein, 6 aa, Mycobacterium
CEPEDE

SEQ ID NO: 1194995 - protein, 5 aa, Mycobacterium
CEPEQ

SEQ ID NO: 1194996 - protein, 9 aa, Mycobacterium
CERPTDQVA

SEQ ID NO: 1194997 - protein, 7 aa, Mycobacterium
CERRGPH

SEQ ID NO: 1194998 - protein, 5 aa, Mycobacterium
CESGG

SEQ ID NO: 1194999 - protein, 6 aa, Mycobacterium
CESGGN

SEQ ID NO: 1195000 - protein, 7 aa, Mycobacterium
CESGPQH

SEQ ID NO: 1195001 - protein, 6 aa, Mycobacterium
CESHAS

SEQ ID NO: 1195002 - protein, 16 aa, Mycobacterium
CESPLPPADGIPDSRQ

SEQ ID NO: 1195003 - protein, 6 aa, Mycobacterium
CESPRV

SEQ ID NO: 1195004 - protein, 9 aa, Mycobacterium
CESRYTPSH

SEQ ID NO: 1195005 - protein, 9 aa, Mycobacterium
CGAGGDCGR

SEQ ID NO: 1195006 - protein, 19 aa, Mycobacterium
CGASSRRKTSSRDSIPGRR

SEQ ID NO: 1195007 - protein, 10 aa, Mycobacterium
CGDGGASFHG

SEQ ID NO: 1195008 - protein, 8 aa, Mycobacterium
CGDGLTPR

SEQ ID NO: 1195009 - protein, 5 aa, Mycobacterium
CGDNA

SEQ ID NO: 1195010 - protein, 7 aa, Mycobacterium
CGDPPKT

SEQ ID NO: 1195011 - protein, 6 aa, Mycobacterium
CGEGGD

SEQ ID NO: 1195012 - protein, 5 aa, Mycobacterium
CGEGY

SEQ ID NO: 1195013 - protein, 5 aa, Mycobacterium
CGGAA

SEQ ID NO: 1195014 - protein, 10 aa, Mycobacterium
CGGATTPAIK

SEQ ID NO: 1195015 - protein, 6 aa, Mycobacterium
CGGDEV

SEQ ID NO: 1195016 - protein, 13 aa, Mycobacterium
CGGGGQGSALIVR

SEQ ID NO: 1195017 - protein, 15 aa, Mycobacterium
CGGPPVAAATREQLQ

SEQ ID NO: 1195018 - protein, 5 aa, Mycobacterium
CGGPS

SEQ ID NO: 1195019 - protein, 8 aa, Mycobacterium
CGGRGEIQ

SEQ ID NO: 1195020 - protein, 6 aa, Mycobacterium
CGHGGS

SEQ ID NO: 1195021 - protein, 4 aa, Mycobacterium
CGPD

SEQ ID NO: 1195022 - protein, 10 aa, Mycobacterium
CGPDDNPGHA

SEQ ID NO: 1195023 - protein, 10 aa, Mycobacterium
CGPGGAGPAV

SEQ ID NO: 1195024 - protein, 25 aa, Mycobacterium
CGPGNGARIAAQRGARVTGVDPSRS

SEQ ID NO: 1195025 - protein, 6 aa, Mycobacterium
CGPGNL

SEQ ID NO: 1195026 - protein, 7 aa, Mycobacterium
CGPPIET

SEQ ID NO: 1195027 - protein, 6 aa, Mycobacterium
CGPQDA

SEQ ID NO: 1195028 - protein, 4 aa, Mycobacterium
CGQR

SEQ ID NO: 1195029 - protein, 24 aa, Mycobacterium
CGSAAERVEEAAGATLTPVSEESA

SEQ ID NO: 1195030 - protein, 6 aa, Mycobacterium
CGSADR

SEQ ID NO: 1195031 - protein, 8 aa, Mycobacterium
CGSPADGE

SEQ ID NO: 1195032 - protein, 5 aa, Mycobacterium
CGSTG

SEQ ID NO: 1195033 - protein, 19 aa, Mycobacterium
CGSTTPDARSTPASPRSRC

SEQ ID NO: 1195034 - protein, 6 aa, Mycobacterium
CGTDAA

SEQ ID NO: 1195035 - protein, 7 aa, Mycobacterium
CGTDGTM

SEQ ID NO: 1195036 - protein, 10 aa, Mycobacterium
CGTEARGPVE

SEQ ID NO: 1195037 - protein, 5 aa, Mycobacterium
CGTGE

SEQ ID NO: 1195038 - protein, 12 aa, Mycobacterium
CGTGTGSLDEPS

SEQ ID NO: 1195039 - protein, 13 aa, Mycobacterium
CGTGYRAPATPLE

SEQ ID NO: 1195040 - protein, 10 aa, Mycobacterium
CGTKGQWTEP

SEQ ID NO: 1195041 - protein, 7 aa, Mycobacterium
CGTPGAP

SEQ ID NO: 1195042 - protein, 21 aa, Mycobacterium
CGTPSGVPTATPFTTTADSTN

SEQ ID NO: 1195043 - protein, 9 aa, Mycobacterium
CGTQSRQGI

SEQ ID NO: 1195044 - protein, 5 aa, Mycobacterium
CHPGQ

SEQ ID NO: 1195045 - protein, 8 aa, Mycobacterium
CHPSNTGH

SEQ ID NO: 1195046 - protein, 6 aa, Mycobacterium
CHREPD

SEQ ID NO: 1195047 - protein, 7 aa, Mycobacterium
CKDGEQE

SEQ ID NO: 1195048 - protein, 6 aa, Mycobacterium
CKGRGG

SEQ ID NO: 1195049 - protein, 13 aa, Mycobacterium
CKGTVEDRPDDGC

SEQ ID NO: 1195050 - protein, 9 aa, Mycobacterium
CKPGDGLGI

SEQ ID NO: 1195051 - protein, 8 aa, Mycobacterium
CKTSDPSI

SEQ ID NO: 1195052 - protein, 11 aa, Mycobacterium
CLAGSDDEPAA

SEQ ID NO: 1195053 - protein, 8 aa, Mycobacterium
CLDDPDHS

SEQ ID NO: 1195054 - protein, 7 aa, Mycobacterium
CLSDGGN

SEQ ID NO: 1195055 - protein, 15 aa, Mycobacterium
CMGPSGEDAEQEAED

SEQ ID NO: 1195056 - protein, 5 aa, Mycobacterium
CNEEL

SEQ ID NO: 1195057 - protein, 10 aa, Mycobacterium
CNGKSCAGGV

SEQ ID NO: 1195058 - protein, 9 aa, Mycobacterium
CNPTANPDL

SEQ ID NO: 1195059 - protein, 6 aa, Mycobacterium
CNPTTD

SEQ ID NO: 1195060 - protein, 6 aa, Mycobacterium
CPADER

SEQ ID NO: 1195061 - protein, 7 aa, Mycobacterium
CPAEKAG

SEQ ID NO: 1195062 - protein, 8 aa, Mycobacterium
CPAPSPAA

SEQ ID NO: 1195063 - protein, 11 aa, Mycobacterium
CPDATDPRRAT

SEQ ID NO: 1195064 - protein, 6 aa, Mycobacterium
CPDENS

SEQ ID NO: 1195065 - protein, 5 aa, Mycobacterium
CPDGT

SEQ ID NO: 1195066 - protein, 4 aa, Mycobacterium
CPEG

SEQ ID NO: 1195067 - protein, 11 aa, Mycobacterium
CPGAAGSWQPV

SEQ ID NO: 1195068 - protein, 8 aa, Mycobacterium
CPGAGKST

SEQ ID NO: 1195069 - protein, 10 aa, Mycobacterium
CPGGAPEDTT

SEQ ID NO: 1195070 - protein, 17 aa, Mycobacterium
CPGGESVEAVNERADRA

SEQ ID NO: 1195071 - protein, 10 aa, Mycobacterium
CPGGETSAQV

SEQ ID NO: 1195072 - protein, 11 aa, Mycobacterium
CPKKTEISDRV

SEQ ID NO: 1195073 - protein, 4 aa, Mycobacterium
CPPA

SEQ ID NO: 1195074 - protein, 5 aa, Mycobacterium
CPPDA

SEQ ID NO: 1195075 - protein, 4 aa, Mycobacterium
CPPG

SEQ ID NO: 1195076 - protein, 5 aa, Mycobacterium
CPPQL

SEQ ID NO: 1195077 - protein, 10 aa, Mycobacterium
CPPSGPHVDD

SEQ ID NO: 1195078 - protein, 5 aa, Mycobacterium
CPQLD

SEQ ID NO: 1195079 - protein, 9 aa, Mycobacterium
CPQPTDPRI

SEQ ID NO: 1195080 - protein, 10 aa, Mycobacterium
CPRAERGKAY

SEQ ID NO: 1195081 - protein, 32 aa, Mycobacterium
CPRPSRRALSGSNVRASGGAHRKTPEAAGAAH

SEQ ID NO: 1195082 - protein, 32 aa, Mycobacterium; identical to SEQ ID NO: 442151

SEQ ID NO: 1195083 - protein, 4 aa, Mycobacterium
CPSD

SEQ ID NO: 1195084 - protein, 4 aa, Mycobacterium
CPSG

SEQ ID NO: 1195085 - protein, 11 aa, Mycobacterium
CPSYGAGPTDP

SEQ ID NO: 1195086 - protein, 10 aa, Mycobacterium
CPTQQSSPIT

SEQ ID NO: 1195087 - protein, 9 aa, Mycobacterium
CQGRQVDDD

SEQ ID NO: 1195088 - protein, 7 aa, Mycobacterium
CQQAQAD

SEQ ID NO: 1195089 - protein, 11 aa, Mycobacterium
CRDGDDPSALA

SEQ ID NO: 1195090 - protein, 11 aa, Mycobacterium
CRDGEEQYCTG

SEQ ID NO: 1195091 - protein, 11 aa, Mycobacterium
CRDNSLPGGPT

SEQ ID NO: 1195092 - protein, 13 aa, Mycobacterium
CREESERLGDGPL

SEQ ID NO: 1195093 - protein, 7 aa, Mycobacterium
CRGNRTR

SEQ ID NO: 1195094 - protein, 18 aa, Mycobacterium
CRGSTGPSSLAPDGKAWG

SEQ ID NO: 1195095 - protein, 25 aa, Mycobacterium
CRNTTDHRDDGKTVGRDVTPELLSG

SEQ ID NO: 1195096 - protein, 14 aa, Mycobacterium
CRPADGDESVSARW

SEQ ID NO: 1195097 - protein, 9 aa, Mycobacterium
CRPDPGGRR

SEQ ID NO: 1195098 - protein, 4 aa, Mycobacterium
CRPE

SEQ ID NO: 1195099 - protein, 11 aa, Mycobacterium
CRPGDGLGISG

SEQ ID NO: 1195100 - protein, 5 aa, Mycobacterium
CRPGG

SEQ ID NO: 1195101 - protein, 7 aa, Mycobacterium
CRPNSGT

SEQ ID NO: 1195102 - protein, 18 aa, Mycobacterium
CRQTAESIAATQESSGAI

SEQ ID NO: 1195103 - protein, 7 aa, Mycobacterium
CRQTDPD

SEQ ID NO: 1195104 - protein, 8 aa, Mycobacterium
CRRADGRA

SEQ ID NO: 1195105 - protein, 5 aa, Mycobacterium
CRRGE

SEQ ID NO: 1195106 - protein, 13 aa, Mycobacterium
CRSAAGQARRHRG

SEQ ID NO: 1195107 - protein, 30 aa, Mycobacterium
CRSQPGEQDRETWGQAQRTERQQCQRDAGR

SEQ ID NO: 1195108 - protein, 10 aa, Mycobacterium
CRTEERDDHD

SEQ ID NO: 1195109 - protein, 6 aa, Mycobacterium
CRTEGG

SEQ ID NO: 1195110 - protein, 6 aa, Mycobacterium
CRTQDP

SEQ ID NO: 1195111 - protein, 10 aa, Mycobacterium
CSAGSDTYEE

SEQ ID NO: 1195112 - protein, 6 aa, Mycobacterium
CSAPTR

SEQ ID NO: 1195113 - protein, 5 aa, Mycobacterium
CSEEA

SEQ ID NO: 1195114 - protein, 7 aa, Mycobacterium
CSESPGT

SEQ ID NO: 1195115 - protein, 8 aa, Mycobacterium
CSETAGGV

SEQ ID NO: 1195116 - protein, 5 aa, Mycobacterium
CSGDG

SEQ ID NO: 1195117 - protein, 11 aa, Mycobacterium
CSGERAPDGLR

SEQ ID NO: 1195118 - protein, 16 aa, Mycobacterium
CSGGMHGSNRLGGNSL

SEQ ID NO: 1195119 - protein, 12 aa, Mycobacterium
CSGGRRKVVLRN

SEQ ID NO: 1195120 - protein, 9 aa, Mycobacterium
CSGRARGRN

SEQ ID NO: 1195121 - protein, 12 aa, Mycobacterium
CSGRNRGPAPTT

SEQ ID NO: 1195122 - protein, 10 aa, Mycobacterium
CSGTPRQDAY

SEQ ID NO: 1195123 - protein, 13 aa, Mycobacterium
CSKPVPNKTDNEY

SEQ ID NO: 1195124 - protein, 24 aa, Mycobacterium
CSNTTEPAPTSSSPTAAATEPPAG

SEQ ID NO: 1195125 - protein, 8 aa, Mycobacterium
CSPAPSAE

SEQ ID NO: 1195126 - protein, 10 aa, Mycobacterium
CSPDGGPPLL

SEQ ID NO: 1195127 - protein, 16 aa, Mycobacterium
CSPTEFARTSGYVGDT

SEQ ID NO: 1195128 - protein, 14 aa, Mycobacterium
CSPTGRDNAAHGGY

SEQ ID NO: 1195129 - protein, 9 aa, Mycobacterium
CSPTSDGSA

SEQ ID NO: 1195130 - protein, 9 aa, Mycobacterium
CSRADGAGR

SEQ ID NO: 1195131 - protein, 7 aa, Mycobacterium
CSRGRGV

SEQ ID NO: 1195132 - protein, 8 aa, Mycobacterium
CSRITDGS

SEQ ID NO: 1195133 - protein, 4 aa, Mycobacterium
CSRP

SEQ ID NO: 1195134 - protein, 8 aa, Mycobacterium
CSSCPSSS

SEQ ID NO: 1195135 - protein, 4 aa, Mycobacterium
CSSE

SEQ ID NO: 1195136 - protein, 21 aa, Mycobacterium
CSSGDYEMGRTEGLSDVERDA

SEQ ID NO: 1195137 - protein, 13 aa, Mycobacterium
CSSNAPDSAPPAI

SEQ ID NO: 1195138 - protein, 11 aa, Mycobacterium
CTAADAPRYGD

SEQ ID NO: 1195139 - protein, 4 aa, Mycobacterium
CTAD

SEQ ID NO: 1195140 - protein, 13 aa, Mycobacterium
CTDDQGTRFYLGE

SEQ ID NO: 1195141 - protein, 9 aa, Mycobacterium
CTDTGSPGI

SEQ ID NO: 1195142 - protein, 5 aa, Mycobacterium
CTESD

SEQ ID NO: 1195143 - protein, 4 aa, Mycobacterium
CTGH

SEQ ID NO: 1195144 - protein, 6 aa, Mycobacterium
CTGNRL

SEQ ID NO: 1195145 - protein, 10 aa, Mycobacterium
CTGSPGCERS

SEQ ID NO: 1195146 - protein, 11 aa, Mycobacterium
CTGTAPPTCED

SEQ ID NO: 1195147 - protein, 6 aa, Mycobacterium
CTNDTA

SEQ ID NO: 1195148 - protein, 9 aa, Mycobacterium
CTNTSNPSV

SEQ ID NO: 1195149 - protein, 8 aa, Mycobacterium
CTPDDTVD

SEQ ID NO: 1195150 - protein, 11 aa, Mycobacterium
CTPGASDTARF

SEQ ID NO: 1195151 - protein, 7 aa, Mycobacterium
CTPRTPL

SEQ ID NO: 1195152 - protein, 6 aa, Mycobacterium
CTPRTQ

SEQ ID NO: 1195153 - protein, 10 aa, Mycobacterium
CTPTGDDYPQ

SEQ ID NO: 1195154 - protein, 5 aa, Mycobacterium
CTQYN

SEQ ID NO: 1195155 - protein, 10 aa, Mycobacterium
CTRQPDAARA

SEQ ID NO: 1195156 - protein, 12 aa, Mycobacterium
CTRTDPQAKGLG

SEQ ID NO: 1195157 - protein, 10 aa, Mycobacterium
CTSDGTPGCG

SEQ ID NO: 1195158 - protein, 10 aa, Mycobacterium
CTSGEISSGT

SEQ ID NO: 1195159 - protein, 11 aa, Mycobacterium
CTSRQPPAARI

SEQ ID NO: 1195160 - protein, 6 aa, Mycobacterium
CTSTGK

SEQ ID NO: 1195161 - protein, 12 aa, Mycobacterium
CTTRNKRRAARL

SEQ ID NO: 1195162 - protein, 10 aa, Mycobacterium
CTVTTADGRS

SEQ ID NO: 1195163 - protein, 4 aa, Mycobacterium
DAAA

SEQ ID NO: 1195164 - protein, 8 aa, Mycobacterium
DAAAADRT

SEQ ID NO: 1195165 - protein, 8 aa, Mycobacterium
DAAAAKAK

SEQ ID NO: 1195166 - protein, 9 aa, Mycobacterium
DAAAATGGL

SEQ ID NO: 1195167 - protein, 8 aa, Mycobacterium
DAAAGGDS

SEQ ID NO: 1195168 - protein, 5 aa, Mycobacterium
DAAAL

SEQ ID NO: 1195169 - protein, 5 aa, Mycobacterium
DAAAN

SEQ ID NO: 1195170 - protein, 11 aa, Mycobacterium
DAAAQASIGAA

SEQ ID NO: 1195171 - protein, 9 aa, Mycobacterium
DAAARGLSR

SEQ ID NO: 1195172 - protein, 13 aa, Mycobacterium
DAAARGVVDGPED

SEQ ID NO: 1195173 - protein, 10 aa, Mycobacterium
DAAASETVAE

SEQ ID NO: 1195174 - protein, 5 aa, Mycobacterium
DAAAT

SEQ ID NO: 1195175 - protein, 8 aa, Mycobacterium
DAADEALR

SEQ ID NO: 1195176 - protein, 7 aa, Mycobacterium
DAADEAS

SEQ ID NO: 1195177 - protein, 8 aa, Mycobacterium
DAADPQAE

SEQ ID NO: 1195178 - protein, 8 aa, Mycobacterium
DAADTPEA

SEQ ID NO: 1195179 - protein, 14 aa, Mycobacterium
DAADVGDTMAAGDE

SEQ ID NO: 1195180 - protein, 8 aa, Mycobacterium
DAAEADPG

SEQ ID NO: 1195181 - protein, 6 aa, Mycobacterium
DAAEAG

SEQ ID NO: 1195182 - protein, 11 aa, Mycobacterium
DAAEDARPVGG

SEQ ID NO: 1195183 - protein, 7 aa, Mycobacterium
DAAELGV

SEQ ID NO: 1195184 - protein, 13 aa, Mycobacterium
DAAEPDLQPVGPD

SEQ ID NO: 1195185 - protein, 41 aa, Mycobacterium
DAAEPPPQPPQPPQPSPPPPSGEPPPRPGPGRYQHIPVTVQ

SEQ ID NO: 1195186 - protein, 8 aa, Mycobacterium
DAAGAPPT

SEQ ID NO: 1195187 - protein, 9 aa, Mycobacterium
DAAGAREID

SEQ ID NO: 1195188 - protein, 5 aa, Mycobacterium
DAAGD

SEQ ID NO: 1195189 - protein, 8 aa, Mycobacterium
DAAGEEDT

SEQ ID NO: 1195190 - protein, 10 aa, Mycobacterium
DAAGEEFGSS

SEQ ID NO: 1195191 - protein, 7 aa, Mycobacterium
DAAGEGV

SEQ ID NO: 1195192 - protein, 8 aa, Mycobacterium
DAAGGTVE

SEQ ID NO: 1195193 - protein, 31 aa, Mycobacterium
DAAGPGRKPVTGESTPAAAQSIAPGKAGRVN

SEQ ID NO: 1195194 - protein, 9 aa, Mycobacterium
DAAGPHTEA

SEQ ID NO: 1195195 - protein, 8 aa, Mycobacterium
DAAGRAYA

SEQ ID NO: 1195196 - protein, 6 aa, Mycobacterium
DAAGRG

SEQ ID NO: 1195197 - protein, 11 aa, Mycobacterium
DAAGSTSTPMS

SEQ ID NO: 1195198 - protein, 6 aa, Mycobacterium
DAAGVG

SEQ ID NO: 1195199 - protein, 7 aa, Mycobacterium
DAAGYSE

SEQ ID NO: 1195200 - protein, 7 aa, Mycobacterium
DAAHTDA

SEQ ID NO: 1195201 - protein, 9 aa, Mycobacterium
DAAKAGSST

SEQ ID NO: 1195202 - protein, 5 aa, Mycobacterium
DAAKQ

SEQ ID NO: 1195203 - protein, 5 aa, Mycobacterium
DAALS

SEQ ID NO: 1195204 - protein, 5 aa, Mycobacterium
DAANA

SEQ ID NO: 1195205 - protein, 14 aa, Mycobacterium
DAANAVKDLTDPAD

SEQ ID NO: 1195206 - protein, 6 aa, Mycobacterium
DAANIQ

SEQ ID NO: 1195207 - protein, 5 aa, Mycobacterium
DAANQ

SEQ ID NO: 1195208 - protein, 10 aa, Mycobacterium
DAANTVSDAT

SEQ ID NO: 1195209 - protein, 4 aa, Mycobacterium
DAAP

SEQ ID NO: 1195210 - protein, 11 aa, Mycobacterium
DAAPASVAASE

SEQ ID NO: 1195211 - protein, 12 aa, Mycobacterium
DAAPGDPKPRTV

SEQ ID NO: 1195212 - protein, 7 aa, Mycobacterium
DAAPGLD

SEQ ID NO: 1195213 - protein, 7 aa, Mycobacterium
DAAPNTG

SEQ ID NO: 1195214 - protein, 10 aa, Mycobacterium
DAAPPEYAAP

SEQ ID NO: 1195215 - protein, 11 aa, Mycobacterium
DAAPTTRRRPK

SEQ ID NO: 1195216 - protein, 10 aa, Mycobacterium
DAAQADHADA

SEQ ID NO: 1195217 - protein, 5 aa, Mycobacterium
DAAQD

SEQ ID NO: 1195218 - protein, 5 aa, Mycobacterium
DAAQE

SEQ ID NO: 1195219 - protein, 18 aa, Mycobacterium
DAARATKASGAEKLSGRD

SEQ ID NO: 1195220 - protein, 5 aa, Mycobacterium
DAARC

SEQ ID NO: 1195221 - protein, 16 aa, Mycobacterium
DAARDCTGTACNGGRG

SEQ ID NO: 1195222 - protein, 10 aa, Mycobacterium
DAAREAREAG

SEQ ID NO: 1195223 - protein, 7 aa, Mycobacterium
DAARPLR

SEQ ID NO: 1195224 - protein, 8 aa, Mycobacterium
DAARRDRE

SEQ ID NO: 1195225 - protein, 8 aa, Mycobacterium
DAARSGRP

SEQ ID NO: 1195226 - protein, 8 aa, Mycobacterium
DAARTTYR

SEQ ID NO: 1195227 - protein, 15 aa, Mycobacterium
DAARVAKKRGHGDDA

SEQ ID NO: 1195228 - protein, 6 aa, Mycobacterium
DAARYG

SEQ ID NO: 1195229 - protein, 7 aa, Mycobacterium
DAASGRV

SEQ ID NO: 1195230 - protein, 24 aa, Mycobacterium
DAASNSTRVSDALSPGASSSHPEV

SEQ ID NO: 1195231 - protein, 9 aa, Mycobacterium
DAATAGGAA

SEQ ID NO: 1195232 - protein, 18 aa, Mycobacterium
DAATAGPVAEGSVGGGTG

SEQ ID NO: 1195233 - protein, 14 aa, Mycobacterium
DAATAKRLRNDRGE

SEQ ID NO: 1195234 - protein, 6 aa, Mycobacterium
DAATAL

SEQ ID NO: 1195235 - protein, 5 aa, Mycobacterium
DAATF

SEQ ID NO: 1195236 - protein, 7 aa, Mycobacterium
DAATKAT

SEQ ID NO: 1195237 - protein, 8 aa, Mycobacterium
DAATREWR

SEQ ID NO: 1195238 - protein, 6 aa, Mycobacterium
DAATRI

SEQ ID NO: 1195239 - protein, 8 aa, Mycobacterium
DAATRLGR

SEQ ID NO: 1195240 - protein, 12 aa, Mycobacterium
DAATTPTSDTVL

SEQ ID NO: 1195241 - protein, 14 aa, Mycobacterium
DAAVERARPGLAAY

SEQ ID NO: 1195242 - protein, 13 aa, Mycobacterium
DAAVGPAQGSTAH

SEQ ID NO: 1195243 - protein, 4 aa, Mycobacterium
DACD

SEQ ID NO: 1195244 - protein, 10 aa, Mycobacterium
DACQRGGSTL

SEQ ID NO: 1195245 - protein, 6 aa, Mycobacterium
DADAAY

SEQ ID NO: 1195246 - protein, 11 aa, Mycobacterium
DADAFARTAPG

SEQ ID NO: 1195247 - protein, 11 aa, Mycobacterium
DADAGAPHVAE

SEQ ID NO: 1195248 - protein, 9 aa, Mycobacterium
DADAGARHV

SEQ ID NO: 1195249 - protein, 17 aa, Mycobacterium
DADAGRLPGKTVLVPVS

SEQ ID NO: 1195250 - protein, 7 aa, Mycobacterium
DADAPRS

SEQ ID NO: 1195251 - protein, 5 aa, Mycobacterium
DADAQ

SEQ ID NO: 1195252 - protein, 12 aa, Mycobacterium
DADARSSSAEVT

SEQ ID NO: 1195253 - protein, 8 aa, Mycobacterium
DADARYND

SEQ ID NO: 1195254 - protein, 82 aa, Mycobacterium
DADATRAVTDSDDDDLDDDFDDEDADDEDTDDEDEIDLDDDDDEADDDIEELDDEDSDDEETDEDSDDEDTDGEDSDEEEEP

SEQ ID NO: 1195255 - protein, 5 aa, Mycobacterium
DADAV

SEQ ID NO: 1195256 - protein, 23 aa, Mycobacterium
DADDGPLSPAEVTRRAQARGCEL

SEQ ID NO: 1195257 - protein, 8 aa, Mycobacterium
DADDPKLG

SEQ ID NO: 1195258 - protein, 54 aa, Mycobacterium
DADDSDAGGDEKPEPEPEPEPEAEAEPEPAPEPEPEPEAKPKAKPAQSSGSATP

SEQ ID NO: 1195259 - protein, 4 aa, Mycobacterium
DADE

SEQ ID NO: 1195260 - protein, 15 aa, Mycobacterium
DADEAESRAKAHDAE

SEQ ID NO: 1195261 - protein, 8 aa, Mycobacterium
DADEARDV

SEQ ID NO: 1195262 - protein, 8 aa, Mycobacterium
DADEEQLG

SEQ ID NO: 1195263 - protein, 6 aa, Mycobacterium
DADEFD

SEQ ID NO: 1195264 - protein, 9 aa, Mycobacterium
DADEGGYVQ

SEQ ID NO: 1195265 - protein, 15 aa, Mycobacterium
DADEHTRQDATSAGT

SEQ ID NO: 1195266 - protein, 9 aa, Mycobacterium
DADESTRSA

SEQ ID NO: 1195267 - protein, 6 aa, Mycobacterium
DADGAA

SEQ ID NO: 1195268 - protein, 8 aa, Mycobacterium
DADGAAQT

SEQ ID NO: 1195269 - protein, 10 aa, Mycobacterium
DADGAPEPLP

SEQ ID NO: 1195270 - protein, 7 aa, Mycobacterium
DADGDLA

SEQ ID NO: 1195271 - protein, 9 aa, Mycobacterium
DADGDPVRA

SEQ ID NO: 1195272 - protein, 9 aa, Mycobacterium
DADGGTRVH

SEQ ID NO: 1195273 - protein, 5 aa, Mycobacterium
DADGI

SEQ ID NO: 1195274 - protein, 9 aa, Mycobacterium
DADGNAKLG

SEQ ID NO: 1195275 - protein, 11 aa, Mycobacterium
DADGPDAVGAY

SEQ ID NO: 1195276 - protein, 23 aa, Mycobacterium
DADGPLLSGGDGPHGLRTAGAQA

SEQ ID NO: 1195277 - protein, 11 aa, Mycobacterium
DADGQPPITAK

SEQ ID NO: 1195278 - protein, 9 aa, Mycobacterium
DADGTEREG

SEQ ID NO: 1195279 - protein, 8 aa, Mycobacterium
DADGTKAG

SEQ ID NO: 1195280 - protein, 9 aa, Mycobacterium
DADGTQTPF

SEQ ID NO: 1195281 - protein, 8 aa, Mycobacterium
DADLAEAA

SEQ ID NO: 1195282 - protein, 36 aa, Mycobacterium
DADLKTEAKGDDGEDLGAVGEDADTGSSTGDDEAEV

SEQ ID NO: 1195283 - protein, 5 aa, Mycobacterium
DADLS

SEQ ID NO: 1195284 - protein, 8 aa, Mycobacterium
DADLTELG

SEQ ID NO: 1195285 - protein, 5 aa, Mycobacterium
DADNA

SEQ ID NO: 1195286 - protein, 5 aa, Mycobacterium
DADNP

SEQ ID NO: 1195287 - protein, 6 aa, Mycobacterium
DADNPA

SEQ ID NO: 1195288 - protein, 5 aa, Mycobacterium
DADPA

SEQ ID NO: 1195289 - protein, 13 aa, Mycobacterium
DADPKGGAVTLSL

SEQ ID NO: 1195290 - protein, 5 aa, Mycobacterium
DADPP

SEQ ID NO: 1195291 - protein, 8 aa, Mycobacterium
DADPRDGL

SEQ ID NO: 1195292 - protein, 7 aa, Mycobacterium
DADQPTA

SEQ ID NO: 1195293 - protein, 9 aa, Mycobacterium
DADQQQPRP

SEQ ID NO: 1195294 - protein, 6 aa, Mycobacterium
DADRAA

SEQ ID NO: 1195295 - protein, 8 aa, Mycobacterium
DADRDAPY

SEQ ID NO: 1195296 - protein, 7 aa, Mycobacterium
DADRHRQ

SEQ ID NO: 1195297 - protein, 7 aa, Mycobacterium
DADRQLK

SEQ ID NO: 1195298 - protein, 6 aa, Mycobacterium
DADSDQ

SEQ ID NO: 1195299 - protein, 7 aa, Mycobacterium
DADSRRV

SEQ ID NO: 1195300 - protein, 12 aa, Mycobacterium
DADTAPCAGSYP

SEQ ID NO: 1195301 - protein, 6 aa, Mycobacterium
DADTGT

SEQ ID NO: 1195302 - protein, 5 aa, Mycobacterium
DADTP

SEQ ID NO: 1195303 - protein, 8 aa, Mycobacterium
DADTPGEV

SEQ ID NO: 1195304 - protein, 20 aa, Mycobacterium
DADTVPPGAYDISGPETTTY

SEQ ID NO: 1195305 - protein, 4 aa, Mycobacterium
DADW

SEQ ID NO: 1195306 - protein, 11 aa, Mycobacterium
DADYRSGPAEG

SEQ ID NO: 1195307 - protein, 15 aa, Mycobacterium
DAEAGTAVVGPGVGG

SEQ ID NO: 1195308 - protein, 22 aa, Mycobacterium
DAEAGTESSSQATEAASSDPIP

SEQ ID NO: 1195309 - protein, 9 aa, Mycobacterium
DAEAKSGYA

SEQ ID NO: 1195310 - protein, 14 aa, Mycobacterium
DAEAPDDQAPQAEP

SEQ ID NO: 1195311 - protein, 6 aa, Mycobacterium
DAEAPT

SEQ ID NO: 1195312 - protein, 7 aa, Mycobacterium
DAEARDF

SEQ ID NO: 1195313 - protein, 12 aa, Mycobacterium
DAEATRRPHGQH

SEQ ID NO: 1195314 - protein, 10 aa, Mycobacterium
DAEATSTAVR

SEQ ID NO: 1195315 - protein, 6 aa, Mycobacterium
DAEAYA

SEQ ID NO: 1195316 - protein, 6 aa, Mycobacterium
DAEEAN

SEQ ID NO: 1195317 - protein, 9 aa, Mycobacterium
DAEEASNEI

SEQ ID NO: 1195318 - protein, 13 aa, Mycobacterium
DAEEGLPSAGLRA

SEQ ID NO: 1195319 - protein, 8 aa, Mycobacterium
DAEEGPDA

SEQ ID NO: 1195320 - protein, 6 aa, Mycobacterium
DAEFDT

SEQ ID NO: 1195321 - protein, 17 aa, Mycobacterium
DAEGAPAYLESTKESNV

SEQ ID NO: 1195322 - protein, 7 aa, Mycobacterium
DAEGGTG

SEQ ID NO: 1195323 - protein, 8 aa, Mycobacterium
DAEGKPLM

SEQ ID NO: 1195324 - protein, 6 aa, Mycobacterium
DAEGRA

SEQ ID NO: 1195325 - protein, 9 aa, Mycobacterium
DAEGRDKQL

SEQ ID NO: 1195326 - protein, 9 aa, Mycobacterium
DAEGVRPEQ

SEQ ID NO: 1195327 - protein, 7 aa, Mycobacterium
DAEGYPK

SEQ ID NO: 1195328 - protein, 9 aa, Mycobacterium
DAEKTASFG

SEQ ID NO: 1195329 - protein, 7 aa, Mycobacterium
DAELEAA

SEQ ID NO: 1195330 - protein, 6 aa, Mycobacterium
DAELGE

SEQ ID NO: 1195331 - protein, 11 aa, Mycobacterium
DAELRGKTDEF

SEQ ID NO: 1195332 - protein, 8 aa, Mycobacterium
DAEPARET

SEQ ID NO: 1195333 - protein, 5 aa, Mycobacterium
DAEPD

SEQ ID NO: 1195334 - protein, 22 aa, Mycobacterium
DAEPEGKPSDPRTRGAQTDKDP

SEQ ID NO: 1195335 - protein, 7 aa, Mycobacterium
DAEPGHH

SEQ ID NO: 1195336 - protein, 16 aa, Mycobacterium
DAEQGPAELGDEFDGD

SEQ ID NO: 1195337 - protein, 4 aa, Mycobacterium
DAER

SEQ ID NO: 1195338 - protein, 25 aa, Mycobacterium
DAERAATAARRGADVAEELDDAPHG

SEQ ID NO: 1195339 - protein, 17 aa, Mycobacterium
DAERDARRRETGRPPAL

SEQ ID NO: 1195340 - protein, 5 aa, Mycobacterium
DAERE

SEQ ID NO: 1195341 - protein, 9 aa, Mycobacterium
DAERGTGGN

SEQ ID NO: 1195342 - protein, 13 aa, Mycobacterium
DAERHGVRSGERV

SEQ ID NO: 1195343 - protein, 8 aa, Mycobacterium
DAERPQGA

SEQ ID NO: 1195344 - protein, 7 aa, Mycobacterium
DAERSAV

SEQ ID NO: 1195345 - protein, 5 aa, Mycobacterium
DAESF

SEQ ID NO: 1195346 - protein, 7 aa, Mycobacterium
DAETRSR

SEQ ID NO: 1195347 - protein, 7 aa, Mycobacterium
DAETSWA

SEQ ID NO: 1195348 - protein, 10 aa, Mycobacterium
DAEVAGPGGR

SEQ ID NO: 1195349 - protein, 6 aa, Mycobacterium
DAFEDT

SEQ ID NO: 1195350 - protein, 6 aa, Mycobacterium
DAFRPG

SEQ ID NO: 1195351 - protein, 5 aa, Mycobacterium
DAFSG

SEQ ID NO: 1195352 - protein, 19 aa, Mycobacterium
DAGAAAAADSIVDSTDPRV

SEQ ID NO: 1195353 - protein, 6 aa, Mycobacterium
DAGAAF

SEQ ID NO: 1195354 - protein, 7 aa, Mycobacterium
DAGAESL

SEQ ID NO: 1195355 - protein, 8 aa, Mycobacterium
DAGAGPGG

SEQ ID NO: 1195356 - protein, 7 aa, Mycobacterium
DAGAGRT

SEQ ID NO: 1195357 - protein, 9 aa, Mycobacterium
DAGAPAYDG

SEQ ID NO: 1195358 - protein, 8 aa, Mycobacterium
DAGAPPHP

SEQ ID NO: 1195359 - protein, 5 aa, Mycobacterium
DAGAQ

SEQ ID NO: 1195360 - protein, 11 aa, Mycobacterium
DAGAQGDDRAF

SEQ ID NO: 1195361 - protein, 5 aa, Mycobacterium
DAGAR

SEQ ID NO: 1195362 - protein, 11 aa, Mycobacterium
DAGASIEAEYP

SEQ ID NO: 1195363 - protein, 7 aa, Mycobacterium
DAGDANA

SEQ ID NO: 1195364 - protein, 10 aa, Mycobacterium
DAGDATPATT

SEQ ID NO: 1195365 - protein, 125 aa, Mycobacterium
DAGDGGFGGYAGSQNQATGRSGGDGGRGGVLSGNGGDGGIGGYATSIGTGPAEGGAGGYGGSGGAFSRGGDGGAGGNGLSATAPGNGGSGGRGGDGGPGGDGGLGGKGGVGSTNNGADGPDGGPA

SEQ ID NO: 1195366 - protein, 30 aa, Mycobacterium
DAGDPQASGKTYKVSGTLKQGISSEDAKKI

SEQ ID NO: 1195367 - protein, 7 aa, Mycobacterium
DAGDPVE

SEQ ID NO: 1195368 - protein, 7 aa, Mycobacterium
DAGDVAS

SEQ ID NO: 1195369 - protein, 8 aa, Mycobacterium
DAGEDVTE

SEQ ID NO: 1195370 - protein, 9 aa, Mycobacterium
DAGEISGQV

SEQ ID NO: 1195371 - protein, 5 aa, Mycobacterium
DAGEL

SEQ ID NO: 1195372 - protein, 5 aa, Mycobacterium
DAGER

SEQ ID NO: 1195373 - protein, 8 aa, Mycobacterium
DAGERADV

SEQ ID NO: 1195374 - protein, 14 aa, Mycobacterium
DAGESAAEEPGLDS

SEQ ID NO: 1195375 - protein, 5 aa, Mycobacterium
DAGGA

SEQ ID NO: 1195376 - protein, 9 aa, Mycobacterium
DAGGARPTF

SEQ ID NO: 1195377 - protein, 5 aa, Mycobacterium
DAGGD

SEQ ID NO: 1195378 - protein, 7 aa, Mycobacterium
DAGGDTD

SEQ ID NO: 1195379 - protein, 13 aa, Mycobacterium
DAGGGLSLEPADL

SEQ ID NO: 1195380 - protein, 17 aa, Mycobacterium
DAGGNGTGISATDRART

SEQ ID NO: 1195381 - protein, 5 aa, Mycobacterium
DAGGP

SEQ ID NO: 1195382 - protein, 6 aa, Mycobacterium
DAGGPI

SEQ ID NO: 1195383 - protein, 8 aa, Mycobacterium
DAGGPPTL

SEQ ID NO: 1195384 - protein, 6 aa, Mycobacterium
DAGGTA

SEQ ID NO: 1195385 - protein, 33 aa, Mycobacterium
DAGGTDPASVDAPAAAADGQALDEPVAQNAASD

SEQ ID NO: 1195386 - protein, 26 aa, Mycobacterium
DAGGVTVTQNGPGSSEQAPGAANRPQ

SEQ ID NO: 1195387 - protein, 8 aa, Mycobacterium
DAGGYESE

SEQ ID NO: 1195388 - protein, 18 aa, Mycobacterium
DAGGYKSEPMWGPGGSEA

SEQ ID NO: 1195389 - protein, 8 aa, Mycobacterium
DAGGYRSD

SEQ ID NO: 1195390 - protein, 7 aa, Mycobacterium
DAGGYTV

SEQ ID NO: 1195391 - protein, 11 aa, Mycobacterium
DAGHHDGGVEE

SEQ ID NO: 1195392 - protein, 8 aa, Mycobacterium
DAGHRQRA

SEQ ID NO: 1195393 - protein, 7 aa, Mycobacterium
DAGIGKT

SEQ ID NO: 1195394 - protein, 7 aa, Mycobacterium
DAGKQRF

SEQ ID NO: 1195395 - protein, 9 aa, Mycobacterium
DAGKTAVTT

SEQ ID NO: 1195396 - protein, 5 aa, Mycobacterium
DAGKV

SEQ ID NO: 1195397 - protein, 8 aa, Mycobacterium
DAGLNTYG

SEQ ID NO: 1195398 - protein, 6 aa, Mycobacterium
DAGLSD

SEQ ID NO: 1195399 - protein, 8 aa, Mycobacterium
DAGLSTAD

SEQ ID NO: 1195400 - protein, 8 aa, Mycobacterium
DAGMDPKT

SEQ ID NO: 1195401 - protein, 7 aa, Mycobacterium
DAGMGRR

SEQ ID NO: 1195402 - protein, 23 aa, Mycobacterium
DAGMVPPQAVPRPALRSNARPAG

SEQ ID NO: 1195403 - protein, 10 aa, Mycobacterium
DAGNGGNAGW

SEQ ID NO: 1195404 - protein, 10 aa, Mycobacterium
DAGNIKEKKD

SEQ ID NO: 1195405 - protein, 8 aa, Mycobacterium
DAGPDRTA

SEQ ID NO: 1195406 - protein, 5 aa, Mycobacterium
DAGPG

SEQ ID NO: 1195407 - protein, 9 aa, Mycobacterium
DAGPGGDVK

SEQ ID NO: 1195408 - protein, 7 aa, Mycobacterium
DAGQQFS

SEQ ID NO: 1195409 - protein, 10 aa, Mycobacterium
DAGQSEGELD

SEQ ID NO: 1195410 - protein, 14 aa, Mycobacterium
DAGQSGQDAADKYR

SEQ ID NO: 1195411 - protein, 7 aa, Mycobacterium
DAGQTTV

SEQ ID NO: 1195412 - protein, 7 aa, Mycobacterium
DAGRARG

SEQ ID NO: 1195413 - protein, 7 aa, Mycobacterium
DAGREAK

SEQ ID NO: 1195414 - protein, 6 aa, Mycobacterium
DAGREL

SEQ ID NO: 1195415 - protein, 9 aa, Mycobacterium
DAGRGDQPA

SEQ ID NO: 1195416 - protein, 8 aa, Mycobacterium
DAGRGDSE

SEQ ID NO: 1195417 - protein, 5 aa, Mycobacterium
DAGRH

SEQ ID NO: 1195418 - protein, 13 aa, Mycobacterium
DAGRLDGPLPVRD

SEQ ID NO: 1195419 - protein, 13 aa, Mycobacterium
DAGRTGDPGGAVY

SEQ ID NO: 1195420 - protein, 8 aa, Mycobacterium
DAGSAAQK

SEQ ID NO: 1195421 - protein, 14 aa, Mycobacterium
DAGSAPKPQSDPSV

SEQ ID NO: 1195422 - protein, 24 aa, Mycobacterium
DAGSEHADDDVVSDPSKGTEDRVD

SEQ ID NO: 1195423 - protein, 7 aa, Mycobacterium
DAGSGFD

SEQ ID NO: 1195424 - protein, 12 aa, Mycobacterium
DAGSSDAISTGT

SEQ ID NO: 1195425 - protein, 19 aa, Mycobacterium
DAGSVEQTSEVAYQITAVG

SEQ ID NO: 1195426 - protein, 6 aa, Mycobacterium
DAGTPI

SEQ ID NO: 1195427 - protein, 8 aa, Mycobacterium
DAGTRGPV

SEQ ID NO: 1195428 - protein, 8 aa, Mycobacterium
DAGVAGRE

SEQ ID NO: 1195429 - protein, 6 aa, Mycobacterium
DAGVDP

SEQ ID NO: 1195430 - protein, 7 aa, Mycobacterium
DAGVDSD

SEQ ID NO: 1195431 - protein, 8 aa, Mycobacterium
DAGVPARG

SEQ ID NO: 1195432 - protein, 8 aa, Mycobacterium
DAGVPLPA

SEQ ID NO: 1195433 - protein, 5 aa, Mycobacterium
DAGVR

SEQ ID NO: 1195434 - protein, 15 aa, Mycobacterium
DAGVRSSAGLLTLSV

SEQ ID NO: 1195435 - protein, 4 aa, Mycobacterium
DAGY

SEQ ID NO: 1195436 - protein, 17 aa, Mycobacterium
DAHADDPADGGDGKSLT

SEQ ID NO: 1195437 - protein, 7 aa, Mycobacterium
DAHADRV

SEQ ID NO: 1195438 - protein, 18 aa, Mycobacterium
DAHDEPNVYSESGVTSSP

SEQ ID NO: 1195439 - protein, 8 aa, Mycobacterium
DAHGDAVK

SEQ ID NO: 1195440 - protein, 8 aa, Mycobacterium
DAHGPSLE

SEQ ID NO: 1195441 - protein, 9 aa, Mycobacterium
DAHGSGRSK

SEQ ID NO: 1195442 - protein, 4 aa, Mycobacterium
DAHP

SEQ ID NO: 1195443 - protein, 7 aa, Mycobacterium
DAHPAAL

SEQ ID NO: 1195444 - protein, 5 aa, Mycobacterium
DAHPG

SEQ ID NO: 1195445 - protein, 7 aa, Mycobacterium
DAHPIGT

SEQ ID NO: 1195446 - protein, 5 aa, Mycobacterium
DAHQG

SEQ ID NO: 1195447 - protein, 14 aa, Mycobacterium
DAHRAAGRNKADPM

SEQ ID NO: 1195448 - protein, 6 aa, Mycobacterium
DAHSDS

SEQ ID NO: 1195449 - protein, 4 aa, Mycobacterium
DAIA

SEQ ID NO: 1195450 - protein, 6 aa, Mycobacterium
DAIAKG

SEQ ID NO: 1195451 - protein, 20 aa, Mycobacterium
DAIPEPTDLPPGPFSPNDPR

SEQ ID NO: 1195452 - protein, 12 aa, Mycobacterium
DAIPGGNVKRGD

SEQ ID NO: 1195453 - protein, 10 aa, Mycobacterium
DAIRSTRKGF

SEQ ID NO: 1195454 - protein, 11 aa, Mycobacterium
DAKAREQLSRR

SEQ ID NO: 1195455 - protein, 19 aa, Mycobacterium
DAKEGPRAFKEKRAPNFQM

SEQ ID NO: 1195456 - protein, 14 aa, Mycobacterium
DAKEPTSKSAIKRA

SEQ ID NO: 1195457 - protein, 7 aa, Mycobacterium
DAKGLTN

SEQ ID NO: 1195458 - protein, 10 aa, Mycobacterium
DAKGNAAYTG

SEQ ID NO: 1195459 - protein, 10 aa, Mycobacterium
DAKKSGRPNA

SEQ ID NO: 1195460 - protein, 7 aa, Mycobacterium
DAKPGNF

SEQ ID NO: 1195461 - protein, 7 aa, Mycobacterium
DAKPGVS

SEQ ID NO: 1195462 - protein, 10 aa, Mycobacterium
DAKQAREVGR

SEQ ID NO: 1195463 - protein, 33 aa, Mycobacterium
DAKRRRTSSGESEFGKPVGDTSPPTPGRHVPPA

SEQ ID NO: 1195464 - protein, 8 aa, Mycobacterium
DAKSEEAR

SEQ ID NO: 1195465 - protein, 9 aa, Mycobacterium
DAKSRRKTI

SEQ ID NO: 1195466 - protein, 6 aa, Mycobacterium
DAKSTL

SEQ ID NO: 1195467 - protein, 15 aa, Mycobacterium
DAKTDRSAFPAGATA

SEQ ID NO: 1195468 - protein, 10 aa, Mycobacterium
DAKTRASRDA

SEQ ID NO: 1195469 - protein, 14 aa, Mycobacterium
DAKYSSNPNPGGQV

SEQ ID NO: 1195470 - protein, 8 aa, Mycobacterium
DALADTDC

SEQ ID NO: 1195471 - protein, 10 aa, Mycobacterium
DALAEEHSAA

SEQ ID NO: 1195472 - protein, 17 aa, Mycobacterium
DALATSAGAVGAAADTV

SEQ ID NO: 1195473 - protein, 5 aa, Mycobacterium
DALDA

SEQ ID NO: 1195474 - protein, 6 aa, Mycobacterium
DALDED

SEQ ID NO: 1195475 - protein, 11 aa, Mycobacterium
DALGGDGPLAE

SEQ ID NO: 1195476 - protein, 8 aa, Mycobacterium
DALGRTDR

SEQ ID NO: 1195477 - protein, 9 aa, Mycobacterium
DALPAEAAT

SEQ ID NO: 1195478 - protein, 14 aa, Mycobacterium
DALPATADGPGRAA

SEQ ID NO: 1195479 - protein, 32 aa, Mycobacterium
DALPEGQPYNTAPQTQDDERGAWDRGADPRLR

SEQ ID NO: 1195480 - protein, 14 aa, Mycobacterium
DALPEKIKEQVAKA

SEQ ID NO: 1195481 - protein, 15 aa, Mycobacterium
DALPPDTATVTGEQR

SEQ ID NO: 1195482 - protein, 7 aa, Mycobacterium
DALPTRD

SEQ ID NO: 1195483 - protein, 8 aa, Mycobacterium
DALPTRDA

SEQ ID NO: 1195484 - protein, 11 aa, Mycobacterium
DALQKHSTAPA

SEQ ID NO: 1195485 - protein, 11 aa, Mycobacterium
DALQSASGVDQ

SEQ ID NO: 1195486 - protein, 7 aa, Mycobacterium
DALRDVK

SEQ ID NO: 1195487 - protein, 9 aa, Mycobacterium
DALRTQRTS

SEQ ID NO: 1195488 - protein, 7 aa, Mycobacterium
DALSGDA

SEQ ID NO: 1195489 - protein, 9 aa, Mycobacterium
DALSPRRED

SEQ ID NO: 1195490 - protein, 9 aa, Mycobacterium
DALTKPGTV

SEQ ID NO: 1195491 - protein, 30 aa, Mycobacterium
DALTPDQRTALADPGPPPPPLPAAPAPADP

SEQ ID NO: 1195492 - protein, 11 aa, Mycobacterium
DAMAGNGEKLR

SEQ ID NO: 1195493 - protein, 6 aa, Mycobacterium
DAMQKG

SEQ ID NO: 1195494 - protein, 11 aa, Mycobacterium
DAMSADSPVTA

SEQ ID NO: 1195495 - protein, 5 aa, Mycobacterium
DAMTQ

SEQ ID NO: 1195496 - protein, 10 aa, Mycobacterium
DANARGEGRV

SEQ ID NO: 1195497 - protein, 10 aa, Mycobacterium
DANDPAGQGR

SEQ ID NO: 1195498 - protein, 4 aa, Mycobacterium
DANG

SEQ ID NO: 1195499 - protein, 6 aa, Mycobacterium
DANGGD

SEQ ID NO: 1195500 - protein, 7 aa, Mycobacterium
DANGIGT

SEQ ID NO: 1195501 - protein, 7 aa, Mycobacterium
DANNRDD

SEQ ID NO: 1195502 - protein, 7 aa, Mycobacterium
DANNRSD

SEQ ID NO: 1195503 - protein, 7 aa, Mycobacterium
DANPDPR

SEQ ID NO: 1195504 - protein, 14 aa, Mycobacterium
DANRAALTDTSDRI

SEQ ID NO: 1195505 - protein, 9 aa, Mycobacterium
DANSASGVL

SEQ ID NO: 1195506 - protein, 9 aa, Mycobacterium
DANTLEATQ

SEQ ID NO: 1195507 - protein, 7 aa, Mycobacterium
DAPADAR

SEQ ID NO: 1195508 - protein, 12 aa, Mycobacterium
DAPADGEPNPLR

SEQ ID NO: 1195509 - protein, 9 aa, Mycobacterium
DAPAGAASK

SEQ ID NO: 1195510 - protein, 28 aa, Mycobacterium
DAPAPDPDAAVPDVDAASDESTSSRSYQ

SEQ ID NO: 1195511 - protein, 7 aa, Mycobacterium
DAPAPLS

SEQ ID NO: 1195512 - protein, 6 aa, Mycobacterium
DAPARN

SEQ ID NO: 1195513 - protein, 10 aa, Mycobacterium
DAPDAPEPLP

SEQ ID NO: 1195514 - protein, 6 aa, Mycobacterium
DAPDGG

SEQ ID NO: 1195515 - protein, 13 aa, Mycobacterium
DAPDTTGGVDPLS

SEQ ID NO: 1195516 - protein, 18 aa, Mycobacterium
DAPDVPPAAPDAEPLPDV

SEQ ID NO: 1195517 - protein, 8 aa, Mycobacterium
DAPEDELR

SEQ ID NO: 1195518 - protein, 7 aa, Mycobacterium
DAPEPTY

SEQ ID NO: 1195519 - protein, 15 aa, Mycobacterium
DAPFGGVGRSGMGAY

SEQ ID NO: 1195520 - protein, 5 aa, Mycobacterium
DAPFT

SEQ ID NO: 1195521 - protein, 4 aa, Mycobacterium
DAPG

SEQ ID NO: 1195522 - protein, 17 aa, Mycobacterium
DAPGDPVHHRPETTSDA

SEQ ID NO: 1195523 - protein, 7 aa, Mycobacterium
DAPGEFA

SEQ ID NO: 1195524 - protein, 5 aa, Mycobacterium
DAPGF

SEQ ID NO: 1195525 - protein, 8 aa, Mycobacterium
DAPGKYRD

SEQ ID NO: 1195526 - protein, 6 aa, Mycobacterium
DAPGLR

SEQ ID NO: 1195527 - protein, 5 aa, Mycobacterium
DAPGR

SEQ ID NO: 1195528 - protein, 49 aa, Mycobacterium; identical to SEQ ID NO: 444012

SEQ ID NO: 1195529 - protein, 11 aa, Mycobacterium
DAPGVTVEPQR

SEQ ID NO: 1195530 - protein, 12 aa, Mycobacterium
DAPGVTVEPQRS

SEQ ID NO: 1195531 - protein, 5 aa, Mycobacterium
DAPHG

SEQ ID NO: 1195532 - protein, 5 aa, Mycobacterium
DAPHR

SEQ ID NO: 1195533 - protein, 4 aa, Mycobacterium
DAPI

SEQ ID NO: 1195534 - protein, 6 aa, Mycobacterium
DAPLDD

SEQ ID NO: 1195535 - protein, 7 aa, Mycobacterium
DAPLEDG

SEQ ID NO: 1195536 - protein, 7 aa, Mycobacterium
DAPLEDT

SEQ ID NO: 1195537 - protein, 7 aa, Mycobacterium
DAPLESD

SEQ ID NO: 1195538 - protein, 6 aa, Mycobacterium
DAPLPI

SEQ ID NO: 1195539 - protein, 19 aa, Mycobacterium
DAPLPTQPFNPDATLPGSA

SEQ ID NO: 1195540 - protein, 15 aa, Mycobacterium
DAPPAAGGESAVSGV

SEQ ID NO: 1195541 - protein, 10 aa, Mycobacterium
DAPPGARMDA

SEQ ID NO: 1195542 - protein, 10 aa, Mycobacterium
DAPPGTPRAR

SEQ ID NO: 1195543 - protein, 12 aa, Mycobacterium
DAPPLSNADLDA

SEQ ID NO: 1195544 - protein, 17 aa, Mycobacterium
DAPPSLPGGDSSPTPVG

SEQ ID NO: 1195545 - protein, 7 aa, Mycobacterium
DAPQELR

SEQ ID NO: 1195546 - protein, 7 aa, Mycobacterium
DAPRADV

SEQ ID NO: 1195547 - protein, 8 aa, Mycobacterium
DAPRAGSQ

SEQ ID NO: 1195548 - protein, 6 aa, Mycobacterium
DAPRAQ

SEQ ID NO: 1195549 - protein, 6 aa, Mycobacterium
DAPRRG

SEQ ID NO: 1195550 - protein, 22 aa, Mycobacterium
DAPRVAEGTERYEVDEQGQTIF

SEQ ID NO: 1195551 - protein, 6 aa, Mycobacterium
DAPSAL

SEQ ID NO: 1195552 - protein, 9 aa, Mycobacterium
DAPSGVPPY

SEQ ID NO: 1195553 - protein, 5 aa, Mycobacterium
DAPSL

SEQ ID NO: 1195554 - protein, 9 aa, Mycobacterium
DAPSLDAVT

SEQ ID NO: 1195555 - protein, 5 aa, Mycobacterium
DAPTA

SEQ ID NO: 1195556 - protein, 13 aa, Mycobacterium
DAPTEASGGQVSF

SEQ ID NO: 1195557 - protein, 7 aa, Mycobacterium
DAPTGDV

SEQ ID NO: 1195558 - protein, 12 aa, Mycobacterium
DAPTGISASTDV

SEQ ID NO: 1195559 - protein, 17 aa, Mycobacterium
DAPTGPYDGSVGPTRAR

SEQ ID NO: 1195560 - protein, 15 aa, Mycobacterium
DAPTKEWAGRRNNPT

SEQ ID NO: 1195561 - protein, 12 aa, Mycobacterium
DAPTRIRAGSHR

SEQ ID NO: 1195562 - protein, 7 aa, Mycobacterium
DAPTTVH

SEQ ID NO: 1195563 - protein, 6 aa, Mycobacterium
DAPVPA

SEQ ID NO: 1195564 - protein, 9 aa, Mycobacterium
DAQAAGTTP

SEQ ID NO: 1195565 - protein, 16 aa, Mycobacterium
DAQAARAAAAGGADKI

SEQ ID NO: 1195566 - protein, 6 aa, Mycobacterium
DAQAAV

SEQ ID NO: 1195567 - protein, 17 aa, Mycobacterium
DAQASEDPSTDTSGDTA

SEQ ID NO: 1195568 - protein, 8 aa, Mycobacterium
DAQASENF

SEQ ID NO: 1195569 - protein, 8 aa, Mycobacterium
DAQDRTPA

SEQ ID NO: 1195570 - protein, 8 aa, Mycobacterium
DAQDTAEL

SEQ ID NO: 1195571 - protein, 20 aa, Mycobacterium
DAQDTPASPADLGANPAPPA

SEQ ID NO: 1195572 - protein, 12 aa, Mycobacterium
DAQEGAAEETPL

SEQ ID NO: 1195573 - protein, 5 aa, Mycobacterium
DAQFR

SEQ ID NO: 1195574 - protein, 5 aa, Mycobacterium
DAQFS

SEQ ID NO: 1195575 - protein, 7 aa, Mycobacterium
DAQGQAV

SEQ ID NO: 1195576 - protein, 7 aa, Mycobacterium
DAQGVEA

SEQ ID NO: 1195577 - protein, 13 aa, Mycobacterium
DAQPTTPGVAAAD

SEQ ID NO: 1195578 - protein, 20 aa, Mycobacterium
DAQPTWETQSPNGNAPVSGA

SEQ ID NO: 1195579 - protein, 15 aa, Mycobacterium
DAQRDDLRAAGAALF

SEQ ID NO: 1195580 - protein, 13 aa, Mycobacterium
DAQREKHGAANSW

SEQ ID NO: 1195581 - protein, 7 aa, Mycobacterium
DAQRGIR

SEQ ID NO: 1195582 - protein, 8 aa, Mycobacterium
DAQRPRME

SEQ ID NO: 1195583 - protein, 8 aa, Mycobacterium
DAQTAEET

SEQ ID NO: 1195584 - protein, 19 aa, Mycobacterium
DAQTGFERQATQESGLEPM

SEQ ID NO: 1195585 - protein, 8 aa, Mycobacterium
DAQTRREL

SEQ ID NO: 1195586 - protein, 14 aa, Mycobacterium
DAQVGEAVAHALIT

SEQ ID NO: 1195587 - protein, 9 aa, Mycobacterium
DARAEAARA

SEQ ID NO: 1195588 - protein, 8 aa, Mycobacterium
DARAQADQ

SEQ ID NO: 1195589 - protein, 6 aa, Mycobacterium
DARERA

SEQ ID NO: 1195590 - protein, 4 aa, Mycobacterium
DARF

SEQ ID NO: 1195591 - protein, 4 aa, Mycobacterium
DARG

SEQ ID NO: 1195592 - protein, 11 aa, Mycobacterium
DARGKSLTSKT

SEQ ID NO: 1195593 - protein, 7 aa, Mycobacterium
DARGSYV

SEQ ID NO: 1195594 - protein, 7 aa, Mycobacterium
DARGTTH

SEQ ID NO: 1195595 - protein, 7 aa, Mycobacterium
DARGYEA

SEQ ID NO: 1195596 - protein, 5 aa, Mycobacterium
DARKL

SEQ ID NO: 1195597 - protein, 14 aa, Mycobacterium
DARNEPKGPQRPHP

SEQ ID NO: 1195598 - protein, 5 aa, Mycobacterium
DARPA

SEQ ID NO: 1195599 - protein, 8 aa, Mycobacterium
DARPEPSP

SEQ ID NO: 1195600 - protein, 14 aa, Mycobacterium
DARPHEISGGQQQR

SEQ ID NO: 1195601 - protein, 18 aa, Mycobacterium
DARQTAETTVTEARQRAD

SEQ ID NO: 1195602 - protein, 5 aa, Mycobacterium
DARRA

SEQ ID NO: 1195603 - protein, 7 aa, Mycobacterium
DARRAGA

SEQ ID NO: 1195604 - protein, 7 aa, Mycobacterium
DARRAKA

SEQ ID NO: 1195605 - protein, 8 aa, Mycobacterium
DARRDGDQ

SEQ ID NO: 1195606 - protein, 9 aa, Mycobacterium
DARRDPDPV

SEQ ID NO: 1195607 - protein, 6 aa, Mycobacterium
DARREA

SEQ ID NO: 1195608 - protein, 6 aa, Mycobacterium
DARREP

SEQ ID NO: 1195609 - protein, 6 aa, Mycobacterium
DARRGP

SEQ ID NO: 1195610 - protein, 7 aa, Mycobacterium
DARRSAD

SEQ ID NO: 1195611 - protein, 9 aa, Mycobacterium
DARSDDPDR

SEQ ID NO: 1195612 - protein, 11 aa, Mycobacterium
DARSDPNFTER

SEQ ID NO: 1195613 - protein, 6 aa, Mycobacterium
DARSGA

SEQ ID NO: 1195614 - protein, 7 aa, Mycobacterium
DARSGSR

SEQ ID NO: 1195615 - protein, 5 aa, Mycobacterium
DARSH

SEQ ID NO: 1195616 - protein, 8 aa, Mycobacterium
DARSVAGQ

SEQ ID NO: 1195617 - protein, 5 aa, Mycobacterium
DARVD

SEQ ID NO: 1195618 - protein, 5 aa, Mycobacterium
DARVE

SEQ ID NO: 1195619 - protein, 7 aa, Mycobacterium
DARVPAG

SEQ ID NO: 1195620 - protein, 5 aa, Mycobacterium
DARYG

SEQ ID NO: 1195621 - protein, 8 aa, Mycobacterium
DASAENSN

SEQ ID NO: 1195622 - protein, 6 aa, Mycobacterium
DASANA

SEQ ID NO: 1195623 - protein, 5 aa, Mycobacterium
DASDT

SEQ ID NO: 1195624 - protein, 4 aa, Mycobacterium
DASG

SEQ ID NO: 1195625 - protein, 10 aa, Mycobacterium
DASGAPARIP

SEQ ID NO: 1195626 - protein, 7 aa, Mycobacterium
DASGART

SEQ ID NO: 1195627 - protein, 7 aa, Mycobacterium
DASGDSA

SEQ ID NO: 1195628 - protein, 11 aa, Mycobacterium
DASGPAPDSVD

SEQ ID NO: 1195629 - protein, 14 aa, Mycobacterium
DASGPDGAMPPGQA

SEQ ID NO: 1195630 - protein, 7 aa, Mycobacterium
DASGTSQ

SEQ ID NO: 1195631 - protein, 7 aa, Mycobacterium
DASGVRR

SEQ ID NO: 1195632 - protein, 4 aa, Mycobacterium
DASP

SEQ ID NO: 1195633 - protein, 6 aa, Mycobacterium
DASPAV

SEQ ID NO: 1195634 - protein, 8 aa, Mycobacterium
DASPNDID

SEQ ID NO: 1195635 - protein, 9 aa, Mycobacterium
DASPPGPQI

SEQ ID NO: 1195636 - protein, 8 aa, Mycobacterium
DASPSLRG

SEQ ID NO: 1195637 - protein, 8 aa, Mycobacterium
DASQPSTL

SEQ ID NO: 1195638 - protein, 4 aa, Mycobacterium
DASR

SEQ ID NO: 1195639 - protein, 7 aa, Mycobacterium
DASRPTA

SEQ ID NO: 1195640 - protein, 8 aa, Mycobacterium
DASRTGLN

SEQ ID NO: 1195641 - protein, 4 aa, Mycobacterium
DASS

SEQ ID NO: 1195642 - protein, 7 aa, Mycobacterium
DASSRQL

SEQ ID NO: 1195643 - protein, 6 aa, Mycobacterium
DASSTD

SEQ ID NO: 1195644 - protein, 19 aa, Mycobacterium
DASSTISGSQIAVDRGTMK

SEQ ID NO: 1195645 - protein, 7 aa, Mycobacterium
DASTASR

SEQ ID NO: 1195646 - protein, 7 aa, Mycobacterium
DASTATD

SEQ ID NO: 1195647 - protein, 7 aa, Mycobacterium
DASTDPV

SEQ ID NO: 1195648 - protein, 11 aa, Mycobacterium
DASTGKSVAND

SEQ ID NO: 1195649 - protein, 7 aa, Mycobacterium
DASTLKP

SEQ ID NO: 1195650 - protein, 7 aa, Mycobacterium
DASTPVA

SEQ ID NO: 1195651 - protein, 10 aa, Mycobacterium
DASTSKPRAD

SEQ ID NO: 1195652 - protein, 7 aa, Mycobacterium
DASTYAD

SEQ ID NO: 1195653 - protein, 14 aa, Mycobacterium
DASVSDAQASPPTF

SEQ ID NO: 1195654 - protein, 9 aa, Mycobacterium
DASVTDEGH

SEQ ID NO: 1195655 - protein, 4 aa, Mycobacterium
DASW

SEQ ID NO: 1195656 - protein, 4 aa, Mycobacterium
DASY

SEQ ID NO: 1195657 - protein, 11 aa, Mycobacterium
DATADDARDAL

SEQ ID NO: 1195658 - protein, 11 aa, Mycobacterium
DATADGYVRGE

SEQ ID NO: 1195659 - protein, 8 aa, Mycobacterium
DATADPVE

SEQ ID NO: 1195660 - protein, 7 aa, Mycobacterium
DATAEAI

SEQ ID NO: 1195661 - protein, 7 aa, Mycobacterium
DATAGAA

SEQ ID NO: 1195662 - protein, 6 aa, Mycobacterium
DATAKP

SEQ ID NO: 1195663 - protein, 11 aa, Mycobacterium
DATAQAAEQGY

SEQ ID NO: 1195664 - protein, 12 aa, Mycobacterium
DATARTADEEVD

SEQ ID NO: 1195665 - protein, 11 aa, Mycobacterium
DATDDPNPKYR

SEQ ID NO: 1195666 - protein, 5 aa, Mycobacterium
DATDR

SEQ ID NO: 1195667 - protein, 12 aa, Mycobacterium
DATEAARHTGLR

SEQ ID NO: 1195668 - protein, 5 aa, Mycobacterium
DATEE

SEQ ID NO: 1195669 - protein, 6 aa, Mycobacterium
DATETA

SEQ ID NO: 1195670 - protein, 12 aa, Mycobacterium
DATFGDPHEVTD

SEQ ID NO: 1195671 - protein, 4 aa, Mycobacterium
DATG

SEQ ID NO: 1195672 - protein, 8 aa, Mycobacterium
DATGAESV

SEQ ID NO: 1195673 - protein, 11 aa, Mycobacterium
DATGDKAAMPS

SEQ ID NO: 1195674 - protein, 7 aa, Mycobacterium
DATGDLD

SEQ ID NO: 1195675 - protein, 5 aa, Mycobacterium
DATGE

SEQ ID NO: 1195676 - protein, 10 aa, Mycobacterium
DATGEDADSM

SEQ ID NO: 1195677 - protein, 7 aa, Mycobacterium
DATGERI

SEQ ID NO: 1195678 - protein, 5 aa, Mycobacterium
DATGH

SEQ ID NO: 1195679 - protein, 8 aa, Mycobacterium
DATGITPA

SEQ ID NO: 1195680 - protein, 6 aa, Mycobacterium
DATGLA

SEQ ID NO: 1195681 - protein, 10 aa, Mycobacterium
DATGTRVSSA

SEQ ID NO: 1195682 - protein, 6 aa, Mycobacterium
DATHDG

SEQ ID NO: 1195683 - protein, 7 aa, Mycobacterium
DATHPYS

SEQ ID NO: 1195684 - protein, 4 aa, Mycobacterium
DATK

SEQ ID NO: 1195685 - protein, 5 aa, Mycobacterium
DATKR

SEQ ID NO: 1195686 - protein, 12 aa, Mycobacterium
DATLRGEDLGPI

SEQ ID NO: 1195687 - protein, 13 aa, Mycobacterium
DATNGQVESAPDA

SEQ ID NO: 1195688 - protein, 4 aa, Mycobacterium
DATP

SEQ ID NO: 1195689 - protein, 9 aa, Mycobacterium
DATPATATQ

SEQ ID NO: 1195690 - protein, 8 aa, Mycobacterium
DATPGTLE

SEQ ID NO: 1195691 - protein, 7 aa, Mycobacterium
DATPTNQ

SEQ ID NO: 1195692 - protein, 7 aa, Mycobacterium
DATRARE

SEQ ID NO: 1195693 - protein, 12 aa, Mycobacterium
DATRATADRPAV

SEQ ID NO: 1195694 - protein, 7 aa, Mycobacterium
DATRQPI

SEQ ID NO: 1195695 - protein, 5 aa, Mycobacterium
DATRV

SEQ ID NO: 1195696 - protein, 12 aa, Mycobacterium
DATSADGVAPVG

SEQ ID NO: 1195697 - protein, 7 aa, Mycobacterium
DATSERE

SEQ ID NO: 1195698 - protein, 9 aa, Mycobacterium
DATSTSPGS

SEQ ID NO: 1195699 - protein, 29 aa, Mycobacterium
DATTRAAAAEQASARSAQDAKTAAEQAAQ

SEQ ID NO: 1195700 - protein, 16 aa, Mycobacterium
DATTSSDTPVTELTET

SEQ ID NO: 1195701 - protein, 8 aa, Mycobacterium
DATVAAST

SEQ ID NO: 1195702 - protein, 7 aa, Mycobacterium
DATVPGD

SEQ ID NO: 1195703 - protein, 5 aa, Mycobacterium
DATVQ

SEQ ID NO: 1195704 - protein, 14 aa, Mycobacterium
DAVAAAKAEIDSAA

SEQ ID NO: 1195705 - protein, 9 aa, Mycobacterium
DAVAEIGDG

SEQ ID NO: 1195706 - protein, 33 aa, Mycobacterium
DAVAGEAPVDLPDGAPPSAAASAGPSGRPAAAH

SEQ ID NO: 1195707 - protein, 16 aa, Mycobacterium
DAVAGRRGRPSPSPVA

SEQ ID NO: 1195708 - protein, 10 aa, Mycobacterium
DAVAPQPVGR

SEQ ID NO: 1195709 - protein, 7 aa, Mycobacterium
DAVDAKG

SEQ ID NO: 1195710 - protein, 13 aa, Mycobacterium
DAVDGSPDHTGTA

SEQ ID NO: 1195711 - protein, 7 aa, Mycobacterium
DAVDKGA

SEQ ID NO: 1195712 - protein, 10 aa, Mycobacterium
DAVDSDGVSD

SEQ ID NO: 1195713 - protein, 9 aa, Mycobacterium
DAVEDTRQR

SEQ ID NO: 1195714 - protein, 6 aa, Mycobacterium
DAVGAE

SEQ ID NO: 1195715 - protein, 9 aa, Mycobacterium
DAVGARRPR

SEQ ID NO: 1195716 - protein, 11 aa, Mycobacterium
DAVGEPGELTR

SEQ ID NO: 1195717 - protein, 12 aa, Mycobacterium
DAVGGTPASYAQ

SEQ ID NO: 1195718 - protein, 5 aa, Mycobacterium
DAVNP

SEQ ID NO: 1195719 - protein, 8 aa, Mycobacterium
DAVPSDAE

SEQ ID NO: 1195720 - protein, 8 aa, Mycobacterium
DAVQRPQG

SEQ ID NO: 1195721 - protein, 4 aa, Mycobacterium
DAVR

SEQ ID NO: 1195722 - protein, 8 aa, Mycobacterium
DAVRDGDR

SEQ ID NO: 1195723 - protein, 10 aa, Mycobacterium
DAVRDKDGIS

SEQ ID NO: 1195724 - protein, 7 aa, Mycobacterium
DAVSPDE

SEQ ID NO: 1195725 - protein, 21 aa, Mycobacterium
DAVSTDADTRAAGSAAGLKSF

SEQ ID NO: 1195726 - protein, 20 aa, Mycobacterium
DAVTADPRIDGTRTAAMGGS

SEQ ID NO: 1195727 - protein, 9 aa, Mycobacterium
DAVTGPHRP

SEQ ID NO: 1195728 - protein, 8 aa, Mycobacterium
DAVTTADA

SEQ ID NO: 1195729 - protein, 11 aa, Mycobacterium
DAVTTSGLPAG

SEQ ID NO: 1195730 - protein, 7 aa, Mycobacterium
DAVTTTG

SEQ ID NO: 1195731 - protein, 7 aa, Mycobacterium
DAYAGDA

SEQ ID NO: 1195732 - protein, 7 aa, Mycobacterium
DAYEEAD

SEQ ID NO: 1195733 - protein, 4 aa, Mycobacterium
DAYG

SEQ ID NO: 1195734 - protein, 9 aa, Mycobacterium
DAYGPGTDQ

SEQ ID NO: 1195735 - protein, 4 aa, Mycobacterium
DAYQ

SEQ ID NO: 1195736 - protein, 17 aa, Mycobacterium
DAYRDPWQDGREPASVG

SEQ ID NO: 1195737 - protein, 13 aa, Mycobacterium
DCAGGSGNGPAYV

SEQ ID NO: 1195738 - protein, 9 aa, Mycobacterium
DCAPGQKRA

SEQ ID NO: 1195739 - protein, 15 aa, Mycobacterium
DCAPYSEAVEDVLEA

SEQ ID NO: 1195740 - protein, 8 aa, Mycobacterium
DCDEDDGV

SEQ ID NO: 1195741 - protein, 7 aa, Mycobacterium
DCETERG

SEQ ID NO: 1195742 - protein, 6 aa, Mycobacterium
DCSAPG

SEQ ID NO: 1195743 - protein, 5 aa, Mycobacterium
DCSPL

SEQ ID NO: 1195744 - protein, 7 aa, Mycobacterium
DCSSEDV

SEQ ID NO: 1195745 - protein, 13 aa, Mycobacterium
DCTNAASLQDQSE

SEQ ID NO: 1195746 - protein, 4 aa, Mycobacterium
DDAA

SEQ ID NO: 1195747 - protein, 6 aa, Mycobacterium
DDAAAR

SEQ ID NO: 1195748 - protein, 10 aa, Mycobacterium
DDAAEPQRTP

SEQ ID NO: 1195749 - protein, 9 aa, Mycobacterium
DDAAERGLA

SEQ ID NO: 1195750 - protein, 7 aa, Mycobacterium
DDAAGGL

SEQ ID NO: 1195751 - protein, 13 aa, Mycobacterium
DDAAKDPAAQGAD

SEQ ID NO: 1195752 - protein, 13 aa, Mycobacterium
DDAAKDPDAVGAS

SEQ ID NO: 1195753 - protein, 8 aa, Mycobacterium
DDAASRLQ

SEQ ID NO: 1195754 - protein, 7 aa, Mycobacterium
DDADEAR

SEQ ID NO: 1195755 - protein, 6 aa, Mycobacterium
DDADEQ

SEQ ID NO: 1195756 - protein, 8 aa, Mycobacterium
DDADERLG

SEQ ID NO: 1195757 - protein, 11 aa, Mycobacterium
DDADGEDSGFR

SEQ ID NO: 1195758 - protein, 8 aa, Mycobacterium
DDADPDSP

SEQ ID NO: 1195759 - protein, 5 aa, Mycobacterium
DDADR

SEQ ID NO: 1195760 - protein, 8 aa, Mycobacterium
DDADRRAL

SEQ ID NO: 1195761 - protein, 9 aa, Mycobacterium
DDADSVSDT

SEQ ID NO: 1195762 - protein, 6 aa, Mycobacterium
DDADTL

SEQ ID NO: 1195763 - protein, 10 aa, Mycobacterium
DDADTRAAIT

SEQ ID NO: 1195764 - protein, 10 aa, Mycobacterium
DDAEKASAMR

SEQ ID NO: 1195765 - protein, 6 aa, Mycobacterium
DDAERA

SEQ ID NO: 1195766 - protein, 8 aa, Mycobacterium
DDAERGRL

SEQ ID NO: 1195767 - protein, 14 aa, Mycobacterium
DDAERLTGAAGLST

SEQ ID NO: 1195768 - protein, 6 aa, Mycobacterium
DDAERV

SEQ ID NO: 1195769 - protein, 26 aa, Mycobacterium
DDAETGSGTRHTVGGTSCVPKDGDGV

SEQ ID NO: 1195770 - protein, 8 aa, Mycobacterium
DDAEVPDD

SEQ ID NO: 1195771 - protein, 8 aa, Mycobacterium
DDAGAAVE

SEQ ID NO: 1195772 - protein, 5 aa, Mycobacterium
DDAGD

SEQ ID NO: 1195773 - protein, 6 aa, Mycobacterium
DDAGDA

SEQ ID NO: 1195774 - protein, 7 aa, Mycobacterium
DDAGDDL

SEQ ID NO: 1195775 - protein, 7 aa, Mycobacterium
DDAGGAY

SEQ ID NO: 1195776 - protein, 12 aa, Mycobacterium
DDAGMGSGWATG

SEQ ID NO: 1195777 - protein, 9 aa, Mycobacterium
DDAGNPVAS

SEQ ID NO: 1195778 - protein, 14 aa, Mycobacterium
DDAGQLAETEDKSM

SEQ ID NO: 1195779 - protein, 5 aa, Mycobacterium
DDAGV

SEQ ID NO: 1195780 - protein, 8 aa, Mycobacterium
DDAGYEYK

SEQ ID NO: 1195781 - protein, 5 aa, Mycobacterium
DDAHE

SEQ ID NO: 1195782 - protein, 15 aa, Mycobacterium
DDAHEREQRERYARR

SEQ ID NO: 1195783 - protein, 6 aa, Mycobacterium
DDAHRT

SEQ ID NO: 1195784 - protein, 7 aa, Mycobacterium
DDAIDDR

SEQ ID NO: 1195785 - protein, 7 aa, Mycobacterium
DDAITEH

SEQ ID NO: 1195786 - protein, 9 aa, Mycobacterium
DDAKIQYKE

SEQ ID NO: 1195787 - protein, 7 aa, Mycobacterium
DDAKPEL

SEQ ID NO: 1195788 - protein, 9 aa, Mycobacterium
DDAKTAESF

SEQ ID NO: 1195789 - protein, 4 aa, Mycobacterium
DDAL

SEQ ID NO: 1195790 - protein, 6 aa, Mycobacterium
DDAPGY

SEQ ID NO: 1195791 - protein, 7 aa, Mycobacterium
DDAPLDG

SEQ ID NO: 1195792 - protein, 7 aa, Mycobacterium
DDAQNGA

SEQ ID NO: 1195793 - protein, 7 aa, Mycobacterium
DDAREAQ

SEQ ID NO: 1195794 - protein, 5 aa, Mycobacterium
DDARF

SEQ ID NO: 1195795 - protein, 7 aa, Mycobacterium
DDARRGI

SEQ ID NO: 1195796 - protein, 4 aa, Mycobacterium
DDAS

SEQ ID NO: 1195797 - protein, 6 aa, Mycobacterium
DDASDA

SEQ ID NO: 1195798 - protein, 7 aa, Mycobacterium
DDATAER

SEQ ID NO: 1195799 - protein, 7 aa, Mycobacterium
DDATESA

SEQ ID NO: 1195800 - protein, 7 aa, Mycobacterium
DDATPRL

SEQ ID NO: 1195801 - protein, 14 aa, Mycobacterium
DDAVTVATTSGRPI

SEQ ID NO: 1195802 - protein, 7 aa, Mycobacterium
DDAWPGP

SEQ ID NO: 1195803 - protein, 13 aa, Mycobacterium
DDCETDASAAAAL

SEQ ID NO: 1195804 - protein, 4 aa, Mycobacterium
DDDA

SEQ ID NO: 1195805 - protein, 13 aa, Mycobacterium
DDDANARSFSPDG

SEQ ID NO: 1195806 - protein, 6 aa, Mycobacterium
DDDASF

SEQ ID NO: 1195807 - protein, 4 aa, Mycobacterium
DDDD

SEQ ID NO: 1195808 - protein, 6 aa, Mycobacterium
DDDDDP

SEQ ID NO: 1195809 - protein, 16 aa, Mycobacterium
DDDDPWSRERGPRHRN

SEQ ID NO: 1195810 - protein, 5 aa, Mycobacterium
DDDDQ

SEQ ID NO: 1195811 - protein, 7 aa, Mycobacterium
DDDDTDA

SEQ ID NO: 1195812 - protein, 6 aa, Mycobacterium
DDDDTF

SEQ ID NO: 1195813 - protein, 8 aa, Mycobacterium
DDDEKDTE

SEQ ID NO: 1195814 - protein, 8 aa, Mycobacterium
DDDELKGL

SEQ ID NO: 1195815 - protein, 8 aa, Mycobacterium
DDDELRQH

SEQ ID NO: 1195816 - protein, 12 aa, Mycobacterium
DDDERNEKQARE

SEQ ID NO: 1195817 - protein, 4 aa, Mycobacterium
DDDF

SEQ ID NO: 1195818 - protein, 10 aa, Mycobacterium
DDDGDAQKSF

SEQ ID NO: 1195819 - protein, 9 aa, Mycobacterium
DDDGDDVSE

SEQ ID NO: 1195820 - protein, 11 aa, Mycobacterium
DDDGDECPPGV

SEQ ID NO: 1195821 - protein, 10 aa, Mycobacterium
DDDGKPVAFG

SEQ ID NO: 1195822 - protein, 12 aa, Mycobacterium
DDDGNDLPGVTT

SEQ ID NO: 1195823 - protein, 15 aa, Mycobacterium
DDDGNELEPSPDYGE

SEQ ID NO: 1195824 - protein, 9 aa, Mycobacterium
DDDGNRLPW

SEQ ID NO: 1195825 - protein, 7 aa, Mycobacterium
DDDGPEA

SEQ ID NO: 1195826 - protein, 7 aa, Mycobacterium
DDDGTVK

SEQ ID NO: 1195827 - protein, 14 aa, Mycobacterium
DDDGTVYVKTEEAS

SEQ ID NO: 1195828 - protein, 5 aa, Mycobacterium
DDDGV

SEQ ID NO: 1195829 - protein, 8 aa, Mycobacterium
DDDGYRGM

SEQ ID NO: 1195830 - protein, 5 aa, Mycobacterium
DDDHA

SEQ ID NO: 1195831 - protein, 11 aa, Mycobacterium
DDDKTPPPFER

SEQ ID NO: 1195832 - protein, 11 aa, Mycobacterium
DDDLQAAAREL

SEQ ID NO: 1195833 - protein, 14 aa, Mycobacterium
DDDPANPDGATTSV

SEQ ID NO: 1195834 - protein, 8 aa, Mycobacterium
DDDPAPPV

SEQ ID NO: 1195835 - protein, 7 aa, Mycobacterium
DDDPDLP

SEQ ID NO: 1195836 - protein, 6 aa, Mycobacterium
DDDPEF

SEQ ID NO: 1195837 - protein, 9 aa, Mycobacterium
DDDPPRAVR

SEQ ID NO: 1195838 - protein, 9 aa, Mycobacterium
DDDPRRGDR

SEQ ID NO: 1195839 - protein, 14 aa, Mycobacterium
DDDRDVVAGPATEG

SEQ ID NO: 1195840 - protein, 9 aa, Mycobacterium
DDDSGVVTP

SEQ ID NO: 1195841 - protein, 5 aa, Mycobacterium
DDDSP

SEQ ID NO: 1195842 - protein, 7 aa, Mycobacterium
DDDSSGK

SEQ ID NO: 1195843 - protein, 17 aa, Mycobacterium
DDDTFAGSHPSKNPVRT

SEQ ID NO: 1195844 - protein, 7 aa, Mycobacterium
DDDTPGL

SEQ ID NO: 1195845 - protein, 6 aa, Mycobacterium
DDDTRA

SEQ ID NO: 1195846 - protein, 6 aa, Mycobacterium
DDDWPI

SEQ ID NO: 1195847 - protein, 12 aa, Mycobacterium
DDDYTKRPFAER

SEQ ID NO: 1195848 - protein, 15 aa, Mycobacterium
DDEAPGWAQGYGPVP

SEQ ID NO: 1195849 - protein, 8 aa, Mycobacterium
DDEAQSEF

SEQ ID NO: 1195850 - protein, 8 aa, Mycobacterium
DDEASSRR

SEQ ID NO: 1195851 - protein, 11 aa, Mycobacterium
DDEDHAAPPMT

SEQ ID NO: 1195852 - protein, 12 aa, Mycobacterium
DDEDWSREVDEG

SEQ ID NO: 1195853 - protein, 8 aa, Mycobacterium
DDEEAVRE

SEQ ID NO: 1195854 - protein, 6 aa, Mycobacterium
DDEEHA

SEQ ID NO: 1195855 - protein, 45 aa, Mycobacterium
DDEEHEHGHTPAGDGPGSWRKAPDFASDPDRAAAVREGTRRDRER

SEQ ID NO: 1195856 - protein, 8 aa, Mycobacterium
DDEENTTG

SEQ ID NO: 1195857 - protein, 7 aa, Mycobacterium
DDEGHPV

SEQ ID NO: 1195858 - protein, 17 aa, Mycobacterium
DDEGKSTLPPWSPHGPQ

SEQ ID NO: 1195859 - protein, 7 aa, Mycobacterium
DDEGVRA

SEQ ID NO: 1195860 - protein, 8 aa, Mycobacterium
DDEIATAD

SEQ ID NO: 1195861 - protein, 18 aa, Mycobacterium
DDEKQRVSGDDEADRIIE

SEQ ID NO: 1195862 - protein, 9 aa, Mycobacterium
DDEKRAGNS

SEQ ID NO: 1195863 - protein, 11 aa, Mycobacterium
DDEKVSPRTRA

SEQ ID NO: 1195864 - protein, 7 aa, Mycobacterium
DDELQRR

SEQ ID NO: 1195865 - protein, 10 aa, Mycobacterium
DDENVSPRTR

SEQ ID NO: 1195866 - protein, 4 aa, Mycobacterium
DDEP

SEQ ID NO: 1195867 - protein, 5 aa, Mycobacterium
DDEPD

SEQ ID NO: 1195868 - protein, 5 aa, Mycobacterium
DDEPR

SEQ ID NO: 1195869 - protein, 11 aa, Mycobacterium
DDEPSNRATPL

SEQ ID NO: 1195870 - protein, 7 aa, Mycobacterium
DDEPTGR

SEQ ID NO: 1195871 - protein, 13 aa, Mycobacterium
DDEPYQASTEDEV

SEQ ID NO: 1195872 - protein, 6 aa, Mycobacterium
DDEQRE

SEQ ID NO: 1195873 - protein, 7 aa, Mycobacterium
DDEQTSL

SEQ ID NO: 1195874 - protein, 7 aa, Mycobacterium
DDERFGS

SEQ ID NO: 1195875 - protein, 6 aa, Mycobacterium
DDERPQ

SEQ ID NO: 1195876 - protein, 10 aa, Mycobacterium
DDESEPVPDN

SEQ ID NO: 1195877 - protein, 13 aa, Mycobacterium
DDESRARIGRLLS

SEQ ID NO: 1195878 - protein, 4 aa, Mycobacterium
DDET

SEQ ID NO: 1195879 - protein, 14 aa, Mycobacterium
DDETARRGFGPYTP

SEQ ID NO: 1195880 - protein, 8 aa, Mycobacterium
DDETGPLS

SEQ ID NO: 1195881 - protein, 13 aa, Mycobacterium
DDETLRGAGRGRE

SEQ ID NO: 1195882 - protein, 9 aa, Mycobacterium
DDETREDAR

SEQ ID NO: 1195883 - protein, 6 aa, Mycobacterium
DDEVRV

SEQ ID NO: 1195884 - protein, 5 aa, Mycobacterium
DDEWQ

SEQ ID NO: 1195885 - protein, 13 aa, Mycobacterium
DDEWQRGHAPGAQ

SEQ ID NO: 1195886 - protein, 5 aa, Mycobacterium
DDEYE

SEQ ID NO: 1195887 - protein, 6 aa, Mycobacterium
DDEYGP

SEQ ID NO: 1195888 - protein, 14 aa, Mycobacterium
DDEYSSLEERAANT

SEQ ID NO: 1195889 - protein, 8 aa, Mycobacterium
DDFKTKTL

SEQ ID NO: 1195890 - protein, 7 aa, Mycobacterium
DDFPELE

SEQ ID NO: 1195891 - protein, 8 aa, Mycobacterium
DDFPSRAC

SEQ ID NO: 1195892 - protein, 6 aa, Mycobacterium
DDFRRP

SEQ ID NO: 1195893 - protein, 9 aa, Mycobacterium
DDGADGTPI

SEQ ID NO: 1195894 - protein, 6 aa, Mycobacterium
DDGADL

SEQ ID NO: 1195895 - protein, 6 aa, Mycobacterium
DDGAEA

SEQ ID NO: 1195896 - protein, 9 aa, Mycobacterium
DDGAELDVP

SEQ ID NO: 1195897 - protein, 6 aa, Mycobacterium
DDGAGN

SEQ ID NO: 1195898 - protein, 8 aa, Mycobacterium
DDGATVTA

SEQ ID NO: 1195899 - protein, 14 aa, Mycobacterium
DDGAVANKNRSVKA

SEQ ID NO: 1195900 - protein, 32 aa, Mycobacterium
DDGAVDARPSAANGATGRPSKPVTVKSAERGE

SEQ ID NO: 1195901 - protein, 19 aa, Mycobacterium
DDGAVTQDEVRATADAYGT

SEQ ID NO: 1195902 - protein, 6 aa, Mycobacterium
DDGCAT

SEQ ID NO: 1195903 - protein, 7 aa, Mycobacterium
DDGDDGP

SEQ ID NO: 1195904 - protein, 9 aa, Mycobacterium
DDGDGPEEG

SEQ ID NO: 1195905 - protein, 8 aa, Mycobacterium
DDGDGPVA

SEQ ID NO: 1195906 - protein, 11 aa, Mycobacterium
DDGEAGPTFRP

SEQ ID NO: 1195907 - protein, 11 aa, Mycobacterium
DDGEDDRTQRY

SEQ ID NO: 1195908 - protein, 19 aa, Mycobacterium
DDGEGGACGGASAPHPTSA

SEQ ID NO: 1195909 - protein, 9 aa, Mycobacterium
DDGEQPGLR

SEQ ID NO: 1195910 - protein, 6 aa, Mycobacterium
DDGETT

SEQ ID NO: 1195911 - protein, 11 aa, Mycobacterium
DDGEYARPGLR

SEQ ID NO: 1195912 - protein, 9 aa, Mycobacterium
DDGGPWPDR

SEQ ID NO: 1195913 - protein, 6 aa, Mycobacterium
DDGGRA

SEQ ID NO: 1195914 - protein, 5 aa, Mycobacterium
DDGLP

SEQ ID NO: 1195915 - protein, 8 aa, Mycobacterium
DDGLVNED

SEQ ID NO: 1195916 - protein, 9 aa, Mycobacterium
DDGNGPEEG

SEQ ID NO: 1195917 - protein, 7 aa, Mycobacterium
DDGNRHV

SEQ ID NO: 1195918 - protein, 5 aa, Mycobacterium
DDGNV

SEQ ID NO: 1195919 - protein, 7 aa, Mycobacterium
DDGPGRW

SEQ ID NO: 1195920 - protein, 10 aa, Mycobacterium
DDGPGSPYDI

SEQ ID NO: 1195921 - protein, 8 aa, Mycobacterium
DDGPNHRG

SEQ ID NO: 1195922 - protein, 7 aa, Mycobacterium
DDGPRPT

SEQ ID NO: 1195923 - protein, 10 aa, Mycobacterium
DDGQLSSISA

SEQ ID NO: 1195924 - protein, 6 aa, Mycobacterium
DDGQME

SEQ ID NO: 1195925 - protein, 6 aa, Mycobacterium
DDGQQK

SEQ ID NO: 1195926 - protein, 5 aa, Mycobacterium
DDGRD

SEQ ID NO: 1195927 - protein, 12 aa, Mycobacterium
DDGRDVPAGETG

SEQ ID NO: 1195928 - protein, 11 aa, Mycobacterium
DDGRLTASNTD

SEQ ID NO: 1195929 - protein, 9 aa, Mycobacterium
DDGRPGDAE

SEQ ID NO: 1195930 - protein, 11 aa, Mycobacterium
DDGRPQKVQFG

SEQ ID NO: 1195931 - protein, 5 aa, Mycobacterium
DDGRT

SEQ ID NO: 1195932 - protein, 11 aa, Mycobacterium
DDGSDDAYADA

SEQ ID NO: 1195933 - protein, 8 aa, Mycobacterium
DDGSGAQT

SEQ ID NO: 1195934 - protein, 8 aa, Mycobacterium
DDGSISPE

SEQ ID NO: 1195935 - protein, 7 aa, Mycobacterium
DDGSLAS

SEQ ID NO: 1195936 - protein, 8 aa, Mycobacterium
DDGSTLPI

SEQ ID NO: 1195937 - protein, 7 aa, Mycobacterium
DDGSVKS

SEQ ID NO: 1195938 - protein, 13 aa, Mycobacterium
DDGTELPHDGESI

SEQ ID NO: 1195939 - protein, 7 aa, Mycobacterium
DDGTGPA

SEQ ID NO: 1195940 - protein, 7 aa, Mycobacterium
DDGTGTW

SEQ ID NO: 1195941 - protein, 6 aa, Mycobacterium
DDGTLA

SEQ ID NO: 1195942 - protein, 8 aa, Mycobacterium
DDGTNRRA

SEQ ID NO: 1195943 - protein, 10 aa, Mycobacterium
DDGTPKSPQW

SEQ ID NO: 1195944 - protein, 7 aa, Mycobacterium
DDGTSVE

SEQ ID NO: 1195945 - protein, 5 aa, Mycobacterium
DDGTT

SEQ ID NO: 1195946 - protein, 7 aa, Mycobacterium
DDGTVDT

SEQ ID NO: 1195947 - protein, 8 aa, Mycobacterium
DDGTVTPE

SEQ ID NO: 1195948 - protein, 18 aa, Mycobacterium
DDGVGEVTYPPKGTFRNG

SEQ ID NO: 1195949 - protein, 8 aa, Mycobacterium
DDGVPGGL

SEQ ID NO: 1195950 - protein, 5 aa, Mycobacterium
DDGVR

SEQ ID NO: 1195951 - protein, 9 aa, Mycobacterium
DDGYEQARA

SEQ ID NO: 1195952 - protein, 5 aa, Mycobacterium
DDHEA

SEQ ID NO: 1195953 - protein, 7 aa, Mycobacterium
DDHGRGP

SEQ ID NO: 1195954 - protein, 8 aa, Mycobacterium
DDHGTETA

SEQ ID NO: 1195955 - protein, 7 aa, Mycobacterium
DDHPEPV

SEQ ID NO: 1195956 - protein, 7 aa, Mycobacterium
DDHQPYQ

SEQ ID NO: 1195957 - protein, 5 aa, Mycobacterium
DDIDA

SEQ ID NO: 1195958 - protein, 7 aa, Mycobacterium
DDIDDRV

SEQ ID NO: 1195959 - protein, 9 aa, Mycobacterium
DDIKDGKYE

SEQ ID NO: 1195960 - protein, 7 aa, Mycobacterium
DDIPEHG

SEQ ID NO: 1195961 - protein, 5 aa, Mycobacterium
DDISR

SEQ ID NO: 1195962 - protein, 6 aa, Mycobacterium
DDITAN

SEQ ID NO: 1195963 - protein, 5 aa, Mycobacterium
DDITG

SEQ ID NO: 1195964 - protein, 9 aa, Mycobacterium
DDITQRQQE

SEQ ID NO: 1195965 - protein, 17 aa, Mycobacterium
DDKGASDRISEYSAGTS

SEQ ID NO: 1195966 - protein, 9 aa, Mycobacterium
DDKGRQLES

SEQ ID NO: 1195967 - protein, 11 aa, Mycobacterium
DDKPADGPVMP

SEQ ID NO: 1195968 - protein, 6 aa, Mycobacterium
DDKQLD

SEQ ID NO: 1195969 - protein, 7 aa, Mycobacterium
DDKRDVA

SEQ ID NO: 1195970 - protein, 6 aa, Mycobacterium
DDKRTE

SEQ ID NO: 1195971 - protein, 16 aa, Mycobacterium
DDLAEYSAGEPNRDRA

SEQ ID NO: 1195972 - protein, 10 aa, Mycobacterium
DDLAKAAEGV

SEQ ID NO: 1195973 - protein, 11 aa, Mycobacterium
DDLAKAQGIPP

SEQ ID NO: 1195974 - protein, 19 aa, Mycobacterium
DDLDNGDGLDRPAAAVEDD

SEQ ID NO: 1195975 - protein, 7 aa, Mycobacterium
DDLDPET

SEQ ID NO: 1195976 - protein, 19 aa, Mycobacterium
DDLGDNRGFDPNSGPEETR

SEQ ID NO: 1195977 - protein, 20 aa, Mycobacterium
DDLGPLGAKSMSESPYNPVA

SEQ ID NO: 1195978 - protein, 4 aa, Mycobacterium
DDLP

SEQ ID NO: 1195979 - protein, 5 aa, Mycobacterium
DDLPP

SEQ ID NO: 1195980 - protein, 9 aa, Mycobacterium
DDLPPADGY

SEQ ID NO: 1195981 - protein, 7 aa, Mycobacterium
DDLRGNV

SEQ ID NO: 1195982 - protein, 7 aa, Mycobacterium
DDLYADE

SEQ ID NO: 1195983 - protein, 13 aa, Mycobacterium
DDMSTSDGGADRR

SEQ ID NO: 1195984 - protein, 12 aa, Mycobacterium
DDMTDEQFEQDA

SEQ ID NO: 1195985 - protein, 12 aa, Mycobacterium
DDNAASTSSAEA

SEQ ID NO: 1195986 - protein, 12 aa, Mycobacterium
DDNAVDTAQPLT

SEQ ID NO: 1195987 - protein, 8 aa, Mycobacterium
DDNDAFSS

SEQ ID NO: 1195988 - protein, 13 aa, Mycobacterium
DDNGSDLFDPSAP

SEQ ID NO: 1195989 - protein, 7 aa, Mycobacterium
DDNKRKF

SEQ ID NO: 1195990 - protein, 10 aa, Mycobacterium
DDNPRDEDPA

SEQ ID NO: 1195991 - protein, 9 aa, Mycobacterium
DDNSPVAPG

SEQ ID NO: 1195992 - protein, 7 aa, Mycobacterium
DDPADCR

SEQ ID NO: 1195993 - protein, 5 aa, Mycobacterium
DDPAE

SEQ ID NO: 1195994 - protein, 5 aa, Mycobacterium
DDPAF

SEQ ID NO: 1195995 - protein, 9 aa, Mycobacterium
DDPAGQSVD

SEQ ID NO: 1195996 - protein, 9 aa, Mycobacterium
DDPAPDGLA

SEQ ID NO: 1195997 - protein, 8 aa, Mycobacterium
DDPAPEAL

SEQ ID NO: 1195998 - protein, 5 aa, Mycobacterium
DDPAR

SEQ ID NO: 1195999 - protein, 9 aa, Mycobacterium
DDPARAAPA

SEQ ID NO: 1196000 - protein, 13 aa, Mycobacterium
DDPATGKRTYYNA

SEQ ID NO: 1196001 - protein, 6 aa, Mycobacterium
DDPAVA

SEQ ID NO: 1196002 - protein, 9 aa, Mycobacterium
DDPAVAAAR

SEQ ID NO: 1196003 - protein, 6 aa, Mycobacterium
DDPAYP

SEQ ID NO: 1196004 - protein, 4 aa, Mycobacterium
DDPD

SEQ ID NO: 1196005 - protein, 7 aa, Mycobacterium
DDPDAAA

SEQ ID NO: 1196006 - protein, 9 aa, Mycobacterium
DDPDAAAKA

SEQ ID NO: 1196007 - protein, 7 aa, Mycobacterium
DDPDAQA

SEQ ID NO: 1196008 - protein, 6 aa, Mycobacterium
DDPDAT

SEQ ID NO: 1196009 - protein, 7 aa, Mycobacterium
DDPDLPQ

SEQ ID NO: 1196010 - protein, 10 aa, Mycobacterium
DDPDMERRAQ

SEQ ID NO: 1196011 - protein, 8 aa, Mycobacterium
DDPDNSRA

SEQ ID NO: 1196012 - protein, 9 aa, Mycobacterium
DDPDPGSAS

SEQ ID NO: 1196013 - protein, 32 aa, Mycobacterium
DDPDRDKRKNDNPDSGPGSGGDPFGSGFPGGE

SEQ ID NO: 1196014 - protein, 5 aa, Mycobacterium
DDPDV

SEQ ID NO: 1196015 - protein, 5 aa, Mycobacterium
DDPEA

SEQ ID NO: 1196016 - protein, 6 aa, Mycobacterium
DDPEEA

SEQ ID NO: 1196017 - protein, 5 aa, Mycobacterium
DDPEG

SEQ ID NO: 1196018 - protein, 6 aa, Mycobacterium
DDPEGY

SEQ ID NO: 1196019 - protein, 12 aa, Mycobacterium
DDPELGADERCG

SEQ ID NO: 1196020 - protein, 8 aa, Mycobacterium
DDPEPFDP

SEQ ID NO: 1196021 - protein, 27 aa, Mycobacterium
DDPERDKSKKDPDGGSGPGGSPSDPFG

SEQ ID NO: 1196022 - protein, 8 aa, Mycobacterium
DDPERGEQ

SEQ ID NO: 1196023 - protein, 7 aa, Mycobacterium
DDPEVST

SEQ ID NO: 1196024 - protein, 5 aa, Mycobacterium
DDPFS

SEQ ID NO: 1196025 - protein, 8 aa, Mycobacterium
DDPGDEAF

SEQ ID NO: 1196026 - protein, 8 aa, Mycobacterium
DDPGEPVT

SEQ ID NO: 1196027 - protein, 6 aa, Mycobacterium
DDPGTI

SEQ ID NO: 1196028 - protein, 7 aa, Mycobacterium
DDPGTVS

SEQ ID NO: 1196029 - protein, 9 aa, Mycobacterium
DDPGTWTEP

SEQ ID NO: 1196030 - protein, 5 aa, Mycobacterium
DDPIS

SEQ ID NO: 1196031 - protein, 4 aa, Mycobacterium
DDPK

SEQ ID NO: 1196032 - protein, 7 aa, Mycobacterium
DDPKSRV

SEQ ID NO: 1196033 - protein, 4 aa, Mycobacterium
DDPM

SEQ ID NO: 1196034 - protein, 11 aa, Mycobacterium
DDPNLQPMAAN

SEQ ID NO: 1196035 - protein, 9 aa, Mycobacterium
DDPNPEAAG

SEQ ID NO: 1196036 - protein, 28 aa, Mycobacterium
DDPNPIGPLNDPNVPGRQFSGNGHGSGG

SEQ ID NO: 1196037 - protein, 6 aa, Mycobacterium
DDPNQW

SEQ ID NO: 1196038 - protein, 9 aa, Mycobacterium
DDPPQPDPH

SEQ ID NO: 1196039 - protein, 6 aa, Mycobacterium
DDPQEG

SEQ ID NO: 1196040 - protein, 7 aa, Mycobacterium
DDPQPEW

SEQ ID NO: 1196041 - protein, 8 aa, Mycobacterium
DDPRFMPP

SEQ ID NO: 1196042 - protein, 9 aa, Mycobacterium
DDPRGEKFA

SEQ ID NO: 1196043 - protein, 8 aa, Mycobacterium
DDPRPEAL

SEQ ID NO: 1196044 - protein, 7 aa, Mycobacterium
DDPRPGQ

SEQ ID NO: 1196045 - protein, 11 aa, Mycobacterium
DDPRSEGERRS

SEQ ID NO: 1196046 - protein, 22 aa, Mycobacterium
DDPRSVGAVGSTGTTAANALAA

SEQ ID NO: 1196047 - protein, 7 aa, Mycobacterium
DDPSGRA

SEQ ID NO: 1196048 - protein, 9 aa, Mycobacterium
DDPSHAADN

SEQ ID NO: 1196049 - protein, 9 aa, Mycobacterium
DDPSTPDIN

SEQ ID NO: 1196050 - protein, 5 aa, Mycobacterium
DDPSV

SEQ ID NO: 1196051 - protein, 12 aa, Mycobacterium
DDPTADVKEGRR

SEQ ID NO: 1196052 - protein, 9 aa, Mycobacterium
DDPTATARE

SEQ ID NO: 1196053 - protein, 6 aa, Mycobacterium
DDPTCP

SEQ ID NO: 1196054 - protein, 9 aa, Mycobacterium
DDPTDNIAN

SEQ ID NO: 1196055 - protein, 6 aa, Mycobacterium
DDPTEM

SEQ ID NO: 1196056 - protein, 10 aa, Mycobacterium
DDPTNGDGFE

SEQ ID NO: 1196057 - protein, 9 aa, Mycobacterium
DDPTQGKDR

SEQ ID NO: 1196058 - protein, 8 aa, Mycobacterium
DDPTRGTG

SEQ ID NO: 1196059 - protein, 6 aa, Mycobacterium
DDPTTL

SEQ ID NO: 1196060 - protein, 4 aa, Mycobacterium
DDPV

SEQ ID NO: 1196061 - protein, 6 aa, Mycobacterium
DDPVAA

SEQ ID NO: 1196062 - protein, 7 aa, Mycobacterium
DDPVEQH

SEQ ID NO: 1196063 - protein, 6 aa, Mycobacterium
DDPVSD

SEQ ID NO: 1196064 - protein, 6 aa, Mycobacterium
DDPYPR

SEQ ID NO: 1196065 - protein, 6 aa, Mycobacterium
DDPYRE

SEQ ID NO: 1196066 - protein, 10 aa, Mycobacterium
DDQAAEEHYR

SEQ ID NO: 1196067 - protein, 12 aa, Mycobacterium
DDQARSKPSVSA

SEQ ID NO: 1196068 - protein, 4 aa, Mycobacterium
DDQD

SEQ ID NO: 1196069 - protein, 5 aa, Mycobacterium
DDQFT

SEQ ID NO: 1196070 - protein, 10 aa, Mycobacterium
DDQLTAATPC

SEQ ID NO: 1196071 - protein, 8 aa, Mycobacterium
DDQPDRVF

SEQ ID NO: 1196072 - protein, 7 aa, Mycobacterium
DDQSERM

SEQ ID NO: 1196073 - protein, 8 aa, Mycobacterium
DDQSGAWT

SEQ ID NO: 1196074 - protein, 8 aa, Mycobacterium
DDQTRTAR

SEQ ID NO: 1196075 - protein, 11 aa, Mycobacterium
DDQTVADASYR

SEQ ID NO: 1196076 - protein, 4 aa, Mycobacterium
DDRA

SEQ ID NO: 1196077 - protein, 8 aa, Mycobacterium
DDRAEHER

SEQ ID NO: 1196078 - protein, 10 aa, Mycobacterium
DDRDGPPQRV

SEQ ID NO: 1196079 - protein, 9 aa, Mycobacterium
DDRDPAEVA

SEQ ID NO: 1196080 - protein, 8 aa, Mycobacterium
DDRDQARE

SEQ ID NO: 1196081 - protein, 9 aa, Mycobacterium
DDREAAAAD

SEQ ID NO: 1196082 - protein, 11 aa, Mycobacterium
DDRFGGKAAGL

SEQ ID NO: 1196083 - protein, 5 aa, Mycobacterium
DDRGD

SEQ ID NO: 1196084 - protein, 16 aa, Mycobacterium
DDRGNDGGLPLRPWWS

SEQ ID NO: 1196085 - protein, 6 aa, Mycobacterium
DDRGNL

SEQ ID NO: 1196086 - protein, 8 aa, Mycobacterium
DDRGRPVT

SEQ ID NO: 1196087 - protein, 6 aa, Mycobacterium
DDRGVP

SEQ ID NO: 1196088 - protein, 6 aa, Mycobacterium
DDRIGS

SEQ ID NO: 1196089 - protein, 8 aa, Mycobacterium
DDRIPAGL

SEQ ID NO: 1196090 - protein, 7 aa, Mycobacterium
DDRPRTM

SEQ ID NO: 1196091 - protein, 20 aa, Mycobacterium
DDRPVAERAEAKQISAESTF

SEQ ID NO: 1196092 - protein, 7 aa, Mycobacterium
DDRQRSR

SEQ ID NO: 1196093 - protein, 6 aa, Mycobacterium
DDRRAS

SEQ ID NO: 1196094 - protein, 7 aa, Mycobacterium
DDRRASF

SEQ ID NO: 1196095 - protein, 7 aa, Mycobacterium
DDRRLTG

SEQ ID NO: 1196096 - protein, 12 aa, Mycobacterium
DDRRREARRDLN

SEQ ID NO: 1196097 - protein, 7 aa, Mycobacterium
DDRSAAL

SEQ ID NO: 1196098 - protein, 9 aa, Mycobacterium
DDRSGFAVG

SEQ ID NO: 1196099 - protein, 7 aa, Mycobacterium
DDRTEEH

SEQ ID NO: 1196100 - protein, 8 aa, Mycobacterium
DDRTHTDI

SEQ ID NO: 1196101 - protein, 6 aa, Mycobacterium
DDRTRA

SEQ ID NO: 1196102 - protein, 9 aa, Mycobacterium
DDRTSLKQS

SEQ ID NO: 1196103 - protein, 10 aa, Mycobacterium
DDRVDDRPAL

SEQ ID NO: 1196104 - protein, 8 aa, Mycobacterium
DDSAGVTA

SEQ ID NO: 1196105 - protein, 10 aa, Mycobacterium
DDSAQGTRRE

SEQ ID NO: 1196106 - protein, 8 aa, Mycobacterium
DDSATRTV

SEQ ID NO: 1196107 - protein, 5 aa, Mycobacterium
DDSAV

SEQ ID NO: 1196108 - protein, 6 aa, Mycobacterium
DDSAYT

SEQ ID NO: 1196109 - protein, 6 aa, Mycobacterium
DDSDHP

SEQ ID NO: 1196110 - protein, 7 aa, Mycobacterium
DDSDLAG

SEQ ID NO: 1196111 - protein, 9 aa, Mycobacterium
DDSDRRALE

SEQ ID NO: 1196112 - protein, 8 aa, Mycobacterium
DDSESRGD

SEQ ID NO: 1196113 - protein, 7 aa, Mycobacterium
DDSFSDD

SEQ ID NO: 1196114 - protein, 12 aa, Mycobacterium
DDSGATADNDPH

SEQ ID NO: 1196115 - protein, 7 aa, Mycobacterium
DDSGGEV

SEQ ID NO: 1196116 - protein, 9 aa, Mycobacterium
DDSGRPDLT

SEQ ID NO: 1196117 - protein, 6 aa, Mycobacterium
DDSGRY

SEQ ID NO: 1196118 - protein, 6 aa, Mycobacterium
DDSNVT

SEQ ID NO: 1196119 - protein, 11 aa, Mycobacterium
DDSPDGTGQLA

SEQ ID NO: 1196120 - protein, 10 aa, Mycobacterium
DDSPSSQPAL

SEQ ID NO: 1196121 - protein, 10 aa, Mycobacterium
DDSRGINGET

SEQ ID NO: 1196122 - protein, 8 aa, Mycobacterium
DDSRKQNR

SEQ ID NO: 1196123 - protein, 4 aa, Mycobacterium
DDST

SEQ ID NO: 1196124 - protein, 7 aa, Mycobacterium
DDSTGRY

SEQ ID NO: 1196125 - protein, 6 aa, Mycobacterium
DDSTVH

SEQ ID NO: 1196126 - protein, 8 aa, Mycobacterium
DDTADPAL

SEQ ID NO: 1196127 - protein, 7 aa, Mycobacterium
DDTAQSI

SEQ ID NO: 1196128 - protein, 29 aa, Mycobacterium
DDTAQTGHDDDLSAIGAGAAPVADPTADW

SEQ ID NO: 1196129 - protein, 4 aa, Mycobacterium
DDTD

SEQ ID NO: 1196130 - protein, 7 aa, Mycobacterium
DDTDDDL

SEQ ID NO: 1196131 - protein, 6 aa, Mycobacterium
DDTDER

SEQ ID NO: 1196132 - protein, 7 aa, Mycobacterium
DDTDIPW

SEQ ID NO: 1196133 - protein, 7 aa, Mycobacterium
DDTEARN

SEQ ID NO: 1196134 - protein, 6 aa, Mycobacterium
DDTENL

SEQ ID NO: 1196135 - protein, 5 aa, Mycobacterium
DDTGA

SEQ ID NO: 1196136 - protein, 7 aa, Mycobacterium
DDTGDTE

SEQ ID NO: 1196137 - protein, 10 aa, Mycobacterium
DDTGIAGPQR

SEQ ID NO: 1196138 - protein, 6 aa, Mycobacterium
DDTGTV

SEQ ID NO: 1196139 - protein, 21 aa, Mycobacterium
DDTHKRRQGEVGPALAGARGL

SEQ ID NO: 1196140 - protein, 5 aa, Mycobacterium
DDTLG

SEQ ID NO: 1196141 - protein, 5 aa, Mycobacterium
DDTLP

SEQ ID NO: 1196142 - protein, 6 aa, Mycobacterium
DDTPAA

SEQ ID NO: 1196143 - protein, 5 aa, Mycobacterium
DDTPS

SEQ ID NO: 1196144 - protein, 6 aa, Mycobacterium
DDTRTE

SEQ ID NO: 1196145 - protein, 6 aa, Mycobacterium
DDTSGT

SEQ ID NO: 1196146 - protein, 6 aa, Mycobacterium
DDTTLS

SEQ ID NO: 1196147 - protein, 5 aa, Mycobacterium
DDTTM

SEQ ID NO: 1196148 - protein, 8 aa, Mycobacterium
DDTTTAPV

SEQ ID NO: 1196149 - protein, 7 aa, Mycobacterium
DDTTYGG

SEQ ID NO: 1196150 - protein, 13 aa, Mycobacterium
DDTVKPGTGFDTH

SEQ ID NO: 1196151 - protein, 17 aa, Mycobacterium
DDVDAAAKAIEASGGGI

SEQ ID NO: 1196152 - protein, 5 aa, Mycobacterium
DDVDG

SEQ ID NO: 1196153 - protein, 9 aa, Mycobacterium
DDVDPRRIR

SEQ ID NO: 1196154 - protein, 12 aa, Mycobacterium
DDVGIERERSEL

SEQ ID NO: 1196155 - protein, 8 aa, Mycobacterium
DDVGNIQP

SEQ ID NO: 1196156 - protein, 7 aa, Mycobacterium
DDVGPGD

SEQ ID NO: 1196157 - protein, 9 aa, Mycobacterium
DDVGRAQFP

SEQ ID NO: 1196158 - protein, 13 aa, Mycobacterium
DDVGYPRRAVTEG

SEQ ID NO: 1196159 - protein, 6 aa, Mycobacterium
DDVPEG

SEQ ID NO: 1196160 - protein, 6 aa, Mycobacterium
DDVPGS

SEQ ID NO: 1196161 - protein, 7 aa, Mycobacterium
DDVPGTV

SEQ ID NO: 1196162 - protein, 10 aa, Mycobacterium
DDVQGWPGEI

SEQ ID NO: 1196163 - protein, 11 aa, Mycobacterium
DDVSATGAGNV

SEQ ID NO: 1196164 - protein, 11 aa, Mycobacterium
DDVSPDQIPDE

SEQ ID NO: 1196165 - protein, 7 aa, Mycobacterium
DDVSSVS

SEQ ID NO: 1196166 - protein, 4 aa, Mycobacterium
DDVT

SEQ ID NO: 1196167 - protein, 16 aa, Mycobacterium
DDVTGGPAAADIPDTG

SEQ ID NO: 1196168 - protein, 9 aa, Mycobacterium
DDVTTPAEA

SEQ ID NO: 1196169 - protein, 9 aa, Mycobacterium
DDWNTSGAW

SEQ ID NO: 1196170 - protein, 6 aa, Mycobacterium
DDWTQE

SEQ ID NO: 1196171 - protein, 7 aa, Mycobacterium
DDYRRND

SEQ ID NO: 1196172 - protein, 8 aa, Mycobacterium
DDYSPAGE

SEQ ID NO: 1196173 - protein, 5 aa, Mycobacterium
DDYSV

SEQ ID NO: 1196174 - protein, 9 aa, Mycobacterium
DEAAAAEYE

SEQ ID NO: 1196175 - protein, 6 aa, Mycobacterium
DEAAAK

SEQ ID NO: 1196176 - protein, 42 aa, Mycobacterium
DEAADGDDAPTSDDTEADDAGADEGTPSDTSAGDADSTDSSA

SEQ ID NO: 1196177 - protein, 7 aa, Mycobacterium
DEAAGRD

SEQ ID NO: 1196178 - protein, 6 aa, Mycobacterium
DEAAHD

SEQ ID NO: 1196179 - protein, 6 aa, Mycobacterium
DEAARR

SEQ ID NO: 1196180 - protein, 8 aa, Mycobacterium
DEADPVAA

SEQ ID NO: 1196181 - protein, 5 aa, Mycobacterium
DEADR

SEQ ID NO: 1196182 - protein, 5 aa, Mycobacterium
DEAEA

SEQ ID NO: 1196183 - protein, 7 aa, Mycobacterium
DEAEAVE

SEQ ID NO: 1196184 - protein, 9 aa, Mycobacterium
DEAEERARG

SEQ ID NO: 1196185 - protein, 6 aa, Mycobacterium
DEAERA

SEQ ID NO: 1196186 - protein, 10 aa, Mycobacterium
DEAESLTGAL

SEQ ID NO: 1196187 - protein, 10 aa, Mycobacterium
DEAGAHTTAA

SEQ ID NO: 1196188 - protein, 8 aa, Mycobacterium
DEAGATKR

SEQ ID NO: 1196189 - protein, 11 aa, Mycobacterium
DEAGAVAPGDL

SEQ ID NO: 1196190 - protein, 21 aa, Mycobacterium
DEAGEVPVPGAGGGGDQMPSP

SEQ ID NO: 1196191 - protein, 7 aa, Mycobacterium
DEAGLPR

SEQ ID NO: 1196192 - protein, 20 aa, Mycobacterium
DEAGPVADLPEPEDLSRNGS

SEQ ID NO: 1196193 - protein, 7 aa, Mycobacterium
DEAGQIR

SEQ ID NO: 1196194 - protein, 22 aa, Mycobacterium
DEAGRNGNTTSNPALESAPQAM

SEQ ID NO: 1196195 - protein, 9 aa, Mycobacterium
DEAGSSPVH

SEQ ID NO: 1196196 - protein, 9 aa, Mycobacterium
DEAKAKNAA

SEQ ID NO: 1196197 - protein, 7 aa, Mycobacterium
DEAKGRQ

SEQ ID NO: 1196198 - protein, 8 aa, Mycobacterium
DEALEGAG

SEQ ID NO: 1196199 - protein, 6 aa, Mycobacterium
DEANKP

SEQ ID NO: 1196200 - protein, 6 aa, Mycobacterium
DEAPAL

SEQ ID NO: 1196201 - protein, 8 aa, Mycobacterium
DEAPDTAR

SEQ ID NO: 1196202 - protein, 9 aa, Mycobacterium
DEAPPGTRS

SEQ ID NO: 1196203 - protein, 5 aa, Mycobacterium
DEAPY

SEQ ID NO: 1196204 - protein, 7 aa, Mycobacterium
DEARARR

SEQ ID NO: 1196205 - protein, 5 aa, Mycobacterium
DEARD

SEQ ID NO: 1196206 - protein, 6 aa, Mycobacterium
DEARDR

SEQ ID NO: 1196207 - protein, 7 aa, Mycobacterium
DEARDRD

SEQ ID NO: 1196208 - protein, 10 aa, Mycobacterium
DEAREALSEL

SEQ ID NO: 1196209 - protein, 6 aa, Mycobacterium
DEARHR

SEQ ID NO: 1196210 - protein, 9 aa, Mycobacterium
DEARRRGGA

SEQ ID NO: 1196211 - protein, 5 aa, Mycobacterium
DEART

SEQ ID NO: 1196212 - protein, 8 aa, Mycobacterium
DEARTTDA

SEQ ID NO: 1196213 - protein, 17 aa, Mycobacterium
DEARVDADRRIGAEGQG

SEQ ID NO: 1196214 - protein, 8 aa, Mycobacterium
DEARVPTP

SEQ ID NO: 1196215 - protein, 8 aa, Mycobacterium
DEASAAEP

SEQ ID NO: 1196216 - protein, 7 aa, Mycobacterium
DEASAIG

SEQ ID NO: 1196217 - protein, 8 aa, Mycobacterium
DEASLSSA

SEQ ID NO: 1196218 - protein, 5 aa, Mycobacterium
DEATD

SEQ ID NO: 1196219 - protein, 8 aa, Mycobacterium
DEATDRAR

SEQ ID NO: 1196220 - protein, 7 aa, Mycobacterium
DEATPHR

SEQ ID NO: 1196221 - protein, 9 aa, Mycobacterium
DEATSGTVA

SEQ ID NO: 1196222 - protein, 8 aa, Mycobacterium
DEATTDGH

SEQ ID NO: 1196223 - protein, 4 aa, Mycobacterium
DEAV

SEQ ID NO: 1196224 - protein, 46 aa, Mycobacterium
DECGAGARRGRCDDGPPREQYGYDEGEQPPSRRTQSSSHLPPTPDL

SEQ ID NO: 1196225 - protein, 4 aa, Mycobacterium
DEDA

SEQ ID NO: 1196226 - protein, 18 aa, Mycobacterium
DEDAPGPVPDVPEPTPAE

SEQ ID NO: 1196227 - protein, 15 aa, Mycobacterium
DEDASGSGAEELSLS

SEQ ID NO: 1196228 - protein, 7 aa, Mycobacterium
DEDDASV

SEQ ID NO: 1196229 - protein, 18 aa, Mycobacterium
DEDDGAAPATDGERRTEG

SEQ ID NO: 1196230 - protein, 14 aa, Mycobacterium
DEDEAVAAANASEF

SEQ ID NO: 1196231 - protein, 4 aa, Mycobacterium
DEDF

SEQ ID NO: 1196232 - protein, 4 aa, Mycobacterium
DEDG

SEQ ID NO: 1196233 - protein, 6 aa, Mycobacterium
DEDGAV

SEQ ID NO: 1196234 - protein, 11 aa, Mycobacterium
DEDGDRKTAAN

SEQ ID NO: 1196235 - protein, 6 aa, Mycobacterium
DEDGTE

SEQ ID NO: 1196236 - protein, 8 aa, Mycobacterium
DEDGTEFT

SEQ ID NO: 1196237 - protein, 7 aa, Mycobacterium
DEDGTQF

SEQ ID NO: 1196238 - protein, 31 aa, Mycobacterium
DEDKFAESLKEQGSSREEFDADNRANAEKAI

SEQ ID NO: 1196239 - protein, 4 aa, Mycobacterium
DEDL

SEQ ID NO: 1196240 - protein, 6 aa, Mycobacterium
DEDLAR

SEQ ID NO: 1196241 - protein, 12 aa, Mycobacterium
DEDLPEQGERER

SEQ ID NO: 1196242 - protein, 11 aa, Mycobacterium
DEDLPSGEELG

SEQ ID NO: 1196243 - protein, 16 aa, Mycobacterium
DEDNREPPPKKQRTLG

SEQ ID NO: 1196244 - protein, 7 aa, Mycobacterium
DEDPEFS

SEQ ID NO: 1196245 - protein, 8 aa, Mycobacterium
DEDPGAAA

SEQ ID NO: 1196246 - protein, 5 aa, Mycobacterium
DEDRF

SEQ ID NO: 1196247 - protein, 10 aa, Mycobacterium
DEDRTREAVD

SEQ ID NO: 1196248 - protein, 4 aa, Mycobacterium
DEDS

SEQ ID NO: 1196249 - protein, 4 aa, Mycobacterium
DEDT

SEQ ID NO: 1196250 - protein, 9 aa, Mycobacterium
DEDTDDDIR

SEQ ID NO: 1196251 - protein, 5 aa, Mycobacterium
DEDTM

SEQ ID NO: 1196252 - protein, 6 aa, Mycobacterium
DEDTRV

SEQ ID NO: 1196253 - protein, 18 aa, Mycobacterium
DEDTVDGGFGAAPKFPPS

SEQ ID NO: 1196254 - protein, 6 aa, Mycobacterium
DEDVDR

SEQ ID NO: 1196255 - protein, 4 aa, Mycobacterium
DEEA

SEQ ID NO: 1196256 - protein, 12 aa, Mycobacterium
DEEAADSRVAEG

SEQ ID NO: 1196257 - protein, 7 aa, Mycobacterium
DEEAGGN

SEQ ID NO: 1196258 - protein, 22 aa, Mycobacterium
DEEALNEARAASYDAKAVEPVP

SEQ ID NO: 1196259 - protein, 5 aa, Mycobacterium
DEEDA

SEQ ID NO: 1196260 - protein, 8 aa, Mycobacterium
DEEDERDL

SEQ ID NO: 1196261 - protein, 21 aa, Mycobacterium
DEEDSDALHSGDTEPQLTTTT

SEQ ID NO: 1196262 - protein, 10 aa, Mycobacterium
DEEDSGDDTG

SEQ ID NO: 1196263 - protein, 5 aa, Mycobacterium
DEEEA

SEQ ID NO: 1196264 - protein, 4 aa, Mycobacterium
DEEG

SEQ ID NO: 1196265 - protein, 8 aa, Mycobacterium
DEEGGRVS

SEQ ID NO: 1196266 - protein, 12 aa, Mycobacterium
DEEGPGSGPGDL

SEQ ID NO: 1196267 - protein, 6 aa, Mycobacterium
DEEIKA

SEQ ID NO: 1196268 - protein, 4 aa, Mycobacterium
DEEK

SEQ ID NO: 1196269 - protein, 8 aa, Mycobacterium
DEEKRATL

SEQ ID NO: 1196270 - protein, 4 aa, Mycobacterium
DEEL

SEQ ID NO: 1196271 - protein, 9 aa, Mycobacterium
DEELGGTPM

SEQ ID NO: 1196272 - protein, 4 aa, Mycobacterium
DEEM

SEQ ID NO: 1196273 - protein, 27 aa, Mycobacterium
DEEPGDLDDADEPPLEQGSFYDGVLEV

SEQ ID NO: 1196274 - protein, 7 aa, Mycobacterium
DEERGLG

SEQ ID NO: 1196275 - protein, 7 aa, Mycobacterium
DEERPAL

SEQ ID NO: 1196276 - protein, 4 aa, Mycobacterium
DEES

SEQ ID NO: 1196277 - protein, 12 aa, Mycobacterium
DEESGGSGRPFD

SEQ ID NO: 1196278 - protein, 9 aa, Mycobacterium
DEESQRAAA

SEQ ID NO: 1196279 - protein, 6 aa, Mycobacterium
DEETAD

SEQ ID NO: 1196280 - protein, 6 aa, Mycobacterium
DEEVAQ

SEQ ID NO: 1196281 - protein, 8 aa, Mycobacterium
DEFAEDPA

SEQ ID NO: 1196282 - protein, 5 aa, Mycobacterium
DEFEA

SEQ ID NO: 1196283 - protein, 4 aa, Mycobacterium
DEFG

SEQ ID NO: 1196284 - protein, 8 aa, Mycobacterium
DEFGGSGQ

SEQ ID NO: 1196285 - protein, 9 aa, Mycobacterium
DEFSATGAD

SEQ ID NO: 1196286 - protein, 9 aa, Mycobacterium
DEGAEHLSE

SEQ ID NO: 1196287 - protein, 10 aa, Mycobacterium
DEGAEHLSED

SEQ ID NO: 1196288 - protein, 7 aa, Mycobacterium
DEGAGDR

SEQ ID NO: 1196289 - protein, 6 aa, Mycobacterium
DEGAKS

SEQ ID NO: 1196290 - protein, 6 aa, Mycobacterium
DEGASL

SEQ ID NO: 1196291 - protein, 4 aa, Mycobacterium
DEGC

SEQ ID NO: 1196292 - protein, 16 aa, Mycobacterium
DEGDEEAGGTVREDEV

SEQ ID NO: 1196293 - protein, 6 aa, Mycobacterium
DEGDKN

SEQ ID NO: 1196294 - protein, 11 aa, Mycobacterium
DEGDPSIDKRD

SEQ ID NO: 1196295 - protein, 16 aa, Mycobacterium
DEGDRTRSVVVLRPAT

SEQ ID NO: 1196296 - protein, 4 aa, Mycobacterium
DEGE

SEQ ID NO: 1196297 - protein, 6 aa, Mycobacterium
DEGEFD

SEQ ID NO: 1196298 - protein, 8 aa, Mycobacterium
DEGEPGTF

SEQ ID NO: 1196299 - protein, 8 aa, Mycobacterium
DEGEVPGG

SEQ ID NO: 1196300 - protein, 8 aa, Mycobacterium
DEGGEEAV

SEQ ID NO: 1196301 - protein, 5 aa, Mycobacterium
DEGGL

SEQ ID NO: 1196302 - protein, 9 aa, Mycobacterium
DEGHGAVNP

SEQ ID NO: 1196303 - protein, 4 aa, Mycobacterium
DEGI

SEQ ID NO: 1196304 - protein, 15 aa, Mycobacterium
DEGIRADTTAESLGG

SEQ ID NO: 1196305 - protein, 13 aa, Mycobacterium
DEGKALADELGDA

SEQ ID NO: 1196306 - protein, 4 aa, Mycobacterium
DEGL

SEQ ID NO: 1196307 - protein, 5 aa, Mycobacterium
DEGNE

SEQ ID NO: 1196308 - protein, 10 aa, Mycobacterium
DEGNELPAGR

SEQ ID NO: 1196309 - protein, 8 aa, Mycobacterium
DEGNRWPA

SEQ ID NO: 1196310 - protein, 10 aa, Mycobacterium
DEGNYVGPTI

SEQ ID NO: 1196311 - protein, 24 aa, Mycobacterium
DEGPFGTGAGAPDGTGAGASPPEV

SEQ ID NO: 1196312 - protein, 5 aa, Mycobacterium
DEGPI

SEQ ID NO: 1196313 - protein, 4 aa, Mycobacterium
DEGQ

SEQ ID NO: 1196314 - protein, 6 aa, Mycobacterium
DEGRAL

SEQ ID NO: 1196315 - protein, 5 aa, Mycobacterium
DEGRI

SEQ ID NO: 1196316 - protein, 9 aa, Mycobacterium
DEGRIRPEQ

SEQ ID NO: 1196317 - protein, 16 aa, Mycobacterium
DEGRSDGVTAATGDGK

SEQ ID NO: 1196318 - protein, 5 aa, Mycobacterium
DEGRT

SEQ ID NO: 1196319 - protein, 9 aa, Mycobacterium
DEGRTDEAA

SEQ ID NO: 1196320 - protein, 8 aa, Mycobacterium
DEGTAAAE

SEQ ID NO: 1196321 - protein, 5 aa, Mycobacterium
DEGTF

SEQ ID NO: 1196322 - protein, 6 aa, Mycobacterium
DEGTQG

SEQ ID NO: 1196323 - protein, 7 aa, Mycobacterium
DEGTRWP

SEQ ID NO: 1196324 - protein, 8 aa, Mycobacterium
DEGTVRRH

SEQ ID NO: 1196325 - protein, 5 aa, Mycobacterium
DEGVG

SEQ ID NO: 1196326 - protein, 18 aa, Mycobacterium
DEGVGDVTYPPKGTFRNG

SEQ ID NO: 1196327 - protein, 16 aa, Mycobacterium
DEGVSGGKAIDARPAL

SEQ ID NO: 1196328 - protein, 5 aa, Mycobacterium
DEHGE

SEQ ID NO: 1196329 - protein, 16 aa, Mycobacterium
DEHGPTVKTGPEYGDW

SEQ ID NO: 1196330 - protein, 11 aa, Mycobacterium
DEHGRSRNVSD

SEQ ID NO: 1196331 - protein, 19 aa, Mycobacterium
DEHHAAKDEPEPAACPQDS

SEQ ID NO: 1196332 - protein, 7 aa, Mycobacterium
DEHPADA

SEQ ID NO: 1196333 - protein, 11 aa, Mycobacterium
DEHPRRESTIE

SEQ ID NO: 1196334 - protein, 5 aa, Mycobacterium
DEHQR

SEQ ID NO: 1196335 - protein, 12 aa, Mycobacterium
DEHRGATPRAMA

SEQ ID NO: 1196336 - protein, 8 aa, Mycobacterium
DEHRGRTP

SEQ ID NO: 1196337 - protein, 5 aa, Mycobacterium
DEHRS

SEQ ID NO: 1196338 - protein, 4 aa, Mycobacterium
DEID

SEQ ID NO: 1196339 - protein, 5 aa, Mycobacterium
DEIDD

SEQ ID NO: 1196340 - protein, 7 aa, Mycobacterium
DEIGGTW

SEQ ID NO: 1196341 - protein, 13 aa, Mycobacterium
DEIPDPQDPETFE

SEQ ID NO: 1196342 - protein, 5 aa, Mycobacterium
DEIPN

SEQ ID NO: 1196343 - protein, 4 aa, Mycobacterium
DEIS

SEQ ID NO: 1196344 - protein, 13 aa, Mycobacterium
DEISPAADQSVRA

SEQ ID NO: 1196345 - protein, 7 aa, Mycobacterium
DEISSET

SEQ ID NO: 1196346 - protein, 5 aa, Mycobacterium
DEKAL

SEQ ID NO: 1196347 - protein, 5 aa, Mycobacterium
DEKGA

SEQ ID NO: 1196348 - protein, 8 aa, Mycobacterium
DEKGGDDK

SEQ ID NO: 1196349 - protein, 10 aa, Mycobacterium
DEKGSRPLAQ

SEQ ID NO: 1196350 - protein, 5 aa, Mycobacterium
DEKIA

SEQ ID NO: 1196351 - protein, 9 aa, Mycobacterium
DEKKTAETF

SEQ ID NO: 1196352 - protein, 7 aa, Mycobacterium
DEKPNAP

SEQ ID NO: 1196353 - protein, 7 aa, Mycobacterium
DEKRQSE

SEQ ID NO: 1196354 - protein, 9 aa, Mycobacterium
DEKSAGDIG

SEQ ID NO: 1196355 - protein, 37 aa, Mycobacterium
DEKSLKDIDPADTRGAAPAGDPESAESDQLGDATPGP

SEQ ID NO: 1196356 - protein, 8 aa, Mycobacterium
DEKTNRVA

SEQ ID NO: 1196357 - protein, 6 aa, Mycobacterium
DEKWGE

SEQ ID NO: 1196358 - protein, 18 aa, Mycobacterium
DELADRRPAQLSGGQAQR

SEQ ID NO: 1196359 - protein, 4 aa, Mycobacterium
DELD

SEQ ID NO: 1196360 - protein, 7 aa, Mycobacterium
DELDEAA

SEQ ID NO: 1196361 - protein, 6 aa, Mycobacterium
DELDGR

SEQ ID NO: 1196362 - protein, 11 aa, Mycobacterium
DELEAGRNRTV

SEQ ID NO: 1196363 - protein, 7 aa, Mycobacterium
DELEPVT

SEQ ID NO: 1196364 - protein, 6 aa, Mycobacterium
DELING

SEQ ID NO: 1196365 - protein, 4 aa, Mycobacterium
DELP

SEQ ID NO: 1196366 - protein, 8 aa, Mycobacterium
DELPDPNA

SEQ ID NO: 1196367 - protein, 7 aa, Mycobacterium
DELPGSF

SEQ ID NO: 1196368 - protein, 7 aa, Mycobacterium
DELPPGL

SEQ ID NO: 1196369 - protein, 8 aa, Mycobacterium
DELPRRGD

SEQ ID NO: 1196370 - protein, 5 aa, Mycobacterium
DELRG

SEQ ID NO: 1196371 - protein, 14 aa, Mycobacterium
DELRGPMEKATPLR

SEQ ID NO: 1196372 - protein, 5 aa, Mycobacterium
DELRP

SEQ ID NO: 1196373 - protein, 5 aa, Mycobacterium
DELSG

SEQ ID NO: 1196374 - protein, 8 aa, Mycobacterium
DELSGGAR

SEQ ID NO: 1196375 - protein, 8 aa, Mycobacterium
DELSGQLT

SEQ ID NO: 1196376 - protein, 6 aa, Mycobacterium
DELSRP

SEQ ID NO: 1196377 - protein, 10 aa, Mycobacterium
DELTAGTAEL

SEQ ID NO: 1196378 - protein, 11 aa, Mycobacterium
DELTDGDRDAV

SEQ ID NO: 1196379 - protein, 5 aa, Mycobacterium
DELTE

SEQ ID NO: 1196380 - protein, 11 aa, Mycobacterium
DEMARHDQSDH

SEQ ID NO: 1196381 - protein, 7 aa, Mycobacterium
DEMSGGR

SEQ ID NO: 1196382 - protein, 11 aa, Mycobacterium
DENDAVATDPD

SEQ ID NO: 1196383 - protein, 41 aa, Mycobacterium
DENGEPKFGKDEGGEGTGGQDGGQDKAEDKAENKAEASSES

SEQ ID NO: 1196384 - protein, 9 aa, Mycobacterium
DENGGYPHP

SEQ ID NO: 1196385 - protein, 5 aa, Mycobacterium
DENGT

SEQ ID NO: 1196386 - protein, 8 aa, Mycobacterium
DENGVGDG

SEQ ID NO: 1196387 - protein, 10 aa, Mycobacterium
DENPDAAREF

SEQ ID NO: 1196388 - protein, 12 aa, Mycobacterium
DENRGGVPSAEQ

SEQ ID NO: 1196389 - protein, 5 aa, Mycobacterium
DENTA

SEQ ID NO: 1196390 - protein, 24 aa, Mycobacterium
DENTAAAIDQAAGVDSPNPPVEVG

SEQ ID NO: 1196391 - protein, 14 aa, Mycobacterium
DENTDFATDNDSRN

SEQ ID NO: 1196392 - protein, 6 aa, Mycobacterium
DEPAED

SEQ ID NO: 1196393 - protein, 5 aa, Mycobacterium
DEPAR

SEQ ID NO: 1196394 - protein, 10 aa, Mycobacterium
DEPDGEVSED

SEQ ID NO: 1196395 - protein, 10 aa, Mycobacterium
DEPDPDDRLG

SEQ ID NO: 1196396 - protein, 8 aa, Mycobacterium
DEPDPEAA

SEQ ID NO: 1196397 - protein, 6 aa, Mycobacterium
DEPDPV

SEQ ID NO: 1196398 - protein, 6 aa, Mycobacterium
DEPDRC

SEQ ID NO: 1196399 - protein, 7 aa, Mycobacterium
DEPDSAD

SEQ ID NO: 1196400 - protein, 9 aa, Mycobacterium
DEPDSNRGA

SEQ ID NO: 1196401 - protein, 5 aa, Mycobacterium
DEPDT

SEQ ID NO: 1196402 - protein, 7 aa, Mycobacterium
DEPERHK

SEQ ID NO: 1196403 - protein, 4 aa, Mycobacterium
DEPG

SEQ ID NO: 1196404 - protein, 14 aa, Mycobacterium
DEPGGAVSLSPDGR

SEQ ID NO: 1196405 - protein, 5 aa, Mycobacterium
DEPGL

SEQ ID NO: 1196406 - protein, 17 aa, Mycobacterium
DEPGPPIHGPTAYPAEV

SEQ ID NO: 1196407 - protein, 7 aa, Mycobacterium
DEPGYGK

SEQ ID NO: 1196408 - protein, 14 aa, Mycobacterium
DEPHEPYDRPPLSK

SEQ ID NO: 1196409 - protein, 15 aa, Mycobacterium
DEPHRRREGRSGAAQ

SEQ ID NO: 1196410 - protein, 4 aa, Mycobacterium
DEPI

SEQ ID NO: 1196411 - protein, 5 aa, Mycobacterium
DEPIP

SEQ ID NO: 1196412 - protein, 9 aa, Mycobacterium
DEPLATPAQ

SEQ ID NO: 1196413 - protein, 6 aa, Mycobacterium
DEPLDA

SEQ ID NO: 1196414 - protein, 18 aa, Mycobacterium
DEPLPAAKDLTTAAISGP

SEQ ID NO: 1196415 - protein, 8 aa, Mycobacterium
DEPLREPV

SEQ ID NO: 1196416 - protein, 5 aa, Mycobacterium
DEPNS

SEQ ID NO: 1196417 - protein, 8 aa, Mycobacterium
DEPPPDLA

SEQ ID NO: 1196418 - protein, 16 aa, Mycobacterium
DEPPPLTGSTQPVLGG

SEQ ID NO: 1196419 - protein, 7 aa, Mycobacterium
DEPRERV

SEQ ID NO: 1196420 - protein, 7 aa, Mycobacterium
DEPRGAQ

SEQ ID NO: 1196421 - protein, 19 aa, Mycobacterium
DEPRSTHQEATVPLAAQER

SEQ ID NO: 1196422 - protein, 7 aa, Mycobacterium
DEPSREI

SEQ ID NO: 1196423 - protein, 6 aa, Mycobacterium
DEPSTV

SEQ ID NO: 1196424 - protein, 5 aa, Mycobacterium
DEPTA

SEQ ID NO: 1196425 - protein, 13 aa, Mycobacterium
DEPTGNLDTKTGA

SEQ ID NO: 1196426 - protein, 12 aa, Mycobacterium
DEPTVGINPGDG

SEQ ID NO: 1196427 - protein, 5 aa, Mycobacterium
DEPVT

SEQ ID NO: 1196428 - protein, 4 aa, Mycobacterium
DEPW

SEQ ID NO: 1196429 - protein, 7 aa, Mycobacterium
DEPYPVK

SEQ ID NO: 1196430 - protein, 7 aa, Mycobacterium
DEQAREG

SEQ ID NO: 1196431 - protein, 6 aa, Mycobacterium
DEQAVT

SEQ ID NO: 1196432 - protein, 4 aa, Mycobacterium
DEQG

SEQ ID NO: 1196433 - protein, 6 aa, Mycobacterium
DEQGRA

SEQ ID NO: 1196434 - protein, 7 aa, Mycobacterium
DEQGRSV

SEQ ID NO: 1196435 - protein, 20 aa, Mycobacterium
DEQIKDSITTTLETTPPRHT

SEQ ID NO: 1196436 - protein, 9 aa, Mycobacterium
DEQPEEGPQ

SEQ ID NO: 1196437 - protein, 5 aa, Mycobacterium
DEQPI

SEQ ID NO: 1196438 - protein, 4 aa, Mycobacterium
DEQR

SEQ ID NO: 1196439 - protein, 5 aa, Mycobacterium
DEQRA

SEQ ID NO: 1196440 - protein, 7 aa, Mycobacterium
DEQRRDG

SEQ ID NO: 1196441 - protein, 9 aa, Mycobacterium
DEQRTAQVS

SEQ ID NO: 1196442 - protein, 5 aa, Mycobacterium
DEQSK

SEQ ID NO: 1196443 - protein, 17 aa, Mycobacterium
DEQSSSGLGDIPTDTNA

SEQ ID NO: 1196444 - protein, 8 aa, Mycobacterium
DEQSVSAG

SEQ ID NO: 1196445 - protein, 8 aa, Mycobacterium
DEQTGRGI

SEQ ID NO: 1196446 - protein, 5 aa, Mycobacterium
DEQTR

SEQ ID NO: 1196447 - protein, 6 aa, Mycobacterium
DEQYGQ

SEQ ID NO: 1196448 - protein, 8 aa, Mycobacterium
DERAAQQA

SEQ ID NO: 1196449 - protein, 10 aa, Mycobacterium
DERDASIERT

SEQ ID NO: 1196450 - protein, 7 aa, Mycobacterium
DERDEGV

SEQ ID NO: 1196451 - protein, 6 aa, Mycobacterium
DERDGT

SEQ ID NO: 1196452 - protein, 4 aa, Mycobacterium
DERE

SEQ ID NO: 1196453 - protein, 7 aa, Mycobacterium
DEREGNS

SEQ ID NO: 1196454 - protein, 4 aa, Mycobacterium
DERG

SEQ ID NO: 1196455 - protein, 12 aa, Mycobacterium
DERGAEAVTTDD

SEQ ID NO: 1196456 - protein, 8 aa, Mycobacterium
DERGEDIA

SEQ ID NO: 1196457 - protein, 16 aa, Mycobacterium
DERGGDGGLPLRPWWT

SEQ ID NO: 1196458 - protein, 13 aa, Mycobacterium
DERGHPTESTGEM

SEQ ID NO: 1196459 - protein, 7 aa, Mycobacterium
DERGTNM

SEQ ID NO: 1196460 - protein, 7 aa, Mycobacterium
DERHGDP

SEQ ID NO: 1196461 - protein, 10 aa, Mycobacterium
DERKKTTRRR

SEQ ID NO: 1196462 - protein, 5 aa, Mycobacterium
DERPD

SEQ ID NO: 1196463 - protein, 6 aa, Mycobacterium
DERPEV

SEQ ID NO: 1196464 - protein, 7 aa, Mycobacterium
DERQPVG

SEQ ID NO: 1196465 - protein, 6 aa, Mycobacterium
DERRRG

SEQ ID NO: 1196466 - protein, 6 aa, Mycobacterium
DERSAS

SEQ ID NO: 1196467 - protein, 11 aa, Mycobacterium
DERTDEGRPNI

SEQ ID NO: 1196468 - protein, 8 aa, Mycobacterium
DERTVAPS

SEQ ID NO: 1196469 - protein, 5 aa, Mycobacterium
DERVA

SEQ ID NO: 1196470 - protein, 13 aa, Mycobacterium
DERVDDGTDDDTP

SEQ ID NO: 1196471 - protein, 35 aa, Mycobacterium
DERVGAAATADAGGFPDRAATLRGEAEVLEALLGN

SEQ ID NO: 1196472 - protein, 5 aa, Mycobacterium
DERYG

SEQ ID NO: 1196473 - protein, 7 aa, Mycobacterium
DESAGSR

SEQ ID NO: 1196474 - protein, 6 aa, Mycobacterium
DESDRR

SEQ ID NO: 1196475 - protein, 13 aa, Mycobacterium
DESDVDDYDEFSD

SEQ ID NO: 1196476 - protein, 8 aa, Mycobacterium
DESEAQVS

SEQ ID NO: 1196477 - protein, 13 aa, Mycobacterium
DESGDGVPPGEEG

SEQ ID NO: 1196478 - protein, 8 aa, Mycobacterium
DESGRAAA

SEQ ID NO: 1196479 - protein, 10 aa, Mycobacterium
DESGREPGYQ

SEQ ID NO: 1196480 - protein, 7 aa, Mycobacterium
DESGVPS

SEQ ID NO: 1196481 - protein, 9 aa, Mycobacterium
DESIRKAED

SEQ ID NO: 1196482 - protein, 15 aa, Mycobacterium
DESKGEPREGFPAGT

SEQ ID NO: 1196483 - protein, 5 aa, Mycobacterium
DESKV

SEQ ID NO: 1196484 - protein, 9 aa, Mycobacterium
DESMDPEQT

SEQ ID NO: 1196485 - protein, 9 aa, Mycobacterium
DESNAAAVD

SEQ ID NO: 1196486 - protein, 20 aa, Mycobacterium
DESPAPSASQVGRPSPIVRP

SEQ ID NO: 1196487 - protein, 8 aa, Mycobacterium
DESPESVR

SEQ ID NO: 1196488 - protein, 10 aa, Mycobacterium
DESPRRDTTL

SEQ ID NO: 1196489 - protein, 5 aa, Mycobacterium
DESRP

SEQ ID NO: 1196490 - protein, 14 aa, Mycobacterium
DESSTTRLVRLREK

SEQ ID NO: 1196491 - protein, 10 aa, Mycobacterium
DESTTGTEQF

SEQ ID NO: 1196492 - protein, 10 aa, Mycobacterium
DESVTPEQAF

SEQ ID NO: 1196493 - protein, 6 aa, Mycobacterium
DETADA

SEQ ID NO: 1196494 - protein, 8 aa, Mycobacterium
DETARDQL

SEQ ID NO: 1196495 - protein, 11 aa, Mycobacterium
DETDEQADDPA

SEQ ID NO: 1196496 - protein, 5 aa, Mycobacterium
DETDW

SEQ ID NO: 1196497 - protein, 7 aa, Mycobacterium
DETEIAR

SEQ ID NO: 1196498 - protein, 8 aa, Mycobacterium
DETLTGPG

SEQ ID NO: 1196499 - protein, 7 aa, Mycobacterium
DETNGFL

SEQ ID NO: 1196500 - protein, 4 aa, Mycobacterium
DETP

SEQ ID NO: 1196501 - protein, 6 aa, Mycobacterium
DETRDG

SEQ ID NO: 1196502 - protein, 7 aa, Mycobacterium
DETSGRA

SEQ ID NO: 1196503 - protein, 5 aa, Mycobacterium
DETST

SEQ ID NO: 1196504 - protein, 15 aa, Mycobacterium
DETTATRPESPYGES

SEQ ID NO: 1196505 - protein, 6 aa, Mycobacterium
DETTGQ

SEQ ID NO: 1196506 - protein, 7 aa, Mycobacterium
DETTYRG

SEQ ID NO: 1196507 - protein, 20 aa, Mycobacterium
DETVRSAQAGLGRSQSEGQR

SEQ ID NO: 1196508 - protein, 4 aa, Mycobacterium
DETW

SEQ ID NO: 1196509 - protein, 6 aa, Mycobacterium
DEVGAR

SEQ ID NO: 1196510 - protein, 8 aa, Mycobacterium
DEVGGTWR

SEQ ID NO: 1196511 - protein, 4 aa, Mycobacterium
DEVP

SEQ ID NO: 1196512 - protein, 15 aa, Mycobacterium
DEVPNGKPEPDPYRR

SEQ ID NO: 1196513 - protein, 5 aa, Mycobacterium
DEVPR

SEQ ID NO: 1196514 - protein, 6 aa, Mycobacterium
DEVPRD

SEQ ID NO: 1196515 - protein, 11 aa, Mycobacterium
DEVRAAKGYRE

SEQ ID NO: 1196516 - protein, 6 aa, Mycobacterium
DEVRVG

SEQ ID NO: 1196517 - protein, 19 aa, Mycobacterium
DEVSDVDSAHAGAAVKDSV

SEQ ID NO: 1196518 - protein, 13 aa, Mycobacterium
DEVVPDSETAFDD

SEQ ID NO: 1196519 - protein, 7 aa, Mycobacterium
DEYEQRG

SEQ ID NO: 1196520 - protein, 6 aa, Mycobacterium
DEYPIP

SEQ ID NO: 1196521 - protein, 6 aa, Mycobacterium
DEYPNA

SEQ ID NO: 1196522 - protein, 5 aa, Mycobacterium
DEYPP

SEQ ID NO: 1196523 - protein, 5 aa, Mycobacterium
DEYPV

SEQ ID NO: 1196524 - protein, 8 aa, Mycobacterium
DFADESYR

SEQ ID NO: 1196525 - protein, 24 aa, Mycobacterium
DFDDSDSISVHTGDTEAQDHATTA

SEQ ID NO: 1196526 - protein, 6 aa, Mycobacterium
DFDEDG

SEQ ID NO: 1196527 - protein, 29 aa, Mycobacterium
DFDPNAPFTRADTQKLRGSGNRKPDAHGT

SEQ ID NO: 1196528 - protein, 17 aa, Mycobacterium
DFDTSAAVGDSTASAAA

SEQ ID NO: 1196529 - protein, 17 aa, Mycobacterium
DFEADKDEEPAAPAESA

SEQ ID NO: 1196530 - protein, 11 aa, Mycobacterium
DFEARPRYTDP

SEQ ID NO: 1196531 - protein, 8 aa, Mycobacterium
DFETPTGA

SEQ ID NO: 1196532 - protein, 19 aa, Mycobacterium
DFGGDPDKVTVAGESAGGM

SEQ ID NO: 1196533 - protein, 9 aa, Mycobacterium
DFGKPSGYL

SEQ ID NO: 1196534 - protein, 12 aa, Mycobacterium
DFGPEGEQARED

SEQ ID NO: 1196535 - protein, 6 aa, Mycobacterium
DFGRPS

SEQ ID NO: 1196536 - protein, 7 aa, Mycobacterium
DFHGTPA

SEQ ID NO: 1196537 - protein, 6 aa, Mycobacterium
DFHPPA

SEQ ID NO: 1196538 - protein, 5 aa, Mycobacterium
DFLPN

SEQ ID NO: 1196539 - protein, 14 aa, Mycobacterium
DFPDYTPDRVRADT

SEQ ID NO: 1196540 - protein, 11 aa, Mycobacterium
DFPEPDPAQAV

SEQ ID NO: 1196541 - protein, 5 aa, Mycobacterium
DFPGE

SEQ ID NO: 1196542 - protein, 5 aa, Mycobacterium
DFPGG

SEQ ID NO: 1196543 - protein, 7 aa, Mycobacterium
DFPGTDL

SEQ ID NO: 1196544 - protein, 6 aa, Mycobacterium
DFPNGG

SEQ ID NO: 1196545 - protein, 5 aa, Mycobacterium
DFPPS

SEQ ID NO: 1196546 - protein, 19 aa, Mycobacterium
DFRDTSADTVRHRGGVWSD

SEQ ID NO: 1196547 - protein, 6 aa, Mycobacterium
DFREGT

SEQ ID NO: 1196548 - protein, 12 aa, Mycobacterium
DFRGPRGEPPGI

SEQ ID NO: 1196549 - protein, 20 aa, Mycobacterium
DFRQPGHAEFEDKDATDPLE

SEQ ID NO: 1196550 - protein, 11 aa, Mycobacterium
DFRRTEAEQLT

SEQ ID NO: 1196551 - protein, 7 aa, Mycobacterium
DFSDTAT

SEQ ID NO: 1196552 - protein, 10 aa, Mycobacterium
DFSSGGPQGA

SEQ ID NO: 1196553 - protein, 5 aa, Mycobacterium
DFTET

SEQ ID NO: 1196554 - protein, 8 aa, Mycobacterium
DFTPDGTI

SEQ ID NO: 1196555 - protein, 5 aa, Mycobacterium
DFTRL

SEQ ID NO: 1196556 - protein, 5 aa, Mycobacterium
DGAAA

SEQ ID NO: 1196557 - protein, 6 aa, Mycobacterium
DGAAAA

SEQ ID NO: 1196558 - protein, 14 aa, Mycobacterium
DGAAAERQETDAEL

SEQ ID NO: 1196559 - protein, 8 aa, Mycobacterium
DGAAAREF

SEQ ID NO: 1196560 - protein, 9 aa, Mycobacterium
DGAAARQNL

SEQ ID NO: 1196561 - protein, 16 aa, Mycobacterium
DGAADGSDRLATSPRS

SEQ ID NO: 1196562 - protein, 8 aa, Mycobacterium
DGAAEADL

SEQ ID NO: 1196563 - protein, 17 aa, Mycobacterium
DGAAHESAKSVNAQAYT

SEQ ID NO: 1196564 - protein, 5 aa, Mycobacterium
DGAAP

SEQ ID NO: 1196565 - protein, 7 aa, Mycobacterium
DGAAPPL

SEQ ID NO: 1196566 - protein, 7 aa, Mycobacterium
DGAAPQW

SEQ ID NO: 1196567 - protein, 7 aa, Mycobacterium
DGAATEW

SEQ ID NO: 1196568 - protein, 8 aa, Mycobacterium
DGAATLEQ

SEQ ID NO: 1196569 - protein, 7 aa, Mycobacterium
DGAATLP

SEQ ID NO: 1196570 - protein, 14 aa, Mycobacterium
DGAATRHPSSTERD

SEQ ID NO: 1196571 - protein, 7 aa, Mycobacterium
DGACGSG

SEQ ID NO: 1196572 - protein, 4 aa, Mycobacterium
DGAD

SEQ ID NO: 1196573 - protein, 17 aa, Mycobacterium
DGADAGSGDKPVIDPSR

SEQ ID NO: 1196574 - protein, 11 aa, Mycobacterium
DGADEPLARRE

SEQ ID NO: 1196575 - protein, 8 aa, Mycobacterium
DGADFDPD

SEQ ID NO: 1196576 - protein, 14 aa, Mycobacterium
DGADPRRPAALDPG

SEQ ID NO: 1196577 - protein, 8 aa, Mycobacterium
DGAEKFTP

SEQ ID NO: 1196578 - protein, 8 aa, Mycobacterium
DGAEPRWP

SEQ ID NO: 1196579 - protein, 18 aa, Mycobacterium
DGAEPVNHRPHELVVVPV

SEQ ID NO: 1196580 - protein, 6 aa, Mycobacterium
DGAERV

SEQ ID NO: 1196581 - protein, 17 aa, Mycobacterium
DGAESKTTARNRRDTAN

SEQ ID NO: 1196582 - protein, 8 aa, Mycobacterium
DGAGARIQ

SEQ ID NO: 1196583 - protein, 8 aa, Mycobacterium
DGAGAVEN

SEQ ID NO: 1196584 - protein, 12 aa, Mycobacterium
DGAGAVTGTSAW

SEQ ID NO: 1196585 - protein, 11 aa, Mycobacterium
DGAGKPGERTF

SEQ ID NO: 1196586 - protein, 15 aa, Mycobacterium
DGAGRATPVNAGQGV

SEQ ID NO: 1196587 - protein, 10 aa, Mycobacterium
DGAGRHGPVP

SEQ ID NO: 1196588 - protein, 13 aa, Mycobacterium
DGAHEKGGVEGEI

SEQ ID NO: 1196589 - protein, 7 aa, Mycobacterium
DGALADR

SEQ ID NO: 1196590 - protein, 6 aa, Mycobacterium
DGALPG

SEQ ID NO: 1196591 - protein, 5 aa, Mycobacterium
DGALR

SEQ ID NO: 1196592 - protein, 8 aa, Mycobacterium
DGALRPAS

SEQ ID NO: 1196593 - protein, 6 aa, Mycobacterium
DGAMGG

SEQ ID NO: 1196594 - protein, 12 aa, Mycobacterium
DGANSIAGATAA

SEQ ID NO: 1196595 - protein, 8 aa, Mycobacterium
DGAPAERP

SEQ ID NO: 1196596 - protein, 9 aa, Mycobacterium
DGAPDPHCT

SEQ ID NO: 1196597 - protein, 7 aa, Mycobacterium
DGAPEDV

SEQ ID NO: 1196598 - protein, 14 aa, Mycobacterium
DGAPLADPETESSG

SEQ ID NO: 1196599 - protein, 7 aa, Mycobacterium
DGAPLDD

SEQ ID NO: 1196600 - protein, 17 aa, Mycobacterium
DGAPLGVADGRPATTAA

SEQ ID NO: 1196601 - protein, 6 aa, Mycobacterium
DGAPLP

SEQ ID NO: 1196602 - protein, 8 aa, Mycobacterium
DGAPRHPL

SEQ ID NO: 1196603 - protein, 9 aa, Mycobacterium
DGAQATADE

SEQ ID NO: 1196604 - protein, 8 aa, Mycobacterium
DGAQQDQL

SEQ ID NO: 1196605 - protein, 6 aa, Mycobacterium
DGAQRE

SEQ ID NO: 1196606 - protein, 7 aa, Mycobacterium
DGAQRYP

SEQ ID NO: 1196607 - protein, 16 aa, Mycobacterium
DGAQVSATTAARQAAD

SEQ ID NO: 1196608 - protein, 5 aa, Mycobacterium
DGARD

SEQ ID NO: 1196609 - protein, 12 aa, Mycobacterium
DGARFDEATPGR

SEQ ID NO: 1196610 - protein, 11 aa, Mycobacterium
DGARLAKRDGA

SEQ ID NO: 1196611 - protein, 33 aa, Mycobacterium
DGARQSEERPPGAKAVEDACNARDAPGEIGIRA

SEQ ID NO: 1196612 - protein, 20 aa, Mycobacterium
DGARRDGAEITVGGGPVDGL

SEQ ID NO: 1196613 - protein, 6 aa, Mycobacterium
DGARRR

SEQ ID NO: 1196614 - protein, 10 aa, Mycobacterium
DGARTGAAST

SEQ ID NO: 1196615 - protein, 44 aa, Mycobacterium
DGASPDTGGETPTDPNAQPGPATPAPAPPVSDPALADPALTDAG

SEQ ID NO: 1196616 - protein, 8 aa, Mycobacterium
DGASSRVA

SEQ ID NO: 1196617 - protein, 8 aa, Mycobacterium
DGASTNRI

SEQ ID NO: 1196618 - protein, 10 aa, Mycobacterium
DGATADLNGV

SEQ ID NO: 1196619 - protein, 9 aa, Mycobacterium
DGATAETLT

SEQ ID NO: 1196620 - protein, 10 aa, Mycobacterium
DGATAPDATV

SEQ ID NO: 1196621 - protein, 8 aa, Mycobacterium
DGATASTK

SEQ ID NO: 1196622 - protein, 6 aa, Mycobacterium
DGATEI

SEQ ID NO: 1196623 - protein, 23 aa, Mycobacterium
DGATIEPSTSGTTVQLVWHGVDR

SEQ ID NO: 1196624 - protein, 8 aa, Mycobacterium
DGATKIGG

SEQ ID NO: 1196625 - protein, 16 aa, Mycobacterium
DGATLDPSPPAPRGAS

SEQ ID NO: 1196626 - protein, 5 aa, Mycobacterium
DGATQ

SEQ ID NO: 1196627 - protein, 11 aa, Mycobacterium
DGATSEGDAHE

SEQ ID NO: 1196628 - protein, 6 aa, Mycobacterium
DGATTI

SEQ ID NO: 1196629 - protein, 8 aa, Mycobacterium
DGATTSVD

SEQ ID NO: 1196630 - protein, 10 aa, Mycobacterium
DGAVADSDRS

SEQ ID NO: 1196631 - protein, 13 aa, Mycobacterium
DGAVESAGDLSPV

SEQ ID NO: 1196632 - protein, 8 aa, Mycobacterium
DGAVPAEP

SEQ ID NO: 1196633 - protein, 9 aa, Mycobacterium
DGAVPASES

SEQ ID NO: 1196634 - protein, 11 aa, Mycobacterium
DGAYAKASNQD

SEQ ID NO: 1196635 - protein, 10 aa, Mycobacterium
DGAYGESKAA

SEQ ID NO: 1196636 - protein, 20 aa, Mycobacterium
DGCDTPSVQREGDEEEETAQ

SEQ ID NO: 1196637 - protein, 10 aa, Mycobacterium
DGDAERADKV

SEQ ID NO: 1196638 - protein, 11 aa, Mycobacterium
DGDAGTSSRAR

SEQ ID NO: 1196639 - protein, 7 aa, Mycobacterium
DGDALSI

SEQ ID NO: 1196640 - protein, 8 aa, Mycobacterium
DGDAPRAQ

SEQ ID NO: 1196641 - protein, 8 aa, Mycobacterium
DGDAQQRC

SEQ ID NO: 1196642 - protein, 4 aa, Mycobacterium
DGDC

SEQ ID NO: 1196643 - protein, 6 aa, Mycobacterium
DGDDAR

SEQ ID NO: 1196644 - protein, 6 aa, Mycobacterium
DGDDAV

SEQ ID NO: 1196645 - protein, 15 aa, Mycobacterium
DGDDQSFSTFTTAVK

SEQ ID NO: 1196646 - protein, 6 aa, Mycobacterium
DGDDSV

SEQ ID NO: 1196647 - protein, 9 aa, Mycobacterium
DGDDTGHVR

SEQ ID NO: 1196648 - protein, 7 aa, Mycobacterium
DGDEFTA

SEQ ID NO: 1196649 - protein, 9 aa, Mycobacterium
DGDEPGGGR

SEQ ID NO: 1196650 - protein, 14 aa, Mycobacterium
DGDEPLARRETDDV

SEQ ID NO: 1196651 - protein, 6 aa, Mycobacterium
DGDERT

SEQ ID NO: 1196652 - protein, 9 aa, Mycobacterium
DGDESDRVD

SEQ ID NO: 1196653 - protein, 4 aa, Mycobacterium
DGDG

SEQ ID NO: 1196654 - protein, 9 aa, Mycobacterium
DGDGAQATA

SEQ ID NO: 1196655 - protein, 21 aa, Mycobacterium
DGDGDTPRLGPADHTSTLEAA

SEQ ID NO: 1196656 - protein, 12 aa, Mycobacterium
DGDGHADKRTRE

SEQ ID NO: 1196657 - protein, 9 aa, Mycobacterium
DGDGLGAEE

SEQ ID NO: 1196658 - protein, 12 aa, Mycobacterium
DGDGPDGERTRT

SEQ ID NO: 1196659 - protein, 8 aa, Mycobacterium
DGDGPGPQ

SEQ ID NO: 1196660 - protein, 13 aa, Mycobacterium
DGDGRWGATGARS

SEQ ID NO: 1196661 - protein, 12 aa, Mycobacterium
DGDHHRKNRDQY

SEQ ID NO: 1196662 - protein, 20 aa, Mycobacterium
DGDHPGWSSRPAVESDAARR

SEQ ID NO: 1196663 - protein, 9 aa, Mycobacterium
DGDIEAQRD

SEQ ID NO: 1196664 - protein, 11 aa, Mycobacterium
DGDLPPGTDPG

SEQ ID NO: 1196665 - protein, 25 aa, Mycobacterium
DGDNDGDIVTGDGAALGDGNTMNNG

SEQ ID NO: 1196666 - protein, 8 aa, Mycobacterium
DGDPASET

SEQ ID NO: 1196667 - protein, 7 aa, Mycobacterium
DGDPKEI

SEQ ID NO: 1196668 - protein, 6 aa, Mycobacterium
DGDPMP

SEQ ID NO: 1196669 - protein, 7 aa, Mycobacterium
DGDQEKL

SEQ ID NO: 1196670 - protein, 7 aa, Mycobacterium
DGDQRSR

SEQ ID NO: 1196671 - protein, 7 aa, Mycobacterium
DGDRATG

SEQ ID NO: 1196672 - protein, 8 aa, Mycobacterium
DGDRDPVR

SEQ ID NO: 1196673 - protein, 33 aa, Mycobacterium
DGDRDVPGLGAQPIEEAGPPPGGRAAGNRCSNG

SEQ ID NO: 1196674 - protein, 12 aa, Mycobacterium
DGDRIDYSYAPR

SEQ ID NO: 1196675 - protein, 6 aa, Mycobacterium
DGDRLR

SEQ ID NO: 1196676 - protein, 7 aa, Mycobacterium
DGDRLTD

SEQ ID NO: 1196677 - protein, 7 aa, Mycobacterium
DGDRPRV

SEQ ID NO: 1196678 - protein, 9 aa, Mycobacterium
DGDSARARA

SEQ ID NO: 1196679 - protein, 8 aa, Mycobacterium
DGDSDELS

SEQ ID NO: 1196680 - protein, 7 aa, Mycobacterium
DGDSETF

SEQ ID NO: 1196681 - protein, 10 aa, Mycobacterium
DGDSGNNRRE

SEQ ID NO: 1196682 - protein, 4 aa, Mycobacterium
DGDT

SEQ ID NO: 1196683 - protein, 7 aa, Mycobacterium
DGDTAAA

SEQ ID NO: 1196684 - protein, 9 aa, Mycobacterium
DGDTATGDA

SEQ ID NO: 1196685 - protein, 8 aa, Mycobacterium
DGDTVVEE

SEQ ID NO: 1196686 - protein, 16 aa, Mycobacterium
DGDTYNPVDPQTLPGR

SEQ ID NO: 1196687 - protein, 7 aa, Mycobacterium
DGDVADE

SEQ ID NO: 1196688 - protein, 6 aa, Mycobacterium
DGEAAA

SEQ ID NO: 1196689 - protein, 18 aa, Mycobacterium
DGEDAHVGSVRSSAAAPA

SEQ ID NO: 1196690 - protein, 15 aa, Mycobacterium
DGEDPLDASGVHPES

SEQ ID NO: 1196691 - protein, 9 aa, Mycobacterium
DGEEDGGWR

SEQ ID NO: 1196692 - protein, 5 aa, Mycobacterium
DGEEG

SEQ ID NO: 1196693 - protein, 6 aa, Mycobacterium
DGEEKV

SEQ ID NO: 1196694 - protein, 7 aa, Mycobacterium
DGEFEGR

SEQ ID NO: 1196695 - protein, 4 aa, Mycobacterium
DGEG

SEQ ID NO: 1196696 - protein, 10 aa, Mycobacterium
DGEGAADETV

SEQ ID NO: 1196697 - protein, 7 aa, Mycobacterium
DGEGGQR

SEQ ID NO: 1196698 - protein, 6 aa, Mycobacterium
DGEGRA

SEQ ID NO: 1196699 - protein, 16 aa, Mycobacterium
DGEGRPPVTDGPFAET

SEQ ID NO: 1196700 - protein, 5 aa, Mycobacterium
DGEHP

SEQ ID NO: 1196701 - protein, 9 aa, Mycobacterium
DGEKMTDDE

SEQ ID NO: 1196702 - protein, 9 aa, Mycobacterium
DGELGGPVA

SEQ ID NO: 1196703 - protein, 5 aa, Mycobacterium
DGELP

SEQ ID NO: 1196704 - protein, 6 aa, Mycobacterium
DGELPL

SEQ ID NO: 1196705 - protein, 5 aa, Mycobacterium
DGELR

SEQ ID NO: 1196706 - protein, 9 aa, Mycobacterium
DGELTDEPE

SEQ ID NO: 1196707 - protein, 4 aa, Mycobacterium
DGEP

SEQ ID NO: 1196708 - protein, 5 aa, Mycobacterium
DGEPL

SEQ ID NO: 1196709 - protein, 34 aa, Mycobacterium
DGEPPSAPSSACATPAPPTKAAPMPSVTAPAPSQ

SEQ ID NO: 1196710 - protein, 8 aa, Mycobacterium
DGEPRAPL

SEQ ID NO: 1196711 - protein, 10 aa, Mycobacterium
DGEPRGAGPL

SEQ ID NO: 1196712 - protein, 7 aa, Mycobacterium
DGEPVDQ

SEQ ID NO: 1196713 - protein, 6 aa, Mycobacterium
DGEPVP

SEQ ID NO: 1196714 - protein, 6 aa, Mycobacterium
DGEQTA

SEQ ID NO: 1196715 - protein, 6 aa, Mycobacterium
DGERDA

SEQ ID NO: 1196716 - protein, 8 aa, Mycobacterium
DGERLTSA

SEQ ID NO: 1196717 - protein, 7 aa, Mycobacterium
DGERQAA

SEQ ID NO: 1196718 - protein, 7 aa, Mycobacterium
DGESGNV

SEQ ID NO: 1196719 - protein, 7 aa, Mycobacterium
DGESSVA

SEQ ID NO: 1196720 - protein, 7 aa, Mycobacterium
DGETARR

SEQ ID NO: 1196721 - protein, 8 aa, Mycobacterium
DGETATAR

SEQ ID NO: 1196722 - protein, 12 aa, Mycobacterium
DGETLADTHEAT

SEQ ID NO: 1196723 - protein, 16 aa, Mycobacterium
DGETSGWASVGGTPSM

SEQ ID NO: 1196724 - protein, 5 aa, Mycobacterium
DGETW

SEQ ID NO: 1196725 - protein, 5 aa, Mycobacterium
DGEVD

SEQ ID NO: 1196726 - protein, 14 aa, Mycobacterium
DGEVGNKKVYDPRS

SEQ ID NO: 1196727 - protein, 14 aa, Mycobacterium
DGEVQGEHVGGSPL

SEQ ID NO: 1196728 - protein, 6 aa, Mycobacterium
DGEVSL

SEQ ID NO: 1196729 - protein, 6 aa, Mycobacterium
DGFGTL

SEQ ID NO: 1196730 - protein, 12 aa, Mycobacterium
DGFPGARRTDPV

SEQ ID NO: 1196731 - protein, 7 aa, Mycobacterium
DGFTRGR

SEQ ID NO: 1196732 - protein, 16 aa, Mycobacterium
DGFTVTPRAGAEPIGG

SEQ ID NO: 1196733 - protein, 7 aa, Mycobacterium
DGGAEQA

SEQ ID NO: 1196734 - protein, 8 aa, Mycobacterium
DGGAQVPE

SEQ ID NO: 1196735 - protein, 23 aa, Mycobacterium
DGGATAVRDEPAAVTKLGNHPHP

SEQ ID NO: 1196736 - protein, 19 aa, Mycobacterium
DGGATSGGKSGGLGGDGDR

SEQ ID NO: 1196737 - protein, 14 aa, Mycobacterium
DGGAWSADYWTMFY

SEQ ID NO: 1196738 - protein, 4 aa, Mycobacterium
DGGC

SEQ ID NO: 1196739 - protein, 7 aa, Mycobacterium
DGGDRLD

SEQ ID NO: 1196740 - protein, 7 aa, Mycobacterium
DGGDSRV

SEQ ID NO: 1196741 - protein, 7 aa, Mycobacterium
DGGDTEL

SEQ ID NO: 1196742 - protein, 7 aa, Mycobacterium
DGGEALR

SEQ ID NO: 1196743 - protein, 7 aa, Mycobacterium
DGGEEDS

SEQ ID NO: 1196744 - protein, 14 aa, Mycobacterium
DGGEIRNGSDLPRI

SEQ ID NO: 1196745 - protein, 5 aa, Mycobacterium
DGGEL

SEQ ID NO: 1196746 - protein, 5 aa, Mycobacterium
DGGEM

SEQ ID NO: 1196747 - protein, 9 aa, Mycobacterium
DGGEPVDAG

SEQ ID NO: 1196748 - protein, 7 aa, Mycobacterium
DGGEQAL

SEQ ID NO: 1196749 - protein, 6 aa, Mycobacterium
DGGGDL

SEQ ID NO: 1196750 - protein, 10 aa, Mycobacterium
DGGGEDEHRR

SEQ ID NO: 1196751 - protein, 7 aa, Mycobacterium
DGGGERY

SEQ ID NO: 1196752 - protein, 14 aa, Mycobacterium
DGGGTQEAIEGRKA

SEQ ID NO: 1196753 - protein, 5 aa, Mycobacterium
DGGLP

SEQ ID NO: 1196754 - protein, 8 aa, Mycobacterium
DGGLPRRA

SEQ ID NO: 1196755 - protein, 5 aa, Mycobacterium
DGGMT

SEQ ID NO: 1196756 - protein, 4 aa, Mycobacterium
DGGN

SEQ ID NO: 1196757 - protein, 7 aa, Mycobacterium
DGGNAID

SEQ ID NO: 1196758 - protein, 8 aa, Mycobacterium
DGGNTNVD

SEQ ID NO: 1196759 - protein, 4 aa, Mycobacterium
DGGP

SEQ ID NO: 1196760 - protein, 7 aa, Mycobacterium
DGGPGRD

SEQ ID NO: 1196761 - protein, 13 aa, Mycobacterium
DGGPHQPIAPGAQ

SEQ ID NO: 1196762 - protein, 9 aa, Mycobacterium
DGGPRIPPN

SEQ ID NO: 1196763 - protein, 8 aa, Mycobacterium
DGGPVHPR

SEQ ID NO: 1196764 - protein, 22 aa, Mycobacterium
DGGQPIVDPDRDMKTPQQGAST

SEQ ID NO: 1196765 - protein, 7 aa, Mycobacterium
DGGRALP

SEQ ID NO: 1196766 - protein, 7 aa, Mycobacterium
DGGRGGS

SEQ ID NO: 1196767 - protein, 7 aa, Mycobacterium
DGGRRRP

SEQ ID NO: 1196768 - protein, 10 aa, Mycobacterium
DGGRSTTRRQ

SEQ ID NO: 1196769 - protein, 6 aa, Mycobacterium
DGGSAR

SEQ ID NO: 1196770 - protein, 7 aa, Mycobacterium
DGGSHGM

SEQ ID NO: 1196771 - protein, 9 aa, Mycobacterium
DGGSLGEAT

SEQ ID NO: 1196772 - protein, 13 aa, Mycobacterium
DGGSPQEVTSKAE

SEQ ID NO: 1196773 - protein, 9 aa, Mycobacterium
DGGSRGGGH

SEQ ID NO: 1196774 - protein, 6 aa, Mycobacterium
DGGSTR

SEQ ID NO: 1196775 - protein, 4 aa, Mycobacterium
DGGT

SEQ ID NO: 1196776 - protein, 8 aa, Mycobacterium
DGGTAAAG

SEQ ID NO: 1196777 - protein, 9 aa, Mycobacterium
DGGTAPGQA

SEQ ID NO: 1196778 - protein, 8 aa, Mycobacterium
DGGTEEQA

SEQ ID NO: 1196779 - protein, 6 aa, Mycobacterium
DGGTVA

SEQ ID NO: 1196780 - protein, 6 aa, Mycobacterium
DGGTYK

SEQ ID NO: 1196781 - protein, 4 aa, Mycobacterium
DGGV

SEQ ID NO: 1196782 - protein, 6 aa, Mycobacterium
DGGVGV

SEQ ID NO: 1196783 - protein, 10 aa, Mycobacterium
DGGVRSRCNH

SEQ ID NO: 1196784 - protein, 13 aa, Mycobacterium
DGGVTEHVGGSPL

SEQ ID NO: 1196785 - protein, 7 aa, Mycobacterium
DGGYPRA

SEQ ID NO: 1196786 - protein, 5 aa, Mycobacterium
DGGYR

SEQ ID NO: 1196787 - protein, 13 aa, Mycobacterium
DGHAGGDKMTPAE

SEQ ID NO: 1196788 - protein, 9 aa, Mycobacterium
DGHDLPAGE

SEQ ID NO: 1196789 - protein, 4 aa, Mycobacterium
DGHE

SEQ ID NO: 1196790 - protein, 12 aa, Mycobacterium
DGHEIDKRENRA

SEQ ID NO: 1196791 - protein, 4 aa, Mycobacterium
DGHG

SEQ ID NO: 1196792 - protein, 6 aa, Mycobacterium
DGHGEE

SEQ ID NO: 1196793 - protein, 7 aa, Mycobacterium
DGHGGTA

SEQ ID NO: 1196794 - protein, 9 aa, Mycobacterium
DGHGGTTSI

SEQ ID NO: 1196795 - protein, 11 aa, Mycobacterium
DGHGTDLRGPT

SEQ ID NO: 1196796 - protein, 4 aa, Mycobacterium
DGHN

SEQ ID NO: 1196797 - protein, 7 aa, Mycobacterium
DGHNAGE

SEQ ID NO: 1196798 - protein, 9 aa, Mycobacterium
DGHPENALT

SEQ ID NO: 1196799 - protein, 5 aa, Mycobacterium
DGHPP

SEQ ID NO: 1196800 - protein, 7 aa, Mycobacterium
DGHRARA

SEQ ID NO: 1196801 - protein, 5 aa, Mycobacterium
DGHRK

SEQ ID NO: 1196802 - protein, 5 aa, Mycobacterium
DGHRN

SEQ ID NO: 1196803 - protein, 13 aa, Mycobacterium
DGHSQRIASVAAN

SEQ ID NO: 1196804 - protein, 19 aa, Mycobacterium
DGHTGPGGTLPTNTGGGQL

SEQ ID NO: 1196805 - protein, 16 aa, Mycobacterium
DGHTPRQAADDPTRRP

SEQ ID NO: 1196806 - protein, 6 aa, Mycobacterium
DGHTRY

SEQ ID NO: 1196807 - protein, 15 aa, Mycobacterium
DGHTSPGRSKETAQD

SEQ ID NO: 1196808 - protein, 5 aa, Mycobacterium
DGHTV

SEQ ID NO: 1196809 - protein, 6 aa, Mycobacterium
DGIAAA

SEQ ID NO: 1196810 - protein, 26 aa, Mycobacterium
DGIAAGRYESAAAGGVDTASDAPIAL

SEQ ID NO: 1196811 - protein, 8 aa, Mycobacterium
DGIADGED

SEQ ID NO: 1196812 - protein, 7 aa, Mycobacterium
DGIARGR

SEQ ID NO: 1196813 - protein, 5 aa, Mycobacterium
DGIDE

SEQ ID NO: 1196814 - protein, 7 aa, Mycobacterium
DGIDGEE

SEQ ID NO: 1196815 - protein, 13 aa, Mycobacterium
DGIDTTTFGGDDG

SEQ ID NO: 1196816 - protein, 10 aa, Mycobacterium
DGIEGQVTAE

SEQ ID NO: 1196817 - protein, 11 aa, Mycobacterium
DGIEPRTPEQA

SEQ ID NO: 1196818 - protein, 5 aa, Mycobacterium
DGIEY

SEQ ID NO: 1196819 - protein, 12 aa, Mycobacterium
DGIGTEVTASAR

SEQ ID NO: 1196820 - protein, 5 aa, Mycobacterium
DGIPE

SEQ ID NO: 1196821 - protein, 4 aa, Mycobacterium
DGIQ

SEQ ID NO: 1196822 - protein, 5 aa, Mycobacterium
DGITA

SEQ ID NO: 1196823 - protein, 11 aa, Mycobacterium
DGITEGVEDPD

SEQ ID NO: 1196824 - protein, 10 aa, Mycobacterium
DGITGSESDQ

SEQ ID NO: 1196825 - protein, 8 aa, Mycobacterium
DGITTESQ

SEQ ID NO: 1196826 - protein, 5 aa, Mycobacterium
DGKAA

SEQ ID NO: 1196827 - protein, 9 aa, Mycobacterium
DGKANPTDL

SEQ ID NO: 1196828 - protein, 9 aa, Mycobacterium
DGKASWDDV

SEQ ID NO: 1196829 - protein, 7 aa, Mycobacterium
DGKDREI

SEQ ID NO: 1196830 - protein, 10 aa, Mycobacterium
DGKEHQNDRS

SEQ ID NO: 1196831 - protein, 8 aa, Mycobacterium
DGKGAGEF

SEQ ID NO: 1196832 - protein, 8 aa, Mycobacterium
DGKIAEAQ

SEQ ID NO: 1196833 - protein, 9 aa, Mycobacterium
DGKIARETT

SEQ ID NO: 1196834 - protein, 9 aa, Mycobacterium
DGKKTTGSW

SEQ ID NO: 1196835 - protein, 4 aa, Mycobacterium
DGKL

SEQ ID NO: 1196836 - protein, 7 aa, Mycobacterium
DGKLSAK

SEQ ID NO: 1196837 - protein, 10 aa, Mycobacterium
DGKLSREVKD

SEQ ID NO: 1196838 - protein, 18 aa, Mycobacterium
DGKNVTGTGYYDSGTLAE

SEQ ID NO: 1196839 - protein, 8 aa, Mycobacterium
DGKPEEVY

SEQ ID NO: 1196840 - protein, 16 aa, Mycobacterium
DGKPGEEVDITKFGGG

SEQ ID NO: 1196841 - protein, 26 aa, Mycobacterium
DGKPGTRADTHIPRNPDGTYPIPKGW

SEQ ID NO: 1196842 - protein, 9 aa, Mycobacterium
DGKPLEEAY

SEQ ID NO: 1196843 - protein, 9 aa, Mycobacterium
DGKPPRKVP

SEQ ID NO: 1196844 - protein, 7 aa, Mycobacterium
DGKRRAA

SEQ ID NO: 1196845 - protein, 19 aa, Mycobacterium
DGKSSTKKTMAQDKGHNAQ

SEQ ID NO: 1196846 - protein, 16 aa, Mycobacterium
DGKTGRELSKFVINGM

SEQ ID NO: 1196847 - protein, 10 aa, Mycobacterium
DGKTLDDPHE

SEQ ID NO: 1196848 - protein, 6 aa, Mycobacterium
DGLAAG

SEQ ID NO: 1196849 - protein, 14 aa, Mycobacterium
DGLAASDSAQDALS

SEQ ID NO: 1196850 - protein, 7 aa, Mycobacterium
DGLAGGT

SEQ ID NO: 1196851 - protein, 12 aa, Mycobacterium
DGLDELTTTTTS

SEQ ID NO: 1196852 - protein, 8 aa, Mycobacterium
DGLDPQNY

SEQ ID NO: 1196853 - protein, 4 aa, Mycobacterium
DGLE

SEQ ID NO: 1196854 - protein, 7 aa, Mycobacterium
DGLGATQ

SEQ ID NO: 1196855 - protein, 9 aa, Mycobacterium
DGLGGSGAT

SEQ ID NO: 1196856 - protein, 8 aa, Mycobacterium
DGLISPDE

SEQ ID NO: 1196857 - protein, 37 aa, Mycobacterium
DGLKKPSSTTDGTKAESTASEADSSNSDSGSDSGGSE

SEQ ID NO: 1196858 - protein, 8 aa, Mycobacterium
DGLPEDER

SEQ ID NO: 1196859 - protein, 9 aa, Mycobacterium
DGLPEKDAE

SEQ ID NO: 1196860 - protein, 8 aa, Mycobacterium
DGLPESGY

SEQ ID NO: 1196861 - protein, 12 aa, Mycobacterium
DGLRQRGRRDGV

SEQ ID NO: 1196862 - protein, 7 aa, Mycobacterium
DGLRSTT

SEQ ID NO: 1196863 - protein, 18 aa, Mycobacterium
DGLSGAQLAERARRQAEK

SEQ ID NO: 1196864 - protein, 21 aa, Mycobacterium
DGLSPIAEGVDDRTAAASGVA

SEQ ID NO: 1196865 - protein, 11 aa, Mycobacterium
DGLTANPKTLP

SEQ ID NO: 1196866 - protein, 6 aa, Mycobacterium
DGLTEG

SEQ ID NO: 1196867 - protein, 13 aa, Mycobacterium
DGMDPASETGPLV

SEQ ID NO: 1196868 - protein, 4 aa, Mycobacterium
DGMP

SEQ ID NO: 1196869 - protein, 5 aa, Mycobacterium
DGMST

SEQ ID NO: 1196870 - protein, 10 aa, Mycobacterium
DGNDAQAGEV

SEQ ID NO: 1196871 - protein, 8 aa, Mycobacterium
DGNELDSG

SEQ ID NO: 1196872 - protein, 7 aa, Mycobacterium
DGNGPVS

SEQ ID NO: 1196873 - protein, 6 aa, Mycobacterium
DGNGRA

SEQ ID NO: 1196874 - protein, 5 aa, Mycobacterium
DGNKL

SEQ ID NO: 1196875 - protein, 21 aa, Mycobacterium
DGNKRRALPSGLGQPASDPAG

SEQ ID NO: 1196876 - protein, 9 aa, Mycobacterium
DGNLDPTIA

SEQ ID NO: 1196877 - protein, 12 aa, Mycobacterium
DGNPIATRDESY

SEQ ID NO: 1196878 - protein, 11 aa, Mycobacterium
DGNPVTPGSGV

SEQ ID NO: 1196879 - protein, 4 aa, Mycobacterium
DGNR

SEQ ID NO: 1196880 - protein, 10 aa, Mycobacterium
DGNRPGGGSV

SEQ ID NO: 1196881 - protein, 8 aa, Mycobacterium
DGNRVPGL

SEQ ID NO: 1196882 - protein, 26 aa, Mycobacterium
DGNSHRYDGYQKRTSRKIPLVRLTPK

SEQ ID NO: 1196883 - protein, 8 aa, Mycobacterium
DGNSSRAV

SEQ ID NO: 1196884 - protein, 12 aa, Mycobacterium
DGNSSTEATPVN

SEQ ID NO: 1196885 - protein, 7 aa, Mycobacterium
DGNTEYG

SEQ ID NO: 1196886 - protein, 14 aa, Mycobacterium
DGPAENQSAHRDRY

SEQ ID NO: 1196887 - protein, 7 aa, Mycobacterium
DGPAPER

SEQ ID NO: 1196888 - protein, 8 aa, Mycobacterium
DGPARAEA

SEQ ID NO: 1196889 - protein, 10 aa, Mycobacterium
DGPASGKDVA

SEQ ID NO: 1196890 - protein, 8 aa, Mycobacterium
DGPATSRP

SEQ ID NO: 1196891 - protein, 9 aa, Mycobacterium
DGPATSRPL

SEQ ID NO: 1196892 - protein, 9 aa, Mycobacterium
DGPCTENGE

SEQ ID NO: 1196893 - protein, 21 aa, Mycobacterium
DGPDDLEGVTAGRGSHLGTGG

SEQ ID NO: 1196894 - protein, 6 aa, Mycobacterium
DGPDGA

SEQ ID NO: 1196895 - protein, 7 aa, Mycobacterium
DGPDPEC

SEQ ID NO: 1196896 - protein, 9 aa, Mycobacterium
DGPEAVPGA

SEQ ID NO: 1196897 - protein, 7 aa, Mycobacterium
DGPEGPP

SEQ ID NO: 1196898 - protein, 25 aa, Mycobacterium
DGPEPDDTERARKRGVTKYKQRPDG

SEQ ID NO: 1196899 - protein, 8 aa, Mycobacterium
DGPEPSVG

SEQ ID NO: 1196900 - protein, 6 aa, Mycobacterium
DGPESD

SEQ ID NO: 1196901 - protein, 7 aa, Mycobacterium
DGPGAEA

SEQ ID NO: 1196902 - protein, 7 aa, Mycobacterium
DGPGATV

SEQ ID NO: 1196903 - protein, 8 aa, Mycobacterium
DGPGCSPG

SEQ ID NO: 1196904 - protein, 15 aa, Mycobacterium
DGPGGFTGVEGDEKW

SEQ ID NO: 1196905 - protein, 7 aa, Mycobacterium
DGPGPFT

SEQ ID NO: 1196906 - protein, 14 aa, Mycobacterium
DGPGVGASISSHPD

SEQ ID NO: 1196907 - protein, 6 aa, Mycobacterium
DGPIPA

SEQ ID NO: 1196908 - protein, 7 aa, Mycobacterium
DGPKMAG

SEQ ID NO: 1196909 - protein, 8 aa, Mycobacterium
DGPLPQRT

SEQ ID NO: 1196910 - protein, 5 aa, Mycobacterium
DGPLT

SEQ ID NO: 1196911 - protein, 8 aa, Mycobacterium
DGPNGPKL

SEQ ID NO: 1196912 - protein, 9 aa, Mycobacterium
DGPNRGETK

SEQ ID NO: 1196913 - protein, 5 aa, Mycobacterium
DGPNV

SEQ ID NO: 1196914 - protein, 8 aa, Mycobacterium
DGPPDAAL

SEQ ID NO: 1196915 - protein, 8 aa, Mycobacterium
DGPPRDMS

SEQ ID NO: 1196916 - protein, 19 aa, Mycobacterium
DGPPSRYRSEPARQHVVSA

SEQ ID NO: 1196917 - protein, 6 aa, Mycobacterium
DGPQGW

SEQ ID NO: 1196918 - protein, 4 aa, Mycobacterium
DGPR

SEQ ID NO: 1196919 - protein, 8 aa, Mycobacterium
DGPRDRGG

SEQ ID NO: 1196920 - protein, 5 aa, Mycobacterium
DGPSA

SEQ ID NO: 1196921 - protein, 9 aa, Mycobacterium
DGPSPAGAR

SEQ ID NO: 1196922 - protein, 7 aa, Mycobacterium
DGPSQAV

SEQ ID NO: 1196923 - protein, 6 aa, Mycobacterium
DGPTAL

SEQ ID NO: 1196924 - protein, 17 aa, Mycobacterium
DGPTAPPPSDAESRAQV

SEQ ID NO: 1196925 - protein, 8 aa, Mycobacterium
DGPTAPQR

SEQ ID NO: 1196926 - protein, 9 aa, Mycobacterium
DGPTGSAQT

SEQ ID NO: 1196927 - protein, 33 aa, Mycobacterium
DGPTRNRLSGRRPGEDHRSPDCASGATGVARHR

SEQ ID NO: 1196928 - protein, 7 aa, Mycobacterium
DGPTSDQ

SEQ ID NO: 1196929 - protein, 5 aa, Mycobacterium
DGPVK

SEQ ID NO: 1196930 - protein, 5 aa, Mycobacterium
DGPVP

SEQ ID NO: 1196931 - protein, 7 aa, Mycobacterium
DGPVSAG

SEQ ID NO: 1196932 - protein, 7 aa, Mycobacterium
DGPVTNG

SEQ ID NO: 1196933 - protein, 14 aa, Mycobacterium
DGPYPDGWTDEADH

SEQ ID NO: 1196934 - protein, 8 aa, Mycobacterium
DGQAEQGG

SEQ ID NO: 1196935 - protein, 7 aa, Mycobacterium
DGQAQPT

SEQ ID NO: 1196936 - protein, 15 aa, Mycobacterium
DGQGIPAESRRRSGL

SEQ ID NO: 1196937 - protein, 6 aa, Mycobacterium
DGQHSA

SEQ ID NO: 1196938 - protein, 8 aa, Mycobacterium
DGQITKQS

SEQ ID NO: 1196939 - protein, 7 aa, Mycobacterium
DGQLPGA

SEQ ID NO: 1196940 - protein, 10 aa, Mycobacterium
DGQPAAALDP

SEQ ID NO: 1196941 - protein, 8 aa, Mycobacterium
DGQPAAPA

SEQ ID NO: 1196942 - protein, 18 aa, Mycobacterium
DGQPAATARSEVQQGNSC

SEQ ID NO: 1196943 - protein, 5 aa, Mycobacterium
DGQPG

SEQ ID NO: 1196944 - protein, 5 aa, Mycobacterium
DGQPL

SEQ ID NO: 1196945 - protein, 17 aa, Mycobacterium
DGQPRVLPPPAPGGPPV

SEQ ID NO: 1196946 - protein, 9 aa, Mycobacterium
DGQPTADGL

SEQ ID NO: 1196947 - protein, 6 aa, Mycobacterium
DGQPTW

SEQ ID NO: 1196948 - protein, 20 aa, Mycobacterium
DGQPTWNDKPEVEAAAEARA

SEQ ID NO: 1196949 - protein, 9 aa, Mycobacterium
DGQPVTPAA

SEQ ID NO: 1196950 - protein, 9 aa, Mycobacterium
DGQRAPRVA

SEQ ID NO: 1196951 - protein, 5 aa, Mycobacterium
DGQRL

SEQ ID NO: 1196952 - protein, 12 aa, Mycobacterium
DGQRTKGSQIGN

SEQ ID NO: 1196953 - protein, 10 aa, Mycobacterium
DGQYGTDAAD

SEQ ID NO: 1196954 - protein, 5 aa, Mycobacterium
DGRAA

SEQ ID NO: 1196955 - protein, 7 aa, Mycobacterium
DGRAARE

SEQ ID NO: 1196956 - protein, 6 aa, Mycobacterium
DGRADE

SEQ ID NO: 1196957 - protein, 7 aa, Mycobacterium
DGRAGDA

SEQ ID NO: 1196958 - protein, 8 aa, Mycobacterium
DGRAGMSA

SEQ ID NO: 1196959 - protein, 7 aa, Mycobacterium
DGRAPAE

SEQ ID NO: 1196960 - protein, 9 aa, Mycobacterium
DGRATTHPI

SEQ ID NO: 1196961 - protein, 15 aa, Mycobacterium
DGRDPAGISTQDPEL

SEQ ID NO: 1196962 - protein, 5 aa, Mycobacterium
DGRDR

SEQ ID NO: 1196963 - protein, 5 aa, Mycobacterium
DGREL

SEQ ID NO: 1196964 - protein, 20 aa, Mycobacterium
DGRELARAANAREEFGDPTA

SEQ ID NO: 1196965 - protein, 9 aa, Mycobacterium
DGRERPDGR

SEQ ID NO: 1196966 - protein, 6 aa, Mycobacterium
DGRFGN

SEQ ID NO: 1196967 - protein, 11 aa, Mycobacterium
DGRGDISGLGA

SEQ ID NO: 1196968 - protein, 8 aa, Mycobacterium
DGRGGSDA

SEQ ID NO: 1196969 - protein, 6 aa, Mycobacterium
DGRGGV

SEQ ID NO: 1196970 - protein, 9 aa, Mycobacterium
DGRGHLSAE

SEQ ID NO: 1196971 - protein, 7 aa, Mycobacterium
DGRGLPA

SEQ ID NO: 1196972 - protein, 8 aa, Mycobacterium
DGRGLPDG

SEQ ID NO: 1196973 - protein, 8 aa, Mycobacterium
DGRGSWGG

SEQ ID NO: 1196974 - protein, 7 aa, Mycobacterium
DGRIKRE

SEQ ID NO: 1196975 - protein, 9 aa, Mycobacterium
DGRKNGKAL

SEQ ID NO: 1196976 - protein, 11 aa, Mycobacterium
DGRLDDRGDEV

SEQ ID NO: 1196977 - protein, 7 aa, Mycobacterium
DGRMGGT

SEQ ID NO: 1196978 - protein, 5 aa, Mycobacterium
DGRNV

SEQ ID NO: 1196979 - protein, 11 aa, Mycobacterium
DGRPAGSAPAT

SEQ ID NO: 1196980 - protein, 5 aa, Mycobacterium
DGRPD

SEQ ID NO: 1196981 - protein, 8 aa, Mycobacterium
DGRPDEAE

SEQ ID NO: 1196982 - protein, 7 aa, Mycobacterium
DGRPGQQ

SEQ ID NO: 1196983 - protein, 5 aa, Mycobacterium
DGRPL

SEQ ID NO: 1196984 - protein, 16 aa, Mycobacterium
DGRQQPGGLTTPEAPE

SEQ ID NO: 1196985 - protein, 4 aa, Mycobacterium
DGRR

SEQ ID NO: 1196986 - protein, 18 aa, Mycobacterium
DGRRAPEAHQVPGSAVGV

SEQ ID NO: 1196987 - protein, 9 aa, Mycobacterium
DGRRAVDAG

SEQ ID NO: 1196988 - protein, 8 aa, Mycobacterium
DGRRGVDA

SEQ ID NO: 1196989 - protein, 6 aa, Mycobacterium
DGRRQR

SEQ ID NO: 1196990 - protein, 8 aa, Mycobacterium
DGRRRTRC

SEQ ID NO: 1196991 - protein, 19 aa, Mycobacterium
DGRRRTRPYSPANADTDPY

SEQ ID NO: 1196992 - protein, 10 aa, Mycobacterium
DGRRTPETHQ

SEQ ID NO: 1196993 - protein, 7 aa, Mycobacterium
DGRRVPS

SEQ ID NO: 1196994 - protein, 5 aa, Mycobacterium
DGRSA

SEQ ID NO: 1196995 - protein, 17 aa, Mycobacterium
DGRTAASRRVDSTQNGR

SEQ ID NO: 1196996 - protein, 8 aa, Mycobacterium
DGRTAPPV

SEQ ID NO: 1196997 - protein, 11 aa, Mycobacterium
DGRTEDSADAL

SEQ ID NO: 1196998 - protein, 13 aa, Mycobacterium
DGRTIGSAPKAQV

SEQ ID NO: 1196999 - protein, 11 aa, Mycobacterium
DGRTNAKDPNL

SEQ ID NO: 1197000 - protein, 18 aa, Mycobacterium
DGRTRSAHSTVGREEADR

SEQ ID NO: 1197001 - protein, 7 aa, Mycobacterium
DGRTTLE

SEQ ID NO: 1197002 - protein, 7 aa, Mycobacterium
DGRTTTL

SEQ ID NO: 1197003 - protein, 6 aa, Mycobacterium
DGRTVP

SEQ ID NO: 1197004 - protein, 6 aa, Mycobacterium
DGRTVT

SEQ ID NO: 1197005 - protein, 14 aa, Mycobacterium
DGRVTGARGDRDDV

SEQ ID NO: 1197006 - protein, 7 aa, Mycobacterium
DGRWTDS

SEQ ID NO: 1197007 - protein, 15 aa, Mycobacterium
DGRYRTQAAHQAPDA

SEQ ID NO: 1197008 - protein, 8 aa, Mycobacterium
DGSAAAAV

SEQ ID NO: 1197009 - protein, 13 aa, Mycobacterium
DGSAAAEAATDTA

SEQ ID NO: 1197010 - protein, 5 aa, Mycobacterium
DGSAM

SEQ ID NO: 1197011 - protein, 29 aa, Mycobacterium
DGSARLAGTSGIAPEHPAVPTRLSADGGG

SEQ ID NO: 1197012 - protein, 8 aa, Mycobacterium
DGSASPDH

SEQ ID NO: 1197013 - protein, 7 aa, Mycobacterium
DGSCEAT

SEQ ID NO: 1197014 - protein, 6 aa, Mycobacterium
DGSDCG

SEQ ID NO: 1197015 - protein, 6 aa, Mycobacterium
DGSDLG

SEQ ID NO: 1197016 - protein, 8 aa, Mycobacterium
DGSDVPAP

SEQ ID NO: 1197017 - protein, 10 aa, Mycobacterium
DGSECRRERR

SEQ ID NO: 1197018 - protein, 8 aa, Mycobacterium
DGSEGQRD

SEQ ID NO: 1197019 - protein, 14 aa, Mycobacterium
DGSEMTDEDWDSGF

SEQ ID NO: 1197020 - protein, 4 aa, Mycobacterium
DGSF

SEQ ID NO: 1197021 - protein, 4 aa, Mycobacterium
DGSG

SEQ ID NO: 1197022 - protein, 11 aa, Mycobacterium
DGSGADDTATL

SEQ ID NO: 1197023 - protein, 10 aa, Mycobacterium
DGSGAPELTG

SEQ ID NO: 1197024 - protein, 10 aa, Mycobacterium
DGSGASTDEH

SEQ ID NO: 1197025 - protein, 8 aa, Mycobacterium
DGSGEADG

SEQ ID NO: 1197026 - protein, 6 aa, Mycobacterium
DGSGHE

SEQ ID NO: 1197027 - protein, 8 aa, Mycobacterium
DGSGNTLA

SEQ ID NO: 1197028 - protein, 20 aa, Mycobacterium
DGSGPSWDPPRFPEAGTGDF

SEQ ID NO: 1197029 - protein, 7 aa, Mycobacterium
DGSGPYH

SEQ ID NO: 1197030 - protein, 9 aa, Mycobacterium
DGSGQAVGG

SEQ ID NO: 1197031 - protein, 6 aa, Mycobacterium
DGSHSS

SEQ ID NO: 1197032 - protein, 8 aa, Mycobacterium
DGSKAAEQ

SEQ ID NO: 1197033 - protein, 8 aa, Mycobacterium
DGSKPSLA

SEQ ID NO: 1197034 - protein, 4 aa, Mycobacterium
DGSL

SEQ ID NO: 1197035 - protein, 9 aa, Mycobacterium
DGSLDPQEL

SEQ ID NO: 1197036 - protein, 6 aa, Mycobacterium
DGSPAG

SEQ ID NO: 1197037 - protein, 10 aa, Mycobacterium
DGSPASEDAT

SEQ ID NO: 1197038 - protein, 9 aa, Mycobacterium
DGSPASEHA

SEQ ID NO: 1197039 - protein, 6 aa, Mycobacterium
DGSPEA

SEQ ID NO: 1197040 - protein, 8 aa, Mycobacterium
DGSPEAHS

SEQ ID NO: 1197041 - protein, 7 aa, Mycobacterium
DGSPESQ

SEQ ID NO: 1197042 - protein, 9 aa, Mycobacterium
DGSPESSAA

SEQ ID NO: 1197043 - protein, 9 aa, Mycobacterium
DGSPGSEAA

SEQ ID NO: 1197044 - protein, 8 aa, Mycobacterium
DGSPPDVD

SEQ ID NO: 1197045 - protein, 7 aa, Mycobacterium
DGSQAAL

SEQ ID NO: 1197046 - protein, 8 aa, Mycobacterium
DGSQEEYD

SEQ ID NO: 1197047 - protein, 9 aa, Mycobacterium
DGSQSTAEA

SEQ ID NO: 1197048 - protein, 7 aa, Mycobacterium
DGSRFSE

SEQ ID NO: 1197049 - protein, 7 aa, Mycobacterium
DGSRIDA

SEQ ID NO: 1197050 - protein, 7 aa, Mycobacterium
DGSRLER

SEQ ID NO: 1197051 - protein, 7 aa, Mycobacterium
DGSRPEL

SEQ ID NO: 1197052 - protein, 8 aa, Mycobacterium
DGSRPPAV

SEQ ID NO: 1197053 - protein, 5 aa, Mycobacterium
DGSRV

SEQ ID NO: 1197054 - protein, 7 aa, Mycobacterium
DGSRVES

SEQ ID NO: 1197055 - protein, 12 aa, Mycobacterium
DGSRVPDPTTAP

SEQ ID NO: 1197056 - protein, 12 aa, Mycobacterium
DGSSSTEATPVN

SEQ ID NO: 1197057 - protein, 14 aa, Mycobacterium
DGSTASVAHRPNET

SEQ ID NO: 1197058 - protein, 8 aa, Mycobacterium
DGSTAVRE

SEQ ID NO: 1197059 - protein, 5 aa, Mycobacterium
DGSTI

SEQ ID NO: 1197060 - protein, 13 aa, Mycobacterium
DGSTLAQASPPDM

SEQ ID NO: 1197061 - protein, 7 aa, Mycobacterium
DGSTLDV

SEQ ID NO: 1197062 - protein, 18 aa, Mycobacterium
DGSTLTNPSIKQVKAKLA

SEQ ID NO: 1197063 - protein, 9 aa, Mycobacterium
DGSVEESTV

SEQ ID NO: 1197064 - protein, 7 aa, Mycobacterium
DGSVGDE

SEQ ID NO: 1197065 - protein, 25 aa, Mycobacterium
DGSVGVADDGRGLPVDSDPVNGKNG

SEQ ID NO: 1197066 - protein, 5 aa, Mycobacterium
DGSVH

SEQ ID NO: 1197067 - protein, 7 aa, Mycobacterium
DGSVRGR

SEQ ID NO: 1197068 - protein, 10 aa, Mycobacterium
DGSVRPTNAR

SEQ ID NO: 1197069 - protein, 20 aa, Mycobacterium
DGSVSNASAGAEHESVDPSR

SEQ ID NO: 1197070 - protein, 6 aa, Mycobacterium
DGSVTE

SEQ ID NO: 1197071 - protein, 11 aa, Mycobacterium
DGSVTLADRPA

SEQ ID NO: 1197072 - protein, 4 aa, Mycobacterium
DGTA

SEQ ID NO: 1197073 - protein, 14 aa, Mycobacterium
DGTAAEKAGDAVRQ

SEQ ID NO: 1197074 - protein, 6 aa, Mycobacterium
DGTAKG

SEQ ID NO: 1197075 - protein, 11 aa, Mycobacterium
DGTANPREDAE

SEQ ID NO: 1197076 - protein, 23 aa, Mycobacterium
DGTAPAPTAAPEPAPEPVPEPPR

SEQ ID NO: 1197077 - protein, 7 aa, Mycobacterium
DGTAPDP

SEQ ID NO: 1197078 - protein, 10 aa, Mycobacterium
DGTDEDYQRY

SEQ ID NO: 1197079 - protein, 5 aa, Mycobacterium
DGTDL

SEQ ID NO: 1197080 - protein, 15 aa, Mycobacterium
DGTDTESAAQYRDAG

SEQ ID NO: 1197081 - protein, 8 aa, Mycobacterium
DGTEAGLR

SEQ ID NO: 1197082 - protein, 5 aa, Mycobacterium
DGTEL

SEQ ID NO: 1197083 - protein, 6 aa, Mycobacterium
DGTERP

SEQ ID NO: 1197084 - protein, 10 aa, Mycobacterium
DGTERTAVER

SEQ ID NO: 1197085 - protein, 12 aa, Mycobacterium
DGTESALEHGSK

SEQ ID NO: 1197086 - protein, 11 aa, Mycobacterium
DGTGEMSPSAR

SEQ ID NO: 1197087 - protein, 7 aa, Mycobacterium
DGTGGAD

SEQ ID NO: 1197088 - protein, 9 aa, Mycobacterium
DGTGGYRGE

SEQ ID NO: 1197089 - protein, 5 aa, Mycobacterium
DGTGK

SEQ ID NO: 1197090 - protein, 5 aa, Mycobacterium
DGTGN

SEQ ID NO: 1197091 - protein, 21 aa, Mycobacterium
DGTGNPLHEEEDTPPPAPEAR

SEQ ID NO: 1197092 - protein, 11 aa, Mycobacterium
DGTGPQGTDVP

SEQ ID NO: 1197093 - protein, 8 aa, Mycobacterium
DGTGQVSV

SEQ ID NO: 1197094 - protein, 8 aa, Mycobacterium
DGTGTGEY

SEQ ID NO: 1197095 - protein, 5 aa, Mycobacterium
DGTHA

SEQ ID NO: 1197096 - protein, 12 aa, Mycobacterium
DGTITGDGALRS

SEQ ID NO: 1197097 - protein, 7 aa, Mycobacterium
DGTKDRT

SEQ ID NO: 1197098 - protein, 5 aa, Mycobacterium
DGTKR

SEQ ID NO: 1197099 - protein, 7 aa, Mycobacterium
DGTKTRI

SEQ ID NO: 1197100 - protein, 13 aa, Mycobacterium
DGTLGPGSGCSQS

SEQ ID NO: 1197101 - protein, 14 aa, Mycobacterium
DGTLGTDEGEPGRR

SEQ ID NO: 1197102 - protein, 10 aa, Mycobacterium
DGTLSDQDAA

SEQ ID NO: 1197103 - protein, 4 aa, Mycobacterium
DGTN

SEQ ID NO: 1197104 - protein, 15 aa, Mycobacterium
DGTPEGAAALADTTR

SEQ ID NO: 1197105 - protein, 6 aa, Mycobacterium
DGTPLS

SEQ ID NO: 1197106 - protein, 41 aa, Mycobacterium
DGTPMPAPTPDPAAGPAPMPAAGAVPTAPSSHGGVGDGPSV

SEQ ID NO: 1197107 - protein, 6 aa, Mycobacterium
DGTPSA

SEQ ID NO: 1197108 - protein, 9 aa, Mycobacterium
DGTPSNPQL

SEQ ID NO: 1197109 - protein, 8 aa, Mycobacterium
DGTPSVDG

SEQ ID NO: 1197110 - protein, 5 aa, Mycobacterium
DGTPW

SEQ ID NO: 1197111 - protein, 8 aa, Mycobacterium
DGTQEQRD

SEQ ID NO: 1197112 - protein, 9 aa, Mycobacterium
DGTQRIGDR

SEQ ID NO: 1197113 - protein, 5 aa, Mycobacterium
DGTQT

SEQ ID NO: 1197114 - protein, 13 aa, Mycobacterium
DGTREYSLPPRSD

SEQ ID NO: 1197115 - protein, 16 aa, Mycobacterium
DGTRLSETARSSKING

SEQ ID NO: 1197116 - protein, 7 aa, Mycobacterium
DGTRNLR

SEQ ID NO: 1197117 - protein, 5 aa, Mycobacterium
DGTRP

SEQ ID NO: 1197118 - protein, 6 aa, Mycobacterium
DGTRRL

SEQ ID NO: 1197119 - protein, 5 aa, Mycobacterium
DGTRV

SEQ ID NO: 1197120 - protein, 4 aa, Mycobacterium
DGTS

SEQ ID NO: 1197121 - protein, 5 aa, Mycobacterium
DGTSM

SEQ ID NO: 1197122 - protein, 131 aa, Mycobacterium
DGTSSGSGSQAASGSDDADGRDSKAGPAAESGTDQQAGDEPDAETPADEAEPEPEPDEDPEDEDPEDEDPEDEDLEDEDPEPDADADADRNDRDTTDEAPAPPSGGKHAAPEPEDAPAEPEPEPPAETPAV

SEQ ID NO: 1197123 - protein, 4 aa, Mycobacterium
DGTT

SEQ ID NO: 1197124 - protein, 7 aa, Mycobacterium
DGTTADV

SEQ ID NO: 1197125 - protein, 6 aa, Mycobacterium
DGTTET

SEQ ID NO: 1197126 - protein, 8 aa, Mycobacterium
DGTTEYNA

SEQ ID NO: 1197127 - protein, 5 aa, Mycobacterium
DGTTL

SEQ ID NO: 1197128 - protein, 5 aa, Mycobacterium
DGTTP

SEQ ID NO: 1197129 - protein, 6 aa, Mycobacterium
DGTTPV

SEQ ID NO: 1197130 - protein, 7 aa, Mycobacterium
DGTTSGV

SEQ ID NO: 1197131 - protein, 7 aa, Mycobacterium
DGTTSST

SEQ ID NO: 1197132 - protein, 23 aa, Mycobacterium
DGTTTLPPLEPPANANPNILPLG

SEQ ID NO: 1197133 - protein, 8 aa, Mycobacterium
DGTTVPAG

SEQ ID NO: 1197134 - protein, 17 aa, Mycobacterium
DGTTVTVSAGDITHLRH

SEQ ID NO: 1197135 - protein, 27 aa, Mycobacterium
DGTVRDDQAEAARHAAANCPESAVAVD

SEQ ID NO: 1197136 - protein, 18 aa, Mycobacterium
DGTVVSTDDGPRAGTTYD

SEQ ID NO: 1197137 - protein, 6 aa, Mycobacterium
DGTVVT

SEQ ID NO: 1197138 - protein, 15 aa, Mycobacterium
DGTYPSGTTAYEKRN

SEQ ID NO: 1197139 - protein, 7 aa, Mycobacterium
DGVAGGT

SEQ ID NO: 1197140 - protein, 7 aa, Mycobacterium
DGVASEE

SEQ ID NO: 1197141 - protein, 5 aa, Mycobacterium
DGVDD

SEQ ID NO: 1197142 - protein, 6 aa, Mycobacterium
DGVDTA

SEQ ID NO: 1197143 - protein, 9 aa, Mycobacterium
DGVENRDAA

SEQ ID NO: 1197144 - protein, 6 aa, Mycobacterium
DGVEPE

SEQ ID NO: 1197145 - protein, 8 aa, Mycobacterium
DGVGGDAG

SEQ ID NO: 1197146 - protein, 8 aa, Mycobacterium
DGVGPEIG

SEQ ID NO: 1197147 - protein, 7 aa, Mycobacterium
DGVPTDA

SEQ ID NO: 1197148 - protein, 6 aa, Mycobacterium
DGVPTL

SEQ ID NO: 1197149 - protein, 8 aa, Mycobacterium
DGVPVPGG

SEQ ID NO: 1197150 - protein, 8 aa, Mycobacterium
DGVQGPSV

SEQ ID NO: 1197151 - protein, 12 aa, Mycobacterium
DGVRPVEQGEGD

SEQ ID NO: 1197152 - protein, 15 aa, Mycobacterium
DGVRSSRFAPPSPKG

SEQ ID NO: 1197153 - protein, 12 aa, Mycobacterium
DGVSTTDPDTDV

SEQ ID NO: 1197154 - protein, 4 aa, Mycobacterium
DGVT

SEQ ID NO: 1197155 - protein, 6 aa, Mycobacterium
DGVTAQ

SEQ ID NO: 1197156 - protein, 12 aa, Mycobacterium
DGVTDVPDSAIE

SEQ ID NO: 1197157 - protein, 10 aa, Mycobacterium
DGVTGWSEGD

SEQ ID NO: 1197158 - protein, 12 aa, Mycobacterium
DGVTLDDGAALD

SEQ ID NO: 1197159 - protein, 8 aa, Mycobacterium
DGVTPETA

SEQ ID NO: 1197160 - protein, 7 aa, Mycobacterium
DGVTPGV

SEQ ID NO: 1197161 - protein, 9 aa, Mycobacterium
DGVVTDPER

SEQ ID NO: 1197162 - protein, 5 aa, Mycobacterium
DGWAR

SEQ ID NO: 1197163 - protein, 19 aa, Mycobacterium
DGWESSDVAATDPGAFAGA

SEQ ID NO: 1197164 - protein, 6 aa, Mycobacterium
DGWRAH

SEQ ID NO: 1197165 - protein, 4 aa, Mycobacterium
DGYE

SEQ ID NO: 1197166 - protein, 7 aa, Mycobacterium
DGYEKTT

SEQ ID NO: 1197167 - protein, 6 aa, Mycobacterium
DGYGEE

SEQ ID NO: 1197168 - protein, 6 aa, Mycobacterium
DGYGER

SEQ ID NO: 1197169 - protein, 9 aa, Mycobacterium
DGYGHGATQ

SEQ ID NO: 1197170 - protein, 6 aa, Mycobacterium
DGYGSY

SEQ ID NO: 1197171 - protein, 5 aa, Mycobacterium
DGYLT

SEQ ID NO: 1197172 - protein, 18 aa, Mycobacterium
DGYPERESGATAHDLPAP

SEQ ID NO: 1197173 - protein, 14 aa, Mycobacterium
DGYPTAEELAADSG

SEQ ID NO: 1197174 - protein, 4 aa, Mycobacterium
DGYQ

SEQ ID NO: 1197175 - protein, 9 aa, Mycobacterium
DGYQPDDAL

SEQ ID NO: 1197176 - protein, 4 aa, Mycobacterium
DGYR

SEQ ID NO: 1197177 - protein, 20 aa, Mycobacterium
DGYRADDPGDNDRRRPVGPY

SEQ ID NO: 1197178 - protein, 7 aa, Mycobacterium
DGYSDTE

SEQ ID NO: 1197179 - protein, 6 aa, Mycobacterium
DGYSEN

SEQ ID NO: 1197180 - protein, 9 aa, Mycobacterium
DGYTFPESR

SEQ ID NO: 1197181 - protein, 5 aa, Mycobacterium
DGYTP

SEQ ID NO: 1197182 - protein, 7 aa, Mycobacterium
DGYVRGE

SEQ ID NO: 1197183 - protein, 13 aa, Mycobacterium
DHAAEQQAKSPTP

SEQ ID NO: 1197184 - protein, 5 aa, Mycobacterium
DHAAT

SEQ ID NO: 1197185 - protein, 6 aa, Mycobacterium
DHADAE

SEQ ID NO: 1197186 - protein, 22 aa, Mycobacterium
DHAEAPKSAEEKAAEAAAPQKV

SEQ ID NO: 1197187 - protein, 8 aa, Mycobacterium
DHAEHAQR

SEQ ID NO: 1197188 - protein, 6 aa, Mycobacterium
DHAGPD

SEQ ID NO: 1197189 - protein, 6 aa, Mycobacterium
DHAPPT

SEQ ID NO: 1197190 - protein, 13 aa, Mycobacterium
DHAQGGSSPSAPR

SEQ ID NO: 1197191 - protein, 17 aa, Mycobacterium
DHARASGAAARRGNQPP

SEQ ID NO: 1197192 - protein, 6 aa, Mycobacterium
DHASVD

SEQ ID NO: 1197193 - protein, 6 aa, Mycobacterium
DHDDRV

SEQ ID NO: 1197194 - protein, 9 aa, Mycobacterium
DHDDTVPDD

SEQ ID NO: 1197195 - protein, 4 aa, Mycobacterium
DHDE

SEQ ID NO: 1197196 - protein, 4 aa, Mycobacterium
DHDG

SEQ ID NO: 1197197 - protein, 8 aa, Mycobacterium
DHDGARTH

SEQ ID NO: 1197198 - protein, 8 aa, Mycobacterium
DHDGGRTV

SEQ ID NO: 1197199 - protein, 6 aa, Mycobacterium
DHDGSD

SEQ ID NO: 1197200 - protein, 22 aa, Mycobacterium
DHDHGDDGRAARAAKDQPGRFT

SEQ ID NO: 1197201 - protein, 9 aa, Mycobacterium
DHDHPHTET

SEQ ID NO: 1197202 - protein, 12 aa, Mycobacterium
DHDPADDLAGPL

SEQ ID NO: 1197203 - protein, 6 aa, Mycobacterium
DHDPQY

SEQ ID NO: 1197204 - protein, 16 aa, Mycobacterium
DHDPTSNLNAGPSTTA

SEQ ID NO: 1197205 - protein, 9 aa, Mycobacterium
DHDPTSRHG

SEQ ID NO: 1197206 - protein, 9 aa, Mycobacterium
DHDREHTGL

SEQ ID NO: 1197207 - protein, 8 aa, Mycobacterium
DHDRGRAA

SEQ ID NO: 1197208 - protein, 22 aa, Mycobacterium
DHDTPTDTPAGAPAGGSPPMPA

SEQ ID NO: 1197209 - protein, 12 aa, Mycobacterium
DHEAPGAPDREL

SEQ ID NO: 1197210 - protein, 8 aa, Mycobacterium
DHEAPTSL

SEQ ID NO: 1197211 - protein, 4 aa, Mycobacterium
DHEE

SEQ ID NO: 1197212 - protein, 7 aa, Mycobacterium
DHEGGDG

SEQ ID NO: 1197213 - protein, 10 aa, Mycobacterium
DHETFSSAQG

SEQ ID NO: 1197214 - protein, 7 aa, Mycobacterium
DHETGSN

SEQ ID NO: 1197215 - protein, 5 aa, Mycobacterium
DHGAD

SEQ ID NO: 1197216 - protein, 8 aa, Mycobacterium
DHGAGDSL

SEQ ID NO: 1197217 - protein, 17 aa, Mycobacterium
DHGDTDDTSGPGRPPMP

SEQ ID NO: 1197218 - protein, 7 aa, Mycobacterium
DHGESGW

SEQ ID NO: 1197219 - protein, 6 aa, Mycobacterium
DHGGAS

SEQ ID NO: 1197220 - protein, 9 aa, Mycobacterium
DHGITDADT

SEQ ID NO: 1197221 - protein, 5 aa, Mycobacterium
DHGPA

SEQ ID NO: 1197222 - protein, 5 aa, Mycobacterium
DHGRR

SEQ ID NO: 1197223 - protein, 5 aa, Mycobacterium
DHGSY

SEQ ID NO: 1197224 - protein, 10 aa, Mycobacterium
DHHDTAPDYP

SEQ ID NO: 1197225 - protein, 14 aa, Mycobacterium
DHISGTATSAAGSV

SEQ ID NO: 1197226 - protein, 9 aa, Mycobacterium
DHLSKQEQR

SEQ ID NO: 1197227 - protein, 6 aa, Mycobacterium
DHPAAE

SEQ ID NO: 1197228 - protein, 21 aa, Mycobacterium
DHPAGRQRLRGGESAGGSCPA

SEQ ID NO: 1197229 - protein, 15 aa, Mycobacterium
DHPDGRLPSADGSWA

SEQ ID NO: 1197230 - protein, 9 aa, Mycobacterium
DHPDNGHTL

SEQ ID NO: 1197231 - protein, 5 aa, Mycobacterium
DHPGE

SEQ ID NO: 1197232 - protein, 17 aa, Mycobacterium
DHPHGDPTSAAFDPSAP

SEQ ID NO: 1197233 - protein, 6 aa, Mycobacterium
DHPMTA

SEQ ID NO: 1197234 - protein, 9 aa, Mycobacterium
DHPPGSETQ

SEQ ID NO: 1197235 - protein, 19 aa, Mycobacterium
DHPRTRDGEADAVVAADAY

SEQ ID NO: 1197236 - protein, 31 aa, Mycobacterium; identical to SEQ ID NO: 450948

SEQ ID NO: 1197237 - protein, 12 aa, Mycobacterium
DHQKGPPQCVRS

SEQ ID NO: 1197238 - protein, 7 aa, Mycobacterium
DHQPTQI

SEQ ID NO: 1197239 - protein, 5 aa, Mycobacterium
DHQTF

SEQ ID NO: 1197240 - protein, 5 aa, Mycobacterium
DHRDP

SEQ ID NO: 1197241 - protein, 5 aa, Mycobacterium
DHRGA

SEQ ID NO: 1197242 - protein, 11 aa, Mycobacterium
DHRREGVATPQ

SEQ ID NO: 1197243 - protein, 7 aa, Mycobacterium
DHSAGDP

SEQ ID NO: 1197244 - protein, 6 aa, Mycobacterium
DHSGLS

SEQ ID NO: 1197245 - protein, 8 aa, Mycobacterium
DHSSSGPV

SEQ ID NO: 1197246 - protein, 4 aa, Mycobacterium
DHTE

SEQ ID NO: 1197247 - protein, 157 aa, Mycobacterium
DHTSPGIEQDENPYSDTEKREAGADAPKPVDDAPTDPAGTSTTQPGVSPGSKSAAGDESIKAATGPVTQPTPGVTSSPAASALGGAGMPSMGGIGGGGMGSGGGIPKMPGGLGSGGMPGMGSNPLSGGVGQMPGAASGLPNPGAVPGAGSASPLSSA

SEQ ID NO: 1197248 - protein, 7 aa, Mycobacterium
DHTTLGD

SEQ ID NO: 1197249 - protein, 6 aa, Mycobacterium
DHVEEG

SEQ ID NO: 1197250 - protein, 5 aa, Mycobacterium
DIAAP

SEQ ID NO: 1197251 - protein, 9 aa, Mycobacterium
DIADRAAPL

SEQ ID NO: 1197252 - protein, 6 aa, Mycobacterium
DIAGAR

SEQ ID NO: 1197253 - protein, 7 aa, Mycobacterium
DIANNQH

SEQ ID NO: 1197254 - protein, 9 aa, Mycobacterium
DIAPASDAT

SEQ ID NO: 1197255 - protein, 15 aa, Mycobacterium
DIARGRAAAGDSAPQ

SEQ ID NO: 1197256 - protein, 10 aa, Mycobacterium
DIARNAKKPP

SEQ ID NO: 1197257 - protein, 7 aa, Mycobacterium
DIATTER

SEQ ID NO: 1197258 - protein, 8 aa, Mycobacterium
DIDAENAL

SEQ ID NO: 1197259 - protein, 7 aa, Mycobacterium
DIDDDTW

SEQ ID NO: 1197260 - protein, 7 aa, Mycobacterium
DIDDEEL

SEQ ID NO: 1197261 - protein, 48 aa, Mycobacterium
DIDEDPKVAGSRAAKGTDDPSEGPYVGRAGGDDDFDAGESGAEARSDD

SEQ ID NO: 1197262 - protein, 9 aa, Mycobacterium
DIDGGASPQ

SEQ ID NO: 1197263 - protein, 6 aa, Mycobacterium
DIDGLP

SEQ ID NO: 1197264 - protein, 6 aa, Mycobacterium
DIDGTP

SEQ ID NO: 1197265 - protein, 14 aa, Mycobacterium
DIDPAVNRPDGTDA

SEQ ID NO: 1197266 - protein, 25 aa, Mycobacterium
DIDPERTADELTEQVQKAIDGKGLI

SEQ ID NO: 1197267 - protein, 7 aa, Mycobacterium
DIDTPDD

SEQ ID NO: 1197268 - protein, 10 aa, Mycobacterium
DIEAAAEARA

SEQ ID NO: 1197269 - protein, 5 aa, Mycobacterium
DIEDP

SEQ ID NO: 1197270 - protein, 11 aa, Mycobacterium
DIEDRDGNRVT

SEQ ID NO: 1197271 - protein, 12 aa, Mycobacterium
DIEDSRGERDAR

SEQ ID NO: 1197272 - protein, 15 aa, Mycobacterium
DIEIGDAGGAAQGHA

SEQ ID NO: 1197273 - protein, 8 aa, Mycobacterium
DIEPDPGQ

SEQ ID NO: 1197274 - protein, 6 aa, Mycobacterium
DIEPGS

SEQ ID NO: 1197275 - protein, 6 aa, Mycobacterium
DIEQRT

SEQ ID NO: 1197276 - protein, 7 aa, Mycobacterium
DIESADD

SEQ ID NO: 1197277 - protein, 7 aa, Mycobacterium
DIETPDS

SEQ ID NO: 1197278 - protein, 4 aa, Mycobacterium
DIGE

SEQ ID NO: 1197279 - protein, 6 aa, Mycobacterium
DIGPGT

SEQ ID NO: 1197280 - protein, 9 aa, Mycobacterium
DIGQPASVR

SEQ ID NO: 1197281 - protein, 9 aa, Mycobacterium
DIGSGKSTI

SEQ ID NO: 1197282 - protein, 5 aa, Mycobacterium
DIGTE

SEQ ID NO: 1197283 - protein, 11 aa, Mycobacterium
DIGTTAKTLPD

SEQ ID NO: 1197284 - protein, 9 aa, Mycobacterium
DIHPSPATR

SEQ ID NO: 1197285 - protein, 5 aa, Mycobacterium
DIKPH

SEQ ID NO: 1197286 - protein, 8 aa, Mycobacterium
DINPGNSV

SEQ ID NO: 1197287 - protein, 11 aa, Mycobacterium
DIPAATPDDLA

SEQ ID NO: 1197288 - protein, 6 aa, Mycobacterium
DIPAED

SEQ ID NO: 1197289 - protein, 16 aa, Mycobacterium
DIPAGRTDIPTLRPGT

SEQ ID NO: 1197290 - protein, 5 aa, Mycobacterium
DIPEG

SEQ ID NO: 1197291 - protein, 12 aa, Mycobacterium
DIPESGQMQGRS

SEQ ID NO: 1197292 - protein, 6 aa, Mycobacterium
DIPGDS

SEQ ID NO: 1197293 - protein, 6 aa, Mycobacterium
DIPGSA

SEQ ID NO: 1197294 - protein, 6 aa, Mycobacterium
DIPPEL

SEQ ID NO: 1197295 - protein, 7 aa, Mycobacterium
DIPPGAV

SEQ ID NO: 1197296 - protein, 14 aa, Mycobacterium
DIPTTEDLEEMLDD

SEQ ID NO: 1197297 - protein, 18 aa, Mycobacterium
DIRPRKGSRAAGTRRGPV

SEQ ID NO: 1197298 - protein, 10 aa, Mycobacterium
DIRRPDGTSG

SEQ ID NO: 1197299 - protein, 19 aa, Mycobacterium
DISAATGATGRFADDGPRR

SEQ ID NO: 1197300 - protein, 5 aa, Mycobacterium
DISED

SEQ ID NO: 1197301 - protein, 10 aa, Mycobacterium
DISEKGGPGY

SEQ ID NO: 1197302 - protein, 5 aa, Mycobacterium
DISGG

SEQ ID NO: 1197303 - protein, 9 aa, Mycobacterium
DISGGAAGE

SEQ ID NO: 1197304 - protein, 60 aa, Mycobacterium
DITDHTDGHDITDRTDGHDTDGHDDNVGDHTDTDGRDITNPGPYYDGDGGEGVGRAPLPD

SEQ ID NO: 1197305 - protein, 5 aa, Mycobacterium
DITDS

SEQ ID NO: 1197306 - protein, 8 aa, Mycobacterium
DITGARNS

SEQ ID NO: 1197307 - protein, 11 aa, Mycobacterium
DITPGSPGTQL

SEQ ID NO: 1197308 - protein, 9 aa, Mycobacterium
DKAAAEKKA

SEQ ID NO: 1197309 - protein, 10 aa, Mycobacterium
DKAAEDGPDV

SEQ ID NO: 1197310 - protein, 16 aa, Mycobacterium
DKAAQKSTIPDPNGRR

SEQ ID NO: 1197311 - protein, 8 aa, Mycobacterium
DKADADLG

SEQ ID NO: 1197312 - protein, 17 aa, Mycobacterium
DKADRQRNSATGHTAHA

SEQ ID NO: 1197313 - protein, 15 aa, Mycobacterium
DKAEQAAAAGADIVG

SEQ ID NO: 1197314 - protein, 14 aa, Mycobacterium
DKAEQAEAAGADIV

SEQ ID NO: 1197315 - protein, 12 aa, Mycobacterium
DKAETKAKYGEE

SEQ ID NO: 1197316 - protein, 21 aa, Mycobacterium
DKAGAQALAPTRAAQDDYNDE

SEQ ID NO: 1197317 - protein, 17 aa, Mycobacterium
DKAGAYPAQLSGGQQQR

SEQ ID NO: 1197318 - protein, 10 aa, Mycobacterium
DKAGFTSGEA

SEQ ID NO: 1197319 - protein, 31 aa, Mycobacterium
DKAGIPAPVGEDDPYRAAEPISDKLGDRRDE

SEQ ID NO: 1197320 - protein, 7 aa, Mycobacterium
DKAGSDV

SEQ ID NO: 1197321 - protein, 8 aa, Mycobacterium
DKAIADGP

SEQ ID NO: 1197322 - protein, 13 aa, Mycobacterium
DKATAAPGVTDAI

SEQ ID NO: 1197323 - protein, 15 aa, Mycobacterium
DKATKETFNEDESER

SEQ ID NO: 1197324 - protein, 13 aa, Mycobacterium
DKATVADAQPVRD

SEQ ID NO: 1197325 - protein, 6 aa, Mycobacterium
DKAVDA

SEQ ID NO: 1197326 - protein, 7 aa, Mycobacterium
DKDESAS

SEQ ID NO: 1197327 - protein, 4 aa, Mycobacterium
DKDG

SEQ ID NO: 1197328 - protein, 7 aa, Mycobacterium
DKDGVNA

SEQ ID NO: 1197329 - protein, 29 aa, Mycobacterium
DKDKGNIETTAEEGNVEYRNTEEFRRKLE

SEQ ID NO: 1197330 - protein, 6 aa, Mycobacterium
DKDLSD

SEQ ID NO: 1197331 - protein, 5 aa, Mycobacterium
DKDRA

SEQ ID NO: 1197332 - protein, 6 aa, Mycobacterium
DKDSRE

SEQ ID NO: 1197333 - protein, 6 aa, Mycobacterium
DKDTAI

SEQ ID NO: 1197334 - protein, 9 aa, Mycobacterium
DKDTEDVRA

SEQ ID NO: 1197335 - protein, 6 aa, Mycobacterium
DKDVED

SEQ ID NO: 1197336 - protein, 8 aa, Mycobacterium
DKDVPKHK

SEQ ID NO: 1197337 - protein, 9 aa, Mycobacterium
DKDYTPQEI

SEQ ID NO: 1197338 - protein, 9 aa, Mycobacterium
DKEGRSASR

SEQ ID NO: 1197339 - protein, 9 aa, Mycobacterium
DKEPTAEEM

SEQ ID NO: 1197340 - protein, 7 aa, Mycobacterium
DKFAAPR

SEQ ID NO: 1197341 - protein, 13 aa, Mycobacterium
DKFGGTTAYSGGG

SEQ ID NO: 1197342 - protein, 15 aa, Mycobacterium
DKFGGTTAYSGGGGT

SEQ ID NO: 1197343 - protein, 8 aa, Mycobacterium
DKGAARKR

SEQ ID NO: 1197344 - protein, 9 aa, Mycobacterium
DKGCGGEAA

SEQ ID NO: 1197345 - protein, 9 aa, Mycobacterium
DKGKALADE

SEQ ID NO: 1197346 - protein, 22 aa, Mycobacterium
DKGLDAARVDPAYADQDNAVSE

SEQ ID NO: 1197347 - protein, 4 aa, Mycobacterium
DKGN

SEQ ID NO: 1197348 - protein, 12 aa, Mycobacterium
DKGNTAAATMTG

SEQ ID NO: 1197349 - protein, 14 aa, Mycobacterium
DKGPESRIADPSRN

SEQ ID NO: 1197350 - protein, 8 aa, Mycobacterium
DKGQKTRI

SEQ ID NO: 1197351 - protein, 19 aa, Mycobacterium
DKGRDVKDAVQDEIQRGEE

SEQ ID NO: 1197352 - protein, 6 aa, Mycobacterium
DKGRKV

SEQ ID NO: 1197353 - protein, 7 aa, Mycobacterium
DKGRQAV

SEQ ID NO: 1197354 - protein, 10 aa, Mycobacterium
DKGSAGEQRF

SEQ ID NO: 1197355 - protein, 7 aa, Mycobacterium
DKGTPFG

SEQ ID NO: 1197356 - protein, 5 aa, Mycobacterium
DKGVF

SEQ ID NO: 1197357 - protein, 5 aa, Mycobacterium
DKGVR

SEQ ID NO: 1197358 - protein, 6 aa, Mycobacterium
DKHPAH

SEQ ID NO: 1197359 - protein, 14 aa, Mycobacterium
DKHRTGGPAGDPGT

SEQ ID NO: 1197360 - protein, 8 aa, Mycobacterium
DKHSHDNE

SEQ ID NO: 1197361 - protein, 6 aa, Mycobacterium
DKHVPL

SEQ ID NO: 1197362 - protein, 6 aa, Mycobacterium
DKIREL

SEQ ID NO: 1197363 - protein, 10 aa, Mycobacterium
DKIRRSSGNI

SEQ ID NO: 1197364 - protein, 5 aa, Mycobacterium
DKKEW

SEQ ID NO: 1197365 - protein, 9 aa, Mycobacterium
DKKGSVGRA

SEQ ID NO: 1197366 - protein, 7 aa, Mycobacterium
DKKPSFD

SEQ ID NO: 1197367 - protein, 7 aa, Mycobacterium
DKKSNFT

SEQ ID NO: 1197368 - protein, 7 aa, Mycobacterium
DKKTRAG

SEQ ID NO: 1197369 - protein, 52 aa, Mycobacterium
DKLESSDRDKSSDSDKSSDDEKSSDEDEKSSDDDESDDSDDSEKSAKSDSEK

SEQ ID NO: 1197370 - protein, 10 aa, Mycobacterium
DKLKPGEQAA

SEQ ID NO: 1197371 - protein, 5 aa, Mycobacterium
DKLPK

SEQ ID NO: 1197372 - protein, 5 aa, Mycobacterium
DKNAL

SEQ ID NO: 1197373 - protein, 6 aa, Mycobacterium
DKNGNW

SEQ ID NO: 1197374 - protein, 17 aa, Mycobacterium
DKNPQWSPASLSTVTPA

SEQ ID NO: 1197375 - protein, 6 aa, Mycobacterium
DKPAGV

SEQ ID NO: 1197376 - protein, 9 aa, Mycobacterium
DKPATEADI

SEQ ID NO: 1197377 - protein, 8 aa, Mycobacterium
DKPDASYT

SEQ ID NO: 1197378 - protein, 10 aa, Mycobacterium
DKPDDEPVAD

SEQ ID NO: 1197379 - protein, 5 aa, Mycobacterium
DKPDG

SEQ ID NO: 1197380 - protein, 7 aa, Mycobacterium
DKPEADA

SEQ ID NO: 1197381 - protein, 6 aa, Mycobacterium
DKPEDV

SEQ ID NO: 1197382 - protein, 8 aa, Mycobacterium
DKPESDGH

SEQ ID NO: 1197383 - protein, 7 aa, Mycobacterium
DKPFASA

SEQ ID NO: 1197384 - protein, 11 aa, Mycobacterium
DKPGGAAARGI

SEQ ID NO: 1197385 - protein, 9 aa, Mycobacterium
DKPGSKIEA

SEQ ID NO: 1197386 - protein, 7 aa, Mycobacterium
DKPLTNS

SEQ ID NO: 1197387 - protein, 11 aa, Mycobacterium
DKPNPRTATNA

SEQ ID NO: 1197388 - protein, 7 aa, Mycobacterium
DKPRAEG

SEQ ID NO: 1197389 - protein, 6 aa, Mycobacterium
DKPSLG

SEQ ID NO: 1197390 - protein, 6 aa, Mycobacterium
DKPTIA

SEQ ID NO: 1197391 - protein, 6 aa, Mycobacterium
DKQAVG

SEQ ID NO: 1197392 - protein, 7 aa, Mycobacterium
DKQERRY

SEQ ID NO: 1197393 - protein, 8 aa, Mycobacterium
DKQKVKQN

SEQ ID NO: 1197394 - protein, 6 aa, Mycobacterium
DKQRAQ

SEQ ID NO: 1197395 - protein, 12 aa, Mycobacterium
DKRESRSRPGEG

SEQ ID NO: 1197396 - protein, 4 aa, Mycobacterium
DKRK

SEQ ID NO: 1197397 - protein, 7 aa, Mycobacterium
DKRPRSV

SEQ ID NO: 1197398 - protein, 21 aa, Mycobacterium
DKRYGGTNDSDTRELAEPFGA

SEQ ID NO: 1197399 - protein, 10 aa, Mycobacterium
DKSAETPQRG

SEQ ID NO: 1197400 - protein, 11 aa, Mycobacterium
DKSDRPGRNQV

SEQ ID NO: 1197401 - protein, 10 aa, Mycobacterium
DKSGDLESSD

SEQ ID NO: 1197402 - protein, 5 aa, Mycobacterium
DKSGI

SEQ ID NO: 1197403 - protein, 6 aa, Mycobacterium
DKSLGA

SEQ ID NO: 1197404 - protein, 18 aa, Mycobacterium
DKSPHWTGSTNSKRTYGH

SEQ ID NO: 1197405 - protein, 7 aa, Mycobacterium
DKSSGTT

SEQ ID NO: 1197406 - protein, 5 aa, Mycobacterium
DKTAA

SEQ ID NO: 1197407 - protein, 20 aa, Mycobacterium
DKTAAEADTIDTVRALHERA

SEQ ID NO: 1197408 - protein, 13 aa, Mycobacterium
DKTAGKQGSVDRS

SEQ ID NO: 1197409 - protein, 5 aa, Mycobacterium
DKTDM

SEQ ID NO: 1197410 - protein, 4 aa, Mycobacterium
DKTE

SEQ ID NO: 1197411 - protein, 13 aa, Mycobacterium
DKTGEEVSRSSSW

SEQ ID NO: 1197412 - protein, 6 aa, Mycobacterium
DKTGRF

SEQ ID NO: 1197413 - protein, 8 aa, Mycobacterium
DKTGRFQN

SEQ ID NO: 1197414 - protein, 9 aa, Mycobacterium
DKTLAGPNQ

SEQ ID NO: 1197415 - protein, 5 aa, Mycobacterium
DKTPG

SEQ ID NO: 1197416 - protein, 8 aa, Mycobacterium
DKTTDMAD

SEQ ID NO: 1197417 - protein, 11 aa, Mycobacterium
DKTVTAAGVSA

SEQ ID NO: 1197418 - protein, 7 aa, Mycobacterium
DKVADDT

SEQ ID NO: 1197419 - protein, 4 aa, Mycobacterium
DKVG

SEQ ID NO: 1197420 - protein, 9 aa, Mycobacterium
DKVGRDAGE

SEQ ID NO: 1197421 - protein, 17 aa, Mycobacterium
DKVGRDAGEIAGTGPIG

SEQ ID NO: 1197422 - protein, 13 aa, Mycobacterium
DKVKTGAKWGGPA

SEQ ID NO: 1197423 - protein, 9 aa, Mycobacterium
DKVNRPAGG

SEQ ID NO: 1197424 - protein, 7 aa, Mycobacterium
DKVSDDD

SEQ ID NO: 1197425 - protein, 5 aa, Mycobacterium
DKVTG

SEQ ID NO: 1197426 - protein, 16 aa, Mycobacterium
DKVTTSPAFRSSAKSR

SEQ ID NO: 1197427 - protein, 15 aa, Mycobacterium
DKWGKNAEDAVDNQQ

SEQ ID NO: 1197428 - protein, 6 aa, Mycobacterium
DKYGAN

SEQ ID NO: 1197429 - protein, 18 aa, Mycobacterium
DKYPEYKEGRSATPDEFR

SEQ ID NO: 1197430 - protein, 4 aa, Mycobacterium
DLAA

SEQ ID NO: 1197431 - protein, 18 aa, Mycobacterium
DLADGDTLGRPRRDEGVG

SEQ ID NO: 1197432 - protein, 7 aa, Mycobacterium
DLADQDI

SEQ ID NO: 1197433 - protein, 13 aa, Mycobacterium
DLAEEVSKGGKTF

SEQ ID NO: 1197434 - protein, 22 aa, Mycobacterium
DLAGDPQLGDRTGRDRNRTRID

SEQ ID NO: 1197435 - protein, 12 aa, Mycobacterium
DLAGKPASRHEA

SEQ ID NO: 1197436 - protein, 5 aa, Mycobacterium
DLAGP

SEQ ID NO: 1197437 - protein, 19 aa, Mycobacterium
DLAGREPGGPLAAATRRAA

SEQ ID NO: 1197438 - protein, 9 aa, Mycobacterium
DLAKAQGIP

SEQ ID NO: 1197439 - protein, 18 aa, Mycobacterium
DLAKGTRFRGDGGSDDIT

SEQ ID NO: 1197440 - protein, 28 aa, Mycobacterium
DLAPAPGRPSGLGMPRRKQTRAQARARR

SEQ ID NO: 1197441 - protein, 11 aa, Mycobacterium
DLAQESDAPVA

SEQ ID NO: 1197442 - protein, 20 aa, Mycobacterium
DLARAARDRAVTRAKTTSGV

SEQ ID NO: 1197443 - protein, 12 aa, Mycobacterium
DLASGGVPPQVD

SEQ ID NO: 1197444 - protein, 5 aa, Mycobacterium
DLDAT

SEQ ID NO: 1197445 - protein, 6 aa, Mycobacterium
DLDDDD

SEQ ID NO: 1197446 - protein, 7 aa, Mycobacterium
DLDDTDG

SEQ ID NO: 1197447 - protein, 4 aa, Mycobacterium
DLDE

SEQ ID NO: 1197448 - protein, 37 aa, Mycobacterium
DLDEDDEDDDDVHEEQDDLDGADTTHDGADQQEHVHQ

SEQ ID NO: 1197449 - protein, 12 aa, Mycobacterium
DLDEEAQTAAEK

SEQ ID NO: 1197450 - protein, 5 aa, Mycobacterium
DLDGA

SEQ ID NO: 1197451 - protein, 19 aa, Mycobacterium
DLDGAQPKGWSGQSRPVTE

SEQ ID NO: 1197452 - protein, 8 aa, Mycobacterium
DLDGDSVG

SEQ ID NO: 1197453 - protein, 8 aa, Mycobacterium
DLDGHKSL

SEQ ID NO: 1197454 - protein, 26 aa, Mycobacterium
DLDGIRAASEEQWEQARQAQKQGTGF

SEQ ID NO: 1197455 - protein, 7 aa, Mycobacterium
DLDKARE

SEQ ID NO: 1197456 - protein, 6 aa, Mycobacterium
DLDKDA

SEQ ID NO: 1197457 - protein, 11 aa, Mycobacterium
DLDPADARACD

SEQ ID NO: 1197458 - protein, 7 aa, Mycobacterium
DLDPDDV

SEQ ID NO: 1197459 - protein, 10 aa, Mycobacterium
DLDRPPTREE

SEQ ID NO: 1197460 - protein, 7 aa, Mycobacterium
DLDTEHP

SEQ ID NO: 1197461 - protein, 10 aa, Mycobacterium
DLEDGGTVDA

SEQ ID NO: 1197462 - protein, 6 aa, Mycobacterium
DLERDN

SEQ ID NO: 1197463 - protein, 11 aa, Mycobacterium
DLESDDTTALP

SEQ ID NO: 1197464 - protein, 9 aa, Mycobacterium
DLESPTRDD

SEQ ID NO: 1197465 - protein, 8 aa, Mycobacterium
DLGDDDAR

SEQ ID NO: 1197466 - protein, 8 aa, Mycobacterium
DLGDGQPH

SEQ ID NO: 1197467 - protein, 6 aa, Mycobacterium
DLGDPA

SEQ ID NO: 1197468 - protein, 12 aa, Mycobacterium
DLGEAVGNVLCP

SEQ ID NO: 1197469 - protein, 6 aa, Mycobacterium
DLGEPL

SEQ ID NO: 1197470 - protein, 5 aa, Mycobacterium
DLGEQ

SEQ ID NO: 1197471 - protein, 7 aa, Mycobacterium
DLGGAQR

SEQ ID NO: 1197472 - protein, 6 aa, Mycobacterium
DLGGGT

SEQ ID NO: 1197473 - protein, 10 aa, Mycobacterium
DLGGPARASR

SEQ ID NO: 1197474 - protein, 8 aa, Mycobacterium
DLGGQGYG

SEQ ID NO: 1197475 - protein, 17 aa, Mycobacterium
DLGGRDPVRRDGAKPGD

SEQ ID NO: 1197476 - protein, 5 aa, Mycobacterium
DLGGT

SEQ ID NO: 1197477 - protein, 14 aa, Mycobacterium
DLGKKVEEGVRNGG

SEQ ID NO: 1197478 - protein, 11 aa, Mycobacterium
DLGNGATRQRR

SEQ ID NO: 1197479 - protein, 7 aa, Mycobacterium
DLGPGAL

SEQ ID NO: 1197480 - protein, 16 aa, Mycobacterium
DLGPGTSTSAASAALA

SEQ ID NO: 1197481 - protein, 13 aa, Mycobacterium
DLGPGYDGQENAA

SEQ ID NO: 1197482 - protein, 6 aa, Mycobacterium
DLGPRG

SEQ ID NO: 1197483 - protein, 6 aa, Mycobacterium
DLGRGP

SEQ ID NO: 1197484 - protein, 6 aa, Mycobacterium
DLGRKG

SEQ ID NO: 1197485 - protein, 13 aa, Mycobacterium
DLGRPAADGLSGV

SEQ ID NO: 1197486 - protein, 11 aa, Mycobacterium
DLGSAEPDGLA

SEQ ID NO: 1197487 - protein, 8 aa, Mycobacterium
DLGTGDQI

SEQ ID NO: 1197488 - protein, 13 aa, Mycobacterium
DLGTKGGLRTDTA

SEQ ID NO: 1197489 - protein, 12 aa, Mycobacterium
DLGTVGDDQFRG

SEQ ID NO: 1197490 - protein, 12 aa, Mycobacterium
DLKDGEGSVGTF

SEQ ID NO: 1197491 - protein, 9 aa, Mycobacterium
DLNGEAQAT

SEQ ID NO: 1197492 - protein, 4 aa, Mycobacterium
DLPA

SEQ ID NO: 1197493 - protein, 7 aa, Mycobacterium
DLPAEPA

SEQ ID NO: 1197494 - protein, 6 aa, Mycobacterium
DLPANA

SEQ ID NO: 1197495 - protein, 12 aa, Mycobacterium
DLPANSTVSLGQ

SEQ ID NO: 1197496 - protein, 28 aa, Mycobacterium
DLPAPDPDAAVPDVDAASDESTNSRSYQ

SEQ ID NO: 1197497 - protein, 12 aa, Mycobacterium
DLPAPRPGDPPY

SEQ ID NO: 1197498 - protein, 15 aa, Mycobacterium
DLPAPVRPGTLPLAV

SEQ ID NO: 1197499 - protein, 5 aa, Mycobacterium
DLPDE

SEQ ID NO: 1197500 - protein, 12 aa, Mycobacterium
DLPDEARQDPTW

SEQ ID NO: 1197501 - protein, 6 aa, Mycobacterium
DLPDED

SEQ ID NO: 1197502 - protein, 8 aa, Mycobacterium
DLPDPDAA

SEQ ID NO: 1197503 - protein, 8 aa, Mycobacterium
DLPDPDGL

SEQ ID NO: 1197504 - protein, 8 aa, Mycobacterium
DLPDPEAH

SEQ ID NO: 1197505 - protein, 9 aa, Mycobacterium
DLPEAGSYA

SEQ ID NO: 1197506 - protein, 13 aa, Mycobacterium
DLPEASRTARGQH

SEQ ID NO: 1197507 - protein, 7 aa, Mycobacterium
DLPEKVR

SEQ ID NO: 1197508 - protein, 6 aa, Mycobacterium
DLPETQ

SEQ ID NO: 1197509 - protein, 19 aa, Mycobacterium
DLPGAVTRGRGGPCRPAPS

SEQ ID NO: 1197510 - protein, 22 aa, Mycobacterium
DLPGDDGEVGAAAARDGERLTE

SEQ ID NO: 1197511 - protein, 10 aa, Mycobacterium
DLPGDDPDYL

SEQ ID NO: 1197512 - protein, 10 aa, Mycobacterium
DLPGGAASGL

SEQ ID NO: 1197513 - protein, 8 aa, Mycobacterium
DLPGPGAI

SEQ ID NO: 1197514 - protein, 10 aa, Mycobacterium
DLPGPRGTEP

SEQ ID NO: 1197515 - protein, 6 aa, Mycobacterium
DLPGYD

SEQ ID NO: 1197516 - protein, 19 aa, Mycobacterium
DLPGYRGAKGRLAGDTGAC

SEQ ID NO: 1197517 - protein, 9 aa, Mycobacterium
DLPNGDNEG

SEQ ID NO: 1197518 - protein, 14 aa, Mycobacterium
DLPPASSPDFANRA

SEQ ID NO: 1197519 - protein, 8 aa, Mycobacterium
DLPPDEQA

SEQ ID NO: 1197520 - protein, 13 aa, Mycobacterium
DLPPEAEQYRQAA

SEQ ID NO: 1197521 - protein, 11 aa, Mycobacterium
DLPPGAGRAIS

SEQ ID NO: 1197522 - protein, 6 aa, Mycobacterium
DLPPGM

SEQ ID NO: 1197523 - protein, 8 aa, Mycobacterium
DLPPPDAA

SEQ ID NO: 1197524 - protein, 9 aa, Mycobacterium
DLPPPHDNR

SEQ ID NO: 1197525 - protein, 7 aa, Mycobacterium
DLPPTAG

SEQ ID NO: 1197526 - protein, 8 aa, Mycobacterium
DLPPTPGA

SEQ ID NO: 1197527 - protein, 10 aa, Mycobacterium
DLPQNTNTTI

SEQ ID NO: 1197528 - protein, 8 aa, Mycobacterium
DLPQRGQR

SEQ ID NO: 1197529 - protein, 6 aa, Mycobacterium
DLPSPY

SEQ ID NO: 1197530 - protein, 9 aa, Mycobacterium
DLPSSVGRT

SEQ ID NO: 1197531 - protein, 4 aa, Mycobacterium
DLPT

SEQ ID NO: 1197532 - protein, 8 aa, Mycobacterium
DLPTAPDP

SEQ ID NO: 1197533 - protein, 13 aa, Mycobacterium
DLPTDDIGELMSI

SEQ ID NO: 1197534 - protein, 7 aa, Mycobacterium
DLPTGEL

SEQ ID NO: 1197535 - protein, 7 aa, Mycobacterium
DLQDSAE

SEQ ID NO: 1197536 - protein, 7 aa, Mycobacterium
DLRANSA

SEQ ID NO: 1197537 - protein, 25 aa, Mycobacterium
DLRATGATAVPGPRRASTLSNPAGL

SEQ ID NO: 1197538 - protein, 5 aa, Mycobacterium
DLRER

SEQ ID NO: 1197539 - protein, 6 aa, Mycobacterium
DLRGDE

SEQ ID NO: 1197540 - protein, 7 aa, Mycobacterium
DLRNTPI

SEQ ID NO: 1197541 - protein, 7 aa, Mycobacterium
DLRPDSR

SEQ ID NO: 1197542 - protein, 41 aa, Mycobacterium
DLRPQHERNTERNTDDDPNRERNERNTSATAKTPSDQGRFP

SEQ ID NO: 1197543 - protein, 4 aa, Mycobacterium
DLRQ

SEQ ID NO: 1197544 - protein, 11 aa, Mycobacterium
DLRRDADKLTA

SEQ ID NO: 1197545 - protein, 17 aa, Mycobacterium
DLSARDPGPAAAPTSAS

SEQ ID NO: 1197546 - protein, 17 aa, Mycobacterium
DLSATNSECACSQPKEC

SEQ ID NO: 1197547 - protein, 9 aa, Mycobacterium
DLSDADVDE

SEQ ID NO: 1197548 - protein, 9 aa, Mycobacterium
DLSDDESGR

SEQ ID NO: 1197549 - protein, 9 aa, Mycobacterium
DLSDDTKAR

SEQ ID NO: 1197550 - protein, 11 aa, Mycobacterium
DLSDGEVKGNE

SEQ ID NO: 1197551 - protein, 7 aa, Mycobacterium
DLSEPPV

SEQ ID NO: 1197552 - protein, 10 aa, Mycobacterium
DLSERADAAQ

SEQ ID NO: 1197553 - protein, 6 aa, Mycobacterium
DLSGED

SEQ ID NO: 1197554 - protein, 9 aa, Mycobacterium
DLSKDRPIA

SEQ ID NO: 1197555 - protein, 8 aa, Mycobacterium
DLSKPNED

SEQ ID NO: 1197556 - protein, 4 aa, Mycobacterium
DLSP

SEQ ID NO: 1197557 - protein, 9 aa, Mycobacterium
DLSPKARDL

SEQ ID NO: 1197558 - protein, 5 aa, Mycobacterium
DLSPR

SEQ ID NO: 1197559 - protein, 9 aa, Mycobacterium
DLSRTQNRD

SEQ ID NO: 1197560 - protein, 7 aa, Mycobacterium
DLSSTDM

SEQ ID NO: 1197561 - protein, 8 aa, Mycobacterium
DLTAPQWG

SEQ ID NO: 1197562 - protein, 8 aa, Mycobacterium
DLTDAEAR

SEQ ID NO: 1197563 - protein, 8 aa, Mycobacterium
DLTDAESA

SEQ ID NO: 1197564 - protein, 24 aa, Mycobacterium
DLTDEPQLAADSSGSAKDAPAPER

SEQ ID NO: 1197565 - protein, 6 aa, Mycobacterium
DLTEFG

SEQ ID NO: 1197566 - protein, 9 aa, Mycobacterium
DLTEGADPY

SEQ ID NO: 1197567 - protein, 8 aa, Mycobacterium
DLTEPDSL

SEQ ID NO: 1197568 - protein, 20 aa, Mycobacterium
DLTGNRAAATEGKKLAAKRR

SEQ ID NO: 1197569 - protein, 20 aa, Mycobacterium
DLTGSRVTATEGKRLAAKRR

SEQ ID NO: 1197570 - protein, 5 aa, Mycobacterium
DLTKA

SEQ ID NO: 1197571 - protein, 15 aa, Mycobacterium
DLTPAEAESTRHGRA

SEQ ID NO: 1197572 - protein, 7 aa, Mycobacterium
DLTPEDI

SEQ ID NO: 1197573 - protein, 5 aa, Mycobacterium
DLTPG

SEQ ID NO: 1197574 - protein, 11 aa, Mycobacterium
DLTPGTELAES

SEQ ID NO: 1197575 - protein, 9 aa, Mycobacterium
DLTPPADHS

SEQ ID NO: 1197576 - protein, 5 aa, Mycobacterium
DLTPR

SEQ ID NO: 1197577 - protein, 7 aa, Mycobacterium
DLTPRNQ

SEQ ID NO: 1197578 - protein, 8 aa, Mycobacterium
DLTPSLKA

SEQ ID NO: 1197579 - protein, 6 aa, Mycobacterium
DLTPTD

SEQ ID NO: 1197580 - protein, 8 aa, Mycobacterium
DLTRPGSD

SEQ ID NO: 1197581 - protein, 7 aa, Mycobacterium
DLTRVPE

SEQ ID NO: 1197582 - protein, 19 aa, Mycobacterium
DLTTANTIRRGKYAQRAGA

SEQ ID NO: 1197583 - protein, 9 aa, Mycobacterium
DLTTPSGRM

SEQ ID NO: 1197584 - protein, 7 aa, Mycobacterium
DLTTRRQ

SEQ ID NO: 1197585 - protein, 22 aa, Mycobacterium
DLTTSPSTAASAQAAAGGDTAS

SEQ ID NO: 1197586 - protein, 10 aa, Mycobacterium
DLVDSAPKPL

SEQ ID NO: 1197587 - protein, 13 aa, Mycobacterium
DLVPEEAAGDNAP

SEQ ID NO: 1197588 - protein, 6 aa, Mycobacterium
DLVPTD

SEQ ID NO: 1197589 - protein, 5 aa, Mycobacterium
DMAGE

SEQ ID NO: 1197590 - protein, 9 aa, Mycobacterium
DMATTKQAL

SEQ ID NO: 1197591 - protein, 4 aa, Mycobacterium
DMDE

SEQ ID NO: 1197592 - protein, 11 aa, Mycobacterium
DMDQESATAHR

SEQ ID NO: 1197593 - protein, 82 aa, Mycobacterium
DMGGAEKDEKAKLEDELREKKDEPSEEKEPEGAAPGETTGERAPEVGPRHAAPEAPQTGPAPEPQPPAPKPAPTRPADSSIL

SEQ ID NO: 1197594 - protein, 7 aa, Mycobacterium
DMGPVNG

SEQ ID NO: 1197595 - protein, 12 aa, Mycobacterium
DMGQETAREGRW

SEQ ID NO: 1197596 - protein, 5 aa, Mycobacterium
DMPDD

SEQ ID NO: 1197597 - protein, 6 aa, Mycobacterium
DMPGVT

SEQ ID NO: 1197598 - protein, 12 aa, Mycobacterium
DMPRSRTSGLRR

SEQ ID NO: 1197599 - protein, 4 aa, Mycobacterium
DMRP

SEQ ID NO: 1197600 - protein, 4 aa, Mycobacterium
DMRR

SEQ ID NO: 1197601 - protein, 8 aa, Mycobacterium
DMSDKELR

SEQ ID NO: 1197602 - protein, 5 aa, Mycobacterium
DMTEM

SEQ ID NO: 1197603 - protein, 8 aa, Mycobacterium
DMVGESKG

SEQ ID NO: 1197604 - protein, 14 aa, Mycobacterium
DNAAGRPNLSEREK

SEQ ID NO: 1197605 - protein, 10 aa, Mycobacterium
DNADAPGVTD

SEQ ID NO: 1197606 - protein, 18 aa, Mycobacterium
DNADRERRRRETGRPPAL

SEQ ID NO: 1197607 - protein, 11 aa, Mycobacterium
DNAGGAWPERA

SEQ ID NO: 1197608 - protein, 7 aa, Mycobacterium
DNAGTAR

SEQ ID NO: 1197609 - protein, 10 aa, Mycobacterium
DNAGTPEEQE

SEQ ID NO: 1197610 - protein, 8 aa, Mycobacterium
DNAPGAVE

SEQ ID NO: 1197611 - protein, 7 aa, Mycobacterium
DNAPIGA

SEQ ID NO: 1197612 - protein, 6 aa, Mycobacterium
DNARAT

SEQ ID NO: 1197613 - protein, 16 aa, Mycobacterium
DNARQRGDTAADVTPM

SEQ ID NO: 1197614 - protein, 4 aa, Mycobacterium
DNAS

SEQ ID NO: 1197615 - protein, 9 aa, Mycobacterium
DNASSGRYV

SEQ ID NO: 1197616 - protein, 7 aa, Mycobacterium
DNATTGY

SEQ ID NO: 1197617 - protein, 8 aa, Mycobacterium
DNAVHPES

SEQ ID NO: 1197618 - protein, 5 aa, Mycobacterium
DNDGR

SEQ ID NO: 1197619 - protein, 18 aa, Mycobacterium
DNDKGPSRRTGELDNRGS

SEQ ID NO: 1197620 - protein, 12 aa, Mycobacterium
DNDPRDMGDRRS

SEQ ID NO: 1197621 - protein, 8 aa, Mycobacterium
DNDQTPGY

SEQ ID NO: 1197622 - protein, 9 aa, Mycobacterium
DNDSNAFAP

SEQ ID NO: 1197623 - protein, 11 aa, Mycobacterium
DNDTDRAATED

SEQ ID NO: 1197624 - protein, 6 aa, Mycobacterium
DNDTLN

SEQ ID NO: 1197625 - protein, 5 aa, Mycobacterium
DNEAR

SEQ ID NO: 1197626 - protein, 23 aa, Mycobacterium
DNEPSPESLDEAQSKIKAALAEL

SEQ ID NO: 1197627 - protein, 6 aa, Mycobacterium
DNESID

SEQ ID NO: 1197628 - protein, 5 aa, Mycobacterium
DNESL

SEQ ID NO: 1197629 - protein, 17 aa, Mycobacterium
DNESQNDLMGTSRANAA

SEQ ID NO: 1197630 - protein, 12 aa, Mycobacterium
DNEVPGATERDH

SEQ ID NO: 1197631 - protein, 11 aa, Mycobacterium
DNEWSAGHAPG

SEQ ID NO: 1197632 - protein, 12 aa, Mycobacterium
DNFARANRSHTE

SEQ ID NO: 1197633 - protein, 6 aa, Mycobacterium
DNGEGI

SEQ ID NO: 1197634 - protein, 11 aa, Mycobacterium
DNGEPVPPGQQ

SEQ ID NO: 1197635 - protein, 6 aa, Mycobacterium
DNGFGG

SEQ ID NO: 1197636 - protein, 14 aa, Mycobacterium
DNGGHGGVGSAVSG

SEQ ID NO: 1197637 - protein, 6 aa, Mycobacterium
DNGGLA

SEQ ID NO: 1197638 - protein, 20 aa, Mycobacterium
DNGGSVARAEQCAEASNGAY

SEQ ID NO: 1197639 - protein, 4 aa, Mycobacterium
DNGI

SEQ ID NO: 1197640 - protein, 7 aa, Mycobacterium
DNGPDAV

SEQ ID NO: 1197641 - protein, 6 aa, Mycobacterium
DNGPHM

SEQ ID NO: 1197642 - protein, 5 aa, Mycobacterium
DNGSL

SEQ ID NO: 1197643 - protein, 5 aa, Mycobacterium
DNGTL

SEQ ID NO: 1197644 - protein, 6 aa, Mycobacterium
DNGVAE

SEQ ID NO: 1197645 - protein, 7 aa, Mycobacterium
DNHGPHQ

SEQ ID NO: 1197646 - protein, 8 aa, Mycobacterium
DNHNPTGL

SEQ ID NO: 1197647 - protein, 12 aa, Mycobacterium
DNHSTGEVQAAG

SEQ ID NO: 1197648 - protein, 6 aa, Mycobacterium
DNIEEP

SEQ ID NO: 1197649 - protein, 6 aa, Mycobacterium
DNITEM

SEQ ID NO: 1197650 - protein, 4 aa, Mycobacterium
DNKD

SEQ ID NO: 1197651 - protein, 8 aa, Mycobacterium
DNKGITSR

SEQ ID NO: 1197652 - protein, 6 aa, Mycobacterium
DNKPDH

SEQ ID NO: 1197653 - protein, 15 aa, Mycobacterium
DNLAPRDQQPYDGPA

SEQ ID NO: 1197654 - protein, 11 aa, Mycobacterium
DNLEASKQADA

SEQ ID NO: 1197655 - protein, 5 aa, Mycobacterium
DNLGG

SEQ ID NO: 1197656 - protein, 38 aa, Mycobacterium
DNLHRTQTERANKVAAAQAARLRADEAAAEAQRRQDAA

SEQ ID NO: 1197657 - protein, 9 aa, Mycobacterium
DNLSTGADG

SEQ ID NO: 1197658 - protein, 9 aa, Mycobacterium
DNMDRGGGP

SEQ ID NO: 1197659 - protein, 10 aa, Mycobacterium
DNNPGATPAE

SEQ ID NO: 1197660 - protein, 4 aa, Mycobacterium
DNNT

SEQ ID NO: 1197661 - protein, 6 aa, Mycobacterium
DNPADR

SEQ ID NO: 1197662 - protein, 9 aa, Mycobacterium
DNPADTEAT

SEQ ID NO: 1197663 - protein, 5 aa, Mycobacterium
DNPDA

SEQ ID NO: 1197664 - protein, 8 aa, Mycobacterium
DNPDDELA

SEQ ID NO: 1197665 - protein, 11 aa, Mycobacterium
DNPDLASEREH

SEQ ID NO: 1197666 - protein, 7 aa, Mycobacterium
DNPDVQV

SEQ ID NO: 1197667 - protein, 7 aa, Mycobacterium
DNPERVT

SEQ ID NO: 1197668 - protein, 5 aa, Mycobacterium
DNPFP

SEQ ID NO: 1197669 - protein, 7 aa, Mycobacterium
DNPHANG

SEQ ID NO: 1197670 - protein, 15 aa, Mycobacterium
DNPHQARRPRSTEQP

SEQ ID NO: 1197671 - protein, 5 aa, Mycobacterium
DNPLD

SEQ ID NO: 1197672 - protein, 12 aa, Mycobacterium
DNPLRGAPHTAE

SEQ ID NO: 1197673 - protein, 14 aa, Mycobacterium
DNPNPSDEEIREGL

SEQ ID NO: 1197674 - protein, 8 aa, Mycobacterium
DNPRTREQ

SEQ ID NO: 1197675 - protein, 11 aa, Mycobacterium
DNPTAPTGKET

SEQ ID NO: 1197676 - protein, 5 aa, Mycobacterium
DNPTD

SEQ ID NO: 1197677 - protein, 8 aa, Mycobacterium
DNPTGTYS

SEQ ID NO: 1197678 - protein, 10 aa, Mycobacterium
DNQNRRQTSF

SEQ ID NO: 1197679 - protein, 4 aa, Mycobacterium
DNQY

SEQ ID NO: 1197680 - protein, 5 aa, Mycobacterium
DNRAR

SEQ ID NO: 1197681 - protein, 8 aa, Mycobacterium
DNRDTARD

SEQ ID NO: 1197682 - protein, 7 aa, Mycobacterium
DNRGKRS

SEQ ID NO: 1197683 - protein, 17 aa, Mycobacterium
DNRLSTDADIAKAAEDF

SEQ ID NO: 1197684 - protein, 9 aa, Mycobacterium
DNRNRAAGE

SEQ ID NO: 1197685 - protein, 8 aa, Mycobacterium
DNRPAFSG

SEQ ID NO: 1197686 - protein, 7 aa, Mycobacterium
DNRSSDD

SEQ ID NO: 1197687 - protein, 4 aa, Mycobacterium
DNRT

SEQ ID NO: 1197688 - protein, 13 aa, Mycobacterium
DNRTQAPGNPLTG

SEQ ID NO: 1197689 - protein, 12 aa, Mycobacterium
DNSLRQSANDIQ

SEQ ID NO: 1197690 - protein, 8 aa, Mycobacterium
DNSPAAVG

SEQ ID NO: 1197691 - protein, 7 aa, Mycobacterium
DNSPEVK

SEQ ID NO: 1197692 - protein, 13 aa, Mycobacterium
DNSTHKVPEGVSD

SEQ ID NO: 1197693 - protein, 8 aa, Mycobacterium
DNSTTWST

SEQ ID NO: 1197694 - protein, 7 aa, Mycobacterium
DNTAAVK

SEQ ID NO: 1197695 - protein, 7 aa, Mycobacterium
DNTASRC

SEQ ID NO: 1197696 - protein, 6 aa, Mycobacterium
DNTGGL

SEQ ID NO: 1197697 - protein, 11 aa, Mycobacterium
DNTGLDDADAY

SEQ ID NO: 1197698 - protein, 6 aa, Mycobacterium
DNTYPG

SEQ ID NO: 1197699 - protein, 13 aa, Mycobacterium
DNVAATTRSAERL

SEQ ID NO: 1197700 - protein, 6 aa, Mycobacterium
DNVGGQ

SEQ ID NO: 1197701 - protein, 6 aa, Mycobacterium
DNVGHE

SEQ ID NO: 1197702 - protein, 4 aa, Mycobacterium
DNVP

SEQ ID NO: 1197703 - protein, 6 aa, Mycobacterium
DNVPDP

SEQ ID NO: 1197704 - protein, 12 aa, Mycobacterium
DNVRSSARSVAN

SEQ ID NO: 1197705 - protein, 7 aa, Mycobacterium
DNWSTDI

SEQ ID NO: 1197706 - protein, 5 aa, Mycobacterium
DNYAN

SEQ ID NO: 1197707 - protein, 6 aa, Mycobacterium
DNYRVE

SEQ ID NO: 1197708 - protein, 16 aa, Mycobacterium
DPAAADVAAEATEEVA

SEQ ID NO: 1197709 - protein, 10 aa, Mycobacterium
DPAAAQRAAN

SEQ ID NO: 1197710 - protein, 9 aa, Mycobacterium
DPAAAQRRA

SEQ ID NO: 1197711 - protein, 8 aa, Mycobacterium
DPAADSTT

SEQ ID NO: 1197712 - protein, 16 aa, Mycobacterium
DPAAEREMLQRFLIQR

SEQ ID NO: 1197713 - protein, 9 aa, Mycobacterium
DPAAGQPLE

SEQ ID NO: 1197714 - protein, 9 aa, Mycobacterium
DPAAGTGGM

SEQ ID NO: 1197715 - protein, 6 aa, Mycobacterium
DPAAHH

SEQ ID NO: 1197716 - protein, 14 aa, Mycobacterium
DPAALPNFQNAGDA

SEQ ID NO: 1197717 - protein, 8 aa, Mycobacterium
DPAANAKS

SEQ ID NO: 1197718 - protein, 11 aa, Mycobacterium
DPAAPGPSAAL

SEQ ID NO: 1197719 - protein, 7 aa, Mycobacterium
DPAAPLR

SEQ ID NO: 1197720 - protein, 5 aa, Mycobacterium
DPAAR

SEQ ID NO: 1197721 - protein, 8 aa, Mycobacterium
DPAARAAA

SEQ ID NO: 1197722 - protein, 9 aa, Mycobacterium
DPAATAEAI

SEQ ID NO: 1197723 - protein, 9 aa, Mycobacterium
DPAATPRHK

SEQ ID NO: 1197724 - protein, 8 aa, Mycobacterium
DPADADGF

SEQ ID NO: 1197725 - protein, 6 aa, Mycobacterium
DPADAM

SEQ ID NO: 1197726 - protein, 12 aa, Mycobacterium
DPADFDDSSTQH

SEQ ID NO: 1197727 - protein, 7 aa, Mycobacterium
DPADKRT

SEQ ID NO: 1197728 - protein, 6 aa, Mycobacterium
DPADLD

SEQ ID NO: 1197729 - protein, 11 aa, Mycobacterium
DPADLPAEPDR

SEQ ID NO: 1197730 - protein, 11 aa, Mycobacterium
DPADLPSEPER

SEQ ID NO: 1197731 - protein, 6 aa, Mycobacterium
DPADPL

SEQ ID NO: 1197732 - protein, 12 aa, Mycobacterium
DPADSGEGDETG

SEQ ID NO: 1197733 - protein, 6 aa, Mycobacterium
DPADVD

SEQ ID NO: 1197734 - protein, 7 aa, Mycobacterium
DPAEAEE

SEQ ID NO: 1197735 - protein, 8 aa, Mycobacterium
DPAEERKQ

SEQ ID NO: 1197736 - protein, 5 aa, Mycobacterium
DPAEL

SEQ ID NO: 1197737 - protein, 10 aa, Mycobacterium
DPAERAGVRR

SEQ ID NO: 1197738 - protein, 6 aa, Mycobacterium
DPAERR

SEQ ID NO: 1197739 - protein, 8 aa, Mycobacterium
DPAFGTEE

SEQ ID NO: 1197740 - protein, 5 aa, Mycobacterium
DPAFS

SEQ ID NO: 1197741 - protein, 7 aa, Mycobacterium
DPAGRTR

SEQ ID NO: 1197742 - protein, 13 aa, Mycobacterium
DPAGSPLLALAAG

SEQ ID NO: 1197743 - protein, 6 aa, Mycobacterium
DPAGTA

SEQ ID NO: 1197744 - protein, 13 aa, Mycobacterium
DPAGTGAGRAAAD

SEQ ID NO: 1197745 - protein, 9 aa, Mycobacterium
DPAGTHSSG

SEQ ID NO: 1197746 - protein, 6 aa, Mycobacterium
DPAGTS

SEQ ID NO: 1197747 - protein, 5 aa, Mycobacterium
DPAGV

SEQ ID NO: 1197748 - protein, 6 aa, Mycobacterium
DPAGVR

SEQ ID NO: 1197749 - protein, 4 aa, Mycobacterium
DPAH

SEQ ID NO: 1197750 - protein, 9 aa, Mycobacterium
DPAHGTGKQ

SEQ ID NO: 1197751 - protein, 14 aa, Mycobacterium
DPAITGGGARGPQV

SEQ ID NO: 1197752 - protein, 4 aa, Mycobacterium
DPAK

SEQ ID NO: 1197753 - protein, 11 aa, Mycobacterium
DPAKGASGPSV

SEQ ID NO: 1197754 - protein, 8 aa, Mycobacterium
DPAKRPPI

SEQ ID NO: 1197755 - protein, 19 aa, Mycobacterium
DPAKTAKKIRSAVTDSERE

SEQ ID NO: 1197756 - protein, 4 aa, Mycobacterium
DPAL

SEQ ID NO: 1197757 - protein, 6 aa, Mycobacterium
DPALGD

SEQ ID NO: 1197758 - protein, 6 aa, Mycobacterium
DPALRP

SEQ ID NO: 1197759 - protein, 6 aa, Mycobacterium
DPALRQ

SEQ ID NO: 1197760 - protein, 5 aa, Mycobacterium
DPAPA

SEQ ID NO: 1197761 - protein, 8 aa, Mycobacterium
DPAPAMRA

SEQ ID NO: 1197762 - protein, 11 aa, Mycobacterium
DPAPDDEQARA

SEQ ID NO: 1197763 - protein, 14 aa, Mycobacterium
DPAPEQGKGYQAGG

SEQ ID NO: 1197764 - protein, 7 aa, Mycobacterium
DPAPERP

SEQ ID NO: 1197765 - protein, 10 aa, Mycobacterium
DPAPGVPDGP

SEQ ID NO: 1197766 - protein, 7 aa, Mycobacterium
DPAPVRG

SEQ ID NO: 1197767 - protein, 9 aa, Mycobacterium
DPAQRQDDL

SEQ ID NO: 1197768 - protein, 14 aa, Mycobacterium
DPARAAAMGAAGRQ

SEQ ID NO: 1197769 - protein, 9 aa, Mycobacterium
DPARKGKVG

SEQ ID NO: 1197770 - protein, 6 aa, Mycobacterium
DPARLE

SEQ ID NO: 1197771 - protein, 15 aa, Mycobacterium
DPARPLTAADYGKAR

SEQ ID NO: 1197772 - protein, 8 aa, Mycobacterium
DPARRAEV

SEQ ID NO: 1197773 - protein, 7 aa, Mycobacterium
DPARRGA

SEQ ID NO: 1197774 - protein, 4 aa, Mycobacterium
DPAS

SEQ ID NO: 1197775 - protein, 17 aa, Mycobacterium
DPASGEEITAQNGRYGP

SEQ ID NO: 1197776 - protein, 10 aa, Mycobacterium
DPASPDIEGT

SEQ ID NO: 1197777 - protein, 11 aa, Mycobacterium
DPASRGPHASK

SEQ ID NO: 1197778 - protein, 7 aa, Mycobacterium
DPATGRR

SEQ ID NO: 1197779 - protein, 9 aa, Mycobacterium
DPATGRTTT

SEQ ID NO: 1197780 - protein, 5 aa, Mycobacterium
DPATP

SEQ ID NO: 1197781 - protein, 8 aa, Mycobacterium
DPATRGPV

SEQ ID NO: 1197782 - protein, 6 aa, Mycobacterium
DPATRR

SEQ ID NO: 1197783 - protein, 8 aa, Mycobacterium
DPATRSDG

SEQ ID NO: 1197784 - protein, 24 aa, Mycobacterium
DPATVTGDVRGNGALFTNSSSVRC

SEQ ID NO: 1197785 - protein, 5 aa, Mycobacterium
DPAWP

SEQ ID NO: 1197786 - protein, 6 aa, Mycobacterium
DPAYRG

SEQ ID NO: 1197787 - protein, 4 aa, Mycobacterium
DPCT

SEQ ID NO: 1197788 - protein, 16 aa, Mycobacterium
DPDAAARYAADPAQAL

SEQ ID NO: 1197789 - protein, 17 aa, Mycobacterium
DPDAALPDIDPDARRRR

SEQ ID NO: 1197790 - protein, 7 aa, Mycobacterium
DPDAAPL

SEQ ID NO: 1197791 - protein, 5 aa, Mycobacterium
DPDAE

SEQ ID NO: 1197792 - protein, 5 aa, Mycobacterium
DPDAG

SEQ ID NO: 1197793 - protein, 24 aa, Mycobacterium
DPDAGTAESPGIGGPTGRRIDTRP

SEQ ID NO: 1197794 - protein, 5 aa, Mycobacterium
DPDAL

SEQ ID NO: 1197795 - protein, 8 aa, Mycobacterium
DPDAPAAD

SEQ ID NO: 1197796 - protein, 11 aa, Mycobacterium
DPDAPAPARAQ

SEQ ID NO: 1197797 - protein, 9 aa, Mycobacterium
DPDAPKALH

SEQ ID NO: 1197798 - protein, 8 aa, Mycobacterium
DPDAPKHK

SEQ ID NO: 1197799 - protein, 10 aa, Mycobacterium
DPDAPKKQAG

SEQ ID NO: 1197800 - protein, 8 aa, Mycobacterium
DPDATAAE

SEQ ID NO: 1197801 - protein, 9 aa, Mycobacterium
DPDDTASFE

SEQ ID NO: 1197802 - protein, 5 aa, Mycobacterium
DPDED

SEQ ID NO: 1197803 - protein, 14 aa, Mycobacterium
DPDEPITADAPPGL

SEQ ID NO: 1197804 - protein, 6 aa, Mycobacterium
DPDETR

SEQ ID NO: 1197805 - protein, 6 aa, Mycobacterium
DPDGAD

SEQ ID NO: 1197806 - protein, 10 aa, Mycobacterium
DPDGGEPQRV

SEQ ID NO: 1197807 - protein, 10 aa, Mycobacterium
DPDGGYGHPD

SEQ ID NO: 1197808 - protein, 7 aa, Mycobacterium
DPDGHRS

SEQ ID NO: 1197809 - protein, 8 aa, Mycobacterium
DPDGKRYR

SEQ ID NO: 1197810 - protein, 5 aa, Mycobacterium
DPDGL

SEQ ID NO: 1197811 - protein, 13 aa, Mycobacterium
DPDGNNVEAVFHG

SEQ ID NO: 1197812 - protein, 6 aa, Mycobacterium
DPDGPV

SEQ ID NO: 1197813 - protein, 7 aa, Mycobacterium
DPDGQSG

SEQ ID NO: 1197814 - protein, 6 aa, Mycobacterium
DPDGRL

SEQ ID NO: 1197815 - protein, 7 aa, Mycobacterium
DPDGSAA

SEQ ID NO: 1197816 - protein, 8 aa, Mycobacterium
DPDKAVEE

SEQ ID NO: 1197817 - protein, 6 aa, Mycobacterium
DPDKKD

SEQ ID NO: 1197818 - protein, 17 aa, Mycobacterium
DPDKTAEAQDASGTMSK

SEQ ID NO: 1197819 - protein, 14 aa, Mycobacterium
DPDKTASSRHPQGW

SEQ ID NO: 1197820 - protein, 23 aa, Mycobacterium
DPDLGAIPPPESIPQPGRHSTSV

SEQ ID NO: 1197821 - protein, 7 aa, Mycobacterium
DPDLPAG

SEQ ID NO: 1197822 - protein, 6 aa, Mycobacterium
DPDMPG

SEQ ID NO: 1197823 - protein, 4 aa, Mycobacterium
DPDN

SEQ ID NO: 1197824 - protein, 15 aa, Mycobacterium
DPDNPGELKPQRANL

SEQ ID NO: 1197825 - protein, 7 aa, Mycobacterium
DPDNRRA

SEQ ID NO: 1197826 - protein, 9 aa, Mycobacterium
DPDPASAAE

SEQ ID NO: 1197827 - protein, 10 aa, Mycobacterium
DPDPATVGRQ

SEQ ID NO: 1197828 - protein, 10 aa, Mycobacterium
DPDPDSVARA

SEQ ID NO: 1197829 - protein, 9 aa, Mycobacterium
DPDPEAAGK

SEQ ID NO: 1197830 - protein, 5 aa, Mycobacterium
DPDPI

SEQ ID NO: 1197831 - protein, 11 aa, Mycobacterium
DPDPMAPGRMP

SEQ ID NO: 1197832 - protein, 8 aa, Mycobacterium
DPDPRRRF

SEQ ID NO: 1197833 - protein, 18 aa, Mycobacterium
DPDPVAAGGAARLAESGV

SEQ ID NO: 1197834 - protein, 23 aa, Mycobacterium
DPDQGWPPQAPGQAATAVTDTES

SEQ ID NO: 1197835 - protein, 6 aa, Mycobacterium
DPDQLT

SEQ ID NO: 1197836 - protein, 4 aa, Mycobacterium
DPDR

SEQ ID NO: 1197837 - protein, 5 aa, Mycobacterium
DPDRA

SEQ ID NO: 1197838 - protein, 6 aa, Mycobacterium
DPDREA

SEQ ID NO: 1197839 - protein, 9 aa, Mycobacterium
DPDRRNAVT

SEQ ID NO: 1197840 - protein, 9 aa, Mycobacterium
DPDRVPRSI

SEQ ID NO: 1197841 - protein, 14 aa, Mycobacterium
DPDRVTTPMRRTPD

SEQ ID NO: 1197842 - protein, 9 aa, Mycobacterium
DPDSDGLAR

SEQ ID NO: 1197843 - protein, 5 aa, Mycobacterium
DPDSV

SEQ ID NO: 1197844 - protein, 10 aa, Mycobacterium
DPDTADPSLP

SEQ ID NO: 1197845 - protein, 7 aa, Mycobacterium
DPDTARE

SEQ ID NO: 1197846 - protein, 9 aa, Mycobacterium
DPDTGADVP

SEQ ID NO: 1197847 - protein, 13 aa, Mycobacterium
DPDTGAIGTTYPY

SEQ ID NO: 1197848 - protein, 7 aa, Mycobacterium
DPDTGAV

SEQ ID NO: 1197849 - protein, 12 aa, Mycobacterium
DPDTGAVSYEPV

SEQ ID NO: 1197850 - protein, 7 aa, Mycobacterium
DPDTGEI

SEQ ID NO: 1197851 - protein, 14 aa, Mycobacterium
DPDTGELTGERNGV

SEQ ID NO: 1197852 - protein, 6 aa, Mycobacterium
DPDTVT

SEQ ID NO: 1197853 - protein, 6 aa, Mycobacterium
DPDTYG

SEQ ID NO: 1197854 - protein, 7 aa, Mycobacterium
DPDVPPA

SEQ ID NO: 1197855 - protein, 9 aa, Mycobacterium
DPDYQGRGI

SEQ ID NO: 1197856 - protein, 16 aa, Mycobacterium
DPEAADRSTSRDAYGN

SEQ ID NO: 1197857 - protein, 13 aa, Mycobacterium
DPEAATRTWGPGD

SEQ ID NO: 1197858 - protein, 7 aa, Mycobacterium
DPEADYQ

SEQ ID NO: 1197859 - protein, 7 aa, Mycobacterium
DPEAEPS

SEQ ID NO: 1197860 - protein, 9 aa, Mycobacterium
DPEATAAAI

SEQ ID NO: 1197861 - protein, 8 aa, Mycobacterium
DPEAVTAS

SEQ ID NO: 1197862 - protein, 7 aa, Mycobacterium
DPEDAEA

SEQ ID NO: 1197863 - protein, 8 aa, Mycobacterium
DPEDGEKR

SEQ ID NO: 1197864 - protein, 6 aa, Mycobacterium
DPEEGR

SEQ ID NO: 1197865 - protein, 9 aa, Mycobacterium
DPEENTPEA

SEQ ID NO: 1197866 - protein, 6 aa, Mycobacterium
DPEEYQ

SEQ ID NO: 1197867 - protein, 4 aa, Mycobacterium
DPEG

SEQ ID NO: 1197868 - protein, 8 aa, Mycobacterium
DPEGANVG

SEQ ID NO: 1197869 - protein, 13 aa, Mycobacterium
DPEGNEFCILAAD

SEQ ID NO: 1197870 - protein, 5 aa, Mycobacterium
DPEGQ

SEQ ID NO: 1197871 - protein, 5 aa, Mycobacterium
DPEGR

SEQ ID NO: 1197872 - protein, 6 aa, Mycobacterium
DPEGRQ

SEQ ID NO: 1197873 - protein, 5 aa, Mycobacterium
DPEGV

SEQ ID NO: 1197874 - protein, 29 aa, Mycobacterium
DPEHPEDPTPFDGELPPSSEEGESDTTTT

SEQ ID NO: 1197875 - protein, 10 aa, Mycobacterium
DPEHREYRSP

SEQ ID NO: 1197876 - protein, 6 aa, Mycobacterium
DPEKGR

SEQ ID NO: 1197877 - protein, 8 aa, Mycobacterium
DPEKKKAL

SEQ ID NO: 1197878 - protein, 8 aa, Mycobacterium
DPELHPPD

SEQ ID NO: 1197879 - protein, 8 aa, Mycobacterium
DPEPGGLA

SEQ ID NO: 1197880 - protein, 16 aa, Mycobacterium
DPEPPTPPSTGSPGYF

SEQ ID NO: 1197881 - protein, 4 aa, Mycobacterium
DPER

SEQ ID NO: 1197882 - protein, 5 aa, Mycobacterium
DPERA

SEQ ID NO: 1197883 - protein, 7 aa, Mycobacterium
DPERDGS

SEQ ID NO: 1197884 - protein, 5 aa, Mycobacterium
DPERF

SEQ ID NO: 1197885 - protein, 12 aa, Mycobacterium
DPERRGALGAAG

SEQ ID NO: 1197886 - protein, 11 aa, Mycobacterium
DPERVPGPRTI

SEQ ID NO: 1197887 - protein, 9 aa, Mycobacterium
DPESARSVE

SEQ ID NO: 1197888 - protein, 6 aa, Mycobacterium
DPESRK

SEQ ID NO: 1197889 - protein, 17 aa, Mycobacterium
DPESTRKNKVPDPQGTW

SEQ ID NO: 1197890 - protein, 8 aa, Mycobacterium
DPETAARG

SEQ ID NO: 1197891 - protein, 7 aa, Mycobacterium
DPETARI

SEQ ID NO: 1197892 - protein, 7 aa, Mycobacterium
DPETEKL

SEQ ID NO: 1197893 - protein, 11 aa, Mycobacterium
DPETGEPGERN

SEQ ID NO: 1197894 - protein, 13 aa, Mycobacterium
DPETGGERAVGEQ

SEQ ID NO: 1197895 - protein, 6 aa, Mycobacterium
DPETSA

SEQ ID NO: 1197896 - protein, 7 aa, Mycobacterium
DPEVRGD

SEQ ID NO: 1197897 - protein, 9 aa, Mycobacterium
DPEVRTKVE

SEQ ID NO: 1197898 - protein, 5 aa, Mycobacterium
DPEVS

SEQ ID NO: 1197899 - protein, 6 aa, Mycobacterium
DPEYDR

SEQ ID NO: 1197900 - protein, 4 aa, Mycobacterium
DPFA

SEQ ID NO: 1197901 - protein, 14 aa, Mycobacterium
DPFADDPSDPSAAL

SEQ ID NO: 1197902 - protein, 118 aa, Mycobacterium
DPFAGSSSGGAPATTASYSAAADPFAAAPSTGTGAVTAASTTTAADPFAASTDTGSGGDGSTDDSGGQDADAAEDNTDGGGEPAAATESSSSGVDTGAFSGADGAAVPADPAASTAGS

SEQ ID NO: 1197903 - protein, 7 aa, Mycobacterium
DPFDPKQ

SEQ ID NO: 1197904 - protein, 8 aa, Mycobacterium
DPFGRTAR

SEQ ID NO: 1197905 - protein, 8 aa, Mycobacterium
DPFPEPAS

SEQ ID NO: 1197906 - protein, 12 aa, Mycobacterium
DPFRPGTTVTSD

SEQ ID NO: 1197907 - protein, 19 aa, Mycobacterium
DPFSPGGEGLAKGSGISVN

SEQ ID NO: 1197908 - protein, 10 aa, Mycobacterium
DPGAAEALDP

SEQ ID NO: 1197909 - protein, 5 aa, Mycobacterium
DPGAR

SEQ ID NO: 1197910 - protein, 6 aa, Mycobacterium
DPGARA

SEQ ID NO: 1197911 - protein, 4 aa, Mycobacterium
DPGC

SEQ ID NO: 1197912 - protein, 39 aa, Mycobacterium
DPGDAPSVPPPLTDPADTTRPSAAEEARTIAASTNAGTL

SEQ ID NO: 1197913 - protein, 9 aa, Mycobacterium
DPGDPEESQ

SEQ ID NO: 1197914 - protein, 8 aa, Mycobacterium
DPGDPMTL

SEQ ID NO: 1197915 - protein, 8 aa, Mycobacterium
DPGDPTGI

SEQ ID NO: 1197916 - protein, 4 aa, Mycobacterium
DPGE

SEQ ID NO: 1197917 - protein, 5 aa, Mycobacterium
DPGEL

SEQ ID NO: 1197918 - protein, 4 aa, Mycobacterium
DPGF

SEQ ID NO: 1197919 - protein, 7 aa, Mycobacterium
DPGGSTF

SEQ ID NO: 1197920 - protein, 6 aa, Mycobacterium
DPGGVD

SEQ ID NO: 1197921 - protein, 6 aa, Mycobacterium
DPGMDG

SEQ ID NO: 1197922 - protein, 9 aa, Mycobacterium
DPGNEAVAR

SEQ ID NO: 1197923 - protein, 13 aa, Mycobacterium
DPGPAERYSPEGY

SEQ ID NO: 1197924 - protein, 13 aa, Mycobacterium
DPGPATAYSEAGH

SEQ ID NO: 1197925 - protein, 5 aa, Mycobacterium
DPGPD

SEQ ID NO: 1197926 - protein, 6 aa, Mycobacterium
DPGPGV

SEQ ID NO: 1197927 - protein, 7 aa, Mycobacterium
DPGPRDM

SEQ ID NO: 1197928 - protein, 6 aa, Mycobacterium
DPGPVQ

SEQ ID NO: 1197929 - protein, 6 aa, Mycobacterium
DPGQQL

SEQ ID NO: 1197930 - protein, 6 aa, Mycobacterium
DPGRNL

SEQ ID NO: 1197931 - protein, 16 aa, Mycobacterium
DPGRPATPRRVEPGAA

SEQ ID NO: 1197932 - protein, 8 aa, Mycobacterium
DPGRPATV

SEQ ID NO: 1197933 - protein, 11 aa, Mycobacterium
DPGSFRPASPS

SEQ ID NO: 1197934 - protein, 8 aa, Mycobacterium
DPGSGRVT

SEQ ID NO: 1197935 - protein, 5 aa, Mycobacterium
DPGSP

SEQ ID NO: 1197936 - protein, 10 aa, Mycobacterium
DPGSPHPALG

SEQ ID NO: 1197937 - protein, 33 aa, Mycobacterium
DPGTAPASAAAPAREPQRGPAEPPPPPDIDDEE

SEQ ID NO: 1197938 - protein, 12 aa, Mycobacterium
DPGVASRAASRS

SEQ ID NO: 1197939 - protein, 5 aa, Mycobacterium
DPGVD

SEQ ID NO: 1197940 - protein, 19 aa, Mycobacterium
DPGVGRDGSSGDGAGPAAD

SEQ ID NO: 1197941 - protein, 15 aa, Mycobacterium
DPGVVTDDDASSSFG

SEQ ID NO: 1197942 - protein, 5 aa, Mycobacterium
DPGWA

SEQ ID NO: 1197943 - protein, 6 aa, Mycobacterium
DPGYQS

SEQ ID NO: 1197944 - protein, 11 aa, Mycobacterium
DPGYSEETTQD

SEQ ID NO: 1197945 - protein, 9 aa, Mycobacterium
DPHASGAAR

SEQ ID NO: 1197946 - protein, 5 aa, Mycobacterium
DPHAT

SEQ ID NO: 1197947 - protein, 5 aa, Mycobacterium
DPHDS

SEQ ID NO: 1197948 - protein, 9 aa, Mycobacterium
DPHEPPLSA

SEQ ID NO: 1197949 - protein, 5 aa, Mycobacterium
DPHGL

SEQ ID NO: 1197950 - protein, 6 aa, Mycobacterium
DPHNTE

SEQ ID NO: 1197951 - protein, 5 aa, Mycobacterium
DPHPD

SEQ ID NO: 1197952 - protein, 25 aa, Mycobacterium
DPHPPIPEAEPESATEGSEAAAEVA

SEQ ID NO: 1197953 - protein, 8 aa, Mycobacterium
DPHPRNTY

SEQ ID NO: 1197954 - protein, 6 aa, Mycobacterium
DPHQTL

SEQ ID NO: 1197955 - protein, 7 aa, Mycobacterium
DPHSPPE

SEQ ID NO: 1197956 - protein, 13 aa, Mycobacterium
DPHSYDPKNQGVD

SEQ ID NO: 1197957 - protein, 10 aa, Mycobacterium
DPICGSQDGT

SEQ ID NO: 1197958 - protein, 5 aa, Mycobacterium
DPIDD

SEQ ID NO: 1197959 - protein, 27 aa, Mycobacterium
DPIERRPPLPRAGSVTAAASPDMATTV

SEQ ID NO: 1197960 - protein, 9 aa, Mycobacterium
DPIETPEEY

SEQ ID NO: 1197961 - protein, 11 aa, Mycobacterium
DPIETPEEYEQ

SEQ ID NO: 1197962 - protein, 4 aa, Mycobacterium
DPIG

SEQ ID NO: 1197963 - protein, 6 aa, Mycobacterium
DPIGAA

SEQ ID NO: 1197964 - protein, 18 aa, Mycobacterium
DPIPDRESHSDATGEGPC

SEQ ID NO: 1197965 - protein, 32 aa, Mycobacterium
DPIPERPDAASAPPEDRSGADFTADPVRSKSR

SEQ ID NO: 1197966 - protein, 7 aa, Mycobacterium
DPIPGND

SEQ ID NO: 1197967 - protein, 11 aa, Mycobacterium
DPIRGSSEPDR

SEQ ID NO: 1197968 - protein, 4 aa, Mycobacterium
DPKE

SEQ ID NO: 1197969 - protein, 4 aa, Mycobacterium
DPKI

SEQ ID NO: 1197970 - protein, 4 aa, Mycobacterium
DPKR

SEQ ID NO: 1197971 - protein, 11 aa, Mycobacterium
DPKRRSAVKQV

SEQ ID NO: 1197972 - protein, 8 aa, Mycobacterium
DPKSRESQ

SEQ ID NO: 1197973 - protein, 9 aa, Mycobacterium
DPKSRESQA

SEQ ID NO: 1197974 - protein, 8 aa, Mycobacterium
DPKVAEAK

SEQ ID NO: 1197975 - protein, 10 aa, Mycobacterium
DPKVQDSVKT

SEQ ID NO: 1197976 - protein, 7 aa, Mycobacterium
DPKYAPG

SEQ ID NO: 1197977 - protein, 13 aa, Mycobacterium
DPLAGRRAHTDHG

SEQ ID NO: 1197978 - protein, 8 aa, Mycobacterium
DPLDSSVT

SEQ ID NO: 1197979 - protein, 7 aa, Mycobacterium
DPLGGAS

SEQ ID NO: 1197980 - protein, 18 aa, Mycobacterium
DPLGHPNSEVGADPARPY

SEQ ID NO: 1197981 - protein, 11 aa, Mycobacterium
DPLGQDGDGND

SEQ ID NO: 1197982 - protein, 23 aa, Mycobacterium
DPLGTGSGGGSLPSTAGGGADSL

SEQ ID NO: 1197983 - protein, 4 aa, Mycobacterium
DPLP

SEQ ID NO: 1197984 - protein, 9 aa, Mycobacterium
DPLPGPDEA

SEQ ID NO: 1197985 - protein, 15 aa, Mycobacterium
DPLPQSGAARGRAAL

SEQ ID NO: 1197986 - protein, 7 aa, Mycobacterium
DPLSEDD

SEQ ID NO: 1197987 - protein, 5 aa, Mycobacterium
DPLSP

SEQ ID NO: 1197988 - protein, 11 aa, Mycobacterium
DPLSRADAEAL

SEQ ID NO: 1197989 - protein, 6 aa, Mycobacterium
DPLTDA

SEQ ID NO: 1197990 - protein, 8 aa, Mycobacterium
DPLVPNQV

SEQ ID NO: 1197991 - protein, 7 aa, Mycobacterium
DPNACRR

SEQ ID NO: 1197992 - protein, 11 aa, Mycobacterium
DPNAQFGQSAQ

SEQ ID NO: 1197993 - protein, 29 aa, Mycobacterium
DPNDVSPSVPADFTPDPALPADPLPEAVS

SEQ ID NO: 1197994 - protein, 9 aa, Mycobacterium
DPNGGYGHP

SEQ ID NO: 1197995 - protein, 6 aa, Mycobacterium
DPNGYA

SEQ ID NO: 1197996 - protein, 8 aa, Mycobacterium
DPNNEPGR

SEQ ID NO: 1197997 - protein, 8 aa, Mycobacterium
DPNSDTLS

SEQ ID NO: 1197998 - protein, 8 aa, Mycobacterium
DPNSRATQ

SEQ ID NO: 1197999 - protein, 7 aa, Mycobacterium
DPNTHVG

SEQ ID NO: 1198000 - protein, 6 aa, Mycobacterium
DPNTPL

SEQ ID NO: 1198001 - protein, 5 aa, Mycobacterium
DPNVP

SEQ ID NO: 1198002 - protein, 12 aa, Mycobacterium
DPPAAGSEDPHP

SEQ ID NO: 1198003 - protein, 7 aa, Mycobacterium
DPPADPF

SEQ ID NO: 1198004 - protein, 26 aa, Mycobacterium
DPPAGPAPLGTQSIPAGGGSSSLPDA

SEQ ID NO: 1198005 - protein, 15 aa, Mycobacterium
DPPAPPDSAPGGGRW

SEQ ID NO: 1198006 - protein, 12 aa, Mycobacterium
DPPAVPTSGASA

SEQ ID NO: 1198007 - protein, 6 aa, Mycobacterium
DPPDGQ

SEQ ID NO: 1198008 - protein, 9 aa, Mycobacterium
DPPDHTNAR

SEQ ID NO: 1198009 - protein, 12 aa, Mycobacterium
DPPDPESADLGR

SEQ ID NO: 1198010 - protein, 6 aa, Mycobacterium
DPPEHQ

SEQ ID NO: 1198011 - protein, 7 aa, Mycobacterium
DPPEHTR

SEQ ID NO: 1198012 - protein, 26 aa, Mycobacterium
DPPEPLELPGPTGSAVPTSWRSQRTT

SEQ ID NO: 1198013 - protein, 7 aa, Mycobacterium
DPPEQAR

SEQ ID NO: 1198014 - protein, 15 aa, Mycobacterium
DPPFGTAGSASAGVA

SEQ ID NO: 1198015 - protein, 12 aa, Mycobacterium
DPPFNSMPGRSG

SEQ ID NO: 1198016 - protein, 7 aa, Mycobacterium
DPPGGAD

SEQ ID NO: 1198017 - protein, 32 aa, Mycobacterium
DPPGGDLGRPGGPGARPDNSLPGGGRRGGGGR

SEQ ID NO: 1198018 - protein, 12 aa, Mycobacterium
DPPGLTASEAAG

SEQ ID NO: 1198019 - protein, 8 aa, Mycobacterium
DPPGNTDR

SEQ ID NO: 1198020 - protein, 13 aa, Mycobacterium
DPPGRWKQTQGEE

SEQ ID NO: 1198021 - protein, 6 aa, Mycobacterium
DPPHGP

SEQ ID NO: 1198022 - protein, 4 aa, Mycobacterium
DPPK

SEQ ID NO: 1198023 - protein, 4 aa, Mycobacterium
DPPL

SEQ ID NO: 1198024 - protein, 7 aa, Mycobacterium
DPPLGQA

SEQ ID NO: 1198025 - protein, 9 aa, Mycobacterium
DPPLRRPSG

SEQ ID NO: 1198026 - protein, 6 aa, Mycobacterium
DPPPGA

SEQ ID NO: 1198027 - protein, 7 aa, Mycobacterium
DPPPGDI

SEQ ID NO: 1198028 - protein, 12 aa, Mycobacterium
DPPPIKKPVPDA

SEQ ID NO: 1198029 - protein, 14 aa, Mycobacterium
DPPPSLTRTRREAA

SEQ ID NO: 1198030 - protein, 9 aa, Mycobacterium
DPPQHTDAR

SEQ ID NO: 1198031 - protein, 7 aa, Mycobacterium
DPPRQQK

SEQ ID NO: 1198032 - protein, 8 aa, Mycobacterium
DPPRRVGR

SEQ ID NO: 1198033 - protein, 9 aa, Mycobacterium
DPPRTGAGR

SEQ ID NO: 1198034 - protein, 5 aa, Mycobacterium
DPPSA

SEQ ID NO: 1198035 - protein, 11 aa, Mycobacterium
DPPSHDRARRQ

SEQ ID NO: 1198036 - protein, 17 aa, Mycobacterium
DPPSPAGLSDDPDRRAF

SEQ ID NO: 1198037 - protein, 6 aa, Mycobacterium
DPPSSV

SEQ ID NO: 1198038 - protein, 13 aa, Mycobacterium
DPPSTRGTIGNLN

SEQ ID NO: 1198039 - protein, 6 aa, Mycobacterium
DPPSTV

SEQ ID NO: 1198040 - protein, 5 aa, Mycobacterium
DPPVA

SEQ ID NO: 1198041 - protein, 12 aa, Mycobacterium
DPPVKGGGSGLE

SEQ ID NO: 1198042 - protein, 7 aa, Mycobacterium
DPPVPVP

SEQ ID NO: 1198043 - protein, 4 aa, Mycobacterium
DPPY

SEQ ID NO: 1198044 - protein, 9 aa, Mycobacterium
DPQAADTYY

SEQ ID NO: 1198045 - protein, 11 aa, Mycobacterium
DPQAALDPTGQ

SEQ ID NO: 1198046 - protein, 8 aa, Mycobacterium
DPQAQIDS

SEQ ID NO: 1198047 - protein, 4 aa, Mycobacterium
DPQG

SEQ ID NO: 1198048 - protein, 6 aa, Mycobacterium
DPQGFR

SEQ ID NO: 1198049 - protein, 5 aa, Mycobacterium
DPQGS

SEQ ID NO: 1198050 - protein, 5 aa, Mycobacterium
DPQGV

SEQ ID NO: 1198051 - protein, 15 aa, Mycobacterium
DPQHPYTQLLVSSRL

SEQ ID NO: 1198052 - protein, 6 aa, Mycobacterium
DPQLQA

SEQ ID NO: 1198053 - protein, 4 aa, Mycobacterium
DPQP

SEQ ID NO: 1198054 - protein, 7 aa, Mycobacterium
DPQPGTG

SEQ ID NO: 1198055 - protein, 10 aa, Mycobacterium
DPQPGTGFAE

SEQ ID NO: 1198056 - protein, 9 aa, Mycobacterium
DPQPPFDSG

SEQ ID NO: 1198057 - protein, 7 aa, Mycobacterium
DPQSGPV

SEQ ID NO: 1198058 - protein, 11 aa, Mycobacterium
DPQTAAQLGGS

SEQ ID NO: 1198059 - protein, 12 aa, Mycobacterium
DPQTCGEAAASV

SEQ ID NO: 1198060 - protein, 5 aa, Mycobacterium
DPQTR

SEQ ID NO: 1198061 - protein, 5 aa, Mycobacterium
DPQYP

SEQ ID NO: 1198062 - protein, 7 aa, Mycobacterium
DPQYRAS

SEQ ID NO: 1198063 - protein, 8 aa, Mycobacterium
DPRAPGLA

SEQ ID NO: 1198064 - protein, 5 aa, Mycobacterium
DPRAW

SEQ ID NO: 1198065 - protein, 9 aa, Mycobacterium
DPRDGTYDL

SEQ ID NO: 1198066 - protein, 14 aa, Mycobacterium
DPRDKGGVPAGFTG

SEQ ID NO: 1198067 - protein, 4 aa, Mycobacterium
DPRE

SEQ ID NO: 1198068 - protein, 6 aa, Mycobacterium
DPREFP

SEQ ID NO: 1198069 - protein, 13 aa, Mycobacterium
DPRETSKDDAERL

SEQ ID NO: 1198070 - protein, 5 aa, Mycobacterium
DPRFS

SEQ ID NO: 1198071 - protein, 4 aa, Mycobacterium
DPRG

SEQ ID NO: 1198072 - protein, 18 aa, Mycobacterium
DPRGAHPGEINHNDGGRG

SEQ ID NO: 1198073 - protein, 12 aa, Mycobacterium
DPRGGADPQGYG

SEQ ID NO: 1198074 - protein, 8 aa, Mycobacterium
DPRGPAHD

SEQ ID NO: 1198075 - protein, 6 aa, Mycobacterium
DPRHSR

SEQ ID NO: 1198076 - protein, 5 aa, Mycobacterium
DPRHT

SEQ ID NO: 1198077 - protein, 6 aa, Mycobacterium
DPRIGH

SEQ ID NO: 1198078 - protein, 16 aa, Mycobacterium
DPRIPQRDHEPSHDKT

SEQ ID NO: 1198079 - protein, 5 aa, Mycobacterium
DPRLP

SEQ ID NO: 1198080 - protein, 5 aa, Mycobacterium
DPRLR

SEQ ID NO: 1198081 - protein, 5 aa, Mycobacterium
DPRLT

SEQ ID NO: 1198082 - protein, 12 aa, Mycobacterium
DPRNGPDRARSG

SEQ ID NO: 1198083 - protein, 5 aa, Mycobacterium
DPRNM

SEQ ID NO: 1198084 - protein, 8 aa, Mycobacterium
DPRPEVSD

SEQ ID NO: 1198085 - protein, 8 aa, Mycobacterium
DPRPGESV

SEQ ID NO: 1198086 - protein, 5 aa, Mycobacterium
DPRPH

SEQ ID NO: 1198087 - protein, 6 aa, Mycobacterium
DPRPIS

SEQ ID NO: 1198088 - protein, 4 aa, Mycobacterium
DPRQ

SEQ ID NO: 1198089 - protein, 4 aa, Mycobacterium
DPRR

SEQ ID NO: 1198090 - protein, 9 aa, Mycobacterium
DPRRSTRRH

SEQ ID NO: 1198091 - protein, 8 aa, Mycobacterium
DPRSAPPE

SEQ ID NO: 1198092 - protein, 9 aa, Mycobacterium
DPRSAQTAR

SEQ ID NO: 1198093 - protein, 9 aa, Mycobacterium
DPRSFDTTS

SEQ ID NO: 1198094 - protein, 6 aa, Mycobacterium
DPRSGA

SEQ ID NO: 1198095 - protein, 11 aa, Mycobacterium
DPRSGEKTGLA

SEQ ID NO: 1198096 - protein, 15 aa, Mycobacterium
DPRSVTEDAGQIAQR

SEQ ID NO: 1198097 - protein, 10 aa, Mycobacterium
DPRTDADGLE

SEQ ID NO: 1198098 - protein, 5 aa, Mycobacterium
DPRTE

SEQ ID NO: 1198099 - protein, 11 aa, Mycobacterium
DPRTGAALGKE

SEQ ID NO: 1198100 - protein, 7 aa, Mycobacterium
DPRTGAG

SEQ ID NO: 1198101 - protein, 7 aa, Mycobacterium
DPRTVNS

SEQ ID NO: 1198102 - protein, 7 aa, Mycobacterium
DPRVDPD

SEQ ID NO: 1198103 - protein, 6 aa, Mycobacterium
DPRVGP

SEQ ID NO: 1198104 - protein, 6 aa, Mycobacterium
DPRVRT

SEQ ID NO: 1198105 - protein, 13 aa, Mycobacterium
DPRVSGVPSTKGT

SEQ ID NO: 1198106 - protein, 8 aa, Mycobacterium
DPRVSSDF

SEQ ID NO: 1198107 - protein, 6 aa, Mycobacterium
DPRWSQ

SEQ ID NO: 1198108 - protein, 5 aa, Mycobacterium
DPRYQ

SEQ ID NO: 1198109 - protein, 4 aa, Mycobacterium
DPSA

SEQ ID NO: 1198110 - protein, 8 aa, Mycobacterium
DPSAALPS

SEQ ID NO: 1198111 - protein, 10 aa, Mycobacterium
DPSAGGLPPW

SEQ ID NO: 1198112 - protein, 16 aa, Mycobacterium
DPSAPLPDIAPEARRR

SEQ ID NO: 1198113 - protein, 7 aa, Mycobacterium
DPSAPWQ

SEQ ID NO: 1198114 - protein, 4 aa, Mycobacterium
DPSD

SEQ ID NO: 1198115 - protein, 6 aa, Mycobacterium
DPSDDE

SEQ ID NO: 1198116 - protein, 8 aa, Mycobacterium
DPSDPEVI

SEQ ID NO: 1198117 - protein, 4 aa, Mycobacterium
DPSE

SEQ ID NO: 1198118 - protein, 7 aa, Mycobacterium
DPSFSEK

SEQ ID NO: 1198119 - protein, 4 aa, Mycobacterium
DPSG

SEQ ID NO: 1198120 - protein, 7 aa, Mycobacterium
DPSGAEA

SEQ ID NO: 1198121 - protein, 5 aa, Mycobacterium
DPSGG

SEQ ID NO: 1198122 - protein, 6 aa, Mycobacterium
DPSGNT

SEQ ID NO: 1198123 - protein, 6 aa, Mycobacterium
DPSGPC

SEQ ID NO: 1198124 - protein, 9 aa, Mycobacterium
DPSGQQPAR

SEQ ID NO: 1198125 - protein, 7 aa, Mycobacterium
DPSGRDL

SEQ ID NO: 1198126 - protein, 5 aa, Mycobacterium
DPSGS

SEQ ID NO: 1198127 - protein, 5 aa, Mycobacterium
DPSGT

SEQ ID NO: 1198128 - protein, 5 aa, Mycobacterium
DPSGV

SEQ ID NO: 1198129 - protein, 4 aa, Mycobacterium
DPSI

SEQ ID NO: 1198130 - protein, 22 aa, Mycobacterium
DPSIPTEESGTRHRSAERTAIQ

SEQ ID NO: 1198131 - protein, 18 aa, Mycobacterium
DPSLAATQPVASSSGGLL

SEQ ID NO: 1198132 - protein, 7 aa, Mycobacterium
DPSLDAT

SEQ ID NO: 1198133 - protein, 8 aa, Mycobacterium
DPSLDTTY

SEQ ID NO: 1198134 - protein, 7 aa, Mycobacterium
DPSLTGA

SEQ ID NO: 1198135 - protein, 7 aa, Mycobacterium
DPSNRRC

SEQ ID NO: 1198136 - protein, 8 aa, Mycobacterium
DPSPANVR

SEQ ID NO: 1198137 - protein, 6 aa, Mycobacterium
DPSQTY

SEQ ID NO: 1198138 - protein, 4 aa, Mycobacterium
DPSR

SEQ ID NO: 1198139 - protein, 8 aa, Mycobacterium
DPSRRPGW

SEQ ID NO: 1198140 - protein, 10 aa, Mycobacterium
DPSSGRASAC

SEQ ID NO: 1198141 - protein, 5 aa, Mycobacterium
DPSSI

SEQ ID NO: 1198142 - protein, 9 aa, Mycobacterium
DPSSPYNGG

SEQ ID NO: 1198143 - protein, 7 aa, Mycobacterium
DPSSRDF

SEQ ID NO: 1198144 - protein, 8 aa, Mycobacterium
DPSSVDPS

SEQ ID NO: 1198145 - protein, 4 aa, Mycobacterium
DPST

SEQ ID NO: 1198146 - protein, 7 aa, Mycobacterium
DPSTAHP

SEQ ID NO: 1198147 - protein, 6 aa, Mycobacterium
DPSTDR

SEQ ID NO: 1198148 - protein, 5 aa, Mycobacterium
DPSTG

SEQ ID NO: 1198149 - protein, 22 aa, Mycobacterium
DPSTGEQYGTAPVSNEQDIDNA

SEQ ID NO: 1198150 - protein, 8 aa, Mycobacterium
DPSTLDTA

SEQ ID NO: 1198151 - protein, 8 aa, Mycobacterium
DPSTPLDL

SEQ ID NO: 1198152 - protein, 5 aa, Mycobacterium
DPSVG

SEQ ID NO: 1198153 - protein, 6 aa, Mycobacterium
DPSVPD

SEQ ID NO: 1198154 - protein, 14 aa, Mycobacterium
DPTADDDDTDAGAK

SEQ ID NO: 1198155 - protein, 11 aa, Mycobacterium
DPTAGLADGTT

SEQ ID NO: 1198156 - protein, 6 aa, Mycobacterium
DPTAPY

SEQ ID NO: 1198157 - protein, 6 aa, Mycobacterium
DPTART

SEQ ID NO: 1198158 - protein, 9 aa, Mycobacterium
DPTEAPGQI

SEQ ID NO: 1198159 - protein, 12 aa, Mycobacterium
DPTEPFSVLDED

SEQ ID NO: 1198160 - protein, 7 aa, Mycobacterium
DPTEPVE

SEQ ID NO: 1198161 - protein, 5 aa, Mycobacterium
DPTGE

SEQ ID NO: 1198162 - protein, 5 aa, Mycobacterium
DPTGL

SEQ ID NO: 1198163 - protein, 8 aa, Mycobacterium
DPTHDRPA

SEQ ID NO: 1198164 - protein, 6 aa, Mycobacterium
DPTLEP

SEQ ID NO: 1198165 - protein, 6 aa, Mycobacterium
DPTLTA

SEQ ID NO: 1198166 - protein, 4 aa, Mycobacterium
DPTM

SEQ ID NO: 1198167 - protein, 13 aa, Mycobacterium
DPTPATIESGQTP

SEQ ID NO: 1198168 - protein, 7 aa, Mycobacterium
DPTPESG

SEQ ID NO: 1198169 - protein, 7 aa, Mycobacterium
DPTPGLA

SEQ ID NO: 1198170 - protein, 7 aa, Mycobacterium
DPTPHNL

SEQ ID NO: 1198171 - protein, 11 aa, Mycobacterium
DPTPPGPEADY

SEQ ID NO: 1198172 - protein, 7 aa, Mycobacterium
DPTPQQR

SEQ ID NO: 1198173 - protein, 8 aa, Mycobacterium
DPTRAGPQ

SEQ ID NO: 1198174 - protein, 12 aa, Mycobacterium
DPTRFDPQSCEQ

SEQ ID NO: 1198175 - protein, 9 aa, Mycobacterium
DPTWSPAGR

SEQ ID NO: 1198176 - protein, 8 aa, Mycobacterium
DPTWTPPG

SEQ ID NO: 1198177 - protein, 8 aa, Mycobacterium
DPVAEADP

SEQ ID NO: 1198178 - protein, 21 aa, Mycobacterium
DPVDPLSQTAALNSSYVAVTR

SEQ ID NO: 1198179 - protein, 8 aa, Mycobacterium
DPVEATRA

SEQ ID NO: 1198180 - protein, 5 aa, Mycobacterium
DPVFG

SEQ ID NO: 1198181 - protein, 7 aa, Mycobacterium
DPVGDTP

SEQ ID NO: 1198182 - protein, 5 aa, Mycobacterium
DPVGP

SEQ ID NO: 1198183 - protein, 5 aa, Mycobacterium
DPVKD

SEQ ID NO: 1198184 - protein, 6 aa, Mycobacterium
DPVPAG

SEQ ID NO: 1198185 - protein, 11 aa, Mycobacterium
DPVPAQEEAVA

SEQ ID NO: 1198186 - protein, 10 aa, Mycobacterium
DPVRTAQAEA

SEQ ID NO: 1198187 - protein, 4 aa, Mycobacterium
DPVS

SEQ ID NO: 1198188 - protein, 5 aa, Mycobacterium
DPVSG

SEQ ID NO: 1198189 - protein, 5 aa, Mycobacterium
DPVSR

SEQ ID NO: 1198190 - protein, 17 aa, Mycobacterium
DPVTAEREQWDDGNNTL

SEQ ID NO: 1198191 - protein, 6 aa, Mycobacterium
DPVTEQ

SEQ ID NO: 1198192 - protein, 8 aa, Mycobacterium
DPVTGAHG

SEQ ID NO: 1198193 - protein, 5 aa, Mycobacterium
DPWGG

SEQ ID NO: 1198194 - protein, 18 aa, Mycobacterium
DPWTPGNMQGPQISEAQR

SEQ ID NO: 1198195 - protein, 6 aa, Mycobacterium
DPYCSS

SEQ ID NO: 1198196 - protein, 9 aa, Mycobacterium
DPYGEPTPY

SEQ ID NO: 1198197 - protein, 4 aa, Mycobacterium
DPYP

SEQ ID NO: 1198198 - protein, 5 aa, Mycobacterium
DPYQE

SEQ ID NO: 1198199 - protein, 5 aa, Mycobacterium
DPYQV

SEQ ID NO: 1198200 - protein, 5 aa, Mycobacterium
DPYRY

SEQ ID NO: 1198201 - protein, 6 aa, Mycobacterium
DPYTGA

SEQ ID NO: 1198202 - protein, 4 aa, Mycobacterium
DPYY

SEQ ID NO: 1198203 - protein, 14 aa, Mycobacterium
DQAAQDDRSADQVR

SEQ ID NO: 1198204 - protein, 6 aa, Mycobacterium
DQADRD

SEQ ID NO: 1198205 - protein, 5 aa, Mycobacterium
DQAEH

SEQ ID NO: 1198206 - protein, 4 aa, Mycobacterium
DQAG

SEQ ID NO: 1198207 - protein, 6 aa, Mycobacterium
DQAGAY

SEQ ID NO: 1198208 - protein, 12 aa, Mycobacterium
DQAGGEVPQGTS

SEQ ID NO: 1198209 - protein, 7 aa, Mycobacterium
DQAGPAA

SEQ ID NO: 1198210 - protein, 9 aa, Mycobacterium
DQAGQTYAA

SEQ ID NO: 1198211 - protein, 7 aa, Mycobacterium
DQAGSGR

SEQ ID NO: 1198212 - protein, 9 aa, Mycobacterium
DQAHGDPAH

SEQ ID NO: 1198213 - protein, 6 aa, Mycobacterium
DQAHPG

SEQ ID NO: 1198214 - protein, 8 aa, Mycobacterium
DQAHSTGD

SEQ ID NO: 1198215 - protein, 7 aa, Mycobacterium
DQALTAS

SEQ ID NO: 1198216 - protein, 7 aa, Mycobacterium
DQAPITE

SEQ ID NO: 1198217 - protein, 5 aa, Mycobacterium
DQAPL

SEQ ID NO: 1198218 - protein, 6 aa, Mycobacterium
DQAQPA

SEQ ID NO: 1198219 - protein, 7 aa, Mycobacterium
DQARAAA

SEQ ID NO: 1198220 - protein, 11 aa, Mycobacterium
DQARTHNIGED

SEQ ID NO: 1198221 - protein, 7 aa, Mycobacterium
DQCPTPA

SEQ ID NO: 1198222 - protein, 6 aa, Mycobacterium
DQDHSA

SEQ ID NO: 1198223 - protein, 4 aa, Mycobacterium
DQDR

SEQ ID NO: 1198224 - protein, 98 aa, Mycobacterium
DQDRDQQDKLADKHAQAKGKAEPEPEAGASEVGEDEESETAEPVREDEELRPEPQTEPRASEVDEDEEPESESEPAAETTPATPAVEPVPSPSPVNRG

SEQ ID NO: 1198225 - protein, 94 aa, Mycobacterium
DQDRDQQDKLADKHAQAKGKAEPEPEPEPAVEAEPEAGASEVGEDEELRPEPQTEPRASEVDEDEEPESESEPAAETTPATPAVEPVPSPSPVN

SEQ ID NO: 1198226 - protein, 49 aa, Mycobacterium
DQDRDQQDKLADKQAKAKEQGKAESQPQTEPIPQPEAEAEAEPEPEAEV

SEQ ID NO: 1198227 - protein, 8 aa, Mycobacterium
DQDRSYGQ

SEQ ID NO: 1198228 - protein, 19 aa, Mycobacterium
DQDSLTVAQTGSRAFDANA

SEQ ID NO: 1198229 - protein, 9 aa, Mycobacterium
DQDSPLADA

SEQ ID NO: 1198230 - protein, 6 aa, Mycobacterium
DQDYDR

SEQ ID NO: 1198231 - protein, 6 aa, Mycobacterium
DQEEAM

SEQ ID NO: 1198232 - protein, 4 aa, Mycobacterium
DQEL

SEQ ID NO: 1198233 - protein, 7 aa, Mycobacterium
DQENAAT

SEQ ID NO: 1198234 - protein, 12 aa, Mycobacterium
DQENPDRVGAAT

SEQ ID NO: 1198235 - protein, 14 aa, Mycobacterium
DQERSLTDRTDLSE

SEQ ID NO: 1198236 - protein, 7 aa, Mycobacterium
DQETEPH

SEQ ID NO: 1198237 - protein, 13 aa, Mycobacterium
DQFRTDRRGPAPL

SEQ ID NO: 1198238 - protein, 21 aa, Mycobacterium
DQGASRIPDGEQCDAEAGGVG

SEQ ID NO: 1198239 - protein, 8 aa, Mycobacterium
DQGESARI

SEQ ID NO: 1198240 - protein, 6 aa, Mycobacterium
DQGGGY

SEQ ID NO: 1198241 - protein, 6 aa, Mycobacterium
DQGNRW

SEQ ID NO: 1198242 - protein, 11 aa, Mycobacterium
DQGPDGGEPAV

SEQ ID NO: 1198243 - protein, 5 aa, Mycobacterium
DQGRS

SEQ ID NO: 1198244 - protein, 5 aa, Mycobacterium
DQGRV

SEQ ID NO: 1198245 - protein, 7 aa, Mycobacterium
DQGTPTF

SEQ ID NO: 1198246 - protein, 14 aa, Mycobacterium
DQGTQKAKDHPGFD

SEQ ID NO: 1198247 - protein, 6 aa, Mycobacterium
DQHESE

SEQ ID NO: 1198248 - protein, 24 aa, Mycobacterium
DQHHAEPDPTPEPAGSEPVPCPQD

SEQ ID NO: 1198249 - protein, 15 aa, Mycobacterium
DQHHSSAHPGPDAYV

SEQ ID NO: 1198250 - protein, 13 aa, Mycobacterium
DQHPSPIDPNFTG

SEQ ID NO: 1198251 - protein, 15 aa, Mycobacterium
DQIAAEEPARPGDQD

SEQ ID NO: 1198252 - protein, 15 aa, Mycobacterium
DQIAASYTASQMQHG

SEQ ID NO: 1198253 - protein, 5 aa, Mycobacterium
DQIER

SEQ ID NO: 1198254 - protein, 7 aa, Mycobacterium
DQIQSAE

SEQ ID NO: 1198255 - protein, 21 aa, Mycobacterium
DQITDYSPDGVKERADAARAA

SEQ ID NO: 1198256 - protein, 7 aa, Mycobacterium
DQKKTGI

SEQ ID NO: 1198257 - protein, 6 aa, Mycobacterium
DQLAED

SEQ ID NO: 1198258 - protein, 8 aa, Mycobacterium
DQLAEQSG

SEQ ID NO: 1198259 - protein, 28 aa, Mycobacterium
DQLAPGERCASTSNRNFEGRQGKGGRTH

SEQ ID NO: 1198260 - protein, 8 aa, Mycobacterium
DQLEAETR

SEQ ID NO: 1198261 - protein, 13 aa, Mycobacterium
DQLPGVASSPSMS

SEQ ID NO: 1198262 - protein, 12 aa, Mycobacterium
DQNGTKAEIGDA

SEQ ID NO: 1198263 - protein, 8 aa, Mycobacterium
DQNNQPVT

SEQ ID NO: 1198264 - protein, 5 aa, Mycobacterium
DQPAR

SEQ ID NO: 1198265 - protein, 4 aa, Mycobacterium
DQPD

SEQ ID NO: 1198266 - protein, 14 aa, Mycobacterium
DQPEDVPPAPEGLD

SEQ ID NO: 1198267 - protein, 9 aa, Mycobacterium
DQPFLPSSE

SEQ ID NO: 1198268 - protein, 7 aa, Mycobacterium
DQPGALG

SEQ ID NO: 1198269 - protein, 7 aa, Mycobacterium
DQPGAQR

SEQ ID NO: 1198270 - protein, 20 aa, Mycobacterium
DQPGDDDTDDDRDDRPAGPD

SEQ ID NO: 1198271 - protein, 8 aa, Mycobacterium
DQPGKNAL

SEQ ID NO: 1198272 - protein, 5 aa, Mycobacterium
DQPGT

SEQ ID NO: 1198273 - protein, 7 aa, Mycobacterium
DQPNNGD

SEQ ID NO: 1198274 - protein, 13 aa, Mycobacterium
DQPPPLDHDGGTH

SEQ ID NO: 1198275 - protein, 7 aa, Mycobacterium
DQPRAEA

SEQ ID NO: 1198276 - protein, 21 aa, Mycobacterium
DQPRPAGRTRSPKQEPAGTRE

SEQ ID NO: 1198277 - protein, 4 aa, Mycobacterium
DQPS

SEQ ID NO: 1198278 - protein, 5 aa, Mycobacterium
DQPTE

SEQ ID NO: 1198279 - protein, 13 aa, Mycobacterium
DQPTPVNSTAPYG

SEQ ID NO: 1198280 - protein, 5 aa, Mycobacterium
DQPVP

SEQ ID NO: 1198281 - protein, 11 aa, Mycobacterium
DQQGNKSKDAQ

SEQ ID NO: 1198282 - protein, 10 aa, Mycobacterium
DQQIPEGGKI

SEQ ID NO: 1198283 - protein, 11 aa, Mycobacterium
DQQPPALPNQY

SEQ ID NO: 1198284 - protein, 6 aa, Mycobacterium
DQQRET

SEQ ID NO: 1198285 - protein, 7 aa, Mycobacterium
DQQRETA

SEQ ID NO: 1198286 - protein, 9 aa, Mycobacterium
DQQRPTAAD

SEQ ID NO: 1198287 - protein, 4 aa, Mycobacterium
DQQV

SEQ ID NO: 1198288 - protein, 8 aa, Mycobacterium
DQQWDART

SEQ ID NO: 1198289 - protein, 10 aa, Mycobacterium
DQRAAAEAQR

SEQ ID NO: 1198290 - protein, 7 aa, Mycobacterium
DQRDDDG

SEQ ID NO: 1198291 - protein, 6 aa, Mycobacterium
DQRDEP

SEQ ID NO: 1198292 - protein, 14 aa, Mycobacterium
DQRGRGIGTAGTAA

SEQ ID NO: 1198293 - protein, 15 aa, Mycobacterium
DQRGYGESSRPEAVT

SEQ ID NO: 1198294 - protein, 16 aa, Mycobacterium
DQRGYGGSDKPDAVDS

SEQ ID NO: 1198295 - protein, 5 aa, Mycobacterium
DQRNR

SEQ ID NO: 1198296 - protein, 8 aa, Mycobacterium
DQRPTDGT

SEQ ID NO: 1198297 - protein, 6 aa, Mycobacterium
DQRQRH

SEQ ID NO: 1198298 - protein, 15 aa, Mycobacterium
DQRRRRYGSEYDPDT

SEQ ID NO: 1198299 - protein, 6 aa, Mycobacterium
DQRSDI

SEQ ID NO: 1198300 - protein, 6 aa, Mycobacterium
DQRSPI

SEQ ID NO: 1198301 - protein, 5 aa, Mycobacterium
DQRTD

SEQ ID NO: 1198302 - protein, 7 aa, Mycobacterium
DQRYRDS

SEQ ID NO: 1198303 - protein, 6 aa, Mycobacterium
DQSAAR

SEQ ID NO: 1198304 - protein, 12 aa, Mycobacterium
DQSDDPDDPDHE

SEQ ID NO: 1198305 - protein, 5 aa, Mycobacterium
DQSGR

SEQ ID NO: 1198306 - protein, 6 aa, Mycobacterium
DQSSVD

SEQ ID NO: 1198307 - protein, 15 aa, Mycobacterium
DQTARRTAEINEAGG

SEQ ID NO: 1198308 - protein, 7 aa, Mycobacterium
DQTDSRV

SEQ ID NO: 1198309 - protein, 15 aa, Mycobacterium
DQTELSYPAPEPGNS

SEQ ID NO: 1198310 - protein, 14 aa, Mycobacterium
DQTGLSQKAGPVTS

SEQ ID NO: 1198311 - protein, 6 aa, Mycobacterium
DQTGRL

SEQ ID NO: 1198312 - protein, 6 aa, Mycobacterium
DQTHPE

SEQ ID NO: 1198313 - protein, 5 aa, Mycobacterium
DQTQV

SEQ ID NO: 1198314 - protein, 10 aa, Mycobacterium
DQTRSAGKRI

SEQ ID NO: 1198315 - protein, 6 aa, Mycobacterium
DQTSSY

SEQ ID NO: 1198316 - protein, 7 aa, Mycobacterium
DQTTARA

SEQ ID NO: 1198317 - protein, 18 aa, Mycobacterium
DQTTREPLAPYGSSSAAM

SEQ ID NO: 1198318 - protein, 11 aa, Mycobacterium
DQVADYAKRKG

SEQ ID NO: 1198319 - protein, 10 aa, Mycobacterium
DQVDAGPLSV

SEQ ID NO: 1198320 - protein, 4 aa, Mycobacterium
DQVE

SEQ ID NO: 1198321 - protein, 6 aa, Mycobacterium
DQVPGS

SEQ ID NO: 1198322 - protein, 11 aa, Mycobacterium
DQYYSSDYSVP

SEQ ID NO: 1198323 - protein, 4 aa, Mycobacterium
DRAA

SEQ ID NO: 1198324 - protein, 5 aa, Mycobacterium
DRAAA

SEQ ID NO: 1198325 - protein, 19 aa, Mycobacterium
DRAAAEEKLDAVGGGSVST

SEQ ID NO: 1198326 - protein, 8 aa, Mycobacterium
DRAADEDG

SEQ ID NO: 1198327 - protein, 8 aa, Mycobacterium
DRAAEDGD

SEQ ID NO: 1198328 - protein, 7 aa, Mycobacterium
DRAAGKD

SEQ ID NO: 1198329 - protein, 14 aa, Mycobacterium
DRAARTVKTADGTA

SEQ ID NO: 1198330 - protein, 4 aa, Mycobacterium
DRAD

SEQ ID NO: 1198331 - protein, 17 aa, Mycobacterium
DRADADPAARTTGTRFQ

SEQ ID NO: 1198332 - protein, 12 aa, Mycobacterium
DRADSEVDGDKG

SEQ ID NO: 1198333 - protein, 9 aa, Mycobacterium
DRAEEVARR

SEQ ID NO: 1198334 - protein, 15 aa, Mycobacterium
DRAEHRPSELSGGQM

SEQ ID NO: 1198335 - protein, 5 aa, Mycobacterium
DRAEL

SEQ ID NO: 1198336 - protein, 8 aa, Mycobacterium
DRAEQYRR

SEQ ID NO: 1198337 - protein, 6 aa, Mycobacterium
DRAGPR

SEQ ID NO: 1198338 - protein, 8 aa, Mycobacterium
DRAGSEAL

SEQ ID NO: 1198339 - protein, 6 aa, Mycobacterium
DRAGTG

SEQ ID NO: 1198340 - protein, 7 aa, Mycobacterium
DRAHGLP

SEQ ID NO: 1198341 - protein, 12 aa, Mycobacterium
DRAKDLKQPPVP

SEQ ID NO: 1198342 - protein, 8 aa, Mycobacterium
DRAKPGDR

SEQ ID NO: 1198343 - protein, 11 aa, Mycobacterium
DRANATASRLG

SEQ ID NO: 1198344 - protein, 20 aa, Mycobacterium
DRAPSPRHDPAPHHPDSGQA

SEQ ID NO: 1198345 - protein, 6 aa, Mycobacterium
DRAQAE

SEQ ID NO: 1198346 - protein, 22 aa, Mycobacterium
DRAQTENRDMTERERDLTAADR

SEQ ID NO: 1198347 - protein, 4 aa, Mycobacterium
DRAR

SEQ ID NO: 1198348 - protein, 8 aa, Mycobacterium
DRAREDPR

SEQ ID NO: 1198349 - protein, 8 aa, Mycobacterium
DRAREDSR

SEQ ID NO: 1198350 - protein, 5 aa, Mycobacterium
DRARP

SEQ ID NO: 1198351 - protein, 8 aa, Mycobacterium
DRARYDDT

SEQ ID NO: 1198352 - protein, 4 aa, Mycobacterium
DRAS

SEQ ID NO: 1198353 - protein, 13 aa, Mycobacterium
DRASEATGDGHDW

SEQ ID NO: 1198354 - protein, 10 aa, Mycobacterium
DRASLEPDGT

SEQ ID NO: 1198355 - protein, 9 aa, Mycobacterium
DRASTAKRE

SEQ ID NO: 1198356 - protein, 8 aa, Mycobacterium
DRASVDEA

SEQ ID NO: 1198357 - protein, 16 aa, Mycobacterium
DRATAEAIGDGAATQW

SEQ ID NO: 1198358 - protein, 13 aa, Mycobacterium
DRATPGPERDRQE

SEQ ID NO: 1198359 - protein, 5 aa, Mycobacterium
DRATY

SEQ ID NO: 1198360 - protein, 21 aa, Mycobacterium
DRAVSRPPIPRPLQAEGGVPD

SEQ ID NO: 1198361 - protein, 9 aa, Mycobacterium
DRDADETHT

SEQ ID NO: 1198362 - protein, 5 aa, Mycobacterium
DRDAF

SEQ ID NO: 1198363 - protein, 11 aa, Mycobacterium
DRDAGGRGAQT

SEQ ID NO: 1198364 - protein, 5 aa, Mycobacterium
DRDAM

SEQ ID NO: 1198365 - protein, 6 aa, Mycobacterium
DRDAMS

SEQ ID NO: 1198366 - protein, 11 aa, Mycobacterium
DRDATPPARYG

SEQ ID NO: 1198367 - protein, 11 aa, Mycobacterium
DRDDFQRRSAR

SEQ ID NO: 1198368 - protein, 20 aa, Mycobacterium
DRDDGVDRSGSAAADGDLSA

SEQ ID NO: 1198369 - protein, 7 aa, Mycobacterium
DRDDNGV

SEQ ID NO: 1198370 - protein, 8 aa, Mycobacterium
DRDDPNVR

SEQ ID NO: 1198371 - protein, 14 aa, Mycobacterium
DRDDQPYKESYGMA

SEQ ID NO: 1198372 - protein, 7 aa, Mycobacterium
DRDDTGY

SEQ ID NO: 1198373 - protein, 7 aa, Mycobacterium
DRDDVTD

SEQ ID NO: 1198374 - protein, 6 aa, Mycobacterium
DRDEAA

SEQ ID NO: 1198375 - protein, 6 aa, Mycobacterium
DRDEFG

SEQ ID NO: 1198376 - protein, 10 aa, Mycobacterium
DRDEHTAGIS

SEQ ID NO: 1198377 - protein, 12 aa, Mycobacterium
DRDELAKLIRKK

SEQ ID NO: 1198378 - protein, 6 aa, Mycobacterium
DRDENF

SEQ ID NO: 1198379 - protein, 8 aa, Mycobacterium
DRDERAPQ

SEQ ID NO: 1198380 - protein, 8 aa, Mycobacterium
DRDGDGGL

SEQ ID NO: 1198381 - protein, 8 aa, Mycobacterium
DRDGKGVA

SEQ ID NO: 1198382 - protein, 6 aa, Mycobacterium
DRDGLG

SEQ ID NO: 1198383 - protein, 15 aa, Mycobacterium
DRDGQDATGGPLPAE

SEQ ID NO: 1198384 - protein, 9 aa, Mycobacterium
DRDGRVPER

SEQ ID NO: 1198385 - protein, 9 aa, Mycobacterium
DRDGTSPAP

SEQ ID NO: 1198386 - protein, 6 aa, Mycobacterium
DRDGVE

SEQ ID NO: 1198387 - protein, 6 aa, Mycobacterium
DRDGYA

SEQ ID NO: 1198388 - protein, 4 aa, Mycobacterium
DRDP

SEQ ID NO: 1198389 - protein, 17 aa, Mycobacterium
DRDPERSFSAAMGLGDP

SEQ ID NO: 1198390 - protein, 7 aa, Mycobacterium
DRDPGAT

SEQ ID NO: 1198391 - protein, 5 aa, Mycobacterium
DRDPH

SEQ ID NO: 1198392 - protein, 13 aa, Mycobacterium
DRDPRTKDQLRSD

SEQ ID NO: 1198393 - protein, 5 aa, Mycobacterium
DRDPV

SEQ ID NO: 1198394 - protein, 6 aa, Mycobacterium
DRDQAI

SEQ ID NO: 1198395 - protein, 9 aa, Mycobacterium
DRDRDAPRT

SEQ ID NO: 1198396 - protein, 15 aa, Mycobacterium
DRDREWDGGAAEKRV

SEQ ID NO: 1198397 - protein, 31 aa, Mycobacterium
DRDRLSDPDLPDLDDQVGTGPHAVSLVEVLV

SEQ ID NO: 1198398 - protein, 8 aa, Mycobacterium
DRDRSVPT

SEQ ID NO: 1198399 - protein, 11 aa, Mycobacterium
DRDSAESTAKQ

SEQ ID NO: 1198400 - protein, 10 aa, Mycobacterium
DRDSGAASFE

SEQ ID NO: 1198401 - protein, 9 aa, Mycobacterium
DRDTTTGRW

SEQ ID NO: 1198402 - protein, 9 aa, Mycobacterium
DREAETPAS

SEQ ID NO: 1198403 - protein, 7 aa, Mycobacterium
DREAGRA

SEQ ID NO: 1198404 - protein, 7 aa, Mycobacterium
DREAHER

SEQ ID NO: 1198405 - protein, 4 aa, Mycobacterium
DRED

SEQ ID NO: 1198406 - protein, 5 aa, Mycobacterium
DREGR

SEQ ID NO: 1198407 - protein, 6 aa, Mycobacterium
DREGVR

SEQ ID NO: 1198408 - protein, 4 aa, Mycobacterium
DREH

SEQ ID NO: 1198409 - protein, 6 aa, Mycobacterium
DREHYN

SEQ ID NO: 1198410 - protein, 6 aa, Mycobacterium
DREKGA

SEQ ID NO: 1198411 - protein, 7 aa, Mycobacterium
DRELSSR

SEQ ID NO: 1198412 - protein, 13 aa, Mycobacterium
DRENDVDLTEGTF

SEQ ID NO: 1198413 - protein, 5 aa, Mycobacterium
DRENG

SEQ ID NO: 1198414 - protein, 5 aa, Mycobacterium
DREPD

SEQ ID NO: 1198415 - protein, 5 aa, Mycobacterium
DREPR

SEQ ID NO: 1198416 - protein, 14 aa, Mycobacterium
DREPSEGPLTADPT

SEQ ID NO: 1198417 - protein, 5 aa, Mycobacterium
DRERA

SEQ ID NO: 1198418 - protein, 5 aa, Mycobacterium
DRERK

SEQ ID NO: 1198419 - protein, 8 aa, Mycobacterium
DRESGEAL

SEQ ID NO: 1198420 - protein, 7 aa, Mycobacterium
DRETGDT

SEQ ID NO: 1198421 - protein, 12 aa, Mycobacterium
DRFGGSEPGRSE

SEQ ID NO: 1198422 - protein, 11 aa, Mycobacterium
DRFSPENVKAR

SEQ ID NO: 1198423 - protein, 22 aa, Mycobacterium
DRGAGRPTKRDRRMLDKWRARQ

SEQ ID NO: 1198424 - protein, 7 aa, Mycobacterium
DRGAPDL

SEQ ID NO: 1198425 - protein, 14 aa, Mycobacterium
DRGAPRIAGTATAF

SEQ ID NO: 1198426 - protein, 10 aa, Mycobacterium
DRGARNLTDA

SEQ ID NO: 1198427 - protein, 16 aa, Mycobacterium
DRGASPASLLCTYAAS

SEQ ID NO: 1198428 - protein, 10 aa, Mycobacterium
DRGDHAQHPQ

SEQ ID NO: 1198429 - protein, 7 aa, Mycobacterium
DRGEIEP

SEQ ID NO: 1198430 - protein, 8 aa, Mycobacterium
DRGELPGD

SEQ ID NO: 1198431 - protein, 7 aa, Mycobacterium
DRGETAL

SEQ ID NO: 1198432 - protein, 11 aa, Mycobacterium
DRGGATYTKDT

SEQ ID NO: 1198433 - protein, 5 aa, Mycobacterium
DRGGG

SEQ ID NO: 1198434 - protein, 6 aa, Mycobacterium
DRGGPE

SEQ ID NO: 1198435 - protein, 5 aa, Mycobacterium
DRGGT

SEQ ID NO: 1198436 - protein, 4 aa, Mycobacterium
DRGH

SEQ ID NO: 1198437 - protein, 6 aa, Mycobacterium
DRGIEN

SEQ ID NO: 1198438 - protein, 4 aa, Mycobacterium
DRGL

SEQ ID NO: 1198439 - protein, 4 aa, Mycobacterium
DRGQ

SEQ ID NO: 1198440 - protein, 5 aa, Mycobacterium
DRGRS

SEQ ID NO: 1198441 - protein, 11 aa, Mycobacterium
DRGSDPGSYSY

SEQ ID NO: 1198442 - protein, 21 aa, Mycobacterium
DRGSDSAGAAVYGDPTWTPPG

SEQ ID NO: 1198443 - protein, 6 aa, Mycobacterium
DRGSSV

SEQ ID NO: 1198444 - protein, 6 aa, Mycobacterium
DRGTGG

SEQ ID NO: 1198445 - protein, 8 aa, Mycobacterium
DRGVRPPT

SEQ ID NO: 1198446 - protein, 7 aa, Mycobacterium
DRGVRSG

SEQ ID NO: 1198447 - protein, 6 aa, Mycobacterium
DRGYDV

SEQ ID NO: 1198448 - protein, 15 aa, Mycobacterium
DRHAGRTELSGESSP

SEQ ID NO: 1198449 - protein, 17 aa, Mycobacterium
DRHDPNLPASQSPPDLR

SEQ ID NO: 1198450 - protein, 6 aa, Mycobacterium
DRHEAR

SEQ ID NO: 1198451 - protein, 5 aa, Mycobacterium
DRHEG

SEQ ID NO: 1198452 - protein, 4 aa, Mycobacterium
DRHG

SEQ ID NO: 1198453 - protein, 6 aa, Mycobacterium
DRHGLT

SEQ ID NO: 1198454 - protein, 12 aa, Mycobacterium
DRHGRTKPFPVG

SEQ ID NO: 1198455 - protein, 9 aa, Mycobacterium
DRHRAGSLA

SEQ ID NO: 1198456 - protein, 11 aa, Mycobacterium
DRHRAGSLAQS

SEQ ID NO: 1198457 - protein, 4 aa, Mycobacterium
DRHT

SEQ ID NO: 1198458 - protein, 15 aa, Mycobacterium
DRIEMRGGDGSANPY

SEQ ID NO: 1198459 - protein, 7 aa, Mycobacterium
DRIGRGR

SEQ ID NO: 1198460 - protein, 7 aa, Mycobacterium
DRIPDDK

SEQ ID NO: 1198461 - protein, 8 aa, Mycobacterium
DRKAFGQS

SEQ ID NO: 1198462 - protein, 7 aa, Mycobacterium
DRKDGAA

SEQ ID NO: 1198463 - protein, 7 aa, Mycobacterium
DRKPAEI

SEQ ID NO: 1198464 - protein, 26 aa, Mycobacterium
DRKYRGAYRRGEPQNTSLPQSVVPNT

SEQ ID NO: 1198465 - protein, 5 aa, Mycobacterium
DRLAR

SEQ ID NO: 1198466 - protein, 9 aa, Mycobacterium
DRLDGAAAA

SEQ ID NO: 1198467 - protein, 13 aa, Mycobacterium
DRLDGAPDAFASA

SEQ ID NO: 1198468 - protein, 4 aa, Mycobacterium
DRLE

SEQ ID NO: 1198469 - protein, 7 aa, Mycobacterium
DRLGETP

SEQ ID NO: 1198470 - protein, 22 aa, Mycobacterium
DRLGGAGTAGDLATAAGTPVDA

SEQ ID NO: 1198471 - protein, 7 aa, Mycobacterium
DRLGPGA

SEQ ID NO: 1198472 - protein, 6 aa, Mycobacterium
DRLGRA

SEQ ID NO: 1198473 - protein, 11 aa, Mycobacterium
DRLHPTNSGRL

SEQ ID NO: 1198474 - protein, 8 aa, Mycobacterium
DRLPDSVE

SEQ ID NO: 1198475 - protein, 6 aa, Mycobacterium
DRLPEL

SEQ ID NO: 1198476 - protein, 10 aa, Mycobacterium
DRLPESARPV

SEQ ID NO: 1198477 - protein, 9 aa, Mycobacterium
DRLPPDHPA

SEQ ID NO: 1198478 - protein, 7 aa, Mycobacterium
DRLPPGV

SEQ ID NO: 1198479 - protein, 9 aa, Mycobacterium
DRLPQDPTI

SEQ ID NO: 1198480 - protein, 9 aa, Mycobacterium
DRLQSEAQS

SEQ ID NO: 1198481 - protein, 11 aa, Mycobacterium
DRLRAANSPIE

SEQ ID NO: 1198482 - protein, 12 aa, Mycobacterium
DRLRAKAPEGIT

SEQ ID NO: 1198483 - protein, 4 aa, Mycobacterium
DRLS

SEQ ID NO: 1198484 - protein, 4 aa, Mycobacterium
DRLV

SEQ ID NO: 1198485 - protein, 5 aa, Mycobacterium
DRMGG

SEQ ID NO: 1198486 - protein, 10 aa, Mycobacterium
DRNAQQLTRQ

SEQ ID NO: 1198487 - protein, 9 aa, Mycobacterium
DRNGTEVTV

SEQ ID NO: 1198488 - protein, 6 aa, Mycobacterium
DRNLDT

SEQ ID NO: 1198489 - protein, 19 aa, Mycobacterium
DRNNDGGTENRQRPPSRSR

SEQ ID NO: 1198490 - protein, 6 aa, Mycobacterium
DRNPLH

SEQ ID NO: 1198491 - protein, 23 aa, Mycobacterium
DRNPSPESLDEAQARIKAALAEL

SEQ ID NO: 1198492 - protein, 10 aa, Mycobacterium
DRNPTGSIKD

SEQ ID NO: 1198493 - protein, 12 aa, Mycobacterium
DRNPTGSIKDRP

SEQ ID NO: 1198494 - protein, 7 aa, Mycobacterium
DRNRGTE

SEQ ID NO: 1198495 - protein, 9 aa, Mycobacterium
DRPAAQRFT

SEQ ID NO: 1198496 - protein, 7 aa, Mycobacterium
DRPDAGS

SEQ ID NO: 1198497 - protein, 15 aa, Mycobacterium
DRPDEKLSRAARQAA

SEQ ID NO: 1198498 - protein, 18 aa, Mycobacterium
DRPDGGTVTVSGRTPFGD

SEQ ID NO: 1198499 - protein, 9 aa, Mycobacterium
DRPDGTRRA

SEQ ID NO: 1198500 - protein, 8 aa, Mycobacterium
DRPDHEWA

SEQ ID NO: 1198501 - protein, 7 aa, Mycobacterium
DRPDIQE

SEQ ID NO: 1198502 - protein, 11 aa, Mycobacterium
DRPDPTSLPEA

SEQ ID NO: 1198503 - protein, 8 aa, Mycobacterium
DRPEARWP

SEQ ID NO: 1198504 - protein, 7 aa, Mycobacterium
DRPESPD

SEQ ID NO: 1198505 - protein, 5 aa, Mycobacterium
DRPEY

SEQ ID NO: 1198506 - protein, 14 aa, Mycobacterium
DRPGKAYSTDNRQK

SEQ ID NO: 1198507 - protein, 7 aa, Mycobacterium
DRPGSLG

SEQ ID NO: 1198508 - protein, 6 aa, Mycobacterium
DRPGTI

SEQ ID NO: 1198509 - protein, 5 aa, Mycobacterium
DRPHF

SEQ ID NO: 1198510 - protein, 12 aa, Mycobacterium
DRPIDKDDAVEG

SEQ ID NO: 1198511 - protein, 4 aa, Mycobacterium
DRPL

SEQ ID NO: 1198512 - protein, 5 aa, Mycobacterium
DRPLG

SEQ ID NO: 1198513 - protein, 6 aa, Mycobacterium
DRPPLS

SEQ ID NO: 1198514 - protein, 6 aa, Mycobacterium
DRPPTL

SEQ ID NO: 1198515 - protein, 8 aa, Mycobacterium
DRPPTTLP

SEQ ID NO: 1198516 - protein, 7 aa, Mycobacterium
DRPQLSR

SEQ ID NO: 1198517 - protein, 14 aa, Mycobacterium
DRPQSKGKEVADQI

SEQ ID NO: 1198518 - protein, 7 aa, Mycobacterium
DRPRPDR

SEQ ID NO: 1198519 - protein, 8 aa, Mycobacterium
DRPRTIPA

SEQ ID NO: 1198520 - protein, 10 aa, Mycobacterium
DRPSAEQTDA

SEQ ID NO: 1198521 - protein, 18 aa, Mycobacterium
DRPSPSKEEFTNTPGFDS

SEQ ID NO: 1198522 - protein, 8 aa, Mycobacterium
DRPTKGTV

SEQ ID NO: 1198523 - protein, 10 aa, Mycobacterium
DRPVDPATDY

SEQ ID NO: 1198524 - protein, 11 aa, Mycobacterium
DRPVGTYSGGM

SEQ ID NO: 1198525 - protein, 4 aa, Mycobacterium
DRQA

SEQ ID NO: 1198526 - protein, 6 aa, Mycobacterium
DRQDKA

SEQ ID NO: 1198527 - protein, 21 aa, Mycobacterium
DRQEYLDRDSAGDAGLEQTKR

SEQ ID NO: 1198528 - protein, 11 aa, Mycobacterium
DRQGESVTDGV

SEQ ID NO: 1198529 - protein, 5 aa, Mycobacterium
DRQGV

SEQ ID NO: 1198530 - protein, 8 aa, Mycobacterium
DRQHPDGT

SEQ ID NO: 1198531 - protein, 19 aa, Mycobacterium
DRQLPDDISDDTVEAVGSV

SEQ ID NO: 1198532 - protein, 5 aa, Mycobacterium
DRQPP

SEQ ID NO: 1198533 - protein, 6 aa, Mycobacterium
DRQPTG

SEQ ID NO: 1198534 - protein, 4 aa, Mycobacterium
DRQR

SEQ ID NO: 1198535 - protein, 5 aa, Mycobacterium
DRQRP

SEQ ID NO: 1198536 - protein, 11 aa, Mycobacterium
DRQTDPTAHPE

SEQ ID NO: 1198537 - protein, 13 aa, Mycobacterium
DRRADPDLDTRTD

SEQ ID NO: 1198538 - protein, 13 aa, Mycobacterium
DRRAEGASGPEVV

SEQ ID NO: 1198539 - protein, 7 aa, Mycobacterium
DRRAGAD

SEQ ID NO: 1198540 - protein, 8 aa, Mycobacterium
DRRDDGYH

SEQ ID NO: 1198541 - protein, 5 aa, Mycobacterium
DRRDY

SEQ ID NO: 1198542 - protein, 9 aa, Mycobacterium
DRRENPRDD

SEQ ID NO: 1198543 - protein, 6 aa, Mycobacterium
DRRERM

SEQ ID NO: 1198544 - protein, 4 aa, Mycobacterium
DRRF

SEQ ID NO: 1198545 - protein, 14 aa, Mycobacterium
DRRGLDAGASTGGF

SEQ ID NO: 1198546 - protein, 13 aa, Mycobacterium
DRRGNPKGEPVEA

SEQ ID NO: 1198547 - protein, 7 aa, Mycobacterium
DRRGPAL

SEQ ID NO: 1198548 - protein, 5 aa, Mycobacterium
DRRGR

SEQ ID NO: 1198549 - protein, 11 aa, Mycobacterium
DRRGSSSRTLD

SEQ ID NO: 1198550 - protein, 12 aa, Mycobacterium
DRRGTRRWTADT

SEQ ID NO: 1198551 - protein, 8 aa, Mycobacterium
DRRGWGEG

SEQ ID NO: 1198552 - protein, 5 aa, Mycobacterium
DRRHD

SEQ ID NO: 1198553 - protein, 7 aa, Mycobacterium
DRRIAPS

SEQ ID NO: 1198554 - protein, 9 aa, Mycobacterium
DRRKAPRDD

SEQ ID NO: 1198555 - protein, 8 aa, Mycobacterium
DRRKRTAI

SEQ ID NO: 1198556 - protein, 9 aa, Mycobacterium
DRRPRVPGV

SEQ ID NO: 1198557 - protein, 5 aa, Mycobacterium
DRRRA

SEQ ID NO: 1198558 - protein, 6 aa, Mycobacterium
DRRRAQ

SEQ ID NO: 1198559 - protein, 6 aa, Mycobacterium
DRRRFG

SEQ ID NO: 1198560 - protein, 23 aa, Mycobacterium
DRRRRERGGEGGGGGDRDTELRE

SEQ ID NO: 1198561 - protein, 17 aa, Mycobacterium
DRRSARKRNALAARTRK

SEQ ID NO: 1198562 - protein, 6 aa, Mycobacterium
DRRSRT

SEQ ID NO: 1198563 - protein, 14 aa, Mycobacterium
DRRSTEISRKVKAL

SEQ ID NO: 1198564 - protein, 11 aa, Mycobacterium
DRRTKGPDEDA

SEQ ID NO: 1198565 - protein, 6 aa, Mycobacterium
DRRVSD

SEQ ID NO: 1198566 - protein, 9 aa, Mycobacterium
DRRYPGSPI

SEQ ID NO: 1198567 - protein, 8 aa, Mycobacterium
DRSALSEA

SEQ ID NO: 1198568 - protein, 7 aa, Mycobacterium
DRSAYDR

SEQ ID NO: 1198569 - protein, 13 aa, Mycobacterium
DRSDAGRPGRFDN

SEQ ID NO: 1198570 - protein, 19 aa, Mycobacterium
DRSDASGTGYYSAETDGYQ

SEQ ID NO: 1198571 - protein, 10 aa, Mycobacterium
DRSDQTHPLR

SEQ ID NO: 1198572 - protein, 6 aa, Mycobacterium
DRSERI

SEQ ID NO: 1198573 - protein, 8 aa, Mycobacterium
DRSGAGPL

SEQ ID NO: 1198574 - protein, 11 aa, Mycobacterium
DRSGARLGRGA

SEQ ID NO: 1198575 - protein, 11 aa, Mycobacterium
DRSKAEAGDTD

SEQ ID NO: 1198576 - protein, 15 aa, Mycobacterium
DRSLRGKANVRGLQP

SEQ ID NO: 1198577 - protein, 12 aa, Mycobacterium
DRSRAEKLSQTR

SEQ ID NO: 1198578 - protein, 10 aa, Mycobacterium
DRSRKVADGR

SEQ ID NO: 1198579 - protein, 4 aa, Mycobacterium
DRST

SEQ ID NO: 1198580 - protein, 8 aa, Mycobacterium
DRSTSLQL

SEQ ID NO: 1198581 - protein, 5 aa, Mycobacterium
DRSVA

SEQ ID NO: 1198582 - protein, 6 aa, Mycobacterium
DRSVEQ

SEQ ID NO: 1198583 - protein, 4 aa, Mycobacterium
DRTA

SEQ ID NO: 1198584 - protein, 7 aa, Mycobacterium
DRTAFGQ

SEQ ID NO: 1198585 - protein, 8 aa, Mycobacterium
DRTAVPAH

SEQ ID NO: 1198586 - protein, 9 aa, Mycobacterium
DRTDGVADS

SEQ ID NO: 1198587 - protein, 14 aa, Mycobacterium
DRTFDEPHEATSAV

SEQ ID NO: 1198588 - protein, 6 aa, Mycobacterium
DRTGHR

SEQ ID NO: 1198589 - protein, 9 aa, Mycobacterium
DRTGQGQHV

SEQ ID NO: 1198590 - protein, 13 aa, Mycobacterium
DRTGQSEALRRNG

SEQ ID NO: 1198591 - protein, 12 aa, Mycobacterium
DRTLKDPHEATD

SEQ ID NO: 1198592 - protein, 5 aa, Mycobacterium
DRTPG

SEQ ID NO: 1198593 - protein, 7 aa, Mycobacterium
DRTPRAL

SEQ ID NO: 1198594 - protein, 8 aa, Mycobacterium
DRTPRDLQ

SEQ ID NO: 1198595 - protein, 19 aa, Mycobacterium
DRTPTAEPGATWPAHSRPP

SEQ ID NO: 1198596 - protein, 9 aa, Mycobacterium
DRTPTGDRL

SEQ ID NO: 1198597 - protein, 5 aa, Mycobacterium
DRTPV

SEQ ID NO: 1198598 - protein, 7 aa, Mycobacterium
DRTQTQE

SEQ ID NO: 1198599 - protein, 4 aa, Mycobacterium
DRTS

SEQ ID NO: 1198600 - protein, 11 aa, Mycobacterium
DRTSGRPDTYF

SEQ ID NO: 1198601 - protein, 5 aa, Mycobacterium
DRTSI

SEQ ID NO: 1198602 - protein, 11 aa, Mycobacterium
DRTVPGPDGPV

SEQ ID NO: 1198603 - protein, 8 aa, Mycobacterium
DRVDGDQL

SEQ ID NO: 1198604 - protein, 8 aa, Mycobacterium
DRVEAGAD

SEQ ID NO: 1198605 - protein, 5 aa, Mycobacterium
DRVED

SEQ ID NO: 1198606 - protein, 6 aa, Mycobacterium
DRVGAA

SEQ ID NO: 1198607 - protein, 15 aa, Mycobacterium
DRVGAGGVVSEPELR

SEQ ID NO: 1198608 - protein, 8 aa, Mycobacterium
DRVGPGGV

SEQ ID NO: 1198609 - protein, 8 aa, Mycobacterium
DRVRVSSP

SEQ ID NO: 1198610 - protein, 5 aa, Mycobacterium
DRVSA

SEQ ID NO: 1198611 - protein, 5 aa, Mycobacterium
DRVSD

SEQ ID NO: 1198612 - protein, 6 aa, Mycobacterium
DRVSRR

SEQ ID NO: 1198613 - protein, 4 aa, Mycobacterium
DRVT

SEQ ID NO: 1198614 - protein, 6 aa, Mycobacterium
DRVTHD

SEQ ID NO: 1198615 - protein, 11 aa, Mycobacterium
DRVTPPASTPV

SEQ ID NO: 1198616 - protein, 16 aa, Mycobacterium
DRYDPSRVLATGQVVR

SEQ ID NO: 1198617 - protein, 9 aa, Mycobacterium
DRYGGSRDK

SEQ ID NO: 1198618 - protein, 6 aa, Mycobacterium
DRYGNQ

SEQ ID NO: 1198619 - protein, 8 aa, Mycobacterium
DRYGPGGA

SEQ ID NO: 1198620 - protein, 11 aa, Mycobacterium
DRYLPGSSARW

SEQ ID NO: 1198621 - protein, 14 aa, Mycobacterium
DRYPNQLSGGQQQR

SEQ ID NO: 1198622 - protein, 5 aa, Mycobacterium
DRYQA

SEQ ID NO: 1198623 - protein, 12 aa, Mycobacterium
DRYRAAERTVAF

SEQ ID NO: 1198624 - protein, 14 aa, Mycobacterium
DRYRDADARAGERV

SEQ ID NO: 1198625 - protein, 6 aa, Mycobacterium
DRYRGT

SEQ ID NO: 1198626 - protein, 13 aa, Mycobacterium
DRYSQLSEAEGKL

SEQ ID NO: 1198627 - protein, 11 aa, Mycobacterium
DRYSRRNGDRN

SEQ ID NO: 1198628 - protein, 4 aa, Mycobacterium
DSAA

SEQ ID NO: 1198629 - protein, 20 aa, Mycobacterium
DSAAAPAEAAARWFGAPTGR

SEQ ID NO: 1198630 - protein, 7 aa, Mycobacterium
DSAAATT

SEQ ID NO: 1198631 - protein, 9 aa, Mycobacterium
DSAAPARRR

SEQ ID NO: 1198632 - protein, 8 aa, Mycobacterium
DSAAPDVA

SEQ ID NO: 1198633 - protein, 18 aa, Mycobacterium
DSAARNAPLTRPRPGHAD

SEQ ID NO: 1198634 - protein, 5 aa, Mycobacterium
DSAAS

SEQ ID NO: 1198635 - protein, 10 aa, Mycobacterium
DSAASVGAPP

SEQ ID NO: 1198636 - protein, 13 aa, Mycobacterium
DSADPASDGPPKL

SEQ ID NO: 1198637 - protein, 10 aa, Mycobacterium
DSADPKDVAG

SEQ ID NO: 1198638 - protein, 7 aa, Mycobacterium
DSADRSP

SEQ ID NO: 1198639 - protein, 6 aa, Mycobacterium
DSADTW

SEQ ID NO: 1198640 - protein, 4 aa, Mycobacterium
DSAE

SEQ ID NO: 1198641 - protein, 9 aa, Mycobacterium
DSAEGQGTA

SEQ ID NO: 1198642 - protein, 5 aa, Mycobacterium
DSAEP

SEQ ID NO: 1198643 - protein, 12 aa, Mycobacterium
DSAGARIQDTAT

SEQ ID NO: 1198644 - protein, 21 aa, Mycobacterium
DSAGGTTDRTTTSTESPGSSR

SEQ ID NO: 1198645 - protein, 5 aa, Mycobacterium
DSAGL

SEQ ID NO: 1198646 - protein, 10 aa, Mycobacterium
DSAGPDPRSL

SEQ ID NO: 1198647 - protein, 23 aa, Mycobacterium
DSAGPLLSGGDGPYGIRPEGGAA

SEQ ID NO: 1198648 - protein, 12 aa, Mycobacterium
DSAGREYSANTS

SEQ ID NO: 1198649 - protein, 6 aa, Mycobacterium
DSAIGD

SEQ ID NO: 1198650 - protein, 5 aa, Mycobacterium
DSALD

SEQ ID NO: 1198651 - protein, 7 aa, Mycobacterium
DSAPVDD

SEQ ID NO: 1198652 - protein, 24 aa, Mycobacterium
DSARADYEQSRRGRHADTTPKGST

SEQ ID NO: 1198653 - protein, 12 aa, Mycobacterium
DSARDRQHGGAG

SEQ ID NO: 1198654 - protein, 8 aa, Mycobacterium
DSARGGWT

SEQ ID NO: 1198655 - protein, 8 aa, Mycobacterium
DSARGTPK

SEQ ID NO: 1198656 - protein, 8 aa, Mycobacterium
DSARQTAA

SEQ ID NO: 1198657 - protein, 9 aa, Mycobacterium
DSASEAAAG

SEQ ID NO: 1198658 - protein, 8 aa, Mycobacterium
DSASRMNR

SEQ ID NO: 1198659 - protein, 7 aa, Mycobacterium
DSATDTL

SEQ ID NO: 1198660 - protein, 6 aa, Mycobacterium
DSATGR

SEQ ID NO: 1198661 - protein, 5 aa, Mycobacterium
DSAVT

SEQ ID NO: 1198662 - protein, 6 aa, Mycobacterium
DSAYGL

SEQ ID NO: 1198663 - protein, 12 aa, Mycobacterium
DSAYPHEVGTGH

SEQ ID NO: 1198664 - protein, 25 aa, Mycobacterium
DSCADAGAELSSRGVAGAHADPEPL

SEQ ID NO: 1198665 - protein, 6 aa, Mycobacterium
DSDAAA

SEQ ID NO: 1198666 - protein, 6 aa, Mycobacterium
DSDALR

SEQ ID NO: 1198667 - protein, 8 aa, Mycobacterium
DSDASTFG

SEQ ID NO: 1198668 - protein, 9 aa, Mycobacterium
DSDAVDDQA

SEQ ID NO: 1198669 - protein, 7 aa, Mycobacterium
DSDDPKF

SEQ ID NO: 1198670 - protein, 10 aa, Mycobacterium
DSDDTAESGV

SEQ ID NO: 1198671 - protein, 8 aa, Mycobacterium
DSDDVLED

SEQ ID NO: 1198672 - protein, 11 aa, Mycobacterium
DSDEADGGART

SEQ ID NO: 1198673 - protein, 9 aa, Mycobacterium
DSDEWTPQA

SEQ ID NO: 1198674 - protein, 13 aa, Mycobacterium
DSDFRSVSDGETL

SEQ ID NO: 1198675 - protein, 7 aa, Mycobacterium
DSDGGAV

SEQ ID NO: 1198676 - protein, 12 aa, Mycobacterium
DSDGHADKRTRG

SEQ ID NO: 1198677 - protein, 17 aa, Mycobacterium
DSDGKVSAARRPVAGAD

SEQ ID NO: 1198678 - protein, 8 aa, Mycobacterium
DSDGQVAQ

SEQ ID NO: 1198679 - protein, 13 aa, Mycobacterium
DSDHSINRLRLRK

SEQ ID NO: 1198680 - protein, 9 aa, Mycobacterium
DSDKASRGV

SEQ ID NO: 1198681 - protein, 7 aa, Mycobacterium
DSDLGRY

SEQ ID NO: 1198682 - protein, 6 aa, Mycobacterium
DSDLTA

SEQ ID NO: 1198683 - protein, 8 aa, Mycobacterium
DSDNGSEF

SEQ ID NO: 1198684 - protein, 8 aa, Mycobacterium
DSDNQARC

SEQ ID NO: 1198685 - protein, 15 aa, Mycobacterium
DSDPDESGKVPGTDL

SEQ ID NO: 1198686 - protein, 6 aa, Mycobacterium
DSDPLG

SEQ ID NO: 1198687 - protein, 7 aa, Mycobacterium
DSDQLAT

SEQ ID NO: 1198688 - protein, 4 aa, Mycobacterium
DSDR

SEQ ID NO: 1198689 - protein, 5 aa, Mycobacterium
DSDTF

SEQ ID NO: 1198690 - protein, 11 aa, Mycobacterium
DSDTLASTRDS

SEQ ID NO: 1198691 - protein, 16 aa, Mycobacterium
DSDYEAGRGDAVRGST

SEQ ID NO: 1198692 - protein, 7 aa, Mycobacterium
DSDYLTS

SEQ ID NO: 1198693 - protein, 50 aa, Mycobacterium
DSEADGSALVGGTDDSGGSGKPGKVGGTDKAGKADGGESAARPMSVRNAG

SEQ ID NO: 1198694 - protein, 6 aa, Mycobacterium
DSEEPL

SEQ ID NO: 1198695 - protein, 5 aa, Mycobacterium
DSEFG

SEQ ID NO: 1198696 - protein, 10 aa, Mycobacterium
DSEGFRSRRA

SEQ ID NO: 1198697 - protein, 18 aa, Mycobacterium
DSEGNTGVGEVPGGEPIR

SEQ ID NO: 1198698 - protein, 4 aa, Mycobacterium
DSEI

SEQ ID NO: 1198699 - protein, 13 aa, Mycobacterium
DSEIEREIGKTAA

SEQ ID NO: 1198700 - protein, 5 aa, Mycobacterium
DSEKG

SEQ ID NO: 1198701 - protein, 7 aa, Mycobacterium
DSELNQA

SEQ ID NO: 1198702 - protein, 25 aa, Mycobacterium
DSELPGPGGRAVDRRRRRRREPRRR

SEQ ID NO: 1198703 - protein, 6 aa, Mycobacterium
DSENLT

SEQ ID NO: 1198704 - protein, 4 aa, Mycobacterium
DSEP

SEQ ID NO: 1198705 - protein, 5 aa, Mycobacterium
DSEQP

SEQ ID NO: 1198706 - protein, 6 aa, Mycobacterium
DSERGR

SEQ ID NO: 1198707 - protein, 9 aa, Mycobacterium
DSESAQTGL

SEQ ID NO: 1198708 - protein, 20 aa, Mycobacterium
DSESPVSANGRGRDGGGPDV

SEQ ID NO: 1198709 - protein, 8 aa, Mycobacterium
DSESSARM

SEQ ID NO: 1198710 - protein, 8 aa, Mycobacterium
DSESSTID

SEQ ID NO: 1198711 - protein, 16 aa, Mycobacterium
DSETFGSNSPALAEDG

SEQ ID NO: 1198712 - protein, 9 aa, Mycobacterium
DSETPALKA

SEQ ID NO: 1198713 - protein, 26 aa, Mycobacterium
DSEVAPPLPDDRFSGPGIARQGYSEF

SEQ ID NO: 1198714 - protein, 16 aa, Mycobacterium
DSEVSPAWTLYAWEPV

SEQ ID NO: 1198715 - protein, 6 aa, Mycobacterium
DSEYNG

SEQ ID NO: 1198716 - protein, 4 aa, Mycobacterium
DSFD

SEQ ID NO: 1198717 - protein, 6 aa, Mycobacterium
DSFSDG

SEQ ID NO: 1198718 - protein, 9 aa, Mycobacterium
DSFTAEEAS

SEQ ID NO: 1198719 - protein, 6 aa, Mycobacterium
DSGADV

SEQ ID NO: 1198720 - protein, 5 aa, Mycobacterium
DSGAG

SEQ ID NO: 1198721 - protein, 9 aa, Mycobacterium
DSGAGESTA

SEQ ID NO: 1198722 - protein, 11 aa, Mycobacterium
DSGASSGGQAL

SEQ ID NO: 1198723 - protein, 7 aa, Mycobacterium
DSGATTP

SEQ ID NO: 1198724 - protein, 15 aa, Mycobacterium
DSGAVAGDTRGEPSA

SEQ ID NO: 1198725 - protein, 9 aa, Mycobacterium
DSGDLTSPA

SEQ ID NO: 1198726 - protein, 7 aa, Mycobacterium
DSGDPAA

SEQ ID NO: 1198727 - protein, 7 aa, Mycobacterium
DSGDRYA

SEQ ID NO: 1198728 - protein, 7 aa, Mycobacterium
DSGEEVG

SEQ ID NO: 1198729 - protein, 4 aa, Mycobacterium
DSGG

SEQ ID NO: 1198730 - protein, 6 aa, Mycobacterium
DSGGAI

SEQ ID NO: 1198731 - protein, 8 aa, Mycobacterium
DSGHPIPP

SEQ ID NO: 1198732 - protein, 12 aa, Mycobacterium
DSGIAGSIGSVG

SEQ ID NO: 1198733 - protein, 4 aa, Mycobacterium
DSGK

SEQ ID NO: 1198734 - protein, 15 aa, Mycobacterium
DSGLRGRGGAGFPTG

SEQ ID NO: 1198735 - protein, 4 aa, Mycobacterium
DSGN

SEQ ID NO: 1198736 - protein, 7 aa, Mycobacterium
DSGNEQL

SEQ ID NO: 1198737 - protein, 7 aa, Mycobacterium
DSGPAMR

SEQ ID NO: 1198738 - protein, 9 aa, Mycobacterium
DSGPGDAAA

SEQ ID NO: 1198739 - protein, 8 aa, Mycobacterium
DSGPGIEG

SEQ ID NO: 1198740 - protein, 7 aa, Mycobacterium
DSGPQQA

SEQ ID NO: 1198741 - protein, 9 aa, Mycobacterium
DSGPSAGYA

SEQ ID NO: 1198742 - protein, 4 aa, Mycobacterium
DSGR

SEQ ID NO: 1198743 - protein, 10 aa, Mycobacterium
DSGRGFGPEV

SEQ ID NO: 1198744 - protein, 10 aa, Mycobacterium
DSGRPQPTGR

SEQ ID NO: 1198745 - protein, 5 aa, Mycobacterium
DSGRT

SEQ ID NO: 1198746 - protein, 9 aa, Mycobacterium
DSGSGLNRP

SEQ ID NO: 1198747 - protein, 7 aa, Mycobacterium
DSGTGKS

SEQ ID NO: 1198748 - protein, 6 aa, Mycobacterium
DSGTHS

SEQ ID NO: 1198749 - protein, 7 aa, Mycobacterium
DSGTPVK

SEQ ID NO: 1198750 - protein, 10 aa, Mycobacterium
DSGTRLGPGG

SEQ ID NO: 1198751 - protein, 7 aa, Mycobacterium
DSGVDIP

SEQ ID NO: 1198752 - protein, 10 aa, Mycobacterium
DSGVESGSVI

SEQ ID NO: 1198753 - protein, 9 aa, Mycobacterium
DSGVGETCD

SEQ ID NO: 1198754 - protein, 15 aa, Mycobacterium
DSGVTDLSGYGGGDD

SEQ ID NO: 1198755 - protein, 5 aa, Mycobacterium
DSGWD

SEQ ID NO: 1198756 - protein, 7 aa, Mycobacterium
DSGYGPT

SEQ ID NO: 1198757 - protein, 11 aa, Mycobacterium
DSGYTKDELAD

SEQ ID NO: 1198758 - protein, 43 aa, Mycobacterium
DSHAGALTSPGGAPGAPPAPNVPAGFGGGAPGALGGATPTASL

SEQ ID NO: 1198759 - protein, 9 aa, Mycobacterium
DSHAPARMP

SEQ ID NO: 1198760 - protein, 19 aa, Mycobacterium
DSHGESVSLSPEEDADEAF

SEQ ID NO: 1198761 - protein, 16 aa, Mycobacterium
DSHITGPAGPDHPTPG

SEQ ID NO: 1198762 - protein, 10 aa, Mycobacterium
DSHPGSRPTL

SEQ ID NO: 1198763 - protein, 4 aa, Mycobacterium
DSHR

SEQ ID NO: 1198764 - protein, 4 aa, Mycobacterium
DSIE

SEQ ID NO: 1198765 - protein, 13 aa, Mycobacterium
DSIEETSELPEGK

SEQ ID NO: 1198766 - protein, 6 aa, Mycobacterium
DSINST

SEQ ID NO: 1198767 - protein, 8 aa, Mycobacterium
DSISPTAT

SEQ ID NO: 1198768 - protein, 18 aa, Mycobacterium
DSKAYYQRKRDEGKRPIP

SEQ ID NO: 1198769 - protein, 21 aa, Mycobacterium
DSKGDTEPDPALRDTENVPLT

SEQ ID NO: 1198770 - protein, 7 aa, Mycobacterium
DSKQLAR

SEQ ID NO: 1198771 - protein, 4 aa, Mycobacterium
DSKV

SEQ ID NO: 1198772 - protein, 9 aa, Mycobacterium
DSLAETQTG

SEQ ID NO: 1198773 - protein, 10 aa, Mycobacterium
DSLAGGSTPA

SEQ ID NO: 1198774 - protein, 6 aa, Mycobacterium
DSLDAE

SEQ ID NO: 1198775 - protein, 12 aa, Mycobacterium
DSLDDLRAGGAP

SEQ ID NO: 1198776 - protein, 4 aa, Mycobacterium
DSLG

SEQ ID NO: 1198777 - protein, 9 aa, Mycobacterium
DSLPGEPPF

SEQ ID NO: 1198778 - protein, 6 aa, Mycobacterium
DSLSGL

SEQ ID NO: 1198779 - protein, 62 aa, Mycobacterium
DSLTDDTPFAGHGERPPDAAVEPDVHPGEDPDEKAGQDAAEAHDLQPDGEPRQEPGSGRGKD

SEQ ID NO: 1198780 - protein, 9 aa, Mycobacterium
DSLTGGSSM

SEQ ID NO: 1198781 - protein, 8 aa, Mycobacterium
DSMAEPKA

SEQ ID NO: 1198782 - protein, 31 aa, Mycobacterium
DSMAPANGRKSEPGTGRRSKRGKRGARAEQE

SEQ ID NO: 1198783 - protein, 7 aa, Mycobacterium
DSMSEAS

SEQ ID NO: 1198784 - protein, 14 aa, Mycobacterium
DSNEPGRYRKPLAA

SEQ ID NO: 1198785 - protein, 13 aa, Mycobacterium
DSNGRVEDQSAAG

SEQ ID NO: 1198786 - protein, 5 aa, Mycobacterium
DSNLP

SEQ ID NO: 1198787 - protein, 10 aa, Mycobacterium
DSNPASAGHW

SEQ ID NO: 1198788 - protein, 5 aa, Mycobacterium
DSNTQ

SEQ ID NO: 1198789 - protein, 17 aa, Mycobacterium
DSPAAAQRRARAARERL

SEQ ID NO: 1198790 - protein, 6 aa, Mycobacterium
DSPAEE

SEQ ID NO: 1198791 - protein, 6 aa, Mycobacterium
DSPAEK

SEQ ID NO: 1198792 - protein, 9 aa, Mycobacterium
DSPAGTPGF

SEQ ID NO: 1198793 - protein, 14 aa, Mycobacterium
DSPARRRRAEQTRD

SEQ ID NO: 1198794 - protein, 5 aa, Mycobacterium
DSPAV

SEQ ID NO: 1198795 - protein, 8 aa, Mycobacterium
DSPDAVTA

SEQ ID NO: 1198796 - protein, 11 aa, Mycobacterium
DSPDEDLTTGK

SEQ ID NO: 1198797 - protein, 9 aa, Mycobacterium
DSPDGPRYR

SEQ ID NO: 1198798 - protein, 5 aa, Mycobacterium
DSPEC

SEQ ID NO: 1198799 - protein, 10 aa, Mycobacterium
DSPEGRASSL

SEQ ID NO: 1198800 - protein, 5 aa, Mycobacterium
DSPEL

SEQ ID NO: 1198801 - protein, 7 aa, Mycobacterium
DSPENAV

SEQ ID NO: 1198802 - protein, 12 aa, Mycobacterium
DSPGGSVTGSET

SEQ ID NO: 1198803 - protein, 5 aa, Mycobacterium
DSPGL

SEQ ID NO: 1198804 - protein, 6 aa, Mycobacterium
DSPGWP

SEQ ID NO: 1198805 - protein, 9 aa, Mycobacterium
DSPHNRNAL

SEQ ID NO: 1198806 - protein, 9 aa, Mycobacterium
DSPKPPPRR

SEQ ID NO: 1198807 - protein, 4 aa, Mycobacterium
DSPL

SEQ ID NO: 1198808 - protein, 6 aa, Mycobacterium
DSPLPD

SEQ ID NO: 1198809 - protein, 12 aa, Mycobacterium
DSPLPVDASTRA

SEQ ID NO: 1198810 - protein, 15 aa, Mycobacterium
DSPLSITEQANEKAK

SEQ ID NO: 1198811 - protein, 7 aa, Mycobacterium
DSPPTGR

SEQ ID NO: 1198812 - protein, 4 aa, Mycobacterium
DSPR

SEQ ID NO: 1198813 - protein, 7 aa, Mycobacterium
DSPRALD

SEQ ID NO: 1198814 - protein, 6 aa, Mycobacterium
DSPRIT

SEQ ID NO: 1198815 - protein, 6 aa, Mycobacterium
DSPRPP

SEQ ID NO: 1198816 - protein, 7 aa, Mycobacterium
DSPSADA

SEQ ID NO: 1198817 - protein, 8 aa, Mycobacterium
DSPSAYRG

SEQ ID NO: 1198818 - protein, 7 aa, Mycobacterium
DSPSYDG

SEQ ID NO: 1198819 - protein, 7 aa, Mycobacterium
DSPTDRE

SEQ ID NO: 1198820 - protein, 7 aa, Mycobacterium
DSPTGAV

SEQ ID NO: 1198821 - protein, 7 aa, Mycobacterium
DSPTRSV

SEQ ID NO: 1198822 - protein, 4 aa, Mycobacterium
DSPV

SEQ ID NO: 1198823 - protein, 14 aa, Mycobacterium
DSPVSGGVHGARAG

SEQ ID NO: 1198824 - protein, 12 aa, Mycobacterium
DSQAKTAVSSRS

SEQ ID NO: 1198825 - protein, 14 aa, Mycobacterium
DSQAVPVPDDDVDP

SEQ ID NO: 1198826 - protein, 5 aa, Mycobacterium
DSQLA

SEQ ID NO: 1198827 - protein, 13 aa, Mycobacterium
DSQRPIGDPLGDR

SEQ ID NO: 1198828 - protein, 6 aa, Mycobacterium
DSQSGR

SEQ ID NO: 1198829 - protein, 8 aa, Mycobacterium
DSQSRSVR

SEQ ID NO: 1198830 - protein, 15 aa, Mycobacterium
DSQTTGTTVHMNARI

SEQ ID NO: 1198831 - protein, 7 aa, Mycobacterium
DSRAAGS

SEQ ID NO: 1198832 - protein, 22 aa, Mycobacterium
DSRDAAGSGADRHANFGSGQID

SEQ ID NO: 1198833 - protein, 6 aa, Mycobacterium
DSRDAQ

SEQ ID NO: 1198834 - protein, 10 aa, Mycobacterium
DSRDPDPRAT

SEQ ID NO: 1198835 - protein, 11 aa, Mycobacterium
DSRDRRITRAG

SEQ ID NO: 1198836 - protein, 6 aa, Mycobacterium
DSRGLA

SEQ ID NO: 1198837 - protein, 6 aa, Mycobacterium
DSRGLL

SEQ ID NO: 1198838 - protein, 20 aa, Mycobacterium
DSRHGSLGSSRTDDAVTDDA

SEQ ID NO: 1198839 - protein, 6 aa, Mycobacterium
DSRIEP

SEQ ID NO: 1198840 - protein, 5 aa, Mycobacterium
DSRQR

SEQ ID NO: 1198841 - protein, 9 aa, Mycobacterium
DSRRSFSTT

SEQ ID NO: 1198842 - protein, 4 aa, Mycobacterium
DSRT

SEQ ID NO: 1198843 - protein, 10 aa, Mycobacterium
DSRTLDDRHR

SEQ ID NO: 1198844 - protein, 8 aa, Mycobacterium
DSRTRSNA

SEQ ID NO: 1198845 - protein, 6 aa, Mycobacterium
DSRYIT

SEQ ID NO: 1198846 - protein, 5 aa, Mycobacterium
DSRYV

SEQ ID NO: 1198847 - protein, 7 aa, Mycobacterium
DSSDTVH

SEQ ID NO: 1198848 - protein, 13 aa, Mycobacterium
DSSGAERDDDGSV

SEQ ID NO: 1198849 - protein, 8 aa, Mycobacterium
DSSGGIDD

SEQ ID NO: 1198850 - protein, 12 aa, Mycobacterium
DSSGRYAYGNQP

SEQ ID NO: 1198851 - protein, 8 aa, Mycobacterium
DSSHIQRR

SEQ ID NO: 1198852 - protein, 6 aa, Mycobacterium
DSSNAT

SEQ ID NO: 1198853 - protein, 17 aa, Mycobacterium
DSSNGKQYVGKADGAER

SEQ ID NO: 1198854 - protein, 8 aa, Mycobacterium
DSSPEKVA

SEQ ID NO: 1198855 - protein, 5 aa, Mycobacterium
DSSRA

SEQ ID NO: 1198856 - protein, 9 aa, Mycobacterium
DSSRERSSA

SEQ ID NO: 1198857 - protein, 5 aa, Mycobacterium
DSSSA

SEQ ID NO: 1198858 - protein, 7 aa, Mycobacterium
DSSSRAA

SEQ ID NO: 1198859 - protein, 9 aa, Mycobacterium
DSSSTFPLA

SEQ ID NO: 1198860 - protein, 6 aa, Mycobacterium
DSSTMQ

SEQ ID NO: 1198861 - protein, 9 aa, Mycobacterium
DSTAAERRA

SEQ ID NO: 1198862 - protein, 7 aa, Mycobacterium
DSTALTR

SEQ ID NO: 1198863 - protein, 7 aa, Mycobacterium
DSTAPTE

SEQ ID NO: 1198864 - protein, 14 aa, Mycobacterium
DSTARGRTLNPGQA

SEQ ID NO: 1198865 - protein, 5 aa, Mycobacterium
DSTAV

SEQ ID NO: 1198866 - protein, 4 aa, Mycobacterium
DSTD

SEQ ID NO: 1198867 - protein, 6 aa, Mycobacterium
DSTDEA

SEQ ID NO: 1198868 - protein, 5 aa, Mycobacterium
DSTDL

SEQ ID NO: 1198869 - protein, 10 aa, Mycobacterium
DSTDQAASGV

SEQ ID NO: 1198870 - protein, 11 aa, Mycobacterium
DSTGADYASAL

SEQ ID NO: 1198871 - protein, 22 aa, Mycobacterium
DSTGHATIDEPAPFASTGRVEP

SEQ ID NO: 1198872 - protein, 10 aa, Mycobacterium
DSTGIRATTD

SEQ ID NO: 1198873 - protein, 10 aa, Mycobacterium
DSTGKLPQYP

SEQ ID NO: 1198874 - protein, 8 aa, Mycobacterium
DSTGQDVA

SEQ ID NO: 1198875 - protein, 7 aa, Mycobacterium
DSTGSVV

SEQ ID NO: 1198876 - protein, 7 aa, Mycobacterium
DSTGVTV

SEQ ID NO: 1198877 - protein, 8 aa, Mycobacterium
DSTNDARV

SEQ ID NO: 1198878 - protein, 7 aa, Mycobacterium
DSTPAVV

SEQ ID NO: 1198879 - protein, 8 aa, Mycobacterium
DSTPDQLR

SEQ ID NO: 1198880 - protein, 6 aa, Mycobacterium
DSTPFD

SEQ ID NO: 1198881 - protein, 9 aa, Mycobacterium
DSTPGVPPE

SEQ ID NO: 1198882 - protein, 5 aa, Mycobacterium
DSTQA

SEQ ID NO: 1198883 - protein, 11 aa, Mycobacterium
DSTRQASRSDS

SEQ ID NO: 1198884 - protein, 23 aa, Mycobacterium
DSTRRARTPAYREGTAPVEDGTP

SEQ ID NO: 1198885 - protein, 23 aa, Mycobacterium
DSTRRGCAPAYREGTAPVEDGTP

SEQ ID NO: 1198886 - protein, 8 aa, Mycobacterium
DSTSGATM

SEQ ID NO: 1198887 - protein, 8 aa, Mycobacterium
DSTSGQAA

SEQ ID NO: 1198888 - protein, 6 aa, Mycobacterium
DSTVNT

SEQ ID NO: 1198889 - protein, 10 aa, Mycobacterium
DSTVPQPSTL

SEQ ID NO: 1198890 - protein, 5 aa, Mycobacterium
DSTYV

SEQ ID NO: 1198891 - protein, 6 aa, Mycobacterium
DSVADR

SEQ ID NO: 1198892 - protein, 11 aa, Mycobacterium
DSVAPDAATTS

SEQ ID NO: 1198893 - protein, 5 aa, Mycobacterium
DSVDA

SEQ ID NO: 1198894 - protein, 9 aa, Mycobacterium
DSVDGDPKV

SEQ ID NO: 1198895 - protein, 11 aa, Mycobacterium
DSVEQEPAPED

SEQ ID NO: 1198896 - protein, 15 aa, Mycobacterium
DSVERARDAAAGDWQ

SEQ ID NO: 1198897 - protein, 13 aa, Mycobacterium
DSVNPTGDPAVKS

SEQ ID NO: 1198898 - protein, 13 aa, Mycobacterium
DSVPDPKIEEPTD

SEQ ID NO: 1198899 - protein, 24 aa, Mycobacterium
DSVSGRLESAVEKRAASVSTLTPE

SEQ ID NO: 1198900 - protein, 12 aa, Mycobacterium
DSVTGTAAAEKA

SEQ ID NO: 1198901 - protein, 5 aa, Mycobacterium
DSWDR

SEQ ID NO: 1198902 - protein, 8 aa, Mycobacterium
DSYDDQGN

SEQ ID NO: 1198903 - protein, 7 aa, Mycobacterium
DSYDGTA

SEQ ID NO: 1198904 - protein, 12 aa, Mycobacterium
DSYDQVSRHPEV

SEQ ID NO: 1198905 - protein, 6 aa, Mycobacterium
DSYGPY

SEQ ID NO: 1198906 - protein, 4 aa, Mycobacterium
DSYR

SEQ ID NO: 1198907 - protein, 5 aa, Mycobacterium
DSYRI

SEQ ID NO: 1198908 - protein, 12 aa, Mycobacterium
DSYTDAHREADT

SEQ ID NO: 1198909 - protein, 17 aa, Mycobacterium
DSYTTGSDQGGNGPKGW

SEQ ID NO: 1198910 - protein, 6 aa, Mycobacterium
DTAAAA

SEQ ID NO: 1198911 - protein, 8 aa, Mycobacterium
DTAAATEN

SEQ ID NO: 1198912 - protein, 5 aa, Mycobacterium
DTAAL

SEQ ID NO: 1198913 - protein, 12 aa, Mycobacterium
DTAARAESNAAE

SEQ ID NO: 1198914 - protein, 6 aa, Mycobacterium
DTACSS

SEQ ID NO: 1198915 - protein, 4 aa, Mycobacterium
DTAD

SEQ ID NO: 1198916 - protein, 12 aa, Mycobacterium
DTADDAPETRSE

SEQ ID NO: 1198917 - protein, 8 aa, Mycobacterium
DTADSAGN

SEQ ID NO: 1198918 - protein, 8 aa, Mycobacterium
DTAERADP

SEQ ID NO: 1198919 - protein, 8 aa, Mycobacterium
DTAESGGG

SEQ ID NO: 1198920 - protein, 4 aa, Mycobacterium
DTAF

SEQ ID NO: 1198921 - protein, 9 aa, Mycobacterium
DTAGADDRQ

SEQ ID NO: 1198922 - protein, 6 aa, Mycobacterium
DTAGDG

SEQ ID NO: 1198923 - protein, 7 aa, Mycobacterium
DTAGNRV

SEQ ID NO: 1198924 - protein, 5 aa, Mycobacterium
DTAGT

SEQ ID NO: 1198925 - protein, 8 aa, Mycobacterium
DTAGTEGM

SEQ ID NO: 1198926 - protein, 14 aa, Mycobacterium
DTAGTEVKKQKRRL

SEQ ID NO: 1198927 - protein, 7 aa, Mycobacterium
DTAHETA

SEQ ID NO: 1198928 - protein, 23 aa, Mycobacterium
DTAHETRVEGAADPLDSQGAGDQ

SEQ ID NO: 1198929 - protein, 9 aa, Mycobacterium
DTAKAAAAL

SEQ ID NO: 1198930 - protein, 4 aa, Mycobacterium
DTAL

SEQ ID NO: 1198931 - protein, 17 aa, Mycobacterium
DTALGRAAAEAATRGLT

SEQ ID NO: 1198932 - protein, 7 aa, Mycobacterium
DTANGKA

SEQ ID NO: 1198933 - protein, 31 aa, Mycobacterium; identical to SEQ ID NO: 395578

SEQ ID NO: 1198934 - protein, 9 aa, Mycobacterium
DTAPVPGEH

SEQ ID NO: 1198935 - protein, 11 aa, Mycobacterium
DTAQDTRDEQF

SEQ ID NO: 1198936 - protein, 7 aa, Mycobacterium
DTAQYGA

SEQ ID NO: 1198937 - protein, 4 aa, Mycobacterium
DTAR

SEQ ID NO: 1198938 - protein, 9 aa, Mycobacterium
DTARHQGVP

SEQ ID NO: 1198939 - protein, 18 aa, Mycobacterium
DTARRNYADAVAKNGRMW

SEQ ID NO: 1198940 - protein, 4 aa, Mycobacterium
DTAT

SEQ ID NO: 1198941 - protein, 7 aa, Mycobacterium
DTATNRT

SEQ ID NO: 1198942 - protein, 7 aa, Mycobacterium
DTATRAE

SEQ ID NO: 1198943 - protein, 14 aa, Mycobacterium
DTATRAVRSAQRRQ

SEQ ID NO: 1198944 - protein, 7 aa, Mycobacterium
DTATSES

SEQ ID NO: 1198945 - protein, 10 aa, Mycobacterium
DTATVEQRAE

SEQ ID NO: 1198946 - protein, 5 aa, Mycobacterium
DTDAM

SEQ ID NO: 1198947 - protein, 5 aa, Mycobacterium
DTDAV

SEQ ID NO: 1198948 - protein, 7 aa, Mycobacterium
DTDDEPV

SEQ ID NO: 1198949 - protein, 8 aa, Mycobacterium
DTDDGPSV

SEQ ID NO: 1198950 - protein, 15 aa, Mycobacterium
DTDDNYEIRSPATEE

SEQ ID NO: 1198951 - protein, 9 aa, Mycobacterium
DTDDTAPGA

SEQ ID NO: 1198952 - protein, 6 aa, Mycobacterium
DTDDVT

SEQ ID NO: 1198953 - protein, 9 aa, Mycobacterium
DTDEERHRE

SEQ ID NO: 1198954 - protein, 51 aa, Mycobacterium
DTDETEATDTANTDPATEDADVAGGEVSEEAATEAPAEAAPVEVEDEDPAV

SEQ ID NO: 1198955 - protein, 8 aa, Mycobacterium
DTDGDGRW

SEQ ID NO: 1198956 - protein, 7 aa, Mycobacterium
DTDGEGV

SEQ ID NO: 1198957 - protein, 9 aa, Mycobacterium
DTDGEPVSQ

SEQ ID NO: 1198958 - protein, 13 aa, Mycobacterium
DTDGLSFGKPEEK

SEQ ID NO: 1198959 - protein, 8 aa, Mycobacterium
DTDGPEGR

SEQ ID NO: 1198960 - protein, 7 aa, Mycobacterium
DTDGTVS

SEQ ID NO: 1198961 - protein, 4 aa, Mycobacterium
DTDI

SEQ ID NO: 1198962 - protein, 7 aa, Mycobacterium
DTDIAAT

SEQ ID NO: 1198963 - protein, 9 aa, Mycobacterium
DTDKDARNL

SEQ ID NO: 1198964 - protein, 10 aa, Mycobacterium
DTDKPTRTKA

SEQ ID NO: 1198965 - protein, 7 aa, Mycobacterium
DTDNHPK

SEQ ID NO: 1198966 - protein, 10 aa, Mycobacterium
DTDPDWAGGD

SEQ ID NO: 1198967 - protein, 51 aa, Mycobacterium
DTDPEPDPEDDVADATPAAETAPAEAVPAEAAPAAPAPAAAPSGGPRPDDL

SEQ ID NO: 1198968 - protein, 7 aa, Mycobacterium
DTDPRVE

SEQ ID NO: 1198969 - protein, 12 aa, Mycobacterium
DTDPSSSSPRRA

SEQ ID NO: 1198970 - protein, 5 aa, Mycobacterium
DTDRA

SEQ ID NO: 1198971 - protein, 13 aa, Mycobacterium
DTDRPRPKSPTFR

SEQ ID NO: 1198972 - protein, 11 aa, Mycobacterium
DTDSARDSEDS

SEQ ID NO: 1198973 - protein, 9 aa, Mycobacterium
DTDSKNSSR

SEQ ID NO: 1198974 - protein, 8 aa, Mycobacterium
DTDSRNTQ

SEQ ID NO: 1198975 - protein, 9 aa, Mycobacterium
DTDSYPRKS

SEQ ID NO: 1198976 - protein, 6 aa, Mycobacterium
DTDTEA

SEQ ID NO: 1198977 - protein, 10 aa, Mycobacterium
DTDTGSPEAQ

SEQ ID NO: 1198978 - protein, 4 aa, Mycobacterium
DTDV

SEQ ID NO: 1198979 - protein, 10 aa, Mycobacterium
DTDYTARPFA

SEQ ID NO: 1198980 - protein, 5 aa, Mycobacterium
DTEAA

SEQ ID NO: 1198981 - protein, 12 aa, Mycobacterium
DTEAARRPHADR

SEQ ID NO: 1198982 - protein, 19 aa, Mycobacterium
DTEADDESAHAPTGSVTAA

SEQ ID NO: 1198983 - protein, 16 aa, Mycobacterium
DTEADGIAAANNTPYG

SEQ ID NO: 1198984 - protein, 8 aa, Mycobacterium
DTEAEQQL

SEQ ID NO: 1198985 - protein, 6 aa, Mycobacterium
DTEAPA

SEQ ID NO: 1198986 - protein, 7 aa, Mycobacterium
DTEATRP

SEQ ID NO: 1198987 - protein, 10 aa, Mycobacterium
DTEDLPPVGG

SEQ ID NO: 1198988 - protein, 8 aa, Mycobacterium
DTEDVDTA

SEQ ID NO: 1198989 - protein, 8 aa, Mycobacterium
DTEEEADE

SEQ ID NO: 1198990 - protein, 15 aa, Mycobacterium
DTEEEGIAAANDTEY

SEQ ID NO: 1198991 - protein, 8 aa, Mycobacterium
DTEEPSLR

SEQ ID NO: 1198992 - protein, 13 aa, Mycobacterium
DTEGLTFGKPEEK

SEQ ID NO: 1198993 - protein, 16 aa, Mycobacterium
DTEGRLTTTRSDLGDA

SEQ ID NO: 1198994 - protein, 4 aa, Mycobacterium
DTEI

SEQ ID NO: 1198995 - protein, 8 aa, Mycobacterium
DTEKEAKE

SEQ ID NO: 1198996 - protein, 13 aa, Mycobacterium
DTEKGAQAAAKMA

SEQ ID NO: 1198997 - protein, 12 aa, Mycobacterium
DTEKGKRAADEI

SEQ ID NO: 1198998 - protein, 4 aa, Mycobacterium
DTEL

SEQ ID NO: 1198999 - protein, 9 aa, Mycobacterium
DTEPAVDEQ

SEQ ID NO: 1199000 - protein, 18 aa, Mycobacterium
DTEPEPSTGRDPDELEAE

SEQ ID NO: 1199001 - protein, 6 aa, Mycobacterium
DTEPLT

SEQ ID NO: 1199002 - protein, 6 aa, Mycobacterium
DTEPPH

SEQ ID NO: 1199003 - protein, 6 aa, Mycobacterium
DTEQEA

SEQ ID NO: 1199004 - protein, 7 aa, Mycobacterium
DTERKAE

SEQ ID NO: 1199005 - protein, 5 aa, Mycobacterium
DTERS

SEQ ID NO: 1199006 - protein, 5 aa, Mycobacterium
DTERT

SEQ ID NO: 1199007 - protein, 5 aa, Mycobacterium
DTESY

SEQ ID NO: 1199008 - protein, 12 aa, Mycobacterium
DTETADGHADRL

SEQ ID NO: 1199009 - protein, 6 aa, Mycobacterium
DTETGE

SEQ ID NO: 1199010 - protein, 9 aa, Mycobacterium
DTETGRTRE

SEQ ID NO: 1199011 - protein, 15 aa, Mycobacterium
DTETGSRNGNGAEGI

SEQ ID NO: 1199012 - protein, 12 aa, Mycobacterium
DTETRRQGDGDE

SEQ ID NO: 1199013 - protein, 4 aa, Mycobacterium
DTEV

SEQ ID NO: 1199014 - protein, 5 aa, Mycobacterium
DTEVK

SEQ ID NO: 1199015 - protein, 11 aa, Mycobacterium
DTFEGFGKRDP

SEQ ID NO: 1199016 - protein, 11 aa, Mycobacterium
DTFEGQPRSRS

SEQ ID NO: 1199017 - protein, 6 aa, Mycobacterium
DTFQGP

SEQ ID NO: 1199018 - protein, 6 aa, Mycobacterium
DTGADA

SEQ ID NO: 1199019 - protein, 13 aa, Mycobacterium
DTGADAAKLNPLG

SEQ ID NO: 1199020 - protein, 9 aa, Mycobacterium
DTGADAKSV

SEQ ID NO: 1199021 - protein, 11 aa, Mycobacterium
DTGADLARTNV

SEQ ID NO: 1199022 - protein, 8 aa, Mycobacterium
DTGAHSEA

SEQ ID NO: 1199023 - protein, 15 aa, Mycobacterium
DTGAPDRPVDSPHPY

SEQ ID NO: 1199024 - protein, 7 aa, Mycobacterium
DTGAPGV

SEQ ID NO: 1199025 - protein, 23 aa, Mycobacterium
DTGAPLTGEGEFDEPDLAATENG

SEQ ID NO: 1199026 - protein, 9 aa, Mycobacterium
DTGAPSNSL

SEQ ID NO: 1199027 - protein, 11 aa, Mycobacterium
DTGASGSGDIT

SEQ ID NO: 1199028 - protein, 11 aa, Mycobacterium
DTGASVSHNPI

SEQ ID NO: 1199029 - protein, 6 aa, Mycobacterium
DTGDEQ

SEQ ID NO: 1199030 - protein, 8 aa, Mycobacterium
DTGEATHT

SEQ ID NO: 1199031 - protein, 14 aa, Mycobacterium
DTGEEFDSSWNRGE

SEQ ID NO: 1199032 - protein, 6 aa, Mycobacterium
DTGEFD

SEQ ID NO: 1199033 - protein, 6 aa, Mycobacterium
DTGEIV

SEQ ID NO: 1199034 - protein, 7 aa, Mycobacterium
DTGEPDW

SEQ ID NO: 1199035 - protein, 6 aa, Mycobacterium
DTGEQH

SEQ ID NO: 1199036 - protein, 13 aa, Mycobacterium
DTGEVTGRTALPG

SEQ ID NO: 1199037 - protein, 4 aa, Mycobacterium
DTGG

SEQ ID NO: 1199038 - protein, 7 aa, Mycobacterium
DTGGAVD

SEQ ID NO: 1199039 - protein, 8 aa, Mycobacterium
DTGGGIPD

SEQ ID NO: 1199040 - protein, 11 aa, Mycobacterium
DTGGGRSAIRA

SEQ ID NO: 1199041 - protein, 6 aa, Mycobacterium
DTGGTI

SEQ ID NO: 1199042 - protein, 14 aa, Mycobacterium
DTGHDTARGRRGVS

SEQ ID NO: 1199043 - protein, 7 aa, Mycobacterium
DTGIMDG

SEQ ID NO: 1199044 - protein, 11 aa, Mycobacterium
DTGIPKALPAG

SEQ ID NO: 1199045 - protein, 4 aa, Mycobacterium
DTGL

SEQ ID NO: 1199046 - protein, 9 aa, Mycobacterium
DTGNCGNRQ

SEQ ID NO: 1199047 - protein, 11 aa, Mycobacterium
DTGNEAQKQQH

SEQ ID NO: 1199048 - protein, 10 aa, Mycobacterium
DTGNPADPIG

SEQ ID NO: 1199049 - protein, 6 aa, Mycobacterium
DTGNPV

SEQ ID NO: 1199050 - protein, 6 aa, Mycobacterium
DTGPAV

SEQ ID NO: 1199051 - protein, 11 aa, Mycobacterium
DTGPQNYSDDG

SEQ ID NO: 1199052 - protein, 13 aa, Mycobacterium
DTGRAELKTLLAV

SEQ ID NO: 1199053 - protein, 8 aa, Mycobacterium
DTGRGESE

SEQ ID NO: 1199054 - protein, 6 aa, Mycobacterium
DTGSGS

SEQ ID NO: 1199055 - protein, 5 aa, Mycobacterium
DTGSW

SEQ ID NO: 1199056 - protein, 22 aa, Mycobacterium
DTGTDGSGPQDRANAAGFRGKV

SEQ ID NO: 1199057 - protein, 13 aa, Mycobacterium
DTGTLTSRPGAQR

SEQ ID NO: 1199058 - protein, 5 aa, Mycobacterium
DTGTT

SEQ ID NO: 1199059 - protein, 4 aa, Mycobacterium
DTGV

SEQ ID NO: 1199060 - protein, 9 aa, Mycobacterium
DTGVPRPGL

SEQ ID NO: 1199061 - protein, 10 aa, Mycobacterium
DTGYGDPQDI

SEQ ID NO: 1199062 - protein, 8 aa, Mycobacterium
DTHATAEA

SEQ ID NO: 1199063 - protein, 12 aa, Mycobacterium
DTHGALDDDDIA

SEQ ID NO: 1199064 - protein, 7 aa, Mycobacterium
DTHPDNT

SEQ ID NO: 1199065 - protein, 5 aa, Mycobacterium
DTHPL

SEQ ID NO: 1199066 - protein, 7 aa, Mycobacterium
DTHRECP

SEQ ID NO: 1199067 - protein, 7 aa, Mycobacterium
DTHTAKR

SEQ ID NO: 1199068 - protein, 7 aa, Mycobacterium
DTIAAEP

SEQ ID NO: 1199069 - protein, 4 aa, Mycobacterium
DTIN

SEQ ID NO: 1199070 - protein, 13 aa, Mycobacterium
DTIPDGASYEPKW

SEQ ID NO: 1199071 - protein, 22 aa, Mycobacterium
DTIPEGYTPPPGMTGPMPPSVA

SEQ ID NO: 1199072 - protein, 13 aa, Mycobacterium
DTIRTRKNNRRIT

SEQ ID NO: 1199073 - protein, 4 aa, Mycobacterium
DTIT

SEQ ID NO: 1199074 - protein, 6 aa, Mycobacterium
DTKAKL

SEQ ID NO: 1199075 - protein, 6 aa, Mycobacterium
DTKARV

SEQ ID NO: 1199076 - protein, 5 aa, Mycobacterium
DTKGY

SEQ ID NO: 1199077 - protein, 8 aa, Mycobacterium
DTKRGTIS

SEQ ID NO: 1199078 - protein, 9 aa, Mycobacterium
DTKSLNDGA

SEQ ID NO: 1199079 - protein, 6 aa, Mycobacterium
DTLAQA

SEQ ID NO: 1199080 - protein, 9 aa, Mycobacterium
DTLDNPAVD

SEQ ID NO: 1199081 - protein, 12 aa, Mycobacterium
DTLEDVPTGEQG

SEQ ID NO: 1199082 - protein, 8 aa, Mycobacterium
DTLESRPY

SEQ ID NO: 1199083 - protein, 4 aa, Mycobacterium
DTLP

SEQ ID NO: 1199084 - protein, 7 aa, Mycobacterium
DTLPAQT

SEQ ID NO: 1199085 - protein, 6 aa, Mycobacterium
DTLPSM

SEQ ID NO: 1199086 - protein, 5 aa, Mycobacterium
DTLRA

SEQ ID NO: 1199087 - protein, 19 aa, Mycobacterium
DTLSPSESLDSDEVRNDDG

SEQ ID NO: 1199088 - protein, 6 aa, Mycobacterium
DTNAQV

SEQ ID NO: 1199089 - protein, 10 aa, Mycobacterium
DTNDKVHSEP

SEQ ID NO: 1199090 - protein, 17 aa, Mycobacterium
DTNDLAGYGSVANGTVN

SEQ ID NO: 1199091 - protein, 8 aa, Mycobacterium
DTNKPNGQ

SEQ ID NO: 1199092 - protein, 16 aa, Mycobacterium
DTNPHRARQRSQATQR

SEQ ID NO: 1199093 - protein, 14 aa, Mycobacterium
DTPAAERRADTHPG

SEQ ID NO: 1199094 - protein, 6 aa, Mycobacterium
DTPAEA

SEQ ID NO: 1199095 - protein, 14 aa, Mycobacterium
DTPANRASAAQLPA

SEQ ID NO: 1199096 - protein, 10 aa, Mycobacterium
DTPARPDGEG

SEQ ID NO: 1199097 - protein, 6 aa, Mycobacterium
DTPAVA

SEQ ID NO: 1199098 - protein, 12 aa, Mycobacterium
DTPDRLGPARAE

SEQ ID NO: 1199099 - protein, 6 aa, Mycobacterium
DTPDRV

SEQ ID NO: 1199100 - protein, 7 aa, Mycobacterium
DTPDVGA

SEQ ID NO: 1199101 - protein, 14 aa, Mycobacterium
DTPEGCKNAVGRAR

SEQ ID NO: 1199102 - protein, 6 aa, Mycobacterium
DTPEGF

SEQ ID NO: 1199103 - protein, 6 aa, Mycobacterium
DTPERL

SEQ ID NO: 1199104 - protein, 5 aa, Mycobacterium
DTPEY

SEQ ID NO: 1199105 - protein, 7 aa, Mycobacterium
DTPGDRL

SEQ ID NO: 1199106 - protein, 6 aa, Mycobacterium
DTPGFT

SEQ ID NO: 1199107 - protein, 7 aa, Mycobacterium
DTPGRMD

SEQ ID NO: 1199108 - protein, 6 aa, Mycobacterium
DTPGSY

SEQ ID NO: 1199109 - protein, 14 aa, Mycobacterium
DTPGTSSLSQDVSA

SEQ ID NO: 1199110 - protein, 9 aa, Mycobacterium
DTPGVAPHA

SEQ ID NO: 1199111 - protein, 19 aa, Mycobacterium
DTPGVEVGAKDKKMGQEGA

SEQ ID NO: 1199112 - protein, 6 aa, Mycobacterium
DTPGVT

SEQ ID NO: 1199113 - protein, 6 aa, Mycobacterium
DTPHGP

SEQ ID NO: 1199114 - protein, 4 aa, Mycobacterium
DTPI

SEQ ID NO: 1199115 - protein, 4 aa, Mycobacterium
DTPL

SEQ ID NO: 1199116 - protein, 8 aa, Mycobacterium
DTPLDPSR

SEQ ID NO: 1199117 - protein, 8 aa, Mycobacterium
DTPPGSDY

SEQ ID NO: 1199118 - protein, 6 aa, Mycobacterium
DTPPSV

SEQ ID NO: 1199119 - protein, 6 aa, Mycobacterium
DTPQHT

SEQ ID NO: 1199120 - protein, 6 aa, Mycobacterium
DTPQLQ

SEQ ID NO: 1199121 - protein, 7 aa, Mycobacterium
DTPRERV

SEQ ID NO: 1199122 - protein, 13 aa, Mycobacterium
DTPRLTSNRARTH

SEQ ID NO: 1199123 - protein, 7 aa, Mycobacterium
DTPRYRD

SEQ ID NO: 1199124 - protein, 6 aa, Mycobacterium
DTPSAY

SEQ ID NO: 1199125 - protein, 10 aa, Mycobacterium
DTPSEPEVSF

SEQ ID NO: 1199126 - protein, 7 aa, Mycobacterium
DTPTDAS

SEQ ID NO: 1199127 - protein, 4 aa, Mycobacterium
DTPY

SEQ ID NO: 1199128 - protein, 7 aa, Mycobacterium
DTQARPV

SEQ ID NO: 1199129 - protein, 8 aa, Mycobacterium
DTQETDLD

SEQ ID NO: 1199130 - protein, 10 aa, Mycobacterium
DTQKQIEQTP

SEQ ID NO: 1199131 - protein, 18 aa, Mycobacterium
DTQNGIASANATTGPPPH

SEQ ID NO: 1199132 - protein, 7 aa, Mycobacterium
DTQPNSM

SEQ ID NO: 1199133 - protein, 17 aa, Mycobacterium
DTQSANSGEGAVDAESV

SEQ ID NO: 1199134 - protein, 6 aa, Mycobacterium
DTQWPA

SEQ ID NO: 1199135 - protein, 9 aa, Mycobacterium
DTRAGQEQL

SEQ ID NO: 1199136 - protein, 7 aa, Mycobacterium
DTRAPVA

SEQ ID NO: 1199137 - protein, 5 aa, Mycobacterium
DTRDE

SEQ ID NO: 1199138 - protein, 5 aa, Mycobacterium
DTRDF

SEQ ID NO: 1199139 - protein, 12 aa, Mycobacterium
DTRDNPDAEKRA

SEQ ID NO: 1199140 - protein, 4 aa, Mycobacterium
DTRE

SEQ ID NO: 1199141 - protein, 6 aa, Mycobacterium
DTREAV

SEQ ID NO: 1199142 - protein, 27 aa, Mycobacterium
DTREDTREDTRDDSRDDGGDPNGDTDH

SEQ ID NO: 1199143 - protein, 6 aa, Mycobacterium
DTREGD

SEQ ID NO: 1199144 - protein, 6 aa, Mycobacterium
DTREGE

SEQ ID NO: 1199145 - protein, 14 aa, Mycobacterium
DTREVAERAAADRE

SEQ ID NO: 1199146 - protein, 20 aa, Mycobacterium
DTRGLRTTANPSFLAPPGHA

SEQ ID NO: 1199147 - protein, 7 aa, Mycobacterium
DTRHAPR

SEQ ID NO: 1199148 - protein, 4 aa, Mycobacterium
DTRI

SEQ ID NO: 1199149 - protein, 7 aa, Mycobacterium
DTRKSIE

SEQ ID NO: 1199150 - protein, 4 aa, Mycobacterium
DTRP

SEQ ID NO: 1199151 - protein, 21 aa, Mycobacterium
DTRPADEREKSAKPVDADLKW

SEQ ID NO: 1199152 - protein, 19 aa, Mycobacterium
DTRPKADTRVDKTAHGEKT

SEQ ID NO: 1199153 - protein, 9 aa, Mycobacterium
DTRPPGAEL

SEQ ID NO: 1199154 - protein, 6 aa, Mycobacterium
DTRPSD

SEQ ID NO: 1199155 - protein, 4 aa, Mycobacterium
DTRR

SEQ ID NO: 1199156 - protein, 6 aa, Mycobacterium
DTRREH

SEQ ID NO: 1199157 - protein, 9 aa, Mycobacterium
DTRRSAKQV

SEQ ID NO: 1199158 - protein, 4 aa, Mycobacterium
DTRS

SEQ ID NO: 1199159 - protein, 17 aa, Mycobacterium
DTRTGNHSGAADPYSSG

SEQ ID NO: 1199160 - protein, 9 aa, Mycobacterium
DTSADGRAG

SEQ ID NO: 1199161 - protein, 10 aa, Mycobacterium
DTSAQQLTDS

SEQ ID NO: 1199162 - protein, 10 aa, Mycobacterium
DTSAYPPMGP

SEQ ID NO: 1199163 - protein, 7 aa, Mycobacterium
DTSDAPL

SEQ ID NO: 1199164 - protein, 4 aa, Mycobacterium
DTSE

SEQ ID NO: 1199165 - protein, 5 aa, Mycobacterium
DTSFS

SEQ ID NO: 1199166 - protein, 10 aa, Mycobacterium
DTSPDRISGN

SEQ ID NO: 1199167 - protein, 14 aa, Mycobacterium
DTSRTDGGRTLASP

SEQ ID NO: 1199168 - protein, 28 aa, Mycobacterium
DTSSGTARSRAASAGAAYAKSAAARVAG

SEQ ID NO: 1199169 - protein, 6 aa, Mycobacterium
DTSSRA

SEQ ID NO: 1199170 - protein, 16 aa, Mycobacterium
DTSTGLPVGNPTDLGN

SEQ ID NO: 1199171 - protein, 7 aa, Mycobacterium
DTSTITT

SEQ ID NO: 1199172 - protein, 7 aa, Mycobacterium
DTSTSTM

SEQ ID NO: 1199173 - protein, 19 aa, Mycobacterium
DTTAAGGGCCGSDSSGATQ

SEQ ID NO: 1199174 - protein, 5 aa, Mycobacterium
DTTAE

SEQ ID NO: 1199175 - protein, 7 aa, Mycobacterium
DTTAEDL

SEQ ID NO: 1199176 - protein, 13 aa, Mycobacterium
DTTAGAVKFDEFR

SEQ ID NO: 1199177 - protein, 6 aa, Mycobacterium
DTTATA

SEQ ID NO: 1199178 - protein, 23 aa, Mycobacterium
DTTATRPTRRAGKPAAKRKTANR

SEQ ID NO: 1199179 - protein, 6 aa, Mycobacterium
DTTATT

SEQ ID NO: 1199180 - protein, 16 aa, Mycobacterium
DTTATTTAGQTLGPID

SEQ ID NO: 1199181 - protein, 7 aa, Mycobacterium
DTTDDAA

SEQ ID NO: 1199182 - protein, 6 aa, Mycobacterium
DTTDHK

SEQ ID NO: 1199183 - protein, 21 aa, Mycobacterium
DTTDMGKPITDTRGNDVPRSA

SEQ ID NO: 1199184 - protein, 7 aa, Mycobacterium
DTTDVAA

SEQ ID NO: 1199185 - protein, 6 aa, Mycobacterium
DTTEEL

SEQ ID NO: 1199186 - protein, 4 aa, Mycobacterium
DTTG

SEQ ID NO: 1199187 - protein, 25 aa, Mycobacterium
DTTGGFTYTPNPEDRPEAGEAPGYD

SEQ ID NO: 1199188 - protein, 7 aa, Mycobacterium
DTTGHGS

SEQ ID NO: 1199189 - protein, 8 aa, Mycobacterium
DTTGHGSV

SEQ ID NO: 1199190 - protein, 31 aa, Mycobacterium
DTTGTGDPHAEGNGTTGTTGAEQGKPAGTTR

SEQ ID NO: 1199191 - protein, 9 aa, Mycobacterium
DTTGVESSE

SEQ ID NO: 1199192 - protein, 11 aa, Mycobacterium
DTTHPEGASTL

SEQ ID NO: 1199193 - protein, 9 aa, Mycobacterium
DTTKARHAQ

SEQ ID NO: 1199194 - protein, 14 aa, Mycobacterium
DTTMTEPITTERRD

SEQ ID NO: 1199195 - protein, 8 aa, Mycobacterium
DTTPDQAE

SEQ ID NO: 1199196 - protein, 7 aa, Mycobacterium
DTTPGRT

SEQ ID NO: 1199197 - protein, 5 aa, Mycobacterium
DTTPQ

SEQ ID NO: 1199198 - protein, 13 aa, Mycobacterium
DTTPQFPDDGSMP

SEQ ID NO: 1199199 - protein, 5 aa, Mycobacterium
DTTPR

SEQ ID NO: 1199200 - protein, 10 aa, Mycobacterium
DTTRAPSANL

SEQ ID NO: 1199201 - protein, 15 aa, Mycobacterium
DTTRVGGHSVAILRA

SEQ ID NO: 1199202 - protein, 7 aa, Mycobacterium
DTTSGFT

SEQ ID NO: 1199203 - protein, 7 aa, Mycobacterium
DTTTCGP

SEQ ID NO: 1199204 - protein, 10 aa, Mycobacterium
DTTTDPDNPH

SEQ ID NO: 1199205 - protein, 8 aa, Mycobacterium
DTTTEAVG

SEQ ID NO: 1199206 - protein, 5 aa, Mycobacterium
DTTVA

SEQ ID NO: 1199207 - protein, 4 aa, Mycobacterium
DTVD

SEQ ID NO: 1199208 - protein, 4 aa, Mycobacterium
DTVG

SEQ ID NO: 1199209 - protein, 5 aa, Mycobacterium
DTVHP

SEQ ID NO: 1199210 - protein, 7 aa, Mycobacterium
DTVNADP

SEQ ID NO: 1199211 - protein, 7 aa, Mycobacterium
DTVPDTA

SEQ ID NO: 1199212 - protein, 5 aa, Mycobacterium
DTVPK

SEQ ID NO: 1199213 - protein, 6 aa, Mycobacterium
DTVPKQ

SEQ ID NO: 1199214 - protein, 5 aa, Mycobacterium
DTVRQ

SEQ ID NO: 1199215 - protein, 4 aa, Mycobacterium
DTVT

SEQ ID NO: 1199216 - protein, 14 aa, Mycobacterium
DTVTEVGARDPGAR

SEQ ID NO: 1199217 - protein, 15 aa, Mycobacterium
DTVTPPPPRAEGPIR

SEQ ID NO: 1199218 - protein, 21 aa, Mycobacterium
DTWSERKLSDGDYTLDREAAD

SEQ ID NO: 1199219 - protein, 4 aa, Mycobacterium
DTWT

SEQ ID NO: 1199220 - protein, 4 aa, Mycobacterium
DTYG

SEQ ID NO: 1199221 - protein, 6 aa, Mycobacterium
DTYTVS

SEQ ID NO: 1199222 - protein, 8 aa, Mycobacterium
DVAAGNLD

SEQ ID NO: 1199223 - protein, 6 aa, Mycobacterium
DVAAGT

SEQ ID NO: 1199224 - protein, 7 aa, Mycobacterium
DVAAGYE

SEQ ID NO: 1199225 - protein, 7 aa, Mycobacterium
DVADRDD

SEQ ID NO: 1199226 - protein, 7 aa, Mycobacterium
DVAESEE

SEQ ID NO: 1199227 - protein, 6 aa, Mycobacterium
DVAGPG

SEQ ID NO: 1199228 - protein, 5 aa, Mycobacterium
DVAGT

SEQ ID NO: 1199229 - protein, 9 aa, Mycobacterium
DVANSAGPL

SEQ ID NO: 1199230 - protein, 9 aa, Mycobacterium
DVAPGTTAS

SEQ ID NO: 1199231 - protein, 17 aa, Mycobacterium
DVAPHPSTRRTDEHQPV

SEQ ID NO: 1199232 - protein, 9 aa, Mycobacterium
DVAQRDSEG

SEQ ID NO: 1199233 - protein, 7 aa, Mycobacterium
DVARGES

SEQ ID NO: 1199234 - protein, 9 aa, Mycobacterium
DVASGGLPG

SEQ ID NO: 1199235 - protein, 11 aa, Mycobacterium
DVATSDPAVDA

SEQ ID NO: 1199236 - protein, 9 aa, Mycobacterium
DVDADEAER

SEQ ID NO: 1199237 - protein, 9 aa, Mycobacterium
DVDDGGLRR

SEQ ID NO: 1199238 - protein, 18 aa, Mycobacterium
DVDEGAKPGKSTNDSADL

SEQ ID NO: 1199239 - protein, 7 aa, Mycobacterium
DVDEGLQ

SEQ ID NO: 1199240 - protein, 8 aa, Mycobacterium
DVDERDRP

SEQ ID NO: 1199241 - protein, 8 aa, Mycobacterium
DVDGAEAG

SEQ ID NO: 1199242 - protein, 12 aa, Mycobacterium
DVDGAQRAADAG

SEQ ID NO: 1199243 - protein, 8 aa, Mycobacterium
DVDGDSAT

SEQ ID NO: 1199244 - protein, 12 aa, Mycobacterium
DVDGNRREAAAP

SEQ ID NO: 1199245 - protein, 11 aa, Mycobacterium
DVDGQKRKLRT

SEQ ID NO: 1199246 - protein, 5 aa, Mycobacterium
DVDGT

SEQ ID NO: 1199247 - protein, 7 aa, Mycobacterium
DVDGTTY

SEQ ID NO: 1199248 - protein, 7 aa, Mycobacterium
DVDPESL

SEQ ID NO: 1199249 - protein, 7 aa, Mycobacterium
DVDPGAV

SEQ ID NO: 1199250 - protein, 12 aa, Mycobacterium
DVDQTDGRPWSS

SEQ ID NO: 1199251 - protein, 14 aa, Mycobacterium
DVDRAADTDGRPGI

SEQ ID NO: 1199252 - protein, 5 aa, Mycobacterium
DVDRS

SEQ ID NO: 1199253 - protein, 7 aa, Mycobacterium
DVDTEAR

SEQ ID NO: 1199254 - protein, 4 aa, Mycobacterium
DVDY

SEQ ID NO: 1199255 - protein, 11 aa, Mycobacterium
DVEAARKQAAE

SEQ ID NO: 1199256 - protein, 5 aa, Mycobacterium
DVEAC

SEQ ID NO: 1199257 - protein, 12 aa, Mycobacterium
DVEAQPKNSAAS

SEQ ID NO: 1199258 - protein, 11 aa, Mycobacterium
DVEDGDASPVR

SEQ ID NO: 1199259 - protein, 4 aa, Mycobacterium
DVEG

SEQ ID NO: 1199260 - protein, 5 aa, Mycobacterium
DVEGA

SEQ ID NO: 1199261 - protein, 8 aa, Mycobacterium
DVEGDESV

SEQ ID NO: 1199262 - protein, 9 aa, Mycobacterium
DVEGRPTTL

SEQ ID NO: 1199263 - protein, 15 aa, Mycobacterium
DVEGVTDAEERVTEL

SEQ ID NO: 1199264 - protein, 7 aa, Mycobacterium
DVEIGSG

SEQ ID NO: 1199265 - protein, 6 aa, Mycobacterium
DVEPAS

SEQ ID NO: 1199266 - protein, 8 aa, Mycobacterium
DVEPGASV

SEQ ID NO: 1199267 - protein, 16 aa, Mycobacterium
DVEPPAGYRPAEVTAD

SEQ ID NO: 1199268 - protein, 8 aa, Mycobacterium
DVERDQIE

SEQ ID NO: 1199269 - protein, 11 aa, Mycobacterium
DVEREADGKSL

SEQ ID NO: 1199270 - protein, 5 aa, Mycobacterium
DVERT

SEQ ID NO: 1199271 - protein, 6 aa, Mycobacterium
DVERTE

SEQ ID NO: 1199272 - protein, 20 aa, Mycobacterium
DVESALAQEATPQFAADTRN

SEQ ID NO: 1199273 - protein, 14 aa, Mycobacterium
DVETAEDVRTGRVD

SEQ ID NO: 1199274 - protein, 6 aa, Mycobacterium
DVGAAE

SEQ ID NO: 1199275 - protein, 6 aa, Mycobacterium
DVGDGA

SEQ ID NO: 1199276 - protein, 7 aa, Mycobacterium
DVGDPTV

SEQ ID NO: 1199277 - protein, 6 aa, Mycobacterium
DVGEDD

SEQ ID NO: 1199278 - protein, 9 aa, Mycobacterium
DVGESPQVR

SEQ ID NO: 1199279 - protein, 15 aa, Mycobacterium
DVGKRPGSEKSQAEQ

SEQ ID NO: 1199280 - protein, 7 aa, Mycobacterium
DVGRGEE

SEQ ID NO: 1199281 - protein, 12 aa, Mycobacterium
DVGSGPGNVTGA

SEQ ID NO: 1199282 - protein, 8 aa, Mycobacterium
DVGSGRSL

SEQ ID NO: 1199283 - protein, 12 aa, Mycobacterium
DVGSTSGHLGPS

SEQ ID NO: 1199284 - protein, 13 aa, Mycobacterium
DVGVDAAAAGGPA

SEQ ID NO: 1199285 - protein, 5 aa, Mycobacterium
DVHGG

SEQ ID NO: 1199286 - protein, 10 aa, Mycobacterium
DVIDPGSGLP

SEQ ID NO: 1199287 - protein, 50 aa, Mycobacterium
DVKPERGGGRRGDRPANPKRNPQRANNSGRREAGSGGGSMAQALREAGFG

SEQ ID NO: 1199288 - protein, 7 aa, Mycobacterium
DVKSNPV

SEQ ID NO: 1199289 - protein, 12 aa, Mycobacterium
DVKTGAKVDPDT

SEQ ID NO: 1199290 - protein, 8 aa, Mycobacterium
DVKTGAVT

SEQ ID NO: 1199291 - protein, 7 aa, Mycobacterium
DVLPPSD

SEQ ID NO: 1199292 - protein, 68 aa, Mycobacterium
DVNAGTQIDGDYGSDNVEDNSVNTSVETNTSTSTESKIEDNSSSYESNIGSGNDTAIGSGNETNTSLF

SEQ ID NO: 1199293 - protein, 7 aa, Mycobacterium
DVNANYR

SEQ ID NO: 1199294 - protein, 12 aa, Mycobacterium
DVNPSNASRTCD

SEQ ID NO: 1199295 - protein, 67 aa, Mycobacterium
DVNTGTQIDGDLGSDNVEDNSVNTAVETEISTSTESAVEDNSSSYESNIGSGNETAIGSGNETNTDL

SEQ ID NO: 1199296 - protein, 4 aa, Mycobacterium
DVPA

SEQ ID NO: 1199297 - protein, 18 aa, Mycobacterium
DVPAALPSGDIETIPPNE

SEQ ID NO: 1199298 - protein, 5 aa, Mycobacterium
DVPAG

SEQ ID NO: 1199299 - protein, 9 aa, Mycobacterium
DVPASRAAE

SEQ ID NO: 1199300 - protein, 4 aa, Mycobacterium
DVPD

SEQ ID NO: 1199301 - protein, 5 aa, Mycobacterium
DVPDD

SEQ ID NO: 1199302 - protein, 8 aa, Mycobacterium
DVPDGAGD

SEQ ID NO: 1199303 - protein, 7 aa, Mycobacterium
DVPDGGT

SEQ ID NO: 1199304 - protein, 28 aa, Mycobacterium
DVPDVAATGGDGEPGSATTPGSTRPEQQ

SEQ ID NO: 1199305 - protein, 20 aa, Mycobacterium
DVPEAPPGPSTTPEPGPAQR

SEQ ID NO: 1199306 - protein, 9 aa, Mycobacterium
DVPEAQRGS

SEQ ID NO: 1199307 - protein, 8 aa, Mycobacterium
DVPEERRG

SEQ ID NO: 1199308 - protein, 6 aa, Mycobacterium
DVPEPL

SEQ ID NO: 1199309 - protein, 6 aa, Mycobacterium
DVPETA

SEQ ID NO: 1199310 - protein, 23 aa, Mycobacterium
DVPFPAAANGPRGRQGSAASVTL

SEQ ID NO: 1199311 - protein, 4 aa, Mycobacterium
DVPG

SEQ ID NO: 1199312 - protein, 15 aa, Mycobacterium
DVPGGADAVAGSPEH

SEQ ID NO: 1199313 - protein, 7 aa, Mycobacterium
DVPGGLP

SEQ ID NO: 1199314 - protein, 17 aa, Mycobacterium
DVPGGTRADGGNTTAAN

SEQ ID NO: 1199315 - protein, 27 aa, Mycobacterium
DVPGKPSATHPNTGARLEQATDDSGHV

SEQ ID NO: 1199316 - protein, 7 aa, Mycobacterium
DVPKSTA

SEQ ID NO: 1199317 - protein, 17 aa, Mycobacterium
DVPPGADSVNIDPATEQ

SEQ ID NO: 1199318 - protein, 7 aa, Mycobacterium
DVPPGSY

SEQ ID NO: 1199319 - protein, 14 aa, Mycobacterium
DVPPRGSPEHYYSE

SEQ ID NO: 1199320 - protein, 4 aa, Mycobacterium
DVPQ

SEQ ID NO: 1199321 - protein, 8 aa, Mycobacterium
DVPRGDIE

SEQ ID NO: 1199322 - protein, 11 aa, Mycobacterium
DVPSPSNPPAG

SEQ ID NO: 1199323 - protein, 8 aa, Mycobacterium
DVPSTDDH

SEQ ID NO: 1199324 - protein, 7 aa, Mycobacterium
DVPTATS

SEQ ID NO: 1199325 - protein, 9 aa, Mycobacterium
DVPTPPESL

SEQ ID NO: 1199326 - protein, 8 aa, Mycobacterium
DVQASNVP

SEQ ID NO: 1199327 - protein, 14 aa, Mycobacterium
DVRDGEPSRWNSAA

SEQ ID NO: 1199328 - protein, 6 aa, Mycobacterium
DVRDPE

SEQ ID NO: 1199329 - protein, 4 aa, Mycobacterium
DVRG

SEQ ID NO: 1199330 - protein, 7 aa, Mycobacterium
DVRKQSH

SEQ ID NO: 1199331 - protein, 5 aa, Mycobacterium
DVRQG

SEQ ID NO: 1199332 - protein, 4 aa, Mycobacterium
DVRT

SEQ ID NO: 1199333 - protein, 5 aa, Mycobacterium
DVSAP

SEQ ID NO: 1199334 - protein, 12 aa, Mycobacterium
DVSASSGRRRPA

SEQ ID NO: 1199335 - protein, 11 aa, Mycobacterium
DVSDEDAARTV

SEQ ID NO: 1199336 - protein, 7 aa, Mycobacterium
DVSDELA

SEQ ID NO: 1199337 - protein, 6 aa, Mycobacterium
DVSGYT

SEQ ID NO: 1199338 - protein, 11 aa, Mycobacterium
DVSKKEARERT

SEQ ID NO: 1199339 - protein, 7 aa, Mycobacterium
DVSPAPE

SEQ ID NO: 1199340 - protein, 12 aa, Mycobacterium
DVSRTPPNKRNV

SEQ ID NO: 1199341 - protein, 10 aa, Mycobacterium
DVSRTSVEYD

SEQ ID NO: 1199342 - protein, 7 aa, Mycobacterium
DVSSNRV

SEQ ID NO: 1199343 - protein, 6 aa, Mycobacterium
DVSTGA

SEQ ID NO: 1199344 - protein, 7 aa, Mycobacterium
DVTAEAG

SEQ ID NO: 1199345 - protein, 18 aa, Mycobacterium
DVTAEQRRRIAEAGFYSY

SEQ ID NO: 1199346 - protein, 12 aa, Mycobacterium
DVTDADAADATV

SEQ ID NO: 1199347 - protein, 9 aa, Mycobacterium
DVTDEDQAA

SEQ ID NO: 1199348 - protein, 5 aa, Mycobacterium
DVTEG

SEQ ID NO: 1199349 - protein, 9 aa, Mycobacterium
DVTERSGVA

SEQ ID NO: 1199350 - protein, 5 aa, Mycobacterium
DVTGH

SEQ ID NO: 1199351 - protein, 5 aa, Mycobacterium
DVTGL

SEQ ID NO: 1199352 - protein, 12 aa, Mycobacterium
DVTGPKGEPWPV

SEQ ID NO: 1199353 - protein, 8 aa, Mycobacterium
DVTGPPPA

SEQ ID NO: 1199354 - protein, 5 aa, Mycobacterium
DVTPE

SEQ ID NO: 1199355 - protein, 11 aa, Mycobacterium
DVTPENEAQVN

SEQ ID NO: 1199356 - protein, 6 aa, Mycobacterium
DVTPEQ

SEQ ID NO: 1199357 - protein, 13 aa, Mycobacterium
DVTPQDPLADGAR

SEQ ID NO: 1199358 - protein, 17 aa, Mycobacterium
DVTPQPHNGCRPPKRRR

SEQ ID NO: 1199359 - protein, 7 aa, Mycobacterium
DVTSGLE

SEQ ID NO: 1199360 - protein, 8 aa, Mycobacterium
DVTSPEDC

SEQ ID NO: 1199361 - protein, 18 aa, Mycobacterium
DVTSPENAAAVASDVSER

SEQ ID NO: 1199362 - protein, 5 aa, Mycobacterium
DVTSY

SEQ ID NO: 1199363 - protein, 7 aa, Mycobacterium
DVTTTMD

SEQ ID NO: 1199364 - protein, 9 aa, Mycobacterium
DVVANGSAQ

SEQ ID NO: 1199365 - protein, 9 aa, Mycobacterium
DVVTSAQSA

SEQ ID NO: 1199366 - protein, 10 aa, Mycobacterium
DVVTSAQSAA

SEQ ID NO: 1199367 - protein, 12 aa, Mycobacterium
DWAPAGRPRRAG

SEQ ID NO: 1199368 - protein, 13 aa, Mycobacterium
DWDSEDEDPAGAL

SEQ ID NO: 1199369 - protein, 12 aa, Mycobacterium
DWELGPDDISDA

SEQ ID NO: 1199370 - protein, 15 aa, Mycobacterium
DWGSPEKVDTVSLIA

SEQ ID NO: 1199371 - protein, 10 aa, Mycobacterium
DWGSPKIPER

SEQ ID NO: 1199372 - protein, 8 aa, Mycobacterium
DWGTETGA

SEQ ID NO: 1199373 - protein, 6 aa, Mycobacterium
DWPAGG

SEQ ID NO: 1199374 - protein, 4 aa, Mycobacterium
DWPD

SEQ ID NO: 1199375 - protein, 6 aa, Mycobacterium
DWQTDA

SEQ ID NO: 1199376 - protein, 15 aa, Mycobacterium
DWSERSAGTNAPGTA

SEQ ID NO: 1199377 - protein, 4 aa, Mycobacterium
DWSG

SEQ ID NO: 1199378 - protein, 9 aa, Mycobacterium
DWTAGQADQ

SEQ ID NO: 1199379 - protein, 5 aa, Mycobacterium
DWTEP

SEQ ID NO: 1199380 - protein, 6 aa, Mycobacterium
DWTPQQ

SEQ ID NO: 1199381 - protein, 7 aa, Mycobacterium
DWTTQDP

SEQ ID NO: 1199382 - protein, 10 aa, Mycobacterium
DYAATASEAY

SEQ ID NO: 1199383 - protein, 12 aa, Mycobacterium
DYAGLPSSRGSR

SEQ ID NO: 1199384 - protein, 11 aa, Mycobacterium
DYAQSGGGNGG

SEQ ID NO: 1199385 - protein, 12 aa, Mycobacterium
DYAQSGGGNGGL

SEQ ID NO: 1199386 - protein, 6 aa, Mycobacterium
DYDAEQ

SEQ ID NO: 1199387 - protein, 7 aa, Mycobacterium
DYDGPEV

SEQ ID NO: 1199388 - protein, 5 aa, Mycobacterium
DYDQR

SEQ ID NO: 1199389 - protein, 9 aa, Mycobacterium
DYDSAPDVD

SEQ ID NO: 1199390 - protein, 7 aa, Mycobacterium
DYDSATK

SEQ ID NO: 1199391 - protein, 6 aa, Mycobacterium
DYEEGG

SEQ ID NO: 1199392 - protein, 10 aa, Mycobacterium
DYEGTTTADI

SEQ ID NO: 1199393 - protein, 12 aa, Mycobacterium
DYEPPPGCGCAG

SEQ ID NO: 1199394 - protein, 5 aa, Mycobacterium
DYESR

SEQ ID NO: 1199395 - protein, 7 aa, Mycobacterium
DYETERK

SEQ ID NO: 1199396 - protein, 13 aa, Mycobacterium
DYGAVSAGGGGRL

SEQ ID NO: 1199397 - protein, 5 aa, Mycobacterium
DYGAY

SEQ ID NO: 1199398 - protein, 5 aa, Mycobacterium
DYGGG

SEQ ID NO: 1199399 - protein, 4 aa, Mycobacterium
DYGL

SEQ ID NO: 1199400 - protein, 6 aa, Mycobacterium
DYGPAV

SEQ ID NO: 1199401 - protein, 16 aa, Mycobacterium
DYGRRPSLMKALKAKG

SEQ ID NO: 1199402 - protein, 9 aa, Mycobacterium
DYGTRPRAG

SEQ ID NO: 1199403 - protein, 9 aa, Mycobacterium
DYGTRPRPG

SEQ ID NO: 1199404 - protein, 7 aa, Mycobacterium
DYHPAAG

SEQ ID NO: 1199405 - protein, 8 aa, Mycobacterium
DYHPAAGS

SEQ ID NO: 1199406 - protein, 6 aa, Mycobacterium
DYHPDD

SEQ ID NO: 1199407 - protein, 6 aa, Mycobacterium
DYKAPD

SEQ ID NO: 1199408 - protein, 13 aa, Mycobacterium
DYNESGDISPDGR

SEQ ID NO: 1199409 - protein, 8 aa, Mycobacterium
DYPDHEAN

SEQ ID NO: 1199410 - protein, 6 aa, Mycobacterium
DYPDRQ

SEQ ID NO: 1199411 - protein, 6 aa, Mycobacterium
DYPGEG

SEQ ID NO: 1199412 - protein, 13 aa, Mycobacterium
DYPNATPDDLDET

SEQ ID NO: 1199413 - protein, 10 aa, Mycobacterium
DYPRDWPRPQ

SEQ ID NO: 1199414 - protein, 4 aa, Mycobacterium
DYPV

SEQ ID NO: 1199415 - protein, 29 aa, Mycobacterium
DYQAEAEQKWGETAEWKESQRRTKSYGKD

SEQ ID NO: 1199416 - protein, 4 aa, Mycobacterium
DYQP

SEQ ID NO: 1199417 - protein, 18 aa, Mycobacterium
DYQQMGAQAARAALADAG

SEQ ID NO: 1199418 - protein, 5 aa, Mycobacterium
DYRDG

SEQ ID NO: 1199419 - protein, 20 aa, Mycobacterium
DYRDKTADSGRQIPIFRLKP

SEQ ID NO: 1199420 - protein, 9 aa, Mycobacterium
DYRDVRESQ

SEQ ID NO: 1199421 - protein, 5 aa, Mycobacterium
DYRPG

SEQ ID NO: 1199422 - protein, 13 aa, Mycobacterium
DYRRQEEARGHSV

SEQ ID NO: 1199423 - protein, 10 aa, Mycobacterium
DYRTEDARVG

SEQ ID NO: 1199424 - protein, 6 aa, Mycobacterium
DYSDVT

SEQ ID NO: 1199425 - protein, 10 aa, Mycobacterium
DYSEDTGVEA

SEQ ID NO: 1199426 - protein, 9 aa, Mycobacterium
DYSQERTTF

SEQ ID NO: 1199427 - protein, 10 aa, Mycobacterium
DYSQGGRTDI

SEQ ID NO: 1199428 - protein, 4 aa, Mycobacterium
DYST

SEQ ID NO: 1199429 - protein, 6 aa, Mycobacterium
DYTAAK

SEQ ID NO: 1199430 - protein, 8 aa, Mycobacterium
DYTGGQRE

SEQ ID NO: 1199431 - protein, 16 aa, Mycobacterium
DYTGPGSGLDGTDPTL

SEQ ID NO: 1199432 - protein, 6 aa, Mycobacterium
EAAAAD

SEQ ID NO: 1199433 - protein, 7 aa, Mycobacterium
EAAAAGA

SEQ ID NO: 1199434 - protein, 8 aa, Mycobacterium
EAAAAGDA

SEQ ID NO: 1199435 - protein, 5 aa, Mycobacterium
EAAAG

SEQ ID NO: 1199436 - protein, 6 aa, Mycobacterium
EAAAGH

SEQ ID NO: 1199437 - protein, 10 aa, Mycobacterium
EAAAGNSDEE

SEQ ID NO: 1199438 - protein, 12 aa, Mycobacterium
EAAANADTDTAE

SEQ ID NO: 1199439 - protein, 9 aa, Mycobacterium
EAAANGEDV

SEQ ID NO: 1199440 - protein, 10 aa, Mycobacterium
EAAAPDGSGA

SEQ ID NO: 1199441 - protein, 8 aa, Mycobacterium
EAAATAVG

SEQ ID NO: 1199442 - protein, 10 aa, Mycobacterium
EAADPGTRIA

SEQ ID NO: 1199443 - protein, 10 aa, Mycobacterium
EAADRAQRTV

SEQ ID NO: 1199444 - protein, 4 aa, Mycobacterium
EAAE

SEQ ID NO: 1199445 - protein, 13 aa, Mycobacterium
EAAEAEESAPRAR

SEQ ID NO: 1199446 - protein, 8 aa, Mycobacterium
EAAEAPAQ

SEQ ID NO: 1199447 - protein, 5 aa, Mycobacterium
EAAER

SEQ ID NO: 1199448 - protein, 22 aa, Mycobacterium
EAAGADGSDTRAVLEDGEVEFS

SEQ ID NO: 1199449 - protein, 11 aa, Mycobacterium
EAAGEGPAGIS

SEQ ID NO: 1199450 - protein, 13 aa, Mycobacterium
EAAGEPPQDSSLA

SEQ ID NO: 1199451 - protein, 7 aa, Mycobacterium
EAAGGKA

SEQ ID NO: 1199452 - protein, 7 aa, Mycobacterium
EAAGGKG

SEQ ID NO: 1199453 - protein, 10 aa, Mycobacterium
EAAGGLGGSE

SEQ ID NO: 1199454 - protein, 12 aa, Mycobacterium
EAAGGTAAGVTG

SEQ ID NO: 1199455 - protein, 8 aa, Mycobacterium
EAAGIAEP

SEQ ID NO: 1199456 - protein, 12 aa, Mycobacterium
EAAGKSQGLTPR

SEQ ID NO: 1199457 - protein, 8 aa, Mycobacterium
EAAGMPTG

SEQ ID NO: 1199458 - protein, 5 aa, Mycobacterium
EAAGR

SEQ ID NO: 1199459 - protein, 7 aa, Mycobacterium
EAAGRGA

SEQ ID NO: 1199460 - protein, 9 aa, Mycobacterium
EAAGSDETW

SEQ ID NO: 1199461 - protein, 14 aa, Mycobacterium
EAAGSYSSRERSSA

SEQ ID NO: 1199462 - protein, 7 aa, Mycobacterium
EAAGVAN

SEQ ID NO: 1199463 - protein, 11 aa, Mycobacterium
EAAHAAGEDTF

SEQ ID NO: 1199464 - protein, 6 aa, Mycobacterium
EAAHAG

SEQ ID NO: 1199465 - protein, 5 aa, Mycobacterium
EAAKF

SEQ ID NO: 1199466 - protein, 7 aa, Mycobacterium
EAAKPKR

SEQ ID NO: 1199467 - protein, 15 aa, Mycobacterium
EAANLEAASTRQAQQ

SEQ ID NO: 1199468 - protein, 4 aa, Mycobacterium
EAAP

SEQ ID NO: 1199469 - protein, 12 aa, Mycobacterium
EAAPAPPSTEGT

SEQ ID NO: 1199470 - protein, 81 aa, Mycobacterium
EAAPGANKPESEHTEDSTSGGTPRDTETSDHADASGDGVAPSSTAGDGNTSGDDGGDAPAEDHDPQPERRGSDTRTQAQRN

SEQ ID NO: 1199471 - protein, 81 aa, Mycobacterium
EAAPGANLPESEHTEDSTSGGTPRDTETSDHADASGDGVAPSSTAGHGNTSGDDGGDAPAEDHDPQPERCGSDTRTQAQRN

SEQ ID NO: 1199472 - protein, 68 aa, Mycobacterium
EAAPGANNPESEHTEDSTSGGAADDASDAPGDHAGAASSAASGASDAAEHDPQPERCGSDTRTQAQRN

SEQ ID NO: 1199473 - protein, 10 aa, Mycobacterium
EAAPGGSRYN

SEQ ID NO: 1199474 - protein, 6 aa, Mycobacterium
EAAPGI

SEQ ID NO: 1199475 - protein, 16 aa, Mycobacterium
EAAPGSRPESQQTRST

SEQ ID NO: 1199476 - protein, 5 aa, Mycobacterium
EAAPL

SEQ ID NO: 1199477 - protein, 7 aa, Mycobacterium
EAAPVGG

SEQ ID NO: 1199478 - protein, 6 aa, Mycobacterium
EAAQAQ

SEQ ID NO: 1199479 - protein, 16 aa, Mycobacterium
EAAQPAVQAAAPVPPA

SEQ ID NO: 1199480 - protein, 20 aa, Mycobacterium
EAAQQTFETAPSIEDEPGVD

SEQ ID NO: 1199481 - protein, 6 aa, Mycobacterium
EAAQRL

SEQ ID NO: 1199482 - protein, 9 aa, Mycobacterium
EAAQRTGLS

SEQ ID NO: 1199483 - protein, 8 aa, Mycobacterium
EAAQRTPS

SEQ ID NO: 1199484 - protein, 37 aa, Mycobacterium
EAARAAAEGAESTRDQIARKGRASYVGDAARGAVDPG

SEQ ID NO: 1199485 - protein, 7 aa, Mycobacterium
EAARADV

SEQ ID NO: 1199486 - protein, 6 aa, Mycobacterium
EAARDG

SEQ ID NO: 1199487 - protein, 7 aa, Mycobacterium
EAAREGA

SEQ ID NO: 1199488 - protein, 24 aa, Mycobacterium
EAARGNADGAAAALARAEDANGPQ

SEQ ID NO: 1199489 - protein, 8 aa, Mycobacterium
EAARGTAD

SEQ ID NO: 1199490 - protein, 11 aa, Mycobacterium
EAARNGHRDEA

SEQ ID NO: 1199491 - protein, 16 aa, Mycobacterium
EAASAATRSLNTPGAA

SEQ ID NO: 1199492 - protein, 12 aa, Mycobacterium
EAASDRRTPRLT

SEQ ID NO: 1199493 - protein, 14 aa, Mycobacterium
EAASREAESAFGDP

SEQ ID NO: 1199494 - protein, 6 aa, Mycobacterium
EAATAG

SEQ ID NO: 1199495 - protein, 6 aa, Mycobacterium
EAATAS

SEQ ID NO: 1199496 - protein, 5 aa, Mycobacterium
EAATF

SEQ ID NO: 1199497 - protein, 8 aa, Mycobacterium
EAATGDLD

SEQ ID NO: 1199498 - protein, 20 aa, Mycobacterium
EACGAGDDAGVRENPDSSYE

SEQ ID NO: 1199499 - protein, 4 aa, Mycobacterium
EADA

SEQ ID NO: 1199500 - protein, 26 aa, Mycobacterium
EADAARASASDDTSAPSTAASPDAPE

SEQ ID NO: 1199501 - protein, 7 aa, Mycobacterium
EADAGVR

SEQ ID NO: 1199502 - protein, 7 aa, Mycobacterium
EADAPGR

SEQ ID NO: 1199503 - protein, 11 aa, Mycobacterium
EADAQRAADQV

SEQ ID NO: 1199504 - protein, 9 aa, Mycobacterium
EADASRPVQ

SEQ ID NO: 1199505 - protein, 6 aa, Mycobacterium
EADAYA

SEQ ID NO: 1199506 - protein, 10 aa, Mycobacterium
EADDAEKTLQ

SEQ ID NO: 1199507 - protein, 5 aa, Mycobacterium
EADDT

SEQ ID NO: 1199508 - protein, 34 aa, Mycobacterium
EADDTEAAESVPIGGSGRNASRGRRAQGEPGRAV

SEQ ID NO: 1199509 - protein, 31 aa, Mycobacterium
EADDTETVEVGGSGRNASRGRRAQGEPGRAV

SEQ ID NO: 1199510 - protein, 7 aa, Mycobacterium
EADEEAT

SEQ ID NO: 1199511 - protein, 9 aa, Mycobacterium
EADGAAPTA

SEQ ID NO: 1199512 - protein, 6 aa, Mycobacterium
EADGEA

SEQ ID NO: 1199513 - protein, 9 aa, Mycobacterium
EADGLDAEQ

SEQ ID NO: 1199514 - protein, 6 aa, Mycobacterium
EADGSL

SEQ ID NO: 1199515 - protein, 6 aa, Mycobacterium
EADGVD

SEQ ID NO: 1199516 - protein, 5 aa, Mycobacterium
EADIQ

SEQ ID NO: 1199517 - protein, 9 aa, Mycobacterium
EADKKFRAE

SEQ ID NO: 1199518 - protein, 13 aa, Mycobacterium
EADKPETSAGPRE

SEQ ID NO: 1199519 - protein, 12 aa, Mycobacterium
EADMGDSDQWPQ

SEQ ID NO: 1199520 - protein, 6 aa, Mycobacterium
EADPAA

SEQ ID NO: 1199521 - protein, 7 aa, Mycobacterium
EADPAER

SEQ ID NO: 1199522 - protein, 11 aa, Mycobacterium
EADPDDRDHDA

SEQ ID NO: 1199523 - protein, 9 aa, Mycobacterium
EADPDPGRR

SEQ ID NO: 1199524 - protein, 9 aa, Mycobacterium
EADPDRTPL

SEQ ID NO: 1199525 - protein, 7 aa, Mycobacterium
EADPEPY

SEQ ID NO: 1199526 - protein, 7 aa, Mycobacterium
EADPSAD

SEQ ID NO: 1199527 - protein, 20 aa, Mycobacterium
EADQAGVRPPPRAERAHNYD

SEQ ID NO: 1199528 - protein, 22 aa, Mycobacterium
EADQTSRKEFTESVTAAKTALT

SEQ ID NO: 1199529 - protein, 7 aa, Mycobacterium
EADREGT

SEQ ID NO: 1199530 - protein, 8 aa, Mycobacterium
EADSPDLR

SEQ ID NO: 1199531 - protein, 8 aa, Mycobacterium
EADSPYAD

SEQ ID NO: 1199532 - protein, 10 aa, Mycobacterium
EADSTASTSL

SEQ ID NO: 1199533 - protein, 13 aa, Mycobacterium
EADTAAAVAVLEE

SEQ ID NO: 1199534 - protein, 8 aa, Mycobacterium
EADVEDSQ

SEQ ID NO: 1199535 - protein, 9 aa, Mycobacterium
EAEAATGLD

SEQ ID NO: 1199536 - protein, 18 aa, Mycobacterium
EAEAEASEAVERAEQLGG

SEQ ID NO: 1199537 - protein, 7 aa, Mycobacterium
EAEARYR

SEQ ID NO: 1199538 - protein, 9 aa, Mycobacterium
EAEASNDVG

SEQ ID NO: 1199539 - protein, 5 aa, Mycobacterium
EAEAV

SEQ ID NO: 1199540 - protein, 7 aa, Mycobacterium
EAEDNGR

SEQ ID NO: 1199541 - protein, 5 aa, Mycobacterium
EAEFD

SEQ ID NO: 1199542 - protein, 7 aa, Mycobacterium
EAEGDFD

SEQ ID NO: 1199543 - protein, 46 aa, Mycobacterium
EAEGGPSTEATTPKKKKAPAKKDAPAEAAEAPAEAEAAAESDAPAA

SEQ ID NO: 1199544 - protein, 6 aa, Mycobacterium
EAEKLD

SEQ ID NO: 1199545 - protein, 8 aa, Mycobacterium
EAEKQDLR

SEQ ID NO: 1199546 - protein, 6 aa, Mycobacterium
EAELPR

SEQ ID NO: 1199547 - protein, 7 aa, Mycobacterium
EAENLRE

SEQ ID NO: 1199548 - protein, 6 aa, Mycobacterium
EAEPAA

SEQ ID NO: 1199549 - protein, 6 aa, Mycobacterium
EAEPDV

SEQ ID NO: 1199550 - protein, 8 aa, Mycobacterium
EAEPGRTH

SEQ ID NO: 1199551 - protein, 17 aa, Mycobacterium
EAEPVDPPAEPAPDPVV

SEQ ID NO: 1199552 - protein, 5 aa, Mycobacterium
EAEQC

SEQ ID NO: 1199553 - protein, 6 aa, Mycobacterium
EAEQRI

SEQ ID NO: 1199554 - protein, 22 aa, Mycobacterium
EAERATGEVTDVGKGRHTSTQS

SEQ ID NO: 1199555 - protein, 5 aa, Mycobacterium
EAERI

SEQ ID NO: 1199556 - protein, 10 aa, Mycobacterium
EAERNRQAAA

SEQ ID NO: 1199557 - protein, 6 aa, Mycobacterium
EAERRG

SEQ ID NO: 1199558 - protein, 8 aa, Mycobacterium
EAERTERD

SEQ ID NO: 1199559 - protein, 4 aa, Mycobacterium
EAES

SEQ ID NO: 1199560 - protein, 8 aa, Mycobacterium
EAESDRVD

SEQ ID NO: 1199561 - protein, 12 aa, Mycobacterium
EAESDTEADELT

SEQ ID NO: 1199562 - protein, 13 aa, Mycobacterium
EAESENWSAVPAV

SEQ ID NO: 1199563 - protein, 16 aa, Mycobacterium
EAESGAQFDNHSPATG

SEQ ID NO: 1199564 - protein, 6 aa, Mycobacterium
EAESID

SEQ ID NO: 1199565 - protein, 20 aa, Mycobacterium
EAESTSPLCTDPGQLDSAVT

SEQ ID NO: 1199566 - protein, 11 aa, Mycobacterium
EAETDGNEYRQ

SEQ ID NO: 1199567 - protein, 14 aa, Mycobacterium
EAETTRLPSGDEQK

SEQ ID NO: 1199568 - protein, 5 aa, Mycobacterium
EAETY

SEQ ID NO: 1199569 - protein, 15 aa, Mycobacterium
EAEYEAEQRRGADPQ

SEQ ID NO: 1199570 - protein, 7 aa, Mycobacterium
EAFDNGP

SEQ ID NO: 1199571 - protein, 8 aa, Mycobacterium
EAFPSSDY

SEQ ID NO: 1199572 - protein, 7 aa, Mycobacterium
EAFSSAR

SEQ ID NO: 1199573 - protein, 6 aa, Mycobacterium
EAGADD

SEQ ID NO: 1199574 - protein, 9 aa, Mycobacterium
EAGAEARTV

SEQ ID NO: 1199575 - protein, 17 aa, Mycobacterium
EAGAGVPDDATKAQASD

SEQ ID NO: 1199576 - protein, 7 aa, Mycobacterium
EAGAQPM

SEQ ID NO: 1199577 - protein, 10 aa, Mycobacterium
EAGARPQSVT

SEQ ID NO: 1199578 - protein, 5 aa, Mycobacterium
EAGAS

SEQ ID NO: 1199579 - protein, 14 aa, Mycobacterium
EAGASDIAARQPAT

SEQ ID NO: 1199580 - protein, 12 aa, Mycobacterium
EAGATVDPGEVD

SEQ ID NO: 1199581 - protein, 10 aa, Mycobacterium
EAGAVPADPQ

SEQ ID NO: 1199582 - protein, 6 aa, Mycobacterium
EAGDEM

SEQ ID NO: 1199583 - protein, 9 aa, Mycobacterium
EAGDGGKPF

SEQ ID NO: 1199584 - protein, 6 aa, Mycobacterium
EAGDGP

SEQ ID NO: 1199585 - protein, 12 aa, Mycobacterium
EAGDKDKAGELL

SEQ ID NO: 1199586 - protein, 38 aa, Mycobacterium
EAGDKTAATSAQAAELTDRTVKDATKTMAKAAEDAKKA

SEQ ID NO: 1199587 - protein, 12 aa, Mycobacterium
EAGDPDKPEQSA

SEQ ID NO: 1199588 - protein, 5 aa, Mycobacterium
EAGED

SEQ ID NO: 1199589 - protein, 6 aa, Mycobacterium
EAGEGY

SEQ ID NO: 1199590 - protein, 5 aa, Mycobacterium
EAGEP

SEQ ID NO: 1199591 - protein, 8 aa, Mycobacterium
EAGEPGAP

SEQ ID NO: 1199592 - protein, 6 aa, Mycobacterium
EAGERL

SEQ ID NO: 1199593 - protein, 17 aa, Mycobacterium
EAGERTPRKNETSRWNA

SEQ ID NO: 1199594 - protein, 7 aa, Mycobacterium
EAGEVRT

SEQ ID NO: 1199595 - protein, 4 aa, Mycobacterium
EAGG

SEQ ID NO: 1199596 - protein, 10 aa, Mycobacterium
EAGGAEPTPA

SEQ ID NO: 1199597 - protein, 13 aa, Mycobacterium
EAGGDPARERSCP

SEQ ID NO: 1199598 - protein, 6 aa, Mycobacterium
EAGGFD

SEQ ID NO: 1199599 - protein, 15 aa, Mycobacterium
EAGGGELPELSSDST

SEQ ID NO: 1199600 - protein, 18 aa, Mycobacterium
EAGGGSDAGATKTTARLD

SEQ ID NO: 1199601 - protein, 16 aa, Mycobacterium
EAGGLPAAGPDRDDAR

SEQ ID NO: 1199602 - protein, 9 aa, Mycobacterium
EAGGPPAEA

SEQ ID NO: 1199603 - protein, 8 aa, Mycobacterium
EAGGSPHE

SEQ ID NO: 1199604 - protein, 7 aa, Mycobacterium
EAGHRSK

SEQ ID NO: 1199605 - protein, 11 aa, Mycobacterium
EAGIDESTAGS

SEQ ID NO: 1199606 - protein, 7 aa, Mycobacterium
EAGIGKS

SEQ ID NO: 1199607 - protein, 8 aa, Mycobacterium
EAGIGPQD

SEQ ID NO: 1199608 - protein, 9 aa, Mycobacterium
EAGKHPGTR

SEQ ID NO: 1199609 - protein, 16 aa, Mycobacterium
EAGKLERASDQSPEGG

SEQ ID NO: 1199610 - protein, 7 aa, Mycobacterium
EAGLEQT

SEQ ID NO: 1199611 - protein, 7 aa, Mycobacterium
EAGLGPR

SEQ ID NO: 1199612 - protein, 5 aa, Mycobacterium
EAGLP

SEQ ID NO: 1199613 - protein, 7 aa, Mycobacterium
EAGLQPN

SEQ ID NO: 1199614 - protein, 5 aa, Mycobacterium
EAGLS

SEQ ID NO: 1199615 - protein, 10 aa, Mycobacterium
EAGNAAGKKI

SEQ ID NO: 1199616 - protein, 11 aa, Mycobacterium
EAGNDSRVPPA

SEQ ID NO: 1199617 - protein, 17 aa, Mycobacterium
EAGNSDPAAPRRDPEEA

SEQ ID NO: 1199618 - protein, 9 aa, Mycobacterium
EAGPEAQEE

SEQ ID NO: 1199619 - protein, 14 aa, Mycobacterium
EAGPETDAPPPGTV

SEQ ID NO: 1199620 - protein, 6 aa, Mycobacterium
EAGPQG

SEQ ID NO: 1199621 - protein, 7 aa, Mycobacterium
EAGPRVE

SEQ ID NO: 1199622 - protein, 7 aa, Mycobacterium
EAGPTGF

SEQ ID NO: 1199623 - protein, 6 aa, Mycobacterium
EAGQGD

SEQ ID NO: 1199624 - protein, 18 aa, Mycobacterium
EAGRAPDDELDERDYTED

SEQ ID NO: 1199625 - protein, 8 aa, Mycobacterium
EAGRASAP

SEQ ID NO: 1199626 - protein, 6 aa, Mycobacterium
EAGRCQ

SEQ ID NO: 1199627 - protein, 19 aa, Mycobacterium
EAGRDPATIERSAEAMGRD

SEQ ID NO: 1199628 - protein, 8 aa, Mycobacterium
EAGRDTVP

SEQ ID NO: 1199629 - protein, 19 aa, Mycobacterium
EAGRNAKPSMATPPGEKAA

SEQ ID NO: 1199630 - protein, 29 aa, Mycobacterium
EAGRQAEVAEQASAASAAEAKTAAEQAAA

SEQ ID NO: 1199631 - protein, 10 aa, Mycobacterium
EAGRRGMVGG

SEQ ID NO: 1199632 - protein, 11 aa, Mycobacterium
EAGSAKCTYGT

SEQ ID NO: 1199633 - protein, 5 aa, Mycobacterium
EAGSM

SEQ ID NO: 1199634 - protein, 6 aa, Mycobacterium
EAGSVA

SEQ ID NO: 1199635 - protein, 8 aa, Mycobacterium
EAGSVSEA

SEQ ID NO: 1199636 - protein, 12 aa, Mycobacterium
EAGTDSDSGAVT

SEQ ID NO: 1199637 - protein, 7 aa, Mycobacterium
EAGTEGF

SEQ ID NO: 1199638 - protein, 11 aa, Mycobacterium
EAGTGETAGPI

SEQ ID NO: 1199639 - protein, 23 aa, Mycobacterium
EAGTPAKSEARLVPSDPSWPAQA

SEQ ID NO: 1199640 - protein, 6 aa, Mycobacterium
EAGTPL

SEQ ID NO: 1199641 - protein, 14 aa, Mycobacterium
EAGTQSGKARKAME

SEQ ID NO: 1199642 - protein, 5 aa, Mycobacterium
EAGTW

SEQ ID NO: 1199643 - protein, 11 aa, Mycobacterium
EAGVPDRTTLT

SEQ ID NO: 1199644 - protein, 5 aa, Mycobacterium
EAGVS

SEQ ID NO: 1199645 - protein, 6 aa, Mycobacterium
EAGYDG

SEQ ID NO: 1199646 - protein, 7 aa, Mycobacterium
EAGYRNA

SEQ ID NO: 1199647 - protein, 20 aa, Mycobacterium
EAHADEDRQRREEADVRNQA

SEQ ID NO: 1199648 - protein, 5 aa, Mycobacterium
EAHAN

SEQ ID NO: 1199649 - protein, 8 aa, Mycobacterium
EAHEQRSF

SEQ ID NO: 1199650 - protein, 4 aa, Mycobacterium
EAHP

SEQ ID NO: 1199651 - protein, 4 aa, Mycobacterium
EAHR

SEQ ID NO: 1199652 - protein, 5 aa, Mycobacterium
EAIGQ

SEQ ID NO: 1199653 - protein, 22 aa, Mycobacterium
EAIGTVTAKGPAAGGTRYEAER

SEQ ID NO: 1199654 - protein, 5 aa, Mycobacterium
EAIPD

SEQ ID NO: 1199655 - protein, 190 aa, Mycobacterium
EAIRETYAKAGQPTPVQPPQPRPDAVAPAAPVTGNGDPNRRGMPAHTEEESRRGGGSGAGQPSGSGGQQPGGQPQIPQEAPVSPMSAAEQAAQGAQQAAPQGGSQGGSPGGGSQGDGSQGGSPAGGSQGGAPGGGMPGLGKGEPKLPTDPSLRPAAAGGGGSGGGGGGGGVPAGPLQPAVGAETVAPTPI

SEQ ID NO: 1199656 - protein, 10 aa, Mycobacterium
EAKDNAENPY

SEQ ID NO: 1199657 - protein, 13 aa, Mycobacterium
EAKEGIETTETGE

SEQ ID NO: 1199658 - protein, 18 aa, Mycobacterium
EAKGAPREGFPAGTPWDD

SEQ ID NO: 1199659 - protein, 16 aa, Mycobacterium
EAKGRNGVPPSHAATE

SEQ ID NO: 1199660 - protein, 8 aa, Mycobacterium
EAKPPRPF

SEQ ID NO: 1199661 - protein, 9 aa, Mycobacterium
EAKQSGDHQ

SEQ ID NO: 1199662 - protein, 13 aa, Mycobacterium
EAKRRIEDAGAVP

SEQ ID NO: 1199663 - protein, 7 aa, Mycobacterium
EAKRRRV

SEQ ID NO: 1199664 - protein, 13 aa, Mycobacterium
EAKSGGRDRVVSS

SEQ ID NO: 1199665 - protein, 12 aa, Mycobacterium
EALADGGYRQSK

SEQ ID NO: 1199666 - protein, 9 aa, Mycobacterium
EALAEGDVD

SEQ ID NO: 1199667 - protein, 6 aa, Mycobacterium
EALAER

SEQ ID NO: 1199668 - protein, 6 aa, Mycobacterium
EALART

SEQ ID NO: 1199669 - protein, 8 aa, Mycobacterium
EALEDGGE

SEQ ID NO: 1199670 - protein, 4 aa, Mycobacterium
EALG

SEQ ID NO: 1199671 - protein, 6 aa, Mycobacterium
EALGAE

SEQ ID NO: 1199672 - protein, 10 aa, Mycobacterium
EALGDTSRRN

SEQ ID NO: 1199673 - protein, 8 aa, Mycobacterium
EALGGRPA

SEQ ID NO: 1199674 - protein, 12 aa, Mycobacterium
EALGSNGSTSMG

SEQ ID NO: 1199675 - protein, 10 aa, Mycobacterium
EALKAAGLPA

SEQ ID NO: 1199676 - protein, 11 aa, Mycobacterium
EALPPPAPGSV

SEQ ID NO: 1199677 - protein, 5 aa, Mycobacterium
EALPR

SEQ ID NO: 1199678 - protein, 20 aa, Mycobacterium
EALQESDADLAAGRTFSEEE

SEQ ID NO: 1199679 - protein, 7 aa, Mycobacterium
EALRNSA

SEQ ID NO: 1199680 - protein, 6 aa, Mycobacterium
EALSRE

SEQ ID NO: 1199681 - protein, 7 aa, Mycobacterium
EALTPAD

SEQ ID NO: 1199682 - protein, 9 aa, Mycobacterium
EALTPDKRR

SEQ ID NO: 1199683 - protein, 8 aa, Mycobacterium
EALTPQQR

SEQ ID NO: 1199684 - protein, 9 aa, Mycobacterium
EALTPRQRE

SEQ ID NO: 1199685 - protein, 7 aa, Mycobacterium
EAMGGRS

SEQ ID NO: 1199686 - protein, 9 aa, Mycobacterium
EAMNAGDDE

SEQ ID NO: 1199687 - protein, 7 aa, Mycobacterium
EANADGA

SEQ ID NO: 1199688 - protein, 6 aa, Mycobacterium
EANGAP

SEQ ID NO: 1199689 - protein, 11 aa, Mycobacterium
EANGPLDQQVP

SEQ ID NO: 1199690 - protein, 8 aa, Mycobacterium
EANGPTEK

SEQ ID NO: 1199691 - protein, 22 aa, Mycobacterium
EANKGLGPGAPVNATGLPADDP

SEQ ID NO: 1199692 - protein, 5 aa, Mycobacterium
EANLT

SEQ ID NO: 1199693 - protein, 6 aa, Mycobacterium
EANQRM

SEQ ID NO: 1199694 - protein, 6 aa, Mycobacterium
EANQRV

SEQ ID NO: 1199695 - protein, 5 aa, Mycobacterium
EANQY

SEQ ID NO: 1199696 - protein, 15 aa, Mycobacterium
EANRARDRDTDRKLA

SEQ ID NO: 1199697 - protein, 14 aa, Mycobacterium
EANRQEATRITSPE

SEQ ID NO: 1199698 - protein, 4 aa, Mycobacterium
EANS

SEQ ID NO: 1199699 - protein, 12 aa, Mycobacterium
EANSVAKQHSSA

SEQ ID NO: 1199700 - protein, 4 aa, Mycobacterium
EAPA

SEQ ID NO: 1199701 - protein, 11 aa, Mycobacterium
EAPAPVENTPV

SEQ ID NO: 1199702 - protein, 20 aa, Mycobacterium
EAPATTPAAAVATGEPSAAA

SEQ ID NO: 1199703 - protein, 13 aa, Mycobacterium
EAPDGPALPGNEA

SEQ ID NO: 1199704 - protein, 17 aa, Mycobacterium
EAPDPGDITALVDTVLA

SEQ ID NO: 1199705 - protein, 7 aa, Mycobacterium
EAPDPNE

SEQ ID NO: 1199706 - protein, 17 aa, Mycobacterium
EAPEETNRLLLDFLRGL

SEQ ID NO: 1199707 - protein, 5 aa, Mycobacterium
EAPFG

SEQ ID NO: 1199708 - protein, 7 aa, Mycobacterium
EAPFSPA

SEQ ID NO: 1199709 - protein, 9 aa, Mycobacterium
EAPGATERL

SEQ ID NO: 1199710 - protein, 9 aa, Mycobacterium
EAPKDAPMP

SEQ ID NO: 1199711 - protein, 7 aa, Mycobacterium
EAPKPRV

SEQ ID NO: 1199712 - protein, 5 aa, Mycobacterium
EAPPR

SEQ ID NO: 1199713 - protein, 13 aa, Mycobacterium
EAPPRPFTYGETQ

SEQ ID NO: 1199714 - protein, 7 aa, Mycobacterium
EAPQGDP

SEQ ID NO: 1199715 - protein, 5 aa, Mycobacterium
EAPRG

SEQ ID NO: 1199716 - protein, 34 aa, Mycobacterium
EAPRGPEAAPPWRNGEEPARAPRSVTRSTGEPRI

SEQ ID NO: 1199717 - protein, 5 aa, Mycobacterium
EAPRL

SEQ ID NO: 1199718 - protein, 7 aa, Mycobacterium
EAPRSSA

SEQ ID NO: 1199719 - protein, 5 aa, Mycobacterium
EAPRV

SEQ ID NO: 1199720 - protein, 9 aa, Mycobacterium
EAPSASPWP

SEQ ID NO: 1199721 - protein, 9 aa, Mycobacterium
EAPSLTQEQ

SEQ ID NO: 1199722 - protein, 24 aa, Mycobacterium
EAPSPETGGPQTAPPVTAKPEPSY

SEQ ID NO: 1199723 - protein, 6 aa, Mycobacterium
EAPSPL

SEQ ID NO: 1199724 - protein, 9 aa, Mycobacterium
EAPSTAVDE

SEQ ID NO: 1199725 - protein, 7 aa, Mycobacterium
EAPSYTP

SEQ ID NO: 1199726 - protein, 6 aa, Mycobacterium
EAPTGK

SEQ ID NO: 1199727 - protein, 21 aa, Mycobacterium
EAPVRPDDAHSGDAELTSPMP

SEQ ID NO: 1199728 - protein, 22 aa, Mycobacterium
EAPVRQDDAHGGDAELTSPMPG

SEQ ID NO: 1199729 - protein, 4 aa, Mycobacterium
EAQA

SEQ ID NO: 1199730 - protein, 9 aa, Mycobacterium
EAQAARDGL

SEQ ID NO: 1199731 - protein, 7 aa, Mycobacterium
EAQADDD

SEQ ID NO: 1199732 - protein, 6 aa, Mycobacterium
EAQAGV

SEQ ID NO: 1199733 - protein, 4 aa, Mycobacterium
EAQD

SEQ ID NO: 1199734 - protein, 11 aa, Mycobacterium
EAQERDPGSTL

SEQ ID NO: 1199735 - protein, 11 aa, Mycobacterium
EAQPDPLGPDS

SEQ ID NO: 1199736 - protein, 9 aa, Mycobacterium
EAQPVGDAA

SEQ ID NO: 1199737 - protein, 5 aa, Mycobacterium
EAQQH

SEQ ID NO: 1199738 - protein, 21 aa, Mycobacterium
EAQQSGADENGVAEAIMAAAN

SEQ ID NO: 1199739 - protein, 8 aa, Mycobacterium
EAQRERRK

SEQ ID NO: 1199740 - protein, 9 aa, Mycobacterium
EAQRSPSVR

SEQ ID NO: 1199741 - protein, 6 aa, Mycobacterium
EAQRTR

SEQ ID NO: 1199742 - protein, 4 aa, Mycobacterium
EARA

SEQ ID NO: 1199743 - protein, 9 aa, Mycobacterium
EARADHPNV

SEQ ID NO: 1199744 - protein, 9 aa, Mycobacterium
EARAEGGPD

SEQ ID NO: 1199745 - protein, 4 aa, Mycobacterium
EARD

SEQ ID NO: 1199746 - protein, 8 aa, Mycobacterium
EARDDTRL

SEQ ID NO: 1199747 - protein, 12 aa, Mycobacterium
EARDPEAGSSVA

SEQ ID NO: 1199748 - protein, 5 aa, Mycobacterium
EARDR

SEQ ID NO: 1199749 - protein, 6 aa, Mycobacterium
EARDWD

SEQ ID NO: 1199750 - protein, 21 aa, Mycobacterium
EAREEAQREATSGPRSNPGTA

SEQ ID NO: 1199751 - protein, 10 aa, Mycobacterium
EARGARRTSP

SEQ ID NO: 1199752 - protein, 9 aa, Mycobacterium
EARGDGGFG

SEQ ID NO: 1199753 - protein, 12 aa, Mycobacterium
EARGLGGTARNS

SEQ ID NO: 1199754 - protein, 9 aa, Mycobacterium
EARKDEAIE

SEQ ID NO: 1199755 - protein, 12 aa, Mycobacterium
EARKGLAEGGIP

SEQ ID NO: 1199756 - protein, 13 aa, Mycobacterium
EARLNEKDSGPIE

SEQ ID NO: 1199757 - protein, 4 aa, Mycobacterium
EARP

SEQ ID NO: 1199758 - protein, 14 aa, Mycobacterium
EARPDSMPTNQEAA

SEQ ID NO: 1199759 - protein, 5 aa, Mycobacterium
EARPG

SEQ ID NO: 1199760 - protein, 4 aa, Mycobacterium
EARQ

SEQ ID NO: 1199761 - protein, 17 aa, Mycobacterium
EARQTAETTVAEARQRA

SEQ ID NO: 1199762 - protein, 4 aa, Mycobacterium
EARR

SEQ ID NO: 1199763 - protein, 12 aa, Mycobacterium
EARRAQARSPLD

SEQ ID NO: 1199764 - protein, 15 aa, Mycobacterium
EARRDDAESIRRRAR

SEQ ID NO: 1199765 - protein, 6 aa, Mycobacterium
EARRGA

SEQ ID NO: 1199766 - protein, 6 aa, Mycobacterium
EARRQA

SEQ ID NO: 1199767 - protein, 7 aa, Mycobacterium
EARSAGL

SEQ ID NO: 1199768 - protein, 6 aa, Mycobacterium
EARTAD

SEQ ID NO: 1199769 - protein, 12 aa, Mycobacterium
EARTGKDAWRGS

SEQ ID NO: 1199770 - protein, 10 aa, Mycobacterium
EARTPAGAVT

SEQ ID NO: 1199771 - protein, 15 aa, Mycobacterium
EARTRSLSAARPGLS

SEQ ID NO: 1199772 - protein, 10 aa, Mycobacterium
EARVSRNGTV

SEQ ID NO: 1199773 - protein, 14 aa, Mycobacterium
EARWRDSAGEEHAA

SEQ ID NO: 1199774 - protein, 11 aa, Mycobacterium
EASADARVAEG

SEQ ID NO: 1199775 - protein, 6 aa, Mycobacterium
EASAHE

SEQ ID NO: 1199776 - protein, 14 aa, Mycobacterium
EASAHRLKPAEDHE

SEQ ID NO: 1199777 - protein, 19 aa, Mycobacterium
EASDEEGTAVVRLVDAGHL

SEQ ID NO: 1199778 - protein, 18 aa, Mycobacterium
EASDITAEYAPEDDGSIR

SEQ ID NO: 1199779 - protein, 40 aa, Mycobacterium
EASEASETTPPPAVSGSADSAPEAPPAATPPTVENPLPED

SEQ ID NO: 1199780 - protein, 10 aa, Mycobacterium
EASEPARVNE

SEQ ID NO: 1199781 - protein, 10 aa, Mycobacterium
EASGAGELTP

SEQ ID NO: 1199782 - protein, 9 aa, Mycobacterium
EASGALTLD

SEQ ID NO: 1199783 - protein, 8 aa, Mycobacterium
EASGGNPL

SEQ ID NO: 1199784 - protein, 7 aa, Mycobacterium
EASGVDA

SEQ ID NO: 1199785 - protein, 7 aa, Mycobacterium
EASGWGH

SEQ ID NO: 1199786 - protein, 4 aa, Mycobacterium
EASL

SEQ ID NO: 1199787 - protein, 9 aa, Mycobacterium
EASPEERRA

SEQ ID NO: 1199788 - protein, 7 aa, Mycobacterium
EASQPTL

SEQ ID NO: 1199789 - protein, 5 aa, Mycobacterium
EASRF

SEQ ID NO: 1199790 - protein, 8 aa, Mycobacterium
EASRQPCS

SEQ ID NO: 1199791 - protein, 6 aa, Mycobacterium
EASRRG

SEQ ID NO: 1199792 - protein, 6 aa, Mycobacterium
EASSGS

SEQ ID NO: 1199793 - protein, 7 aa, Mycobacterium
EASSLTG

SEQ ID NO: 1199794 - protein, 7 aa, Mycobacterium
EASTPVD

SEQ ID NO: 1199795 - protein, 6 aa, Mycobacterium
EATAAA

SEQ ID NO: 1199796 - protein, 13 aa, Mycobacterium
EATAAGERLPSPL

SEQ ID NO: 1199797 - protein, 10 aa, Mycobacterium
EATAAGVADD

SEQ ID NO: 1199798 - protein, 8 aa, Mycobacterium
EATANPDS

SEQ ID NO: 1199799 - protein, 12 aa, Mycobacterium
EATAQRANASFE

SEQ ID NO: 1199800 - protein, 11 aa, Mycobacterium
EATARAAAQGA

SEQ ID NO: 1199801 - protein, 7 aa, Mycobacterium
EATARGR

SEQ ID NO: 1199802 - protein, 18 aa, Mycobacterium
EATASGLRGGRPGTGESI

SEQ ID NO: 1199803 - protein, 5 aa, Mycobacterium
EATAV

SEQ ID NO: 1199804 - protein, 10 aa, Mycobacterium
EATDAERDEY

SEQ ID NO: 1199805 - protein, 12 aa, Mycobacterium
EATDAGDEPPTL

SEQ ID NO: 1199806 - protein, 7 aa, Mycobacterium
EATDNPV

SEQ ID NO: 1199807 - protein, 12 aa, Mycobacterium
EATDSATDPDRR

SEQ ID NO: 1199808 - protein, 9 aa, Mycobacterium
EATEESGID

SEQ ID NO: 1199809 - protein, 16 aa, Mycobacterium
EATETSPLGADPGLAD

SEQ ID NO: 1199810 - protein, 10 aa, Mycobacterium
EATGAPTAAH

SEQ ID NO: 1199811 - protein, 9 aa, Mycobacterium
EATGDPEAF

SEQ ID NO: 1199812 - protein, 22 aa, Mycobacterium
EATGITTSGSRGRPAELFRRVG

SEQ ID NO: 1199813 - protein, 14 aa, Mycobacterium
EATGRATAAATTPA

SEQ ID NO: 1199814 - protein, 8 aa, Mycobacterium
EATGTDTF

SEQ ID NO: 1199815 - protein, 7 aa, Mycobacterium
EATHNRL

SEQ ID NO: 1199816 - protein, 12 aa, Mycobacterium
EATKDLPAATGE

SEQ ID NO: 1199817 - protein, 9 aa, Mycobacterium
EATPAGTGL

SEQ ID NO: 1199818 - protein, 7 aa, Mycobacterium
EATPARR

SEQ ID NO: 1199819 - protein, 10 aa, Mycobacterium
EATPEERRQA

SEQ ID NO: 1199820 - protein, 12 aa, Mycobacterium
EATPSWSPQYQS

SEQ ID NO: 1199821 - protein, 10 aa, Mycobacterium
EATPTRRDRW

SEQ ID NO: 1199822 - protein, 11 aa, Mycobacterium
EATPTWSPQYQ

SEQ ID NO: 1199823 - protein, 8 aa, Mycobacterium
EATPVPAG

SEQ ID NO: 1199824 - protein, 5 aa, Mycobacterium
EATQR

SEQ ID NO: 1199825 - protein, 6 aa, Mycobacterium
EATRTA

SEQ ID NO: 1199826 - protein, 6 aa, Mycobacterium
EATTDA

SEQ ID NO: 1199827 - protein, 7 aa, Mycobacterium
EATTMTP

SEQ ID NO: 1199828 - protein, 8 aa, Mycobacterium
EATTSPAV

SEQ ID NO: 1199829 - protein, 5 aa, Mycobacterium
EATTV

SEQ ID NO: 1199830 - protein, 5 aa, Mycobacterium
EATVR

SEQ ID NO: 1199831 - protein, 12 aa, Mycobacterium
EAVAGDGMPLDS

SEQ ID NO: 1199832 - protein, 9 aa, Mycobacterium
EAVAGSPDV

SEQ ID NO: 1199833 - protein, 13 aa, Mycobacterium
EAVATSAGKPWET

SEQ ID NO: 1199834 - protein, 7 aa, Mycobacterium
EAVDGGP

SEQ ID NO: 1199835 - protein, 6 aa, Mycobacterium
EAVDRG

SEQ ID NO: 1199836 - protein, 4 aa, Mycobacterium
EAVE

SEQ ID NO: 1199837 - protein, 52 aa, Mycobacterium
EAVEDADEADSVDAGQGDEDAAESEDSTDTDDSDSSGDAASDGTGSSESGSS

SEQ ID NO: 1199838 - protein, 5 aa, Mycobacterium
EAVES

SEQ ID NO: 1199839 - protein, 4 aa, Mycobacterium
EAVG

SEQ ID NO: 1199840 - protein, 9 aa, Mycobacterium
EAVGGDEPV

SEQ ID NO: 1199841 - protein, 5 aa, Mycobacterium
EAVGR

SEQ ID NO: 1199842 - protein, 10 aa, Mycobacterium
EAVGRPAPTQ

SEQ ID NO: 1199843 - protein, 4 aa, Mycobacterium
EAVN

SEQ ID NO: 1199844 - protein, 5 aa, Mycobacterium
EAVPG

SEQ ID NO: 1199845 - protein, 6 aa, Mycobacterium
EAVPGG

SEQ ID NO: 1199846 - protein, 6 aa, Mycobacterium
EAVPRG

SEQ ID NO: 1199847 - protein, 4 aa, Mycobacterium
EAVQ

SEQ ID NO: 1199848 - protein, 4 aa, Mycobacterium
EAVR

SEQ ID NO: 1199849 - protein, 7 aa, Mycobacterium
EAVSPGE

SEQ ID NO: 1199850 - protein, 10 aa, Mycobacterium
EAVSSLPGGA

SEQ ID NO: 1199851 - protein, 15 aa, Mycobacterium
EAVTNPDGNGVRGKD

SEQ ID NO: 1199852 - protein, 15 aa, Mycobacterium
EAVTNPDGTGVRGKD

SEQ ID NO: 1199853 - protein, 11 aa, Mycobacterium
EAYKSASAHGY

SEQ ID NO: 1199854 - protein, 6 aa, Mycobacterium
EAYPDA

SEQ ID NO: 1199855 - protein, 17 aa, Mycobacterium
EAYSRDPRNVARKAENY

SEQ ID NO: 1199856 - protein, 14 aa, Mycobacterium
ECAATDDTDAFART

SEQ ID NO: 1199857 - protein, 12 aa, Mycobacterium
ECAGTNARPEQF

SEQ ID NO: 1199858 - protein, 9 aa, Mycobacterium
ECDDPEAPT

SEQ ID NO: 1199859 - protein, 8 aa, Mycobacterium
ECDSGETR

SEQ ID NO: 1199860 - protein, 6 aa, Mycobacterium
ECEPQR

SEQ ID NO: 1199861 - protein, 7 aa, Mycobacterium
ECETGQE

SEQ ID NO: 1199862 - protein, 9 aa, Mycobacterium
ECGGAGGSL

SEQ ID NO: 1199863 - protein, 5 aa, Mycobacterium
ECGKT

SEQ ID NO: 1199864 - protein, 4 aa, Mycobacterium
ECGL

SEQ ID NO: 1199865 - protein, 8 aa, Mycobacterium
ECGTDPMT

SEQ ID NO: 1199866 - protein, 10 aa, Mycobacterium
ECGTQSRQGI

SEQ ID NO: 1199867 - protein, 6 aa, Mycobacterium
ECRGSG

SEQ ID NO: 1199868 - protein, 4 aa, Mycobacterium
ECRY

SEQ ID NO: 1199869 - protein, 26 aa, Mycobacterium
ECTTGEAADGKEPLSETELEKLFLAL

SEQ ID NO: 1199870 - protein, 10 aa, Mycobacterium
EDAAARSGAD

SEQ ID NO: 1199871 - protein, 8 aa, Mycobacterium
EDAAEGTA

SEQ ID NO: 1199872 - protein, 15 aa, Mycobacterium
EDAAGRVRDQRWGPR

SEQ ID NO: 1199873 - protein, 9 aa, Mycobacterium
EDAAPGGRG

SEQ ID NO: 1199874 - protein, 8 aa, Mycobacterium
EDADEIAG

SEQ ID NO: 1199875 - protein, 9 aa, Mycobacterium
EDADQDAIT

SEQ ID NO: 1199876 - protein, 9 aa, Mycobacterium
EDADRDAIA

SEQ ID NO: 1199877 - protein, 15 aa, Mycobacterium
EDADRLAGEDGDYHQ

SEQ ID NO: 1199878 - protein, 5 aa, Mycobacterium
EDADW

SEQ ID NO: 1199879 - protein, 8 aa, Mycobacterium
EDAEARAY

SEQ ID NO: 1199880 - protein, 33 aa, Mycobacterium
EDAEFTPPQQPHPSKPAATAAPMTKRTTAATTI

SEQ ID NO: 1199881 - protein, 6 aa, Mycobacterium
EDAESY

SEQ ID NO: 1199882 - protein, 7 aa, Mycobacterium
EDAGADF

SEQ ID NO: 1199883 - protein, 6 aa, Mycobacterium
EDAGAR

SEQ ID NO: 1199884 - protein, 8 aa, Mycobacterium
EDAGEDLP

SEQ ID NO: 1199885 - protein, 15 aa, Mycobacterium
EDAGGLATSARAARD

SEQ ID NO: 1199886 - protein, 10 aa, Mycobacterium
EDAGLTPESG

SEQ ID NO: 1199887 - protein, 14 aa, Mycobacterium
EDAGWQDAPYDPDA

SEQ ID NO: 1199888 - protein, 8 aa, Mycobacterium
EDAKSPFA

SEQ ID NO: 1199889 - protein, 14 aa, Mycobacterium
EDAPSAAPETPTET

SEQ ID NO: 1199890 - protein, 4 aa, Mycobacterium
EDAR

SEQ ID NO: 1199891 - protein, 9 aa, Mycobacterium
EDARPAQEE

SEQ ID NO: 1199892 - protein, 8 aa, Mycobacterium
EDASRSLE

SEQ ID NO: 1199893 - protein, 8 aa, Mycobacterium
EDATDAAA

SEQ ID NO: 1199894 - protein, 9 aa, Mycobacterium
EDATDPASI

SEQ ID NO: 1199895 - protein, 8 aa, Mycobacterium
EDATNRFS

SEQ ID NO: 1199896 - protein, 7 aa, Mycobacterium
EDAVAEG

SEQ ID NO: 1199897 - protein, 10 aa, Mycobacterium
EDAYGAADSS

SEQ ID NO: 1199898 - protein, 17 aa, Mycobacterium
EDDALREARAAGQAAGM

SEQ ID NO: 1199899 - protein, 6 aa, Mycobacterium
EDDAVD

SEQ ID NO: 1199900 - protein, 11 aa, Mycobacterium
EDDDAPKSDRW

SEQ ID NO: 1199901 - protein, 4 aa, Mycobacterium
EDDE

SEQ ID NO: 1199902 - protein, 7 aa, Mycobacterium
EDDEIGE

SEQ ID NO: 1199903 - protein, 11 aa, Mycobacterium
EDDEKAHGDLP

SEQ ID NO: 1199904 - protein, 8 aa, Mycobacterium
EDDELDPD

SEQ ID NO: 1199905 - protein, 7 aa, Mycobacterium
EDDEPDR

SEQ ID NO: 1199906 - protein, 6 aa, Mycobacterium
EDDETE

SEQ ID NO: 1199907 - protein, 6 aa, Mycobacterium
EDDGSY

SEQ ID NO: 1199908 - protein, 9 aa, Mycobacterium
EDDLDGAEE

SEQ ID NO: 1199909 - protein, 8 aa, Mycobacterium
EDDLEETA

SEQ ID NO: 1199910 - protein, 6 aa, Mycobacterium
EDDLGG

SEQ ID NO: 1199911 - protein, 17 aa, Mycobacterium
EDDPLKTPYPYVGAGQM

SEQ ID NO: 1199912 - protein, 18 aa, Mycobacterium
EDDPQPGWYDTESGDLVD

SEQ ID NO: 1199913 - protein, 6 aa, Mycobacterium
EDDVAA

SEQ ID NO: 1199914 - protein, 8 aa, Mycobacterium
EDDVDDRR

SEQ ID NO: 1199915 - protein, 8 aa, Mycobacterium
EDDYPSAE

SEQ ID NO: 1199916 - protein, 50 aa, Mycobacterium
EDDYYEDDDRVPARGYRRPREDRFEDEAYPRGYDDRAREYDEPAGYRGGF

SEQ ID NO: 1199917 - protein, 8 aa, Mycobacterium
EDEATGAA

SEQ ID NO: 1199918 - protein, 8 aa, Mycobacterium
EDEDDAVR

SEQ ID NO: 1199919 - protein, 4 aa, Mycobacterium
EDEE

SEQ ID NO: 1199920 - protein, 9 aa, Mycobacterium
EDELDATGC

SEQ ID NO: 1199921 - protein, 6 aa, Mycobacterium
EDELDR

SEQ ID NO: 1199922 - protein, 6 aa, Mycobacterium
EDELNR

SEQ ID NO: 1199923 - protein, 9 aa, Mycobacterium
EDEPDDVTA

SEQ ID NO: 1199924 - protein, 8 aa, Mycobacterium
EDEPQFSA

SEQ ID NO: 1199925 - protein, 10 aa, Mycobacterium
EDEQFSDTAT

SEQ ID NO: 1199926 - protein, 23 aa, Mycobacterium
EDFADDADEDAAAEDAPVPPLDG

SEQ ID NO: 1199927 - protein, 20 aa, Mycobacterium
EDFAGTSARVRAKKDDGSWG

SEQ ID NO: 1199928 - protein, 15 aa, Mycobacterium
EDFPKETKLAPRGLP

SEQ ID NO: 1199929 - protein, 21 aa, Mycobacterium
EDFPNPDDFDPDRYEKPRQED

SEQ ID NO: 1199930 - protein, 4 aa, Mycobacterium
EDGA

SEQ ID NO: 1199931 - protein, 41 aa, Mycobacterium
EDGAAQRGELPPCRRPGVGTGQSDDVRDQRRHRQPRGQREI

SEQ ID NO: 1199932 - protein, 6 aa, Mycobacterium
EDGADD

SEQ ID NO: 1199933 - protein, 9 aa, Mycobacterium
EDGAELPAR

SEQ ID NO: 1199934 - protein, 10 aa, Mycobacterium
EDGDAARALA

SEQ ID NO: 1199935 - protein, 5 aa, Mycobacterium
EDGDE

SEQ ID NO: 1199936 - protein, 7 aa, Mycobacterium
EDGDGRI

SEQ ID NO: 1199937 - protein, 8 aa, Mycobacterium
EDGDRPIE

SEQ ID NO: 1199938 - protein, 14 aa, Mycobacterium
EDGEAVSGKLSQDG

SEQ ID NO: 1199939 - protein, 12 aa, Mycobacterium
EDGEELPPGQAG

SEQ ID NO: 1199940 - protein, 11 aa, Mycobacterium
EDGGPPDSTVT

SEQ ID NO: 1199941 - protein, 27 aa, Mycobacterium
EDGGYSATVTTPERDNAVALAGVEFVP

SEQ ID NO: 1199942 - protein, 4 aa, Mycobacterium
EDGI

SEQ ID NO: 1199943 - protein, 4 aa, Mycobacterium
EDGL

SEQ ID NO: 1199944 - protein, 5 aa, Mycobacterium
EDGLP

SEQ ID NO: 1199945 - protein, 20 aa, Mycobacterium
EDGLPEDDLPEDDLPEDGQG

SEQ ID NO: 1199946 - protein, 5 aa, Mycobacterium
EDGMR

SEQ ID NO: 1199947 - protein, 7 aa, Mycobacterium
EDGPSIA

SEQ ID NO: 1199948 - protein, 6 aa, Mycobacterium
EDGPVQ

SEQ ID NO: 1199949 - protein, 7 aa, Mycobacterium
EDGQSLA

SEQ ID NO: 1199950 - protein, 8 aa, Mycobacterium
EDGQTYRV

SEQ ID NO: 1199951 - protein, 15 aa, Mycobacterium
EDGRAAAEKIETAPW

SEQ ID NO: 1199952 - protein, 27 aa, Mycobacterium
EDGRSTARGGSVMTSTAGHPITTAKEK

SEQ ID NO: 1199953 - protein, 7 aa, Mycobacterium
EDGRVTG

SEQ ID NO: 1199954 - protein, 7 aa, Mycobacterium
EDGSAVD

SEQ ID NO: 1199955 - protein, 8 aa, Mycobacterium
EDGSDREV

SEQ ID NO: 1199956 - protein, 8 aa, Mycobacterium
EDGSLSGR

SEQ ID NO: 1199957 - protein, 6 aa, Mycobacterium
EDGSPI

SEQ ID NO: 1199958 - protein, 16 aa, Mycobacterium
EDGSPVRGVAGGTERV

SEQ ID NO: 1199959 - protein, 6 aa, Mycobacterium
EDGSTL

SEQ ID NO: 1199960 - protein, 5 aa, Mycobacterium
EDGSV

SEQ ID NO: 1199961 - protein, 4 aa, Mycobacterium
EDGT

SEQ ID NO: 1199962 - protein, 7 aa, Mycobacterium
EDGTALS

SEQ ID NO: 1199963 - protein, 12 aa, Mycobacterium
EDGTPLGPDQPG

SEQ ID NO: 1199964 - protein, 9 aa, Mycobacterium
EDGTRLEPG

SEQ ID NO: 1199965 - protein, 12 aa, Mycobacterium
EDGTVLGPNETG

SEQ ID NO: 1199966 - protein, 28 aa, Mycobacterium
EDHAAEAQQRWGDTEAWRQSRQRTARMS

SEQ ID NO: 1199967 - protein, 9 aa, Mycobacterium
EDHDGRQRG

SEQ ID NO: 1199968 - protein, 10 aa, Mycobacterium
EDHKRPNSDV

SEQ ID NO: 1199969 - protein, 7 aa, Mycobacterium
EDHRGKR

SEQ ID NO: 1199970 - protein, 13 aa, Mycobacterium
EDIEDDEAKAAET

SEQ ID NO: 1199971 - protein, 5 aa, Mycobacterium
EDIEG

SEQ ID NO: 1199972 - protein, 4 aa, Mycobacterium
EDIP

SEQ ID NO: 1199973 - protein, 9 aa, Mycobacterium
EDIPDDDEG

SEQ ID NO: 1199974 - protein, 8 aa, Mycobacterium
EDIPGSAL

SEQ ID NO: 1199975 - protein, 8 aa, Mycobacterium
EDKGEARI

SEQ ID NO: 1199976 - protein, 7 aa, Mycobacterium
EDKGMRD

SEQ ID NO: 1199977 - protein, 7 aa, Mycobacterium
EDKGPEL

SEQ ID NO: 1199978 - protein, 7 aa, Mycobacterium
EDKSTVE

SEQ ID NO: 1199979 - protein, 4 aa, Mycobacterium
EDKT

SEQ ID NO: 1199980 - protein, 6 aa, Mycobacterium
EDLEET

SEQ ID NO: 1199981 - protein, 5 aa, Mycobacterium
EDLGA

SEQ ID NO: 1199982 - protein, 9 aa, Mycobacterium
EDLGAYPRT

SEQ ID NO: 1199983 - protein, 11 aa, Mycobacterium
EDLGGAGYGAS

SEQ ID NO: 1199984 - protein, 12 aa, Mycobacterium
EDLGPTGPLPRQ

SEQ ID NO: 1199985 - protein, 6 aa, Mycobacterium
EDLGSG

SEQ ID NO: 1199986 - protein, 7 aa, Mycobacterium
EDLSGDE

SEQ ID NO: 1199987 - protein, 5 aa, Mycobacterium
EDLTR

SEQ ID NO: 1199988 - protein, 5 aa, Mycobacterium
EDMNA

SEQ ID NO: 1199989 - protein, 5 aa, Mycobacterium
EDMPE

SEQ ID NO: 1199990 - protein, 7 aa, Mycobacterium
EDMPTDR

SEQ ID NO: 1199991 - protein, 20 aa, Mycobacterium
EDMRSAGDGTAAPAGDLGDE

SEQ ID NO: 1199992 - protein, 27 aa, Mycobacterium
EDNAKSVIEQSQETVAAATAGAPPPEV

SEQ ID NO: 1199993 - protein, 7 aa, Mycobacterium
EDNEQLR

SEQ ID NO: 1199994 - protein, 4 aa, Mycobacterium
EDNG

SEQ ID NO: 1199995 - protein, 8 aa, Mycobacterium
EDNIYQTE

SEQ ID NO: 1199996 - protein, 15 aa, Mycobacterium
EDNLPEDDLPEDDQG

SEQ ID NO: 1199997 - protein, 10 aa, Mycobacterium
EDNPEGTPKE

SEQ ID NO: 1199998 - protein, 8 aa, Mycobacterium
EDNRATAL

SEQ ID NO: 1199999 - protein, 4 aa, Mycobacterium
EDPA

SEQ ID NO: 1200000 - protein, 8 aa, Mycobacterium
EDPATAEA

SEQ ID NO: 1200001 - protein, 12 aa, Mycobacterium
EDPATARATARR

SEQ ID NO: 1200002 - protein, 10 aa, Mycobacterium
EDPDPGNGVE

SEQ ID NO: 1200003 - protein, 15 aa, Mycobacterium
EDPDREGLRDTPARV

SEQ ID NO: 1200004 - protein, 5 aa, Mycobacterium
EDPDS

SEQ ID NO: 1200005 - protein, 9 aa, Mycobacterium
EDPDSGTVR

SEQ ID NO: 1200006 - protein, 6 aa, Mycobacterium
EDPDSV

SEQ ID NO: 1200007 - protein, 10 aa, Mycobacterium
EDPDTAETLT

SEQ ID NO: 1200008 - protein, 9 aa, Mycobacterium
EDPDTGNRV

SEQ ID NO: 1200009 - protein, 5 aa, Mycobacterium
EDPHE

SEQ ID NO: 1200010 - protein, 9 aa, Mycobacterium
EDPLAPAAG

SEQ ID NO: 1200011 - protein, 6 aa, Mycobacterium
EDPMAP

SEQ ID NO: 1200012 - protein, 9 aa, Mycobacterium
EDPPGQCRQ

SEQ ID NO: 1200013 - protein, 8 aa, Mycobacterium
EDPRGLGG

SEQ ID NO: 1200014 - protein, 6 aa, Mycobacterium
EDPRGM

SEQ ID NO: 1200015 - protein, 7 aa, Mycobacterium
EDPRLGS

SEQ ID NO: 1200016 - protein, 6 aa, Mycobacterium
EDPRRS

SEQ ID NO: 1200017 - protein, 13 aa, Mycobacterium
EDPRTADERRNDA

SEQ ID NO: 1200018 - protein, 6 aa, Mycobacterium
EDPSAR

SEQ ID NO: 1200019 - protein, 8 aa, Mycobacterium
EDPSHGVD

SEQ ID NO: 1200020 - protein, 7 aa, Mycobacterium
EDPTRLE

SEQ ID NO: 1200021 - protein, 13 aa, Mycobacterium
EDPVGPEDGFSGR

SEQ ID NO: 1200022 - protein, 43 aa, Mycobacterium
EDPVVDPEPEAEAPAAETAPTAESPPPAAAPAAPSGGPRPDDI

SEQ ID NO: 1200023 - protein, 8 aa, Mycobacterium
EDQGRDPV

SEQ ID NO: 1200024 - protein, 4 aa, Mycobacterium
EDQL

SEQ ID NO: 1200025 - protein, 6 aa, Mycobacterium
EDQPRE

SEQ ID NO: 1200026 - protein, 22 aa, Mycobacterium
EDQPRPAGRARSSTQEPAGNRE

SEQ ID NO: 1200027 - protein, 6 aa, Mycobacterium
EDQQLG

SEQ ID NO: 1200028 - protein, 6 aa, Mycobacterium
EDRAAR

SEQ ID NO: 1200029 - protein, 6 aa, Mycobacterium
EDRARR

SEQ ID NO: 1200030 - protein, 9 aa, Mycobacterium
EDRDPADTV

SEQ ID NO: 1200031 - protein, 6 aa, Mycobacterium
EDREAE

SEQ ID NO: 1200032 - protein, 36 aa, Mycobacterium
EDREQQDKLADKQAKAKEQGKAESQPQTEPIPQAEA

SEQ ID NO: 1200033 - protein, 6 aa, Mycobacterium
EDRGEF

SEQ ID NO: 1200034 - protein, 9 aa, Mycobacterium
EDRHADSIT

SEQ ID NO: 1200035 - protein, 11 aa, Mycobacterium
EDRKGVELNPQ

SEQ ID NO: 1200036 - protein, 20 aa, Mycobacterium
EDRLSGLSKREARKHLLPVA

SEQ ID NO: 1200037 - protein, 9 aa, Mycobacterium
EDRPAPGLV

SEQ ID NO: 1200038 - protein, 8 aa, Mycobacterium
EDRPARSA

SEQ ID NO: 1200039 - protein, 9 aa, Mycobacterium
EDRPDEDSF

SEQ ID NO: 1200040 - protein, 7 aa, Mycobacterium
EDRPDLE

SEQ ID NO: 1200041 - protein, 19 aa, Mycobacterium
EDRPGPGLARGECGDPPKT

SEQ ID NO: 1200042 - protein, 6 aa, Mycobacterium
EDRPNH

SEQ ID NO: 1200043 - protein, 10 aa, Mycobacterium
EDRRAAENER

SEQ ID NO: 1200044 - protein, 8 aa, Mycobacterium
EDRRHRGE

SEQ ID NO: 1200045 - protein, 12 aa, Mycobacterium
EDRSGGPGLAGD

SEQ ID NO: 1200046 - protein, 6 aa, Mycobacterium
EDRTAT

SEQ ID NO: 1200047 - protein, 8 aa, Mycobacterium
EDRVAESD

SEQ ID NO: 1200048 - protein, 10 aa, Mycobacterium
EDSAASFASG

SEQ ID NO: 1200049 - protein, 18 aa, Mycobacterium
EDSAEAALESRTGEDGSL

SEQ ID NO: 1200050 - protein, 7 aa, Mycobacterium
EDSDPAI

SEQ ID NO: 1200051 - protein, 7 aa, Mycobacterium
EDSGDAM

SEQ ID NO: 1200052 - protein, 5 aa, Mycobacterium
EDSGR

SEQ ID NO: 1200053 - protein, 8 aa, Mycobacterium
EDSGTDDL

SEQ ID NO: 1200054 - protein, 7 aa, Mycobacterium
EDSKRAV

SEQ ID NO: 1200055 - protein, 8 aa, Mycobacterium
EDSPRKGI

SEQ ID NO: 1200056 - protein, 6 aa, Mycobacterium
EDSQTV

SEQ ID NO: 1200057 - protein, 10 aa, Mycobacterium
EDSTAVPEGF

SEQ ID NO: 1200058 - protein, 6 aa, Mycobacterium
EDSVDD

SEQ ID NO: 1200059 - protein, 9 aa, Mycobacterium
EDTADEADL

SEQ ID NO: 1200060 - protein, 17 aa, Mycobacterium
EDTAEVAAGSRVQLWDL

SEQ ID NO: 1200061 - protein, 5 aa, Mycobacterium
EDTAG

SEQ ID NO: 1200062 - protein, 10 aa, Mycobacterium
EDTASALDDA

SEQ ID NO: 1200063 - protein, 5 aa, Mycobacterium
EDTDD

SEQ ID NO: 1200064 - protein, 4 aa, Mycobacterium
EDTF

SEQ ID NO: 1200065 - protein, 10 aa, Mycobacterium
EDTGNGAVTA

SEQ ID NO: 1200066 - protein, 7 aa, Mycobacterium
EDTKRNV

SEQ ID NO: 1200067 - protein, 6 aa, Mycobacterium
EDTLDE

SEQ ID NO: 1200068 - protein, 14 aa, Mycobacterium
EDTPNGWDPFGPDM

SEQ ID NO: 1200069 - protein, 6 aa, Mycobacterium
EDTQAA

SEQ ID NO: 1200070 - protein, 6 aa, Mycobacterium
EDTSTR

SEQ ID NO: 1200071 - protein, 23 aa, Mycobacterium
EDTTIPASSTVSWGGTGENRADN

SEQ ID NO: 1200072 - protein, 9 aa, Mycobacterium
EDTTRPPSL

SEQ ID NO: 1200073 - protein, 20 aa, Mycobacterium
EDTWNDTQRVGEERDWQASE

SEQ ID NO: 1200074 - protein, 14 aa, Mycobacterium
EDVADGTALGVQGT

SEQ ID NO: 1200075 - protein, 5 aa, Mycobacterium
EDVAQ

SEQ ID NO: 1200076 - protein, 4 aa, Mycobacterium
EDVD

SEQ ID NO: 1200077 - protein, 8 aa, Mycobacterium
EDVGGSGF

SEQ ID NO: 1200078 - protein, 4 aa, Mycobacterium
EDVP

SEQ ID NO: 1200079 - protein, 21 aa, Mycobacterium
EDVPDGPEPGGAAAGGRGMEQ

SEQ ID NO: 1200080 - protein, 8 aa, Mycobacterium
EDVPEEDI

SEQ ID NO: 1200081 - protein, 11 aa, Mycobacterium
EDVSAEIRGDA

SEQ ID NO: 1200082 - protein, 10 aa, Mycobacterium
EDVSEEADDL

SEQ ID NO: 1200083 - protein, 5 aa, Mycobacterium
EDVSN

SEQ ID NO: 1200084 - protein, 4 aa, Mycobacterium
EDVT

SEQ ID NO: 1200085 - protein, 13 aa, Mycobacterium
EDVTPEQAAAHPT

SEQ ID NO: 1200086 - protein, 7 aa, Mycobacterium
EDWQSNP

SEQ ID NO: 1200087 - protein, 15 aa, Mycobacterium
EDYDRVPADDPNPEQ

SEQ ID NO: 1200088 - protein, 16 aa, Mycobacterium
EDYDRVPADEPNPEQI

SEQ ID NO: 1200089 - protein, 9 aa, Mycobacterium
EDYGPHPPG

SEQ ID NO: 1200090 - protein, 10 aa, Mycobacterium
EDYKRPNADV

SEQ ID NO: 1200091 - protein, 9 aa, Mycobacterium
EEAAARDSA

SEQ ID NO: 1200092 - protein, 9 aa, Mycobacterium
EEAADAAGV

SEQ ID NO: 1200093 - protein, 29 aa, Mycobacterium
EEADDAAASLSELTGRPARTLSSEPEAAA

SEQ ID NO: 1200094 - protein, 6 aa, Mycobacterium
EEADLA

SEQ ID NO: 1200095 - protein, 5 aa, Mycobacterium
EEAGA

SEQ ID NO: 1200096 - protein, 6 aa, Mycobacterium
EEAGAL

SEQ ID NO: 1200097 - protein, 12 aa, Mycobacterium
EEAGGLGAGPQQ

SEQ ID NO: 1200098 - protein, 6 aa, Mycobacterium
EEAGRP

SEQ ID NO: 1200099 - protein, 5 aa, Mycobacterium
EEAGS

SEQ ID NO: 1200100 - protein, 5 aa, Mycobacterium
EEAKT

SEQ ID NO: 1200101 - protein, 12 aa, Mycobacterium
EEALSGASEATG

SEQ ID NO: 1200102 - protein, 4 aa, Mycobacterium
EEAN

SEQ ID NO: 1200103 - protein, 10 aa, Mycobacterium
EEAPAPALPE

SEQ ID NO: 1200104 - protein, 7 aa, Mycobacterium
EEAPHNS

SEQ ID NO: 1200105 - protein, 16 aa, Mycobacterium
EEAPSPLLDPQTRARI

SEQ ID NO: 1200106 - protein, 7 aa, Mycobacterium
EEAQGRR

SEQ ID NO: 1200107 - protein, 7 aa, Mycobacterium
EEAQRAK

SEQ ID NO: 1200108 - protein, 15 aa, Mycobacterium
EEARGAARQQGKNVG

SEQ ID NO: 1200109 - protein, 8 aa, Mycobacterium
EEARSARN

SEQ ID NO: 1200110 - protein, 12 aa, Mycobacterium
EEARVTKQTAGA

SEQ ID NO: 1200111 - protein, 8 aa, Mycobacterium
EEASELSD

SEQ ID NO: 1200112 - protein, 12 aa, Mycobacterium
EEASKRLDGIRE

SEQ ID NO: 1200113 - protein, 12 aa, Mycobacterium
EEATAGGTARYV

SEQ ID NO: 1200114 - protein, 8 aa, Mycobacterium
EEATQRHN

SEQ ID NO: 1200115 - protein, 12 aa, Mycobacterium
EEATRRLDAIRD

SEQ ID NO: 1200116 - protein, 6 aa, Mycobacterium
EEATRT

SEQ ID NO: 1200117 - protein, 7 aa, Mycobacterium
EEAVKEL

SEQ ID NO: 1200118 - protein, 19 aa, Mycobacterium
EEAVKGAVEGVKGKAKEVA

SEQ ID NO: 1200119 - protein, 10 aa, Mycobacterium
EEDAARALGG

SEQ ID NO: 1200120 - protein, 8 aa, Mycobacterium
EEDARARI

SEQ ID NO: 1200121 - protein, 6 aa, Mycobacterium
EEDDDG

SEQ ID NO: 1200122 - protein, 11 aa, Mycobacterium
EEDDSDEGPAT

SEQ ID NO: 1200123 - protein, 5 aa, Mycobacterium
EEDGA

SEQ ID NO: 1200124 - protein, 6 aa, Mycobacterium
EEDGPV

SEQ ID NO: 1200125 - protein, 4 aa, Mycobacterium
EEDP

SEQ ID NO: 1200126 - protein, 18 aa, Mycobacterium
EEDQRRVTDHGEATLQSD

SEQ ID NO: 1200127 - protein, 8 aa, Mycobacterium
EEDSRGRT

SEQ ID NO: 1200128 - protein, 14 aa, Mycobacterium
EEEAASVRAEHGPA

SEQ ID NO: 1200129 - protein, 16 aa, Mycobacterium
EEEADSSGVFQPANAP

SEQ ID NO: 1200130 - protein, 5 aa, Mycobacterium
EEEEA

SEQ ID NO: 1200131 - protein, 5 aa, Mycobacterium
EEEHS

SEQ ID NO: 1200132 - protein, 15 aa, Mycobacterium
EEEKAAARATDTRAA

SEQ ID NO: 1200133 - protein, 18 aa, Mycobacterium
EEENPEAAAAIRAQITGD

SEQ ID NO: 1200134 - protein, 9 aa, Mycobacterium
EEEPDRGSN

SEQ ID NO: 1200135 - protein, 6 aa, Mycobacterium
EEEVGG

SEQ ID NO: 1200136 - protein, 4 aa, Mycobacterium
EEFG

SEQ ID NO: 1200137 - protein, 8 aa, Mycobacterium
EEFGGESV

SEQ ID NO: 1200138 - protein, 10 aa, Mycobacterium
EEFGGGGAGM

SEQ ID NO: 1200139 - protein, 5 aa, Mycobacterium
EEGAD

SEQ ID NO: 1200140 - protein, 34 aa, Mycobacterium
EEGAEDSVGDGAARSEAPLTDAADAGADVPGRDL

SEQ ID NO: 1200141 - protein, 9 aa, Mycobacterium
EEGDEIGGN

SEQ ID NO: 1200142 - protein, 6 aa, Mycobacterium
EEGEGP

SEQ ID NO: 1200143 - protein, 5 aa, Mycobacterium
EEGEV

SEQ ID NO: 1200144 - protein, 4 aa, Mycobacterium
EEGG

SEQ ID NO: 1200145 - protein, 6 aa, Mycobacterium
EEGGAL

SEQ ID NO: 1200146 - protein, 8 aa, Mycobacterium
EEGGEVTD

SEQ ID NO: 1200147 - protein, 10 aa, Mycobacterium
EEGKAQVNGD

SEQ ID NO: 1200148 - protein, 6 aa, Mycobacterium
EEGKEP

SEQ ID NO: 1200149 - protein, 9 aa, Mycobacterium
EEGKTVAEA

SEQ ID NO: 1200150 - protein, 4 aa, Mycobacterium
EEGN

SEQ ID NO: 1200151 - protein, 7 aa, Mycobacterium
EEGQTVA

SEQ ID NO: 1200152 - protein, 8 aa, Mycobacterium
EEGRGFDG

SEQ ID NO: 1200153 - protein, 11 aa, Mycobacterium
EEHGGADGTVS

SEQ ID NO: 1200154 - protein, 8 aa, Mycobacterium
EEHGGRGL

SEQ ID NO: 1200155 - protein, 17 aa, Mycobacterium
EEIPGGVRTTTESDSAD

SEQ ID NO: 1200156 - protein, 18 aa, Mycobacterium
EEIPGGVRTTTESDSADL

SEQ ID NO: 1200157 - protein, 7 aa, Mycobacterium
EEIPPAR

SEQ ID NO: 1200158 - protein, 7 aa, Mycobacterium
EEIRGSS

SEQ ID NO: 1200159 - protein, 5 aa, Mycobacterium
EEKAA

SEQ ID NO: 1200160 - protein, 9 aa, Mycobacterium
EEKLGPTGE

SEQ ID NO: 1200161 - protein, 12 aa, Mycobacterium
EEKSDAAKKVRE

SEQ ID NO: 1200162 - protein, 6 aa, Mycobacterium
EEKSNR

SEQ ID NO: 1200163 - protein, 5 aa, Mycobacterium
EEKSS

SEQ ID NO: 1200164 - protein, 9 aa, Mycobacterium
EEKTAQAVD

SEQ ID NO: 1200165 - protein, 7 aa, Mycobacterium
EEKVAAA

SEQ ID NO: 1200166 - protein, 16 aa, Mycobacterium
EELADQPDKVADSQGA

SEQ ID NO: 1200167 - protein, 4 aa, Mycobacterium
EELD

SEQ ID NO: 1200168 - protein, 7 aa, Mycobacterium
EELEAGR

SEQ ID NO: 1200169 - protein, 31 aa, Mycobacterium
EELETTNEELQSTNEELETTNEELQSTNDEL

SEQ ID NO: 1200170 - protein, 12 aa, Mycobacterium
EELGEKTGIDPV

SEQ ID NO: 1200171 - protein, 8 aa, Mycobacterium
EELGGGDL

SEQ ID NO: 1200172 - protein, 5 aa, Mycobacterium
EELGH

SEQ ID NO: 1200173 - protein, 10 aa, Mycobacterium
EELGNTPAVA

SEQ ID NO: 1200174 - protein, 10 aa, Mycobacterium
EELGPTESTS

SEQ ID NO: 1200175 - protein, 9 aa, Mycobacterium
EELRGDGVP

SEQ ID NO: 1200176 - protein, 5 aa, Mycobacterium
EELSA

SEQ ID NO: 1200177 - protein, 6 aa, Mycobacterium
EELSAE

SEQ ID NO: 1200178 - protein, 8 aa, Mycobacterium
EELTGTAG

SEQ ID NO: 1200179 - protein, 9 aa, Mycobacterium
EEMEEARAR

SEQ ID NO: 1200180 - protein, 6 aa, Mycobacterium
EEMGQS

SEQ ID NO: 1200181 - protein, 5 aa, Mycobacterium
EEMTP

SEQ ID NO: 1200182 - protein, 10 aa, Mycobacterium
EENAKARGAT

SEQ ID NO: 1200183 - protein, 5 aa, Mycobacterium
EENGG

SEQ ID NO: 1200184 - protein, 4 aa, Mycobacterium
EENR

SEQ ID NO: 1200185 - protein, 8 aa, Mycobacterium
EENTAQIG

SEQ ID NO: 1200186 - protein, 22 aa, Mycobacterium
EEPAGGRTGPEDHGREGGMATR

SEQ ID NO: 1200187 - protein, 9 aa, Mycobacterium
EEPAPPGGA

SEQ ID NO: 1200188 - protein, 5 aa, Mycobacterium
EEPDR

SEQ ID NO: 1200189 - protein, 6 aa, Mycobacterium
EEPEGH

SEQ ID NO: 1200190 - protein, 10 aa, Mycobacterium
EEPGGSAAET

SEQ ID NO: 1200191 - protein, 5 aa, Mycobacterium
EEPGV

SEQ ID NO: 1200192 - protein, 7 aa, Mycobacterium
EEPIDHT

SEQ ID NO: 1200193 - protein, 9 aa, Mycobacterium
EEPIHEGKD

SEQ ID NO: 1200194 - protein, 4 aa, Mycobacterium
EEPM

SEQ ID NO: 1200195 - protein, 10 aa, Mycobacterium
EEPRTDSERA

SEQ ID NO: 1200196 - protein, 9 aa, Mycobacterium
EEPSQGSVQ

SEQ ID NO: 1200197 - protein, 14 aa, Mycobacterium
EEQARAAAAGDDEA

SEQ ID NO: 1200198 - protein, 35 aa, Mycobacterium
EEQESAERPNALRERAQQRAAARQRAASRRKVGPR

SEQ ID NO: 1200199 - protein, 10 aa, Mycobacterium
EEQGAPITPA

SEQ ID NO: 1200200 - protein, 9 aa, Mycobacterium
EEQGVDEES

SEQ ID NO: 1200201 - protein, 5 aa, Mycobacterium
EEQQL

SEQ ID NO: 1200202 - protein, 6 aa, Mycobacterium
EEQREA

SEQ ID NO: 1200203 - protein, 5 aa, Mycobacterium
EEQRK

SEQ ID NO: 1200204 - protein, 9 aa, Mycobacterium
EEQRKAYGG

SEQ ID NO: 1200205 - protein, 5 aa, Mycobacterium
EEQRQ

SEQ ID NO: 1200206 - protein, 6 aa, Mycobacterium
EERATG

SEQ ID NO: 1200207 - protein, 12 aa, Mycobacterium
EERATPPYEPDT

SEQ ID NO: 1200208 - protein, 17 aa, Mycobacterium
EERFGGDDAVRPEFGSP

SEQ ID NO: 1200209 - protein, 6 aa, Mycobacterium
EERMTA

SEQ ID NO: 1200210 - protein, 6 aa, Mycobacterium
EERNNQ

SEQ ID NO: 1200211 - protein, 7 aa, Mycobacterium
EERPDEV

SEQ ID NO: 1200212 - protein, 5 aa, Mycobacterium
EERPE

SEQ ID NO: 1200213 - protein, 11 aa, Mycobacterium
EERPGRPDDDP

SEQ ID NO: 1200214 - protein, 11 aa, Mycobacterium
EERPPGAGSHE

SEQ ID NO: 1200215 - protein, 15 aa, Mycobacterium
EERPRDLTPTPGQAL

SEQ ID NO: 1200216 - protein, 8 aa, Mycobacterium
EERQGTST

SEQ ID NO: 1200217 - protein, 13 aa, Mycobacterium
EERRAAIQRSGAS

SEQ ID NO: 1200218 - protein, 11 aa, Mycobacterium
EERSAAVSQAR

SEQ ID NO: 1200219 - protein, 7 aa, Mycobacterium
EERSGAR

SEQ ID NO: 1200220 - protein, 5 aa, Mycobacterium
EERSP

SEQ ID NO: 1200221 - protein, 8 aa, Mycobacterium
EERTGKTF

SEQ ID NO: 1200222 - protein, 5 aa, Mycobacterium
EESAI

SEQ ID NO: 1200223 - protein, 7 aa, Mycobacterium
EESARRL

SEQ ID NO: 1200224 - protein, 14 aa, Mycobacterium
EESGSAGDAAGMGG

SEQ ID NO: 1200225 - protein, 7 aa, Mycobacterium
EESIRRE

SEQ ID NO: 1200226 - protein, 7 aa, Mycobacterium
EESKKAT

SEQ ID NO: 1200227 - protein, 9 aa, Mycobacterium
EESLGSRDA

SEQ ID NO: 1200228 - protein, 9 aa, Mycobacterium
EESNPDPVE

SEQ ID NO: 1200229 - protein, 6 aa, Mycobacterium
EESPAI

SEQ ID NO: 1200230 - protein, 8 aa, Mycobacterium
EESQRDAE

SEQ ID NO: 1200231 - protein, 4 aa, Mycobacterium
EESR

SEQ ID NO: 1200232 - protein, 5 aa, Mycobacterium
EESRD

SEQ ID NO: 1200233 - protein, 19 aa, Mycobacterium
EESRKGPNTDDKNQKIPNI

SEQ ID NO: 1200234 - protein, 4 aa, Mycobacterium
EESS

SEQ ID NO: 1200235 - protein, 6 aa, Mycobacterium
EESSGS

SEQ ID NO: 1200236 - protein, 11 aa, Mycobacterium
EESTKARAPYQ

SEQ ID NO: 1200237 - protein, 13 aa, Mycobacterium
EESVGDGACPNVE

SEQ ID NO: 1200238 - protein, 5 aa, Mycobacterium
EESVP

SEQ ID NO: 1200239 - protein, 4 aa, Mycobacterium
EETA

SEQ ID NO: 1200240 - protein, 6 aa, Mycobacterium
EETADA

SEQ ID NO: 1200241 - protein, 13 aa, Mycobacterium
EETDDGLSGEEGT

SEQ ID NO: 1200242 - protein, 21 aa, Mycobacterium
EETDTTPEKPATKRVNPGAKI

SEQ ID NO: 1200243 - protein, 8 aa, Mycobacterium
EETDTVPA

SEQ ID NO: 1200244 - protein, 4 aa, Mycobacterium
EETF

SEQ ID NO: 1200245 - protein, 8 aa, Mycobacterium
EETGETVV

SEQ ID NO: 1200246 - protein, 9 aa, Mycobacterium
EETGSTNAD

SEQ ID NO: 1200247 - protein, 9 aa, Mycobacterium
EETHTPTPY

SEQ ID NO: 1200248 - protein, 4 aa, Mycobacterium
EETL

SEQ ID NO: 1200249 - protein, 98 aa, Mycobacterium
EETLDAARTQTETQPEPEAEPHAETEPQHEPEAEDEAQPEPEAEPQAEPEPEPEAEAGPTPEAEAEATPEPEATPEAEAAPLAEAATQPPSAPQQSAC

SEQ ID NO: 1200250 - protein, 5 aa, Mycobacterium
EETLT

SEQ ID NO: 1200251 - protein, 6 aa, Mycobacterium
EETPEF

SEQ ID NO: 1200252 - protein, 6 aa, Mycobacterium
EETPEV

SEQ ID NO: 1200253 - protein, 4 aa, Mycobacterium
EETR

SEQ ID NO: 1200254 - protein, 7 aa, Mycobacterium
EETREHA

SEQ ID NO: 1200255 - protein, 8 aa, Mycobacterium
EETRSAVP

SEQ ID NO: 1200256 - protein, 4 aa, Mycobacterium
EETT

SEQ ID NO: 1200257 - protein, 7 aa, Mycobacterium
EETTDAE

SEQ ID NO: 1200258 - protein, 5 aa, Mycobacterium
EETVA

SEQ ID NO: 1200259 - protein, 5 aa, Mycobacterium
EEVEH

SEQ ID NO: 1200260 - protein, 12 aa, Mycobacterium
EEVELGSRHERP

SEQ ID NO: 1200261 - protein, 7 aa, Mycobacterium
EEVGPEE

SEQ ID NO: 1200262 - protein, 5 aa, Mycobacterium
EEVGR

SEQ ID NO: 1200263 - protein, 13 aa, Mycobacterium
EEVTSDGRSERGN

SEQ ID NO: 1200264 - protein, 5 aa, Mycobacterium
EEVTT

SEQ ID NO: 1200265 - protein, 17 aa, Mycobacterium
EEWQDSPEGWPQRPTYS

SEQ ID NO: 1200266 - protein, 7 aa, Mycobacterium
EEYAKTF

SEQ ID NO: 1200267 - protein, 7 aa, Mycobacterium
EEYDPDD

SEQ ID NO: 1200268 - protein, 11 aa, Mycobacterium
EEYGGGGQPDY

SEQ ID NO: 1200269 - protein, 10 aa, Mycobacterium
EEYGGGGSDD

SEQ ID NO: 1200270 - protein, 10 aa, Mycobacterium
EEYGGGGSED

SEQ ID NO: 1200271 - protein, 8 aa, Mycobacterium
EEYGGGGV

SEQ ID NO: 1200272 - protein, 9 aa, Mycobacterium
EEYGGGGVD

SEQ ID NO: 1200273 - protein, 9 aa, Mycobacterium
EEYGGHGRS

SEQ ID NO: 1200274 - protein, 7 aa, Mycobacterium
EEYGSHD

SEQ ID NO: 1200275 - protein, 5 aa, Mycobacterium
EEYSG

SEQ ID NO: 1200276 - protein, 5 aa, Mycobacterium
EEYSR

SEQ ID NO: 1200277 - protein, 8 aa, Mycobacterium
EEYSTGAE

SEQ ID NO: 1200278 - protein, 16 aa, Mycobacterium
EFANGDPNKRWDTSRN

SEQ ID NO: 1200279 - protein, 15 aa, Mycobacterium
EFDAKAADLDDEQLR

SEQ ID NO: 1200280 - protein, 10 aa, Mycobacterium
EFDDQRVTTR

SEQ ID NO: 1200281 - protein, 10 aa, Mycobacterium
EFDEQTDPFE

SEQ ID NO: 1200282 - protein, 10 aa, Mycobacterium
EFDRSTAAAV

SEQ ID NO: 1200283 - protein, 10 aa, Mycobacterium
EFEGEKSYAQ

SEQ ID NO: 1200284 - protein, 8 aa, Mycobacterium
EFGDGSKL

SEQ ID NO: 1200285 - protein, 9 aa, Mycobacterium
EFGGQGADS

SEQ ID NO: 1200286 - protein, 5 aa, Mycobacterium
EFGPG

SEQ ID NO: 1200287 - protein, 22 aa, Mycobacterium
EFGPGHRAPSARPTVGFWSDLV

SEQ ID NO: 1200288 - protein, 11 aa, Mycobacterium
EFGSNSSTVDR

SEQ ID NO: 1200289 - protein, 9 aa, Mycobacterium
EFKDPDGTW

SEQ ID NO: 1200290 - protein, 6 aa, Mycobacterium
EFKTSD

SEQ ID NO: 1200291 - protein, 9 aa, Mycobacterium
EFNPDQAGR

SEQ ID NO: 1200292 - protein, 4 aa, Mycobacterium
EFPP

SEQ ID NO: 1200293 - protein, 12 aa, Mycobacterium
EFPPPDPRPVEE

SEQ ID NO: 1200294 - protein, 16 aa, Mycobacterium
EFPPPLPYKGNRSPDV

SEQ ID NO: 1200295 - protein, 8 aa, Mycobacterium
EFRPERKN

SEQ ID NO: 1200296 - protein, 7 aa, Mycobacterium
EFRPGDD

SEQ ID NO: 1200297 - protein, 6 aa, Mycobacterium
EFRSGK

SEQ ID NO: 1200298 - protein, 18 aa, Mycobacterium
EFSAPPDVPWSTDADGGA

SEQ ID NO: 1200299 - protein, 7 aa, Mycobacterium
EFSGDRS

SEQ ID NO: 1200300 - protein, 11 aa, Mycobacterium
EFSGPRAPDAP

SEQ ID NO: 1200301 - protein, 4 aa, Mycobacterium
EFSK

SEQ ID NO: 1200302 - protein, 12 aa, Mycobacterium
EFSPPADADDEL

SEQ ID NO: 1200303 - protein, 11 aa, Mycobacterium
EFSSPAGQSDV

SEQ ID NO: 1200304 - protein, 10 aa, Mycobacterium
EFSTPDKPRY

SEQ ID NO: 1200305 - protein, 19 aa, Mycobacterium
EFTETTAQAIESVGGAARG

SEQ ID NO: 1200306 - protein, 5 aa, Mycobacterium
EGAAA

SEQ ID NO: 1200307 - protein, 8 aa, Mycobacterium
EGAAGNGA

SEQ ID NO: 1200308 - protein, 9 aa, Mycobacterium
EGAAVPRAS

SEQ ID NO: 1200309 - protein, 4 aa, Mycobacterium
EGAD

SEQ ID NO: 1200310 - protein, 5 aa, Mycobacterium
EGADA

SEQ ID NO: 1200311 - protein, 8 aa, Mycobacterium
EGADGDHD

SEQ ID NO: 1200312 - protein, 10 aa, Mycobacterium
EGADGDTPIP

SEQ ID NO: 1200313 - protein, 7 aa, Mycobacterium
EGADKPL

SEQ ID NO: 1200314 - protein, 13 aa, Mycobacterium
EGAEAAGKNPDDI

SEQ ID NO: 1200315 - protein, 7 aa, Mycobacterium
EGAEHGS

SEQ ID NO: 1200316 - protein, 15 aa, Mycobacterium
EGAEPVPGGTGGPAV

SEQ ID NO: 1200317 - protein, 8 aa, Mycobacterium
EGAEVAAG

SEQ ID NO: 1200318 - protein, 12 aa, Mycobacterium
EGAGGAYSLRGG

SEQ ID NO: 1200319 - protein, 13 aa, Mycobacterium
EGAGTAGDEGGLE

SEQ ID NO: 1200320 - protein, 11 aa, Mycobacterium
EGAIPKGTVAA

SEQ ID NO: 1200321 - protein, 11 aa, Mycobacterium
EGAKKTTGVDE

SEQ ID NO: 1200322 - protein, 8 aa, Mycobacterium
EGAPDDPA

SEQ ID NO: 1200323 - protein, 9 aa, Mycobacterium
EGAPDDPAA

SEQ ID NO: 1200324 - protein, 5 aa, Mycobacterium
EGAPG

SEQ ID NO: 1200325 - protein, 6 aa, Mycobacterium
EGAPGY

SEQ ID NO: 1200326 - protein, 10 aa, Mycobacterium
EGAPSTAATF

SEQ ID NO: 1200327 - protein, 13 aa, Mycobacterium
EGARERAAGLGAE

SEQ ID NO: 1200328 - protein, 6 aa, Mycobacterium
EGARPE

SEQ ID NO: 1200329 - protein, 4 aa, Mycobacterium
EGAS

SEQ ID NO: 1200330 - protein, 10 aa, Mycobacterium
EGASHGRAFS

SEQ ID NO: 1200331 - protein, 7 aa, Mycobacterium
EGASTVR

SEQ ID NO: 1200332 - protein, 9 aa, Mycobacterium
EGATADADE

SEQ ID NO: 1200333 - protein, 5 aa, Mycobacterium
EGATD

SEQ ID NO: 1200334 - protein, 9 aa, Mycobacterium
EGATDDPTI

SEQ ID NO: 1200335 - protein, 7 aa, Mycobacterium
EGATPHR

SEQ ID NO: 1200336 - protein, 4 aa, Mycobacterium
EGCD

SEQ ID NO: 1200337 - protein, 9 aa, Mycobacterium
EGDARGERA

SEQ ID NO: 1200338 - protein, 5 aa, Mycobacterium
EGDCG

SEQ ID NO: 1200339 - protein, 8 aa, Mycobacterium
EGDDTVRP

SEQ ID NO: 1200340 - protein, 8 aa, Mycobacterium
EGDELDSE

SEQ ID NO: 1200341 - protein, 5 aa, Mycobacterium
EGDFD

SEQ ID NO: 1200342 - protein, 8 aa, Mycobacterium
EGDGGGYG

SEQ ID NO: 1200343 - protein, 6 aa, Mycobacterium
EGDGQW

SEQ ID NO: 1200344 - protein, 5 aa, Mycobacterium
EGDGR

SEQ ID NO: 1200345 - protein, 6 aa, Mycobacterium
EGDGTH

SEQ ID NO: 1200346 - protein, 4 aa, Mycobacterium
EGDI

SEQ ID NO: 1200347 - protein, 9 aa, Mycobacterium
EGDITDETG

SEQ ID NO: 1200348 - protein, 11 aa, Mycobacterium
EGDKVDAGQTI

SEQ ID NO: 1200349 - protein, 4 aa, Mycobacterium
EGDL

SEQ ID NO: 1200350 - protein, 7 aa, Mycobacterium
EGDNDSV

SEQ ID NO: 1200351 - protein, 16 aa, Mycobacterium
EGDNSISAGWDPETGQ

SEQ ID NO: 1200352 - protein, 4 aa, Mycobacterium
EGDP

SEQ ID NO: 1200353 - protein, 9 aa, Mycobacterium
EGDPFPPER

SEQ ID NO: 1200354 - protein, 7 aa, Mycobacterium
EGDPGQL

SEQ ID NO: 1200355 - protein, 9 aa, Mycobacterium
EGDPNPNIE

SEQ ID NO: 1200356 - protein, 7 aa, Mycobacterium
EGDPSNV

SEQ ID NO: 1200357 - protein, 13 aa, Mycobacterium
EGDRGTAEKPDPA

SEQ ID NO: 1200358 - protein, 13 aa, Mycobacterium
EGDRKKGAIGNQR

SEQ ID NO: 1200359 - protein, 7 aa, Mycobacterium
EGDSEPH

SEQ ID NO: 1200360 - protein, 15 aa, Mycobacterium
EGDSTPPERGDAARN

SEQ ID NO: 1200361 - protein, 4 aa, Mycobacterium
EGDV

SEQ ID NO: 1200362 - protein, 8 aa, Mycobacterium
EGEAKVAA

SEQ ID NO: 1200363 - protein, 10 aa, Mycobacterium
EGEAPRRDGT

SEQ ID NO: 1200364 - protein, 6 aa, Mycobacterium
EGEARD

SEQ ID NO: 1200365 - protein, 4 aa, Mycobacterium
EGED

SEQ ID NO: 1200366 - protein, 15 aa, Mycobacterium
EGEDFGSGGDLPEQR

SEQ ID NO: 1200367 - protein, 6 aa, Mycobacterium
EGEEHH

SEQ ID NO: 1200368 - protein, 5 aa, Mycobacterium
EGEFD

SEQ ID NO: 1200369 - protein, 9 aa, Mycobacterium
EGEFGSPGL

SEQ ID NO: 1200370 - protein, 8 aa, Mycobacterium
EGEIDGDP

SEQ ID NO: 1200371 - protein, 4 aa, Mycobacterium
EGEK

SEQ ID NO: 1200372 - protein, 9 aa, Mycobacterium
EGEPADRRA

SEQ ID NO: 1200373 - protein, 14 aa, Mycobacterium
EGEPYAGSVTRTGE

SEQ ID NO: 1200374 - protein, 5 aa, Mycobacterium
EGERD

SEQ ID NO: 1200375 - protein, 6 aa, Mycobacterium
EGEYAT

SEQ ID NO: 1200376 - protein, 7 aa, Mycobacterium
EGFRDGD

SEQ ID NO: 1200377 - protein, 4 aa, Mycobacterium
EGFT

SEQ ID NO: 1200378 - protein, 7 aa, Mycobacterium
EGFTNQE

SEQ ID NO: 1200379 - protein, 6 aa, Mycobacterium
EGFTRG

SEQ ID NO: 1200380 - protein, 6 aa, Mycobacterium
EGGAPA

SEQ ID NO: 1200381 - protein, 12 aa, Mycobacterium
EGGASYQRPEWD

SEQ ID NO: 1200382 - protein, 9 aa, Mycobacterium
EGGDEEADA

SEQ ID NO: 1200383 - protein, 8 aa, Mycobacterium
EGGDIDKL

SEQ ID NO: 1200384 - protein, 6 aa, Mycobacterium
EGGEHT

SEQ ID NO: 1200385 - protein, 12 aa, Mycobacterium
EGGERQVPSTPE

SEQ ID NO: 1200386 - protein, 7 aa, Mycobacterium
EGGERVA

SEQ ID NO: 1200387 - protein, 25 aa, Mycobacterium
EGGFGGRPGQRPPAPEIPERDPDAR

SEQ ID NO: 1200388 - protein, 10 aa, Mycobacterium
EGGGRQVAES

SEQ ID NO: 1200389 - protein, 14 aa, Mycobacterium
EGGGTANATLIELV

SEQ ID NO: 1200390 - protein, 13 aa, Mycobacterium
EGGHAGASDNPQI

SEQ ID NO: 1200391 - protein, 9 aa, Mycobacterium
EGGHPAGGL

SEQ ID NO: 1200392 - protein, 4 aa, Mycobacterium
EGGI

SEQ ID NO: 1200393 - protein, 7 aa, Mycobacterium
EGGITEK

SEQ ID NO: 1200394 - protein, 13 aa, Mycobacterium
EGGKVSNNKGMSL

SEQ ID NO: 1200395 - protein, 6 aa, Mycobacterium
EGGLDS

SEQ ID NO: 1200396 - protein, 11 aa, Mycobacterium
EGGPSRNHERT

SEQ ID NO: 1200397 - protein, 5 aa, Mycobacterium
EGGPT

SEQ ID NO: 1200398 - protein, 11 aa, Mycobacterium
EGGPTRDGSVV

SEQ ID NO: 1200399 - protein, 8 aa, Mycobacterium
EGGQWGAD

SEQ ID NO: 1200400 - protein, 17 aa, Mycobacterium
EGGRAALAAGAPANAAR

SEQ ID NO: 1200401 - protein, 7 aa, Mycobacterium
EGGRNRQ

SEQ ID NO: 1200402 - protein, 9 aa, Mycobacterium
EGGSGVSAA

SEQ ID NO: 1200403 - protein, 8 aa, Mycobacterium
EGGSKTAQ

SEQ ID NO: 1200404 - protein, 10 aa, Mycobacterium
EGGTETRSHA

SEQ ID NO: 1200405 - protein, 7 aa, Mycobacterium
EGGTPLL

SEQ ID NO: 1200406 - protein, 7 aa, Mycobacterium
EGHDQGS

SEQ ID NO: 1200407 - protein, 7 aa, Mycobacterium
EGHPAVR

SEQ ID NO: 1200408 - protein, 30 aa, Mycobacterium
EGHQPDLSDCPPAKLNRGTPSKRIGDPGRY

SEQ ID NO: 1200409 - protein, 12 aa, Mycobacterium
EGHSRAGPVRDR

SEQ ID NO: 1200410 - protein, 6 aa, Mycobacterium
EGHTGW

SEQ ID NO: 1200411 - protein, 5 aa, Mycobacterium
EGIED

SEQ ID NO: 1200412 - protein, 5 aa, Mycobacterium
EGIER

SEQ ID NO: 1200413 - protein, 5 aa, Mycobacterium
EGIEY

SEQ ID NO: 1200414 - protein, 6 aa, Mycobacterium
EGIPTG

SEQ ID NO: 1200415 - protein, 8 aa, Mycobacterium
EGIRDEKS

SEQ ID NO: 1200416 - protein, 9 aa, Mycobacterium
EGITCSEDG

SEQ ID NO: 1200417 - protein, 5 aa, Mycobacterium
EGKAV

SEQ ID NO: 1200418 - protein, 9 aa, Mycobacterium
EGKDVPEAY

SEQ ID NO: 1200419 - protein, 11 aa, Mycobacterium
EGKFTSEESRK

SEQ ID NO: 1200420 - protein, 10 aa, Mycobacterium
EGKGENLTRT

SEQ ID NO: 1200421 - protein, 14 aa, Mycobacterium
EGKITGEEDRYSKT

SEQ ID NO: 1200422 - protein, 9 aa, Mycobacterium
EGKPARRPF

SEQ ID NO: 1200423 - protein, 6 aa, Mycobacterium
EGKPLS

SEQ ID NO: 1200424 - protein, 26 aa, Mycobacterium
EGKPPFANPRNSAAGSLRQKNPAVTA

SEQ ID NO: 1200425 - protein, 10 aa, Mycobacterium
EGKTAGETAR

SEQ ID NO: 1200426 - protein, 9 aa, Mycobacterium
EGLDDPARM

SEQ ID NO: 1200427 - protein, 7 aa, Mycobacterium
EGLDQDQ

SEQ ID NO: 1200428 - protein, 6 aa, Mycobacterium
EGLEEA

SEQ ID NO: 1200429 - protein, 9 aa, Mycobacterium
EGLGGRDDA

SEQ ID NO: 1200430 - protein, 11 aa, Mycobacterium
EGLQDNARRVG

SEQ ID NO: 1200431 - protein, 14 aa, Mycobacterium
EGLRGRVPDPPGGL

SEQ ID NO: 1200432 - protein, 11 aa, Mycobacterium
EGLSDAEKNQI

SEQ ID NO: 1200433 - protein, 10 aa, Mycobacterium
EGLSPSAEEI

SEQ ID NO: 1200434 - protein, 6 aa, Mycobacterium
EGLVPP

SEQ ID NO: 1200435 - protein, 10 aa, Mycobacterium
EGMAGAEGEH

SEQ ID NO: 1200436 - protein, 6 aa, Mycobacterium
EGMDES

SEQ ID NO: 1200437 - protein, 14 aa, Mycobacterium
EGMDSNMSADELKS

SEQ ID NO: 1200438 - protein, 15 aa, Mycobacterium
EGNAYTSGADRLPTT

SEQ ID NO: 1200439 - protein, 6 aa, Mycobacterium
EGNCGS

SEQ ID NO: 1200440 - protein, 4 aa, Mycobacterium
EGND

SEQ ID NO: 1200441 - protein, 6 aa, Mycobacterium
EGNDDR

SEQ ID NO: 1200442 - protein, 9 aa, Mycobacterium
EGNPPQPEV

SEQ ID NO: 1200443 - protein, 15 aa, Mycobacterium
EGNRGTPRLKPPYPI

SEQ ID NO: 1200444 - protein, 5 aa, Mycobacterium
EGNRL

SEQ ID NO: 1200445 - protein, 6 aa, Mycobacterium
EGNRYR

SEQ ID NO: 1200446 - protein, 7 aa, Mycobacterium
EGPADGP

SEQ ID NO: 1200447 - protein, 14 aa, Mycobacterium
EGPADVPPVEPSPD

SEQ ID NO: 1200448 - protein, 11 aa, Mycobacterium
EGPATRGLSGC

SEQ ID NO: 1200449 - protein, 8 aa, Mycobacterium
EGPATSRP

SEQ ID NO: 1200450 - protein, 4 aa, Mycobacterium
EGPD

SEQ ID NO: 1200451 - protein, 8 aa, Mycobacterium
EGPDAEVP

SEQ ID NO: 1200452 - protein, 7 aa, Mycobacterium
EGPDGPV

SEQ ID NO: 1200453 - protein, 6 aa, Mycobacterium
EGPDPV

SEQ ID NO: 1200454 - protein, 6 aa, Mycobacterium
EGPDYA

SEQ ID NO: 1200455 - protein, 15 aa, Mycobacterium
EGPEIGGPYGPYRQS

SEQ ID NO: 1200456 - protein, 6 aa, Mycobacterium
EGPGGY

SEQ ID NO: 1200457 - protein, 15 aa, Mycobacterium
EGPGITDDAKAGAPL

SEQ ID NO: 1200458 - protein, 15 aa, Mycobacterium
EGPGITDDAKTGARL

SEQ ID NO: 1200459 - protein, 6 aa, Mycobacterium
EGPGLK

SEQ ID NO: 1200460 - protein, 5 aa, Mycobacterium
EGPKE

SEQ ID NO: 1200461 - protein, 4 aa, Mycobacterium
EGPL

SEQ ID NO: 1200462 - protein, 12 aa, Mycobacterium
EGPLRDATAGRA

SEQ ID NO: 1200463 - protein, 4 aa, Mycobacterium
EGPN

SEQ ID NO: 1200464 - protein, 16 aa, Mycobacterium
EGPPALAEGGPQAGDV

SEQ ID NO: 1200465 - protein, 11 aa, Mycobacterium
EGPPDDPGGAV

SEQ ID NO: 1200466 - protein, 6 aa, Mycobacterium
EGPPGH

SEQ ID NO: 1200467 - protein, 6 aa, Mycobacterium
EGPPLG

SEQ ID NO: 1200468 - protein, 13 aa, Mycobacterium
EGPPPDPITADPS

SEQ ID NO: 1200469 - protein, 7 aa, Mycobacterium
EGPRIGA

SEQ ID NO: 1200470 - protein, 10 aa, Mycobacterium
EGPRPPGALP

SEQ ID NO: 1200471 - protein, 10 aa, Mycobacterium
EGPRVSGTEP

SEQ ID NO: 1200472 - protein, 9 aa, Mycobacterium
EGPSKPPTV

SEQ ID NO: 1200473 - protein, 4 aa, Mycobacterium
EGPV

SEQ ID NO: 1200474 - protein, 7 aa, Mycobacterium
EGQAGEL

SEQ ID NO: 1200475 - protein, 8 aa, Mycobacterium
EGQDETKA

SEQ ID NO: 1200476 - protein, 12 aa, Mycobacterium
EGQDPGPQASAR

SEQ ID NO: 1200477 - protein, 4 aa, Mycobacterium
EGQG

SEQ ID NO: 1200478 - protein, 16 aa, Mycobacterium
EGQGAFTSFGGDTRRI

SEQ ID NO: 1200479 - protein, 4 aa, Mycobacterium
EGQI

SEQ ID NO: 1200480 - protein, 5 aa, Mycobacterium
EGQIT

SEQ ID NO: 1200481 - protein, 4 aa, Mycobacterium
EGQL

SEQ ID NO: 1200482 - protein, 10 aa, Mycobacterium
EGQLTADGDG

SEQ ID NO: 1200483 - protein, 12 aa, Mycobacterium
EGQPFSGDTSAY

SEQ ID NO: 1200484 - protein, 17 aa, Mycobacterium
EGQQDPTGVAAKSAAVS

SEQ ID NO: 1200485 - protein, 7 aa, Mycobacterium
EGQRSPV

SEQ ID NO: 1200486 - protein, 8 aa, Mycobacterium
EGRAHDAA

SEQ ID NO: 1200487 - protein, 4 aa, Mycobacterium
EGRD

SEQ ID NO: 1200488 - protein, 8 aa, Mycobacterium
EGRDAADD

SEQ ID NO: 1200489 - protein, 6 aa, Mycobacterium
EGRDAD

SEQ ID NO: 1200490 - protein, 10 aa, Mycobacterium
EGRDDRDGWQ

SEQ ID NO: 1200491 - protein, 6 aa, Mycobacterium
EGRDEH

SEQ ID NO: 1200492 - protein, 5 aa, Mycobacterium
EGRDG

SEQ ID NO: 1200493 - protein, 8 aa, Mycobacterium
EGRDPYPV

SEQ ID NO: 1200494 - protein, 5 aa, Mycobacterium
EGRDQ

SEQ ID NO: 1200495 - protein, 11 aa, Mycobacterium
EGRDTSNMPRA

SEQ ID NO: 1200496 - protein, 5 aa, Mycobacterium
EGRDV

SEQ ID NO: 1200497 - protein, 10 aa, Mycobacterium
EGRELGDTST

SEQ ID NO: 1200498 - protein, 11 aa, Mycobacterium
EGRELGDTSTL

SEQ ID NO: 1200499 - protein, 10 aa, Mycobacterium
EGRENGDTAT

SEQ ID NO: 1200500 - protein, 9 aa, Mycobacterium
EGREQREAR

SEQ ID NO: 1200501 - protein, 8 aa, Mycobacterium
EGRFDDQS

SEQ ID NO: 1200502 - protein, 13 aa, Mycobacterium
EGRFRDRTPESAV

SEQ ID NO: 1200503 - protein, 8 aa, Mycobacterium
EGRGGRQA

SEQ ID NO: 1200504 - protein, 5 aa, Mycobacterium
EGRKP

SEQ ID NO: 1200505 - protein, 6 aa, Mycobacterium
EGRKRS

SEQ ID NO: 1200506 - protein, 7 aa, Mycobacterium
EGRKSEL

SEQ ID NO: 1200507 - protein, 13 aa, Mycobacterium
EGRLRKSKDRRKI

SEQ ID NO: 1200508 - protein, 7 aa, Mycobacterium
EGRPSIK

SEQ ID NO: 1200509 - protein, 8 aa, Mycobacterium
EGRPYDPA

SEQ ID NO: 1200510 - protein, 8 aa, Mycobacterium
EGRQDDDI

SEQ ID NO: 1200511 - protein, 6 aa, Mycobacterium
EGRQGT

SEQ ID NO: 1200512 - protein, 4 aa, Mycobacterium
EGRR

SEQ ID NO: 1200513 - protein, 11 aa, Mycobacterium
EGRRADDYDQR

SEQ ID NO: 1200514 - protein, 15 aa, Mycobacterium
EGRRRLPDDGTDQTY

SEQ ID NO: 1200515 - protein, 7 aa, Mycobacterium
EGRSDAQ

SEQ ID NO: 1200516 - protein, 6 aa, Mycobacterium
EGRSKG

SEQ ID NO: 1200517 - protein, 8 aa, Mycobacterium
EGRSTASA

SEQ ID NO: 1200518 - protein, 5 aa, Mycobacterium
EGRTF

SEQ ID NO: 1200519 - protein, 11 aa, Mycobacterium
EGRVSGHSGGN

SEQ ID NO: 1200520 - protein, 11 aa, Mycobacterium
EGSAADADASL

SEQ ID NO: 1200521 - protein, 30 aa, Mycobacterium
EGSAASKSVDTEKDPDRDTPDVDKDADEPT

SEQ ID NO: 1200522 - protein, 8 aa, Mycobacterium
EGSAGTSG

SEQ ID NO: 1200523 - protein, 6 aa, Mycobacterium
EGSAHR

SEQ ID NO: 1200524 - protein, 9 aa, Mycobacterium
EGSAPYRRQ

SEQ ID NO: 1200525 - protein, 8 aa, Mycobacterium
EGSGDLSD

SEQ ID NO: 1200526 - protein, 9 aa, Mycobacterium
EGSGEYPTI

SEQ ID NO: 1200527 - protein, 7 aa, Mycobacterium
EGSGFDD

SEQ ID NO: 1200528 - protein, 6 aa, Mycobacterium
EGSGFI

SEQ ID NO: 1200529 - protein, 9 aa, Mycobacterium
EGSGPDPDA

SEQ ID NO: 1200530 - protein, 5 aa, Mycobacterium
EGSGR

SEQ ID NO: 1200531 - protein, 9 aa, Mycobacterium
EGSGSTEGA

SEQ ID NO: 1200532 - protein, 8 aa, Mycobacterium
EGSGTTPF

SEQ ID NO: 1200533 - protein, 8 aa, Mycobacterium
EGSGVSEA

SEQ ID NO: 1200534 - protein, 9 aa, Mycobacterium
EGSLGERDA

SEQ ID NO: 1200535 - protein, 8 aa, Mycobacterium
EGSNDPVP

SEQ ID NO: 1200536 - protein, 6 aa, Mycobacterium
EGSPDR

SEQ ID NO: 1200537 - protein, 12 aa, Mycobacterium
EGSPEDGRSRGV

SEQ ID NO: 1200538 - protein, 8 aa, Mycobacterium
EGSPIGDR

SEQ ID NO: 1200539 - protein, 12 aa, Mycobacterium
EGSPTASSEGTG

SEQ ID NO: 1200540 - protein, 11 aa, Mycobacterium
EGSRAAPGYAA

SEQ ID NO: 1200541 - protein, 7 aa, Mycobacterium
EGSRGAA

SEQ ID NO: 1200542 - protein, 5 aa, Mycobacterium
EGSSN

SEQ ID NO: 1200543 - protein, 24 aa, Mycobacterium
EGSTHGYDVTDPTTVSAALGGADA

SEQ ID NO: 1200544 - protein, 5 aa, Mycobacterium
EGSTI

SEQ ID NO: 1200545 - protein, 5 aa, Mycobacterium
EGSTV

SEQ ID NO: 1200546 - protein, 5 aa, Mycobacterium
EGTAE

SEQ ID NO: 1200547 - protein, 8 aa, Mycobacterium
EGTAVTPA

SEQ ID NO: 1200548 - protein, 20 aa, Mycobacterium
EGTDTRHDAQVDSPDLTGPY

SEQ ID NO: 1200549 - protein, 14 aa, Mycobacterium
EGTEDLLADLDRAL

SEQ ID NO: 1200550 - protein, 5 aa, Mycobacterium
EGTEG

SEQ ID NO: 1200551 - protein, 14 aa, Mycobacterium
EGTGADAPPAYDES

SEQ ID NO: 1200552 - protein, 6 aa, Mycobacterium
EGTGWT

SEQ ID NO: 1200553 - protein, 5 aa, Mycobacterium
EGTHQ

SEQ ID NO: 1200554 - protein, 9 aa, Mycobacterium
EGTKLTSAA

SEQ ID NO: 1200555 - protein, 10 aa, Mycobacterium
EGTLGEKEIE

SEQ ID NO: 1200556 - protein, 6 aa, Mycobacterium
EGTLPS

SEQ ID NO: 1200557 - protein, 7 aa, Mycobacterium
EGTPALR

SEQ ID NO: 1200558 - protein, 10 aa, Mycobacterium
EGTPASPDEH

SEQ ID NO: 1200559 - protein, 5 aa, Mycobacterium
EGTPQ

SEQ ID NO: 1200560 - protein, 6 aa, Mycobacterium
EGTPQA

SEQ ID NO: 1200561 - protein, 7 aa, Mycobacterium
EGTPTAA

SEQ ID NO: 1200562 - protein, 6 aa, Mycobacterium
EGTPVS

SEQ ID NO: 1200563 - protein, 7 aa, Mycobacterium
EGTPVTS

SEQ ID NO: 1200564 - protein, 6 aa, Mycobacterium
EGTQKF

SEQ ID NO: 1200565 - protein, 7 aa, Mycobacterium
EGTQLGP

SEQ ID NO: 1200566 - protein, 6 aa, Mycobacterium
EGTQRR

SEQ ID NO: 1200567 - protein, 8 aa, Mycobacterium
EGTREGHE

SEQ ID NO: 1200568 - protein, 5 aa, Mycobacterium
EGTRF

SEQ ID NO: 1200569 - protein, 15 aa, Mycobacterium
EGTRLDTTEVGPFKK

SEQ ID NO: 1200570 - protein, 15 aa, Mycobacterium
EGTRLTEQARSSKIK

SEQ ID NO: 1200571 - protein, 6 aa, Mycobacterium
EGTRPA

SEQ ID NO: 1200572 - protein, 11 aa, Mycobacterium
EGTRSPDGRLY

SEQ ID NO: 1200573 - protein, 8 aa, Mycobacterium
EGTRTGKL

SEQ ID NO: 1200574 - protein, 4 aa, Mycobacterium
EGTS

SEQ ID NO: 1200575 - protein, 8 aa, Mycobacterium
EGTSPRRA

SEQ ID NO: 1200576 - protein, 8 aa, Mycobacterium
EGTTEQRD

SEQ ID NO: 1200577 - protein, 5 aa, Mycobacterium
EGTTP

SEQ ID NO: 1200578 - protein, 8 aa, Mycobacterium
EGTVAEGA

SEQ ID NO: 1200579 - protein, 15 aa, Mycobacterium
EGTWADASYDAPMGQ

SEQ ID NO: 1200580 - protein, 6 aa, Mycobacterium
EGTYRG

SEQ ID NO: 1200581 - protein, 8 aa, Mycobacterium
EGVDATAA

SEQ ID NO: 1200582 - protein, 11 aa, Mycobacterium
EGVDEQGQPID

SEQ ID NO: 1200583 - protein, 11 aa, Mycobacterium
EGVDPSQNPAI

SEQ ID NO: 1200584 - protein, 5 aa, Mycobacterium
EGVDQ

SEQ ID NO: 1200585 - protein, 5 aa, Mycobacterium
EGVEA

SEQ ID NO: 1200586 - protein, 9 aa, Mycobacterium
EGVKGKAKE

SEQ ID NO: 1200587 - protein, 6 aa, Mycobacterium
EGVNPA

SEQ ID NO: 1200588 - protein, 27 aa, Mycobacterium
EGVPPGLPTLGDRPDGAVLVDRSDGDD

SEQ ID NO: 1200589 - protein, 8 aa, Mycobacterium
EGVPPKVG

SEQ ID NO: 1200590 - protein, 5 aa, Mycobacterium
EGVPT

SEQ ID NO: 1200591 - protein, 4 aa, Mycobacterium
EGVS

SEQ ID NO: 1200592 - protein, 6 aa, Mycobacterium
EGVSPE

SEQ ID NO: 1200593 - protein, 9 aa, Mycobacterium
EGVSQETIG

SEQ ID NO: 1200594 - protein, 5 aa, Mycobacterium
EGVTG

SEQ ID NO: 1200595 - protein, 9 aa, Mycobacterium
EGYAGPEDA

SEQ ID NO: 1200596 - protein, 5 aa, Mycobacterium
EGYDY

SEQ ID NO: 1200597 - protein, 11 aa, Mycobacterium
EGYEHAEPGTV

SEQ ID NO: 1200598 - protein, 10 aa, Mycobacterium
EGYEVTGTAN

SEQ ID NO: 1200599 - protein, 11 aa, Mycobacterium
EGYGTRRYKPH

SEQ ID NO: 1200600 - protein, 9 aa, Mycobacterium
EGYPAPGVV

SEQ ID NO: 1200601 - protein, 9 aa, Mycobacterium
EGYQSVGSG

SEQ ID NO: 1200602 - protein, 14 aa, Mycobacterium
EGYSPDFPGSEDFE

SEQ ID NO: 1200603 - protein, 21 aa, Mycobacterium
EGYSPPERPYGRGAFGPDESM

SEQ ID NO: 1200604 - protein, 15 aa, Mycobacterium
EHADDSSGAIGGECQ

SEQ ID NO: 1200605 - protein, 8 aa, Mycobacterium
EHADTYPQ

SEQ ID NO: 1200606 - protein, 6 aa, Mycobacterium
EHADVN

SEQ ID NO: 1200607 - protein, 10 aa, Mycobacterium
EHAEQTGPAR

SEQ ID NO: 1200608 - protein, 8 aa, Mycobacterium
EHAERGRS

SEQ ID NO: 1200609 - protein, 13 aa, Mycobacterium
EHAGPGVPGHHRD

SEQ ID NO: 1200610 - protein, 16 aa, Mycobacterium
EHAGPGVPGHHRDASD

SEQ ID NO: 1200611 - protein, 8 aa, Mycobacterium
EHAGQEAE

SEQ ID NO: 1200612 - protein, 6 aa, Mycobacterium
EHAGSW

SEQ ID NO: 1200613 - protein, 7 aa, Mycobacterium
EHAGTDA

SEQ ID NO: 1200614 - protein, 10 aa, Mycobacterium
EHAKARGATP

SEQ ID NO: 1200615 - protein, 8 aa, Mycobacterium
EHAPNDLR

SEQ ID NO: 1200616 - protein, 8 aa, Mycobacterium
EHAQTDEV

SEQ ID NO: 1200617 - protein, 10 aa, Mycobacterium
EHARARGATP

SEQ ID NO: 1200618 - protein, 16 aa, Mycobacterium
EHARTDWDNGGVPRRE

SEQ ID NO: 1200619 - protein, 4 aa, Mycobacterium
EHAY

SEQ ID NO: 1200620 - protein, 6 aa, Mycobacterium
EHDAVP

SEQ ID NO: 1200621 - protein, 9 aa, Mycobacterium
EHDDEPYYP

SEQ ID NO: 1200622 - protein, 5 aa, Mycobacterium
EHDGE

SEQ ID NO: 1200623 - protein, 8 aa, Mycobacterium
EHDPKTVP

SEQ ID NO: 1200624 - protein, 9 aa, Mycobacterium
EHDPKTVPI

SEQ ID NO: 1200625 - protein, 11 aa, Mycobacterium
EHDSSHDLGVD

SEQ ID NO: 1200626 - protein, 8 aa, Mycobacterium
EHEDQTRA

SEQ ID NO: 1200627 - protein, 8 aa, Mycobacterium
EHEEAEEF

SEQ ID NO: 1200628 - protein, 13 aa, Mycobacterium
EHGADGSIARSGG

SEQ ID NO: 1200629 - protein, 6 aa, Mycobacterium
EHGAHT

SEQ ID NO: 1200630 - protein, 10 aa, Mycobacterium
EHGASSDQAR

SEQ ID NO: 1200631 - protein, 7 aa, Mycobacterium
EHGGPSI

SEQ ID NO: 1200632 - protein, 14 aa, Mycobacterium
EHGHAAPGQHYRTA

SEQ ID NO: 1200633 - protein, 19 aa, Mycobacterium
EHGHTNPPGGEQTDDGRSL

SEQ ID NO: 1200634 - protein, 5 aa, Mycobacterium
EHGPD

SEQ ID NO: 1200635 - protein, 5 aa, Mycobacterium
EHGPL

SEQ ID NO: 1200636 - protein, 7 aa, Mycobacterium
EHGREQA

SEQ ID NO: 1200637 - protein, 12 aa, Mycobacterium
EHGRNLATDPRA

SEQ ID NO: 1200638 - protein, 7 aa, Mycobacterium
EHGRSAG

SEQ ID NO: 1200639 - protein, 7 aa, Mycobacterium
EHGTEGK

SEQ ID NO: 1200640 - protein, 9 aa, Mycobacterium
EHGTPSDID

SEQ ID NO: 1200641 - protein, 7 aa, Mycobacterium
EHGTRPR

SEQ ID NO: 1200642 - protein, 4 aa, Mycobacterium
EHGY

SEQ ID NO: 1200643 - protein, 12 aa, Mycobacterium
EHHEGPVGDQTD

SEQ ID NO: 1200644 - protein, 13 aa, Mycobacterium
EHHNDPTTRRDER

SEQ ID NO: 1200645 - protein, 20 aa, Mycobacterium
EHISGAKETVGGNVRAAQEK

SEQ ID NO: 1200646 - protein, 14 aa, Mycobacterium
EHNDPYNVRCQLGQ

SEQ ID NO: 1200647 - protein, 4 aa, Mycobacterium
EHNL

SEQ ID NO: 1200648 - protein, 13 aa, Mycobacterium
EHNPAIRAEFGTT

SEQ ID NO: 1200649 - protein, 36 aa, Mycobacterium
EHPAASAPADLDGDGDQERLVDGDGDGVADRAFGTG

SEQ ID NO: 1200650 - protein, 12 aa, Mycobacterium
EHPDAADEPQAF

SEQ ID NO: 1200651 - protein, 7 aa, Mycobacterium
EHPDGRR

SEQ ID NO: 1200652 - protein, 6 aa, Mycobacterium
EHPERY

SEQ ID NO: 1200653 - protein, 8 aa, Mycobacterium
EHPESGAR

SEQ ID NO: 1200654 - protein, 4 aa, Mycobacterium
EHPG

SEQ ID NO: 1200655 - protein, 6 aa, Mycobacterium
EHPGPR

SEQ ID NO: 1200656 - protein, 9 aa, Mycobacterium
EHPGRPRDR

SEQ ID NO: 1200657 - protein, 6 aa, Mycobacterium
EHPGYG

SEQ ID NO: 1200658 - protein, 8 aa, Mycobacterium
EHPPSPGL

SEQ ID NO: 1200659 - protein, 7 aa, Mycobacterium
EHPQQRR

SEQ ID NO: 1200660 - protein, 5 aa, Mycobacterium
EHPQR

SEQ ID NO: 1200661 - protein, 7 aa, Mycobacterium
EHPSDES

SEQ ID NO: 1200662 - protein, 8 aa, Mycobacterium
EHPSLKRP

SEQ ID NO: 1200663 - protein, 8 aa, Mycobacterium
EHPSSGDI

SEQ ID NO: 1200664 - protein, 8 aa, Mycobacterium
EHPSSGTA

SEQ ID NO: 1200665 - protein, 7 aa, Mycobacterium
EHPYPDK

SEQ ID NO: 1200666 - protein, 9 aa, Mycobacterium
EHQESRAGA

SEQ ID NO: 1200667 - protein, 6 aa, Mycobacterium
EHQGKR

SEQ ID NO: 1200668 - protein, 7 aa, Mycobacterium
EHQNDDM

SEQ ID NO: 1200669 - protein, 20 aa, Mycobacterium
EHQTYKVTTTEGYTVTGTEN

SEQ ID NO: 1200670 - protein, 6 aa, Mycobacterium
EHRDSA

SEQ ID NO: 1200671 - protein, 6 aa, Mycobacterium
EHRERR

SEQ ID NO: 1200672 - protein, 7 aa, Mycobacterium
EHRERRR

SEQ ID NO: 1200673 - protein, 4 aa, Mycobacterium
EHRG

SEQ ID NO: 1200674 - protein, 6 aa, Mycobacterium
EHRGDC

SEQ ID NO: 1200675 - protein, 6 aa, Mycobacterium
EHRGQI

SEQ ID NO: 1200676 - protein, 7 aa, Mycobacterium
EHRPATF

SEQ ID NO: 1200677 - protein, 6 aa, Mycobacterium
EHRPAV

SEQ ID NO: 1200678 - protein, 8 aa, Mycobacterium
EHRPGYGS

SEQ ID NO: 1200679 - protein, 5 aa, Mycobacterium
EHRPR

SEQ ID NO: 1200680 - protein, 4 aa, Mycobacterium
EHRR

SEQ ID NO: 1200681 - protein, 6 aa, Mycobacterium
EHRRDP

SEQ ID NO: 1200682 - protein, 7 aa, Mycobacterium
EHRSEQA

SEQ ID NO: 1200683 - protein, 13 aa, Mycobacterium
EHRSTVSPYLVRQ

SEQ ID NO: 1200684 - protein, 7 aa, Mycobacterium
EHRTNEG

SEQ ID NO: 1200685 - protein, 25 aa, Mycobacterium
EHSCTQKPVPVSAQKVTGSAEPTLA

SEQ ID NO: 1200686 - protein, 9 aa, Mycobacterium
EHSCTTDET

SEQ ID NO: 1200687 - protein, 8 aa, Mycobacterium
EHSDTYPQ

SEQ ID NO: 1200688 - protein, 11 aa, Mycobacterium
EHSEQLSDEHK

SEQ ID NO: 1200689 - protein, 5 aa, Mycobacterium
EHSES

SEQ ID NO: 1200690 - protein, 4 aa, Mycobacterium
EHSG

SEQ ID NO: 1200691 - protein, 17 aa, Mycobacterium
EHSGPGVPGHHASTGEL

SEQ ID NO: 1200692 - protein, 14 aa, Mycobacterium
EHSHPGGGLPSYPH

SEQ ID NO: 1200693 - protein, 7 aa, Mycobacterium
EHSKQVA

SEQ ID NO: 1200694 - protein, 4 aa, Mycobacterium
EHSM

SEQ ID NO: 1200695 - protein, 6 aa, Mycobacterium
EHSVAE

SEQ ID NO: 1200696 - protein, 6 aa, Mycobacterium
EHSYRK

SEQ ID NO: 1200697 - protein, 11 aa, Mycobacterium
EHTDAPEPSEM

SEQ ID NO: 1200698 - protein, 4 aa, Mycobacterium
EHTE

SEQ ID NO: 1200699 - protein, 11 aa, Mycobacterium
EHTGRTGTTPV

SEQ ID NO: 1200700 - protein, 8 aa, Mycobacterium
EHTGTDEH

SEQ ID NO: 1200701 - protein, 7 aa, Mycobacterium
EHYTSEE

SEQ ID NO: 1200702 - protein, 9 aa, Mycobacterium
EIAAETGRA

SEQ ID NO: 1200703 - protein, 5 aa, Mycobacterium
EIAAG

SEQ ID NO: 1200704 - protein, 16 aa, Mycobacterium
EIAAPAAPEPREHPTD

SEQ ID NO: 1200705 - protein, 8 aa, Mycobacterium
EIAGAPPE

SEQ ID NO: 1200706 - protein, 15 aa, Mycobacterium
EIAGGRDGVPTPGCG

SEQ ID NO: 1200707 - protein, 5 aa, Mycobacterium
EIAPE

SEQ ID NO: 1200708 - protein, 5 aa, Mycobacterium
EIAPH

SEQ ID NO: 1200709 - protein, 10 aa, Mycobacterium
EIARQSGQYA

SEQ ID NO: 1200710 - protein, 11 aa, Mycobacterium
EIASRSAALAA

SEQ ID NO: 1200711 - protein, 11 aa, Mycobacterium
EIDAAEAAEIQ

SEQ ID NO: 1200712 - protein, 11 aa, Mycobacterium
EIDAAKDRANR

SEQ ID NO: 1200713 - protein, 9 aa, Mycobacterium
EIDAGPTNN

SEQ ID NO: 1200714 - protein, 14 aa, Mycobacterium
EIDAGTLRVKPYEV

SEQ ID NO: 1200715 - protein, 9 aa, Mycobacterium
EIDDGDHGR

SEQ ID NO: 1200716 - protein, 11 aa, Mycobacterium
EIDGKNKDNVA

SEQ ID NO: 1200717 - protein, 8 aa, Mycobacterium
EIDGKTER

SEQ ID NO: 1200718 - protein, 10 aa, Mycobacterium
EIDPRKARLT

SEQ ID NO: 1200719 - protein, 10 aa, Mycobacterium
EIDRSEDEVR

SEQ ID NO: 1200720 - protein, 6 aa, Mycobacterium
EIDTGL

SEQ ID NO: 1200721 - protein, 5 aa, Mycobacterium
EIEDD

SEQ ID NO: 1200722 - protein, 13 aa, Mycobacterium
EIEPRGSEALQSN

SEQ ID NO: 1200723 - protein, 12 aa, Mycobacterium
EIEPRGSTALEA

SEQ ID NO: 1200724 - protein, 9 aa, Mycobacterium
EIETPGEGQ

SEQ ID NO: 1200725 - protein, 10 aa, Mycobacterium
EIGAPSATTL

SEQ ID NO: 1200726 - protein, 7 aa, Mycobacterium
EIGDTTA

SEQ ID NO: 1200727 - protein, 11 aa, Mycobacterium
EIGGPAGHTEI

SEQ ID NO: 1200728 - protein, 6 aa, Mycobacterium
EIGPSA

SEQ ID NO: 1200729 - protein, 12 aa, Mycobacterium
EIGPSPAEADQA

SEQ ID NO: 1200730 - protein, 9 aa, Mycobacterium
EIGRDDPAL

SEQ ID NO: 1200731 - protein, 7 aa, Mycobacterium
EIGSGSV

SEQ ID NO: 1200732 - protein, 15 aa, Mycobacterium
EIGSTSGKGSQARRA

SEQ ID NO: 1200733 - protein, 4 aa, Mycobacterium
EIPD

SEQ ID NO: 1200734 - protein, 7 aa, Mycobacterium
EIPDKGR

SEQ ID NO: 1200735 - protein, 20 aa, Mycobacterium
EIPENPAQSGVDTPALPLGQ

SEQ ID NO: 1200736 - protein, 5 aa, Mycobacterium
EIPGQ

SEQ ID NO: 1200737 - protein, 6 aa, Mycobacterium
EIPPGT

SEQ ID NO: 1200738 - protein, 4 aa, Mycobacterium
EIPS

SEQ ID NO: 1200739 - protein, 11 aa, Mycobacterium
EIPSAGDRPTI

SEQ ID NO: 1200740 - protein, 16 aa, Mycobacterium
EIPSFAPPKNLQPGEY

SEQ ID NO: 1200741 - protein, 8 aa, Mycobacterium
EIPSPAAG

SEQ ID NO: 1200742 - protein, 8 aa, Mycobacterium
EIPTGSGQ

SEQ ID NO: 1200743 - protein, 19 aa, Mycobacterium
EIQDSDKPAAVAESIVRFI

SEQ ID NO: 1200744 - protein, 8 aa, Mycobacterium
EIQGSSGI

SEQ ID NO: 1200745 - protein, 6 aa, Mycobacterium
EIQRNE

SEQ ID NO: 1200746 - protein, 4 aa, Mycobacterium
EIRD

SEQ ID NO: 1200747 - protein, 17 aa, Mycobacterium
EIRERTRSGTEANRDDI

SEQ ID NO: 1200748 - protein, 5 aa, Mycobacterium
EIRQG

SEQ ID NO: 1200749 - protein, 17 aa, Mycobacterium
EIRSGKSAAIQSNDPAT

SEQ ID NO: 1200750 - protein, 7 aa, Mycobacterium
EIRSSDP

SEQ ID NO: 1200751 - protein, 6 aa, Mycobacterium
EIRTNA

SEQ ID NO: 1200752 - protein, 10 aa, Mycobacterium
EISGPHSDGH

SEQ ID NO: 1200753 - protein, 19 aa, Mycobacterium
EISPSRDDEPVPPESPEAA

SEQ ID NO: 1200754 - protein, 11 aa, Mycobacterium
EISRTDEDSPL

SEQ ID NO: 1200755 - protein, 7 aa, Mycobacterium
EISSGHD

SEQ ID NO: 1200756 - protein, 8 aa, Mycobacterium
EITESSEL

SEQ ID NO: 1200757 - protein, 4 aa, Mycobacterium
EITS

SEQ ID NO: 1200758 - protein, 8 aa, Mycobacterium
EITSPETA

SEQ ID NO: 1200759 - protein, 11 aa, Mycobacterium
EITTGPLGQGL

SEQ ID NO: 1200760 - protein, 7 aa, Mycobacterium
EKAAAQN

SEQ ID NO: 1200761 - protein, 18 aa, Mycobacterium
EKAAEAAEELEQTDPDSV

SEQ ID NO: 1200762 - protein, 9 aa, Mycobacterium
EKAAGPRRT

SEQ ID NO: 1200763 - protein, 8 aa, Mycobacterium
EKAAKAIR

SEQ ID NO: 1200764 - protein, 11 aa, Mycobacterium
EKAASLRDKEK

SEQ ID NO: 1200765 - protein, 12 aa, Mycobacterium
EKAAVNTKDRGA

SEQ ID NO: 1200766 - protein, 12 aa, Mycobacterium
EKADAGEIEPGH

SEQ ID NO: 1200767 - protein, 7 aa, Mycobacterium
EKADDDR

SEQ ID NO: 1200768 - protein, 16 aa, Mycobacterium
EKAENGTSDSKDTNGT

SEQ ID NO: 1200769 - protein, 9 aa, Mycobacterium
EKAEQIASE

SEQ ID NO: 1200770 - protein, 7 aa, Mycobacterium
EKAETEP

SEQ ID NO: 1200771 - protein, 7 aa, Mycobacterium
EKAFAAG

SEQ ID NO: 1200772 - protein, 9 aa, Mycobacterium
EKAGQDGAV

SEQ ID NO: 1200773 - protein, 7 aa, Mycobacterium
EKAGRAV

SEQ ID NO: 1200774 - protein, 4 aa, Mycobacterium
EKAK

SEQ ID NO: 1200775 - protein, 8 aa, Mycobacterium
EKAKPRKI

SEQ ID NO: 1200776 - protein, 6 aa, Mycobacterium
EKAKWA

SEQ ID NO: 1200777 - protein, 9 aa, Mycobacterium
EKAMPTAAG

SEQ ID NO: 1200778 - protein, 11 aa, Mycobacterium
EKAPRKQRHTA

SEQ ID NO: 1200779 - protein, 7 aa, Mycobacterium
EKARAMS

SEQ ID NO: 1200780 - protein, 15 aa, Mycobacterium
EKARTDLEAAEKQVG

SEQ ID NO: 1200781 - protein, 10 aa, Mycobacterium
EKATARGAHG

SEQ ID NO: 1200782 - protein, 7 aa, Mycobacterium
EKATRET

SEQ ID NO: 1200783 - protein, 11 aa, Mycobacterium
EKCTDTGPAFA

SEQ ID NO: 1200784 - protein, 9 aa, Mycobacterium
EKDASDPQL

SEQ ID NO: 1200785 - protein, 8 aa, Mycobacterium
EKDHPGTE

SEQ ID NO: 1200786 - protein, 6 aa, Mycobacterium
EKDPEL

SEQ ID NO: 1200787 - protein, 9 aa, Mycobacterium
EKECGSTEF

SEQ ID NO: 1200788 - protein, 4 aa, Mycobacterium
EKEE

SEQ ID NO: 1200789 - protein, 7 aa, Mycobacterium
EKEFQSQ

SEQ ID NO: 1200790 - protein, 6 aa, Mycobacterium
EKEGTL

SEQ ID NO: 1200791 - protein, 9 aa, Mycobacterium
EKEISDNAT

SEQ ID NO: 1200792 - protein, 21 aa, Mycobacterium
EKELDDAASKRSAAAGARAHA

SEQ ID NO: 1200793 - protein, 5 aa, Mycobacterium
EKERA

SEQ ID NO: 1200794 - protein, 5 aa, Mycobacterium
EKESI

SEQ ID NO: 1200795 - protein, 4 aa, Mycobacterium
EKEV

SEQ ID NO: 1200796 - protein, 5 aa, Mycobacterium
EKFDA

SEQ ID NO: 1200797 - protein, 6 aa, Mycobacterium
EKFGED

SEQ ID NO: 1200798 - protein, 5 aa, Mycobacterium
EKFGQ

SEQ ID NO: 1200799 - protein, 8 aa, Mycobacterium
EKGAEPDL

SEQ ID NO: 1200800 - protein, 10 aa, Mycobacterium
EKGAKLDPAI

SEQ ID NO: 1200801 - protein, 8 aa, Mycobacterium
EKGDAGPV

SEQ ID NO: 1200802 - protein, 5 aa, Mycobacterium
EKGDR

SEQ ID NO: 1200803 - protein, 8 aa, Mycobacterium
EKGESRDL

SEQ ID NO: 1200804 - protein, 6 aa, Mycobacterium
EKGGFL

SEQ ID NO: 1200805 - protein, 18 aa, Mycobacterium
EKGGKDGPRAVLVGQHPR

SEQ ID NO: 1200806 - protein, 5 aa, Mycobacterium
EKGLP

SEQ ID NO: 1200807 - protein, 5 aa, Mycobacterium
EKGPE

SEQ ID NO: 1200808 - protein, 9 aa, Mycobacterium
EKGPPAAEE

SEQ ID NO: 1200809 - protein, 17 aa, Mycobacterium
EKGRSSVHGSGINPGNL

SEQ ID NO: 1200810 - protein, 6 aa, Mycobacterium
EKGTDI

SEQ ID NO: 1200811 - protein, 12 aa, Mycobacterium
EKIDKKTLATAF

SEQ ID NO: 1200812 - protein, 8 aa, Mycobacterium
EKIEGSDF

SEQ ID NO: 1200813 - protein, 7 aa, Mycobacterium
EKIGPGD

SEQ ID NO: 1200814 - protein, 11 aa, Mycobacterium
EKIQDDGSTVT

SEQ ID NO: 1200815 - protein, 7 aa, Mycobacterium
EKKAAKR

SEQ ID NO: 1200816 - protein, 14 aa, Mycobacterium
EKKGVPREKLTGTI

SEQ ID NO: 1200817 - protein, 4 aa, Mycobacterium
EKKM

SEQ ID NO: 1200818 - protein, 8 aa, Mycobacterium
EKLARRGA

SEQ ID NO: 1200819 - protein, 10 aa, Mycobacterium
EKLGEESQAL

SEQ ID NO: 1200820 - protein, 18 aa, Mycobacterium
EKLGLSDADPEESPYRDL

SEQ ID NO: 1200821 - protein, 6 aa, Mycobacterium
EKLGSA

SEQ ID NO: 1200822 - protein, 6 aa, Mycobacterium
EKLPME

SEQ ID NO: 1200823 - protein, 9 aa, Mycobacterium
EKLTGTEEF

SEQ ID NO: 1200824 - protein, 7 aa, Mycobacterium
EKLTPGA

SEQ ID NO: 1200825 - protein, 17 aa, Mycobacterium
EKNDSWTLTGRESHSEP

SEQ ID NO: 1200826 - protein, 8 aa, Mycobacterium
EKNPGRAK

SEQ ID NO: 1200827 - protein, 7 aa, Mycobacterium
EKNQSGL

SEQ ID NO: 1200828 - protein, 22 aa, Mycobacterium
EKPEESEDDGHGHGHGHHHGHA

SEQ ID NO: 1200829 - protein, 13 aa, Mycobacterium
EKPGGTESERRTF

SEQ ID NO: 1200830 - protein, 12 aa, Mycobacterium
EKPGRDPRPAFT

SEQ ID NO: 1200831 - protein, 6 aa, Mycobacterium
EKPHHD

SEQ ID NO: 1200832 - protein, 8 aa, Mycobacterium
EKPIGDGG

SEQ ID NO: 1200833 - protein, 11 aa, Mycobacterium
EKPKPEDAPSL

SEQ ID NO: 1200834 - protein, 4 aa, Mycobacterium
EKPN

SEQ ID NO: 1200835 - protein, 9 aa, Mycobacterium
EKPTEKERT

SEQ ID NO: 1200836 - protein, 8 aa, Mycobacterium
EKQADGTL

SEQ ID NO: 1200837 - protein, 13 aa, Mycobacterium
EKQARQSTDVGAP

SEQ ID NO: 1200838 - protein, 7 aa, Mycobacterium
EKQPHRS

SEQ ID NO: 1200839 - protein, 8 aa, Mycobacterium
EKQRDRVE

SEQ ID NO: 1200840 - protein, 7 aa, Mycobacterium
EKQRGQV

SEQ ID NO: 1200841 - protein, 6 aa, Mycobacterium
EKQRQR

SEQ ID NO: 1200842 - protein, 13 aa, Mycobacterium
EKRDPDWSPFPRY

SEQ ID NO: 1200843 - protein, 11 aa, Mycobacterium
EKRNGRPPRER

SEQ ID NO: 1200844 - protein, 23 aa, Mycobacterium
EKRRSYADQPYWGRPAPGFGSPR

SEQ ID NO: 1200845 - protein, 6 aa, Mycobacterium
EKRSRA

SEQ ID NO: 1200846 - protein, 4 aa, Mycobacterium
EKSR

SEQ ID NO: 1200847 - protein, 14 aa, Mycobacterium
EKSRAAAKTGAGWQ

SEQ ID NO: 1200848 - protein, 12 aa, Mycobacterium
EKSRAAAKTGLG

SEQ ID NO: 1200849 - protein, 9 aa, Mycobacterium
EKSREEQPA

SEQ ID NO: 1200850 - protein, 8 aa, Mycobacterium
EKSSADRV

SEQ ID NO: 1200851 - protein, 7 aa, Mycobacterium
EKSSDRI

SEQ ID NO: 1200852 - protein, 10 aa, Mycobacterium
EKSSGRDLSG

SEQ ID NO: 1200853 - protein, 19 aa, Mycobacterium
EKTAAEDSAAWSEGHPLSE

SEQ ID NO: 1200854 - protein, 9 aa, Mycobacterium
EKTGDTTDK

SEQ ID NO: 1200855 - protein, 9 aa, Mycobacterium
EKTIAGSDV

SEQ ID NO: 1200856 - protein, 22 aa, Mycobacterium
EKTPALPTLATSSPTQEVSSPR

SEQ ID NO: 1200857 - protein, 7 aa, Mycobacterium
EKTRRGL

SEQ ID NO: 1200858 - protein, 8 aa, Mycobacterium
EKTSSSDL

SEQ ID NO: 1200859 - protein, 9 aa, Mycobacterium
EKTTQNSWQ

SEQ ID NO: 1200860 - protein, 4 aa, Mycobacterium
EKTV

SEQ ID NO: 1200861 - protein, 9 aa, Mycobacterium
EKTVADSMR

SEQ ID NO: 1200862 - protein, 13 aa, Mycobacterium
EKVAAAVSKAGGL

SEQ ID NO: 1200863 - protein, 10 aa, Mycobacterium
EKVDVTDSAV

SEQ ID NO: 1200864 - protein, 9 aa, Mycobacterium
EKVEQTAKT

SEQ ID NO: 1200865 - protein, 9 aa, Mycobacterium
EKVREDPRW

SEQ ID NO: 1200866 - protein, 21 aa, Mycobacterium
EKVTESTLPVGPPPVQPGGPE

SEQ ID NO: 1200867 - protein, 10 aa, Mycobacterium
EKYEAPLAEG

SEQ ID NO: 1200868 - protein, 11 aa, Mycobacterium
EKYEAPLAEGQ

SEQ ID NO: 1200869 - protein, 4 aa, Mycobacterium
EKYP

SEQ ID NO: 1200870 - protein, 10 aa, Mycobacterium
ELAADDASFA

SEQ ID NO: 1200871 - protein, 19 aa, Mycobacterium
ELAARQDHRVPAGSTVPTE

SEQ ID NO: 1200872 - protein, 8 aa, Mycobacterium
ELADGQSL

SEQ ID NO: 1200873 - protein, 15 aa, Mycobacterium
ELADRPPGRGITRDG

SEQ ID NO: 1200874 - protein, 7 aa, Mycobacterium
ELAEEGR

SEQ ID NO: 1200875 - protein, 6 aa, Mycobacterium
ELAPDH

SEQ ID NO: 1200876 - protein, 7 aa, Mycobacterium
ELAPGEK

SEQ ID NO: 1200877 - protein, 6 aa, Mycobacterium
ELAPGQ

SEQ ID NO: 1200878 - protein, 15 aa, Mycobacterium
ELAPTDETPEVSRPS

SEQ ID NO: 1200879 - protein, 5 aa, Mycobacterium
ELASE

SEQ ID NO: 1200880 - protein, 6 aa, Mycobacterium
ELDADE

SEQ ID NO: 1200881 - protein, 11 aa, Mycobacterium
ELDAKSSASIT

SEQ ID NO: 1200882 - protein, 8 aa, Mycobacterium
ELDATSNR

SEQ ID NO: 1200883 - protein, 9 aa, Mycobacterium
ELDDPQSGL

SEQ ID NO: 1200884 - protein, 6 aa, Mycobacterium
ELDEPT

SEQ ID NO: 1200885 - protein, 13 aa, Mycobacterium
ELDETKTVRENVE

SEQ ID NO: 1200886 - protein, 7 aa, Mycobacterium
ELDGDER

SEQ ID NO: 1200887 - protein, 6 aa, Mycobacterium
ELDPDE

SEQ ID NO: 1200888 - protein, 9 aa, Mycobacterium
ELDRREESQ

SEQ ID NO: 1200889 - protein, 6 aa, Mycobacterium
ELDSEQ

SEQ ID NO: 1200890 - protein, 10 aa, Mycobacterium
ELDSGAKRHT

SEQ ID NO: 1200891 - protein, 8 aa, Mycobacterium
ELDSGEVG

SEQ ID NO: 1200892 - protein, 7 aa, Mycobacterium
ELDSSAE

SEQ ID NO: 1200893 - protein, 5 aa, Mycobacterium
ELDTG

SEQ ID NO: 1200894 - protein, 12 aa, Mycobacterium
ELEANSEDDVET

SEQ ID NO: 1200895 - protein, 23 aa, Mycobacterium
ELEDEGAKSDVKRKVRDGGEREM

SEQ ID NO: 1200896 - protein, 8 aa, Mycobacterium
ELEEDGTM

SEQ ID NO: 1200897 - protein, 8 aa, Mycobacterium
ELEESGIT

SEQ ID NO: 1200898 - protein, 18 aa, Mycobacterium
ELEKRQKSRHTRASRDAL

SEQ ID NO: 1200899 - protein, 12 aa, Mycobacterium
ELEPPEDPDAAT

SEQ ID NO: 1200900 - protein, 7 aa, Mycobacterium
ELEPPEP

SEQ ID NO: 1200901 - protein, 4 aa, Mycobacterium
ELER

SEQ ID NO: 1200902 - protein, 5 aa, Mycobacterium
ELGAG

SEQ ID NO: 1200903 - protein, 7 aa, Mycobacterium
ELGEEPT

SEQ ID NO: 1200904 - protein, 7 aa, Mycobacterium
ELGEHTE

SEQ ID NO: 1200905 - protein, 8 aa, Mycobacterium
ELGEPDRL

SEQ ID NO: 1200906 - protein, 4 aa, Mycobacterium
ELGG

SEQ ID NO: 1200907 - protein, 12 aa, Mycobacterium
ELGGADAQARYG

SEQ ID NO: 1200908 - protein, 7 aa, Mycobacterium
ELGGAGD

SEQ ID NO: 1200909 - protein, 7 aa, Mycobacterium
ELGGDAG

SEQ ID NO: 1200910 - protein, 8 aa, Mycobacterium
ELGGTQTY

SEQ ID NO: 1200911 - protein, 7 aa, Mycobacterium
ELGGTTT

SEQ ID NO: 1200912 - protein, 5 aa, Mycobacterium
ELGMD

SEQ ID NO: 1200913 - protein, 10 aa, Mycobacterium
ELGNQAEGKV

SEQ ID NO: 1200914 - protein, 15 aa, Mycobacterium
ELGPDPTRGTGGPLE

SEQ ID NO: 1200915 - protein, 7 aa, Mycobacterium
ELGPSSV

SEQ ID NO: 1200916 - protein, 11 aa, Mycobacterium
ELGPYGSSRTR

SEQ ID NO: 1200917 - protein, 4 aa, Mycobacterium
ELGQ

SEQ ID NO: 1200918 - protein, 28 aa, Mycobacterium
ELGQRGSAAPVDSGANNDGGFNQFNRGN

SEQ ID NO: 1200919 - protein, 4 aa, Mycobacterium
ELGR

SEQ ID NO: 1200920 - protein, 38 aa, Mycobacterium
ELGREKSAMATAASRQSDTAASRQSNPAASRQSETAVT

SEQ ID NO: 1200921 - protein, 7 aa, Mycobacterium
ELGRTTG

SEQ ID NO: 1200922 - protein, 9 aa, Mycobacterium
ELGTLPDEA

SEQ ID NO: 1200923 - protein, 5 aa, Mycobacterium
ELGTQ

SEQ ID NO: 1200924 - protein, 9 aa, Mycobacterium
ELGTTRSAA

SEQ ID NO: 1200925 - protein, 4 aa, Mycobacterium
ELGV

SEQ ID NO: 1200926 - protein, 12 aa, Mycobacterium
ELKGQTGDLGEL

SEQ ID NO: 1200927 - protein, 14 aa, Mycobacterium
ELKPSDATDANGGP

SEQ ID NO: 1200928 - protein, 11 aa, Mycobacterium
ELKRGSAERGV

SEQ ID NO: 1200929 - protein, 11 aa, Mycobacterium
ELKSADPAYDT

SEQ ID NO: 1200930 - protein, 7 aa, Mycobacterium
ELMPPND

SEQ ID NO: 1200931 - protein, 11 aa, Mycobacterium
ELNAQDSGKGA

SEQ ID NO: 1200932 - protein, 27 aa, Mycobacterium
ELNDAAAGNKSVADALRDAQAAAERIQ

SEQ ID NO: 1200933 - protein, 4 aa, Mycobacterium
ELNE

SEQ ID NO: 1200934 - protein, 11 aa, Mycobacterium
ELNGARPGGID

SEQ ID NO: 1200935 - protein, 4 aa, Mycobacterium
ELNR

SEQ ID NO: 1200936 - protein, 7 aa, Mycobacterium
ELPADTS

SEQ ID NO: 1200937 - protein, 7 aa, Mycobacterium
ELPAEPA

SEQ ID NO: 1200938 - protein, 13 aa, Mycobacterium
ELPAPQVSEAQAQ

SEQ ID NO: 1200939 - protein, 5 aa, Mycobacterium
ELPDD

SEQ ID NO: 1200940 - protein, 6 aa, Mycobacterium
ELPDDD

SEQ ID NO: 1200941 - protein, 12 aa, Mycobacterium
ELPDDERDATYP

SEQ ID NO: 1200942 - protein, 5 aa, Mycobacterium
ELPDE

SEQ ID NO: 1200943 - protein, 10 aa, Mycobacterium
ELPDEPEPGT

SEQ ID NO: 1200944 - protein, 5 aa, Mycobacterium
ELPDG

SEQ ID NO: 1200945 - protein, 5 aa, Mycobacterium
ELPEG

SEQ ID NO: 1200946 - protein, 19 aa, Mycobacterium
ELPERGPQRGPNPAPADDV

SEQ ID NO: 1200947 - protein, 5 aa, Mycobacterium
ELPES

SEQ ID NO: 1200948 - protein, 5 aa, Mycobacterium
ELPEW

SEQ ID NO: 1200949 - protein, 10 aa, Mycobacterium
ELPGGRDRLR

SEQ ID NO: 1200950 - protein, 8 aa, Mycobacterium
ELPGRGST

SEQ ID NO: 1200951 - protein, 8 aa, Mycobacterium
ELPIGPQE

SEQ ID NO: 1200952 - protein, 6 aa, Mycobacterium
ELPNGL

SEQ ID NO: 1200953 - protein, 6 aa, Mycobacterium
ELPNKR

SEQ ID NO: 1200954 - protein, 16 aa, Mycobacterium
ELPPAVNPARQPTWGQ

SEQ ID NO: 1200955 - protein, 17 aa, Mycobacterium
ELPPEEAANIPQAPTSL

SEQ ID NO: 1200956 - protein, 7 aa, Mycobacterium
ELPPGGR

SEQ ID NO: 1200957 - protein, 10 aa, Mycobacterium
ELPPLQAPDV

SEQ ID NO: 1200958 - protein, 8 aa, Mycobacterium
ELPPPLDE

SEQ ID NO: 1200959 - protein, 24 aa, Mycobacterium
ELPPPSGPLPPVAAGAAPKPADAV

SEQ ID NO: 1200960 - protein, 7 aa, Mycobacterium
ELPPRRP

SEQ ID NO: 1200961 - protein, 11 aa, Mycobacterium
ELPPSSWGSGK

SEQ ID NO: 1200962 - protein, 5 aa, Mycobacterium
ELPQH

SEQ ID NO: 1200963 - protein, 7 aa, Mycobacterium
ELPRAGS

SEQ ID NO: 1200964 - protein, 8 aa, Mycobacterium
ELPREERD

SEQ ID NO: 1200965 - protein, 16 aa, Mycobacterium
ELPRNAPVEVEVIVEV

SEQ ID NO: 1200966 - protein, 6 aa, Mycobacterium
ELPRTE

SEQ ID NO: 1200967 - protein, 8 aa, Mycobacterium
ELPSDPSI

SEQ ID NO: 1200968 - protein, 9 aa, Mycobacterium
ELPSPDDVE

SEQ ID NO: 1200969 - protein, 19 aa, Mycobacterium
ELPSSAPIHAKETKEVERR

SEQ ID NO: 1200970 - protein, 4 aa, Mycobacterium
ELPT

SEQ ID NO: 1200971 - protein, 26 aa, Mycobacterium
ELPTAAGRQAESVEGAVNASEIPERD

SEQ ID NO: 1200972 - protein, 6 aa, Mycobacterium
ELPTQS

SEQ ID NO: 1200973 - protein, 13 aa, Mycobacterium
ELQGRRSARPGAR

SEQ ID NO: 1200974 - protein, 9 aa, Mycobacterium
ELQKRSTGR

SEQ ID NO: 1200975 - protein, 5 aa, Mycobacterium
ELQQA

SEQ ID NO: 1200976 - protein, 5 aa, Mycobacterium
ELQQR

SEQ ID NO: 1200977 - protein, 19 aa, Mycobacterium
ELQSTNEELETTNEELQST

SEQ ID NO: 1200978 - protein, 11 aa, Mycobacterium
ELRANSKLTPV

SEQ ID NO: 1200979 - protein, 12 aa, Mycobacterium
ELRDAARSQPIA

SEQ ID NO: 1200980 - protein, 7 aa, Mycobacterium
ELRDEGK

SEQ ID NO: 1200981 - protein, 16 aa, Mycobacterium
ELREQKRDEPGEEENK

SEQ ID NO: 1200982 - protein, 14 aa, Mycobacterium
ELRGPGKTRALAQS

SEQ ID NO: 1200983 - protein, 8 aa, Mycobacterium
ELRNGSTA

SEQ ID NO: 1200984 - protein, 4 aa, Mycobacterium
ELRP

SEQ ID NO: 1200985 - protein, 12 aa, Mycobacterium
ELRSNSPMVGTP

SEQ ID NO: 1200986 - protein, 14 aa, Mycobacterium
ELRSNSPVVGTPGE

SEQ ID NO: 1200987 - protein, 5 aa, Mycobacterium
ELRTD

SEQ ID NO: 1200988 - protein, 9 aa, Mycobacterium
ELRTPWPGQ

SEQ ID NO: 1200989 - protein, 11 aa, Mycobacterium
ELSAGSPGDMT

SEQ ID NO: 1200990 - protein, 15 aa, Mycobacterium
ELSASGPPAKRRGDG

SEQ ID NO: 1200991 - protein, 4 aa, Mycobacterium
ELSD

SEQ ID NO: 1200992 - protein, 7 aa, Mycobacterium
ELSEDDA

SEQ ID NO: 1200993 - protein, 6 aa, Mycobacterium
ELSEER

SEQ ID NO: 1200994 - protein, 8 aa, Mycobacterium
ELSEPAAA

SEQ ID NO: 1200995 - protein, 5 aa, Mycobacterium
ELSEQ

SEQ ID NO: 1200996 - protein, 7 aa, Mycobacterium
ELSERAR

SEQ ID NO: 1200997 - protein, 12 aa, Mycobacterium
ELSESDPWPGAG

SEQ ID NO: 1200998 - protein, 11 aa, Mycobacterium
ELSESEAERSV

SEQ ID NO: 1200999 - protein, 9 aa, Mycobacterium
ELSGADAAR

SEQ ID NO: 1201000 - protein, 8 aa, Mycobacterium
ELSGGQRQ

SEQ ID NO: 1201001 - protein, 9 aa, Mycobacterium
ELSKGDSAI

SEQ ID NO: 1201002 - protein, 14 aa, Mycobacterium
ELSNTDDQGRPAMA

SEQ ID NO: 1201003 - protein, 10 aa, Mycobacterium
ELSPGERTRA

SEQ ID NO: 1201004 - protein, 5 aa, Mycobacterium
ELSPH

SEQ ID NO: 1201005 - protein, 7 aa, Mycobacterium
ELSPTSV

SEQ ID NO: 1201006 - protein, 12 aa, Mycobacterium
ELSQNAENAKIR

SEQ ID NO: 1201007 - protein, 12 aa, Mycobacterium
ELSRSGIPGREP

SEQ ID NO: 1201008 - protein, 7 aa, Mycobacterium
ELTDEER

SEQ ID NO: 1201009 - protein, 11 aa, Mycobacterium
ELTDGGEAGTV

SEQ ID NO: 1201010 - protein, 5 aa, Mycobacterium
ELTDR

SEQ ID NO: 1201011 - protein, 9 aa, Mycobacterium
ELTGAAPSS

SEQ ID NO: 1201012 - protein, 17 aa, Mycobacterium
ELTGGDAESNAASARAV

SEQ ID NO: 1201013 - protein, 19 aa, Mycobacterium
ELTGTYDPAPGKPYGGEGH

SEQ ID NO: 1201014 - protein, 9 aa, Mycobacterium
ELTNTPAQS

SEQ ID NO: 1201015 - protein, 10 aa, Mycobacterium
ELTPADGPTV

SEQ ID NO: 1201016 - protein, 10 aa, Mycobacterium
ELTPSENPVE

SEQ ID NO: 1201017 - protein, 5 aa, Mycobacterium
ELTRE

SEQ ID NO: 1201018 - protein, 12 aa, Mycobacterium
ELTRSARRYDSK

SEQ ID NO: 1201019 - protein, 7 aa, Mycobacterium
ELTTQEK

SEQ ID NO: 1201020 - protein, 27 aa, Mycobacterium
EMAAEQRRKYQATLKAKAKAAQMSRST

SEQ ID NO: 1201021 - protein, 10 aa, Mycobacterium
EMDSPVAGSD

SEQ ID NO: 1201022 - protein, 20 aa, Mycobacterium
EMESDAAGRQSHAIGGSPRK

SEQ ID NO: 1201023 - protein, 4 aa, Mycobacterium
EMEV

SEQ ID NO: 1201024 - protein, 6 aa, Mycobacterium
EMGEGP

SEQ ID NO: 1201025 - protein, 8 aa, Mycobacterium
EMGGPDSA

SEQ ID NO: 1201026 - protein, 21 aa, Mycobacterium
EMGQGPVQAQPDGSGYRLTGS

SEQ ID NO: 1201027 - protein, 11 aa, Mycobacterium
EMGRTQRGNNN

SEQ ID NO: 1201028 - protein, 7 aa, Mycobacterium
EMNPAED

SEQ ID NO: 1201029 - protein, 6 aa, Mycobacterium
EMNTTS

SEQ ID NO: 1201030 - protein, 9 aa, Mycobacterium
EMPGTDGAR

SEQ ID NO: 1201031 - protein, 4 aa, Mycobacterium
EMQE

SEQ ID NO: 1201032 - protein, 5 aa, Mycobacterium
EMQPG

SEQ ID NO: 1201033 - protein, 8 aa, Mycobacterium
EMQRPQDW

SEQ ID NO: 1201034 - protein, 9 aa, Mycobacterium
EMRGGSAEL

SEQ ID NO: 1201035 - protein, 9 aa, Mycobacterium
EMSEESRVR

SEQ ID NO: 1201036 - protein, 5 aa, Mycobacterium
EMSGG

SEQ ID NO: 1201037 - protein, 4 aa, Mycobacterium
EMSR

SEQ ID NO: 1201038 - protein, 7 aa, Mycobacterium
EMTASTP

SEQ ID NO: 1201039 - protein, 9 aa, Mycobacterium
EMTSEDDEI

SEQ ID NO: 1201040 - protein, 4 aa, Mycobacterium
ENAD

SEQ ID NO: 1201041 - protein, 9 aa, Mycobacterium
ENAEDRDRA

SEQ ID NO: 1201042 - protein, 21 aa, Mycobacterium
ENAGRYTDAASAYREASAAAR

SEQ ID NO: 1201043 - protein, 7 aa, Mycobacterium
ENALTDP

SEQ ID NO: 1201044 - protein, 12 aa, Mycobacterium
ENAPADAERDRL

SEQ ID NO: 1201045 - protein, 5 aa, Mycobacterium
ENAPT

SEQ ID NO: 1201046 - protein, 8 aa, Mycobacterium
ENAQTSCS

SEQ ID NO: 1201047 - protein, 7 aa, Mycobacterium
ENARRSD

SEQ ID NO: 1201048 - protein, 4 aa, Mycobacterium
ENAS

SEQ ID NO: 1201049 - protein, 9 aa, Mycobacterium
ENDADTPRG

SEQ ID NO: 1201050 - protein, 4 aa, Mycobacterium
ENDI

SEQ ID NO: 1201051 - protein, 4 aa, Mycobacterium
ENDL

SEQ ID NO: 1201052 - protein, 7 aa, Mycobacterium
ENDPDTY

SEQ ID NO: 1201053 - protein, 4 aa, Mycobacterium
ENDR

SEQ ID NO: 1201054 - protein, 5 aa, Mycobacterium
ENDRG

SEQ ID NO: 1201055 - protein, 16 aa, Mycobacterium
ENDRRRELTEAQRARG

SEQ ID NO: 1201056 - protein, 74 aa, Mycobacterium
ENDTPDSDEVSPTEDDALKDTETINESQDGPTESASGVSGEDAADADSRSADADSLSADAGDSAPADAAAADTA

SEQ ID NO: 1201057 - protein, 10 aa, Mycobacterium
ENEARSAGYR

SEQ ID NO: 1201058 - protein, 6 aa, Mycobacterium
ENEGAI

SEQ ID NO: 1201059 - protein, 10 aa, Mycobacterium
ENETGLSAGY

SEQ ID NO: 1201060 - protein, 12 aa, Mycobacterium
ENETLSRGADFP

SEQ ID NO: 1201061 - protein, 9 aa, Mycobacterium
ENFRTAAST

SEQ ID NO: 1201062 - protein, 16 aa, Mycobacterium
ENGAPVRRSAGAEASR

SEQ ID NO: 1201063 - protein, 6 aa, Mycobacterium
ENGARG

SEQ ID NO: 1201064 - protein, 7 aa, Mycobacterium
ENGATVR

SEQ ID NO: 1201065 - protein, 7 aa, Mycobacterium
ENGEPVR

SEQ ID NO: 1201066 - protein, 7 aa, Mycobacterium
ENGGRIT

SEQ ID NO: 1201067 - protein, 7 aa, Mycobacterium
ENGNAPV

SEQ ID NO: 1201068 - protein, 4 aa, Mycobacterium
ENGP

SEQ ID NO: 1201069 - protein, 8 aa, Mycobacterium
ENGPQATV

SEQ ID NO: 1201070 - protein, 7 aa, Mycobacterium
ENGPTER

SEQ ID NO: 1201071 - protein, 4 aa, Mycobacterium
ENGQ

SEQ ID NO: 1201072 - protein, 8 aa, Mycobacterium
ENGQGRTK

SEQ ID NO: 1201073 - protein, 12 aa, Mycobacterium
ENGQPTAARPGK

SEQ ID NO: 1201074 - protein, 14 aa, Mycobacterium
ENGSPVTTGERVSA

SEQ ID NO: 1201075 - protein, 7 aa, Mycobacterium
ENGSSID

SEQ ID NO: 1201076 - protein, 8 aa, Mycobacterium
ENGWRDEQ

SEQ ID NO: 1201077 - protein, 8 aa, Mycobacterium
ENGWRDQQ

SEQ ID NO: 1201078 - protein, 9 aa, Mycobacterium
ENGWRDQQF

SEQ ID NO: 1201079 - protein, 7 aa, Mycobacterium
ENHAGAR

SEQ ID NO: 1201080 - protein, 13 aa, Mycobacterium
ENHPTPETKLDEA

SEQ ID NO: 1201081 - protein, 15 aa, Mycobacterium
ENHRGGTVLGPEAAP

SEQ ID NO: 1201082 - protein, 8 aa, Mycobacterium
ENHRGRRP

SEQ ID NO: 1201083 - protein, 11 aa, Mycobacterium
ENHYGADGVGV

SEQ ID NO: 1201084 - protein, 5 aa, Mycobacterium
ENIAG

SEQ ID NO: 1201085 - protein, 7 aa, Mycobacterium
ENIAPSE

SEQ ID NO: 1201086 - protein, 15 aa, Mycobacterium
ENKPTEPRPRDDAGI

SEQ ID NO: 1201087 - protein, 9 aa, Mycobacterium
ENKQPTAEW

SEQ ID NO: 1201088 - protein, 4 aa, Mycobacterium
ENLG

SEQ ID NO: 1201089 - protein, 13 aa, Mycobacterium
ENLGRRPAPFATP

SEQ ID NO: 1201090 - protein, 11 aa, Mycobacterium
ENLPAGHWPPT

SEQ ID NO: 1201091 - protein, 15 aa, Mycobacterium
ENLPSHGEAVRRRFE

SEQ ID NO: 1201092 - protein, 12 aa, Mycobacterium
ENLSQVSGALKL

SEQ ID NO: 1201093 - protein, 4 aa, Mycobacterium
ENLT

SEQ ID NO: 1201094 - protein, 7 aa, Mycobacterium
ENMTSAP

SEQ ID NO: 1201095 - protein, 9 aa, Mycobacterium
ENNPGGLPK

SEQ ID NO: 1201096 - protein, 9 aa, Mycobacterium
ENNRPPYDL

SEQ ID NO: 1201097 - protein, 9 aa, Mycobacterium
ENPDGGTIS

SEQ ID NO: 1201098 - protein, 8 aa, Mycobacterium
ENPDTGQV

SEQ ID NO: 1201099 - protein, 7 aa, Mycobacterium
ENPEYPP

SEQ ID NO: 1201100 - protein, 7 aa, Mycobacterium
ENPGEGG

SEQ ID NO: 1201101 - protein, 5 aa, Mycobacterium
ENPPL

SEQ ID NO: 1201102 - protein, 6 aa, Mycobacterium
ENPPLA

SEQ ID NO: 1201103 - protein, 8 aa, Mycobacterium
ENPPTDTR

SEQ ID NO: 1201104 - protein, 7 aa, Mycobacterium
ENPRPGI

SEQ ID NO: 1201105 - protein, 5 aa, Mycobacterium
ENPRR

SEQ ID NO: 1201106 - protein, 8 aa, Mycobacterium
ENPSEELR

SEQ ID NO: 1201107 - protein, 11 aa, Mycobacterium
ENPSPVTGQPF

SEQ ID NO: 1201108 - protein, 9 aa, Mycobacterium
ENPTESDAA

SEQ ID NO: 1201109 - protein, 8 aa, Mycobacterium
ENQKQHIE

SEQ ID NO: 1201110 - protein, 7 aa, Mycobacterium
ENQNGRM

SEQ ID NO: 1201111 - protein, 7 aa, Mycobacterium
ENQPLTP

SEQ ID NO: 1201112 - protein, 7 aa, Mycobacterium
ENQSSRA

SEQ ID NO: 1201113 - protein, 5 aa, Mycobacterium
ENRDA

SEQ ID NO: 1201114 - protein, 4 aa, Mycobacterium
ENRH

SEQ ID NO: 1201115 - protein, 10 aa, Mycobacterium
ENRPNRGRKV

SEQ ID NO: 1201116 - protein, 7 aa, Mycobacterium
ENRSGAG

SEQ ID NO: 1201117 - protein, 5 aa, Mycobacterium
ENRTE

SEQ ID NO: 1201118 - protein, 6 aa, Mycobacterium
ENRTVP

SEQ ID NO: 1201119 - protein, 5 aa, Mycobacterium
ENRYP

SEQ ID NO: 1201120 - protein, 5 aa, Mycobacterium
ENSAF

SEQ ID NO: 1201121 - protein, 8 aa, Mycobacterium
ENSANIGG

SEQ ID NO: 1201122 - protein, 4 aa, Mycobacterium
ENSF

SEQ ID NO: 1201123 - protein, 8 aa, Mycobacterium
ENSGGELV

SEQ ID NO: 1201124 - protein, 8 aa, Mycobacterium
ENSGGGFP

SEQ ID NO: 1201125 - protein, 15 aa, Mycobacterium
ENSGRVSADSPVLVP

SEQ ID NO: 1201126 - protein, 15 aa, Mycobacterium
ENSPPGSVSEATFDG

SEQ ID NO: 1201127 - protein, 9 aa, Mycobacterium
ENSVAAPPL

SEQ ID NO: 1201128 - protein, 4 aa, Mycobacterium
ENTA

SEQ ID NO: 1201129 - protein, 31 aa, Mycobacterium
ENTDAQNQQLTEKPDVTDEHREKAKQMATAY

SEQ ID NO: 1201130 - protein, 4 aa, Mycobacterium
ENTE

SEQ ID NO: 1201131 - protein, 5 aa, Mycobacterium
ENTRI

SEQ ID NO: 1201132 - protein, 15 aa, Mycobacterium
ENTTRAELANQQKGG

SEQ ID NO: 1201133 - protein, 5 aa, Mycobacterium
ENVDD

SEQ ID NO: 1201134 - protein, 15 aa, Mycobacterium
ENVTAEDPAPDLGQA

SEQ ID NO: 1201135 - protein, 6 aa, Mycobacterium
ENVTTA

SEQ ID NO: 1201136 - protein, 11 aa, Mycobacterium
EPAATPDEIEA

SEQ ID NO: 1201137 - protein, 38 aa, Mycobacterium
EPADPASVPVHTNGATVSIGGDDGGIADDDVDVPPFMR

SEQ ID NO: 1201138 - protein, 7 aa, Mycobacterium
EPAEQGT

SEQ ID NO: 1201139 - protein, 10 aa, Mycobacterium
EPAESGGSSF

SEQ ID NO: 1201140 - protein, 8 aa, Mycobacterium
EPAETQSA

SEQ ID NO: 1201141 - protein, 12 aa, Mycobacterium
EPAGAEDGGEEG

SEQ ID NO: 1201142 - protein, 8 aa, Mycobacterium
EPAGAGVR

SEQ ID NO: 1201143 - protein, 10 aa, Mycobacterium
EPAGDQPAAI

SEQ ID NO: 1201144 - protein, 21 aa, Mycobacterium
EPAGGVGQHDRAHARRARRPH

SEQ ID NO: 1201145 - protein, 9 aa, Mycobacterium
EPAGGVVPT

SEQ ID NO: 1201146 - protein, 7 aa, Mycobacterium
EPAGHTS

SEQ ID NO: 1201147 - protein, 7 aa, Mycobacterium
EPAGPWA

SEQ ID NO: 1201148 - protein, 5 aa, Mycobacterium
EPAGR

SEQ ID NO: 1201149 - protein, 8 aa, Mycobacterium
EPAIPTPP

SEQ ID NO: 1201150 - protein, 17 aa, Mycobacterium
EPAITSTDRVNMRSMWP

SEQ ID NO: 1201151 - protein, 5 aa, Mycobacterium
EPAKA

SEQ ID NO: 1201152 - protein, 7 aa, Mycobacterium
EPAKTAS

SEQ ID NO: 1201153 - protein, 4 aa, Mycobacterium
EPAN

SEQ ID NO: 1201154 - protein, 21 aa, Mycobacterium
EPAPEGDGTRLDGHSFAVLRT

SEQ ID NO: 1201155 - protein, 7 aa, Mycobacterium
EPAPEPD

SEQ ID NO: 1201156 - protein, 7 aa, Mycobacterium
EPAPPKH

SEQ ID NO: 1201157 - protein, 11 aa, Mycobacterium
EPAQQGSDPRE

SEQ ID NO: 1201158 - protein, 5 aa, Mycobacterium
EPAQV

SEQ ID NO: 1201159 - protein, 4 aa, Mycobacterium
EPAR

SEQ ID NO: 1201160 - protein, 18 aa, Mycobacterium
EPARDRGHRGFRGGRRDG

SEQ ID NO: 1201161 - protein, 11 aa, Mycobacterium
EPARQGSDPRE

SEQ ID NO: 1201162 - protein, 6 aa, Mycobacterium
EPARSE

SEQ ID NO: 1201163 - protein, 11 aa, Mycobacterium
EPARSSAESAR

SEQ ID NO: 1201164 - protein, 5 aa, Mycobacterium
EPARW

SEQ ID NO: 1201165 - protein, 4 aa, Mycobacterium
EPAT

SEQ ID NO: 1201166 - protein, 6 aa, Mycobacterium
EPATCD

SEQ ID NO: 1201167 - protein, 9 aa, Mycobacterium
EPATPDDDD

SEQ ID NO: 1201168 - protein, 5 aa, Mycobacterium
EPATS

SEQ ID NO: 1201169 - protein, 7 aa, Mycobacterium
EPAYGTL

SEQ ID NO: 1201170 - protein, 5 aa, Mycobacterium
EPCRQ

SEQ ID NO: 1201171 - protein, 9 aa, Mycobacterium
EPDADEPRC

SEQ ID NO: 1201172 - protein, 23 aa, Mycobacterium
EPDAGSDVGAGRTKAVKQDDGSW

SEQ ID NO: 1201173 - protein, 21 aa, Mycobacterium
EPDAGSDVGAGRTKAVQQADG

SEQ ID NO: 1201174 - protein, 22 aa, Mycobacterium
EPDAGSDVGAGRTKAVQQPDGT

SEQ ID NO: 1201175 - protein, 20 aa, Mycobacterium
EPDAGSNSHKITTTARRDGS

SEQ ID NO: 1201176 - protein, 21 aa, Mycobacterium
EPDAGSNTHKISTTAQRDGDD

SEQ ID NO: 1201177 - protein, 6 aa, Mycobacterium
EPDAQM

SEQ ID NO: 1201178 - protein, 15 aa, Mycobacterium
EPDDDDEHGSGSSAP

SEQ ID NO: 1201179 - protein, 6 aa, Mycobacterium
EPDDGE

SEQ ID NO: 1201180 - protein, 6 aa, Mycobacterium
EPDDVS

SEQ ID NO: 1201181 - protein, 5 aa, Mycobacterium
EPDEV

SEQ ID NO: 1201182 - protein, 8 aa, Mycobacterium
EPDGQPGQ

SEQ ID NO: 1201183 - protein, 6 aa, Mycobacterium
EPDGTL

SEQ ID NO: 1201184 - protein, 6 aa, Mycobacterium
EPDKLP

SEQ ID NO: 1201185 - protein, 5 aa, Mycobacterium
EPDLP

SEQ ID NO: 1201186 - protein, 10 aa, Mycobacterium
EPDLPGDEAD

SEQ ID NO: 1201187 - protein, 19 aa, Mycobacterium
EPDNPANQYRQVERKDKIE

SEQ ID NO: 1201188 - protein, 9 aa, Mycobacterium
EPDNPARDY

SEQ ID NO: 1201189 - protein, 5 aa, Mycobacterium
EPDPA

SEQ ID NO: 1201190 - protein, 6 aa, Mycobacterium
EPDPDT

SEQ ID NO: 1201191 - protein, 7 aa, Mycobacterium
EPDPREM

SEQ ID NO: 1201192 - protein, 8 aa, Mycobacterium
EPDPREMH

SEQ ID NO: 1201193 - protein, 7 aa, Mycobacterium
EPDPRES

SEQ ID NO: 1201194 - protein, 12 aa, Mycobacterium
EPDPVPSGVRGA

SEQ ID NO: 1201195 - protein, 13 aa, Mycobacterium
EPDSRATRPHHTG

SEQ ID NO: 1201196 - protein, 7 aa, Mycobacterium
EPDVQAS

SEQ ID NO: 1201197 - protein, 5 aa, Mycobacterium
EPDVR

SEQ ID NO: 1201198 - protein, 4 aa, Mycobacterium
EPDY

SEQ ID NO: 1201199 - protein, 8 aa, Mycobacterium
EPEAKPWV

SEQ ID NO: 1201200 - protein, 6 aa, Mycobacterium
EPEDGE

SEQ ID NO: 1201201 - protein, 5 aa, Mycobacterium
EPEDI

SEQ ID NO: 1201202 - protein, 6 aa, Mycobacterium
EPEEES

SEQ ID NO: 1201203 - protein, 5 aa, Mycobacterium
EPEFA

SEQ ID NO: 1201204 - protein, 4 aa, Mycobacterium
EPEI

SEQ ID NO: 1201205 - protein, 8 aa, Mycobacterium
EPEKSVEE

SEQ ID NO: 1201206 - protein, 4 aa, Mycobacterium
EPEN

SEQ ID NO: 1201207 - protein, 6 aa, Mycobacterium
EPEPAD

SEQ ID NO: 1201208 - protein, 13 aa, Mycobacterium
EPEPEPAPAPEPV

SEQ ID NO: 1201209 - protein, 27 aa, Mycobacterium
EPEPEPEPAIESEPAPVKPVAPSNPAA

SEQ ID NO: 1201210 - protein, 5 aa, Mycobacterium
EPEPF

SEQ ID NO: 1201211 - protein, 6 aa, Mycobacterium
EPEVTA

SEQ ID NO: 1201212 - protein, 9 aa, Mycobacterium
EPEYPSTDR

SEQ ID NO: 1201213 - protein, 8 aa, Mycobacterium
EPGAEPMA

SEQ ID NO: 1201214 - protein, 19 aa, Mycobacterium
EPGAGSDAAAVATKARRVD

SEQ ID NO: 1201215 - protein, 22 aa, Mycobacterium
EPGAGSDAAAVRTSAKKVDGGW

SEQ ID NO: 1201216 - protein, 13 aa, Mycobacterium
EPGAGSDASALRT

SEQ ID NO: 1201217 - protein, 11 aa, Mycobacterium
EPGAGSDLAGI

SEQ ID NO: 1201218 - protein, 11 aa, Mycobacterium
EPGAGSDLAGV

SEQ ID NO: 1201219 - protein, 21 aa, Mycobacterium
EPGAGSDLASLTTKATKVDGG

SEQ ID NO: 1201220 - protein, 22 aa, Mycobacterium
EPGAGSDLASLTTRATKVDGGW

SEQ ID NO: 1201221 - protein, 19 aa, Mycobacterium
EPGAQGGSDAEVQLLTNTR

SEQ ID NO: 1201222 - protein, 11 aa, Mycobacterium
EPGAQLPDRPA

SEQ ID NO: 1201223 - protein, 14 aa, Mycobacterium
EPGASSDGESATAG

SEQ ID NO: 1201224 - protein, 4 aa, Mycobacterium
EPGD

SEQ ID NO: 1201225 - protein, 19 aa, Mycobacterium
EPGDAAGQQPPVFGQPGPV

SEQ ID NO: 1201226 - protein, 20 aa, Mycobacterium
EPGDDASAAVSGLGTVSVTF

SEQ ID NO: 1201227 - protein, 5 aa, Mycobacterium
EPGDR

SEQ ID NO: 1201228 - protein, 6 aa, Mycobacterium
EPGEAL

SEQ ID NO: 1201229 - protein, 5 aa, Mycobacterium
EPGEL

SEQ ID NO: 1201230 - protein, 8 aa, Mycobacterium
EPGETAGF

SEQ ID NO: 1201231 - protein, 4 aa, Mycobacterium
EPGG

SEQ ID NO: 1201232 - protein, 5 aa, Mycobacterium
EPGGE

SEQ ID NO: 1201233 - protein, 6 aa, Mycobacterium
EPGGSI

SEQ ID NO: 1201234 - protein, 6 aa, Mycobacterium
EPGGTA

SEQ ID NO: 1201235 - protein, 5 aa, Mycobacterium
EPGGW

SEQ ID NO: 1201236 - protein, 4 aa, Mycobacterium
EPGK

SEQ ID NO: 1201237 - protein, 4 aa, Mycobacterium
EPGL

SEQ ID NO: 1201238 - protein, 18 aa, Mycobacterium
EPGMTPPTRNRSLGSGSC

SEQ ID NO: 1201239 - protein, 14 aa, Mycobacterium
EPGNPPRNRRQEET

SEQ ID NO: 1201240 - protein, 25 aa, Mycobacterium
EPGPEYAEETRKAATACPALAIHIE

SEQ ID NO: 1201241 - protein, 13 aa, Mycobacterium
EPGQAREDGTVEH

SEQ ID NO: 1201242 - protein, 6 aa, Mycobacterium
EPGRQV

SEQ ID NO: 1201243 - protein, 5 aa, Mycobacterium
EPGRT

SEQ ID NO: 1201244 - protein, 6 aa, Mycobacterium
EPGSPE

SEQ ID NO: 1201245 - protein, 6 aa, Mycobacterium
EPGTDA

SEQ ID NO: 1201246 - protein, 7 aa, Mycobacterium
EPGTPGL

SEQ ID NO: 1201247 - protein, 35 aa, Mycobacterium
EPGTPPPGVAGQDAYGIGGPSVTLPNQTPPPAPAV

SEQ ID NO: 1201248 - protein, 8 aa, Mycobacterium
EPGTPSHA

SEQ ID NO: 1201249 - protein, 10 aa, Mycobacterium
EPGTPSPEAR

SEQ ID NO: 1201250 - protein, 9 aa, Mycobacterium
EPGTSAADA

SEQ ID NO: 1201251 - protein, 9 aa, Mycobacterium
EPGTVTPTT

SEQ ID NO: 1201252 - protein, 16 aa, Mycobacterium
EPGYGPGTQFASNGSH

SEQ ID NO: 1201253 - protein, 10 aa, Mycobacterium
EPHAGADPTM

SEQ ID NO: 1201254 - protein, 4 aa, Mycobacterium
EPHG

SEQ ID NO: 1201255 - protein, 13 aa, Mycobacterium
EPHGPMATDESAK

SEQ ID NO: 1201256 - protein, 8 aa, Mycobacterium
EPHGSSVT

SEQ ID NO: 1201257 - protein, 15 aa, Mycobacterium
EPHPQGGWQQARRDR

SEQ ID NO: 1201258 - protein, 4 aa, Mycobacterium
EPIE

SEQ ID NO: 1201259 - protein, 14 aa, Mycobacterium
EPIGAGHRPTTDGH

SEQ ID NO: 1201260 - protein, 5 aa, Mycobacterium
EPINP

SEQ ID NO: 1201261 - protein, 14 aa, Mycobacterium
EPIPGLSTARNTGL

SEQ ID NO: 1201262 - protein, 6 aa, Mycobacterium
EPISSA

SEQ ID NO: 1201263 - protein, 8 aa, Mycobacterium
EPISSRGA

SEQ ID NO: 1201264 - protein, 5 aa, Mycobacterium
EPKHG

SEQ ID NO: 1201265 - protein, 5 aa, Mycobacterium
EPKKE

SEQ ID NO: 1201266 - protein, 6 aa, Mycobacterium
EPKTDK

SEQ ID NO: 1201267 - protein, 5 aa, Mycobacterium
EPLAP

SEQ ID NO: 1201268 - protein, 21 aa, Mycobacterium
EPLARRESGFDEDDDRGDDEF

SEQ ID NO: 1201269 - protein, 4 aa, Mycobacterium
EPLD

SEQ ID NO: 1201270 - protein, 11 aa, Mycobacterium
EPLGTGGGIAN

SEQ ID NO: 1201271 - protein, 7 aa, Mycobacterium
EPLPAEG

SEQ ID NO: 1201272 - protein, 18 aa, Mycobacterium
EPLPAEGEVYPVAFAKLL

SEQ ID NO: 1201273 - protein, 6 aa, Mycobacterium
EPLPGA

SEQ ID NO: 1201274 - protein, 8 aa, Mycobacterium
EPLPGAGG

SEQ ID NO: 1201275 - protein, 22 aa, Mycobacterium
EPLPPLGEEGTIEPRRERTGAA

SEQ ID NO: 1201276 - protein, 5 aa, Mycobacterium
EPLPV

SEQ ID NO: 1201277 - protein, 4 aa, Mycobacterium
EPLR

SEQ ID NO: 1201278 - protein, 13 aa, Mycobacterium
EPLSSGRARLDTA

SEQ ID NO: 1201279 - protein, 4 aa, Mycobacterium
EPLT

SEQ ID NO: 1201280 - protein, 5 aa, Mycobacterium
EPLTE

SEQ ID NO: 1201281 - protein, 11 aa, Mycobacterium
EPLTEESRSAI

SEQ ID NO: 1201282 - protein, 6 aa, Mycobacterium
EPLTVT

SEQ ID NO: 1201283 - protein, 7 aa, Mycobacterium
EPMGDDG

SEQ ID NO: 1201284 - protein, 4 aa, Mycobacterium
EPMR

SEQ ID NO: 1201285 - protein, 6 aa, Mycobacterium
EPMSSA

SEQ ID NO: 1201286 - protein, 11 aa, Mycobacterium
EPNDDPQYDGD

SEQ ID NO: 1201287 - protein, 7 aa, Mycobacterium
EPNPLSA

SEQ ID NO: 1201288 - protein, 4 aa, Mycobacterium
EPNQ

SEQ ID NO: 1201289 - protein, 7 aa, Mycobacterium
EPNQDDL

SEQ ID NO: 1201290 - protein, 7 aa, Mycobacterium
EPPAAVA

SEQ ID NO: 1201291 - protein, 5 aa, Mycobacterium
EPPAE

SEQ ID NO: 1201292 - protein, 5 aa, Mycobacterium
EPPAG

SEQ ID NO: 1201293 - protein, 8 aa, Mycobacterium
EPPAGSDL

SEQ ID NO: 1201294 - protein, 33 aa, Mycobacterium
EPPAQSADLRQPPTDGKDGAAGLESATAPEPAG

SEQ ID NO: 1201295 - protein, 7 aa, Mycobacterium
EPPAQVA

SEQ ID NO: 1201296 - protein, 10 aa, Mycobacterium
EPPDALSDEE

SEQ ID NO: 1201297 - protein, 13 aa, Mycobacterium
EPPDPAAAAAGRC

SEQ ID NO: 1201298 - protein, 17 aa, Mycobacterium
EPPDPFRHGEAETAAAL

SEQ ID NO: 1201299 - protein, 8 aa, Mycobacterium
EPPDQVAE

SEQ ID NO: 1201300 - protein, 7 aa, Mycobacterium
EPPDSPA

SEQ ID NO: 1201301 - protein, 6 aa, Mycobacterium
EPPEAM

SEQ ID NO: 1201302 - protein, 5 aa, Mycobacterium
EPPED

SEQ ID NO: 1201303 - protein, 8 aa, Mycobacterium
EPPEGDNT

SEQ ID NO: 1201304 - protein, 11 aa, Mycobacterium
EPPGGEISRQV

SEQ ID NO: 1201305 - protein, 14 aa, Mycobacterium
EPPGGKLSSTASGL

SEQ ID NO: 1201306 - protein, 27 aa, Mycobacterium
EPPNYEPSPSDSIGARAQARGVSPLEE

SEQ ID NO: 1201307 - protein, 32 aa, Mycobacterium
EPPPEKRRERRERDGRDGDDRGPRKPRERRSD

SEQ ID NO: 1201308 - protein, 38 aa, Mycobacterium
EPPPQPEPDADSDADVEPKPLPDPADLQPSITTTSDEQ

SEQ ID NO: 1201309 - protein, 39 aa, Mycobacterium
EPPPQPEPDADSDADVEPKPLPDPADLQPSITTTSDEQY

SEQ ID NO: 1201310 - protein, 42 aa, Mycobacterium
EPPPQPEPEPEPDADSDADVEPKPLPDPADLQPSITTTSDEQ

SEQ ID NO: 1201311 - protein, 8 aa, Mycobacterium
EPPQGGSI

SEQ ID NO: 1201312 - protein, 6 aa, Mycobacterium
EPPQNQ

SEQ ID NO: 1201313 - protein, 6 aa, Mycobacterium
EPPTDV

SEQ ID NO: 1201314 - protein, 7 aa, Mycobacterium
EPPTSDV

SEQ ID NO: 1201315 - protein, 14 aa, Mycobacterium
EPPVTTREEEAARA

SEQ ID NO: 1201316 - protein, 8 aa, Mycobacterium
EPQAADTL

SEQ ID NO: 1201317 - protein, 4 aa, Mycobacterium
EPQF

SEQ ID NO: 1201318 - protein, 4 aa, Mycobacterium
EPQH

SEQ ID NO: 1201319 - protein, 5 aa, Mycobacterium
EPQHF

SEQ ID NO: 1201320 - protein, 13 aa, Mycobacterium
EPQPIDDDGRDEY

SEQ ID NO: 1201321 - protein, 7 aa, Mycobacterium
EPQPPMR

SEQ ID NO: 1201322 - protein, 6 aa, Mycobacterium
EPQPQV

SEQ ID NO: 1201323 - protein, 5 aa, Mycobacterium
EPQSL

SEQ ID NO: 1201324 - protein, 10 aa, Mycobacterium
EPQSSGVGGG

SEQ ID NO: 1201325 - protein, 5 aa, Mycobacterium
EPQVP

SEQ ID NO: 1201326 - protein, 6 aa, Mycobacterium
EPQVPR

SEQ ID NO: 1201327 - protein, 4 aa, Mycobacterium
EPRD

SEQ ID NO: 1201328 - protein, 5 aa, Mycobacterium
EPRHG

SEQ ID NO: 1201329 - protein, 4 aa, Mycobacterium
EPRI

SEQ ID NO: 1201330 - protein, 7 aa, Mycobacterium
EPRPDQS

SEQ ID NO: 1201331 - protein, 7 aa, Mycobacterium
EPRPDQT

SEQ ID NO: 1201332 - protein, 6 aa, Mycobacterium
EPRPYR

SEQ ID NO: 1201333 - protein, 5 aa, Mycobacterium
EPRQT

SEQ ID NO: 1201334 - protein, 6 aa, Mycobacterium
EPRRAA

SEQ ID NO: 1201335 - protein, 11 aa, Mycobacterium
EPRRGSSPATR

SEQ ID NO: 1201336 - protein, 8 aa, Mycobacterium
EPRRLATR

SEQ ID NO: 1201337 - protein, 16 aa, Mycobacterium
EPRRLATRTDTQVLGV

SEQ ID NO: 1201338 - protein, 7 aa, Mycobacterium
EPRSENS

SEQ ID NO: 1201339 - protein, 8 aa, Mycobacterium
EPRSVDAA

SEQ ID NO: 1201340 - protein, 4 aa, Mycobacterium
EPRT

SEQ ID NO: 1201341 - protein, 9 aa, Mycobacterium
EPRTLSDPQ

SEQ ID NO: 1201342 - protein, 12 aa, Mycobacterium
EPRWPASHSEAA

SEQ ID NO: 1201343 - protein, 10 aa, Mycobacterium
EPRYSPAAQQ

SEQ ID NO: 1201344 - protein, 7 aa, Mycobacterium
EPSAASC

SEQ ID NO: 1201345 - protein, 14 aa, Mycobacterium
EPSACPSITEGEYR

SEQ ID NO: 1201346 - protein, 13 aa, Mycobacterium
EPSCGPVSDDPTL

SEQ ID NO: 1201347 - protein, 6 aa, Mycobacterium
EPSDLV

SEQ ID NO: 1201348 - protein, 9 aa, Mycobacterium
EPSDSTERV

SEQ ID NO: 1201349 - protein, 5 aa, Mycobacterium
EPSEI

SEQ ID NO: 1201350 - protein, 8 aa, Mycobacterium
EPSERRGL

SEQ ID NO: 1201351 - protein, 8 aa, Mycobacterium
EPSETNEV

SEQ ID NO: 1201352 - protein, 14 aa, Mycobacterium
EPSFGSDSAAVSTT

SEQ ID NO: 1201353 - protein, 4 aa, Mycobacterium
EPSG

SEQ ID NO: 1201354 - protein, 5 aa, Mycobacterium
EPSGA

SEQ ID NO: 1201355 - protein, 9 aa, Mycobacterium
EPSGAAARD

SEQ ID NO: 1201356 - protein, 8 aa, Mycobacterium
EPSGGGPA

SEQ ID NO: 1201357 - protein, 7 aa, Mycobacterium
EPSGTQT

SEQ ID NO: 1201358 - protein, 13 aa, Mycobacterium
EPSPGQDTYSESP

SEQ ID NO: 1201359 - protein, 7 aa, Mycobacterium
EPSQRQD

SEQ ID NO: 1201360 - protein, 9 aa, Mycobacterium
EPSRAPGLH

SEQ ID NO: 1201361 - protein, 15 aa, Mycobacterium
EPSSAVRGAESSRNV

SEQ ID NO: 1201362 - protein, 8 aa, Mycobacterium
EPSSGEVR

SEQ ID NO: 1201363 - protein, 5 aa, Mycobacterium
EPSSP

SEQ ID NO: 1201364 - protein, 7 aa, Mycobacterium
EPSTGLD

SEQ ID NO: 1201365 - protein, 11 aa, Mycobacterium
EPSTGSFAGEK

SEQ ID NO: 1201366 - protein, 6 aa, Mycobacterium
EPSTVG

SEQ ID NO: 1201367 - protein, 18 aa, Mycobacterium
EPSVPPPPAVQAGPDTSL

SEQ ID NO: 1201368 - protein, 23 aa, Mycobacterium
EPTAETGAVERIPNDRRPTDDEI

SEQ ID NO: 1201369 - protein, 12 aa, Mycobacterium
EPTAQGAVWFLQ

SEQ ID NO: 1201370 - protein, 15 aa, Mycobacterium
EPTARAAATDADAAR

SEQ ID NO: 1201371 - protein, 10 aa, Mycobacterium
EPTATLSAGE

SEQ ID NO: 1201372 - protein, 8 aa, Mycobacterium
EPTATPSW

SEQ ID NO: 1201373 - protein, 21 aa, Mycobacterium
EPTEAGTRLTETRHAENGTTA

SEQ ID NO: 1201374 - protein, 16 aa, Mycobacterium
EPTGAATGNLATEGAT

SEQ ID NO: 1201375 - protein, 5 aa, Mycobacterium
EPTGP

SEQ ID NO: 1201376 - protein, 5 aa, Mycobacterium
EPTHY

SEQ ID NO: 1201377 - protein, 4 aa, Mycobacterium
EPTL

SEQ ID NO: 1201378 - protein, 4 aa, Mycobacterium
EPTN

SEQ ID NO: 1201379 - protein, 7 aa, Mycobacterium
EPTNDVD

SEQ ID NO: 1201380 - protein, 5 aa, Mycobacterium
EPTNH

SEQ ID NO: 1201381 - protein, 5 aa, Mycobacterium
EPTPD

SEQ ID NO: 1201382 - protein, 5 aa, Mycobacterium
EPTPI

SEQ ID NO: 1201383 - protein, 8 aa, Mycobacterium
EPTPPLSE

SEQ ID NO: 1201384 - protein, 7 aa, Mycobacterium
EPTPPPI

SEQ ID NO: 1201385 - protein, 10 aa, Mycobacterium
EPTPVPGTRA

SEQ ID NO: 1201386 - protein, 8 aa, Mycobacterium
EPTQEAQD

SEQ ID NO: 1201387 - protein, 4 aa, Mycobacterium
EPTR

SEQ ID NO: 1201388 - protein, 5 aa, Mycobacterium
EPTRG

SEQ ID NO: 1201389 - protein, 5 aa, Mycobacterium
EPTRT

SEQ ID NO: 1201390 - protein, 9 aa, Mycobacterium
EPTSGNTGI

SEQ ID NO: 1201391 - protein, 15 aa, Mycobacterium
EPTSGQLVDSEGRPV

SEQ ID NO: 1201392 - protein, 8 aa, Mycobacterium
EPTSGTVT

SEQ ID NO: 1201393 - protein, 11 aa, Mycobacterium
EPTTEAATETH

SEQ ID NO: 1201394 - protein, 23 aa, Mycobacterium
EPTTEPDEKPHSRGVTVTPGRNG

SEQ ID NO: 1201395 - protein, 6 aa, Mycobacterium
EPTTGE

SEQ ID NO: 1201396 - protein, 15 aa, Mycobacterium
EPTTPPSNTPGEEQA

SEQ ID NO: 1201397 - protein, 12 aa, Mycobacterium
EPTTRRGQFDDG

SEQ ID NO: 1201398 - protein, 5 aa, Mycobacterium
EPTTT

SEQ ID NO: 1201399 - protein, 14 aa, Mycobacterium
EPTYTEGTGDRSKA

SEQ ID NO: 1201400 - protein, 26 aa, Mycobacterium
EPVAAGDAAGTGDGSVRGTPAGPGVV

SEQ ID NO: 1201401 - protein, 6 aa, Mycobacterium
EPVAPS

SEQ ID NO: 1201402 - protein, 14 aa, Mycobacterium
EPVASGRGETPAEL

SEQ ID NO: 1201403 - protein, 7 aa, Mycobacterium
EPVDAAK

SEQ ID NO: 1201404 - protein, 10 aa, Mycobacterium
EPVDPEPNTL

SEQ ID NO: 1201405 - protein, 11 aa, Mycobacterium
EPVEGGNAGMG

SEQ ID NO: 1201406 - protein, 10 aa, Mycobacterium
EPVEPEPNTL

SEQ ID NO: 1201407 - protein, 4 aa, Mycobacterium
EPVG

SEQ ID NO: 1201408 - protein, 8 aa, Mycobacterium
EPVGDARD

SEQ ID NO: 1201409 - protein, 6 aa, Mycobacterium
EPVGDP

SEQ ID NO: 1201410 - protein, 23 aa, Mycobacterium
EPVGKGGNTFDPDRVKYAWKVCP

SEQ ID NO: 1201411 - protein, 10 aa, Mycobacterium
EPVGPDNPHG

SEQ ID NO: 1201412 - protein, 13 aa, Mycobacterium
EPVGTGRVERTEP

SEQ ID NO: 1201413 - protein, 7 aa, Mycobacterium
EPVLTGT

SEQ ID NO: 1201414 - protein, 7 aa, Mycobacterium
EPVPGAV

SEQ ID NO: 1201415 - protein, 17 aa, Mycobacterium
EPVPSVPGSAPDDPPLK

SEQ ID NO: 1201416 - protein, 6 aa, Mycobacterium
EPVPVP

SEQ ID NO: 1201417 - protein, 9 aa, Mycobacterium
EPVSEGTGA

SEQ ID NO: 1201418 - protein, 8 aa, Mycobacterium
EPVSGTSH

SEQ ID NO: 1201419 - protein, 4 aa, Mycobacterium
EPVT

SEQ ID NO: 1201420 - protein, 12 aa, Mycobacterium
EPVTARAPGHGW

SEQ ID NO: 1201421 - protein, 11 aa, Mycobacterium
EPWGSDPFGNT

SEQ ID NO: 1201422 - protein, 7 aa, Mycobacterium
EPWSRPG

SEQ ID NO: 1201423 - protein, 6 aa, Mycobacterium
EPYSTR

SEQ ID NO: 1201424 - protein, 4 aa, Mycobacterium
EQAA

SEQ ID NO: 1201425 - protein, 33 aa, Mycobacterium
EQAAGAAGHDLGDSVTAVDEPAPMESDAAAAVR

SEQ ID NO: 1201426 - protein, 5 aa, Mycobacterium
EQAAQ

SEQ ID NO: 1201427 - protein, 7 aa, Mycobacterium
EQADEAG

SEQ ID NO: 1201428 - protein, 6 aa, Mycobacterium
EQADEL

SEQ ID NO: 1201429 - protein, 7 aa, Mycobacterium
EQAEHAT

SEQ ID NO: 1201430 - protein, 12 aa, Mycobacterium
EQAESAGGAPPR

SEQ ID NO: 1201431 - protein, 8 aa, Mycobacterium
EQAETPEF

SEQ ID NO: 1201432 - protein, 9 aa, Mycobacterium
EQAGAAEPN

SEQ ID NO: 1201433 - protein, 7 aa, Mycobacterium
EQAGAAR

SEQ ID NO: 1201434 - protein, 11 aa, Mycobacterium
EQAGDPDPVAA

SEQ ID NO: 1201435 - protein, 6 aa, Mycobacterium
EQAGPA

SEQ ID NO: 1201436 - protein, 9 aa, Mycobacterium
EQAGRAKDS

SEQ ID NO: 1201437 - protein, 9 aa, Mycobacterium
EQAGTPLTP

SEQ ID NO: 1201438 - protein, 5 aa, Mycobacterium
EQAGY

SEQ ID NO: 1201439 - protein, 35 aa, Mycobacterium
EQAKERGEQVTAPAPMPYDRPTQERRAKRADKELR

SEQ ID NO: 1201440 - protein, 14 aa, Mycobacterium
EQALETRNDAQAAN

SEQ ID NO: 1201441 - protein, 22 aa, Mycobacterium
EQAPAKAGSQPASAAANRTDEP

SEQ ID NO: 1201442 - protein, 11 aa, Mycobacterium
EQAPSTGGRPA

SEQ ID NO: 1201443 - protein, 4 aa, Mycobacterium
EQAQ

SEQ ID NO: 1201444 - protein, 20 aa, Mycobacterium
EQARKTVRSAGLTDRATIES

SEQ ID NO: 1201445 - protein, 7 aa, Mycobacterium
EQARNAL

SEQ ID NO: 1201446 - protein, 8 aa, Mycobacterium
EQARNNDH

SEQ ID NO: 1201447 - protein, 7 aa, Mycobacterium
EQARTHG

SEQ ID NO: 1201448 - protein, 9 aa, Mycobacterium
EQASLQDTN

SEQ ID NO: 1201449 - protein, 10 aa, Mycobacterium
EQASSWAGRA

SEQ ID NO: 1201450 - protein, 22 aa, Mycobacterium
EQASVAAADAARAAGESDADQL

SEQ ID NO: 1201451 - protein, 34 aa, Mycobacterium
EQATESVVKTEKSTTEEDEISDAIKEENRNDTKF

SEQ ID NO: 1201452 - protein, 5 aa, Mycobacterium
EQDAP

SEQ ID NO: 1201453 - protein, 10 aa, Mycobacterium
EQDEPADPAA

SEQ ID NO: 1201454 - protein, 4 aa, Mycobacterium
EQDG

SEQ ID NO: 1201455 - protein, 8 aa, Mycobacterium
EQDRRRWD

SEQ ID NO: 1201456 - protein, 10 aa, Mycobacterium
EQDSPRRLPS

SEQ ID NO: 1201457 - protein, 4 aa, Mycobacterium
EQDT

SEQ ID NO: 1201458 - protein, 12 aa, Mycobacterium
EQDTGVYPSDAR

SEQ ID NO: 1201459 - protein, 7 aa, Mycobacterium
EQDYPGP

SEQ ID NO: 1201460 - protein, 5 aa, Mycobacterium
EQEDR

SEQ ID NO: 1201461 - protein, 6 aa, Mycobacterium
EQEEKR

SEQ ID NO: 1201462 - protein, 15 aa, Mycobacterium
EQEGGQFTDENLTPT

SEQ ID NO: 1201463 - protein, 7 aa, Mycobacterium
EQEKGGI

SEQ ID NO: 1201464 - protein, 9 aa, Mycobacterium
EQENRELER

SEQ ID NO: 1201465 - protein, 7 aa, Mycobacterium
EQERGIT

SEQ ID NO: 1201466 - protein, 5 aa, Mycobacterium
EQESA

SEQ ID NO: 1201467 - protein, 8 aa, Mycobacterium
EQETRRIS

SEQ ID NO: 1201468 - protein, 6 aa, Mycobacterium
EQFGKP

SEQ ID NO: 1201469 - protein, 7 aa, Mycobacterium
EQFGKPI

SEQ ID NO: 1201470 - protein, 6 aa, Mycobacterium
EQGAEC

SEQ ID NO: 1201471 - protein, 5 aa, Mycobacterium
EQGAG

SEQ ID NO: 1201472 - protein, 6 aa, Mycobacterium
EQGAGK

SEQ ID NO: 1201473 - protein, 6 aa, Mycobacterium
EQGASE

SEQ ID NO: 1201474 - protein, 9 aa, Mycobacterium
EQGDGDQVF

SEQ ID NO: 1201475 - protein, 5 aa, Mycobacterium
EQGDR

SEQ ID NO: 1201476 - protein, 6 aa, Mycobacterium
EQGDSD

SEQ ID NO: 1201477 - protein, 17 aa, Mycobacterium
EQGEVPASAKGEAVKGD

SEQ ID NO: 1201478 - protein, 8 aa, Mycobacterium
EQGFSSGD

SEQ ID NO: 1201479 - protein, 16 aa, Mycobacterium
EQGGGHAASGYAHATG

SEQ ID NO: 1201480 - protein, 6 aa, Mycobacterium
EQGGTE

SEQ ID NO: 1201481 - protein, 7 aa, Mycobacterium
EQGGWTE

SEQ ID NO: 1201482 - protein, 9 aa, Mycobacterium
EQGKEADPR

SEQ ID NO: 1201483 - protein, 15 aa, Mycobacterium
EQGLQRTRERRPDLL

SEQ ID NO: 1201484 - protein, 12 aa, Mycobacterium
EQGMDPAEAEPL

SEQ ID NO: 1201485 - protein, 14 aa, Mycobacterium
EQGNKGPQAVRVTA

SEQ ID NO: 1201486 - protein, 15 aa, Mycobacterium
EQGPDRAPARPADGE

SEQ ID NO: 1201487 - protein, 16 aa, Mycobacterium
EQGPGANRDAQAAAAA

SEQ ID NO: 1201488 - protein, 5 aa, Mycobacterium
EQGPS

SEQ ID NO: 1201489 - protein, 5 aa, Mycobacterium
EQGQL

SEQ ID NO: 1201490 - protein, 10 aa, Mycobacterium
EQGQQVKRTG

SEQ ID NO: 1201491 - protein, 10 aa, Mycobacterium
EQGRSPADDF

SEQ ID NO: 1201492 - protein, 5 aa, Mycobacterium
EQGRT

SEQ ID NO: 1201493 - protein, 7 aa, Mycobacterium
EQGRTGP

SEQ ID NO: 1201494 - protein, 6 aa, Mycobacterium
EQGSGP

SEQ ID NO: 1201495 - protein, 15 aa, Mycobacterium
EQGSPERDFGPRSED

SEQ ID NO: 1201496 - protein, 14 aa, Mycobacterium
EQGTGHELYTDHVD

SEQ ID NO: 1201497 - protein, 8 aa, Mycobacterium
EQGTTDGV

SEQ ID NO: 1201498 - protein, 11 aa, Mycobacterium
EQGTVPLPGSE

SEQ ID NO: 1201499 - protein, 5 aa, Mycobacterium
EQGYD

SEQ ID NO: 1201500 - protein, 8 aa, Mycobacterium
EQHGPQLP

SEQ ID NO: 1201501 - protein, 8 aa, Mycobacterium
EQHWTNPE

SEQ ID NO: 1201502 - protein, 4 aa, Mycobacterium
EQIG

SEQ ID NO: 1201503 - protein, 4 aa, Mycobacterium
EQIP

SEQ ID NO: 1201504 - protein, 5 aa, Mycobacterium
EQIPT

SEQ ID NO: 1201505 - protein, 5 aa, Mycobacterium
EQIRP

SEQ ID NO: 1201506 - protein, 15 aa, Mycobacterium
EQKAQMEAQTAQGFG

SEQ ID NO: 1201507 - protein, 51 aa, Mycobacterium
EQKFGNGEKDEKKGDAEALGVKEDEKKDEGTKDGEALAEQANLPPAQRDPA

SEQ ID NO: 1201508 - protein, 9 aa, Mycobacterium
EQKKRGREQ

SEQ ID NO: 1201509 - protein, 6 aa, Mycobacterium
EQLDSW

SEQ ID NO: 1201510 - protein, 6 aa, Mycobacterium
EQLGKA

SEQ ID NO: 1201511 - protein, 11 aa, Mycobacterium
EQLGPGGPADA

SEQ ID NO: 1201512 - protein, 11 aa, Mycobacterium
EQLGQGKENAR

SEQ ID NO: 1201513 - protein, 7 aa, Mycobacterium
EQLGTEP

SEQ ID NO: 1201514 - protein, 8 aa, Mycobacterium
EQLRDDER

SEQ ID NO: 1201515 - protein, 8 aa, Mycobacterium
EQLTDNEA

SEQ ID NO: 1201516 - protein, 9 aa, Mycobacterium
EQNAADPDF

SEQ ID NO: 1201517 - protein, 7 aa, Mycobacterium
EQNAGQS

SEQ ID NO: 1201518 - protein, 9 aa, Mycobacterium
EQNDEWAEG

SEQ ID NO: 1201519 - protein, 11 aa, Mycobacterium
EQNGVGSRSGG

SEQ ID NO: 1201520 - protein, 16 aa, Mycobacterium
EQNKDAAIAATDEENY

SEQ ID NO: 1201521 - protein, 8 aa, Mycobacterium
EQNNRDLG

SEQ ID NO: 1201522 - protein, 18 aa, Mycobacterium
EQNRRSHPLQGDQTLAEG

SEQ ID NO: 1201523 - protein, 25 aa, Mycobacterium
EQNSQAVADGADVKRPRPRRRGEVS

SEQ ID NO: 1201524 - protein, 6 aa, Mycobacterium
EQNVES

SEQ ID NO: 1201525 - protein, 15 aa, Mycobacterium
EQPATELPMAQRYFL

SEQ ID NO: 1201526 - protein, 10 aa, Mycobacterium
EQPDSGTVKI

SEQ ID NO: 1201527 - protein, 5 aa, Mycobacterium
EQPEP

SEQ ID NO: 1201528 - protein, 7 aa, Mycobacterium
EQPEPIH

SEQ ID NO: 1201529 - protein, 4 aa, Mycobacterium
EQPG

SEQ ID NO: 1201530 - protein, 6 aa, Mycobacterium
EQPGAA

SEQ ID NO: 1201531 - protein, 8 aa, Mycobacterium
EQPGAAQT

SEQ ID NO: 1201532 - protein, 15 aa, Mycobacterium
EQPGDREDRAGEPFV

SEQ ID NO: 1201533 - protein, 15 aa, Mycobacterium
EQPGDREDVAGEPFV

SEQ ID NO: 1201534 - protein, 6 aa, Mycobacterium
EQPGMD

SEQ ID NO: 1201535 - protein, 6 aa, Mycobacterium
EQPPLR

SEQ ID NO: 1201536 - protein, 5 aa, Mycobacterium
EQPPN

SEQ ID NO: 1201537 - protein, 6 aa, Mycobacterium
EQPPRA

SEQ ID NO: 1201538 - protein, 7 aa, Mycobacterium
EQPQNAE

SEQ ID NO: 1201539 - protein, 7 aa, Mycobacterium
EQPSRLA

SEQ ID NO: 1201540 - protein, 5 aa, Mycobacterium
EQPTH

SEQ ID NO: 1201541 - protein, 14 aa, Mycobacterium
EQPVTYNQATTDRA

SEQ ID NO: 1201542 - protein, 7 aa, Mycobacterium
EQQGTRW

SEQ ID NO: 1201543 - protein, 11 aa, Mycobacterium
EQQGTTASKEL

SEQ ID NO: 1201544 - protein, 4 aa, Mycobacterium
EQQM

SEQ ID NO: 1201545 - protein, 8 aa, Mycobacterium
EQQPRTDA

SEQ ID NO: 1201546 - protein, 10 aa, Mycobacterium
EQQRGPQPSV

SEQ ID NO: 1201547 - protein, 18 aa, Mycobacterium
EQQRPDTVTGGGAPDTPW

SEQ ID NO: 1201548 - protein, 14 aa, Mycobacterium
EQQYARAGKLADAD

SEQ ID NO: 1201549 - protein, 12 aa, Mycobacterium
EQRAASGAGRID

SEQ ID NO: 1201550 - protein, 8 aa, Mycobacterium
EQRAAYGG

SEQ ID NO: 1201551 - protein, 21 aa, Mycobacterium
EQRADSATGFGARPDDGGPAD

SEQ ID NO: 1201552 - protein, 7 aa, Mycobacterium
EQRASFA

SEQ ID NO: 1201553 - protein, 10 aa, Mycobacterium
EQRDDPSLRG

SEQ ID NO: 1201554 - protein, 6 aa, Mycobacterium
EQRDGR

SEQ ID NO: 1201555 - protein, 17 aa, Mycobacterium
EQREAEGGSKVPEDTLT

SEQ ID NO: 1201556 - protein, 5 aa, Mycobacterium
EQRGF

SEQ ID NO: 1201557 - protein, 6 aa, Mycobacterium
EQRGSV

SEQ ID NO: 1201558 - protein, 12 aa, Mycobacterium
EQRLGDGRPPGA

SEQ ID NO: 1201559 - protein, 5 aa, Mycobacterium
EQRNS

SEQ ID NO: 1201560 - protein, 5 aa, Mycobacterium
EQRPD

SEQ ID NO: 1201561 - protein, 9 aa, Mycobacterium
EQRREPGET

SEQ ID NO: 1201562 - protein, 8 aa, Mycobacterium
EQRRSARS

SEQ ID NO: 1201563 - protein, 11 aa, Mycobacterium
EQRRVQGRRRV

SEQ ID NO: 1201564 - protein, 6 aa, Mycobacterium
EQSACG

SEQ ID NO: 1201565 - protein, 7 aa, Mycobacterium
EQSCTAG

SEQ ID NO: 1201566 - protein, 10 aa, Mycobacterium
EQSDQQIADQ

SEQ ID NO: 1201567 - protein, 16 aa, Mycobacterium
EQSERVKGRTYPNPPV

SEQ ID NO: 1201568 - protein, 10 aa, Mycobacterium
EQSESLGPKS

SEQ ID NO: 1201569 - protein, 13 aa, Mycobacterium
EQSGDADADDAAA

SEQ ID NO: 1201570 - protein, 7 aa, Mycobacterium
EQSGFGT

SEQ ID NO: 1201571 - protein, 20 aa, Mycobacterium
EQSGGANVPSEGESYSDSAH

SEQ ID NO: 1201572 - protein, 9 aa, Mycobacterium
EQSGTKEDV

SEQ ID NO: 1201573 - protein, 11 aa, Mycobacterium
EQSKAGEQPTA

SEQ ID NO: 1201574 - protein, 11 aa, Mycobacterium
EQSRGRGKRPV

SEQ ID NO: 1201575 - protein, 4 aa, Mycobacterium
EQSS

SEQ ID NO: 1201576 - protein, 15 aa, Mycobacterium
EQTADGRFALCGEAG

SEQ ID NO: 1201577 - protein, 5 aa, Mycobacterium
EQTAH

SEQ ID NO: 1201578 - protein, 11 aa, Mycobacterium
EQTDEAGVDDA

SEQ ID NO: 1201579 - protein, 23 aa, Mycobacterium
EQTDRVGADERKAARKARRQSGD

SEQ ID NO: 1201580 - protein, 8 aa, Mycobacterium
EQTEGGQY

SEQ ID NO: 1201581 - protein, 5 aa, Mycobacterium
EQTGG

SEQ ID NO: 1201582 - protein, 11 aa, Mycobacterium
EQTGGFEGRTK

SEQ ID NO: 1201583 - protein, 4 aa, Mycobacterium
EQTL

SEQ ID NO: 1201584 - protein, 7 aa, Mycobacterium
EQTLPGL

SEQ ID NO: 1201585 - protein, 4 aa, Mycobacterium
EQTP

SEQ ID NO: 1201586 - protein, 7 aa, Mycobacterium
EQTRTPI

SEQ ID NO: 1201587 - protein, 8 aa, Mycobacterium
EQTSEATL

SEQ ID NO: 1201588 - protein, 17 aa, Mycobacterium
EQTSLNNAQAVANPDGS

SEQ ID NO: 1201589 - protein, 9 aa, Mycobacterium
EQVAGSAEV

SEQ ID NO: 1201590 - protein, 4 aa, Mycobacterium
EQVE

SEQ ID NO: 1201591 - protein, 11 aa, Mycobacterium
EQVGGGVGRYS

SEQ ID NO: 1201592 - protein, 12 aa, Mycobacterium
EQVPDGPGSVAG

SEQ ID NO: 1201593 - protein, 11 aa, Mycobacterium
EQVPDPEVQRA

SEQ ID NO: 1201594 - protein, 7 aa, Mycobacterium
EQVPDRQ

SEQ ID NO: 1201595 - protein, 5 aa, Mycobacterium
EQVSG

SEQ ID NO: 1201596 - protein, 10 aa, Mycobacterium
EQVTTPCTPE

SEQ ID NO: 1201597 - protein, 7 aa, Mycobacterium
EQWDDGN

SEQ ID NO: 1201598 - protein, 7 aa, Mycobacterium
EQYAGPR

SEQ ID NO: 1201599 - protein, 4 aa, Mycobacterium
EQYG

SEQ ID NO: 1201600 - protein, 8 aa, Mycobacterium
EQYGGGGG

SEQ ID NO: 1201601 - protein, 12 aa, Mycobacterium
EQYRNAGQLPDG

SEQ ID NO: 1201602 - protein, 4 aa, Mycobacterium
ERAA

SEQ ID NO: 1201603 - protein, 7 aa, Mycobacterium
ERAAAEV

SEQ ID NO: 1201604 - protein, 10 aa, Mycobacterium
ERAAAHGGIS

SEQ ID NO: 1201605 - protein, 7 aa, Mycobacterium
ERAAGAT

SEQ ID NO: 1201606 - protein, 8 aa, Mycobacterium
ERAAGDPR

SEQ ID NO: 1201607 - protein, 11 aa, Mycobacterium
ERAAGRPPGSV

SEQ ID NO: 1201608 - protein, 8 aa, Mycobacterium
ERAALTGA

SEQ ID NO: 1201609 - protein, 10 aa, Mycobacterium
ERAANGPFGG

SEQ ID NO: 1201610 - protein, 6 aa, Mycobacterium
ERAAPY

SEQ ID NO: 1201611 - protein, 7 aa, Mycobacterium
ERAASAL

SEQ ID NO: 1201612 - protein, 14 aa, Mycobacterium
ERAASARTDTGPVP

SEQ ID NO: 1201613 - protein, 5 aa, Mycobacterium
ERADA

SEQ ID NO: 1201614 - protein, 12 aa, Mycobacterium
ERADGAAPVTVP

SEQ ID NO: 1201615 - protein, 5 aa, Mycobacterium
ERADH

SEQ ID NO: 1201616 - protein, 9 aa, Mycobacterium
ERADVSPPT

SEQ ID NO: 1201617 - protein, 8 aa, Mycobacterium
ERAEAGGI

SEQ ID NO: 1201618 - protein, 10 aa, Mycobacterium
ERAEAKDHHP

SEQ ID NO: 1201619 - protein, 7 aa, Mycobacterium
ERAEAMT

SEQ ID NO: 1201620 - protein, 7 aa, Mycobacterium
ERAERRD

SEQ ID NO: 1201621 - protein, 14 aa, Mycobacterium
ERAETIGATGPEVL

SEQ ID NO: 1201622 - protein, 5 aa, Mycobacterium
ERAEV

SEQ ID NO: 1201623 - protein, 9 aa, Mycobacterium
ERAEVSPPT

SEQ ID NO: 1201624 - protein, 10 aa, Mycobacterium
ERAGASGTPW

SEQ ID NO: 1201625 - protein, 20 aa, Mycobacterium
ERAGEARTDSKSRVEESRAR

SEQ ID NO: 1201626 - protein, 7 aa, Mycobacterium
ERAGGKG

SEQ ID NO: 1201627 - protein, 8 aa, Mycobacterium
ERAGRPDL

SEQ ID NO: 1201628 - protein, 9 aa, Mycobacterium
ERAGRTRAD

SEQ ID NO: 1201629 - protein, 5 aa, Mycobacterium
ERAGV

SEQ ID NO: 1201630 - protein, 16 aa, Mycobacterium
ERAHGTYRNPAGATAP

SEQ ID NO: 1201631 - protein, 5 aa, Mycobacterium
ERAHR

SEQ ID NO: 1201632 - protein, 11 aa, Mycobacterium
ERAKAGGDRIG

SEQ ID NO: 1201633 - protein, 14 aa, Mycobacterium
ERAKAKGKLAADDF

SEQ ID NO: 1201634 - protein, 8 aa, Mycobacterium
ERAKPRKI

SEQ ID NO: 1201635 - protein, 9 aa, Mycobacterium
ERAKSAAGV

SEQ ID NO: 1201636 - protein, 4 aa, Mycobacterium
ERAL

SEQ ID NO: 1201637 - protein, 6 aa, Mycobacterium
ERALSD

SEQ ID NO: 1201638 - protein, 10 aa, Mycobacterium
ERANAQSSEM

SEQ ID NO: 1201639 - protein, 4 aa, Mycobacterium
ERAP

SEQ ID NO: 1201640 - protein, 13 aa, Mycobacterium
ERAPDGVTVTDEH

SEQ ID NO: 1201641 - protein, 5 aa, Mycobacterium
ERAPR

SEQ ID NO: 1201642 - protein, 5 aa, Mycobacterium
ERAQH

SEQ ID NO: 1201643 - protein, 10 aa, Mycobacterium
ERARGRAGDA

SEQ ID NO: 1201644 - protein, 29 aa, Mycobacterium
ERARHESGSTGEKHEKKAGGGLGDIGAQA

SEQ ID NO: 1201645 - protein, 5 aa, Mycobacterium
ERARQ

SEQ ID NO: 1201646 - protein, 14 aa, Mycobacterium
ERARRLSSNTPEEL

SEQ ID NO: 1201647 - protein, 8 aa, Mycobacterium
ERARRNPK

SEQ ID NO: 1201648 - protein, 10 aa, Mycobacterium
ERARTEGPRR

SEQ ID NO: 1201649 - protein, 14 aa, Mycobacterium
ERARTRPAGSGTVA

SEQ ID NO: 1201650 - protein, 15 aa, Mycobacterium
ERASDLTDRAASLSD

SEQ ID NO: 1201651 - protein, 7 aa, Mycobacterium
ERASEPF

SEQ ID NO: 1201652 - protein, 5 aa, Mycobacterium
ERASF

SEQ ID NO: 1201653 - protein, 10 aa, Mycobacterium
ERASGLPPER

SEQ ID NO: 1201654 - protein, 9 aa, Mycobacterium
ERASPGSGD

SEQ ID NO: 1201655 - protein, 7 aa, Mycobacterium
ERASYGE

SEQ ID NO: 1201656 - protein, 5 aa, Mycobacterium
ERATA

SEQ ID NO: 1201657 - protein, 5 aa, Mycobacterium
ERATG

SEQ ID NO: 1201658 - protein, 5 aa, Mycobacterium
ERATR

SEQ ID NO: 1201659 - protein, 10 aa, Mycobacterium
ERAVPPYESP

SEQ ID NO: 1201660 - protein, 10 aa, Mycobacterium
ERAYAAREAE

SEQ ID NO: 1201661 - protein, 8 aa, Mycobacterium
ERCDDGRN

SEQ ID NO: 1201662 - protein, 12 aa, Mycobacterium
ERDAAAKAAPLR

SEQ ID NO: 1201663 - protein, 9 aa, Mycobacterium
ERDADGNLL

SEQ ID NO: 1201664 - protein, 5 aa, Mycobacterium
ERDDA

SEQ ID NO: 1201665 - protein, 5 aa, Mycobacterium
ERDDI

SEQ ID NO: 1201666 - protein, 7 aa, Mycobacterium
ERDEAGR

SEQ ID NO: 1201667 - protein, 7 aa, Mycobacterium
ERDEDLT

SEQ ID NO: 1201668 - protein, 15 aa, Mycobacterium
ERDGAKRRAAVERTY

SEQ ID NO: 1201669 - protein, 7 aa, Mycobacterium
ERDGDID

SEQ ID NO: 1201670 - protein, 9 aa, Mycobacterium
ERDGGPRIA

SEQ ID NO: 1201671 - protein, 8 aa, Mycobacterium
ERDGKVSR

SEQ ID NO: 1201672 - protein, 5 aa, Mycobacterium
ERDGP

SEQ ID NO: 1201673 - protein, 8 aa, Mycobacterium
ERDHGADI

SEQ ID NO: 1201674 - protein, 4 aa, Mycobacterium
ERDK

SEQ ID NO: 1201675 - protein, 5 aa, Mycobacterium
ERDLG

SEQ ID NO: 1201676 - protein, 4 aa, Mycobacterium
ERDP

SEQ ID NO: 1201677 - protein, 14 aa, Mycobacterium
ERDPPPSDVPPLPI

SEQ ID NO: 1201678 - protein, 5 aa, Mycobacterium
ERDPS

SEQ ID NO: 1201679 - protein, 8 aa, Mycobacterium
ERDRGSAP

SEQ ID NO: 1201680 - protein, 15 aa, Mycobacterium
ERDRQAAAVEAKRQN

SEQ ID NO: 1201681 - protein, 12 aa, Mycobacterium
ERDRQAATIEAR

SEQ ID NO: 1201682 - protein, 18 aa, Mycobacterium
ERDRSAAAAYDDVERLCD

SEQ ID NO: 1201683 - protein, 5 aa, Mycobacterium
ERDSP

SEQ ID NO: 1201684 - protein, 14 aa, Mycobacterium
ERDSPAGPTLTERE

SEQ ID NO: 1201685 - protein, 9 aa, Mycobacterium
ERDSRAAAT

SEQ ID NO: 1201686 - protein, 8 aa, Mycobacterium
ERDTREGR

SEQ ID NO: 1201687 - protein, 6 aa, Mycobacterium
ERDVDT

SEQ ID NO: 1201688 - protein, 5 aa, Mycobacterium
EREDF

SEQ ID NO: 1201689 - protein, 4 aa, Mycobacterium
EREG

SEQ ID NO: 1201690 - protein, 7 aa, Mycobacterium
EREGEDD

SEQ ID NO: 1201691 - protein, 9 aa, Mycobacterium
EREGEPSSM

SEQ ID NO: 1201692 - protein, 9 aa, Mycobacterium
EREGGDSTV

SEQ ID NO: 1201693 - protein, 7 aa, Mycobacterium
EREGIPR

SEQ ID NO: 1201694 - protein, 4 aa, Mycobacterium
EREI

SEQ ID NO: 1201695 - protein, 49 aa, Mycobacterium
EREPRKSANRGDKTSSDSEIQGISGSTRLEAKRQRRRDGRDAGRRRPPI

SEQ ID NO: 1201696 - protein, 7 aa, Mycobacterium
EREPSTL

SEQ ID NO: 1201697 - protein, 14 aa, Mycobacterium
EREQLRESRRRSYD

SEQ ID NO: 1201698 - protein, 13 aa, Mycobacterium
EREQQHLQAYITQ

SEQ ID NO: 1201699 - protein, 10 aa, Mycobacterium
ERERSGKGQV

SEQ ID NO: 1201700 - protein, 5 aa, Mycobacterium
ERESG

SEQ ID NO: 1201701 - protein, 5 aa, Mycobacterium
ERETA

SEQ ID NO: 1201702 - protein, 5 aa, Mycobacterium
ERETF

SEQ ID NO: 1201703 - protein, 6 aa, Mycobacterium
ERFERQ

SEQ ID NO: 1201704 - protein, 7 aa, Mycobacterium
ERFPEGV

SEQ ID NO: 1201705 - protein, 8 aa, Mycobacterium
ERGAPTPV

SEQ ID NO: 1201706 - protein, 5 aa, Mycobacterium
ERGAQ

SEQ ID NO: 1201707 - protein, 8 aa, Mycobacterium
ERGARPVP

SEQ ID NO: 1201708 - protein, 10 aa, Mycobacterium
ERGASKHARP

SEQ ID NO: 1201709 - protein, 10 aa, Mycobacterium
ERGASTHARP

SEQ ID NO: 1201710 - protein, 14 aa, Mycobacterium
ERGDHRGAEAIRTA

SEQ ID NO: 1201711 - protein, 11 aa, Mycobacterium
ERGDPGRTGTR

SEQ ID NO: 1201712 - protein, 4 aa, Mycobacterium
ERGE

SEQ ID NO: 1201713 - protein, 7 aa, Mycobacterium
ERGEAVD

SEQ ID NO: 1201714 - protein, 11 aa, Mycobacterium
ERGEAVGQPPL

SEQ ID NO: 1201715 - protein, 8 aa, Mycobacterium
ERGEGGNL

SEQ ID NO: 1201716 - protein, 6 aa, Mycobacterium
ERGEGS

SEQ ID NO: 1201717 - protein, 10 aa, Mycobacterium
ERGEGTSKED

SEQ ID NO: 1201718 - protein, 11 aa, Mycobacterium
ERGELSTDTDI

SEQ ID NO: 1201719 - protein, 12 aa, Mycobacterium
ERGEVRAGVDPD

SEQ ID NO: 1201720 - protein, 6 aa, Mycobacterium
ERGGRG

SEQ ID NO: 1201721 - protein, 8 aa, Mycobacterium
ERGGRSDD

SEQ ID NO: 1201722 - protein, 9 aa, Mycobacterium
ERGGTPVRS

SEQ ID NO: 1201723 - protein, 14 aa, Mycobacterium
ERGGYGANGHGNSV

SEQ ID NO: 1201724 - protein, 7 aa, Mycobacterium
ERGLPNL

SEQ ID NO: 1201725 - protein, 8 aa, Mycobacterium
ERGNADAV

SEQ ID NO: 1201726 - protein, 5 aa, Mycobacterium
ERGND

SEQ ID NO: 1201727 - protein, 14 aa, Mycobacterium
ERGNVARDSAFATS

SEQ ID NO: 1201728 - protein, 4 aa, Mycobacterium
ERGP

SEQ ID NO: 1201729 - protein, 7 aa, Mycobacterium
ERGPATA

SEQ ID NO: 1201730 - protein, 9 aa, Mycobacterium
ERGPKGQVG

SEQ ID NO: 1201731 - protein, 9 aa, Mycobacterium
ERGPSASVA

SEQ ID NO: 1201732 - protein, 8 aa, Mycobacterium
ERGQGKTR

SEQ ID NO: 1201733 - protein, 8 aa, Mycobacterium
ERGRPGER

SEQ ID NO: 1201734 - protein, 8 aa, Mycobacterium
ERGRTGER

SEQ ID NO: 1201735 - protein, 21 aa, Mycobacterium
ERGSAAVPERGSAAVPDHGSA

SEQ ID NO: 1201736 - protein, 6 aa, Mycobacterium
ERGSGA

SEQ ID NO: 1201737 - protein, 10 aa, Mycobacterium
ERGSTAPTVQ

SEQ ID NO: 1201738 - protein, 9 aa, Mycobacterium
ERGTDRDLA

SEQ ID NO: 1201739 - protein, 8 aa, Mycobacterium
ERGTPGEF

SEQ ID NO: 1201740 - protein, 9 aa, Mycobacterium
ERGTPIPLD

SEQ ID NO: 1201741 - protein, 6 aa, Mycobacterium
ERGTRR

SEQ ID NO: 1201742 - protein, 5 aa, Mycobacterium
ERGVE

SEQ ID NO: 1201743 - protein, 8 aa, Mycobacterium
ERGVPPEM

SEQ ID NO: 1201744 - protein, 19 aa, Mycobacterium
ERGVTARSLDKSAATPGQP

SEQ ID NO: 1201745 - protein, 5 aa, Mycobacterium
ERHAR

SEQ ID NO: 1201746 - protein, 5 aa, Mycobacterium
ERHGA

SEQ ID NO: 1201747 - protein, 6 aa, Mycobacterium
ERHGSG

SEQ ID NO: 1201748 - protein, 14 aa, Mycobacterium
ERHPGGTYSQAGVG

SEQ ID NO: 1201749 - protein, 7 aa, Mycobacterium
ERHRHTS

SEQ ID NO: 1201750 - protein, 13 aa, Mycobacterium
ERHRPEWKPHTLP

SEQ ID NO: 1201751 - protein, 6 aa, Mycobacterium
ERIAPD

SEQ ID NO: 1201752 - protein, 16 aa, Mycobacterium
ERIAVQGRKDAKLQKR

SEQ ID NO: 1201753 - protein, 13 aa, Mycobacterium
ERIEATSATPEQA

SEQ ID NO: 1201754 - protein, 5 aa, Mycobacterium
ERIES

SEQ ID NO: 1201755 - protein, 6 aa, Mycobacterium
ERIPDD

SEQ ID NO: 1201756 - protein, 11 aa, Mycobacterium
ERKAATPRGAA

SEQ ID NO: 1201757 - protein, 9 aa, Mycobacterium
ERKGAEAEA

SEQ ID NO: 1201758 - protein, 5 aa, Mycobacterium
ERKGE

SEQ ID NO: 1201759 - protein, 11 aa, Mycobacterium
ERKKLQTRETI

SEQ ID NO: 1201760 - protein, 8 aa, Mycobacterium
ERKKTQTR

SEQ ID NO: 1201761 - protein, 5 aa, Mycobacterium
ERKKV

SEQ ID NO: 1201762 - protein, 37 aa, Mycobacterium
ERKNAKAGGGSSHKDAGAKQPRAHGPVENRREFRRKS

SEQ ID NO: 1201763 - protein, 14 aa, Mycobacterium
ERKPAQLSGGQQQR

SEQ ID NO: 1201764 - protein, 9 aa, Mycobacterium
ERKTAYRHE

SEQ ID NO: 1201765 - protein, 5 aa, Mycobacterium
ERLAP

SEQ ID NO: 1201766 - protein, 8 aa, Mycobacterium
ERLATEGA

SEQ ID NO: 1201767 - protein, 7 aa, Mycobacterium
ERLEAPR

SEQ ID NO: 1201768 - protein, 12 aa, Mycobacterium
ERLEEGIERGAA

SEQ ID NO: 1201769 - protein, 7 aa, Mycobacterium
ERLGEHA

SEQ ID NO: 1201770 - protein, 7 aa, Mycobacterium
ERLGGDG

SEQ ID NO: 1201771 - protein, 7 aa, Mycobacterium
ERLQAPR

SEQ ID NO: 1201772 - protein, 34 aa, Mycobacterium
ERLREERTIGDERLREGRTIGDERLREGRTIGDE

SEQ ID NO: 1201773 - protein, 6 aa, Mycobacterium
ERLTES

SEQ ID NO: 1201774 - protein, 4 aa, Mycobacterium
ERMA

SEQ ID NO: 1201775 - protein, 4 aa, Mycobacterium
ERMP

SEQ ID NO: 1201776 - protein, 4 aa, Mycobacterium
ERMT

SEQ ID NO: 1201777 - protein, 8 aa, Mycobacterium
ERNAENAV

SEQ ID NO: 1201778 - protein, 12 aa, Mycobacterium
ERNAEVSDEARE

SEQ ID NO: 1201779 - protein, 11 aa, Mycobacterium
ERNDAALNAGR

SEQ ID NO: 1201780 - protein, 11 aa, Mycobacterium
ERNDGDSTGSI

SEQ ID NO: 1201781 - protein, 6 aa, Mycobacterium
ERNGPK

SEQ ID NO: 1201782 - protein, 5 aa, Mycobacterium
ERNGY

SEQ ID NO: 1201783 - protein, 7 aa, Mycobacterium
ERNKEQR

SEQ ID NO: 1201784 - protein, 6 aa, Mycobacterium
ERNKER

SEQ ID NO: 1201785 - protein, 8 aa, Mycobacterium
ERNPDDPR

SEQ ID NO: 1201786 - protein, 4 aa, Mycobacterium
ERNQ

SEQ ID NO: 1201787 - protein, 8 aa, Mycobacterium
ERNQRKAK

SEQ ID NO: 1201788 - protein, 28 aa, Mycobacterium
ERNREASTDAEYAQKSARMARDEAAKEL

SEQ ID NO: 1201789 - protein, 8 aa, Mycobacterium
ERNRYETA

SEQ ID NO: 1201790 - protein, 8 aa, Mycobacterium
ERNTQPID

SEQ ID NO: 1201791 - protein, 4 aa, Mycobacterium
ERNY

SEQ ID NO: 1201792 - protein, 4 aa, Mycobacterium
ERPA

SEQ ID NO: 1201793 - protein, 9 aa, Mycobacterium
ERPADGGAA

SEQ ID NO: 1201794 - protein, 9 aa, Mycobacterium
ERPADPQMR

SEQ ID NO: 1201795 - protein, 17 aa, Mycobacterium
ERPAETNRLLLEFLGQL

SEQ ID NO: 1201796 - protein, 6 aa, Mycobacterium
ERPAGA

SEQ ID NO: 1201797 - protein, 7 aa, Mycobacterium
ERPAPGL

SEQ ID NO: 1201798 - protein, 6 aa, Mycobacterium
ERPATA

SEQ ID NO: 1201799 - protein, 4 aa, Mycobacterium
ERPD

SEQ ID NO: 1201800 - protein, 10 aa, Mycobacterium
ERPDAESAQD

SEQ ID NO: 1201801 - protein, 6 aa, Mycobacterium
ERPEGP

SEQ ID NO: 1201802 - protein, 11 aa, Mycobacterium
ERPEPSAGPGQ

SEQ ID NO: 1201803 - protein, 5 aa, Mycobacterium
ERPET

SEQ ID NO: 1201804 - protein, 6 aa, Mycobacterium
ERPETA

SEQ ID NO: 1201805 - protein, 13 aa, Mycobacterium
ERPGIDAAPQFPP

SEQ ID NO: 1201806 - protein, 16 aa, Mycobacterium
ERPGKGPGPATKPGGD

SEQ ID NO: 1201807 - protein, 13 aa, Mycobacterium
ERPGRGGGGAQLR

SEQ ID NO: 1201808 - protein, 6 aa, Mycobacterium
ERPGTL

SEQ ID NO: 1201809 - protein, 5 aa, Mycobacterium
ERPGY

SEQ ID NO: 1201810 - protein, 4 aa, Mycobacterium
ERPH

SEQ ID NO: 1201811 - protein, 9 aa, Mycobacterium
ERPHENELR

SEQ ID NO: 1201812 - protein, 7 aa, Mycobacterium
ERPHPTK

SEQ ID NO: 1201813 - protein, 7 aa, Mycobacterium
ERPLQSG

SEQ ID NO: 1201814 - protein, 6 aa, Mycobacterium
ERPQGL

SEQ ID NO: 1201815 - protein, 19 aa, Mycobacterium
ERPSSNAVPRRRRHATAPR

SEQ ID NO: 1201816 - protein, 4 aa, Mycobacterium
ERPT

SEQ ID NO: 1201817 - protein, 6 aa, Mycobacterium
ERPTFT

SEQ ID NO: 1201818 - protein, 6 aa, Mycobacterium
ERPTSR

SEQ ID NO: 1201819 - protein, 7 aa, Mycobacterium
ERQAAEK

SEQ ID NO: 1201820 - protein, 15 aa, Mycobacterium
ERQAGADDRSKPLTD

SEQ ID NO: 1201821 - protein, 13 aa, Mycobacterium
ERQGFSPDDISGI

SEQ ID NO: 1201822 - protein, 5 aa, Mycobacterium
ERQPA

SEQ ID NO: 1201823 - protein, 5 aa, Mycobacterium
ERQPP

SEQ ID NO: 1201824 - protein, 5 aa, Mycobacterium
ERQTT

SEQ ID NO: 1201825 - protein, 4 aa, Mycobacterium
ERRA

SEQ ID NO: 1201826 - protein, 9 aa, Mycobacterium
ERRAARDAR

SEQ ID NO: 1201827 - protein, 18 aa, Mycobacterium
ERRAARDRTHDTEAPQTT

SEQ ID NO: 1201828 - protein, 5 aa, Mycobacterium
ERRAD

SEQ ID NO: 1201829 - protein, 14 aa, Mycobacterium
ERRADTLSGGQQQR

SEQ ID NO: 1201830 - protein, 8 aa, Mycobacterium
ERRAEGLG

SEQ ID NO: 1201831 - protein, 10 aa, Mycobacterium
ERRAKDTDEL

SEQ ID NO: 1201832 - protein, 5 aa, Mycobacterium
ERRAP

SEQ ID NO: 1201833 - protein, 9 aa, Mycobacterium
ERRAPDAVT

SEQ ID NO: 1201834 - protein, 10 aa, Mycobacterium
ERRAPESATA

SEQ ID NO: 1201835 - protein, 28 aa, Mycobacterium
ERRAVTREGQVRSGDRHEKDDRHRVDDP

SEQ ID NO: 1201836 - protein, 7 aa, Mycobacterium
ERRDLGD

SEQ ID NO: 1201837 - protein, 7 aa, Mycobacterium
ERRDQRR

SEQ ID NO: 1201838 - protein, 16 aa, Mycobacterium
ERRDQRSEEAEGRKIS

SEQ ID NO: 1201839 - protein, 189 aa, Mycobacterium
ERRGEANGKPAAKSDTAEATAAAPSGDTSAPAGDTAAPAGDTAAPAGDTSADSAASEQAAEAQPQQRRRERRGSSREQGGPNAGEQAGDQAGGQDKTEAGRPESGQAEGRGKNAPQEQQGGGRETRERTESQGGQASKAEGRADSDTRSDGGDQQGGQNRGRGGEGGGNRAADNDDDGDGRQGRRGRRF

SEQ ID NO: 1201840 - protein, 7 aa, Mycobacterium
ERRGEYL

SEQ ID NO: 1201841 - protein, 8 aa, Mycobacterium
ERRGRRTD

SEQ ID NO: 1201842 - protein, 18 aa, Mycobacterium
ERRIAGRGATASDATPAM

SEQ ID NO: 1201843 - protein, 8 aa, Mycobacterium
ERRKPDVP

SEQ ID NO: 1201844 - protein, 9 aa, Mycobacterium
ERRNEQQHQ

SEQ ID NO: 1201845 - protein, 16 aa, Mycobacterium
ERRPDGTGIQPLREPD

SEQ ID NO: 1201846 - protein, 5 aa, Mycobacterium
ERRPS

SEQ ID NO: 1201847 - protein, 4 aa, Mycobacterium
ERRQ

SEQ ID NO: 1201848 - protein, 10 aa, Mycobacterium
ERRRELSGGK

SEQ ID NO: 1201849 - protein, 20 aa, Mycobacterium
ERRRNAQTRYATTGNTPPYL

SEQ ID NO: 1201850 - protein, 12 aa, Mycobacterium
ERRRQTGAAARE

SEQ ID NO: 1201851 - protein, 7 aa, Mycobacterium
ERRRSER

SEQ ID NO: 1201852 - protein, 7 aa, Mycobacterium
ERRRTHG

SEQ ID NO: 1201853 - protein, 8 aa, Mycobacterium
ERRSNERG

SEQ ID NO: 1201854 - protein, 10 aa, Mycobacterium
ERRTDTSGSD

SEQ ID NO: 1201855 - protein, 7 aa, Mycobacterium
ERRTGRP

SEQ ID NO: 1201856 - protein, 9 aa, Mycobacterium
ERRTKSRAL

SEQ ID NO: 1201857 - protein, 5 aa, Mycobacterium
ERRTQ

SEQ ID NO: 1201858 - protein, 5 aa, Mycobacterium
ERRTR

SEQ ID NO: 1201859 - protein, 12 aa, Mycobacterium
ERRTTRDSSLSA

SEQ ID NO: 1201860 - protein, 13 aa, Mycobacterium
ERSAELSAATTAR

SEQ ID NO: 1201861 - protein, 29 aa, Mycobacterium
ERSAELSAATTERLRRQKRAGRLRDDVPG

SEQ ID NO: 1201862 - protein, 12 aa, Mycobacterium
ERSAGVAPPGVD

SEQ ID NO: 1201863 - protein, 9 aa, Mycobacterium
ERSARGRGL

SEQ ID NO: 1201864 - protein, 6 aa, Mycobacterium
ERSDYF

SEQ ID NO: 1201865 - protein, 5 aa, Mycobacterium
ERSEE

SEQ ID NO: 1201866 - protein, 9 aa, Mycobacterium
ERSEGAKTF

SEQ ID NO: 1201867 - protein, 8 aa, Mycobacterium
ERSEQLGE

SEQ ID NO: 1201868 - protein, 5 aa, Mycobacterium
ERSES

SEQ ID NO: 1201869 - protein, 6 aa, Mycobacterium
ERSGEI

SEQ ID NO: 1201870 - protein, 8 aa, Mycobacterium
ERSGGQRG

SEQ ID NO: 1201871 - protein, 8 aa, Mycobacterium
ERSGPARA

SEQ ID NO: 1201872 - protein, 10 aa, Mycobacterium
ERSGVSAGHP

SEQ ID NO: 1201873 - protein, 23 aa, Mycobacterium
ERSKDTAEVRSAQGGNGSSHGGG

SEQ ID NO: 1201874 - protein, 5 aa, Mycobacterium
ERSPE

SEQ ID NO: 1201875 - protein, 5 aa, Mycobacterium
ERSPI

SEQ ID NO: 1201876 - protein, 10 aa, Mycobacterium
ERSPNLPQAA

SEQ ID NO: 1201877 - protein, 8 aa, Mycobacterium
ERSSDRRT

SEQ ID NO: 1201878 - protein, 6 aa, Mycobacterium
ERSSGV

SEQ ID NO: 1201879 - protein, 8 aa, Mycobacterium
ERSSHQAI

SEQ ID NO: 1201880 - protein, 8 aa, Mycobacterium
ERSSPGTW

SEQ ID NO: 1201881 - protein, 6 aa, Mycobacterium
ERSTGV

SEQ ID NO: 1201882 - protein, 12 aa, Mycobacterium
ERSTSGRRQYAA

SEQ ID NO: 1201883 - protein, 4 aa, Mycobacterium
ERSV

SEQ ID NO: 1201884 - protein, 5 aa, Mycobacterium
ERTAE

SEQ ID NO: 1201885 - protein, 5 aa, Mycobacterium
ERTAQ

SEQ ID NO: 1201886 - protein, 5 aa, Mycobacterium
ERTAR

SEQ ID NO: 1201887 - protein, 7 aa, Mycobacterium
ERTARRE

SEQ ID NO: 1201888 - protein, 20 aa, Mycobacterium
ERTASLGMSEPSAGSDLASL

SEQ ID NO: 1201889 - protein, 7 aa, Mycobacterium
ERTATAM

SEQ ID NO: 1201890 - protein, 7 aa, Mycobacterium
ERTDKTT

SEQ ID NO: 1201891 - protein, 7 aa, Mycobacterium
ERTEREL

SEQ ID NO: 1201892 - protein, 4 aa, Mycobacterium
ERTG

SEQ ID NO: 1201893 - protein, 13 aa, Mycobacterium
ERTGAGGSASISQ

SEQ ID NO: 1201894 - protein, 7 aa, Mycobacterium
ERTGCSH

SEQ ID NO: 1201895 - protein, 6 aa, Mycobacterium
ERTGIE

SEQ ID NO: 1201896 - protein, 7 aa, Mycobacterium
ERTGITQ

SEQ ID NO: 1201897 - protein, 10 aa, Mycobacterium
ERTGKTPSRL

SEQ ID NO: 1201898 - protein, 10 aa, Mycobacterium
ERTGQQPPAI

SEQ ID NO: 1201899 - protein, 7 aa, Mycobacterium
ERTGRVR

SEQ ID NO: 1201900 - protein, 11 aa, Mycobacterium
ERTGSPESLAT

SEQ ID NO: 1201901 - protein, 12 aa, Mycobacterium
ERTKHSASSRAE

SEQ ID NO: 1201902 - protein, 18 aa, Mycobacterium
ERTNQDRADRAADAGGRW

SEQ ID NO: 1201903 - protein, 8 aa, Mycobacterium
ERTPDGGL

SEQ ID NO: 1201904 - protein, 6 aa, Mycobacterium
ERTPGD

SEQ ID NO: 1201905 - protein, 5 aa, Mycobacterium
ERTPR

SEQ ID NO: 1201906 - protein, 4 aa, Mycobacterium
ERTQ

SEQ ID NO: 1201907 - protein, 10 aa, Mycobacterium
ERTRSASASQ

SEQ ID NO: 1201908 - protein, 7 aa, Mycobacterium
ERTSADL

SEQ ID NO: 1201909 - protein, 10 aa, Mycobacterium
ERTSRQRCQH

SEQ ID NO: 1201910 - protein, 11 aa, Mycobacterium
ERTSSDTDTDP

SEQ ID NO: 1201911 - protein, 8 aa, Mycobacterium
ERTTGAVK

SEQ ID NO: 1201912 - protein, 8 aa, Mycobacterium
ERTVGGPV

SEQ ID NO: 1201913 - protein, 5 aa, Mycobacterium
ERVEP

SEQ ID NO: 1201914 - protein, 9 aa, Mycobacterium
ERVGPRGGP

SEQ ID NO: 1201915 - protein, 7 aa, Mycobacterium
ERVNSAG

SEQ ID NO: 1201916 - protein, 13 aa, Mycobacterium
ERVPGDTRGNALT

SEQ ID NO: 1201917 - protein, 6 aa, Mycobacterium
ERVQGA

SEQ ID NO: 1201918 - protein, 6 aa, Mycobacterium
ERVRPQ

SEQ ID NO: 1201919 - protein, 12 aa, Mycobacterium
ERVRTGEPQALS

SEQ ID NO: 1201920 - protein, 6 aa, Mycobacterium
ERVTPA

SEQ ID NO: 1201921 - protein, 5 aa, Mycobacterium
ERWGT

SEQ ID NO: 1201922 - protein, 5 aa, Mycobacterium
ERYAG

SEQ ID NO: 1201923 - protein, 7 aa, Mycobacterium
ERYEKGQ

SEQ ID NO: 1201924 - protein, 24 aa, Mycobacterium
ERYGETGDAEIAKRSEAARSGIPA

SEQ ID NO: 1201925 - protein, 10 aa, Mycobacterium
ERYRTSRSSL

SEQ ID NO: 1201926 - protein, 8 aa, Mycobacterium
ERYTPTPA

SEQ ID NO: 1201927 - protein, 12 aa, Mycobacterium
ESAAGDGVGDAA

SEQ ID NO: 1201928 - protein, 12 aa, Mycobacterium
ESAAGKVGHGVE

SEQ ID NO: 1201929 - protein, 9 aa, Mycobacterium
ESAARQGNT

SEQ ID NO: 1201930 - protein, 5 aa, Mycobacterium
ESAAV

SEQ ID NO: 1201931 - protein, 10 aa, Mycobacterium
ESADDSERER

SEQ ID NO: 1201932 - protein, 10 aa, Mycobacterium
ESADDSERQR

SEQ ID NO: 1201933 - protein, 10 aa, Mycobacterium
ESADGLSEAH

SEQ ID NO: 1201934 - protein, 11 aa, Mycobacterium
ESADPLPDGRG

SEQ ID NO: 1201935 - protein, 5 aa, Mycobacterium
ESAEA

SEQ ID NO: 1201936 - protein, 7 aa, Mycobacterium
ESAEDEV

SEQ ID NO: 1201937 - protein, 21 aa, Mycobacterium
ESAGAEVRQGAEVAGPEFDAS

SEQ ID NO: 1201938 - protein, 21 aa, Mycobacterium
ESAGAEVRQGAEVAGPELDAN

SEQ ID NO: 1201939 - protein, 7 aa, Mycobacterium
ESAGALE

SEQ ID NO: 1201940 - protein, 7 aa, Mycobacterium
ESAGGSA

SEQ ID NO: 1201941 - protein, 9 aa, Mycobacterium
ESAGTDPRV

SEQ ID NO: 1201942 - protein, 9 aa, Mycobacterium
ESAGVPPSS

SEQ ID NO: 1201943 - protein, 28 aa, Mycobacterium
ESAIEDGELEEVTESELDSALEDGELDS

SEQ ID NO: 1201944 - protein, 5 aa, Mycobacterium
ESAKE

SEQ ID NO: 1201945 - protein, 21 aa, Mycobacterium
ESAKPTLNPAPTTPQPDTESS

SEQ ID NO: 1201946 - protein, 6 aa, Mycobacterium
ESALPA

SEQ ID NO: 1201947 - protein, 8 aa, Mycobacterium
ESALPPGE

SEQ ID NO: 1201948 - protein, 8 aa, Mycobacterium
ESAPGRSA

SEQ ID NO: 1201949 - protein, 7 aa, Mycobacterium
ESAPPAA

SEQ ID NO: 1201950 - protein, 10 aa, Mycobacterium
ESAPPPTDMP

SEQ ID NO: 1201951 - protein, 25 aa, Mycobacterium
ESAPQQADEDAATNGVDADRAGEDA

SEQ ID NO: 1201952 - protein, 12 aa, Mycobacterium
ESAPSNDSAAGA

SEQ ID NO: 1201953 - protein, 7 aa, Mycobacterium
ESAPYDR

SEQ ID NO: 1201954 - protein, 28 aa, Mycobacterium
ESAQGRLDRSGSRAAARATLEDGPAHPA

SEQ ID NO: 1201955 - protein, 30 aa, Mycobacterium
ESAQRLHRDQDRRHERQAAGAESTYSSRPN

SEQ ID NO: 1201956 - protein, 4 aa, Mycobacterium
ESAR

SEQ ID NO: 1201957 - protein, 8 aa, Mycobacterium
ESARGTGL

SEQ ID NO: 1201958 - protein, 6 aa, Mycobacterium
ESASGV

SEQ ID NO: 1201959 - protein, 11 aa, Mycobacterium
ESASQSWDDAG

SEQ ID NO: 1201960 - protein, 8 aa, Mycobacterium
ESASSYGE

SEQ ID NO: 1201961 - protein, 4 aa, Mycobacterium
ESAT

SEQ ID NO: 1201962 - protein, 7 aa, Mycobacterium
ESATARR

SEQ ID NO: 1201963 - protein, 45 aa, Mycobacterium
ESATQEEKAKREEHRAAQTARKEALAAEAEDIAANSTQWKAAGDR

SEQ ID NO: 1201964 - protein, 8 aa, Mycobacterium
ESATQGDH

SEQ ID NO: 1201965 - protein, 7 aa, Mycobacterium
ESCEGDP

SEQ ID NO: 1201966 - protein, 16 aa, Mycobacterium
ESCEPGQPPVTVKVEW

SEQ ID NO: 1201967 - protein, 7 aa, Mycobacterium
ESCSTTP

SEQ ID NO: 1201968 - protein, 5 aa, Mycobacterium
ESDAI

SEQ ID NO: 1201969 - protein, 9 aa, Mycobacterium
ESDASRTSE

SEQ ID NO: 1201970 - protein, 7 aa, Mycobacterium
ESDDAES

SEQ ID NO: 1201971 - protein, 6 aa, Mycobacterium
ESDDLR

SEQ ID NO: 1201972 - protein, 48 aa, Mycobacterium
ESDEVGVANAGSKVLSSTPKPPKTAGEKVTDEGDGGTKIAEYLVAQKI

SEQ ID NO: 1201973 - protein, 9 aa, Mycobacterium
ESDEVTKGQ

SEQ ID NO: 1201974 - protein, 9 aa, Mycobacterium
ESDGDTGLS

SEQ ID NO: 1201975 - protein, 5 aa, Mycobacterium
ESDGT

SEQ ID NO: 1201976 - protein, 5 aa, Mycobacterium
ESDGV

SEQ ID NO: 1201977 - protein, 4 aa, Mycobacterium
ESDL

SEQ ID NO: 1201978 - protein, 13 aa, Mycobacterium
ESDMAASAPEAYD

SEQ ID NO: 1201979 - protein, 8 aa, Mycobacterium
ESDPDGLA

SEQ ID NO: 1201980 - protein, 5 aa, Mycobacterium
ESDPF

SEQ ID NO: 1201981 - protein, 10 aa, Mycobacterium
ESDPGAEKRI

SEQ ID NO: 1201982 - protein, 9 aa, Mycobacterium
ESDPRVSRA

SEQ ID NO: 1201983 - protein, 17 aa, Mycobacterium
ESDPSEIDRATARPTFN

SEQ ID NO: 1201984 - protein, 9 aa, Mycobacterium
ESDRDTDRD

SEQ ID NO: 1201985 - protein, 8 aa, Mycobacterium
ESDRGGAI

SEQ ID NO: 1201986 - protein, 6 aa, Mycobacterium
ESDRRG

SEQ ID NO: 1201987 - protein, 5 aa, Mycobacterium
ESDST

SEQ ID NO: 1201988 - protein, 16 aa, Mycobacterium
ESDTNARRAHAPTRTT

SEQ ID NO: 1201989 - protein, 51 aa, Mycobacterium
ESDVGDDQKVASSRAGKEGDEEAGTYVGRTGSDDALDDEQTGAEARSQQQG

SEQ ID NO: 1201990 - protein, 17 aa, Mycobacterium
ESEATAEPVGDGGATGW

SEQ ID NO: 1201991 - protein, 9 aa, Mycobacterium
ESEATRQEL

SEQ ID NO: 1201992 - protein, 15 aa, Mycobacterium
ESEDELRELVLNPQH

SEQ ID NO: 1201993 - protein, 4 aa, Mycobacterium
ESEE

SEQ ID NO: 1201994 - protein, 18 aa, Mycobacterium
ESEEAAGDTDAGAQRDRL

SEQ ID NO: 1201995 - protein, 8 aa, Mycobacterium
ESEEFGDH

SEQ ID NO: 1201996 - protein, 11 aa, Mycobacterium
ESEFSGGRSVK

SEQ ID NO: 1201997 - protein, 10 aa, Mycobacterium
ESEGGAQTTR

SEQ ID NO: 1201998 - protein, 15 aa, Mycobacterium
ESEGKTQLSAADRKS

SEQ ID NO: 1201999 - protein, 15 aa, Mycobacterium
ESEIDGVRQREDRDR

SEQ ID NO: 1202000 - protein, 10 aa, Mycobacterium
ESELAQADQA

SEQ ID NO: 1202001 - protein, 20 aa, Mycobacterium
ESEPADNPAALRRTATDGLR

SEQ ID NO: 1202002 - protein, 16 aa, Mycobacterium
ESEPHNTERDTFYSEN

SEQ ID NO: 1202003 - protein, 11 aa, Mycobacterium
ESEPRGRKGPW

SEQ ID NO: 1202004 - protein, 21 aa, Mycobacterium
ESEPSPYAASYDNPEIRETYE

SEQ ID NO: 1202005 - protein, 10 aa, Mycobacterium
ESEPVGADSS

SEQ ID NO: 1202006 - protein, 4 aa, Mycobacterium
ESEQ

SEQ ID NO: 1202007 - protein, 23 aa, Mycobacterium
ESEQVSVRDANDANLRTRPGAPM

SEQ ID NO: 1202008 - protein, 20 aa, Mycobacterium
ESETAADAPADAPVDAATTS

SEQ ID NO: 1202009 - protein, 5 aa, Mycobacterium
ESETE

SEQ ID NO: 1202010 - protein, 13 aa, Mycobacterium
ESETKRRTAEQLG

SEQ ID NO: 1202011 - protein, 4 aa, Mycobacterium
ESEV

SEQ ID NO: 1202012 - protein, 8 aa, Mycobacterium
ESGAGATV

SEQ ID NO: 1202013 - protein, 8 aa, Mycobacterium
ESGAGKTS

SEQ ID NO: 1202014 - protein, 6 aa, Mycobacterium
ESGAGV

SEQ ID NO: 1202015 - protein, 9 aa, Mycobacterium
ESGALSPYP

SEQ ID NO: 1202016 - protein, 6 aa, Mycobacterium
ESGAYT

SEQ ID NO: 1202017 - protein, 4 aa, Mycobacterium
ESGC

SEQ ID NO: 1202018 - protein, 14 aa, Mycobacterium
ESGCDTTPDSIAPL

SEQ ID NO: 1202019 - protein, 7 aa, Mycobacterium
ESGCGKS

SEQ ID NO: 1202020 - protein, 9 aa, Mycobacterium
ESGCGKSMT

SEQ ID NO: 1202021 - protein, 9 aa, Mycobacterium
ESGCGKSTL

SEQ ID NO: 1202022 - protein, 13 aa, Mycobacterium
ESGCGKSVTAQTL

SEQ ID NO: 1202023 - protein, 9 aa, Mycobacterium
ESGCGVDTS

SEQ ID NO: 1202024 - protein, 6 aa, Mycobacterium
ESGCTT

SEQ ID NO: 1202025 - protein, 8 aa, Mycobacterium
ESGDAAAQ

SEQ ID NO: 1202026 - protein, 10 aa, Mycobacterium
ESGDATEADV

SEQ ID NO: 1202027 - protein, 9 aa, Mycobacterium
ESGDQLTED

SEQ ID NO: 1202028 - protein, 6 aa, Mycobacterium
ESGECL

SEQ ID NO: 1202029 - protein, 5 aa, Mycobacterium
ESGEH

SEQ ID NO: 1202030 - protein, 6 aa, Mycobacterium
ESGEHD

SEQ ID NO: 1202031 - protein, 8 aa, Mycobacterium
ESGELASD

SEQ ID NO: 1202032 - protein, 8 aa, Mycobacterium
ESGEPAAV

SEQ ID NO: 1202033 - protein, 4 aa, Mycobacterium
ESGF

SEQ ID NO: 1202034 - protein, 19 aa, Mycobacterium
ESGFGTAAADATAATGGDN

SEQ ID NO: 1202035 - protein, 9 aa, Mycobacterium
ESGGPELAD

SEQ ID NO: 1202036 - protein, 26 aa, Mycobacterium
ESGGPELADELEENGYERFTQAAAAG

SEQ ID NO: 1202037 - protein, 18 aa, Mycobacterium
ESGHASGGATDSRGTAVT

SEQ ID NO: 1202038 - protein, 7 aa, Mycobacterium
ESGHSDA

SEQ ID NO: 1202039 - protein, 7 aa, Mycobacterium
ESGIGQR

SEQ ID NO: 1202040 - protein, 6 aa, Mycobacterium
ESGISA

SEQ ID NO: 1202041 - protein, 7 aa, Mycobacterium
ESGKGRQ

SEQ ID NO: 1202042 - protein, 8 aa, Mycobacterium
ESGLPQAR

SEQ ID NO: 1202043 - protein, 4 aa, Mycobacterium
ESGM

SEQ ID NO: 1202044 - protein, 17 aa, Mycobacterium
ESGNTDRNGDNQVAGPI

SEQ ID NO: 1202045 - protein, 7 aa, Mycobacterium
ESGPDLE

SEQ ID NO: 1202046 - protein, 8 aa, Mycobacterium
ESGPDQRR

SEQ ID NO: 1202047 - protein, 14 aa, Mycobacterium
ESGPFGEASGQPIP

SEQ ID NO: 1202048 - protein, 8 aa, Mycobacterium
ESGQGENE

SEQ ID NO: 1202049 - protein, 27 aa, Mycobacterium
ESGQRRGDGVGARGQLREREGSVDVDD

SEQ ID NO: 1202050 - protein, 4 aa, Mycobacterium
ESGR

SEQ ID NO: 1202051 - protein, 8 aa, Mycobacterium
ESGRTESQ

SEQ ID NO: 1202052 - protein, 8 aa, Mycobacterium
ESGRVEQD

SEQ ID NO: 1202053 - protein, 4 aa, Mycobacterium
ESGS

SEQ ID NO: 1202054 - protein, 8 aa, Mycobacterium
ESGSETAG

SEQ ID NO: 1202055 - protein, 10 aa, Mycobacterium
ESGSGTAISR

SEQ ID NO: 1202056 - protein, 8 aa, Mycobacterium
ESGSIEQD

SEQ ID NO: 1202057 - protein, 10 aa, Mycobacterium
ESGSKTLKDA

SEQ ID NO: 1202058 - protein, 6 aa, Mycobacterium
ESGSKW

SEQ ID NO: 1202059 - protein, 8 aa, Mycobacterium
ESGSPEAF

SEQ ID NO: 1202060 - protein, 7 aa, Mycobacterium
ESGSTPV

SEQ ID NO: 1202061 - protein, 4 aa, Mycobacterium
ESGT

SEQ ID NO: 1202062 - protein, 7 aa, Mycobacterium
ESGTAAS

SEQ ID NO: 1202063 - protein, 7 aa, Mycobacterium
ESGTQEL

SEQ ID NO: 1202064 - protein, 6 aa, Mycobacterium
ESGTSL

SEQ ID NO: 1202065 - protein, 9 aa, Mycobacterium
ESGVAANTY

SEQ ID NO: 1202066 - protein, 5 aa, Mycobacterium
ESGVD

SEQ ID NO: 1202067 - protein, 4 aa, Mycobacterium
ESGW

SEQ ID NO: 1202068 - protein, 9 aa, Mycobacterium
ESGYDEREA

SEQ ID NO: 1202069 - protein, 7 aa, Mycobacterium
ESGYDRD

SEQ ID NO: 1202070 - protein, 10 aa, Mycobacterium
ESGYGEAPTR

SEQ ID NO: 1202071 - protein, 5 aa, Mycobacterium
ESHDA

SEQ ID NO: 1202072 - protein, 4 aa, Mycobacterium
ESHH

SEQ ID NO: 1202073 - protein, 4 aa, Mycobacterium
ESHL

SEQ ID NO: 1202074 - protein, 5 aa, Mycobacterium
ESHSD

SEQ ID NO: 1202075 - protein, 4 aa, Mycobacterium
ESHT

SEQ ID NO: 1202076 - protein, 7 aa, Mycobacterium
ESIDEPV

SEQ ID NO: 1202077 - protein, 4 aa, Mycobacterium
ESIE

SEQ ID NO: 1202078 - protein, 8 aa, Mycobacterium
ESIETTTA

SEQ ID NO: 1202079 - protein, 5 aa, Mycobacterium
ESIGT

SEQ ID NO: 1202080 - protein, 11 aa, Mycobacterium
ESIPDPVRETD

SEQ ID NO: 1202081 - protein, 7 aa, Mycobacterium
ESIPIDE

SEQ ID NO: 1202082 - protein, 6 aa, Mycobacterium
ESKETF

SEQ ID NO: 1202083 - protein, 8 aa, Mycobacterium
ESKGEVTY

SEQ ID NO: 1202084 - protein, 12 aa, Mycobacterium
ESKKLSEEAEQK

SEQ ID NO: 1202085 - protein, 10 aa, Mycobacterium
ESKPQALAGA

SEQ ID NO: 1202086 - protein, 10 aa, Mycobacterium
ESKTVAPGRD

SEQ ID NO: 1202087 - protein, 13 aa, Mycobacterium
ESLAAEGDTLTDR

SEQ ID NO: 1202088 - protein, 12 aa, Mycobacterium
ESLAQADTLGDA

SEQ ID NO: 1202089 - protein, 4 aa, Mycobacterium
ESLE

SEQ ID NO: 1202090 - protein, 7 aa, Mycobacterium
ESLEPGR

SEQ ID NO: 1202091 - protein, 8 aa, Mycobacterium
ESLGARDA

SEQ ID NO: 1202092 - protein, 9 aa, Mycobacterium
ESLGDDNPV

SEQ ID NO: 1202093 - protein, 10 aa, Mycobacterium
ESLGGAGTRP

SEQ ID NO: 1202094 - protein, 5 aa, Mycobacterium
ESLGS

SEQ ID NO: 1202095 - protein, 5 aa, Mycobacterium
ESLPF

SEQ ID NO: 1202096 - protein, 7 aa, Mycobacterium
ESLPPSG

SEQ ID NO: 1202097 - protein, 5 aa, Mycobacterium
ESLRQ

SEQ ID NO: 1202098 - protein, 8 aa, Mycobacterium
ESLRSGAH

SEQ ID NO: 1202099 - protein, 10 aa, Mycobacterium
ESLSQGGGGT

SEQ ID NO: 1202100 - protein, 5 aa, Mycobacterium
ESLVS

SEQ ID NO: 1202101 - protein, 6 aa, Mycobacterium
ESMDPA

SEQ ID NO: 1202102 - protein, 18 aa, Mycobacterium
ESMGQSRVTRADGAPDTV

SEQ ID NO: 1202103 - protein, 5 aa, Mycobacterium
ESMPG

SEQ ID NO: 1202104 - protein, 8 aa, Mycobacterium
ESNCAATG

SEQ ID NO: 1202105 - protein, 8 aa, Mycobacterium
ESNEPDEL

SEQ ID NO: 1202106 - protein, 19 aa, Mycobacterium
ESNGKSVRADGTPVSTGTG

SEQ ID NO: 1202107 - protein, 15 aa, Mycobacterium
ESNGYPMATRGELDE

SEQ ID NO: 1202108 - protein, 7 aa, Mycobacterium
ESNLEAP

SEQ ID NO: 1202109 - protein, 12 aa, Mycobacterium
ESNNAQAGDHFT

SEQ ID NO: 1202110 - protein, 8 aa, Mycobacterium
ESNPSAPI

SEQ ID NO: 1202111 - protein, 8 aa, Mycobacterium
ESNTAGVG

SEQ ID NO: 1202112 - protein, 4 aa, Mycobacterium
ESNW

SEQ ID NO: 1202113 - protein, 4 aa, Mycobacterium
ESPA

SEQ ID NO: 1202114 - protein, 17 aa, Mycobacterium
ESPAAEDETWDRPDAKP

SEQ ID NO: 1202115 - protein, 7 aa, Mycobacterium
ESPATEE

SEQ ID NO: 1202116 - protein, 8 aa, Mycobacterium
ESPDAGQK

SEQ ID NO: 1202117 - protein, 9 aa, Mycobacterium
ESPDQIAEA

SEQ ID NO: 1202118 - protein, 9 aa, Mycobacterium
ESPDVASGR

SEQ ID NO: 1202119 - protein, 7 aa, Mycobacterium
ESPEFSG

SEQ ID NO: 1202120 - protein, 5 aa, Mycobacterium
ESPGI

SEQ ID NO: 1202121 - protein, 11 aa, Mycobacterium
ESPHPSPLSAS

SEQ ID NO: 1202122 - protein, 7 aa, Mycobacterium
ESPITET

SEQ ID NO: 1202123 - protein, 16 aa, Mycobacterium
ESPKAGAALSREKTKS

SEQ ID NO: 1202124 - protein, 6 aa, Mycobacterium
ESPLEQ

SEQ ID NO: 1202125 - protein, 7 aa, Mycobacterium
ESPLPQN

SEQ ID NO: 1202126 - protein, 6 aa, Mycobacterium
ESPPEL

SEQ ID NO: 1202127 - protein, 10 aa, Mycobacterium
ESPPPAPPRW

SEQ ID NO: 1202128 - protein, 9 aa, Mycobacterium
ESPPSVASG

SEQ ID NO: 1202129 - protein, 5 aa, Mycobacterium
ESPQA

SEQ ID NO: 1202130 - protein, 6 aa, Mycobacterium
ESPQRR

SEQ ID NO: 1202131 - protein, 6 aa, Mycobacterium
ESPTSA

SEQ ID NO: 1202132 - protein, 4 aa, Mycobacterium
ESPV

SEQ ID NO: 1202133 - protein, 8 aa, Mycobacterium
ESPVAGTP

SEQ ID NO: 1202134 - protein, 8 aa, Mycobacterium
ESQALRRG

SEQ ID NO: 1202135 - protein, 26 aa, Mycobacterium
ESQARLESARAELGEREQAAAEAERA

SEQ ID NO: 1202136 - protein, 9 aa, Mycobacterium
ESQDEIRQS

SEQ ID NO: 1202137 - protein, 6 aa, Mycobacterium
ESQKAT

SEQ ID NO: 1202138 - protein, 12 aa, Mycobacterium
ESQKDDDGQQTR

SEQ ID NO: 1202139 - protein, 10 aa, Mycobacterium
ESQLDTPGVA

SEQ ID NO: 1202140 - protein, 7 aa, Mycobacterium
ESQPELK

SEQ ID NO: 1202141 - protein, 9 aa, Mycobacterium
ESQRGAPPQ

SEQ ID NO: 1202142 - protein, 7 aa, Mycobacterium
ESQRTRP

SEQ ID NO: 1202143 - protein, 7 aa, Mycobacterium
ESRAGFN

SEQ ID NO: 1202144 - protein, 5 aa, Mycobacterium
ESRDG

SEQ ID NO: 1202145 - protein, 5 aa, Mycobacterium
ESRDL

SEQ ID NO: 1202146 - protein, 6 aa, Mycobacterium
ESRDVT

SEQ ID NO: 1202147 - protein, 7 aa, Mycobacterium
ESRELEP

SEQ ID NO: 1202148 - protein, 7 aa, Mycobacterium
ESRFRRG

SEQ ID NO: 1202149 - protein, 11 aa, Mycobacterium
ESRPDLRHPRR

SEQ ID NO: 1202150 - protein, 9 aa, Mycobacterium
ESRPTRTGL

SEQ ID NO: 1202151 - protein, 8 aa, Mycobacterium
ESRQGRTD

SEQ ID NO: 1202152 - protein, 7 aa, Mycobacterium
ESRSGVP

SEQ ID NO: 1202153 - protein, 6 aa, Mycobacterium
ESRTGV

SEQ ID NO: 1202154 - protein, 9 aa, Mycobacterium
ESSDCRSGE

SEQ ID NO: 1202155 - protein, 6 aa, Mycobacterium
ESSERE

SEQ ID NO: 1202156 - protein, 4 aa, Mycobacterium
ESSF

SEQ ID NO: 1202157 - protein, 13 aa, Mycobacterium
ESSFPDADKFNPD

SEQ ID NO: 1202158 - protein, 5 aa, Mycobacterium
ESSGF

SEQ ID NO: 1202159 - protein, 6 aa, Mycobacterium
ESSGTA

SEQ ID NO: 1202160 - protein, 15 aa, Mycobacterium
ESSIDGNHLVMGSPA

SEQ ID NO: 1202161 - protein, 9 aa, Mycobacterium
ESSKPEWGL

SEQ ID NO: 1202162 - protein, 14 aa, Mycobacterium
ESSSRRRPPGEGFA

SEQ ID NO: 1202163 - protein, 8 aa, Mycobacterium
ESSTGSIS

SEQ ID NO: 1202164 - protein, 24 aa, Mycobacterium
ESSTSAAQNAAAQRDTDPDTAGGA

SEQ ID NO: 1202165 - protein, 11 aa, Mycobacterium
ESTDAYEQGRA

SEQ ID NO: 1202166 - protein, 7 aa, Mycobacterium
ESTDGTV

SEQ ID NO: 1202167 - protein, 7 aa, Mycobacterium
ESTELAS

SEQ ID NO: 1202168 - protein, 5 aa, Mycobacterium
ESTFG

SEQ ID NO: 1202169 - protein, 5 aa, Mycobacterium
ESTGA

SEQ ID NO: 1202170 - protein, 7 aa, Mycobacterium
ESTGDLS

SEQ ID NO: 1202171 - protein, 11 aa, Mycobacterium
ESTGFRPVDAD

SEQ ID NO: 1202172 - protein, 8 aa, Mycobacterium
ESTMGTNG

SEQ ID NO: 1202173 - protein, 4 aa, Mycobacterium
ESTR

SEQ ID NO: 1202174 - protein, 8 aa, Mycobacterium
ESTSGQRA

SEQ ID NO: 1202175 - protein, 4 aa, Mycobacterium
ESTV

SEQ ID NO: 1202176 - protein, 19 aa, Mycobacterium
ESTVASGPSAPPPVQPSPD

SEQ ID NO: 1202177 - protein, 5 aa, Mycobacterium
ESTVK

SEQ ID NO: 1202178 - protein, 5 aa, Mycobacterium
ESTWD

SEQ ID NO: 1202179 - protein, 11 aa, Mycobacterium
ESVAEGRMDPY

SEQ ID NO: 1202180 - protein, 10 aa, Mycobacterium
ESVAGTSELP

SEQ ID NO: 1202181 - protein, 11 aa, Mycobacterium
ESVERRKSERV

SEQ ID NO: 1202182 - protein, 5 aa, Mycobacterium
ESVGD

SEQ ID NO: 1202183 - protein, 9 aa, Mycobacterium
ESVGGDGAT

SEQ ID NO: 1202184 - protein, 9 aa, Mycobacterium
ESVGSARHT

SEQ ID NO: 1202185 - protein, 10 aa, Mycobacterium
ESVNPDIAED

SEQ ID NO: 1202186 - protein, 4 aa, Mycobacterium
ESVP

SEQ ID NO: 1202187 - protein, 6 aa, Mycobacterium
ESVPGD

SEQ ID NO: 1202188 - protein, 9 aa, Mycobacterium
ESVPPGAAS

SEQ ID NO: 1202189 - protein, 4 aa, Mycobacterium
ESVQ

SEQ ID NO: 1202190 - protein, 4 aa, Mycobacterium
ESVR

SEQ ID NO: 1202191 - protein, 7 aa, Mycobacterium
ESVTEGT

SEQ ID NO: 1202192 - protein, 6 aa, Mycobacterium
ESVTEP

SEQ ID NO: 1202193 - protein, 20 aa, Mycobacterium
ESVYTRDGETWTSSGGTAGI

SEQ ID NO: 1202194 - protein, 4 aa, Mycobacterium
ESYA

SEQ ID NO: 1202195 - protein, 11 aa, Mycobacterium
ESYDAKQPQFE

SEQ ID NO: 1202196 - protein, 6 aa, Mycobacterium
ETAAVE

SEQ ID NO: 1202197 - protein, 9 aa, Mycobacterium
ETADGVRTG

SEQ ID NO: 1202198 - protein, 24 aa, Mycobacterium
ETADLTPIDQPAPADATPPDAARA

SEQ ID NO: 1202199 - protein, 15 aa, Mycobacterium
ETAEAGKPLDPPSAA

SEQ ID NO: 1202200 - protein, 8 aa, Mycobacterium
ETAESCRE

SEQ ID NO: 1202201 - protein, 8 aa, Mycobacterium
ETAGEEAR

SEQ ID NO: 1202202 - protein, 4 aa, Mycobacterium
ETAK

SEQ ID NO: 1202203 - protein, 7 aa, Mycobacterium
ETAKQPE

SEQ ID NO: 1202204 - protein, 29 aa, Mycobacterium
ETAKQRRLERETKMAENRAAKQAAKQAVS

SEQ ID NO: 1202205 - protein, 8 aa, Mycobacterium
ETAPCDEQ

SEQ ID NO: 1202206 - protein, 12 aa, Mycobacterium
ETAQRALGDADA

SEQ ID NO: 1202207 - protein, 4 aa, Mycobacterium
ETAR

SEQ ID NO: 1202208 - protein, 8 aa, Mycobacterium
ETARERAE

SEQ ID NO: 1202209 - protein, 5 aa, Mycobacterium
ETARH

SEQ ID NO: 1202210 - protein, 10 aa, Mycobacterium
ETARRRDDAN

SEQ ID NO: 1202211 - protein, 9 aa, Mycobacterium
ETASDPRFD

SEQ ID NO: 1202212 - protein, 10 aa, Mycobacterium
ETASELPDGQ

SEQ ID NO: 1202213 - protein, 9 aa, Mycobacterium
ETASGPVAT

SEQ ID NO: 1202214 - protein, 8 aa, Mycobacterium
ETASSARG

SEQ ID NO: 1202215 - protein, 8 aa, Mycobacterium
ETASSGVR

SEQ ID NO: 1202216 - protein, 4 aa, Mycobacterium
ETAT

SEQ ID NO: 1202217 - protein, 12 aa, Mycobacterium
ETATADSDPELA

SEQ ID NO: 1202218 - protein, 10 aa, Mycobacterium
ETATAGSEWP

SEQ ID NO: 1202219 - protein, 9 aa, Mycobacterium
ETCPSSDGA

SEQ ID NO: 1202220 - protein, 7 aa, Mycobacterium
ETDADGH

SEQ ID NO: 1202221 - protein, 7 aa, Mycobacterium
ETDAVTA

SEQ ID NO: 1202222 - protein, 4 aa, Mycobacterium
ETDD

SEQ ID NO: 1202223 - protein, 5 aa, Mycobacterium
ETDDE

SEQ ID NO: 1202224 - protein, 9 aa, Mycobacterium
ETDDISRAL

SEQ ID NO: 1202225 - protein, 4 aa, Mycobacterium
ETDE

SEQ ID NO: 1202226 - protein, 6 aa, Mycobacterium
ETDEQA

SEQ ID NO: 1202227 - protein, 15 aa, Mycobacterium
ETDGARRAAAMLADL

SEQ ID NO: 1202228 - protein, 6 aa, Mycobacterium
ETDLTD

SEQ ID NO: 1202229 - protein, 4 aa, Mycobacterium
ETDP

SEQ ID NO: 1202230 - protein, 7 aa, Mycobacterium
ETDPEAV

SEQ ID NO: 1202231 - protein, 8 aa, Mycobacterium
ETDPSAVK

SEQ ID NO: 1202232 - protein, 7 aa, Mycobacterium
ETDPVAA

SEQ ID NO: 1202233 - protein, 10 aa, Mycobacterium
ETDRPQSTAA

SEQ ID NO: 1202234 - protein, 8 aa, Mycobacterium
ETDTVPEA

SEQ ID NO: 1202235 - protein, 4 aa, Mycobacterium
ETDW

SEQ ID NO: 1202236 - protein, 9 aa, Mycobacterium
ETDYGGDEF

SEQ ID NO: 1202237 - protein, 9 aa, Mycobacterium
ETEAEEMAG

SEQ ID NO: 1202238 - protein, 27 aa, Mycobacterium
ETEASRTDSAAEDGRRVRTSGDALRRR

SEQ ID NO: 1202239 - protein, 5 aa, Mycobacterium
ETEDD

SEQ ID NO: 1202240 - protein, 9 aa, Mycobacterium
ETEDDDDFP

SEQ ID NO: 1202241 - protein, 6 aa, Mycobacterium
ETEDGD

SEQ ID NO: 1202242 - protein, 6 aa, Mycobacterium
ETEGMH

SEQ ID NO: 1202243 - protein, 13 aa, Mycobacterium
ETEGSVSAPTRTM

SEQ ID NO: 1202244 - protein, 6 aa, Mycobacterium
ETEGVS

SEQ ID NO: 1202245 - protein, 6 aa, Mycobacterium
ETEKPW

SEQ ID NO: 1202246 - protein, 18 aa, Mycobacterium
ETELGRKTRIDQSTCNTD

SEQ ID NO: 1202247 - protein, 16 aa, Mycobacterium
ETEQKMTSSVPITPGR

SEQ ID NO: 1202248 - protein, 8 aa, Mycobacterium
ETESDGWL

SEQ ID NO: 1202249 - protein, 5 aa, Mycobacterium
ETESS

SEQ ID NO: 1202250 - protein, 5 aa, Mycobacterium
ETETR

SEQ ID NO: 1202251 - protein, 11 aa, Mycobacterium
ETEVTAPPEGH

SEQ ID NO: 1202252 - protein, 15 aa, Mycobacterium
ETEWSKSGKHTSRTE

SEQ ID NO: 1202253 - protein, 6 aa, Mycobacterium
ETFAEK

SEQ ID NO: 1202254 - protein, 18 aa, Mycobacterium
ETFDTRQAAQDRADEIAP

SEQ ID NO: 1202255 - protein, 5 aa, Mycobacterium
ETFEE

SEQ ID NO: 1202256 - protein, 18 aa, Mycobacterium
ETFGGDESGAGRKKLPSV

SEQ ID NO: 1202257 - protein, 6 aa, Mycobacterium
ETFGTE

SEQ ID NO: 1202258 - protein, 18 aa, Mycobacterium
ETFGVSPGHADGGTAESG

SEQ ID NO: 1202259 - protein, 4 aa, Mycobacterium
ETGA

SEQ ID NO: 1202260 - protein, 10 aa, Mycobacterium
ETGADAVAGT

SEQ ID NO: 1202261 - protein, 8 aa, Mycobacterium
ETGADGYD

SEQ ID NO: 1202262 - protein, 10 aa, Mycobacterium
ETGAGQHGVA

SEQ ID NO: 1202263 - protein, 10 aa, Mycobacterium
ETGAGTEADL

SEQ ID NO: 1202264 - protein, 5 aa, Mycobacterium
ETGAP

SEQ ID NO: 1202265 - protein, 6 aa, Mycobacterium
ETGAPM

SEQ ID NO: 1202266 - protein, 7 aa, Mycobacterium
ETGAVPS

SEQ ID NO: 1202267 - protein, 8 aa, Mycobacterium
ETGEPERL

SEQ ID NO: 1202268 - protein, 14 aa, Mycobacterium
ETGEPISPPATEPI

SEQ ID NO: 1202269 - protein, 6 aa, Mycobacterium
ETGETL

SEQ ID NO: 1202270 - protein, 7 aa, Mycobacterium
ETGEVKA

SEQ ID NO: 1202271 - protein, 8 aa, Mycobacterium
ETGGFTGT

SEQ ID NO: 1202272 - protein, 8 aa, Mycobacterium
ETGGGEGR

SEQ ID NO: 1202273 - protein, 21 aa, Mycobacterium
ETGHGSDVQSLETTATYDPAT

SEQ ID NO: 1202274 - protein, 7 aa, Mycobacterium
ETGKPIA

SEQ ID NO: 1202275 - protein, 7 aa, Mycobacterium
ETGNPLD

SEQ ID NO: 1202276 - protein, 8 aa, Mycobacterium
ETGPDADR

SEQ ID NO: 1202277 - protein, 18 aa, Mycobacterium
ETGPDGFARSKADHTYGY

SEQ ID NO: 1202278 - protein, 7 aa, Mycobacterium
ETGPDLT

SEQ ID NO: 1202279 - protein, 4 aa, Mycobacterium
ETGQ

SEQ ID NO: 1202280 - protein, 7 aa, Mycobacterium
ETGQPPT

SEQ ID NO: 1202281 - protein, 4 aa, Mycobacterium
ETGR

SEQ ID NO: 1202282 - protein, 9 aa, Mycobacterium
ETGRSTPSR

SEQ ID NO: 1202283 - protein, 6 aa, Mycobacterium
ETGRTP

SEQ ID NO: 1202284 - protein, 6 aa, Mycobacterium
ETGSHA

SEQ ID NO: 1202285 - protein, 17 aa, Mycobacterium
ETGTAAVEASAPANAAR

SEQ ID NO: 1202286 - protein, 7 aa, Mycobacterium
ETGTGDP

SEQ ID NO: 1202287 - protein, 11 aa, Mycobacterium
ETGVTTPAPLA

SEQ ID NO: 1202288 - protein, 5 aa, Mycobacterium
ETGYR

SEQ ID NO: 1202289 - protein, 9 aa, Mycobacterium
ETIAETDSA

SEQ ID NO: 1202290 - protein, 13 aa, Mycobacterium
ETIEGMPKSRRSL

SEQ ID NO: 1202291 - protein, 10 aa, Mycobacterium
ETISTPRKAP

SEQ ID NO: 1202292 - protein, 5 aa, Mycobacterium
ETKIA

SEQ ID NO: 1202293 - protein, 16 aa, Mycobacterium
ETKNTTRNIPTPKADR

SEQ ID NO: 1202294 - protein, 18 aa, Mycobacterium
ETLDTGGSRLTATRDGLT

SEQ ID NO: 1202295 - protein, 7 aa, Mycobacterium
ETLEPSS

SEQ ID NO: 1202296 - protein, 7 aa, Mycobacterium
ETLGPVA

SEQ ID NO: 1202297 - protein, 19 aa, Mycobacterium
ETLPKPAEIDEPQRWIDRV

SEQ ID NO: 1202298 - protein, 7 aa, Mycobacterium
ETLPPRA

SEQ ID NO: 1202299 - protein, 5 aa, Mycobacterium
ETLRD

SEQ ID NO: 1202300 - protein, 14 aa, Mycobacterium
ETLRESANWPEGRP

SEQ ID NO: 1202301 - protein, 5 aa, Mycobacterium
ETLSA

SEQ ID NO: 1202302 - protein, 7 aa, Mycobacterium
ETLSEEP

SEQ ID NO: 1202303 - protein, 10 aa, Mycobacterium
ETNATTTETL

SEQ ID NO: 1202304 - protein, 12 aa, Mycobacterium
ETNDDAPQLTEA

SEQ ID NO: 1202305 - protein, 7 aa, Mycobacterium
ETNDPAA

SEQ ID NO: 1202306 - protein, 7 aa, Mycobacterium
ETNPTLN

SEQ ID NO: 1202307 - protein, 6 aa, Mycobacterium
ETNSHA

SEQ ID NO: 1202308 - protein, 12 aa, Mycobacterium
ETNYGPDGIGTT

SEQ ID NO: 1202309 - protein, 23 aa, Mycobacterium
ETPAGRREYTRAQEAISARAAPL

SEQ ID NO: 1202310 - protein, 9 aa, Mycobacterium
ETPDQGRVE

SEQ ID NO: 1202311 - protein, 7 aa, Mycobacterium
ETPDRTR

SEQ ID NO: 1202312 - protein, 6 aa, Mycobacterium
ETPEEV

SEQ ID NO: 1202313 - protein, 7 aa, Mycobacterium
ETPEEVR

SEQ ID NO: 1202314 - protein, 5 aa, Mycobacterium
ETPEF

SEQ ID NO: 1202315 - protein, 6 aa, Mycobacterium
ETPGFG

SEQ ID NO: 1202316 - protein, 20 aa, Mycobacterium
ETPGTIRSAGSSRPGEHNDE

SEQ ID NO: 1202317 - protein, 27 aa, Mycobacterium
ETPNHSGRAPSDGPAADVTASAPKRGP

SEQ ID NO: 1202318 - protein, 9 aa, Mycobacterium
ETPRDQHGR

SEQ ID NO: 1202319 - protein, 14 aa, Mycobacterium
ETPSAYRKRVADAS

SEQ ID NO: 1202320 - protein, 8 aa, Mycobacterium
ETPSNPGL

SEQ ID NO: 1202321 - protein, 9 aa, Mycobacterium
ETPSPPPGH

SEQ ID NO: 1202322 - protein, 14 aa, Mycobacterium
ETPSPPTGSDTDDA

SEQ ID NO: 1202323 - protein, 7 aa, Mycobacterium
ETPTEGA

SEQ ID NO: 1202324 - protein, 22 aa, Mycobacterium
ETPTPAALPGSPLERLEASRKG

SEQ ID NO: 1202325 - protein, 8 aa, Mycobacterium
ETPTPGKN

SEQ ID NO: 1202326 - protein, 8 aa, Mycobacterium
ETPTPSPF

SEQ ID NO: 1202327 - protein, 5 aa, Mycobacterium
ETPVL

SEQ ID NO: 1202328 - protein, 4 aa, Mycobacterium
ETQR

SEQ ID NO: 1202329 - protein, 8 aa, Mycobacterium
ETQRRAAG

SEQ ID NO: 1202330 - protein, 7 aa, Mycobacterium
ETRAYTK

SEQ ID NO: 1202331 - protein, 11 aa, Mycobacterium
ETRDAAPGPVS

SEQ ID NO: 1202332 - protein, 5 aa, Mycobacterium
ETRDE

SEQ ID NO: 1202333 - protein, 12 aa, Mycobacterium
ETRDPAAKDENA

SEQ ID NO: 1202334 - protein, 18 aa, Mycobacterium
ETRDPETFANNPAWTANY

SEQ ID NO: 1202335 - protein, 43 aa, Mycobacterium
ETREGRRQVPTADRRLGASGGAPPRAAAAYPNSDIGRSGPRRT

SEQ ID NO: 1202336 - protein, 10 aa, Mycobacterium
ETREPDHRAA

SEQ ID NO: 1202337 - protein, 6 aa, Mycobacterium
ETRKTP

SEQ ID NO: 1202338 - protein, 6 aa, Mycobacterium
ETRPAR

SEQ ID NO: 1202339 - protein, 13 aa, Mycobacterium
ETRPDPQLPGPDG

SEQ ID NO: 1202340 - protein, 13 aa, Mycobacterium
ETRPGADVSSDQA

SEQ ID NO: 1202341 - protein, 17 aa, Mycobacterium
ETRPGQGYPRTYQDQER

SEQ ID NO: 1202342 - protein, 7 aa, Mycobacterium
ETRPTLT

SEQ ID NO: 1202343 - protein, 4 aa, Mycobacterium
ETRR

SEQ ID NO: 1202344 - protein, 9 aa, Mycobacterium
ETRSGQEQL

SEQ ID NO: 1202345 - protein, 5 aa, Mycobacterium
ETRST

SEQ ID NO: 1202346 - protein, 36 aa, Mycobacterium
ETRYATSLGSAELASETPEGRTVEEQYDARQRAAAE

SEQ ID NO: 1202347 - protein, 9 aa, Mycobacterium
ETSAAQRAE

SEQ ID NO: 1202348 - protein, 6 aa, Mycobacterium
ETSATA

SEQ ID NO: 1202349 - protein, 7 aa, Mycobacterium
ETSDRIG

SEQ ID NO: 1202350 - protein, 4 aa, Mycobacterium
ETSE

SEQ ID NO: 1202351 - protein, 9 aa, Mycobacterium
ETSEETRDR

SEQ ID NO: 1202352 - protein, 6 aa, Mycobacterium
ETSENA

SEQ ID NO: 1202353 - protein, 7 aa, Mycobacterium
ETSENGW

SEQ ID NO: 1202354 - protein, 16 aa, Mycobacterium
ETSETHPALSDGQRTH

SEQ ID NO: 1202355 - protein, 16 aa, Mycobacterium
ETSEVHPRLSDGQRGH

SEQ ID NO: 1202356 - protein, 8 aa, Mycobacterium
ETSGPGQV

SEQ ID NO: 1202357 - protein, 11 aa, Mycobacterium
ETSGRAGNQRT

SEQ ID NO: 1202358 - protein, 5 aa, Mycobacterium
ETSHE

SEQ ID NO: 1202359 - protein, 4 aa, Mycobacterium
ETSL

SEQ ID NO: 1202360 - protein, 4 aa, Mycobacterium
ETSP

SEQ ID NO: 1202361 - protein, 7 aa, Mycobacterium
ETSPAKT

SEQ ID NO: 1202362 - protein, 10 aa, Mycobacterium
ETSPKEKATP

SEQ ID NO: 1202363 - protein, 16 aa, Mycobacterium
ETSPPVRDDGALGPSS

SEQ ID NO: 1202364 - protein, 12 aa, Mycobacterium
ETSPRNSAGPSV

SEQ ID NO: 1202365 - protein, 10 aa, Mycobacterium
ETSPWPTDPE

SEQ ID NO: 1202366 - protein, 7 aa, Mycobacterium
ETSRCGD

SEQ ID NO: 1202367 - protein, 11 aa, Mycobacterium
ETSRDTWPPTR

SEQ ID NO: 1202368 - protein, 14 aa, Mycobacterium
ETSSAIGTATNNVA

SEQ ID NO: 1202369 - protein, 9 aa, Mycobacterium
ETSSDKLTT

SEQ ID NO: 1202370 - protein, 7 aa, Mycobacterium
ETSSPEQ

SEQ ID NO: 1202371 - protein, 10 aa, Mycobacterium
ETSTDPGRGE

SEQ ID NO: 1202372 - protein, 5 aa, Mycobacterium
ETSTP

SEQ ID NO: 1202373 - protein, 6 aa, Mycobacterium
ETSVAD

SEQ ID NO: 1202374 - protein, 6 aa, Mycobacterium
ETSVDA

SEQ ID NO: 1202375 - protein, 5 aa, Mycobacterium
ETSWA

SEQ ID NO: 1202376 - protein, 15 aa, Mycobacterium
ETSYGPDGIGTTTGT

SEQ ID NO: 1202377 - protein, 5 aa, Mycobacterium
ETTDF

SEQ ID NO: 1202378 - protein, 10 aa, Mycobacterium
ETTDSGGDST

SEQ ID NO: 1202379 - protein, 5 aa, Mycobacterium
ETTEH

SEQ ID NO: 1202380 - protein, 9 aa, Mycobacterium
ETTFPAGSV

SEQ ID NO: 1202381 - protein, 5 aa, Mycobacterium
ETTGA

SEQ ID NO: 1202382 - protein, 7 aa, Mycobacterium
ETTGANF

SEQ ID NO: 1202383 - protein, 9 aa, Mycobacterium
ETTGQVRQA

SEQ ID NO: 1202384 - protein, 7 aa, Mycobacterium
ETTPARG

SEQ ID NO: 1202385 - protein, 10 aa, Mycobacterium
ETTQVRDQGM

SEQ ID NO: 1202386 - protein, 4 aa, Mycobacterium
ETTR

SEQ ID NO: 1202387 - protein, 7 aa, Mycobacterium
ETTRERI

SEQ ID NO: 1202388 - protein, 4 aa, Mycobacterium
ETTS

SEQ ID NO: 1202389 - protein, 10 aa, Mycobacterium
ETTTARGEHR

SEQ ID NO: 1202390 - protein, 7 aa, Mycobacterium
ETTTEKM

SEQ ID NO: 1202391 - protein, 4 aa, Mycobacterium
ETTV

SEQ ID NO: 1202392 - protein, 4 aa, Mycobacterium
ETTY

SEQ ID NO: 1202393 - protein, 4 aa, Mycobacterium
ETVA

SEQ ID NO: 1202394 - protein, 5 aa, Mycobacterium
ETVAG

SEQ ID NO: 1202395 - protein, 9 aa, Mycobacterium
ETVAGDGAA

SEQ ID NO: 1202396 - protein, 8 aa, Mycobacterium
ETVDGVPP

SEQ ID NO: 1202397 - protein, 12 aa, Mycobacterium
ETVPRDKRGTKH

SEQ ID NO: 1202398 - protein, 7 aa, Mycobacterium
ETVRDGT

SEQ ID NO: 1202399 - protein, 18 aa, Mycobacterium
ETVRGGGGLSSITPKNDR

SEQ ID NO: 1202400 - protein, 9 aa, Mycobacterium
ETVSDTDEF

SEQ ID NO: 1202401 - protein, 4 aa, Mycobacterium
ETVT

SEQ ID NO: 1202402 - protein, 15 aa, Mycobacterium
ETVTTGVGDQATASE

SEQ ID NO: 1202403 - protein, 12 aa, Mycobacterium
ETVVSPRFCGGS

SEQ ID NO: 1202404 - protein, 5 aa, Mycobacterium
ETWGP

SEQ ID NO: 1202405 - protein, 17 aa, Mycobacterium
ETWTASSSSALAAAPGV

SEQ ID NO: 1202406 - protein, 4 aa, Mycobacterium
ETYG

SEQ ID NO: 1202407 - protein, 5 aa, Mycobacterium
ETYGG

SEQ ID NO: 1202408 - protein, 22 aa, Mycobacterium
ETYPAGSLGAPIEASSDDPKTI

SEQ ID NO: 1202409 - protein, 8 aa, Mycobacterium
ETYSGGYT

SEQ ID NO: 1202410 - protein, 76 aa, Mycobacterium
EVAAEHPAVSPKQPAAAPSEQPAAVSSEQPAAVAPGRPAAVSSGRPAAVSSGRPAAVSSGRPAAVSSGRPAAVPSG

SEQ ID NO: 1202411 - protein, 11 aa, Mycobacterium
EVAAGAELRSE

SEQ ID NO: 1202412 - protein, 4 aa, Mycobacterium
EVAD

SEQ ID NO: 1202413 - protein, 16 aa, Mycobacterium
EVADAESRWFELSEQI

SEQ ID NO: 1202414 - protein, 5 aa, Mycobacterium
EVADG

SEQ ID NO: 1202415 - protein, 8 aa, Mycobacterium
EVAEDAMT

SEQ ID NO: 1202416 - protein, 14 aa, Mycobacterium
EVAERAEQTEGATL

SEQ ID NO: 1202417 - protein, 7 aa, Mycobacterium
EVAKAQA

SEQ ID NO: 1202418 - protein, 5 aa, Mycobacterium
EVAPE

SEQ ID NO: 1202419 - protein, 6 aa, Mycobacterium
EVAPGT

SEQ ID NO: 1202420 - protein, 9 aa, Mycobacterium
EVAPKRKDY

SEQ ID NO: 1202421 - protein, 7 aa, Mycobacterium
EVAPQGV

SEQ ID NO: 1202422 - protein, 7 aa, Mycobacterium
EVAPYQD

SEQ ID NO: 1202423 - protein, 7 aa, Mycobacterium
EVAQAPD

SEQ ID NO: 1202424 - protein, 13 aa, Mycobacterium
EVARGAGLRPRDK

SEQ ID NO: 1202425 - protein, 13 aa, Mycobacterium
EVATATAQALGLY

SEQ ID NO: 1202426 - protein, 16 aa, Mycobacterium
EVATTDADRAGRTPWN

SEQ ID NO: 1202427 - protein, 7 aa, Mycobacterium
EVDAGGN

SEQ ID NO: 1202428 - protein, 6 aa, Mycobacterium
EVDAPG

SEQ ID NO: 1202429 - protein, 12 aa, Mycobacterium
EVDATAAEDTRQ

SEQ ID NO: 1202430 - protein, 5 aa, Mycobacterium
EVDDP

SEQ ID NO: 1202431 - protein, 9 aa, Mycobacterium
EVDDTETNR

SEQ ID NO: 1202432 - protein, 5 aa, Mycobacterium
EVDED

SEQ ID NO: 1202433 - protein, 5 aa, Mycobacterium
EVDGE

SEQ ID NO: 1202434 - protein, 11 aa, Mycobacterium
EVDGETTEADP

SEQ ID NO: 1202435 - protein, 10 aa, Mycobacterium
EVDGSRVVGG

SEQ ID NO: 1202436 - protein, 8 aa, Mycobacterium
EVDKARAE

SEQ ID NO: 1202437 - protein, 8 aa, Mycobacterium
EVDSPTYR

SEQ ID NO: 1202438 - protein, 6 aa, Mycobacterium
EVDTRI

SEQ ID NO: 1202439 - protein, 9 aa, Mycobacterium
EVDTSDDRM

SEQ ID NO: 1202440 - protein, 11 aa, Mycobacterium
EVEAPAPEIER

SEQ ID NO: 1202441 - protein, 8 aa, Mycobacterium
EVEEPRKE

SEQ ID NO: 1202442 - protein, 6 aa, Mycobacterium
EVEGQD

SEQ ID NO: 1202443 - protein, 37 aa, Mycobacterium
EVEHQGRGVGRGDEISRSGRIGTDNTAGATENGDSHA

SEQ ID NO: 1202444 - protein, 12 aa, Mycobacterium
EVELGSRNERPM

SEQ ID NO: 1202445 - protein, 6 aa, Mycobacterium
EVEPAQ

SEQ ID NO: 1202446 - protein, 29 aa, Mycobacterium
EVEPEAETETAIESEPAPVKPVAPSNPAA

SEQ ID NO: 1202447 - protein, 7 aa, Mycobacterium
EVEPSNL

SEQ ID NO: 1202448 - protein, 8 aa, Mycobacterium
EVEQEAAR

SEQ ID NO: 1202449 - protein, 5 aa, Mycobacterium
EVEQR

SEQ ID NO: 1202450 - protein, 7 aa, Mycobacterium
EVEQRDG

SEQ ID NO: 1202451 - protein, 6 aa, Mycobacterium
EVGATP

SEQ ID NO: 1202452 - protein, 9 aa, Mycobacterium
EVGDEPRKA

SEQ ID NO: 1202453 - protein, 9 aa, Mycobacterium
EVGEDEEIH

SEQ ID NO: 1202454 - protein, 8 aa, Mycobacterium
EVGEEAVQ

SEQ ID NO: 1202455 - protein, 6 aa, Mycobacterium
EVGGEP

SEQ ID NO: 1202456 - protein, 10 aa, Mycobacterium
EVGGQGGTLT

SEQ ID NO: 1202457 - protein, 7 aa, Mycobacterium
EVGNIQP

SEQ ID NO: 1202458 - protein, 12 aa, Mycobacterium
EVGPTKTRESRR

SEQ ID NO: 1202459 - protein, 12 aa, Mycobacterium
EVGSQSDHGAQS

SEQ ID NO: 1202460 - protein, 7 aa, Mycobacterium
EVGSRSA

SEQ ID NO: 1202461 - protein, 11 aa, Mycobacterium
EVGTEVEEASF

SEQ ID NO: 1202462 - protein, 9 aa, Mycobacterium
EVGTSGRHH

SEQ ID NO: 1202463 - protein, 9 aa, Mycobacterium
EVHSQSAIG

SEQ ID NO: 1202464 - protein, 12 aa, Mycobacterium
EVIGTGGVSTDV

SEQ ID NO: 1202465 - protein, 11 aa, Mycobacterium
EVKAGRGTPHG

SEQ ID NO: 1202466 - protein, 8 aa, Mycobacterium
EVKEETGL

SEQ ID NO: 1202467 - protein, 11 aa, Mycobacterium
EVKPPTPGRRL

SEQ ID NO: 1202468 - protein, 4 aa, Mycobacterium
EVLP

SEQ ID NO: 1202469 - protein, 11 aa, Mycobacterium
EVNAGAARGSV

SEQ ID NO: 1202470 - protein, 12 aa, Mycobacterium
EVNGDVKQRSRT

SEQ ID NO: 1202471 - protein, 8 aa, Mycobacterium
EVNGPNRH

SEQ ID NO: 1202472 - protein, 5 aa, Mycobacterium
EVNPD

SEQ ID NO: 1202473 - protein, 14 aa, Mycobacterium
EVNPDPTTPASMTP

SEQ ID NO: 1202474 - protein, 10 aa, Mycobacterium
EVNQKAGHAE

SEQ ID NO: 1202475 - protein, 12 aa, Mycobacterium
EVPAEQPDDAPV

SEQ ID NO: 1202476 - protein, 12 aa, Mycobacterium
EVPAGGSAYTDG

SEQ ID NO: 1202477 - protein, 19 aa, Mycobacterium
EVPAGSRHHVPSDPDGPAE

SEQ ID NO: 1202478 - protein, 5 aa, Mycobacterium
EVPAV

SEQ ID NO: 1202479 - protein, 4 aa, Mycobacterium
EVPD

SEQ ID NO: 1202480 - protein, 8 aa, Mycobacterium
EVPDDLTP

SEQ ID NO: 1202481 - protein, 16 aa, Mycobacterium
EVPDTAPAATPSGRTE

SEQ ID NO: 1202482 - protein, 6 aa, Mycobacterium
EVPDTE

SEQ ID NO: 1202483 - protein, 33 aa, Mycobacterium
EVPDVAPGGAPPDSRPTRRTGGQVDGAPEDGDS

SEQ ID NO: 1202484 - protein, 11 aa, Mycobacterium
EVPEDDPDKAA

SEQ ID NO: 1202485 - protein, 6 aa, Mycobacterium
EVPEGR

SEQ ID NO: 1202486 - protein, 7 aa, Mycobacterium
EVPEGTD

SEQ ID NO: 1202487 - protein, 5 aa, Mycobacterium
EVPET

SEQ ID NO: 1202488 - protein, 13 aa, Mycobacterium
EVPGGAPAAPFDR

SEQ ID NO: 1202489 - protein, 7 aa, Mycobacterium
EVPGLSA

SEQ ID NO: 1202490 - protein, 7 aa, Mycobacterium
EVPNPGD

SEQ ID NO: 1202491 - protein, 6 aa, Mycobacterium
EVPPER

SEQ ID NO: 1202492 - protein, 12 aa, Mycobacterium
EVPPGSGVGAGD

SEQ ID NO: 1202493 - protein, 6 aa, Mycobacterium
EVPPPP

SEQ ID NO: 1202494 - protein, 9 aa, Mycobacterium
EVPPQPGKG

SEQ ID NO: 1202495 - protein, 8 aa, Mycobacterium
EVPPQTAS

SEQ ID NO: 1202496 - protein, 14 aa, Mycobacterium
EVPSPFPDTPEGSV

SEQ ID NO: 1202497 - protein, 5 aa, Mycobacterium
EVPSS

SEQ ID NO: 1202498 - protein, 22 aa, Mycobacterium
EVPSSYPPPAEFAEQANAKAEM

SEQ ID NO: 1202499 - protein, 7 aa, Mycobacterium
EVPTGEV

SEQ ID NO: 1202500 - protein, 13 aa, Mycobacterium
EVQGRRAGHTSLD

SEQ ID NO: 1202501 - protein, 16 aa, Mycobacterium
EVQPGESAVAQFRIKV

SEQ ID NO: 1202502 - protein, 8 aa, Mycobacterium
EVQPPGYG

SEQ ID NO: 1202503 - protein, 7 aa, Mycobacterium
EVRATAA

SEQ ID NO: 1202504 - protein, 15 aa, Mycobacterium
EVREGDPSPDGAGPL

SEQ ID NO: 1202505 - protein, 4 aa, Mycobacterium
EVRG

SEQ ID NO: 1202506 - protein, 27 aa, Mycobacterium
EVRGAAPRETWTGSASDGYASANERHA

SEQ ID NO: 1202507 - protein, 7 aa, Mycobacterium
EVRKNGT

SEQ ID NO: 1202508 - protein, 13 aa, Mycobacterium
EVRPEDEQLTRDG

SEQ ID NO: 1202509 - protein, 7 aa, Mycobacterium
EVRPGDT

SEQ ID NO: 1202510 - protein, 10 aa, Mycobacterium
EVRSPDSACN

SEQ ID NO: 1202511 - protein, 5 aa, Mycobacterium
EVRSR

SEQ ID NO: 1202512 - protein, 14 aa, Mycobacterium
EVRTTSVSGPLDTD

SEQ ID NO: 1202513 - protein, 4 aa, Mycobacterium
EVSA

SEQ ID NO: 1202514 - protein, 20 aa, Mycobacterium
EVSDGPAREPGARVGTSRTA

SEQ ID NO: 1202515 - protein, 8 aa, Mycobacterium
EVSEDDRF

SEQ ID NO: 1202516 - protein, 9 aa, Mycobacterium
EVSEDDRFR

SEQ ID NO: 1202517 - protein, 9 aa, Mycobacterium
EVSGAGESA

SEQ ID NO: 1202518 - protein, 8 aa, Mycobacterium
EVSGTESD

SEQ ID NO: 1202519 - protein, 7 aa, Mycobacterium
EVSQPTV

SEQ ID NO: 1202520 - protein, 9 aa, Mycobacterium
EVSQTGKPV

SEQ ID NO: 1202521 - protein, 7 aa, Mycobacterium
EVSSPTA

SEQ ID NO: 1202522 - protein, 10 aa, Mycobacterium
EVSSRAGAVG

SEQ ID NO: 1202523 - protein, 10 aa, Mycobacterium
EVSYEQKRRA

SEQ ID NO: 1202524 - protein, 4 aa, Mycobacterium
EVTA

SEQ ID NO: 1202525 - protein, 23 aa, Mycobacterium
EVTAKSRPFGPRDEGRPDEPSSG

SEQ ID NO: 1202526 - protein, 17 aa, Mycobacterium
EVTDPDSGVEKATEAST

SEQ ID NO: 1202527 - protein, 4 aa, Mycobacterium
EVTE

SEQ ID NO: 1202528 - protein, 7 aa, Mycobacterium
EVTESTR

SEQ ID NO: 1202529 - protein, 7 aa, Mycobacterium
EVTGANR

SEQ ID NO: 1202530 - protein, 12 aa, Mycobacterium
EVTGDAAEHARE

SEQ ID NO: 1202531 - protein, 7 aa, Mycobacterium
EVTGEYD

SEQ ID NO: 1202532 - protein, 9 aa, Mycobacterium
EVTKDGDDA

SEQ ID NO: 1202533 - protein, 5 aa, Mycobacterium
EVTPD

SEQ ID NO: 1202534 - protein, 10 aa, Mycobacterium
EVTRTGNARE

SEQ ID NO: 1202535 - protein, 10 aa, Mycobacterium
EVTSPPGSRR

SEQ ID NO: 1202536 - protein, 6 aa, Mycobacterium
EVTTPD

SEQ ID NO: 1202537 - protein, 6 aa, Mycobacterium
EVTTPG

SEQ ID NO: 1202538 - protein, 12 aa, Mycobacterium
EVVDEGADTVTV

SEQ ID NO: 1202539 - protein, 5 aa, Mycobacterium
EVVPA

SEQ ID NO: 1202540 - protein, 8 aa, Mycobacterium
EVVPTDKP

SEQ ID NO: 1202541 - protein, 5 aa, Mycobacterium
EWDAE

SEQ ID NO: 1202542 - protein, 6 aa, Mycobacterium
EWGDDE

SEQ ID NO: 1202543 - protein, 6 aa, Mycobacterium
EWHGAD

SEQ ID NO: 1202544 - protein, 7 aa, Mycobacterium
EWPDRPG

SEQ ID NO: 1202545 - protein, 5 aa, Mycobacterium
EWRGR

SEQ ID NO: 1202546 - protein, 16 aa, Mycobacterium
EWSSPSGRRNDLPNRG

SEQ ID NO: 1202547 - protein, 38 aa, Mycobacterium
EWSSQGTRNAIRKAPDNDKIRRRAATESSEKQAQKVRQ

SEQ ID NO: 1202548 - protein, 28 aa, Mycobacterium
EWTPAGTRFRRPGRQRARSSRSLASSIS

SEQ ID NO: 1202549 - protein, 9 aa, Mycobacterium
EWTSPAGKR

SEQ ID NO: 1202550 - protein, 13 aa, Mycobacterium
EYAGRAQGKWDPG

SEQ ID NO: 1202551 - protein, 13 aa, Mycobacterium
EYAKTDEQAAGAL

SEQ ID NO: 1202552 - protein, 7 aa, Mycobacterium
EYAPAVD

SEQ ID NO: 1202553 - protein, 7 aa, Mycobacterium
EYAQTTD

SEQ ID NO: 1202554 - protein, 11 aa, Mycobacterium
EYDESPTRQAG

SEQ ID NO: 1202555 - protein, 13 aa, Mycobacterium
EYDRQRASYEPLT

SEQ ID NO: 1202556 - protein, 13 aa, Mycobacterium
EYEDRDGNRRSSL

SEQ ID NO: 1202557 - protein, 12 aa, Mycobacterium
EYEPGEPRGTDW

SEQ ID NO: 1202558 - protein, 9 aa, Mycobacterium
EYESQGEEV

SEQ ID NO: 1202559 - protein, 8 aa, Mycobacterium
EYGAGSDL

SEQ ID NO: 1202560 - protein, 8 aa, Mycobacterium
EYGDPSGP

SEQ ID NO: 1202561 - protein, 9 aa, Mycobacterium
EYGGADASV

SEQ ID NO: 1202562 - protein, 9 aa, Mycobacterium
EYGSDGARA

SEQ ID NO: 1202563 - protein, 8 aa, Mycobacterium
EYGTGPDT

SEQ ID NO: 1202564 - protein, 6 aa, Mycobacterium
EYGTHP

SEQ ID NO: 1202565 - protein, 4 aa, Mycobacterium
EYGV

SEQ ID NO: 1202566 - protein, 15 aa, Mycobacterium
EYNDDGTVRKPGQDY

SEQ ID NO: 1202567 - protein, 6 aa, Mycobacterium
EYPGHW

SEQ ID NO: 1202568 - protein, 6 aa, Mycobacterium
EYPKPW

SEQ ID NO: 1202569 - protein, 15 aa, Mycobacterium
EYPNLEEPALPPGEA

SEQ ID NO: 1202570 - protein, 19 aa, Mycobacterium
EYPPGDPGAPPHRHPGGPA

SEQ ID NO: 1202571 - protein, 5 aa, Mycobacterium
EYPSA

SEQ ID NO: 1202572 - protein, 10 aa, Mycobacterium
EYQGETVPAG

SEQ ID NO: 1202573 - protein, 8 aa, Mycobacterium
EYQGGSPE

SEQ ID NO: 1202574 - protein, 11 aa, Mycobacterium
EYQPGEPRGTD

SEQ ID NO: 1202575 - protein, 5 aa, Mycobacterium
EYRAA

SEQ ID NO: 1202576 - protein, 6 aa, Mycobacterium
EYRESD

SEQ ID NO: 1202577 - protein, 11 aa, Mycobacterium
EYRSKNKEFGI

SEQ ID NO: 1202578 - protein, 18 aa, Mycobacterium
EYSAPAGTPREVKGANHN

SEQ ID NO: 1202579 - protein, 7 aa, Mycobacterium
EYSHNTT

SEQ ID NO: 1202580 - protein, 5 aa, Mycobacterium
EYTDS

SEQ ID NO: 1202581 - protein, 10 aa, Mycobacterium
EYTEDNVPDN

SEQ ID NO: 1202582 - protein, 4 aa, Mycobacterium
EYTG

SEQ ID NO: 1202583 - protein, 8 aa, Mycobacterium
FAAPKTAF

SEQ ID NO: 1202584 - protein, 5 aa, Mycobacterium
FAAPT

SEQ ID NO: 1202585 - protein, 8 aa, Mycobacterium
FAASGDDY

SEQ ID NO: 1202586 - protein, 10 aa, Mycobacterium
FAATAGEPCP

SEQ ID NO: 1202587 - protein, 16 aa, Mycobacterium
FAATGLPAVADDSGLE

SEQ ID NO: 1202588 - protein, 22 aa, Mycobacterium
FADADEEPEPAPVPRPEITSTC

SEQ ID NO: 1202589 - protein, 12 aa, Mycobacterium
FADADSRAAHDD

SEQ ID NO: 1202590 - protein, 19 aa, Mycobacterium
FADAGESSTPPTISTAPQR

SEQ ID NO: 1202591 - protein, 5 aa, Mycobacterium
FADAT

SEQ ID NO: 1202592 - protein, 9 aa, Mycobacterium
FADDDPAKL

SEQ ID NO: 1202593 - protein, 12 aa, Mycobacterium
FADEDRKSLAAS

SEQ ID NO: 1202594 - protein, 5 aa, Mycobacterium
FADGA

SEQ ID NO: 1202595 - protein, 20 aa, Mycobacterium
FADGADKKDGYAEIEQATNR

SEQ ID NO: 1202596 - protein, 7 aa, Mycobacterium
FADNEPT

SEQ ID NO: 1202597 - protein, 8 aa, Mycobacterium
FADPATLR

SEQ ID NO: 1202598 - protein, 8 aa, Mycobacterium
FADRDRDL

SEQ ID NO: 1202599 - protein, 14 aa, Mycobacterium
FADRPTVSTPDPRL

SEQ ID NO: 1202600 - protein, 7 aa, Mycobacterium
FADSRTD

SEQ ID NO: 1202601 - protein, 7 aa, Mycobacterium
FADTEPV

SEQ ID NO: 1202602 - protein, 10 aa, Mycobacterium
FADTGYAGTT

SEQ ID NO: 1202603 - protein, 6 aa, Mycobacterium
FAEPAD

SEQ ID NO: 1202604 - protein, 12 aa, Mycobacterium
FAERRDEEDALS

SEQ ID NO: 1202605 - protein, 5 aa, Mycobacterium
FAESG

SEQ ID NO: 1202606 - protein, 5 aa, Mycobacterium
FAGAD

SEQ ID NO: 1202607 - protein, 62 aa, Mycobacterium
FAGGAGPALDTLAGNDRALSTQLDEAARSDRTGRTSSGTVVNGAAADTNGLAPFTNTPAGQK

SEQ ID NO: 1202608 - protein, 6 aa, Mycobacterium
FAGGGA

SEQ ID NO: 1202609 - protein, 6 aa, Mycobacterium
FAGGPA

SEQ ID NO: 1202610 - protein, 5 aa, Mycobacterium
FAGRG

SEQ ID NO: 1202611 - protein, 6 aa, Mycobacterium
FAGSGL

SEQ ID NO: 1202612 - protein, 7 aa, Mycobacterium
FANPGVP

SEQ ID NO: 1202613 - protein, 11 aa, Mycobacterium
FAPAAEDATGA

SEQ ID NO: 1202614 - protein, 19 aa, Mycobacterium
FAPAGGDHATPPAGPNLSP

SEQ ID NO: 1202615 - protein, 10 aa, Mycobacterium
FAPASDTPGI

SEQ ID NO: 1202616 - protein, 8 aa, Mycobacterium
FAPDTPWQ

SEQ ID NO: 1202617 - protein, 9 aa, Mycobacterium
FAPGASGNI

SEQ ID NO: 1202618 - protein, 13 aa, Mycobacterium
FAPGGDLGQAAED

SEQ ID NO: 1202619 - protein, 14 aa, Mycobacterium
FAPGKAVNAGGVAT

SEQ ID NO: 1202620 - protein, 6 aa, Mycobacterium
FAPGTT

SEQ ID NO: 1202621 - protein, 4 aa, Mycobacterium
FAPK

SEQ ID NO: 1202622 - protein, 5 aa, Mycobacterium
FAPKG

SEQ ID NO: 1202623 - protein, 18 aa, Mycobacterium
FAPPPDDIPDFKSSSKVF

SEQ ID NO: 1202624 - protein, 6 aa, Mycobacterium
FAPPPT

SEQ ID NO: 1202625 - protein, 10 aa, Mycobacterium
FAPSARDERL

SEQ ID NO: 1202626 - protein, 9 aa, Mycobacterium
FAPSARDHE

SEQ ID NO: 1202627 - protein, 10 aa, Mycobacterium
FAPSGGNRQG

SEQ ID NO: 1202628 - protein, 6 aa, Mycobacterium
FAPSSL

SEQ ID NO: 1202629 - protein, 4 aa, Mycobacterium
FAPT

SEQ ID NO: 1202630 - protein, 9 aa, Mycobacterium
FAPTRPETV

SEQ ID NO: 1202631 - protein, 7 aa, Mycobacterium
FAQGNGE

SEQ ID NO: 1202632 - protein, 7 aa, Mycobacterium
FAQKARD

SEQ ID NO: 1202633 - protein, 4 aa, Mycobacterium
FARD

SEQ ID NO: 1202634 - protein, 11 aa, Mycobacterium
FARDRQKRAAL

SEQ ID NO: 1202635 - protein, 13 aa, Mycobacterium
FARDTADLSDRQN

SEQ ID NO: 1202636 - protein, 9 aa, Mycobacterium
FAREGGATF

SEQ ID NO: 1202637 - protein, 67 aa, Mycobacterium
FARGGDGGRGGAAIGGSQESVGGDGGRGGDGGFGGLGGDGGDGASPGGQGGEGGSPGGRPGGDNGGD

SEQ ID NO: 1202638 - protein, 11 aa, Mycobacterium
FARPGARHTRE

SEQ ID NO: 1202639 - protein, 6 aa, Mycobacterium
FASAAD

SEQ ID NO: 1202640 - protein, 11 aa, Mycobacterium
FASAPSRGRHV

SEQ ID NO: 1202641 - protein, 10 aa, Mycobacterium
FASEADRPTV

SEQ ID NO: 1202642 - protein, 7 aa, Mycobacterium
FASEGRA

SEQ ID NO: 1202643 - protein, 14 aa, Mycobacterium
FASGQGALAPLNPD

SEQ ID NO: 1202644 - protein, 8 aa, Mycobacterium
FASGTAAA

SEQ ID NO: 1202645 - protein, 7 aa, Mycobacterium
FASHGES

SEQ ID NO: 1202646 - protein, 7 aa, Mycobacterium
FASKGHP

SEQ ID NO: 1202647 - protein, 9 aa, Mycobacterium
FASPDAPAQ

SEQ ID NO: 1202648 - protein, 6 aa, Mycobacterium
FASPTT

SEQ ID NO: 1202649 - protein, 6 aa, Mycobacterium
FASTDL

SEQ ID NO: 1202650 - protein, 6 aa, Mycobacterium
FATDDP

SEQ ID NO: 1202651 - protein, 12 aa, Mycobacterium
FATDGPAELGYG

SEQ ID NO: 1202652 - protein, 11 aa, Mycobacterium
FATDPQTGRTT

SEQ ID NO: 1202653 - protein, 4 aa, Mycobacterium
FATG

SEQ ID NO: 1202654 - protein, 11 aa, Mycobacterium
FATGPKPDLKR

SEQ ID NO: 1202655 - protein, 10 aa, Mycobacterium
FATGRARAAN

SEQ ID NO: 1202656 - protein, 13 aa, Mycobacterium
FATNTARVTNDAE

SEQ ID NO: 1202657 - protein, 16 aa, Mycobacterium
FATNTGAVADPSDTTE

SEQ ID NO: 1202658 - protein, 6 aa, Mycobacterium
FATPEV

SEQ ID NO: 1202659 - protein, 7 aa, Mycobacterium
FATTRGD

SEQ ID NO: 1202660 - protein, 14 aa, Mycobacterium
FDADADGYGRGEGA

SEQ ID NO: 1202661 - protein, 9 aa, Mycobacterium
FDADEADMR

SEQ ID NO: 1202662 - protein, 7 aa, Mycobacterium
FDADGDR

SEQ ID NO: 1202663 - protein, 8 aa, Mycobacterium
FDADSQLR

SEQ ID NO: 1202664 - protein, 6 aa, Mycobacterium
FDAPSH

SEQ ID NO: 1202665 - protein, 8 aa, Mycobacterium
FDATGVRG

SEQ ID NO: 1202666 - protein, 4 aa, Mycobacterium
FDDA

SEQ ID NO: 1202667 - protein, 10 aa, Mycobacterium
FDDDPAALAR

SEQ ID NO: 1202668 - protein, 6 aa, Mycobacterium
FDDDPD

SEQ ID NO: 1202669 - protein, 5 aa, Mycobacterium
FDDDR

SEQ ID NO: 1202670 - protein, 5 aa, Mycobacterium
FDDGD

SEQ ID NO: 1202671 - protein, 4 aa, Mycobacterium
FDDN

SEQ ID NO: 1202672 - protein, 11 aa, Mycobacterium
FDDPARDLGRS

SEQ ID NO: 1202673 - protein, 12 aa, Mycobacterium
FDDQGAKYDGDG

SEQ ID NO: 1202674 - protein, 5 aa, Mycobacterium
FDEEA

SEQ ID NO: 1202675 - protein, 7 aa, Mycobacterium
FDEGSQT

SEQ ID NO: 1202676 - protein, 8 aa, Mycobacterium
FDEPGKPF

SEQ ID NO: 1202677 - protein, 14 aa, Mycobacterium
FDEPPPGPAEHADD

SEQ ID NO: 1202678 - protein, 20 aa, Mycobacterium
FDEPPTLHRGNASDDAGRPG

SEQ ID NO: 1202679 - protein, 7 aa, Mycobacterium
FDESGEL

SEQ ID NO: 1202680 - protein, 5 aa, Mycobacterium
FDETR

SEQ ID NO: 1202681 - protein, 6 aa, Mycobacterium
FDGAEA

SEQ ID NO: 1202682 - protein, 7 aa, Mycobacterium
FDGDGRS

SEQ ID NO: 1202683 - protein, 20 aa, Mycobacterium
FDGDGTADHAARDLDGDGIP

SEQ ID NO: 1202684 - protein, 4 aa, Mycobacterium
FDGG

SEQ ID NO: 1202685 - protein, 11 aa, Mycobacterium
FDGGGRPMQNR

SEQ ID NO: 1202686 - protein, 11 aa, Mycobacterium
FDGGSQRRYSL

SEQ ID NO: 1202687 - protein, 7 aa, Mycobacterium
FDGPAVE

SEQ ID NO: 1202688 - protein, 11 aa, Mycobacterium
FDGPGQVDVDN

SEQ ID NO: 1202689 - protein, 12 aa, Mycobacterium
FDGTDWSTHSAG

SEQ ID NO: 1202690 - protein, 9 aa, Mycobacterium
FDGTEGATE

SEQ ID NO: 1202691 - protein, 6 aa, Mycobacterium
FDGTLS

SEQ ID NO: 1202692 - protein, 6 aa, Mycobacterium
FDGTSI

SEQ ID NO: 1202693 - protein, 14 aa, Mycobacterium
FDGTVAEHRAALIT

SEQ ID NO: 1202694 - protein, 12 aa, Mycobacterium
FDHDESEKAQEA

SEQ ID NO: 1202695 - protein, 5 aa, Mycobacterium
FDNDA

SEQ ID NO: 1202696 - protein, 5 aa, Mycobacterium
FDPAA

SEQ ID NO: 1202697 - protein, 7 aa, Mycobacterium
FDPDGKV

SEQ ID NO: 1202698 - protein, 5 aa, Mycobacterium
FDPEA

SEQ ID NO: 1202699 - protein, 9 aa, Mycobacterium
FDPGGSRDV

SEQ ID NO: 1202700 - protein, 5 aa, Mycobacterium
FDPPP

SEQ ID NO: 1202701 - protein, 4 aa, Mycobacterium
FDPQ

SEQ ID NO: 1202702 - protein, 13 aa, Mycobacterium
FDPTGYLNRAVLF

SEQ ID NO: 1202703 - protein, 12 aa, Mycobacterium
FDPTLNTAPGVS

SEQ ID NO: 1202704 - protein, 5 aa, Mycobacterium
FDPYT

SEQ ID NO: 1202705 - protein, 6 aa, Mycobacterium
FDQRAA

SEQ ID NO: 1202706 - protein, 6 aa, Mycobacterium
FDQTTV

SEQ ID NO: 1202707 - protein, 12 aa, Mycobacterium
FDRGGKTVKERR

SEQ ID NO: 1202708 - protein, 11 aa, Mycobacterium
FDRPPSDHTQA

SEQ ID NO: 1202709 - protein, 5 aa, Mycobacterium
FDRSG

SEQ ID NO: 1202710 - protein, 6 aa, Mycobacterium
FDRSGP

SEQ ID NO: 1202711 - protein, 13 aa, Mycobacterium
FDSAGRAPRRRRR

SEQ ID NO: 1202712 - protein, 9 aa, Mycobacterium
FDSGSGWPS

SEQ ID NO: 1202713 - protein, 14 aa, Mycobacterium
FDSPPKPAPQVPLP

SEQ ID NO: 1202714 - protein, 10 aa, Mycobacterium
FDSYRDDPEL

SEQ ID NO: 1202715 - protein, 7 aa, Mycobacterium
FDTDDRE

SEQ ID NO: 1202716 - protein, 13 aa, Mycobacterium
FDTEGDPQKATAI

SEQ ID NO: 1202717 - protein, 7 aa, Mycobacterium
FDTEPDQ

SEQ ID NO: 1202718 - protein, 10 aa, Mycobacterium
FDTGGKTPLA

SEQ ID NO: 1202719 - protein, 8 aa, Mycobacterium
FDTNGGAS

SEQ ID NO: 1202720 - protein, 4 aa, Mycobacterium
FDTS

SEQ ID NO: 1202721 - protein, 11 aa, Mycobacterium
FDWPPGDTFEH

SEQ ID NO: 1202722 - protein, 6 aa, Mycobacterium
FDYSGT

SEQ ID NO: 1202723 - protein, 7 aa, Mycobacterium
FEAAQSA

SEQ ID NO: 1202724 - protein, 5 aa, Mycobacterium
FEANP

SEQ ID NO: 1202725 - protein, 6 aa, Mycobacterium
FEAPGG

SEQ ID NO: 1202726 - protein, 10 aa, Mycobacterium
FEAPTGPGVR

SEQ ID NO: 1202727 - protein, 9 aa, Mycobacterium
FEASTPDAL

SEQ ID NO: 1202728 - protein, 11 aa, Mycobacterium
FEDETGTRRRL

SEQ ID NO: 1202729 - protein, 8 aa, Mycobacterium
FEDPSSAT

SEQ ID NO: 1202730 - protein, 19 aa, Mycobacterium
FEEADRHPPVYDPSTRSVT

SEQ ID NO: 1202731 - protein, 13 aa, Mycobacterium
FEGKGEKLSSSEL

SEQ ID NO: 1202732 - protein, 14 aa, Mycobacterium
FEGNPDENGHRGVT

SEQ ID NO: 1202733 - protein, 8 aa, Mycobacterium
FEGPEGPA

SEQ ID NO: 1202734 - protein, 6 aa, Mycobacterium
FEGRSS

SEQ ID NO: 1202735 - protein, 9 aa, Mycobacterium
FEGSSPSFR

SEQ ID NO: 1202736 - protein, 6 aa, Mycobacterium
FEGTES

SEQ ID NO: 1202737 - protein, 8 aa, Mycobacterium
FEGTGDHS

SEQ ID NO: 1202738 - protein, 19 aa, Mycobacterium
FEGTTARIRERQKAGDVKG

SEQ ID NO: 1202739 - protein, 7 aa, Mycobacterium
FEHADTS

SEQ ID NO: 1202740 - protein, 9 aa, Mycobacterium
FEKDKTKWT

SEQ ID NO: 1202741 - protein, 21 aa, Mycobacterium
FEKPGGRAARGADHEPGREGW

SEQ ID NO: 1202742 - protein, 11 aa, Mycobacterium
FEKPGSREGWD

SEQ ID NO: 1202743 - protein, 9 aa, Mycobacterium
FEKVDGTDF

SEQ ID NO: 1202744 - protein, 7 aa, Mycobacterium
FENGTGP

SEQ ID NO: 1202745 - protein, 5 aa, Mycobacterium
FEPED

SEQ ID NO: 1202746 - protein, 11 aa, Mycobacterium
FEPKSAKSLSL

SEQ ID NO: 1202747 - protein, 6 aa, Mycobacterium
FEPLTP

SEQ ID NO: 1202748 - protein, 6 aa, Mycobacterium
FEPNDR

SEQ ID NO: 1202749 - protein, 9 aa, Mycobacterium
FEPNGERVS

SEQ ID NO: 1202750 - protein, 14 aa, Mycobacterium
FEPPADDYVSGEPW

SEQ ID NO: 1202751 - protein, 5 aa, Mycobacterium
FEPPD

SEQ ID NO: 1202752 - protein, 6 aa, Mycobacterium
FEPPPD

SEQ ID NO: 1202753 - protein, 7 aa, Mycobacterium
FEPQPDA

SEQ ID NO: 1202754 - protein, 41 aa, Mycobacterium
FEPSDPAAVPAGQTNGATVRIGGGDDGGISDDDVDVPPFMR

SEQ ID NO: 1202755 - protein, 22 aa, Mycobacterium
FEPTERDGRLYGRGTADDKAGI

SEQ ID NO: 1202756 - protein, 5 aa, Mycobacterium
FEQQA

SEQ ID NO: 1202757 - protein, 4 aa, Mycobacterium
FERS

SEQ ID NO: 1202758 - protein, 12 aa, Mycobacterium
FESDGARASLES

SEQ ID NO: 1202759 - protein, 8 aa, Mycobacterium
FESDGRSV

SEQ ID NO: 1202760 - protein, 17 aa, Mycobacterium
FESDSKYPYTPDGSREF

SEQ ID NO: 1202761 - protein, 11 aa, Mycobacterium
FESEHKSERIR

SEQ ID NO: 1202762 - protein, 24 aa, Mycobacterium
FESGDSSFPDAPYSGASQTSASVG

SEQ ID NO: 1202763 - protein, 9 aa, Mycobacterium
FESGSGWPS

SEQ ID NO: 1202764 - protein, 8 aa, Mycobacterium
FESLSDDQ

SEQ ID NO: 1202765 - protein, 6 aa, Mycobacterium
FESPGA

SEQ ID NO: 1202766 - protein, 5 aa, Mycobacterium
FETGA

SEQ ID NO: 1202767 - protein, 4 aa, Mycobacterium
FGAA

SEQ ID NO: 1202768 - protein, 11 aa, Mycobacterium
FGAAASGHGGA

SEQ ID NO: 1202769 - protein, 5 aa, Mycobacterium
FGAAD

SEQ ID NO: 1202770 - protein, 6 aa, Mycobacterium
FGAAEA

SEQ ID NO: 1202771 - protein, 5 aa, Mycobacterium
FGADT

SEQ ID NO: 1202772 - protein, 14 aa, Mycobacterium
FGAEGTSAAVPGLE

SEQ ID NO: 1202773 - protein, 7 aa, Mycobacterium
FGAPGGG

SEQ ID NO: 1202774 - protein, 5 aa, Mycobacterium
FGAPP

SEQ ID NO: 1202775 - protein, 6 aa, Mycobacterium
FGAPPV

SEQ ID NO: 1202776 - protein, 10 aa, Mycobacterium
FGAPTPSEAE

SEQ ID NO: 1202777 - protein, 4 aa, Mycobacterium
FGAR

SEQ ID NO: 1202778 - protein, 8 aa, Mycobacterium
FGARPDGL

SEQ ID NO: 1202779 - protein, 4 aa, Mycobacterium
FGAS

SEQ ID NO: 1202780 - protein, 7 aa, Mycobacterium
FGDETQV

SEQ ID NO: 1202781 - protein, 8 aa, Mycobacterium
FGDGATDT

SEQ ID NO: 1202782 - protein, 5 aa, Mycobacterium
FGDGS

SEQ ID NO: 1202783 - protein, 4 aa, Mycobacterium
FGDK

SEQ ID NO: 1202784 - protein, 11 aa, Mycobacterium
FGDKSGAGGHV

SEQ ID NO: 1202785 - protein, 8 aa, Mycobacterium
FGDKTGNG

SEQ ID NO: 1202786 - protein, 21 aa, Mycobacterium
FGDTDTTTVPKTEADRRVQVS

SEQ ID NO: 1202787 - protein, 5 aa, Mycobacterium
FGDTP

SEQ ID NO: 1202788 - protein, 4 aa, Mycobacterium
FGEA

SEQ ID NO: 1202789 - protein, 9 aa, Mycobacterium
FGEDPNVDE

SEQ ID NO: 1202790 - protein, 9 aa, Mycobacterium
FGEDTEDEL

SEQ ID NO: 1202791 - protein, 9 aa, Mycobacterium
FGEEGDEFD

SEQ ID NO: 1202792 - protein, 17 aa, Mycobacterium
FGEGSKEVKQATSQAVK

SEQ ID NO: 1202793 - protein, 12 aa, Mycobacterium
FGEGSLTESGYP

SEQ ID NO: 1202794 - protein, 4 aa, Mycobacterium
FGEP

SEQ ID NO: 1202795 - protein, 15 aa, Mycobacterium
FGEPTDLAGAAEPEV

SEQ ID NO: 1202796 - protein, 4 aa, Mycobacterium
FGER

SEQ ID NO: 1202797 - protein, 8 aa, Mycobacterium
FGERGSVD

SEQ ID NO: 1202798 - protein, 7 aa, Mycobacterium
FGESPRA

SEQ ID NO: 1202799 - protein, 12 aa, Mycobacterium
FGETAAAPRVTD

SEQ ID NO: 1202800 - protein, 10 aa, Mycobacterium
FGGASPHPYE

SEQ ID NO: 1202801 - protein, 11 aa, Mycobacterium
FGGDASTMTGR

SEQ ID NO: 1202802 - protein, 9 aa, Mycobacterium
FGGDDEGIR

SEQ ID NO: 1202803 - protein, 11 aa, Mycobacterium
FGGDKHEIPVD

SEQ ID NO: 1202804 - protein, 7 aa, Mycobacterium
FGGDPDK

SEQ ID NO: 1202805 - protein, 8 aa, Mycobacterium
FGGDPGRV

SEQ ID NO: 1202806 - protein, 7 aa, Mycobacterium
FGGEGAS

SEQ ID NO: 1202807 - protein, 8 aa, Mycobacterium
FGGGGRGM

SEQ ID NO: 1202808 - protein, 6 aa, Mycobacterium
FGGGPI

SEQ ID NO: 1202809 - protein, 8 aa, Mycobacterium
FGGNEPAR

SEQ ID NO: 1202810 - protein, 7 aa, Mycobacterium
FGGNPPN

SEQ ID NO: 1202811 - protein, 7 aa, Mycobacterium
FGGPPAD

SEQ ID NO: 1202812 - protein, 9 aa, Mycobacterium
FGGPPADYQ

SEQ ID NO: 1202813 - protein, 7 aa, Mycobacterium
FGGRPGG

SEQ ID NO: 1202814 - protein, 6 aa, Mycobacterium
FGGRTG

SEQ ID NO: 1202815 - protein, 7 aa, Mycobacterium
FGGSTHP

SEQ ID NO: 1202816 - protein, 4 aa, Mycobacterium
FGGT

SEQ ID NO: 1202817 - protein, 6 aa, Mycobacterium
FGGTTK

SEQ ID NO: 1202818 - protein, 4 aa, Mycobacterium
FGGY

SEQ ID NO: 1202819 - protein, 4 aa, Mycobacterium
FGHH

SEQ ID NO: 1202820 - protein, 4 aa, Mycobacterium
FGHK

SEQ ID NO: 1202821 - protein, 14 aa, Mycobacterium
FGHNKTPAAEGRPC

SEQ ID NO: 1202822 - protein, 10 aa, Mycobacterium
FGKGSGHPAG

SEQ ID NO: 1202823 - protein, 4 aa, Mycobacterium
FGKS

SEQ ID NO: 1202824 - protein, 14 aa, Mycobacterium
FGMKGPDRDAGAYD

SEQ ID NO: 1202825 - protein, 18 aa, Mycobacterium
FGNDAQPGEDPATGGRYS

SEQ ID NO: 1202826 - protein, 7 aa, Mycobacterium
FGNPDPD

SEQ ID NO: 1202827 - protein, 11 aa, Mycobacterium
FGNPGDAPGYT

SEQ ID NO: 1202828 - protein, 6 aa, Mycobacterium
FGNPTA

SEQ ID NO: 1202829 - protein, 7 aa, Mycobacterium
FGNPTFT

SEQ ID NO: 1202830 - protein, 9 aa, Mycobacterium
FGNSPQDEL

SEQ ID NO: 1202831 - protein, 10 aa, Mycobacterium
FGPAPGTPFG

SEQ ID NO: 1202832 - protein, 9 aa, Mycobacterium
FGPDDAPRV

SEQ ID NO: 1202833 - protein, 4 aa, Mycobacterium
FGPE

SEQ ID NO: 1202834 - protein, 5 aa, Mycobacterium
FGPEE

SEQ ID NO: 1202835 - protein, 8 aa, Mycobacterium
FGPEGQRY

SEQ ID NO: 1202836 - protein, 24 aa, Mycobacterium
FGPGGRGGRRGGPRGGGRSRRGDV

SEQ ID NO: 1202837 - protein, 5 aa, Mycobacterium
FGPGL

SEQ ID NO: 1202838 - protein, 8 aa, Mycobacterium
FGPPAGQA

SEQ ID NO: 1202839 - protein, 8 aa, Mycobacterium
FGPPLDPG

SEQ ID NO: 1202840 - protein, 15 aa, Mycobacterium
FGPPREQLRRLEAQV

SEQ ID NO: 1202841 - protein, 12 aa, Mycobacterium
FGPQKGADPDTV

SEQ ID NO: 1202842 - protein, 22 aa, Mycobacterium
FGPQSGEQRARQLDRDVGEGVT

SEQ ID NO: 1202843 - protein, 4 aa, Mycobacterium
FGPR

SEQ ID NO: 1202844 - protein, 5 aa, Mycobacterium
FGPTT

SEQ ID NO: 1202845 - protein, 9 aa, Mycobacterium
FGQAGNAGG

SEQ ID NO: 1202846 - protein, 20 aa, Mycobacterium
FGQAPNQASAAISRSGQDAA

SEQ ID NO: 1202847 - protein, 8 aa, Mycobacterium
FGQDDEGL

SEQ ID NO: 1202848 - protein, 8 aa, Mycobacterium
FGQDPDID

SEQ ID NO: 1202849 - protein, 12 aa, Mycobacterium
FGRAGARAPGPL

SEQ ID NO: 1202850 - protein, 9 aa, Mycobacterium
FGRDGDDLT

SEQ ID NO: 1202851 - protein, 7 aa, Mycobacterium
FGRDSDF

SEQ ID NO: 1202852 - protein, 4 aa, Mycobacterium
FGRE

SEQ ID NO: 1202853 - protein, 12 aa, Mycobacterium
FGREDQDGGSDT

SEQ ID NO: 1202854 - protein, 11 aa, Mycobacterium
FGRGGGAALPG

SEQ ID NO: 1202855 - protein, 200 aa, Mycobacterium
FGRGGNAGNGGNGGTGGNGGNGGTGGTGGNGGTGGTGGTGGIGGAGSTGGTGGTGGTGGTGGTGGTGGTGGTGGTGGTGGKGGTGGTGGDGGTGGTGGTGGTGGTGGTGGTGGTGGTGGAGDGLGGTGGTGGTGGFGGQGGQGGTGGTGGQGGLGGVGGTGGTGGTGGTGGQGGTGGTGGTGGTGGTGGAGGDGGLGGLG

SEQ ID NO: 1202856 - protein, 5 aa, Mycobacterium
FGRGP

SEQ ID NO: 1202857 - protein, 8 aa, Mycobacterium
FGRGPGQL

SEQ ID NO: 1202858 - protein, 24 aa, Mycobacterium
FGRGRFSGGGGGFGGFGGGDGQEF

SEQ ID NO: 1202859 - protein, 10 aa, Mycobacterium
FGRGSDVSTR

SEQ ID NO: 1202860 - protein, 4 aa, Mycobacterium
FGRP

SEQ ID NO: 1202861 - protein, 45 aa, Mycobacterium
FGRPGSGGRGGDSHSRTDYAEGGAGGAGGAGVGGAGNGGAGGKGD

SEQ ID NO: 1202862 - protein, 4 aa, Mycobacterium
FGRR

SEQ ID NO: 1202863 - protein, 13 aa, Mycobacterium
FGRRGGTPDAGTQ

SEQ ID NO: 1202864 - protein, 10 aa, Mycobacterium
FGRTRGEGAV

SEQ ID NO: 1202865 - protein, 8 aa, Mycobacterium
FGSDELKD

SEQ ID NO: 1202866 - protein, 5 aa, Mycobacterium
FGSEG

SEQ ID NO: 1202867 - protein, 15 aa, Mycobacterium
FGSGSSNGSGTATAA

SEQ ID NO: 1202868 - protein, 9 aa, Mycobacterium
FGSGTGHAE

SEQ ID NO: 1202869 - protein, 11 aa, Mycobacterium
FGSPGQANYAT

SEQ ID NO: 1202870 - protein, 8 aa, Mycobacterium
FGSPPAAE

SEQ ID NO: 1202871 - protein, 8 aa, Mycobacterium
FGSQPNVV

SEQ ID NO: 1202872 - protein, 4 aa, Mycobacterium
FGSR

SEQ ID NO: 1202873 - protein, 34 aa, Mycobacterium
FGSSASPLPGSGTGGMSQSGSVRPAVSASPSPAV

SEQ ID NO: 1202874 - protein, 9 aa, Mycobacterium
FGSSEGGVS

SEQ ID NO: 1202875 - protein, 9 aa, Mycobacterium
FGSSPDGAI

SEQ ID NO: 1202876 - protein, 5 aa, Mycobacterium
FGSTA

SEQ ID NO: 1202877 - protein, 10 aa, Mycobacterium
FGTDDTNEHE

SEQ ID NO: 1202878 - protein, 6 aa, Mycobacterium
FGTDTR

SEQ ID NO: 1202879 - protein, 7 aa, Mycobacterium
FGTEEQK

SEQ ID NO: 1202880 - protein, 10 aa, Mycobacterium
FGTERDEHVP

SEQ ID NO: 1202881 - protein, 9 aa, Mycobacterium
FGTGGGEQL

SEQ ID NO: 1202882 - protein, 4 aa, Mycobacterium
FGTK

SEQ ID NO: 1202883 - protein, 8 aa, Mycobacterium
FGTKRGRK

SEQ ID NO: 1202884 - protein, 11 aa, Mycobacterium
FGTPTQTTSTS

SEQ ID NO: 1202885 - protein, 11 aa, Mycobacterium
FGTSGHRGSSL

SEQ ID NO: 1202886 - protein, 6 aa, Mycobacterium
FGVGGT

SEQ ID NO: 1202887 - protein, 6 aa, Mycobacterium
FGVSGT

SEQ ID NO: 1202888 - protein, 9 aa, Mycobacterium
FGYPEEGQS

SEQ ID NO: 1202889 - protein, 11 aa, Mycobacterium
FHEPKPAGPVT

SEQ ID NO: 1202890 - protein, 7 aa, Mycobacterium
FHKREDK

SEQ ID NO: 1202891 - protein, 21 aa, Mycobacterium
FHPEKSGDAGAELLSNWVGAL

SEQ ID NO: 1202892 - protein, 6 aa, Mycobacterium
FHRPDD

SEQ ID NO: 1202893 - protein, 11 aa, Mycobacterium
FHTDGSTLGSG

SEQ ID NO: 1202894 - protein, 17 aa, Mycobacterium
FHTPEKGRNNFSYSASK

SEQ ID NO: 1202895 - protein, 11 aa, Mycobacterium
FIGSKSDAPVL

SEQ ID NO: 1202896 - protein, 9 aa, Mycobacterium
FKGGYSGPE

SEQ ID NO: 1202897 - protein, 11 aa, Mycobacterium
FKGPPTLSGRA

SEQ ID NO: 1202898 - protein, 6 aa, Mycobacterium
FKGPQS

SEQ ID NO: 1202899 - protein, 4 aa, Mycobacterium
FKHP

SEQ ID NO: 1202900 - protein, 4 aa, Mycobacterium
FKKA

SEQ ID NO: 1202901 - protein, 5 aa, Mycobacterium
FKNGG

SEQ ID NO: 1202902 - protein, 8 aa, Mycobacterium
FKPDLTQA

SEQ ID NO: 1202903 - protein, 14 aa, Mycobacterium
FKPESDDVRDSPAL

SEQ ID NO: 1202904 - protein, 4 aa, Mycobacterium
FKQQ

SEQ ID NO: 1202905 - protein, 17 aa, Mycobacterium
FKQTDADVGSFDGGYGS

SEQ ID NO: 1202906 - protein, 5 aa, Mycobacterium
FKRTK

SEQ ID NO: 1202907 - protein, 7 aa, Mycobacterium
FKSEEAA

SEQ ID NO: 1202908 - protein, 13 aa, Mycobacterium
FKSSTPSARPVTY

SEQ ID NO: 1202909 - protein, 6 aa, Mycobacterium
FKTDEA

SEQ ID NO: 1202910 - protein, 5 aa, Mycobacterium
FNAPS

SEQ ID NO: 1202911 - protein, 5 aa, Mycobacterium
FNDYA

SEQ ID NO: 1202912 - protein, 7 aa, Mycobacterium
FNEGAPE

SEQ ID NO: 1202913 - protein, 10 aa, Mycobacterium
FNEKQTGADE

SEQ ID NO: 1202914 - protein, 9 aa, Mycobacterium
FNGESARLR

SEQ ID NO: 1202915 - protein, 13 aa, Mycobacterium
FNGTAPATPPTLG

SEQ ID NO: 1202916 - protein, 8 aa, Mycobacterium
FNKAQRGA

SEQ ID NO: 1202917 - protein, 12 aa, Mycobacterium
FNKSENPKNPPH

SEQ ID NO: 1202918 - protein, 4 aa, Mycobacterium
FNNE

SEQ ID NO: 1202919 - protein, 14 aa, Mycobacterium
FNPEARSSTVTGNT

SEQ ID NO: 1202920 - protein, 8 aa, Mycobacterium
FNPGGVRQ

SEQ ID NO: 1202921 - protein, 7 aa, Mycobacterium
FNPGTEI

SEQ ID NO: 1202922 - protein, 4 aa, Mycobacterium
FNPK

SEQ ID NO: 1202923 - protein, 7 aa, Mycobacterium
FNPPTDI

SEQ ID NO: 1202924 - protein, 7 aa, Mycobacterium
FNPSGGV

SEQ ID NO: 1202925 - protein, 7 aa, Mycobacterium
FNPSSGA

SEQ ID NO: 1202926 - protein, 13 aa, Mycobacterium
FNQEPGTYSAEGY

SEQ ID NO: 1202927 - protein, 4 aa, Mycobacterium
FNSG

SEQ ID NO: 1202928 - protein, 12 aa, Mycobacterium
FNSTASQDVAVI

SEQ ID NO: 1202929 - protein, 4 aa, Mycobacterium
FPAA

SEQ ID NO: 1202930 - protein, 6 aa, Mycobacterium
FPAAPQ

SEQ ID NO: 1202931 - protein, 12 aa, Mycobacterium
FPAEAGSVAEAN

SEQ ID NO: 1202932 - protein, 7 aa, Mycobacterium
FPAEDQI

SEQ ID NO: 1202933 - protein, 5 aa, Mycobacterium
FPAGE

SEQ ID NO: 1202934 - protein, 23 aa, Mycobacterium
FPAGTGPARRAQKYAGTDRQARG

SEQ ID NO: 1202935 - protein, 12 aa, Mycobacterium
FPAHPDPDGSVK

SEQ ID NO: 1202936 - protein, 6 aa, Mycobacterium
FPAPGV

SEQ ID NO: 1202937 - protein, 9 aa, Mycobacterium
FPAPPASKG

SEQ ID NO: 1202938 - protein, 6 aa, Mycobacterium
FPDAQD

SEQ ID NO: 1202939 - protein, 4 aa, Mycobacterium
FPDG

SEQ ID NO: 1202940 - protein, 6 aa, Mycobacterium
FPDGGT

SEQ ID NO: 1202941 - protein, 5 aa, Mycobacterium
FPDGV

SEQ ID NO: 1202942 - protein, 5 aa, Mycobacterium
FPDPA

SEQ ID NO: 1202943 - protein, 7 aa, Mycobacterium
FPDPDPD

SEQ ID NO: 1202944 - protein, 18 aa, Mycobacterium
FPDPNGVRQPNGAPPPAL

SEQ ID NO: 1202945 - protein, 55 aa, Mycobacterium
FPDPNGVRQPNGAPPPAPATLQGTPEYPNPAVPRGDPCSYTPPADGLPTPGNPLP

SEQ ID NO: 1202946 - protein, 10 aa, Mycobacterium
FPDPRVPTGI

SEQ ID NO: 1202947 - protein, 12 aa, Mycobacterium
FPDPSANQEPGS

SEQ ID NO: 1202948 - protein, 8 aa, Mycobacterium
FPDSADPH

SEQ ID NO: 1202949 - protein, 9 aa, Mycobacterium
FPDSPLPEA

SEQ ID NO: 1202950 - protein, 6 aa, Mycobacterium
FPDTDS

SEQ ID NO: 1202951 - protein, 4 aa, Mycobacterium
FPDV

SEQ ID NO: 1202952 - protein, 8 aa, Mycobacterium
FPEGEGLA

SEQ ID NO: 1202953 - protein, 6 aa, Mycobacterium
FPEGFT

SEQ ID NO: 1202954 - protein, 29 aa, Mycobacterium
FPEGGGPSGPKRSRLAGTRSPLDRVQTTQ

SEQ ID NO: 1202955 - protein, 11 aa, Mycobacterium
FPELPDAPTPD

SEQ ID NO: 1202956 - protein, 6 aa, Mycobacterium
FPEPKT

SEQ ID NO: 1202957 - protein, 5 aa, Mycobacterium
FPEQR

SEQ ID NO: 1202958 - protein, 6 aa, Mycobacterium
FPESDV

SEQ ID NO: 1202959 - protein, 14 aa, Mycobacterium
FPESVGGGGGDGAD

SEQ ID NO: 1202960 - protein, 4 aa, Mycobacterium
FPFQ

SEQ ID NO: 1202961 - protein, 13 aa, Mycobacterium
FPGADEHYGGGHH

SEQ ID NO: 1202962 - protein, 6 aa, Mycobacterium
FPGAGS

SEQ ID NO: 1202963 - protein, 8 aa, Mycobacterium
FPGAPDAD

SEQ ID NO: 1202964 - protein, 6 aa, Mycobacterium
FPGAPR

SEQ ID NO: 1202965 - protein, 8 aa, Mycobacterium
FPGAQDAD

SEQ ID NO: 1202966 - protein, 6 aa, Mycobacterium
FPGASE

SEQ ID NO: 1202967 - protein, 9 aa, Mycobacterium
FPGDMNTPD

SEQ ID NO: 1202968 - protein, 30 aa, Mycobacterium
FPGERADGGESISAPEDELASRRKSRDRKI

SEQ ID NO: 1202969 - protein, 11 aa, Mycobacterium
FPGGSQRRYTL

SEQ ID NO: 1202970 - protein, 11 aa, Mycobacterium
FPGPTGANTVE

SEQ ID NO: 1202971 - protein, 5 aa, Mycobacterium
FPGPV

SEQ ID NO: 1202972 - protein, 6 aa, Mycobacterium
FPGRDP

SEQ ID NO: 1202973 - protein, 14 aa, Mycobacterium
FPGRPDATSLTTRP

SEQ ID NO: 1202974 - protein, 4 aa, Mycobacterium
FPGT

SEQ ID NO: 1202975 - protein, 12 aa, Mycobacterium
FPNHEANPLNPA

SEQ ID NO: 1202976 - protein, 9 aa, Mycobacterium
FPNPADPNH

SEQ ID NO: 1202977 - protein, 8 aa, Mycobacterium
FPNPNNRD

SEQ ID NO: 1202978 - protein, 15 aa, Mycobacterium
FPPAEHTGPPGGRYD

SEQ ID NO: 1202979 - protein, 15 aa, Mycobacterium
FPPASVTGTPKGRAR

SEQ ID NO: 1202980 - protein, 16 aa, Mycobacterium
FPPASVTGTPKSRARG

SEQ ID NO: 1202981 - protein, 6 aa, Mycobacterium
FPPDGE

SEQ ID NO: 1202982 - protein, 9 aa, Mycobacterium
FPPDPQDPY

SEQ ID NO: 1202983 - protein, 12 aa, Mycobacterium
FPPEQTQVRTGV

SEQ ID NO: 1202984 - protein, 11 aa, Mycobacterium
FPPGAHGSPIN

SEQ ID NO: 1202985 - protein, 16 aa, Mycobacterium
FPPGGGLGGGSPLDAL

SEQ ID NO: 1202986 - protein, 7 aa, Mycobacterium
FPPNHPP

SEQ ID NO: 1202987 - protein, 6 aa, Mycobacterium
FPPPDG

SEQ ID NO: 1202988 - protein, 5 aa, Mycobacterium
FPPPQ

SEQ ID NO: 1202989 - protein, 7 aa, Mycobacterium
FPPPTTQ

SEQ ID NO: 1202990 - protein, 10 aa, Mycobacterium
FPPRRGDDGA

SEQ ID NO: 1202991 - protein, 4 aa, Mycobacterium
FPPS

SEQ ID NO: 1202992 - protein, 14 aa, Mycobacterium
FPPVERTGPPGGHY

SEQ ID NO: 1202993 - protein, 12 aa, Mycobacterium
FPRAKPCGDGLT

SEQ ID NO: 1202994 - protein, 17 aa, Mycobacterium
FPRPSTQIPVPGPSGYP

SEQ ID NO: 1202995 - protein, 5 aa, Mycobacterium
FPSDR

SEQ ID NO: 1202996 - protein, 4 aa, Mycobacterium
FPSG

SEQ ID NO: 1202997 - protein, 9 aa, Mycobacterium
FPSKAEHDE

SEQ ID NO: 1202998 - protein, 9 aa, Mycobacterium
FPSPYTQGN

SEQ ID NO: 1202999 - protein, 6 aa, Mycobacterium
FPSRKS

SEQ ID NO: 1203000 - protein, 6 aa, Mycobacterium
FPTGTS

SEQ ID NO: 1203001 - protein, 8 aa, Mycobacterium
FPTKSSAG

SEQ ID NO: 1203002 - protein, 6 aa, Mycobacterium
FPTLTP

SEQ ID NO: 1203003 - protein, 16 aa, Mycobacterium
FPTPDAAALTRLDSST

SEQ ID NO: 1203004 - protein, 5 aa, Mycobacterium
FPTSG

SEQ ID NO: 1203005 - protein, 4 aa, Mycobacterium
FPTT

SEQ ID NO: 1203006 - protein, 10 aa, Mycobacterium
FPTVDTGGFR

SEQ ID NO: 1203007 - protein, 4 aa, Mycobacterium
FPVT

SEQ ID NO: 1203008 - protein, 21 aa, Mycobacterium
FPYDDGYEGRYAEADSRKALE

SEQ ID NO: 1203009 - protein, 10 aa, Mycobacterium
FQDPDEDVRQ

SEQ ID NO: 1203010 - protein, 5 aa, Mycobacterium
FQGNS

SEQ ID NO: 1203011 - protein, 5 aa, Mycobacterium
FQGRE

SEQ ID NO: 1203012 - protein, 10 aa, Mycobacterium
FQGTHPSVGA

SEQ ID NO: 1203013 - protein, 8 aa, Mycobacterium
FQPPRGTE

SEQ ID NO: 1203014 - protein, 7 aa, Mycobacterium
FQRRSTE

SEQ ID NO: 1203015 - protein, 9 aa, Mycobacterium
FQSSQDALR

SEQ ID NO: 1203016 - protein, 10 aa, Mycobacterium
FQTDQSGIEH

SEQ ID NO: 1203017 - protein, 9 aa, Mycobacterium
FRAANDEAV

SEQ ID NO: 1203018 - protein, 6 aa, Mycobacterium
FRAGAQ

SEQ ID NO: 1203019 - protein, 13 aa, Mycobacterium
FRDAEGTDTRNYG

SEQ ID NO: 1203020 - protein, 24 aa, Mycobacterium
FRDPAADEPQAPPEWSAPTPPTGI

SEQ ID NO: 1203021 - protein, 6 aa, Mycobacterium
FREKPN

SEQ ID NO: 1203022 - protein, 9 aa, Mycobacterium
FREQTRSER

SEQ ID NO: 1203023 - protein, 5 aa, Mycobacterium
FRGEG

SEQ ID NO: 1203024 - protein, 9 aa, Mycobacterium
FRGGSTGRK

SEQ ID NO: 1203025 - protein, 10 aa, Mycobacterium
FRGPDEPAIP

SEQ ID NO: 1203026 - protein, 13 aa, Mycobacterium
FRGYDEDAAHGEL

SEQ ID NO: 1203027 - protein, 11 aa, Mycobacterium
FRKEQADALAE

SEQ ID NO: 1203028 - protein, 4 aa, Mycobacterium
FRPD

SEQ ID NO: 1203029 - protein, 8 aa, Mycobacterium
FRPDRGNV

SEQ ID NO: 1203030 - protein, 6 aa, Mycobacterium
FRPGDN

SEQ ID NO: 1203031 - protein, 7 aa, Mycobacterium
FRPPTDL

SEQ ID NO: 1203032 - protein, 19 aa, Mycobacterium
FRQAGGGSVRDIMDTLIGR

SEQ ID NO: 1203033 - protein, 10 aa, Mycobacterium
FRRAGEEGLL

SEQ ID NO: 1203034 - protein, 8 aa, Mycobacterium
FRRSTENT

SEQ ID NO: 1203035 - protein, 5 aa, Mycobacterium
FRSPA

SEQ ID NO: 1203036 - protein, 5 aa, Mycobacterium
FRSPT

SEQ ID NO: 1203037 - protein, 14 aa, Mycobacterium
FRTARGADKSGATM

SEQ ID NO: 1203038 - protein, 8 aa, Mycobacterium
FRTDSNDA

SEQ ID NO: 1203039 - protein, 4 aa, Mycobacterium
FRTE

SEQ ID NO: 1203040 - protein, 7 aa, Mycobacterium
FSAAGSG

SEQ ID NO: 1203041 - protein, 12 aa, Mycobacterium
FSAASDEALGDI

SEQ ID NO: 1203042 - protein, 11 aa, Mycobacterium
FSAQNSGGRDR

SEQ ID NO: 1203043 - protein, 8 aa, Mycobacterium
FSASGEGG

SEQ ID NO: 1203044 - protein, 9 aa, Mycobacterium
FSDDPDRDI

SEQ ID NO: 1203045 - protein, 7 aa, Mycobacterium
FSDEEEA

SEQ ID NO: 1203046 - protein, 16 aa, Mycobacterium
FSDNSLADRVPETVGS

SEQ ID NO: 1203047 - protein, 4 aa, Mycobacterium
FSDP

SEQ ID NO: 1203048 - protein, 6 aa, Mycobacterium
FSDPEE

SEQ ID NO: 1203049 - protein, 7 aa, Mycobacterium
FSDPSRL

SEQ ID NO: 1203050 - protein, 7 aa, Mycobacterium
FSDSDGI

SEQ ID NO: 1203051 - protein, 8 aa, Mycobacterium
FSDTTEPD

SEQ ID NO: 1203052 - protein, 4 aa, Mycobacterium
FSEA

SEQ ID NO: 1203053 - protein, 14 aa, Mycobacterium
FSEAEKDKRQAEKS

SEQ ID NO: 1203054 - protein, 10 aa, Mycobacterium
FSEAEQAATL

SEQ ID NO: 1203055 - protein, 11 aa, Mycobacterium
FSEAGVGPGRT

SEQ ID NO: 1203056 - protein, 11 aa, Mycobacterium
FSEPESGSDLA

SEQ ID NO: 1203057 - protein, 9 aa, Mycobacterium
FSGADDEQI

SEQ ID NO: 1203058 - protein, 10 aa, Mycobacterium
FSGEAGPEQL

SEQ ID NO: 1203059 - protein, 4 aa, Mycobacterium
FSGG

SEQ ID NO: 1203060 - protein, 5 aa, Mycobacterium
FSGGA

SEQ ID NO: 1203061 - protein, 8 aa, Mycobacterium
FSGGAAPL

SEQ ID NO: 1203062 - protein, 8 aa, Mycobacterium
FSGGQRQR

SEQ ID NO: 1203063 - protein, 8 aa, Mycobacterium
FSGPAGTY

SEQ ID NO: 1203064 - protein, 10 aa, Mycobacterium
FSGPDRDLPS

SEQ ID NO: 1203065 - protein, 4 aa, Mycobacterium
FSGR

SEQ ID NO: 1203066 - protein, 13 aa, Mycobacterium
FSGRPEKAEESER

SEQ ID NO: 1203067 - protein, 6 aa, Mycobacterium
FSGRRQ

SEQ ID NO: 1203068 - protein, 18 aa, Mycobacterium
FSGSAETGKGTVAVAPDG

SEQ ID NO: 1203069 - protein, 18 aa, Mycobacterium
FSGSAREAITAAGGTATE

SEQ ID NO: 1203070 - protein, 6 aa, Mycobacterium
FSGSES

SEQ ID NO: 1203071 - protein, 7 aa, Mycobacterium
FSGSRND

SEQ ID NO: 1203072 - protein, 4 aa, Mycobacterium
FSHS

SEQ ID NO: 1203073 - protein, 6 aa, Mycobacterium
FSKEQS

SEQ ID NO: 1203074 - protein, 11 aa, Mycobacterium
FSKPGKRGGTM

SEQ ID NO: 1203075 - protein, 11 aa, Mycobacterium
FSNGNSNPGLL

SEQ ID NO: 1203076 - protein, 11 aa, Mycobacterium
FSNGQAPGDGQ

SEQ ID NO: 1203077 - protein, 17 aa, Mycobacterium
FSNPSQKATEDYISGRF

SEQ ID NO: 1203078 - protein, 6 aa, Mycobacterium
FSNSRS

SEQ ID NO: 1203079 - protein, 8 aa, Mycobacterium
FSNTRPPG

SEQ ID NO: 1203080 - protein, 7 aa, Mycobacterium
FSPDSGS

SEQ ID NO: 1203081 - protein, 6 aa, Mycobacterium
FSPERV

SEQ ID NO: 1203082 - protein, 5 aa, Mycobacterium
FSPGE

SEQ ID NO: 1203083 - protein, 11 aa, Mycobacterium
FSPGQADPRVR

SEQ ID NO: 1203084 - protein, 6 aa, Mycobacterium
FSPGRR

SEQ ID NO: 1203085 - protein, 9 aa, Mycobacterium
FSPGSAERF

SEQ ID NO: 1203086 - protein, 8 aa, Mycobacterium
FSPPGNTA

SEQ ID NO: 1203087 - protein, 7 aa, Mycobacterium
FSPQQGL

SEQ ID NO: 1203088 - protein, 4 aa, Mycobacterium
FSQG

SEQ ID NO: 1203089 - protein, 12 aa, Mycobacterium
FSQSDLSDREQA

SEQ ID NO: 1203090 - protein, 10 aa, Mycobacterium
FSQTAMPQPV

SEQ ID NO: 1203091 - protein, 9 aa, Mycobacterium
FSRPGTELT

SEQ ID NO: 1203092 - protein, 11 aa, Mycobacterium
FSRQGDGRARD

SEQ ID NO: 1203093 - protein, 16 aa, Mycobacterium
FSSAPTVHRTGGLSAA

SEQ ID NO: 1203094 - protein, 8 aa, Mycobacterium
FSSASLSA

SEQ ID NO: 1203095 - protein, 5 aa, Mycobacterium
FSSGE

SEQ ID NO: 1203096 - protein, 11 aa, Mycobacterium
FSSNSEGACPT

SEQ ID NO: 1203097 - protein, 23 aa, Mycobacterium
FSSQQKTALPRYPEGSTTEQVET

SEQ ID NO: 1203098 - protein, 9 aa, Mycobacterium
FSTAGAKRS

SEQ ID NO: 1203099 - protein, 9 aa, Mycobacterium
FSTEGERRR

SEQ ID NO: 1203100 - protein, 8 aa, Mycobacterium
FSTGADMN

SEQ ID NO: 1203101 - protein, 6 aa, Mycobacterium
FSTPEF

SEQ ID NO: 1203102 - protein, 7 aa, Mycobacterium
FSTQPEI

SEQ ID NO: 1203103 - protein, 8 aa, Mycobacterium
FSTSPDRL

SEQ ID NO: 1203104 - protein, 5 aa, Mycobacterium
FSVPP

SEQ ID NO: 1203105 - protein, 11 aa, Mycobacterium
FSYDSDAYDDE

SEQ ID NO: 1203106 - protein, 8 aa, Mycobacterium
FTAASTAA

SEQ ID NO: 1203107 - protein, 8 aa, Mycobacterium
FTAETAAA

SEQ ID NO: 1203108 - protein, 24 aa, Mycobacterium
FTAKDAANATKISSLNTASEGAAV

SEQ ID NO: 1203109 - protein, 25 aa, Mycobacterium
FTAPESSTPALAPDPAVAGPPLPEG

SEQ ID NO: 1203110 - protein, 9 aa, Mycobacterium
FTAPGGDAQ

SEQ ID NO: 1203111 - protein, 21 aa, Mycobacterium
FTARPGQSTIKASAMSATGAP

SEQ ID NO: 1203112 - protein, 10 aa, Mycobacterium
FTASDQTETV

SEQ ID NO: 1203113 - protein, 9 aa, Mycobacterium
FTASPVDPA

SEQ ID NO: 1203114 - protein, 10 aa, Mycobacterium
FTDADEPQYC

SEQ ID NO: 1203115 - protein, 17 aa, Mycobacterium
FTDDDDALRQANDTAYG

SEQ ID NO: 1203116 - protein, 14 aa, Mycobacterium
FTDDSDFLVAVLRP

SEQ ID NO: 1203117 - protein, 7 aa, Mycobacterium
FTDEPVP

SEQ ID NO: 1203118 - protein, 9 aa, Mycobacterium
FTDEPVPRE

SEQ ID NO: 1203119 - protein, 10 aa, Mycobacterium
FTDEQQAHVE

SEQ ID NO: 1203120 - protein, 5 aa, Mycobacterium
FTDGV

SEQ ID NO: 1203121 - protein, 9 aa, Mycobacterium
FTDPEGSSL

SEQ ID NO: 1203122 - protein, 9 aa, Mycobacterium
FTDQPRTAF

SEQ ID NO: 1203123 - protein, 5 aa, Mycobacterium
FTDTE

SEQ ID NO: 1203124 - protein, 7 aa, Mycobacterium
FTDVPTD

SEQ ID NO: 1203125 - protein, 9 aa, Mycobacterium
FTEGAGSGI

SEQ ID NO: 1203126 - protein, 7 aa, Mycobacterium
FTEGDDD

SEQ ID NO: 1203127 - protein, 17 aa, Mycobacterium
FTEGIGDPHPVSPNGVR

SEQ ID NO: 1203128 - protein, 8 aa, Mycobacterium
FTEGRTSA

SEQ ID NO: 1203129 - protein, 4 aa, Mycobacterium
FTEH

SEQ ID NO: 1203130 - protein, 9 aa, Mycobacterium
FTENASTKV

SEQ ID NO: 1203131 - protein, 6 aa, Mycobacterium
FTGDPA

SEQ ID NO: 1203132 - protein, 12 aa, Mycobacterium
FTGDSNRRAPTA

SEQ ID NO: 1203133 - protein, 10 aa, Mycobacterium
FTGEDGATYE

SEQ ID NO: 1203134 - protein, 11 aa, Mycobacterium
FTGGAGSGESN

SEQ ID NO: 1203135 - protein, 8 aa, Mycobacterium
FTGGGMPD

SEQ ID NO: 1203136 - protein, 13 aa, Mycobacterium
FTGGGYDKPVPID

SEQ ID NO: 1203137 - protein, 14 aa, Mycobacterium
FTGPDGRRYKAPTT

SEQ ID NO: 1203138 - protein, 8 aa, Mycobacterium
FTGPPDAP

SEQ ID NO: 1203139 - protein, 8 aa, Mycobacterium
FTGSRSGG

SEQ ID NO: 1203140 - protein, 10 aa, Mycobacterium
FTGSSGVGKE

SEQ ID NO: 1203141 - protein, 10 aa, Mycobacterium
FTGSTATGIQ

SEQ ID NO: 1203142 - protein, 9 aa, Mycobacterium
FTGSTAVGA

SEQ ID NO: 1203143 - protein, 5 aa, Mycobacterium
FTGTP

SEQ ID NO: 1203144 - protein, 5 aa, Mycobacterium
FTHGD

SEQ ID NO: 1203145 - protein, 11 aa, Mycobacterium
FTIGPKERKLG

SEQ ID NO: 1203146 - protein, 5 aa, Mycobacterium
FTKAR

SEQ ID NO: 1203147 - protein, 4 aa, Mycobacterium
FTKP

SEQ ID NO: 1203148 - protein, 18 aa, Mycobacterium
FTKTTSAGVQNIGGAQRG

SEQ ID NO: 1203149 - protein, 18 aa, Mycobacterium
FTKTTSKGVETIGGARRG

SEQ ID NO: 1203150 - protein, 9 aa, Mycobacterium
FTPAEADQL

SEQ ID NO: 1203151 - protein, 5 aa, Mycobacterium
FTPAT

SEQ ID NO: 1203152 - protein, 12 aa, Mycobacterium
FTPDDQKALTKT

SEQ ID NO: 1203153 - protein, 19 aa, Mycobacterium
FTPDPPEQVGATDPETHEG

SEQ ID NO: 1203154 - protein, 10 aa, Mycobacterium
FTPDQKARNV

SEQ ID NO: 1203155 - protein, 7 aa, Mycobacterium
FTPDSSR

SEQ ID NO: 1203156 - protein, 10 aa, Mycobacterium
FTPEGDDITA

SEQ ID NO: 1203157 - protein, 11 aa, Mycobacterium
FTPEGDDITEQ

SEQ ID NO: 1203158 - protein, 10 aa, Mycobacterium
FTPEGDDITG

SEQ ID NO: 1203159 - protein, 7 aa, Mycobacterium
FTPESIA

SEQ ID NO: 1203160 - protein, 4 aa, Mycobacterium
FTPG

SEQ ID NO: 1203161 - protein, 12 aa, Mycobacterium
FTPGDQAAARAA

SEQ ID NO: 1203162 - protein, 6 aa, Mycobacterium
FTPGDR

SEQ ID NO: 1203163 - protein, 13 aa, Mycobacterium
FTPGEPKGPGVAE

SEQ ID NO: 1203164 - protein, 6 aa, Mycobacterium
FTPGGT

SEQ ID NO: 1203165 - protein, 7 aa, Mycobacterium
FTPGPGT

SEQ ID NO: 1203166 - protein, 6 aa, Mycobacterium
FTPGTN

SEQ ID NO: 1203167 - protein, 10 aa, Mycobacterium
FTPNPADAYS

SEQ ID NO: 1203168 - protein, 7 aa, Mycobacterium
FTPRATE

SEQ ID NO: 1203169 - protein, 9 aa, Mycobacterium
FTPRPVPTV

SEQ ID NO: 1203170 - protein, 9 aa, Mycobacterium
FTPRSGDRL

SEQ ID NO: 1203171 - protein, 10 aa, Mycobacterium
FTPSTSQVRT

SEQ ID NO: 1203172 - protein, 7 aa, Mycobacterium
FTPTDEP

SEQ ID NO: 1203173 - protein, 11 aa, Mycobacterium
FTPTGVDGYPQ

SEQ ID NO: 1203174 - protein, 8 aa, Mycobacterium
FTQDGGPQ

SEQ ID NO: 1203175 - protein, 7 aa, Mycobacterium
FTQSPEE

SEQ ID NO: 1203176 - protein, 11 aa, Mycobacterium
FTRGDGGSRLR

SEQ ID NO: 1203177 - protein, 6 aa, Mycobacterium
FTRPDG

SEQ ID NO: 1203178 - protein, 6 aa, Mycobacterium
FTRPEP

SEQ ID NO: 1203179 - protein, 11 aa, Mycobacterium
FTRTGAGGIAQ

SEQ ID NO: 1203180 - protein, 8 aa, Mycobacterium
FTSGSKVS

SEQ ID NO: 1203181 - protein, 10 aa, Mycobacterium
FTSPQAGFSG

SEQ ID NO: 1203182 - protein, 13 aa, Mycobacterium
FTSSQTAHGGQET

SEQ ID NO: 1203183 - protein, 13 aa, Mycobacterium
FTSVGKKELENDP

SEQ ID NO: 1203184 - protein, 19 aa, Mycobacterium
FTTDDPADARTLQAGHTAY

SEQ ID NO: 1203185 - protein, 6 aa, Mycobacterium
FTTGNG

SEQ ID NO: 1203186 - protein, 12 aa, Mycobacterium
FTTHDGAPYPDL

SEQ ID NO: 1203187 - protein, 9 aa, Mycobacterium
FTTPEYGAA

SEQ ID NO: 1203188 - protein, 12 aa, Mycobacterium
FTTRSTKQSGQI

SEQ ID NO: 1203189 - protein, 14 aa, Mycobacterium
FTTSPAAAKSSEYC

SEQ ID NO: 1203190 - protein, 10 aa, Mycobacterium
FTTTTRAGNA

SEQ ID NO: 1203191 - protein, 5 aa, Mycobacterium
FTYSE

SEQ ID NO: 1203192 - protein, 6 aa, Mycobacterium
FVGPPH

SEQ ID NO: 1203193 - protein, 5 aa, Mycobacterium
FVPRG

SEQ ID NO: 1203194 - protein, 11 aa, Mycobacterium
FYASGGGPLYT

SEQ ID NO: 1203195 - protein, 5 aa, Mycobacterium
FYEPP

SEQ ID NO: 1203196 - protein, 7 aa, Mycobacterium
FYGPRGA

SEQ ID NO: 1203197 - protein, 4 aa, Mycobacterium
FYTG

SEQ ID NO: 1203198 - protein, 16 aa, Mycobacterium
GAAAAGEVRDDLSPDT

SEQ ID NO: 1203199 - protein, 9 aa, Mycobacterium
GAAADAPVD

SEQ ID NO: 1203200 - protein, 23 aa, Mycobacterium
GAAADDGMSPLPVNEREPAHPEY

SEQ ID NO: 1203201 - protein, 14 aa, Mycobacterium
GAAAERNVTPPRQF

SEQ ID NO: 1203202 - protein, 6 aa, Mycobacterium
GAAAHS

SEQ ID NO: 1203203 - protein, 30 aa, Mycobacterium
GAAANAPKVQKAVDKAADATGRLRSEQEKL

SEQ ID NO: 1203204 - protein, 13 aa, Mycobacterium
GAAAPGTDERMRT

SEQ ID NO: 1203205 - protein, 8 aa, Mycobacterium
GAAAPLAG

SEQ ID NO: 1203206 - protein, 8 aa, Mycobacterium
GAAAPLHP

SEQ ID NO: 1203207 - protein, 15 aa, Mycobacterium
GAAAPSPDGAGDAID

SEQ ID NO: 1203208 - protein, 19 aa, Mycobacterium
GAAAQSALGAASMDSGPAV

SEQ ID NO: 1203209 - protein, 15 aa, Mycobacterium
GAAARALGDQARNRW

SEQ ID NO: 1203210 - protein, 5 aa, Mycobacterium
GAAAT

SEQ ID NO: 1203211 - protein, 20 aa, Mycobacterium
GAAAVDSFSGHQAERTDAGP

SEQ ID NO: 1203212 - protein, 4 aa, Mycobacterium
GAAC

SEQ ID NO: 1203213 - protein, 10 aa, Mycobacterium
GAADADAAAD

SEQ ID NO: 1203214 - protein, 7 aa, Mycobacterium
GAADAEL

SEQ ID NO: 1203215 - protein, 5 aa, Mycobacterium
GAADD

SEQ ID NO: 1203216 - protein, 7 aa, Mycobacterium
GAADPNF

SEQ ID NO: 1203217 - protein, 14 aa, Mycobacterium
GAADPRQEGVALGV

SEQ ID NO: 1203218 - protein, 9 aa, Mycobacterium
GAADPVTEL

SEQ ID NO: 1203219 - protein, 16 aa, Mycobacterium
GAADREQDRTGEGAGW

SEQ ID NO: 1203220 - protein, 6 aa, Mycobacterium
GAADSP

SEQ ID NO: 1203221 - protein, 9 aa, Mycobacterium
GAADSSLEQ

SEQ ID NO: 1203222 - protein, 22 aa, Mycobacterium
GAADVGAKTLPAGDALPGSTTQ

SEQ ID NO: 1203223 - protein, 17 aa, Mycobacterium
GAAEALAETATKVGGTA

SEQ ID NO: 1203224 - protein, 8 aa, Mycobacterium
GAAEDGRA

SEQ ID NO: 1203225 - protein, 6 aa, Mycobacterium
GAAEGA

SEQ ID NO: 1203226 - protein, 9 aa, Mycobacterium
GAAEGETYD

SEQ ID NO: 1203227 - protein, 12 aa, Mycobacterium
GAAERISAALAG

SEQ ID NO: 1203228 - protein, 16 aa, Mycobacterium
GAAERMRDDVAYLAHR

SEQ ID NO: 1203229 - protein, 5 aa, Mycobacterium
GAAGA

SEQ ID NO: 1203230 - protein, 6 aa, Mycobacterium
GAAGAG

SEQ ID NO: 1203231 - protein, 9 aa, Mycobacterium
GAAGDAKHD

SEQ ID NO: 1203232 - protein, 8 aa, Mycobacterium
GAAGDQQT

SEQ ID NO: 1203233 - protein, 9 aa, Mycobacterium
GAAGDRVEY

SEQ ID NO: 1203234 - protein, 14 aa, Mycobacterium
GAAGEGTITQAERN

SEQ ID NO: 1203235 - protein, 14 aa, Mycobacterium
GAAGFAGRAGPLSC

SEQ ID NO: 1203236 - protein, 7 aa, Mycobacterium
GAAGGAM

SEQ ID NO: 1203237 - protein, 9 aa, Mycobacterium
GAAGGGRPL

SEQ ID NO: 1203238 - protein, 9 aa, Mycobacterium
GAAGGIGSA

SEQ ID NO: 1203239 - protein, 7 aa, Mycobacterium
GAAGGTD

SEQ ID NO: 1203240 - protein, 21 aa, Mycobacterium
GAAGPPAGGAPTGGAAGVAAG

SEQ ID NO: 1203241 - protein, 10 aa, Mycobacterium
GAAGQAAAQD

SEQ ID NO: 1203242 - protein, 10 aa, Mycobacterium
GAAGRDERDI

SEQ ID NO: 1203243 - protein, 7 aa, Mycobacterium
GAAGRGF

SEQ ID NO: 1203244 - protein, 12 aa, Mycobacterium
GAAGTAPSTIGR

SEQ ID NO: 1203245 - protein, 10 aa, Mycobacterium
GAAGTAVPTA

SEQ ID NO: 1203246 - protein, 9 aa, Mycobacterium
GAAGTVTTL

SEQ ID NO: 1203247 - protein, 11 aa, Mycobacterium
GAAHTGRDAND

SEQ ID NO: 1203248 - protein, 5 aa, Mycobacterium
GAAIT

SEQ ID NO: 1203249 - protein, 12 aa, Mycobacterium
GAAKGNSKKTGD

SEQ ID NO: 1203250 - protein, 10 aa, Mycobacterium
GAALDEQGRS

SEQ ID NO: 1203251 - protein, 17 aa, Mycobacterium
GAANQERKLDDPTCDGP

SEQ ID NO: 1203252 - protein, 12 aa, Mycobacterium
GAAPAARPSVEQ

SEQ ID NO: 1203253 - protein, 25 aa, Mycobacterium
GAAPAATADHGAAPAATADHGAADG

SEQ ID NO: 1203254 - protein, 13 aa, Mycobacterium
GAAPAELDGTPAE

SEQ ID NO: 1203255 - protein, 18 aa, Mycobacterium
GAAPARWPSPLHLLPAPR

SEQ ID NO: 1203256 - protein, 10 aa, Mycobacterium
GAAPDGNATM

SEQ ID NO: 1203257 - protein, 12 aa, Mycobacterium
GAAPDTPSAAEH

SEQ ID NO: 1203258 - protein, 9 aa, Mycobacterium
GAAPEVRTR

SEQ ID NO: 1203259 - protein, 21 aa, Mycobacterium
GAAPGGAQSAVRAKSSPTDPV

SEQ ID NO: 1203260 - protein, 5 aa, Mycobacterium
GAAPH

SEQ ID NO: 1203261 - protein, 6 aa, Mycobacterium
GAAPLD

SEQ ID NO: 1203262 - protein, 13 aa, Mycobacterium
GAAPPDQRRADEV

SEQ ID NO: 1203263 - protein, 8 aa, Mycobacterium
GAAPQDYR

SEQ ID NO: 1203264 - protein, 7 aa, Mycobacterium
GAAPRRA

SEQ ID NO: 1203265 - protein, 14 aa, Mycobacterium
GAAPRRTDTSHRDV

SEQ ID NO: 1203266 - protein, 15 aa, Mycobacterium
GAAPTAVPASFEPSA

SEQ ID NO: 1203267 - protein, 6 aa, Mycobacterium
GAAPVP

SEQ ID NO: 1203268 - protein, 12 aa, Mycobacterium
GAAQADNVADVG

SEQ ID NO: 1203269 - protein, 12 aa, Mycobacterium
GAAQIARARTPP

SEQ ID NO: 1203270 - protein, 5 aa, Mycobacterium
GAAQP

SEQ ID NO: 1203271 - protein, 8 aa, Mycobacterium
GAAQRGNR

SEQ ID NO: 1203272 - protein, 16 aa, Mycobacterium
GAAQSESLARQVEDNG

SEQ ID NO: 1203273 - protein, 9 aa, Mycobacterium
GAAQSGPDA

SEQ ID NO: 1203274 - protein, 5 aa, Mycobacterium
GAAQV

SEQ ID NO: 1203275 - protein, 7 aa, Mycobacterium
GAAQVTK

SEQ ID NO: 1203276 - protein, 4 aa, Mycobacterium
GAAR

SEQ ID NO: 1203277 - protein, 9 aa, Mycobacterium
GAARDPDVT

SEQ ID NO: 1203278 - protein, 10 aa, Mycobacterium
GAARGQGRSH

SEQ ID NO: 1203279 - protein, 9 aa, Mycobacterium
GAARGTGRA

SEQ ID NO: 1203280 - protein, 5 aa, Mycobacterium
GAARL

SEQ ID NO: 1203281 - protein, 6 aa, Mycobacterium
GAARNN

SEQ ID NO: 1203282 - protein, 6 aa, Mycobacterium
GAASAA

SEQ ID NO: 1203283 - protein, 5 aa, Mycobacterium
GAASG

SEQ ID NO: 1203284 - protein, 9 aa, Mycobacterium
GAASGIGRE

SEQ ID NO: 1203285 - protein, 14 aa, Mycobacterium
GAASGSYETDSGTF

SEQ ID NO: 1203286 - protein, 10 aa, Mycobacterium
GAASHRATTT

SEQ ID NO: 1203287 - protein, 8 aa, Mycobacterium
GAASPKET

SEQ ID NO: 1203288 - protein, 8 aa, Mycobacterium
GAASPRQS

SEQ ID NO: 1203289 - protein, 4 aa, Mycobacterium
GAAT

SEQ ID NO: 1203290 - protein, 7 aa, Mycobacterium
GAATAED

SEQ ID NO: 1203291 - protein, 6 aa, Mycobacterium
GAATAH

SEQ ID NO: 1203292 - protein, 9 aa, Mycobacterium
GAATAPELQ

SEQ ID NO: 1203293 - protein, 6 aa, Mycobacterium
GAATAV

SEQ ID NO: 1203294 - protein, 15 aa, Mycobacterium
GAATDAAKPATLNAC

SEQ ID NO: 1203295 - protein, 8 aa, Mycobacterium
GAATEGTV

SEQ ID NO: 1203296 - protein, 8 aa, Mycobacterium
GAATEPVG

SEQ ID NO: 1203297 - protein, 6 aa, Mycobacterium
GAATGA

SEQ ID NO: 1203298 - protein, 11 aa, Mycobacterium
GAATGRFDATG

SEQ ID NO: 1203299 - protein, 16 aa, Mycobacterium
GAATGTEHGSAAAGGL

SEQ ID NO: 1203300 - protein, 7 aa, Mycobacterium
GAATRTA

SEQ ID NO: 1203301 - protein, 30 aa, Mycobacterium
GAATTADVETPPVEEERAESGASNSGEDLE

SEQ ID NO: 1203302 - protein, 6 aa, Mycobacterium
GAAVDV

SEQ ID NO: 1203303 - protein, 13 aa, Mycobacterium
GAAVGSTAAYPGI

SEQ ID NO: 1203304 - protein, 9 aa, Mycobacterium
GAAVSPSAV

SEQ ID NO: 1203305 - protein, 8 aa, Mycobacterium
GAAYSGAV

SEQ ID NO: 1203306 - protein, 12 aa, Mycobacterium
GAAYSPDSAKTF

SEQ ID NO: 1203307 - protein, 18 aa, Mycobacterium
GACAEQPSFRTRAASQVS

SEQ ID NO: 1203308 - protein, 6 aa, Mycobacterium
GACHTG

SEQ ID NO: 1203309 - protein, 9 aa, Mycobacterium
GADADPAVN

SEQ ID NO: 1203310 - protein, 12 aa, Mycobacterium
GADAEAYAAATR

SEQ ID NO: 1203311 - protein, 13 aa, Mycobacterium
GADAGHQQSPLSE

SEQ ID NO: 1203312 - protein, 10 aa, Mycobacterium
GADARPSPWP

SEQ ID NO: 1203313 - protein, 9 aa, Mycobacterium
GADASAYRA

SEQ ID NO: 1203314 - protein, 15 aa, Mycobacterium
GADDDDAGFAPQEPT

SEQ ID NO: 1203315 - protein, 14 aa, Mycobacterium
GADDEGDDAGADGI

SEQ ID NO: 1203316 - protein, 9 aa, Mycobacterium
GADDESPAE

SEQ ID NO: 1203317 - protein, 10 aa, Mycobacterium
GADDRSPAQI

SEQ ID NO: 1203318 - protein, 5 aa, Mycobacterium
GADDV

SEQ ID NO: 1203319 - protein, 10 aa, Mycobacterium
GADEAEVSSA

SEQ ID NO: 1203320 - protein, 7 aa, Mycobacterium
GADEDIA

SEQ ID NO: 1203321 - protein, 13 aa, Mycobacterium
GADEKKLNPNGGA

SEQ ID NO: 1203322 - protein, 14 aa, Mycobacterium
GADEPVAEEPDAAE

SEQ ID NO: 1203323 - protein, 9 aa, Mycobacterium
GADESGEAA

SEQ ID NO: 1203324 - protein, 8 aa, Mycobacterium
GADGAPEI

SEQ ID NO: 1203325 - protein, 13 aa, Mycobacterium
GADGAPGQNGGRG

SEQ ID NO: 1203326 - protein, 11 aa, Mycobacterium
GADGGLRTVSP

SEQ ID NO: 1203327 - protein, 11 aa, Mycobacterium
GADGGPRGGVA

SEQ ID NO: 1203328 - protein, 7 aa, Mycobacterium
GADGIGE

SEQ ID NO: 1203329 - protein, 7 aa, Mycobacterium
GADGPGY

SEQ ID NO: 1203330 - protein, 10 aa, Mycobacterium
GADGQRQESG

SEQ ID NO: 1203331 - protein, 7 aa, Mycobacterium
GADGRNC

SEQ ID NO: 1203332 - protein, 7 aa, Mycobacterium
GADGRPD

SEQ ID NO: 1203333 - protein, 12 aa, Mycobacterium
GADGSDTRDDLN

SEQ ID NO: 1203334 - protein, 13 aa, Mycobacterium
GADGSGADAGDSA

SEQ ID NO: 1203335 - protein, 9 aa, Mycobacterium
GADGSVTGK

SEQ ID NO: 1203336 - protein, 5 aa, Mycobacterium
GADGT

SEQ ID NO: 1203337 - protein, 6 aa, Mycobacterium
GADGTD

SEQ ID NO: 1203338 - protein, 7 aa, Mycobacterium
GADHESV

SEQ ID NO: 1203339 - protein, 6 aa, Mycobacterium
GADIDA

SEQ ID NO: 1203340 - protein, 8 aa, Mycobacterium
GADIDEPT

SEQ ID NO: 1203341 - protein, 4 aa, Mycobacterium
GADL

SEQ ID NO: 1203342 - protein, 8 aa, Mycobacterium
GADLDKAR

SEQ ID NO: 1203343 - protein, 7 aa, Mycobacterium
GADLGRA

SEQ ID NO: 1203344 - protein, 13 aa, Mycobacterium
GADLGRTVTAADT

SEQ ID NO: 1203345 - protein, 10 aa, Mycobacterium
GADLPDQNDM

SEQ ID NO: 1203346 - protein, 8 aa, Mycobacterium
GADLPTSV

SEQ ID NO: 1203347 - protein, 19 aa, Mycobacterium
GADLSGGQGVADELPDKAR

SEQ ID NO: 1203348 - protein, 15 aa, Mycobacterium
GADPAVGAALTTSPD

SEQ ID NO: 1203349 - protein, 5 aa, Mycobacterium
GADPE

SEQ ID NO: 1203350 - protein, 7 aa, Mycobacterium
GADPERF

SEQ ID NO: 1203351 - protein, 34 aa, Mycobacterium
GADPERVRPVGSDRVPRPAPRPAYSALSGAGSAA

SEQ ID NO: 1203352 - protein, 14 aa, Mycobacterium
GADPGAWPLPPATE

SEQ ID NO: 1203353 - protein, 6 aa, Mycobacterium
GADPGR

SEQ ID NO: 1203354 - protein, 10 aa, Mycobacterium
GADPKVNGGT

SEQ ID NO: 1203355 - protein, 6 aa, Mycobacterium
GADPRE

SEQ ID NO: 1203356 - protein, 8 aa, Mycobacterium
GADPRTRI

SEQ ID NO: 1203357 - protein, 8 aa, Mycobacterium
GADPRYPN

SEQ ID NO: 1203358 - protein, 12 aa, Mycobacterium
GADPSAPGAEVS

SEQ ID NO: 1203359 - protein, 26 aa, Mycobacterium
GADPSRVRPVGSDRHPRPAPRPAYSA

SEQ ID NO: 1203360 - protein, 7 aa, Mycobacterium
GADPTLA

SEQ ID NO: 1203361 - protein, 8 aa, Mycobacterium
GADQPEGL

SEQ ID NO: 1203362 - protein, 11 aa, Mycobacterium
GADRAADGPHR

SEQ ID NO: 1203363 - protein, 11 aa, Mycobacterium
GADRADSQYPI

SEQ ID NO: 1203364 - protein, 5 aa, Mycobacterium
GADRD

SEQ ID NO: 1203365 - protein, 6 aa, Mycobacterium
GADRGA

SEQ ID NO: 1203366 - protein, 10 aa, Mycobacterium
GADRPEAGGI

SEQ ID NO: 1203367 - protein, 6 aa, Mycobacterium
GADRPH

SEQ ID NO: 1203368 - protein, 7 aa, Mycobacterium
GADRSRG

SEQ ID NO: 1203369 - protein, 25 aa, Mycobacterium
GADRTGHAVAERDERGRVTVTVTLD

SEQ ID NO: 1203370 - protein, 19 aa, Mycobacterium
GADSGAAPTDIGNDQSRIS

SEQ ID NO: 1203371 - protein, 13 aa, Mycobacterium
GADSGGSSGRLEN

SEQ ID NO: 1203372 - protein, 8 aa, Mycobacterium
GADSPVSV

SEQ ID NO: 1203373 - protein, 8 aa, Mycobacterium
GADTARRD

SEQ ID NO: 1203374 - protein, 13 aa, Mycobacterium
GADTERARALLSA

SEQ ID NO: 1203375 - protein, 5 aa, Mycobacterium
GADVA

SEQ ID NO: 1203376 - protein, 9 aa, Mycobacterium
GADVDDPRG

SEQ ID NO: 1203377 - protein, 6 aa, Mycobacterium
GADVRQ

SEQ ID NO: 1203378 - protein, 5 aa, Mycobacterium
GAEAA

SEQ ID NO: 1203379 - protein, 12 aa, Mycobacterium
GAEAGGHGQPRV

SEQ ID NO: 1203380 - protein, 8 aa, Mycobacterium
GAEAGRRL

SEQ ID NO: 1203381 - protein, 14 aa, Mycobacterium
GAEALRSATETRPD

SEQ ID NO: 1203382 - protein, 28 aa, Mycobacterium
GAEANASQKVADDPDAKITEKPEITDEH

SEQ ID NO: 1203383 - protein, 8 aa, Mycobacterium
GAEAPEVV

SEQ ID NO: 1203384 - protein, 6 aa, Mycobacterium
GAEAPN

SEQ ID NO: 1203385 - protein, 4 aa, Mycobacterium
GAED

SEQ ID NO: 1203386 - protein, 6 aa, Mycobacterium
GAEDDH

SEQ ID NO: 1203387 - protein, 7 aa, Mycobacterium
GAEDGDV

SEQ ID NO: 1203388 - protein, 7 aa, Mycobacterium
GAEDPAI

SEQ ID NO: 1203389 - protein, 21 aa, Mycobacterium
GAEDRQRRVPGRQHRGGGGER

SEQ ID NO: 1203390 - protein, 8 aa, Mycobacterium
GAEDVNDL

SEQ ID NO: 1203391 - protein, 8 aa, Mycobacterium
GAEDYAQR

SEQ ID NO: 1203392 - protein, 7 aa, Mycobacterium
GAEEGTQ

SEQ ID NO: 1203393 - protein, 12 aa, Mycobacterium
GAEESGGSGAGW

SEQ ID NO: 1203394 - protein, 5 aa, Mycobacterium
GAEGA

SEQ ID NO: 1203395 - protein, 12 aa, Mycobacterium
GAEGGGHGEPRV

SEQ ID NO: 1203396 - protein, 7 aa, Mycobacterium
GAEHPVG

SEQ ID NO: 1203397 - protein, 9 aa, Mycobacterium
GAEKRYQTG

SEQ ID NO: 1203398 - protein, 4 aa, Mycobacterium
GAEM

SEQ ID NO: 1203399 - protein, 8 aa, Mycobacterium
GAEMSTTG

SEQ ID NO: 1203400 - protein, 13 aa, Mycobacterium
GAEMTGEDWGSGF

SEQ ID NO: 1203401 - protein, 4 aa, Mycobacterium
GAEN

SEQ ID NO: 1203402 - protein, 12 aa, Mycobacterium
GAENAATPGPSA

SEQ ID NO: 1203403 - protein, 8 aa, Mycobacterium
GAEPDDTY

SEQ ID NO: 1203404 - protein, 11 aa, Mycobacterium
GAEPDENALTS

SEQ ID NO: 1203405 - protein, 7 aa, Mycobacterium
GAEPGDT

SEQ ID NO: 1203406 - protein, 8 aa, Mycobacterium
GAEPQWGN

SEQ ID NO: 1203407 - protein, 12 aa, Mycobacterium
GAEPRRGNGSSV

SEQ ID NO: 1203408 - protein, 18 aa, Mycobacterium
GAERADAEEIERNPRSAS

SEQ ID NO: 1203409 - protein, 7 aa, Mycobacterium
GAESEHL

SEQ ID NO: 1203410 - protein, 8 aa, Mycobacterium
GAESNEAA

SEQ ID NO: 1203411 - protein, 10 aa, Mycobacterium
GAESPDDSAV

SEQ ID NO: 1203412 - protein, 15 aa, Mycobacterium
GAESPDDSAVRQAGA

SEQ ID NO: 1203413 - protein, 15 aa, Mycobacterium
GAESSATSASSELEG

SEQ ID NO: 1203414 - protein, 9 aa, Mycobacterium
GAETTRNAI

SEQ ID NO: 1203415 - protein, 7 aa, Mycobacterium
GAETVQQ

SEQ ID NO: 1203416 - protein, 7 aa, Mycobacterium
GAEVSDT

SEQ ID NO: 1203417 - protein, 4 aa, Mycobacterium
GAEY

SEQ ID NO: 1203418 - protein, 6 aa, Mycobacterium
GAEYPD

SEQ ID NO: 1203419 - protein, 27 aa, Mycobacterium
GAEYTDLEQAEESTSEYRSARNGPAPE

SEQ ID NO: 1203420 - protein, 6 aa, Mycobacterium
GAFDEG

SEQ ID NO: 1203421 - protein, 5 aa, Mycobacterium
GAFDR

SEQ ID NO: 1203422 - protein, 6 aa, Mycobacterium
GAFPED

SEQ ID NO: 1203423 - protein, 5 aa, Mycobacterium
GAGAD

SEQ ID NO: 1203424 - protein, 27 aa, Mycobacterium
GAGAGAGAGAGLAPVGAGSGMGGGGPM

SEQ ID NO: 1203425 - protein, 9 aa, Mycobacterium
GAGALTEGD

SEQ ID NO: 1203426 - protein, 8 aa, Mycobacterium
GAGAPTET

SEQ ID NO: 1203427 - protein, 7 aa, Mycobacterium
GAGAREV

SEQ ID NO: 1203428 - protein, 6 aa, Mycobacterium
GAGARW

SEQ ID NO: 1203429 - protein, 7 aa, Mycobacterium
GAGASTH

SEQ ID NO: 1203430 - protein, 7 aa, Mycobacterium
GAGDAFG

SEQ ID NO: 1203431 - protein, 6 aa, Mycobacterium
GAGDDA

SEQ ID NO: 1203432 - protein, 9 aa, Mycobacterium
GAGDDNTVT

SEQ ID NO: 1203433 - protein, 14 aa, Mycobacterium
GAGDEHTQRANRTA

SEQ ID NO: 1203434 - protein, 5 aa, Mycobacterium
GAGDF

SEQ ID NO: 1203435 - protein, 7 aa, Mycobacterium
GAGDRGL

SEQ ID NO: 1203436 - protein, 9 aa, Mycobacterium
GAGDVATGA

SEQ ID NO: 1203437 - protein, 13 aa, Mycobacterium
GAGDVKKSLDPAV

SEQ ID NO: 1203438 - protein, 18 aa, Mycobacterium
GAGEKLKDAFRSRRRPRG

SEQ ID NO: 1203439 - protein, 13 aa, Mycobacterium
GAGERAIRGGDGP

SEQ ID NO: 1203440 - protein, 7 aa, Mycobacterium
GAGETVD

SEQ ID NO: 1203441 - protein, 9 aa, Mycobacterium
GAGEVSAAE

SEQ ID NO: 1203442 - protein, 71 aa, Mycobacterium
GAGGAGGDHMTSTGGVAAVGGAGGAGGDGGAVFGDGGSGGRGGIANQIGTDPNRFDPAKGGAGGKGGSAGL

SEQ ID NO: 1203443 - protein, 14 aa, Mycobacterium
GAGGAGNPDAAKER

SEQ ID NO: 1203444 - protein, 8 aa, Mycobacterium
GAGGAVAQ

SEQ ID NO: 1203445 - protein, 14 aa, Mycobacterium
GAGGGAAGDPGPQE

SEQ ID NO: 1203446 - protein, 6 aa, Mycobacterium
GAGGGP

SEQ ID NO: 1203447 - protein, 9 aa, Mycobacterium
GAGGGSIAS

SEQ ID NO: 1203448 - protein, 10 aa, Mycobacterium
GAGGGYGDPL

SEQ ID NO: 1203449 - protein, 8 aa, Mycobacterium
GAGGLGEA

SEQ ID NO: 1203450 - protein, 8 aa, Mycobacterium
GAGGPVPL

SEQ ID NO: 1203451 - protein, 10 aa, Mycobacterium
GAGGQRQVPD

SEQ ID NO: 1203452 - protein, 8 aa, Mycobacterium
GAGGQTGW

SEQ ID NO: 1203453 - protein, 6 aa, Mycobacterium
GAGGRD

SEQ ID NO: 1203454 - protein, 10 aa, Mycobacterium
GAGGVGKTRL

SEQ ID NO: 1203455 - protein, 7 aa, Mycobacterium
GAGHDDT

SEQ ID NO: 1203456 - protein, 13 aa, Mycobacterium
GAGHPRGSGEELA

SEQ ID NO: 1203457 - protein, 23 aa, Mycobacterium
GAGHTAAGDDNDAFSEVVAQFVL

SEQ ID NO: 1203458 - protein, 4 aa, Mycobacterium
GAGI

SEQ ID NO: 1203459 - protein, 5 aa, Mycobacterium
GAGIN

SEQ ID NO: 1203460 - protein, 8 aa, Mycobacterium
GAGIQADS

SEQ ID NO: 1203461 - protein, 7 aa, Mycobacterium
GAGKGAR

SEQ ID NO: 1203462 - protein, 6 aa, Mycobacterium
GAGKTS

SEQ ID NO: 1203463 - protein, 4 aa, Mycobacterium
GAGL

SEQ ID NO: 1203464 - protein, 6 aa, Mycobacterium
GAGLPK

SEQ ID NO: 1203465 - protein, 5 aa, Mycobacterium
GAGNF

SEQ ID NO: 1203466 - protein, 6 aa, Mycobacterium
GAGNGA

SEQ ID NO: 1203467 - protein, 8 aa, Mycobacterium
GAGNGIGA

SEQ ID NO: 1203468 - protein, 6 aa, Mycobacterium
GAGNGL

SEQ ID NO: 1203469 - protein, 5 aa, Mycobacterium
GAGNV

SEQ ID NO: 1203470 - protein, 14 aa, Mycobacterium
GAGPAPDDRTAADV

SEQ ID NO: 1203471 - protein, 11 aa, Mycobacterium
GAGPDGPGSAI

SEQ ID NO: 1203472 - protein, 7 aa, Mycobacterium
GAGPEYS

SEQ ID NO: 1203473 - protein, 24 aa, Mycobacterium
GAGPQSWRGRAGGPAGKRAYGGQL

SEQ ID NO: 1203474 - protein, 6 aa, Mycobacterium
GAGPQV

SEQ ID NO: 1203475 - protein, 7 aa, Mycobacterium
GAGPSCD

SEQ ID NO: 1203476 - protein, 7 aa, Mycobacterium
GAGPSSM

SEQ ID NO: 1203477 - protein, 7 aa, Mycobacterium
GAGPTVG

SEQ ID NO: 1203478 - protein, 6 aa, Mycobacterium
GAGQAT

SEQ ID NO: 1203479 - protein, 9 aa, Mycobacterium
GAGQIPARQ

SEQ ID NO: 1203480 - protein, 8 aa, Mycobacterium
GAGQLGDY

SEQ ID NO: 1203481 - protein, 4 aa, Mycobacterium
GAGR

SEQ ID NO: 1203482 - protein, 9 aa, Mycobacterium
GAGRDPDRP

SEQ ID NO: 1203483 - protein, 9 aa, Mycobacterium
GAGRGGRDS

SEQ ID NO: 1203484 - protein, 5 aa, Mycobacterium
GAGRP

SEQ ID NO: 1203485 - protein, 16 aa, Mycobacterium
GAGRQYAETYGTQPET

SEQ ID NO: 1203486 - protein, 8 aa, Mycobacterium
GAGRRDTF

SEQ ID NO: 1203487 - protein, 6 aa, Mycobacterium
GAGRTG

SEQ ID NO: 1203488 - protein, 7 aa, Mycobacterium
GAGSDAS

SEQ ID NO: 1203489 - protein, 9 aa, Mycobacterium
GAGSGKSTV

SEQ ID NO: 1203490 - protein, 8 aa, Mycobacterium
GAGSNVLR

SEQ ID NO: 1203491 - protein, 8 aa, Mycobacterium
GAGSPTEI

SEQ ID NO: 1203492 - protein, 7 aa, Mycobacterium
GAGSRKH

SEQ ID NO: 1203493 - protein, 13 aa, Mycobacterium
GAGSSGAPRPGCG

SEQ ID NO: 1203494 - protein, 8 aa, Mycobacterium
GAGSSRGG

SEQ ID NO: 1203495 - protein, 5 aa, Mycobacterium
GAGSV

SEQ ID NO: 1203496 - protein, 6 aa, Mycobacterium
GAGTDR

SEQ ID NO: 1203497 - protein, 8 aa, Mycobacterium
GAGTESDV

SEQ ID NO: 1203498 - protein, 5 aa, Mycobacterium
GAGTG

SEQ ID NO: 1203499 - protein, 6 aa, Mycobacterium
GAGTGD

SEQ ID NO: 1203500 - protein, 8 aa, Mycobacterium
GAGTGKLT

SEQ ID NO: 1203501 - protein, 7 aa, Mycobacterium
GAGTGRN

SEQ ID NO: 1203502 - protein, 10 aa, Mycobacterium
GAGTGRSHAG

SEQ ID NO: 1203503 - protein, 5 aa, Mycobacterium
GAGTP

SEQ ID NO: 1203504 - protein, 8 aa, Mycobacterium
GAGTPVDP

SEQ ID NO: 1203505 - protein, 12 aa, Mycobacterium
GAGTSHDTRRVP

SEQ ID NO: 1203506 - protein, 8 aa, Mycobacterium
GAGTSNTI

SEQ ID NO: 1203507 - protein, 5 aa, Mycobacterium
GAGWT

SEQ ID NO: 1203508 - protein, 4 aa, Mycobacterium
GAGY

SEQ ID NO: 1203509 - protein, 14 aa, Mycobacterium
GAHAGGPAGTGACG

SEQ ID NO: 1203510 - protein, 7 aa, Mycobacterium
GAHENSR

SEQ ID NO: 1203511 - protein, 7 aa, Mycobacterium
GAHEVPE

SEQ ID NO: 1203512 - protein, 8 aa, Mycobacterium
GAHGGTTI

SEQ ID NO: 1203513 - protein, 5 aa, Mycobacterium
GAHGI

SEQ ID NO: 1203514 - protein, 4 aa, Mycobacterium
GAHP

SEQ ID NO: 1203515 - protein, 8 aa, Mycobacterium
GAHPDSSV

SEQ ID NO: 1203516 - protein, 4 aa, Mycobacterium
GAHR

SEQ ID NO: 1203517 - protein, 5 aa, Mycobacterium
GAHRL

SEQ ID NO: 1203518 - protein, 5 aa, Mycobacterium
GAHRP

SEQ ID NO: 1203519 - protein, 16 aa, Mycobacterium
GAHSDTPAAPGNGSPL

SEQ ID NO: 1203520 - protein, 7 aa, Mycobacterium
GAHSNDG

SEQ ID NO: 1203521 - protein, 6 aa, Mycobacterium
GAHYPG

SEQ ID NO: 1203522 - protein, 10 aa, Mycobacterium
GAIADGPFGT

SEQ ID NO: 1203523 - protein, 11 aa, Mycobacterium
GAIASTSDSGV

SEQ ID NO: 1203524 - protein, 6 aa, Mycobacterium
GAIEPG

SEQ ID NO: 1203525 - protein, 22 aa, Mycobacterium
GAIGTMTAKGPAAGGTRYEAER

SEQ ID NO: 1203526 - protein, 14 aa, Mycobacterium
GAIQPERTRGAIQP

SEQ ID NO: 1203527 - protein, 11 aa, Mycobacterium
GAIRTERPRRA

SEQ ID NO: 1203528 - protein, 19 aa, Mycobacterium
GAKADATVAGGERAGDSRA

SEQ ID NO: 1203529 - protein, 6 aa, Mycobacterium
GAKAEL

SEQ ID NO: 1203530 - protein, 5 aa, Mycobacterium
GAKAL

SEQ ID NO: 1203531 - protein, 14 aa, Mycobacterium
GAKARQAKSKARLQ

SEQ ID NO: 1203532 - protein, 13 aa, Mycobacterium
GAKDTLKVGDNSY

SEQ ID NO: 1203533 - protein, 7 aa, Mycobacterium
GAKGMTG

SEQ ID NO: 1203534 - protein, 16 aa, Mycobacterium
GAKIGSKGRPLPGGGE

SEQ ID NO: 1203535 - protein, 13 aa, Mycobacterium
GAKPACGAGNTSR

SEQ ID NO: 1203536 - protein, 9 aa, Mycobacterium
GAKPAEGSM

SEQ ID NO: 1203537 - protein, 8 aa, Mycobacterium
GAKPGGGG

SEQ ID NO: 1203538 - protein, 10 aa, Mycobacterium
GAKPTADHRT

SEQ ID NO: 1203539 - protein, 10 aa, Mycobacterium
GAKPVGKDTG

SEQ ID NO: 1203540 - protein, 6 aa, Mycobacterium
GAKPVT

SEQ ID NO: 1203541 - protein, 4 aa, Mycobacterium
GAKQ

SEQ ID NO: 1203542 - protein, 11 aa, Mycobacterium
GAKQKPGQSRL

SEQ ID NO: 1203543 - protein, 7 aa, Mycobacterium
GAKSAAA

SEQ ID NO: 1203544 - protein, 18 aa, Mycobacterium
GAKSTRASSPSGLDGPGW

SEQ ID NO: 1203545 - protein, 11 aa, Mycobacterium
GAKSVAQEIGG

SEQ ID NO: 1203546 - protein, 11 aa, Mycobacterium
GAKSVDTDSRT

SEQ ID NO: 1203547 - protein, 10 aa, Mycobacterium
GAKSVPAQKH

SEQ ID NO: 1203548 - protein, 27 aa, Mycobacterium
GAKTDRQPSGRIRPPYTPPGGDAPTIY

SEQ ID NO: 1203549 - protein, 5 aa, Mycobacterium
GAKTL

SEQ ID NO: 1203550 - protein, 9 aa, Mycobacterium
GAKTLRGGK

SEQ ID NO: 1203551 - protein, 10 aa, Mycobacterium
GALAPDTQPL

SEQ ID NO: 1203552 - protein, 25 aa, Mycobacterium
GALEDDPNVTDKRLPGNPTRSFRTR

SEQ ID NO: 1203553 - protein, 20 aa, Mycobacterium
GALEGSRDDRAAQANGASKT

SEQ ID NO: 1203554 - protein, 14 aa, Mycobacterium
GALKSAGDQLNSAV

SEQ ID NO: 1203555 - protein, 12 aa, Mycobacterium
GALNGQTAAMTG

SEQ ID NO: 1203556 - protein, 9 aa, Mycobacterium
GALNSEQSC

SEQ ID NO: 1203557 - protein, 6 aa, Mycobacterium
GALPDN

SEQ ID NO: 1203558 - protein, 7 aa, Mycobacterium
GALPDRY

SEQ ID NO: 1203559 - protein, 6 aa, Mycobacterium
GALPEA

SEQ ID NO: 1203560 - protein, 14 aa, Mycobacterium
GALPGVSGSSGTEL

SEQ ID NO: 1203561 - protein, 5 aa, Mycobacterium
GALPP

SEQ ID NO: 1203562 - protein, 4 aa, Mycobacterium
GALQ

SEQ ID NO: 1203563 - protein, 4 aa, Mycobacterium
GALR

SEQ ID NO: 1203564 - protein, 5 aa, Mycobacterium
GALRG

SEQ ID NO: 1203565 - protein, 8 aa, Mycobacterium
GALRGGRE

SEQ ID NO: 1203566 - protein, 11 aa, Mycobacterium
GALTTTYTSSQ

SEQ ID NO: 1203567 - protein, 9 aa, Mycobacterium
GANAGPDRS

SEQ ID NO: 1203568 - protein, 5 aa, Mycobacterium
GANFG

SEQ ID NO: 1203569 - protein, 9 aa, Mycobacterium
GANGAGKST

SEQ ID NO: 1203570 - protein, 5 aa, Mycobacterium
GANGH

SEQ ID NO: 1203571 - protein, 9 aa, Mycobacterium
GANGKSAIT

SEQ ID NO: 1203572 - protein, 9 aa, Mycobacterium
GANGLTDKQ

SEQ ID NO: 1203573 - protein, 9 aa, Mycobacterium
GANGSGKST

SEQ ID NO: 1203574 - protein, 10 aa, Mycobacterium
GANGTGKSSL

SEQ ID NO: 1203575 - protein, 8 aa, Mycobacterium
GANPENMR

SEQ ID NO: 1203576 - protein, 5 aa, Mycobacterium
GANPT

SEQ ID NO: 1203577 - protein, 7 aa, Mycobacterium
GANPTAY

SEQ ID NO: 1203578 - protein, 12 aa, Mycobacterium
GANSAIPHHRPT

SEQ ID NO: 1203579 - protein, 8 aa, Mycobacterium
GANSGIGY

SEQ ID NO: 1203580 - protein, 4 aa, Mycobacterium
GANT

SEQ ID NO: 1203581 - protein, 8 aa, Mycobacterium
GANTGLGF

SEQ ID NO: 1203582 - protein, 9 aa, Mycobacterium
GAPAADVEP

SEQ ID NO: 1203583 - protein, 7 aa, Mycobacterium
GAPAALA

SEQ ID NO: 1203584 - protein, 10 aa, Mycobacterium
GAPAAPGQAN

SEQ ID NO: 1203585 - protein, 7 aa, Mycobacterium
GAPAARP

SEQ ID NO: 1203586 - protein, 6 aa, Mycobacterium
GAPADD

SEQ ID NO: 1203587 - protein, 8 aa, Mycobacterium
GAPAKGNT

SEQ ID NO: 1203588 - protein, 5 aa, Mycobacterium
GAPAM

SEQ ID NO: 1203589 - protein, 10 aa, Mycobacterium
GAPAPGPAPA

SEQ ID NO: 1203590 - protein, 7 aa, Mycobacterium
GAPAPRE

SEQ ID NO: 1203591 - protein, 7 aa, Mycobacterium
GAPAPTV

SEQ ID NO: 1203592 - protein, 8 aa, Mycobacterium
GAPAPTVA

SEQ ID NO: 1203593 - protein, 9 aa, Mycobacterium
GAPARPWPT

SEQ ID NO: 1203594 - protein, 12 aa, Mycobacterium
GAPARTSKPKFR

SEQ ID NO: 1203595 - protein, 6 aa, Mycobacterium
GAPATS

SEQ ID NO: 1203596 - protein, 8 aa, Mycobacterium
GAPDADLG

SEQ ID NO: 1203597 - protein, 9 aa, Mycobacterium
GAPDAKNRG

SEQ ID NO: 1203598 - protein, 6 aa, Mycobacterium
GAPDAV

SEQ ID NO: 1203599 - protein, 7 aa, Mycobacterium
GAPDDRR

SEQ ID NO: 1203600 - protein, 14 aa, Mycobacterium
GAPDDVQAGKPAQL

SEQ ID NO: 1203601 - protein, 7 aa, Mycobacterium
GAPDEFA

SEQ ID NO: 1203602 - protein, 5 aa, Mycobacterium
GAPDM

SEQ ID NO: 1203603 - protein, 6 aa, Mycobacterium
GAPDMQ

SEQ ID NO: 1203604 - protein, 7 aa, Mycobacterium
GAPDPGM

SEQ ID NO: 1203605 - protein, 13 aa, Mycobacterium
GAPDPLPATTGCA

SEQ ID NO: 1203606 - protein, 5 aa, Mycobacterium
GAPDR

SEQ ID NO: 1203607 - protein, 14 aa, Mycobacterium
GAPEGPDEAVRTEE

SEQ ID NO: 1203608 - protein, 6 aa, Mycobacterium
GAPEGV

SEQ ID NO: 1203609 - protein, 7 aa, Mycobacterium
GAPEQRE

SEQ ID NO: 1203610 - protein, 6 aa, Mycobacterium
GAPEVE

SEQ ID NO: 1203611 - protein, 6 aa, Mycobacterium
GAPFDG

SEQ ID NO: 1203612 - protein, 5 aa, Mycobacterium
GAPFG

SEQ ID NO: 1203613 - protein, 6 aa, Mycobacterium
GAPGAT

SEQ ID NO: 1203614 - protein, 8 aa, Mycobacterium
GAPGDAAG

SEQ ID NO: 1203615 - protein, 6 aa, Mycobacterium
GAPGDR

SEQ ID NO: 1203616 - protein, 8 aa, Mycobacterium
GAPGEPEF

SEQ ID NO: 1203617 - protein, 6 aa, Mycobacterium
GAPGER

SEQ ID NO: 1203618 - protein, 9 aa, Mycobacterium
GAPGNTINH

SEQ ID NO: 1203619 - protein, 10 aa, Mycobacterium
GAPGPRDARG

SEQ ID NO: 1203620 - protein, 14 aa, Mycobacterium
GAPGSGGSGAGWAE

SEQ ID NO: 1203621 - protein, 12 aa, Mycobacterium
GAPGTAAVAILS

SEQ ID NO: 1203622 - protein, 12 aa, Mycobacterium
GAPGTAGATILT

SEQ ID NO: 1203623 - protein, 22 aa, Mycobacterium
GAPIASRNVEPAAGSDVGASAS

SEQ ID NO: 1203624 - protein, 8 aa, Mycobacterium
GAPITPDE

SEQ ID NO: 1203625 - protein, 24 aa, Mycobacterium
GAPKPAGLRNYGPTPTAADVEPGR

SEQ ID NO: 1203626 - protein, 7 aa, Mycobacterium
GAPLHQT

SEQ ID NO: 1203627 - protein, 17 aa, Mycobacterium
GAPLPKKMEPAVPELSN

SEQ ID NO: 1203628 - protein, 7 aa, Mycobacterium
GAPLRPR

SEQ ID NO: 1203629 - protein, 6 aa, Mycobacterium
GAPLRS

SEQ ID NO: 1203630 - protein, 5 aa, Mycobacterium
GAPMP

SEQ ID NO: 1203631 - protein, 6 aa, Mycobacterium
GAPMPT

SEQ ID NO: 1203632 - protein, 7 aa, Mycobacterium
GAPNDRR

SEQ ID NO: 1203633 - protein, 6 aa, Mycobacterium
GAPNRS

SEQ ID NO: 1203634 - protein, 10 aa, Mycobacterium
GAPNTETGLA

SEQ ID NO: 1203635 - protein, 17 aa, Mycobacterium
GAPPACGGPLTRRVDGY

SEQ ID NO: 1203636 - protein, 11 aa, Mycobacterium
GAPPAGGSDWP

SEQ ID NO: 1203637 - protein, 6 aa, Mycobacterium
GAPPDA

SEQ ID NO: 1203638 - protein, 7 aa, Mycobacterium
GAPPDRQ

SEQ ID NO: 1203639 - protein, 8 aa, Mycobacterium
GAPPKGLT

SEQ ID NO: 1203640 - protein, 5 aa, Mycobacterium
GAPPS

SEQ ID NO: 1203641 - protein, 10 aa, Mycobacterium
GAPPSHPATI

SEQ ID NO: 1203642 - protein, 7 aa, Mycobacterium
GAPPTEL

SEQ ID NO: 1203643 - protein, 5 aa, Mycobacterium
GAPPV

SEQ ID NO: 1203644 - protein, 8 aa, Mycobacterium
GAPPVDLP

SEQ ID NO: 1203645 - protein, 6 aa, Mycobacterium
GAPQEC

SEQ ID NO: 1203646 - protein, 7 aa, Mycobacterium
GAPQGED

SEQ ID NO: 1203647 - protein, 4 aa, Mycobacterium
GAPR

SEQ ID NO: 1203648 - protein, 5 aa, Mycobacterium
GAPRA

SEQ ID NO: 1203649 - protein, 9 aa, Mycobacterium
GAPRALADA

SEQ ID NO: 1203650 - protein, 12 aa, Mycobacterium
GAPRAVTYGPQL

SEQ ID NO: 1203651 - protein, 5 aa, Mycobacterium
GAPRF

SEQ ID NO: 1203652 - protein, 7 aa, Mycobacterium
GAPRNRG

SEQ ID NO: 1203653 - protein, 6 aa, Mycobacterium
GAPRPD

SEQ ID NO: 1203654 - protein, 12 aa, Mycobacterium
GAPRQSDVTEDQ

SEQ ID NO: 1203655 - protein, 11 aa, Mycobacterium
GAPRSGKSTAL

SEQ ID NO: 1203656 - protein, 5 aa, Mycobacterium
GAPSA

SEQ ID NO: 1203657 - protein, 15 aa, Mycobacterium
GAPSAADVDATAVIS

SEQ ID NO: 1203658 - protein, 5 aa, Mycobacterium
GAPSL

SEQ ID NO: 1203659 - protein, 9 aa, Mycobacterium
GAPSNPVAT

SEQ ID NO: 1203660 - protein, 9 aa, Mycobacterium
GAPSPAGTI

SEQ ID NO: 1203661 - protein, 8 aa, Mycobacterium
GAPSPRTE

SEQ ID NO: 1203662 - protein, 15 aa, Mycobacterium
GAPSQRREGYVPDPD

SEQ ID NO: 1203663 - protein, 14 aa, Mycobacterium
GAPSTGKPGPSTAD

SEQ ID NO: 1203664 - protein, 4 aa, Mycobacterium
GAPT

SEQ ID NO: 1203665 - protein, 18 aa, Mycobacterium
GAPTAVEQARRNAEAQGV

SEQ ID NO: 1203666 - protein, 20 aa, Mycobacterium
GAPTGGRGQTQRIDSGAVTE

SEQ ID NO: 1203667 - protein, 8 aa, Mycobacterium
GAPTHGTT

SEQ ID NO: 1203668 - protein, 10 aa, Mycobacterium
GAPTPGGLTR

SEQ ID NO: 1203669 - protein, 6 aa, Mycobacterium
GAPTQL

SEQ ID NO: 1203670 - protein, 8 aa, Mycobacterium
GAPTTDLT

SEQ ID NO: 1203671 - protein, 8 aa, Mycobacterium
GAPTTPRI

SEQ ID NO: 1203672 - protein, 10 aa, Mycobacterium
GAPVARPSWQ

SEQ ID NO: 1203673 - protein, 7 aa, Mycobacterium
GAPVGGV

SEQ ID NO: 1203674 - protein, 7 aa, Mycobacterium
GAPVGST

SEQ ID NO: 1203675 - protein, 9 aa, Mycobacterium
GAPVSTGTG

SEQ ID NO: 1203676 - protein, 8 aa, Mycobacterium
GAPVTGPV

SEQ ID NO: 1203677 - protein, 6 aa, Mycobacterium
GAPYNP

SEQ ID NO: 1203678 - protein, 14 aa, Mycobacterium
GAPYYDTYETADGK

SEQ ID NO: 1203679 - protein, 14 aa, Mycobacterium
GAQAEQRARQDAAE

SEQ ID NO: 1203680 - protein, 5 aa, Mycobacterium
GAQAT

SEQ ID NO: 1203681 - protein, 4 aa, Mycobacterium
GAQE

SEQ ID NO: 1203682 - protein, 13 aa, Mycobacterium
GAQEDPFASTTAA

SEQ ID NO: 1203683 - protein, 6 aa, Mycobacterium
GAQEGD

SEQ ID NO: 1203684 - protein, 7 aa, Mycobacterium
GAQEGEL

SEQ ID NO: 1203685 - protein, 10 aa, Mycobacterium
GAQGGRPEAL

SEQ ID NO: 1203686 - protein, 9 aa, Mycobacterium
GAQGRPEVT

SEQ ID NO: 1203687 - protein, 5 aa, Mycobacterium
GAQLT

SEQ ID NO: 1203688 - protein, 6 aa, Mycobacterium
GAQNPR

SEQ ID NO: 1203689 - protein, 8 aa, Mycobacterium
GAQPGDRI

SEQ ID NO: 1203690 - protein, 6 aa, Mycobacterium
GAQPIG

SEQ ID NO: 1203691 - protein, 8 aa, Mycobacterium
GAQPTSDS

SEQ ID NO: 1203692 - protein, 7 aa, Mycobacterium
GAQQPDI

SEQ ID NO: 1203693 - protein, 20 aa, Mycobacterium
GAQQPRPSRPRRGNDLETET

SEQ ID NO: 1203694 - protein, 4 aa, Mycobacterium
GAQR

SEQ ID NO: 1203695 - protein, 9 aa, Mycobacterium
GAQRAREVS

SEQ ID NO: 1203696 - protein, 7 aa, Mycobacterium
GAQRGGV

SEQ ID NO: 1203697 - protein, 15 aa, Mycobacterium
GAQSAESRPLTYGQS

SEQ ID NO: 1203698 - protein, 11 aa, Mycobacterium
GAQSNLAATGI

SEQ ID NO: 1203699 - protein, 8 aa, Mycobacterium
GAQSPKET

SEQ ID NO: 1203700 - protein, 5 aa, Mycobacterium
GAQSV

SEQ ID NO: 1203701 - protein, 11 aa, Mycobacterium
GAQVDGIPAPC

SEQ ID NO: 1203702 - protein, 5 aa, Mycobacterium
GAQVR

SEQ ID NO: 1203703 - protein, 5 aa, Mycobacterium
GAQWA

SEQ ID NO: 1203704 - protein, 5 aa, Mycobacterium
GARAD

SEQ ID NO: 1203705 - protein, 13 aa, Mycobacterium
GARASGRTALERA

SEQ ID NO: 1203706 - protein, 15 aa, Mycobacterium
GARDDGQKSNVNGAN

SEQ ID NO: 1203707 - protein, 9 aa, Mycobacterium
GARDDRPGL

SEQ ID NO: 1203708 - protein, 7 aa, Mycobacterium
GARDEAV

SEQ ID NO: 1203709 - protein, 5 aa, Mycobacterium
GARDF

SEQ ID NO: 1203710 - protein, 5 aa, Mycobacterium
GARDR

SEQ ID NO: 1203711 - protein, 5 aa, Mycobacterium
GARDV

SEQ ID NO: 1203712 - protein, 5 aa, Mycobacterium
GAREF

SEQ ID NO: 1203713 - protein, 7 aa, Mycobacterium
GARENNL

SEQ ID NO: 1203714 - protein, 7 aa, Mycobacterium
GARETYR

SEQ ID NO: 1203715 - protein, 4 aa, Mycobacterium
GARG

SEQ ID NO: 1203716 - protein, 12 aa, Mycobacterium
GARGAAVRRGPV

SEQ ID NO: 1203717 - protein, 17 aa, Mycobacterium
GARGANCRTAHRPHPRG

SEQ ID NO: 1203718 - protein, 8 aa, Mycobacterium
GARGATYV

SEQ ID NO: 1203719 - protein, 6 aa, Mycobacterium
GARGEG

SEQ ID NO: 1203720 - protein, 6 aa, Mycobacterium
GARGGI

SEQ ID NO: 1203721 - protein, 22 aa, Mycobacterium
GARGSGPRKSATPSHRHRRAPR

SEQ ID NO: 1203722 - protein, 5 aa, Mycobacterium
GARIS

SEQ ID NO: 1203723 - protein, 8 aa, Mycobacterium
GARKASIT

SEQ ID NO: 1203724 - protein, 6 aa, Mycobacterium
GARKGV

SEQ ID NO: 1203725 - protein, 7 aa, Mycobacterium
GARKPGS

SEQ ID NO: 1203726 - protein, 6 aa, Mycobacterium
GARKPT

SEQ ID NO: 1203727 - protein, 7 aa, Mycobacterium
GARNADD

SEQ ID NO: 1203728 - protein, 7 aa, Mycobacterium
GARNDGG

SEQ ID NO: 1203729 - protein, 10 aa, Mycobacterium
GARPAGHGSK

SEQ ID NO: 1203730 - protein, 8 aa, Mycobacterium
GARPEDDH

SEQ ID NO: 1203731 - protein, 8 aa, Mycobacterium
GARPGVEV

SEQ ID NO: 1203732 - protein, 8 aa, Mycobacterium
GARPLSEV

SEQ ID NO: 1203733 - protein, 7 aa, Mycobacterium
GARPNER

SEQ ID NO: 1203734 - protein, 7 aa, Mycobacterium
GARPSPA

SEQ ID NO: 1203735 - protein, 22 aa, Mycobacterium
GARPSPLDAASDPGLPVVQGQV

SEQ ID NO: 1203736 - protein, 13 aa, Mycobacterium
GARRASQQADEED

SEQ ID NO: 1203737 - protein, 5 aa, Mycobacterium
GARRD

SEQ ID NO: 1203738 - protein, 13 aa, Mycobacterium
GARRDVPRLGDDA

SEQ ID NO: 1203739 - protein, 9 aa, Mycobacterium
GARRGPDPH

SEQ ID NO: 1203740 - protein, 6 aa, Mycobacterium
GARRIT

SEQ ID NO: 1203741 - protein, 8 aa, Mycobacterium
GARRSLGD

SEQ ID NO: 1203742 - protein, 6 aa, Mycobacterium
GARSGH

SEQ ID NO: 1203743 - protein, 13 aa, Mycobacterium
GARSMEPLPQPTE

SEQ ID NO: 1203744 - protein, 9 aa, Mycobacterium
GARSPGARA

SEQ ID NO: 1203745 - protein, 17 aa, Mycobacterium
GARSRVEKALAANDEAE

SEQ ID NO: 1203746 - protein, 8 aa, Mycobacterium
GARSSTGI

SEQ ID NO: 1203747 - protein, 8 aa, Mycobacterium
GARSTLGR

SEQ ID NO: 1203748 - protein, 9 aa, Mycobacterium
GARTNPGDD

SEQ ID NO: 1203749 - protein, 11 aa, Mycobacterium
GARTPDQHPRL

SEQ ID NO: 1203750 - protein, 6 aa, Mycobacterium
GARTRG

SEQ ID NO: 1203751 - protein, 8 aa, Mycobacterium
GARVPGAV

SEQ ID NO: 1203752 - protein, 5 aa, Mycobacterium
GARVT

SEQ ID NO: 1203753 - protein, 8 aa, Mycobacterium
GARWDEEN

SEQ ID NO: 1203754 - protein, 4 aa, Mycobacterium
GARY

SEQ ID NO: 1203755 - protein, 8 aa, Mycobacterium
GARYGTDG

SEQ ID NO: 1203756 - protein, 18 aa, Mycobacterium
GASAAARRAVDQSGARVK

SEQ ID NO: 1203757 - protein, 15 aa, Mycobacterium
GASAAATAAALDTAA

SEQ ID NO: 1203758 - protein, 8 aa, Mycobacterium
GASADQPL

SEQ ID NO: 1203759 - protein, 7 aa, Mycobacterium
GASAGGH

SEQ ID NO: 1203760 - protein, 10 aa, Mycobacterium
GASAGYTEKM

SEQ ID NO: 1203761 - protein, 9 aa, Mycobacterium
GASATATGD

SEQ ID NO: 1203762 - protein, 9 aa, Mycobacterium
GASATPEDL

SEQ ID NO: 1203763 - protein, 22 aa, Mycobacterium
GASAVDGASAPLAGTTSQPALS

SEQ ID NO: 1203764 - protein, 7 aa, Mycobacterium
GASDDPD

SEQ ID NO: 1203765 - protein, 10 aa, Mycobacterium
GASDGTTAVT

SEQ ID NO: 1203766 - protein, 8 aa, Mycobacterium
GASELTEQ

SEQ ID NO: 1203767 - protein, 13 aa, Mycobacterium
GASEVAPSQQDLD

SEQ ID NO: 1203768 - protein, 14 aa, Mycobacterium
GASFPYRKDPEDKN

SEQ ID NO: 1203769 - protein, 8 aa, Mycobacterium
GASGGIGE

SEQ ID NO: 1203770 - protein, 9 aa, Mycobacterium
GASGGVGSA

SEQ ID NO: 1203771 - protein, 10 aa, Mycobacterium
GASGGVPRQS

SEQ ID NO: 1203772 - protein, 6 aa, Mycobacterium
GASGIG

SEQ ID NO: 1203773 - protein, 7 aa, Mycobacterium
GASGIGA

SEQ ID NO: 1203774 - protein, 6 aa, Mycobacterium
GASGSG

SEQ ID NO: 1203775 - protein, 7 aa, Mycobacterium
GASGTSL

SEQ ID NO: 1203776 - protein, 7 aa, Mycobacterium
GASGYDA

SEQ ID NO: 1203777 - protein, 5 aa, Mycobacterium
GASIP

SEQ ID NO: 1203778 - protein, 8 aa, Mycobacterium
GASIPPEH

SEQ ID NO: 1203779 - protein, 7 aa, Mycobacterium
GASKAAQ

SEQ ID NO: 1203780 - protein, 5 aa, Mycobacterium
GASLT

SEQ ID NO: 1203781 - protein, 4 aa, Mycobacterium
GASP

SEQ ID NO: 1203782 - protein, 6 aa, Mycobacterium
GASPAA

SEQ ID NO: 1203783 - protein, 8 aa, Mycobacterium
GASPAAVA

SEQ ID NO: 1203784 - protein, 10 aa, Mycobacterium
GASPGASTAV

SEQ ID NO: 1203785 - protein, 6 aa, Mycobacterium
GASPRV

SEQ ID NO: 1203786 - protein, 11 aa, Mycobacterium
GASPTEPTTGQ

SEQ ID NO: 1203787 - protein, 10 aa, Mycobacterium
GASRGAGQGI

SEQ ID NO: 1203788 - protein, 6 aa, Mycobacterium
GASRKA

SEQ ID NO: 1203789 - protein, 6 aa, Mycobacterium
GASRSL

SEQ ID NO: 1203790 - protein, 19 aa, Mycobacterium
GASSAFGGPCATPTAERLA

SEQ ID NO: 1203791 - protein, 9 aa, Mycobacterium
GASSGIGEA

SEQ ID NO: 1203792 - protein, 10 aa, Mycobacterium
GASSGIGEAT

SEQ ID NO: 1203793 - protein, 9 aa, Mycobacterium
GASSQQERR

SEQ ID NO: 1203794 - protein, 4 aa, Mycobacterium
GAST

SEQ ID NO: 1203795 - protein, 8 aa, Mycobacterium
GASTDGLA

SEQ ID NO: 1203796 - protein, 6 aa, Mycobacterium
GASTDM

SEQ ID NO: 1203797 - protein, 13 aa, Mycobacterium
GASTGDREVSEHV

SEQ ID NO: 1203798 - protein, 5 aa, Mycobacterium
GASTN

SEQ ID NO: 1203799 - protein, 8 aa, Mycobacterium
GASTPEEL

SEQ ID NO: 1203800 - protein, 7 aa, Mycobacterium
GASTQQT

SEQ ID NO: 1203801 - protein, 8 aa, Mycobacterium
GASTVTGS

SEQ ID NO: 1203802 - protein, 10 aa, Mycobacterium
GASVPTLGAR

SEQ ID NO: 1203803 - protein, 9 aa, Mycobacterium
GASWDDDQS

SEQ ID NO: 1203804 - protein, 5 aa, Mycobacterium
GASYE

SEQ ID NO: 1203805 - protein, 9 aa, Mycobacterium
GATAADEAA

SEQ ID NO: 1203806 - protein, 21 aa, Mycobacterium
GATAAGAYSMTQNTAPATTDT

SEQ ID NO: 1203807 - protein, 9 aa, Mycobacterium
GATADGRPC

SEQ ID NO: 1203808 - protein, 10 aa, Mycobacterium
GATAEGYSED

SEQ ID NO: 1203809 - protein, 15 aa, Mycobacterium
GATAEVNDTVRGPGS

SEQ ID NO: 1203810 - protein, 11 aa, Mycobacterium
GATAGAPTDTE

SEQ ID NO: 1203811 - protein, 7 aa, Mycobacterium
GATAIGP

SEQ ID NO: 1203812 - protein, 7 aa, Mycobacterium
GATAPLA

SEQ ID NO: 1203813 - protein, 11 aa, Mycobacterium
GATAPPGGPHA

SEQ ID NO: 1203814 - protein, 13 aa, Mycobacterium
GATARRDLPIPGR

SEQ ID NO: 1203815 - protein, 7 aa, Mycobacterium
GATASFT

SEQ ID NO: 1203816 - protein, 8 aa, Mycobacterium
GATDESPR

SEQ ID NO: 1203817 - protein, 8 aa, Mycobacterium
GATDPEIE

SEQ ID NO: 1203818 - protein, 4 aa, Mycobacterium
GATE

SEQ ID NO: 1203819 - protein, 8 aa, Mycobacterium
GATEHPTV

SEQ ID NO: 1203820 - protein, 7 aa, Mycobacterium
GATEIGG

SEQ ID NO: 1203821 - protein, 5 aa, Mycobacterium
GATEQ

SEQ ID NO: 1203822 - protein, 11 aa, Mycobacterium
GATESKPRGPS

SEQ ID NO: 1203823 - protein, 10 aa, Mycobacterium
GATESPAAEH

SEQ ID NO: 1203824 - protein, 4 aa, Mycobacterium
GATG

SEQ ID NO: 1203825 - protein, 7 aa, Mycobacterium
GATGARS

SEQ ID NO: 1203826 - protein, 6 aa, Mycobacterium
GATGDA

SEQ ID NO: 1203827 - protein, 5 aa, Mycobacterium
GATGE

SEQ ID NO: 1203828 - protein, 6 aa, Mycobacterium
GATGIL

SEQ ID NO: 1203829 - protein, 21 aa, Mycobacterium
GATGIRRTDNPKFSTPDYPGQ

SEQ ID NO: 1203830 - protein, 5 aa, Mycobacterium
GATGL

SEQ ID NO: 1203831 - protein, 8 aa, Mycobacterium
GATGNPLT

SEQ ID NO: 1203832 - protein, 6 aa, Mycobacterium
GATGPG

SEQ ID NO: 1203833 - protein, 7 aa, Mycobacterium
GATGQGS

SEQ ID NO: 1203834 - protein, 15 aa, Mycobacterium
GATGSALDLFRAKRT

SEQ ID NO: 1203835 - protein, 12 aa, Mycobacterium
GATGTGPARYTG

SEQ ID NO: 1203836 - protein, 8 aa, Mycobacterium
GATIGKEN

SEQ ID NO: 1203837 - protein, 5 aa, Mycobacterium
GATIP

SEQ ID NO: 1203838 - protein, 6 aa, Mycobacterium
GATNAR

SEQ ID NO: 1203839 - protein, 7 aa, Mycobacterium
GATNREI

SEQ ID NO: 1203840 - protein, 13 aa, Mycobacterium
GATPDWPEDRRRA

SEQ ID NO: 1203841 - protein, 10 aa, Mycobacterium
GATPEPREVA

SEQ ID NO: 1203842 - protein, 7 aa, Mycobacterium
GATPEQV

SEQ ID NO: 1203843 - protein, 9 aa, Mycobacterium
GATPPFDSE

SEQ ID NO: 1203844 - protein, 6 aa, Mycobacterium
GATRDD

SEQ ID NO: 1203845 - protein, 12 aa, Mycobacterium
GATRDEALARSR

SEQ ID NO: 1203846 - protein, 5 aa, Mycobacterium
GATRE

SEQ ID NO: 1203847 - protein, 18 aa, Mycobacterium
GATRGGKPFAGPEIATRT

SEQ ID NO: 1203848 - protein, 5 aa, Mycobacterium
GATRR

SEQ ID NO: 1203849 - protein, 10 aa, Mycobacterium
GATRTPEDDG

SEQ ID NO: 1203850 - protein, 4 aa, Mycobacterium
GATS

SEQ ID NO: 1203851 - protein, 5 aa, Mycobacterium
GATSN

SEQ ID NO: 1203852 - protein, 6 aa, Mycobacterium
GATSTH

SEQ ID NO: 1203853 - protein, 7 aa, Mycobacterium
GATTDGG

SEQ ID NO: 1203854 - protein, 17 aa, Mycobacterium
GATTGAVPASIAGPQVV

SEQ ID NO: 1203855 - protein, 6 aa, Mycobacterium
GATTLG

SEQ ID NO: 1203856 - protein, 8 aa, Mycobacterium
GATTLGGT

SEQ ID NO: 1203857 - protein, 5 aa, Mycobacterium
GATTQ

SEQ ID NO: 1203858 - protein, 5 aa, Mycobacterium
GATVE

SEQ ID NO: 1203859 - protein, 5 aa, Mycobacterium
GATVG

SEQ ID NO: 1203860 - protein, 5 aa, Mycobacterium
GATVP

SEQ ID NO: 1203861 - protein, 7 aa, Mycobacterium
GATVTTG

SEQ ID NO: 1203862 - protein, 16 aa, Mycobacterium
GATWTADHGGKATAVR

SEQ ID NO: 1203863 - protein, 13 aa, Mycobacterium
GATYGASGELDGR

SEQ ID NO: 1203864 - protein, 17 aa, Mycobacterium
GATYRPGTRFGPQGIRR

SEQ ID NO: 1203865 - protein, 38 aa, Mycobacterium
GAVAGASNVTTMADDSTLPKPGVPSTPPPVPGRPKKPT

SEQ ID NO: 1203866 - protein, 7 aa, Mycobacterium
GAVDEKV

SEQ ID NO: 1203867 - protein, 9 aa, Mycobacterium
GAVDGTKAR

SEQ ID NO: 1203868 - protein, 24 aa, Mycobacterium
GAVGDKSPVDTSHPKPDEAGRSVP

SEQ ID NO: 1203869 - protein, 7 aa, Mycobacterium
GAVGTSA

SEQ ID NO: 1203870 - protein, 5 aa, Mycobacterium
GAVHG

SEQ ID NO: 1203871 - protein, 8 aa, Mycobacterium
GAVNTVRP

SEQ ID NO: 1203872 - protein, 9 aa, Mycobacterium
GAVPGTPLN

SEQ ID NO: 1203873 - protein, 7 aa, Mycobacterium
GAVPPDV

SEQ ID NO: 1203874 - protein, 12 aa, Mycobacterium
GAVPRDFQGNDD

SEQ ID NO: 1203875 - protein, 7 aa, Mycobacterium
GAVPSAP

SEQ ID NO: 1203876 - protein, 16 aa, Mycobacterium
GAVPSTPPSHTGTPDG

SEQ ID NO: 1203877 - protein, 13 aa, Mycobacterium
GAVQGGCGSSGAG

SEQ ID NO: 1203878 - protein, 17 aa, Mycobacterium
GAVRTRTRGARTGGSKR

SEQ ID NO: 1203879 - protein, 7 aa, Mycobacterium
GAVRTSK

SEQ ID NO: 1203880 - protein, 5 aa, Mycobacterium
GAVSA

SEQ ID NO: 1203881 - protein, 6 aa, Mycobacterium
GAVSPA

SEQ ID NO: 1203882 - protein, 9 aa, Mycobacterium
GAVTSAPMR

SEQ ID NO: 1203883 - protein, 7 aa, Mycobacterium
GAVVGGR

SEQ ID NO: 1203884 - protein, 9 aa, Mycobacterium
GAWPATPVA

SEQ ID NO: 1203885 - protein, 5 aa, Mycobacterium
GAWPS

SEQ ID NO: 1203886 - protein, 19 aa, Mycobacterium
GAYAGSLDDAEDALEGQLW

SEQ ID NO: 1203887 - protein, 17 aa, Mycobacterium
GAYGCSGPIPAAPGGAN

SEQ ID NO: 1203888 - protein, 8 aa, Mycobacterium
GAYGNHSP

SEQ ID NO: 1203889 - protein, 12 aa, Mycobacterium
GAYGRSAKDAVD

SEQ ID NO: 1203890 - protein, 8 aa, Mycobacterium
GAYGSEVA

SEQ ID NO: 1203891 - protein, 9 aa, Mycobacterium
GAYGSEVAD

SEQ ID NO: 1203892 - protein, 4 aa, Mycobacterium
GAYN

SEQ ID NO: 1203893 - protein, 13 aa, Mycobacterium
GAYRNKPGKYADP

SEQ ID NO: 1203894 - protein, 7 aa, Mycobacterium
GAYSQSK

SEQ ID NO: 1203895 - protein, 12 aa, Mycobacterium
GAYVGSQAREGG

SEQ ID NO: 1203896 - protein, 9 aa, Mycobacterium
GCAGTPGAC

SEQ ID NO: 1203897 - protein, 7 aa, Mycobacterium
GCDAGDC

SEQ ID NO: 1203898 - protein, 7 aa, Mycobacterium
GCDGSPK

SEQ ID NO: 1203899 - protein, 8 aa, Mycobacterium
GCEPSEAA

SEQ ID NO: 1203900 - protein, 13 aa, Mycobacterium
GCGDSPPAPDPHA

SEQ ID NO: 1203901 - protein, 6 aa, Mycobacterium
GCGETP

SEQ ID NO: 1203902 - protein, 9 aa, Mycobacterium
GCGGDHDRG

SEQ ID NO: 1203903 - protein, 8 aa, Mycobacterium
GCGGGDRS

SEQ ID NO: 1203904 - protein, 5 aa, Mycobacterium
GCGMP

SEQ ID NO: 1203905 - protein, 5 aa, Mycobacterium
GCGQW

SEQ ID NO: 1203906 - protein, 7 aa, Mycobacterium
GCGRPSS

SEQ ID NO: 1203907 - protein, 10 aa, Mycobacterium
GCGSQGGPPT

SEQ ID NO: 1203908 - protein, 7 aa, Mycobacterium
GCHGGPG

SEQ ID NO: 1203909 - protein, 7 aa, Mycobacterium
GCPAGEN

SEQ ID NO: 1203910 - protein, 4 aa, Mycobacterium
GCPE

SEQ ID NO: 1203911 - protein, 9 aa, Mycobacterium
GCPEPAPIR

SEQ ID NO: 1203912 - protein, 6 aa, Mycobacterium
GCQQQD

SEQ ID NO: 1203913 - protein, 8 aa, Mycobacterium
GCQRRTNQ

SEQ ID NO: 1203914 - protein, 6 aa, Mycobacterium
GCRNAG

SEQ ID NO: 1203915 - protein, 7 aa, Mycobacterium
GCSEDEL

SEQ ID NO: 1203916 - protein, 9 aa, Mycobacterium
GCSGSTATA

SEQ ID NO: 1203917 - protein, 12 aa, Mycobacterium
GCSPHNAKTITT

SEQ ID NO: 1203918 - protein, 9 aa, Mycobacterium
GCSRGRGGS

SEQ ID NO: 1203919 - protein, 4 aa, Mycobacterium
GCSS

SEQ ID NO: 1203920 - protein, 15 aa, Mycobacterium
GCTGTGSGACENPSG

SEQ ID NO: 1203921 - protein, 6 aa, Mycobacterium
GCTPAE

SEQ ID NO: 1203922 - protein, 4 aa, Mycobacterium
GDAA

SEQ ID NO: 1203923 - protein, 18 aa, Mycobacterium
GDAAAGKIDAEEVAKYAG

SEQ ID NO: 1203924 - protein, 9 aa, Mycobacterium
GDAAAPSDL

SEQ ID NO: 1203925 - protein, 7 aa, Mycobacterium
GDAAPIT

SEQ ID NO: 1203926 - protein, 9 aa, Mycobacterium
GDAATAEDV

SEQ ID NO: 1203927 - protein, 10 aa, Mycobacterium
GDADKRQVNG

SEQ ID NO: 1203928 - protein, 6 aa, Mycobacterium
GDADNE

SEQ ID NO: 1203929 - protein, 16 aa, Mycobacterium
GDADPDVAVPARREDL

SEQ ID NO: 1203930 - protein, 16 aa, Mycobacterium
GDADPNEAVPARRDDL

SEQ ID NO: 1203931 - protein, 7 aa, Mycobacterium
GDADTAV

SEQ ID NO: 1203932 - protein, 6 aa, Mycobacterium
GDAETL

SEQ ID NO: 1203933 - protein, 7 aa, Mycobacterium
GDAEVAR

SEQ ID NO: 1203934 - protein, 4 aa, Mycobacterium
GDAF

SEQ ID NO: 1203935 - protein, 8 aa, Mycobacterium
GDAGADEV

SEQ ID NO: 1203936 - protein, 8 aa, Mycobacterium
GDAGDADG

SEQ ID NO: 1203937 - protein, 16 aa, Mycobacterium
GDAGDDGDADLSSISP

SEQ ID NO: 1203938 - protein, 9 aa, Mycobacterium
GDAGDKRAN

SEQ ID NO: 1203939 - protein, 10 aa, Mycobacterium
GDAGGDERAR

SEQ ID NO: 1203940 - protein, 6 aa, Mycobacterium
GDAGIA

SEQ ID NO: 1203941 - protein, 7 aa, Mycobacterium
GDAGPIA

SEQ ID NO: 1203942 - protein, 14 aa, Mycobacterium
GDALPRPGAGEARQ

SEQ ID NO: 1203943 - protein, 4 aa, Mycobacterium
GDAM

SEQ ID NO: 1203944 - protein, 5 aa, Mycobacterium
GDAMS

SEQ ID NO: 1203945 - protein, 15 aa, Mycobacterium
GDAPAAGDGTGWEAA

SEQ ID NO: 1203946 - protein, 77 aa, Mycobacterium
GDAPAAPPARPLDSPSPGITQGDDNPKKAPPQEDDSSKSTPLQEGSDQSPPAMSPTDSAGTSTTQPGIKTGTGDEGI

SEQ ID NO: 1203947 - protein, 8 aa, Mycobacterium
GDAPDGML

SEQ ID NO: 1203948 - protein, 6 aa, Mycobacterium
GDAPDV

SEQ ID NO: 1203949 - protein, 9 aa, Mycobacterium
GDAPGPDEW

SEQ ID NO: 1203950 - protein, 8 aa, Mycobacterium
GDAPSGPG

SEQ ID NO: 1203951 - protein, 11 aa, Mycobacterium
GDAPTAPPVQP

SEQ ID NO: 1203952 - protein, 13 aa, Mycobacterium
GDAQPRYSASRRA

SEQ ID NO: 1203953 - protein, 8 aa, Mycobacterium
GDARSPSV

SEQ ID NO: 1203954 - protein, 12 aa, Mycobacterium
GDARTALGAGDA

SEQ ID NO: 1203955 - protein, 4 aa, Mycobacterium
GDAS

SEQ ID NO: 1203956 - protein, 6 aa, Mycobacterium
GDASER

SEQ ID NO: 1203957 - protein, 8 aa, Mycobacterium
GDASPDEL

SEQ ID NO: 1203958 - protein, 12 aa, Mycobacterium
GDASQSAGATAH

SEQ ID NO: 1203959 - protein, 10 aa, Mycobacterium
GDATAPVTRP

SEQ ID NO: 1203960 - protein, 16 aa, Mycobacterium
GDATMTAGNSTPLTDG

SEQ ID NO: 1203961 - protein, 8 aa, Mycobacterium
GDATPGTL

SEQ ID NO: 1203962 - protein, 7 aa, Mycobacterium
GDATSAL

SEQ ID NO: 1203963 - protein, 8 aa, Mycobacterium
GDAVARPD

SEQ ID NO: 1203964 - protein, 23 aa, Mycobacterium
GDAVPGGRADDPSVATTLPTRAA

SEQ ID NO: 1203965 - protein, 4 aa, Mycobacterium
GDAY

SEQ ID NO: 1203966 - protein, 4 aa, Mycobacterium
GDCE

SEQ ID NO: 1203967 - protein, 9 aa, Mycobacterium
GDCGTAGRL

SEQ ID NO: 1203968 - protein, 7 aa, Mycobacterium
GDCSRSR

SEQ ID NO: 1203969 - protein, 12 aa, Mycobacterium
GDDADVPVSDRE

SEQ ID NO: 1203970 - protein, 5 aa, Mycobacterium
GDDAP

SEQ ID NO: 1203971 - protein, 7 aa, Mycobacterium
GDDAPAR

SEQ ID NO: 1203972 - protein, 8 aa, Mycobacterium
GDDAPTPV

SEQ ID NO: 1203973 - protein, 5 aa, Mycobacterium
GDDAR

SEQ ID NO: 1203974 - protein, 7 aa, Mycobacterium
GDDCQRN

SEQ ID NO: 1203975 - protein, 6 aa, Mycobacterium
GDDDEA

SEQ ID NO: 1203976 - protein, 7 aa, Mycobacterium
GDDDETA

SEQ ID NO: 1203977 - protein, 7 aa, Mycobacterium
GDDDEVG

SEQ ID NO: 1203978 - protein, 7 aa, Mycobacterium
GDDDGSW

SEQ ID NO: 1203979 - protein, 5 aa, Mycobacterium
GDDDL

SEQ ID NO: 1203980 - protein, 7 aa, Mycobacterium
GDDDRHP

SEQ ID NO: 1203981 - protein, 33 aa, Mycobacterium
GDDDSRHDPHGRVENTVESDRRRQAGSESGEKQ

SEQ ID NO: 1203982 - protein, 5 aa, Mycobacterium
GDDEL

SEQ ID NO: 1203983 - protein, 10 aa, Mycobacterium
GDDELDDGRT

SEQ ID NO: 1203984 - protein, 6 aa, Mycobacterium
GDDELT

SEQ ID NO: 1203985 - protein, 8 aa, Mycobacterium
GDDETGLA

SEQ ID NO: 1203986 - protein, 7 aa, Mycobacterium
GDDEVRD

SEQ ID NO: 1203987 - protein, 4 aa, Mycobacterium
GDDF

SEQ ID NO: 1203988 - protein, 5 aa, Mycobacterium
GDDFC

SEQ ID NO: 1203989 - protein, 8 aa, Mycobacterium
GDDGALAT

SEQ ID NO: 1203990 - protein, 6 aa, Mycobacterium
GDDGDE

SEQ ID NO: 1203991 - protein, 8 aa, Mycobacterium
GDDGGVEI

SEQ ID NO: 1203992 - protein, 11 aa, Mycobacterium
GDDGLTASQLD

SEQ ID NO: 1203993 - protein, 9 aa, Mycobacterium
GDDGPEPDV

SEQ ID NO: 1203994 - protein, 10 aa, Mycobacterium
GDDGQRIEEV

SEQ ID NO: 1203995 - protein, 10 aa, Mycobacterium
GDDGSVQPTS

SEQ ID NO: 1203996 - protein, 9 aa, Mycobacterium
GDDGTTSAE

SEQ ID NO: 1203997 - protein, 9 aa, Mycobacterium
GDDHEGPEF

SEQ ID NO: 1203998 - protein, 4 aa, Mycobacterium
GDDI

SEQ ID NO: 1203999 - protein, 7 aa, Mycobacterium
GDDIDGP

SEQ ID NO: 1204000 - protein, 14 aa, Mycobacterium
GDDLTGAAHGAGFA

SEQ ID NO: 1204001 - protein, 16 aa, Mycobacterium
GDDLTGAAHNAGFSDS

SEQ ID NO: 1204002 - protein, 4 aa, Mycobacterium
GDDP

SEQ ID NO: 1204003 - protein, 9 aa, Mycobacterium
GDDPADPAL

SEQ ID NO: 1204004 - protein, 24 aa, Mycobacterium
GDDPASRRRSRERTAEFLASVVSE

SEQ ID NO: 1204005 - protein, 8 aa, Mycobacterium
GDDPEHPF

SEQ ID NO: 1204006 - protein, 17 aa, Mycobacterium
GDDPGAKSSSLPVASER

SEQ ID NO: 1204007 - protein, 13 aa, Mycobacterium
GDDPLAAAEADGA

SEQ ID NO: 1204008 - protein, 7 aa, Mycobacterium
GDDPWPE

SEQ ID NO: 1204009 - protein, 5 aa, Mycobacterium
GDDPY

SEQ ID NO: 1204010 - protein, 8 aa, Mycobacterium
GDDRAGAE

SEQ ID NO: 1204011 - protein, 10 aa, Mycobacterium
GDDRDTDRLQ

SEQ ID NO: 1204012 - protein, 20 aa, Mycobacterium
GDDRFTAQTGVAAADERQVV

SEQ ID NO: 1204013 - protein, 7 aa, Mycobacterium
GDDRSPL

SEQ ID NO: 1204014 - protein, 4 aa, Mycobacterium
GDDS

SEQ ID NO: 1204015 - protein, 11 aa, Mycobacterium
GDDSDLPAGLT

SEQ ID NO: 1204016 - protein, 13 aa, Mycobacterium
GDDSGIPDEDQWQ

SEQ ID NO: 1204017 - protein, 14 aa, Mycobacterium
GDDSLSEPRAPYPH

SEQ ID NO: 1204018 - protein, 15 aa, Mycobacterium
GDDTARRDYNRRIDT

SEQ ID NO: 1204019 - protein, 13 aa, Mycobacterium
GDDTEPTDGLTRR

SEQ ID NO: 1204020 - protein, 9 aa, Mycobacterium
GDDTGGGLQ

SEQ ID NO: 1204021 - protein, 8 aa, Mycobacterium
GDDVGTPT

SEQ ID NO: 1204022 - protein, 5 aa, Mycobacterium
GDDVS

SEQ ID NO: 1204023 - protein, 4 aa, Mycobacterium
GDDY

SEQ ID NO: 1204024 - protein, 7 aa, Mycobacterium
GDEAAVN

SEQ ID NO: 1204025 - protein, 5 aa, Mycobacterium
GDEAD

SEQ ID NO: 1204026 - protein, 13 aa, Mycobacterium
GDEAMGRARRPDV

SEQ ID NO: 1204027 - protein, 7 aa, Mycobacterium
GDEAPEA

SEQ ID NO: 1204028 - protein, 6 aa, Mycobacterium
GDECDR

SEQ ID NO: 1204029 - protein, 10 aa, Mycobacterium
GDEDHAGVDT

SEQ ID NO: 1204030 - protein, 6 aa, Mycobacterium
GDEDTL

SEQ ID NO: 1204031 - protein, 6 aa, Mycobacterium
GDEDTV

SEQ ID NO: 1204032 - protein, 6 aa, Mycobacterium
GDEEGS

SEQ ID NO: 1204033 - protein, 7 aa, Mycobacterium
GDEEMAR

SEQ ID NO: 1204034 - protein, 7 aa, Mycobacterium
GDEGAVA

SEQ ID NO: 1204035 - protein, 5 aa, Mycobacterium
GDEGE

SEQ ID NO: 1204036 - protein, 5 aa, Mycobacterium
GDEGK

SEQ ID NO: 1204037 - protein, 6 aa, Mycobacterium
GDEGWG

SEQ ID NO: 1204038 - protein, 5 aa, Mycobacterium
GDEHR

SEQ ID NO: 1204039 - protein, 4 aa, Mycobacterium
GDEI

SEQ ID NO: 1204040 - protein, 4 aa, Mycobacterium
GDEK

SEQ ID NO: 1204041 - protein, 9 aa, Mycobacterium
GDEKPGAAI

SEQ ID NO: 1204042 - protein, 9 aa, Mycobacterium
GDELASAGG

SEQ ID NO: 1204043 - protein, 9 aa, Mycobacterium
GDELRRRPA

SEQ ID NO: 1204044 - protein, 8 aa, Mycobacterium
GDENRPAW

SEQ ID NO: 1204045 - protein, 8 aa, Mycobacterium
GDEPGENG

SEQ ID NO: 1204046 - protein, 13 aa, Mycobacterium
GDEPGLTDLEDGN

SEQ ID NO: 1204047 - protein, 8 aa, Mycobacterium
GDEPHTSQ

SEQ ID NO: 1204048 - protein, 9 aa, Mycobacterium
GDEPMTGAQ

SEQ ID NO: 1204049 - protein, 8 aa, Mycobacterium
GDEPVGNR

SEQ ID NO: 1204050 - protein, 9 aa, Mycobacterium
GDEPVPRQG

SEQ ID NO: 1204051 - protein, 5 aa, Mycobacterium
GDEQG

SEQ ID NO: 1204052 - protein, 5 aa, Mycobacterium
GDEQM

SEQ ID NO: 1204053 - protein, 8 aa, Mycobacterium
GDESLEKD

SEQ ID NO: 1204054 - protein, 15 aa, Mycobacterium
GDESMARSRKPEVYS

SEQ ID NO: 1204055 - protein, 6 aa, Mycobacterium
GDESQV

SEQ ID NO: 1204056 - protein, 10 aa, Mycobacterium
GDETGGVGDA

SEQ ID NO: 1204057 - protein, 9 aa, Mycobacterium
GDETVDPGA

SEQ ID NO: 1204058 - protein, 6 aa, Mycobacterium
GDEVRR

SEQ ID NO: 1204059 - protein, 8 aa, Mycobacterium
GDFDVTDN

SEQ ID NO: 1204060 - protein, 15 aa, Mycobacterium
GDFGPGSAMARSTKR

SEQ ID NO: 1204061 - protein, 6 aa, Mycobacterium
GDFPGG

SEQ ID NO: 1204062 - protein, 6 aa, Mycobacterium
GDFQGT

SEQ ID NO: 1204063 - protein, 4 aa, Mycobacterium
GDFT

SEQ ID NO: 1204064 - protein, 5 aa, Mycobacterium
GDFTD

SEQ ID NO: 1204065 - protein, 4 aa, Mycobacterium
GDGA

SEQ ID NO: 1204066 - protein, 6 aa, Mycobacterium
GDGADI

SEQ ID NO: 1204067 - protein, 6 aa, Mycobacterium
GDGADV

SEQ ID NO: 1204068 - protein, 11 aa, Mycobacterium
GDGAESLFTGE

SEQ ID NO: 1204069 - protein, 8 aa, Mycobacterium
GDGAPERF

SEQ ID NO: 1204070 - protein, 13 aa, Mycobacterium
GDGATAVEHAEGA

SEQ ID NO: 1204071 - protein, 6 aa, Mycobacterium
GDGAVS

SEQ ID NO: 1204072 - protein, 10 aa, Mycobacterium
GDGDARPVKG

SEQ ID NO: 1204073 - protein, 6 aa, Mycobacterium
GDGDDA

SEQ ID NO: 1204074 - protein, 6 aa, Mycobacterium
GDGDGE

SEQ ID NO: 1204075 - protein, 9 aa, Mycobacterium
GDGDSLSIG

SEQ ID NO: 1204076 - protein, 16 aa, Mycobacterium
GDGDSTADTAAPGSPW

SEQ ID NO: 1204077 - protein, 9 aa, Mycobacterium
GDGDWRDSE

SEQ ID NO: 1204078 - protein, 11 aa, Mycobacterium
GDGEAETGPLA

SEQ ID NO: 1204079 - protein, 11 aa, Mycobacterium
GDGEGPRATAR

SEQ ID NO: 1204080 - protein, 8 aa, Mycobacterium
GDGEPVGA

SEQ ID NO: 1204081 - protein, 5 aa, Mycobacterium
GDGFD

SEQ ID NO: 1204082 - protein, 88 aa, Mycobacterium
GDGGDGGDGLSDAGVGLPGTGGRGGDAGLLGGKGGRGGAGGGASAQIGDTITGGAGGRGGNAGLLGTGGQGGAGGVARDTRANSGSET

SEQ ID NO: 1204083 - protein, 6 aa, Mycobacterium
GDGGEH

SEQ ID NO: 1204084 - protein, 5 aa, Mycobacterium
GDGGP

SEQ ID NO: 1204085 - protein, 8 aa, Mycobacterium
GDGGRFDE

SEQ ID NO: 1204086 - protein, 37 aa, Mycobacterium
GDGGRRRLGAADGDRVSGRWKPNGVVGGEPGDALTVG

SEQ ID NO: 1204087 - protein, 8 aa, Mycobacterium
GDGGSHHE

SEQ ID NO: 1204088 - protein, 15 aa, Mycobacterium
GDGGYIGRDDAANMT

SEQ ID NO: 1204089 - protein, 7 aa, Mycobacterium
GDGIGDP

SEQ ID NO: 1204090 - protein, 4 aa, Mycobacterium
GDGK

SEQ ID NO: 1204091 - protein, 13 aa, Mycobacterium
GDGKLEAVDPIPN

SEQ ID NO: 1204092 - protein, 10 aa, Mycobacterium
GDGKWKRQED

SEQ ID NO: 1204093 - protein, 8 aa, Mycobacterium
GDGKWRSE

SEQ ID NO: 1204094 - protein, 5 aa, Mycobacterium
GDGLT

SEQ ID NO: 1204095 - protein, 9 aa, Mycobacterium
GDGLTNQEI

SEQ ID NO: 1204096 - protein, 8 aa, Mycobacterium
GDGPAALA

SEQ ID NO: 1204097 - protein, 9 aa, Mycobacterium
GDGPPAGPV

SEQ ID NO: 1204098 - protein, 13 aa, Mycobacterium
GDGPSVRAARDQR

SEQ ID NO: 1204099 - protein, 5 aa, Mycobacterium
GDGPT

SEQ ID NO: 1204100 - protein, 24 aa, Mycobacterium
GDGPVRVAGGNAEQAARNSGPDRA

SEQ ID NO: 1204101 - protein, 6 aa, Mycobacterium
GDGPVV

SEQ ID NO: 1204102 - protein, 4 aa, Mycobacterium
GDGQ

SEQ ID NO: 1204103 - protein, 31 aa, Mycobacterium
GDGQGGEARSATGQPPRDAGASKRARNRAST

SEQ ID NO: 1204104 - protein, 9 aa, Mycobacterium
GDGQQRSRV

SEQ ID NO: 1204105 - protein, 7 aa, Mycobacterium
GDGRAEG

SEQ ID NO: 1204106 - protein, 8 aa, Mycobacterium
GDGRAVPA

SEQ ID NO: 1204107 - protein, 18 aa, Mycobacterium
GDGRCKQVPYSKRAPRLA

SEQ ID NO: 1204108 - protein, 13 aa, Mycobacterium
GDGRDPESVERRV

SEQ ID NO: 1204109 - protein, 6 aa, Mycobacterium
GDGRGR

SEQ ID NO: 1204110 - protein, 11 aa, Mycobacterium
GDGRKRYTRDT

SEQ ID NO: 1204111 - protein, 7 aa, Mycobacterium
GDGRNAR

SEQ ID NO: 1204112 - protein, 8 aa, Mycobacterium
GDGRTAAR

SEQ ID NO: 1204113 - protein, 10 aa, Mycobacterium
GDGSCSALPR

SEQ ID NO: 1204114 - protein, 16 aa, Mycobacterium
GDGSGINLSRSSPSPA

SEQ ID NO: 1204115 - protein, 7 aa, Mycobacterium
GDGSRTR

SEQ ID NO: 1204116 - protein, 12 aa, Mycobacterium
GDGSSADDYYPP

SEQ ID NO: 1204117 - protein, 10 aa, Mycobacterium
GDGSTDPAEI

SEQ ID NO: 1204118 - protein, 6 aa, Mycobacterium
GDGTDA

SEQ ID NO: 1204119 - protein, 11 aa, Mycobacterium
GDGTGAPQSFT

SEQ ID NO: 1204120 - protein, 9 aa, Mycobacterium
GDGTGDIRG

SEQ ID NO: 1204121 - protein, 8 aa, Mycobacterium
GDGTPDDL

SEQ ID NO: 1204122 - protein, 14 aa, Mycobacterium
GDGTSAAAQITTAD

SEQ ID NO: 1204123 - protein, 15 aa, Mycobacterium
GDGTSAAAQITTADP

SEQ ID NO: 1204124 - protein, 14 aa, Mycobacterium
GDGTSRAAQITTAD

SEQ ID NO: 1204125 - protein, 11 aa, Mycobacterium
GDGTVDTRRRD

SEQ ID NO: 1204126 - protein, 7 aa, Mycobacterium
GDGTVGE

SEQ ID NO: 1204127 - protein, 4 aa, Mycobacterium
GDGV

SEQ ID NO: 1204128 - protein, 9 aa, Mycobacterium
GDGVSTRTI

SEQ ID NO: 1204129 - protein, 10 aa, Mycobacterium
GDGWKGRTPN

SEQ ID NO: 1204130 - protein, 5 aa, Mycobacterium
GDHGT

SEQ ID NO: 1204131 - protein, 11 aa, Mycobacterium
GDHHQSSRAQY

SEQ ID NO: 1204132 - protein, 4 aa, Mycobacterium
GDHP

SEQ ID NO: 1204133 - protein, 7 aa, Mycobacterium
GDHPEPA

SEQ ID NO: 1204134 - protein, 8 aa, Mycobacterium
GDHPGFSG

SEQ ID NO: 1204135 - protein, 5 aa, Mycobacterium
GDHRS

SEQ ID NO: 1204136 - protein, 7 aa, Mycobacterium
GDIAPEE

SEQ ID NO: 1204137 - protein, 6 aa, Mycobacterium
GDIATA

SEQ ID NO: 1204138 - protein, 4 aa, Mycobacterium
GDID

SEQ ID NO: 1204139 - protein, 7 aa, Mycobacterium
GDIDDDK

SEQ ID NO: 1204140 - protein, 5 aa, Mycobacterium
GDIDP

SEQ ID NO: 1204141 - protein, 7 aa, Mycobacterium
GDIDPTC

SEQ ID NO: 1204142 - protein, 20 aa, Mycobacterium
GDIGSSGVGLAGPGRSSSIG

SEQ ID NO: 1204143 - protein, 11 aa, Mycobacterium
GDIPERDRDAV

SEQ ID NO: 1204144 - protein, 5 aa, Mycobacterium
GDIPT

SEQ ID NO: 1204145 - protein, 4 aa, Mycobacterium
GDIQ

SEQ ID NO: 1204146 - protein, 8 aa, Mycobacterium
GDIRPDEA

SEQ ID NO: 1204147 - protein, 15 aa, Mycobacterium
GDISVSSDGPGTGAA

SEQ ID NO: 1204148 - protein, 8 aa, Mycobacterium
GDKARAHE

SEQ ID NO: 1204149 - protein, 5 aa, Mycobacterium
GDKAS

SEQ ID NO: 1204150 - protein, 14 aa, Mycobacterium
GDKAYRDFSDPEAV

SEQ ID NO: 1204151 - protein, 9 aa, Mycobacterium
GDKGEADLG

SEQ ID NO: 1204152 - protein, 6 aa, Mycobacterium
GDKLEL

SEQ ID NO: 1204153 - protein, 27 aa, Mycobacterium
GDKPANSTGLPKNNRRGNRLPRDERRG

SEQ ID NO: 1204154 - protein, 13 aa, Mycobacterium
GDKPTNPGQSVTL

SEQ ID NO: 1204155 - protein, 15 aa, Mycobacterium
GDKTPGAGRPRDPRI

SEQ ID NO: 1204156 - protein, 9 aa, Mycobacterium
GDKTPRSLR

SEQ ID NO: 1204157 - protein, 12 aa, Mycobacterium
GDKTSNTATDGG

SEQ ID NO: 1204158 - protein, 6 aa, Mycobacterium
GDKTYR

SEQ ID NO: 1204159 - protein, 9 aa, Mycobacterium
GDLADPSHC

SEQ ID NO: 1204160 - protein, 15 aa, Mycobacterium
GDLAGPDAADPPTGV

SEQ ID NO: 1204161 - protein, 8 aa, Mycobacterium
GDLARAGR

SEQ ID NO: 1204162 - protein, 12 aa, Mycobacterium
GDLATELGDALV

SEQ ID NO: 1204163 - protein, 9 aa, Mycobacterium
GDLDEESWE

SEQ ID NO: 1204164 - protein, 10 aa, Mycobacterium
GDLDGAATAF

SEQ ID NO: 1204165 - protein, 8 aa, Mycobacterium
GDLDGPSV

SEQ ID NO: 1204166 - protein, 10 aa, Mycobacterium
GDLDSDNLSE

SEQ ID NO: 1204167 - protein, 9 aa, Mycobacterium
GDLEGNPQL

SEQ ID NO: 1204168 - protein, 7 aa, Mycobacterium
GDLERTG

SEQ ID NO: 1204169 - protein, 17 aa, Mycobacterium
GDLGEAGTNAHHGSGSS

SEQ ID NO: 1204170 - protein, 9 aa, Mycobacterium
GDLGGESGQ

SEQ ID NO: 1204171 - protein, 11 aa, Mycobacterium
GDLGNDPASVG

SEQ ID NO: 1204172 - protein, 10 aa, Mycobacterium
GDLGSHPRAT

SEQ ID NO: 1204173 - protein, 16 aa, Mycobacterium
GDLNEHRPTGRSTVAA

SEQ ID NO: 1204174 - protein, 6 aa, Mycobacterium
GDLPDQ

SEQ ID NO: 1204175 - protein, 11 aa, Mycobacterium
GDLPGEPVPEA

SEQ ID NO: 1204176 - protein, 13 aa, Mycobacterium
GDLPGTARIGAPQ

SEQ ID NO: 1204177 - protein, 6 aa, Mycobacterium
GDLPQR

SEQ ID NO: 1204178 - protein, 14 aa, Mycobacterium
GDLQGAVDAQAGRR

SEQ ID NO: 1204179 - protein, 4 aa, Mycobacterium
GDLR

SEQ ID NO: 1204180 - protein, 10 aa, Mycobacterium
GDLSADQERA

SEQ ID NO: 1204181 - protein, 28 aa, Mycobacterium
GDLSGLSKPGEAGDKVTQRAADTGDEWA

SEQ ID NO: 1204182 - protein, 9 aa, Mycobacterium
GDLSNPEEN

SEQ ID NO: 1204183 - protein, 16 aa, Mycobacterium
GDLTGRDTSGAAEAAN

SEQ ID NO: 1204184 - protein, 64 aa, Mycobacterium
GDLVDKKTQGKYASTVDKVQEAAKKAVADNAGPVPPGQQSGHVPPPQPPPTTPPQQQPPTAPPT

SEQ ID NO: 1204185 - protein, 10 aa, Mycobacterium
GDLVPKPDGM

SEQ ID NO: 1204186 - protein, 10 aa, Mycobacterium
GDMSGGGGMM

SEQ ID NO: 1204187 - protein, 15 aa, Mycobacterium
GDMSTSSGDGDSASI

SEQ ID NO: 1204188 - protein, 15 aa, Mycobacterium
GDMSTSSGDGDSQSI

SEQ ID NO: 1204189 - protein, 10 aa, Mycobacterium
GDMTPDEEEA

SEQ ID NO: 1204190 - protein, 7 aa, Mycobacterium
GDNDTDR

SEQ ID NO: 1204191 - protein, 4 aa, Mycobacterium
GDNE

SEQ ID NO: 1204192 - protein, 10 aa, Mycobacterium
GDNERTINGP

SEQ ID NO: 1204193 - protein, 9 aa, Mycobacterium
GDNGAGKST

SEQ ID NO: 1204194 - protein, 10 aa, Mycobacterium
GDNGAGKSTL

SEQ ID NO: 1204195 - protein, 7 aa, Mycobacterium
GDNGRRR

SEQ ID NO: 1204196 - protein, 10 aa, Mycobacterium
GDNIDKDAKI

SEQ ID NO: 1204197 - protein, 6 aa, Mycobacterium
GDNPYE

SEQ ID NO: 1204198 - protein, 14 aa, Mycobacterium
GDNRSAIGLVSDLW

SEQ ID NO: 1204199 - protein, 8 aa, Mycobacterium
GDNSGTVE

SEQ ID NO: 1204200 - protein, 6 aa, Mycobacterium
GDNTHV

SEQ ID NO: 1204201 - protein, 6 aa, Mycobacterium
GDNTPV

SEQ ID NO: 1204202 - protein, 5 aa, Mycobacterium
GDNVV

SEQ ID NO: 1204203 - protein, 10 aa, Mycobacterium
GDPAAARDNA

SEQ ID NO: 1204204 - protein, 16 aa, Mycobacterium
GDPAAEAELDASENPA

SEQ ID NO: 1204205 - protein, 11 aa, Mycobacterium
GDPAAEDTEMG

SEQ ID NO: 1204206 - protein, 8 aa, Mycobacterium
GDPADQPQ

SEQ ID NO: 1204207 - protein, 30 aa, Mycobacterium; identical to SEQ ID NO: 1107578

SEQ ID NO: 1204208 - protein, 5 aa, Mycobacterium
GDPAG

SEQ ID NO: 1204209 - protein, 16 aa, Mycobacterium
GDPAPSFTAATTQGDI

SEQ ID NO: 1204210 - protein, 7 aa, Mycobacterium
GDPASVR

SEQ ID NO: 1204211 - protein, 5 aa, Mycobacterium
GDPAT

SEQ ID NO: 1204212 - protein, 6 aa, Mycobacterium
GDPDAA

SEQ ID NO: 1204213 - protein, 10 aa, Mycobacterium
GDPDDHAATA

SEQ ID NO: 1204214 - protein, 9 aa, Mycobacterium
GDPDDPEQL

SEQ ID NO: 1204215 - protein, 7 aa, Mycobacterium
GDPDEFE

SEQ ID NO: 1204216 - protein, 6 aa, Mycobacterium
GDPDGI

SEQ ID NO: 1204217 - protein, 5 aa, Mycobacterium
GDPDM

SEQ ID NO: 1204218 - protein, 17 aa, Mycobacterium
GDPDSRNDDDSADSMPK

SEQ ID NO: 1204219 - protein, 7 aa, Mycobacterium
GDPEDDI

SEQ ID NO: 1204220 - protein, 7 aa, Mycobacterium
GDPEGVA

SEQ ID NO: 1204221 - protein, 15 aa, Mycobacterium
GDPEPTDGVDNGMSG

SEQ ID NO: 1204222 - protein, 6 aa, Mycobacterium
GDPEQP

SEQ ID NO: 1204223 - protein, 7 aa, Mycobacterium
GDPESAW

SEQ ID NO: 1204224 - protein, 5 aa, Mycobacterium
GDPGA

SEQ ID NO: 1204225 - protein, 10 aa, Mycobacterium
GDPGDPDTDL

SEQ ID NO: 1204226 - protein, 10 aa, Mycobacterium
GDPGELSEER

SEQ ID NO: 1204227 - protein, 18 aa, Mycobacterium
GDPGLAADYRNASTTLGA

SEQ ID NO: 1204228 - protein, 6 aa, Mycobacterium
GDPGPF

SEQ ID NO: 1204229 - protein, 6 aa, Mycobacterium
GDPGRR

SEQ ID NO: 1204230 - protein, 5 aa, Mycobacterium
GDPHI

SEQ ID NO: 1204231 - protein, 6 aa, Mycobacterium
GDPHPE

SEQ ID NO: 1204232 - protein, 7 aa, Mycobacterium
GDPHPEQ

SEQ ID NO: 1204233 - protein, 7 aa, Mycobacterium
GDPKVTV

SEQ ID NO: 1204234 - protein, 6 aa, Mycobacterium
GDPLEI

SEQ ID NO: 1204235 - protein, 5 aa, Mycobacterium
GDPLS

SEQ ID NO: 1204236 - protein, 6 aa, Mycobacterium
GDPLTG

SEQ ID NO: 1204237 - protein, 16 aa, Mycobacterium
GDPMESAAAGGGGGFA

SEQ ID NO: 1204238 - protein, 6 aa, Mycobacterium
GDPNDP

SEQ ID NO: 1204239 - protein, 5 aa, Mycobacterium
GDPNI

SEQ ID NO: 1204240 - protein, 14 aa, Mycobacterium
GDPPDYEPTPDKTV

SEQ ID NO: 1204241 - protein, 7 aa, Mycobacterium
GDPPHRV

SEQ ID NO: 1204242 - protein, 6 aa, Mycobacterium
GDPPTL

SEQ ID NO: 1204243 - protein, 16 aa, Mycobacterium
GDPPVVETEPGVGYRI

SEQ ID NO: 1204244 - protein, 4 aa, Mycobacterium
GDPQ

SEQ ID NO: 1204245 - protein, 7 aa, Mycobacterium
GDPQANV

SEQ ID NO: 1204246 - protein, 5 aa, Mycobacterium
GDPQG

SEQ ID NO: 1204247 - protein, 6 aa, Mycobacterium
GDPRAP

SEQ ID NO: 1204248 - protein, 19 aa, Mycobacterium
GDPRPGQRRAARAVTGDGT

SEQ ID NO: 1204249 - protein, 7 aa, Mycobacterium
GDPRRGH

SEQ ID NO: 1204250 - protein, 6 aa, Mycobacterium
GDPRTY

SEQ ID NO: 1204251 - protein, 18 aa, Mycobacterium
GDPSDGLPGVPGIGEKTA

SEQ ID NO: 1204252 - protein, 6 aa, Mycobacterium
GDPSGD

SEQ ID NO: 1204253 - protein, 9 aa, Mycobacterium
GDPSNDIAT

SEQ ID NO: 1204254 - protein, 16 aa, Mycobacterium
GDPSQKSDDVSGGGSY

SEQ ID NO: 1204255 - protein, 7 aa, Mycobacterium
GDPSSPD

SEQ ID NO: 1204256 - protein, 22 aa, Mycobacterium
GDPSVHAETDAFRNAGRQRGYR

SEQ ID NO: 1204257 - protein, 8 aa, Mycobacterium
GDPSVPSG

SEQ ID NO: 1204258 - protein, 6 aa, Mycobacterium
GDPSVY

SEQ ID NO: 1204259 - protein, 8 aa, Mycobacterium
GDPTAAGT

SEQ ID NO: 1204260 - protein, 11 aa, Mycobacterium
GDPTDGATQVG

SEQ ID NO: 1204261 - protein, 7 aa, Mycobacterium
GDPTDPA

SEQ ID NO: 1204262 - protein, 10 aa, Mycobacterium
GDPTDPEEAF

SEQ ID NO: 1204263 - protein, 5 aa, Mycobacterium
GDPTL

SEQ ID NO: 1204264 - protein, 7 aa, Mycobacterium
GDPTLTA

SEQ ID NO: 1204265 - protein, 12 aa, Mycobacterium
GDPTTATADEGR

SEQ ID NO: 1204266 - protein, 5 aa, Mycobacterium
GDPTV

SEQ ID NO: 1204267 - protein, 5 aa, Mycobacterium
GDPTY

SEQ ID NO: 1204268 - protein, 11 aa, Mycobacterium
GDPVDDATQMG

SEQ ID NO: 1204269 - protein, 8 aa, Mycobacterium
GDPVDPGT

SEQ ID NO: 1204270 - protein, 9 aa, Mycobacterium
GDPVDTAAR

SEQ ID NO: 1204271 - protein, 6 aa, Mycobacterium
GDPVEQ

SEQ ID NO: 1204272 - protein, 12 aa, Mycobacterium
GDPVERPVRGQA

SEQ ID NO: 1204273 - protein, 6 aa, Mycobacterium
GDQDAL

SEQ ID NO: 1204274 - protein, 4 aa, Mycobacterium
GDQE

SEQ ID NO: 1204275 - protein, 65 aa, Mycobacterium
GDQGAKDGQKGTPSGELPTAANREEGAAAAEPHAERAPEPEEKTDTDGGQRPGRHRAAESDERIE

SEQ ID NO: 1204276 - protein, 6 aa, Mycobacterium
GDQGVA

SEQ ID NO: 1204277 - protein, 8 aa, Mycobacterium
GDQIGEGD

SEQ ID NO: 1204278 - protein, 4 aa, Mycobacterium
GDQP

SEQ ID NO: 1204279 - protein, 7 aa, Mycobacterium
GDQPAPA

SEQ ID NO: 1204280 - protein, 6 aa, Mycobacterium
GDQPSL

SEQ ID NO: 1204281 - protein, 5 aa, Mycobacterium
GDQPW

SEQ ID NO: 1204282 - protein, 4 aa, Mycobacterium
GDQR

SEQ ID NO: 1204283 - protein, 28 aa, Mycobacterium
GDQRIRGRSGYQYASGETAETVDPARAG

SEQ ID NO: 1204284 - protein, 11 aa, Mycobacterium
GDQTDVPESGD

SEQ ID NO: 1204285 - protein, 14 aa, Mycobacterium
GDQTMTAPGGSEVP

SEQ ID NO: 1204286 - protein, 7 aa, Mycobacterium
GDQTPEL

SEQ ID NO: 1204287 - protein, 18 aa, Mycobacterium
GDQYDAGRKVPPSQAKRG

SEQ ID NO: 1204288 - protein, 18 aa, Mycobacterium
GDQYNTGRKIPPSQAKRG

SEQ ID NO: 1204289 - protein, 13 aa, Mycobacterium
GDQYRADVPAPEH

SEQ ID NO: 1204290 - protein, 10 aa, Mycobacterium
GDRAAQTGAQ

SEQ ID NO: 1204291 - protein, 15 aa, Mycobacterium
GDRAELEARVGRVLD

SEQ ID NO: 1204292 - protein, 6 aa, Mycobacterium
GDRAGS

SEQ ID NO: 1204293 - protein, 11 aa, Mycobacterium
GDRAPKTGAQV

SEQ ID NO: 1204294 - protein, 8 aa, Mycobacterium
GDRARAED

SEQ ID NO: 1204295 - protein, 9 aa, Mycobacterium
GDRARELRE

SEQ ID NO: 1204296 - protein, 12 aa, Mycobacterium
GDRARGSGRSPA

SEQ ID NO: 1204297 - protein, 5 aa, Mycobacterium
GDRAT

SEQ ID NO: 1204298 - protein, 17 aa, Mycobacterium
GDRATAADTRDRIDRAT

SEQ ID NO: 1204299 - protein, 4 aa, Mycobacterium
GDRD

SEQ ID NO: 1204300 - protein, 10 aa, Mycobacterium
GDRDAAQSRL

SEQ ID NO: 1204301 - protein, 8 aa, Mycobacterium
GDRDDARR

SEQ ID NO: 1204302 - protein, 5 aa, Mycobacterium
GDRDE

SEQ ID NO: 1204303 - protein, 8 aa, Mycobacterium
GDRDREDH

SEQ ID NO: 1204304 - protein, 18 aa, Mycobacterium
GDREPDVPSAAGRGRQDG

SEQ ID NO: 1204305 - protein, 5 aa, Mycobacterium
GDRET

SEQ ID NO: 1204306 - protein, 5 aa, Mycobacterium
GDRGF

SEQ ID NO: 1204307 - protein, 6 aa, Mycobacterium
GDRGGP

SEQ ID NO: 1204308 - protein, 14 aa, Mycobacterium
GDRGGRATVQSPIK

SEQ ID NO: 1204309 - protein, 10 aa, Mycobacterium
GDRGSDSAGV

SEQ ID NO: 1204310 - protein, 11 aa, Mycobacterium
GDRGTAEDLTS

SEQ ID NO: 1204311 - protein, 4 aa, Mycobacterium
GDRI

SEQ ID NO: 1204312 - protein, 9 aa, Mycobacterium
GDRIPGTPA

SEQ ID NO: 1204313 - protein, 4 aa, Mycobacterium
GDRL

SEQ ID NO: 1204314 - protein, 7 aa, Mycobacterium
GDRPAVP

SEQ ID NO: 1204315 - protein, 6 aa, Mycobacterium
GDRPSA

SEQ ID NO: 1204316 - protein, 7 aa, Mycobacterium
GDRPTAL

SEQ ID NO: 1204317 - protein, 9 aa, Mycobacterium
GDRQPEAEA

SEQ ID NO: 1204318 - protein, 6 aa, Mycobacterium
GDRSDA

SEQ ID NO: 1204319 - protein, 10 aa, Mycobacterium
GDRSGQPVSI

SEQ ID NO: 1204320 - protein, 6 aa, Mycobacterium
GDRSGV

SEQ ID NO: 1204321 - protein, 18 aa, Mycobacterium
GDRSLKGAMKGADRSGAS

SEQ ID NO: 1204322 - protein, 9 aa, Mycobacterium
GDRSPQTVA

SEQ ID NO: 1204323 - protein, 9 aa, Mycobacterium
GDRSQSARL

SEQ ID NO: 1204324 - protein, 9 aa, Mycobacterium
GDRSTAPRL

SEQ ID NO: 1204325 - protein, 9 aa, Mycobacterium
GDRTATTVK

SEQ ID NO: 1204326 - protein, 6 aa, Mycobacterium
GDRTGA

SEQ ID NO: 1204327 - protein, 10 aa, Mycobacterium
GDRTGASTPV

SEQ ID NO: 1204328 - protein, 13 aa, Mycobacterium
GDRTGTSRAAACG

SEQ ID NO: 1204329 - protein, 21 aa, Mycobacterium
GDRVPDRARDLRSAGAAAGLA

SEQ ID NO: 1204330 - protein, 5 aa, Mycobacterium
GDRVT

SEQ ID NO: 1204331 - protein, 6 aa, Mycobacterium
GDSAAT

SEQ ID NO: 1204332 - protein, 7 aa, Mycobacterium
GDSAEPT

SEQ ID NO: 1204333 - protein, 8 aa, Mycobacterium
GDSAGAAE

SEQ ID NO: 1204334 - protein, 8 aa, Mycobacterium
GDSAGGNL

SEQ ID NO: 1204335 - protein, 16 aa, Mycobacterium
GDSAPAVGSRVPQPEL

SEQ ID NO: 1204336 - protein, 8 aa, Mycobacterium
GDSAQIDG

SEQ ID NO: 1204337 - protein, 8 aa, Mycobacterium
GDSASSPA

SEQ ID NO: 1204338 - protein, 5 aa, Mycobacterium
GDSAT

SEQ ID NO: 1204339 - protein, 7 aa, Mycobacterium
GDSAVPR

SEQ ID NO: 1204340 - protein, 25 aa, Mycobacterium
GDSDRAPATPAVGAQGIPPADSLPR

SEQ ID NO: 1204341 - protein, 7 aa, Mycobacterium
GDSERTD

SEQ ID NO: 1204342 - protein, 27 aa, Mycobacterium
GDSGENLTIPDERSAEPPAIVEPAKPA

SEQ ID NO: 1204343 - protein, 11 aa, Mycobacterium
GDSGFTPRGEP

SEQ ID NO: 1204344 - protein, 14 aa, Mycobacterium
GDSGRGSRNRKADS

SEQ ID NO: 1204345 - protein, 9 aa, Mycobacterium
GDSGTGKTM

SEQ ID NO: 1204346 - protein, 6 aa, Mycobacterium
GDSGVT

SEQ ID NO: 1204347 - protein, 6 aa, Mycobacterium
GDSHRV

SEQ ID NO: 1204348 - protein, 19 aa, Mycobacterium
GDSKPDAEKDRPAPPRKAV

SEQ ID NO: 1204349 - protein, 6 aa, Mycobacterium
GDSMDG

SEQ ID NO: 1204350 - protein, 5 aa, Mycobacterium
GDSPC

SEQ ID NO: 1204351 - protein, 8 aa, Mycobacterium
GDSPDESL

SEQ ID NO: 1204352 - protein, 7 aa, Mycobacterium
GDSPGAV

SEQ ID NO: 1204353 - protein, 6 aa, Mycobacterium
GDSQIA

SEQ ID NO: 1204354 - protein, 4 aa, Mycobacterium
GDSR

SEQ ID NO: 1204355 - protein, 8 aa, Mycobacterium
GDSRAGLT

SEQ ID NO: 1204356 - protein, 6 aa, Mycobacterium
GDSRGL

SEQ ID NO: 1204357 - protein, 6 aa, Mycobacterium
GDSRTD

SEQ ID NO: 1204358 - protein, 11 aa, Mycobacterium
GDSSPGHPGDD

SEQ ID NO: 1204359 - protein, 8 aa, Mycobacterium
GDSSPTHW

SEQ ID NO: 1204360 - protein, 5 aa, Mycobacterium
GDSTA

SEQ ID NO: 1204361 - protein, 17 aa, Mycobacterium
GDSTTPGPNSTGMPGHN

SEQ ID NO: 1204362 - protein, 4 aa, Mycobacterium
GDSV

SEQ ID NO: 1204363 - protein, 6 aa, Mycobacterium
GDSVDV

SEQ ID NO: 1204364 - protein, 7 aa, Mycobacterium
GDSVTTV

SEQ ID NO: 1204365 - protein, 17 aa, Mycobacterium
GDSYPSLPTGDWREPPA

SEQ ID NO: 1204366 - protein, 18 aa, Mycobacterium
GDSYRMKDAKHRKEQSTP

SEQ ID NO: 1204367 - protein, 19 aa, Mycobacterium
GDTAAAAPTYSDVTTQVSA

SEQ ID NO: 1204368 - protein, 10 aa, Mycobacterium
GDTANDVESA

SEQ ID NO: 1204369 - protein, 7 aa, Mycobacterium
GDTASDV

SEQ ID NO: 1204370 - protein, 21 aa, Mycobacterium
GDTATIADNRGSAAARTASHL

SEQ ID NO: 1204371 - protein, 5 aa, Mycobacterium
GDTDG

SEQ ID NO: 1204372 - protein, 6 aa, Mycobacterium
GDTDRL

SEQ ID NO: 1204373 - protein, 5 aa, Mycobacterium
GDTDT

SEQ ID NO: 1204374 - protein, 7 aa, Mycobacterium
GDTESVR

SEQ ID NO: 1204375 - protein, 9 aa, Mycobacterium
GDTGAAAPE

SEQ ID NO: 1204376 - protein, 9 aa, Mycobacterium
GDTGANAPD

SEQ ID NO: 1204377 - protein, 5 aa, Mycobacterium
GDTGV

SEQ ID NO: 1204378 - protein, 5 aa, Mycobacterium
GDTGY

SEQ ID NO: 1204379 - protein, 5 aa, Mycobacterium
GDTIT

SEQ ID NO: 1204380 - protein, 8 aa, Mycobacterium
GDTNDELG

SEQ ID NO: 1204381 - protein, 7 aa, Mycobacterium
GDTPHEN

SEQ ID NO: 1204382 - protein, 5 aa, Mycobacterium
GDTPL

SEQ ID NO: 1204383 - protein, 14 aa, Mycobacterium
GDTQLTEDSTRGDG

SEQ ID NO: 1204384 - protein, 6 aa, Mycobacterium
GDTQTA

SEQ ID NO: 1204385 - protein, 5 aa, Mycobacterium
GDTRN

SEQ ID NO: 1204386 - protein, 10 aa, Mycobacterium
GDTSAEAEAH

SEQ ID NO: 1204387 - protein, 6 aa, Mycobacterium
GDTSAV

SEQ ID NO: 1204388 - protein, 8 aa, Mycobacterium
GDTSDLDN

SEQ ID NO: 1204389 - protein, 8 aa, Mycobacterium
GDTSSLSA

SEQ ID NO: 1204390 - protein, 6 aa, Mycobacterium
GDTTDE

SEQ ID NO: 1204391 - protein, 10 aa, Mycobacterium
GDTTPDAPKV

SEQ ID NO: 1204392 - protein, 4 aa, Mycobacterium
GDTV

SEQ ID NO: 1204393 - protein, 5 aa, Mycobacterium
GDTVP

SEQ ID NO: 1204394 - protein, 5 aa, Mycobacterium
GDTVT

SEQ ID NO: 1204395 - protein, 6 aa, Mycobacterium
GDTYPT

SEQ ID NO: 1204396 - protein, 9 aa, Mycobacterium
GDVARTRGW

SEQ ID NO: 1204397 - protein, 10 aa, Mycobacterium
GDVASRDADG

SEQ ID NO: 1204398 - protein, 6 aa, Mycobacterium
GDVDGD

SEQ ID NO: 1204399 - protein, 5 aa, Mycobacterium
GDVDK

SEQ ID NO: 1204400 - protein, 6 aa, Mycobacterium
GDVGAG

SEQ ID NO: 1204401 - protein, 8 aa, Mycobacterium
GDVGSLDA

SEQ ID NO: 1204402 - protein, 7 aa, Mycobacterium
GDVLPSQ

SEQ ID NO: 1204403 - protein, 6 aa, Mycobacterium
GDVPKP

SEQ ID NO: 1204404 - protein, 31 aa, Mycobacterium
GDVPPPPGWSDPAHPPGAYAPHGLPANPHPA

SEQ ID NO: 1204405 - protein, 5 aa, Mycobacterium
GDVRE

SEQ ID NO: 1204406 - protein, 9 aa, Mycobacterium
GDVSERDRA

SEQ ID NO: 1204407 - protein, 8 aa, Mycobacterium
GDVSPGDT

SEQ ID NO: 1204408 - protein, 5 aa, Mycobacterium
GDVSY

SEQ ID NO: 1204409 - protein, 13 aa, Mycobacterium
GDVTAIGPARDAE

SEQ ID NO: 1204410 - protein, 14 aa, Mycobacterium
GDVTALPDPPRPYR

SEQ ID NO: 1204411 - protein, 9 aa, Mycobacterium
GDVTGATRD

SEQ ID NO: 1204412 - protein, 15 aa, Mycobacterium
GDVTRYQNAKRTQEG

SEQ ID NO: 1204413 - protein, 34 aa, Mycobacterium
GDVVGSEQRPATPPPGSQPGVATDEQQSGRTADA

SEQ ID NO: 1204414 - protein, 9 aa, Mycobacterium
GDWGSGGTS

SEQ ID NO: 1204415 - protein, 19 aa, Mycobacterium
GDWPAAEASTPSHRSQASG

SEQ ID NO: 1204416 - protein, 4 aa, Mycobacterium
GDWQ

SEQ ID NO: 1204417 - protein, 11 aa, Mycobacterium
GDWQGASARLD

SEQ ID NO: 1204418 - protein, 14 aa, Mycobacterium
GDWSSGAGTPQQRL

SEQ ID NO: 1204419 - protein, 9 aa, Mycobacterium
GDYDPTDPL

SEQ ID NO: 1204420 - protein, 9 aa, Mycobacterium
GDYDSYRPT

SEQ ID NO: 1204421 - protein, 11 aa, Mycobacterium
GDYGPGSAMAR

SEQ ID NO: 1204422 - protein, 10 aa, Mycobacterium
GDYQDAESGQ

SEQ ID NO: 1204423 - protein, 8 aa, Mycobacterium
GDYQRSTT

SEQ ID NO: 1204424 - protein, 6 aa, Mycobacterium
GDYQST

SEQ ID NO: 1204425 - protein, 7 aa, Mycobacterium
GDYRAAA

SEQ ID NO: 1204426 - protein, 11 aa, Mycobacterium
GDYTRPGQQSL

SEQ ID NO: 1204427 - protein, 4 aa, Mycobacterium
GEAA

SEQ ID NO: 1204428 - protein, 22 aa, Mycobacterium
GEAADGQEPMSEAELEKLFLAL

SEQ ID NO: 1204429 - protein, 11 aa, Mycobacterium
GEAAGFGGGGV

SEQ ID NO: 1204430 - protein, 13 aa, Mycobacterium
GEAAGRALGGAYN

SEQ ID NO: 1204431 - protein, 9 aa, Mycobacterium
GEAAGTNRC

SEQ ID NO: 1204432 - protein, 6 aa, Mycobacterium
GEAAQQ

SEQ ID NO: 1204433 - protein, 7 aa, Mycobacterium
GEAAQSD

SEQ ID NO: 1204434 - protein, 9 aa, Mycobacterium
GEAASFDDA

SEQ ID NO: 1204435 - protein, 7 aa, Mycobacterium
GEACEAG

SEQ ID NO: 1204436 - protein, 9 aa, Mycobacterium
GEADADGAC

SEQ ID NO: 1204437 - protein, 5 aa, Mycobacterium
GEADD

SEQ ID NO: 1204438 - protein, 11 aa, Mycobacterium
GEADGQRVTTR

SEQ ID NO: 1204439 - protein, 13 aa, Mycobacterium
GEADIASDARDDI

SEQ ID NO: 1204440 - protein, 7 aa, Mycobacterium
GEADPIS

SEQ ID NO: 1204441 - protein, 10 aa, Mycobacterium
GEAENQVDGA

SEQ ID NO: 1204442 - protein, 14 aa, Mycobacterium
GEAEPAGRPDDPPF

SEQ ID NO: 1204443 - protein, 10 aa, Mycobacterium
GEAGATSNNR

SEQ ID NO: 1204444 - protein, 6 aa, Mycobacterium
GEAGED

SEQ ID NO: 1204445 - protein, 6 aa, Mycobacterium
GEAGKG

SEQ ID NO: 1204446 - protein, 13 aa, Mycobacterium
GEAGQTFDTPFGD

SEQ ID NO: 1204447 - protein, 9 aa, Mycobacterium
GEAGRGATI

SEQ ID NO: 1204448 - protein, 8 aa, Mycobacterium
GEAGRPVD

SEQ ID NO: 1204449 - protein, 6 aa, Mycobacterium
GEAGVG

SEQ ID NO: 1204450 - protein, 6 aa, Mycobacterium
GEAKHG

SEQ ID NO: 1204451 - protein, 9 aa, Mycobacterium
GEAKNTYGT

SEQ ID NO: 1204452 - protein, 8 aa, Mycobacterium
GEALPGEV

SEQ ID NO: 1204453 - protein, 20 aa, Mycobacterium
GEAMPARSSAVRVSSSTSLR

SEQ ID NO: 1204454 - protein, 4 aa, Mycobacterium
GEAN

SEQ ID NO: 1204455 - protein, 9 aa, Mycobacterium
GEAPEPSTY

SEQ ID NO: 1204456 - protein, 6 aa, Mycobacterium
GEAPGQ

SEQ ID NO: 1204457 - protein, 7 aa, Mycobacterium
GEAPPDI

SEQ ID NO: 1204458 - protein, 5 aa, Mycobacterium
GEAPT

SEQ ID NO: 1204459 - protein, 23 aa, Mycobacterium
GEAQANAAAAWQQEGRGRPAKRY

SEQ ID NO: 1204460 - protein, 11 aa, Mycobacterium
GEAREEQLSDS

SEQ ID NO: 1204461 - protein, 8 aa, Mycobacterium
GEARPGDR

SEQ ID NO: 1204462 - protein, 4 aa, Mycobacterium
GEAS

SEQ ID NO: 1204463 - protein, 5 aa, Mycobacterium
GEASR

SEQ ID NO: 1204464 - protein, 4 aa, Mycobacterium
GEAT

SEQ ID NO: 1204465 - protein, 8 aa, Mycobacterium
GEATGRSR

SEQ ID NO: 1204466 - protein, 6 aa, Mycobacterium
GEATPD

SEQ ID NO: 1204467 - protein, 6 aa, Mycobacterium
GEATPT

SEQ ID NO: 1204468 - protein, 5 aa, Mycobacterium
GEAVP

SEQ ID NO: 1204469 - protein, 9 aa, Mycobacterium
GEAVSASYD

SEQ ID NO: 1204470 - protein, 7 aa, Mycobacterium
GEAVSPA

SEQ ID NO: 1204471 - protein, 11 aa, Mycobacterium
GECGPRQTPDA

SEQ ID NO: 1204472 - protein, 6 aa, Mycobacterium
GECPGT

SEQ ID NO: 1204473 - protein, 14 aa, Mycobacterium
GECPPSGLSPHTDT

SEQ ID NO: 1204474 - protein, 7 aa, Mycobacterium
GECTGCG

SEQ ID NO: 1204475 - protein, 19 aa, Mycobacterium
GECTRDPERWTTTADDEAK

SEQ ID NO: 1204476 - protein, 8 aa, Mycobacterium
GEDARPWG

SEQ ID NO: 1204477 - protein, 18 aa, Mycobacterium
GEDARRRREGGGRPHHHH

SEQ ID NO: 1204478 - protein, 4 aa, Mycobacterium
GEDD

SEQ ID NO: 1204479 - protein, 5 aa, Mycobacterium
GEDDD

SEQ ID NO: 1204480 - protein, 10 aa, Mycobacterium
GEDDPEAEAA

SEQ ID NO: 1204481 - protein, 8 aa, Mycobacterium
GEDDSAKL

SEQ ID NO: 1204482 - protein, 10 aa, Mycobacterium
GEDEAADDEY

SEQ ID NO: 1204483 - protein, 8 aa, Mycobacterium
GEDGARHG

SEQ ID NO: 1204484 - protein, 8 aa, Mycobacterium
GEDGGKSV

SEQ ID NO: 1204485 - protein, 13 aa, Mycobacterium
GEDGKPVRSPRFP

SEQ ID NO: 1204486 - protein, 5 aa, Mycobacterium
GEDGL

SEQ ID NO: 1204487 - protein, 8 aa, Mycobacterium
GEDGRYRS

SEQ ID NO: 1204488 - protein, 7 aa, Mycobacterium
GEDGSRC

SEQ ID NO: 1204489 - protein, 7 aa, Mycobacterium
GEDGVGT

SEQ ID NO: 1204490 - protein, 8 aa, Mycobacterium
GEDKPTRA

SEQ ID NO: 1204491 - protein, 8 aa, Mycobacterium
GEDLPAEH

SEQ ID NO: 1204492 - protein, 16 aa, Mycobacterium
GEDLPQPGDSVTEDNL

SEQ ID NO: 1204493 - protein, 8 aa, Mycobacterium
GEDPAQLG

SEQ ID NO: 1204494 - protein, 8 aa, Mycobacterium
GEDPDIDE

SEQ ID NO: 1204495 - protein, 8 aa, Mycobacterium
GEDPDVAE

SEQ ID NO: 1204496 - protein, 6 aa, Mycobacterium
GEDPEF

SEQ ID NO: 1204497 - protein, 7 aa, Mycobacterium
GEDPGEL

SEQ ID NO: 1204498 - protein, 8 aa, Mycobacterium
GEDPGGVA

SEQ ID NO: 1204499 - protein, 7 aa, Mycobacterium
GEDPREV

SEQ ID NO: 1204500 - protein, 9 aa, Mycobacterium
GEDPSLTDL

SEQ ID NO: 1204501 - protein, 10 aa, Mycobacterium
GEDQAPQRVG

SEQ ID NO: 1204502 - protein, 6 aa, Mycobacterium
GEDRGG

SEQ ID NO: 1204503 - protein, 6 aa, Mycobacterium
GEDRRQ

SEQ ID NO: 1204504 - protein, 7 aa, Mycobacterium
GEDRSGI

SEQ ID NO: 1204505 - protein, 4 aa, Mycobacterium
GEDS

SEQ ID NO: 1204506 - protein, 7 aa, Mycobacterium
GEDTTKA

SEQ ID NO: 1204507 - protein, 5 aa, Mycobacterium
GEDVE

SEQ ID NO: 1204508 - protein, 11 aa, Mycobacterium
GEDYTPLGSTD

SEQ ID NO: 1204509 - protein, 4 aa, Mycobacterium
GEEA

SEQ ID NO: 1204510 - protein, 13 aa, Mycobacterium
GEEAGQAWLLARR

SEQ ID NO: 1204511 - protein, 7 aa, Mycobacterium
GEEATTV

SEQ ID NO: 1204512 - protein, 5 aa, Mycobacterium
GEEAV

SEQ ID NO: 1204513 - protein, 10 aa, Mycobacterium
GEEEGGSVDV

SEQ ID NO: 1204514 - protein, 4 aa, Mycobacterium
GEEG

SEQ ID NO: 1204515 - protein, 6 aa, Mycobacterium
GEEGEV

SEQ ID NO: 1204516 - protein, 6 aa, Mycobacterium
GEEGHH

SEQ ID NO: 1204517 - protein, 6 aa, Mycobacterium
GEEGLA

SEQ ID NO: 1204518 - protein, 8 aa, Mycobacterium
GEEIESTC

SEQ ID NO: 1204519 - protein, 9 aa, Mycobacterium
GEEITPQTA

SEQ ID NO: 1204520 - protein, 4 aa, Mycobacterium
GEEL

SEQ ID NO: 1204521 - protein, 5 aa, Mycobacterium
GEENF

SEQ ID NO: 1204522 - protein, 5 aa, Mycobacterium
GEEPG

SEQ ID NO: 1204523 - protein, 6 aa, Mycobacterium
GEEQDR

SEQ ID NO: 1204524 - protein, 10 aa, Mycobacterium
GEEQELRQSR

SEQ ID NO: 1204525 - protein, 8 aa, Mycobacterium
GEEQQAER

SEQ ID NO: 1204526 - protein, 4 aa, Mycobacterium
GEES

SEQ ID NO: 1204527 - protein, 10 aa, Mycobacterium
GEESADDNVV

SEQ ID NO: 1204528 - protein, 8 aa, Mycobacterium
GEESAGQI

SEQ ID NO: 1204529 - protein, 4 aa, Mycobacterium
GEET

SEQ ID NO: 1204530 - protein, 12 aa, Mycobacterium
GEETEADSHPEL

SEQ ID NO: 1204531 - protein, 6 aa, Mycobacterium
GEETGY

SEQ ID NO: 1204532 - protein, 4 aa, Mycobacterium
GEFA

SEQ ID NO: 1204533 - protein, 11 aa, Mycobacterium
GEFDARRRTQQ

SEQ ID NO: 1204534 - protein, 8 aa, Mycobacterium
GEFNRDTE

SEQ ID NO: 1204535 - protein, 12 aa, Mycobacterium
GEFRDADNSPFA

SEQ ID NO: 1204536 - protein, 9 aa, Mycobacterium
GEFSSQPSA

SEQ ID NO: 1204537 - protein, 11 aa, Mycobacterium
GEGALPDPGPI

SEQ ID NO: 1204538 - protein, 11 aa, Mycobacterium
GEGDLDRNVTR

SEQ ID NO: 1204539 - protein, 10 aa, Mycobacterium
GEGDTAPGRK

SEQ ID NO: 1204540 - protein, 8 aa, Mycobacterium
GEGEAPKL

SEQ ID NO: 1204541 - protein, 11 aa, Mycobacterium
GEGEGRAAHGD

SEQ ID NO: 1204542 - protein, 27 aa, Mycobacterium
GEGEKTIYAGDTSAQFQPAEPFAFLAV

SEQ ID NO: 1204543 - protein, 15 aa, Mycobacterium
GEGERTDPLSGLTEQ

SEQ ID NO: 1204544 - protein, 5 aa, Mycobacterium
GEGET

SEQ ID NO: 1204545 - protein, 23 aa, Mycobacterium
GEGGFGGDRGPSGSSAAPDRAPD

SEQ ID NO: 1204546 - protein, 12 aa, Mycobacterium
GEGGNLGVTSRG

SEQ ID NO: 1204547 - protein, 15 aa, Mycobacterium
GEGGNLGVTSRGRTE

SEQ ID NO: 1204548 - protein, 9 aa, Mycobacterium
GEGGPFAAS

SEQ ID NO: 1204549 - protein, 14 aa, Mycobacterium
GEGGRAVGHAERGA

SEQ ID NO: 1204550 - protein, 20 aa, Mycobacterium
GEGGVKGLTGPEKALARSNA

SEQ ID NO: 1204551 - protein, 7 aa, Mycobacterium
GEGGVTA

SEQ ID NO: 1204552 - protein, 8 aa, Mycobacterium
GEGMANPA

SEQ ID NO: 1204553 - protein, 14 aa, Mycobacterium
GEGNKKLSKRDPQS

SEQ ID NO: 1204554 - protein, 9 aa, Mycobacterium
GEGNPRTRS

SEQ ID NO: 1204555 - protein, 9 aa, Mycobacterium
GEGPGSAER

SEQ ID NO: 1204556 - protein, 9 aa, Mycobacterium
GEGPPAVET

SEQ ID NO: 1204557 - protein, 4 aa, Mycobacterium
GEGQ

SEQ ID NO: 1204558 - protein, 17 aa, Mycobacterium
GEGQPSLARTSTSDQQS

SEQ ID NO: 1204559 - protein, 5 aa, Mycobacterium
GEGQV

SEQ ID NO: 1204560 - protein, 7 aa, Mycobacterium
GEGRGSV

SEQ ID NO: 1204561 - protein, 13 aa, Mycobacterium
GEGRPDKRYLGTG

SEQ ID NO: 1204562 - protein, 5 aa, Mycobacterium
GEGRT

SEQ ID NO: 1204563 - protein, 5 aa, Mycobacterium
GEGSF

SEQ ID NO: 1204564 - protein, 5 aa, Mycobacterium
GEGSG

SEQ ID NO: 1204565 - protein, 6 aa, Mycobacterium
GEGSGD

SEQ ID NO: 1204566 - protein, 8 aa, Mycobacterium
GEGVTPDQ

SEQ ID NO: 1204567 - protein, 7 aa, Mycobacterium
GEGVTSA

SEQ ID NO: 1204568 - protein, 11 aa, Mycobacterium
GEHADPELDGA

SEQ ID NO: 1204569 - protein, 4 aa, Mycobacterium
GEHD

SEQ ID NO: 1204570 - protein, 7 aa, Mycobacterium
GEHGRTL

SEQ ID NO: 1204571 - protein, 11 aa, Mycobacterium
GEHGSTFGGNP

SEQ ID NO: 1204572 - protein, 16 aa, Mycobacterium
GEHGTVDPHDQARSIA

SEQ ID NO: 1204573 - protein, 9 aa, Mycobacterium
GEHHQKNRD

SEQ ID NO: 1204574 - protein, 12 aa, Mycobacterium
GEHHRNDQASYR

SEQ ID NO: 1204575 - protein, 6 aa, Mycobacterium
GEHPDW

SEQ ID NO: 1204576 - protein, 6 aa, Mycobacterium
GEHPGR

SEQ ID NO: 1204577 - protein, 13 aa, Mycobacterium
GEHPYSPITPESI

SEQ ID NO: 1204578 - protein, 21 aa, Mycobacterium
GEHQTYKVTTTEGYTVTGTEN

SEQ ID NO: 1204579 - protein, 10 aa, Mycobacterium
GEHQVPGARK

SEQ ID NO: 1204580 - protein, 16 aa, Mycobacterium
GEHRDRRAAPGGAHIV

SEQ ID NO: 1204581 - protein, 14 aa, Mycobacterium
GEHRQAPGGAEGVD

SEQ ID NO: 1204582 - protein, 4 aa, Mycobacterium
GEHT

SEQ ID NO: 1204583 - protein, 6 aa, Mycobacterium
GEHTRE

SEQ ID NO: 1204584 - protein, 6 aa, Mycobacterium
GEIAGV

SEQ ID NO: 1204585 - protein, 6 aa, Mycobacterium
GEIASG

SEQ ID NO: 1204586 - protein, 5 aa, Mycobacterium
GEIDD

SEQ ID NO: 1204587 - protein, 6 aa, Mycobacterium
GEIEAA

SEQ ID NO: 1204588 - protein, 6 aa, Mycobacterium
GEIGMR

SEQ ID NO: 1204589 - protein, 9 aa, Mycobacterium
GEIGTSPLR

SEQ ID NO: 1204590 - protein, 4 aa, Mycobacterium
GEIR

SEQ ID NO: 1204591 - protein, 24 aa, Mycobacterium
GEIRGADNSPFAPALPASQGGNEL

SEQ ID NO: 1204592 - protein, 14 aa, Mycobacterium
GEISPGTRLPSERE

SEQ ID NO: 1204593 - protein, 7 aa, Mycobacterium
GEITQDT

SEQ ID NO: 1204594 - protein, 7 aa, Mycobacterium
GEKAKRA

SEQ ID NO: 1204595 - protein, 5 aa, Mycobacterium
GEKEQ

SEQ ID NO: 1204596 - protein, 4 aa, Mycobacterium
GEKG

SEQ ID NO: 1204597 - protein, 11 aa, Mycobacterium
GEKGTAKSTAV

SEQ ID NO: 1204598 - protein, 9 aa, Mycobacterium
GEKHGGVKP

SEQ ID NO: 1204599 - protein, 4 aa, Mycobacterium
GEKL

SEQ ID NO: 1204600 - protein, 5 aa, Mycobacterium
GEKLT

SEQ ID NO: 1204601 - protein, 9 aa, Mycobacterium
GEKMSKSVG

SEQ ID NO: 1204602 - protein, 9 aa, Mycobacterium
GEKPPGGKV

SEQ ID NO: 1204603 - protein, 5 aa, Mycobacterium
GEKRS

SEQ ID NO: 1204604 - protein, 4 aa, Mycobacterium
GEKV

SEQ ID NO: 1204605 - protein, 5 aa, Mycobacterium
GEKVY

SEQ ID NO: 1204606 - protein, 14 aa, Mycobacterium
GELAAEQQRNGRTV

SEQ ID NO: 1204607 - protein, 7 aa, Mycobacterium
GELADEG

SEQ ID NO: 1204608 - protein, 4 aa, Mycobacterium
GELD

SEQ ID NO: 1204609 - protein, 6 aa, Mycobacterium
GELDGT

SEQ ID NO: 1204610 - protein, 8 aa, Mycobacterium
GELDRPDD

SEQ ID NO: 1204611 - protein, 5 aa, Mycobacterium
GELGA

SEQ ID NO: 1204612 - protein, 5 aa, Mycobacterium
GELGG

SEQ ID NO: 1204613 - protein, 17 aa, Mycobacterium
GELGPDGQEGEADYRSR

SEQ ID NO: 1204614 - protein, 6 aa, Mycobacterium
GELKNT

SEQ ID NO: 1204615 - protein, 5 aa, Mycobacterium
GELKP

SEQ ID NO: 1204616 - protein, 17 aa, Mycobacterium
GELPDDGGHQIDTTPPV

SEQ ID NO: 1204617 - protein, 15 aa, Mycobacterium
GELPDNTHLALTLRS

SEQ ID NO: 1204618 - protein, 5 aa, Mycobacterium
GELPR

SEQ ID NO: 1204619 - protein, 13 aa, Mycobacterium
GELPTNTDGGGLS

SEQ ID NO: 1204620 - protein, 9 aa, Mycobacterium
GELSDEDVE

SEQ ID NO: 1204621 - protein, 11 aa, Mycobacterium
GELSGERAETF

SEQ ID NO: 1204622 - protein, 9 aa, Mycobacterium
GELSGGQRR

SEQ ID NO: 1204623 - protein, 6 aa, Mycobacterium
GELSRE

SEQ ID NO: 1204624 - protein, 7 aa, Mycobacterium
GELTGSG

SEQ ID NO: 1204625 - protein, 9 aa, Mycobacterium
GELTPGTRL

SEQ ID NO: 1204626 - protein, 18 aa, Mycobacterium
GELTTEELDTNDAESPVG

SEQ ID NO: 1204627 - protein, 9 aa, Mycobacterium
GEMPAPDDD

SEQ ID NO: 1204628 - protein, 13 aa, Mycobacterium
GEMRPGETLPSER

SEQ ID NO: 1204629 - protein, 4 aa, Mycobacterium
GEND

SEQ ID NO: 1204630 - protein, 5 aa, Mycobacterium
GENDN

SEQ ID NO: 1204631 - protein, 9 aa, Mycobacterium
GENGESVPP

SEQ ID NO: 1204632 - protein, 12 aa, Mycobacterium
GENGETVDEDTP

SEQ ID NO: 1204633 - protein, 7 aa, Mycobacterium
GENGKPV

SEQ ID NO: 1204634 - protein, 18 aa, Mycobacterium
GENNGRTSWRNGQGQSIS

SEQ ID NO: 1204635 - protein, 5 aa, Mycobacterium
GENPR

SEQ ID NO: 1204636 - protein, 7 aa, Mycobacterium
GENTEGL

SEQ ID NO: 1204637 - protein, 22 aa, Mycobacterium
GEPAAAASGATYDSVDPYTGRP

SEQ ID NO: 1204638 - protein, 9 aa, Mycobacterium
GEPAAGAAT

SEQ ID NO: 1204639 - protein, 9 aa, Mycobacterium
GEPAHDPDF

SEQ ID NO: 1204640 - protein, 13 aa, Mycobacterium
GEPANATGETVTT

SEQ ID NO: 1204641 - protein, 20 aa, Mycobacterium
GEPAPPIYDPTADTDGHDGG

SEQ ID NO: 1204642 - protein, 14 aa, Mycobacterium
GEPARYDADATPQV

SEQ ID NO: 1204643 - protein, 7 aa, Mycobacterium
GEPATLG

SEQ ID NO: 1204644 - protein, 5 aa, Mycobacterium
GEPCR

SEQ ID NO: 1204645 - protein, 9 aa, Mycobacterium
GEPDEDGVE

SEQ ID NO: 1204646 - protein, 7 aa, Mycobacterium
GEPDPRH

SEQ ID NO: 1204647 - protein, 8 aa, Mycobacterium
GEPDRHAH

SEQ ID NO: 1204648 - protein, 8 aa, Mycobacterium
GEPEADIS

SEQ ID NO: 1204649 - protein, 9 aa, Mycobacterium
GEPEEHGEV

SEQ ID NO: 1204650 - protein, 6 aa, Mycobacterium
GEPEEV

SEQ ID NO: 1204651 - protein, 9 aa, Mycobacterium
GEPEHQTPP

SEQ ID NO: 1204652 - protein, 16 aa, Mycobacterium
GEPEKPLTAADYSRTR

SEQ ID NO: 1204653 - protein, 10 aa, Mycobacterium
GEPESARERL

SEQ ID NO: 1204654 - protein, 13 aa, Mycobacterium
GEPGASSGPGDRP

SEQ ID NO: 1204655 - protein, 10 aa, Mycobacterium
GEPGLGNGGL

SEQ ID NO: 1204656 - protein, 18 aa, Mycobacterium
GEPGQPLDERRRPDSPLR

SEQ ID NO: 1204657 - protein, 7 aa, Mycobacterium
GEPGTGF

SEQ ID NO: 1204658 - protein, 6 aa, Mycobacterium
GEPGVA

SEQ ID NO: 1204659 - protein, 15 aa, Mycobacterium
GEPGVAEEAMPTAAG

SEQ ID NO: 1204660 - protein, 15 aa, Mycobacterium
GEPGVAEKAMPTAAG

SEQ ID NO: 1204661 - protein, 5 aa, Mycobacterium
GEPHW

SEQ ID NO: 1204662 - protein, 4 aa, Mycobacterium
GEPI

SEQ ID NO: 1204663 - protein, 5 aa, Mycobacterium
GEPID

SEQ ID NO: 1204664 - protein, 6 aa, Mycobacterium
GEPIGA

SEQ ID NO: 1204665 - protein, 5 aa, Mycobacterium
GEPIS

SEQ ID NO: 1204666 - protein, 7 aa, Mycobacterium
GEPKDVG

SEQ ID NO: 1204667 - protein, 21 aa, Mycobacterium
GEPLEADGSPNRGYKVRPKGG

SEQ ID NO: 1204668 - protein, 10 aa, Mycobacterium
GEPLEPEATA

SEQ ID NO: 1204669 - protein, 12 aa, Mycobacterium
GEPLTAEQTARA

SEQ ID NO: 1204670 - protein, 9 aa, Mycobacterium
GEPLTGKEA

SEQ ID NO: 1204671 - protein, 10 aa, Mycobacterium
GEPNKIGRPR

SEQ ID NO: 1204672 - protein, 5 aa, Mycobacterium
GEPPL

SEQ ID NO: 1204673 - protein, 15 aa, Mycobacterium
GEPPLGTETGEDVAD

SEQ ID NO: 1204674 - protein, 13 aa, Mycobacterium
GEPPQVPQSQQRG

SEQ ID NO: 1204675 - protein, 5 aa, Mycobacterium
GEPQD

SEQ ID NO: 1204676 - protein, 7 aa, Mycobacterium
GEPQTVR

SEQ ID NO: 1204677 - protein, 5 aa, Mycobacterium
GEPRA

SEQ ID NO: 1204678 - protein, 10 aa, Mycobacterium
GEPRDDVTAD

SEQ ID NO: 1204679 - protein, 6 aa, Mycobacterium
GEPREP

SEQ ID NO: 1204680 - protein, 6 aa, Mycobacterium
GEPRHG

SEQ ID NO: 1204681 - protein, 7 aa, Mycobacterium
GEPRRPA

SEQ ID NO: 1204682 - protein, 5 aa, Mycobacterium
GEPRV

SEQ ID NO: 1204683 - protein, 12 aa, Mycobacterium
GEPSAGTPKGPW

SEQ ID NO: 1204684 - protein, 7 aa, Mycobacterium
GEPSGGL

SEQ ID NO: 1204685 - protein, 23 aa, Mycobacterium
GEPTAAQLATAQKATRPTKPEQL

SEQ ID NO: 1204686 - protein, 7 aa, Mycobacterium
GEPTDAA

SEQ ID NO: 1204687 - protein, 15 aa, Mycobacterium
GEPTKFASPAEALGK

SEQ ID NO: 1204688 - protein, 6 aa, Mycobacterium
GEPTLE

SEQ ID NO: 1204689 - protein, 7 aa, Mycobacterium
GEPTQGM

SEQ ID NO: 1204690 - protein, 8 aa, Mycobacterium
GEPVRATT

SEQ ID NO: 1204691 - protein, 9 aa, Mycobacterium
GEPVTKGYT

SEQ ID NO: 1204692 - protein, 9 aa, Mycobacterium
GEQAEYAER

SEQ ID NO: 1204693 - protein, 5 aa, Mycobacterium
GEQAR

SEQ ID NO: 1204694 - protein, 7 aa, Mycobacterium
GEQDRPL

SEQ ID NO: 1204695 - protein, 7 aa, Mycobacterium
GEQGQRI

SEQ ID NO: 1204696 - protein, 5 aa, Mycobacterium
GEQKT

SEQ ID NO: 1204697 - protein, 32 aa, Mycobacterium
GEQLPAGGATQATPAQSPATPAANPAPENPLS

SEQ ID NO: 1204698 - protein, 4 aa, Mycobacterium
GEQN

SEQ ID NO: 1204699 - protein, 11 aa, Mycobacterium
GEQPEGYTEGD

SEQ ID NO: 1204700 - protein, 10 aa, Mycobacterium
GEQPPGPRWS

SEQ ID NO: 1204701 - protein, 7 aa, Mycobacterium
GEQSNNI

SEQ ID NO: 1204702 - protein, 8 aa, Mycobacterium
GEQSPDAD

SEQ ID NO: 1204703 - protein, 11 aa, Mycobacterium
GEQSRSPEPVG

SEQ ID NO: 1204704 - protein, 8 aa, Mycobacterium
GEQTVPGL

SEQ ID NO: 1204705 - protein, 7 aa, Mycobacterium
GERAAAA

SEQ ID NO: 1204706 - protein, 10 aa, Mycobacterium
GERAAPPEDC

SEQ ID NO: 1204707 - protein, 11 aa, Mycobacterium
GERADDEVQQH

SEQ ID NO: 1204708 - protein, 6 aa, Mycobacterium
GERADG

SEQ ID NO: 1204709 - protein, 10 aa, Mycobacterium
GERAETIAEA

SEQ ID NO: 1204710 - protein, 5 aa, Mycobacterium
GERAF

SEQ ID NO: 1204711 - protein, 5 aa, Mycobacterium
GERAT

SEQ ID NO: 1204712 - protein, 7 aa, Mycobacterium
GERDDVK

SEQ ID NO: 1204713 - protein, 8 aa, Mycobacterium
GERDQHGN

SEQ ID NO: 1204714 - protein, 10 aa, Mycobacterium
GERDSGEEKL

SEQ ID NO: 1204715 - protein, 4 aa, Mycobacterium
GERF

SEQ ID NO: 1204716 - protein, 4 aa, Mycobacterium
GERG

SEQ ID NO: 1204717 - protein, 14 aa, Mycobacterium
GERGANNEEATADD

SEQ ID NO: 1204718 - protein, 7 aa, Mycobacterium
GERGRGY

SEQ ID NO: 1204719 - protein, 6 aa, Mycobacterium
GERGRP

SEQ ID NO: 1204720 - protein, 6 aa, Mycobacterium
GERGSG

SEQ ID NO: 1204721 - protein, 9 aa, Mycobacterium
GERHPDNPD

SEQ ID NO: 1204722 - protein, 6 aa, Mycobacterium
GERIHP

SEQ ID NO: 1204723 - protein, 7 aa, Mycobacterium
GERISRG

SEQ ID NO: 1204724 - protein, 6 aa, Mycobacterium
GERNSY

SEQ ID NO: 1204725 - protein, 16 aa, Mycobacterium
GERPRLTGEKRDLDTA

SEQ ID NO: 1204726 - protein, 10 aa, Mycobacterium
GERPVDLPPG

SEQ ID NO: 1204727 - protein, 5 aa, Mycobacterium
GERRA

SEQ ID NO: 1204728 - protein, 5 aa, Mycobacterium
GERRH

SEQ ID NO: 1204729 - protein, 22 aa, Mycobacterium
GERSPDHAAAQQQGRREAAGDD

SEQ ID NO: 1204730 - protein, 6 aa, Mycobacterium
GERSSE

SEQ ID NO: 1204731 - protein, 5 aa, Mycobacterium
GERSY

SEQ ID NO: 1204732 - protein, 7 aa, Mycobacterium
GERTAEG

SEQ ID NO: 1204733 - protein, 6 aa, Mycobacterium
GERTDG

SEQ ID NO: 1204734 - protein, 6 aa, Mycobacterium
GERTGR

SEQ ID NO: 1204735 - protein, 13 aa, Mycobacterium
GERTPTVHRDGAG

SEQ ID NO: 1204736 - protein, 13 aa, Mycobacterium
GERVNERSTKDRD

SEQ ID NO: 1204737 - protein, 8 aa, Mycobacterium
GESADDKT

SEQ ID NO: 1204738 - protein, 8 aa, Mycobacterium
GESATLTH

SEQ ID NO: 1204739 - protein, 5 aa, Mycobacterium
GESAV

SEQ ID NO: 1204740 - protein, 9 aa, Mycobacterium
GESFPTGRA

SEQ ID NO: 1204741 - protein, 5 aa, Mycobacterium
GESGE

SEQ ID NO: 1204742 - protein, 8 aa, Mycobacterium
GESGGGNL

SEQ ID NO: 1204743 - protein, 10 aa, Mycobacterium
GESGSGKSTV

SEQ ID NO: 1204744 - protein, 9 aa, Mycobacterium
GESGSGKTM

SEQ ID NO: 1204745 - protein, 9 aa, Mycobacterium
GESGSGKTT

SEQ ID NO: 1204746 - protein, 11 aa, Mycobacterium
GESGTERTQWR

SEQ ID NO: 1204747 - protein, 5 aa, Mycobacterium
GESIG

SEQ ID NO: 1204748 - protein, 4 aa, Mycobacterium
GESK

SEQ ID NO: 1204749 - protein, 6 aa, Mycobacterium
GESMTP

SEQ ID NO: 1204750 - protein, 6 aa, Mycobacterium
GESMTT

SEQ ID NO: 1204751 - protein, 8 aa, Mycobacterium
GESPGPHA

SEQ ID NO: 1204752 - protein, 6 aa, Mycobacterium
GESPKV

SEQ ID NO: 1204753 - protein, 5 aa, Mycobacterium
GESPT

SEQ ID NO: 1204754 - protein, 8 aa, Mycobacterium
GESRGRPI

SEQ ID NO: 1204755 - protein, 6 aa, Mycobacterium
GESRIQ

SEQ ID NO: 1204756 - protein, 10 aa, Mycobacterium
GESRNDSSSR

SEQ ID NO: 1204757 - protein, 6 aa, Mycobacterium
GESRQQ

SEQ ID NO: 1204758 - protein, 11 aa, Mycobacterium
GESRRSARRSA

SEQ ID NO: 1204759 - protein, 9 aa, Mycobacterium
GESRRTARK

SEQ ID NO: 1204760 - protein, 6 aa, Mycobacterium
GESSGI

SEQ ID NO: 1204761 - protein, 6 aa, Mycobacterium
GESSGR

SEQ ID NO: 1204762 - protein, 6 aa, Mycobacterium
GESTGL

SEQ ID NO: 1204763 - protein, 6 aa, Mycobacterium
GESTGV

SEQ ID NO: 1204764 - protein, 12 aa, Mycobacterium
GETAEQITAQPG

SEQ ID NO: 1204765 - protein, 8 aa, Mycobacterium
GETAGDFP

SEQ ID NO: 1204766 - protein, 6 aa, Mycobacterium
GETAGL

SEQ ID NO: 1204767 - protein, 8 aa, Mycobacterium
GETAPEQE

SEQ ID NO: 1204768 - protein, 15 aa, Mycobacterium
GETAQLQRRTGVAPG

SEQ ID NO: 1204769 - protein, 9 aa, Mycobacterium
GETDDPAVQ

SEQ ID NO: 1204770 - protein, 10 aa, Mycobacterium
GETDPKYTDV

SEQ ID NO: 1204771 - protein, 21 aa, Mycobacterium
GETEDNSGGDGRDSARSNFSA

SEQ ID NO: 1204772 - protein, 19 aa, Mycobacterium
GETEQHGAGDGRDSARANF

SEQ ID NO: 1204773 - protein, 8 aa, Mycobacterium
GETGARGL

SEQ ID NO: 1204774 - protein, 10 aa, Mycobacterium
GETGGGRPAF

SEQ ID NO: 1204775 - protein, 7 aa, Mycobacterium
GETGGNA

SEQ ID NO: 1204776 - protein, 10 aa, Mycobacterium
GETGPDPRSY

SEQ ID NO: 1204777 - protein, 12 aa, Mycobacterium
GETGPGDSDSVH

SEQ ID NO: 1204778 - protein, 8 aa, Mycobacterium
GETGSAAP

SEQ ID NO: 1204779 - protein, 8 aa, Mycobacterium
GETISSAQ

SEQ ID NO: 1204780 - protein, 9 aa, Mycobacterium
GETKLGEKY

SEQ ID NO: 1204781 - protein, 4 aa, Mycobacterium
GETM

SEQ ID NO: 1204782 - protein, 11 aa, Mycobacterium
GETPDKALTGP

SEQ ID NO: 1204783 - protein, 6 aa, Mycobacterium
GETPDV

SEQ ID NO: 1204784 - protein, 6 aa, Mycobacterium
GETPQL

SEQ ID NO: 1204785 - protein, 7 aa, Mycobacterium
GETPSRQ

SEQ ID NO: 1204786 - protein, 7 aa, Mycobacterium
GETRPRD

SEQ ID NO: 1204787 - protein, 10 aa, Mycobacterium
GETSDKAEVA

SEQ ID NO: 1204788 - protein, 5 aa, Mycobacterium
GETSV

SEQ ID NO: 1204789 - protein, 6 aa, Mycobacterium
GEVDRR

SEQ ID NO: 1204790 - protein, 6 aa, Mycobacterium
GEVDSS

SEQ ID NO: 1204791 - protein, 20 aa, Mycobacterium
GEVEPVDPGPGVRPAATNEP

SEQ ID NO: 1204792 - protein, 10 aa, Mycobacterium
GEVGRERGGL

SEQ ID NO: 1204793 - protein, 7 aa, Mycobacterium
GEVNSSE

SEQ ID NO: 1204794 - protein, 8 aa, Mycobacterium
GEVPDDPV

SEQ ID NO: 1204795 - protein, 16 aa, Mycobacterium
GEVQAAQREAQSAFGD

SEQ ID NO: 1204796 - protein, 13 aa, Mycobacterium
GEVQPDAAAQNSY

SEQ ID NO: 1204797 - protein, 10 aa, Mycobacterium
GEVRDDVSAD

SEQ ID NO: 1204798 - protein, 10 aa, Mycobacterium
GEVRSDGAGD

SEQ ID NO: 1204799 - protein, 13 aa, Mycobacterium
GEVRTLTPSGPDA

SEQ ID NO: 1204800 - protein, 16 aa, Mycobacterium
GEVRTQNQPGTTNEYP

SEQ ID NO: 1204801 - protein, 4 aa, Mycobacterium
GEVS

SEQ ID NO: 1204802 - protein, 9 aa, Mycobacterium
GEVSSADVD

SEQ ID NO: 1204803 - protein, 7 aa, Mycobacterium
GEVSTDA

SEQ ID NO: 1204804 - protein, 5 aa, Mycobacterium
GEVTA

SEQ ID NO: 1204805 - protein, 11 aa, Mycobacterium
GEVTDDNGEPV

SEQ ID NO: 1204806 - protein, 8 aa, Mycobacterium
GEVTDSGR

SEQ ID NO: 1204807 - protein, 6 aa, Mycobacterium
GEWGRT

SEQ ID NO: 1204808 - protein, 6 aa, Mycobacterium
GEWNTQ

SEQ ID NO: 1204809 - protein, 4 aa, Mycobacterium
GEWP

SEQ ID NO: 1204810 - protein, 13 aa, Mycobacterium
GEWTPEREREAAD

SEQ ID NO: 1204811 - protein, 8 aa, Mycobacterium
GEYDDSEG

SEQ ID NO: 1204812 - protein, 5 aa, Mycobacterium
GEYPA

SEQ ID NO: 1204813 - protein, 7 aa, Mycobacterium
GEYPKPW

SEQ ID NO: 1204814 - protein, 10 aa, Mycobacterium
GEYTDPTDRR

SEQ ID NO: 1204815 - protein, 5 aa, Mycobacterium
GFADA

SEQ ID NO: 1204816 - protein, 13 aa, Mycobacterium
GFAGASSLSGLGG

SEQ ID NO: 1204817 - protein, 6 aa, Mycobacterium
GFAPET

SEQ ID NO: 1204818 - protein, 10 aa, Mycobacterium
GFASGTPDGL

SEQ ID NO: 1204819 - protein, 14 aa, Mycobacterium
GFATTTARVGGPVG

SEQ ID NO: 1204820 - protein, 9 aa, Mycobacterium
GFDASAPTA

SEQ ID NO: 1204821 - protein, 7 aa, Mycobacterium
GFDEDRA

SEQ ID NO: 1204822 - protein, 10 aa, Mycobacterium
GFDKEDADLR

SEQ ID NO: 1204823 - protein, 4 aa, Mycobacterium
GFDP

SEQ ID NO: 1204824 - protein, 7 aa, Mycobacterium
GFDPGQT

SEQ ID NO: 1204825 - protein, 6 aa, Mycobacterium
GFDPRD

SEQ ID NO: 1204826 - protein, 8 aa, Mycobacterium
GFDPTPQL

SEQ ID NO: 1204827 - protein, 8 aa, Mycobacterium
GFDPTRPT

SEQ ID NO: 1204828 - protein, 8 aa, Mycobacterium
GFDRPEDH

SEQ ID NO: 1204829 - protein, 11 aa, Mycobacterium
GFDSIDKGDLR

SEQ ID NO: 1204830 - protein, 5 aa, Mycobacterium
GFDTD

SEQ ID NO: 1204831 - protein, 6 aa, Mycobacterium
GFEDHG

SEQ ID NO: 1204832 - protein, 16 aa, Mycobacterium
GFEGDDTRSYTRYGSA

SEQ ID NO: 1204833 - protein, 16 aa, Mycobacterium
GFERSGNDFERHRGPL

SEQ ID NO: 1204834 - protein, 15 aa, Mycobacterium
GFETTSGESVVPDEN

SEQ ID NO: 1204835 - protein, 12 aa, Mycobacterium
GFGEAGGAGPGH

SEQ ID NO: 1204836 - protein, 9 aa, Mycobacterium
GFGELGDGR

SEQ ID NO: 1204837 - protein, 57 aa, Mycobacterium
GFGGGGGGGGMTSPASGGAPSTPPVMPSTGPNPTPPTLPTGGSLPPPVSPTMGPGGG

SEQ ID NO: 1204838 - protein, 5 aa, Mycobacterium
GFGGR

SEQ ID NO: 1204839 - protein, 4 aa, Mycobacterium
GFGP

SEQ ID NO: 1204840 - protein, 12 aa, Mycobacterium
GFGPGGGKFGPG

SEQ ID NO: 1204841 - protein, 4 aa, Mycobacterium
GFGR

SEQ ID NO: 1204842 - protein, 4 aa, Mycobacterium
GFGS

SEQ ID NO: 1204843 - protein, 14 aa, Mycobacterium
GFGSEGPDRETGAH

SEQ ID NO: 1204844 - protein, 8 aa, Mycobacterium
GFHPSQPV

SEQ ID NO: 1204845 - protein, 8 aa, Mycobacterium
GFPADSVT

SEQ ID NO: 1204846 - protein, 7 aa, Mycobacterium
GFPKPKA

SEQ ID NO: 1204847 - protein, 4 aa, Mycobacterium
GFPP

SEQ ID NO: 1204848 - protein, 7 aa, Mycobacterium
GFPTPAT

SEQ ID NO: 1204849 - protein, 17 aa, Mycobacterium
GFPTTGDSGFPGEQNIN

SEQ ID NO: 1204850 - protein, 8 aa, Mycobacterium
GFQGKSSV

SEQ ID NO: 1204851 - protein, 12 aa, Mycobacterium
GFRGQGASHGAQ

SEQ ID NO: 1204852 - protein, 15 aa, Mycobacterium
GFRPSGEHYGRTPTD

SEQ ID NO: 1204853 - protein, 10 aa, Mycobacterium
GFSASDGSSV

SEQ ID NO: 1204854 - protein, 12 aa, Mycobacterium
GFSEDPKALEPV

SEQ ID NO: 1204855 - protein, 9 aa, Mycobacterium
GFSGKPDYD

SEQ ID NO: 1204856 - protein, 10 aa, Mycobacterium
GFSGQPGPLN

SEQ ID NO: 1204857 - protein, 6 aa, Mycobacterium
GFSHQD

SEQ ID NO: 1204858 - protein, 8 aa, Mycobacterium
GFSPATQQ

SEQ ID NO: 1204859 - protein, 9 aa, Mycobacterium
GFSPDTQGK

SEQ ID NO: 1204860 - protein, 10 aa, Mycobacterium
GFSPGQNEQI

SEQ ID NO: 1204861 - protein, 7 aa, Mycobacterium
GFSPTTY

SEQ ID NO: 1204862 - protein, 5 aa, Mycobacterium
GFSTD

SEQ ID NO: 1204863 - protein, 7 aa, Mycobacterium
GFTDEGG

SEQ ID NO: 1204864 - protein, 8 aa, Mycobacterium
GFTDPDGQ

SEQ ID NO: 1204865 - protein, 13 aa, Mycobacterium
GFTPPSAQGHGGQ

SEQ ID NO: 1204866 - protein, 7 aa, Mycobacterium
GFTPRQV

SEQ ID NO: 1204867 - protein, 5 aa, Mycobacterium
GFTPS

SEQ ID NO: 1204868 - protein, 5 aa, Mycobacterium
GFTRG

SEQ ID NO: 1204869 - protein, 7 aa, Mycobacterium
GFTSDGL

SEQ ID NO: 1204870 - protein, 11 aa, Mycobacterium
GFTTAGGRHQA

SEQ ID NO: 1204871 - protein, 7 aa, Mycobacterium
GFVRGEG

SEQ ID NO: 1204872 - protein, 12 aa, Mycobacterium
GFYASGGGPLYT

SEQ ID NO: 1204873 - protein, 7 aa, Mycobacterium
GGAAAEA

SEQ ID NO: 1204874 - protein, 10 aa, Mycobacterium
GGAAEDRPAI

SEQ ID NO: 1204875 - protein, 8 aa, Mycobacterium
GGAAFGPA

SEQ ID NO: 1204876 - protein, 5 aa, Mycobacterium
GGAAG

SEQ ID NO: 1204877 - protein, 13 aa, Mycobacterium
GGAAGGPLGTGFP

SEQ ID NO: 1204878 - protein, 6 aa, Mycobacterium
GGAAPR

SEQ ID NO: 1204879 - protein, 16 aa, Mycobacterium
GGAATAVGGGARSPAT

SEQ ID NO: 1204880 - protein, 7 aa, Mycobacterium
GGAATGE

SEQ ID NO: 1204881 - protein, 6 aa, Mycobacterium
GGADAV

SEQ ID NO: 1204882 - protein, 10 aa, Mycobacterium
GGADFADDPV

SEQ ID NO: 1204883 - protein, 7 aa, Mycobacterium
GGADGEE

SEQ ID NO: 1204884 - protein, 9 aa, Mycobacterium
GGADGPQLR

SEQ ID NO: 1204885 - protein, 6 aa, Mycobacterium
GGADKV

SEQ ID NO: 1204886 - protein, 8 aa, Mycobacterium
GGADLPTQ

SEQ ID NO: 1204887 - protein, 6 aa, Mycobacterium
GGADSA

SEQ ID NO: 1204888 - protein, 6 aa, Mycobacterium
GGADSM

SEQ ID NO: 1204889 - protein, 20 aa, Mycobacterium
GGADVEPRRYGAEPAPETTG

SEQ ID NO: 1204890 - protein, 9 aa, Mycobacterium
GGAEADAVA

SEQ ID NO: 1204891 - protein, 17 aa, Mycobacterium
GGAEAQVSHRGKTRTMR

SEQ ID NO: 1204892 - protein, 10 aa, Mycobacterium
GGAEFPEADM

SEQ ID NO: 1204893 - protein, 5 aa, Mycobacterium
GGAEM

SEQ ID NO: 1204894 - protein, 8 aa, Mycobacterium
GGAESATA

SEQ ID NO: 1204895 - protein, 9 aa, Mycobacterium
GGAESPRES

SEQ ID NO: 1204896 - protein, 4 aa, Mycobacterium
GGAF

SEQ ID NO: 1204897 - protein, 5 aa, Mycobacterium
GGAFG

SEQ ID NO: 1204898 - protein, 72 aa, Mycobacterium
GGAFGSAGGGAFGSAGGGGGSWPAGGGAAFGSAGGGGGTGPGPGGGGAGAAGEGAGGGGGGVGCAPATEGIA

SEQ ID NO: 1204899 - protein, 29 aa, Mycobacterium
GGAGADGTAAAAGSAGVAPVAAGGTSTVE

SEQ ID NO: 1204900 - protein, 15 aa, Mycobacterium
GGAGGAGADGGAAGL

SEQ ID NO: 1204901 - protein, 11 aa, Mycobacterium
GGAGGQGGDGV

SEQ ID NO: 1204902 - protein, 9 aa, Mycobacterium
GGAGPARTG

SEQ ID NO: 1204903 - protein, 6 aa, Mycobacterium
GGAGQL

SEQ ID NO: 1204904 - protein, 5 aa, Mycobacterium
GGAGS

SEQ ID NO: 1204905 - protein, 9 aa, Mycobacterium
GGAGSGAER

SEQ ID NO: 1204906 - protein, 22 aa, Mycobacterium
GGAGSKAASHVADEPLTEAATS

SEQ ID NO: 1204907 - protein, 6 aa, Mycobacterium
GGAGTD

SEQ ID NO: 1204908 - protein, 10 aa, Mycobacterium
GGAGTTAAGL

SEQ ID NO: 1204909 - protein, 5 aa, Mycobacterium
GGAHG

SEQ ID NO: 1204910 - protein, 6 aa, Mycobacterium
GGAHGD

SEQ ID NO: 1204911 - protein, 6 aa, Mycobacterium
GGAHPQ

SEQ ID NO: 1204912 - protein, 8 aa, Mycobacterium
GGAKGPVR

SEQ ID NO: 1204913 - protein, 9 aa, Mycobacterium
GGAKRTPAL

SEQ ID NO: 1204914 - protein, 8 aa, Mycobacterium
GGAMPEGV

SEQ ID NO: 1204915 - protein, 12 aa, Mycobacterium
GGANPGVAGGAP

SEQ ID NO: 1204916 - protein, 6 aa, Mycobacterium
GGAPAW

SEQ ID NO: 1204917 - protein, 22 aa, Mycobacterium
GGAPEAPPDQDPAATTRRQNEI

SEQ ID NO: 1204918 - protein, 7 aa, Mycobacterium
GGAPFTG

SEQ ID NO: 1204919 - protein, 11 aa, Mycobacterium
GGAPPGSPIPV

SEQ ID NO: 1204920 - protein, 9 aa, Mycobacterium
GGAPQRGAI

SEQ ID NO: 1204921 - protein, 5 aa, Mycobacterium
GGAPV

SEQ ID NO: 1204922 - protein, 10 aa, Mycobacterium
GGAQLTPTAK

SEQ ID NO: 1204923 - protein, 8 aa, Mycobacterium
GGAQSPRE

SEQ ID NO: 1204924 - protein, 9 aa, Mycobacterium
GGAQSPRES

SEQ ID NO: 1204925 - protein, 11 aa, Mycobacterium
GGAQTAYDKSA

SEQ ID NO: 1204926 - protein, 13 aa, Mycobacterium
GGARGASPRQQSL

SEQ ID NO: 1204927 - protein, 10 aa, Mycobacterium
GGARGQGRSH

SEQ ID NO: 1204928 - protein, 6 aa, Mycobacterium
GGARPV

SEQ ID NO: 1204929 - protein, 19 aa, Mycobacterium
GGARPVRAEPMQQAGTIDK

SEQ ID NO: 1204930 - protein, 4 aa, Mycobacterium
GGAS

SEQ ID NO: 1204931 - protein, 11 aa, Mycobacterium
GGASADGSTLR

SEQ ID NO: 1204932 - protein, 8 aa, Mycobacterium
GGASAFDY

SEQ ID NO: 1204933 - protein, 20 aa, Mycobacterium
GGASEATGDDRSPESLDPTL

SEQ ID NO: 1204934 - protein, 6 aa, Mycobacterium
GGASEI

SEQ ID NO: 1204935 - protein, 18 aa, Mycobacterium
GGASEKAGAQVSKSAGSM

SEQ ID NO: 1204936 - protein, 16 aa, Mycobacterium
GGASGGAGQVYRGPGG

SEQ ID NO: 1204937 - protein, 8 aa, Mycobacterium
GGASGIGA

SEQ ID NO: 1204938 - protein, 11 aa, Mycobacterium
GGASGIGAGTA

SEQ ID NO: 1204939 - protein, 23 aa, Mycobacterium
GGASVTRATRLPGNRSDIRERST

SEQ ID NO: 1204940 - protein, 8 aa, Mycobacterium
GGATAGRA

SEQ ID NO: 1204941 - protein, 9 aa, Mycobacterium
GGATETATH

SEQ ID NO: 1204942 - protein, 6 aa, Mycobacterium
GGATSH

SEQ ID NO: 1204943 - protein, 18 aa, Mycobacterium
GGATSRGPVGRVRPGSDS

SEQ ID NO: 1204944 - protein, 7 aa, Mycobacterium
GGATSSA

SEQ ID NO: 1204945 - protein, 4 aa, Mycobacterium
GGAV

SEQ ID NO: 1204946 - protein, 12 aa, Mycobacterium
GGAVGAPAPKFG

SEQ ID NO: 1204947 - protein, 17 aa, Mycobacterium
GGAVGASRAAVDSGYYP

SEQ ID NO: 1204948 - protein, 8 aa, Mycobacterium
GGAVPPQR

SEQ ID NO: 1204949 - protein, 9 aa, Mycobacterium
GGAVTTEGV

SEQ ID NO: 1204950 - protein, 4 aa, Mycobacterium
GGAW

SEQ ID NO: 1204951 - protein, 13 aa, Mycobacterium
GGAYGRNKSVSRE

SEQ ID NO: 1204952 - protein, 9 aa, Mycobacterium
GGAYPAARA

SEQ ID NO: 1204953 - protein, 8 aa, Mycobacterium
GGCPADEA

SEQ ID NO: 1204954 - protein, 7 aa, Mycobacterium
GGCPPRQ

SEQ ID NO: 1204955 - protein, 9 aa, Mycobacterium
GGCTKPGCP

SEQ ID NO: 1204956 - protein, 6 aa, Mycobacterium
GGCTQE

SEQ ID NO: 1204957 - protein, 5 aa, Mycobacterium
GGCTT

SEQ ID NO: 1204958 - protein, 9 aa, Mycobacterium
GGDAKSWGD

SEQ ID NO: 1204959 - protein, 7 aa, Mycobacterium
GGDASTL

SEQ ID NO: 1204960 - protein, 6 aa, Mycobacterium
GGDAWQ

SEQ ID NO: 1204961 - protein, 7 aa, Mycobacterium
GGDDAAS

SEQ ID NO: 1204962 - protein, 14 aa, Mycobacterium
GGDDDEYKRGATVE

SEQ ID NO: 1204963 - protein, 16 aa, Mycobacterium
GGDDPEFTDATRAAAT

SEQ ID NO: 1204964 - protein, 16 aa, Mycobacterium
GGDDPEFTEATRAAAA

SEQ ID NO: 1204965 - protein, 6 aa, Mycobacterium
GGDDPY

SEQ ID NO: 1204966 - protein, 8 aa, Mycobacterium
GGDDRTSV

SEQ ID NO: 1204967 - protein, 5 aa, Mycobacterium
GGDEA

SEQ ID NO: 1204968 - protein, 6 aa, Mycobacterium
GGDEFA

SEQ ID NO: 1204969 - protein, 21 aa, Mycobacterium
GGDENKFPGEISGGMRKRAGL

SEQ ID NO: 1204970 - protein, 13 aa, Mycobacterium
GGDEPLARRAESS

SEQ ID NO: 1204971 - protein, 7 aa, Mycobacterium
GGDEPSL

SEQ ID NO: 1204972 - protein, 21 aa, Mycobacterium
GGDESKFPGEISGGMRKRAGL

SEQ ID NO: 1204973 - protein, 7 aa, Mycobacterium
GGDETVG

SEQ ID NO: 1204974 - protein, 4 aa, Mycobacterium
GGDG

SEQ ID NO: 1204975 - protein, 12 aa, Mycobacterium
GGDGEEGSEARA

SEQ ID NO: 1204976 - protein, 9 aa, Mycobacterium
GGDGHDAHA

SEQ ID NO: 1204977 - protein, 16 aa, Mycobacterium
GGDGPAGMTAEGASAV

SEQ ID NO: 1204978 - protein, 10 aa, Mycobacterium
GGDGPPTDQR

SEQ ID NO: 1204979 - protein, 17 aa, Mycobacterium
GGDGRPLSQTDGRIHHP

SEQ ID NO: 1204980 - protein, 7 aa, Mycobacterium
GGDGWSS

SEQ ID NO: 1204981 - protein, 7 aa, Mycobacterium
GGDHRKR

SEQ ID NO: 1204982 - protein, 19 aa, Mycobacterium
GGDKGGPLGDILGGLLGGK

SEQ ID NO: 1204983 - protein, 16 aa, Mycobacterium
GGDLPKPTTVAEHATK

SEQ ID NO: 1204984 - protein, 15 aa, Mycobacterium
GGDLTGDGVDAGPAH

SEQ ID NO: 1204985 - protein, 13 aa, Mycobacterium
GGDLTGMSTTEIA

SEQ ID NO: 1204986 - protein, 6 aa, Mycobacterium
GGDPAA

SEQ ID NO: 1204987 - protein, 8 aa, Mycobacterium
GGDPARIR

SEQ ID NO: 1204988 - protein, 7 aa, Mycobacterium
GGDPHDP

SEQ ID NO: 1204989 - protein, 19 aa, Mycobacterium
GGDPLPEDAVPARADELSE

SEQ ID NO: 1204990 - protein, 8 aa, Mycobacterium
GGDPMPAA

SEQ ID NO: 1204991 - protein, 7 aa, Mycobacterium
GGDPSRP

SEQ ID NO: 1204992 - protein, 14 aa, Mycobacterium
GGDPTGTGRGDAGY

SEQ ID NO: 1204993 - protein, 5 aa, Mycobacterium
GGDPV

SEQ ID NO: 1204994 - protein, 4 aa, Mycobacterium
GGDR

SEQ ID NO: 1204995 - protein, 14 aa, Mycobacterium
GGDRAAEGDDDPLA

SEQ ID NO: 1204996 - protein, 14 aa, Mycobacterium
GGDRAATADEDPLA

SEQ ID NO: 1204997 - protein, 10 aa, Mycobacterium
GGDREPSTQQ

SEQ ID NO: 1204998 - protein, 6 aa, Mycobacterium
GGDRFT

SEQ ID NO: 1204999 - protein, 10 aa, Mycobacterium
GGDRQQVSPG

SEQ ID NO: 1205000 - protein, 5 aa, Mycobacterium
GGDRR

SEQ ID NO: 1205001 - protein, 7 aa, Mycobacterium
GGDRRVE

SEQ ID NO: 1205002 - protein, 5 aa, Mycobacterium
GGDSA

SEQ ID NO: 1205003 - protein, 34 aa, Mycobacterium
GGDSETSSTTSGTSESSAAAAAPSPEAQKAATEY

SEQ ID NO: 1205004 - protein, 11 aa, Mycobacterium
GGDSLAETRAN

SEQ ID NO: 1205005 - protein, 7 aa, Mycobacterium
GGDSQEA

SEQ ID NO: 1205006 - protein, 15 aa, Mycobacterium
GGDSTPQRPPEFAAP

SEQ ID NO: 1205007 - protein, 4 aa, Mycobacterium
GGDT

SEQ ID NO: 1205008 - protein, 6 aa, Mycobacterium
GGDTAT

SEQ ID NO: 1205009 - protein, 9 aa, Mycobacterium
GGDTGGGAQ

SEQ ID NO: 1205010 - protein, 7 aa, Mycobacterium
GGDTTRN

SEQ ID NO: 1205011 - protein, 19 aa, Mycobacterium
GGDVSPPQGDCAPPPQGDY

SEQ ID NO: 1205012 - protein, 10 aa, Mycobacterium
GGEAPRGEIA

SEQ ID NO: 1205013 - protein, 26 aa, Mycobacterium
GGEAPTLSRLGGSDWANTKTKARKAV

SEQ ID NO: 1205014 - protein, 4 aa, Mycobacterium
GGED

SEQ ID NO: 1205015 - protein, 27 aa, Mycobacterium
GGEDDDLSGGAGAGQERREKLAEETDD

SEQ ID NO: 1205016 - protein, 27 aa, Mycobacterium
GGEDDDLTGSTAAGQERREKLTDETDD

SEQ ID NO: 1205017 - protein, 9 aa, Mycobacterium
GGEDGSSAA

SEQ ID NO: 1205018 - protein, 24 aa, Mycobacterium
GGEDNGKNQGGKAQTKKRPSQRRR

SEQ ID NO: 1205019 - protein, 7 aa, Mycobacterium
GGEEEHG

SEQ ID NO: 1205020 - protein, 8 aa, Mycobacterium
GGEEMSGY

SEQ ID NO: 1205021 - protein, 12 aa, Mycobacterium
GGEEVGQFTSAD

SEQ ID NO: 1205022 - protein, 4 aa, Mycobacterium
GGEF

SEQ ID NO: 1205023 - protein, 8 aa, Mycobacterium
GGEGGAAL

SEQ ID NO: 1205024 - protein, 6 aa, Mycobacterium
GGEGKR

SEQ ID NO: 1205025 - protein, 7 aa, Mycobacterium
GGEGNGW

SEQ ID NO: 1205026 - protein, 9 aa, Mycobacterium
GGEHRRSAG

SEQ ID NO: 1205027 - protein, 5 aa, Mycobacterium
GGEIP

SEQ ID NO: 1205028 - protein, 9 aa, Mycobacterium
GGEKAPDRL

SEQ ID NO: 1205029 - protein, 10 aa, Mycobacterium
GGELAPGDRF

SEQ ID NO: 1205030 - protein, 7 aa, Mycobacterium
GGELGPG

SEQ ID NO: 1205031 - protein, 15 aa, Mycobacterium
GGELPVNASGEARGI

SEQ ID NO: 1205032 - protein, 14 aa, Mycobacterium
GGEPFSRTVDGSDI

SEQ ID NO: 1205033 - protein, 9 aa, Mycobacterium
GGEPPHASA

SEQ ID NO: 1205034 - protein, 7 aa, Mycobacterium
GGEPVDC

SEQ ID NO: 1205035 - protein, 8 aa, Mycobacterium
GGEPWGPF

SEQ ID NO: 1205036 - protein, 117 aa, Mycobacterium
GGEQARTTTGDDTTPDDDQSEIVDDGDAEDPAESEDAEESEDLAEDEDPDEGEDLDEPDGIGDPLEPAQPPAEPVEEPDVPAEPAVETPVDTGTPAQETGGPAGDDAGQAADPADAT

SEQ ID NO: 1205037 - protein, 120 aa, Mycobacterium
GGEQARTTTGDDTTPDDDQSEIVDDGDAEDPAESEDAEESEDLAEDEDPDEGEDLDEPDGIGDPLEPAQPPAEPVEEPDVPAEPAVETPVDTGTPAQETGGPAGDDAGQAADPADTTLTD

SEQ ID NO: 1205038 - protein, 9 aa, Mycobacterium
GGEQPTDRP

SEQ ID NO: 1205039 - protein, 6 aa, Mycobacterium
GGEQSG

SEQ ID NO: 1205040 - protein, 15 aa, Mycobacterium
GGEQSGAGDEAGLPK

SEQ ID NO: 1205041 - protein, 9 aa, Mycobacterium
GGEQYAEEH

SEQ ID NO: 1205042 - protein, 12 aa, Mycobacterium
GGESGPRARPLD

SEQ ID NO: 1205043 - protein, 6 aa, Mycobacterium
GGESRD

SEQ ID NO: 1205044 - protein, 17 aa, Mycobacterium
GGESTRPGATRIDPAVE

SEQ ID NO: 1205045 - protein, 17 aa, Mycobacterium
GGETADVTDVPAGPTQV

SEQ ID NO: 1205046 - protein, 21 aa, Mycobacterium
GGETDSGVQVGEATSAADFGG

SEQ ID NO: 1205047 - protein, 5 aa, Mycobacterium
GGETG

SEQ ID NO: 1205048 - protein, 8 aa, Mycobacterium
GGETIRAG

SEQ ID NO: 1205049 - protein, 7 aa, Mycobacterium
GGETSLS

SEQ ID NO: 1205050 - protein, 11 aa, Mycobacterium
GGETVSGDAQV

SEQ ID NO: 1205051 - protein, 7 aa, Mycobacterium
GGETYKT

SEQ ID NO: 1205052 - protein, 8 aa, Mycobacterium
GGEVGRDH

SEQ ID NO: 1205053 - protein, 8 aa, Mycobacterium
GGFANERQ

SEQ ID NO: 1205054 - protein, 5 aa, Mycobacterium
GGFEG

SEQ ID NO: 1205055 - protein, 8 aa, Mycobacterium
GGFEQNAD

SEQ ID NO: 1205056 - protein, 16 aa, Mycobacterium
GGFETGTPKSAKSRRV

SEQ ID NO: 1205057 - protein, 9 aa, Mycobacterium
GGFGGGPQQ

SEQ ID NO: 1205058 - protein, 15 aa, Mycobacterium
GGFGGSIGGELGGGI

SEQ ID NO: 1205059 - protein, 17 aa, Mycobacterium
GGFNPPEPTTRGGPDYG

SEQ ID NO: 1205060 - protein, 5 aa, Mycobacterium
GGFPG

SEQ ID NO: 1205061 - protein, 8 aa, Mycobacterium
GGFPGTAR

SEQ ID NO: 1205062 - protein, 7 aa, Mycobacterium
GGFTPTR

SEQ ID NO: 1205063 - protein, 8 aa, Mycobacterium
GGFTSNDR

SEQ ID NO: 1205064 - protein, 8 aa, Mycobacterium
GGGADDGL

SEQ ID NO: 1205065 - protein, 39 aa, Mycobacterium
GGGAPSLAEANQMDAEEAAAKAARRGGTPGLDAGSAEAP

SEQ ID NO: 1205066 - protein, 14 aa, Mycobacterium
GGGAPTPEEARRLD

SEQ ID NO: 1205067 - protein, 19 aa, Mycobacterium
GGGARHPKSYGVDARADRD

SEQ ID NO: 1205068 - protein, 4 aa, Mycobacterium
GGGD

SEQ ID NO: 1205069 - protein, 9 aa, Mycobacterium
GGGDEDDPV

SEQ ID NO: 1205070 - protein, 6 aa, Mycobacterium
GGGDGR

SEQ ID NO: 1205071 - protein, 8 aa, Mycobacterium
GGGDPEEL

SEQ ID NO: 1205072 - protein, 22 aa, Mycobacterium
GGGDPVAARTAGEEARELADEM

SEQ ID NO: 1205073 - protein, 5 aa, Mycobacterium
GGGDQ

SEQ ID NO: 1205074 - protein, 8 aa, Mycobacterium
GGGDSAME

SEQ ID NO: 1205075 - protein, 12 aa, Mycobacterium
GGGDTKVSAEPW

SEQ ID NO: 1205076 - protein, 20 aa, Mycobacterium
GGGDVDPTRWGGDPGDPTLA

SEQ ID NO: 1205077 - protein, 6 aa, Mycobacterium
GGGEGG

SEQ ID NO: 1205078 - protein, 7 aa, Mycobacterium
GGGEGHY

SEQ ID NO: 1205079 - protein, 7 aa, Mycobacterium
GGGEKKT

SEQ ID NO: 1205080 - protein, 15 aa, Mycobacterium
GGGELSPDNLAPLTD

SEQ ID NO: 1205081 - protein, 10 aa, Mycobacterium
GGGEPGDPQI

SEQ ID NO: 1205082 - protein, 22 aa, Mycobacterium
GGGEQPAATTPTSDAPAESPAG

SEQ ID NO: 1205083 - protein, 7 aa, Mycobacterium
GGGETAA

SEQ ID NO: 1205084 - protein, 8 aa, Mycobacterium
GGGFGGKQ

SEQ ID NO: 1205085 - protein, 8 aa, Mycobacterium
GGGGAAGV

SEQ ID NO: 1205086 - protein, 9 aa, Mycobacterium
GGGGAPDVQ

SEQ ID NO: 1205087 - protein, 15 aa, Mycobacterium
GGGGEELVPVCGEGR

SEQ ID NO: 1205088 - protein, 8 aa, Mycobacterium
GGGGPTGM

SEQ ID NO: 1205089 - protein, 13 aa, Mycobacterium
GGGGQGNHLGGAY

SEQ ID NO: 1205090 - protein, 15 aa, Mycobacterium
GGGGQRGAGADNPLG

SEQ ID NO: 1205091 - protein, 10 aa, Mycobacterium
GGGGRAVEDA

SEQ ID NO: 1205092 - protein, 12 aa, Mycobacterium
GGGGRPGDTDYP

SEQ ID NO: 1205093 - protein, 16 aa, Mycobacterium
GGGHANGPDPDRGGYV

SEQ ID NO: 1205094 - protein, 6 aa, Mycobacterium
GGGHID

SEQ ID NO: 1205095 - protein, 7 aa, Mycobacterium
GGGIPTV

SEQ ID NO: 1205096 - protein, 4 aa, Mycobacterium
GGGK

SEQ ID NO: 1205097 - protein, 9 aa, Mycobacterium
GGGLASGIG

SEQ ID NO: 1205098 - protein, 8 aa, Mycobacterium
GGGLDGPA

SEQ ID NO: 1205099 - protein, 5 aa, Mycobacterium
GGGLG

SEQ ID NO: 1205100 - protein, 13 aa, Mycobacterium
GGGLPDGASGDAI

SEQ ID NO: 1205101 - protein, 6 aa, Mycobacterium
GGGLPS

SEQ ID NO: 1205102 - protein, 5 aa, Mycobacterium
GGGLR

SEQ ID NO: 1205103 - protein, 7 aa, Mycobacterium
GGGLRVT

SEQ ID NO: 1205104 - protein, 12 aa, Mycobacterium
GGGMANATIIER

SEQ ID NO: 1205105 - protein, 9 aa, Mycobacterium
GGGNPADDA

SEQ ID NO: 1205106 - protein, 10 aa, Mycobacterium
GGGNPAQVQS

SEQ ID NO: 1205107 - protein, 9 aa, Mycobacterium
GGGNPQGIQ

SEQ ID NO: 1205108 - protein, 8 aa, Mycobacterium
GGGNTAMD

SEQ ID NO: 1205109 - protein, 5 aa, Mycobacterium
GGGNV

SEQ ID NO: 1205110 - protein, 6 aa, Mycobacterium
GGGNVS

SEQ ID NO: 1205111 - protein, 7 aa, Mycobacterium
GGGPAWP

SEQ ID NO: 1205112 - protein, 9 aa, Mycobacterium
GGGPGDPEL

SEQ ID NO: 1205113 - protein, 6 aa, Mycobacterium
GGGPGY

SEQ ID NO: 1205114 - protein, 6 aa, Mycobacterium
GGGPQI

SEQ ID NO: 1205115 - protein, 13 aa, Mycobacterium
GGGPVAGSMLLSS

SEQ ID NO: 1205116 - protein, 13 aa, Mycobacterium
GGGPWTPGEWTDD

SEQ ID NO: 1205117 - protein, 4 aa, Mycobacterium
GGGR

SEQ ID NO: 1205118 - protein, 8 aa, Mycobacterium
GGGRGIGR

SEQ ID NO: 1205119 - protein, 8 aa, Mycobacterium
GGGRKGKK

SEQ ID NO: 1205120 - protein, 6 aa, Mycobacterium
GGGSDI

SEQ ID NO: 1205121 - protein, 6 aa, Mycobacterium
GGGSNA

SEQ ID NO: 1205122 - protein, 10 aa, Mycobacterium
GGGSTHDACK

SEQ ID NO: 1205123 - protein, 8 aa, Mycobacterium
GGGSVIDT

SEQ ID NO: 1205124 - protein, 7 aa, Mycobacterium
GGGTDQI

SEQ ID NO: 1205125 - protein, 10 aa, Mycobacterium
GGGTEQEHAA

SEQ ID NO: 1205126 - protein, 5 aa, Mycobacterium
GGGTF

SEQ ID NO: 1205127 - protein, 6 aa, Mycobacterium
GGGTGI

SEQ ID NO: 1205128 - protein, 8 aa, Mycobacterium
GGGTGIGR

SEQ ID NO: 1205129 - protein, 5 aa, Mycobacterium
GGGTS

SEQ ID NO: 1205130 - protein, 6 aa, Mycobacterium
GGGTSE

SEQ ID NO: 1205131 - protein, 11 aa, Mycobacterium
GGGTTGTPRTV

SEQ ID NO: 1205132 - protein, 9 aa, Mycobacterium
GGGVEQDPE

SEQ ID NO: 1205133 - protein, 5 aa, Mycobacterium
GGGVG

SEQ ID NO: 1205134 - protein, 5 aa, Mycobacterium
GGGVK

SEQ ID NO: 1205135 - protein, 5 aa, Mycobacterium
GGGYP

SEQ ID NO: 1205136 - protein, 6 aa, Mycobacterium
GGGYSG

SEQ ID NO: 1205137 - protein, 13 aa, Mycobacterium
GGHDVPESKIRQR

SEQ ID NO: 1205138 - protein, 42 aa, Mycobacterium
GGHGGAGGAGVNGAVGTSGVNNGRGGDGTAGGSGGAGGNAGL

SEQ ID NO: 1205139 - protein, 180 aa, Mycobacterium
GGHGGNGGAGGTGAAGATGAAGGNGGAGGRSGSRTGNGGAGGAAGNGGSGGNGATGGDGGSGGVGGADVSDPGSGPVTAGTGGNGGSGGAGGAGGDGGAGGLGGKGGAGSSEGSAGADAANGATGVGGSGGAGGRGGTGGASGDGASGGSGGAGKPGTGPTGSKGGAGGSGGSGGSGGQA

SEQ ID NO: 1205140 - protein, 10 aa, Mycobacterium
GGHGLRRGPD

SEQ ID NO: 1205141 - protein, 17 aa, Mycobacterium
GGHGTPAGAARGDRDAS

SEQ ID NO: 1205142 - protein, 19 aa, Mycobacterium
GGHGVGPWQGPPPDDPRLD

SEQ ID NO: 1205143 - protein, 15 aa, Mycobacterium
GGHKNSGTGTEEGVE

SEQ ID NO: 1205144 - protein, 5 aa, Mycobacterium
GGHPV

SEQ ID NO: 1205145 - protein, 8 aa, Mycobacterium
GGHPVGAN

SEQ ID NO: 1205146 - protein, 8 aa, Mycobacterium
GGHPVGAS

SEQ ID NO: 1205147 - protein, 6 aa, Mycobacterium
GGHRGG

SEQ ID NO: 1205148 - protein, 6 aa, Mycobacterium
GGHRTG

SEQ ID NO: 1205149 - protein, 5 aa, Mycobacterium
GGHVR

SEQ ID NO: 1205150 - protein, 6 aa, Mycobacterium
GGIDSD

SEQ ID NO: 1205151 - protein, 4 aa, Mycobacterium
GGIE

SEQ ID NO: 1205152 - protein, 19 aa, Mycobacterium
GGIGDAYSDGDGSYPPIQR

SEQ ID NO: 1205153 - protein, 7 aa, Mycobacterium
GGIGGNH

SEQ ID NO: 1205154 - protein, 8 aa, Mycobacterium
GGIGTGRQ

SEQ ID NO: 1205155 - protein, 14 aa, Mycobacterium
GGIGTTRGLPTPGL

SEQ ID NO: 1205156 - protein, 19 aa, Mycobacterium
GGIPAARAAGLTADAVDPR

SEQ ID NO: 1205157 - protein, 6 aa, Mycobacterium
GGIPEG

SEQ ID NO: 1205158 - protein, 17 aa, Mycobacterium
GGIPGDGHGPAGSSTTT

SEQ ID NO: 1205159 - protein, 5 aa, Mycobacterium
GGIPS

SEQ ID NO: 1205160 - protein, 10 aa, Mycobacterium
GGIRDDESLE

SEQ ID NO: 1205161 - protein, 6 aa, Mycobacterium
GGISGA

SEQ ID NO: 1205162 - protein, 5 aa, Mycobacterium
GGITA

SEQ ID NO: 1205163 - protein, 11 aa, Mycobacterium
GGITADSDPDL

SEQ ID NO: 1205164 - protein, 4 aa, Mycobacterium
GGKD

SEQ ID NO: 1205165 - protein, 4 aa, Mycobacterium
GGKE

SEQ ID NO: 1205166 - protein, 19 aa, Mycobacterium
GGKEAEHRAASSVKEAKGW

SEQ ID NO: 1205167 - protein, 5 aa, Mycobacterium
GGKGA

SEQ ID NO: 1205168 - protein, 16 aa, Mycobacterium
GGKGLEHGVEPPPLDD

SEQ ID NO: 1205169 - protein, 4 aa, Mycobacterium
GGKI

SEQ ID NO: 1205170 - protein, 32 aa, Mycobacterium
GGKLSDSDGAGGAGGVGGAAGLGGDGGGGGLG

SEQ ID NO: 1205171 - protein, 5 aa, Mycobacterium
GGKNP

SEQ ID NO: 1205172 - protein, 8 aa, Mycobacterium
GGKPFQPR

SEQ ID NO: 1205173 - protein, 11 aa, Mycobacterium
GGKQPAPAPVV

SEQ ID NO: 1205174 - protein, 71 aa, Mycobacterium
GGKRELTAAAPAADRPRRDRPSGTRPRRSGASGTTATSTDAGRAASEGTVEAPATEAAATAPSAGQPETTE

SEQ ID NO: 1205175 - protein, 7 aa, Mycobacterium
GGKRRTA

SEQ ID NO: 1205176 - protein, 16 aa, Mycobacterium
GGKSPHWTGSANSTRT

SEQ ID NO: 1205177 - protein, 16 aa, Mycobacterium
GGKTPWTGLDSNTTAN

SEQ ID NO: 1205178 - protein, 8 aa, Mycobacterium
GGLAGSSF

SEQ ID NO: 1205179 - protein, 9 aa, Mycobacterium
GGLAPAAGA

SEQ ID NO: 1205180 - protein, 9 aa, Mycobacterium
GGLASGIGT

SEQ ID NO: 1205181 - protein, 11 aa, Mycobacterium
GGLATQRRHTT

SEQ ID NO: 1205182 - protein, 7 aa, Mycobacterium
GGLDGEL

SEQ ID NO: 1205183 - protein, 8 aa, Mycobacterium
GGLDPKSG

SEQ ID NO: 1205184 - protein, 5 aa, Mycobacterium
GGLGA

SEQ ID NO: 1205185 - protein, 6 aa, Mycobacterium
GGLGEQ

SEQ ID NO: 1205186 - protein, 5 aa, Mycobacterium
GGLGH

SEQ ID NO: 1205187 - protein, 7 aa, Mycobacterium
GGLGPAG

SEQ ID NO: 1205188 - protein, 6 aa, Mycobacterium
GGLGPE

SEQ ID NO: 1205189 - protein, 8 aa, Mycobacterium
GGLGPELG

SEQ ID NO: 1205190 - protein, 6 aa, Mycobacterium
GGLGQD

SEQ ID NO: 1205191 - protein, 9 aa, Mycobacterium
GGLKPTVTD

SEQ ID NO: 1205192 - protein, 5 aa, Mycobacterium
GGLNA

SEQ ID NO: 1205193 - protein, 8 aa, Mycobacterium
GGLNGEPV

SEQ ID NO: 1205194 - protein, 7 aa, Mycobacterium
GGLNKGT

SEQ ID NO: 1205195 - protein, 12 aa, Mycobacterium
GGLPGGGPPVRP

SEQ ID NO: 1205196 - protein, 8 aa, Mycobacterium
GGLPGVDN

SEQ ID NO: 1205197 - protein, 6 aa, Mycobacterium
GGLPPR

SEQ ID NO: 1205198 - protein, 15 aa, Mycobacterium
GGLQPVPAGEEEHEP

SEQ ID NO: 1205199 - protein, 12 aa, Mycobacterium
GGLRAGRTEKEV

SEQ ID NO: 1205200 - protein, 7 aa, Mycobacterium
GGLSARG

SEQ ID NO: 1205201 - protein, 4 aa, Mycobacterium
GGLT

SEQ ID NO: 1205202 - protein, 8 aa, Mycobacterium
GGLTGRTT

SEQ ID NO: 1205203 - protein, 12 aa, Mycobacterium
GGLTPESTPAEI

SEQ ID NO: 1205204 - protein, 6 aa, Mycobacterium
GGLTRS

SEQ ID NO: 1205205 - protein, 13 aa, Mycobacterium
GGLTTGSSQLKTE

SEQ ID NO: 1205206 - protein, 9 aa, Mycobacterium
GGMANQENL

SEQ ID NO: 1205207 - protein, 15 aa, Mycobacterium
GGMASSEAATANIGA

SEQ ID NO: 1205208 - protein, 15 aa, Mycobacterium
GGMATSDAARANLGA

SEQ ID NO: 1205209 - protein, 14 aa, Mycobacterium
GGMEKNVSIELRPV

SEQ ID NO: 1205210 - protein, 4 aa, Mycobacterium
GGML

SEQ ID NO: 1205211 - protein, 6 aa, Mycobacterium
GGMPPE

SEQ ID NO: 1205212 - protein, 18 aa, Mycobacterium
GGMPTMQPKQGGIALPAG

SEQ ID NO: 1205213 - protein, 6 aa, Mycobacterium
GGMQDD

SEQ ID NO: 1205214 - protein, 13 aa, Mycobacterium
GGMSADAARDYKR

SEQ ID NO: 1205215 - protein, 12 aa, Mycobacterium
GGMSSAAAERSP

SEQ ID NO: 1205216 - protein, 14 aa, Mycobacterium
GGNAVGGDGGNGGG

SEQ ID NO: 1205217 - protein, 9 aa, Mycobacterium
GGNAVRNAR

SEQ ID NO: 1205218 - protein, 4 aa, Mycobacterium
GGND

SEQ ID NO: 1205219 - protein, 6 aa, Mycobacterium
GGNDAG

SEQ ID NO: 1205220 - protein, 21 aa, Mycobacterium
GGNDTGQVASALSGGGAGNSD

SEQ ID NO: 1205221 - protein, 5 aa, Mycobacterium
GGNEP

SEQ ID NO: 1205222 - protein, 6 aa, Mycobacterium
GGNGGS

SEQ ID NO: 1205223 - protein, 9 aa, Mycobacterium
GGNGTRMDK

SEQ ID NO: 1205224 - protein, 7 aa, Mycobacterium
GGNIGGG

SEQ ID NO: 1205225 - protein, 4 aa, Mycobacterium
GGNP

SEQ ID NO: 1205226 - protein, 7 aa, Mycobacterium
GGNPHHD

SEQ ID NO: 1205227 - protein, 7 aa, Mycobacterium
GGNPNAG

SEQ ID NO: 1205228 - protein, 4 aa, Mycobacterium
GGNR

SEQ ID NO: 1205229 - protein, 13 aa, Mycobacterium
GGNRDQGKREPMG

SEQ ID NO: 1205230 - protein, 7 aa, Mycobacterium
GGNRDTF

SEQ ID NO: 1205231 - protein, 9 aa, Mycobacterium
GGNRQGDKG

SEQ ID NO: 1205232 - protein, 4 aa, Mycobacterium
GGNS

SEQ ID NO: 1205233 - protein, 12 aa, Mycobacterium
GGNSRYTEDGRH

SEQ ID NO: 1205234 - protein, 13 aa, Mycobacterium
GGNSTAARRNGGY

SEQ ID NO: 1205235 - protein, 7 aa, Mycobacterium
GGNSTKQ

SEQ ID NO: 1205236 - protein, 8 aa, Mycobacterium
GGNTPGHV

SEQ ID NO: 1205237 - protein, 5 aa, Mycobacterium
GGNVE

SEQ ID NO: 1205238 - protein, 6 aa, Mycobacterium
GGNVPQ

SEQ ID NO: 1205239 - protein, 15 aa, Mycobacterium
GGNVSSEHGVGTRKR

SEQ ID NO: 1205240 - protein, 7 aa, Mycobacterium
GGPAAAR

SEQ ID NO: 1205241 - protein, 9 aa, Mycobacterium
GGPADEDVD

SEQ ID NO: 1205242 - protein, 18 aa, Mycobacterium
GGPADERSREERTAKSDL

SEQ ID NO: 1205243 - protein, 8 aa, Mycobacterium
GGPADPAI

SEQ ID NO: 1205244 - protein, 10 aa, Mycobacterium
GGPAEQQAAS

SEQ ID NO: 1205245 - protein, 5 aa, Mycobacterium
GGPAG

SEQ ID NO: 1205246 - protein, 7 aa, Mycobacterium
GGPAGYE

SEQ ID NO: 1205247 - protein, 9 aa, Mycobacterium
GGPANTQAL

SEQ ID NO: 1205248 - protein, 5 aa, Mycobacterium
GGPAP

SEQ ID NO: 1205249 - protein, 6 aa, Mycobacterium
GGPAPL

SEQ ID NO: 1205250 - protein, 9 aa, Mycobacterium
GGPCTEERL

SEQ ID NO: 1205251 - protein, 6 aa, Mycobacterium
GGPDHH

SEQ ID NO: 1205252 - protein, 5 aa, Mycobacterium
GGPDK

SEQ ID NO: 1205253 - protein, 12 aa, Mycobacterium
GGPDLARRLNIP

SEQ ID NO: 1205254 - protein, 5 aa, Mycobacterium
GGPEA

SEQ ID NO: 1205255 - protein, 24 aa, Mycobacterium
GGPEERRRTGTARSWSADPPGDVD

SEQ ID NO: 1205256 - protein, 8 aa, Mycobacterium
GGPEGPEQ

SEQ ID NO: 1205257 - protein, 7 aa, Mycobacterium
GGPEPYL

SEQ ID NO: 1205258 - protein, 21 aa, Mycobacterium
GGPFDRGQRLGDSGMRGRRPL

SEQ ID NO: 1205259 - protein, 6 aa, Mycobacterium
GGPFHD

SEQ ID NO: 1205260 - protein, 9 aa, Mycobacterium
GGPFTEAGA

SEQ ID NO: 1205261 - protein, 18 aa, Mycobacterium
GGPGAAPATKLDVEQSGD

SEQ ID NO: 1205262 - protein, 7 aa, Mycobacterium
GGPGAAS

SEQ ID NO: 1205263 - protein, 13 aa, Mycobacterium
GGPGASGISNYSR

SEQ ID NO: 1205264 - protein, 5 aa, Mycobacterium
GGPGI

SEQ ID NO: 1205265 - protein, 5 aa, Mycobacterium
GGPGP

SEQ ID NO: 1205266 - protein, 7 aa, Mycobacterium
GGPGRSA

SEQ ID NO: 1205267 - protein, 7 aa, Mycobacterium
GGPGSPA

SEQ ID NO: 1205268 - protein, 9 aa, Mycobacterium
GGPGTGKSS

SEQ ID NO: 1205269 - protein, 10 aa, Mycobacterium
GGPGTGKTTL

SEQ ID NO: 1205270 - protein, 6 aa, Mycobacterium
GGPGVA

SEQ ID NO: 1205271 - protein, 4 aa, Mycobacterium
GGPH

SEQ ID NO: 1205272 - protein, 16 aa, Mycobacterium
GGPHAKTALLDLEAVR

SEQ ID NO: 1205273 - protein, 5 aa, Mycobacterium
GGPHK

SEQ ID NO: 1205274 - protein, 7 aa, Mycobacterium
GGPIRGA

SEQ ID NO: 1205275 - protein, 14 aa, Mycobacterium
GGPKELRRTSTARE

SEQ ID NO: 1205276 - protein, 9 aa, Mycobacterium
GGPLAATDL

SEQ ID NO: 1205277 - protein, 9 aa, Mycobacterium
GGPLQPGQI

SEQ ID NO: 1205278 - protein, 7 aa, Mycobacterium
GGPLSSS

SEQ ID NO: 1205279 - protein, 7 aa, Mycobacterium
GGPLTDG

SEQ ID NO: 1205280 - protein, 5 aa, Mycobacterium
GGPMA

SEQ ID NO: 1205281 - protein, 6 aa, Mycobacterium
GGPMDE

SEQ ID NO: 1205282 - protein, 9 aa, Mycobacterium
GGPMGADPL

SEQ ID NO: 1205283 - protein, 16 aa, Mycobacterium
GGPMPAGLAEKASAAA

SEQ ID NO: 1205284 - protein, 16 aa, Mycobacterium
GGPMPAKVAEQASAAG

SEQ ID NO: 1205285 - protein, 8 aa, Mycobacterium
GGPNPDGR

SEQ ID NO: 1205286 - protein, 24 aa, Mycobacterium
GGPPPRIARDEPTPRDLPKTRVTD

SEQ ID NO: 1205287 - protein, 5 aa, Mycobacterium
GGPQI

SEQ ID NO: 1205288 - protein, 5 aa, Mycobacterium
GGPQR

SEQ ID NO: 1205289 - protein, 6 aa, Mycobacterium
GGPQVA

SEQ ID NO: 1205290 - protein, 7 aa, Mycobacterium
GGPRAER

SEQ ID NO: 1205291 - protein, 17 aa, Mycobacterium
GGPRPGQPAVRPRAVTQ

SEQ ID NO: 1205292 - protein, 10 aa, Mycobacterium
GGPRSGKSTA

SEQ ID NO: 1205293 - protein, 5 aa, Mycobacterium
GGPSF

SEQ ID NO: 1205294 - protein, 7 aa, Mycobacterium
GGPSGIG

SEQ ID NO: 1205295 - protein, 9 aa, Mycobacterium
GGPSGSAAA

SEQ ID NO: 1205296 - protein, 22 aa, Mycobacterium
GGPSGSGLISRPGAGGLATPDN

SEQ ID NO: 1205297 - protein, 12 aa, Mycobacterium
GGPSTRSVAADD

SEQ ID NO: 1205298 - protein, 6 aa, Mycobacterium
GGPTAV

SEQ ID NO: 1205299 - protein, 6 aa, Mycobacterium
GGPTDG

SEQ ID NO: 1205300 - protein, 8 aa, Mycobacterium
GGPTGVTA

SEQ ID NO: 1205301 - protein, 6 aa, Mycobacterium
GGPTQY

SEQ ID NO: 1205302 - protein, 4 aa, Mycobacterium
GGPV

SEQ ID NO: 1205303 - protein, 5 aa, Mycobacterium
GGPVT

SEQ ID NO: 1205304 - protein, 5 aa, Mycobacterium
GGPYR

SEQ ID NO: 1205305 - protein, 5 aa, Mycobacterium
GGQAG

SEQ ID NO: 1205306 - protein, 6 aa, Mycobacterium
GGQAGV

SEQ ID NO: 1205307 - protein, 9 aa, Mycobacterium
GGQCEETAD

SEQ ID NO: 1205308 - protein, 13 aa, Mycobacterium
GGQDPLNTEDPVA

SEQ ID NO: 1205309 - protein, 17 aa, Mycobacterium
GGQERDVRSGTQDVPGA

SEQ ID NO: 1205310 - protein, 9 aa, Mycobacterium
GGQESMSQA

SEQ ID NO: 1205311 - protein, 7 aa, Mycobacterium
GGQESQC

SEQ ID NO: 1205312 - protein, 5 aa, Mycobacterium
GGQFE

SEQ ID NO: 1205313 - protein, 9 aa, Mycobacterium
GGQGLNTGM

SEQ ID NO: 1205314 - protein, 4 aa, Mycobacterium
GGQI

SEQ ID NO: 1205315 - protein, 4 aa, Mycobacterium
GGQL

SEQ ID NO: 1205316 - protein, 10 aa, Mycobacterium
GGQLSHGRTH

SEQ ID NO: 1205317 - protein, 7 aa, Mycobacterium
GGQNRHA

SEQ ID NO: 1205318 - protein, 6 aa, Mycobacterium
GGQPVD

SEQ ID NO: 1205319 - protein, 4 aa, Mycobacterium
GGQR

SEQ ID NO: 1205320 - protein, 6 aa, Mycobacterium
GGQSGR

SEQ ID NO: 1205321 - protein, 7 aa, Mycobacterium
GGQTALN

SEQ ID NO: 1205322 - protein, 5 aa, Mycobacterium
GGQTL

SEQ ID NO: 1205323 - protein, 8 aa, Mycobacterium
GGQTLSSP

SEQ ID NO: 1205324 - protein, 9 aa, Mycobacterium
GGQTRRSWG

SEQ ID NO: 1205325 - protein, 8 aa, Mycobacterium
GGQTSAES

SEQ ID NO: 1205326 - protein, 8 aa, Mycobacterium
GGQTSTLL

SEQ ID NO: 1205327 - protein, 12 aa, Mycobacterium
GGQTVLSGTTSD

SEQ ID NO: 1205328 - protein, 10 aa, Mycobacterium
GGQVTPTNAQ

SEQ ID NO: 1205329 - protein, 4 aa, Mycobacterium
GGRA

SEQ ID NO: 1205330 - protein, 18 aa, Mycobacterium
GGRAAQALEGKSLSRPSW

SEQ ID NO: 1205331 - protein, 16 aa, Mycobacterium
GGRADDPALDPARSSP

SEQ ID NO: 1205332 - protein, 8 aa, Mycobacterium
GGRAGDEI

SEQ ID NO: 1205333 - protein, 10 aa, Mycobacterium
GGRAGEEVGV

SEQ ID NO: 1205334 - protein, 9 aa, Mycobacterium
GGRAGGHHS

SEQ ID NO: 1205335 - protein, 6 aa, Mycobacterium
GGRASR

SEQ ID NO: 1205336 - protein, 7 aa, Mycobacterium
GGRATAS

SEQ ID NO: 1205337 - protein, 15 aa, Mycobacterium
GGRATGKKGASTSKA

SEQ ID NO: 1205338 - protein, 12 aa, Mycobacterium
GGRAVGWQGVTH

SEQ ID NO: 1205339 - protein, 4 aa, Mycobacterium
GGRD

SEQ ID NO: 1205340 - protein, 14 aa, Mycobacterium
GGRDPGSADRSRAY

SEQ ID NO: 1205341 - protein, 7 aa, Mycobacterium
GGRDRSP

SEQ ID NO: 1205342 - protein, 10 aa, Mycobacterium
GGRDYVGGNG

SEQ ID NO: 1205343 - protein, 6 aa, Mycobacterium
GGREED

SEQ ID NO: 1205344 - protein, 9 aa, Mycobacterium
GGRERTASQ

SEQ ID NO: 1205345 - protein, 4 aa, Mycobacterium
GGRF

SEQ ID NO: 1205346 - protein, 8 aa, Mycobacterium
GGRGAHEL

SEQ ID NO: 1205347 - protein, 15 aa, Mycobacterium
GGRGDVDLTTADPRT

SEQ ID NO: 1205348 - protein, 5 aa, Mycobacterium
GGRGG

SEQ ID NO: 1205349 - protein, 6 aa, Mycobacterium
GGRGGV

SEQ ID NO: 1205350 - protein, 23 aa, Mycobacterium
GGRGGVGAGSGSPFGGGSGLSMP

SEQ ID NO: 1205351 - protein, 12 aa, Mycobacterium
GGRGIRPESKFD

SEQ ID NO: 1205352 - protein, 11 aa, Mycobacterium
GGRKSGAAVSE

SEQ ID NO: 1205353 - protein, 7 aa, Mycobacterium
GGRLAGR

SEQ ID NO: 1205354 - protein, 9 aa, Mycobacterium
GGRLDPGET

SEQ ID NO: 1205355 - protein, 7 aa, Mycobacterium
GGRLGSG

SEQ ID NO: 1205356 - protein, 13 aa, Mycobacterium
GGRLRPAEWCMSR

SEQ ID NO: 1205357 - protein, 11 aa, Mycobacterium
GGRMKSDPSFT

SEQ ID NO: 1205358 - protein, 4 aa, Mycobacterium
GGRN

SEQ ID NO: 1205359 - protein, 33 aa, Mycobacterium
GGRNGHVKSSDDKIDFDTRPPKELGGSGEGVNP

SEQ ID NO: 1205360 - protein, 6 aa, Mycobacterium
GGRNKI

SEQ ID NO: 1205361 - protein, 6 aa, Mycobacterium
GGRNLA

SEQ ID NO: 1205362 - protein, 7 aa, Mycobacterium
GGRNMKS

SEQ ID NO: 1205363 - protein, 7 aa, Mycobacterium
GGRNRGL

SEQ ID NO: 1205364 - protein, 4 aa, Mycobacterium
GGRP

SEQ ID NO: 1205365 - protein, 8 aa, Mycobacterium
GGRPADTP

SEQ ID NO: 1205366 - protein, 8 aa, Mycobacterium
GGRPEFAG

SEQ ID NO: 1205367 - protein, 9 aa, Mycobacterium
GGRPESSPL

SEQ ID NO: 1205368 - protein, 7 aa, Mycobacterium
GGRPGAA

SEQ ID NO: 1205369 - protein, 16 aa, Mycobacterium
GGRPVGDAAARRQTAE

SEQ ID NO: 1205370 - protein, 10 aa, Mycobacterium
GGRRAASVTG

SEQ ID NO: 1205371 - protein, 11 aa, Mycobacterium
GGRRDGDDPST

SEQ ID NO: 1205372 - protein, 8 aa, Mycobacterium
GGRRESGA

SEQ ID NO: 1205373 - protein, 10 aa, Mycobacterium
GGRRGEQDGR

SEQ ID NO: 1205374 - protein, 13 aa, Mycobacterium
GGRRPTVQDRQDL

SEQ ID NO: 1205375 - protein, 19 aa, Mycobacterium
GGRRSVAATARRLSPGEAD

SEQ ID NO: 1205376 - protein, 9 aa, Mycobacterium
GGRRVTGTV

SEQ ID NO: 1205377 - protein, 26 aa, Mycobacterium
GGRSNSGEGGESVTRFDPDENGDWRR

SEQ ID NO: 1205378 - protein, 6 aa, Mycobacterium
GGRSVV

SEQ ID NO: 1205379 - protein, 8 aa, Mycobacterium
GGRTARGR

SEQ ID NO: 1205380 - protein, 5 aa, Mycobacterium
GGRTG

SEQ ID NO: 1205381 - protein, 11 aa, Mycobacterium
GGRTGCRTTAE

SEQ ID NO: 1205382 - protein, 10 aa, Mycobacterium
GGRTPKAGGR

SEQ ID NO: 1205383 - protein, 11 aa, Mycobacterium
GGRTTGGAGCP

SEQ ID NO: 1205384 - protein, 6 aa, Mycobacterium
GGRTVG

SEQ ID NO: 1205385 - protein, 14 aa, Mycobacterium
GGRTVGAGRVTKII

SEQ ID NO: 1205386 - protein, 7 aa, Mycobacterium
GGRVPPD

SEQ ID NO: 1205387 - protein, 9 aa, Mycobacterium
GGSAGNSIE

SEQ ID NO: 1205388 - protein, 9 aa, Mycobacterium
GGSAGQDAV

SEQ ID NO: 1205389 - protein, 13 aa, Mycobacterium
GGSALQSSGGPVP

SEQ ID NO: 1205390 - protein, 6 aa, Mycobacterium
GGSAPE

SEQ ID NO: 1205391 - protein, 8 aa, Mycobacterium
GGSASPEA

SEQ ID NO: 1205392 - protein, 22 aa, Mycobacterium
GGSDEDAGLDGESDRDESRPRE

SEQ ID NO: 1205393 - protein, 5 aa, Mycobacterium
GGSDY

SEQ ID NO: 1205394 - protein, 6 aa, Mycobacterium
GGSEQG

SEQ ID NO: 1205395 - protein, 6 aa, Mycobacterium
GGSGAI

SEQ ID NO: 1205396 - protein, 7 aa, Mycobacterium
GGSGDSL

SEQ ID NO: 1205397 - protein, 9 aa, Mycobacterium
GGSGGDATF

SEQ ID NO: 1205398 - protein, 8 aa, Mycobacterium
GGSGGDTQ

SEQ ID NO: 1205399 - protein, 6 aa, Mycobacterium
GGSGIT

SEQ ID NO: 1205400 - protein, 25 aa, Mycobacterium
GGSGTDAASRLGLSPDTVGDGPRAA

SEQ ID NO: 1205401 - protein, 7 aa, Mycobacterium
GGSGVKG

SEQ ID NO: 1205402 - protein, 10 aa, Mycobacterium
GGSHEGGLPT

SEQ ID NO: 1205403 - protein, 9 aa, Mycobacterium
GGSIPSADL

SEQ ID NO: 1205404 - protein, 9 aa, Mycobacterium
GGSITTAEL

SEQ ID NO: 1205405 - protein, 8 aa, Mycobacterium
GGSKVAQP

SEQ ID NO: 1205406 - protein, 5 aa, Mycobacterium
GGSLE

SEQ ID NO: 1205407 - protein, 7 aa, Mycobacterium
GGSLKSS

SEQ ID NO: 1205408 - protein, 18 aa, Mycobacterium
GGSLTGPTRGVDQGADTV

SEQ ID NO: 1205409 - protein, 4 aa, Mycobacterium
GGSM

SEQ ID NO: 1205410 - protein, 6 aa, Mycobacterium
GGSNPS

SEQ ID NO: 1205411 - protein, 8 aa, Mycobacterium
GGSNTELS

SEQ ID NO: 1205412 - protein, 6 aa, Mycobacterium
GGSPAE

SEQ ID NO: 1205413 - protein, 21 aa, Mycobacterium
GGSPLRERKAAAEDTLGQHRP

SEQ ID NO: 1205414 - protein, 6 aa, Mycobacterium
GGSPSG

SEQ ID NO: 1205415 - protein, 4 aa, Mycobacterium
GGSQ

SEQ ID NO: 1205416 - protein, 5 aa, Mycobacterium
GGSQQ

SEQ ID NO: 1205417 - protein, 8 aa, Mycobacterium
GGSQRATG

SEQ ID NO: 1205418 - protein, 8 aa, Mycobacterium
GGSRAPAP

SEQ ID NO: 1205419 - protein, 13 aa, Mycobacterium
GGSRPGPTHRDNR

SEQ ID NO: 1205420 - protein, 12 aa, Mycobacterium
GGSRTAVRRQQT

SEQ ID NO: 1205421 - protein, 23 aa, Mycobacterium
GGSRTEWRRSQGIADDSDQPHTT

SEQ ID NO: 1205422 - protein, 10 aa, Mycobacterium
GGSSDGTADV

SEQ ID NO: 1205423 - protein, 6 aa, Mycobacterium
GGSSEY

SEQ ID NO: 1205424 - protein, 5 aa, Mycobacterium
GGSSH

SEQ ID NO: 1205425 - protein, 5 aa, Mycobacterium
GGSSL

SEQ ID NO: 1205426 - protein, 16 aa, Mycobacterium
GGSTATTVSFLVGAPP

SEQ ID NO: 1205427 - protein, 15 aa, Mycobacterium
GGSTATTVSFVVGRT

SEQ ID NO: 1205428 - protein, 5 aa, Mycobacterium
GGSTN

SEQ ID NO: 1205429 - protein, 10 aa, Mycobacterium
GGSVGDAEAA

SEQ ID NO: 1205430 - protein, 11 aa, Mycobacterium
GGSVSDEDRDT

SEQ ID NO: 1205431 - protein, 15 aa, Mycobacterium
GGSVVRGAEDTPYGR

SEQ ID NO: 1205432 - protein, 5 aa, Mycobacterium
GGSWD

SEQ ID NO: 1205433 - protein, 10 aa, Mycobacterium
GGTAAEDFPD

SEQ ID NO: 1205434 - protein, 5 aa, Mycobacterium
GGTAC

SEQ ID NO: 1205435 - protein, 7 aa, Mycobacterium
GGTAEQA

SEQ ID NO: 1205436 - protein, 5 aa, Mycobacterium
GGTAG

SEQ ID NO: 1205437 - protein, 5 aa, Mycobacterium
GGTAR

SEQ ID NO: 1205438 - protein, 5 aa, Mycobacterium
GGTDA

SEQ ID NO: 1205439 - protein, 6 aa, Mycobacterium
GGTDAK

SEQ ID NO: 1205440 - protein, 9 aa, Mycobacterium
GGTDESISA

SEQ ID NO: 1205441 - protein, 7 aa, Mycobacterium
GGTDPRV

SEQ ID NO: 1205442 - protein, 9 aa, Mycobacterium
GGTDQVPSV

SEQ ID NO: 1205443 - protein, 5 aa, Mycobacterium
GGTDR

SEQ ID NO: 1205444 - protein, 7 aa, Mycobacterium
GGTESDN

SEQ ID NO: 1205445 - protein, 19 aa, Mycobacterium
GGTGRAGAKIARIRLFGDI

SEQ ID NO: 1205446 - protein, 5 aa, Mycobacterium
GGTGV

SEQ ID NO: 1205447 - protein, 10 aa, Mycobacterium
GGTKDSGLEP

SEQ ID NO: 1205448 - protein, 4 aa, Mycobacterium
GGTL

SEQ ID NO: 1205449 - protein, 6 aa, Mycobacterium
GGTMRE

SEQ ID NO: 1205450 - protein, 9 aa, Mycobacterium
GGTNGKTSV

SEQ ID NO: 1205451 - protein, 14 aa, Mycobacterium
GGTPAGITAAGASW

SEQ ID NO: 1205452 - protein, 10 aa, Mycobacterium
GGTPAQARRA

SEQ ID NO: 1205453 - protein, 9 aa, Mycobacterium
GGTPDEREQ

SEQ ID NO: 1205454 - protein, 6 aa, Mycobacterium
GGTPEG

SEQ ID NO: 1205455 - protein, 7 aa, Mycobacterium
GGTPESL

SEQ ID NO: 1205456 - protein, 9 aa, Mycobacterium
GGTPKPKDI

SEQ ID NO: 1205457 - protein, 8 aa, Mycobacterium
GGTPPPDV

SEQ ID NO: 1205458 - protein, 10 aa, Mycobacterium
GGTPPPYPGW

SEQ ID NO: 1205459 - protein, 14 aa, Mycobacterium
GGTPQERESRARRI

SEQ ID NO: 1205460 - protein, 7 aa, Mycobacterium
GGTPRPI

SEQ ID NO: 1205461 - protein, 7 aa, Mycobacterium
GGTPSLL

SEQ ID NO: 1205462 - protein, 5 aa, Mycobacterium
GGTRD

SEQ ID NO: 1205463 - protein, 10 aa, Mycobacterium
GGTRDAISER

SEQ ID NO: 1205464 - protein, 7 aa, Mycobacterium
GGTREFT

SEQ ID NO: 1205465 - protein, 11 aa, Mycobacterium
GGTRPAHCTST

SEQ ID NO: 1205466 - protein, 7 aa, Mycobacterium
GGTRRTR

SEQ ID NO: 1205467 - protein, 5 aa, Mycobacterium
GGTSE

SEQ ID NO: 1205468 - protein, 6 aa, Mycobacterium
GGTSEI

SEQ ID NO: 1205469 - protein, 8 aa, Mycobacterium
GGTSGHPK

SEQ ID NO: 1205470 - protein, 7 aa, Mycobacterium
GGTSGNA

SEQ ID NO: 1205471 - protein, 4 aa, Mycobacterium
GGTT

SEQ ID NO: 1205472 - protein, 10 aa, Mycobacterium
GGTTLSRTGE

SEQ ID NO: 1205473 - protein, 8 aa, Mycobacterium
GGTTQINK

SEQ ID NO: 1205474 - protein, 5 aa, Mycobacterium
GGTTT

SEQ ID NO: 1205475 - protein, 9 aa, Mycobacterium
GGTVDPKQL

SEQ ID NO: 1205476 - protein, 7 aa, Mycobacterium
GGTVEPT

SEQ ID NO: 1205477 - protein, 6 aa, Mycobacterium
GGTVGE

SEQ ID NO: 1205478 - protein, 5 aa, Mycobacterium
GGTVI

SEQ ID NO: 1205479 - protein, 7 aa, Mycobacterium
GGTVNGD

SEQ ID NO: 1205480 - protein, 18 aa, Mycobacterium
GGTVSESGYLTPDSVAGL

SEQ ID NO: 1205481 - protein, 12 aa, Mycobacterium
GGVAAGASWGNA

SEQ ID NO: 1205482 - protein, 5 aa, Mycobacterium
GGVAG

SEQ ID NO: 1205483 - protein, 7 aa, Mycobacterium
GGVAGDE

SEQ ID NO: 1205484 - protein, 6 aa, Mycobacterium
GGVAGP

SEQ ID NO: 1205485 - protein, 10 aa, Mycobacterium
GGVAKTTTVA

SEQ ID NO: 1205486 - protein, 7 aa, Mycobacterium
GGVATSG

SEQ ID NO: 1205487 - protein, 20 aa, Mycobacterium
GGVDASAAGTDVAAAEAQRE

SEQ ID NO: 1205488 - protein, 10 aa, Mycobacterium
GGVDDRDRKA

SEQ ID NO: 1205489 - protein, 7 aa, Mycobacterium
GGVDGRF

SEQ ID NO: 1205490 - protein, 6 aa, Mycobacterium
GGVDNA

SEQ ID NO: 1205491 - protein, 12 aa, Mycobacterium
GGVDQPGETTNT

SEQ ID NO: 1205492 - protein, 8 aa, Mycobacterium
GGVDTSAT

SEQ ID NO: 1205493 - protein, 5 aa, Mycobacterium
GGVEQ

SEQ ID NO: 1205494 - protein, 152 aa, Mycobacterium
GGVGGTGGQGGQGGPGGSTGGAGGAGGQAGVAGKGGLFGGSGSAGTAGVTGASGASGGKGAQGATGAQGATGAQGATGATGASGAQGSAGSAGSAGVAGSAGTTGAQGSAGTNGANGANGSQGAAGKAGATGTTGATGAAGDAGDPGSEAVD

SEQ ID NO: 1205495 - protein, 13 aa, Mycobacterium
GGVGKSTLATATA

SEQ ID NO: 1205496 - protein, 9 aa, Mycobacterium
GGVGKSTTV

SEQ ID NO: 1205497 - protein, 7 aa, Mycobacterium
GGVGKTT

SEQ ID NO: 1205498 - protein, 6 aa, Mycobacterium
GGVGQV

SEQ ID NO: 1205499 - protein, 11 aa, Mycobacterium
GGVGRTPVTGA

SEQ ID NO: 1205500 - protein, 8 aa, Mycobacterium
GGVGTASV

SEQ ID NO: 1205501 - protein, 6 aa, Mycobacterium
GGVLPD

SEQ ID NO: 1205502 - protein, 6 aa, Mycobacterium
GGVNPV

SEQ ID NO: 1205503 - protein, 5 aa, Mycobacterium
GGVPA

SEQ ID NO: 1205504 - protein, 9 aa, Mycobacterium
GGVPATEFR

SEQ ID NO: 1205505 - protein, 10 aa, Mycobacterium
GGVPDGPGFD

SEQ ID NO: 1205506 - protein, 9 aa, Mycobacterium
GGVPDGQVE

SEQ ID NO: 1205507 - protein, 9 aa, Mycobacterium
GGVPPQDTT

SEQ ID NO: 1205508 - protein, 8 aa, Mycobacterium
GGVPPTVD

SEQ ID NO: 1205509 - protein, 5 aa, Mycobacterium
GGVPS

SEQ ID NO: 1205510 - protein, 4 aa, Mycobacterium
GGVR

SEQ ID NO: 1205511 - protein, 9 aa, Mycobacterium
GGVSAGAAP

SEQ ID NO: 1205512 - protein, 9 aa, Mycobacterium
GGVSGGTVA

SEQ ID NO: 1205513 - protein, 8 aa, Mycobacterium
GGVSPTLE

SEQ ID NO: 1205514 - protein, 5 aa, Mycobacterium
GGVSQ

SEQ ID NO: 1205515 - protein, 13 aa, Mycobacterium
GGVSRGELTEAGA

SEQ ID NO: 1205516 - protein, 15 aa, Mycobacterium
GGVSSSPSTSAAGFP

SEQ ID NO: 1205517 - protein, 11 aa, Mycobacterium
GGVSTATQAAW

SEQ ID NO: 1205518 - protein, 8 aa, Mycobacterium
GGVTGGAD

SEQ ID NO: 1205519 - protein, 8 aa, Mycobacterium
GGVTGPDS

SEQ ID NO: 1205520 - protein, 6 aa, Mycobacterium
GGVTSV

SEQ ID NO: 1205521 - protein, 21 aa, Mycobacterium
GGVVADSNGPYEYNEASNKAR

SEQ ID NO: 1205522 - protein, 5 aa, Mycobacterium
GGVYG

SEQ ID NO: 1205523 - protein, 13 aa, Mycobacterium
GGWASDSVSCPRS

SEQ ID NO: 1205524 - protein, 9 aa, Mycobacterium
GGWEPDAKG

SEQ ID NO: 1205525 - protein, 13 aa, Mycobacterium
GGWPDDPEEDVAA

SEQ ID NO: 1205526 - protein, 5 aa, Mycobacterium
GGWTT

SEQ ID NO: 1205527 - protein, 6 aa, Mycobacterium
GGYAEN

SEQ ID NO: 1205528 - protein, 6 aa, Mycobacterium
GGYAGR

SEQ ID NO: 1205529 - protein, 14 aa, Mycobacterium
GGYDSVPQPLGPDS

SEQ ID NO: 1205530 - protein, 6 aa, Mycobacterium
GGYEEN

SEQ ID NO: 1205531 - protein, 5 aa, Mycobacterium
GGYGA

SEQ ID NO: 1205532 - protein, 6 aa, Mycobacterium
GGYGGV

SEQ ID NO: 1205533 - protein, 6 aa, Mycobacterium
GGYGNS

SEQ ID NO: 1205534 - protein, 9 aa, Mycobacterium
GGYGRDEAC

SEQ ID NO: 1205535 - protein, 4 aa, Mycobacterium
GGYH

SEQ ID NO: 1205536 - protein, 17 aa, Mycobacterium
GGYKASSTTTFKEQAGA

SEQ ID NO: 1205537 - protein, 5 aa, Mycobacterium
GGYKD

SEQ ID NO: 1205538 - protein, 16 aa, Mycobacterium
GGYKESGLGREGGPHA

SEQ ID NO: 1205539 - protein, 12 aa, Mycobacterium
GGYKRSGNGREW

SEQ ID NO: 1205540 - protein, 4 aa, Mycobacterium
GGYP

SEQ ID NO: 1205541 - protein, 13 aa, Mycobacterium
GGYPDTRSATCTG

SEQ ID NO: 1205542 - protein, 6 aa, Mycobacterium
GGYTET

SEQ ID NO: 1205543 - protein, 14 aa, Mycobacterium
GGYTGGGSKKTVDG

SEQ ID NO: 1205544 - protein, 25 aa, Mycobacterium
GHAARRPSYRPAAPPARRAAGAAPQ

SEQ ID NO: 1205545 - protein, 4 aa, Mycobacterium
GHAD

SEQ ID NO: 1205546 - protein, 9 aa, Mycobacterium
GHAEAIPDA

SEQ ID NO: 1205547 - protein, 8 aa, Mycobacterium
GHAEPLSA

SEQ ID NO: 1205548 - protein, 13 aa, Mycobacterium
GHAERCDDDGGAE

SEQ ID NO: 1205549 - protein, 4 aa, Mycobacterium
GHAP

SEQ ID NO: 1205550 - protein, 6 aa, Mycobacterium
GHAPAG

SEQ ID NO: 1205551 - protein, 7 aa, Mycobacterium
GHAPETW

SEQ ID NO: 1205552 - protein, 7 aa, Mycobacterium
GHAPNAW

SEQ ID NO: 1205553 - protein, 28 aa, Mycobacterium
GHAPRRGVYQPSPNKSSAPSSAAHATPS

SEQ ID NO: 1205554 - protein, 12 aa, Mycobacterium
GHAPSGLGFRPD

SEQ ID NO: 1205555 - protein, 10 aa, Mycobacterium
GHAPVGLSGS

SEQ ID NO: 1205556 - protein, 10 aa, Mycobacterium
GHARKAKSEE

SEQ ID NO: 1205557 - protein, 15 aa, Mycobacterium
GHATPQSSSRPDRGP

SEQ ID NO: 1205558 - protein, 47 aa, Mycobacterium
GHDDDGHDHPAPSTGGRKSWSKAPSFADDEERAAAVREATRRDRERY

SEQ ID NO: 1205559 - protein, 5 aa, Mycobacterium
GHDET

SEQ ID NO: 1205560 - protein, 8 aa, Mycobacterium
GHDGGPHR

SEQ ID NO: 1205561 - protein, 5 aa, Mycobacterium
GHDGV

SEQ ID NO: 1205562 - protein, 7 aa, Mycobacterium
GHDNVTT

SEQ ID NO: 1205563 - protein, 6 aa, Mycobacterium
GHDPAA

SEQ ID NO: 1205564 - protein, 8 aa, Mycobacterium
GHDPGDWA

SEQ ID NO: 1205565 - protein, 13 aa, Mycobacterium
GHDPTDRGAEFLR

SEQ ID NO: 1205566 - protein, 9 aa, Mycobacterium
GHDSGLAGQ

SEQ ID NO: 1205567 - protein, 8 aa, Mycobacterium
GHDSQSGT

SEQ ID NO: 1205568 - protein, 7 aa, Mycobacterium
GHDTSEI

SEQ ID NO: 1205569 - protein, 12 aa, Mycobacterium
GHDTTSATISGG

SEQ ID NO: 1205570 - protein, 9 aa, Mycobacterium
GHDVDDRTA

SEQ ID NO: 1205571 - protein, 5 aa, Mycobacterium
GHEPF

SEQ ID NO: 1205572 - protein, 6 aa, Mycobacterium
GHERDQ

SEQ ID NO: 1205573 - protein, 8 aa, Mycobacterium
GHERTSVG

SEQ ID NO: 1205574 - protein, 6 aa, Mycobacterium
GHETEE

SEQ ID NO: 1205575 - protein, 24 aa, Mycobacterium
GHETGHAPDEAAPEPTFDGPAPDL

SEQ ID NO: 1205576 - protein, 4 aa, Mycobacterium
GHGD

SEQ ID NO: 1205577 - protein, 10 aa, Mycobacterium
GHGDSTTVGD

SEQ ID NO: 1205578 - protein, 14 aa, Mycobacterium
GHGESDWSPDGDYR

SEQ ID NO: 1205579 - protein, 6 aa, Mycobacterium
GHGGLS

SEQ ID NO: 1205580 - protein, 9 aa, Mycobacterium
GHGGSNRLR

SEQ ID NO: 1205581 - protein, 11 aa, Mycobacterium
GHGGSPADKKL

SEQ ID NO: 1205582 - protein, 8 aa, Mycobacterium
GHGGTRSV

SEQ ID NO: 1205583 - protein, 5 aa, Mycobacterium
GHGHP

SEQ ID NO: 1205584 - protein, 8 aa, Mycobacterium
GHGHRETI

SEQ ID NO: 1205585 - protein, 6 aa, Mycobacterium
GHGIGR

SEQ ID NO: 1205586 - protein, 8 aa, Mycobacterium
GHGKKAAR

SEQ ID NO: 1205587 - protein, 9 aa, Mycobacterium
GHGNARTDA

SEQ ID NO: 1205588 - protein, 4 aa, Mycobacterium
GHGP

SEQ ID NO: 1205589 - protein, 6 aa, Mycobacterium
GHGPEL

SEQ ID NO: 1205590 - protein, 6 aa, Mycobacterium
GHGRED

SEQ ID NO: 1205591 - protein, 5 aa, Mycobacterium
GHGRS

SEQ ID NO: 1205592 - protein, 14 aa, Mycobacterium
GHGRSAIPPRRGGY

SEQ ID NO: 1205593 - protein, 5 aa, Mycobacterium
GHGRY

SEQ ID NO: 1205594 - protein, 9 aa, Mycobacterium
GHGTGTRLG

SEQ ID NO: 1205595 - protein, 9 aa, Mycobacterium
GHGTIDGRP

SEQ ID NO: 1205596 - protein, 8 aa, Mycobacterium
GHGTINGR

SEQ ID NO: 1205597 - protein, 5 aa, Mycobacterium
GHGTV

SEQ ID NO: 1205598 - protein, 11 aa, Mycobacterium
GHHSDSMQSAS

SEQ ID NO: 1205599 - protein, 8 aa, Mycobacterium
GHIGGGDV

SEQ ID NO: 1205600 - protein, 6 aa, Mycobacterium
GHKLTD

SEQ ID NO: 1205601 - protein, 28 aa, Mycobacterium
GHKPDQPVQKRPIGRPRAGVDDDRRVPQ

SEQ ID NO: 1205602 - protein, 13 aa, Mycobacterium
GHLGPDEDLTSSV

SEQ ID NO: 1205603 - protein, 7 aa, Mycobacterium
GHLPDPA

SEQ ID NO: 1205604 - protein, 10 aa, Mycobacterium
GHPAGEASNM

SEQ ID NO: 1205605 - protein, 11 aa, Mycobacterium
GHPAPGEPERG

SEQ ID NO: 1205606 - protein, 10 aa, Mycobacterium
GHPDEANPAL

SEQ ID NO: 1205607 - protein, 13 aa, Mycobacterium
GHPDPADRQQPPH

SEQ ID NO: 1205608 - protein, 5 aa, Mycobacterium
GHPEA

SEQ ID NO: 1205609 - protein, 7 aa, Mycobacterium
GHPEHGA

SEQ ID NO: 1205610 - protein, 8 aa, Mycobacterium
GHPGEDDV

SEQ ID NO: 1205611 - protein, 6 aa, Mycobacterium
GHPGYS

SEQ ID NO: 1205612 - protein, 11 aa, Mycobacterium
GHPKKKDPNKI

SEQ ID NO: 1205613 - protein, 5 aa, Mycobacterium
GHPLA

SEQ ID NO: 1205614 - protein, 9 aa, Mycobacterium
GHPNRQSAE

SEQ ID NO: 1205615 - protein, 5 aa, Mycobacterium
GHPPP

SEQ ID NO: 1205616 - protein, 9 aa, Mycobacterium
GHPPSSWEP

SEQ ID NO: 1205617 - protein, 6 aa, Mycobacterium
GHPPVG

SEQ ID NO: 1205618 - protein, 18 aa, Mycobacterium
GHPPVPAPITPLNAVTPA

SEQ ID NO: 1205619 - protein, 12 aa, Mycobacterium
GHPPYGHNGERA

SEQ ID NO: 1205620 - protein, 5 aa, Mycobacterium
GHPQI

SEQ ID NO: 1205621 - protein, 4 aa, Mycobacterium
GHPR

SEQ ID NO: 1205622 - protein, 29 aa, Mycobacterium
GHPRIGAKADNPSSAREQARVADSGPEVK

SEQ ID NO: 1205623 - protein, 5 aa, Mycobacterium
GHPRL

SEQ ID NO: 1205624 - protein, 8 aa, Mycobacterium
GHPSPRGR

SEQ ID NO: 1205625 - protein, 18 aa, Mycobacterium
GHPSWSSVSSDDPAPGRL

SEQ ID NO: 1205626 - protein, 4 aa, Mycobacterium
GHPV

SEQ ID NO: 1205627 - protein, 14 aa, Mycobacterium
GHPVGRADNPSKAV

SEQ ID NO: 1205628 - protein, 4 aa, Mycobacterium
GHQE

SEQ ID NO: 1205629 - protein, 14 aa, Mycobacterium
GHQREVGRIGMSYL

SEQ ID NO: 1205630 - protein, 12 aa, Mycobacterium
GHQRSDAQDHDA

SEQ ID NO: 1205631 - protein, 9 aa, Mycobacterium
GHQVQGDPA

SEQ ID NO: 1205632 - protein, 13 aa, Mycobacterium
GHRAEQAQDENGL

SEQ ID NO: 1205633 - protein, 13 aa, Mycobacterium
GHRARPPLRGRGH

SEQ ID NO: 1205634 - protein, 10 aa, Mycobacterium
GHREQPRGPV

SEQ ID NO: 1205635 - protein, 12 aa, Mycobacterium
GHRKPGRRPPDE

SEQ ID NO: 1205636 - protein, 7 aa, Mycobacterium
GHRNKRS

SEQ ID NO: 1205637 - protein, 5 aa, Mycobacterium
GHRPD

SEQ ID NO: 1205638 - protein, 5 aa, Mycobacterium
GHRPS

SEQ ID NO: 1205639 - protein, 6 aa, Mycobacterium
GHRSDD

SEQ ID NO: 1205640 - protein, 10 aa, Mycobacterium
GHRSPTNRPH

SEQ ID NO: 1205641 - protein, 7 aa, Mycobacterium
GHRTRRP

SEQ ID NO: 1205642 - protein, 10 aa, Mycobacterium
GHSARAAETL

SEQ ID NO: 1205643 - protein, 12 aa, Mycobacterium
GHSGHPASGDLS

SEQ ID NO: 1205644 - protein, 10 aa, Mycobacterium
GHSGRPGTEV

SEQ ID NO: 1205645 - protein, 8 aa, Mycobacterium
GHSPDTGW

SEQ ID NO: 1205646 - protein, 11 aa, Mycobacterium
GHSSDSRIPAS

SEQ ID NO: 1205647 - protein, 5 aa, Mycobacterium
GHTDP

SEQ ID NO: 1205648 - protein, 15 aa, Mycobacterium
GHTDRPRRVRQPGEP

SEQ ID NO: 1205649 - protein, 4 aa, Mycobacterium
GHTE

SEQ ID NO: 1205650 - protein, 11 aa, Mycobacterium
GHTEEAANRDF

SEQ ID NO: 1205651 - protein, 13 aa, Mycobacterium
GHTHTGASRPDAP

SEQ ID NO: 1205652 - protein, 8 aa, Mycobacterium
GHTKTEHD

SEQ ID NO: 1205653 - protein, 17 aa, Mycobacterium
GHTPVGKNISETRRTSR

SEQ ID NO: 1205654 - protein, 6 aa, Mycobacterium
GHTQDT

SEQ ID NO: 1205655 - protein, 4 aa, Mycobacterium
GHTR

SEQ ID NO: 1205656 - protein, 20 aa, Mycobacterium
GHTRRSTTLSPQAAPAGAPA

SEQ ID NO: 1205657 - protein, 6 aa, Mycobacterium
GHTSPE

SEQ ID NO: 1205658 - protein, 7 aa, Mycobacterium
GHTSSSP

SEQ ID NO: 1205659 - protein, 9 aa, Mycobacterium
GHVGSTKGD

SEQ ID NO: 1205660 - protein, 9 aa, Mycobacterium
GHVPPADPV

SEQ ID NO: 1205661 - protein, 15 aa, Mycobacterium
GHWTASPQEGRTVRD

SEQ ID NO: 1205662 - protein, 18 aa, Mycobacterium
GHYPQDIEATTADASPLV

SEQ ID NO: 1205663 - protein, 14 aa, Mycobacterium
GHYRQGEGETCGTA

SEQ ID NO: 1205664 - protein, 12 aa, Mycobacterium
GHYSGAQKMGNA

SEQ ID NO: 1205665 - protein, 5 aa, Mycobacterium
GIAAS

SEQ ID NO: 1205666 - protein, 4 aa, Mycobacterium
GIAP

SEQ ID NO: 1205667 - protein, 20 aa, Mycobacterium
GIAPRAPGSPRTAGRSARNY

SEQ ID NO: 1205668 - protein, 8 aa, Mycobacterium
GIASGRGL

SEQ ID NO: 1205669 - protein, 12 aa, Mycobacterium
GIATDSKGSGTA

SEQ ID NO: 1205670 - protein, 8 aa, Mycobacterium
GIATPPQA

SEQ ID NO: 1205671 - protein, 5 aa, Mycobacterium
GIATS

SEQ ID NO: 1205672 - protein, 4 aa, Mycobacterium
GIDD

SEQ ID NO: 1205673 - protein, 6 aa, Mycobacterium
GIDDGQ

SEQ ID NO: 1205674 - protein, 5 aa, Mycobacterium
GIDDP

SEQ ID NO: 1205675 - protein, 7 aa, Mycobacterium
GIDPASV

SEQ ID NO: 1205676 - protein, 9 aa, Mycobacterium
GIDPERGWG

SEQ ID NO: 1205677 - protein, 5 aa, Mycobacterium
GIDPR

SEQ ID NO: 1205678 - protein, 5 aa, Mycobacterium
GIDQL

SEQ ID NO: 1205679 - protein, 7 aa, Mycobacterium
GIDSGAR

SEQ ID NO: 1205680 - protein, 13 aa, Mycobacterium
GIDSNNSPLPIPD

SEQ ID NO: 1205681 - protein, 5 aa, Mycobacterium
GIDTE

SEQ ID NO: 1205682 - protein, 7 aa, Mycobacterium
GIDTPAP

SEQ ID NO: 1205683 - protein, 5 aa, Mycobacterium
GIDTR

SEQ ID NO: 1205684 - protein, 10 aa, Mycobacterium
GIDVKSSDIS

SEQ ID NO: 1205685 - protein, 7 aa, Mycobacterium
GIEAGAP

SEQ ID NO: 1205686 - protein, 8 aa, Mycobacterium
GIEAQTDQ

SEQ ID NO: 1205687 - protein, 6 aa, Mycobacterium
GIEDGT

SEQ ID NO: 1205688 - protein, 6 aa, Mycobacterium
GIEEGA

SEQ ID NO: 1205689 - protein, 5 aa, Mycobacterium
GIEEP

SEQ ID NO: 1205690 - protein, 5 aa, Mycobacterium
GIEGQ

SEQ ID NO: 1205691 - protein, 5 aa, Mycobacterium
GIEPG

SEQ ID NO: 1205692 - protein, 11 aa, Mycobacterium
GIEPGRFTEDD

SEQ ID NO: 1205693 - protein, 12 aa, Mycobacterium
GIEPQRHPNGAH

SEQ ID NO: 1205694 - protein, 9 aa, Mycobacterium
GIERADQEP

SEQ ID NO: 1205695 - protein, 6 aa, Mycobacterium
GIERQY

SEQ ID NO: 1205696 - protein, 5 aa, Mycobacterium
GIESE

SEQ ID NO: 1205697 - protein, 6 aa, Mycobacterium
GIGAAT

SEQ ID NO: 1205698 - protein, 6 aa, Mycobacterium
GIGAGD

SEQ ID NO: 1205699 - protein, 14 aa, Mycobacterium
GIGATENASGFTTE

SEQ ID NO: 1205700 - protein, 9 aa, Mycobacterium
GIGATRPDE

SEQ ID NO: 1205701 - protein, 5 aa, Mycobacterium
GIGGP

SEQ ID NO: 1205702 - protein, 5 aa, Mycobacterium
GIGGT

SEQ ID NO: 1205703 - protein, 6 aa, Mycobacterium
GIGKTV

SEQ ID NO: 1205704 - protein, 7 aa, Mycobacterium
GIGLPDE

SEQ ID NO: 1205705 - protein, 6 aa, Mycobacterium
GIGNGG

SEQ ID NO: 1205706 - protein, 12 aa, Mycobacterium
GIGNGGAGGDAE

SEQ ID NO: 1205707 - protein, 17 aa, Mycobacterium
GIGNGGQTLDHTSEEDW

SEQ ID NO: 1205708 - protein, 12 aa, Mycobacterium
GIGNGGQTVETL

SEQ ID NO: 1205709 - protein, 39 aa, Mycobacterium
GIGPGGRNSRRHGERQDQGGFSKGRVKTSFRTGHGASDN

SEQ ID NO: 1205710 - protein, 16 aa, Mycobacterium
GIGPGLGATDDPPTVS

SEQ ID NO: 1205711 - protein, 6 aa, Mycobacterium
GIGPVD

SEQ ID NO: 1205712 - protein, 20 aa, Mycobacterium
GIGQRGTHRQSLTRRIVIEC

SEQ ID NO: 1205713 - protein, 12 aa, Mycobacterium
GIGRQNGTEGFE

SEQ ID NO: 1205714 - protein, 4 aa, Mycobacterium
GIGS

SEQ ID NO: 1205715 - protein, 16 aa, Mycobacterium
GIGSPKPLHETDDETL

SEQ ID NO: 1205716 - protein, 7 aa, Mycobacterium
GIGSTVT

SEQ ID NO: 1205717 - protein, 5 aa, Mycobacterium
GIGTG

SEQ ID NO: 1205718 - protein, 10 aa, Mycobacterium
GIGTPDRARE

SEQ ID NO: 1205719 - protein, 11 aa, Mycobacterium
GIGTPGRAADL

SEQ ID NO: 1205720 - protein, 21 aa, Mycobacterium
GIGTRAAGIDDDTAAVDGQQA

SEQ ID NO: 1205721 - protein, 8 aa, Mycobacterium
GIKDTSKQ

SEQ ID NO: 1205722 - protein, 6 aa, Mycobacterium
GIKPTT

SEQ ID NO: 1205723 - protein, 4 aa, Mycobacterium
GING

SEQ ID NO: 1205724 - protein, 11 aa, Mycobacterium
GINPRKLRANP

SEQ ID NO: 1205725 - protein, 5 aa, Mycobacterium
GIPAD

SEQ ID NO: 1205726 - protein, 17 aa, Mycobacterium
GIPADITGTGVAAGDNF

SEQ ID NO: 1205727 - protein, 6 aa, Mycobacterium
GIPDGN

SEQ ID NO: 1205728 - protein, 4 aa, Mycobacterium
GIPE

SEQ ID NO: 1205729 - protein, 7 aa, Mycobacterium
GIPENQA

SEQ ID NO: 1205730 - protein, 8 aa, Mycobacterium
GIPEPGQA

SEQ ID NO: 1205731 - protein, 12 aa, Mycobacterium
GIPFTSTEGAHD

SEQ ID NO: 1205732 - protein, 5 aa, Mycobacterium
GIPGH

SEQ ID NO: 1205733 - protein, 10 aa, Mycobacterium
GIPGRDTTSD

SEQ ID NO: 1205734 - protein, 4 aa, Mycobacterium
GIPH

SEQ ID NO: 1205735 - protein, 12 aa, Mycobacterium
GIPPRSLAGSDT

SEQ ID NO: 1205736 - protein, 15 aa, Mycobacterium
GIPQDPATRCRAEQT

SEQ ID NO: 1205737 - protein, 5 aa, Mycobacterium
GIPRT

SEQ ID NO: 1205738 - protein, 16 aa, Mycobacterium
GIPSTVTRPAPMSSAA

SEQ ID NO: 1205739 - protein, 4 aa, Mycobacterium
GIPT

SEQ ID NO: 1205740 - protein, 14 aa, Mycobacterium
GIQAGGGVSTYRAS

SEQ ID NO: 1205741 - protein, 4 aa, Mycobacterium
GIQD

SEQ ID NO: 1205742 - protein, 7 aa, Mycobacterium
GIQDPNV

SEQ ID NO: 1205743 - protein, 6 aa, Mycobacterium
GIRKST

SEQ ID NO: 1205744 - protein, 10 aa, Mycobacterium
GIRPAPGYPA

SEQ ID NO: 1205745 - protein, 5 aa, Mycobacterium
GIRPG

SEQ ID NO: 1205746 - protein, 19 aa, Mycobacterium
GIRPPADGAPFRAGRSARN

SEQ ID NO: 1205747 - protein, 6 aa, Mycobacterium
GIRSDS

SEQ ID NO: 1205748 - protein, 13 aa, Mycobacterium
GISASQDAEIDRN

SEQ ID NO: 1205749 - protein, 6 aa, Mycobacterium
GISDGR

SEQ ID NO: 1205750 - protein, 5 aa, Mycobacterium
GISGG

SEQ ID NO: 1205751 - protein, 20 aa, Mycobacterium
GISGGAASAEEAAVHIIEDD

SEQ ID NO: 1205752 - protein, 21 aa, Mycobacterium
GISHSGPAPWRRSSSPAMTPS

SEQ ID NO: 1205753 - protein, 19 aa, Mycobacterium
GISPRSGLPGDDGLSPATS

SEQ ID NO: 1205754 - protein, 8 aa, Mycobacterium
GISPSDGP

SEQ ID NO: 1205755 - protein, 6 aa, Mycobacterium
GISREG

SEQ ID NO: 1205756 - protein, 13 aa, Mycobacterium
GISVPDDSGDIRG

SEQ ID NO: 1205757 - protein, 4 aa, Mycobacterium
GITA

SEQ ID NO: 1205758 - protein, 11 aa, Mycobacterium
GITASRQSTSQ

SEQ ID NO: 1205759 - protein, 7 aa, Mycobacterium
GITEGTP

SEQ ID NO: 1205760 - protein, 5 aa, Mycobacterium
GITGA

SEQ ID NO: 1205761 - protein, 6 aa, Mycobacterium
GITGDS

SEQ ID NO: 1205762 - protein, 7 aa, Mycobacterium
GITGGAA

SEQ ID NO: 1205763 - protein, 13 aa, Mycobacterium
GITGKPGLGTESD

SEQ ID NO: 1205764 - protein, 11 aa, Mycobacterium
GITRPSGSNVE

SEQ ID NO: 1205765 - protein, 6 aa, Mycobacterium
GITSPI

SEQ ID NO: 1205766 - protein, 5 aa, Mycobacterium
GITSR

SEQ ID NO: 1205767 - protein, 14 aa, Mycobacterium
GITSRGAATQMPED

SEQ ID NO: 1205768 - protein, 5 aa, Mycobacterium
GITTK

SEQ ID NO: 1205769 - protein, 15 aa, Mycobacterium
GITVDGATAEAPTSD

SEQ ID NO: 1205770 - protein, 11 aa, Mycobacterium
GITVSDSEIDE

SEQ ID NO: 1205771 - protein, 9 aa, Mycobacterium
GKAAGVPSA

SEQ ID NO: 1205772 - protein, 20 aa, Mycobacterium
GKAARDAGQSTAGDGQPQRA

SEQ ID NO: 1205773 - protein, 19 aa, Mycobacterium
GKADGLTVTKTPTSNGSDE

SEQ ID NO: 1205774 - protein, 6 aa, Mycobacterium
GKADVV

SEQ ID NO: 1205775 - protein, 4 aa, Mycobacterium
GKAE

SEQ ID NO: 1205776 - protein, 4 aa, Mycobacterium
GKAG

SEQ ID NO: 1205777 - protein, 7 aa, Mycobacterium
GKAGCST

SEQ ID NO: 1205778 - protein, 12 aa, Mycobacterium
GKAGGAIGRNES

SEQ ID NO: 1205779 - protein, 12 aa, Mycobacterium
GKAGGAIGRNGS

SEQ ID NO: 1205780 - protein, 8 aa, Mycobacterium
GKAGGQQL

SEQ ID NO: 1205781 - protein, 102 aa, Mycobacterium
GKAKEVAGAITGNDSLTAEGQLEQAEAKERRAASRNEAEADAEAAQAREKAGEAELRGAQQRARAEVQAATAESAVRSEQAARRQMAEESGRRDVAGAQSAF

SEQ ID NO: 1205782 - protein, 9 aa, Mycobacterium
GKAKEVPAA

SEQ ID NO: 1205783 - protein, 7 aa, Mycobacterium
GKAKKRH

SEQ ID NO: 1205784 - protein, 10 aa, Mycobacterium
GKAKRDRLSR

SEQ ID NO: 1205785 - protein, 8 aa, Mycobacterium
GKAPTLSD

SEQ ID NO: 1205786 - protein, 12 aa, Mycobacterium
GKAPWKIWADQL

SEQ ID NO: 1205787 - protein, 6 aa, Mycobacterium
GKARAV

SEQ ID NO: 1205788 - protein, 5 aa, Mycobacterium
GKARE

SEQ ID NO: 1205789 - protein, 10 aa, Mycobacterium
GKATPTARSH

SEQ ID NO: 1205790 - protein, 13 aa, Mycobacterium
GKAVVSAGSRESM

SEQ ID NO: 1205791 - protein, 12 aa, Mycobacterium
GKAWGQRMRSRG

SEQ ID NO: 1205792 - protein, 4 aa, Mycobacterium
GKAY

SEQ ID NO: 1205793 - protein, 8 aa, Mycobacterium
GKAYATSN

SEQ ID NO: 1205794 - protein, 8 aa, Mycobacterium
GKAYSQSK

SEQ ID NO: 1205795 - protein, 19 aa, Mycobacterium
GKCKTFDADADGYVRSEGA

SEQ ID NO: 1205796 - protein, 7 aa, Mycobacterium
GKDGRLR

SEQ ID NO: 1205797 - protein, 12 aa, Mycobacterium
GKDMTGVPSKDR

SEQ ID NO: 1205798 - protein, 9 aa, Mycobacterium
GKDNAKYAN

SEQ ID NO: 1205799 - protein, 7 aa, Mycobacterium
GKDPQSG

SEQ ID NO: 1205800 - protein, 9 aa, Mycobacterium
GKDSPAASR

SEQ ID NO: 1205801 - protein, 7 aa, Mycobacterium
GKDVTPA

SEQ ID NO: 1205802 - protein, 7 aa, Mycobacterium
GKEEIEV

SEQ ID NO: 1205803 - protein, 10 aa, Mycobacterium
GKEFTAAEGS

SEQ ID NO: 1205804 - protein, 7 aa, Mycobacterium
GKEPRRL

SEQ ID NO: 1205805 - protein, 9 aa, Mycobacterium
GKEQPALPE

SEQ ID NO: 1205806 - protein, 14 aa, Mycobacterium
GKFQDDSAAGAVSE

SEQ ID NO: 1205807 - protein, 16 aa, Mycobacterium
GKGAADGAPDSKNPMF

SEQ ID NO: 1205808 - protein, 6 aa, Mycobacterium
GKGDGF

SEQ ID NO: 1205809 - protein, 4 aa, Mycobacterium
GKGE

SEQ ID NO: 1205810 - protein, 8 aa, Mycobacterium
GKGEGGAF

SEQ ID NO: 1205811 - protein, 7 aa, Mycobacterium
GKGEGHE

SEQ ID NO: 1205812 - protein, 9 aa, Mycobacterium
GKGERPGRK

SEQ ID NO: 1205813 - protein, 10 aa, Mycobacterium
GKGGTGKSTI

SEQ ID NO: 1205814 - protein, 7 aa, Mycobacterium
GKGITPP

SEQ ID NO: 1205815 - protein, 8 aa, Mycobacterium
GKGQGRSH

SEQ ID NO: 1205816 - protein, 8 aa, Mycobacterium
GKGRTPDD

SEQ ID NO: 1205817 - protein, 8 aa, Mycobacterium
GKGRTPEQ

SEQ ID NO: 1205818 - protein, 9 aa, Mycobacterium
GKGTQAQKL

SEQ ID NO: 1205819 - protein, 15 aa, Mycobacterium
GKGYPDDEAPARLST

SEQ ID NO: 1205820 - protein, 11 aa, Mycobacterium
GKHGDTGRSEL

SEQ ID NO: 1205821 - protein, 5 aa, Mycobacterium
GKHLG

SEQ ID NO: 1205822 - protein, 8 aa, Mycobacterium
GKHRGVGE

SEQ ID NO: 1205823 - protein, 13 aa, Mycobacterium
GKHTDDNRKGRAM

SEQ ID NO: 1205824 - protein, 7 aa, Mycobacterium
GKIDDDT

SEQ ID NO: 1205825 - protein, 5 aa, Mycobacterium
GKIDE

SEQ ID NO: 1205826 - protein, 8 aa, Mycobacterium
GKIRSRSV

SEQ ID NO: 1205827 - protein, 8 aa, Mycobacterium
GKISDGKP

SEQ ID NO: 1205828 - protein, 5 aa, Mycobacterium
GKKAD

SEQ ID NO: 1205829 - protein, 7 aa, Mycobacterium
GKKAGFT

SEQ ID NO: 1205830 - protein, 9 aa, Mycobacterium
GKKELENDP

SEQ ID NO: 1205831 - protein, 12 aa, Mycobacterium
GKKIGELSPSHK

SEQ ID NO: 1205832 - protein, 7 aa, Mycobacterium
GKKPSLA

SEQ ID NO: 1205833 - protein, 10 aa, Mycobacterium
GKKSIGPDKV

SEQ ID NO: 1205834 - protein, 5 aa, Mycobacterium
GKKVT

SEQ ID NO: 1205835 - protein, 18 aa, Mycobacterium
GKLDNGSKAIYNPHYEIQ

SEQ ID NO: 1205836 - protein, 7 aa, Mycobacterium
GKLGDTA

SEQ ID NO: 1205837 - protein, 22 aa, Mycobacterium
GKLGGTGEDEQAEAVDPEVEQA

SEQ ID NO: 1205838 - protein, 8 aa, Mycobacterium
GKLGSDPA

SEQ ID NO: 1205839 - protein, 8 aa, Mycobacterium
GKLNGTKV

SEQ ID NO: 1205840 - protein, 5 aa, Mycobacterium
GKLPG

SEQ ID NO: 1205841 - protein, 14 aa, Mycobacterium
GKLPSTDVGDTMPD

SEQ ID NO: 1205842 - protein, 7 aa, Mycobacterium
GKLRDDG

SEQ ID NO: 1205843 - protein, 8 aa, Mycobacterium
GKLSDPRP

SEQ ID NO: 1205844 - protein, 7 aa, Mycobacterium
GKNASLG

SEQ ID NO: 1205845 - protein, 11 aa, Mycobacterium
GKNERNDRTDE

SEQ ID NO: 1205846 - protein, 27 aa, Mycobacterium
GKNFSAGHDLGSEEAIAERTPGPDQHP

SEQ ID NO: 1205847 - protein, 4 aa, Mycobacterium
GKNM

SEQ ID NO: 1205848 - protein, 11 aa, Mycobacterium
GKNPTSVASDD

SEQ ID NO: 1205849 - protein, 8 aa, Mycobacterium
GKNQAARA

SEQ ID NO: 1205850 - protein, 12 aa, Mycobacterium
GKNRGPTAERPD

SEQ ID NO: 1205851 - protein, 5 aa, Mycobacterium
GKNVA

SEQ ID NO: 1205852 - protein, 7 aa, Mycobacterium
GKPADLV

SEQ ID NO: 1205853 - protein, 9 aa, Mycobacterium
GKPAEDEIT

SEQ ID NO: 1205854 - protein, 8 aa, Mycobacterium
GKPAKDDL

SEQ ID NO: 1205855 - protein, 11 aa, Mycobacterium
GKPCGREANTA

SEQ ID NO: 1205856 - protein, 4 aa, Mycobacterium
GKPD

SEQ ID NO: 1205857 - protein, 11 aa, Mycobacterium
GKPDKTADAID

SEQ ID NO: 1205858 - protein, 15 aa, Mycobacterium
GKPEHPSQSIERRTS

SEQ ID NO: 1205859 - protein, 9 aa, Mycobacterium
GKPEYSNLP

SEQ ID NO: 1205860 - protein, 11 aa, Mycobacterium
GKPGASDETRR

SEQ ID NO: 1205861 - protein, 12 aa, Mycobacterium
GKPGRLEGPDPS

SEQ ID NO: 1205862 - protein, 8 aa, Mycobacterium
GKPGTAEG

SEQ ID NO: 1205863 - protein, 7 aa, Mycobacterium
GKPGWSA

SEQ ID NO: 1205864 - protein, 11 aa, Mycobacterium
GKPGYDTPNGT

SEQ ID NO: 1205865 - protein, 11 aa, Mycobacterium
GKPGYETPNGT

SEQ ID NO: 1205866 - protein, 6 aa, Mycobacterium
GKPHDT

SEQ ID NO: 1205867 - protein, 16 aa, Mycobacterium
GKPHPDREIPQAQSAH

SEQ ID NO: 1205868 - protein, 9 aa, Mycobacterium
GKPKGEPVE

SEQ ID NO: 1205869 - protein, 33 aa, Mycobacterium
GKPLQSVAKGEVDLDSDADNDGQDAERQEREQG

SEQ ID NO: 1205870 - protein, 13 aa, Mycobacterium
GKPLREYRAPKRR

SEQ ID NO: 1205871 - protein, 8 aa, Mycobacterium
GKPNLDGF

SEQ ID NO: 1205872 - protein, 14 aa, Mycobacterium
GKPQDAVSGASAGY

SEQ ID NO: 1205873 - protein, 10 aa, Mycobacterium
GKPQSTGEQI

SEQ ID NO: 1205874 - protein, 13 aa, Mycobacterium
GKPRGDERGGDSA

SEQ ID NO: 1205875 - protein, 6 aa, Mycobacterium
GKPRLD

SEQ ID NO: 1205876 - protein, 9 aa, Mycobacterium
GKPSSTLEQ

SEQ ID NO: 1205877 - protein, 7 aa, Mycobacterium
GKPTAEE

SEQ ID NO: 1205878 - protein, 12 aa, Mycobacterium
GKPTDQLPGPGK

SEQ ID NO: 1205879 - protein, 7 aa, Mycobacterium
GKPTTVN

SEQ ID NO: 1205880 - protein, 5 aa, Mycobacterium
GKPVK

SEQ ID NO: 1205881 - protein, 20 aa, Mycobacterium
GKPVLTEKPYARDRGEAARV

SEQ ID NO: 1205882 - protein, 6 aa, Mycobacterium
GKPVPD

SEQ ID NO: 1205883 - protein, 5 aa, Mycobacterium
GKQAA

SEQ ID NO: 1205884 - protein, 32 aa, Mycobacterium; identical to SEQ ID NO: 488732

SEQ ID NO: 1205885 - protein, 9 aa, Mycobacterium
GKQDGAMQA

SEQ ID NO: 1205886 - protein, 9 aa, Mycobacterium
GKQFDGTGN

SEQ ID NO: 1205887 - protein, 16 aa, Mycobacterium
GKQPPANPAPPAPLPS

SEQ ID NO: 1205888 - protein, 7 aa, Mycobacterium
GKQPSPN

SEQ ID NO: 1205889 - protein, 11 aa, Mycobacterium
GKQSPDIAQGV

SEQ ID NO: 1205890 - protein, 14 aa, Mycobacterium
GKRESGADGQQPRA

SEQ ID NO: 1205891 - protein, 4 aa, Mycobacterium
GKRG

SEQ ID NO: 1205892 - protein, 15 aa, Mycobacterium
GKRGSGIAGSVAVFA

SEQ ID NO: 1205893 - protein, 13 aa, Mycobacterium
GKRQQKLAAQPVS

SEQ ID NO: 1205894 - protein, 12 aa, Mycobacterium
GKRRSNQAADGI

SEQ ID NO: 1205895 - protein, 14 aa, Mycobacterium
GKRRSNQAENGIQS

SEQ ID NO: 1205896 - protein, 7 aa, Mycobacterium
GKRSGVA

SEQ ID NO: 1205897 - protein, 7 aa, Mycobacterium
GKRTLTN

SEQ ID NO: 1205898 - protein, 7 aa, Mycobacterium
GKRTLTT

SEQ ID NO: 1205899 - protein, 10 aa, Mycobacterium
GKRVGTPFAS

SEQ ID NO: 1205900 - protein, 8 aa, Mycobacterium
GKSAGVNA

SEQ ID NO: 1205901 - protein, 5 aa, Mycobacterium
GKSAN

SEQ ID NO: 1205902 - protein, 7 aa, Mycobacterium
GKSHGSR

SEQ ID NO: 1205903 - protein, 8 aa, Mycobacterium
GKSIRRPL

SEQ ID NO: 1205904 - protein, 12 aa, Mycobacterium
GKSLKNSVSPDE

SEQ ID NO: 1205905 - protein, 8 aa, Mycobacterium
GKSPDAAR

SEQ ID NO: 1205906 - protein, 10 aa, Mycobacterium
GKSPERIASQ

SEQ ID NO: 1205907 - protein, 11 aa, Mycobacterium
GKSRDDWSAET

SEQ ID NO: 1205908 - protein, 6 aa, Mycobacterium
GKSTLA

SEQ ID NO: 1205909 - protein, 12 aa, Mycobacterium
GKSYDRNDPPMN

SEQ ID NO: 1205910 - protein, 7 aa, Mycobacterium
GKSYGNI

SEQ ID NO: 1205911 - protein, 6 aa, Mycobacterium
GKTALD

SEQ ID NO: 1205912 - protein, 8 aa, Mycobacterium
GKTAPRIA

SEQ ID NO: 1205913 - protein, 22 aa, Mycobacterium
GKTAYASDPGMTNTAITRDGSG

SEQ ID NO: 1205914 - protein, 9 aa, Mycobacterium
GKTDARNEE

SEQ ID NO: 1205915 - protein, 12 aa, Mycobacterium
GKTEKRISTTAE

SEQ ID NO: 1205916 - protein, 4 aa, Mycobacterium
GKTF

SEQ ID NO: 1205917 - protein, 11 aa, Mycobacterium
GKTGTTESHRS

SEQ ID NO: 1205918 - protein, 8 aa, Mycobacterium
GKTHGATD

SEQ ID NO: 1205919 - protein, 7 aa, Mycobacterium
GKTNSAI

SEQ ID NO: 1205920 - protein, 6 aa, Mycobacterium
GKTPKK

SEQ ID NO: 1205921 - protein, 8 aa, Mycobacterium
GKTQAINH

SEQ ID NO: 1205922 - protein, 13 aa, Mycobacterium
GKTSERLAASARS

SEQ ID NO: 1205923 - protein, 6 aa, Mycobacterium
GKTTAL

SEQ ID NO: 1205924 - protein, 11 aa, Mycobacterium
GKVAPGESDEA

SEQ ID NO: 1205925 - protein, 6 aa, Mycobacterium
GKVDAR

SEQ ID NO: 1205926 - protein, 12 aa, Mycobacterium
GKVDRPALRAQF

SEQ ID NO: 1205927 - protein, 20 aa, Mycobacterium
GKVDSGSQVVNSTKGKKERL

SEQ ID NO: 1205928 - protein, 9 aa, Mycobacterium
GKVEESGRS

SEQ ID NO: 1205929 - protein, 16 aa, Mycobacterium
GKVGEPQVAEGEPGQP

SEQ ID NO: 1205930 - protein, 5 aa, Mycobacterium
GKVGV

SEQ ID NO: 1205931 - protein, 16 aa, Mycobacterium
GKVRESRIDDRGQEFP

SEQ ID NO: 1205932 - protein, 17 aa, Mycobacterium
GKVSDDADEADNEADAV

SEQ ID NO: 1205933 - protein, 8 aa, Mycobacterium
GKVYGRTA

SEQ ID NO: 1205934 - protein, 7 aa, Mycobacterium
GKYDTTG

SEQ ID NO: 1205935 - protein, 8 aa, Mycobacterium
GKYGAPTY

SEQ ID NO: 1205936 - protein, 7 aa, Mycobacterium
GKYGTTV

SEQ ID NO: 1205937 - protein, 10 aa, Mycobacterium
GKYPPPPGAS

SEQ ID NO: 1205938 - protein, 4 aa, Mycobacterium
GKYY

SEQ ID NO: 1205939 - protein, 6 aa, Mycobacterium
GKYYTG

SEQ ID NO: 1205940 - protein, 8 aa, Mycobacterium
GLAAASTE

SEQ ID NO: 1205941 - protein, 16 aa, Mycobacterium
GLAAQGPVANVVDYPL

SEQ ID NO: 1205942 - protein, 9 aa, Mycobacterium
GLAASPPVG

SEQ ID NO: 1205943 - protein, 8 aa, Mycobacterium
GLAASPSA

SEQ ID NO: 1205944 - protein, 8 aa, Mycobacterium
GLADEDTA

SEQ ID NO: 1205945 - protein, 10 aa, Mycobacterium
GLADEKDGAQ

SEQ ID NO: 1205946 - protein, 6 aa, Mycobacterium
GLADGA

SEQ ID NO: 1205947 - protein, 6 aa, Mycobacterium
GLADPT

SEQ ID NO: 1205948 - protein, 20 aa, Mycobacterium
GLADTTRGDGGHGSSGGHAS

SEQ ID NO: 1205949 - protein, 7 aa, Mycobacterium
GLAEQAN

SEQ ID NO: 1205950 - protein, 8 aa, Mycobacterium
GLAGDPEF

SEQ ID NO: 1205951 - protein, 5 aa, Mycobacterium
GLAGP

SEQ ID NO: 1205952 - protein, 21 aa, Mycobacterium
GLAHGDTDDTQQALLDACERM

SEQ ID NO: 1205953 - protein, 12 aa, Mycobacterium
GLAPADLRGSRT

SEQ ID NO: 1205954 - protein, 10 aa, Mycobacterium
GLAPASRAEL

SEQ ID NO: 1205955 - protein, 11 aa, Mycobacterium
GLAPDTLSETR

SEQ ID NO: 1205956 - protein, 8 aa, Mycobacterium
GLAPPASV

SEQ ID NO: 1205957 - protein, 7 aa, Mycobacterium
GLAPPDS

SEQ ID NO: 1205958 - protein, 8 aa, Mycobacterium
GLAPPGSV

SEQ ID NO: 1205959 - protein, 8 aa, Mycobacterium
GLAPRGTQ

SEQ ID NO: 1205960 - protein, 9 aa, Mycobacterium
GLAPRPGPA

SEQ ID NO: 1205961 - protein, 11 aa, Mycobacterium
GLAPTKSAGVP

SEQ ID NO: 1205962 - protein, 4 aa, Mycobacterium
GLAT

SEQ ID NO: 1205963 - protein, 6 aa, Mycobacterium
GLATDD

SEQ ID NO: 1205964 - protein, 10 aa, Mycobacterium
GLATDDPHSP

SEQ ID NO: 1205965 - protein, 8 aa, Mycobacterium
GLATPGVD

SEQ ID NO: 1205966 - protein, 14 aa, Mycobacterium
GLATTGKADKWTAT

SEQ ID NO: 1205967 - protein, 7 aa, Mycobacterium
GLDDESW

SEQ ID NO: 1205968 - protein, 17 aa, Mycobacterium
GLDDPHAGPVPEPPPGV

SEQ ID NO: 1205969 - protein, 7 aa, Mycobacterium
GLDEESL

SEQ ID NO: 1205970 - protein, 10 aa, Mycobacterium
GLDEKSTLGP

SEQ ID NO: 1205971 - protein, 4 aa, Mycobacterium
GLDG

SEQ ID NO: 1205972 - protein, 12 aa, Mycobacterium
GLDGAPATDDMN

SEQ ID NO: 1205973 - protein, 7 aa, Mycobacterium
GLDNPNG

SEQ ID NO: 1205974 - protein, 4 aa, Mycobacterium
GLDP

SEQ ID NO: 1205975 - protein, 6 aa, Mycobacterium
GLDPED

SEQ ID NO: 1205976 - protein, 7 aa, Mycobacterium
GLDPETV

SEQ ID NO: 1205977 - protein, 6 aa, Mycobacterium
GLDPHP

SEQ ID NO: 1205978 - protein, 8 aa, Mycobacterium
GLDPTRGD

SEQ ID NO: 1205979 - protein, 7 aa, Mycobacterium
GLDQEGV

SEQ ID NO: 1205980 - protein, 9 aa, Mycobacterium
GLDRKGNDA

SEQ ID NO: 1205981 - protein, 12 aa, Mycobacterium
GLDRTGIPTTAA

SEQ ID NO: 1205982 - protein, 7 aa, Mycobacterium
GLDSTEG

SEQ ID NO: 1205983 - protein, 30 aa, Mycobacterium
GLDTPRGAEADRCGDTDGQTGRPPVTLTER

SEQ ID NO: 1205984 - protein, 8 aa, Mycobacterium
GLEAGDGD

SEQ ID NO: 1205985 - protein, 5 aa, Mycobacterium
GLEAR

SEQ ID NO: 1205986 - protein, 4 aa, Mycobacterium
GLEE

SEQ ID NO: 1205987 - protein, 6 aa, Mycobacterium
GLEGPA

SEQ ID NO: 1205988 - protein, 7 aa, Mycobacterium
GLEPASP

SEQ ID NO: 1205989 - protein, 5 aa, Mycobacterium
GLEPQ

SEQ ID NO: 1205990 - protein, 18 aa, Mycobacterium
GLEQPGREEKAPVTPPGH

SEQ ID NO: 1205991 - protein, 7 aa, Mycobacterium
GLEQPRS

SEQ ID NO: 1205992 - protein, 6 aa, Mycobacterium
GLESRD

SEQ ID NO: 1205993 - protein, 5 aa, Mycobacterium
GLESS

SEQ ID NO: 1205994 - protein, 13 aa, Mycobacterium
GLGAGVEETPTEL

SEQ ID NO: 1205995 - protein, 10 aa, Mycobacterium
GLGATAANPI

SEQ ID NO: 1205996 - protein, 22 aa, Mycobacterium
GLGDVPPDEVGPMTTQEPNGNV

SEQ ID NO: 1205997 - protein, 4 aa, Mycobacterium
GLGE

SEQ ID NO: 1205998 - protein, 7 aa, Mycobacterium
GLGENTA

SEQ ID NO: 1205999 - protein, 10 aa, Mycobacterium
GLGGAQRKIE

SEQ ID NO: 1206000 - protein, 8 aa, Mycobacterium
GLGGARRG

SEQ ID NO: 1206001 - protein, 5 aa, Mycobacterium
GLGGD

SEQ ID NO: 1206002 - protein, 9 aa, Mycobacterium
GLGGDRGAQ

SEQ ID NO: 1206003 - protein, 16 aa, Mycobacterium
GLGGQNRKIEQALKPG

SEQ ID NO: 1206004 - protein, 8 aa, Mycobacterium
GLGGSKSQ

SEQ ID NO: 1206005 - protein, 5 aa, Mycobacterium
GLGNG

SEQ ID NO: 1206006 - protein, 7 aa, Mycobacterium
GLGPAER

SEQ ID NO: 1206007 - protein, 19 aa, Mycobacterium
GLGPRQGSGGRCRRSGGGE

SEQ ID NO: 1206008 - protein, 9 aa, Mycobacterium
GLGPSGPQV

SEQ ID NO: 1206009 - protein, 9 aa, Mycobacterium
GLGPSQGAE

SEQ ID NO: 1206010 - protein, 6 aa, Mycobacterium
GLGPVG

SEQ ID NO: 1206011 - protein, 5 aa, Mycobacterium
GLGQT

SEQ ID NO: 1206012 - protein, 6 aa, Mycobacterium
GLGRKG

SEQ ID NO: 1206013 - protein, 5 aa, Mycobacterium
GLGRP

SEQ ID NO: 1206014 - protein, 11 aa, Mycobacterium
GLGSDDPDEMS

SEQ ID NO: 1206015 - protein, 7 aa, Mycobacterium
GLGSTSA

SEQ ID NO: 1206016 - protein, 5 aa, Mycobacterium
GLGSV

SEQ ID NO: 1206017 - protein, 8 aa, Mycobacterium
GLGTPKDL

SEQ ID NO: 1206018 - protein, 4 aa, Mycobacterium
GLGV

SEQ ID NO: 1206019 - protein, 5 aa, Mycobacterium
GLHGD

SEQ ID NO: 1206020 - protein, 10 aa, Mycobacterium
GLHPSGKGSE

SEQ ID NO: 1206021 - protein, 6 aa, Mycobacterium
GLHSNG

SEQ ID NO: 1206022 - protein, 12 aa, Mycobacterium
GLKPRRVNTAGK

SEQ ID NO: 1206023 - protein, 6 aa, Mycobacterium
GLKPSD

SEQ ID NO: 1206024 - protein, 5 aa, Mycobacterium
GLKPY

SEQ ID NO: 1206025 - protein, 4 aa, Mycobacterium
GLKR

SEQ ID NO: 1206026 - protein, 11 aa, Mycobacterium
GLNDPGNKTFV

SEQ ID NO: 1206027 - protein, 9 aa, Mycobacterium
GLNEGNAVT

SEQ ID NO: 1206028 - protein, 8 aa, Mycobacterium
GLNPAGMA

SEQ ID NO: 1206029 - protein, 5 aa, Mycobacterium
GLPAD

SEQ ID NO: 1206030 - protein, 6 aa, Mycobacterium
GLPADG

SEQ ID NO: 1206031 - protein, 14 aa, Mycobacterium
GLPADTALTTGGEV

SEQ ID NO: 1206032 - protein, 7 aa, Mycobacterium
GLPAGDP

SEQ ID NO: 1206033 - protein, 9 aa, Mycobacterium
GLPAGTQFQ

SEQ ID NO: 1206034 - protein, 5 aa, Mycobacterium
GLPAN

SEQ ID NO: 1206035 - protein, 15 aa, Mycobacterium
GLPAPKEAMRAALES

SEQ ID NO: 1206036 - protein, 14 aa, Mycobacterium
GLPAPKGKPPAEVT

SEQ ID NO: 1206037 - protein, 8 aa, Mycobacterium
GLPAPTGR

SEQ ID NO: 1206038 - protein, 27 aa, Mycobacterium
GLPARAPSGLGLREPPGVRPRAGLEPN

SEQ ID NO: 1206039 - protein, 16 aa, Mycobacterium
GLPATPAKSDADVAKS

SEQ ID NO: 1206040 - protein, 8 aa, Mycobacterium
GLPDAKSV

SEQ ID NO: 1206041 - protein, 7 aa, Mycobacterium
GLPDGDL

SEQ ID NO: 1206042 - protein, 7 aa, Mycobacterium
GLPDQPI

SEQ ID NO: 1206043 - protein, 12 aa, Mycobacterium
GLPDQSGPLGPL

SEQ ID NO: 1206044 - protein, 6 aa, Mycobacterium
GLPDRE

SEQ ID NO: 1206045 - protein, 16 aa, Mycobacterium
GLPDSTRINPSGGALA

SEQ ID NO: 1206046 - protein, 6 aa, Mycobacterium
GLPDYS

SEQ ID NO: 1206047 - protein, 5 aa, Mycobacterium
GLPED

SEQ ID NO: 1206048 - protein, 9 aa, Mycobacterium
GLPEDPSHA

SEQ ID NO: 1206049 - protein, 14 aa, Mycobacterium
GLPEEWSPESESSR

SEQ ID NO: 1206050 - protein, 13 aa, Mycobacterium
GLPEGDPPPPLPE

SEQ ID NO: 1206051 - protein, 22 aa, Mycobacterium
GLPEGDTSTIETTGSASATAVT

SEQ ID NO: 1206052 - protein, 12 aa, Mycobacterium
GLPEPGVPLPDE

SEQ ID NO: 1206053 - protein, 5 aa, Mycobacterium
GLPET

SEQ ID NO: 1206054 - protein, 5 aa, Mycobacterium
GLPEY

SEQ ID NO: 1206055 - protein, 8 aa, Mycobacterium
GLPGADDA

SEQ ID NO: 1206056 - protein, 6 aa, Mycobacterium
GLPGAR

SEQ ID NO: 1206057 - protein, 9 aa, Mycobacterium
GLPGDGARQ

SEQ ID NO: 1206058 - protein, 18 aa, Mycobacterium
GLPGEHNIGGPISTETRV

SEQ ID NO: 1206059 - protein, 5 aa, Mycobacterium
GLPGG

SEQ ID NO: 1206060 - protein, 30 aa, Mycobacterium
GLPGPSADLDGIPTSASEAAGAAPARHANG

SEQ ID NO: 1206061 - protein, 13 aa, Mycobacterium
GLPGQRSVASAAD

SEQ ID NO: 1206062 - protein, 7 aa, Mycobacterium
GLPGREQ

SEQ ID NO: 1206063 - protein, 7 aa, Mycobacterium
GLPGTQV

SEQ ID NO: 1206064 - protein, 7 aa, Mycobacterium
GLPGTVT

SEQ ID NO: 1206065 - protein, 9 aa, Mycobacterium
GLPKGDALA

SEQ ID NO: 1206066 - protein, 14 aa, Mycobacterium
GLPKPSLSDLTPEF

SEQ ID NO: 1206067 - protein, 7 aa, Mycobacterium
GLPNDAT

SEQ ID NO: 1206068 - protein, 7 aa, Mycobacterium
GLPNETN

SEQ ID NO: 1206069 - protein, 10 aa, Mycobacterium
GLPNRKDVKD

SEQ ID NO: 1206070 - protein, 4 aa, Mycobacterium
GLPP

SEQ ID NO: 1206071 - protein, 5 aa, Mycobacterium
GLPPA

SEQ ID NO: 1206072 - protein, 13 aa, Mycobacterium
GLPPDSAEAMNAA

SEQ ID NO: 1206073 - protein, 6 aa, Mycobacterium
GLPPEE

SEQ ID NO: 1206074 - protein, 9 aa, Mycobacterium
GLPPGEAAA

SEQ ID NO: 1206075 - protein, 16 aa, Mycobacterium
GLPPGTPGADGKVAGH

SEQ ID NO: 1206076 - protein, 30 aa, Mycobacterium
GLPPGTPGADGKVAGHTEPPSPQPEKPFSS

SEQ ID NO: 1206077 - protein, 5 aa, Mycobacterium
GLPPP

SEQ ID NO: 1206078 - protein, 18 aa, Mycobacterium
GLPPPASPQPDYGNDPPP

SEQ ID NO: 1206079 - protein, 14 aa, Mycobacterium
GLPPPPGYGDDPPP

SEQ ID NO: 1206080 - protein, 7 aa, Mycobacterium
GLPPRDR

SEQ ID NO: 1206081 - protein, 15 aa, Mycobacterium
GLPPTGVTDLSSRTR

SEQ ID NO: 1206082 - protein, 13 aa, Mycobacterium
GLPRPQACDPTPN

SEQ ID NO: 1206083 - protein, 6 aa, Mycobacterium
GLPRQD

SEQ ID NO: 1206084 - protein, 7 aa, Mycobacterium
GLPRQDQ

SEQ ID NO: 1206085 - protein, 5 aa, Mycobacterium
GLPRR

SEQ ID NO: 1206086 - protein, 5 aa, Mycobacterium
GLPSG

SEQ ID NO: 1206087 - protein, 5 aa, Mycobacterium
GLPSP

SEQ ID NO: 1206088 - protein, 9 aa, Mycobacterium
GLPSRSAAI

SEQ ID NO: 1206089 - protein, 14 aa, Mycobacterium
GLPSSPGVTGAAAA

SEQ ID NO: 1206090 - protein, 7 aa, Mycobacterium
GLPSSPW

SEQ ID NO: 1206091 - protein, 8 aa, Mycobacterium
GLPSTPSH

SEQ ID NO: 1206092 - protein, 13 aa, Mycobacterium
GLPTAEKAAGRAA

SEQ ID NO: 1206093 - protein, 7 aa, Mycobacterium
GLPTDPD

SEQ ID NO: 1206094 - protein, 12 aa, Mycobacterium
GLPTEGGTYLGD

SEQ ID NO: 1206095 - protein, 8 aa, Mycobacterium
GLPTPSEG

SEQ ID NO: 1206096 - protein, 9 aa, Mycobacterium
GLPTPSEGV

SEQ ID NO: 1206097 - protein, 5 aa, Mycobacterium
GLPTS

SEQ ID NO: 1206098 - protein, 6 aa, Mycobacterium
GLPTSP

SEQ ID NO: 1206099 - protein, 21 aa, Mycobacterium
GLQARAGAGADKAAAEAAEPL

SEQ ID NO: 1206100 - protein, 22 aa, Mycobacterium
GLQARAGGGNGNKPEAEAAEPL

SEQ ID NO: 1206101 - protein, 8 aa, Mycobacterium
GLQARTDV

SEQ ID NO: 1206102 - protein, 5 aa, Mycobacterium
GLQEK

SEQ ID NO: 1206103 - protein, 10 aa, Mycobacterium
GLQGGGLGYA

SEQ ID NO: 1206104 - protein, 12 aa, Mycobacterium
GLQSDDRAEHER

SEQ ID NO: 1206105 - protein, 5 aa, Mycobacterium
GLQSG

SEQ ID NO: 1206106 - protein, 9 aa, Mycobacterium
GLRASTRKA

SEQ ID NO: 1206107 - protein, 6 aa, Mycobacterium
GLRDDE

SEQ ID NO: 1206108 - protein, 9 aa, Mycobacterium
GLRGAQQKL

SEQ ID NO: 1206109 - protein, 17 aa, Mycobacterium
GLRGQGPAIGEATTAAN

SEQ ID NO: 1206110 - protein, 18 aa, Mycobacterium
GLRGTAGSAVYDATKASV

SEQ ID NO: 1206111 - protein, 16 aa, Mycobacterium
GLRPDDAAKVSLSPAR

SEQ ID NO: 1206112 - protein, 6 aa, Mycobacterium
GLRPDG

SEQ ID NO: 1206113 - protein, 10 aa, Mycobacterium
GLRPEAGGRF

SEQ ID NO: 1206114 - protein, 5 aa, Mycobacterium
GLRPG

SEQ ID NO: 1206115 - protein, 11 aa, Mycobacterium
GLRPGPRHAPT

SEQ ID NO: 1206116 - protein, 21 aa, Mycobacterium
GLRPGRKWSDSNSFRMYAVQP

SEQ ID NO: 1206117 - protein, 15 aa, Mycobacterium
GLRPGSIADANDAAQ

SEQ ID NO: 1206118 - protein, 10 aa, Mycobacterium
GLRQASDGTF

SEQ ID NO: 1206119 - protein, 9 aa, Mycobacterium
GLRRGDAVT

SEQ ID NO: 1206120 - protein, 7 aa, Mycobacterium
GLRRPGK

SEQ ID NO: 1206121 - protein, 11 aa, Mycobacterium
GLRRSDTLTGR

SEQ ID NO: 1206122 - protein, 4 aa, Mycobacterium
GLRS

SEQ ID NO: 1206123 - protein, 8 aa, Mycobacterium
GLRSAESE

SEQ ID NO: 1206124 - protein, 9 aa, Mycobacterium
GLRSAGSIA

SEQ ID NO: 1206125 - protein, 9 aa, Mycobacterium
GLRSGKGRF

SEQ ID NO: 1206126 - protein, 8 aa, Mycobacterium
GLRSQPSE

SEQ ID NO: 1206127 - protein, 9 aa, Mycobacterium
GLRYGEKAK

SEQ ID NO: 1206128 - protein, 16 aa, Mycobacterium
GLSAAVNDNDSKFPPE

SEQ ID NO: 1206129 - protein, 4 aa, Mycobacterium
GLSD

SEQ ID NO: 1206130 - protein, 8 aa, Mycobacterium
GLSDEDRD

SEQ ID NO: 1206131 - protein, 9 aa, Mycobacterium
GLSDGEARD

SEQ ID NO: 1206132 - protein, 21 aa, Mycobacterium
GLSDGGRARITTAAGSAEATV

SEQ ID NO: 1206133 - protein, 6 aa, Mycobacterium
GLSDSE

SEQ ID NO: 1206134 - protein, 12 aa, Mycobacterium
GLSDSVGSQRFG

SEQ ID NO: 1206135 - protein, 6 aa, Mycobacterium
GLSEDE

SEQ ID NO: 1206136 - protein, 21 aa, Mycobacterium
GLSGPVNAVGPDPVRNSDYTR

SEQ ID NO: 1206137 - protein, 14 aa, Mycobacterium
GLSGRRDDDAQSYT

SEQ ID NO: 1206138 - protein, 13 aa, Mycobacterium
GLSGRTSREDIEE

SEQ ID NO: 1206139 - protein, 9 aa, Mycobacterium
GLSGTPGRV

SEQ ID NO: 1206140 - protein, 12 aa, Mycobacterium
GLSGTRPPGDGR

SEQ ID NO: 1206141 - protein, 11 aa, Mycobacterium
GLSGVSETTKE

SEQ ID NO: 1206142 - protein, 10 aa, Mycobacterium
GLSHSPPSLE

SEQ ID NO: 1206143 - protein, 4 aa, Mycobacterium
GLSN

SEQ ID NO: 1206144 - protein, 6 aa, Mycobacterium
GLSNKD

SEQ ID NO: 1206145 - protein, 6 aa, Mycobacterium
GLSPAD

SEQ ID NO: 1206146 - protein, 10 aa, Mycobacterium
GLSPAGRDSH

SEQ ID NO: 1206147 - protein, 21 aa, Mycobacterium
GLSPGDRGDFGTIEDSSALAE

SEQ ID NO: 1206148 - protein, 7 aa, Mycobacterium
GLSPTDR

SEQ ID NO: 1206149 - protein, 5 aa, Mycobacterium
GLSPV

SEQ ID NO: 1206150 - protein, 5 aa, Mycobacterium
GLSQE

SEQ ID NO: 1206151 - protein, 7 aa, Mycobacterium
GLSQPTV

SEQ ID NO: 1206152 - protein, 9 aa, Mycobacterium
GLSRAERRV

SEQ ID NO: 1206153 - protein, 7 aa, Mycobacterium
GLSRRDR

SEQ ID NO: 1206154 - protein, 9 aa, Mycobacterium
GLSRSTTKD

SEQ ID NO: 1206155 - protein, 6 aa, Mycobacterium
GLSSDA

SEQ ID NO: 1206156 - protein, 7 aa, Mycobacterium
GLSSNGY

SEQ ID NO: 1206157 - protein, 7 aa, Mycobacterium
GLSTADA

SEQ ID NO: 1206158 - protein, 9 aa, Mycobacterium
GLSTDEAVY

SEQ ID NO: 1206159 - protein, 18 aa, Mycobacterium
GLSTGANSRDITSDAHRS

SEQ ID NO: 1206160 - protein, 9 aa, Mycobacterium
GLTAGGDDY

SEQ ID NO: 1206161 - protein, 14 aa, Mycobacterium
GLTAPGDVSDPKSC

SEQ ID NO: 1206162 - protein, 12 aa, Mycobacterium
GLTAQQSDEEFN

SEQ ID NO: 1206163 - protein, 5 aa, Mycobacterium
GLTDE

SEQ ID NO: 1206164 - protein, 13 aa, Mycobacterium
GLTDEQVKERFKG

SEQ ID NO: 1206165 - protein, 6 aa, Mycobacterium
GLTDQT

SEQ ID NO: 1206166 - protein, 8 aa, Mycobacterium
GLTDSRDH

SEQ ID NO: 1206167 - protein, 10 aa, Mycobacterium
GLTEEDGGEF

SEQ ID NO: 1206168 - protein, 13 aa, Mycobacterium
GLTESDPASLSPA

SEQ ID NO: 1206169 - protein, 15 aa, Mycobacterium
GLTETGRDQATQTAA

SEQ ID NO: 1206170 - protein, 8 aa, Mycobacterium
GLTGAPHG

SEQ ID NO: 1206171 - protein, 9 aa, Mycobacterium
GLTGGEEAA

SEQ ID NO: 1206172 - protein, 5 aa, Mycobacterium
GLTGP

SEQ ID NO: 1206173 - protein, 14 aa, Mycobacterium
GLTHGGSGPVDRTA

SEQ ID NO: 1206174 - protein, 4 aa, Mycobacterium
GLTN

SEQ ID NO: 1206175 - protein, 4 aa, Mycobacterium
GLTP

SEQ ID NO: 1206176 - protein, 7 aa, Mycobacterium
GLTPAQY

SEQ ID NO: 1206177 - protein, 5 aa, Mycobacterium
GLTPQ

SEQ ID NO: 1206178 - protein, 6 aa, Mycobacterium
GLTPSG

SEQ ID NO: 1206179 - protein, 6 aa, Mycobacterium
GLTPYR

SEQ ID NO: 1206180 - protein, 7 aa, Mycobacterium
GLTQGRP

SEQ ID NO: 1206181 - protein, 5 aa, Mycobacterium
GLTQR

SEQ ID NO: 1206182 - protein, 6 aa, Mycobacterium
GLTSPE

SEQ ID NO: 1206183 - protein, 5 aa, Mycobacterium
GLTTN

SEQ ID NO: 1206184 - protein, 7 aa, Mycobacterium
GLTTNAA

SEQ ID NO: 1206185 - protein, 5 aa, Mycobacterium
GLVDG

SEQ ID NO: 1206186 - protein, 14 aa, Mycobacterium
GLVPGRNGDPNSDE

SEQ ID NO: 1206187 - protein, 12 aa, Mycobacterium
GLVSTGKPHEHG

SEQ ID NO: 1206188 - protein, 4 aa, Mycobacterium
GMAG

SEQ ID NO: 1206189 - protein, 9 aa, Mycobacterium
GMAGGSADA

SEQ ID NO: 1206190 - protein, 11 aa, Mycobacterium
GMAGTDQKAGC

SEQ ID NO: 1206191 - protein, 10 aa, Mycobacterium
GMAQMNSTDA

SEQ ID NO: 1206192 - protein, 11 aa, Mycobacterium
GMARDDPRRRT

SEQ ID NO: 1206193 - protein, 4 aa, Mycobacterium
GMAS

SEQ ID NO: 1206194 - protein, 5 aa, Mycobacterium
GMATG

SEQ ID NO: 1206195 - protein, 6 aa, Mycobacterium
GMDGSA

SEQ ID NO: 1206196 - protein, 6 aa, Mycobacterium
GMDNEA

SEQ ID NO: 1206197 - protein, 9 aa, Mycobacterium
GMDTGGAEP

SEQ ID NO: 1206198 - protein, 12 aa, Mycobacterium
GMESGHAYGKSL

SEQ ID NO: 1206199 - protein, 4 aa, Mycobacterium
GMGA

SEQ ID NO: 1206200 - protein, 10 aa, Mycobacterium
GMGAETATAA

SEQ ID NO: 1206201 - protein, 5 aa, Mycobacterium
GMGGT

SEQ ID NO: 1206202 - protein, 4 aa, Mycobacterium
GMGH

SEQ ID NO: 1206203 - protein, 11 aa, Mycobacterium
GMHGGDPFATA

SEQ ID NO: 1206204 - protein, 9 aa, Mycobacterium
GMKGNPPMQ

SEQ ID NO: 1206205 - protein, 22 aa, Mycobacterium
GMKNATDPGKPTQGSSYDAPVD

SEQ ID NO: 1206206 - protein, 5 aa, Mycobacterium
GMNPG

SEQ ID NO: 1206207 - protein, 8 aa, Mycobacterium
GMNQTDES

SEQ ID NO: 1206208 - protein, 4 aa, Mycobacterium
GMPD

SEQ ID NO: 1206209 - protein, 14 aa, Mycobacterium
GMPEPDPLDGAGSH

SEQ ID NO: 1206210 - protein, 7 aa, Mycobacterium
GMPESGL

SEQ ID NO: 1206211 - protein, 15 aa, Mycobacterium
GMPGGAKPFHDGEDA

SEQ ID NO: 1206212 - protein, 14 aa, Mycobacterium
GMPGPGSSALILRT

SEQ ID NO: 1206213 - protein, 22 aa, Mycobacterium
GMPIGGGKGGSDFDPKGRSDGE

SEQ ID NO: 1206214 - protein, 36 aa, Mycobacterium
GMPRNAAPPPPATPASPAGPPADASQIASAEDEDPV

SEQ ID NO: 1206215 - protein, 6 aa, Mycobacterium
GMPTRP

SEQ ID NO: 1206216 - protein, 5 aa, Mycobacterium
GMPTS

SEQ ID NO: 1206217 - protein, 5 aa, Mycobacterium
GMPVS

SEQ ID NO: 1206218 - protein, 10 aa, Mycobacterium
GMQGGGLGYA

SEQ ID NO: 1206219 - protein, 12 aa, Mycobacterium
GMQPGDPRRGAR

SEQ ID NO: 1206220 - protein, 7 aa, Mycobacterium
GMRGGEP

SEQ ID NO: 1206221 - protein, 4 aa, Mycobacterium
GMRN

SEQ ID NO: 1206222 - protein, 5 aa, Mycobacterium
GMRPE

SEQ ID NO: 1206223 - protein, 9 aa, Mycobacterium
GMRPSDPPW

SEQ ID NO: 1206224 - protein, 8 aa, Mycobacterium
GMSAEPDE

SEQ ID NO: 1206225 - protein, 10 aa, Mycobacterium
GMSAESGVPT

SEQ ID NO: 1206226 - protein, 12 aa, Mycobacterium
GMSEPSAGSDLA

SEQ ID NO: 1206227 - protein, 10 aa, Mycobacterium
GMSKLDGSVK

SEQ ID NO: 1206228 - protein, 18 aa, Mycobacterium
GMTAGNPRNPLRDLMIAA

SEQ ID NO: 1206229 - protein, 11 aa, Mycobacterium
GMTGTAETEAA

SEQ ID NO: 1206230 - protein, 6 aa, Mycobacterium
GMTTEQ

SEQ ID NO: 1206231 - protein, 14 aa, Mycobacterium
GNAAKTLSKDGPFP

SEQ ID NO: 1206232 - protein, 5 aa, Mycobacterium
GNADD

SEQ ID NO: 1206233 - protein, 6 aa, Mycobacterium
GNAEAV

SEQ ID NO: 1206234 - protein, 5 aa, Mycobacterium
GNAEG

SEQ ID NO: 1206235 - protein, 8 aa, Mycobacterium
GNAETAGS

SEQ ID NO: 1206236 - protein, 7 aa, Mycobacterium
GNAGEVR

SEQ ID NO: 1206237 - protein, 7 aa, Mycobacterium
GNAKRPY

SEQ ID NO: 1206238 - protein, 4 aa, Mycobacterium
GNAL

SEQ ID NO: 1206239 - protein, 7 aa, Mycobacterium
GNAMTDD

SEQ ID NO: 1206240 - protein, 12 aa, Mycobacterium
GNAPRPGAPRRR

SEQ ID NO: 1206241 - protein, 6 aa, Mycobacterium
GNARAG

SEQ ID NO: 1206242 - protein, 5 aa, Mycobacterium
GNART

SEQ ID NO: 1206243 - protein, 10 aa, Mycobacterium
GNASAQIGSG

SEQ ID NO: 1206244 - protein, 11 aa, Mycobacterium
GNATESPEEAD

SEQ ID NO: 1206245 - protein, 4 aa, Mycobacterium
GNAV

SEQ ID NO: 1206246 - protein, 6 aa, Mycobacterium
GNAVEY

SEQ ID NO: 1206247 - protein, 5 aa, Mycobacterium
GNDAA

SEQ ID NO: 1206248 - protein, 6 aa, Mycobacterium
GNDAAV

SEQ ID NO: 1206249 - protein, 4 aa, Mycobacterium
GNDH

SEQ ID NO: 1206250 - protein, 15 aa, Mycobacterium
GNDIGGAITNTPTRQ

SEQ ID NO: 1206251 - protein, 8 aa, Mycobacterium
GNDNPAAR

SEQ ID NO: 1206252 - protein, 7 aa, Mycobacterium
GNDNPDL

SEQ ID NO: 1206253 - protein, 5 aa, Mycobacterium
GNDNR

SEQ ID NO: 1206254 - protein, 30 aa, Mycobacterium
GNDTENDRAGDTDSDGDSATDAEKDAPRRP

SEQ ID NO: 1206255 - protein, 15 aa, Mycobacterium
GNEDDVARRNDPDRA

SEQ ID NO: 1206256 - protein, 6 aa, Mycobacterium
GNEEQR

SEQ ID NO: 1206257 - protein, 9 aa, Mycobacterium
GNEGAPRDL

SEQ ID NO: 1206258 - protein, 13 aa, Mycobacterium
GNELASGNTKDAV

SEQ ID NO: 1206259 - protein, 6 aa, Mycobacterium
GNESIG

SEQ ID NO: 1206260 - protein, 9 aa, Mycobacterium
GNETASGSV

SEQ ID NO: 1206261 - protein, 12 aa, Mycobacterium
GNETKAVAAIFP

SEQ ID NO: 1206262 - protein, 5 aa, Mycobacterium
GNFGA

SEQ ID NO: 1206263 - protein, 4 aa, Mycobacterium
GNGA

SEQ ID NO: 1206264 - protein, 9 aa, Mycobacterium
GNGAATGGA

SEQ ID NO: 1206265 - protein, 5 aa, Mycobacterium
GNGAD

SEQ ID NO: 1206266 - protein, 7 aa, Mycobacterium
GNGAIYG

SEQ ID NO: 1206267 - protein, 8 aa, Mycobacterium
GNGDTRPG

SEQ ID NO: 1206268 - protein, 8 aa, Mycobacterium
GNGEMTGT

SEQ ID NO: 1206269 - protein, 6 aa, Mycobacterium
GNGEQR

SEQ ID NO: 1206270 - protein, 32 aa, Mycobacterium
GNGGAGGAGGNGSTVNGPTSGGHGGDGGKAGL

SEQ ID NO: 1206271 - protein, 5 aa, Mycobacterium
GNGGF

SEQ ID NO: 1206272 - protein, 16 aa, Mycobacterium
GNGGGTTYKLPDGSLE

SEQ ID NO: 1206273 - protein, 22 aa, Mycobacterium
GNGGHGGRATATAAAGDGGRGG

SEQ ID NO: 1206274 - protein, 8 aa, Mycobacterium
GNGGMTPR

SEQ ID NO: 1206275 - protein, 9 aa, Mycobacterium
GNGGNGGRA

SEQ ID NO: 1206276 - protein, 14 aa, Mycobacterium
GNGGTLAPLAARGA

SEQ ID NO: 1206277 - protein, 15 aa, Mycobacterium
GNGHSEIDYSDEYRK

SEQ ID NO: 1206278 - protein, 12 aa, Mycobacterium
GNGLKDPDTALK

SEQ ID NO: 1206279 - protein, 6 aa, Mycobacterium
GNGLRR

SEQ ID NO: 1206280 - protein, 9 aa, Mycobacterium
GNGPAAAAR

SEQ ID NO: 1206281 - protein, 17 aa, Mycobacterium
GNGPAFGGHGNDNDYGY

SEQ ID NO: 1206282 - protein, 5 aa, Mycobacterium
GNGPL

SEQ ID NO: 1206283 - protein, 6 aa, Mycobacterium
GNGPQV

SEQ ID NO: 1206284 - protein, 9 aa, Mycobacterium
GNGPSFCSG

SEQ ID NO: 1206285 - protein, 6 aa, Mycobacterium
GNGRYA

SEQ ID NO: 1206286 - protein, 14 aa, Mycobacterium
GNGTRQDLDDVAGR

SEQ ID NO: 1206287 - protein, 10 aa, Mycobacterium
GNHPVGGEET

SEQ ID NO: 1206288 - protein, 5 aa, Mycobacterium
GNIGP

SEQ ID NO: 1206289 - protein, 10 aa, Mycobacterium
GNKARAIQAA

SEQ ID NO: 1206290 - protein, 5 aa, Mycobacterium
GNKGH

SEQ ID NO: 1206291 - protein, 10 aa, Mycobacterium
GNKRNSRNVA

SEQ ID NO: 1206292 - protein, 7 aa, Mycobacterium
GNLAGLP

SEQ ID NO: 1206293 - protein, 6 aa, Mycobacterium
GNLGGE

SEQ ID NO: 1206294 - protein, 16 aa, Mycobacterium
GNLPPAAKRQVRRKQR

SEQ ID NO: 1206295 - protein, 6 aa, Mycobacterium
GNLSSS

SEQ ID NO: 1206296 - protein, 8 aa, Mycobacterium
GNNDVSRY

SEQ ID NO: 1206297 - protein, 8 aa, Mycobacterium
GNNKSVAE

SEQ ID NO: 1206298 - protein, 6 aa, Mycobacterium
GNNPVR

SEQ ID NO: 1206299 - protein, 6 aa, Mycobacterium
GNNQNA

SEQ ID NO: 1206300 - protein, 21 aa, Mycobacterium
GNPAATGDGIRAGEKVGAATD

SEQ ID NO: 1206301 - protein, 5 aa, Mycobacterium
GNPAE

SEQ ID NO: 1206302 - protein, 7 aa, Mycobacterium
GNPAELG

SEQ ID NO: 1206303 - protein, 10 aa, Mycobacterium
GNPAESTRSC

SEQ ID NO: 1206304 - protein, 10 aa, Mycobacterium
GNPANLGDGI

SEQ ID NO: 1206305 - protein, 16 aa, Mycobacterium
GNPATLDGTDVAGGLE

SEQ ID NO: 1206306 - protein, 5 aa, Mycobacterium
GNPDF

SEQ ID NO: 1206307 - protein, 7 aa, Mycobacterium
GNPDRAA

SEQ ID NO: 1206308 - protein, 9 aa, Mycobacterium
GNPDRPGLL

SEQ ID NO: 1206309 - protein, 6 aa, Mycobacterium
GNPEAQ

SEQ ID NO: 1206310 - protein, 4 aa, Mycobacterium
GNPG

SEQ ID NO: 1206311 - protein, 6 aa, Mycobacterium
GNPGFR

SEQ ID NO: 1206312 - protein, 4 aa, Mycobacterium
GNPL

SEQ ID NO: 1206313 - protein, 11 aa, Mycobacterium
GNPLAAAPLSD

SEQ ID NO: 1206314 - protein, 11 aa, Mycobacterium
GNPLPGRPAAV

SEQ ID NO: 1206315 - protein, 6 aa, Mycobacterium
GNPPGL

SEQ ID NO: 1206316 - protein, 6 aa, Mycobacterium
GNPPNP

SEQ ID NO: 1206317 - protein, 10 aa, Mycobacterium
GNPPQVPWPT

SEQ ID NO: 1206318 - protein, 5 aa, Mycobacterium
GNPPY

SEQ ID NO: 1206319 - protein, 5 aa, Mycobacterium
GNPRS

SEQ ID NO: 1206320 - protein, 4 aa, Mycobacterium
GNPS

SEQ ID NO: 1206321 - protein, 16 aa, Mycobacterium
GNPSNAAAHYDGTGPE

SEQ ID NO: 1206322 - protein, 4 aa, Mycobacterium
GNPV

SEQ ID NO: 1206323 - protein, 13 aa, Mycobacterium
GNPVISGPDGAKL

SEQ ID NO: 1206324 - protein, 7 aa, Mycobacterium
GNPVTAR

SEQ ID NO: 1206325 - protein, 6 aa, Mycobacterium
GNQFPG

SEQ ID NO: 1206326 - protein, 4 aa, Mycobacterium
GNQM

SEQ ID NO: 1206327 - protein, 15 aa, Mycobacterium
GNRAASSLSGGADTL

SEQ ID NO: 1206328 - protein, 9 aa, Mycobacterium
GNRADYDGL

SEQ ID NO: 1206329 - protein, 7 aa, Mycobacterium
GNRAQDR

SEQ ID NO: 1206330 - protein, 22 aa, Mycobacterium
GNRDERQYGDDAGELDVTRKPR

SEQ ID NO: 1206331 - protein, 7 aa, Mycobacterium
GNRDERV

SEQ ID NO: 1206332 - protein, 12 aa, Mycobacterium
GNRGIRPESKFD

SEQ ID NO: 1206333 - protein, 10 aa, Mycobacterium
GNRNFEGRIS

SEQ ID NO: 1206334 - protein, 7 aa, Mycobacterium
GNRPDFD

SEQ ID NO: 1206335 - protein, 7 aa, Mycobacterium
GNRPPTI

SEQ ID NO: 1206336 - protein, 7 aa, Mycobacterium
GNRPSFD

SEQ ID NO: 1206337 - protein, 7 aa, Mycobacterium
GNRQVPE

SEQ ID NO: 1206338 - protein, 4 aa, Mycobacterium
GNRR

SEQ ID NO: 1206339 - protein, 14 aa, Mycobacterium
GNRSAPEPRYTPSQ

SEQ ID NO: 1206340 - protein, 19 aa, Mycobacterium
GNRSIGAAKAATEAGIAPS

SEQ ID NO: 1206341 - protein, 8 aa, Mycobacterium
GNRTGADG

SEQ ID NO: 1206342 - protein, 6 aa, Mycobacterium
GNRTHT

SEQ ID NO: 1206343 - protein, 15 aa, Mycobacterium
GNSGVVEDPTASPTA

SEQ ID NO: 1206344 - protein, 7 aa, Mycobacterium
GNSHRPT

SEQ ID NO: 1206345 - protein, 7 aa, Mycobacterium
GNSNGDI

SEQ ID NO: 1206346 - protein, 15 aa, Mycobacterium
GNSPDAARRAAADGI

SEQ ID NO: 1206347 - protein, 7 aa, Mycobacterium
GNSPLEA

SEQ ID NO: 1206348 - protein, 6 aa, Mycobacterium
GNSREQ

SEQ ID NO: 1206349 - protein, 10 aa, Mycobacterium
GNSSQISDGA

SEQ ID NO: 1206350 - protein, 8 aa, Mycobacterium
GNTECPGN

SEQ ID NO: 1206351 - protein, 6 aa, Mycobacterium
GNTNFG

SEQ ID NO: 1206352 - protein, 7 aa, Mycobacterium
GNTPQRV

SEQ ID NO: 1206353 - protein, 12 aa, Mycobacterium
GNTPTEQEVSEH

SEQ ID NO: 1206354 - protein, 6 aa, Mycobacterium
GNTRLG

SEQ ID NO: 1206355 - protein, 4 aa, Mycobacterium
GNTT

SEQ ID NO: 1206356 - protein, 23 aa, Mycobacterium
GNTYPLSRPEDLDETARLAEKEG

SEQ ID NO: 1206357 - protein, 9 aa, Mycobacterium
GNVASSTTV

SEQ ID NO: 1206358 - protein, 4 aa, Mycobacterium
GNVD

SEQ ID NO: 1206359 - protein, 11 aa, Mycobacterium
GNVDKGIQKSE

SEQ ID NO: 1206360 - protein, 10 aa, Mycobacterium
GNVGKSSVAA

SEQ ID NO: 1206361 - protein, 7 aa, Mycobacterium
GNVNATA

SEQ ID NO: 1206362 - protein, 4 aa, Mycobacterium
GNVR

SEQ ID NO: 1206363 - protein, 8 aa, Mycobacterium
GNVRGPYK

SEQ ID NO: 1206364 - protein, 6 aa, Mycobacterium
GNVRPA

SEQ ID NO: 1206365 - protein, 5 aa, Mycobacterium
GNVRT

SEQ ID NO: 1206366 - protein, 8 aa, Mycobacterium
GNVSSATE

SEQ ID NO: 1206367 - protein, 4 aa, Mycobacterium
GNVW

SEQ ID NO: 1206368 - protein, 14 aa, Mycobacterium
GNYGWPQAEGNCTG

SEQ ID NO: 1206369 - protein, 14 aa, Mycobacterium
GNYGWPQAEGSCTG

SEQ ID NO: 1206370 - protein, 7 aa, Mycobacterium
GNYPERG

SEQ ID NO: 1206371 - protein, 6 aa, Mycobacterium
GNYRGT

SEQ ID NO: 1206372 - protein, 11 aa, Mycobacterium
GPAAAARGPED

SEQ ID NO: 1206373 - protein, 7 aa, Mycobacterium
GPAATLA

SEQ ID NO: 1206374 - protein, 8 aa, Mycobacterium
GPAAVSGP

SEQ ID NO: 1206375 - protein, 6 aa, Mycobacterium
GPADAV

SEQ ID NO: 1206376 - protein, 8 aa, Mycobacterium
GPADDATR

SEQ ID NO: 1206377 - protein, 9 aa, Mycobacterium
GPADEAGAA

SEQ ID NO: 1206378 - protein, 5 aa, Mycobacterium
GPADG

SEQ ID NO: 1206379 - protein, 8 aa, Mycobacterium
GPADGEIP

SEQ ID NO: 1206380 - protein, 8 aa, Mycobacterium
GPADGGSN

SEQ ID NO: 1206381 - protein, 12 aa, Mycobacterium
GPADSWSAPDQT

SEQ ID NO: 1206382 - protein, 8 aa, Mycobacterium
GPAEDTTA

SEQ ID NO: 1206383 - protein, 23 aa, Mycobacterium
GPAELTDTDRSRLADAGAAVDER

SEQ ID NO: 1206384 - protein, 10 aa, Mycobacterium
GPAGGDGPQN

SEQ ID NO: 1206385 - protein, 6 aa, Mycobacterium
GPAGPA

SEQ ID NO: 1206386 - protein, 8 aa, Mycobacterium
GPAGSGKT

SEQ ID NO: 1206387 - protein, 6 aa, Mycobacterium
GPAGSI

SEQ ID NO: 1206388 - protein, 11 aa, Mycobacterium
GPAGYDTAAEL

SEQ ID NO: 1206389 - protein, 6 aa, Mycobacterium
GPAGYE

SEQ ID NO: 1206390 - protein, 9 aa, Mycobacterium
GPAIAPAGE

SEQ ID NO: 1206391 - protein, 5 aa, Mycobacterium
GPAIE

SEQ ID NO: 1206392 - protein, 17 aa, Mycobacterium
GPAIEAPAATRNPADRV

SEQ ID NO: 1206393 - protein, 5 aa, Mycobacterium
GPAIG

SEQ ID NO: 1206394 - protein, 5 aa, Mycobacterium
GPALS

SEQ ID NO: 1206395 - protein, 20 aa, Mycobacterium
GPANVTRSDRSLSLSEDPPV

SEQ ID NO: 1206396 - protein, 6 aa, Mycobacterium
GPAPAG

SEQ ID NO: 1206397 - protein, 8 aa, Mycobacterium
GPAPARQS

SEQ ID NO: 1206398 - protein, 7 aa, Mycobacterium
GPAPDYD

SEQ ID NO: 1206399 - protein, 9 aa, Mycobacterium
GPAPEPVTR

SEQ ID NO: 1206400 - protein, 6 aa, Mycobacterium
GPAPEV

SEQ ID NO: 1206401 - protein, 14 aa, Mycobacterium
GPAPFQPGEWTDGT

SEQ ID NO: 1206402 - protein, 8 aa, Mycobacterium
GPAPLGGL

SEQ ID NO: 1206403 - protein, 5 aa, Mycobacterium
GPAPQ

SEQ ID NO: 1206404 - protein, 9 aa, Mycobacterium
GPAPSGRET

SEQ ID NO: 1206405 - protein, 9 aa, Mycobacterium
GPAPTAGPV

SEQ ID NO: 1206406 - protein, 4 aa, Mycobacterium
GPAQ

SEQ ID NO: 1206407 - protein, 6 aa, Mycobacterium
GPAQAL

SEQ ID NO: 1206408 - protein, 20 aa, Mycobacterium
GPARGAHERQWDPRDPAPDL

SEQ ID NO: 1206409 - protein, 8 aa, Mycobacterium
GPARGASK

SEQ ID NO: 1206410 - protein, 6 aa, Mycobacterium
GPARMS

SEQ ID NO: 1206411 - protein, 15 aa, Mycobacterium
GPARRARKSDHEAVD

SEQ ID NO: 1206412 - protein, 10 aa, Mycobacterium
GPASAAGGVT

SEQ ID NO: 1206413 - protein, 17 aa, Mycobacterium
GPASDLEEALRRIGAWL

SEQ ID NO: 1206414 - protein, 9 aa, Mycobacterium
GPASGLGVD

SEQ ID NO: 1206415 - protein, 10 aa, Mycobacterium
GPATGSFAEE

SEQ ID NO: 1206416 - protein, 6 aa, Mycobacterium
GPCEHP

SEQ ID NO: 1206417 - protein, 8 aa, Mycobacterium
GPCGPSSE

SEQ ID NO: 1206418 - protein, 11 aa, Mycobacterium
GPCHSTGPGDL

SEQ ID NO: 1206419 - protein, 4 aa, Mycobacterium
GPDA

SEQ ID NO: 1206420 - protein, 5 aa, Mycobacterium
GPDAA

SEQ ID NO: 1206421 - protein, 8 aa, Mycobacterium
GPDAALAA

SEQ ID NO: 1206422 - protein, 20 aa, Mycobacterium
GPDADYMTGQSGLIDGGLVY

SEQ ID NO: 1206423 - protein, 8 aa, Mycobacterium
GPDAGNVT

SEQ ID NO: 1206424 - protein, 9 aa, Mycobacterium
GPDALDPRH

SEQ ID NO: 1206425 - protein, 9 aa, Mycobacterium
GPDAPPVRT

SEQ ID NO: 1206426 - protein, 7 aa, Mycobacterium
GPDATQA

SEQ ID NO: 1206427 - protein, 19 aa, Mycobacterium
GPDATREAFTSEAKAFSQD

SEQ ID NO: 1206428 - protein, 6 aa, Mycobacterium
GPDDAE

SEQ ID NO: 1206429 - protein, 11 aa, Mycobacterium
GPDDVGHTGGM

SEQ ID NO: 1206430 - protein, 12 aa, Mycobacterium
GPDDVSGPRWGR

SEQ ID NO: 1206431 - protein, 4 aa, Mycobacterium
GPDE

SEQ ID NO: 1206432 - protein, 10 aa, Mycobacterium
GPDEDAREAA

SEQ ID NO: 1206433 - protein, 6 aa, Mycobacterium
GPDEID

SEQ ID NO: 1206434 - protein, 15 aa, Mycobacterium
GPDETPPEGWEQDPD

SEQ ID NO: 1206435 - protein, 8 aa, Mycobacterium
GPDEVHSR

SEQ ID NO: 1206436 - protein, 8 aa, Mycobacterium
GPDGAPVA

SEQ ID NO: 1206437 - protein, 7 aa, Mycobacterium
GPDGDKF

SEQ ID NO: 1206438 - protein, 8 aa, Mycobacterium
GPDGFRGS

SEQ ID NO: 1206439 - protein, 5 aa, Mycobacterium
GPDGG

SEQ ID NO: 1206440 - protein, 11 aa, Mycobacterium
GPDGQPRPVAR

SEQ ID NO: 1206441 - protein, 8 aa, Mycobacterium
GPDGRDCP

SEQ ID NO: 1206442 - protein, 6 aa, Mycobacterium
GPDGSA

SEQ ID NO: 1206443 - protein, 8 aa, Mycobacterium
GPDKVGVD

SEQ ID NO: 1206444 - protein, 8 aa, Mycobacterium
GPDNAAES

SEQ ID NO: 1206445 - protein, 14 aa, Mycobacterium
GPDNRDVNDHGGWT

SEQ ID NO: 1206446 - protein, 15 aa, Mycobacterium
GPDNRDVNDRGGWTT

SEQ ID NO: 1206447 - protein, 15 aa, Mycobacterium
GPDNRSVDNNGGWTT

SEQ ID NO: 1206448 - protein, 16 aa, Mycobacterium
GPDNRSVDNNGGWTTQ

SEQ ID NO: 1206449 - protein, 16 aa, Mycobacterium
GPDNRSVGTNDGWTTR

SEQ ID NO: 1206450 - protein, 7 aa, Mycobacterium
GPDPATG

SEQ ID NO: 1206451 - protein, 5 aa, Mycobacterium
GPDPD

SEQ ID NO: 1206452 - protein, 10 aa, Mycobacterium
GPDPDGEGEL

SEQ ID NO: 1206453 - protein, 9 aa, Mycobacterium
GPDPDTATR

SEQ ID NO: 1206454 - protein, 12 aa, Mycobacterium
GPDPEPHYRPST

SEQ ID NO: 1206455 - protein, 12 aa, Mycobacterium
GPDPGDPSVGGS

SEQ ID NO: 1206456 - protein, 13 aa, Mycobacterium
GPDPLRSDADPEL

SEQ ID NO: 1206457 - protein, 15 aa, Mycobacterium
GPDPQAMYGGSYSAD

SEQ ID NO: 1206458 - protein, 5 aa, Mycobacterium
GPDPT

SEQ ID NO: 1206459 - protein, 8 aa, Mycobacterium
GPDPTYDT

SEQ ID NO: 1206460 - protein, 5 aa, Mycobacterium
GPDRQ

SEQ ID NO: 1206461 - protein, 11 aa, Mycobacterium
GPDRSATERTL

SEQ ID NO: 1206462 - protein, 19 aa, Mycobacterium
GPDRTAAPKGASPGTNDEI

SEQ ID NO: 1206463 - protein, 10 aa, Mycobacterium
GPDRVRDTPL

SEQ ID NO: 1206464 - protein, 10 aa, Mycobacterium
GPDSEGLTDR

SEQ ID NO: 1206465 - protein, 8 aa, Mycobacterium
GPDSETPM

SEQ ID NO: 1206466 - protein, 19 aa, Mycobacterium
GPDSGWDRHGDQPPPPLPP

SEQ ID NO: 1206467 - protein, 4 aa, Mycobacterium
GPEA

SEQ ID NO: 1206468 - protein, 11 aa, Mycobacterium
GPEAGSPLRTS

SEQ ID NO: 1206469 - protein, 14 aa, Mycobacterium
GPEAPLGAYTAAPA

SEQ ID NO: 1206470 - protein, 4 aa, Mycobacterium
GPED

SEQ ID NO: 1206471 - protein, 12 aa, Mycobacterium
GPEDAAQRVTGS

SEQ ID NO: 1206472 - protein, 5 aa, Mycobacterium
GPEDG

SEQ ID NO: 1206473 - protein, 7 aa, Mycobacterium
GPEESAR

SEQ ID NO: 1206474 - protein, 8 aa, Mycobacterium
GPEGDNTY

SEQ ID NO: 1206475 - protein, 12 aa, Mycobacterium
GPEGGSGGGTVV

SEQ ID NO: 1206476 - protein, 6 aa, Mycobacterium
GPEGLG

SEQ ID NO: 1206477 - protein, 10 aa, Mycobacterium
GPEGQGRPGY

SEQ ID NO: 1206478 - protein, 17 aa, Mycobacterium
GPEGRRTVHERRRQARR

SEQ ID NO: 1206479 - protein, 9 aa, Mycobacterium
GPEGSDRPE

SEQ ID NO: 1206480 - protein, 12 aa, Mycobacterium
GPEHSERPGVDD

SEQ ID NO: 1206481 - protein, 4 aa, Mycobacterium
GPEI

SEQ ID NO: 1206482 - protein, 11 aa, Mycobacterium
GPEKAGEGLPH

SEQ ID NO: 1206483 - protein, 17 aa, Mycobacterium
GPEKALAEADPKPDDYL

SEQ ID NO: 1206484 - protein, 15 aa, Mycobacterium
GPELASRSDNTPYED

SEQ ID NO: 1206485 - protein, 14 aa, Mycobacterium
GPELPAGGCGRPRR

SEQ ID NO: 1206486 - protein, 5 aa, Mycobacterium
GPEPD

SEQ ID NO: 1206487 - protein, 6 aa, Mycobacterium
GPEPDA

SEQ ID NO: 1206488 - protein, 10 aa, Mycobacterium
GPEPDGPRRG

SEQ ID NO: 1206489 - protein, 7 aa, Mycobacterium
GPEPGLS

SEQ ID NO: 1206490 - protein, 15 aa, Mycobacterium
GPEPHGAKLSNAGIR

SEQ ID NO: 1206491 - protein, 17 aa, Mycobacterium
GPEPRSPEAVEGWDLLS

SEQ ID NO: 1206492 - protein, 6 aa, Mycobacterium
GPEPVA

SEQ ID NO: 1206493 - protein, 5 aa, Mycobacterium
GPEQG

SEQ ID NO: 1206494 - protein, 19 aa, Mycobacterium
GPEQSSDDHHSGAVARNSL

SEQ ID NO: 1206495 - protein, 5 aa, Mycobacterium
GPEQY

SEQ ID NO: 1206496 - protein, 5 aa, Mycobacterium
GPERM

SEQ ID NO: 1206497 - protein, 10 aa, Mycobacterium
GPERVRDTPL

SEQ ID NO: 1206498 - protein, 6 aa, Mycobacterium
GPESGY

SEQ ID NO: 1206499 - protein, 7 aa, Mycobacterium
GPESGYI

SEQ ID NO: 1206500 - protein, 8 aa, Mycobacterium
GPETESAV

SEQ ID NO: 1206501 - protein, 21 aa, Mycobacterium
GPETLPLPTEVDEPQRWIDRV

SEQ ID NO: 1206502 - protein, 6 aa, Mycobacterium
GPEVGQ

SEQ ID NO: 1206503 - protein, 12 aa, Mycobacterium
GPEVGSLRPEDR

SEQ ID NO: 1206504 - protein, 4 aa, Mycobacterium
GPEY

SEQ ID NO: 1206505 - protein, 8 aa, Mycobacterium
GPFAEGAE

SEQ ID NO: 1206506 - protein, 78 aa, Mycobacterium
GPFGDNPYGPNYHGRPNVATSEPNPNGMLPTPGVASSGVPGQQAPVVPGTPVPLPPAPPGARNEPPGPFPGPTAVGGQ

SEQ ID NO: 1206507 - protein, 79 aa, Mycobacterium
GPFGDNPYGPNYHGRPNVATSEPNPNGMLPTPGVASSGVPGQQAPVVPGTPVPLPPAPPGARNEPPGPFPGPTAVGGQV

SEQ ID NO: 1206508 - protein, 5 aa, Mycobacterium
GPFGE

SEQ ID NO: 1206509 - protein, 5 aa, Mycobacterium
GPFGR

SEQ ID NO: 1206510 - protein, 4 aa, Mycobacterium
GPFP

SEQ ID NO: 1206511 - protein, 9 aa, Mycobacterium
GPGADENRI

SEQ ID NO: 1206512 - protein, 9 aa, Mycobacterium
GPGAEDTLA

SEQ ID NO: 1206513 - protein, 9 aa, Mycobacterium
GPGAGTAGG

SEQ ID NO: 1206514 - protein, 5 aa, Mycobacterium
GPGAS

SEQ ID NO: 1206515 - protein, 5 aa, Mycobacterium
GPGAV

SEQ ID NO: 1206516 - protein, 6 aa, Mycobacterium
GPGAWP

SEQ ID NO: 1206517 - protein, 6 aa, Mycobacterium
GPGDDA

SEQ ID NO: 1206518 - protein, 5 aa, Mycobacterium
GPGDR

SEQ ID NO: 1206519 - protein, 14 aa, Mycobacterium
GPGDSADKVRGSAE

SEQ ID NO: 1206520 - protein, 7 aa, Mycobacterium
GPGEAPA

SEQ ID NO: 1206521 - protein, 7 aa, Mycobacterium
GPGEAPG

SEQ ID NO: 1206522 - protein, 47 aa, Mycobacterium
GPGEDGTAEVQRSNGGPRHAAPGGATRRERREAARKQAKTSKPTRRR

SEQ ID NO: 1206523 - protein, 5 aa, Mycobacterium
GPGEI

SEQ ID NO: 1206524 - protein, 6 aa, Mycobacterium
GPGFEV

SEQ ID NO: 1206525 - protein, 13 aa, Mycobacterium
GPGFGRGPGRGPG

SEQ ID NO: 1206526 - protein, 6 aa, Mycobacterium
GPGFSE

SEQ ID NO: 1206527 - protein, 8 aa, Mycobacterium
GPGGAAGV

SEQ ID NO: 1206528 - protein, 8 aa, Mycobacterium
GPGGEAAT

SEQ ID NO: 1206529 - protein, 14 aa, Mycobacterium
GPGGHKLDDATEDR

SEQ ID NO: 1206530 - protein, 15 aa, Mycobacterium
GPGGHKLDDATEDRI

SEQ ID NO: 1206531 - protein, 7 aa, Mycobacterium
GPGGKTA

SEQ ID NO: 1206532 - protein, 5 aa, Mycobacterium
GPGGR

SEQ ID NO: 1206533 - protein, 17 aa, Mycobacterium
GPGGTLTSSAGRHPKWT

SEQ ID NO: 1206534 - protein, 6 aa, Mycobacterium
GPGGVD

SEQ ID NO: 1206535 - protein, 15 aa, Mycobacterium
GPGHAGNGRRTPGAM

SEQ ID NO: 1206536 - protein, 8 aa, Mycobacterium
GPGHGGPG

SEQ ID NO: 1206537 - protein, 6 aa, Mycobacterium
GPGKGV

SEQ ID NO: 1206538 - protein, 5 aa, Mycobacterium
GPGLD

SEQ ID NO: 1206539 - protein, 10 aa, Mycobacterium
GPGLHPPPPV

SEQ ID NO: 1206540 - protein, 12 aa, Mycobacterium
GPGMAERPEFAP

SEQ ID NO: 1206541 - protein, 5 aa, Mycobacterium
GPGNA

SEQ ID NO: 1206542 - protein, 6 aa, Mycobacterium
GPGPAT

SEQ ID NO: 1206543 - protein, 15 aa, Mycobacterium
GPGPGRGKWAGAGWD

SEQ ID NO: 1206544 - protein, 12 aa, Mycobacterium
GPGPTQPADEPL

SEQ ID NO: 1206545 - protein, 11 aa, Mycobacterium
GPGPVDVAEGD

SEQ ID NO: 1206546 - protein, 6 aa, Mycobacterium
GPGRPA

SEQ ID NO: 1206547 - protein, 5 aa, Mycobacterium
GPGRT

SEQ ID NO: 1206548 - protein, 5 aa, Mycobacterium
GPGRV

SEQ ID NO: 1206549 - protein, 4 aa, Mycobacterium
GPGS

SEQ ID NO: 1206550 - protein, 5 aa, Mycobacterium
GPGSD

SEQ ID NO: 1206551 - protein, 50 aa, Mycobacterium
GPGSLDPATWQPPTPYGTPPPPPAAAPGSPPPPASAPPPVWPPVPVPAQV

SEQ ID NO: 1206552 - protein, 9 aa, Mycobacterium
GPGSPGSDV

SEQ ID NO: 1206553 - protein, 9 aa, Mycobacterium
GPGSPSAAA

SEQ ID NO: 1206554 - protein, 5 aa, Mycobacterium
GPGSQ

SEQ ID NO: 1206555 - protein, 6 aa, Mycobacterium
GPGSRA

SEQ ID NO: 1206556 - protein, 7 aa, Mycobacterium
GPGTGSE

SEQ ID NO: 1206557 - protein, 9 aa, Mycobacterium
GPGTRPSDR

SEQ ID NO: 1206558 - protein, 16 aa, Mycobacterium
GPGTRWASTAAPGDRV

SEQ ID NO: 1206559 - protein, 4 aa, Mycobacterium
GPGV

SEQ ID NO: 1206560 - protein, 5 aa, Mycobacterium
GPGWG

SEQ ID NO: 1206561 - protein, 5 aa, Mycobacterium
GPGYE

SEQ ID NO: 1206562 - protein, 7 aa, Mycobacterium
GPGYGAT

SEQ ID NO: 1206563 - protein, 5 aa, Mycobacterium
GPHDG

SEQ ID NO: 1206564 - protein, 8 aa, Mycobacterium
GPHGPRAA

SEQ ID NO: 1206565 - protein, 5 aa, Mycobacterium
GPHPA

SEQ ID NO: 1206566 - protein, 6 aa, Mycobacterium
GPHVDD

SEQ ID NO: 1206567 - protein, 5 aa, Mycobacterium
GPIAA

SEQ ID NO: 1206568 - protein, 4 aa, Mycobacterium
GPIG

SEQ ID NO: 1206569 - protein, 11 aa, Mycobacterium
GPIPVDDDTIA

SEQ ID NO: 1206570 - protein, 16 aa, Mycobacterium
GPITRSYSDGDATEGP

SEQ ID NO: 1206571 - protein, 6 aa, Mycobacterium
GPKEHA

SEQ ID NO: 1206572 - protein, 9 aa, Mycobacterium
GPKESERLR

SEQ ID NO: 1206573 - protein, 6 aa, Mycobacterium
GPKGDT

SEQ ID NO: 1206574 - protein, 9 aa, Mycobacterium
GPKKIADRM

SEQ ID NO: 1206575 - protein, 10 aa, Mycobacterium
GPKPISSPHP

SEQ ID NO: 1206576 - protein, 14 aa, Mycobacterium
GPKPRDYSERTPKK

SEQ ID NO: 1206577 - protein, 7 aa, Mycobacterium
GPKQTAL

SEQ ID NO: 1206578 - protein, 7 aa, Mycobacterium
GPKTAKK

SEQ ID NO: 1206579 - protein, 10 aa, Mycobacterium
GPLAAPPARR

SEQ ID NO: 1206580 - protein, 6 aa, Mycobacterium
GPLAPG

SEQ ID NO: 1206581 - protein, 4 aa, Mycobacterium
GPLD

SEQ ID NO: 1206582 - protein, 6 aa, Mycobacterium
GPLDPA

SEQ ID NO: 1206583 - protein, 14 aa, Mycobacterium
GPLDSDRLGRPRPD

SEQ ID NO: 1206584 - protein, 6 aa, Mycobacterium
GPLDTS

SEQ ID NO: 1206585 - protein, 10 aa, Mycobacterium
GPLGESDRDF

SEQ ID NO: 1206586 - protein, 16 aa, Mycobacterium
GPLGGRGPKPRAGDRI

SEQ ID NO: 1206587 - protein, 8 aa, Mycobacterium
GPLGPDEV

SEQ ID NO: 1206588 - protein, 13 aa, Mycobacterium
GPLKAPKRVQPPV

SEQ ID NO: 1206589 - protein, 7 aa, Mycobacterium
GPLKAPQ

SEQ ID NO: 1206590 - protein, 4 aa, Mycobacterium
GPLP

SEQ ID NO: 1206591 - protein, 5 aa, Mycobacterium
GPLPA

SEQ ID NO: 1206592 - protein, 6 aa, Mycobacterium
GPLPAG

SEQ ID NO: 1206593 - protein, 6 aa, Mycobacterium
GPLPDS

SEQ ID NO: 1206594 - protein, 6 aa, Mycobacterium
GPLPEF

SEQ ID NO: 1206595 - protein, 8 aa, Mycobacterium
GPLPEPAQ

SEQ ID NO: 1206596 - protein, 8 aa, Mycobacterium
GPLPHPAT

SEQ ID NO: 1206597 - protein, 5 aa, Mycobacterium
GPLPK

SEQ ID NO: 1206598 - protein, 8 aa, Mycobacterium
GPLPLPPS

SEQ ID NO: 1206599 - protein, 11 aa, Mycobacterium
GPLPSHPDDDD

SEQ ID NO: 1206600 - protein, 7 aa, Mycobacterium
GPLQRQT

SEQ ID NO: 1206601 - protein, 11 aa, Mycobacterium
GPLQTTPGVTG

SEQ ID NO: 1206602 - protein, 5 aa, Mycobacterium
GPLTG

SEQ ID NO: 1206603 - protein, 7 aa, Mycobacterium
GPMEGGT

SEQ ID NO: 1206604 - protein, 5 aa, Mycobacterium
GPMEP

SEQ ID NO: 1206605 - protein, 9 aa, Mycobacterium
GPMGAAGEA

SEQ ID NO: 1206606 - protein, 15 aa, Mycobacterium
GPMPAGLAEKASAAA

SEQ ID NO: 1206607 - protein, 4 aa, Mycobacterium
GPMT

SEQ ID NO: 1206608 - protein, 6 aa, Mycobacterium
GPMYGH

SEQ ID NO: 1206609 - protein, 15 aa, Mycobacterium
GPNDGGWTTSRPRWA

SEQ ID NO: 1206610 - protein, 9 aa, Mycobacterium
GPNEAGKSS

SEQ ID NO: 1206611 - protein, 10 aa, Mycobacterium
GPNEAGKSSM

SEQ ID NO: 1206612 - protein, 4 aa, Mycobacterium
GPNG

SEQ ID NO: 1206613 - protein, 8 aa, Mycobacterium
GPNGAGKS

SEQ ID NO: 1206614 - protein, 9 aa, Mycobacterium
GPNGAGKST

SEQ ID NO: 1206615 - protein, 9 aa, Mycobacterium
GPNGSGKTT

SEQ ID NO: 1206616 - protein, 13 aa, Mycobacterium
GPNGTPEEPKGTP

SEQ ID NO: 1206617 - protein, 5 aa, Mycobacterium
GPNLA

SEQ ID NO: 1206618 - protein, 9 aa, Mycobacterium
GPNPFGPPP

SEQ ID NO: 1206619 - protein, 7 aa, Mycobacterium
GPNPIDV

SEQ ID NO: 1206620 - protein, 8 aa, Mycobacterium
GPNRGETK

SEQ ID NO: 1206621 - protein, 9 aa, Mycobacterium
GPNRPGPKG

SEQ ID NO: 1206622 - protein, 8 aa, Mycobacterium
GPNRSQRI

SEQ ID NO: 1206623 - protein, 7 aa, Mycobacterium
GPNTGSR

SEQ ID NO: 1206624 - protein, 8 aa, Mycobacterium
GPPADPGQ

SEQ ID NO: 1206625 - protein, 9 aa, Mycobacterium
GPPANGGSC

SEQ ID NO: 1206626 - protein, 12 aa, Mycobacterium
GPPARTSKPKFR

SEQ ID NO: 1206627 - protein, 5 aa, Mycobacterium
GPPAY

SEQ ID NO: 1206628 - protein, 5 aa, Mycobacterium
GPPCQ

SEQ ID NO: 1206629 - protein, 8 aa, Mycobacterium
GPPDDAAR

SEQ ID NO: 1206630 - protein, 8 aa, Mycobacterium
GPPDEDVA

SEQ ID NO: 1206631 - protein, 6 aa, Mycobacterium
GPPDIT

SEQ ID NO: 1206632 - protein, 11 aa, Mycobacterium
GPPDRPPAPPL

SEQ ID NO: 1206633 - protein, 7 aa, Mycobacterium
GPPEEFA

SEQ ID NO: 1206634 - protein, 7 aa, Mycobacterium
GPPELTT

SEQ ID NO: 1206635 - protein, 5 aa, Mycobacterium
GPPFP

SEQ ID NO: 1206636 - protein, 5 aa, Mycobacterium
GPPGA

SEQ ID NO: 1206637 - protein, 14 aa, Mycobacterium
GPPGAEQSGVGEHD

SEQ ID NO: 1206638 - protein, 19 aa, Mycobacterium
GPPGESPGPNVAAGAAPGF

SEQ ID NO: 1206639 - protein, 8 aa, Mycobacterium
GPPGIGKS

SEQ ID NO: 1206640 - protein, 12 aa, Mycobacterium
GPPGNGKTSLAE

SEQ ID NO: 1206641 - protein, 7 aa, Mycobacterium
GPPGQDD

SEQ ID NO: 1206642 - protein, 8 aa, Mycobacterium
GPPGTAEV

SEQ ID NO: 1206643 - protein, 9 aa, Mycobacterium
GPPGTAKTT

SEQ ID NO: 1206644 - protein, 11 aa, Mycobacterium
GPPHEIDPDTL

SEQ ID NO: 1206645 - protein, 9 aa, Mycobacterium
GPPNQPGTS

SEQ ID NO: 1206646 - protein, 4 aa, Mycobacterium
GPPP

SEQ ID NO: 1206647 - protein, 20 aa, Mycobacterium
GPPPATGFSPDQWGDTDTLT

SEQ ID NO: 1206648 - protein, 6 aa, Mycobacterium
GPPPIH

SEQ ID NO: 1206649 - protein, 6 aa, Mycobacterium
GPPPVE

SEQ ID NO: 1206650 - protein, 8 aa, Mycobacterium
GPPRVSGP

SEQ ID NO: 1206651 - protein, 6 aa, Mycobacterium
GPPTVR

SEQ ID NO: 1206652 - protein, 22 aa, Mycobacterium
GPPVVKESTGEEISKEDLGGPA

SEQ ID NO: 1206653 - protein, 6 aa, Mycobacterium
GPQAAR

SEQ ID NO: 1206654 - protein, 6 aa, Mycobacterium
GPQAED

SEQ ID NO: 1206655 - protein, 8 aa, Mycobacterium
GPQAPARA

SEQ ID NO: 1206656 - protein, 5 aa, Mycobacterium
GPQAR

SEQ ID NO: 1206657 - protein, 10 aa, Mycobacterium
GPQARSIESP

SEQ ID NO: 1206658 - protein, 13 aa, Mycobacterium
GPQEGSRGTLPDD

SEQ ID NO: 1206659 - protein, 15 aa, Mycobacterium
GPQGREVLSAAGFGP

SEQ ID NO: 1206660 - protein, 10 aa, Mycobacterium
GPQIGDGRKS

SEQ ID NO: 1206661 - protein, 5 aa, Mycobacterium
GPQLD

SEQ ID NO: 1206662 - protein, 12 aa, Mycobacterium
GPQLSSPDGRGP

SEQ ID NO: 1206663 - protein, 9 aa, Mycobacterium
GPQPLKPGD

SEQ ID NO: 1206664 - protein, 7 aa, Mycobacterium
GPQPVSP

SEQ ID NO: 1206665 - protein, 7 aa, Mycobacterium
GPQSGYI

SEQ ID NO: 1206666 - protein, 5 aa, Mycobacterium
GPQTD

SEQ ID NO: 1206667 - protein, 7 aa, Mycobacterium
GPQTGAA

SEQ ID NO: 1206668 - protein, 4 aa, Mycobacterium
GPQY

SEQ ID NO: 1206669 - protein, 4 aa, Mycobacterium
GPRA

SEQ ID NO: 1206670 - protein, 5 aa, Mycobacterium
GPRAG

SEQ ID NO: 1206671 - protein, 13 aa, Mycobacterium
GPREFDRTPPRFG

SEQ ID NO: 1206672 - protein, 5 aa, Mycobacterium
GPREL

SEQ ID NO: 1206673 - protein, 5 aa, Mycobacterium
GPRER

SEQ ID NO: 1206674 - protein, 26 aa, Mycobacterium
GPRESAGATPHGAALGPGAGDNAAAA

SEQ ID NO: 1206675 - protein, 4 aa, Mycobacterium
GPRF

SEQ ID NO: 1206676 - protein, 5 aa, Mycobacterium
GPRFS

SEQ ID NO: 1206677 - protein, 15 aa, Mycobacterium
GPRHTRGNPPNVVET

SEQ ID NO: 1206678 - protein, 5 aa, Mycobacterium
GPRKA

SEQ ID NO: 1206679 - protein, 12 aa, Mycobacterium
GPRLSELAAESR

SEQ ID NO: 1206680 - protein, 5 aa, Mycobacterium
GPRPA

SEQ ID NO: 1206681 - protein, 8 aa, Mycobacterium
GPRPAAAL

SEQ ID NO: 1206682 - protein, 6 aa, Mycobacterium
GPRPAE

SEQ ID NO: 1206683 - protein, 6 aa, Mycobacterium
GPRPEF

SEQ ID NO: 1206684 - protein, 7 aa, Mycobacterium
GPRPEMA

SEQ ID NO: 1206685 - protein, 7 aa, Mycobacterium
GPRPERP

SEQ ID NO: 1206686 - protein, 5 aa, Mycobacterium
GPRPI

SEQ ID NO: 1206687 - protein, 5 aa, Mycobacterium
GPRPL

SEQ ID NO: 1206688 - protein, 12 aa, Mycobacterium
GPRPPGSLYGTP

SEQ ID NO: 1206689 - protein, 6 aa, Mycobacterium
GPRQID

SEQ ID NO: 1206690 - protein, 5 aa, Mycobacterium
GPRRA

SEQ ID NO: 1206691 - protein, 34 aa, Mycobacterium
GPRRRQLNGGGNWSRTPRRSQEHHSGSDHGCTGE

SEQ ID NO: 1206692 - protein, 6 aa, Mycobacterium
GPRSGG

SEQ ID NO: 1206693 - protein, 5 aa, Mycobacterium
GPRST

SEQ ID NO: 1206694 - protein, 4 aa, Mycobacterium
GPRT

SEQ ID NO: 1206695 - protein, 9 aa, Mycobacterium
GPRTSATEH

SEQ ID NO: 1206696 - protein, 26 aa, Mycobacterium
GPRWPDVSGNSQATGTRAVTAGAPAQ

SEQ ID NO: 1206697 - protein, 9 aa, Mycobacterium
GPSADLPAE

SEQ ID NO: 1206698 - protein, 10 aa, Mycobacterium
GPSADLPAEL

SEQ ID NO: 1206699 - protein, 10 aa, Mycobacterium
GPSAESAAVD

SEQ ID NO: 1206700 - protein, 5 aa, Mycobacterium
GPSAV

SEQ ID NO: 1206701 - protein, 8 aa, Mycobacterium
GPSAVGKS

SEQ ID NO: 1206702 - protein, 7 aa, Mycobacterium
GPSAYTA

SEQ ID NO: 1206703 - protein, 4 aa, Mycobacterium
GPSD

SEQ ID NO: 1206704 - protein, 7 aa, Mycobacterium
GPSDTVT

SEQ ID NO: 1206705 - protein, 16 aa, Mycobacterium
GPSFPSTGSAVPRTEL

SEQ ID NO: 1206706 - protein, 8 aa, Mycobacterium
GPSGAGKS

SEQ ID NO: 1206707 - protein, 35 aa, Mycobacterium
GPSGEQAEAEQDEAAPAEDATEETDADSDEAADDS

SEQ ID NO: 1206708 - protein, 7 aa, Mycobacterium
GPSGGAD

SEQ ID NO: 1206709 - protein, 44 aa, Mycobacterium
GPSGGAQAEAEGADEADADSDADSDTEADSDADSDTEADEADEA

SEQ ID NO: 1206710 - protein, 9 aa, Mycobacterium
GPSGKRPAY

SEQ ID NO: 1206711 - protein, 9 aa, Mycobacterium
GPSGSGKST

SEQ ID NO: 1206712 - protein, 8 aa, Mycobacterium
GPSGTTTM

SEQ ID NO: 1206713 - protein, 6 aa, Mycobacterium
GPSIAA

SEQ ID NO: 1206714 - protein, 14 aa, Mycobacterium
GPSKDASRIEGSKA

SEQ ID NO: 1206715 - protein, 5 aa, Mycobacterium
GPSLA

SEQ ID NO: 1206716 - protein, 9 aa, Mycobacterium
GPSPAGLSR

SEQ ID NO: 1206717 - protein, 9 aa, Mycobacterium
GPSPEDKRV

SEQ ID NO: 1206718 - protein, 5 aa, Mycobacterium
GPSRA

SEQ ID NO: 1206719 - protein, 12 aa, Mycobacterium
GPSRGVDQGANT

SEQ ID NO: 1206720 - protein, 12 aa, Mycobacterium
GPSRPPYTDAPA

SEQ ID NO: 1206721 - protein, 12 aa, Mycobacterium
GPSSAVRTPGAA

SEQ ID NO: 1206722 - protein, 5 aa, Mycobacterium
GPSSF

SEQ ID NO: 1206723 - protein, 17 aa, Mycobacterium
GPSTSSSEVDKAESHYK

SEQ ID NO: 1206724 - protein, 5 aa, Mycobacterium
GPSVG

SEQ ID NO: 1206725 - protein, 6 aa, Mycobacterium
GPSVPD

SEQ ID NO: 1206726 - protein, 15 aa, Mycobacterium
GPSVTKGVERSLDTR

SEQ ID NO: 1206727 - protein, 4 aa, Mycobacterium
GPSW

SEQ ID NO: 1206728 - protein, 9 aa, Mycobacterium
GPSYTRPAS

SEQ ID NO: 1206729 - protein, 5 aa, Mycobacterium
GPTAD

SEQ ID NO: 1206730 - protein, 13 aa, Mycobacterium
GPTAGLGADPAFE

SEQ ID NO: 1206731 - protein, 15 aa, Mycobacterium
GPTAGTGTPTRDYGI

SEQ ID NO: 1206732 - protein, 8 aa, Mycobacterium
GPTAVPSG

SEQ ID NO: 1206733 - protein, 10 aa, Mycobacterium
GPTDHRPVTP

SEQ ID NO: 1206734 - protein, 4 aa, Mycobacterium
GPTE

SEQ ID NO: 1206735 - protein, 13 aa, Mycobacterium
GPTERPAPRYAFY

SEQ ID NO: 1206736 - protein, 5 aa, Mycobacterium
GPTFA

SEQ ID NO: 1206737 - protein, 11 aa, Mycobacterium
GPTFDTPPATI

SEQ ID NO: 1206738 - protein, 5 aa, Mycobacterium
GPTGL

SEQ ID NO: 1206739 - protein, 7 aa, Mycobacterium
GPTGLET

SEQ ID NO: 1206740 - protein, 5 aa, Mycobacterium
GPTGM

SEQ ID NO: 1206741 - protein, 8 aa, Mycobacterium
GPTGRRRA

SEQ ID NO: 1206742 - protein, 18 aa, Mycobacterium
GPTGSNAQAEDRHTSGAL

SEQ ID NO: 1206743 - protein, 17 aa, Mycobacterium
GPTGSNNEADDRHTSGA

SEQ ID NO: 1206744 - protein, 5 aa, Mycobacterium
GPTHA

SEQ ID NO: 1206745 - protein, 7 aa, Mycobacterium
GPTHTAG

SEQ ID NO: 1206746 - protein, 6 aa, Mycobacterium
GPTLGA

SEQ ID NO: 1206747 - protein, 10 aa, Mycobacterium
GPTLPEGLSG

SEQ ID NO: 1206748 - protein, 11 aa, Mycobacterium
GPTLSGTDGLG

SEQ ID NO: 1206749 - protein, 6 aa, Mycobacterium
GPTPAE

SEQ ID NO: 1206750 - protein, 8 aa, Mycobacterium
GPTPATQK

SEQ ID NO: 1206751 - protein, 21 aa, Mycobacterium
GPTPESGQATRRDRFLELMLR

SEQ ID NO: 1206752 - protein, 32 aa, Mycobacterium
GPTPKVTANHRGGRRSNVPITRDRADPQGRRG

SEQ ID NO: 1206753 - protein, 15 aa, Mycobacterium
GPTPSDALSALPDRP

SEQ ID NO: 1206754 - protein, 7 aa, Mycobacterium
GPTRNPW

SEQ ID NO: 1206755 - protein, 26 aa, Mycobacterium
GPTRPPAAEPRGGSAGLSAKAANDAY

SEQ ID NO: 1206756 - protein, 7 aa, Mycobacterium
GPTRRGE

SEQ ID NO: 1206757 - protein, 4 aa, Mycobacterium
GPVA

SEQ ID NO: 1206758 - protein, 6 aa, Mycobacterium
GPVAGR

SEQ ID NO: 1206759 - protein, 14 aa, Mycobacterium
GPVANGDSARGGSS

SEQ ID NO: 1206760 - protein, 13 aa, Mycobacterium
GPVATNAEGANMD

SEQ ID NO: 1206761 - protein, 11 aa, Mycobacterium
GPVGDPGWFGP

SEQ ID NO: 1206762 - protein, 7 aa, Mycobacterium
GPVGGTE

SEQ ID NO: 1206763 - protein, 6 aa, Mycobacterium
GPVGVG

SEQ ID NO: 1206764 - protein, 19 aa, Mycobacterium
GPVPAARPAGAPDEPEAGM

SEQ ID NO: 1206765 - protein, 6 aa, Mycobacterium
GPVPQA

SEQ ID NO: 1206766 - protein, 10 aa, Mycobacterium
GPVQGDTPAE

SEQ ID NO: 1206767 - protein, 9 aa, Mycobacterium
GPVRGADDR

SEQ ID NO: 1206768 - protein, 4 aa, Mycobacterium
GPVS

SEQ ID NO: 1206769 - protein, 7 aa, Mycobacterium
GPVSGDA

SEQ ID NO: 1206770 - protein, 8 aa, Mycobacterium
GPVTASRI

SEQ ID NO: 1206771 - protein, 9 aa, Mycobacterium
GPWSPGGKF

SEQ ID NO: 1206772 - protein, 7 aa, Mycobacterium
GPYATSG

SEQ ID NO: 1206773 - protein, 25 aa, Mycobacterium
GPYDPGYNSDSTRTYSIGEPDPEVA

SEQ ID NO: 1206774 - protein, 6 aa, Mycobacterium
GPYLPG

SEQ ID NO: 1206775 - protein, 18 aa, Mycobacterium
GPYNVSDDPASKSPTQMR

SEQ ID NO: 1206776 - protein, 7 aa, Mycobacterium
GPYPSSD

SEQ ID NO: 1206777 - protein, 8 aa, Mycobacterium
GPYQPNQY

SEQ ID NO: 1206778 - protein, 5 aa, Mycobacterium
GQAAA

SEQ ID NO: 1206779 - protein, 8 aa, Mycobacterium
GQAAPAEL

SEQ ID NO: 1206780 - protein, 17 aa, Mycobacterium
GQAAPDQVAGEHATVQG

SEQ ID NO: 1206781 - protein, 7 aa, Mycobacterium
GQAAQRV

SEQ ID NO: 1206782 - protein, 7 aa, Mycobacterium
GQAAYNS

SEQ ID NO: 1206783 - protein, 11 aa, Mycobacterium
GQADKAALDAG

SEQ ID NO: 1206784 - protein, 6 aa, Mycobacterium
GQADPA

SEQ ID NO: 1206785 - protein, 8 aa, Mycobacterium
GQADQARQ

SEQ ID NO: 1206786 - protein, 6 aa, Mycobacterium
GQADRP

SEQ ID NO: 1206787 - protein, 8 aa, Mycobacterium
GQAGDGEK

SEQ ID NO: 1206788 - protein, 5 aa, Mycobacterium
GQAGQ

SEQ ID NO: 1206789 - protein, 5 aa, Mycobacterium
GQALP

SEQ ID NO: 1206790 - protein, 17 aa, Mycobacterium
GQAPTRGRKGSAESLQG

SEQ ID NO: 1206791 - protein, 16 aa, Mycobacterium
GQAPYRPNSIDGGEPL

SEQ ID NO: 1206792 - protein, 4 aa, Mycobacterium
GQAQ

SEQ ID NO: 1206793 - protein, 18 aa, Mycobacterium
GQAQTGAPALPAGRPVSS

SEQ ID NO: 1206794 - protein, 6 aa, Mycobacterium
GQARPE

SEQ ID NO: 1206795 - protein, 13 aa, Mycobacterium
GQARTAPTDPVHT

SEQ ID NO: 1206796 - protein, 11 aa, Mycobacterium
GQASAEAGERL

SEQ ID NO: 1206797 - protein, 5 aa, Mycobacterium
GQASL

SEQ ID NO: 1206798 - protein, 4 aa, Mycobacterium
GQAT

SEQ ID NO: 1206799 - protein, 6 aa, Mycobacterium
GQATRE

SEQ ID NO: 1206800 - protein, 9 aa, Mycobacterium
GQAVPGTYA

SEQ ID NO: 1206801 - protein, 20 aa, Mycobacterium
GQAVQSPPPPVATPETQPME

SEQ ID NO: 1206802 - protein, 26 aa, Mycobacterium
GQAYESEATSTGTVAVTGGDNTLVDK

SEQ ID NO: 1206803 - protein, 8 aa, Mycobacterium
GQCEETDD

SEQ ID NO: 1206804 - protein, 13 aa, Mycobacterium
GQCVDQPAERRSF

SEQ ID NO: 1206805 - protein, 10 aa, Mycobacterium
GQDARAADDE

SEQ ID NO: 1206806 - protein, 7 aa, Mycobacterium
GQDAVTG

SEQ ID NO: 1206807 - protein, 13 aa, Mycobacterium
GQDDSSAEAAMGS

SEQ ID NO: 1206808 - protein, 6 aa, Mycobacterium
GQDGQM

SEQ ID NO: 1206809 - protein, 4 aa, Mycobacterium
GQDH

SEQ ID NO: 1206810 - protein, 7 aa, Mycobacterium
GQDNPAH

SEQ ID NO: 1206811 - protein, 8 aa, Mycobacterium
GQDPDKLP

SEQ ID NO: 1206812 - protein, 6 aa, Mycobacterium
GQDPGR

SEQ ID NO: 1206813 - protein, 9 aa, Mycobacterium
GQDPRLAPA

SEQ ID NO: 1206814 - protein, 9 aa, Mycobacterium
GQDTPPPWS

SEQ ID NO: 1206815 - protein, 4 aa, Mycobacterium
GQEA

SEQ ID NO: 1206816 - protein, 7 aa, Mycobacterium
GQEAAQI

SEQ ID NO: 1206817 - protein, 8 aa, Mycobacterium
GQEDPNRL

SEQ ID NO: 1206818 - protein, 6 aa, Mycobacterium
GQEKFD

SEQ ID NO: 1206819 - protein, 4 aa, Mycobacterium
GQEP

SEQ ID NO: 1206820 - protein, 9 aa, Mycobacterium
GQEQPEWRE

SEQ ID NO: 1206821 - protein, 14 aa, Mycobacterium
GQERAEALRRYRAI

SEQ ID NO: 1206822 - protein, 6 aa, Mycobacterium
GQERPF

SEQ ID NO: 1206823 - protein, 8 aa, Mycobacterium
GQESARAR

SEQ ID NO: 1206824 - protein, 12 aa, Mycobacterium
GQESDDSDDVET

SEQ ID NO: 1206825 - protein, 7 aa, Mycobacterium
GQETTTK

SEQ ID NO: 1206826 - protein, 7 aa, Mycobacterium
GQETYEG

SEQ ID NO: 1206827 - protein, 6 aa, Mycobacterium
GQEVTT

SEQ ID NO: 1206828 - protein, 7 aa, Mycobacterium
GQFDPRT

SEQ ID NO: 1206829 - protein, 5 aa, Mycobacterium
GQFDR

SEQ ID NO: 1206830 - protein, 7 aa, Mycobacterium
GQFGEKS

SEQ ID NO: 1206831 - protein, 15 aa, Mycobacterium
GQFLPGDGATPAIGS

SEQ ID NO: 1206832 - protein, 7 aa, Mycobacterium
GQFTDGR

SEQ ID NO: 1206833 - protein, 17 aa, Mycobacterium
GQGAKSGGSKPGLTAPA

SEQ ID NO: 1206834 - protein, 9 aa, Mycobacterium
GQGGGEPVE

SEQ ID NO: 1206835 - protein, 12 aa, Mycobacterium
GQGGLADAVGRS

SEQ ID NO: 1206836 - protein, 8 aa, Mycobacterium
GQGGLKRN

SEQ ID NO: 1206837 - protein, 6 aa, Mycobacterium
GQGGPW

SEQ ID NO: 1206838 - protein, 6 aa, Mycobacterium
GQGHPV

SEQ ID NO: 1206839 - protein, 5 aa, Mycobacterium
GQGHT

SEQ ID NO: 1206840 - protein, 8 aa, Mycobacterium
GQGIQSKG

SEQ ID NO: 1206841 - protein, 7 aa, Mycobacterium
GQGKTTL

SEQ ID NO: 1206842 - protein, 8 aa, Mycobacterium
GQGPAGGL

SEQ ID NO: 1206843 - protein, 6 aa, Mycobacterium
GQGRLQ

SEQ ID NO: 1206844 - protein, 13 aa, Mycobacterium
GQGRTSGEHDPRM

SEQ ID NO: 1206845 - protein, 26 aa, Mycobacterium
GQGSALSAGAHLGTGGRPVDQQTLET

SEQ ID NO: 1206846 - protein, 8 aa, Mycobacterium
GQGSQWPG

SEQ ID NO: 1206847 - protein, 10 aa, Mycobacterium
GQGSVRGGTV

SEQ ID NO: 1206848 - protein, 7 aa, Mycobacterium
GQGTEEA

SEQ ID NO: 1206849 - protein, 8 aa, Mycobacterium
GQGVTGPG

SEQ ID NO: 1206850 - protein, 9 aa, Mycobacterium
GQHDPAAPS

SEQ ID NO: 1206851 - protein, 5 aa, Mycobacterium
GQHLT

SEQ ID NO: 1206852 - protein, 6 aa, Mycobacterium
GQHLTP

SEQ ID NO: 1206853 - protein, 16 aa, Mycobacterium
GQHNWEGESLAEAARR

SEQ ID NO: 1206854 - protein, 18 aa, Mycobacterium
GQHPGGGLSGTSGSAAAA

SEQ ID NO: 1206855 - protein, 5 aa, Mycobacterium
GQHPT

SEQ ID NO: 1206856 - protein, 8 aa, Mycobacterium
GQHQPDRV

SEQ ID NO: 1206857 - protein, 8 aa, Mycobacterium
GQHTNDKE

SEQ ID NO: 1206858 - protein, 7 aa, Mycobacterium
GQIAGDS

SEQ ID NO: 1206859 - protein, 5 aa, Mycobacterium
GQIPG

SEQ ID NO: 1206860 - protein, 7 aa, Mycobacterium
GQITGAR

SEQ ID NO: 1206861 - protein, 9 aa, Mycobacterium
GQKGAKTPY

SEQ ID NO: 1206862 - protein, 6 aa, Mycobacterium
GQKGGI

SEQ ID NO: 1206863 - protein, 5 aa, Mycobacterium
GQKPM

SEQ ID NO: 1206864 - protein, 5 aa, Mycobacterium
GQKTA

SEQ ID NO: 1206865 - protein, 4 aa, Mycobacterium
GQLD

SEQ ID NO: 1206866 - protein, 13 aa, Mycobacterium
GQLDTRPAERAAC

SEQ ID NO: 1206867 - protein, 5 aa, Mycobacterium
GQLDV

SEQ ID NO: 1206868 - protein, 9 aa, Mycobacterium
GQLEDADRQ

SEQ ID NO: 1206869 - protein, 7 aa, Mycobacterium
GQLEDRG

SEQ ID NO: 1206870 - protein, 9 aa, Mycobacterium
GQLEKQDRA

SEQ ID NO: 1206871 - protein, 13 aa, Mycobacterium
GQLGKKSGKGFYT

SEQ ID NO: 1206872 - protein, 8 aa, Mycobacterium
GQLPKTGA

SEQ ID NO: 1206873 - protein, 18 aa, Mycobacterium
GQLPPDSWQRDAEEGQGR

SEQ ID NO: 1206874 - protein, 13 aa, Mycobacterium
GQLPPGKAPEKGL

SEQ ID NO: 1206875 - protein, 8 aa, Mycobacterium
GQLPPGVS

SEQ ID NO: 1206876 - protein, 9 aa, Mycobacterium
GQLPRPKRQ

SEQ ID NO: 1206877 - protein, 8 aa, Mycobacterium
GQLSPDGL

SEQ ID NO: 1206878 - protein, 8 aa, Mycobacterium
GQLSSGTT

SEQ ID NO: 1206879 - protein, 6 aa, Mycobacterium
GQLTAD

SEQ ID NO: 1206880 - protein, 6 aa, Mycobacterium
GQMGSG

SEQ ID NO: 1206881 - protein, 4 aa, Mycobacterium
GQNA

SEQ ID NO: 1206882 - protein, 9 aa, Mycobacterium
GQNGEHREM

SEQ ID NO: 1206883 - protein, 4 aa, Mycobacterium
GQNL

SEQ ID NO: 1206884 - protein, 8 aa, Mycobacterium
GQNPDKSY

SEQ ID NO: 1206885 - protein, 6 aa, Mycobacterium
GQNPTL

SEQ ID NO: 1206886 - protein, 7 aa, Mycobacterium
GQNSLPQ

SEQ ID NO: 1206887 - protein, 5 aa, Mycobacterium
GQPAA

SEQ ID NO: 1206888 - protein, 8 aa, Mycobacterium
GQPAAVQT

SEQ ID NO: 1206889 - protein, 8 aa, Mycobacterium
GQPADFAS

SEQ ID NO: 1206890 - protein, 6 aa, Mycobacterium
GQPADR

SEQ ID NO: 1206891 - protein, 5 aa, Mycobacterium
GQPAG

SEQ ID NO: 1206892 - protein, 9 aa, Mycobacterium
GQPAGRTIG

SEQ ID NO: 1206893 - protein, 6 aa, Mycobacterium
GQPAQA

SEQ ID NO: 1206894 - protein, 7 aa, Mycobacterium
GQPASQD

SEQ ID NO: 1206895 - protein, 18 aa, Mycobacterium
GQPDAGSVEPNAGQACSA

SEQ ID NO: 1206896 - protein, 8 aa, Mycobacterium
GQPDGITG

SEQ ID NO: 1206897 - protein, 6 aa, Mycobacterium
GQPDLN

SEQ ID NO: 1206898 - protein, 26 aa, Mycobacterium
GQPGITARPGFRGAASRARTPVGRGA

SEQ ID NO: 1206899 - protein, 5 aa, Mycobacterium
GQPGL

SEQ ID NO: 1206900 - protein, 18 aa, Mycobacterium
GQPGLPQAWTPDEAPGPG

SEQ ID NO: 1206901 - protein, 11 aa, Mycobacterium
GQPGPVTTAED

SEQ ID NO: 1206902 - protein, 5 aa, Mycobacterium
GQPGS

SEQ ID NO: 1206903 - protein, 6 aa, Mycobacterium
GQPGVL

SEQ ID NO: 1206904 - protein, 19 aa, Mycobacterium
GQPHRHADRPKRVRTPGEP

SEQ ID NO: 1206905 - protein, 16 aa, Mycobacterium
GQPIDGQGDIEAEGRR

SEQ ID NO: 1206906 - protein, 7 aa, Mycobacterium
GQPIPTT

SEQ ID NO: 1206907 - protein, 10 aa, Mycobacterium
GQPLGAGRTT

SEQ ID NO: 1206908 - protein, 11 aa, Mycobacterium
GQPLGSGRTTR

SEQ ID NO: 1206909 - protein, 19 aa, Mycobacterium
GQPMTADNQRENIRSAAQS

SEQ ID NO: 1206910 - protein, 8 aa, Mycobacterium
GQPNGASS

SEQ ID NO: 1206911 - protein, 9 aa, Mycobacterium
GQPPLEAAG

SEQ ID NO: 1206912 - protein, 18 aa, Mycobacterium
GQPPVENAVPPAAPGGEG

SEQ ID NO: 1206913 - protein, 10 aa, Mycobacterium
GQPQRKGSEL

SEQ ID NO: 1206914 - protein, 6 aa, Mycobacterium
GQPRLD

SEQ ID NO: 1206915 - protein, 8 aa, Mycobacterium
GQPRPGET

SEQ ID NO: 1206916 - protein, 9 aa, Mycobacterium
GQPSPDAVT

SEQ ID NO: 1206917 - protein, 7 aa, Mycobacterium
GQPTDRH

SEQ ID NO: 1206918 - protein, 12 aa, Mycobacterium
GQPVAVTASDDR

SEQ ID NO: 1206919 - protein, 7 aa, Mycobacterium
GQPWQKR

SEQ ID NO: 1206920 - protein, 6 aa, Mycobacterium
GQPYPE

SEQ ID NO: 1206921 - protein, 5 aa, Mycobacterium
GQQRR

SEQ ID NO: 1206922 - protein, 10 aa, Mycobacterium
GQQRRSDDEL

SEQ ID NO: 1206923 - protein, 5 aa, Mycobacterium
GQQRT

SEQ ID NO: 1206924 - protein, 14 aa, Mycobacterium
GQQSYRDKDGHVRD

SEQ ID NO: 1206925 - protein, 5 aa, Mycobacterium
GQRAM

SEQ ID NO: 1206926 - protein, 9 aa, Mycobacterium
GQRDAPGRA

SEQ ID NO: 1206927 - protein, 21 aa, Mycobacterium
GQRDERSGAPERNRRLDSDAA

SEQ ID NO: 1206928 - protein, 13 aa, Mycobacterium
GQRGGPGHGTGQY

SEQ ID NO: 1206929 - protein, 10 aa, Mycobacterium
GQRGTASGEV

SEQ ID NO: 1206930 - protein, 8 aa, Mycobacterium
GQRHGVAR

SEQ ID NO: 1206931 - protein, 5 aa, Mycobacterium
GQRIT

SEQ ID NO: 1206932 - protein, 8 aa, Mycobacterium
GQRLTPDA

SEQ ID NO: 1206933 - protein, 9 aa, Mycobacterium
GQRNGRAHG

SEQ ID NO: 1206934 - protein, 4 aa, Mycobacterium
GQRP

SEQ ID NO: 1206935 - protein, 22 aa, Mycobacterium
GQRPEPSVSRTKPAAAEQLSGA

SEQ ID NO: 1206936 - protein, 9 aa, Mycobacterium
GQRPGREAA

SEQ ID NO: 1206937 - protein, 6 aa, Mycobacterium
GQRPPT

SEQ ID NO: 1206938 - protein, 7 aa, Mycobacterium
GQRPSRM

SEQ ID NO: 1206939 - protein, 7 aa, Mycobacterium
GQRRTLA

SEQ ID NO: 1206940 - protein, 7 aa, Mycobacterium
GQRRVAT

SEQ ID NO: 1206941 - protein, 6 aa, Mycobacterium
GQRVAS

SEQ ID NO: 1206942 - protein, 8 aa, Mycobacterium
GQRVESGQ

SEQ ID NO: 1206943 - protein, 12 aa, Mycobacterium
GQRVPNSAGGHR

SEQ ID NO: 1206944 - protein, 7 aa, Mycobacterium
GQRYTSY

SEQ ID NO: 1206945 - protein, 12 aa, Mycobacterium
GQSAALQLLEQP

SEQ ID NO: 1206946 - protein, 9 aa, Mycobacterium
GQSAGGGFA

SEQ ID NO: 1206947 - protein, 11 aa, Mycobacterium
GQSAGGNLSAA

SEQ ID NO: 1206948 - protein, 8 aa, Mycobacterium
GQSATTAR

SEQ ID NO: 1206949 - protein, 10 aa, Mycobacterium
GQSAYGAAKA

SEQ ID NO: 1206950 - protein, 7 aa, Mycobacterium
GQSCGST

SEQ ID NO: 1206951 - protein, 10 aa, Mycobacterium
GQSDRHPQEP

SEQ ID NO: 1206952 - protein, 7 aa, Mycobacterium
GQSGARA

SEQ ID NO: 1206953 - protein, 6 aa, Mycobacterium
GQSHTA

SEQ ID NO: 1206954 - protein, 6 aa, Mycobacterium
GQSKTA

SEQ ID NO: 1206955 - protein, 8 aa, Mycobacterium
GQSLGRPV

SEQ ID NO: 1206956 - protein, 6 aa, Mycobacterium
GQSLQT

SEQ ID NO: 1206957 - protein, 14 aa, Mycobacterium
GQSPKGPQATGVRA

SEQ ID NO: 1206958 - protein, 7 aa, Mycobacterium
GQSQSGL

SEQ ID NO: 1206959 - protein, 7 aa, Mycobacterium
GQSRAVS

SEQ ID NO: 1206960 - protein, 4 aa, Mycobacterium
GQST

SEQ ID NO: 1206961 - protein, 5 aa, Mycobacterium
GQTAE

SEQ ID NO: 1206962 - protein, 7 aa, Mycobacterium
GQTAYGA

SEQ ID NO: 1206963 - protein, 10 aa, Mycobacterium
GQTDPAPVTE

SEQ ID NO: 1206964 - protein, 4 aa, Mycobacterium
GQTE

SEQ ID NO: 1206965 - protein, 4 aa, Mycobacterium
GQTH

SEQ ID NO: 1206966 - protein, 5 aa, Mycobacterium
GQTIP

SEQ ID NO: 1206967 - protein, 5 aa, Mycobacterium
GQTPD

SEQ ID NO: 1206968 - protein, 12 aa, Mycobacterium
GQTPEPRNRNTA

SEQ ID NO: 1206969 - protein, 6 aa, Mycobacterium
GQTPLG

SEQ ID NO: 1206970 - protein, 7 aa, Mycobacterium
GQTPQLT

SEQ ID NO: 1206971 - protein, 8 aa, Mycobacterium
GQTPSTGE

SEQ ID NO: 1206972 - protein, 11 aa, Mycobacterium
GQTPSTKSAKS

SEQ ID NO: 1206973 - protein, 8 aa, Mycobacterium
GQTSATRI

SEQ ID NO: 1206974 - protein, 34 aa, Mycobacterium
GQTSVTTVDASGTKAAQALRAGEGATTMAADSQG

SEQ ID NO: 1206975 - protein, 9 aa, Mycobacterium
GQTTEAQHG

SEQ ID NO: 1206976 - protein, 13 aa, Mycobacterium
GQTTSTEDAEGEV

SEQ ID NO: 1206977 - protein, 7 aa, Mycobacterium
GQTVPAG

SEQ ID NO: 1206978 - protein, 5 aa, Mycobacterium
GQTYQ

SEQ ID NO: 1206979 - protein, 23 aa, Mycobacterium
GQVATVSAGGIPVDRSNPTTGAG

SEQ ID NO: 1206980 - protein, 9 aa, Mycobacterium
GQVDEPASI

SEQ ID NO: 1206981 - protein, 5 aa, Mycobacterium
GQVPE

SEQ ID NO: 1206982 - protein, 6 aa, Mycobacterium
GQVPRT

SEQ ID NO: 1206983 - protein, 4 aa, Mycobacterium
GQVS

SEQ ID NO: 1206984 - protein, 21 aa, Mycobacterium
GQVTANGARGLATGTAATSAV

SEQ ID NO: 1206985 - protein, 7 aa, Mycobacterium
GQVTEQE

SEQ ID NO: 1206986 - protein, 4 aa, Mycobacterium
GQYP

SEQ ID NO: 1206987 - protein, 20 aa, Mycobacterium
GQYSPTSETGKVTKSTPMGS

SEQ ID NO: 1206988 - protein, 9 aa, Mycobacterium
GRAAAAAAD

SEQ ID NO: 1206989 - protein, 8 aa, Mycobacterium
GRAAAEAG

SEQ ID NO: 1206990 - protein, 32 aa, Mycobacterium
GRAAAGAASDRRASAGAADAVRDAGRRGRDDA

SEQ ID NO: 1206991 - protein, 11 aa, Mycobacterium
GRAADPDATAQ

SEQ ID NO: 1206992 - protein, 8 aa, Mycobacterium
GRAAKDVD

SEQ ID NO: 1206993 - protein, 16 aa, Mycobacterium
GRAAPEDLTDDPRRLA

SEQ ID NO: 1206994 - protein, 12 aa, Mycobacterium
GRAARPRQRSTG

SEQ ID NO: 1206995 - protein, 8 aa, Mycobacterium
GRAASTTL

SEQ ID NO: 1206996 - protein, 4 aa, Mycobacterium
GRAC

SEQ ID NO: 1206997 - protein, 8 aa, Mycobacterium
GRADARTA

SEQ ID NO: 1206998 - protein, 15 aa, Mycobacterium
GRADLAPEDSAGDHA

SEQ ID NO: 1206999 - protein, 7 aa, Mycobacterium
GRADTCA

SEQ ID NO: 1207000 - protein, 12 aa, Mycobacterium
GRADVHSESVTS

SEQ ID NO: 1207001 - protein, 8 aa, Mycobacterium
GRAEADDE

SEQ ID NO: 1207002 - protein, 15 aa, Mycobacterium
GRAEDRSVREEVGTT

SEQ ID NO: 1207003 - protein, 20 aa, Mycobacterium
GRAERDAAYNTAARTGRYPL

SEQ ID NO: 1207004 - protein, 5 aa, Mycobacterium
GRAEV

SEQ ID NO: 1207005 - protein, 8 aa, Mycobacterium
GRAFSAGN

SEQ ID NO: 1207006 - protein, 9 aa, Mycobacterium
GRAFSGGYD

SEQ ID NO: 1207007 - protein, 6 aa, Mycobacterium
GRAGEA

SEQ ID NO: 1207008 - protein, 9 aa, Mycobacterium
GRAGGTRST

SEQ ID NO: 1207009 - protein, 22 aa, Mycobacterium
GRAGIASTVQPANGENPDGENL

SEQ ID NO: 1207010 - protein, 17 aa, Mycobacterium
GRAGLNSGSAVPNSDGS

SEQ ID NO: 1207011 - protein, 9 aa, Mycobacterium
GRAGRRGQG

SEQ ID NO: 1207012 - protein, 10 aa, Mycobacterium
GRAGRSTASA

SEQ ID NO: 1207013 - protein, 5 aa, Mycobacterium
GRAGT

SEQ ID NO: 1207014 - protein, 9 aa, Mycobacterium
GRAGTAEDI

SEQ ID NO: 1207015 - protein, 9 aa, Mycobacterium
GRAKAEEIG

SEQ ID NO: 1207016 - protein, 12 aa, Mycobacterium
GRAKEKSPYPNQ

SEQ ID NO: 1207017 - protein, 5 aa, Mycobacterium
GRALG

SEQ ID NO: 1207018 - protein, 11 aa, Mycobacterium
GRAMAEAGDRV

SEQ ID NO: 1207019 - protein, 4 aa, Mycobacterium
GRAN

SEQ ID NO: 1207020 - protein, 29 aa, Mycobacterium
GRANSRRAVPTGTVPDSPAVRGDPADRHP

SEQ ID NO: 1207021 - protein, 11 aa, Mycobacterium
GRAPAGGAATR

SEQ ID NO: 1207022 - protein, 9 aa, Mycobacterium
GRAPGDPVV

SEQ ID NO: 1207023 - protein, 26 aa, Mycobacterium
GRAPGETTVPDRCDPPKVDDADARTA

SEQ ID NO: 1207024 - protein, 17 aa, Mycobacterium
GRAPKDLSDPTPDEQAA

SEQ ID NO: 1207025 - protein, 9 aa, Mycobacterium
GRAPTPSTI

SEQ ID NO: 1207026 - protein, 16 aa, Mycobacterium
GRAQARGGSHEGAAAK

SEQ ID NO: 1207027 - protein, 5 aa, Mycobacterium
GRAQG

SEQ ID NO: 1207028 - protein, 7 aa, Mycobacterium
GRAQQRR

SEQ ID NO: 1207029 - protein, 7 aa, Mycobacterium
GRAQTTV

SEQ ID NO: 1207030 - protein, 12 aa, Mycobacterium
GRARCAPTDAEA

SEQ ID NO: 1207031 - protein, 11 aa, Mycobacterium
GRARPEEPSAD

SEQ ID NO: 1207032 - protein, 7 aa, Mycobacterium
GRARPGD

SEQ ID NO: 1207033 - protein, 5 aa, Mycobacterium
GRARQ

SEQ ID NO: 1207034 - protein, 6 aa, Mycobacterium
GRARRT

SEQ ID NO: 1207035 - protein, 7 aa, Mycobacterium
GRASAAG

SEQ ID NO: 1207036 - protein, 8 aa, Mycobacterium
GRASDYPQ

SEQ ID NO: 1207037 - protein, 10 aa, Mycobacterium
GRASLDPGDN

SEQ ID NO: 1207038 - protein, 7 aa, Mycobacterium
GRASVTE

SEQ ID NO: 1207039 - protein, 8 aa, Mycobacterium
GRATAEEA

SEQ ID NO: 1207040 - protein, 16 aa, Mycobacterium
GRATGGPDPLGRARAA

SEQ ID NO: 1207041 - protein, 7 aa, Mycobacterium
GRATSAI

SEQ ID NO: 1207042 - protein, 7 aa, Mycobacterium
GRATYGG

SEQ ID NO: 1207043 - protein, 6 aa, Mycobacterium
GRAVTA

SEQ ID NO: 1207044 - protein, 4 aa, Mycobacterium
GRAW

SEQ ID NO: 1207045 - protein, 4 aa, Mycobacterium
GRAY

SEQ ID NO: 1207046 - protein, 7 aa, Mycobacterium
GRCPSAQ

SEQ ID NO: 1207047 - protein, 8 aa, Mycobacterium
GRDADPAI

SEQ ID NO: 1207048 - protein, 7 aa, Mycobacterium
GRDAEQM

SEQ ID NO: 1207049 - protein, 9 aa, Mycobacterium
GRDAEQVRA

SEQ ID NO: 1207050 - protein, 6 aa, Mycobacterium
GRDAET

SEQ ID NO: 1207051 - protein, 8 aa, Mycobacterium
GRDAGAGE

SEQ ID NO: 1207052 - protein, 12 aa, Mycobacterium
GRDAISDVPRDR

SEQ ID NO: 1207053 - protein, 12 aa, Mycobacterium
GRDAISEVPQDR

SEQ ID NO: 1207054 - protein, 24 aa, Mycobacterium
GRDAPPAADPAPDATTGPGEGDTF

SEQ ID NO: 1207055 - protein, 8 aa, Mycobacterium
GRDAPPDW

SEQ ID NO: 1207056 - protein, 7 aa, Mycobacterium
GRDAPQA

SEQ ID NO: 1207057 - protein, 11 aa, Mycobacterium
GRDAVSEVPAD

SEQ ID NO: 1207058 - protein, 12 aa, Mycobacterium
GRDDDGRKVPEP

SEQ ID NO: 1207059 - protein, 6 aa, Mycobacterium
GRDDDR

SEQ ID NO: 1207060 - protein, 47 aa, Mycobacterium
GRDDLQREGEAQQDKADAQREAAKKEAEAESARAAAKANEERQRAEQ

SEQ ID NO: 1207061 - protein, 7 aa, Mycobacterium
GRDDPLE

SEQ ID NO: 1207062 - protein, 5 aa, Mycobacterium
GRDDR

SEQ ID NO: 1207063 - protein, 6 aa, Mycobacterium
GRDDRP

SEQ ID NO: 1207064 - protein, 6 aa, Mycobacterium
GRDDSA

SEQ ID NO: 1207065 - protein, 7 aa, Mycobacterium
GRDDTLD

SEQ ID NO: 1207066 - protein, 11 aa, Mycobacterium
GRDEEAYPDAR

SEQ ID NO: 1207067 - protein, 7 aa, Mycobacterium
GRDGAAM

SEQ ID NO: 1207068 - protein, 7 aa, Mycobacterium
GRDGDPV

SEQ ID NO: 1207069 - protein, 5 aa, Mycobacterium
GRDHP

SEQ ID NO: 1207070 - protein, 9 aa, Mycobacterium
GRDHTAGAG

SEQ ID NO: 1207071 - protein, 5 aa, Mycobacterium
GRDIH

SEQ ID NO: 1207072 - protein, 6 aa, Mycobacterium
GRDKRI

SEQ ID NO: 1207073 - protein, 11 aa, Mycobacterium
GRDLTTPPEVA

SEQ ID NO: 1207074 - protein, 5 aa, Mycobacterium
GRDNG

SEQ ID NO: 1207075 - protein, 12 aa, Mycobacterium
GRDNRDESKIRA

SEQ ID NO: 1207076 - protein, 14 aa, Mycobacterium
GRDPERGRTAAASH

SEQ ID NO: 1207077 - protein, 16 aa, Mycobacterium
GRDPGRGEAAAASDPR

SEQ ID NO: 1207078 - protein, 6 aa, Mycobacterium
GRDPRI

SEQ ID NO: 1207079 - protein, 6 aa, Mycobacterium
GRDPTA

SEQ ID NO: 1207080 - protein, 12 aa, Mycobacterium
GRDPVEGSPGVG

SEQ ID NO: 1207081 - protein, 8 aa, Mycobacterium
GRDQPGVT

SEQ ID NO: 1207082 - protein, 14 aa, Mycobacterium
GRDQVNPQASRDAA

SEQ ID NO: 1207083 - protein, 5 aa, Mycobacterium
GRDRE

SEQ ID NO: 1207084 - protein, 8 aa, Mycobacterium
GRDREAGP

SEQ ID NO: 1207085 - protein, 9 aa, Mycobacterium
GRDRTESER

SEQ ID NO: 1207086 - protein, 6 aa, Mycobacterium
GRDRTL

SEQ ID NO: 1207087 - protein, 8 aa, Mycobacterium
GRDSSHAR

SEQ ID NO: 1207088 - protein, 8 aa, Mycobacterium
GRDTDYRN

SEQ ID NO: 1207089 - protein, 7 aa, Mycobacterium
GRDTPTY

SEQ ID NO: 1207090 - protein, 17 aa, Mycobacterium
GRDTTLDVPSKQTTGYP

SEQ ID NO: 1207091 - protein, 28 aa, Mycobacterium
GRDVDPSSYGAQRHPATDEPVGDSRTRD

SEQ ID NO: 1207092 - protein, 7 aa, Mycobacterium
GRDVEGA

SEQ ID NO: 1207093 - protein, 5 aa, Mycobacterium
GRDYD

SEQ ID NO: 1207094 - protein, 36 aa, Mycobacterium
GREALGGRPFGDGTAPGPTRDTERVPEGHTAGDSQP

SEQ ID NO: 1207095 - protein, 16 aa, Mycobacterium
GREATDEELAAESGIP

SEQ ID NO: 1207096 - protein, 20 aa, Mycobacterium
GREATDETPQSAADQVGTSL

SEQ ID NO: 1207097 - protein, 7 aa, Mycobacterium
GREEDAY

SEQ ID NO: 1207098 - protein, 8 aa, Mycobacterium
GREEGSVR

SEQ ID NO: 1207099 - protein, 5 aa, Mycobacterium
GREEH

SEQ ID NO: 1207100 - protein, 7 aa, Mycobacterium
GREGADA

SEQ ID NO: 1207101 - protein, 13 aa, Mycobacterium
GREGDGDDRRGAT

SEQ ID NO: 1207102 - protein, 6 aa, Mycobacterium
GREGID

SEQ ID NO: 1207103 - protein, 13 aa, Mycobacterium
GREHGSDPTAYAT

SEQ ID NO: 1207104 - protein, 8 aa, Mycobacterium
GREHPTVA

SEQ ID NO: 1207105 - protein, 8 aa, Mycobacterium
GREKAEAE

SEQ ID NO: 1207106 - protein, 5 aa, Mycobacterium
GREMR

SEQ ID NO: 1207107 - protein, 4 aa, Mycobacterium
GREP

SEQ ID NO: 1207108 - protein, 10 aa, Mycobacterium
GREPDGPLTG

SEQ ID NO: 1207109 - protein, 11 aa, Mycobacterium
GREPDGPLTGA

SEQ ID NO: 1207110 - protein, 7 aa, Mycobacterium
GREPDRP

SEQ ID NO: 1207111 - protein, 8 aa, Mycobacterium
GREPGLAP

SEQ ID NO: 1207112 - protein, 10 aa, Mycobacterium
GREPHASADL

SEQ ID NO: 1207113 - protein, 7 aa, Mycobacterium
GREPSDR

SEQ ID NO: 1207114 - protein, 23 aa, Mycobacterium
GREQAAALDASGRLRRGDAGPVA

SEQ ID NO: 1207115 - protein, 5 aa, Mycobacterium
GREQS

SEQ ID NO: 1207116 - protein, 4 aa, Mycobacterium
GRER

SEQ ID NO: 1207117 - protein, 8 aa, Mycobacterium
GREREHQR

SEQ ID NO: 1207118 - protein, 9 aa, Mycobacterium
GRERTTDEL

SEQ ID NO: 1207119 - protein, 11 aa, Mycobacterium
GRESDGPLTGA

SEQ ID NO: 1207120 - protein, 9 aa, Mycobacterium
GRETARRRG

SEQ ID NO: 1207121 - protein, 8 aa, Mycobacterium
GRETLGDT

SEQ ID NO: 1207122 - protein, 8 aa, Mycobacterium
GRETRRRR

SEQ ID NO: 1207123 - protein, 6 aa, Mycobacterium
GRFDGG

SEQ ID NO: 1207124 - protein, 6 aa, Mycobacterium
GRFEGP

SEQ ID NO: 1207125 - protein, 11 aa, Mycobacterium
GRFPGEDAEPA

SEQ ID NO: 1207126 - protein, 17 aa, Mycobacterium
GRFPTDEPLNAQGHRQA

SEQ ID NO: 1207127 - protein, 4 aa, Mycobacterium
GRFS

SEQ ID NO: 1207128 - protein, 11 aa, Mycobacterium
GRFSGGSSGLS

SEQ ID NO: 1207129 - protein, 9 aa, Mycobacterium
GRGADPARA

SEQ ID NO: 1207130 - protein, 16 aa, Mycobacterium
GRGAGLPVSSRVPPRP

SEQ ID NO: 1207131 - protein, 9 aa, Mycobacterium
GRGAPDRAP

SEQ ID NO: 1207132 - protein, 11 aa, Mycobacterium
GRGAPGTSETA

SEQ ID NO: 1207133 - protein, 14 aa, Mycobacterium
GRGAPSGLFPQDGD

SEQ ID NO: 1207134 - protein, 23 aa, Mycobacterium
GRGAQEGRTALAAPGGGTRVGEK

SEQ ID NO: 1207135 - protein, 22 aa, Mycobacterium
GRGAQEGRTALSAPGGTRVGEK

SEQ ID NO: 1207136 - protein, 6 aa, Mycobacterium
GRGATR

SEQ ID NO: 1207137 - protein, 7 aa, Mycobacterium
GRGDEFE

SEQ ID NO: 1207138 - protein, 8 aa, Mycobacterium
GRGDKSPM

SEQ ID NO: 1207139 - protein, 7 aa, Mycobacterium
GRGEAHE

SEQ ID NO: 1207140 - protein, 18 aa, Mycobacterium
GRGENPGLSQVQDDPATR

SEQ ID NO: 1207141 - protein, 7 aa, Mycobacterium
GRGGDLK

SEQ ID NO: 1207142 - protein, 8 aa, Mycobacterium
GRGGGGAS

SEQ ID NO: 1207143 - protein, 12 aa, Mycobacterium
GRGGHGQSGRSP

SEQ ID NO: 1207144 - protein, 5 aa, Mycobacterium
GRGGL

SEQ ID NO: 1207145 - protein, 19 aa, Mycobacterium
GRGGRAVGPRRGDRRDRSS

SEQ ID NO: 1207146 - protein, 8 aa, Mycobacterium
GRGGRGGC

SEQ ID NO: 1207147 - protein, 6 aa, Mycobacterium
GRGGRN

SEQ ID NO: 1207148 - protein, 22 aa, Mycobacterium
GRGGRNAHGRITTRHKGGGHKR

SEQ ID NO: 1207149 - protein, 6 aa, Mycobacterium
GRGHRR

SEQ ID NO: 1207150 - protein, 10 aa, Mycobacterium
GRGKDESDAV

SEQ ID NO: 1207151 - protein, 10 aa, Mycobacterium
GRGKQAHDAW

SEQ ID NO: 1207152 - protein, 6 aa, Mycobacterium
GRGKRI

SEQ ID NO: 1207153 - protein, 4 aa, Mycobacterium
GRGL

SEQ ID NO: 1207154 - protein, 7 aa, Mycobacterium
GRGMPRA

SEQ ID NO: 1207155 - protein, 5 aa, Mycobacterium
GRGPE

SEQ ID NO: 1207156 - protein, 8 aa, Mycobacterium
GRGPVGDI

SEQ ID NO: 1207157 - protein, 4 aa, Mycobacterium
GRGR

SEQ ID NO: 1207158 - protein, 13 aa, Mycobacterium
GRGRPQVAGSARP

SEQ ID NO: 1207159 - protein, 6 aa, Mycobacterium
GRGRRA

SEQ ID NO: 1207160 - protein, 8 aa, Mycobacterium
GRGRTVPD

SEQ ID NO: 1207161 - protein, 7 aa, Mycobacterium
GRGSPWA

SEQ ID NO: 1207162 - protein, 5 aa, Mycobacterium
GRGSR

SEQ ID NO: 1207163 - protein, 8 aa, Mycobacterium
GRGTETPD

SEQ ID NO: 1207164 - protein, 12 aa, Mycobacterium
GRGTGKAEEATQ

SEQ ID NO: 1207165 - protein, 11 aa, Mycobacterium
GRGTYARETGR

SEQ ID NO: 1207166 - protein, 4 aa, Mycobacterium
GRGW

SEQ ID NO: 1207167 - protein, 8 aa, Mycobacterium
GRGYPSEL

SEQ ID NO: 1207168 - protein, 4 aa, Mycobacterium
GRHD

SEQ ID NO: 1207169 - protein, 10 aa, Mycobacterium
GRHDGGTGVD

SEQ ID NO: 1207170 - protein, 15 aa, Mycobacterium
GRHDPSGFADWLTVA

SEQ ID NO: 1207171 - protein, 6 aa, Mycobacterium
GRHDRT

SEQ ID NO: 1207172 - protein, 5 aa, Mycobacterium
GRHED

SEQ ID NO: 1207173 - protein, 18 aa, Mycobacterium
GRHEDYEAVGADPATQTM

SEQ ID NO: 1207174 - protein, 9 aa, Mycobacterium
GRHEERSEE

SEQ ID NO: 1207175 - protein, 10 aa, Mycobacterium
GRHGDDAANT

SEQ ID NO: 1207176 - protein, 10 aa, Mycobacterium
GRHHAPSTPG

SEQ ID NO: 1207177 - protein, 7 aa, Mycobacterium
GRHNDVQ

SEQ ID NO: 1207178 - protein, 13 aa, Mycobacterium
GRHRPRPRPKGGL

SEQ ID NO: 1207179 - protein, 4 aa, Mycobacterium
GRHS

SEQ ID NO: 1207180 - protein, 10 aa, Mycobacterium
GRIADTRTQF

SEQ ID NO: 1207181 - protein, 11 aa, Mycobacterium
GRIANTDTQFD

SEQ ID NO: 1207182 - protein, 14 aa, Mycobacterium
GRIDATEHTERGTR

SEQ ID NO: 1207183 - protein, 7 aa, Mycobacterium
GRIDPED

SEQ ID NO: 1207184 - protein, 5 aa, Mycobacterium
GRIEP

SEQ ID NO: 1207185 - protein, 4 aa, Mycobacterium
GRIP

SEQ ID NO: 1207186 - protein, 14 aa, Mycobacterium
GRIRRREDGDHRGD

SEQ ID NO: 1207187 - protein, 12 aa, Mycobacterium
GRISGSASAPHS

SEQ ID NO: 1207188 - protein, 10 aa, Mycobacterium
GRISTESASR

SEQ ID NO: 1207189 - protein, 10 aa, Mycobacterium
GRISTGTSQL

SEQ ID NO: 1207190 - protein, 12 aa, Mycobacterium
GRITDGPAPGRV

SEQ ID NO: 1207191 - protein, 11 aa, Mycobacterium
GRIVSDDEVKE

SEQ ID NO: 1207192 - protein, 10 aa, Mycobacterium
GRKEAAGDDV

SEQ ID NO: 1207193 - protein, 7 aa, Mycobacterium
GRKESRF

SEQ ID NO: 1207194 - protein, 10 aa, Mycobacterium
GRKGAPDTFD

SEQ ID NO: 1207195 - protein, 7 aa, Mycobacterium
GRKGGLI

SEQ ID NO: 1207196 - protein, 16 aa, Mycobacterium
GRKLTEKVRAELFGRG

SEQ ID NO: 1207197 - protein, 8 aa, Mycobacterium
GRKNKGAM

SEQ ID NO: 1207198 - protein, 47 aa, Mycobacterium
GRKPGSSRGQAQSAPKRTAREKTLAKQAARAAAGKVARKPGRAERGR

SEQ ID NO: 1207199 - protein, 13 aa, Mycobacterium
GRKRRAVPLTTTT

SEQ ID NO: 1207200 - protein, 5 aa, Mycobacterium
GRKSA

SEQ ID NO: 1207201 - protein, 9 aa, Mycobacterium
GRKSGKEYA

SEQ ID NO: 1207202 - protein, 13 aa, Mycobacterium
GRKSGKPRSTPIT

SEQ ID NO: 1207203 - protein, 10 aa, Mycobacterium
GRKSGQPRES

SEQ ID NO: 1207204 - protein, 10 aa, Mycobacterium
GRKTGKPRSV

SEQ ID NO: 1207205 - protein, 4 aa, Mycobacterium
GRKY

SEQ ID NO: 1207206 - protein, 8 aa, Mycobacterium
GRLAPGRR

SEQ ID NO: 1207207 - protein, 10 aa, Mycobacterium
GRLGPTADGL

SEQ ID NO: 1207208 - protein, 4 aa, Mycobacterium
GRLP

SEQ ID NO: 1207209 - protein, 5 aa, Mycobacterium
GRLPT

SEQ ID NO: 1207210 - protein, 15 aa, Mycobacterium
GRLQAEDDRIGDVRG

SEQ ID NO: 1207211 - protein, 6 aa, Mycobacterium
GRLQQG

SEQ ID NO: 1207212 - protein, 11 aa, Mycobacterium
GRLTNATGVGA

SEQ ID NO: 1207213 - protein, 6 aa, Mycobacterium
GRMPET

SEQ ID NO: 1207214 - protein, 6 aa, Mycobacterium
GRMPSL

SEQ ID NO: 1207215 - protein, 13 aa, Mycobacterium
GRMSATADPIDMD

SEQ ID NO: 1207216 - protein, 13 aa, Mycobacterium
GRMSRPSDSVTTA

SEQ ID NO: 1207217 - protein, 9 aa, Mycobacterium
GRNGDGKSS

SEQ ID NO: 1207218 - protein, 9 aa, Mycobacterium
GRNGDGKST

SEQ ID NO: 1207219 - protein, 5 aa, Mycobacterium
GRNLG

SEQ ID NO: 1207220 - protein, 12 aa, Mycobacterium
GRNLRAGQADQW

SEQ ID NO: 1207221 - protein, 6 aa, Mycobacterium
GRNNVA

SEQ ID NO: 1207222 - protein, 9 aa, Mycobacterium
GRNNYRNPE

SEQ ID NO: 1207223 - protein, 8 aa, Mycobacterium
GRNQADID

SEQ ID NO: 1207224 - protein, 5 aa, Mycobacterium
GRNTV

SEQ ID NO: 1207225 - protein, 6 aa, Mycobacterium
GRPAAG

SEQ ID NO: 1207226 - protein, 5 aa, Mycobacterium
GRPAL

SEQ ID NO: 1207227 - protein, 6 aa, Mycobacterium
GRPARG

SEQ ID NO: 1207228 - protein, 9 aa, Mycobacterium
GRPARGGAE

SEQ ID NO: 1207229 - protein, 18 aa, Mycobacterium
GRPATGRPAIYYPLAAWK

SEQ ID NO: 1207230 - protein, 13 aa, Mycobacterium
GRPAVDAPAPVAG

SEQ ID NO: 1207231 - protein, 8 aa, Mycobacterium
GRPDGNVS

SEQ ID NO: 1207232 - protein, 6 aa, Mycobacterium
GRPDGV

SEQ ID NO: 1207233 - protein, 8 aa, Mycobacterium
GRPDPWAG

SEQ ID NO: 1207234 - protein, 5 aa, Mycobacterium
GRPDV

SEQ ID NO: 1207235 - protein, 24 aa, Mycobacterium
GRPDVNDMGTAYGEASLDSEASYF

SEQ ID NO: 1207236 - protein, 6 aa, Mycobacterium
GRPEEA

SEQ ID NO: 1207237 - protein, 7 aa, Mycobacterium
GRPEEIA

SEQ ID NO: 1207238 - protein, 10 aa, Mycobacterium
GRPEETETTF

SEQ ID NO: 1207239 - protein, 6 aa, Mycobacterium
GRPEEV

SEQ ID NO: 1207240 - protein, 8 aa, Mycobacterium
GRPERAEA

SEQ ID NO: 1207241 - protein, 6 aa, Mycobacterium
GRPGDG

SEQ ID NO: 1207242 - protein, 7 aa, Mycobacterium
GRPGDTF

SEQ ID NO: 1207243 - protein, 6 aa, Mycobacterium
GRPGEV

SEQ ID NO: 1207244 - protein, 6 aa, Mycobacterium
GRPGLV

SEQ ID NO: 1207245 - protein, 9 aa, Mycobacterium
GRPGQPEEV

SEQ ID NO: 1207246 - protein, 4 aa, Mycobacterium
GRPH

SEQ ID NO: 1207247 - protein, 14 aa, Mycobacterium
GRPHELDPDSLDTY

SEQ ID NO: 1207248 - protein, 7 aa, Mycobacterium
GRPISPA

SEQ ID NO: 1207249 - protein, 11 aa, Mycobacterium
GRPKGEPDPKF

SEQ ID NO: 1207250 - protein, 6 aa, Mycobacterium
GRPLEE

SEQ ID NO: 1207251 - protein, 5 aa, Mycobacterium
GRPLR

SEQ ID NO: 1207252 - protein, 5 aa, Mycobacterium
GRPLS

SEQ ID NO: 1207253 - protein, 6 aa, Mycobacterium
GRPLTE

SEQ ID NO: 1207254 - protein, 4 aa, Mycobacterium
GRPM

SEQ ID NO: 1207255 - protein, 4 aa, Mycobacterium
GRPP

SEQ ID NO: 1207256 - protein, 33 aa, Mycobacterium
GRPPAAEPPGAPASLPTDAELATPGPGRSDAYD

SEQ ID NO: 1207257 - protein, 7 aa, Mycobacterium
GRPPEYR

SEQ ID NO: 1207258 - protein, 10 aa, Mycobacterium
GRPPGHKSGA

SEQ ID NO: 1207259 - protein, 17 aa, Mycobacterium
GRPPVSRTAGAGPSDDG

SEQ ID NO: 1207260 - protein, 5 aa, Mycobacterium
GRPQA

SEQ ID NO: 1207261 - protein, 7 aa, Mycobacterium
GRPQERR

SEQ ID NO: 1207262 - protein, 9 aa, Mycobacterium
GRPQNNLGG

SEQ ID NO: 1207263 - protein, 8 aa, Mycobacterium
GRPQPGET

SEQ ID NO: 1207264 - protein, 7 aa, Mycobacterium
GRPQRIG

SEQ ID NO: 1207265 - protein, 7 aa, Mycobacterium
GRPQRQV

SEQ ID NO: 1207266 - protein, 12 aa, Mycobacterium
GRPQTGAHSAGR

SEQ ID NO: 1207267 - protein, 5 aa, Mycobacterium
GRPQW

SEQ ID NO: 1207268 - protein, 6 aa, Mycobacterium
GRPRRE

SEQ ID NO: 1207269 - protein, 9 aa, Mycobacterium
GRPRRTATG

SEQ ID NO: 1207270 - protein, 5 aa, Mycobacterium
GRPRT

SEQ ID NO: 1207271 - protein, 9 aa, Mycobacterium
GRPSDKWGQ

SEQ ID NO: 1207272 - protein, 8 aa, Mycobacterium
GRPSFGQP

SEQ ID NO: 1207273 - protein, 18 aa, Mycobacterium
GRPSLVGSRGPDNKPYAA

SEQ ID NO: 1207274 - protein, 8 aa, Mycobacterium
GRPSPAAY

SEQ ID NO: 1207275 - protein, 9 aa, Mycobacterium
GRPSRAAEL

SEQ ID NO: 1207276 - protein, 11 aa, Mycobacterium
GRPSRRKTARA

SEQ ID NO: 1207277 - protein, 12 aa, Mycobacterium
GRPTAREGNEPW

SEQ ID NO: 1207278 - protein, 15 aa, Mycobacterium
GRPTSPEASGEGATR

SEQ ID NO: 1207279 - protein, 9 aa, Mycobacterium
GRPTTVPPS

SEQ ID NO: 1207280 - protein, 7 aa, Mycobacterium
GRPVDAT

SEQ ID NO: 1207281 - protein, 7 aa, Mycobacterium
GRPVETS

SEQ ID NO: 1207282 - protein, 6 aa, Mycobacterium
GRPVSS

SEQ ID NO: 1207283 - protein, 7 aa, Mycobacterium
GRPYEPQ

SEQ ID NO: 1207284 - protein, 4 aa, Mycobacterium
GRQD

SEQ ID NO: 1207285 - protein, 4 aa, Mycobacterium
GRQG

SEQ ID NO: 1207286 - protein, 16 aa, Mycobacterium
GRQHQAGRSAAGDDHI

SEQ ID NO: 1207287 - protein, 6 aa, Mycobacterium
GRQIGN

SEQ ID NO: 1207288 - protein, 6 aa, Mycobacterium
GRQPAE

SEQ ID NO: 1207289 - protein, 6 aa, Mycobacterium
GRQPDA

SEQ ID NO: 1207290 - protein, 11 aa, Mycobacterium
GRQPGAANDEI

SEQ ID NO: 1207291 - protein, 11 aa, Mycobacterium
GRQRPPRPGVH

SEQ ID NO: 1207292 - protein, 9 aa, Mycobacterium
GRQSTVAGT

SEQ ID NO: 1207293 - protein, 10 aa, Mycobacterium
GRQTGRANRD

SEQ ID NO: 1207294 - protein, 6 aa, Mycobacterium
GRRAAE

SEQ ID NO: 1207295 - protein, 13 aa, Mycobacterium
GRRAARPSGDDRE

SEQ ID NO: 1207296 - protein, 14 aa, Mycobacterium
GRRADTLSGGQQQR

SEQ ID NO: 1207297 - protein, 17 aa, Mycobacterium
GRRATRASGLAQRLRTR

SEQ ID NO: 1207298 - protein, 6 aa, Mycobacterium
GRRCPA

SEQ ID NO: 1207299 - protein, 9 aa, Mycobacterium
GRRCRSTGD

SEQ ID NO: 1207300 - protein, 11 aa, Mycobacterium
GRRDAEGAGAW

SEQ ID NO: 1207301 - protein, 8 aa, Mycobacterium
GRRDGSFP

SEQ ID NO: 1207302 - protein, 10 aa, Mycobacterium
GRRDHDAAEL

SEQ ID NO: 1207303 - protein, 6 aa, Mycobacterium
GRRDPT

SEQ ID NO: 1207304 - protein, 8 aa, Mycobacterium
GRREGADH

SEQ ID NO: 1207305 - protein, 13 aa, Mycobacterium
GRREPIPLPPKTS

SEQ ID NO: 1207306 - protein, 5 aa, Mycobacterium
GRRET

SEQ ID NO: 1207307 - protein, 13 aa, Mycobacterium
GRRGADAGLTERQ

SEQ ID NO: 1207308 - protein, 7 aa, Mycobacterium
GRRGERI

SEQ ID NO: 1207309 - protein, 7 aa, Mycobacterium
GRRGPAA

SEQ ID NO: 1207310 - protein, 15 aa, Mycobacterium
GRRGPERDRPAYDDT

SEQ ID NO: 1207311 - protein, 8 aa, Mycobacterium
GRRGSSVS

SEQ ID NO: 1207312 - protein, 7 aa, Mycobacterium
GRRITPS

SEQ ID NO: 1207313 - protein, 8 aa, Mycobacterium
GRRKGQEM

SEQ ID NO: 1207314 - protein, 9 aa, Mycobacterium
GRRLDPRQA

SEQ ID NO: 1207315 - protein, 7 aa, Mycobacterium
GRRNGVS

SEQ ID NO: 1207316 - protein, 4 aa, Mycobacterium
GRRP

SEQ ID NO: 1207317 - protein, 6 aa, Mycobacterium
GRRPAA

SEQ ID NO: 1207318 - protein, 6 aa, Mycobacterium
GRRPAR

SEQ ID NO: 1207319 - protein, 21 aa, Mycobacterium
GRRPDSATCSGDLEGRPGNSV

SEQ ID NO: 1207320 - protein, 5 aa, Mycobacterium
GRRPP

SEQ ID NO: 1207321 - protein, 8 aa, Mycobacterium
GRRQREAL

SEQ ID NO: 1207322 - protein, 6 aa, Mycobacterium
GRRRAR

SEQ ID NO: 1207323 - protein, 6 aa, Mycobacterium
GRRRDE

SEQ ID NO: 1207324 - protein, 9 aa, Mycobacterium
GRRRGRVAT

SEQ ID NO: 1207325 - protein, 15 aa, Mycobacterium
GRRRTREAQAATGRD

SEQ ID NO: 1207326 - protein, 14 aa, Mycobacterium
GRRSARPSGDDREQ

SEQ ID NO: 1207327 - protein, 10 aa, Mycobacterium
GRRSGQTFQT

SEQ ID NO: 1207328 - protein, 9 aa, Mycobacterium
GRRSNYDEG

SEQ ID NO: 1207329 - protein, 7 aa, Mycobacterium
GRRSPAQ

SEQ ID NO: 1207330 - protein, 11 aa, Mycobacterium
GRRSRPATPPV

SEQ ID NO: 1207331 - protein, 16 aa, Mycobacterium
GRRSRPSDGSGWRCTG

SEQ ID NO: 1207332 - protein, 7 aa, Mycobacterium
GRRSSDR

SEQ ID NO: 1207333 - protein, 19 aa, Mycobacterium
GRRTAAAALTGDGGPWRPD

SEQ ID NO: 1207334 - protein, 6 aa, Mycobacterium
GRRTAQ

SEQ ID NO: 1207335 - protein, 5 aa, Mycobacterium
GRRTD

SEQ ID NO: 1207336 - protein, 13 aa, Mycobacterium
GRRTFGPSFDRGR

SEQ ID NO: 1207337 - protein, 24 aa, Mycobacterium
GRRTLPEERPADGTPVIDTDRGGK

SEQ ID NO: 1207338 - protein, 6 aa, Mycobacterium
GRRVRS

SEQ ID NO: 1207339 - protein, 9 aa, Mycobacterium
GRRYADDEF

SEQ ID NO: 1207340 - protein, 10 aa, Mycobacterium
GRRYAGTVEP

SEQ ID NO: 1207341 - protein, 5 aa, Mycobacterium
GRRYK

SEQ ID NO: 1207342 - protein, 4 aa, Mycobacterium
GRSA

SEQ ID NO: 1207343 - protein, 11 aa, Mycobacterium
GRSAAAIGRGH

SEQ ID NO: 1207344 - protein, 5 aa, Mycobacterium
GRSAD

SEQ ID NO: 1207345 - protein, 5 aa, Mycobacterium
GRSAG

SEQ ID NO: 1207346 - protein, 12 aa, Mycobacterium
GRSAHDAATPQF

SEQ ID NO: 1207347 - protein, 10 aa, Mycobacterium
GRSALSGAPQ

SEQ ID NO: 1207348 - protein, 6 aa, Mycobacterium
GRSATE

SEQ ID NO: 1207349 - protein, 7 aa, Mycobacterium
GRSCGGR

SEQ ID NO: 1207350 - protein, 16 aa, Mycobacterium
GRSDPVDELEQPVFAW

SEQ ID NO: 1207351 - protein, 6 aa, Mycobacterium
GRSFTG

SEQ ID NO: 1207352 - protein, 5 aa, Mycobacterium
GRSGA

SEQ ID NO: 1207353 - protein, 10 aa, Mycobacterium
GRSGADYAAD

SEQ ID NO: 1207354 - protein, 16 aa, Mycobacterium
GRSGGAPETVVDGETG

SEQ ID NO: 1207355 - protein, 10 aa, Mycobacterium
GRSGPSDEVA

SEQ ID NO: 1207356 - protein, 8 aa, Mycobacterium
GRSGRGEA

SEQ ID NO: 1207357 - protein, 13 aa, Mycobacterium
GRSGTSVHLDTRI

SEQ ID NO: 1207358 - protein, 8 aa, Mycobacterium
GRSIRRPL

SEQ ID NO: 1207359 - protein, 10 aa, Mycobacterium
GRSKPYKGVS

SEQ ID NO: 1207360 - protein, 5 aa, Mycobacterium
GRSLQ

SEQ ID NO: 1207361 - protein, 6 aa, Mycobacterium
GRSNGW

SEQ ID NO: 1207362 - protein, 5 aa, Mycobacterium
GRSNL

SEQ ID NO: 1207363 - protein, 8 aa, Mycobacterium
GRSNSEIA

SEQ ID NO: 1207364 - protein, 4 aa, Mycobacterium
GRSP

SEQ ID NO: 1207365 - protein, 14 aa, Mycobacterium
GRSPDRRPTRRGDV

SEQ ID NO: 1207366 - protein, 6 aa, Mycobacterium
GRSPEM

SEQ ID NO: 1207367 - protein, 5 aa, Mycobacterium
GRSPH

SEQ ID NO: 1207368 - protein, 6 aa, Mycobacterium
GRSPRL

SEQ ID NO: 1207369 - protein, 8 aa, Mycobacterium
GRSPSDVD

SEQ ID NO: 1207370 - protein, 6 aa, Mycobacterium
GRSPVN

SEQ ID NO: 1207371 - protein, 10 aa, Mycobacterium
GRSREFSSAT

SEQ ID NO: 1207372 - protein, 4 aa, Mycobacterium
GRSS

SEQ ID NO: 1207373 - protein, 25 aa, Mycobacterium
GRSSAAPTDLSNASEEQARANFQSD

SEQ ID NO: 1207374 - protein, 10 aa, Mycobacterium
GRSSVREVPE

SEQ ID NO: 1207375 - protein, 6 aa, Mycobacterium
GRSSWD

SEQ ID NO: 1207376 - protein, 7 aa, Mycobacterium
GRSTTPD

SEQ ID NO: 1207377 - protein, 12 aa, Mycobacterium
GRSVDHTGRYRG

SEQ ID NO: 1207378 - protein, 15 aa, Mycobacterium
GRSVGSEGAPERDPA

SEQ ID NO: 1207379 - protein, 12 aa, Mycobacterium
GRSVPAKSLSGF

SEQ ID NO: 1207380 - protein, 6 aa, Mycobacterium
GRSVRS

SEQ ID NO: 1207381 - protein, 5 aa, Mycobacterium
GRSYT

SEQ ID NO: 1207382 - protein, 4 aa, Mycobacterium
GRTA

SEQ ID NO: 1207383 - protein, 6 aa, Mycobacterium
GRTAPS

SEQ ID NO: 1207384 - protein, 7 aa, Mycobacterium
GRTAPTD

SEQ ID NO: 1207385 - protein, 9 aa, Mycobacterium
GRTATPGEI

SEQ ID NO: 1207386 - protein, 9 aa, Mycobacterium
GRTATSGDL

SEQ ID NO: 1207387 - protein, 4 aa, Mycobacterium
GRTD

SEQ ID NO: 1207388 - protein, 9 aa, Mycobacterium
GRTDDVAVP

SEQ ID NO: 1207389 - protein, 6 aa, Mycobacterium
GRTDEQ

SEQ ID NO: 1207390 - protein, 12 aa, Mycobacterium
GRTDRDIQAGGK

SEQ ID NO: 1207391 - protein, 4 aa, Mycobacterium
GRTE

SEQ ID NO: 1207392 - protein, 6 aa, Mycobacterium
GRTEAA

SEQ ID NO: 1207393 - protein, 6 aa, Mycobacterium
GRTEPW

SEQ ID NO: 1207394 - protein, 6 aa, Mycobacterium
GRTEVS

SEQ ID NO: 1207395 - protein, 30 aa, Mycobacterium
GRTGAAELADPPRAGGAITDNATDTPRRRR

SEQ ID NO: 1207396 - protein, 14 aa, Mycobacterium
GRTGCRSEADTDEV

SEQ ID NO: 1207397 - protein, 8 aa, Mycobacterium
GRTGDQDV

SEQ ID NO: 1207398 - protein, 5 aa, Mycobacterium
GRTGF

SEQ ID NO: 1207399 - protein, 15 aa, Mycobacterium
GRTGPYAARPAYDDT

SEQ ID NO: 1207400 - protein, 7 aa, Mycobacterium
GRTGTAE

SEQ ID NO: 1207401 - protein, 4 aa, Mycobacterium
GRTI

SEQ ID NO: 1207402 - protein, 6 aa, Mycobacterium
GRTIGT

SEQ ID NO: 1207403 - protein, 4 aa, Mycobacterium
GRTK

SEQ ID NO: 1207404 - protein, 5 aa, Mycobacterium
GRTKL

SEQ ID NO: 1207405 - protein, 5 aa, Mycobacterium
GRTKT

SEQ ID NO: 1207406 - protein, 7 aa, Mycobacterium
GRTNQQI

SEQ ID NO: 1207407 - protein, 6 aa, Mycobacterium
GRTPGA

SEQ ID NO: 1207408 - protein, 8 aa, Mycobacterium
GRTPSPTL

SEQ ID NO: 1207409 - protein, 8 aa, Mycobacterium
GRTPVPAE

SEQ ID NO: 1207410 - protein, 7 aa, Mycobacterium
GRTQARL

SEQ ID NO: 1207411 - protein, 15 aa, Mycobacterium
GRTQGGEQAASDGAI

SEQ ID NO: 1207412 - protein, 8 aa, Mycobacterium
GRTQPLHE

SEQ ID NO: 1207413 - protein, 8 aa, Mycobacterium
GRTRGDDL

SEQ ID NO: 1207414 - protein, 9 aa, Mycobacterium
GRTRLSGRT

SEQ ID NO: 1207415 - protein, 5 aa, Mycobacterium
GRTSI

SEQ ID NO: 1207416 - protein, 20 aa, Mycobacterium
GRTSMSAKAGDDGAAGGTEF

SEQ ID NO: 1207417 - protein, 17 aa, Mycobacterium
GRTSTSGSHAAGAEADR

SEQ ID NO: 1207418 - protein, 5 aa, Mycobacterium
GRTSV

SEQ ID NO: 1207419 - protein, 7 aa, Mycobacterium
GRTTDVT

SEQ ID NO: 1207420 - protein, 5 aa, Mycobacterium
GRTTF

SEQ ID NO: 1207421 - protein, 10 aa, Mycobacterium
GRTTPGAEAV

SEQ ID NO: 1207422 - protein, 8 aa, Mycobacterium
GRTTPPRC

SEQ ID NO: 1207423 - protein, 7 aa, Mycobacterium
GRTTYTS

SEQ ID NO: 1207424 - protein, 12 aa, Mycobacterium
GRTVADAPAWGT

SEQ ID NO: 1207425 - protein, 24 aa, Mycobacterium
GRTVDKEPRWRHPGTTLETGATRT

SEQ ID NO: 1207426 - protein, 7 aa, Mycobacterium
GRTVDSP

SEQ ID NO: 1207427 - protein, 5 aa, Mycobacterium
GRTVS

SEQ ID NO: 1207428 - protein, 8 aa, Mycobacterium
GRVDAEGR

SEQ ID NO: 1207429 - protein, 10 aa, Mycobacterium
GRVDDKGPYE

SEQ ID NO: 1207430 - protein, 7 aa, Mycobacterium
GRVDRND

SEQ ID NO: 1207431 - protein, 5 aa, Mycobacterium
GRVDT

SEQ ID NO: 1207432 - protein, 9 aa, Mycobacterium
GRVEDARAD

SEQ ID NO: 1207433 - protein, 11 aa, Mycobacterium
GRVEEAETAGT

SEQ ID NO: 1207434 - protein, 14 aa, Mycobacterium
GRVEQRPAVSEPLG

SEQ ID NO: 1207435 - protein, 15 aa, Mycobacterium
GRVEYGTGEGSSVAE

SEQ ID NO: 1207436 - protein, 10 aa, Mycobacterium
GRVGTKPGSL

SEQ ID NO: 1207437 - protein, 7 aa, Mycobacterium
GRVISPK

SEQ ID NO: 1207438 - protein, 4 aa, Mycobacterium
GRVK

SEQ ID NO: 1207439 - protein, 19 aa, Mycobacterium
GRVPDLTAPNLADGGTAPT

SEQ ID NO: 1207440 - protein, 5 aa, Mycobacterium
GRVPG

SEQ ID NO: 1207441 - protein, 7 aa, Mycobacterium
GRVPNGD

SEQ ID NO: 1207442 - protein, 5 aa, Mycobacterium
GRVPT

SEQ ID NO: 1207443 - protein, 4 aa, Mycobacterium
GRVR

SEQ ID NO: 1207444 - protein, 11 aa, Mycobacterium
GRVSPPGGTRV

SEQ ID NO: 1207445 - protein, 13 aa, Mycobacterium
GRVSPSDPAEGYR

SEQ ID NO: 1207446 - protein, 8 aa, Mycobacterium
GRVSSSAV

SEQ ID NO: 1207447 - protein, 13 aa, Mycobacterium
GRVTSPTDRPSQV

SEQ ID NO: 1207448 - protein, 4 aa, Mycobacterium
GRWD

SEQ ID NO: 1207449 - protein, 5 aa, Mycobacterium
GRWPE

SEQ ID NO: 1207450 - protein, 9 aa, Mycobacterium
GRWSGERGA

SEQ ID NO: 1207451 - protein, 24 aa, Mycobacterium
GRYASTAGVPARNVPDGDGTGPIP

SEQ ID NO: 1207452 - protein, 4 aa, Mycobacterium
GRYD

SEQ ID NO: 1207453 - protein, 8 aa, Mycobacterium
GRYGHTSD

SEQ ID NO: 1207454 - protein, 11 aa, Mycobacterium
GRYGPTTRRPV

SEQ ID NO: 1207455 - protein, 6 aa, Mycobacterium
GRYPPG

SEQ ID NO: 1207456 - protein, 10 aa, Mycobacterium
GRYQRDRGPS

SEQ ID NO: 1207457 - protein, 8 aa, Mycobacterium
GRYREASD

SEQ ID NO: 1207458 - protein, 6 aa, Mycobacterium
GRYSDG

SEQ ID NO: 1207459 - protein, 9 aa, Mycobacterium
GSAAAIGSA

SEQ ID NO: 1207460 - protein, 22 aa, Mycobacterium
GSAAARAAAANAVEQGAGQGSV

SEQ ID NO: 1207461 - protein, 9 aa, Mycobacterium
GSAAELPGE

SEQ ID NO: 1207462 - protein, 18 aa, Mycobacterium
GSAAGNSPIPNNATYAAT

SEQ ID NO: 1207463 - protein, 8 aa, Mycobacterium
GSAAKRIR

SEQ ID NO: 1207464 - protein, 5 aa, Mycobacterium
GSAAN

SEQ ID NO: 1207465 - protein, 10 aa, Mycobacterium
GSAANPPIEV

SEQ ID NO: 1207466 - protein, 17 aa, Mycobacterium
GSAAPGIASAAARNATF

SEQ ID NO: 1207467 - protein, 6 aa, Mycobacterium
GSAASA

SEQ ID NO: 1207468 - protein, 8 aa, Mycobacterium
GSADDPGI

SEQ ID NO: 1207469 - protein, 5 aa, Mycobacterium
GSADE

SEQ ID NO: 1207470 - protein, 13 aa, Mycobacterium
GSADGSGARPWRR

SEQ ID NO: 1207471 - protein, 12 aa, Mycobacterium
GSADGSGTRPWR

SEQ ID NO: 1207472 - protein, 10 aa, Mycobacterium
GSADKTMRSV

SEQ ID NO: 1207473 - protein, 8 aa, Mycobacterium
GSADQQAT

SEQ ID NO: 1207474 - protein, 8 aa, Mycobacterium
GSADRPTI

SEQ ID NO: 1207475 - protein, 4 aa, Mycobacterium
GSAE

SEQ ID NO: 1207476 - protein, 10 aa, Mycobacterium
GSAEDGPQLT

SEQ ID NO: 1207477 - protein, 11 aa, Mycobacterium
GSAEDGRSRGV

SEQ ID NO: 1207478 - protein, 8 aa, Mycobacterium
GSAEDPNA

SEQ ID NO: 1207479 - protein, 11 aa, Mycobacterium
GSAELAQNSVQ

SEQ ID NO: 1207480 - protein, 5 aa, Mycobacterium
GSAEQ

SEQ ID NO: 1207481 - protein, 7 aa, Mycobacterium
GSAEQRQ

SEQ ID NO: 1207482 - protein, 15 aa, Mycobacterium
GSAFPYRKDPEDKNI

SEQ ID NO: 1207483 - protein, 4 aa, Mycobacterium
GSAG

SEQ ID NO: 1207484 - protein, 21 aa, Mycobacterium
GSAGARDERGWETDLLSGLSV

SEQ ID NO: 1207485 - protein, 7 aa, Mycobacterium
GSAGASI

SEQ ID NO: 1207486 - protein, 7 aa, Mycobacterium
GSAGEGA

SEQ ID NO: 1207487 - protein, 7 aa, Mycobacterium
GSAGNSF

SEQ ID NO: 1207488 - protein, 8 aa, Mycobacterium
GSAGPGTT

SEQ ID NO: 1207489 - protein, 7 aa, Mycobacterium
GSAGQSI

SEQ ID NO: 1207490 - protein, 9 aa, Mycobacterium
GSAGSGFEE

SEQ ID NO: 1207491 - protein, 9 aa, Mycobacterium
GSAGTSEAH

SEQ ID NO: 1207492 - protein, 8 aa, Mycobacterium
GSAKAARA

SEQ ID NO: 1207493 - protein, 15 aa, Mycobacterium
GSAKRDSVGRALPDT

SEQ ID NO: 1207494 - protein, 7 aa, Mycobacterium
GSALGGG

SEQ ID NO: 1207495 - protein, 15 aa, Mycobacterium
GSAMDTPPAPDDLPN

SEQ ID NO: 1207496 - protein, 21 aa, Mycobacterium
GSAPASACKAADNAPSALTPK

SEQ ID NO: 1207497 - protein, 10 aa, Mycobacterium
GSAPGARDDG

SEQ ID NO: 1207498 - protein, 8 aa, Mycobacterium
GSAPGARR

SEQ ID NO: 1207499 - protein, 21 aa, Mycobacterium
GSAPHIQTGPAPSGAGGRPQL

SEQ ID NO: 1207500 - protein, 8 aa, Mycobacterium
GSAPISPE

SEQ ID NO: 1207501 - protein, 8 aa, Mycobacterium
GSAPLSPE

SEQ ID NO: 1207502 - protein, 11 aa, Mycobacterium
GSAPQVGQGTT

SEQ ID NO: 1207503 - protein, 28 aa, Mycobacterium
GSAPRLDDPAADAANGAALADSEKNRHE

SEQ ID NO: 1207504 - protein, 25 aa, Mycobacterium
GSAPSGDAIGSPTPRRPVADVLEIR

SEQ ID NO: 1207505 - protein, 20 aa, Mycobacterium
GSAPSTQTEESSRAAADPNR

SEQ ID NO: 1207506 - protein, 10 aa, Mycobacterium
GSAPVPPGLA

SEQ ID NO: 1207507 - protein, 8 aa, Mycobacterium
GSAQDFDS

SEQ ID NO: 1207508 - protein, 6 aa, Mycobacterium
GSAQQA

SEQ ID NO: 1207509 - protein, 14 aa, Mycobacterium
GSAQSKQELIDNPR

SEQ ID NO: 1207510 - protein, 4 aa, Mycobacterium
GSAR

SEQ ID NO: 1207511 - protein, 37 aa, Mycobacterium
GSARASNGDGVNASGAAVSAVSDRRARPVPSTPTAPT

SEQ ID NO: 1207512 - protein, 16 aa, Mycobacterium
GSARRETAVESPSMTQ

SEQ ID NO: 1207513 - protein, 6 aa, Mycobacterium
GSARSE

SEQ ID NO: 1207514 - protein, 17 aa, Mycobacterium
GSARYQHDGDPRTSGPG

SEQ ID NO: 1207515 - protein, 9 aa, Mycobacterium
GSASAAAKG

SEQ ID NO: 1207516 - protein, 10 aa, Mycobacterium
GSASDDDGEM

SEQ ID NO: 1207517 - protein, 9 aa, Mycobacterium
GSASPRQRL

SEQ ID NO: 1207518 - protein, 9 aa, Mycobacterium
GSATASASL

SEQ ID NO: 1207519 - protein, 6 aa, Mycobacterium
GSATER

SEQ ID NO: 1207520 - protein, 9 aa, Mycobacterium
GSATPSEVR

SEQ ID NO: 1207521 - protein, 12 aa, Mycobacterium
GSATRDQSGFAD

SEQ ID NO: 1207522 - protein, 7 aa, Mycobacterium
GSATRDR

SEQ ID NO: 1207523 - protein, 18 aa, Mycobacterium
GSAVGAVTDSSPAPGTSV

SEQ ID NO: 1207524 - protein, 14 aa, Mycobacterium
GSAVGEDGKAVPVS

SEQ ID NO: 1207525 - protein, 14 aa, Mycobacterium
GSAVPKSAGLAEGD

SEQ ID NO: 1207526 - protein, 24 aa, Mycobacterium
GSAVRPRSDGSAVDRDPAAQPPVR

SEQ ID NO: 1207527 - protein, 17 aa, Mycobacterium
GSAYGDKGSERDTGGFD

SEQ ID NO: 1207528 - protein, 18 aa, Mycobacterium
GSCPGLPSAEPHRVRKAA

SEQ ID NO: 1207529 - protein, 4 aa, Mycobacterium
GSDA

SEQ ID NO: 1207530 - protein, 7 aa, Mycobacterium
GSDADVA

SEQ ID NO: 1207531 - protein, 13 aa, Mycobacterium
GSDADVVGSPDEL

SEQ ID NO: 1207532 - protein, 14 aa, Mycobacterium
GSDADYEKTVRPGH

SEQ ID NO: 1207533 - protein, 9 aa, Mycobacterium
GSDAGLREG

SEQ ID NO: 1207534 - protein, 9 aa, Mycobacterium
GSDAGSAVA

SEQ ID NO: 1207535 - protein, 9 aa, Mycobacterium
GSDAHKSAS

SEQ ID NO: 1207536 - protein, 5 aa, Mycobacterium
GSDAQ

SEQ ID NO: 1207537 - protein, 6 aa, Mycobacterium
GSDASR

SEQ ID NO: 1207538 - protein, 5 aa, Mycobacterium
GSDDA

SEQ ID NO: 1207539 - protein, 17 aa, Mycobacterium
GSDDEEFQRGDSSEEQM

SEQ ID NO: 1207540 - protein, 9 aa, Mycobacterium
GSDDIAVTA

SEQ ID NO: 1207541 - protein, 7 aa, Mycobacterium
GSDEGLT

SEQ ID NO: 1207542 - protein, 9 aa, Mycobacterium
GSDENNAGL

SEQ ID NO: 1207543 - protein, 8 aa, Mycobacterium
GSDEQKNE

SEQ ID NO: 1207544 - protein, 7 aa, Mycobacterium
GSDFGVT

SEQ ID NO: 1207545 - protein, 7 aa, Mycobacterium
GSDGGGL

SEQ ID NO: 1207546 - protein, 12 aa, Mycobacterium
GSDGPDHLPGDH

SEQ ID NO: 1207547 - protein, 5 aa, Mycobacterium
GSDGR

SEQ ID NO: 1207548 - protein, 7 aa, Mycobacterium
GSDKPDM

SEQ ID NO: 1207549 - protein, 7 aa, Mycobacterium
GSDNPVS

SEQ ID NO: 1207550 - protein, 5 aa, Mycobacterium
GSDPI

SEQ ID NO: 1207551 - protein, 5 aa, Mycobacterium
GSDPL

SEQ ID NO: 1207552 - protein, 7 aa, Mycobacterium
GSDRDRV

SEQ ID NO: 1207553 - protein, 8 aa, Mycobacterium
GSDREPTV

SEQ ID NO: 1207554 - protein, 5 aa, Mycobacterium
GSDRM

SEQ ID NO: 1207555 - protein, 11 aa, Mycobacterium
GSDRPHEVPPY

SEQ ID NO: 1207556 - protein, 4 aa, Mycobacterium
GSDS

SEQ ID NO: 1207557 - protein, 10 aa, Mycobacterium
GSDSAASADL

SEQ ID NO: 1207558 - protein, 11 aa, Mycobacterium
GSDSGGGAGIQ

SEQ ID NO: 1207559 - protein, 18 aa, Mycobacterium
GSDSPDSAAREIELWFPG

SEQ ID NO: 1207560 - protein, 9 aa, Mycobacterium
GSDSPVTRA

SEQ ID NO: 1207561 - protein, 10 aa, Mycobacterium
GSDTDPGARY

SEQ ID NO: 1207562 - protein, 15 aa, Mycobacterium
GSDTPKDPGPWEGEQ

SEQ ID NO: 1207563 - protein, 17 aa, Mycobacterium
GSDTQDRVNKGLTSYND

SEQ ID NO: 1207564 - protein, 4 aa, Mycobacterium
GSDV

SEQ ID NO: 1207565 - protein, 5 aa, Mycobacterium
GSDYP

SEQ ID NO: 1207566 - protein, 8 aa, Mycobacterium
GSEAHRRL

SEQ ID NO: 1207567 - protein, 15 aa, Mycobacterium
GSEAPLGAYTAAPAP

SEQ ID NO: 1207568 - protein, 10 aa, Mycobacterium
GSEAQKRDRI

SEQ ID NO: 1207569 - protein, 8 aa, Mycobacterium
GSEDAGPA

SEQ ID NO: 1207570 - protein, 9 aa, Mycobacterium
GSEDALEAA

SEQ ID NO: 1207571 - protein, 6 aa, Mycobacterium
GSEDEI

SEQ ID NO: 1207572 - protein, 11 aa, Mycobacterium
GSEDGGGDGSV

SEQ ID NO: 1207573 - protein, 7 aa, Mycobacterium
GSEDVDD

SEQ ID NO: 1207574 - protein, 6 aa, Mycobacterium
GSEEAI

SEQ ID NO: 1207575 - protein, 7 aa, Mycobacterium
GSEEGHG

SEQ ID NO: 1207576 - protein, 6 aa, Mycobacterium
GSEENA

SEQ ID NO: 1207577 - protein, 5 aa, Mycobacterium
GSEFT

SEQ ID NO: 1207578 - protein, 9 aa, Mycobacterium
GSEGAPGNI

SEQ ID NO: 1207579 - protein, 6 aa, Mycobacterium
GSEGDF

SEQ ID NO: 1207580 - protein, 5 aa, Mycobacterium
GSEHS

SEQ ID NO: 1207581 - protein, 6 aa, Mycobacterium
GSEHTR

SEQ ID NO: 1207582 - protein, 7 aa, Mycobacterium
GSEIKAG

SEQ ID NO: 1207583 - protein, 9 aa, Mycobacterium
GSEKGVTVG

SEQ ID NO: 1207584 - protein, 14 aa, Mycobacterium
GSELAKKVTPDFAP

SEQ ID NO: 1207585 - protein, 17 aa, Mycobacterium
GSEPGLVSPDGDSVPAP

SEQ ID NO: 1207586 - protein, 7 aa, Mycobacterium
GSEPGSI

SEQ ID NO: 1207587 - protein, 13 aa, Mycobacterium
GSEPSGVTVGPDG

SEQ ID NO: 1207588 - protein, 4 aa, Mycobacterium
GSET

SEQ ID NO: 1207589 - protein, 11 aa, Mycobacterium
GSETGGDENFR

SEQ ID NO: 1207590 - protein, 13 aa, Mycobacterium
GSETVDEARQGLQ

SEQ ID NO: 1207591 - protein, 9 aa, Mycobacterium
GSFEGPPPW

SEQ ID NO: 1207592 - protein, 4 aa, Mycobacterium
GSFN

SEQ ID NO: 1207593 - protein, 10 aa, Mycobacterium
GSFSPSDEQF

SEQ ID NO: 1207594 - protein, 4 aa, Mycobacterium
GSGA

SEQ ID NO: 1207595 - protein, 10 aa, Mycobacterium
GSGAAGGGRV

SEQ ID NO: 1207596 - protein, 5 aa, Mycobacterium
GSGAD

SEQ ID NO: 1207597 - protein, 9 aa, Mycobacterium
GSGADVGTA

SEQ ID NO: 1207598 - protein, 5 aa, Mycobacterium
GSGAG

SEQ ID NO: 1207599 - protein, 16 aa, Mycobacterium
GSGAGGVTGAYTAARE

SEQ ID NO: 1207600 - protein, 9 aa, Mycobacterium
GSGAGPVEF

SEQ ID NO: 1207601 - protein, 7 aa, Mycobacterium
GSGAIQG

SEQ ID NO: 1207602 - protein, 13 aa, Mycobacterium
GSGARPGTSPKVC

SEQ ID NO: 1207603 - protein, 15 aa, Mycobacterium
GSGATLGSALTDTPD

SEQ ID NO: 1207604 - protein, 7 aa, Mycobacterium
GSGAVAG

SEQ ID NO: 1207605 - protein, 4 aa, Mycobacterium
GSGC

SEQ ID NO: 1207606 - protein, 7 aa, Mycobacterium
GSGDHAK

SEQ ID NO: 1207607 - protein, 25 aa, Mycobacterium
GSGDRGDADYGTGRINGSPALGPDI

SEQ ID NO: 1207608 - protein, 8 aa, Mycobacterium
GSGEKRTL

SEQ ID NO: 1207609 - protein, 7 aa, Mycobacterium
GSGENLN

SEQ ID NO: 1207610 - protein, 7 aa, Mycobacterium
GSGEPVS

SEQ ID NO: 1207611 - protein, 9 aa, Mycobacterium
GSGEQTGVD

SEQ ID NO: 1207612 - protein, 4 aa, Mycobacterium
GSGG

SEQ ID NO: 1207613 - protein, 9 aa, Mycobacterium
GSGGGIAGA

SEQ ID NO: 1207614 - protein, 5 aa, Mycobacterium
GSGGL

SEQ ID NO: 1207615 - protein, 8 aa, Mycobacterium
GSGGRSLD

SEQ ID NO: 1207616 - protein, 7 aa, Mycobacterium
GSGGTVL

SEQ ID NO: 1207617 - protein, 5 aa, Mycobacterium
GSGHN

SEQ ID NO: 1207618 - protein, 6 aa, Mycobacterium
GSGIGR

SEQ ID NO: 1207619 - protein, 5 aa, Mycobacterium
GSGKG

SEQ ID NO: 1207620 - protein, 6 aa, Mycobacterium
GSGKPV

SEQ ID NO: 1207621 - protein, 5 aa, Mycobacterium
GSGKR

SEQ ID NO: 1207622 - protein, 9 aa, Mycobacterium
GSGKSTVGA

SEQ ID NO: 1207623 - protein, 9 aa, Mycobacterium
GSGMTTGGA

SEQ ID NO: 1207624 - protein, 15 aa, Mycobacterium
GSGNAAGGDGGSGGG

SEQ ID NO: 1207625 - protein, 7 aa, Mycobacterium
GSGNAGA

SEQ ID NO: 1207626 - protein, 10 aa, Mycobacterium
GSGNERLGEE

SEQ ID NO: 1207627 - protein, 9 aa, Mycobacterium
GSGNPRADI

SEQ ID NO: 1207628 - protein, 7 aa, Mycobacterium
GSGNRTL

SEQ ID NO: 1207629 - protein, 6 aa, Mycobacterium
GSGNSI

SEQ ID NO: 1207630 - protein, 7 aa, Mycobacterium
GSGPDGV

SEQ ID NO: 1207631 - protein, 8 aa, Mycobacterium
GSGPEGHV

SEQ ID NO: 1207632 - protein, 9 aa, Mycobacterium
GSGPGDPGL

SEQ ID NO: 1207633 - protein, 10 aa, Mycobacterium
GSGPGDPGLL

SEQ ID NO: 1207634 - protein, 9 aa, Mycobacterium
GSGPKRYGE

SEQ ID NO: 1207635 - protein, 6 aa, Mycobacterium
GSGPLT

SEQ ID NO: 1207636 - protein, 6 aa, Mycobacterium
GSGPNP

SEQ ID NO: 1207637 - protein, 8 aa, Mycobacterium
GSGPNPAI

SEQ ID NO: 1207638 - protein, 6 aa, Mycobacterium
GSGPTR

SEQ ID NO: 1207639 - protein, 5 aa, Mycobacterium
GSGPV

SEQ ID NO: 1207640 - protein, 9 aa, Mycobacterium
GSGQNVAPA

SEQ ID NO: 1207641 - protein, 9 aa, Mycobacterium
GSGQTFGAE

SEQ ID NO: 1207642 - protein, 4 aa, Mycobacterium
GSGR

SEQ ID NO: 1207643 - protein, 7 aa, Mycobacterium
GSGREVT

SEQ ID NO: 1207644 - protein, 9 aa, Mycobacterium
GSGRQAEAL

SEQ ID NO: 1207645 - protein, 14 aa, Mycobacterium
GSGRSVVDNASSGG

SEQ ID NO: 1207646 - protein, 14 aa, Mycobacterium
GSGRTPFARGGDGL

SEQ ID NO: 1207647 - protein, 9 aa, Mycobacterium
GSGRTSGAW

SEQ ID NO: 1207648 - protein, 7 aa, Mycobacterium
GSGSGKT

SEQ ID NO: 1207649 - protein, 25 aa, Mycobacterium
GSGSGTMGKPKFGAYAGAKEAIRGI

SEQ ID NO: 1207650 - protein, 8 aa, Mycobacterium
GSGSGTSV

SEQ ID NO: 1207651 - protein, 11 aa, Mycobacterium
GSGSIEDEHRR

SEQ ID NO: 1207652 - protein, 8 aa, Mycobacterium
GSGSLETE

SEQ ID NO: 1207653 - protein, 12 aa, Mycobacterium
GSGSPADDEIAA

SEQ ID NO: 1207654 - protein, 9 aa, Mycobacterium
GSGSSGERC

SEQ ID NO: 1207655 - protein, 9 aa, Mycobacterium
GSGSSRHSI

SEQ ID NO: 1207656 - protein, 9 aa, Mycobacterium
GSGTSEKTR

SEQ ID NO: 1207657 - protein, 7 aa, Mycobacterium
GSGVADD

SEQ ID NO: 1207658 - protein, 10 aa, Mycobacterium
GSGVRTPRVK

SEQ ID NO: 1207659 - protein, 6 aa, Mycobacterium
GSGVTP

SEQ ID NO: 1207660 - protein, 13 aa, Mycobacterium
GSGYGPDGGTPEF

SEQ ID NO: 1207661 - protein, 6 aa, Mycobacterium
GSHELG

SEQ ID NO: 1207662 - protein, 6 aa, Mycobacterium
GSHGGD

SEQ ID NO: 1207663 - protein, 11 aa, Mycobacterium
GSHPSKNPVRT

SEQ ID NO: 1207664 - protein, 7 aa, Mycobacterium
GSIAAPL

SEQ ID NO: 1207665 - protein, 8 aa, Mycobacterium
GSIAPTDR

SEQ ID NO: 1207666 - protein, 6 aa, Mycobacterium
GSIDED

SEQ ID NO: 1207667 - protein, 9 aa, Mycobacterium
GSIEERARE

SEQ ID NO: 1207668 - protein, 4 aa, Mycobacterium
GSIG

SEQ ID NO: 1207669 - protein, 10 aa, Mycobacterium
GSIGPDGVGV

SEQ ID NO: 1207670 - protein, 6 aa, Mycobacterium
GSIPAP

SEQ ID NO: 1207671 - protein, 20 aa, Mycobacterium
GSIPKTSSGKLRRSNSVSLV

SEQ ID NO: 1207672 - protein, 11 aa, Mycobacterium
GSIPTTTSGKI

SEQ ID NO: 1207673 - protein, 18 aa, Mycobacterium
GSIQPRGEQPHLQSGPTV

SEQ ID NO: 1207674 - protein, 6 aa, Mycobacterium
GSIRPH

SEQ ID NO: 1207675 - protein, 23 aa, Mycobacterium
GSKASEPRDRARRKATVDTHRAQ

SEQ ID NO: 1207676 - protein, 7 aa, Mycobacterium
GSKEARI

SEQ ID NO: 1207677 - protein, 4 aa, Mycobacterium
GSKG

SEQ ID NO: 1207678 - protein, 4 aa, Mycobacterium
GSKI

SEQ ID NO: 1207679 - protein, 15 aa, Mycobacterium
GSKKGPLVETGPDGE

SEQ ID NO: 1207680 - protein, 15 aa, Mycobacterium
GSKKVRSTTPEAAGR

SEQ ID NO: 1207681 - protein, 10 aa, Mycobacterium
GSKLPGRPTL

SEQ ID NO: 1207682 - protein, 8 aa, Mycobacterium
GSKQRRSA

SEQ ID NO: 1207683 - protein, 5 aa, Mycobacterium
GSKSG

SEQ ID NO: 1207684 - protein, 11 aa, Mycobacterium
GSKWPDRPSPF

SEQ ID NO: 1207685 - protein, 4 aa, Mycobacterium
GSLA

SEQ ID NO: 1207686 - protein, 9 aa, Mycobacterium
GSLAESGTP

SEQ ID NO: 1207687 - protein, 9 aa, Mycobacterium
GSLAGTRLT

SEQ ID NO: 1207688 - protein, 10 aa, Mycobacterium
GSLAGTSDGV

SEQ ID NO: 1207689 - protein, 25 aa, Mycobacterium
GSLARQPNQPPPQVPPYRGPSGERA

SEQ ID NO: 1207690 - protein, 5 aa, Mycobacterium
GSLDG

SEQ ID NO: 1207691 - protein, 8 aa, Mycobacterium
GSLDQEEE

SEQ ID NO: 1207692 - protein, 8 aa, Mycobacterium
GSLDQEPE

SEQ ID NO: 1207693 - protein, 10 aa, Mycobacterium
GSLDSSHEAA

SEQ ID NO: 1207694 - protein, 9 aa, Mycobacterium
GSLGKATEL

SEQ ID NO: 1207695 - protein, 6 aa, Mycobacterium
GSLKPT

SEQ ID NO: 1207696 - protein, 16 aa, Mycobacterium
GSLKTGAQQSYLETRP

SEQ ID NO: 1207697 - protein, 34 aa, Mycobacterium
GSLPAAAGEAGDAETDARTPSPAARAASRAQGRG

SEQ ID NO: 1207698 - protein, 6 aa, Mycobacterium
GSLPDT

SEQ ID NO: 1207699 - protein, 15 aa, Mycobacterium
GSLPKTDRADAGKRV

SEQ ID NO: 1207700 - protein, 9 aa, Mycobacterium
GSLPPGVSP

SEQ ID NO: 1207701 - protein, 14 aa, Mycobacterium
GSLPSYKDGTGRKV

SEQ ID NO: 1207702 - protein, 19 aa, Mycobacterium
GSLPTTPWTTNAEGRGPAW

SEQ ID NO: 1207703 - protein, 8 aa, Mycobacterium
GSLQSHGR

SEQ ID NO: 1207704 - protein, 5 aa, Mycobacterium
GSLRD

SEQ ID NO: 1207705 - protein, 7 aa, Mycobacterium
GSLSGRE

SEQ ID NO: 1207706 - protein, 5 aa, Mycobacterium
GSLTD

SEQ ID NO: 1207707 - protein, 36 aa, Mycobacterium
GSLYPAPAPRFSRSAPSAPKPPGVPGADTEAVLREW

SEQ ID NO: 1207708 - protein, 6 aa, Mycobacterium
GSMAPQ

SEQ ID NO: 1207709 - protein, 43 aa, Mycobacterium
GSMGPPAGAPPPAPTVPAGTVGSTNAPAAPAPSAASAAAGPTL

SEQ ID NO: 1207710 - protein, 44 aa, Mycobacterium
GSMGPPAGPFPPPAATVPAGALAAGSNAPSTAPPAAAAGAGPTL

SEQ ID NO: 1207711 - protein, 8 aa, Mycobacterium
GSMNEPGL

SEQ ID NO: 1207712 - protein, 6 aa, Mycobacterium
GSMPGD

SEQ ID NO: 1207713 - protein, 16 aa, Mycobacterium
GSMPTTSSAHPAARRS

SEQ ID NO: 1207714 - protein, 13 aa, Mycobacterium
GSMSGLTSARTQL

SEQ ID NO: 1207715 - protein, 13 aa, Mycobacterium
GSMSSNSNGEGDI

SEQ ID NO: 1207716 - protein, 10 aa, Mycobacterium
GSMVSGDESL

SEQ ID NO: 1207717 - protein, 4 aa, Mycobacterium
GSNA

SEQ ID NO: 1207718 - protein, 7 aa, Mycobacterium
GSNERQV

SEQ ID NO: 1207719 - protein, 9 aa, Mycobacterium
GSNSATAAS

SEQ ID NO: 1207720 - protein, 9 aa, Mycobacterium
GSNTGNSFG

SEQ ID NO: 1207721 - protein, 10 aa, Mycobacterium
GSPAAAPADE

SEQ ID NO: 1207722 - protein, 17 aa, Mycobacterium
GSPAAQRKRLSQRYSKG

SEQ ID NO: 1207723 - protein, 10 aa, Mycobacterium
GSPAEAGDQL

SEQ ID NO: 1207724 - protein, 6 aa, Mycobacterium
GSPAEV

SEQ ID NO: 1207725 - protein, 6 aa, Mycobacterium
GSPAPV

SEQ ID NO: 1207726 - protein, 9 aa, Mycobacterium
GSPASENAT

SEQ ID NO: 1207727 - protein, 19 aa, Mycobacterium
GSPASGSPRRAVSGIDSSR

SEQ ID NO: 1207728 - protein, 9 aa, Mycobacterium
GSPASWSSA

SEQ ID NO: 1207729 - protein, 12 aa, Mycobacterium
GSPAYPPDPAAI

SEQ ID NO: 1207730 - protein, 4 aa, Mycobacterium
GSPD

SEQ ID NO: 1207731 - protein, 17 aa, Mycobacterium
GSPDCTASAPPAPGSSN

SEQ ID NO: 1207732 - protein, 8 aa, Mycobacterium
GSPDQKER

SEQ ID NO: 1207733 - protein, 6 aa, Mycobacterium
GSPEVA

SEQ ID NO: 1207734 - protein, 6 aa, Mycobacterium
GSPFRD

SEQ ID NO: 1207735 - protein, 6 aa, Mycobacterium
GSPGEQ

SEQ ID NO: 1207736 - protein, 12 aa, Mycobacterium
GSPGLLDDDSGR

SEQ ID NO: 1207737 - protein, 7 aa, Mycobacterium
GSPGQAA

SEQ ID NO: 1207738 - protein, 10 aa, Mycobacterium
GSPGTDVARS

SEQ ID NO: 1207739 - protein, 17 aa, Mycobacterium
GSPGYREAARRAGAGVA

SEQ ID NO: 1207740 - protein, 20 aa, Mycobacterium
GSPIGRTRDAIPGTPPDRPV

SEQ ID NO: 1207741 - protein, 5 aa, Mycobacterium
GSPLE

SEQ ID NO: 1207742 - protein, 7 aa, Mycobacterium
GSPLSGL

SEQ ID NO: 1207743 - protein, 10 aa, Mycobacterium
GSPNAPQPDS

SEQ ID NO: 1207744 - protein, 32 aa, Mycobacterium
GSPNPGYFTDDGDQSTQTGPVAPVPDGSAGIE

SEQ ID NO: 1207745 - protein, 7 aa, Mycobacterium
GSPNYLG

SEQ ID NO: 1207746 - protein, 11 aa, Mycobacterium
GSPPPPAPDSI

SEQ ID NO: 1207747 - protein, 8 aa, Mycobacterium
GSPRLDSA

SEQ ID NO: 1207748 - protein, 7 aa, Mycobacterium
GSPRSGL

SEQ ID NO: 1207749 - protein, 5 aa, Mycobacterium
GSPSA

SEQ ID NO: 1207750 - protein, 5 aa, Mycobacterium
GSPSV

SEQ ID NO: 1207751 - protein, 8 aa, Mycobacterium
GSPTARRA

SEQ ID NO: 1207752 - protein, 5 aa, Mycobacterium
GSPTL

SEQ ID NO: 1207753 - protein, 5 aa, Mycobacterium
GSPVD

SEQ ID NO: 1207754 - protein, 7 aa, Mycobacterium
GSPVGTA

SEQ ID NO: 1207755 - protein, 4 aa, Mycobacterium
GSPY

SEQ ID NO: 1207756 - protein, 5 aa, Mycobacterium
GSQAA

SEQ ID NO: 1207757 - protein, 8 aa, Mycobacterium
GSQARRNR

SEQ ID NO: 1207758 - protein, 5 aa, Mycobacterium
GSQCN

SEQ ID NO: 1207759 - protein, 4 aa, Mycobacterium
GSQD

SEQ ID NO: 1207760 - protein, 6 aa, Mycobacterium
GSQFPG

SEQ ID NO: 1207761 - protein, 6 aa, Mycobacterium
GSQGIS

SEQ ID NO: 1207762 - protein, 5 aa, Mycobacterium
GSQGT

SEQ ID NO: 1207763 - protein, 7 aa, Mycobacterium
GSQGTYV

SEQ ID NO: 1207764 - protein, 4 aa, Mycobacterium
GSQI

SEQ ID NO: 1207765 - protein, 19 aa, Mycobacterium
GSQISPEGKGYADTPGIHS

SEQ ID NO: 1207766 - protein, 15 aa, Mycobacterium
GSQLAGAPADFDSAP

SEQ ID NO: 1207767 - protein, 10 aa, Mycobacterium
GSQLATAADG

SEQ ID NO: 1207768 - protein, 10 aa, Mycobacterium
GSQLGDPVKG

SEQ ID NO: 1207769 - protein, 14 aa, Mycobacterium
GSQNDLPSGTRDYD

SEQ ID NO: 1207770 - protein, 6 aa, Mycobacterium
GSQNWG

SEQ ID NO: 1207771 - protein, 5 aa, Mycobacterium
GSQPE

SEQ ID NO: 1207772 - protein, 11 aa, Mycobacterium
GSQPGPSRDSA

SEQ ID NO: 1207773 - protein, 6 aa, Mycobacterium
GSQQPW

SEQ ID NO: 1207774 - protein, 6 aa, Mycobacterium
GSQVTT

SEQ ID NO: 1207775 - protein, 4 aa, Mycobacterium
GSRA

SEQ ID NO: 1207776 - protein, 19 aa, Mycobacterium
GSRAPSRYGDERNAKSDTD

SEQ ID NO: 1207777 - protein, 17 aa, Mycobacterium
GSRASTRAVVHAVAAAM

SEQ ID NO: 1207778 - protein, 9 aa, Mycobacterium
GSRDRRYGA

SEQ ID NO: 1207779 - protein, 9 aa, Mycobacterium
GSRDRTDGF

SEQ ID NO: 1207780 - protein, 8 aa, Mycobacterium
GSREGTRE

SEQ ID NO: 1207781 - protein, 8 aa, Mycobacterium
GSRGQTVE

SEQ ID NO: 1207782 - protein, 13 aa, Mycobacterium
GSRGSADTVRDTR

SEQ ID NO: 1207783 - protein, 8 aa, Mycobacterium
GSRGTSAL

SEQ ID NO: 1207784 - protein, 9 aa, Mycobacterium
GSRKPDERR

SEQ ID NO: 1207785 - protein, 5 aa, Mycobacterium
GSRLP

SEQ ID NO: 1207786 - protein, 8 aa, Mycobacterium
GSRMQPGH

SEQ ID NO: 1207787 - protein, 8 aa, Mycobacterium
GSRMSPEE

SEQ ID NO: 1207788 - protein, 15 aa, Mycobacterium
GSRNKYEVDHDSGKV

SEQ ID NO: 1207789 - protein, 9 aa, Mycobacterium
GSRNPDAAQ

SEQ ID NO: 1207790 - protein, 8 aa, Mycobacterium
GSRPATGG

SEQ ID NO: 1207791 - protein, 19 aa, Mycobacterium
GSRPPAAAPSVAVGPGEHP

SEQ ID NO: 1207792 - protein, 12 aa, Mycobacterium
GSRPSDPALAKG

SEQ ID NO: 1207793 - protein, 14 aa, Mycobacterium
GSRPTSRKPTTSIS

SEQ ID NO: 1207794 - protein, 9 aa, Mycobacterium
GSRQEITRK

SEQ ID NO: 1207795 - protein, 7 aa, Mycobacterium
GSRQGLA

SEQ ID NO: 1207796 - protein, 6 aa, Mycobacterium
GSRQGQ

SEQ ID NO: 1207797 - protein, 6 aa, Mycobacterium
GSRRDG

SEQ ID NO: 1207798 - protein, 8 aa, Mycobacterium
GSRRPAGI

SEQ ID NO: 1207799 - protein, 5 aa, Mycobacterium
GSRRQ

SEQ ID NO: 1207800 - protein, 8 aa, Mycobacterium
GSRRRPYE

SEQ ID NO: 1207801 - protein, 24 aa, Mycobacterium
GSRRSTGRRGAPAHRQRSRPPRLS

SEQ ID NO: 1207802 - protein, 6 aa, Mycobacterium
GSRVSN

SEQ ID NO: 1207803 - protein, 9 aa, Mycobacterium
GSRYPLDRG

SEQ ID NO: 1207804 - protein, 5 aa, Mycobacterium
GSSAD

SEQ ID NO: 1207805 - protein, 11 aa, Mycobacterium
GSSAPADNRRD

SEQ ID NO: 1207806 - protein, 7 aa, Mycobacterium
GSSAPYH

SEQ ID NO: 1207807 - protein, 10 aa, Mycobacterium
GSSCTDGGRG

SEQ ID NO: 1207808 - protein, 7 aa, Mycobacterium
GSSDLSQ

SEQ ID NO: 1207809 - protein, 5 aa, Mycobacterium
GSSDT

SEQ ID NO: 1207810 - protein, 6 aa, Mycobacterium
GSSEKA

SEQ ID NO: 1207811 - protein, 9 aa, Mycobacterium
GSSESDVKD

SEQ ID NO: 1207812 - protein, 20 aa, Mycobacterium
GSSESGAQMSTYASAGAEVE

SEQ ID NO: 1207813 - protein, 5 aa, Mycobacterium
GSSEV

SEQ ID NO: 1207814 - protein, 9 aa, Mycobacterium
GSSGGRAYD

SEQ ID NO: 1207815 - protein, 10 aa, Mycobacterium
GSSGKTSTKD

SEQ ID NO: 1207816 - protein, 10 aa, Mycobacterium
GSSGRDGDKI

SEQ ID NO: 1207817 - protein, 7 aa, Mycobacterium
GSSHRFT

SEQ ID NO: 1207818 - protein, 5 aa, Mycobacterium
GSSHT

SEQ ID NO: 1207819 - protein, 4 aa, Mycobacterium
GSSK

SEQ ID NO: 1207820 - protein, 8 aa, Mycobacterium
GSSKPACA

SEQ ID NO: 1207821 - protein, 8 aa, Mycobacterium
GSSLPPSS

SEQ ID NO: 1207822 - protein, 20 aa, Mycobacterium
GSSLQGDRRTYQQDPGNARE

SEQ ID NO: 1207823 - protein, 25 aa, Mycobacterium
GSSNRSANARTSTVAPALADGTRWA

SEQ ID NO: 1207824 - protein, 8 aa, Mycobacterium
GSSPAGQL

SEQ ID NO: 1207825 - protein, 29 aa, Mycobacterium
GSSPESARQLASRARRAASAAPPPADEHA

SEQ ID NO: 1207826 - protein, 5 aa, Mycobacterium
GSSPG

SEQ ID NO: 1207827 - protein, 6 aa, Mycobacterium
GSSPGV

SEQ ID NO: 1207828 - protein, 8 aa, Mycobacterium
GSSPLQDR

SEQ ID NO: 1207829 - protein, 7 aa, Mycobacterium
GSSPLYT

SEQ ID NO: 1207830 - protein, 7 aa, Mycobacterium
GSSPVES

SEQ ID NO: 1207831 - protein, 11 aa, Mycobacterium
GSSQPEPRPPR

SEQ ID NO: 1207832 - protein, 11 aa, Mycobacterium
GSSRPAANVRT

SEQ ID NO: 1207833 - protein, 6 aa, Mycobacterium
GSSRPP

SEQ ID NO: 1207834 - protein, 12 aa, Mycobacterium
GSSRRREAPDRN

SEQ ID NO: 1207835 - protein, 10 aa, Mycobacterium
GSSSAAHSNA

SEQ ID NO: 1207836 - protein, 10 aa, Mycobacterium
GSSSAARSNA

SEQ ID NO: 1207837 - protein, 9 aa, Mycobacterium
GSSSLGVHG

SEQ ID NO: 1207838 - protein, 4 aa, Mycobacterium
GSST

SEQ ID NO: 1207839 - protein, 15 aa, Mycobacterium
GSSTENSAYGPTRNP

SEQ ID NO: 1207840 - protein, 7 aa, Mycobacterium
GSSTNDY

SEQ ID NO: 1207841 - protein, 15 aa, Mycobacterium
GSSVDERDADARRMR

SEQ ID NO: 1207842 - protein, 16 aa, Mycobacterium
GSSVLGSPGQANYATA

SEQ ID NO: 1207843 - protein, 15 aa, Mycobacterium
GSTAARHPNTTVTER

SEQ ID NO: 1207844 - protein, 5 aa, Mycobacterium
GSTAL

SEQ ID NO: 1207845 - protein, 5 aa, Mycobacterium
GSTAQ

SEQ ID NO: 1207846 - protein, 8 aa, Mycobacterium
GSTAQAVS

SEQ ID NO: 1207847 - protein, 6 aa, Mycobacterium
GSTATG

SEQ ID NO: 1207848 - protein, 5 aa, Mycobacterium
GSTAV

SEQ ID NO: 1207849 - protein, 4 aa, Mycobacterium
GSTD

SEQ ID NO: 1207850 - protein, 10 aa, Mycobacterium
GSTDGESGLQ

SEQ ID NO: 1207851 - protein, 17 aa, Mycobacterium
GSTDVGSRVGELAGKSI

SEQ ID NO: 1207852 - protein, 24 aa, Mycobacterium
GSTENAVTVTREDGCPPGSIGKGF

SEQ ID NO: 1207853 - protein, 9 aa, Mycobacterium
GSTEPMTSR

SEQ ID NO: 1207854 - protein, 12 aa, Mycobacterium
GSTESPAAARGR

SEQ ID NO: 1207855 - protein, 6 aa, Mycobacterium
GSTEVG

SEQ ID NO: 1207856 - protein, 10 aa, Mycobacterium
GSTGEPKGVE

SEQ ID NO: 1207857 - protein, 15 aa, Mycobacterium
GSTGQEPESRETSIQ

SEQ ID NO: 1207858 - protein, 8 aa, Mycobacterium
GSTGTGAL

SEQ ID NO: 1207859 - protein, 8 aa, Mycobacterium
GSTGVGRD

SEQ ID NO: 1207860 - protein, 4 aa, Mycobacterium
GSTL

SEQ ID NO: 1207861 - protein, 5 aa, Mycobacterium
GSTLG

SEQ ID NO: 1207862 - protein, 6 aa, Mycobacterium
GSTPAI

SEQ ID NO: 1207863 - protein, 14 aa, Mycobacterium
GSTPDRLHSLFGPT

SEQ ID NO: 1207864 - protein, 13 aa, Mycobacterium
GSTPERGTPAEQA

SEQ ID NO: 1207865 - protein, 14 aa, Mycobacterium
GSTPGEYAATHGRR

SEQ ID NO: 1207866 - protein, 8 aa, Mycobacterium
GSTPSGRR

SEQ ID NO: 1207867 - protein, 14 aa, Mycobacterium
GSTPTFSPQPRPLT

SEQ ID NO: 1207868 - protein, 7 aa, Mycobacterium
GSTPTGR

SEQ ID NO: 1207869 - protein, 6 aa, Mycobacterium
GSTPVG

SEQ ID NO: 1207870 - protein, 15 aa, Mycobacterium
GSTQPDRQTARQQRE

SEQ ID NO: 1207871 - protein, 5 aa, Mycobacterium
GSTQV

SEQ ID NO: 1207872 - protein, 6 aa, Mycobacterium
GSTRAG

SEQ ID NO: 1207873 - protein, 5 aa, Mycobacterium
GSTRG

SEQ ID NO: 1207874 - protein, 8 aa, Mycobacterium
GSTRSINA

SEQ ID NO: 1207875 - protein, 4 aa, Mycobacterium
GSTS

SEQ ID NO: 1207876 - protein, 9 aa, Mycobacterium
GSTTGTTSI

SEQ ID NO: 1207877 - protein, 5 aa, Mycobacterium
GSTTL

SEQ ID NO: 1207878 - protein, 6 aa, Mycobacterium
GSTVDV

SEQ ID NO: 1207879 - protein, 22 aa, Mycobacterium
GSTVSAQMASSAARGFAPGDPV

SEQ ID NO: 1207880 - protein, 11 aa, Mycobacterium
GSTVSDGVGSA

SEQ ID NO: 1207881 - protein, 4 aa, Mycobacterium
GSTW

SEQ ID NO: 1207882 - protein, 5 aa, Mycobacterium
GSTWP

SEQ ID NO: 1207883 - protein, 5 aa, Mycobacterium
GSTYA

SEQ ID NO: 1207884 - protein, 5 aa, Mycobacterium
GSTYS

SEQ ID NO: 1207885 - protein, 28 aa, Mycobacterium
GSVAQRRATTGLASGRLGERVPADGEAA

SEQ ID NO: 1207886 - protein, 10 aa, Mycobacterium
GSVARSPRPE

SEQ ID NO: 1207887 - protein, 4 aa, Mycobacterium
GSVE

SEQ ID NO: 1207888 - protein, 8 aa, Mycobacterium
GSVGSGAH

SEQ ID NO: 1207889 - protein, 7 aa, Mycobacterium
GSVGSNA

SEQ ID NO: 1207890 - protein, 16 aa, Mycobacterium
GSVNSRDARGGTAPVQ

SEQ ID NO: 1207891 - protein, 8 aa, Mycobacterium
GSVPDGGG

SEQ ID NO: 1207892 - protein, 9 aa, Mycobacterium
GSVPGGQAE

SEQ ID NO: 1207893 - protein, 12 aa, Mycobacterium
GSVPPAGPERAA

SEQ ID NO: 1207894 - protein, 10 aa, Mycobacterium
GSVRNDSTGA

SEQ ID NO: 1207895 - protein, 4 aa, Mycobacterium
GSVS

SEQ ID NO: 1207896 - protein, 19 aa, Mycobacterium
GSVSKEARADVEEALKSGR

SEQ ID NO: 1207897 - protein, 24 aa, Mycobacterium
GSVSVADDGRGLPVDSDPVTGKNG

SEQ ID NO: 1207898 - protein, 6 aa, Mycobacterium
GSVSVH

SEQ ID NO: 1207899 - protein, 10 aa, Mycobacterium
GSVTDAEDAV

SEQ ID NO: 1207900 - protein, 8 aa, Mycobacterium
GSVTEKFG

SEQ ID NO: 1207901 - protein, 12 aa, Mycobacterium
GSVTEVQANPKV

SEQ ID NO: 1207902 - protein, 12 aa, Mycobacterium
GSVTSAASFVVG

SEQ ID NO: 1207903 - protein, 12 aa, Mycobacterium
GSWATEKPQRMP

SEQ ID NO: 1207904 - protein, 5 aa, Mycobacterium
GSWNG

SEQ ID NO: 1207905 - protein, 6 aa, Mycobacterium
GSYATQ

SEQ ID NO: 1207906 - protein, 4 aa, Mycobacterium
GSYH

SEQ ID NO: 1207907 - protein, 8 aa, Mycobacterium
GSYNGDTT

SEQ ID NO: 1207908 - protein, 4 aa, Mycobacterium
GSYP

SEQ ID NO: 1207909 - protein, 5 aa, Mycobacterium
GSYTA

SEQ ID NO: 1207910 - protein, 10 aa, Mycobacterium
GTAAEAAGAN

SEQ ID NO: 1207911 - protein, 8 aa, Mycobacterium
GTAAGEYP

SEQ ID NO: 1207912 - protein, 6 aa, Mycobacterium
GTAAPK

SEQ ID NO: 1207913 - protein, 7 aa, Mycobacterium
GTAARTQ

SEQ ID NO: 1207914 - protein, 14 aa, Mycobacterium
GTAAVGEDPGDEPC

SEQ ID NO: 1207915 - protein, 10 aa, Mycobacterium
GTADARQVDN

SEQ ID NO: 1207916 - protein, 8 aa, Mycobacterium
GTADGPSL

SEQ ID NO: 1207917 - protein, 10 aa, Mycobacterium
GTADKRQVDD

SEQ ID NO: 1207918 - protein, 12 aa, Mycobacterium
GTAEALPVPDAS

SEQ ID NO: 1207919 - protein, 11 aa, Mycobacterium
GTAEGSHTPVG

SEQ ID NO: 1207920 - protein, 19 aa, Mycobacterium
GTAEHRNRPVQQGKSQTSV

SEQ ID NO: 1207921 - protein, 8 aa, Mycobacterium
GTAEPVGS

SEQ ID NO: 1207922 - protein, 8 aa, Mycobacterium
GTAESPGD

SEQ ID NO: 1207923 - protein, 8 aa, Mycobacterium
GTAETRAV

SEQ ID NO: 1207924 - protein, 28 aa, Mycobacterium
GTAGDRSRYRGDDRNRPLDKHGRAQAES

SEQ ID NO: 1207925 - protein, 6 aa, Mycobacterium
GTAGEI

SEQ ID NO: 1207926 - protein, 8 aa, Mycobacterium
GTAGGDGR

SEQ ID NO: 1207927 - protein, 19 aa, Mycobacterium
GTAGGKGELDDGYQPPNEL

SEQ ID NO: 1207928 - protein, 11 aa, Mycobacterium
GTAGIEGDDPQ

SEQ ID NO: 1207929 - protein, 6 aa, Mycobacterium
GTAGSV

SEQ ID NO: 1207930 - protein, 4 aa, Mycobacterium
GTAI

SEQ ID NO: 1207931 - protein, 18 aa, Mycobacterium
GTALDGGAEAAGYGVTST

SEQ ID NO: 1207932 - protein, 10 aa, Mycobacterium
GTALGGGSEL

SEQ ID NO: 1207933 - protein, 5 aa, Mycobacterium
GTALS

SEQ ID NO: 1207934 - protein, 4 aa, Mycobacterium
GTAP

SEQ ID NO: 1207935 - protein, 41 aa, Mycobacterium
GTAPASAPAGGSNNADGSAPPPLPITPPRTQAAPAPPPRHA

SEQ ID NO: 1207936 - protein, 9 aa, Mycobacterium
GTAQREAGM

SEQ ID NO: 1207937 - protein, 10 aa, Mycobacterium
GTARAENYGP

SEQ ID NO: 1207938 - protein, 9 aa, Mycobacterium
GTARPVSEQ

SEQ ID NO: 1207939 - protein, 9 aa, Mycobacterium
GTARRDDGA

SEQ ID NO: 1207940 - protein, 8 aa, Mycobacterium
GTARTESD

SEQ ID NO: 1207941 - protein, 11 aa, Mycobacterium
GTASAANLSRN

SEQ ID NO: 1207942 - protein, 8 aa, Mycobacterium
GTASARRL

SEQ ID NO: 1207943 - protein, 6 aa, Mycobacterium
GTASER

SEQ ID NO: 1207944 - protein, 11 aa, Mycobacterium
GTASPETADGW

SEQ ID NO: 1207945 - protein, 8 aa, Mycobacterium
GTASTTRK

SEQ ID NO: 1207946 - protein, 5 aa, Mycobacterium
GTATF

SEQ ID NO: 1207947 - protein, 6 aa, Mycobacterium
GTATGI

SEQ ID NO: 1207948 - protein, 5 aa, Mycobacterium
GTATM

SEQ ID NO: 1207949 - protein, 5 aa, Mycobacterium
GTATW

SEQ ID NO: 1207950 - protein, 6 aa, Mycobacterium
GTAVPH

SEQ ID NO: 1207951 - protein, 5 aa, Mycobacterium
GTAYH

SEQ ID NO: 1207952 - protein, 5 aa, Mycobacterium
GTCGA

SEQ ID NO: 1207953 - protein, 11 aa, Mycobacterium
GTDAGDPAPKG

SEQ ID NO: 1207954 - protein, 8 aa, Mycobacterium
GTDAHAGG

SEQ ID NO: 1207955 - protein, 8 aa, Mycobacterium
GTDAITEV

SEQ ID NO: 1207956 - protein, 8 aa, Mycobacterium
GTDANGKN

SEQ ID NO: 1207957 - protein, 15 aa, Mycobacterium
GTDAPAIPHGKNADE

SEQ ID NO: 1207958 - protein, 7 aa, Mycobacterium
GTDAQKR

SEQ ID NO: 1207959 - protein, 8 aa, Mycobacterium
GTDASRPF

SEQ ID NO: 1207960 - protein, 7 aa, Mycobacterium
GTDDHQL

SEQ ID NO: 1207961 - protein, 9 aa, Mycobacterium
GTDEAAHER

SEQ ID NO: 1207962 - protein, 7 aa, Mycobacterium
GTDEDAH

SEQ ID NO: 1207963 - protein, 7 aa, Mycobacterium
GTDEQAL

SEQ ID NO: 1207964 - protein, 7 aa, Mycobacterium
GTDEQKH

SEQ ID NO: 1207965 - protein, 8 aa, Mycobacterium
GTDEQKST

SEQ ID NO: 1207966 - protein, 7 aa, Mycobacterium
GTDEQRQ

SEQ ID NO: 1207967 - protein, 11 aa, Mycobacterium
GTDGANSADAF

SEQ ID NO: 1207968 - protein, 5 aa, Mycobacterium
GTDGE

SEQ ID NO: 1207969 - protein, 5 aa, Mycobacterium
GTDGH

SEQ ID NO: 1207970 - protein, 13 aa, Mycobacterium
GTDGMSSSDTARM

SEQ ID NO: 1207971 - protein, 10 aa, Mycobacterium
GTDGNSARQG

SEQ ID NO: 1207972 - protein, 25 aa, Mycobacterium
GTDGPNYDADAVQAAAAKLTAAGLP

SEQ ID NO: 1207973 - protein, 5 aa, Mycobacterium
GTDGT

SEQ ID NO: 1207974 - protein, 21 aa, Mycobacterium
GTDGTAEHRRVDADPSDVAGL

SEQ ID NO: 1207975 - protein, 9 aa, Mycobacterium
GTDHEIPDS

SEQ ID NO: 1207976 - protein, 37 aa, Mycobacterium
GTDIDGTGASGAPGDGTGASGAPGDGTGASGAPGDVT

SEQ ID NO: 1207977 - protein, 5 aa, Mycobacterium
GTDIS

SEQ ID NO: 1207978 - protein, 9 aa, Mycobacterium
GTDKAGDRT

SEQ ID NO: 1207979 - protein, 8 aa, Mycobacterium
GTDKSGTL

SEQ ID NO: 1207980 - protein, 7 aa, Mycobacterium
GTDLGDD

SEQ ID NO: 1207981 - protein, 11 aa, Mycobacterium
GTDLPTTKAET

SEQ ID NO: 1207982 - protein, 24 aa, Mycobacterium
GTDPAYSAQDDQGGDHGDHSPFGR

SEQ ID NO: 1207983 - protein, 6 aa, Mycobacterium
GTDPVR

SEQ ID NO: 1207984 - protein, 6 aa, Mycobacterium
GTDRVD

SEQ ID NO: 1207985 - protein, 11 aa, Mycobacterium
GTDSAPGGPGE

SEQ ID NO: 1207986 - protein, 7 aa, Mycobacterium
GTDSYAD

SEQ ID NO: 1207987 - protein, 7 aa, Mycobacterium
GTDTHGV

SEQ ID NO: 1207988 - protein, 7 aa, Mycobacterium
GTDTMEE

SEQ ID NO: 1207989 - protein, 5 aa, Mycobacterium
GTDTS

SEQ ID NO: 1207990 - protein, 7 aa, Mycobacterium
GTDTSLD

SEQ ID NO: 1207991 - protein, 9 aa, Mycobacterium
GTDTTRSQL

SEQ ID NO: 1207992 - protein, 5 aa, Mycobacterium
GTDTV

SEQ ID NO: 1207993 - protein, 12 aa, Mycobacterium
GTDVRHDVEWAR

SEQ ID NO: 1207994 - protein, 9 aa, Mycobacterium
GTDYATDFG

SEQ ID NO: 1207995 - protein, 4 aa, Mycobacterium
GTEA

SEQ ID NO: 1207996 - protein, 18 aa, Mycobacterium
GTEAARAAARKNRLQRGK

SEQ ID NO: 1207997 - protein, 13 aa, Mycobacterium
GTEAGRAAARAGV

SEQ ID NO: 1207998 - protein, 7 aa, Mycobacterium
GTEAQRG

SEQ ID NO: 1207999 - protein, 4 aa, Mycobacterium
GTED

SEQ ID NO: 1208000 - protein, 16 aa, Mycobacterium
GTEDEERAPVRGSAGP

SEQ ID NO: 1208001 - protein, 5 aa, Mycobacterium
GTEDG

SEQ ID NO: 1208002 - protein, 5 aa, Mycobacterium
GTEEQ

SEQ ID NO: 1208003 - protein, 9 aa, Mycobacterium
GTEEQKDRY

SEQ ID NO: 1208004 - protein, 7 aa, Mycobacterium
GTEEQKK

SEQ ID NO: 1208005 - protein, 9 aa, Mycobacterium
GTEEQKKEW

SEQ ID NO: 1208006 - protein, 8 aa, Mycobacterium
GTEEQKQK

SEQ ID NO: 1208007 - protein, 7 aa, Mycobacterium
GTEEQRE

SEQ ID NO: 1208008 - protein, 7 aa, Mycobacterium
GTEEQRK

SEQ ID NO: 1208009 - protein, 10 aa, Mycobacterium
GTEEYTMDDT

SEQ ID NO: 1208010 - protein, 76 aa, Mycobacterium
GTEGGTGGVGGVGGVGATGGAGGVGGKGIQGGQGLQGGQGGDGGTGGTGGDATSMGEAGATGGKGGNGGNGGRGSL

SEQ ID NO: 1208011 - protein, 12 aa, Mycobacterium
GTEGPYTGNGGA

SEQ ID NO: 1208012 - protein, 10 aa, Mycobacterium
GTEKTNHPAV

SEQ ID NO: 1208013 - protein, 24 aa, Mycobacterium
GTENPDGPLADSATQIGDEDPDFA

SEQ ID NO: 1208014 - protein, 9 aa, Mycobacterium
GTEPGDAAE

SEQ ID NO: 1208015 - protein, 7 aa, Mycobacterium
GTEPPKH

SEQ ID NO: 1208016 - protein, 6 aa, Mycobacterium
GTEPQH

SEQ ID NO: 1208017 - protein, 7 aa, Mycobacterium
GTEQLGS

SEQ ID NO: 1208018 - protein, 4 aa, Mycobacterium
GTER

SEQ ID NO: 1208019 - protein, 22 aa, Mycobacterium
GTERGGPGSTKRIERGAVTERQ

SEQ ID NO: 1208020 - protein, 6 aa, Mycobacterium
GTERGL

SEQ ID NO: 1208021 - protein, 7 aa, Mycobacterium
GTESGDR

SEQ ID NO: 1208022 - protein, 8 aa, Mycobacterium
GTESGPLT

SEQ ID NO: 1208023 - protein, 8 aa, Mycobacterium
GTESQKAT

SEQ ID NO: 1208024 - protein, 5 aa, Mycobacterium
GTESS

SEQ ID NO: 1208025 - protein, 14 aa, Mycobacterium
GTESVESLRERAER

SEQ ID NO: 1208026 - protein, 4 aa, Mycobacterium
GTET

SEQ ID NO: 1208027 - protein, 8 aa, Mycobacterium
GTETEPEV

SEQ ID NO: 1208028 - protein, 6 aa, Mycobacterium
GTETNN

SEQ ID NO: 1208029 - protein, 5 aa, Mycobacterium
GTEVA

SEQ ID NO: 1208030 - protein, 12 aa, Mycobacterium
GTEVATSPLATE

SEQ ID NO: 1208031 - protein, 6 aa, Mycobacterium
GTEVGR

SEQ ID NO: 1208032 - protein, 5 aa, Mycobacterium
GTFDD

SEQ ID NO: 1208033 - protein, 6 aa, Mycobacterium
GTFDNA

SEQ ID NO: 1208034 - protein, 6 aa, Mycobacterium
GTFEGG

SEQ ID NO: 1208035 - protein, 7 aa, Mycobacterium
GTFTPTL

SEQ ID NO: 1208036 - protein, 8 aa, Mycobacterium
GTGAAAGV

SEQ ID NO: 1208037 - protein, 7 aa, Mycobacterium
GTGAEAL

SEQ ID NO: 1208038 - protein, 15 aa, Mycobacterium
GTGAGVQVIGDAAEP

SEQ ID NO: 1208039 - protein, 8 aa, Mycobacterium
GTGAPSAV

SEQ ID NO: 1208040 - protein, 7 aa, Mycobacterium
GTGASSA

SEQ ID NO: 1208041 - protein, 8 aa, Mycobacterium
GTGASTAA

SEQ ID NO: 1208042 - protein, 6 aa, Mycobacterium
GTGATG

SEQ ID NO: 1208043 - protein, 6 aa, Mycobacterium
GTGATT

SEQ ID NO: 1208044 - protein, 9 aa, Mycobacterium
GTGCRSGEH

SEQ ID NO: 1208045 - protein, 4 aa, Mycobacterium
GTGD

SEQ ID NO: 1208046 - protein, 12 aa, Mycobacterium
GTGDGTTSVPNG

SEQ ID NO: 1208047 - protein, 10 aa, Mycobacterium
GTGDSPDYGI

SEQ ID NO: 1208048 - protein, 5 aa, Mycobacterium
GTGDV

SEQ ID NO: 1208049 - protein, 10 aa, Mycobacterium
GTGEGAAREP

SEQ ID NO: 1208050 - protein, 7 aa, Mycobacterium
GTGEPVG

SEQ ID NO: 1208051 - protein, 7 aa, Mycobacterium
GTGEQRR

SEQ ID NO: 1208052 - protein, 15 aa, Mycobacterium
GTGETATTATTYKTA

SEQ ID NO: 1208053 - protein, 19 aa, Mycobacterium
GTGFKQSLGADGPPGSYTD

SEQ ID NO: 1208054 - protein, 4 aa, Mycobacterium
GTGG

SEQ ID NO: 1208055 - protein, 6 aa, Mycobacterium
GTGGAA

SEQ ID NO: 1208056 - protein, 10 aa, Mycobacterium
GTGGDGANTV

SEQ ID NO: 1208057 - protein, 25 aa, Mycobacterium
GTGGPNWDAESVRSAADKLESAGLP

SEQ ID NO: 1208058 - protein, 9 aa, Mycobacterium
GTGGRDPLD

SEQ ID NO: 1208059 - protein, 10 aa, Mycobacterium
GTGGTVAGTA

SEQ ID NO: 1208060 - protein, 6 aa, Mycobacterium
GTGIGR

SEQ ID NO: 1208061 - protein, 6 aa, Mycobacterium
GTGIPQ

SEQ ID NO: 1208062 - protein, 5 aa, Mycobacterium
GTGKH

SEQ ID NO: 1208063 - protein, 10 aa, Mycobacterium
GTGKPAAPAH

SEQ ID NO: 1208064 - protein, 4 aa, Mycobacterium
GTGL

SEQ ID NO: 1208065 - protein, 5 aa, Mycobacterium
GTGMA

SEQ ID NO: 1208066 - protein, 11 aa, Mycobacterium
GTGNAGDTVTS

SEQ ID NO: 1208067 - protein, 14 aa, Mycobacterium
GTGNGYAPSTLASS

SEQ ID NO: 1208068 - protein, 5 aa, Mycobacterium
GTGPE

SEQ ID NO: 1208069 - protein, 5 aa, Mycobacterium
GTGPF

SEQ ID NO: 1208070 - protein, 5 aa, Mycobacterium
GTGPK

SEQ ID NO: 1208071 - protein, 10 aa, Mycobacterium
GTGPKRSLPA

SEQ ID NO: 1208072 - protein, 9 aa, Mycobacterium
GTGQGEAAT

SEQ ID NO: 1208073 - protein, 11 aa, Mycobacterium
GTGQLESTVSD

SEQ ID NO: 1208074 - protein, 9 aa, Mycobacterium
GTGQTGATY

SEQ ID NO: 1208075 - protein, 5 aa, Mycobacterium
GTGRG

SEQ ID NO: 1208076 - protein, 12 aa, Mycobacterium
GTGRGGAALDTA

SEQ ID NO: 1208077 - protein, 10 aa, Mycobacterium
GTGRPDGIDK

SEQ ID NO: 1208078 - protein, 16 aa, Mycobacterium
GTGRQYHRNDARDTGV

SEQ ID NO: 1208079 - protein, 4 aa, Mycobacterium
GTGS

SEQ ID NO: 1208080 - protein, 16 aa, Mycobacterium
GTGSAALAAAARGAQV

SEQ ID NO: 1208081 - protein, 5 aa, Mycobacterium
GTGSD

SEQ ID NO: 1208082 - protein, 8 aa, Mycobacterium
GTGSDVGA

SEQ ID NO: 1208083 - protein, 5 aa, Mycobacterium
GTGSP

SEQ ID NO: 1208084 - protein, 11 aa, Mycobacterium
GTGTDPDTGEV

SEQ ID NO: 1208085 - protein, 7 aa, Mycobacterium
GTGTGAR

SEQ ID NO: 1208086 - protein, 10 aa, Mycobacterium
GTGTSPAAAI

SEQ ID NO: 1208087 - protein, 6 aa, Mycobacterium
GTGTST

SEQ ID NO: 1208088 - protein, 5 aa, Mycobacterium
GTGTV

SEQ ID NO: 1208089 - protein, 5 aa, Mycobacterium
GTGVE

SEQ ID NO: 1208090 - protein, 16 aa, Mycobacterium
GTGVTPRDVTPESTRE

SEQ ID NO: 1208091 - protein, 4 aa, Mycobacterium
GTGW

SEQ ID NO: 1208092 - protein, 10 aa, Mycobacterium
GTGWPEPGGL

SEQ ID NO: 1208093 - protein, 5 aa, Mycobacterium
GTGYG

SEQ ID NO: 1208094 - protein, 8 aa, Mycobacterium
GTHADGAH

SEQ ID NO: 1208095 - protein, 10 aa, Mycobacterium
GTHDDAADVE

SEQ ID NO: 1208096 - protein, 10 aa, Mycobacterium
GTHEYSMPGR

SEQ ID NO: 1208097 - protein, 4 aa, Mycobacterium
GTHL

SEQ ID NO: 1208098 - protein, 9 aa, Mycobacterium
GTHSGTATL

SEQ ID NO: 1208099 - protein, 5 aa, Mycobacterium
GTIDG

SEQ ID NO: 1208100 - protein, 6 aa, Mycobacterium
GTIDNA

SEQ ID NO: 1208101 - protein, 17 aa, Mycobacterium
GTIGEKNSYGNDPNPPR

SEQ ID NO: 1208102 - protein, 15 aa, Mycobacterium
GTINTPAYGKAADQL

SEQ ID NO: 1208103 - protein, 6 aa, Mycobacterium
GTIPAG

SEQ ID NO: 1208104 - protein, 20 aa, Mycobacterium
GTIPKTPSGKLRRAHALSLV

SEQ ID NO: 1208105 - protein, 4 aa, Mycobacterium
GTIS

SEQ ID NO: 1208106 - protein, 14 aa, Mycobacterium
GTITVGEDGTASVT

SEQ ID NO: 1208107 - protein, 8 aa, Mycobacterium
GTKAQYEE

SEQ ID NO: 1208108 - protein, 15 aa, Mycobacterium
GTKEDIKEAQSNGGS

SEQ ID NO: 1208109 - protein, 5 aa, Mycobacterium
GTKGS

SEQ ID NO: 1208110 - protein, 10 aa, Mycobacterium
GTKPARPAGV

SEQ ID NO: 1208111 - protein, 9 aa, Mycobacterium
GTKPHTSRL

SEQ ID NO: 1208112 - protein, 16 aa, Mycobacterium
GTKPVEPEKTPEQGYT

SEQ ID NO: 1208113 - protein, 10 aa, Mycobacterium
GTKQKANRIR

SEQ ID NO: 1208114 - protein, 19 aa, Mycobacterium
GTKTIPKSVKKPGTIQKAI

SEQ ID NO: 1208115 - protein, 4 aa, Mycobacterium
GTKV

SEQ ID NO: 1208116 - protein, 5 aa, Mycobacterium
GTKVS

SEQ ID NO: 1208117 - protein, 4 aa, Mycobacterium
GTLA

SEQ ID NO: 1208118 - protein, 20 aa, Mycobacterium
GTLAGKGFYDNTKRTTTPNA

SEQ ID NO: 1208119 - protein, 17 aa, Mycobacterium
GTLAQTADAVQRAGGRA

SEQ ID NO: 1208120 - protein, 13 aa, Mycobacterium
GTLGGARSARLGA

SEQ ID NO: 1208121 - protein, 5 aa, Mycobacterium
GTLGP

SEQ ID NO: 1208122 - protein, 5 aa, Mycobacterium
GTLGV

SEQ ID NO: 1208123 - protein, 7 aa, Mycobacterium
GTLPEGL

SEQ ID NO: 1208124 - protein, 10 aa, Mycobacterium
GTLPGGSGME

SEQ ID NO: 1208125 - protein, 11 aa, Mycobacterium
GTLPTGPPQGR

SEQ ID NO: 1208126 - protein, 14 aa, Mycobacterium
GTLTAEDQANAASA

SEQ ID NO: 1208127 - protein, 12 aa, Mycobacterium
GTLTRTPGTASF

SEQ ID NO: 1208128 - protein, 10 aa, Mycobacterium
GTLTSSGELS

SEQ ID NO: 1208129 - protein, 4 aa, Mycobacterium
GTMG

SEQ ID NO: 1208130 - protein, 14 aa, Mycobacterium
GTMPPTEGRAGYGY

SEQ ID NO: 1208131 - protein, 7 aa, Mycobacterium
GTMRGRE

SEQ ID NO: 1208132 - protein, 5 aa, Mycobacterium
GTMTA

SEQ ID NO: 1208133 - protein, 5 aa, Mycobacterium
GTNAD

SEQ ID NO: 1208134 - protein, 9 aa, Mycobacterium
GTNDGSSTI

SEQ ID NO: 1208135 - protein, 8 aa, Mycobacterium
GTNNYRPP

SEQ ID NO: 1208136 - protein, 7 aa, Mycobacterium
GTNRAAD

SEQ ID NO: 1208137 - protein, 12 aa, Mycobacterium
GTNTDPYQRAEG

SEQ ID NO: 1208138 - protein, 4 aa, Mycobacterium
GTPA

SEQ ID NO: 1208139 - protein, 9 aa, Mycobacterium
GTPCEPRSV

SEQ ID NO: 1208140 - protein, 7 aa, Mycobacterium
GTPDGDW

SEQ ID NO: 1208141 - protein, 6 aa, Mycobacterium
GTPDQK

SEQ ID NO: 1208142 - protein, 10 aa, Mycobacterium
GTPDRGLPAE

SEQ ID NO: 1208143 - protein, 21 aa, Mycobacterium
GTPDTRAPHAEGNFPTPSGKC

SEQ ID NO: 1208144 - protein, 14 aa, Mycobacterium
GTPEDIAANPENRL

SEQ ID NO: 1208145 - protein, 12 aa, Mycobacterium
GTPEGVGPLEHG

SEQ ID NO: 1208146 - protein, 6 aa, Mycobacterium
GTPERP

SEQ ID NO: 1208147 - protein, 12 aa, Mycobacterium
GTPGAPALGPGA

SEQ ID NO: 1208148 - protein, 17 aa, Mycobacterium
GTPGDATATVEGGRTRT

SEQ ID NO: 1208149 - protein, 10 aa, Mycobacterium
GTPGETDDDL

SEQ ID NO: 1208150 - protein, 5 aa, Mycobacterium
GTPGL

SEQ ID NO: 1208151 - protein, 10 aa, Mycobacterium
GTPGPAAEQK

SEQ ID NO: 1208152 - protein, 11 aa, Mycobacterium
GTPGPAAEQKL

SEQ ID NO: 1208153 - protein, 6 aa, Mycobacterium
GTPGQG

SEQ ID NO: 1208154 - protein, 8 aa, Mycobacterium
GTPIDGPD

SEQ ID NO: 1208155 - protein, 6 aa, Mycobacterium
GTPIPW

SEQ ID NO: 1208156 - protein, 15 aa, Mycobacterium
GTPLAEGKESRTIGD

SEQ ID NO: 1208157 - protein, 5 aa, Mycobacterium
GTPLD

SEQ ID NO: 1208158 - protein, 5 aa, Mycobacterium
GTPLP

SEQ ID NO: 1208159 - protein, 6 aa, Mycobacterium
GTPLPG

SEQ ID NO: 1208160 - protein, 5 aa, Mycobacterium
GTPMR

SEQ ID NO: 1208161 - protein, 14 aa, Mycobacterium
GTPPAAENTPQAPV

SEQ ID NO: 1208162 - protein, 15 aa, Mycobacterium
GTPPDACHTSATSVH

SEQ ID NO: 1208163 - protein, 6 aa, Mycobacterium
GTPPLA

SEQ ID NO: 1208164 - protein, 4 aa, Mycobacterium
GTPQ

SEQ ID NO: 1208165 - protein, 11 aa, Mycobacterium
GTPQKKGEYGA

SEQ ID NO: 1208166 - protein, 5 aa, Mycobacterium
GTPQV

SEQ ID NO: 1208167 - protein, 5 aa, Mycobacterium
GTPQW

SEQ ID NO: 1208168 - protein, 4 aa, Mycobacterium
GTPS

SEQ ID NO: 1208169 - protein, 21 aa, Mycobacterium
GTPSCEYNESEALGSDAPMPD

SEQ ID NO: 1208170 - protein, 6 aa, Mycobacterium
GTPSIV

SEQ ID NO: 1208171 - protein, 17 aa, Mycobacterium
GTPSMTPHPTRPETLSP

SEQ ID NO: 1208172 - protein, 11 aa, Mycobacterium
GTPSSDPPLEV

SEQ ID NO: 1208173 - protein, 7 aa, Mycobacterium
GTPSVYA

SEQ ID NO: 1208174 - protein, 6 aa, Mycobacterium
GTPTFT

SEQ ID NO: 1208175 - protein, 7 aa, Mycobacterium
GTPTGID

SEQ ID NO: 1208176 - protein, 6 aa, Mycobacterium
GTPTGL

SEQ ID NO: 1208177 - protein, 8 aa, Mycobacterium
GTPTHTIG

SEQ ID NO: 1208178 - protein, 22 aa, Mycobacterium
GTPTLSQRVDPRSIAPNASAGL

SEQ ID NO: 1208179 - protein, 7 aa, Mycobacterium
GTPTQLG

SEQ ID NO: 1208180 - protein, 14 aa, Mycobacterium
GTPTRARGYPPYAG

SEQ ID NO: 1208181 - protein, 9 aa, Mycobacterium
GTPTSVPIP

SEQ ID NO: 1208182 - protein, 5 aa, Mycobacterium
GTPVD

SEQ ID NO: 1208183 - protein, 15 aa, Mycobacterium
GTPVGTALSAPPKPI

SEQ ID NO: 1208184 - protein, 7 aa, Mycobacterium
GTPWQGK

SEQ ID NO: 1208185 - protein, 4 aa, Mycobacterium
GTPY

SEQ ID NO: 1208186 - protein, 8 aa, Mycobacterium
GTQAGPAR

SEQ ID NO: 1208187 - protein, 4 aa, Mycobacterium
GTQI

SEQ ID NO: 1208188 - protein, 5 aa, Mycobacterium
GTQLG

SEQ ID NO: 1208189 - protein, 20 aa, Mycobacterium
GTQNMPGADKLAAEANRRRR

SEQ ID NO: 1208190 - protein, 15 aa, Mycobacterium
GTQPAGYSDLADDTM

SEQ ID NO: 1208191 - protein, 8 aa, Mycobacterium
GTQPGAVS

SEQ ID NO: 1208192 - protein, 7 aa, Mycobacterium
GTQTAQV

SEQ ID NO: 1208193 - protein, 20 aa, Mycobacterium
GTQTVEQSLENAQASWDSAT

SEQ ID NO: 1208194 - protein, 4 aa, Mycobacterium
GTQV

SEQ ID NO: 1208195 - protein, 8 aa, Mycobacterium
GTQVSDSD

SEQ ID NO: 1208196 - protein, 5 aa, Mycobacterium
GTRAT

SEQ ID NO: 1208197 - protein, 6 aa, Mycobacterium
GTRDRC

SEQ ID NO: 1208198 - protein, 13 aa, Mycobacterium
GTREGSSVRGGAL

SEQ ID NO: 1208199 - protein, 9 aa, Mycobacterium
GTREPNRDA

SEQ ID NO: 1208200 - protein, 8 aa, Mycobacterium
GTRERRRR

SEQ ID NO: 1208201 - protein, 4 aa, Mycobacterium
GTRG

SEQ ID NO: 1208202 - protein, 9 aa, Mycobacterium
GTRGELTEV

SEQ ID NO: 1208203 - protein, 16 aa, Mycobacterium
GTRGPLYGKKDLEDDR

SEQ ID NO: 1208204 - protein, 5 aa, Mycobacterium
GTRGS

SEQ ID NO: 1208205 - protein, 10 aa, Mycobacterium
GTRGSRPALR

SEQ ID NO: 1208206 - protein, 9 aa, Mycobacterium
GTRIPTGAT

SEQ ID NO: 1208207 - protein, 14 aa, Mycobacterium
GTRLADESATAAAE

SEQ ID NO: 1208208 - protein, 5 aa, Mycobacterium
GTRLP

SEQ ID NO: 1208209 - protein, 4 aa, Mycobacterium
GTRM

SEQ ID NO: 1208210 - protein, 9 aa, Mycobacterium
GTRPDAPAT

SEQ ID NO: 1208211 - protein, 10 aa, Mycobacterium
GTRPDREADY

SEQ ID NO: 1208212 - protein, 10 aa, Mycobacterium
GTRRGPSSSA

SEQ ID NO: 1208213 - protein, 5 aa, Mycobacterium
GTRRP

SEQ ID NO: 1208214 - protein, 17 aa, Mycobacterium
GTRSPYGAVPDSRRPEF

SEQ ID NO: 1208215 - protein, 9 aa, Mycobacterium
GTRSRTGKM

SEQ ID NO: 1208216 - protein, 8 aa, Mycobacterium
GTRTPSWG

SEQ ID NO: 1208217 - protein, 5 aa, Mycobacterium
GTRVP

SEQ ID NO: 1208218 - protein, 4 aa, Mycobacterium
GTSA

SEQ ID NO: 1208219 - protein, 9 aa, Mycobacterium
GTSAGGSLS

SEQ ID NO: 1208220 - protein, 11 aa, Mycobacterium
GTSAGTDRGAR

SEQ ID NO: 1208221 - protein, 23 aa, Mycobacterium
GTSAPQAVEDEGPVQGPPTIGVP

SEQ ID NO: 1208222 - protein, 12 aa, Mycobacterium
GTSAQTLLVQRR

SEQ ID NO: 1208223 - protein, 8 aa, Mycobacterium
GTSASVRD

SEQ ID NO: 1208224 - protein, 8 aa, Mycobacterium
GTSDMKAG

SEQ ID NO: 1208225 - protein, 8 aa, Mycobacterium
GTSGDPKA

SEQ ID NO: 1208226 - protein, 12 aa, Mycobacterium
GTSGEPKAVRVT

SEQ ID NO: 1208227 - protein, 7 aa, Mycobacterium
GTSGHPK

SEQ ID NO: 1208228 - protein, 16 aa, Mycobacterium
GTSGPGAAPASFDVDR

SEQ ID NO: 1208229 - protein, 9 aa, Mycobacterium
GTSGTDGAV

SEQ ID NO: 1208230 - protein, 6 aa, Mycobacterium
GTSKPD

SEQ ID NO: 1208231 - protein, 4 aa, Mycobacterium
GTSL

SEQ ID NO: 1208232 - protein, 6 aa, Mycobacterium
GTSLGR

SEQ ID NO: 1208233 - protein, 18 aa, Mycobacterium
GTSLPPGRPQTAGTSVRV

SEQ ID NO: 1208234 - protein, 12 aa, Mycobacterium
GTSNATALATRT

SEQ ID NO: 1208235 - protein, 10 aa, Mycobacterium
GTSNDEIQAA

SEQ ID NO: 1208236 - protein, 10 aa, Mycobacterium
GTSPLPQRSS

SEQ ID NO: 1208237 - protein, 7 aa, Mycobacterium
GTSPRAE

SEQ ID NO: 1208238 - protein, 9 aa, Mycobacterium
GTSPSRDEF

SEQ ID NO: 1208239 - protein, 10 aa, Mycobacterium
GTSPTGQTVP

SEQ ID NO: 1208240 - protein, 8 aa, Mycobacterium
GTSRQRIG

SEQ ID NO: 1208241 - protein, 10 aa, Mycobacterium
GTSRRAADRG

SEQ ID NO: 1208242 - protein, 7 aa, Mycobacterium
GTSSAAR

SEQ ID NO: 1208243 - protein, 7 aa, Mycobacterium
GTSSSSG

SEQ ID NO: 1208244 - protein, 8 aa, Mycobacterium
GTSTEGDI

SEQ ID NO: 1208245 - protein, 8 aa, Mycobacterium
GTSTTAGI

SEQ ID NO: 1208246 - protein, 5 aa, Mycobacterium
GTSVA

SEQ ID NO: 1208247 - protein, 6 aa, Mycobacterium
GTSVGE

SEQ ID NO: 1208248 - protein, 7 aa, Mycobacterium
GTSVPPD

SEQ ID NO: 1208249 - protein, 20 aa, Mycobacterium
GTTAEAARAAYESAGIGPED

SEQ ID NO: 1208250 - protein, 10 aa, Mycobacterium
GTTAGELEPS

SEQ ID NO: 1208251 - protein, 7 aa, Mycobacterium
GTTAGQR

SEQ ID NO: 1208252 - protein, 14 aa, Mycobacterium
GTTAPGAGPAAQAR

SEQ ID NO: 1208253 - protein, 21 aa, Mycobacterium
GTTAPPRGGPAARSGIADTIE

SEQ ID NO: 1208254 - protein, 9 aa, Mycobacterium
GTTAQAVTA

SEQ ID NO: 1208255 - protein, 13 aa, Mycobacterium
GTTASAEEITDTA

SEQ ID NO: 1208256 - protein, 6 aa, Mycobacterium
GTTEQH

SEQ ID NO: 1208257 - protein, 4 aa, Mycobacterium
GTTF

SEQ ID NO: 1208258 - protein, 9 aa, Mycobacterium
GTTGAPKGA

SEQ ID NO: 1208259 - protein, 7 aa, Mycobacterium
GTTGDGI

SEQ ID NO: 1208260 - protein, 7 aa, Mycobacterium
GTTGFPK

SEQ ID NO: 1208261 - protein, 16 aa, Mycobacterium
GTTGIPKGAPRDRLNP

SEQ ID NO: 1208262 - protein, 6 aa, Mycobacterium
GTTGLP

SEQ ID NO: 1208263 - protein, 9 aa, Mycobacterium
GTTGPPKRV

SEQ ID NO: 1208264 - protein, 11 aa, Mycobacterium
GTTGRPKGVVG

SEQ ID NO: 1208265 - protein, 9 aa, Mycobacterium
GTTGSGDDI

SEQ ID NO: 1208266 - protein, 8 aa, Mycobacterium
GTTGTSKA

SEQ ID NO: 1208267 - protein, 5 aa, Mycobacterium
GTTHR

SEQ ID NO: 1208268 - protein, 6 aa, Mycobacterium
GTTKET

SEQ ID NO: 1208269 - protein, 4 aa, Mycobacterium
GTTL

SEQ ID NO: 1208270 - protein, 4 aa, Mycobacterium
GTTM

SEQ ID NO: 1208271 - protein, 5 aa, Mycobacterium
GTTPA

SEQ ID NO: 1208272 - protein, 10 aa, Mycobacterium
GTTPKHAPQE

SEQ ID NO: 1208273 - protein, 15 aa, Mycobacterium
GTTPNAGGRKAWNSH

SEQ ID NO: 1208274 - protein, 11 aa, Mycobacterium
GTTPSGKTIPG

SEQ ID NO: 1208275 - protein, 8 aa, Mycobacterium
GTTPTHRA

SEQ ID NO: 1208276 - protein, 5 aa, Mycobacterium
GTTQT

SEQ ID NO: 1208277 - protein, 4 aa, Mycobacterium
GTTR

SEQ ID NO: 1208278 - protein, 8 aa, Mycobacterium
GTTSAGLG

SEQ ID NO: 1208279 - protein, 12 aa, Mycobacterium
GTTSAPKGVQHT

SEQ ID NO: 1208280 - protein, 7 aa, Mycobacterium
GTTSEQL

SEQ ID NO: 1208281 - protein, 10 aa, Mycobacterium
GTTSESSNLD

SEQ ID NO: 1208282 - protein, 9 aa, Mycobacterium
GTTSSQRTL

SEQ ID NO: 1208283 - protein, 4 aa, Mycobacterium
GTTT

SEQ ID NO: 1208284 - protein, 7 aa, Mycobacterium
GTTTARI

SEQ ID NO: 1208285 - protein, 6 aa, Mycobacterium
GTTTDV

SEQ ID NO: 1208286 - protein, 8 aa, Mycobacterium
GTTTEGDI

SEQ ID NO: 1208287 - protein, 5 aa, Mycobacterium
GTTTF

SEQ ID NO: 1208288 - protein, 7 aa, Mycobacterium
GTTTGAR

SEQ ID NO: 1208289 - protein, 28 aa, Mycobacterium
GTTTGTDNPHRPGHTPGGSSAGSAAAVG

SEQ ID NO: 1208290 - protein, 9 aa, Mycobacterium
GTTTTEKGS

SEQ ID NO: 1208291 - protein, 17 aa, Mycobacterium
GTTVESEEDQDPERLRT

SEQ ID NO: 1208292 - protein, 4 aa, Mycobacterium
GTVA

SEQ ID NO: 1208293 - protein, 4 aa, Mycobacterium
GTVD

SEQ ID NO: 1208294 - protein, 6 aa, Mycobacterium
GTVDDA

SEQ ID NO: 1208295 - protein, 17 aa, Mycobacterium
GTVDDTVARHTSGTPAT

SEQ ID NO: 1208296 - protein, 9 aa, Mycobacterium
GTVDREGVT

SEQ ID NO: 1208297 - protein, 7 aa, Mycobacterium
GTVEGTP

SEQ ID NO: 1208298 - protein, 6 aa, Mycobacterium
GTVGAG

SEQ ID NO: 1208299 - protein, 13 aa, Mycobacterium
GTVKSRCSRARTK

SEQ ID NO: 1208300 - protein, 11 aa, Mycobacterium
GTVNRGNATQA

SEQ ID NO: 1208301 - protein, 6 aa, Mycobacterium
GTVPDP

SEQ ID NO: 1208302 - protein, 5 aa, Mycobacterium
GTVPR

SEQ ID NO: 1208303 - protein, 9 aa, Mycobacterium
GTVPTDPAL

SEQ ID NO: 1208304 - protein, 6 aa, Mycobacterium
GTVQTR

SEQ ID NO: 1208305 - protein, 4 aa, Mycobacterium
GTVS

SEQ ID NO: 1208306 - protein, 4 aa, Mycobacterium
GTVT

SEQ ID NO: 1208307 - protein, 9 aa, Mycobacterium
GTVTADGRE

SEQ ID NO: 1208308 - protein, 14 aa, Mycobacterium
GTVTATPPSWRPDL

SEQ ID NO: 1208309 - protein, 14 aa, Mycobacterium
GTVTATSSPIHRGR

SEQ ID NO: 1208310 - protein, 9 aa, Mycobacterium
GTVTDSTIS

SEQ ID NO: 1208311 - protein, 12 aa, Mycobacterium
GTVTSSRSPEFA

SEQ ID NO: 1208312 - protein, 9 aa, Mycobacterium
GTWKPPATV

SEQ ID NO: 1208313 - protein, 4 aa, Mycobacterium
GTYD

SEQ ID NO: 1208314 - protein, 5 aa, Mycobacterium
GTYRE

SEQ ID NO: 1208315 - protein, 5 aa, Mycobacterium
GVAAG

SEQ ID NO: 1208316 - protein, 12 aa, Mycobacterium
GVAAKDREAARK

SEQ ID NO: 1208317 - protein, 13 aa, Mycobacterium
GVAASGVSAYPAD

SEQ ID NO: 1208318 - protein, 5 aa, Mycobacterium
GVADD

SEQ ID NO: 1208319 - protein, 7 aa, Mycobacterium
GVADGDV

SEQ ID NO: 1208320 - protein, 9 aa, Mycobacterium
GVADGPHVA

SEQ ID NO: 1208321 - protein, 15 aa, Mycobacterium
GVADTTAALEEGADD

SEQ ID NO: 1208322 - protein, 11 aa, Mycobacterium
GVAEADTRITG

SEQ ID NO: 1208323 - protein, 5 aa, Mycobacterium
GVAGA

SEQ ID NO: 1208324 - protein, 5 aa, Mycobacterium
GVAGT

SEQ ID NO: 1208325 - protein, 4 aa, Mycobacterium
GVAN

SEQ ID NO: 1208326 - protein, 10 aa, Mycobacterium
GVANPKTPCS

SEQ ID NO: 1208327 - protein, 6 aa, Mycobacterium
GVAPAA

SEQ ID NO: 1208328 - protein, 10 aa, Mycobacterium
GVAPDGPGSF

SEQ ID NO: 1208329 - protein, 7 aa, Mycobacterium
GVAPEVA

SEQ ID NO: 1208330 - protein, 8 aa, Mycobacterium
GVAPGRGP

SEQ ID NO: 1208331 - protein, 5 aa, Mycobacterium
GVAPP

SEQ ID NO: 1208332 - protein, 10 aa, Mycobacterium
GVAPTAERRT

SEQ ID NO: 1208333 - protein, 15 aa, Mycobacterium
GVARAGAAAAARRRE

SEQ ID NO: 1208334 - protein, 6 aa, Mycobacterium
GVASGA

SEQ ID NO: 1208335 - protein, 5 aa, Mycobacterium
GVATT

SEQ ID NO: 1208336 - protein, 8 aa, Mycobacterium
GVAVPGGL

SEQ ID NO: 1208337 - protein, 4 aa, Mycobacterium
GVDA

SEQ ID NO: 1208338 - protein, 6 aa, Mycobacterium
GVDAGK

SEQ ID NO: 1208339 - protein, 8 aa, Mycobacterium
GVDDAGGG

SEQ ID NO: 1208340 - protein, 5 aa, Mycobacterium
GVDDH

SEQ ID NO: 1208341 - protein, 8 aa, Mycobacterium
GVDDNDRR

SEQ ID NO: 1208342 - protein, 9 aa, Mycobacterium
GVDDSENIS

SEQ ID NO: 1208343 - protein, 11 aa, Mycobacterium
GVDEAPSRLGS

SEQ ID NO: 1208344 - protein, 12 aa, Mycobacterium
GVDEDFGRGGEA

SEQ ID NO: 1208345 - protein, 4 aa, Mycobacterium
GVDG

SEQ ID NO: 1208346 - protein, 10 aa, Mycobacterium
GVDHADTARL

SEQ ID NO: 1208347 - protein, 7 aa, Mycobacterium
GVDPAEV

SEQ ID NO: 1208348 - protein, 6 aa, Mycobacterium
GVDPDQ

SEQ ID NO: 1208349 - protein, 8 aa, Mycobacterium
GVDPGPTH

SEQ ID NO: 1208350 - protein, 28 aa, Mycobacterium
GVDPLDEGYSPPERPYAPGAFGPGETLD

SEQ ID NO: 1208351 - protein, 7 aa, Mycobacterium
GVDPTAL

SEQ ID NO: 1208352 - protein, 8 aa, Mycobacterium
GVDPTDPP

SEQ ID NO: 1208353 - protein, 14 aa, Mycobacterium
GVDPTDPRRRAASP

SEQ ID NO: 1208354 - protein, 7 aa, Mycobacterium
GVDRRAE

SEQ ID NO: 1208355 - protein, 4 aa, Mycobacterium
GVDT

SEQ ID NO: 1208356 - protein, 9 aa, Mycobacterium
GVDTDGAEL

SEQ ID NO: 1208357 - protein, 15 aa, Mycobacterium
GVDTGARPGRLLRGV

SEQ ID NO: 1208358 - protein, 11 aa, Mycobacterium
GVDTGTPTGRA

SEQ ID NO: 1208359 - protein, 4 aa, Mycobacterium
GVEA

SEQ ID NO: 1208360 - protein, 5 aa, Mycobacterium
GVEAG

SEQ ID NO: 1208361 - protein, 7 aa, Mycobacterium
GVEESTA

SEQ ID NO: 1208362 - protein, 10 aa, Mycobacterium
GVEGASGMRK

SEQ ID NO: 1208363 - protein, 6 aa, Mycobacterium
GVEGAV

SEQ ID NO: 1208364 - protein, 11 aa, Mycobacterium
GVEGDSSDVGT

SEQ ID NO: 1208365 - protein, 5 aa, Mycobacterium
GVEGK

SEQ ID NO: 1208366 - protein, 8 aa, Mycobacterium
GVEHGQGV

SEQ ID NO: 1208367 - protein, 15 aa, Mycobacterium
GVEHPPACTRETNPL

SEQ ID NO: 1208368 - protein, 8 aa, Mycobacterium
GVEHQDTA

SEQ ID NO: 1208369 - protein, 10 aa, Mycobacterium
GVEKRTRSGL

SEQ ID NO: 1208370 - protein, 5 aa, Mycobacterium
GVELT

SEQ ID NO: 1208371 - protein, 5 aa, Mycobacterium
GVENP

SEQ ID NO: 1208372 - protein, 5 aa, Mycobacterium
GVEPF

SEQ ID NO: 1208373 - protein, 17 aa, Mycobacterium
GVEPKDFNSLGSRRGNH

SEQ ID NO: 1208374 - protein, 5 aa, Mycobacterium
GVEPL

SEQ ID NO: 1208375 - protein, 7 aa, Mycobacterium
GVEPTTE

SEQ ID NO: 1208376 - protein, 6 aa, Mycobacterium
GVETEA

SEQ ID NO: 1208377 - protein, 20 aa, Mycobacterium
GVETRAAAAQNKLYALLQDG

SEQ ID NO: 1208378 - protein, 4 aa, Mycobacterium
GVGA

SEQ ID NO: 1208379 - protein, 7 aa, Mycobacterium
GVGAEQS

SEQ ID NO: 1208380 - protein, 6 aa, Mycobacterium
GVGAGG

SEQ ID NO: 1208381 - protein, 14 aa, Mycobacterium
GVGAPSAALRDDVT

SEQ ID NO: 1208382 - protein, 22 aa, Mycobacterium
GVGATAAGAVAGAQSGAPDPLL

SEQ ID NO: 1208383 - protein, 13 aa, Mycobacterium
GVGDYGTYQGPLD

SEQ ID NO: 1208384 - protein, 4 aa, Mycobacterium
GVGE

SEQ ID NO: 1208385 - protein, 7 aa, Mycobacterium
GVGEDGA

SEQ ID NO: 1208386 - protein, 9 aa, Mycobacterium
GVGEEVNAT

SEQ ID NO: 1208387 - protein, 5 aa, Mycobacterium
GVGGA

SEQ ID NO: 1208388 - protein, 133 aa, Mycobacterium
GVGGAGGAAYTSGDDKAGDLAVGGPGGAGGSAQASSSGRGGAGGDAVATEGDALGGTGGQGGTSTRAGDGGAGGIGGAGTSATGTGAGGTGGAGGSGATLGDGGRGGDAGYGEALDESGIAEGGTGGAGGLGG

SEQ ID NO: 1208389 - protein, 25 aa, Mycobacterium
GVGGDGGAAGLVGNGGAGGRGGQYD

SEQ ID NO: 1208390 - protein, 7 aa, Mycobacterium
GVGGGTG

SEQ ID NO: 1208391 - protein, 14 aa, Mycobacterium
GVGGNAGQANYAAA

SEQ ID NO: 1208392 - protein, 5 aa, Mycobacterium
GVGKG

SEQ ID NO: 1208393 - protein, 15 aa, Mycobacterium
GVGKGEALRYVETAF

SEQ ID NO: 1208394 - protein, 12 aa, Mycobacterium
GVGKSGSLKESG

SEQ ID NO: 1208395 - protein, 16 aa, Mycobacterium
GVGKTTLARAATATVP

SEQ ID NO: 1208396 - protein, 6 aa, Mycobacterium
GVGKTV

SEQ ID NO: 1208397 - protein, 12 aa, Mycobacterium
GVGNDKERPNTP

SEQ ID NO: 1208398 - protein, 7 aa, Mycobacterium
GVGPAPD

SEQ ID NO: 1208399 - protein, 9 aa, Mycobacterium
GVGPSGLGA

SEQ ID NO: 1208400 - protein, 8 aa, Mycobacterium
GVGPSGMG

SEQ ID NO: 1208401 - protein, 5 aa, Mycobacterium
GVGPT

SEQ ID NO: 1208402 - protein, 8 aa, Mycobacterium
GVGRPAEL

SEQ ID NO: 1208403 - protein, 9 aa, Mycobacterium
GVGSGEQLT

SEQ ID NO: 1208404 - protein, 6 aa, Mycobacterium
GVGSLS

SEQ ID NO: 1208405 - protein, 7 aa, Mycobacterium
GVGTDGR

SEQ ID NO: 1208406 - protein, 7 aa, Mycobacterium
GVGTESL

SEQ ID NO: 1208407 - protein, 6 aa, Mycobacterium
GVGTGE

SEQ ID NO: 1208408 - protein, 10 aa, Mycobacterium
GVGTPVADGG

SEQ ID NO: 1208409 - protein, 5 aa, Mycobacterium
GVGTQ

SEQ ID NO: 1208410 - protein, 13 aa, Mycobacterium
GVGVGPEELDEAA

SEQ ID NO: 1208411 - protein, 13 aa, Mycobacterium
GVHGADPASWYGS

SEQ ID NO: 1208412 - protein, 9 aa, Mycobacterium
GVHPTDAGH

SEQ ID NO: 1208413 - protein, 14 aa, Mycobacterium
GVIDGDGRVKPSVA

SEQ ID NO: 1208414 - protein, 8 aa, Mycobacterium
GVKDGEAF

SEQ ID NO: 1208415 - protein, 15 aa, Mycobacterium
GVNATAARTVTAPTS

SEQ ID NO: 1208416 - protein, 8 aa, Mycobacterium
GVNDPGDA

SEQ ID NO: 1208417 - protein, 7 aa, Mycobacterium
GVNGGAA

SEQ ID NO: 1208418 - protein, 4 aa, Mycobacterium
GVNP

SEQ ID NO: 1208419 - protein, 8 aa, Mycobacterium
GVNQSQGV

SEQ ID NO: 1208420 - protein, 10 aa, Mycobacterium
GVNSDGPSRN

SEQ ID NO: 1208421 - protein, 7 aa, Mycobacterium
GVPAEGE

SEQ ID NO: 1208422 - protein, 7 aa, Mycobacterium
GVPAERA

SEQ ID NO: 1208423 - protein, 13 aa, Mycobacterium
GVPAGEATIGQGG

SEQ ID NO: 1208424 - protein, 9 aa, Mycobacterium
GVPAGPIND

SEQ ID NO: 1208425 - protein, 7 aa, Mycobacterium
GVPARAT

SEQ ID NO: 1208426 - protein, 5 aa, Mycobacterium
GVPAS

SEQ ID NO: 1208427 - protein, 5 aa, Mycobacterium
GVPAY

SEQ ID NO: 1208428 - protein, 7 aa, Mycobacterium
GVPDGAK

SEQ ID NO: 1208429 - protein, 8 aa, Mycobacterium
GVPDPGGV

SEQ ID NO: 1208430 - protein, 10 aa, Mycobacterium
GVPDYLPPAS

SEQ ID NO: 1208431 - protein, 9 aa, Mycobacterium
GVPEARRRG

SEQ ID NO: 1208432 - protein, 11 aa, Mycobacterium
GVPGAPAESVT

SEQ ID NO: 1208433 - protein, 17 aa, Mycobacterium
GVPGASRDTMGPEGNQG

SEQ ID NO: 1208434 - protein, 7 aa, Mycobacterium
GVPGAST

SEQ ID NO: 1208435 - protein, 6 aa, Mycobacterium
GVPGED

SEQ ID NO: 1208436 - protein, 7 aa, Mycobacterium
GVPGEEL

SEQ ID NO: 1208437 - protein, 12 aa, Mycobacterium
GVPGTRLRGTAE

SEQ ID NO: 1208438 - protein, 8 aa, Mycobacterium
GVPGTSFG

SEQ ID NO: 1208439 - protein, 4 aa, Mycobacterium
GVPH

SEQ ID NO: 1208440 - protein, 4 aa, Mycobacterium
GVPP

SEQ ID NO: 1208441 - protein, 5 aa, Mycobacterium
GVPPA

SEQ ID NO: 1208442 - protein, 7 aa, Mycobacterium
GVPPARA

SEQ ID NO: 1208443 - protein, 6 aa, Mycobacterium
GVPPAV

SEQ ID NO: 1208444 - protein, 7 aa, Mycobacterium
GVPPDDR

SEQ ID NO: 1208445 - protein, 7 aa, Mycobacterium
GVPPDGL

SEQ ID NO: 1208446 - protein, 7 aa, Mycobacterium
GVPPGQL

SEQ ID NO: 1208447 - protein, 6 aa, Mycobacterium
GVPPSD

SEQ ID NO: 1208448 - protein, 9 aa, Mycobacterium
GVPQPEPLR

SEQ ID NO: 1208449 - protein, 11 aa, Mycobacterium
GVPTDDSDDNA

SEQ ID NO: 1208450 - protein, 12 aa, Mycobacterium
GVPTDGKTLTTR

SEQ ID NO: 1208451 - protein, 8 aa, Mycobacterium
GVPTTDRH

SEQ ID NO: 1208452 - protein, 50 aa, Mycobacterium
GVPVPPPAQPADSDKAEPAKRTRRRKPDKSEEPEHEPDAEPEPDPGDSAT

SEQ ID NO: 1208453 - protein, 13 aa, Mycobacterium
GVPYTSDSRFVSN

SEQ ID NO: 1208454 - protein, 13 aa, Mycobacterium
GVQATTSKGGAAV

SEQ ID NO: 1208455 - protein, 7 aa, Mycobacterium
GVQTDSR

SEQ ID NO: 1208456 - protein, 6 aa, Mycobacterium
GVQTRP

SEQ ID NO: 1208457 - protein, 13 aa, Mycobacterium
GVRANTVSPGNTY

SEQ ID NO: 1208458 - protein, 11 aa, Mycobacterium
GVRAQTRYRPA

SEQ ID NO: 1208459 - protein, 5 aa, Mycobacterium
GVRDR

SEQ ID NO: 1208460 - protein, 12 aa, Mycobacterium
GVREAAEKGDAI

SEQ ID NO: 1208461 - protein, 5 aa, Mycobacterium
GVREG

SEQ ID NO: 1208462 - protein, 6 aa, Mycobacterium
GVREGR

SEQ ID NO: 1208463 - protein, 5 aa, Mycobacterium
GVREP

SEQ ID NO: 1208464 - protein, 10 aa, Mycobacterium
GVRGDGGRGL

SEQ ID NO: 1208465 - protein, 5 aa, Mycobacterium
GVRGG

SEQ ID NO: 1208466 - protein, 15 aa, Mycobacterium
GVRGGARVTRPRRET

SEQ ID NO: 1208467 - protein, 5 aa, Mycobacterium
GVRHG

SEQ ID NO: 1208468 - protein, 6 aa, Mycobacterium
GVRPAR

SEQ ID NO: 1208469 - protein, 8 aa, Mycobacterium
GVRPDARL

SEQ ID NO: 1208470 - protein, 12 aa, Mycobacterium
GVRPDSKPWHPS

SEQ ID NO: 1208471 - protein, 6 aa, Mycobacterium
GVRPGG

SEQ ID NO: 1208472 - protein, 6 aa, Mycobacterium
GVRQRG

SEQ ID NO: 1208473 - protein, 6 aa, Mycobacterium
GVRQVD

SEQ ID NO: 1208474 - protein, 5 aa, Mycobacterium
GVRRQ

SEQ ID NO: 1208475 - protein, 4 aa, Mycobacterium
GVRS

SEQ ID NO: 1208476 - protein, 12 aa, Mycobacterium
GVRTRDERSRVE

SEQ ID NO: 1208477 - protein, 30 aa, Mycobacterium
GVSASVGTMNSAGVTGSIGTAGSAAVAGSA

SEQ ID NO: 1208478 - protein, 9 aa, Mycobacterium
GVSDRRQIT

SEQ ID NO: 1208479 - protein, 7 aa, Mycobacterium
GVSEGDR

SEQ ID NO: 1208480 - protein, 11 aa, Mycobacterium
GVSEPQPAEHD

SEQ ID NO: 1208481 - protein, 4 aa, Mycobacterium
GVSG

SEQ ID NO: 1208482 - protein, 7 aa, Mycobacterium
GVSGKPH

SEQ ID NO: 1208483 - protein, 7 aa, Mycobacterium
GVSGLSP

SEQ ID NO: 1208484 - protein, 6 aa, Mycobacterium
GVSGRE

SEQ ID NO: 1208485 - protein, 10 aa, Mycobacterium
GVSGSTATNA

SEQ ID NO: 1208486 - protein, 18 aa, Mycobacterium
GVSHGSDDRRRDLGGGSI

SEQ ID NO: 1208487 - protein, 6 aa, Mycobacterium
GVSHSH

SEQ ID NO: 1208488 - protein, 11 aa, Mycobacterium
GVSNQSASAAL

SEQ ID NO: 1208489 - protein, 10 aa, Mycobacterium
GVSPGNEGRG

SEQ ID NO: 1208490 - protein, 16 aa, Mycobacterium
GVSPLTPDHVNPERPW

SEQ ID NO: 1208491 - protein, 6 aa, Mycobacterium
GVSPPK

SEQ ID NO: 1208492 - protein, 7 aa, Mycobacterium
GVSPSDV

SEQ ID NO: 1208493 - protein, 15 aa, Mycobacterium
GVSQDQYVGPDGHRP

SEQ ID NO: 1208494 - protein, 13 aa, Mycobacterium
GVSRAELREAGAR

SEQ ID NO: 1208495 - protein, 7 aa, Mycobacterium
GVSREEM

SEQ ID NO: 1208496 - protein, 15 aa, Mycobacterium
GVSRRRTPATSGPWS

SEQ ID NO: 1208497 - protein, 7 aa, Mycobacterium
GVSSGKI

SEQ ID NO: 1208498 - protein, 5 aa, Mycobacterium
GVSSS

SEQ ID NO: 1208499 - protein, 10 aa, Mycobacterium
GVSTDTSGAK

SEQ ID NO: 1208500 - protein, 7 aa, Mycobacterium
GVSTGRA

SEQ ID NO: 1208501 - protein, 8 aa, Mycobacterium
GVSTPRSK

SEQ ID NO: 1208502 - protein, 6 aa, Mycobacterium
GVSTRA

SEQ ID NO: 1208503 - protein, 6 aa, Mycobacterium
GVTAEQ

SEQ ID NO: 1208504 - protein, 9 aa, Mycobacterium
GVTAEQDSK

SEQ ID NO: 1208505 - protein, 8 aa, Mycobacterium
GVTANSVP

SEQ ID NO: 1208506 - protein, 18 aa, Mycobacterium
GVTEDDLDKAADEVTAGL

SEQ ID NO: 1208507 - protein, 13 aa, Mycobacterium
GVTESSPAQTERM

SEQ ID NO: 1208508 - protein, 4 aa, Mycobacterium
GVTG

SEQ ID NO: 1208509 - protein, 15 aa, Mycobacterium
GVTGARDAVSNAAPE

SEQ ID NO: 1208510 - protein, 7 aa, Mycobacterium
GVTGDAP

SEQ ID NO: 1208511 - protein, 6 aa, Mycobacterium
GVTGPF

SEQ ID NO: 1208512 - protein, 11 aa, Mycobacterium
GVTGPLAGNPE

SEQ ID NO: 1208513 - protein, 7 aa, Mycobacterium
GVTGQDI

SEQ ID NO: 1208514 - protein, 13 aa, Mycobacterium
GVTGRTRVVVHDG

SEQ ID NO: 1208515 - protein, 8 aa, Mycobacterium
GVTGSGDD

SEQ ID NO: 1208516 - protein, 9 aa, Mycobacterium
GVTGSYGRR

SEQ ID NO: 1208517 - protein, 4 aa, Mycobacterium
GVTI

SEQ ID NO: 1208518 - protein, 31 aa, Mycobacterium
GVTNAHPQLASTAATSNRIQTPTTGPRLSAT

SEQ ID NO: 1208519 - protein, 6 aa, Mycobacterium
GVTPET

SEQ ID NO: 1208520 - protein, 15 aa, Mycobacterium
GVTPNGEAGRAFGTN

SEQ ID NO: 1208521 - protein, 5 aa, Mycobacterium
GVTPP

SEQ ID NO: 1208522 - protein, 7 aa, Mycobacterium
GVTPPGD

SEQ ID NO: 1208523 - protein, 5 aa, Mycobacterium
GVTRP

SEQ ID NO: 1208524 - protein, 7 aa, Mycobacterium
GVTRPRA

SEQ ID NO: 1208525 - protein, 5 aa, Mycobacterium
GVTSL

SEQ ID NO: 1208526 - protein, 4 aa, Mycobacterium
GVTT

SEQ ID NO: 1208527 - protein, 11 aa, Mycobacterium
GVTVPDPALEN

SEQ ID NO: 1208528 - protein, 12 aa, Mycobacterium
GVVDDTDKVGEA

SEQ ID NO: 1208529 - protein, 9 aa, Mycobacterium
GVVDSATGY

SEQ ID NO: 1208530 - protein, 13 aa, Mycobacterium
GWAPGPPPGFQPA

SEQ ID NO: 1208531 - protein, 14 aa, Mycobacterium
GWAPPSPPIPPDAR

SEQ ID NO: 1208532 - protein, 14 aa, Mycobacterium
GWASPEAIATESPY

SEQ ID NO: 1208533 - protein, 17 aa, Mycobacterium
GWATGVSDRDTANAGNI

SEQ ID NO: 1208534 - protein, 6 aa, Mycobacterium
GWEEKR

SEQ ID NO: 1208535 - protein, 11 aa, Mycobacterium
GWERDRHREAV

SEQ ID NO: 1208536 - protein, 17 aa, Mycobacterium
GWGDPTYDDSEDEGTVN

SEQ ID NO: 1208537 - protein, 11 aa, Mycobacterium
GWGRGGDTGAA

SEQ ID NO: 1208538 - protein, 10 aa, Mycobacterium
GWGSTGPFRD

SEQ ID NO: 1208539 - protein, 9 aa, Mycobacterium
GWGTPDQRR

SEQ ID NO: 1208540 - protein, 12 aa, Mycobacterium
GWKGGAATAFGT

SEQ ID NO: 1208541 - protein, 5 aa, Mycobacterium
GWNPL

SEQ ID NO: 1208542 - protein, 14 aa, Mycobacterium
GWPEPTGVTATDDI

SEQ ID NO: 1208543 - protein, 13 aa, Mycobacterium
GWPETEWLKPFTP

SEQ ID NO: 1208544 - protein, 8 aa, Mycobacterium
GWPGEEIP

SEQ ID NO: 1208545 - protein, 9 aa, Mycobacterium
GWPGGDGGE

SEQ ID NO: 1208546 - protein, 4 aa, Mycobacterium
GWPK

SEQ ID NO: 1208547 - protein, 23 aa, Mycobacterium
GWPKSAAEASLRAARASSVLDGG

SEQ ID NO: 1208548 - protein, 9 aa, Mycobacterium
GWPSKLSDL

SEQ ID NO: 1208549 - protein, 4 aa, Mycobacterium
GWQS

SEQ ID NO: 1208550 - protein, 5 aa, Mycobacterium
GWRDD

SEQ ID NO: 1208551 - protein, 6 aa, Mycobacterium
GWRPND

SEQ ID NO: 1208552 - protein, 31 aa, Mycobacterium
GWRTRKNGKNQTEWLPPPDLDTGQHRTNDYH

SEQ ID NO: 1208553 - protein, 9 aa, Mycobacterium
GWSDPTAQS

SEQ ID NO: 1208554 - protein, 4 aa, Mycobacterium
GWSV

SEQ ID NO: 1208555 - protein, 6 aa, Mycobacterium
GWTDGQ

SEQ ID NO: 1208556 - protein, 8 aa, Mycobacterium
GWTGQQAE

SEQ ID NO: 1208557 - protein, 11 aa, Mycobacterium
GWTPVDDQAGA

SEQ ID NO: 1208558 - protein, 5 aa, Mycobacterium
GWTSS

SEQ ID NO: 1208559 - protein, 12 aa, Mycobacterium
GWTTQRPGNGRT

SEQ ID NO: 1208560 - protein, 16 aa, Mycobacterium
GYAAATSRRVAAEAGV

SEQ ID NO: 1208561 - protein, 7 aa, Mycobacterium
GYAATSR

SEQ ID NO: 1208562 - protein, 6 aa, Mycobacterium
GYADPD

SEQ ID NO: 1208563 - protein, 10 aa, Mycobacterium
GYAEAAQSTY

SEQ ID NO: 1208564 - protein, 5 aa, Mycobacterium
GYAEP

SEQ ID NO: 1208565 - protein, 5 aa, Mycobacterium
GYAND

SEQ ID NO: 1208566 - protein, 7 aa, Mycobacterium
GYANTTI

SEQ ID NO: 1208567 - protein, 7 aa, Mycobacterium
GYANTTV

SEQ ID NO: 1208568 - protein, 8 aa, Mycobacterium
GYAPTDAE

SEQ ID NO: 1208569 - protein, 13 aa, Mycobacterium
GYAPTGPAPDGDY

SEQ ID NO: 1208570 - protein, 10 aa, Mycobacterium
GYARGGSAAE

SEQ ID NO: 1208571 - protein, 6 aa, Mycobacterium
GYATTT

SEQ ID NO: 1208572 - protein, 19 aa, Mycobacterium
GYDETTTDEIAASAGVSPR

SEQ ID NO: 1208573 - protein, 10 aa, Mycobacterium
GYDNARPVRI

SEQ ID NO: 1208574 - protein, 4 aa, Mycobacterium
GYDP

SEQ ID NO: 1208575 - protein, 8 aa, Mycobacterium
GYDPAREH

SEQ ID NO: 1208576 - protein, 13 aa, Mycobacterium
GYDRPTDGKYAAT

SEQ ID NO: 1208577 - protein, 17 aa, Mycobacterium
GYDRPVGSGEYPDEPEP

SEQ ID NO: 1208578 - protein, 4 aa, Mycobacterium
GYDS

SEQ ID NO: 1208579 - protein, 12 aa, Mycobacterium
GYEADQDRCQPT

SEQ ID NO: 1208580 - protein, 7 aa, Mycobacterium
GYEDTQG

SEQ ID NO: 1208581 - protein, 9 aa, Mycobacterium
GYEGEDAAR

SEQ ID NO: 1208582 - protein, 15 aa, Mycobacterium
GYEGQIGQTAYAAAK

SEQ ID NO: 1208583 - protein, 10 aa, Mycobacterium
GYEHAEPGTV

SEQ ID NO: 1208584 - protein, 16 aa, Mycobacterium
GYEHPGDPRQPDNTHR

SEQ ID NO: 1208585 - protein, 10 aa, Mycobacterium
GYETPSPIQA

SEQ ID NO: 1208586 - protein, 5 aa, Mycobacterium
GYGAD

SEQ ID NO: 1208587 - protein, 7 aa, Mycobacterium
GYGATTM

SEQ ID NO: 1208588 - protein, 6 aa, Mycobacterium
GYGDAG

SEQ ID NO: 1208589 - protein, 5 aa, Mycobacterium
GYGEP

SEQ ID NO: 1208590 - protein, 9 aa, Mycobacterium
GYGERMSTA

SEQ ID NO: 1208591 - protein, 6 aa, Mycobacterium
GYGGDS

SEQ ID NO: 1208592 - protein, 12 aa, Mycobacterium
GYGKRKGEKDLS

SEQ ID NO: 1208593 - protein, 12 aa, Mycobacterium
GYGNNPNTATGL

SEQ ID NO: 1208594 - protein, 12 aa, Mycobacterium
GYGNNPNTRSGL

SEQ ID NO: 1208595 - protein, 11 aa, Mycobacterium
GYGNPADPETA

SEQ ID NO: 1208596 - protein, 7 aa, Mycobacterium
GYGPGAD

SEQ ID NO: 1208597 - protein, 13 aa, Mycobacterium
GYGPGGPYTSKKA

SEQ ID NO: 1208598 - protein, 6 aa, Mycobacterium
GYGPRQ

SEQ ID NO: 1208599 - protein, 7 aa, Mycobacterium
GYGQPEQ

SEQ ID NO: 1208600 - protein, 23 aa, Mycobacterium
GYGQTGPDAHKAGYASVAEAASG

SEQ ID NO: 1208601 - protein, 9 aa, Mycobacterium
GYGRDSNNP

SEQ ID NO: 1208602 - protein, 4 aa, Mycobacterium
GYGS

SEQ ID NO: 1208603 - protein, 7 aa, Mycobacterium
GYGSARG

SEQ ID NO: 1208604 - protein, 20 aa, Mycobacterium
GYHGDGRRDATWRGRNDGRN

SEQ ID NO: 1208605 - protein, 16 aa, Mycobacterium
GYITGSDLRVDGGFQL

SEQ ID NO: 1208606 - protein, 5 aa, Mycobacterium
GYKQP

SEQ ID NO: 1208607 - protein, 10 aa, Mycobacterium
GYKQSGIGRE

SEQ ID NO: 1208608 - protein, 7 aa, Mycobacterium
GYPDATT

SEQ ID NO: 1208609 - protein, 8 aa, Mycobacterium
GYPETREE

SEQ ID NO: 1208610 - protein, 4 aa, Mycobacterium
GYPG

SEQ ID NO: 1208611 - protein, 10 aa, Mycobacterium
GYPPPGVPPR

SEQ ID NO: 1208612 - protein, 12 aa, Mycobacterium
GYPSSHRATQIN

SEQ ID NO: 1208613 - protein, 11 aa, Mycobacterium
GYPVDTETPVD

SEQ ID NO: 1208614 - protein, 13 aa, Mycobacterium
GYQRPSIGQPTRT

SEQ ID NO: 1208615 - protein, 7 aa, Mycobacterium
GYQSATA

SEQ ID NO: 1208616 - protein, 8 aa, Mycobacterium
GYQSPNPH

SEQ ID NO: 1208617 - protein, 10 aa, Mycobacterium
GYQSRAAAGD

SEQ ID NO: 1208618 - protein, 5 aa, Mycobacterium
GYRAE

SEQ ID NO: 1208619 - protein, 5 aa, Mycobacterium
GYRAG

SEQ ID NO: 1208620 - protein, 12 aa, Mycobacterium
GYRASEDHEAVG

SEQ ID NO: 1208621 - protein, 7 aa, Mycobacterium
GYRDTTM

SEQ ID NO: 1208622 - protein, 4 aa, Mycobacterium
GYRI

SEQ ID NO: 1208623 - protein, 10 aa, Mycobacterium
GYRPDPATGV

SEQ ID NO: 1208624 - protein, 7 aa, Mycobacterium
GYRPDSA

SEQ ID NO: 1208625 - protein, 7 aa, Mycobacterium
GYRPETP

SEQ ID NO: 1208626 - protein, 14 aa, Mycobacterium
GYRRGALTGSDDDE

SEQ ID NO: 1208627 - protein, 10 aa, Mycobacterium
GYRRRRDSKD

SEQ ID NO: 1208628 - protein, 9 aa, Mycobacterium
GYSAAPSLV

SEQ ID NO: 1208629 - protein, 19 aa, Mycobacterium
GYSASGTADDLIASLRTAL

SEQ ID NO: 1208630 - protein, 7 aa, Mycobacterium
GYSDPDY

SEQ ID NO: 1208631 - protein, 16 aa, Mycobacterium
GYSEPGAGSDLANVST

SEQ ID NO: 1208632 - protein, 17 aa, Mycobacterium
GYSETDAAALADGAWPQ

SEQ ID NO: 1208633 - protein, 4 aa, Mycobacterium
GYSG

SEQ ID NO: 1208634 - protein, 6 aa, Mycobacterium
GYSGAG

SEQ ID NO: 1208635 - protein, 31 aa, Mycobacterium
GYSNGSTAPTPPRDREHGRSRPYLPQTNGKV

SEQ ID NO: 1208636 - protein, 8 aa, Mycobacterium
GYSPQTLE

SEQ ID NO: 1208637 - protein, 6 aa, Mycobacterium
GYSPRA

SEQ ID NO: 1208638 - protein, 8 aa, Mycobacterium
GYSRKESY

SEQ ID NO: 1208639 - protein, 10 aa, Mycobacterium
GYSSDGVPTF

SEQ ID NO: 1208640 - protein, 7 aa, Mycobacterium
GYSTREI

SEQ ID NO: 1208641 - protein, 7 aa, Mycobacterium
GYSTSQF

SEQ ID NO: 1208642 - protein, 6 aa, Mycobacterium
GYTGEH

SEQ ID NO: 1208643 - protein, 19 aa, Mycobacterium
GYTGGQNDHPTYRNHPGHA

SEQ ID NO: 1208644 - protein, 6 aa, Mycobacterium
GYTGSA

SEQ ID NO: 1208645 - protein, 5 aa, Mycobacterium
GYTRD

SEQ ID NO: 1208646 - protein, 10 aa, Mycobacterium
GYTSGSTKDF

SEQ ID NO: 1208647 - protein, 10 aa, Mycobacterium
GYTSSLAAAS

SEQ ID NO: 1208648 - protein, 5 aa, Mycobacterium
GYTYG

SEQ ID NO: 1208649 - protein, 11 aa, Mycobacterium
GYVAPTSGEME

SEQ ID NO: 1208650 - protein, 7 aa, Mycobacterium
GYVTPDD

SEQ ID NO: 1208651 - protein, 19 aa, Mycobacterium
GYYGDTGGTPVDETAGPGH

SEQ ID NO: 1208652 - protein, 16 aa, Mycobacterium
GYYNNEGRGGKEGNGA

SEQ ID NO: 1208653 - protein, 5 aa, Mycobacterium
GYYRT

SEQ ID NO: 1208654 - protein, 17 aa, Mycobacterium
HAADGGTLIPPDGELTT

SEQ ID NO: 1208655 - protein, 5 aa, Mycobacterium
HAAES

SEQ ID NO: 1208656 - protein, 8 aa, Mycobacterium
HAAGEDTF

SEQ ID NO: 1208657 - protein, 10 aa, Mycobacterium
HAAGPAGSRT

SEQ ID NO: 1208658 - protein, 9 aa, Mycobacterium
HAAGRPAPR

SEQ ID NO: 1208659 - protein, 7 aa, Mycobacterium
HAAPEGR

SEQ ID NO: 1208660 - protein, 7 aa, Mycobacterium
HAAPGLE

SEQ ID NO: 1208661 - protein, 7 aa, Mycobacterium
HAAPPEG

SEQ ID NO: 1208662 - protein, 8 aa, Mycobacterium
HAAPPEGR

SEQ ID NO: 1208663 - protein, 6 aa, Mycobacterium
HAARGD

SEQ ID NO: 1208664 - protein, 35 aa, Mycobacterium
HAARTAVDTAPNDPKTTSARAEAATALSEVGDTAS

SEQ ID NO: 1208665 - protein, 22 aa, Mycobacterium
HAATERTRQARTARPGDPQASA

SEQ ID NO: 1208666 - protein, 10 aa, Mycobacterium
HADASSADDI

SEQ ID NO: 1208667 - protein, 9 aa, Mycobacterium
HADDNDMDA

SEQ ID NO: 1208668 - protein, 6 aa, Mycobacterium
HADDPA

SEQ ID NO: 1208669 - protein, 5 aa, Mycobacterium
HADEP

SEQ ID NO: 1208670 - protein, 4 aa, Mycobacterium
HADG

SEQ ID NO: 1208671 - protein, 5 aa, Mycobacterium
HADGI

SEQ ID NO: 1208672 - protein, 11 aa, Mycobacterium
HADGRGTVETY

SEQ ID NO: 1208673 - protein, 9 aa, Mycobacterium
HADGRRTTV

SEQ ID NO: 1208674 - protein, 18 aa, Mycobacterium
HADGSELDDDDDDGPAEK

SEQ ID NO: 1208675 - protein, 6 aa, Mycobacterium
HADKAS

SEQ ID NO: 1208676 - protein, 5 aa, Mycobacterium
HADKP

SEQ ID NO: 1208677 - protein, 4 aa, Mycobacterium
HADP

SEQ ID NO: 1208678 - protein, 11 aa, Mycobacterium
HADPAAAKKVG

SEQ ID NO: 1208679 - protein, 7 aa, Mycobacterium
HADPAEA

SEQ ID NO: 1208680 - protein, 9 aa, Mycobacterium
HADPEDRHR

SEQ ID NO: 1208681 - protein, 9 aa, Mycobacterium
HADPSEDEL

SEQ ID NO: 1208682 - protein, 5 aa, Mycobacterium
HADPT

SEQ ID NO: 1208683 - protein, 6 aa, Mycobacterium
HADQPA

SEQ ID NO: 1208684 - protein, 4 aa, Mycobacterium
HADS

SEQ ID NO: 1208685 - protein, 5 aa, Mycobacterium
HADSA

SEQ ID NO: 1208686 - protein, 10 aa, Mycobacterium
HADSIDDQQH

SEQ ID NO: 1208687 - protein, 8 aa, Mycobacterium
HADTGRPV

SEQ ID NO: 1208688 - protein, 5 aa, Mycobacterium
HAEPA

SEQ ID NO: 1208689 - protein, 6 aa, Mycobacterium
HAEPAP

SEQ ID NO: 1208690 - protein, 6 aa, Mycobacterium
HAEPGT

SEQ ID NO: 1208691 - protein, 5 aa, Mycobacterium
HAEPY

SEQ ID NO: 1208692 - protein, 10 aa, Mycobacterium
HAEQAGFTAG

SEQ ID NO: 1208693 - protein, 5 aa, Mycobacterium
HAERL

SEQ ID NO: 1208694 - protein, 14 aa, Mycobacterium
HAESELASRGEVGL

SEQ ID NO: 1208695 - protein, 16 aa, Mycobacterium
HAFAGDTSLTGYGATK

SEQ ID NO: 1208696 - protein, 11 aa, Mycobacterium
HAFGDDELGDT

SEQ ID NO: 1208697 - protein, 4 aa, Mycobacterium
HAGA

SEQ ID NO: 1208698 - protein, 8 aa, Mycobacterium
HAGDGEDQ

SEQ ID NO: 1208699 - protein, 6 aa, Mycobacterium
HAGEPG

SEQ ID NO: 1208700 - protein, 23 aa, Mycobacterium
HAGGDDADAKIKEATDAINRLVR

SEQ ID NO: 1208701 - protein, 9 aa, Mycobacterium
HAGGPTLEG

SEQ ID NO: 1208702 - protein, 13 aa, Mycobacterium
HAGGRPADERATA

SEQ ID NO: 1208703 - protein, 14 aa, Mycobacterium
HAGGTGSPTKTAAR

SEQ ID NO: 1208704 - protein, 13 aa, Mycobacterium
HAGLKRDPDDTSE

SEQ ID NO: 1208705 - protein, 4 aa, Mycobacterium
HAGM

SEQ ID NO: 1208706 - protein, 5 aa, Mycobacterium
HAGPA

SEQ ID NO: 1208707 - protein, 6 aa, Mycobacterium
HAGPDI

SEQ ID NO: 1208708 - protein, 5 aa, Mycobacterium
HAGPI

SEQ ID NO: 1208709 - protein, 7 aa, Mycobacterium
HAGPRGL

SEQ ID NO: 1208710 - protein, 16 aa, Mycobacterium
HAGPVANARTNKAQAL

SEQ ID NO: 1208711 - protein, 7 aa, Mycobacterium
HAGQAVE

SEQ ID NO: 1208712 - protein, 6 aa, Mycobacterium
HAGQGD

SEQ ID NO: 1208713 - protein, 9 aa, Mycobacterium
HAGQGSDAH

SEQ ID NO: 1208714 - protein, 11 aa, Mycobacterium
HAGQTPDIATN

SEQ ID NO: 1208715 - protein, 14 aa, Mycobacterium
HAGRPEAERPRVRA

SEQ ID NO: 1208716 - protein, 10 aa, Mycobacterium
HAGRTSSLTQ

SEQ ID NO: 1208717 - protein, 14 aa, Mycobacterium
HAGSGLDPEGLDEA

SEQ ID NO: 1208718 - protein, 23 aa, Mycobacterium
HAHADADADADADAEADADAEVK

SEQ ID NO: 1208719 - protein, 17 aa, Mycobacterium
HAHADADADADAEVDAE

SEQ ID NO: 1208720 - protein, 13 aa, Mycobacterium
HAHADADAEVDAE

SEQ ID NO: 1208721 - protein, 10 aa, Mycobacterium
HAHGPTASRT

SEQ ID NO: 1208722 - protein, 11 aa, Mycobacterium
HAKGQDSPQDF

SEQ ID NO: 1208723 - protein, 12 aa, Mycobacterium
HALKDKAAQGLA

SEQ ID NO: 1208724 - protein, 11 aa, Mycobacterium
HALSDDGHCRP

SEQ ID NO: 1208725 - protein, 13 aa, Mycobacterium
HANAGDPPARQVG

SEQ ID NO: 1208726 - protein, 7 aa, Mycobacterium
HANGEHL

SEQ ID NO: 1208727 - protein, 11 aa, Mycobacterium
HANGQDSQQDF

SEQ ID NO: 1208728 - protein, 10 aa, Mycobacterium
HANSGKDHVR

SEQ ID NO: 1208729 - protein, 11 aa, Mycobacterium
HANSGKDHVRQ

SEQ ID NO: 1208730 - protein, 5 aa, Mycobacterium
HANTY

SEQ ID NO: 1208731 - protein, 6 aa, Mycobacterium
HANYTR

SEQ ID NO: 1208732 - protein, 10 aa, Mycobacterium
HAPAADRERM

SEQ ID NO: 1208733 - protein, 15 aa, Mycobacterium
HAPAEPEPPRVGPDD

SEQ ID NO: 1208734 - protein, 5 aa, Mycobacterium
HAPAR

SEQ ID NO: 1208735 - protein, 16 aa, Mycobacterium
HAPDEDPPIGPADKTV

SEQ ID NO: 1208736 - protein, 7 aa, Mycobacterium
HAPDIPA

SEQ ID NO: 1208737 - protein, 6 aa, Mycobacterium
HAPEPR

SEQ ID NO: 1208738 - protein, 12 aa, Mycobacterium
HAPGDDPATVTA

SEQ ID NO: 1208739 - protein, 7 aa, Mycobacterium
HAPGTTV

SEQ ID NO: 1208740 - protein, 7 aa, Mycobacterium
HAPHGAH

SEQ ID NO: 1208741 - protein, 5 aa, Mycobacterium
HAPLA

SEQ ID NO: 1208742 - protein, 14 aa, Mycobacterium
HAPPQGLPFLPPGS

SEQ ID NO: 1208743 - protein, 6 aa, Mycobacterium
HAPRRN

SEQ ID NO: 1208744 - protein, 8 aa, Mycobacterium
HAPTHPPT

SEQ ID NO: 1208745 - protein, 12 aa, Mycobacterium
HAPTNAPPRQAR

SEQ ID NO: 1208746 - protein, 4 aa, Mycobacterium
HAPW

SEQ ID NO: 1208747 - protein, 5 aa, Mycobacterium
HAQSR

SEQ ID NO: 1208748 - protein, 11 aa, Mycobacterium
HARAGAGANEV

SEQ ID NO: 1208749 - protein, 6 aa, Mycobacterium
HARARG

SEQ ID NO: 1208750 - protein, 7 aa, Mycobacterium
HARGGGE

SEQ ID NO: 1208751 - protein, 8 aa, Mycobacterium
HARHEAEV

SEQ ID NO: 1208752 - protein, 29 aa, Mycobacterium
HARQNSDSVSEDTYRSPDPATAEGAADTI

SEQ ID NO: 1208753 - protein, 7 aa, Mycobacterium
HARRDGG

SEQ ID NO: 1208754 - protein, 10 aa, Mycobacterium
HASEAERTAV

SEQ ID NO: 1208755 - protein, 5 aa, Mycobacterium
HASGD

SEQ ID NO: 1208756 - protein, 5 aa, Mycobacterium
HASPE

SEQ ID NO: 1208757 - protein, 18 aa, Mycobacterium
HASPEAVRKAAASERGYD

SEQ ID NO: 1208758 - protein, 17 aa, Mycobacterium
HASPPPDPSGVGSSARN

SEQ ID NO: 1208759 - protein, 8 aa, Mycobacterium
HASTGKPF

SEQ ID NO: 1208760 - protein, 12 aa, Mycobacterium
HASWTGKSARLA

SEQ ID NO: 1208761 - protein, 6 aa, Mycobacterium
HATEDG

SEQ ID NO: 1208762 - protein, 7 aa, Mycobacterium
HATERRL

SEQ ID NO: 1208763 - protein, 12 aa, Mycobacterium
HATETHPTAPSL

SEQ ID NO: 1208764 - protein, 8 aa, Mycobacterium
HATGEPFE

SEQ ID NO: 1208765 - protein, 7 aa, Mycobacterium
HATGLPG

SEQ ID NO: 1208766 - protein, 10 aa, Mycobacterium
HATGTSVGDL

SEQ ID NO: 1208767 - protein, 10 aa, Mycobacterium
HATGTTVGDV

SEQ ID NO: 1208768 - protein, 16 aa, Mycobacterium
HATPDRQGGPTSALNG

SEQ ID NO: 1208769 - protein, 6 aa, Mycobacterium
HATPSQ

SEQ ID NO: 1208770 - protein, 12 aa, Mycobacterium
HATQPSREAETL

SEQ ID NO: 1208771 - protein, 7 aa, Mycobacterium
HATTSGD

SEQ ID NO: 1208772 - protein, 21 aa, Mycobacterium
HAVTGRGRHPLPSGDSVESAA

SEQ ID NO: 1208773 - protein, 7 aa, Mycobacterium
HAYGGGA

SEQ ID NO: 1208774 - protein, 4 aa, Mycobacterium
HAYK

SEQ ID NO: 1208775 - protein, 7 aa, Mycobacterium
HCPPDRF

SEQ ID NO: 1208776 - protein, 16 aa, Mycobacterium
HDAAARTLAAKTGDRF

SEQ ID NO: 1208777 - protein, 8 aa, Mycobacterium
HDAADELG

SEQ ID NO: 1208778 - protein, 7 aa, Mycobacterium
HDAEPAI

SEQ ID NO: 1208779 - protein, 9 aa, Mycobacterium
HDAGPENIQ

SEQ ID NO: 1208780 - protein, 10 aa, Mycobacterium
HDAKGGVAAG

SEQ ID NO: 1208781 - protein, 5 aa, Mycobacterium
HDAPD

SEQ ID NO: 1208782 - protein, 10 aa, Mycobacterium
HDAPDETADP

SEQ ID NO: 1208783 - protein, 29 aa, Mycobacterium
HDAPPRGARGSQPYDNDGSSAAAARGRAL

SEQ ID NO: 1208784 - protein, 9 aa, Mycobacterium
HDAQRRGAW

SEQ ID NO: 1208785 - protein, 4 aa, Mycobacterium
HDAT

SEQ ID NO: 1208786 - protein, 5 aa, Mycobacterium
HDATG

SEQ ID NO: 1208787 - protein, 10 aa, Mycobacterium
HDAVKRAREQ

SEQ ID NO: 1208788 - protein, 15 aa, Mycobacterium
HDDAEAEKLRTEANT

SEQ ID NO: 1208789 - protein, 6 aa, Mycobacterium
HDDAEQ

SEQ ID NO: 1208790 - protein, 4 aa, Mycobacterium
HDDD

SEQ ID NO: 1208791 - protein, 11 aa, Mycobacterium
HDDDDAKAQRM

SEQ ID NO: 1208792 - protein, 5 aa, Mycobacterium
HDDDK

SEQ ID NO: 1208793 - protein, 9 aa, Mycobacterium
HDDDSGAQT

SEQ ID NO: 1208794 - protein, 5 aa, Mycobacterium
HDDGR

SEQ ID NO: 1208795 - protein, 8 aa, Mycobacterium
HDDGSAYG

SEQ ID NO: 1208796 - protein, 9 aa, Mycobacterium
HDDGSERLL

SEQ ID NO: 1208797 - protein, 4 aa, Mycobacterium
HDDP

SEQ ID NO: 1208798 - protein, 7 aa, Mycobacterium
HDDPDAA

SEQ ID NO: 1208799 - protein, 9 aa, Mycobacterium
HDDPPPMGE

SEQ ID NO: 1208800 - protein, 6 aa, Mycobacterium
HDDPQA

SEQ ID NO: 1208801 - protein, 16 aa, Mycobacterium
HDDPTDERSEKNARQH

SEQ ID NO: 1208802 - protein, 9 aa, Mycobacterium
HDDRTDALR

SEQ ID NO: 1208803 - protein, 9 aa, Mycobacterium
HDDTAAAEL

SEQ ID NO: 1208804 - protein, 7 aa, Mycobacterium
HDEAGTN

SEQ ID NO: 1208805 - protein, 5 aa, Mycobacterium
HDEGA

SEQ ID NO: 1208806 - protein, 8 aa, Mycobacterium
HDELPTPE

SEQ ID NO: 1208807 - protein, 13 aa, Mycobacterium
HDENGAYPAAVQA

SEQ ID NO: 1208808 - protein, 7 aa, Mycobacterium
HDETDER

SEQ ID NO: 1208809 - protein, 6 aa, Mycobacterium
HDFTGT

SEQ ID NO: 1208810 - protein, 8 aa, Mycobacterium
HDGAAGGL

SEQ ID NO: 1208811 - protein, 12 aa, Mycobacterium
HDGAAPAAYPLD

SEQ ID NO: 1208812 - protein, 7 aa, Mycobacterium
HDGDDSV

SEQ ID NO: 1208813 - protein, 8 aa, Mycobacterium
HDGDGDLD

SEQ ID NO: 1208814 - protein, 11 aa, Mycobacterium
HDGDGGPLPAE

SEQ ID NO: 1208815 - protein, 6 aa, Mycobacterium
HDGDVD

SEQ ID NO: 1208816 - protein, 7 aa, Mycobacterium
HDGEALD

SEQ ID NO: 1208817 - protein, 9 aa, Mycobacterium
HDGEDTTMP

SEQ ID NO: 1208818 - protein, 4 aa, Mycobacterium
HDGF

SEQ ID NO: 1208819 - protein, 5 aa, Mycobacterium
HDGKP

SEQ ID NO: 1208820 - protein, 8 aa, Mycobacterium
HDGPCGSG

SEQ ID NO: 1208821 - protein, 12 aa, Mycobacterium
HDGPTDGAEKHD

SEQ ID NO: 1208822 - protein, 9 aa, Mycobacterium
HDGPVPELS

SEQ ID NO: 1208823 - protein, 4 aa, Mycobacterium
HDGR

SEQ ID NO: 1208824 - protein, 11 aa, Mycobacterium
HDGRSGEPGAV

SEQ ID NO: 1208825 - protein, 8 aa, Mycobacterium
HDGRTATF

SEQ ID NO: 1208826 - protein, 12 aa, Mycobacterium
HDGSAPATGTAT

SEQ ID NO: 1208827 - protein, 7 aa, Mycobacterium
HDGTGGW

SEQ ID NO: 1208828 - protein, 4 aa, Mycobacterium
HDHD

SEQ ID NO: 1208829 - protein, 123 aa, Mycobacterium
HDHDDDDGDDVDDDGDDVDSESDSDEDQPGRPAAKRRRRGRRGRGRGRGEQNGDESSADSDEGDVDTEKAQSGESADDSDDDSGEDDGTGADGATRRRRRRRRRKSGSDDDGENGSPDDPPNT

SEQ ID NO: 1208830 - protein, 15 aa, Mycobacterium
HDHDDQGRRSGNEQC

SEQ ID NO: 1208831 - protein, 15 aa, Mycobacterium
HDHGAPSYREGRPRT

SEQ ID NO: 1208832 - protein, 8 aa, Mycobacterium
HDHHGPEH

SEQ ID NO: 1208833 - protein, 7 aa, Mycobacterium
HDHPEAA

SEQ ID NO: 1208834 - protein, 8 aa, Mycobacterium
HDLEPAGT

SEQ ID NO: 1208835 - protein, 4 aa, Mycobacterium
HDLP

SEQ ID NO: 1208836 - protein, 16 aa, Mycobacterium
HDPAELTGASSSVSTL

SEQ ID NO: 1208837 - protein, 5 aa, Mycobacterium
HDPAP

SEQ ID NO: 1208838 - protein, 17 aa, Mycobacterium
HDPDAVRKSRAPETGRT

SEQ ID NO: 1208839 - protein, 8 aa, Mycobacterium
HDPDPTWS

SEQ ID NO: 1208840 - protein, 10 aa, Mycobacterium
HDPGDAPADL

SEQ ID NO: 1208841 - protein, 9 aa, Mycobacterium
HDPGEDRSY

SEQ ID NO: 1208842 - protein, 6 aa, Mycobacterium
HDPHTG

SEQ ID NO: 1208843 - protein, 8 aa, Mycobacterium
HDPLRDDG

SEQ ID NO: 1208844 - protein, 12 aa, Mycobacterium
HDPRDSTSVNAA

SEQ ID NO: 1208845 - protein, 6 aa, Mycobacterium
HDPRSE

SEQ ID NO: 1208846 - protein, 11 aa, Mycobacterium
HDPRSESFGEE

SEQ ID NO: 1208847 - protein, 4 aa, Mycobacterium
HDPS

SEQ ID NO: 1208848 - protein, 7 aa, Mycobacterium
HDPSIGA

SEQ ID NO: 1208849 - protein, 7 aa, Mycobacterium
HDPTARR

SEQ ID NO: 1208850 - protein, 5 aa, Mycobacterium
HDPTT

SEQ ID NO: 1208851 - protein, 4 aa, Mycobacterium
HDRE

SEQ ID NO: 1208852 - protein, 7 aa, Mycobacterium
HDREHTG

SEQ ID NO: 1208853 - protein, 14 aa, Mycobacterium
HDREPTTTVRGSRS

SEQ ID NO: 1208854 - protein, 16 aa, Mycobacterium
HDRGARRRRSRHGRRH

SEQ ID NO: 1208855 - protein, 7 aa, Mycobacterium
HDRGEAK

SEQ ID NO: 1208856 - protein, 8 aa, Mycobacterium
HDRGGTGQ

SEQ ID NO: 1208857 - protein, 25 aa, Mycobacterium
HDRGNPADGAEETSLVQGSEDEARR

SEQ ID NO: 1208858 - protein, 5 aa, Mycobacterium
HDRPA

SEQ ID NO: 1208859 - protein, 7 aa, Mycobacterium
HDSMDTS

SEQ ID NO: 1208860 - protein, 7 aa, Mycobacterium
HDSQSGR

SEQ ID NO: 1208861 - protein, 6 aa, Mycobacterium
HDSRPY

SEQ ID NO: 1208862 - protein, 5 aa, Mycobacterium
HDSRV

SEQ ID NO: 1208863 - protein, 7 aa, Mycobacterium
HDSSHEL

SEQ ID NO: 1208864 - protein, 8 aa, Mycobacterium
HDSTHGTA

SEQ ID NO: 1208865 - protein, 6 aa, Mycobacterium
HDTDDL

SEQ ID NO: 1208866 - protein, 5 aa, Mycobacterium
HDTMS

SEQ ID NO: 1208867 - protein, 6 aa, Mycobacterium
HDTPGA

SEQ ID NO: 1208868 - protein, 9 aa, Mycobacterium
HDTPLGPAR

SEQ ID NO: 1208869 - protein, 9 aa, Mycobacterium
HDTPLPGDP

SEQ ID NO: 1208870 - protein, 15 aa, Mycobacterium
HDTSTLANDPNETEL

SEQ ID NO: 1208871 - protein, 6 aa, Mycobacterium
HDTTAT

SEQ ID NO: 1208872 - protein, 4 aa, Mycobacterium
HDTW

SEQ ID NO: 1208873 - protein, 5 aa, Mycobacterium
HDVTG

SEQ ID NO: 1208874 - protein, 5 aa, Mycobacterium
HDYPR

SEQ ID NO: 1208875 - protein, 10 aa, Mycobacterium
HEAAKSGESV

SEQ ID NO: 1208876 - protein, 7 aa, Mycobacterium
HEAATRE

SEQ ID NO: 1208877 - protein, 4 aa, Mycobacterium
HEAD

SEQ ID NO: 1208878 - protein, 4 aa, Mycobacterium
HEAQ

SEQ ID NO: 1208879 - protein, 4 aa, Mycobacterium
HEDA

SEQ ID NO: 1208880 - protein, 15 aa, Mycobacterium
HEDDAPTGRIPVSGE

SEQ ID NO: 1208881 - protein, 7 aa, Mycobacterium
HEDRPGV

SEQ ID NO: 1208882 - protein, 6 aa, Mycobacterium
HEDTRK

SEQ ID NO: 1208883 - protein, 5 aa, Mycobacterium
HEDTS

SEQ ID NO: 1208884 - protein, 8 aa, Mycobacterium
HEEAPAAV

SEQ ID NO: 1208885 - protein, 5 aa, Mycobacterium
HEERD

SEQ ID NO: 1208886 - protein, 22 aa, Mycobacterium
HEGENGACEPGGMPSGSETAFD

SEQ ID NO: 1208887 - protein, 9 aa, Mycobacterium
HEGERRARR

SEQ ID NO: 1208888 - protein, 6 aa, Mycobacterium
HEGGPL

SEQ ID NO: 1208889 - protein, 5 aa, Mycobacterium
HEGGT

SEQ ID NO: 1208890 - protein, 13 aa, Mycobacterium
HEGKRRARARRAS

SEQ ID NO: 1208891 - protein, 5 aa, Mycobacterium
HEGNE

SEQ ID NO: 1208892 - protein, 7 aa, Mycobacterium
HEGPGRR

SEQ ID NO: 1208893 - protein, 6 aa, Mycobacterium
HEHEPG

SEQ ID NO: 1208894 - protein, 8 aa, Mycobacterium
HEIDQGAG

SEQ ID NO: 1208895 - protein, 5 aa, Mycobacterium
HEIGT

SEQ ID NO: 1208896 - protein, 9 aa, Mycobacterium
HEKDETYPD

SEQ ID NO: 1208897 - protein, 8 aa, Mycobacterium
HEKPTVAE

SEQ ID NO: 1208898 - protein, 9 aa, Mycobacterium
HELPNTPGV

SEQ ID NO: 1208899 - protein, 4 aa, Mycobacterium
HEPA

SEQ ID NO: 1208900 - protein, 5 aa, Mycobacterium
HEPAA

SEQ ID NO: 1208901 - protein, 11 aa, Mycobacterium
HEPAPPPAEPS

SEQ ID NO: 1208902 - protein, 11 aa, Mycobacterium
HEPARADEPYR

SEQ ID NO: 1208903 - protein, 6 aa, Mycobacterium
HEPDGT

SEQ ID NO: 1208904 - protein, 8 aa, Mycobacterium
HEPEDSRG

SEQ ID NO: 1208905 - protein, 4 aa, Mycobacterium
HEPR

SEQ ID NO: 1208906 - protein, 8 aa, Mycobacterium
HEPTPGAV

SEQ ID NO: 1208907 - protein, 6 aa, Mycobacterium
HEPVEG

SEQ ID NO: 1208908 - protein, 31 aa, Mycobacterium
HEQGSTSGKLAGGVPLEPAKEAGTGSVKDPE

SEQ ID NO: 1208909 - protein, 8 aa, Mycobacterium
HEQPRGEV

SEQ ID NO: 1208910 - protein, 6 aa, Mycobacterium
HEQSAR

SEQ ID NO: 1208911 - protein, 4 aa, Mycobacterium
HEQT

SEQ ID NO: 1208912 - protein, 13 aa, Mycobacterium
HERAAAAQDAGAF

SEQ ID NO: 1208913 - protein, 8 aa, Mycobacterium
HERAGSSR

SEQ ID NO: 1208914 - protein, 7 aa, Mycobacterium
HERDDPD

SEQ ID NO: 1208915 - protein, 11 aa, Mycobacterium
HERGLRRTDPT

SEQ ID NO: 1208916 - protein, 9 aa, Mycobacterium
HERSETYPD

SEQ ID NO: 1208917 - protein, 8 aa, Mycobacterium
HERSGGRT

SEQ ID NO: 1208918 - protein, 11 aa, Mycobacterium
HERTGSPAPLA

SEQ ID NO: 1208919 - protein, 5 aa, Mycobacterium
HERTL

SEQ ID NO: 1208920 - protein, 4 aa, Mycobacterium
HESA

SEQ ID NO: 1208921 - protein, 9 aa, Mycobacterium
HESESSTLA

SEQ ID NO: 1208922 - protein, 23 aa, Mycobacterium
HESGVADTEYVPDSASPDEADTA

SEQ ID NO: 1208923 - protein, 9 aa, Mycobacterium
HESPSDLPE

SEQ ID NO: 1208924 - protein, 11 aa, Mycobacterium
HESSGSGAHTV

SEQ ID NO: 1208925 - protein, 5 aa, Mycobacterium
HETDR

SEQ ID NO: 1208926 - protein, 5 aa, Mycobacterium
HETGG

SEQ ID NO: 1208927 - protein, 31 aa, Mycobacterium
HETSEQLAAERGPFPAYPDSRLTRPRRNAQL

SEQ ID NO: 1208928 - protein, 5 aa, Mycobacterium
HETTA

SEQ ID NO: 1208929 - protein, 6 aa, Mycobacterium
HETTAA

SEQ ID NO: 1208930 - protein, 5 aa, Mycobacterium
HETTS

SEQ ID NO: 1208931 - protein, 7 aa, Mycobacterium
HETTSTQ

SEQ ID NO: 1208932 - protein, 6 aa, Mycobacterium
HETTVT

SEQ ID NO: 1208933 - protein, 11 aa, Mycobacterium
HEVPDSPYTYA

SEQ ID NO: 1208934 - protein, 8 aa, Mycobacterium
HEYGSTCE

SEQ ID NO: 1208935 - protein, 12 aa, Mycobacterium
HFPPAADPIGAD

SEQ ID NO: 1208936 - protein, 10 aa, Mycobacterium
HFRPPQDSHT

SEQ ID NO: 1208937 - protein, 8 aa, Mycobacterium
HFSDTPDY

SEQ ID NO: 1208938 - protein, 9 aa, Mycobacterium
HGAAASSLP

SEQ ID NO: 1208939 - protein, 13 aa, Mycobacterium
HGAADWSKRPLPD

SEQ ID NO: 1208940 - protein, 12 aa, Mycobacterium
HGAASDRTSATS

SEQ ID NO: 1208941 - protein, 9 aa, Mycobacterium
HGAATATSE

SEQ ID NO: 1208942 - protein, 16 aa, Mycobacterium
HGAATPGSKLVTESGH

SEQ ID NO: 1208943 - protein, 6 aa, Mycobacterium
HGADPT

SEQ ID NO: 1208944 - protein, 4 aa, Mycobacterium
HGAE

SEQ ID NO: 1208945 - protein, 4 aa, Mycobacterium
HGAG

SEQ ID NO: 1208946 - protein, 5 aa, Mycobacterium
HGAGA

SEQ ID NO: 1208947 - protein, 7 aa, Mycobacterium
HGAGDTL

SEQ ID NO: 1208948 - protein, 10 aa, Mycobacterium
HGAGGNRESP

SEQ ID NO: 1208949 - protein, 33 aa, Mycobacterium
HGAGSSCGKNLSAELTSTIGEQRRTNPSVQPMT

SEQ ID NO: 1208950 - protein, 5 aa, Mycobacterium
HGAGV

SEQ ID NO: 1208951 - protein, 8 aa, Mycobacterium
HGAGVRRG

SEQ ID NO: 1208952 - protein, 13 aa, Mycobacterium
HGAHDTDDDGVAP

SEQ ID NO: 1208953 - protein, 8 aa, Mycobacterium
HGAKPGAL

SEQ ID NO: 1208954 - protein, 12 aa, Mycobacterium
HGAPADGAPPFP

SEQ ID NO: 1208955 - protein, 11 aa, Mycobacterium
HGAPTGPAGEP

SEQ ID NO: 1208956 - protein, 11 aa, Mycobacterium
HGARSQNAAGL

SEQ ID NO: 1208957 - protein, 5 aa, Mycobacterium
HGDDA

SEQ ID NO: 1208958 - protein, 12 aa, Mycobacterium
HGDDPAGWPSQH

SEQ ID NO: 1208959 - protein, 24 aa, Mycobacterium
HGDDPDPRSWAEKKAAEDEELGRS

SEQ ID NO: 1208960 - protein, 10 aa, Mycobacterium
HGDEPAPETM

SEQ ID NO: 1208961 - protein, 5 aa, Mycobacterium
HGDGA

SEQ ID NO: 1208962 - protein, 5 aa, Mycobacterium
HGDGE

SEQ ID NO: 1208963 - protein, 5 aa, Mycobacterium
HGDGT

SEQ ID NO: 1208964 - protein, 5 aa, Mycobacterium
HGDGW

SEQ ID NO: 1208965 - protein, 19 aa, Mycobacterium
HGDPAGNGSGNSRNGHGRK

SEQ ID NO: 1208966 - protein, 15 aa, Mycobacterium
HGDPDPDYRGTGGPV

SEQ ID NO: 1208967 - protein, 9 aa, Mycobacterium
HGDPRRGEQ

SEQ ID NO: 1208968 - protein, 10 aa, Mycobacterium
HGDQGGRAIR

SEQ ID NO: 1208969 - protein, 14 aa, Mycobacterium
HGDRDDPSRDSGTD

SEQ ID NO: 1208970 - protein, 5 aa, Mycobacterium
HGDSF

SEQ ID NO: 1208971 - protein, 9 aa, Mycobacterium
HGDSPQAKE

SEQ ID NO: 1208972 - protein, 11 aa, Mycobacterium
HGDSRRTFARS

SEQ ID NO: 1208973 - protein, 9 aa, Mycobacterium
HGEAPPHPA

SEQ ID NO: 1208974 - protein, 6 aa, Mycobacterium
HGEAYR

SEQ ID NO: 1208975 - protein, 11 aa, Mycobacterium
HGEDAAPPDDV

SEQ ID NO: 1208976 - protein, 7 aa, Mycobacterium
HGEDGEI

SEQ ID NO: 1208977 - protein, 6 aa, Mycobacterium
HGEDVE

SEQ ID NO: 1208978 - protein, 13 aa, Mycobacterium
HGEDVEEALPSRP

SEQ ID NO: 1208979 - protein, 12 aa, Mycobacterium
HGEGTGAPATEA

SEQ ID NO: 1208980 - protein, 5 aa, Mycobacterium
HGEGW

SEQ ID NO: 1208981 - protein, 7 aa, Mycobacterium
HGENSTY

SEQ ID NO: 1208982 - protein, 7 aa, Mycobacterium
HGERSTI

SEQ ID NO: 1208983 - protein, 12 aa, Mycobacterium
HGESPRTWRARH

SEQ ID NO: 1208984 - protein, 6 aa, Mycobacterium
HGESRV

SEQ ID NO: 1208985 - protein, 8 aa, Mycobacterium
HGETKAPE

SEQ ID NO: 1208986 - protein, 17 aa, Mycobacterium
HGFTDEPVDTTGDEDKR

SEQ ID NO: 1208987 - protein, 4 aa, Mycobacterium
HGGA

SEQ ID NO: 1208988 - protein, 29 aa, Mycobacterium
HGGADARRRTDADHQPDEKPVPGGRPVGR

SEQ ID NO: 1208989 - protein, 14 aa, Mycobacterium
HGGARTAPAPAGTR

SEQ ID NO: 1208990 - protein, 4 aa, Mycobacterium
HGGC

SEQ ID NO: 1208991 - protein, 10 aa, Mycobacterium
HGGDDGHDTV

SEQ ID NO: 1208992 - protein, 7 aa, Mycobacterium
HGGDDQA

SEQ ID NO: 1208993 - protein, 7 aa, Mycobacterium
HGGDGEG

SEQ ID NO: 1208994 - protein, 10 aa, Mycobacterium
HGGETVDATD

SEQ ID NO: 1208995 - protein, 12 aa, Mycobacterium
HGGFGASGFGKD

SEQ ID NO: 1208996 - protein, 6 aa, Mycobacterium
HGGGAV

SEQ ID NO: 1208997 - protein, 7 aa, Mycobacterium
HGGGRRP

SEQ ID NO: 1208998 - protein, 5 aa, Mycobacterium
HGGGS

SEQ ID NO: 1208999 - protein, 8 aa, Mycobacterium
HGGNPPVG

SEQ ID NO: 1209000 - protein, 5 aa, Mycobacterium
HGGPA

SEQ ID NO: 1209001 - protein, 14 aa, Mycobacterium
HGGPDGGPAYDGPR

SEQ ID NO: 1209002 - protein, 13 aa, Mycobacterium
HGGQEPVRAPEKS

SEQ ID NO: 1209003 - protein, 5 aa, Mycobacterium
HGGRG

SEQ ID NO: 1209004 - protein, 5 aa, Mycobacterium
HGGRS

SEQ ID NO: 1209005 - protein, 12 aa, Mycobacterium
HGGSRGRDVRST

SEQ ID NO: 1209006 - protein, 4 aa, Mycobacterium
HGGW

SEQ ID NO: 1209007 - protein, 14 aa, Mycobacterium
HGGWKNEKVDTKTM

SEQ ID NO: 1209008 - protein, 9 aa, Mycobacterium
HGHASPPIG

SEQ ID NO: 1209009 - protein, 18 aa, Mycobacterium
HGHASPPQQYTTADGRPL

SEQ ID NO: 1209010 - protein, 13 aa, Mycobacterium
HGHGPVSALFRLT

SEQ ID NO: 1209011 - protein, 7 aa, Mycobacterium
HGHPTSV

SEQ ID NO: 1209012 - protein, 4 aa, Mycobacterium
HGHR

SEQ ID NO: 1209013 - protein, 6 aa, Mycobacterium
HGHRGP

SEQ ID NO: 1209014 - protein, 11 aa, Mycobacterium
HGHRPKNDYGS

SEQ ID NO: 1209015 - protein, 8 aa, Mycobacterium
HGHSGDPA

SEQ ID NO: 1209016 - protein, 19 aa, Mycobacterium
HGHSRAVAGPYDSDTLGRD

SEQ ID NO: 1209017 - protein, 10 aa, Mycobacterium
HGHSYPPRTA

SEQ ID NO: 1209018 - protein, 9 aa, Mycobacterium
HGIDPSAIG

SEQ ID NO: 1209019 - protein, 5 aa, Mycobacterium
HGIGE

SEQ ID NO: 1209020 - protein, 7 aa, Mycobacterium
HGKAERE

SEQ ID NO: 1209021 - protein, 9 aa, Mycobacterium
HGKAPAASV

SEQ ID NO: 1209022 - protein, 6 aa, Mycobacterium
HGLPES

SEQ ID NO: 1209023 - protein, 4 aa, Mycobacterium
HGLR

SEQ ID NO: 1209024 - protein, 10 aa, Mycobacterium
HGLSPGTPAE

SEQ ID NO: 1209025 - protein, 5 aa, Mycobacterium
HGLTN

SEQ ID NO: 1209026 - protein, 6 aa, Mycobacterium
HGNDAA

SEQ ID NO: 1209027 - protein, 7 aa, Mycobacterium
HGNEAIY

SEQ ID NO: 1209028 - protein, 10 aa, Mycobacterium
HGNPDDARTR

SEQ ID NO: 1209029 - protein, 8 aa, Mycobacterium
HGNQHRGT

SEQ ID NO: 1209030 - protein, 8 aa, Mycobacterium
HGPARADV

SEQ ID NO: 1209031 - protein, 4 aa, Mycobacterium
HGPD

SEQ ID NO: 1209032 - protein, 6 aa, Mycobacterium
HGPDDR

SEQ ID NO: 1209033 - protein, 19 aa, Mycobacterium
HGPDGPAQRPMRWLQRQRY

SEQ ID NO: 1209034 - protein, 10 aa, Mycobacterium
HGPDPRPQHV

SEQ ID NO: 1209035 - protein, 9 aa, Mycobacterium
HGPDREKSV

SEQ ID NO: 1209036 - protein, 5 aa, Mycobacterium
HGPEA

SEQ ID NO: 1209037 - protein, 6 aa, Mycobacterium
HGPEGQ

SEQ ID NO: 1209038 - protein, 14 aa, Mycobacterium
HGPEIDKGARWDPA

SEQ ID NO: 1209039 - protein, 8 aa, Mycobacterium
HGPFTTAE

SEQ ID NO: 1209040 - protein, 12 aa, Mycobacterium
HGPGPDDSRGAD

SEQ ID NO: 1209041 - protein, 8 aa, Mycobacterium
HGPGQGRR

SEQ ID NO: 1209042 - protein, 6 aa, Mycobacterium
HGPGRK

SEQ ID NO: 1209043 - protein, 5 aa, Mycobacterium
HGPHE

SEQ ID NO: 1209044 - protein, 7 aa, Mycobacterium
HGPKNTL

SEQ ID NO: 1209045 - protein, 7 aa, Mycobacterium
HGPNEGN

SEQ ID NO: 1209046 - protein, 13 aa, Mycobacterium
HGPPGTGKTHTSA

SEQ ID NO: 1209047 - protein, 8 aa, Mycobacterium
HGPPPRSV

SEQ ID NO: 1209048 - protein, 6 aa, Mycobacterium
HGPQAE

SEQ ID NO: 1209049 - protein, 5 aa, Mycobacterium
HGPRA

SEQ ID NO: 1209050 - protein, 8 aa, Mycobacterium
HGPTEAWT

SEQ ID NO: 1209051 - protein, 12 aa, Mycobacterium
HGQSAKPRSDYS

SEQ ID NO: 1209052 - protein, 12 aa, Mycobacterium
HGQSDKPRGDYS

SEQ ID NO: 1209053 - protein, 8 aa, Mycobacterium
HGQTAYGA

SEQ ID NO: 1209054 - protein, 8 aa, Mycobacterium
HGQTEVSH

SEQ ID NO: 1209055 - protein, 8 aa, Mycobacterium
HGQTTDAL

SEQ ID NO: 1209056 - protein, 11 aa, Mycobacterium
HGQTTDALTAA

SEQ ID NO: 1209057 - protein, 5 aa, Mycobacterium
HGRAI

SEQ ID NO: 1209058 - protein, 7 aa, Mycobacterium
HGRANGL

SEQ ID NO: 1209059 - protein, 6 aa, Mycobacterium
HGRDGD

SEQ ID NO: 1209060 - protein, 66 aa, Mycobacterium
HGREPRQLAEPSVHGPGTGPARRGAAGTGARAAGSRPSRGGCDGGRSGGRDGGGSGGRDGSRRGGV

SEQ ID NO: 1209061 - protein, 15 aa, Mycobacterium
HGRESELAADTEAVT

SEQ ID NO: 1209062 - protein, 6 aa, Mycobacterium
HGRGSG

SEQ ID NO: 1209063 - protein, 15 aa, Mycobacterium
HGRKELAEAAAKQAE

SEQ ID NO: 1209064 - protein, 6 aa, Mycobacterium
HGRPWR

SEQ ID NO: 1209065 - protein, 8 aa, Mycobacterium
HGRRATAA

SEQ ID NO: 1209066 - protein, 8 aa, Mycobacterium
HGRRDRQF

SEQ ID NO: 1209067 - protein, 12 aa, Mycobacterium
HGRSDKPRADYS

SEQ ID NO: 1209068 - protein, 5 aa, Mycobacterium
HGRSG

SEQ ID NO: 1209069 - protein, 9 aa, Mycobacterium
HGRSTEEEV

SEQ ID NO: 1209070 - protein, 8 aa, Mycobacterium
HGRTDLQQ

SEQ ID NO: 1209071 - protein, 5 aa, Mycobacterium
HGRTG

SEQ ID NO: 1209072 - protein, 11 aa, Mycobacterium
HGSAITSSGRI
